United States Patent 7,250,289 (METHODS OF GENETIC ANALYSIS OF MOUSE) - sequence listing, part 4

SEQ ID NO: 120320 - DNA, 25 bp, Mus musculus
acgaggttcccagtcaagaggacat

SEQ ID NO: 120321 - DNA, 25 bp, Mus musculus
acgaggttgaccaggatgaacttgt

SEQ ID NO: 120322 - DNA, 25 bp, Mus musculus
acgaggttgacctggatgaacttgt

SEQ ID NO: 120323 - DNA, 25 bp, Mus musculus
acgaggtttcttacttgtatattat

SEQ ID NO: 120324 - DNA, 25 bp, Mus musculus
acgaggtttctttcttgtatattat

SEQ ID NO: 120325 - DNA, 25 bp, Mus musculus
acgaggttttgtacctggctttcag

SEQ ID NO: 120326 - DNA, 25 bp, Mus musculus
acgaggttttgttcctggctttcag

SEQ ID NO: 120327 - DNA, 25 bp, Mus musculus
acgagtactcggcaggcctgtgcta

SEQ ID NO: 120328 - DNA, 25 bp, Mus musculus
acgagtactcgggaggcctgtgcta

SEQ ID NO: 120329 - DNA, 25 bp, Mus musculus
acgagtagcctgacttgctttgtct

SEQ ID NO: 120330 - DNA, 25 bp, Mus musculus
acgagtagcctgtcttgctttgtct

SEQ ID NO: 120331 - DNA, 25 bp, Mus musculus
acgagtatggcaaagcttttattca

SEQ ID NO: 120332 - DNA, 25 bp, Mus musculus
acgagtatggcatagcttttattca

SEQ ID NO: 120333 - DNA, 25 bp, Mus musculus
acgagtcaccatatgatcagtcatt

SEQ ID NO: 120334 - DNA, 25 bp, Mus musculus
acgagtcaccatttgatcagtcatt

SEQ ID NO: 120335 - DNA, 25 bp, Mus musculus
acgagtcagtgccaatgccttattc

SEQ ID NO: 120336 - DNA, 25 bp, Mus musculus
acgagtcagtgcgaatgccttattc

SEQ ID NO: 120337 - DNA, 25 bp, Mus musculus
acgagtcatgaaccacaggctgaga

SEQ ID NO: 120338 - DNA, 25 bp, Mus musculus
acgagtcatgaagcacaggctgaga

SEQ ID NO: 120339 - DNA, 25 bp, Mus musculus
acgagtccaaccatacagccatgaa

SEQ ID NO: 120340 - DNA, 25 bp, Mus musculus
acgagtccaaccttacagccatgaa

SEQ ID NO: 120341 - DNA, 25 bp, Mus musculus
acgagtcctcagacacgcagagtga

SEQ ID NO: 120342 - DNA, 25 bp, Mus musculus
acgagtcctcagtcacgcagagtga

SEQ ID NO: 120343 - DNA, 25 bp, Mus musculus
acgagtcctggaacctttgtctaga

SEQ ID NO: 120344 - DNA, 25 bp, Mus musculus
acgagtcctggatcctttgtctaga

SEQ ID NO: 120345 - DNA, 25 bp, Mus musculus
acgagtctactgagctttaagtctg

SEQ ID NO: 120346 - DNA, 25 bp, Mus musculus
acgagtctactgtgctttaagtctg

SEQ ID NO: 120347 - DNA, 25 bp, Mus musculus
acgagtctagtgaatgtatacgaaa

SEQ ID NO: 120348 - DNA, 25 bp, Mus musculus
acgagtctagtgtatgtatacgaaa

SEQ ID NO: 120349 - DNA, 25 bp, Mus musculus
acgagtcttgaaacacagttgtcag

SEQ ID NO: 120350 - DNA, 25 bp, Mus musculus
acgagtcttgaatcacagttgtcag

SEQ ID NO: 120351 - DNA, 25 bp, Mus musculus
acgagtgacactcacgaaccataag

SEQ ID NO: 120352 - DNA, 25 bp, Mus musculus
acgagtgacactgacgaaccataag

SEQ ID NO: 120353 - DNA, 25 bp, Mus musculus
acgagtgatccacgcgcttggtgac

SEQ ID NO: 120354 - DNA, 25 bp, Mus musculus
acgagtgatccaggcgcttggtgac

SEQ ID NO: 120355 - DNA, 25 bp, Mus musculus
acgagtgccctaccggtgtggtcaa

SEQ ID NO: 120356 - DNA, 25 bp, Mus musculus
acgagtgccctagcggtgtggtcaa

SEQ ID NO: 120357 - DNA, 25 bp, Mus musculus
acgagtgcctttcactgtgctagat

SEQ ID NO: 120358 - DNA, 25 bp, Mus musculus
acgagtgcctttgactgtgctagat

SEQ ID NO: 120359 - DNA, 25 bp, Mus musculus
acgagtgcgaaactggttttttcag

SEQ ID NO: 120360 - DNA, 25 bp, Mus musculus
acgagtgcgaaagtggttttttcag

SEQ ID NO: 120361 - DNA, 25 bp, Mus musculus
acgagtgctgtaatccttatatgga

SEQ ID NO: 120362 - DNA, 25 bp, Mus musculus
acgagtgctgtattccttatatgga

SEQ ID NO: 120363 - DNA, 25 bp, Mus musculus
acgagtgcttggctcttcattgaac

SEQ ID NO: 120364 - DNA, 25 bp, Mus musculus
acgagtgcttgggtcttcattgaac

SEQ ID NO: 120365 - DNA, 25 bp, Mus musculus
acgagtgggcacctgctgtcatcga

SEQ ID NO: 120366 - DNA, 25 bp, Mus musculus
acgagtgggcacgtgctgtcatcga

SEQ ID NO: 120367 - DNA, 25 bp, Mus musculus
acgagtggttccatggagactgcat

SEQ ID NO: 120368 - DNA, 25 bp, Mus musculus
acgagtggttccttggagactgcat

SEQ ID NO: 120369 - DNA, 25 bp, Mus musculus
acgagtgtatccattaacgactgtg

SEQ ID NO: 120370 - DNA, 25 bp, Mus musculus
acgagtgtatcctttaacgactgtg

SEQ ID NO: 120371 - DNA, 25 bp, Mus musculus
acgagtgtggtaccaaattcttttt

SEQ ID NO: 120372 - DNA, 25 bp, Mus musculus
acgagtgtggtagcaaattcttttt

SEQ ID NO: 120373 - DNA, 25 bp, Mus musculus
acgagtgttcaaattccaccacctg

SEQ ID NO: 120374 - DNA, 25 bp, Mus musculus
acgagtgttcaatttccaccacctg

SEQ ID NO: 120375 - DNA, 25 bp, Mus musculus
acgagtgttgttagccaaccccaca

SEQ ID NO: 120376 - DNA, 25 bp, Mus musculus
acgagtgttgtttgccaaccccaca

SEQ ID NO: 120377 - DNA, 25 bp, Mus musculus
acgagttataacacatgcgtgtatt

SEQ ID NO: 120378 - DNA, 25 bp, Mus musculus
acgagttataactcatgcgtgtatt

SEQ ID NO: 120379 - DNA, 25 bp, Mus musculus
acgagttcctctctgataccattaa

SEQ ID NO: 120380 - DNA, 25 bp, Mus musculus
acgagttcctctgtgataccattaa

SEQ ID NO: 120381 - DNA, 25 bp, Mus musculus
acgagttcgaagacgacctgctcga

SEQ ID NO: 120382 - DNA, 25 bp, Mus musculus
acgagttcgaagtcgacctgctcga

SEQ ID NO: 120383 - DNA, 25 bp, Mus musculus
acgagttcgtggcacttgtggaata

SEQ ID NO: 120384 - DNA, 25 bp, Mus musculus
acgagttcgtgggacttgtggaata

SEQ ID NO: 120385 - DNA, 25 bp, Mus musculus
acgagttcttagacatcagtgccca

SEQ ID NO: 120386 - DNA, 25 bp, Mus musculus
acgagttcttagtcatcagtgccca

SEQ ID NO: 120387 - DNA, 25 bp, Mus musculus
acgagttgctcgagttcagtaccag

SEQ ID NO: 120388 - DNA, 25 bp, Mus musculus
acgagttgctcgtgttcagtaccag

SEQ ID NO: 120389 - DNA, 25 bp, Mus musculus
acgagtttacagagtgcttataggt

SEQ ID NO: 120390 - DNA, 25 bp, Mus musculus
acgagtttacagtgtgcttataggt

SEQ ID NO: 120391 - DNA, 25 bp, Mus musculus
acgagtttaggacccagcacctcaa

SEQ ID NO: 120392 - DNA, 25 bp, Mus musculus
acgagtttaggagccagcacctcaa

SEQ ID NO: 120393 - DNA, 25 bp, Mus musculus
acgagtttctgactatcagcgattt

SEQ ID NO: 120394 - DNA, 25 bp, Mus musculus
acgagtttctgagtatcagcgattt

SEQ ID NO: 120395 - DNA, 25 bp, Mus musculus
acgagtttctgcagctgatgagcgc

SEQ ID NO: 120396 - DNA, 25 bp, Mus musculus
acgagtttctgctgctgatgagcgc

SEQ ID NO: 120397 - DNA, 25 bp, Mus musculus
acgataaactgcatgcagggaaacc

SEQ ID NO: 120398 - DNA, 25 bp, Mus musculus
acgataaactgcttgcagggaaacc

SEQ ID NO: 120399 - DNA, 25 bp, Mus musculus
acgatacaacagagccacctaggaa

SEQ ID NO: 120400 - DNA, 25 bp, Mus musculus
acgatacaacagtgccacctaggaa

SEQ ID NO: 120401 - DNA, 25 bp, Mus musculus
acgatacaagtccagcctgggctgt

SEQ ID NO: 120402 - DNA, 25 bp, Mus musculus
acgatacaagtcgagcctgggctgt

SEQ ID NO: 120403 - DNA, 25 bp, Mus musculus
acgatacagccacggactccaatgc

SEQ ID NO: 120404 - DNA, 25 bp, Mus musculus
acgatacagccagggactccaatgc

SEQ ID NO: 120405 - DNA, 25 bp, Mus musculus
acgatacaggttatgtcatcagaaa

SEQ ID NO: 120406 - DNA, 25 bp, Mus musculus
acgatacaggttttgtcatcagaaa

SEQ ID NO: 120407 - DNA, 25 bp, Mus musculus
acgatacattctaccccaaatttag

SEQ ID NO: 120408 - DNA, 25 bp, Mus musculus
acgatacattcttccccaaatttag

SEQ ID NO: 120409 - DNA, 25 bp, Mus musculus
acgatagaaaccagcatcttgcctg

SEQ ID NO: 120410 - DNA, 25 bp, Mus musculus
acgatagaaacctgcatcttgcctg

SEQ ID NO: 120411 - DNA, 25 bp, Mus musculus
acgataggcacaagccgcctggcgt

SEQ ID NO: 120412 - DNA, 25 bp, Mus musculus
acgataggcacatgccgcctggcgt

SEQ ID NO: 120413 - DNA, 25 bp, Mus musculus
acgatagtggcgctgagagtctctc

SEQ ID NO: 120414 - DNA, 25 bp, Mus musculus
acgatagtggcggtgagagtctctc

SEQ ID NO: 120415 - DNA, 25 bp, Mus musculus
acgatatcccttagagtgaccatta

SEQ ID NO: 120416 - DNA, 25 bp, Mus musculus
acgatatccctttgagtgaccatta

SEQ ID NO: 120417 - DNA, 25 bp, Mus musculus
acgatatgaactcatttttcctgtt

SEQ ID NO: 120418 - DNA, 25 bp, Mus musculus
acgatatgaactgatttttcctgtt

SEQ ID NO: 120419 - DNA, 25 bp, Mus musculus
acgatattggttattagaagcttta

SEQ ID NO: 120420 - DNA, 25 bp, Mus musculus
acgatattggtttttagaagcttta

SEQ ID NO: 120421 - DNA, 25 bp, Mus musculus
acgatcaatggccacctcggaggag

SEQ ID NO: 120422 - DNA, 25 bp, Mus musculus
acgatcaatggcgacctcggaggag

SEQ ID NO: 120423 - DNA, 25 bp, Mus musculus
acgatcacggctcaccatgaggaag

SEQ ID NO: 120424 - DNA, 25 bp, Mus musculus
acgatcacggctgaccatgaggaag

SEQ ID NO: 120425 - DNA, 25 bp, Mus musculus
acgatcagaaatcgcgccacgcaag

SEQ ID NO: 120426 - DNA, 25 bp, Mus musculus
acgatcagaaatggcgccacgcaag

SEQ ID NO: 120427 - DNA, 25 bp, Mus musculus
acgatccagtggattctcaattccc

SEQ ID NO: 120428 - DNA, 25 bp, Mus musculus
acgatccagtggtttctcaattccc

SEQ ID NO: 120429 - DNA, 25 bp, Mus musculus
acgatccgatccaaaggttcttcct

SEQ ID NO: 120430 - DNA, 25 bp, Mus musculus
acgatccgatcctaaggttcttcct

SEQ ID NO: 120431 - DNA, 25 bp, Mus musculus
acgatcctcccacagaaatgtgctg

SEQ ID NO: 120432 - DNA, 25 bp, Mus musculus
acgatcctcccagagaaatgtgctg

SEQ ID NO: 120433 - DNA, 25 bp, Mus musculus
acgatccttctgacctggatttcca

SEQ ID NO: 120434 - DNA, 25 bp, Mus musculus
acgatccttctgtcctggatttcca

SEQ ID NO: 120435 - DNA, 25 bp, Mus musculus
acgatcgccaagatccatcttcgcg

SEQ ID NO: 120436 - DNA, 25 bp, Mus musculus
acgatcgccaagttccatcttcgcg

SEQ ID NO: 120437 - DNA, 25 bp, Mus musculus
acgatcgctgagatctttcagacca

SEQ ID NO: 120438 - DNA, 25 bp, Mus musculus
acgatcgctgagttctttcagacca

SEQ ID NO: 120439 - DNA, 25 bp, Mus musculus
acgatcggcctacgagacttgctgc

SEQ ID NO: 120440 - DNA, 25 bp, Mus musculus
acgatcggcctaggagacttgctgc

SEQ ID NO: 120441 - DNA, 25 bp, Mus musculus
acgatcggctacagcaaatgttgct

SEQ ID NO: 120442 - DNA, 25 bp, Mus musculus
acgatcggctactgcaaatgttgct

SEQ ID NO: 120443 - DNA, 25 bp, Mus musculus
acgatcgtctggatgcatttcttac

SEQ ID NO: 120444 - DNA, 25 bp, Mus musculus
acgatcgtctggttgcatttcttac

SEQ ID NO: 120445 - DNA, 25 bp, Mus musculus
acgatcgtggtgacataaatctttg

SEQ ID NO: 120446 - DNA, 25 bp, Mus musculus
acgatcgtggtgtcataaatctttg

SEQ ID NO: 120447 - DNA, 25 bp, Mus musculus
acgatctccgctcttcaacagtgta

SEQ ID NO: 120448 - DNA, 25 bp, Mus musculus
acgatctccgctgttcaacagtgta

SEQ ID NO: 120449 - DNA, 25 bp, Mus musculus
acgatctggtccacgtgactaggaa

SEQ ID NO: 120450 - DNA, 25 bp, Mus musculus
acgatctggtcctcgtgactaggaa

SEQ ID NO: 120451 - DNA, 25 bp, Mus musculus
acgatcttaatcacatcagctgtgt

SEQ ID NO: 120452 - DNA, 25 bp, Mus musculus
acgatcttaatctcatcagctgtgt

SEQ ID NO: 120453 - DNA, 25 bp, Mus musculus
acgatgaaaagcaccttgctctgag

SEQ ID NO: 120454 - DNA, 25 bp, Mus musculus
acgatgaaaagctccttgctctgag

SEQ ID NO: 120455 - DNA, 25 bp, Mus musculus
acgatgaagatgattccgacagcga

SEQ ID NO: 120456 - DNA, 25 bp, Mus musculus
acgatgaagatgtttccgacagcga

SEQ ID NO: 120457 - DNA, 25 bp, Mus musculus
acgatgaatctgattccctggaaca

SEQ ID NO: 120458 - DNA, 25 bp, Mus musculus
acgatgaatctgtttccctggaaca

SEQ ID NO: 120459 - DNA, 25 bp, Mus musculus
acgatgacacaacagggaggcactc

SEQ ID NO: 120460 - DNA, 25 bp, Mus musculus
acgatgacacaagagggaggcactc

SEQ ID NO: 120461 - DNA, 25 bp, Mus musculus
acgatgacatcgagtttgaggactt

SEQ ID NO: 120462 - DNA, 25 bp, Mus musculus
acgatgacatcgtgtttgaggactt

SEQ ID NO: 120463 - DNA, 25 bp, Mus musculus
acgatgacatttagcaggttcaata

SEQ ID NO: 120464 - DNA, 25 bp, Mus musculus
acgatgacattttgcaggttcaata

SEQ ID NO: 120465 - DNA, 25 bp, Mus musculus
acgatgagaagtctcccaaggcagc

SEQ ID NO: 120466 - DNA, 25 bp, Mus musculus
acgatgagaagtgtcccaaggcagc

SEQ ID NO: 120467 - DNA, 25 bp, Mus musculus
acgatgagatatcagcccgacggca

SEQ ID NO: 120468 - DNA, 25 bp, Mus musculus
acgatgagatatgagcccgacggca

SEQ ID NO: 120469 - DNA, 25 bp, Mus musculus
acgatgagctgtcgcccagtggaca

SEQ ID NO: 120470 - DNA, 25 bp, Mus musculus
acgatgagctgtggcccagtggaca

SEQ ID NO: 120471 - DNA, 25 bp, Mus musculus
acgatgaggcgaatgcatgatatca

SEQ ID NO: 120472 - DNA, 25 bp, Mus musculus
acgatgaggcgattgcatgatatca

SEQ ID NO: 120473 - DNA, 25 bp, Mus musculus
acgatgaggcggagcaagcttgtct

SEQ ID NO: 120474 - DNA, 25 bp, Mus musculus
acgatgaggcggtgcaagcttgtct

SEQ ID NO: 120475 - DNA, 25 bp, Mus musculus
acgatgaggtcgctcagctcaggaa

SEQ ID NO: 120476 - DNA, 25 bp, Mus musculus
acgatgaggtcggtcagctcaggaa

SEQ ID NO: 120477 - DNA, 25 bp, Mus musculus
acgatgatagtgattatggcagttc

SEQ ID NO: 120478 - DNA, 25 bp, Mus musculus
acgatgatagtgtttatggcagttc

SEQ ID NO: 120479 - DNA, 25 bp, Mus musculus
acgatgatatgccttagtgtctccc

SEQ ID NO: 120480 - DNA, 25 bp, Mus musculus
acgatgatatgcgttagtgtctccc

SEQ ID NO: 120481 - DNA, 25 bp, Mus musculus
acgatgatcttgctgctccaggcag

SEQ ID NO: 120482 - DNA, 25 bp, Mus musculus
acgatgatcttggtgctccaggcag

SEQ ID NO: 120483 - DNA, 25 bp, Mus musculus
acgatgatgtcgatgcctttgattt

SEQ ID NO: 120484 - DNA, 25 bp, Mus musculus
acgatgatgtcgttgcctttgattt

SEQ ID NO: 120485 - DNA, 25 bp, Mus musculus
acgatgcaaatcacttgcctgctgg

SEQ ID NO: 120486 - DNA, 25 bp, Mus musculus
acgatgcaaatctcttgcctgctgg

SEQ ID NO: 120487 - DNA, 25 bp, Mus musculus
acgatgcagtccagctggtagcagc

SEQ ID NO: 120488 - DNA, 25 bp, Mus musculus
acgatgcagtcctgctggtagcagc

SEQ ID NO: 120489 - DNA, 25 bp, Mus musculus
acgatgccagccacagtgtttgtgt

SEQ ID NO: 120490 - DNA, 25 bp, Mus musculus
acgatgccagcctcagtgtttgtgt

SEQ ID NO: 120491 - DNA, 25 bp, Mus musculus
acgatgccatttacccttggagctc

SEQ ID NO: 120492 - DNA, 25 bp, Mus musculus
acgatgccattttcccttggagctc

SEQ ID NO: 120493 - DNA, 25 bp, Mus musculus
acgatgccgactcgcgatgcggcgg

SEQ ID NO: 120494 - DNA, 25 bp, Mus musculus
acgatgccgactggcgatgcggcgg

SEQ ID NO: 120495 - DNA, 25 bp, Mus musculus
acgatgctgcgtcgcctttgaaggc

SEQ ID NO: 120496 - DNA, 25 bp, Mus musculus
acgatgctgcgtggcctttgaaggc

SEQ ID NO: 120497 - DNA, 25 bp, Mus musculus
acgatgctggttagcctatggctga

SEQ ID NO: 120498 - DNA, 25 bp, Mus musculus
acgatgctggtttgcctatggctga

SEQ ID NO: 120499 - DNA, 25 bp, Mus musculus
acgatgctgtctatgttctcagacc

SEQ ID NO: 120500 - DNA, 25 bp, Mus musculus
acgatgctgtctttgttctcagacc

SEQ ID NO: 120501 - DNA, 25 bp, Mus musculus
acgatgcttatccacattcttatag

SEQ ID NO: 120502 - DNA, 25 bp, Mus musculus
acgatgcttatcgacattcttatag

SEQ ID NO: 120503 - DNA, 25 bp, Mus musculus
acgatgcttgtgaatcagtctctca

SEQ ID NO: 120504 - DNA, 25 bp, Mus musculus
acgatgcttgtgtatcagtctctca

SEQ ID NO: 120505 - DNA, 25 bp, Mus musculus
acgatgctttggatgttgccaacaa

SEQ ID NO: 120506 - DNA, 25 bp, Mus musculus
acgatgctttggttgttgccaacaa

SEQ ID NO: 120507 - DNA, 25 bp, Mus musculus
acgatggaagtgagacccctgatca

SEQ ID NO: 120508 - DNA, 25 bp, Mus musculus
acgatggaagtgtgacccctgatca

SEQ ID NO: 120509 - DNA, 25 bp, Mus musculus
acgatggactgtatccccagatgga

SEQ ID NO: 120510 - DNA, 25 bp, Mus musculus
acgatggactgtttccccagatgga

SEQ ID NO: 120511 - DNA, 25 bp, Mus musculus
acgatggacttacctcagaggagga

SEQ ID NO: 120512 - DNA, 25 bp, Mus musculus
acgatggacttagctcagaggagga

SEQ ID NO: 120513 - DNA, 25 bp, Mus musculus
acgatggcatcgaggccgactgaca

SEQ ID NO: 120514 - DNA, 25 bp, Mus musculus
acgatggcatcgtggccgactgaca

SEQ ID NO: 120515 - DNA, 25 bp, Mus musculus
acgatggccaatcagcaagtgctta

SEQ ID NO: 120516 - DNA, 25 bp, Mus musculus
acgatggccaatgagcaagtgctta

SEQ ID NO: 120517 - DNA, 25 bp, Mus musculus
acgatgggccaccttctgcatactg

SEQ ID NO: 120518 - DNA, 25 bp, Mus musculus
acgatgggccacgttctgcatactg

SEQ ID NO: 120519 - DNA, 25 bp, Mus musculus
acgatgggtttcaagacactacaca

SEQ ID NO: 120520 - DNA, 25 bp, Mus musculus
acgatgggtttctagacactacaca

SEQ ID NO: 120521 - DNA, 25 bp, Mus musculus
acgatggtgactacgagtacaacat

SEQ ID NO: 120522 - DNA, 25 bp, Mus musculus
acgatggtgacttcgagtacaacat

SEQ ID NO: 120523 - DNA, 25 bp, Mus musculus
acgatggtgagaagacactgtgcac

SEQ ID NO: 120524 - DNA, 25 bp, Mus musculus
acgatggtgagatgacactgtgcac

SEQ ID NO: 120525 - DNA, 25 bp, Mus musculus
acgatggtgctactctgggtcttcc

SEQ ID NO: 120526 - DNA, 25 bp, Mus musculus
acgatggtgctagtctgggtcttcc

SEQ ID NO: 120527 - DNA, 25 bp, Mus musculus
acgatggtgtatctctctgtgtaat

SEQ ID NO: 120528 - DNA, 25 bp, Mus musculus
acgatggtgtatgtctctgtgtaat

SEQ ID NO: 120529 - DNA, 25 bp, Mus musculus
acgatgtcacgtattgccaagagct

SEQ ID NO: 120530 - DNA, 25 bp, Mus musculus
acgatgtcacgttttgccaagagct

SEQ ID NO: 120531 - DNA, 25 bp, Mus musculus
acgatgtcattacaagcaccttgtg

SEQ ID NO: 120532 - DNA, 25 bp, Mus musculus
acgatgtcattagaagcaccttgtg

SEQ ID NO: 120533 - DNA, 25 bp, Mus musculus
acgatgtgattgatgttgctgcccc

SEQ ID NO: 120534 - DNA, 25 bp, Mus musculus
acgatgtgattgttgttgctgcccc

SEQ ID NO: 120535 - DNA, 25 bp, Mus musculus
acgatgtgtattagatgctgcccca

SEQ ID NO: 120536 - DNA, 25 bp, Mus musculus
acgatgtgtatttgatgctgcccca

SEQ ID NO: 120537 - DNA, 25 bp, Mus musculus
acgatgttccacactgccagcttgt

SEQ ID NO: 120538 - DNA, 25 bp, Mus musculus
acgatgttccactctgccagcttgt

SEQ ID NO: 120539 - DNA, 25 bp, Mus musculus
acgatgttgtataggttggtcttga

SEQ ID NO: 120540 - DNA, 25 bp, Mus musculus
acgatgttgtattggttggtcttga

SEQ ID NO: 120541 - DNA, 25 bp, Mus musculus
acgatgttgtggctatggcacgaaa

SEQ ID NO: 120542 - DNA, 25 bp, Mus musculus
acgatgttgtgggtatggcacgaaa

SEQ ID NO: 120543 - DNA, 25 bp, Mus musculus
acgatgtttgttctgggttccaatc

SEQ ID NO: 120544 - DNA, 25 bp, Mus musculus
acgatgtttgttgtgggttccaatc

SEQ ID NO: 120545 - DNA, 25 bp, Mus musculus
acgattaagtggatcccacacacaa

SEQ ID NO: 120546 - DNA, 25 bp, Mus musculus
acgattaagtggttcccacacacaa

SEQ ID NO: 120547 - DNA, 25 bp, Mus musculus
acgattagctgcactggatattcgc

SEQ ID NO: 120548 - DNA, 25 bp, Mus musculus
acgattagctgctctggatattcgc

SEQ ID NO: 120549 - DNA, 25 bp, Mus musculus
acgattatcgtacccttgaagccta

SEQ ID NO: 120550 - DNA, 25 bp, Mus musculus
acgattatcgtagccttgaagccta

SEQ ID NO: 120551 - DNA, 25 bp, Mus musculus
acgattcatgcacgtgcgctcgctg

SEQ ID NO: 120552 - DNA, 25 bp, Mus musculus
acgattcatgcaggtgcgctcgctg

SEQ ID NO: 120553 - DNA, 25 bp, Mus musculus
acgattccagaacccctagttttag

SEQ ID NO: 120554 - DNA, 25 bp, Mus musculus
acgattccagaagccctagttttag

SEQ ID NO: 120555 - DNA, 25 bp, Mus musculus
acgattcccttgacaatcctggaga

SEQ ID NO: 120556 - DNA, 25 bp, Mus musculus
acgattcccttgtcaatcctggaga

SEQ ID NO: 120557 - DNA, 25 bp, Mus musculus
acgattcctgagaccatttgttagt

SEQ ID NO: 120558 - DNA, 25 bp, Mus musculus
acgattcctgagtccatttgttagt

SEQ ID NO: 120559 - DNA, 25 bp, Mus musculus
acgattccttggcaggcagcgagac

SEQ ID NO: 120560 - DNA, 25 bp, Mus musculus
acgattccttgggaggcagcgagac

SEQ ID NO: 120561 - DNA, 25 bp, Mus musculus
acgattcggagaactcaaccttcct

SEQ ID NO: 120562 - DNA, 25 bp, Mus musculus
acgattcggagatctcaaccttcct

SEQ ID NO: 120563 - DNA, 25 bp, Mus musculus
acgattctgactccccatactcaga

SEQ ID NO: 120564 - DNA, 25 bp, Mus musculus
acgattctgactgcccatactcaga

SEQ ID NO: 120565 - DNA, 25 bp, Mus musculus
acgattctggacatcatgttgtgtt

SEQ ID NO: 120566 - DNA, 25 bp, Mus musculus
acgattctggacttcatgttgtgtt

SEQ ID NO: 120567 - DNA, 25 bp, Mus musculus
acgattgctgctcgtattctgtaca

SEQ ID NO: 120568 - DNA, 25 bp, Mus musculus
acgattgctgctggtattctgtaca

SEQ ID NO: 120569 - DNA, 25 bp, Mus musculus
acgattggcttgcagaaccccaggt

SEQ ID NO: 120570 - DNA, 25 bp, Mus musculus
acgattggcttggagaaccccaggt

SEQ ID NO: 120571 - DNA, 25 bp, Mus musculus
acgattgtaaatcggaggctttcct

SEQ ID NO: 120572 - DNA, 25 bp, Mus musculus
acgattgtaaatgggaggctttcct

SEQ ID NO: 120573 - DNA, 25 bp, Mus musculus
acgattgtttatcaacgtcatctag

SEQ ID NO: 120574 - DNA, 25 bp, Mus musculus
acgattgtttatgaacgtcatctag

SEQ ID NO: 120575 - DNA, 25 bp, Mus musculus
acgatttaacccatgatcgggctga

SEQ ID NO: 120576 - DNA, 25 bp, Mus musculus
acgatttaacccttgatcgggctga

SEQ ID NO: 120577 - DNA, 25 bp, Mus musculus
acgatttacacgctgctctgagaat

SEQ ID NO: 120578 - DNA, 25 bp, Mus musculus
acgatttacacggtgctctgagaat

SEQ ID NO: 120579 - DNA, 25 bp, Mus musculus
acgatttggctcagtccaggaatat

SEQ ID NO: 120580 - DNA, 25 bp, Mus musculus
acgatttggctctgtccaggaatat

SEQ ID NO: 120581 - DNA, 25 bp, Mus musculus
acgattttaagtcgtttgcgacatt

SEQ ID NO: 120582 - DNA, 25 bp, Mus musculus
acgattttaagtggtttgcgacatt

SEQ ID NO: 120583 - DNA, 25 bp, Mus musculus
acgattttatctacttcatttattt

SEQ ID NO: 120584 - DNA, 25 bp, Mus musculus
acgattttatcttcttcatttattt

SEQ ID NO: 120585 - DNA, 25 bp, Mus musculus
acgatttttagcctagtcccgatgg

SEQ ID NO: 120586 - DNA, 25 bp, Mus musculus
acgatttttagcgtagtcccgatgg

SEQ ID NO: 120587 - DNA, 25 bp, Mus musculus
acgcaaaataatccagaaagtctta

SEQ ID NO: 120588 - DNA, 25 bp, Mus musculus
acgcaaaataatgcagaaagtctta

SEQ ID NO: 120589 - DNA, 25 bp, Mus musculus
acgcaaaatgtgatgagtcagcaaa

SEQ ID NO: 120590 - DNA, 25 bp, Mus musculus
acgcaaaatgtgttgagtcagcaaa

SEQ ID NO: 120591 - DNA, 25 bp, Mus musculus
acgcaaagctacatccttgagtgac

SEQ ID NO: 120592 - DNA, 25 bp, Mus musculus
acgcaaagctacttccttgagtgac

SEQ ID NO: 120593 - DNA, 25 bp, Mus musculus
acgcaaagttggcagcatcggcaat

SEQ ID NO: 120594 - DNA, 25 bp, Mus musculus
acgcaaagttgggagcatcggcaat

SEQ ID NO: 120595 - DNA, 25 bp, Mus musculus
acgcaacacacaatctaagcacaca

SEQ ID NO: 120596 - DNA, 25 bp, Mus musculus
acgcaacacacattctaagcacaca

SEQ ID NO: 120597 - DNA, 25 bp, Mus musculus
acgcaacagtaaatccttacacctt

SEQ ID NO: 120598 - DNA, 25 bp, Mus musculus
acgcaacagtaattccttacacctt

SEQ ID NO: 120599 - DNA, 25 bp, Mus musculus
acgcaacatgataccctcctgcgga

SEQ ID NO: 120600 - DNA, 25 bp, Mus musculus
acgcaacatgattccctcctgcgga

SEQ ID NO: 120601 - DNA, 25 bp, Mus musculus
acgcaacgagtcataaagtatttct

SEQ ID NO: 120602 - DNA, 25 bp, Mus musculus
acgcaacgagtcttaaagtatttct

SEQ ID NO: 120603 - DNA, 25 bp, Mus musculus
acgcaacgattgatatagttctcat

SEQ ID NO: 120604 - DNA, 25 bp, Mus musculus
acgcaacgattgttatagttctcat

SEQ ID NO: 120605 - DNA, 25 bp, Mus musculus
acgcaacttgctaggactataccca

SEQ ID NO: 120606 - DNA, 25 bp, Mus musculus
acgcaacttgcttggactataccca

SEQ ID NO: 120607 - DNA, 25 bp, Mus musculus
acgcaacttgggatcttatcaacag

SEQ ID NO: 120608 - DNA, 25 bp, Mus musculus
acgcaacttgggttcttatcaacag

SEQ ID NO: 120609 - DNA, 25 bp, Mus musculus
acgcaagagactcagctagttccgg

SEQ ID NO: 120610 - DNA, 25 bp, Mus musculus
acgcaagagactgagctagttccgg

SEQ ID NO: 120611 - DNA, 25 bp, Mus musculus
acgcaagctgcacagataattaagt

SEQ ID NO: 120612 - DNA, 25 bp, Mus musculus
acgcaagctgcagagataattaagt

SEQ ID NO: 120613 - DNA, 25 bp, Mus musculus
acgcaagctgcccatctagattaga

SEQ ID NO: 120614 - DNA, 25 bp, Mus musculus
acgcaagctgccgatctagattaga

SEQ ID NO: 120615 - DNA, 25 bp, Mus musculus
acgcaaggcgtgacccagtgactcc

SEQ ID NO: 120616 - DNA, 25 bp, Mus musculus
acgcaaggcgtgtcccagtgactcc

SEQ ID NO: 120617 - DNA, 25 bp, Mus musculus
acgcaagggcctacgctgaacagaa

SEQ ID NO: 120618 - DNA, 25 bp, Mus musculus
acgcaagggccttcgctgaacagaa

SEQ ID NO: 120619 - DNA, 25 bp, Mus musculus
acgcaagtatttccaccataaccag

SEQ ID NO: 120620 - DNA, 25 bp, Mus musculus
acgcaagtatttgcaccataaccag

SEQ ID NO: 120621 - DNA, 25 bp, Mus musculus
acgcaagtcagaagcagggacctat

SEQ ID NO: 120622 - DNA, 25 bp, Mus musculus
acgcaagtcagatgcagggacctat

SEQ ID NO: 120623 - DNA, 25 bp, Mus musculus
acgcaagttctgctattcatttttt

SEQ ID NO: 120624 - DNA, 25 bp, Mus musculus
acgcaagttctggtattcatttttt

SEQ ID NO: 120625 - DNA, 25 bp, Mus musculus
acgcaattattcaggccttggtcca

SEQ ID NO: 120626 - DNA, 25 bp, Mus musculus
acgcaattattctggccttggtcca

SEQ ID NO: 120627 - DNA, 25 bp, Mus musculus
acgcacaagtgacgcacagcactct

SEQ ID NO: 120628 - DNA, 25 bp, Mus musculus
acgcacaagtgaggcacagcactct

SEQ ID NO: 120629 - DNA, 25 bp, Mus musculus
acgcacacacgtccgcgcaggtgga

SEQ ID NO: 120630 - DNA, 25 bp, Mus musculus
acgcacacacgtgcgcgcaggtgga

SEQ ID NO: 120631 - DNA, 25 bp, Mus musculus
acgcacaccttacggacacggagat

SEQ ID NO: 120632 - DNA, 25 bp, Mus musculus
acgcacaccttagggacacggagat

SEQ ID NO: 120633 - DNA, 25 bp, Mus musculus
acgcacactagacatgccatctaac

SEQ ID NO: 120634 - DNA, 25 bp, Mus musculus
acgcacactagagatgccatctaac

SEQ ID NO: 120635 - DNA, 25 bp, Mus musculus
acgcacactttactctggccaagat

SEQ ID NO: 120636 - DNA, 25 bp, Mus musculus
acgcacactttagtctggccaagat

SEQ ID NO: 120637 - DNA, 25 bp, Mus musculus
acgcacagcactacaatatgtcttg

SEQ ID NO: 120638 - DNA, 25 bp, Mus musculus
acgcacagcacttcaatatgtcttg

SEQ ID NO: 120639 - DNA, 25 bp, Mus musculus
acgcacagcgtaatgatggtcttta

SEQ ID NO: 120640 - DNA, 25 bp, Mus musculus
acgcacagcgtattgatggtcttta

SEQ ID NO: 120641 - DNA, 25 bp, Mus musculus
acgcacagctggatgcttacaatgc

SEQ ID NO: 120642 - DNA, 25 bp, Mus musculus
acgcacagctggttgcttacaatgc

SEQ ID NO: 120643 - DNA, 25 bp, Mus musculus
acgcacaggcatcgttacgtaacct

SEQ ID NO: 120644 - DNA, 25 bp, Mus musculus
acgcacaggcatggttacgtaacct

SEQ ID NO: 120645 - DNA, 25 bp, Mus musculus
acgcacatccaactctgttttgtaa

SEQ ID NO: 120646 - DNA, 25 bp, Mus musculus
acgcacatccaagtctgttttgtaa

SEQ ID NO: 120647 - DNA, 25 bp, Mus musculus
acgcacatccctattctaaggctgg

SEQ ID NO: 120648 - DNA, 25 bp, Mus musculus
acgcacatcccttttctaaggctgg

SEQ ID NO: 120649 - DNA, 25 bp, Mus musculus
acgcacatggctctcatgcctgaga

SEQ ID NO: 120650 - DNA, 25 bp, Mus musculus
acgcacatggctgtcatgcctgaga

SEQ ID NO: 120651 - DNA, 25 bp, Mus musculus
acgcacatggtaaaaggtgtctcct

SEQ ID NO: 120652 - DNA, 25 bp, Mus musculus
acgcacatggtataaggtgtctcct

SEQ ID NO: 120653 - DNA, 25 bp, Mus musculus
acgcacccttggaatctatatgatt

SEQ ID NO: 120654 - DNA, 25 bp, Mus musculus
acgcacccttggtatctatatgatt

SEQ ID NO: 120655 - DNA, 25 bp, Mus musculus
acgcaccgacgtatgaaagttcgtg

SEQ ID NO: 120656 - DNA, 25 bp, Mus musculus
acgcaccgacgtttgaaagttcgtg

SEQ ID NO: 120657 - DNA, 25 bp, Mus musculus
acgcacctcattatggcctttccat

SEQ ID NO: 120658 - DNA, 25 bp, Mus musculus
acgcacctcattttggcctttccat

SEQ ID NO: 120659 - DNA, 25 bp, Mus musculus
acgcacctccatccagtcaggaaat

SEQ ID NO: 120660 - DNA, 25 bp, Mus musculus
acgcacctccatgcagtcaggaaat

SEQ ID NO: 120661 - DNA, 25 bp, Mus musculus
acgcacgcaagacagcacagagaaa

SEQ ID NO: 120662 - DNA, 25 bp, Mus musculus
acgcacgcaagagagcacagagaaa

SEQ ID NO: 120663 - DNA, 25 bp, Mus musculus
acgcacgctacccaatcacaagaag

SEQ ID NO: 120664 - DNA, 25 bp, Mus musculus
acgcacgctaccgaatcacaagaag

SEQ ID NO: 120665 - DNA, 25 bp, Mus musculus
acgcacgctgttcatttttatggga

SEQ ID NO: 120666 - DNA, 25 bp, Mus musculus
acgcacgctgttgatttttatggga

SEQ ID NO: 120667 - DNA, 25 bp, Mus musculus
acgcacggacggagaccctcctgct

SEQ ID NO: 120668 - DNA, 25 bp, Mus musculus
acgcacggacggtgaccctcctgct

SEQ ID NO: 120669 - DNA, 25 bp, Mus musculus
acgcactagctgacattgggcttct

SEQ ID NO: 120670 - DNA, 25 bp, Mus musculus
acgcactagctgtcattgggcttct

SEQ ID NO: 120671 - DNA, 25 bp, Mus musculus
acgcactccacaactgcttgattat

SEQ ID NO: 120672 - DNA, 25 bp, Mus musculus
acgcactccacatctgcttgattat

SEQ ID NO: 120673 - DNA, 25 bp, Mus musculus
acgcactgcacgaacatgcatgtag

SEQ ID NO: 120674 - DNA, 25 bp, Mus musculus
acgcactgcacgtacatgcatgtag

SEQ ID NO: 120675 - DNA, 25 bp, Mus musculus
acgcactgcactcttgtttcagaaa

SEQ ID NO: 120676 - DNA, 25 bp, Mus musculus
acgcactgcactgttgtttcagaaa

SEQ ID NO: 120677 - DNA, 25 bp, Mus musculus
acgcactgtcacaactgtacaacaa

SEQ ID NO: 120678 - DNA, 25 bp, Mus musculus
acgcactgtcactactgtacaacaa

SEQ ID NO: 120679 - DNA, 25 bp, Mus musculus
acgcactgtgatatgccctaggctt

SEQ ID NO: 120680 - DNA, 25 bp, Mus musculus
acgcactgtgatttgccctaggctt

SEQ ID NO: 120681 - DNA, 25 bp, Mus musculus
acgcacttacacatcttacacattt

SEQ ID NO: 120682 - DNA, 25 bp, Mus musculus
acgcacttacacttcttacacattt

SEQ ID NO: 120683 - DNA, 25 bp, Mus musculus
acgcacttatcacgaacgcctcgat

SEQ ID NO: 120684 - DNA, 25 bp, Mus musculus
acgcacttatcaggaacgcctcgat

SEQ ID NO: 120685 - DNA, 25 bp, Mus musculus
acgcacttcgtgactaaagtctatt

SEQ ID NO: 120686 - DNA, 25 bp, Mus musculus
acgcacttcgtgtctaaagtctatt

SEQ ID NO: 120687 - DNA, 25 bp, Mus musculus
acgcacttctagctcttctgctatt

SEQ ID NO: 120688 - DNA, 25 bp, Mus musculus
acgcacttctaggtcttctgctatt

SEQ ID NO: 120689 - DNA, 25 bp, Mus musculus
acgcagaaaggccatgtgccccatt

SEQ ID NO: 120690 - DNA, 25 bp, Mus musculus
acgcagaaaggcgatgtgccccatt

SEQ ID NO: 120691 - DNA, 25 bp, Mus musculus
acgcagaatgcactgtatttccctg

SEQ ID NO: 120692 - DNA, 25 bp, Mus musculus
acgcagaatgcagtgtatttccctg

SEQ ID NO: 120693 - DNA, 25 bp, Mus musculus
acgcagacaaagatggcacccgggt

SEQ ID NO: 120694 - DNA, 25 bp, Mus musculus
acgcagacaaagttggcacccgggt

SEQ ID NO: 120695 - DNA, 25 bp, Mus musculus
acgcagaccttgaattttggccata

SEQ ID NO: 120696 - DNA, 25 bp, Mus musculus
acgcagaccttgtattttggccata

SEQ ID NO: 120697 - DNA, 25 bp, Mus musculus
acgcagacttctcgaatatcaccaa

SEQ ID NO: 120698 - DNA, 25 bp, Mus musculus
acgcagacttctggaatatcaccaa

SEQ ID NO: 120699 - DNA, 25 bp, Mus musculus
acgcagagtttgacttcaagggcga

SEQ ID NO: 120700 - DNA, 25 bp, Mus musculus
acgcagagtttgtcttcaagggcga

SEQ ID NO: 120701 - DNA, 25 bp, Mus musculus
acgcagagttttctaaagttgaagc

SEQ ID NO: 120702 - DNA, 25 bp, Mus musculus
acgcagagttttgtaaagttgaagc

SEQ ID NO: 120703 - DNA, 25 bp, Mus musculus
acgcagcactctaaattcaagccca

SEQ ID NO: 120704 - DNA, 25 bp, Mus musculus
acgcagcactcttaattcaagccca

SEQ ID NO: 120705 - DNA, 25 bp, Mus musculus
acgcagcagggcaaccagcacgagt

SEQ ID NO: 120706 - DNA, 25 bp, Mus musculus
acgcagcagggctaccagcacgagt

SEQ ID NO: 120707 - DNA, 25 bp, Mus musculus
acgcagctacaacgcactttctcaa

SEQ ID NO: 120708 - DNA, 25 bp, Mus musculus
acgcagctacaaggcactttctcaa

SEQ ID NO: 120709 - DNA, 25 bp, Mus musculus
acgcagctggcaacctgaccatggg

SEQ ID NO: 120710 - DNA, 25 bp, Mus musculus
acgcagctggcatcctgaccatggg

SEQ ID NO: 120711 - DNA, 25 bp, Mus musculus
acgcagcttcgccttggtcagatag

SEQ ID NO: 120712 - DNA, 25 bp, Mus musculus
acgcagcttcgcgttggtcagatag

SEQ ID NO: 120713 - DNA, 25 bp, Mus musculus
acgcagcttgtgaggacagtgtgtt

SEQ ID NO: 120714 - DNA, 25 bp, Mus musculus
acgcagcttgtgtggacagtgtgtt

SEQ ID NO: 120715 - DNA, 25 bp, Mus musculus
acgcaggagactctctgaaggcact

SEQ ID NO: 120716 - DNA, 25 bp, Mus musculus
acgcaggagactgtctgaaggcact

SEQ ID NO: 120717 - DNA, 25 bp, Mus musculus
acgcaggagctgctccaggccttta

SEQ ID NO: 120718 - DNA, 25 bp, Mus musculus
acgcaggagctggtccaggccttta

SEQ ID NO: 120719 - DNA, 25 bp, Mus musculus
acgcaggatgcccattttaatgttt

SEQ ID NO: 120720 - DNA, 25 bp, Mus musculus
acgcaggatgccgattttaatgttt

SEQ ID NO: 120721 - DNA, 25 bp, Mus musculus
acgcaggcatctcccacattagaga

SEQ ID NO: 120722 - DNA, 25 bp, Mus musculus
acgcaggcatctgccacattagaga

SEQ ID NO: 120723 - DNA, 25 bp, Mus musculus
acgcaggctgacagtattccttttt

SEQ ID NO: 120724 - DNA, 25 bp, Mus musculus
acgcaggctgactgtattccttttt

SEQ ID NO: 120725 - DNA, 25 bp, Mus musculus
acgcaggctgcacacaatatgaaca

SEQ ID NO: 120726 - DNA, 25 bp, Mus musculus
acgcaggctgcagacaatatgaaca

SEQ ID NO: 120727 - DNA, 25 bp, Mus musculus
acgcagggatgcatcacacgaggaa

SEQ ID NO: 120728 - DNA, 25 bp, Mus musculus
acgcagggatgcttcacacgaggaa

SEQ ID NO: 120729 - DNA, 25 bp, Mus musculus
acgcagggctgtatgtcattgtacc

SEQ ID NO: 120730 - DNA, 25 bp, Mus musculus
acgcagggctgtttgtcattgtacc

SEQ ID NO: 120731 - DNA, 25 bp, Mus musculus
acgcaggttcgtcctttctgactgt

SEQ ID NO: 120732 - DNA, 25 bp, Mus musculus
acgcaggttcgtgctttctgactgt

SEQ ID NO: 120733 - DNA, 25 bp, Mus musculus
acgcaggttgtacaggacgccgata

SEQ ID NO: 120734 - DNA, 25 bp, Mus musculus
acgcaggttgtagaggacgccgata

SEQ ID NO: 120735 - DNA, 25 bp, Mus musculus
acgcagtcaggtcgtgttcgtccat

SEQ ID NO: 120736 - DNA, 25 bp, Mus musculus
acgcagtcaggtggtgttcgtccat

SEQ ID NO: 120737 - DNA, 25 bp, Mus musculus
acgcagtcatagagtgttccagctg

SEQ ID NO: 120738 - DNA, 25 bp, Mus musculus
acgcagtcatagtgtgttccagctg

SEQ ID NO: 120739 - DNA, 25 bp, Mus musculus
acgcagtccgccagttgatgaggaa

SEQ ID NO: 120740 - DNA, 25 bp, Mus musculus
acgcagtccgcctgttgatgaggaa

SEQ ID NO: 120741 - DNA, 25 bp, Mus musculus
acgcagtcctcgagggccgtggata

SEQ ID NO: 120742 - DNA, 25 bp, Mus musculus
acgcagtcctcgtgggccgtggata

SEQ ID NO: 120743 - DNA, 25 bp, Mus musculus
acgcagtcggctacggtgcaggttc

SEQ ID NO: 120744 - DNA, 25 bp, Mus musculus
acgcagtcggcttcggtgcaggttc

SEQ ID NO: 120745 - DNA, 25 bp, Mus musculus
acgcagtgctgcatgagtgctctct

SEQ ID NO: 120746 - DNA, 25 bp, Mus musculus
acgcagtgctgcttgagtgctctct

SEQ ID NO: 120747 - DNA, 25 bp, Mus musculus
acgcagtgggtgctgtgatgaccgt

SEQ ID NO: 120748 - DNA, 25 bp, Mus musculus
acgcagtgggtggtgtgatgaccgt

SEQ ID NO: 120749 - DNA, 25 bp, Mus musculus
acgcagtgtgtgaccatgagcttca

SEQ ID NO: 120750 - DNA, 25 bp, Mus musculus
acgcagtgtgtgtccatgagcttca

SEQ ID NO: 120751 - DNA, 25 bp, Mus musculus
acgcataaagaactgtggtccccac

SEQ ID NO: 120752 - DNA, 25 bp, Mus musculus
acgcataaagaagtgtggtccccac

SEQ ID NO: 120753 - DNA, 25 bp, Mus musculus
acgcataccttactccaagtcagat

SEQ ID NO: 120754 - DNA, 25 bp, Mus musculus
acgcataccttagtccaagtcagat

SEQ ID NO: 120755 - DNA, 25 bp, Mus musculus
acgcatactgctcgaaccttagttt

SEQ ID NO: 120756 - DNA, 25 bp, Mus musculus
acgcatactgctggaaccttagttt

SEQ ID NO: 120757 - DNA, 25 bp, Mus musculus
acgcatactgtcctgctaggtcaat

SEQ ID NO: 120758 - DNA, 25 bp, Mus musculus
acgcatactgtcgtgctaggtcaat

SEQ ID NO: 120759 - DNA, 25 bp, Mus musculus
acgcatagtgtcacagtgcttctga

SEQ ID NO: 120760 - DNA, 25 bp, Mus musculus
acgcatagtgtctcagtgcttctga

SEQ ID NO: 120761 - DNA, 25 bp, Mus musculus
acgcatatgcgaaactctcaacaag

SEQ ID NO: 120762 - DNA, 25 bp, Mus musculus
acgcatatgcgatactctcaacaag

SEQ ID NO: 120763 - DNA, 25 bp, Mus musculus
acgcatcaacgaccatcggcagaaa

SEQ ID NO: 120764 - DNA, 25 bp, Mus musculus
acgcatcaacgagcatcggcagaaa

SEQ ID NO: 120765 - DNA, 25 bp, Mus musculus
acgcatcaagggagtggaagtgttc

SEQ ID NO: 120766 - DNA, 25 bp, Mus musculus
acgcatcaagggtgtggaagtgttc

SEQ ID NO: 120767 - DNA, 25 bp, Mus musculus
acgcatcctggtcgtcccttgggta

SEQ ID NO: 120768 - DNA, 25 bp, Mus musculus
acgcatcctggtggtcccttgggta

SEQ ID NO: 120769 - DNA, 25 bp, Mus musculus
acgcatccttatactgtgacttcac

SEQ ID NO: 120770 - DNA, 25 bp, Mus musculus
acgcatccttattctgtgacttcac

SEQ ID NO: 120771 - DNA, 25 bp, Mus musculus
acgcatcgtactagttctttgttgg

SEQ ID NO: 120772 - DNA, 25 bp, Mus musculus
acgcatcgtacttgttctttgttgg

SEQ ID NO: 120773 - DNA, 25 bp, Mus musculus
acgcatctaagtcatcagaggccaa

SEQ ID NO: 120774 - DNA, 25 bp, Mus musculus
acgcatctaagtgatcagaggccaa

SEQ ID NO: 120775 - DNA, 25 bp, Mus musculus
acgcatcttcccacagttataaaaa

SEQ ID NO: 120776 - DNA, 25 bp, Mus musculus
acgcatcttccctcagttataaaaa

SEQ ID NO: 120777 - DNA, 25 bp, Mus musculus
acgcatgaatgaagcctttggtgac

SEQ ID NO: 120778 - DNA, 25 bp, Mus musculus
acgcatgaatgatgcctttggtgac

SEQ ID NO: 120779 - DNA, 25 bp, Mus musculus
acgcatgatgggagccgtcttaatt

SEQ ID NO: 120780 - DNA, 25 bp, Mus musculus
acgcatgatgggtgccgtcttaatt

SEQ ID NO: 120781 - DNA, 25 bp, Mus musculus
acgcatgcatggcacccctgactgt

SEQ ID NO: 120782 - DNA, 25 bp, Mus musculus
acgcatgcatgggacccctgactgt

SEQ ID NO: 120783 - DNA, 25 bp, Mus musculus
acgcatgcattcatgtgggtagata

SEQ ID NO: 120784 - DNA, 25 bp, Mus musculus
acgcatgcattcttgtgggtagata

SEQ ID NO: 120785 - DNA, 25 bp, Mus musculus
acgcatgcatttagtgttgacccct

SEQ ID NO: 120786 - DNA, 25 bp, Mus musculus
acgcatgcattttgtgttgacccct

SEQ ID NO: 120787 - DNA, 25 bp, Mus musculus
acgcatgcgcaaccacctctgtttt

SEQ ID NO: 120788 - DNA, 25 bp, Mus musculus
acgcatgcgcaagcacctctgtttt

SEQ ID NO: 120789 - DNA, 25 bp, Mus musculus
acgcatgcgcatctgtatagaccca

SEQ ID NO: 120790 - DNA, 25 bp, Mus musculus
acgcatgcgcatgtgtatagaccca

SEQ ID NO: 120791 - DNA, 25 bp, Mus musculus
acgcatgcgggtcgactctgataat

SEQ ID NO: 120792 - DNA, 25 bp, Mus musculus
acgcatgcgggtggactctgataat

SEQ ID NO: 120793 - DNA, 25 bp, Mus musculus
acgcatggcaggagtgcagattcct

SEQ ID NO: 120794 - DNA, 25 bp, Mus musculus
acgcatggcaggtgtgcagattcct

SEQ ID NO: 120795 - DNA, 25 bp, Mus musculus
acgcatggtctcactcttgtaaaga

SEQ ID NO: 120796 - DNA, 25 bp, Mus musculus
acgcatggtctctctcttgtaaaga

SEQ ID NO: 120797 - DNA, 25 bp, Mus musculus
acgcatgtgcttattctaggtttta

SEQ ID NO: 120798 - DNA, 25 bp, Mus musculus
acgcatgtgctttttctaggtttta

SEQ ID NO: 120799 - DNA, 25 bp, Mus musculus
acgcatgtgtttcttgctgttgatg

SEQ ID NO: 120800 - DNA, 25 bp, Mus musculus
acgcatgtgtttgttgctgttgatg

SEQ ID NO: 120801 - DNA, 25 bp, Mus musculus
acgcatgttacaactctgagtgagt

SEQ ID NO: 120802 - DNA, 25 bp, Mus musculus
acgcatgttacatctctgagtgagt

SEQ ID NO: 120803 - DNA, 25 bp, Mus musculus
acgcattcctgcaacttttttcaat

SEQ ID NO: 120804 - DNA, 25 bp, Mus musculus
acgcattcctgctacttttttcaat

SEQ ID NO: 120805 - DNA, 25 bp, Mus musculus
acgcattctggccagactacattaa

SEQ ID NO: 120806 - DNA, 25 bp, Mus musculus
acgcattctggcgagactacattaa

SEQ ID NO: 120807 - DNA, 25 bp, Mus musculus
acgcattgcaggcattcctcagaaa

SEQ ID NO: 120808 - DNA, 25 bp, Mus musculus
acgcattgcagggattcctcagaaa

SEQ ID NO: 120809 - DNA, 25 bp, Mus musculus
acgcattggagcaggtggctcgcaa

SEQ ID NO: 120810 - DNA, 25 bp, Mus musculus
acgcattggagctggtggctcgcaa

SEQ ID NO: 120811 - DNA, 25 bp, Mus musculus
acgccaaactctatctactacgaga

SEQ ID NO: 120812 - DNA, 25 bp, Mus musculus
acgccaaactctttctactacgaga

SEQ ID NO: 120813 - DNA, 25 bp, Mus musculus
acgccaaaggctaaagtttccatct

SEQ ID NO: 120814 - DNA, 25 bp, Mus musculus
acgccaaaggcttaagtttccatct

SEQ ID NO: 120815 - DNA, 25 bp, Mus musculus
acgccaaatggacgcttagggcttg

SEQ ID NO: 120816 - DNA, 25 bp, Mus musculus
acgccaaatggaggcttagggcttg

SEQ ID NO: 120817 - DNA, 25 bp, Mus musculus
acgccaaatggtcttacgtattcaa

SEQ ID NO: 120818 - DNA, 25 bp, Mus musculus
acgccaaatggtgttacgtattcaa

SEQ ID NO: 120819 - DNA, 25 bp, Mus musculus
acgccaagaataagccccttgcatt

SEQ ID NO: 120820 - DNA, 25 bp, Mus musculus
acgccaagaatatgccccttgcatt

SEQ ID NO: 120821 - DNA, 25 bp, Mus musculus
acgccaagcagcagggcttccggga

SEQ ID NO: 120822 - DNA, 25 bp, Mus musculus
acgccaagcagctgggcttccggga

SEQ ID NO: 120823 - DNA, 25 bp, Mus musculus
acgccaagcgccacatgtattttta

SEQ ID NO: 120824 - DNA, 25 bp, Mus musculus
acgccaagcgcctcatgtattttta

SEQ ID NO: 120825 - DNA, 25 bp, Mus musculus
acgccaaggagtcgagcaccgtgtt

SEQ ID NO: 120826 - DNA, 25 bp, Mus musculus
acgccaaggagtggagcaccgtgtt

SEQ ID NO: 120827 - DNA, 25 bp, Mus musculus
acgccaagggaactcagggcctttg

SEQ ID NO: 120828 - DNA, 25 bp, Mus musculus
acgccaagggaagtcagggcctttg

SEQ ID NO: 120829 - DNA, 25 bp, Mus musculus
acgccacaaggaccaccagaaatat

SEQ ID NO: 120830 - DNA, 25 bp, Mus musculus
acgccacaaggagcaccagaaatat

SEQ ID NO: 120831 - DNA, 25 bp, Mus musculus
acgccacacgtacaaatgtaacctg

SEQ ID NO: 120832 - DNA, 25 bp, Mus musculus
acgccacacgtagaaatgtaacctg

SEQ ID NO: 120833 - DNA, 25 bp, Mus musculus
acgccacatcagagttgtttgagga

SEQ ID NO: 120834 - DNA, 25 bp, Mus musculus
acgccacatcagcttcctgaaaaag

SEQ ID NO: 120835 - DNA, 25 bp, Mus musculus
acgccacatcaggttcctgaaaaag

SEQ ID NO: 120836 - DNA, 25 bp, Mus musculus
acgccacatcagtgttgtttgagga

SEQ ID NO: 120837 - DNA, 25 bp, Mus musculus
acgccaccatcgcagagaggaactg

SEQ ID NO: 120838 - DNA, 25 bp, Mus musculus
acgccaccatcggagagaggaactg

SEQ ID NO: 120839 - DNA, 25 bp, Mus musculus
acgccacctcatagactgttacagt

SEQ ID NO: 120840 - DNA, 25 bp, Mus musculus
acgccacctcattgactgttacagt

SEQ ID NO: 120841 - DNA, 25 bp, Mus musculus
acgccacttttgattaagggctgtg

SEQ ID NO: 120842 - DNA, 25 bp, Mus musculus
acgccacttttgtttaagggctgtg

SEQ ID NO: 120843 - DNA, 25 bp, Mus musculus
acgccagacactaggaagtgactgt

SEQ ID NO: 120844 - DNA, 25 bp, Mus musculus
acgccagacacttggaagtgactgt

SEQ ID NO: 120845 - DNA, 25 bp, Mus musculus
acgccagaccgtctgatctcgtgtg

SEQ ID NO: 120846 - DNA, 25 bp, Mus musculus
acgccagaccgtgtgatctcgtgtg

SEQ ID NO: 120847 - DNA, 25 bp, Mus musculus
acgccagagagacgtacagggtctt

SEQ ID NO: 120848 - DNA, 25 bp, Mus musculus
acgccagagagaggtacagggtctt

SEQ ID NO: 120849 - DNA, 25 bp, Mus musculus
acgccagagcttcagaacccagaga

SEQ ID NO: 120850 - DNA, 25 bp, Mus musculus
acgccagagcttgagaacccagaga

SEQ ID NO: 120851 - DNA, 25 bp, Mus musculus
acgccagatccaaaatgttgacctg

SEQ ID NO: 120852 - DNA, 25 bp, Mus musculus
acgccagatccataatgttgacctg

SEQ ID NO: 120853 - DNA, 25 bp, Mus musculus
acgccagcttctcgaacttcatcag

SEQ ID NO: 120854 - DNA, 25 bp, Mus musculus
acgccagcttctggaacttcatcag

SEQ ID NO: 120855 - DNA, 25 bp, Mus musculus
acgccagggtcaatcgaaacctgca

SEQ ID NO: 120856 - DNA, 25 bp, Mus musculus
acgccagggtcattcgaaacctgca

SEQ ID NO: 120857 - DNA, 25 bp, Mus musculus
acgccaggttggctagtctgtctga

SEQ ID NO: 120858 - DNA, 25 bp, Mus musculus
acgccaggttgggtagtctgtctga

SEQ ID NO: 120859 - DNA, 25 bp, Mus musculus
acgccaggtttgattcaatttgtga

SEQ ID NO: 120860 - DNA, 25 bp, Mus musculus
acgccaggtttgtttcaatttgtga

SEQ ID NO: 120861 - DNA, 25 bp, Mus musculus
acgccagtgtgtattcccttcgaat

SEQ ID NO: 120862 - DNA, 25 bp, Mus musculus
acgccagtgtgttttcccttcgaat

SEQ ID NO: 120863 - DNA, 25 bp, Mus musculus
acgccagttctgacacttaggattt

SEQ ID NO: 120864 - DNA, 25 bp, Mus musculus
acgccagttctgtcacttaggattt

SEQ ID NO: 120865 - DNA, 25 bp, Mus musculus
acgccataaggcatcactgggtaga

SEQ ID NO: 120866 - DNA, 25 bp, Mus musculus
acgccataaggcttcactgggtaga

SEQ ID NO: 120867 - DNA, 25 bp, Mus musculus
acgccatatgtactcaccagtgact

SEQ ID NO: 120868 - DNA, 25 bp, Mus musculus
acgccatatgtagtcaccagtgact

SEQ ID NO: 120869 - DNA, 25 bp, Mus musculus
acgccatcaaacacggactgagctt

SEQ ID NO: 120870 - DNA, 25 bp, Mus musculus
acgccatcaaactcggactgagctt

SEQ ID NO: 120871 - DNA, 25 bp, Mus musculus
acgccatcctcacccagaagcagag

SEQ ID NO: 120872 - DNA, 25 bp, Mus musculus
acgccatcctcagccagaagcagag

SEQ ID NO: 120873 - DNA, 25 bp, Mus musculus
acgccatccttgaaggactccatgc

SEQ ID NO: 120874 - DNA, 25 bp, Mus musculus
acgccatccttgtaggactccatgc

SEQ ID NO: 120875 - DNA, 25 bp, Mus musculus
acgccatcggagcaggtctagagac

SEQ ID NO: 120876 - DNA, 25 bp, Mus musculus
acgccatcggaggaggtctagagac

SEQ ID NO: 120877 - DNA, 25 bp, Mus musculus
acgccatctccacgagctgtgctga

SEQ ID NO: 120878 - DNA, 25 bp, Mus musculus
acgccatctccaggagctgtgctga

SEQ ID NO: 120879 - DNA, 25 bp, Mus musculus
acgccatcttttcctaataactact

SEQ ID NO: 120880 - DNA, 25 bp, Mus musculus
acgccatcttttgctaataactact

SEQ ID NO: 120881 - DNA, 25 bp, Mus musculus
acgccatgaccaccaacagcaatat

SEQ ID NO: 120882 - DNA, 25 bp, Mus musculus
acgccatgaccagcaacagcaatat

SEQ ID NO: 120883 - DNA, 25 bp, Mus musculus
acgccattgactaccttcgttatat

SEQ ID NO: 120884 - DNA, 25 bp, Mus musculus
acgccattgacttccttcgttatat

SEQ ID NO: 120885 - DNA, 25 bp, Mus musculus
acgcccaacaagaagccacctgagg

SEQ ID NO: 120886 - DNA, 25 bp, Mus musculus
acgcccaacaagtagccacctgagg

SEQ ID NO: 120887 - DNA, 25 bp, Mus musculus
acgcccaagatcctcggtttgatat

SEQ ID NO: 120888 - DNA, 25 bp, Mus musculus
acgcccaagatcgtcggtttgatat

SEQ ID NO: 120889 - DNA, 25 bp, Mus musculus
acgcccaaggaaaggagcctgtgtc

SEQ ID NO: 120890 - DNA, 25 bp, Mus musculus
acgcccaaggaatggagcctgtgtc

SEQ ID NO: 120891 - DNA, 25 bp, Mus musculus
acgcccaaggctctgactgctatag

SEQ ID NO: 120892 - DNA, 25 bp, Mus musculus
acgcccaaggctgtgactgctatag

SEQ ID NO: 120893 - DNA, 25 bp, Mus musculus
acgcccacataaattcatggctatt

SEQ ID NO: 120894 - DNA, 25 bp, Mus musculus
acgcccacataatttcatggctatt

SEQ ID NO: 120895 - DNA, 25 bp, Mus musculus
acgcccacattacctgggtgtgaaa

SEQ ID NO: 120896 - DNA, 25 bp, Mus musculus
acgcccacattagctgggtgtgaaa

SEQ ID NO: 120897 - DNA, 25 bp, Mus musculus
acgcccactcgccagcaagtaagat

SEQ ID NO: 120898 - DNA, 25 bp, Mus musculus
acgcccactcgcgagcaagtaagat

SEQ ID NO: 120899 - DNA, 25 bp, Mus musculus
acgcccagagtgaccaatgtcacag

SEQ ID NO: 120900 - DNA, 25 bp, Mus musculus
acgcccagagtgtccaatgtcacag

SEQ ID NO: 120901 - DNA, 25 bp, Mus musculus
acgcccagattgctcagtttgttac

SEQ ID NO: 120902 - DNA, 25 bp, Mus musculus
acgcccagattggtcagtttgttac

SEQ ID NO: 120903 - DNA, 25 bp, Mus musculus
acgcccagctataaacagttgcaat

SEQ ID NO: 120904 - DNA, 25 bp, Mus musculus
acgcccagctattaacagttgcaat

SEQ ID NO: 120905 - DNA, 25 bp, Mus musculus
acgcccagcttaagttttttctcaa

SEQ ID NO: 120906 - DNA, 25 bp, Mus musculus
acgcccagcttatgttttttctcaa

SEQ ID NO: 120907 - DNA, 25 bp, Mus musculus
acgcccaggttcaaatctcagtgta

SEQ ID NO: 120908 - DNA, 25 bp, Mus musculus
acgcccaggttctaatctcagtgta

SEQ ID NO: 120909 - DNA, 25 bp, Mus musculus
acgcccagtggcagacaaggacact

SEQ ID NO: 120910 - DNA, 25 bp, Mus musculus
acgcccagtggctgacaaggacact

SEQ ID NO: 120911 - DNA, 25 bp, Mus musculus
acgcccatcatcacgagggtaatca

SEQ ID NO: 120912 - DNA, 25 bp, Mus musculus
acgcccatcatctcgagggtaatca

SEQ ID NO: 120913 - DNA, 25 bp, Mus musculus
acgccccacctgagtggctaggaag

SEQ ID NO: 120914 - DNA, 25 bp, Mus musculus
acgccccacctgtgtggctaggaag

SEQ ID NO: 120915 - DNA, 25 bp, Mus musculus
acgccccactttacatgatgctgga

SEQ ID NO: 120916 - DNA, 25 bp, Mus musculus
acgccccacttttcatgatgctgga

SEQ ID NO: 120917 - DNA, 25 bp, Mus musculus
acgccccaggtgatctgtgcatgtc

SEQ ID NO: 120918 - DNA, 25 bp, Mus musculus
acgccccaggtgttctgtgcatgtc

SEQ ID NO: 120919 - DNA, 25 bp, Mus musculus
acgccccgagtgctggatggactac

SEQ ID NO: 120920 - DNA, 25 bp, Mus musculus
acgccccgagtggtggatggactac

SEQ ID NO: 120921 - DNA, 25 bp, Mus musculus
acgccccggaggacgctgcgcttgt

SEQ ID NO: 120922 - DNA, 25 bp, Mus musculus
acgccccggaggtcgctgcgcttgt

SEQ ID NO: 120923 - DNA, 25 bp, Mus musculus
acgccccttctacagcatgagacaa

SEQ ID NO: 120924 - DNA, 25 bp, Mus musculus
acgccccttctagagcatgagacaa

SEQ ID NO: 120925 - DNA, 25 bp, Mus musculus
acgccccttctgaattgtggcttta

SEQ ID NO: 120926 - DNA, 25 bp, Mus musculus
acgccccttctgtattgtggcttta

SEQ ID NO: 120927 - DNA, 25 bp, Mus musculus
acgccccttgttctgaagtttacat

SEQ ID NO: 120928 - DNA, 25 bp, Mus musculus
acgccccttgttgtgaagtttacat

SEQ ID NO: 120929 - DNA, 25 bp, Mus musculus
acgcccgctgcgcagatattttgag

SEQ ID NO: 120930 - DNA, 25 bp, Mus musculus
acgcccgctgcggagatattttgag

SEQ ID NO: 120931 - DNA, 25 bp, Mus musculus
acgcccggaatcacagcaactgaag

SEQ ID NO: 120932 - DNA, 25 bp, Mus musculus
acgcccggaatctcagcaactgaag

SEQ ID NO: 120933 - DNA, 25 bp, Mus musculus
acgcccggccttattattatctagc

SEQ ID NO: 120934 - DNA, 25 bp, Mus musculus
acgcccggcctttttattatctagc

SEQ ID NO: 120935 - DNA, 25 bp, Mus musculus
acgcccggctgtaagtgttcattct

SEQ ID NO: 120936 - DNA, 25 bp, Mus musculus
acgcccggctgttagtgttcattct

SEQ ID NO: 120937 - DNA, 25 bp, Mus musculus
acgccctagagcctttgtggagtca

SEQ ID NO: 120938 - DNA, 25 bp, Mus musculus
acgccctagagcgtttgtggagtca

SEQ ID NO: 120939 - DNA, 25 bp, Mus musculus
acgccctcaaatcggttgctgctga

SEQ ID NO: 120940 - DNA, 25 bp, Mus musculus
acgccctcaaatgggttgctgctga

SEQ ID NO: 120941 - DNA, 25 bp, Mus musculus
acgccctcattcagctttcagaaag

SEQ ID NO: 120942 - DNA, 25 bp, Mus musculus
acgccctcattctgctttcagaaag

SEQ ID NO: 120943 - DNA, 25 bp, Mus musculus
acgccctctccacattcaaaagtat

SEQ ID NO: 120944 - DNA, 25 bp, Mus musculus
acgccctctccagattcaaaagtat

SEQ ID NO: 120945 - DNA, 25 bp, Mus musculus
acgccctctcttactgtgttcagat

SEQ ID NO: 120946 - DNA, 25 bp, Mus musculus
acgccctctctttctgtgttcagat

SEQ ID NO: 120947 - DNA, 25 bp, Mus musculus
acgcccttagtgacgtcaggacaaa

SEQ ID NO: 120948 - DNA, 25 bp, Mus musculus
acgcccttagtgtcgtcaggacaaa

SEQ ID NO: 120949 - DNA, 25 bp, Mus musculus
acgccgaacgggattgtctacacag

SEQ ID NO: 120950 - DNA, 25 bp, Mus musculus
acgccgaacgggtttgtctacacag

SEQ ID NO: 120951 - DNA, 25 bp, Mus musculus
acgccgacatagagcatcttctgct

SEQ ID NO: 120952 - DNA, 25 bp, Mus musculus
acgccgacatagtgcatcttctgct

SEQ ID NO: 120953 - DNA, 25 bp, Mus musculus
acgccgagagccagcagaacatgag

SEQ ID NO: 120954 - DNA, 25 bp, Mus musculus
acgccgagagcctgcagaacatgag

SEQ ID NO: 120955 - DNA, 25 bp, Mus musculus
acgccgagctgcatggttcctttga

SEQ ID NO: 120956 - DNA, 25 bp, Mus musculus
acgccgagctgcttggttcctttga

SEQ ID NO: 120957 - DNA, 25 bp, Mus musculus
acgccgcaagtcacaaagcgccggg

SEQ ID NO: 120958 - DNA, 25 bp, Mus musculus
acgccgcaagtccttcagagaaaca

SEQ ID NO: 120959 - DNA, 25 bp, Mus musculus
acgccgcaagtcgttcagagaaaca

SEQ ID NO: 120960 - DNA, 25 bp, Mus musculus
acgccgcaagtctcaaagcgccggg

SEQ ID NO: 120961 - DNA, 25 bp, Mus musculus
acgccgccgagcacgtaaagtgagc

SEQ ID NO: 120962 - DNA, 25 bp, Mus musculus
acgccgccgagctcgtaaagtgagc

SEQ ID NO: 120963 - DNA, 25 bp, Mus musculus
acgccgcctaacatatttttagcag

SEQ ID NO: 120964 - DNA, 25 bp, Mus musculus
acgccgcctaacttatttttagcag

SEQ ID NO: 120965 - DNA, 25 bp, Mus musculus
acgccgctgtgccattgaagcagat

SEQ ID NO: 120966 - DNA, 25 bp, Mus musculus
acgccgctgtgcgattgaagcagat

SEQ ID NO: 120967 - DNA, 25 bp, Mus musculus
acgccgcttgcccataacgatgatg

SEQ ID NO: 120968 - DNA, 25 bp, Mus musculus
acgccgcttgccgataacgatgatg

SEQ ID NO: 120969 - DNA, 25 bp, Mus musculus
acgccggatagtctgcttgtgaatc

SEQ ID NO: 120970 - DNA, 25 bp, Mus musculus
acgccggatagtgtgcttgtgaatc

SEQ ID NO: 120971 - DNA, 25 bp, Mus musculus
acgccggctctcacaggatcagact

SEQ ID NO: 120972 - DNA, 25 bp, Mus musculus
acgccggctctctcaggatcagact

SEQ ID NO: 120973 - DNA, 25 bp, Mus musculus
acgccgggaaggaaacatctggtat

SEQ ID NO: 120974 - DNA, 25 bp, Mus musculus
acgccgggaaggtaacatctggtat

SEQ ID NO: 120975 - DNA, 25 bp, Mus musculus
acgccggttgccatgggagatcaag

SEQ ID NO: 120976 - DNA, 25 bp, Mus musculus
acgccggttgccttgggagatcaag

SEQ ID NO: 120977 - DNA, 25 bp, Mus musculus
acgccgtaacagcagatctagtgat

SEQ ID NO: 120978 - DNA, 25 bp, Mus musculus
acgccgtaacaggagatctagtgat

SEQ ID NO: 120979 - DNA, 25 bp, Mus musculus
acgccgtggtgcaggcctccaagct

SEQ ID NO: 120980 - DNA, 25 bp, Mus musculus
acgccgtggtgctggcctccaagct

SEQ ID NO: 120981 - DNA, 25 bp, Mus musculus
acgcctacaaagacttctgccagaa

SEQ ID NO: 120982 - DNA, 25 bp, Mus musculus
acgcctacaaagtcttctgccagaa

SEQ ID NO: 120983 - DNA, 25 bp, Mus musculus
acgcctagcacaactgattatccag

SEQ ID NO: 120984 - DNA, 25 bp, Mus musculus
acgcctagcacatctgattatccag

SEQ ID NO: 120985 - DNA, 25 bp, Mus musculus
acgcctatgatgaggaggactgtgt

SEQ ID NO: 120986 - DNA, 25 bp, Mus musculus
acgcctatgatgtggaggactgtgt

SEQ ID NO: 120987 - DNA, 25 bp, Mus musculus
acgcctcactctcacaataggatga

SEQ ID NO: 120988 - DNA, 25 bp, Mus musculus
acgcctcactctgacaataggatga

SEQ ID NO: 120989 - DNA, 25 bp, Mus musculus
acgcctcacttgctcattacaggtt

SEQ ID NO: 120990 - DNA, 25 bp, Mus musculus
acgcctcacttggtcattacaggtt

SEQ ID NO: 120991 - DNA, 25 bp, Mus musculus
acgcctcattggacttactctgtat

SEQ ID NO: 120992 - DNA, 25 bp, Mus musculus
acgcctcattggtcttactctgtat

SEQ ID NO: 120993 - DNA, 25 bp, Mus musculus
acgcctccgagcatgcagtgaacaa

SEQ ID NO: 120994 - DNA, 25 bp, Mus musculus
acgcctccgagcttgcagtgaacaa

SEQ ID NO: 120995 - DNA, 25 bp, Mus musculus
acgcctcgctatatctcaggacaga

SEQ ID NO: 120996 - DNA, 25 bp, Mus musculus
acgcctcgctatttctcaggacaga

SEQ ID NO: 120997 - DNA, 25 bp, Mus musculus
acgcctctaatgcagtgtctgagtc

SEQ ID NO: 120998 - DNA, 25 bp, Mus musculus
acgcctctaatggagtgtctgagtc

SEQ ID NO: 120999 - DNA, 25 bp, Mus musculus
acgcctctatgaatgtgtgtctctg

SEQ ID NO: 121000 - DNA, 25 bp, Mus musculus
acgcctctatgattgtgtgtctctg

SEQ ID NO: 121001 - DNA, 25 bp, Mus musculus
acgcctgaacagaagggcattcctc

SEQ ID NO: 121002 - DNA, 25 bp, Mus musculus
acgcctgaacagtagggcattcctc

SEQ ID NO: 121003 - DNA, 25 bp, Mus musculus
acgcctgcaggacgtgaccgatgac

SEQ ID NO: 121004 - DNA, 25 bp, Mus musculus
acgcctgcaggaggtgaccgatgac

SEQ ID NO: 121005 - DNA, 25 bp, Mus musculus
acgcctgccctcatacttggaagaa

SEQ ID NO: 121006 - DNA, 25 bp, Mus musculus
acgcctgccctcttacttggaagaa

SEQ ID NO: 121007 - DNA, 25 bp, Mus musculus
acgcctggacatagacccgaaggac

SEQ ID NO: 121008 - DNA, 25 bp, Mus musculus
acgcctggacattgacccgaaggac

SEQ ID NO: 121009 - DNA, 25 bp, Mus musculus
acgcctggcagcaggtgacagagct

SEQ ID NO: 121010 - DNA, 25 bp, Mus musculus
acgcctggcagctggtgacagagct

SEQ ID NO: 121011 - DNA, 25 bp, Mus musculus
acgcctggccaaatgtctcttttct

SEQ ID NO: 121012 - DNA, 25 bp, Mus musculus
acgcctggccaattgtctcttttct

SEQ ID NO: 121013 - DNA, 25 bp, Mus musculus
acgcctggccagaaatttcttaaag

SEQ ID NO: 121014 - DNA, 25 bp, Mus musculus
acgcctggccagtaatttcttaaag

SEQ ID NO: 121015 - DNA, 25 bp, Mus musculus
acgcctggctaacattgttctggtc

SEQ ID NO: 121016 - DNA, 25 bp, Mus musculus
acgcctggctaagattgttctggtc

SEQ ID NO: 121017 - DNA, 25 bp, Mus musculus
acgcctgggttcagtctgagcatgt

SEQ ID NO: 121018 - DNA, 25 bp, Mus musculus
acgcctgggttctgtctgagcatgt

SEQ ID NO: 121019 - DNA, 25 bp, Mus musculus
acgcctggttctaccgatggatgat

SEQ ID NO: 121020 - DNA, 25 bp, Mus musculus
acgcctggttcttccgatggatgat

SEQ ID NO: 121021 - DNA, 25 bp, Mus musculus
acgcctgtatgtcactagcatctaa

SEQ ID NO: 121022 - DNA, 25 bp, Mus musculus
acgcctgtatgtgactagcatctaa

SEQ ID NO: 121023 - DNA, 25 bp, Mus musculus
acgcctgtctggaagatgccatgct

SEQ ID NO: 121024 - DNA, 25 bp, Mus musculus
acgcctgtctggtagatgccatgct

SEQ ID NO: 121025 - DNA, 25 bp, Mus musculus
acgcctgtcttaaatcatgtactcc

SEQ ID NO: 121026 - DNA, 25 bp, Mus musculus
acgcctgtcttatatcatgtactcc

SEQ ID NO: 121027 - DNA, 25 bp, Mus musculus
acgcctgtgaaaaagctgctggtgg

SEQ ID NO: 121028 - DNA, 25 bp, Mus musculus
acgcctgtgaaatagctgctggtgg

SEQ ID NO: 121029 - DNA, 25 bp, Mus musculus
acgcctgtgactagacagcctggaa

SEQ ID NO: 121030 - DNA, 25 bp, Mus musculus
acgcctgtgacttgacagcctggaa

SEQ ID NO: 121031 - DNA, 25 bp, Mus musculus
acgcctgtgagaccttgtccaaaat

SEQ ID NO: 121032 - DNA, 25 bp, Mus musculus
acgcctgtgagagcttgtccaaaat

SEQ ID NO: 121033 - DNA, 25 bp, Mus musculus
acgcctgtgcaacacactcaacggg

SEQ ID NO: 121034 - DNA, 25 bp, Mus musculus
acgcctgtgcaagacactcaacggg

SEQ ID NO: 121035 - DNA, 25 bp, Mus musculus
acgcctgtgtcccttgccgcgattg

SEQ ID NO: 121036 - DNA, 25 bp, Mus musculus
acgcctgtgtccgttgccgcgattg

SEQ ID NO: 121037 - DNA, 25 bp, Mus musculus
acgccttcccgtacattatattagt

SEQ ID NO: 121038 - DNA, 25 bp, Mus musculus
acgccttcccgttcattatattagt

SEQ ID NO: 121039 - DNA, 25 bp, Mus musculus
acgccttccttacatgttttgtctt

SEQ ID NO: 121040 - DNA, 25 bp, Mus musculus
acgccttccttagatgttttgtctt

SEQ ID NO: 121041 - DNA, 25 bp, Mus musculus
acgccttctatgactcttgagtggt

SEQ ID NO: 121042 - DNA, 25 bp, Mus musculus
acgccttctatgtctcttgagtggt

SEQ ID NO: 121043 - DNA, 25 bp, Mus musculus
acgccttcttatagaatcttcacca

SEQ ID NO: 121044 - DNA, 25 bp, Mus musculus
acgccttcttattgaatcttcacca

SEQ ID NO: 121045 - DNA, 25 bp, Mus musculus
acgccttcttggatacacattgcaa

SEQ ID NO: 121046 - DNA, 25 bp, Mus musculus
acgccttcttggttacacattgcaa

SEQ ID NO: 121047 - DNA, 25 bp, Mus musculus
acgccttgactgctgcggaagatcg

SEQ ID NO: 121048 - DNA, 25 bp, Mus musculus
acgccttgactggtgcggaagatcg

SEQ ID NO: 121049 - DNA, 25 bp, Mus musculus
acgccttgatggacctggaagtgtg

SEQ ID NO: 121050 - DNA, 25 bp, Mus musculus
acgccttgatggtcctggaagtgtg

SEQ ID NO: 121051 - DNA, 25 bp, Mus musculus
acgccttgctgaaggtgaattcact

SEQ ID NO: 121052 - DNA, 25 bp, Mus musculus
acgccttgctgatggtgaattcact

SEQ ID NO: 121053 - DNA, 25 bp, Mus musculus
acgccttggcccagtgctgaaggag

SEQ ID NO: 121054 - DNA, 25 bp, Mus musculus
acgccttggccctgtgctgaaggag

SEQ ID NO: 121055 - DNA, 25 bp, Mus musculus
acgccttggtggagcattactctga

SEQ ID NO: 121056 - DNA, 25 bp, Mus musculus
acgccttggtggtgcattactctga

SEQ ID NO: 121057 - DNA, 25 bp, Mus musculus
acgccttggttcactaatgcagcta

SEQ ID NO: 121058 - DNA, 25 bp, Mus musculus
acgccttggttctctaatgcagcta

SEQ ID NO: 121059 - DNA, 25 bp, Mus musculus
acgccttgtcatctttaataccaga

SEQ ID NO: 121060 - DNA, 25 bp, Mus musculus
acgccttgtcatgtttaataccaga

SEQ ID NO: 121061 - DNA, 25 bp, Mus musculus
acgcctttaacgagacagtctctta

SEQ ID NO: 121062 - DNA, 25 bp, Mus musculus
acgcctttaacgtgacagtctctta

SEQ ID NO: 121063 - DNA, 25 bp, Mus musculus
acgcctttcaggaccagtatctaga

SEQ ID NO: 121064 - DNA, 25 bp, Mus musculus
acgcctttcaggtccagtatctaga

SEQ ID NO: 121065 - DNA, 25 bp, Mus musculus
acgcctttcttcctggtgcacatca

SEQ ID NO: 121066 - DNA, 25 bp, Mus musculus
acgcctttcttcgtggtgcacatca

SEQ ID NO: 121067 - DNA, 25 bp, Mus musculus
acgcctttgtttctaaatgttgctt

SEQ ID NO: 121068 - DNA, 25 bp, Mus musculus
acgcctttgtttgtaaatgttgctt

SEQ ID NO: 121069 - DNA, 25 bp, Mus musculus
acgcgaaaacgtcacataacatatg

SEQ ID NO: 121070 - DNA, 25 bp, Mus musculus
acgcgaaaacgtgacataacatatg

SEQ ID NO: 121071 - DNA, 25 bp, Mus musculus
acgcgaccagtgaagcagtagtcca

SEQ ID NO: 121072 - DNA, 25 bp, Mus musculus
acgcgaccagtgtagcagtagtcca

SEQ ID NO: 121073 - DNA, 25 bp, Mus musculus
acgcgactctaccactgccaggagg

SEQ ID NO: 121074 - DNA, 25 bp, Mus musculus
acgcgactctacgactgccaggagg

SEQ ID NO: 121075 - DNA, 25 bp, Mus musculus
acgcgagagacgagcttccgaagga

SEQ ID NO: 121076 - DNA, 25 bp, Mus musculus
acgcgagagacgtgcttccgaagga

SEQ ID NO: 121077 - DNA, 25 bp, Mus musculus
acgcgagccacaagctgcactgtga

SEQ ID NO: 121078 - DNA, 25 bp, Mus musculus
acgcgagccacatgctgcactgtga

SEQ ID NO: 121079 - DNA, 25 bp, Mus musculus
acgcgatcgatcctttgaaagtccc

SEQ ID NO: 121080 - DNA, 25 bp, Mus musculus
acgcgatcgatcgtttgaaagtccc

SEQ ID NO: 121081 - DNA, 25 bp, Mus musculus
acgcgattgctaattgcccctgatc

SEQ ID NO: 121082 - DNA, 25 bp, Mus musculus
acgcgattgctatttgcccctgatc

SEQ ID NO: 121083 - DNA, 25 bp, Mus musculus
acgcgcaagctcaacaagtgcatca

SEQ ID NO: 121084 - DNA, 25 bp, Mus musculus
acgcgcaagctctacaagtgcatca

SEQ ID NO: 121085 - DNA, 25 bp, Mus musculus
acgcgcacctgcctgagaacttggg

SEQ ID NO: 121086 - DNA, 25 bp, Mus musculus
acgcgcacctgcgtgagaacttggg

SEQ ID NO: 121087 - DNA, 25 bp, Mus musculus
acgcgcactcttattgacggtcggt

SEQ ID NO: 121088 - DNA, 25 bp, Mus musculus
acgcgcactctttttgacggtcggt

SEQ ID NO: 121089 - DNA, 25 bp, Mus musculus
acgcgcactgtgcagatcatcaacg

SEQ ID NO: 121090 - DNA, 25 bp, Mus musculus
acgcgcactgtggagatcatcaacg

SEQ ID NO: 121091 - DNA, 25 bp, Mus musculus
acgcgcagaaggatttgtgaacttg

SEQ ID NO: 121092 - DNA, 25 bp, Mus musculus
acgcgcagaaggttttgtgaacttg

SEQ ID NO: 121093 - DNA, 25 bp, Mus musculus
acgcgcagccataaggcagccagca

SEQ ID NO: 121094 - DNA, 25 bp, Mus musculus
acgcgcagccattaggcagccagca

SEQ ID NO: 121095 - DNA, 25 bp, Mus musculus
acgcgcattacgcacccagagattt

SEQ ID NO: 121096 - DNA, 25 bp, Mus musculus
acgcgcattacggacccagagattt

SEQ ID NO: 121097 - DNA, 25 bp, Mus musculus
acgcgccctcggcatgtggaaagac

SEQ ID NO: 121098 - DNA, 25 bp, Mus musculus
acgcgccctcgggatgtggaaagac

SEQ ID NO: 121099 - DNA, 25 bp, Mus musculus
acgcgccgccaacgtctatataagg

SEQ ID NO: 121100 - DNA, 25 bp, Mus musculus
acgcgccgccaaggtctatataagg

SEQ ID NO: 121101 - DNA, 25 bp, Mus musculus
acgcgcgagtcacggtcaagtacga

SEQ ID NO: 121102 - DNA, 25 bp, Mus musculus
acgcgcgagtcagggtcaagtacga

SEQ ID NO: 121103 - DNA, 25 bp, Mus musculus
acgcgcgcacacactcagaggaaaa

SEQ ID NO: 121104 - DNA, 25 bp, Mus musculus
acgcgcgcacactctcagaggaaaa

SEQ ID NO: 121105 - DNA, 25 bp, Mus musculus
acgcgcgcacagaacatttgacttc

SEQ ID NO: 121106 - DNA, 25 bp, Mus musculus
acgcgcgcacagtacatttgacttc

SEQ ID NO: 121107 - DNA, 25 bp, Mus musculus
acgcgcgcgtaactggtcatcggcc

SEQ ID NO: 121108 - DNA, 25 bp, Mus musculus
acgcgcgcgtaagtggtcatcggcc

SEQ ID NO: 121109 - DNA, 25 bp, Mus musculus
acgcgcgcgtcaaccagtggttgta

SEQ ID NO: 121110 - DNA, 25 bp, Mus musculus
acgcgcgcgtcatccagtggttgta

SEQ ID NO: 121111 - DNA, 25 bp, Mus musculus
acgcgcgctgatccctccgcggagt

SEQ ID NO: 121112 - DNA, 25 bp, Mus musculus
acgcgcgctgatgcctccgcggagt

SEQ ID NO: 121113 - DNA, 25 bp, Mus musculus
acgcgctatctgacggtgtgcgaac

SEQ ID NO: 121114 - DNA, 25 bp, Mus musculus
acgcgctatctgtcggtgtgcgaac

SEQ ID NO: 121115 - DNA, 25 bp, Mus musculus
acgcgctgcagcattgtatgattta

SEQ ID NO: 121116 - DNA, 25 bp, Mus musculus
acgcgctgcagctttgtatgattta

SEQ ID NO: 121117 - DNA, 25 bp, Mus musculus
acgcgctgtgtacgtgttagatcta

SEQ ID NO: 121118 - DNA, 25 bp, Mus musculus
acgcgctgtgtaggtgttagatcta

SEQ ID NO: 121119 - DNA, 25 bp, Mus musculus
acgcgcttctgcagcgggaaggtgt

SEQ ID NO: 121120 - DNA, 25 bp, Mus musculus
acgcgcttctgctgcgggaaggtgt

SEQ ID NO: 121121 - DNA, 25 bp, Mus musculus
acgcggaagcctatgttgtgacatc

SEQ ID NO: 121122 - DNA, 25 bp, Mus musculus
acgcggaagcctttgttgtgacatc

SEQ ID NO: 121123 - DNA, 25 bp, Mus musculus
acgcggacacgcacctggagagcat

SEQ ID NO: 121124 - DNA, 25 bp, Mus musculus
acgcggacacgctcctggagagcat

SEQ ID NO: 121125 - DNA, 25 bp, Mus musculus
acgcggatgcatacattccttcttg

SEQ ID NO: 121126 - DNA, 25 bp, Mus musculus
acgcggatgcattcattccttcttg

SEQ ID NO: 121127 - DNA, 25 bp, Mus musculus
acgcggcagccacgtgattccctag

SEQ ID NO: 121128 - DNA, 25 bp, Mus musculus
acgcggcagccaggtgattccctag

SEQ ID NO: 121129 - DNA, 25 bp, Mus musculus
acgcggcctcggaactctgaatgag

SEQ ID NO: 121130 - DNA, 25 bp, Mus musculus
acgcggcctcggtactctgaatgag

SEQ ID NO: 121131 - DNA, 25 bp, Mus musculus
acgcggctgcggaaactggacgttt

SEQ ID NO: 121132 - DNA, 25 bp, Mus musculus
acgcggctgcggtaactggacgttt

SEQ ID NO: 121133 - DNA, 25 bp, Mus musculus
acgcgggagagcagttcactggcca

SEQ ID NO: 121134 - DNA, 25 bp, Mus musculus
acgcgggagagctgttcactggcca

SEQ ID NO: 121135 - DNA, 25 bp, Mus musculus
acgcgggtgcaaatctctctgagga

SEQ ID NO: 121136 - DNA, 25 bp, Mus musculus
acgcgggtgcaattctctctgagga

SEQ ID NO: 121137 - DNA, 25 bp, Mus musculus
acgcgggttgtgcacctggctggat

SEQ ID NO: 121138 - DNA, 25 bp, Mus musculus
acgcgggttgtggacctggctggat

SEQ ID NO: 121139 - DNA, 25 bp, Mus musculus
acgcggtgtcggagggcaccaaggc

SEQ ID NO: 121140 - DNA, 25 bp, Mus musculus
acgcggtgtcggtgggcaccaaggc

SEQ ID NO: 121141 - DNA, 25 bp, Mus musculus
acgcgtccaacaactcaaacttgat

SEQ ID NO: 121142 - DNA, 25 bp, Mus musculus
acgcgtccaacatctcaaacttgat

SEQ ID NO: 121143 - DNA, 25 bp, Mus musculus
acgcgtccgactatgacatttcaga

SEQ ID NO: 121144 - DNA, 25 bp, Mus musculus
acgcgtccgactttgacatttcaga

SEQ ID NO: 121145 - DNA, 25 bp, Mus musculus
acgcgtgcaagcagttgttccagga

SEQ ID NO: 121146 - DNA, 25 bp, Mus musculus
acgcgtgcaagctgttgttccagga

SEQ ID NO: 121147 - DNA, 25 bp, Mus musculus
acgcgtgcacatcctcgtgtgtgtg

SEQ ID NO: 121148 - DNA, 25 bp, Mus musculus
acgcgtgcacatgctcgtgtgtgtg

SEQ ID NO: 121149 - DNA, 25 bp, Mus musculus
acgcgtgcatcgactgggtcaaata

SEQ ID NO: 121150 - DNA, 25 bp, Mus musculus
acgcgtgcatcgtctgggtcaaata

SEQ ID NO: 121151 - DNA, 25 bp, Mus musculus
acgcgtgctctgatggtgatggttt

SEQ ID NO: 121152 - DNA, 25 bp, Mus musculus
acgcgtgctctgttggtgatggttt

SEQ ID NO: 121153 - DNA, 25 bp, Mus musculus
acgcgtgctgcgaatgcggcaagac

SEQ ID NO: 121154 - DNA, 25 bp, Mus musculus
acgcgtgctgcgtatgcggcaagac

SEQ ID NO: 121155 - DNA, 25 bp, Mus musculus
acgcgtggccaacaacgagctaaaa

SEQ ID NO: 121156 - DNA, 25 bp, Mus musculus
acgcgtggccaagaacgagctaaaa

SEQ ID NO: 121157 - DNA, 25 bp, Mus musculus
acgcgtggctgaagacgtgttcaca

SEQ ID NO: 121158 - DNA, 25 bp, Mus musculus
acgcgtggctgatgacgtgttcaca

SEQ ID NO: 121159 - DNA, 25 bp, Mus musculus
acgcgtgtaaagatctgtgcatttg

SEQ ID NO: 121160 - DNA, 25 bp, Mus musculus
acgcgtgtaaagttctgtgcatttg

SEQ ID NO: 121161 - DNA, 25 bp, Mus musculus
acgcgtgtcgtcagtaaagttcaga

SEQ ID NO: 121162 - DNA, 25 bp, Mus musculus
acgcgtgtcgtctgtaaagttcaga

SEQ ID NO: 121163 - DNA, 25 bp, Mus musculus
acgcgtgtcgtgcttgcttgagtta

SEQ ID NO: 121164 - DNA, 25 bp, Mus musculus
acgcgtgtcgtggttgcttgagtta

SEQ ID NO: 121165 - DNA, 25 bp, Mus musculus
acgcgttcccaaagtgtagacggac

SEQ ID NO: 121166 - DNA, 25 bp, Mus musculus
acgcgttcccaatgtgtagacggac

SEQ ID NO: 121167 - DNA, 25 bp, Mus musculus
acgcgttctgcgcaagatgtgtgta

SEQ ID NO: 121168 - DNA, 25 bp, Mus musculus
acgcgttctgcggaagatgtgtgta

SEQ ID NO: 121169 - DNA, 25 bp, Mus musculus
acgcgttcttgtcagctttgatgtc

SEQ ID NO: 121170 - DNA, 25 bp, Mus musculus
acgcgttcttgtgagctttgatgtc

SEQ ID NO: 121171 - DNA, 25 bp, Mus musculus
acgcgtttttggcacctgcagaaat

SEQ ID NO: 121172 - DNA, 25 bp, Mus musculus
acgcgtttttgggacctgcagaaat

SEQ ID NO: 121173 - DNA, 25 bp, Mus musculus
acgctaactaatcctgcttgtcggg

SEQ ID NO: 121174 - DNA, 25 bp, Mus musculus
acgctaactaatgctgcttgtcggg

SEQ ID NO: 121175 - DNA, 25 bp, Mus musculus
acgctaagtgctctttacagtccga

SEQ ID NO: 121176 - DNA, 25 bp, Mus musculus
acgctaagtgctgtttacagtccga

SEQ ID NO: 121177 - DNA, 25 bp, Mus musculus
acgctaatcttcaccctagaacagt

SEQ ID NO: 121178 - DNA, 25 bp, Mus musculus
acgctaatcttctccctagaacagt

SEQ ID NO: 121179 - DNA, 25 bp, Mus musculus
acgctacactctctggttctgcatg

SEQ ID NO: 121180 - DNA, 25 bp, Mus musculus
acgctacactctgtggttctgcatg

SEQ ID NO: 121181 - DNA, 25 bp, Mus musculus
acgctacatggaagggctccaggtc

SEQ ID NO: 121182 - DNA, 25 bp, Mus musculus
acgctacatggatgggctccaggtc

SEQ ID NO: 121183 - DNA, 25 bp, Mus musculus
acgctaccctctcattcttggaatc

SEQ ID NO: 121184 - DNA, 25 bp, Mus musculus
acgctaccctctgattcttggaatc

SEQ ID NO: 121185 - DNA, 25 bp, Mus musculus
acgctaccgcctccttcgtgacctg

SEQ ID NO: 121186 - DNA, 25 bp, Mus musculus
acgctaccgcctgcttcgtgacctg

SEQ ID NO: 121187 - DNA, 25 bp, Mus musculus
acgctaccgcgtagatgatgagtgt

SEQ ID NO: 121188 - DNA, 25 bp, Mus musculus
acgctaccgcgttgatgatgagtgt

SEQ ID NO: 121189 - DNA, 25 bp, Mus musculus
acgctacctgttcaggacttcctag

SEQ ID NO: 121190 - DNA, 25 bp, Mus musculus
acgctacctgttgaggacttcctag

SEQ ID NO: 121191 - DNA, 25 bp, Mus musculus
acgctactgggtattgcagcactgc

SEQ ID NO: 121192 - DNA, 25 bp, Mus musculus
acgctactgggttttgcagcactgc

SEQ ID NO: 121193 - DNA, 25 bp, Mus musculus
acgctagaaggaaagctgcccctat

SEQ ID NO: 121194 - DNA, 25 bp, Mus musculus
acgctagaaggatagctgcccctat

SEQ ID NO: 121195 - DNA, 25 bp, Mus musculus
acgctagagaagctgaatccaggtc

SEQ ID NO: 121196 - DNA, 25 bp, Mus musculus
acgctagagaaggtgaatccaggtc

SEQ ID NO: 121197 - DNA, 25 bp, Mus musculus
acgctagcacaaaacaaagctctga

SEQ ID NO: 121198 - DNA, 25 bp, Mus musculus
acgctagcacaatacaaagctctga

SEQ ID NO: 121199 - DNA, 25 bp, Mus musculus
acgctagcacagaatgccgccaaca

SEQ ID NO: 121200 - DNA, 25 bp, Mus musculus
acgctagcacagtatgccgccaaca

SEQ ID NO: 121201 - DNA, 25 bp, Mus musculus
acgctagctctcataagagatggca

SEQ ID NO: 121202 - DNA, 25 bp, Mus musculus
acgctagctctcttaagagatggca

SEQ ID NO: 121203 - DNA, 25 bp, Mus musculus
acgctaggatcgagtgtgtctgcgt

SEQ ID NO: 121204 - DNA, 25 bp, Mus musculus
acgctaggatcgtgtgtgtctgcgt

SEQ ID NO: 121205 - DNA, 25 bp, Mus musculus
acgctagtcttgcaattctgtttca

SEQ ID NO: 121206 - DNA, 25 bp, Mus musculus
acgctagtcttggaattctgtttca

SEQ ID NO: 121207 - DNA, 25 bp, Mus musculus
acgctagtgcagagacagcctgtgt

SEQ ID NO: 121208 - DNA, 25 bp, Mus musculus
acgctagtgcagtgacagcctgtgt

SEQ ID NO: 121209 - DNA, 25 bp, Mus musculus
acgctatacacgactccgggactgg

SEQ ID NO: 121210 - DNA, 25 bp, Mus musculus
acgctatacacgtctccgggactgg

SEQ ID NO: 121211 - DNA, 25 bp, Mus musculus
acgctatatctgatgcaagtgacca

SEQ ID NO: 121212 - DNA, 25 bp, Mus musculus
acgctatatctgttgcaagtgacca

SEQ ID NO: 121213 - DNA, 25 bp, Mus musculus
acgctatattggcttcacagttaca

SEQ ID NO: 121214 - DNA, 25 bp, Mus musculus
acgctatattgggttcacagttaca

SEQ ID NO: 121215 - DNA, 25 bp, Mus musculus
acgctatccgaaaggtgctgcagct

SEQ ID NO: 121216 - DNA, 25 bp, Mus musculus
acgctatccgaatggtgctgcagct

SEQ ID NO: 121217 - DNA, 25 bp, Mus musculus
acgctatgctgtaatgagtccttca

SEQ ID NO: 121218 - DNA, 25 bp, Mus musculus
acgctatgctgttatgagtccttca

SEQ ID NO: 121219 - DNA, 25 bp, Mus musculus
acgctatggagtacctcggagtgat

SEQ ID NO: 121220 - DNA, 25 bp, Mus musculus
acgctatggagttcctcggagtgat

SEQ ID NO: 121221 - DNA, 25 bp, Mus musculus
acgctatgtagcagagttcgggctt

SEQ ID NO: 121222 - DNA, 25 bp, Mus musculus
acgctatgtagctgagttcgggctt

SEQ ID NO: 121223 - DNA, 25 bp, Mus musculus
acgctcaaaaccatcacacttaata

SEQ ID NO: 121224 - DNA, 25 bp, Mus musculus
acgctcaaaaccttcacacttaata

SEQ ID NO: 121225 - DNA, 25 bp, Mus musculus
acgctcaatgccctgactttcaagc

SEQ ID NO: 121226 - DNA, 25 bp, Mus musculus
acgctcaatgccgtgactttcaagc

SEQ ID NO: 121227 - DNA, 25 bp, Mus musculus
acgctcagatcgacaggcttgacag

SEQ ID NO: 121228 - DNA, 25 bp, Mus musculus
acgctcagatcgtcaggcttgacag

SEQ ID NO: 121229 - DNA, 25 bp, Mus musculus
acgctcagcttgagcagagccatgg

SEQ ID NO: 121230 - DNA, 25 bp, Mus musculus
acgctcagcttgtgcagagccatgg

SEQ ID NO: 121231 - DNA, 25 bp, Mus musculus
acgctcaggtagcatcgctgtttga

SEQ ID NO: 121232 - DNA, 25 bp, Mus musculus
acgctcaggtaggatcgctgtttga

SEQ ID NO: 121233 - DNA, 25 bp, Mus musculus
acgctcagtctaagtctcttatatc

SEQ ID NO: 121234 - DNA, 25 bp, Mus musculus
acgctcagtctatgtctcttatatc

SEQ ID NO: 121235 - DNA, 25 bp, Mus musculus
acgctcagttttaggagacgattga

SEQ ID NO: 121236 - DNA, 25 bp, Mus musculus
acgctcagtttttggagacgattga

SEQ ID NO: 121237 - DNA, 25 bp, Mus musculus
acgctcatcaccaatagaaatccag

SEQ ID NO: 121238 - DNA, 25 bp, Mus musculus
acgctcatcacctatagaaatccag

SEQ ID NO: 121239 - DNA, 25 bp, Mus musculus
acgctcattactaactgcatgtgat

SEQ ID NO: 121240 - DNA, 25 bp, Mus musculus
acgctcattacttactgcatgtgat

SEQ ID NO: 121241 - DNA, 25 bp, Mus musculus
acgctccactggctgtacaatggac

SEQ ID NO: 121242 - DNA, 25 bp, Mus musculus
acgctccactgggtgtacaatggac

SEQ ID NO: 121243 - DNA, 25 bp, Mus musculus
acgctcccgggcaaacagggcagag

SEQ ID NO: 121244 - DNA, 25 bp, Mus musculus
acgctcccgggctaacagggcagag

SEQ ID NO: 121245 - DNA, 25 bp, Mus musculus
acgctcctcctgatactttgtgtaa

SEQ ID NO: 121246 - DNA, 25 bp, Mus musculus
acgctcctcctgttactttgtgtaa

SEQ ID NO: 121247 - DNA, 25 bp, Mus musculus
acgctcctctcacaaaggcactgga

SEQ ID NO: 121248 - DNA, 25 bp, Mus musculus
acgctcctctcagaaaggcactgga

SEQ ID NO: 121249 - DNA, 25 bp, Mus musculus
acgctcctggtcaggtgcgaaggta

SEQ ID NO: 121250 - DNA, 25 bp, Mus musculus
acgctcctggtctggtgcgaaggta

SEQ ID NO: 121251 - DNA, 25 bp, Mus musculus
acgctcgagtgacagtcgtctgtga

SEQ ID NO: 121252 - DNA, 25 bp, Mus musculus
acgctcgagtgagagtcgtctgtga

SEQ ID NO: 121253 - DNA, 25 bp, Mus musculus
acgctcgcctttctggtggacgtgc

SEQ ID NO: 121254 - DNA, 25 bp, Mus musculus
acgctcgcctttgtggtggacgtgc

SEQ ID NO: 121255 - DNA, 25 bp, Mus musculus
acgctcgctacactaatcctggtga

SEQ ID NO: 121256 - DNA, 25 bp, Mus musculus
acgctcgctacagtaatcctggtga

SEQ ID NO: 121257 - DNA, 25 bp, Mus musculus
acgctcgctcgtatgatactttgac

SEQ ID NO: 121258 - DNA, 25 bp, Mus musculus
acgctcgctcgtttgatactttgac

SEQ ID NO: 121259 - DNA, 25 bp, Mus musculus
acgctcgtcgaaatgctgctgtatt

SEQ ID NO: 121260 - DNA, 25 bp, Mus musculus
acgctcgtcgaattgctgctgtatt

SEQ ID NO: 121261 - DNA, 25 bp, Mus musculus
acgctctactaacccacttaatagt

SEQ ID NO: 121262 - DNA, 25 bp, Mus musculus
acgctctactaagccacttaatagt

SEQ ID NO: 121263 - DNA, 25 bp, Mus musculus
acgctctctctgagtatttaagtgt

SEQ ID NO: 121264 - DNA, 25 bp, Mus musculus
acgctctctctgtgtatttaagtgt

SEQ ID NO: 121265 - DNA, 25 bp, Mus musculus
acgctctctgtaacctctgttagat

SEQ ID NO: 121266 - DNA, 25 bp, Mus musculus
acgctctctgtatcctctgttagat

SEQ ID NO: 121267 - DNA, 25 bp, Mus musculus
acgctctgcattctgtcattcttta

SEQ ID NO: 121268 - DNA, 25 bp, Mus musculus
acgctctgcattgtgtcattcttta

SEQ ID NO: 121269 - DNA, 25 bp, Mus musculus
acgctctgtacgcttactgatggac

SEQ ID NO: 121270 - DNA, 25 bp, Mus musculus
acgctctgtacggttactgatggac

SEQ ID NO: 121271 - DNA, 25 bp, Mus musculus
acgctctgtgcaagcatttgttaaa

SEQ ID NO: 121272 - DNA, 25 bp, Mus musculus
acgctctgtgcatgcatttgttaaa

SEQ ID NO: 121273 - DNA, 25 bp, Mus musculus
acgctctgtgccatcgacttgcagt

SEQ ID NO: 121274 - DNA, 25 bp, Mus musculus
acgctctgtgccttcgacttgcagt

SEQ ID NO: 121275 - DNA, 25 bp, Mus musculus
acgctcttagcactgaggcctgtga

SEQ ID NO: 121276 - DNA, 25 bp, Mus musculus
acgctcttagcagtgaggcctgtga

SEQ ID NO: 121277 - DNA, 25 bp, Mus musculus
acgctcttgagcactgggtgagact

SEQ ID NO: 121278 - DNA, 25 bp, Mus musculus
acgctcttgagctctgggtgagact

SEQ ID NO: 121279 - DNA, 25 bp, Mus musculus
acgctctttgtactgctggtgatca

SEQ ID NO: 121280 - DNA, 25 bp, Mus musculus
acgctctttgtagtgctggtgatca

SEQ ID NO: 121281 - DNA, 25 bp, Mus musculus
acgctgaactttctgcatcgggacc

SEQ ID NO: 121282 - DNA, 25 bp, Mus musculus
acgctgaactttgtgcatcgggacc

SEQ ID NO: 121283 - DNA, 25 bp, Mus musculus
acgctgaagaggacctgggcccaag

SEQ ID NO: 121284 - DNA, 25 bp, Mus musculus
acgctgaagaggtcctgggcccaag

SEQ ID NO: 121285 - DNA, 25 bp, Mus musculus
acgctgaagcctagaaaagctggcc

SEQ ID NO: 121286 - DNA, 25 bp, Mus musculus
acgctgaagccttgaaaagctggcc

SEQ ID NO: 121287 - DNA, 25 bp, Mus musculus
acgctgaatataagaccacgctcac

SEQ ID NO: 121288 - DNA, 25 bp, Mus musculus
acgctgaatatatgaccacgctcac

SEQ ID NO: 121289 - DNA, 25 bp, Mus musculus
acgctgactgctaccgggccactga

SEQ ID NO: 121290 - DNA, 25 bp, Mus musculus
acgctgactgcttccgggccactga

SEQ ID NO: 121291 - DNA, 25 bp, Mus musculus
acgctgagaatgatgtcgtctgcca

SEQ ID NO: 121292 - DNA, 25 bp, Mus musculus
acgctgagaatgttgtcgtctgcca

SEQ ID NO: 121293 - DNA, 25 bp, Mus musculus
acgctgagagtacgcgacgcaccag

SEQ ID NO: 121294 - DNA, 25 bp, Mus musculus
acgctgagagtaggcgacgcaccag

SEQ ID NO: 121295 - DNA, 25 bp, Mus musculus
acgctgagtccgaggccgagtctcc

SEQ ID NO: 121296 - DNA, 25 bp, Mus musculus
acgctgagtccgtggccgagtctcc

SEQ ID NO: 121297 - DNA, 25 bp, Mus musculus
acgctgatgagaccccaggatctgg

SEQ ID NO: 121298 - DNA, 25 bp, Mus musculus
acgctgatgagagcccaggatctgg

SEQ ID NO: 121299 - DNA, 25 bp, Mus musculus
acgctgatgcttaaattatcttaaa

SEQ ID NO: 121300 - DNA, 25 bp, Mus musculus
acgctgatgctttaattatcttaaa

SEQ ID NO: 121301 - DNA, 25 bp, Mus musculus
acgctgatggagatctgagccctgg

SEQ ID NO: 121302 - DNA, 25 bp, Mus musculus
acgctgatggagttctgagccctgg

SEQ ID NO: 121303 - DNA, 25 bp, Mus musculus
acgctgcagatgaacctattggaac

SEQ ID NO: 121304 - DNA, 25 bp, Mus musculus
acgctgcagatgtacctattggaac

SEQ ID NO: 121305 - DNA, 25 bp, Mus musculus
acgctgcagcctacatagtcgagga

SEQ ID NO: 121306 - DNA, 25 bp, Mus musculus
acgctgcagccttcatagtcgagga

SEQ ID NO: 121307 - DNA, 25 bp, Mus musculus
acgctgcatgtcaactgtagtcact

SEQ ID NO: 121308 - DNA, 25 bp, Mus musculus
acgctgcatgtctactgtagtcact

SEQ ID NO: 121309 - DNA, 25 bp, Mus musculus
acgctgccaggcagactctgagtgc

SEQ ID NO: 121310 - DNA, 25 bp, Mus musculus
acgctgccaggcctgagctacttga

SEQ ID NO: 121311 - DNA, 25 bp, Mus musculus
acgctgccaggcgtgagctacttga

SEQ ID NO: 121312 - DNA, 25 bp, Mus musculus
acgctgccaggctgactctgagtgc

SEQ ID NO: 121313 - DNA, 25 bp, Mus musculus
acgctgccctgcatctgtaaggtgt

SEQ ID NO: 121314 - DNA, 25 bp, Mus musculus
acgctgccctgcttctgtaaggtgt

SEQ ID NO: 121315 - DNA, 25 bp, Mus musculus
acgctgcctcacctgataatgatga

SEQ ID NO: 121316 - DNA, 25 bp, Mus musculus
acgctgcctcacgtgataatgatga

SEQ ID NO: 121317 - DNA, 25 bp, Mus musculus
acgctgcctgtgaccttgtggagaa

SEQ ID NO: 121318 - DNA, 25 bp, Mus musculus
acgctgcctgtgtccttgtggagaa

SEQ ID NO: 121319 - DNA, 25 bp, Mus musculus
acgctgcgtaaaagctaaggtgctt

SEQ ID NO: 121320 - DNA, 25 bp, Mus musculus
acgctgcgtaaatgctaaggtgctt

SEQ ID NO: 121321 - DNA, 25 bp, Mus musculus
acgctgctaccccagctgaaagata

SEQ ID NO: 121322 - DNA, 25 bp, Mus musculus
acgctgctacccgagctgaaagata

SEQ ID NO: 121323 - DNA, 25 bp, Mus musculus
acgctgctccatcggaattggtagt

SEQ ID NO: 121324 - DNA, 25 bp, Mus musculus
acgctgctccatgggaattggtagt

SEQ ID NO: 121325 - DNA, 25 bp, Mus musculus
acgctgctcgaacaatcaaaagcaa

SEQ ID NO: 121326 - DNA, 25 bp, Mus musculus
acgctgctcgaagaatcaaaagcaa

SEQ ID NO: 121327 - DNA, 25 bp, Mus musculus
acgctgctgaacatgtgtcacttta

SEQ ID NO: 121328 - DNA, 25 bp, Mus musculus
acgctgctgaacttgtgtcacttta

SEQ ID NO: 121329 - DNA, 25 bp, Mus musculus
acgctgctgaagcagagcaccgtgt

SEQ ID NO: 121330 - DNA, 25 bp, Mus musculus
acgctgctgaaggagagcaccgtgt

SEQ ID NO: 121331 - DNA, 25 bp, Mus musculus
acgctgcttgtcagactcgtggagt

SEQ ID NO: 121332 - DNA, 25 bp, Mus musculus
acgctgcttgtctgactcgtggagt

SEQ ID NO: 121333 - DNA, 25 bp, Mus musculus
acgctggacgatcccacggatgact

SEQ ID NO: 121334 - DNA, 25 bp, Mus musculus
acgctggacgatgccacggatgact

SEQ ID NO: 121335 - DNA, 25 bp, Mus musculus
acgctggcacagaaacttgcctgaa

SEQ ID NO: 121336 - DNA, 25 bp, Mus musculus
acgctggcacagtaacttgcctgaa

SEQ ID NO: 121337 - DNA, 25 bp, Mus musculus
acgctggcatgcatgaggtttctac

SEQ ID NO: 121338 - DNA, 25 bp, Mus musculus
acgctggcatgcttgaggtttctac

SEQ ID NO: 121339 - DNA, 25 bp, Mus musculus
acgctggctgagcttgagaggctga

SEQ ID NO: 121340 - DNA, 25 bp, Mus musculus
acgctggctgaggttgagaggctga

SEQ ID NO: 121341 - DNA, 25 bp, Mus musculus
acgctggcttctctttgaggctgaa

SEQ ID NO: 121342 - DNA, 25 bp, Mus musculus
acgctggcttctgtttgaggctgaa

SEQ ID NO: 121343 - DNA, 25 bp, Mus musculus
acgctgggcaggctctatcattgag

SEQ ID NO: 121344 - DNA, 25 bp, Mus musculus
acgctgggcagggtctatcattgag

SEQ ID NO: 121345 - DNA, 25 bp, Mus musculus
acgctgggcgagataagccattcca

SEQ ID NO: 121346 - DNA, 25 bp, Mus musculus
acgctgggcgagcagctcatgtaca

SEQ ID NO: 121347 - DNA, 25 bp, Mus musculus
acgctgggcgaggagctcatgtaca

SEQ ID NO: 121348 - DNA, 25 bp, Mus musculus
acgctgggcgagttaagccattcca

SEQ ID NO: 121349 - DNA, 25 bp, Mus musculus
acgctggtaactaacgtgcctgtta

SEQ ID NO: 121350 - DNA, 25 bp, Mus musculus
acgctggtaacttacgtgcctgtta

SEQ ID NO: 121351 - DNA, 25 bp, Mus musculus
acgctggtcattcatgtggttcact

SEQ ID NO: 121352 - DNA, 25 bp, Mus musculus
acgctggtcattgatgtggttcact

SEQ ID NO: 121353 - DNA, 25 bp, Mus musculus
acgctggtgttcattgtcctgacgg

SEQ ID NO: 121354 - DNA, 25 bp, Mus musculus
acgctggtgttctttgtcctgacgg

SEQ ID NO: 121355 - DNA, 25 bp, Mus musculus
acgctggttcccaagaggctgcaga

SEQ ID NO: 121356 - DNA, 25 bp, Mus musculus
acgctggttccctagaggctgcaga

SEQ ID NO: 121357 - DNA, 25 bp, Mus musculus
acgctgtaatacacaactcatggat

SEQ ID NO: 121358 - DNA, 25 bp, Mus musculus
acgctgtaatactcaactcatggat

SEQ ID NO: 121359 - DNA, 25 bp, Mus musculus
acgctgtaatgcagactggtcacgg

SEQ ID NO: 121360 - DNA, 25 bp, Mus musculus
acgctgtaatgctgactggtcacgg

SEQ ID NO: 121361 - DNA, 25 bp, Mus musculus
acgctgtactccctgatgcaggcgg

SEQ ID NO: 121362 - DNA, 25 bp, Mus musculus
acgctgtactccgtgatgcaggcgg

SEQ ID NO: 121363 - DNA, 25 bp, Mus musculus
acgctgtatatcattccatgctccg

SEQ ID NO: 121364 - DNA, 25 bp, Mus musculus
acgctgtatatctttccatgctccg

SEQ ID NO: 121365 - DNA, 25 bp, Mus musculus
acgctgtcattgaaccattgctcaa

SEQ ID NO: 121366 - DNA, 25 bp, Mus musculus
acgctgtcattgtaccattgctcaa

SEQ ID NO: 121367 - DNA, 25 bp, Mus musculus
acgctgtcctggacctgtgtctcct

SEQ ID NO: 121368 - DNA, 25 bp, Mus musculus
acgctgtcctggtcctgtgtctcct

SEQ ID NO: 121369 - DNA, 25 bp, Mus musculus
acgctgtgctcactccagttttctg

SEQ ID NO: 121370 - DNA, 25 bp, Mus musculus
acgctgtgctcagtccagttttctg

SEQ ID NO: 121371 - DNA, 25 bp, Mus musculus
acgctgtggacacccgacagtgctg

SEQ ID NO: 121372 - DNA, 25 bp, Mus musculus
acgctgtggacagccgacagtgctg

SEQ ID NO: 121373 - DNA, 25 bp, Mus musculus
acgctgtggcctcatggttctcaca

SEQ ID NO: 121374 - DNA, 25 bp, Mus musculus
acgctgtggcctgatggttctcaca

SEQ ID NO: 121375 - DNA, 25 bp, Mus musculus
acgctgtggttcagcagcctttaga

SEQ ID NO: 121376 - DNA, 25 bp, Mus musculus
acgctgtggttctgcagcctttaga

SEQ ID NO: 121377 - DNA, 25 bp, Mus musculus
acgctgtgtagtacggagaatacaa

SEQ ID NO: 121378 - DNA, 25 bp, Mus musculus
acgctgtgtagttcggagaatacaa

SEQ ID NO: 121379 - DNA, 25 bp, Mus musculus
acgctgtgtgaacaaccgggcccca

SEQ ID NO: 121380 - DNA, 25 bp, Mus musculus
acgctgtgtgaagaaccgggcccca

SEQ ID NO: 121381 - DNA, 25 bp, Mus musculus
acgctgttcaccagcaatgcaaaca

SEQ ID NO: 121382 - DNA, 25 bp, Mus musculus
acgctgttcacctgcaatgcaaaca

SEQ ID NO: 121383 - DNA, 25 bp, Mus musculus
acgctgttctttacctctgaagtat

SEQ ID NO: 121384 - DNA, 25 bp, Mus musculus
acgctgttcttttcctctgaagtat

SEQ ID NO: 121385 - DNA, 25 bp, Mus musculus
acgctgttgatgagcctcgcagaaa

SEQ ID NO: 121386 - DNA, 25 bp, Mus musculus
acgctgttgatgtgcctcgcagaaa

SEQ ID NO: 121387 - DNA, 25 bp, Mus musculus
acgctgttgctgaagtcactctgta

SEQ ID NO: 121388 - DNA, 25 bp, Mus musculus
acgctgttgctgtagtcactctgta

SEQ ID NO: 121389 - DNA, 25 bp, Mus musculus
acgctgttgttactcatgcaccatt

SEQ ID NO: 121390 - DNA, 25 bp, Mus musculus
acgctgttgttagtcatgcaccatt

SEQ ID NO: 121391 - DNA, 25 bp, Mus musculus
acgcttaatagtcgtgacttctggc

SEQ ID NO: 121392 - DNA, 25 bp, Mus musculus
acgcttaatagtggtgacttctggc

SEQ ID NO: 121393 - DNA, 25 bp, Mus musculus
acgcttactccccaaagttgtatgt

SEQ ID NO: 121394 - DNA, 25 bp, Mus musculus
acgcttactcccgaaagttgtatgt

SEQ ID NO: 121395 - DNA, 25 bp, Mus musculus
acgcttatgctcacaggtgtggcct

SEQ ID NO: 121396 - DNA, 25 bp, Mus musculus
acgcttatgctctcaggtgtggcct

SEQ ID NO: 121397 - DNA, 25 bp, Mus musculus
acgcttcaacctcatacactgcaga

SEQ ID NO: 121398 - DNA, 25 bp, Mus musculus
acgcttcaacctgatacactgcaga

SEQ ID NO: 121399 - DNA, 25 bp, Mus musculus
acgcttcaggctacgggtgacggtt

SEQ ID NO: 121400 - DNA, 25 bp, Mus musculus
acgcttcaggcttcgggtgacggtt

SEQ ID NO: 121401 - DNA, 25 bp, Mus musculus
acgcttcatactctggtcctgtttg

SEQ ID NO: 121402 - DNA, 25 bp, Mus musculus
acgcttcatactgtggtcctgtttg

SEQ ID NO: 121403 - DNA, 25 bp, Mus musculus
acgcttcccttgcacattttgtgtc

SEQ ID NO: 121404 - DNA, 25 bp, Mus musculus
acgcttcccttggacattttgtgtc

SEQ ID NO: 121405 - DNA, 25 bp, Mus musculus
acgcttcgagaaatgagagttgcta

SEQ ID NO: 121406 - DNA, 25 bp, Mus musculus
acgcttcgagaattgagagttgcta

SEQ ID NO: 121407 - DNA, 25 bp, Mus musculus
acgcttctaattcatgtacctgcac

SEQ ID NO: 121408 - DNA, 25 bp, Mus musculus
acgcttctaattgatgtacctgcac

SEQ ID NO: 121409 - DNA, 25 bp, Mus musculus
acgcttctggaaatttgactgcaca

SEQ ID NO: 121410 - DNA, 25 bp, Mus musculus
acgcttctggaattttgactgcaca

SEQ ID NO: 121411 - DNA, 25 bp, Mus musculus
acgcttcttaatatcctggtgtgct

SEQ ID NO: 121412 - DNA, 25 bp, Mus musculus
acgcttcttaatttcctggtgtgct

SEQ ID NO: 121413 - DNA, 25 bp, Mus musculus
acgcttctttggatttacttcccag

SEQ ID NO: 121414 - DNA, 25 bp, Mus musculus
acgcttctttggttttacttcccag

SEQ ID NO: 121415 - DNA, 25 bp, Mus musculus
acgcttgactgcaggcggaagatcg

SEQ ID NO: 121416 - DNA, 25 bp, Mus musculus
acgcttgactgctggcggaagatcg

SEQ ID NO: 121417 - DNA, 25 bp, Mus musculus
acgcttgcaaatcctgagactccat

SEQ ID NO: 121418 - DNA, 25 bp, Mus musculus
acgcttgcaaatgctgagactccat

SEQ ID NO: 121419 - DNA, 25 bp, Mus musculus
acgcttgctcttacatttatcatca

SEQ ID NO: 121420 - DNA, 25 bp, Mus musculus
acgcttgctctttcatttatcatca

SEQ ID NO: 121421 - DNA, 25 bp, Mus musculus
acgcttgctggcagatttttggtca

SEQ ID NO: 121422 - DNA, 25 bp, Mus musculus
acgcttgctggctgatttttggtca

SEQ ID NO: 121423 - DNA, 25 bp, Mus musculus
acgcttggagatcacaggagtctgc

SEQ ID NO: 121424 - DNA, 25 bp, Mus musculus
acgcttggagatgacaggagtctgc

SEQ ID NO: 121425 - DNA, 25 bp, Mus musculus
acgcttggctatatcacaagtttga

SEQ ID NO: 121426 - DNA, 25 bp, Mus musculus
acgcttggctatttcacaagtttga

SEQ ID NO: 121427 - DNA, 25 bp, Mus musculus
acgcttgtctcaagccagcgaccaa

SEQ ID NO: 121428 - DNA, 25 bp, Mus musculus
acgcttgtctcatgccagcgaccaa

SEQ ID NO: 121429 - DNA, 25 bp, Mus musculus
acgcttgtctgtcttttgatgtaga

SEQ ID NO: 121430 - DNA, 25 bp, Mus musculus
acgcttgtctgtgttttgatgtaga

SEQ ID NO: 121431 - DNA, 25 bp, Mus musculus
acgcttgtgggcagacatggccaga

SEQ ID NO: 121432 - DNA, 25 bp, Mus musculus
acgcttgtgggctgacatggccaga

SEQ ID NO: 121433 - DNA, 25 bp, Mus musculus
acgcttgtttccacgttctagaaat

SEQ ID NO: 121434 - DNA, 25 bp, Mus musculus
acgcttgtttcctcgttctagaaat

SEQ ID NO: 121435 - DNA, 25 bp, Mus musculus
acgctttagcccagtacttggtcga

SEQ ID NO: 121436 - DNA, 25 bp, Mus musculus
acgctttagccctgtacttggtcga

SEQ ID NO: 121437 - DNA, 25 bp, Mus musculus
acgctttcattgcacgctttccctt

SEQ ID NO: 121438 - DNA, 25 bp, Mus musculus
acgctttcattggacgctttccctt

SEQ ID NO: 121439 - DNA, 25 bp, Mus musculus
acgctttccccacaacagcaggaaa

SEQ ID NO: 121440 - DNA, 25 bp, Mus musculus
acgctttccccagaacagcaggaaa

SEQ ID NO: 121441 - DNA, 25 bp, Mus musculus
acgctttcggagagtcgctgcaaaa

SEQ ID NO: 121442 - DNA, 25 bp, Mus musculus
acgctttcggagtgtcgctgcaaaa

SEQ ID NO: 121443 - DNA, 25 bp, Mus musculus
acgctttctacactggcacgtaaac

SEQ ID NO: 121444 - DNA, 25 bp, Mus musculus
acgctttctacagtggcacgtaaac

SEQ ID NO: 121445 - DNA, 25 bp, Mus musculus
acgctttcttcaaaggtgcttggtc

SEQ ID NO: 121446 - DNA, 25 bp, Mus musculus
acgctttcttcataggtgcttggtc

SEQ ID NO: 121447 - DNA, 25 bp, Mus musculus
acgcttttccccaaagacattcagt

SEQ ID NO: 121448 - DNA, 25 bp, Mus musculus
acgcttttcccctaagacattcagt

SEQ ID NO: 121449 - DNA, 25 bp, Mus musculus
acggaaaacctactttgctcacgat

SEQ ID NO: 121450 - DNA, 25 bp, Mus musculus
acggaaaacctagtttgctcacgat

SEQ ID NO: 121451 - DNA, 25 bp, Mus musculus
acggaaacatcaacgttgagattat

SEQ ID NO: 121452 - DNA, 25 bp, Mus musculus
acggaaacatcatcgttgagattat

SEQ ID NO: 121453 - DNA, 25 bp, Mus musculus
acggaaattttgctgttgtcaagga

SEQ ID NO: 121454 - DNA, 25 bp, Mus musculus
acggaaattttggtgttgtcaagga

SEQ ID NO: 121455 - DNA, 25 bp, Mus musculus
acggaacagacgattggacgctgat

SEQ ID NO: 121456 - DNA, 25 bp, Mus musculus
acggaacagacgtttggacgctgat

SEQ ID NO: 121457 - DNA, 25 bp, Mus musculus
acggaaccaggtctactcattgctt

SEQ ID NO: 121458 - DNA, 25 bp, Mus musculus
acggaaccaggtgtactcattgctt

SEQ ID NO: 121459 - DNA, 25 bp, Mus musculus
acggaaccatgcctttgcgaaacat

SEQ ID NO: 121460 - DNA, 25 bp, Mus musculus
acggaaccatgcgtttgcgaaacat

SEQ ID NO: 121461 - DNA, 25 bp, Mus musculus
acggaaccccatatggttacagcac

SEQ ID NO: 121462 - DNA, 25 bp, Mus musculus
acggaaccccatttggttacagcac

SEQ ID NO: 121463 - DNA, 25 bp, Mus musculus
acggaactactcactgggacattgt

SEQ ID NO: 121464 - DNA, 25 bp, Mus musculus
acggaactactctctgggacattgt

SEQ ID NO: 121465 - DNA, 25 bp, Mus musculus
acggaactagttcttcagatgaagg

SEQ ID NO: 121466 - DNA, 25 bp, Mus musculus
acggaactagttgttcagatgaagg

SEQ ID NO: 121467 - DNA, 25 bp, Mus musculus
acggaactcgatcagaccctgtgcg

SEQ ID NO: 121468 - DNA, 25 bp, Mus musculus
acggaactcgatgagaccctgtgcg

SEQ ID NO: 121469 - DNA, 25 bp, Mus musculus
acggaactgggtcaggcaagcctct

SEQ ID NO: 121470 - DNA, 25 bp, Mus musculus
acggaactgggtgaggcaagcctct

SEQ ID NO: 121471 - DNA, 25 bp, Mus musculus
acggaagaccttacagtgctgagac

SEQ ID NO: 121472 - DNA, 25 bp, Mus musculus
acggaagacctttcagtgctgagac

SEQ ID NO: 121473 - DNA, 25 bp, Mus musculus
acggaagcggccactacaggttgtc

SEQ ID NO: 121474 - DNA, 25 bp, Mus musculus
acggaagcggcctctacaggttgtc

SEQ ID NO: 121475 - DNA, 25 bp, Mus musculus
acggaagctcacacagtctaaggta

SEQ ID NO: 121476 - DNA, 25 bp, Mus musculus
acggaagctcactcagtctaaggta

SEQ ID NO: 121477 - DNA, 25 bp, Mus musculus
acggaaggctccaacatagaaatga

SEQ ID NO: 121478 - DNA, 25 bp, Mus musculus
acggaaggctcctacatagaaatga

SEQ ID NO: 121479 - DNA, 25 bp, Mus musculus
acggaagggcccagcctattatgaa

SEQ ID NO: 121480 - DNA, 25 bp, Mus musculus
acggaagggccctgcctattatgaa

SEQ ID NO: 121481 - DNA, 25 bp, Mus musculus
acggaagggtctcgagtacacatct

SEQ ID NO: 121482 - DNA, 25 bp, Mus musculus
acggaagggtctggagtacacatct

SEQ ID NO: 121483 - DNA, 25 bp, Mus musculus
acggaagtgctgatctttggccaag

SEQ ID NO: 121484 - DNA, 25 bp, Mus musculus
acggaagtgctgttctttggccaag

SEQ ID NO: 121485 - DNA, 25 bp, Mus musculus
acggaagttatgctgctgcttgcaa

SEQ ID NO: 121486 - DNA, 25 bp, Mus musculus
acggaagttatggtgctgcttgcaa

SEQ ID NO: 121487 - DNA, 25 bp, Mus musculus
acggaatctgccctgtgacatgaaa

SEQ ID NO: 121488 - DNA, 25 bp, Mus musculus
acggaatctgccgtgtgacatgaaa

SEQ ID NO: 121489 - DNA, 25 bp, Mus musculus
acggaatgccatactctaaaaaagg

SEQ ID NO: 121490 - DNA, 25 bp, Mus musculus
acggaatgccattctctaaaaaagg

SEQ ID NO: 121491 - DNA, 25 bp, Mus musculus
acggaatgttcaccagcgagctcag

SEQ ID NO: 121492 - DNA, 25 bp, Mus musculus
acggaatgttcagcagcgagctcag

SEQ ID NO: 121493 - DNA, 25 bp, Mus musculus
acggaattcagaaacctctctgcct

SEQ ID NO: 121494 - DNA, 25 bp, Mus musculus
acggaattcagatacctctctgcct

SEQ ID NO: 121495 - DNA, 25 bp, Mus musculus
acggacacatctacaagggacggat

SEQ ID NO: 121496 - DNA, 25 bp, Mus musculus
acggacacatcttcaagggacggat

SEQ ID NO: 121497 - DNA, 25 bp, Mus musculus
acggacaccaggaagctcagcccgg

SEQ ID NO: 121498 - DNA, 25 bp, Mus musculus
acggacaccaggtagctcagcccgg

SEQ ID NO: 121499 - DNA, 25 bp, Mus musculus
acggacactgacatgggagggactt

SEQ ID NO: 121500 - DNA, 25 bp, Mus musculus
acggacactgacttgggagggactt

SEQ ID NO: 121501 - DNA, 25 bp, Mus musculus
acggacagctttcgccgacaacata

SEQ ID NO: 121502 - DNA, 25 bp, Mus musculus
acggacagctttggccgacaacata

SEQ ID NO: 121503 - DNA, 25 bp, Mus musculus
acggacatactgattatcccatctc

SEQ ID NO: 121504 - DNA, 25 bp, Mus musculus
acggacatactgtttatcccatctc

SEQ ID NO: 121505 - DNA, 25 bp, Mus musculus
acggacatcgtgagggtgctcttga

SEQ ID NO: 121506 - DNA, 25 bp, Mus musculus
acggacatcgtgtgggtgctcttga

SEQ ID NO: 121507 - DNA, 25 bp, Mus musculus
acggacatctccatcactaatttga

SEQ ID NO: 121508 - DNA, 25 bp, Mus musculus
acggacatctccttcactaatttga

SEQ ID NO: 121509 - DNA, 25 bp, Mus musculus
acggacatgatgctcgccaacagcc

SEQ ID NO: 121510 - DNA, 25 bp, Mus musculus
acggacatgatggtcgccaacagcc

SEQ ID NO: 121511 - DNA, 25 bp, Mus musculus
acggacatgcacagagagaaccaca

SEQ ID NO: 121512 - DNA, 25 bp, Mus musculus
acggacatgcactgagagaaccaca

SEQ ID NO: 121513 - DNA, 25 bp, Mus musculus
acggacatgtgtacagtcaccgctt

SEQ ID NO: 121514 - DNA, 25 bp, Mus musculus
acggacatgtgttcagtcaccgctt

SEQ ID NO: 121515 - DNA, 25 bp, Mus musculus
acggaccacagacacgcaggtgctt

SEQ ID NO: 121516 - DNA, 25 bp, Mus musculus
acggaccacagagacgcaggtgctt

SEQ ID NO: 121517 - DNA, 25 bp, Mus musculus
acggaccatcagaagatttcttcaa

SEQ ID NO: 121518 - DNA, 25 bp, Mus musculus
acggaccatcagtagatttcttcaa

SEQ ID NO: 121519 - DNA, 25 bp, Mus musculus
acggaccatctgcactgttgcttaa

SEQ ID NO: 121520 - DNA, 25 bp, Mus musculus
acggaccatctggactgttgcttaa

SEQ ID NO: 121521 - DNA, 25 bp, Mus musculus
acggaccatgaccagacactaaatc

SEQ ID NO: 121522 - DNA, 25 bp, Mus musculus
acggaccatgacgagacactaaatc

SEQ ID NO: 121523 - DNA, 25 bp, Mus musculus
acggacctctccaagggatcgatga

SEQ ID NO: 121524 - DNA, 25 bp, Mus musculus
acggacctctcctagggatcgatga

SEQ ID NO: 121525 - DNA, 25 bp, Mus musculus
acggacctggcaatcataaccattt

SEQ ID NO: 121526 - DNA, 25 bp, Mus musculus
acggacctggcattcataaccattt

SEQ ID NO: 121527 - DNA, 25 bp, Mus musculus
acggacctgggaagaccatgaggaa

SEQ ID NO: 121528 - DNA, 25 bp, Mus musculus
acggacctgggatgaccatgaggaa

SEQ ID NO: 121529 - DNA, 25 bp, Mus musculus
acggacggatgcagctcagtgctga

SEQ ID NO: 121530 - DNA, 25 bp, Mus musculus
acggacggatgctgctcagtgctga

SEQ ID NO: 121531 - DNA, 25 bp, Mus musculus
acggacgtatataagccgcagtgct

SEQ ID NO: 121532 - DNA, 25 bp, Mus musculus
acggacgtatattagccgcagtgct

SEQ ID NO: 121533 - DNA, 25 bp, Mus musculus
acggactcacccagggacataatct

SEQ ID NO: 121534 - DNA, 25 bp, Mus musculus
acggactcaccctgggacataatct

SEQ ID NO: 121535 - DNA, 25 bp, Mus musculus
acggactcgagaatgggctttcaat

SEQ ID NO: 121536 - DNA, 25 bp, Mus musculus
acggactcgagattgggctttcaat

SEQ ID NO: 121537 - DNA, 25 bp, Mus musculus
acggactcgtgcactgcttacagtt

SEQ ID NO: 121538 - DNA, 25 bp, Mus musculus
acggactcgtgctctgcttacagtt

SEQ ID NO: 121539 - DNA, 25 bp, Mus musculus
acggactggtagcacccacgttcag

SEQ ID NO: 121540 - DNA, 25 bp, Mus musculus
acggactggtaggacccacgttcag

SEQ ID NO: 121541 - DNA, 25 bp, Mus musculus
acggactgtatgacctcatgggcaa

SEQ ID NO: 121542 - DNA, 25 bp, Mus musculus
acggactgtatgtcctcatgggcaa

SEQ ID NO: 121543 - DNA, 25 bp, Mus musculus
acggactgtgttctcattaaagaga

SEQ ID NO: 121544 - DNA, 25 bp, Mus musculus
acggactgtgttgtcattaaagaga

SEQ ID NO: 121545 - DNA, 25 bp, Mus musculus
acggacttttaaccgcagcatgaaa

SEQ ID NO: 121546 - DNA, 25 bp, Mus musculus
acggacttttaagcgcagcatgaaa

SEQ ID NO: 121547 - DNA, 25 bp, Mus musculus
acggagaactctaccagctctgttg

SEQ ID NO: 121548 - DNA, 25 bp, Mus musculus
acggagaactcttccagctctgttg

SEQ ID NO: 121549 - DNA, 25 bp, Mus musculus
acggagacaaaaccatcatgttcag

SEQ ID NO: 121550 - DNA, 25 bp, Mus musculus
acggagacaaaagcatcatgttcag

SEQ ID NO: 121551 - DNA, 25 bp, Mus musculus
acggagaccagcagatttattttat

SEQ ID NO: 121552 - DNA, 25 bp, Mus musculus
acggagaccagctgatttattttat

SEQ ID NO: 121553 - DNA, 25 bp, Mus musculus
acggagacctggaaactgagggaca

SEQ ID NO: 121554 - DNA, 25 bp, Mus musculus
acggagacctggtaactgagggaca

SEQ ID NO: 121555 - DNA, 25 bp, Mus musculus
acggagactcctctgcagcgcggac

SEQ ID NO: 121556 - DNA, 25 bp, Mus musculus
acggagactcctgtgcagcgcggac

SEQ ID NO: 121557 - DNA, 25 bp, Mus musculus
acggagagaagtcggattagctctt

SEQ ID NO: 121558 - DNA, 25 bp, Mus musculus
acggagagaagtgggattagctctt

SEQ ID NO: 121559 - DNA, 25 bp, Mus musculus
acggagagcttcatgttgctgagca

SEQ ID NO: 121560 - DNA, 25 bp, Mus musculus
acggagagcttcttgttgctgagca

SEQ ID NO: 121561 - DNA, 25 bp, Mus musculus
acggagattatcctgtggcctggca

SEQ ID NO: 121562 - DNA, 25 bp, Mus musculus
acggagattatcgtgtggcctggca

SEQ ID NO: 121563 - DNA, 25 bp, Mus musculus
acggagcacagcagttggcaagcca

SEQ ID NO: 121564 - DNA, 25 bp, Mus musculus
acggagcacagctgttggcaagcca

SEQ ID NO: 121565 - DNA, 25 bp, Mus musculus
acggagccaagcatctacagttagt

SEQ ID NO: 121566 - DNA, 25 bp, Mus musculus
acggagccaagcttctacagttagt

SEQ ID NO: 121567 - DNA, 25 bp, Mus musculus
acggagcctcctcagtgtgagcagt

SEQ ID NO: 121568 - DNA, 25 bp, Mus musculus
acggagcctcctgagtgtgagcagt

SEQ ID NO: 121569 - DNA, 25 bp, Mus musculus
acggagcctgagcagtgttgacatc

SEQ ID NO: 121570 - DNA, 25 bp, Mus musculus
acggagcctgaggagtgttgacatc

SEQ ID NO: 121571 - DNA, 25 bp, Mus musculus
acggagctctcccagaaccgaggtg

SEQ ID NO: 121572 - DNA, 25 bp, Mus musculus
acggagctctccgagaaccgaggtg

SEQ ID NO: 121573 - DNA, 25 bp, Mus musculus
acggagctgctgaatcagacacaca

SEQ ID NO: 121574 - DNA, 25 bp, Mus musculus
acggagctgctgtatcagacacaca

SEQ ID NO: 121575 - DNA, 25 bp, Mus musculus
acggagctttaccaccagaagtcgg

SEQ ID NO: 121576 - DNA, 25 bp, Mus musculus
acggagctttacgaccagaagtcgg

SEQ ID NO: 121577 - DNA, 25 bp, Mus musculus
acggaggacaaccatcagtgtagct

SEQ ID NO: 121578 - DNA, 25 bp, Mus musculus
acggaggacaacgatcagtgtagct

SEQ ID NO: 121579 - DNA, 25 bp, Mus musculus
acggaggaccagcagtgatcactct

SEQ ID NO: 121580 - DNA, 25 bp, Mus musculus
acggaggaccaggagtgatcactct

SEQ ID NO: 121581 - DNA, 25 bp, Mus musculus
acggaggagctcaactggcaaccca

SEQ ID NO: 121582 - DNA, 25 bp, Mus musculus
acggaggagctctactggcaaccca

SEQ ID NO: 121583 - DNA, 25 bp, Mus musculus
acggaggagctgattctctgggcca

SEQ ID NO: 121584 - DNA, 25 bp, Mus musculus
acggaggagctgtttctctgggcca

SEQ ID NO: 121585 - DNA, 25 bp, Mus musculus
acggaggaggatatcagccacgaca

SEQ ID NO: 121586 - DNA, 25 bp, Mus musculus
acggaggaggatttcagccacgaca

SEQ ID NO: 121587 - DNA, 25 bp, Mus musculus
acggaggcccgtaatggagtccagc

SEQ ID NO: 121588 - DNA, 25 bp, Mus musculus
acggaggcccgttatggagtccagc

SEQ ID NO: 121589 - DNA, 25 bp, Mus musculus
acggaggctttaattcttaggcttg

SEQ ID NO: 121590 - DNA, 25 bp, Mus musculus
acggaggctttatttcttaggcttg

SEQ ID NO: 121591 - DNA, 25 bp, Mus musculus
acggagggaaccacacgagccttga

SEQ ID NO: 121592 - DNA, 25 bp, Mus musculus
acggagggaacctcacgagccttga

SEQ ID NO: 121593 - DNA, 25 bp, Mus musculus
acggagggtccaaacctaagtcaga

SEQ ID NO: 121594 - DNA, 25 bp, Mus musculus
acggagggtccatacctaagtcaga

SEQ ID NO: 121595 - DNA, 25 bp, Mus musculus
acggaggttaccagcttaccatcaa

SEQ ID NO: 121596 - DNA, 25 bp, Mus musculus
acggaggttacctgcttaccatcaa

SEQ ID NO: 121597 - DNA, 25 bp, Mus musculus
acggagtaaagtaatgtgccaccac

SEQ ID NO: 121598 - DNA, 25 bp, Mus musculus
acggagtaaagttatgtgccaccac

SEQ ID NO: 121599 - DNA, 25 bp, Mus musculus
acggagtactgcaatggctgggcct

SEQ ID NO: 121600 - DNA, 25 bp, Mus musculus
acggagtactgctatggctgggcct

SEQ ID NO: 121601 - DNA, 25 bp, Mus musculus
acggagtagttcacgcacaccttta

SEQ ID NO: 121602 - DNA, 25 bp, Mus musculus
acggagtagttctcgcacaccttta

SEQ ID NO: 121603 - DNA, 25 bp, Mus musculus
acggagtattggactcacatggctt

SEQ ID NO: 121604 - DNA, 25 bp, Mus musculus
acggagtattggtctcacatggctt

SEQ ID NO: 121605 - DNA, 25 bp, Mus musculus
acggagtcatgcatcgtgtttgaac

SEQ ID NO: 121606 - DNA, 25 bp, Mus musculus
acggagtcatgcttcgtgtttgaac

SEQ ID NO: 121607 - DNA, 25 bp, Mus musculus
acggagtgccagaatcagagtctat

SEQ ID NO: 121608 - DNA, 25 bp, Mus musculus
acggagtgccagtatcagagtctat

SEQ ID NO: 121609 - DNA, 25 bp, Mus musculus
acggagtgcctgaatcatgaccgca

SEQ ID NO: 121610 - DNA, 25 bp, Mus musculus
acggagtgcctgtatcatgaccgca

SEQ ID NO: 121611 - DNA, 25 bp, Mus musculus
acggagttactgatgctcttccaaa

SEQ ID NO: 121612 - DNA, 25 bp, Mus musculus
acggagttactgttgctcttccaaa

SEQ ID NO: 121613 - DNA, 25 bp, Mus musculus
acggagttaggcatgtggaacacca

SEQ ID NO: 121614 - DNA, 25 bp, Mus musculus
acggagttaggcttgtggaacacca

SEQ ID NO: 121615 - DNA, 25 bp, Mus musculus
acggatacggctcgcatggtgtcaa

SEQ ID NO: 121616 - DNA, 25 bp, Mus musculus
acggatacggctggcatggtgtcaa

SEQ ID NO: 121617 - DNA, 25 bp, Mus musculus
acggatagccgcaatgcctttgcta

SEQ ID NO: 121618 - DNA, 25 bp, Mus musculus
acggatagccgctatgcctttgcta

SEQ ID NO: 121619 - DNA, 25 bp, Mus musculus
acggatatgagcagaggcccctggc

SEQ ID NO: 121620 - DNA, 25 bp, Mus musculus
acggatatgagctgaggcccctggc

SEQ ID NO: 121621 - DNA, 25 bp, Mus musculus
acggatcaccttagttgtgctagaa

SEQ ID NO: 121622 - DNA, 25 bp, Mus musculus
acggatcacctttgttgtgctagaa

SEQ ID NO: 121623 - DNA, 25 bp, Mus musculus
acggatcatgtcagtacaagattct

SEQ ID NO: 121624 - DNA, 25 bp, Mus musculus
acggatcatgtctgtacaagattct

SEQ ID NO: 121625 - DNA, 25 bp, Mus musculus
acggatccatttcgcccattctttt

SEQ ID NO: 121626 - DNA, 25 bp, Mus musculus
acggatccatttggcccattctttt

SEQ ID NO: 121627 - DNA, 25 bp, Mus musculus
acggatcccctgagagggtggcctt

SEQ ID NO: 121628 - DNA, 25 bp, Mus musculus
acggatcccctgtgagggtggcctt

SEQ ID NO: 121629 - DNA, 25 bp, Mus musculus
acggatcgtcttaaaactggtctag

SEQ ID NO: 121630 - DNA, 25 bp, Mus musculus
acggatcgtctttaaactggtctag

SEQ ID NO: 121631 - DNA, 25 bp, Mus musculus
acggatctacggatccattgcactg

SEQ ID NO: 121632 - DNA, 25 bp, Mus musculus
acggatctacggttccattgcactg

SEQ ID NO: 121633 - DNA, 25 bp, Mus musculus
acggatcttctcaaagttcttgctg

SEQ ID NO: 121634 - DNA, 25 bp, Mus musculus
acggatcttctctaagttcttgctg

SEQ ID NO: 121635 - DNA, 25 bp, Mus musculus
acggatgacatgcttccttgtgatt

SEQ ID NO: 121636 - DNA, 25 bp, Mus musculus
acggatgacatggttccttgtgatt

SEQ ID NO: 121637 - DNA, 25 bp, Mus musculus
acggatgccaatctccctggaccag

SEQ ID NO: 121638 - DNA, 25 bp, Mus musculus
acggatgccaatgtccctggaccag

SEQ ID NO: 121639 - DNA, 25 bp, Mus musculus
acggatgctctcacaactagatatg

SEQ ID NO: 121640 - DNA, 25 bp, Mus musculus
acggatgctctctcaactagatatg

SEQ ID NO: 121641 - DNA, 25 bp, Mus musculus
acggatgctgagaacaatgtgggtc

SEQ ID NO: 121642 - DNA, 25 bp, Mus musculus
acggatgctgagtacaatgtgggtc

SEQ ID NO: 121643 - DNA, 25 bp, Mus musculus
acggatgcttcaaggttactctgac

SEQ ID NO: 121644 - DNA, 25 bp, Mus musculus
acggatgcttcatggttactctgac

SEQ ID NO: 121645 - DNA, 25 bp, Mus musculus
acggatggatacacggttgccaggc

SEQ ID NO: 121646 - DNA, 25 bp, Mus musculus
acggatggatactcggttgccaggc

SEQ ID NO: 121647 - DNA, 25 bp, Mus musculus
acggatggccatcggctaccatgtg

SEQ ID NO: 121648 - DNA, 25 bp, Mus musculus
acggatggccatgggctaccatgtg

SEQ ID NO: 121649 - DNA, 25 bp, Mus musculus
acggatgtagcaccatctgctggta

SEQ ID NO: 121650 - DNA, 25 bp, Mus musculus
acggatgtagcagcatctgctggta

SEQ ID NO: 121651 - DNA, 25 bp, Mus musculus
acggatgtcacaacaaatgcacttg

SEQ ID NO: 121652 - DNA, 25 bp, Mus musculus
acggatgtcacatcaaatgcacttg

SEQ ID NO: 121653 - DNA, 25 bp, Mus musculus
acggatgtcttaattacacgttatt

SEQ ID NO: 121654 - DNA, 25 bp, Mus musculus
acggatgtcttatttacacgttatt

SEQ ID NO: 121655 - DNA, 25 bp, Mus musculus
acggatgtgctcagagattctcttg

SEQ ID NO: 121656 - DNA, 25 bp, Mus musculus
acggatgtgctctgagattctcttg

SEQ ID NO: 121657 - DNA, 25 bp, Mus musculus
acggatgtttctaacagctctggga

SEQ ID NO: 121658 - DNA, 25 bp, Mus musculus
acggatgtttcttacagctctggga

SEQ ID NO: 121659 - DNA, 25 bp, Mus musculus
acggattagttaatcctgtgggtgg

SEQ ID NO: 121660 - DNA, 25 bp, Mus musculus
acggattagttattcctgtgggtgg

SEQ ID NO: 121661 - DNA, 25 bp, Mus musculus
acggattccggccaccttgtaggct

SEQ ID NO: 121662 - DNA, 25 bp, Mus musculus
acggattccggcgaccttgtaggct

SEQ ID NO: 121663 - DNA, 25 bp, Mus musculus
acggattcggaacagatccaccctg

SEQ ID NO: 121664 - DNA, 25 bp, Mus musculus
acggattcggaagagatccaccctg

SEQ ID NO: 121665 - DNA, 25 bp, Mus musculus
acggattcgggaattctatcagtcc

SEQ ID NO: 121666 - DNA, 25 bp, Mus musculus
acggattcgggatttctatcagtcc

SEQ ID NO: 121667 - DNA, 25 bp, Mus musculus
acggattctgtgaccaatggctttt

SEQ ID NO: 121668 - DNA, 25 bp, Mus musculus
acggattctgtgtccaatggctttt

SEQ ID NO: 121669 - DNA, 25 bp, Mus musculus
acggattgatggacactagcttgga

SEQ ID NO: 121670 - DNA, 25 bp, Mus musculus
acggattgatggtcactagcttgga

SEQ ID NO: 121671 - DNA, 25 bp, Mus musculus
acggattgcaccactgtaagctatt

SEQ ID NO: 121672 - DNA, 25 bp, Mus musculus
acggattgcacctctgtaagctatt

SEQ ID NO: 121673 - DNA, 25 bp, Mus musculus
acggatttctagagtccagaccaaa

SEQ ID NO: 121674 - DNA, 25 bp, Mus musculus
acggatttctagtgtccagaccaaa

SEQ ID NO: 121675 - DNA, 25 bp, Mus musculus
acggattttccgagaggctctgcag

SEQ ID NO: 121676 - DNA, 25 bp, Mus musculus
acggattttccgtgaggctctgcag

SEQ ID NO: 121677 - DNA, 25 bp, Mus musculus
acggcaaacttcctcatcttatatg

SEQ ID NO: 121678 - DNA, 25 bp, Mus musculus
acggcaaacttcgtcatcttatatg

SEQ ID NO: 121679 - DNA, 25 bp, Mus musculus
acggcaaatcctagagtgttctcta

SEQ ID NO: 121680 - DNA, 25 bp, Mus musculus
acggcaaatccttgagtgttctcta

SEQ ID NO: 121681 - DNA, 25 bp, Mus musculus
acggcaaatggcagatcgtccactt

SEQ ID NO: 121682 - DNA, 25 bp, Mus musculus
acggcaaatggctgatcgtccactt

SEQ ID NO: 121683 - DNA, 25 bp, Mus musculus
acggcaaccatacgtcactaggcaa

SEQ ID NO: 121684 - DNA, 25 bp, Mus musculus
acggcaaccataggtcactaggcaa

SEQ ID NO: 121685 - DNA, 25 bp, Mus musculus
acggcaactactatggtggccttgg

SEQ ID NO: 121686 - DNA, 25 bp, Mus musculus
acggcaactactttggtggccttgg

SEQ ID NO: 121687 - DNA, 25 bp, Mus musculus
acggcaactggtatgttggcctcac

SEQ ID NO: 121688 - DNA, 25 bp, Mus musculus
acggcaactggtttgttggcctcac

SEQ ID NO: 121689 - DNA, 25 bp, Mus musculus
acggcaactttcagaacatcccaca

SEQ ID NO: 121690 - DNA, 25 bp, Mus musculus
acggcaactttctgaacatcccaca

SEQ ID NO: 121691 - DNA, 25 bp, Mus musculus
acggcaagactaactttaggagcaa

SEQ ID NO: 121692 - DNA, 25 bp, Mus musculus
acggcaagactatctttaggagcaa

SEQ ID NO: 121693 - DNA, 25 bp, Mus musculus
acggcaagcacgaagaacgccagga

SEQ ID NO: 121694 - DNA, 25 bp, Mus musculus
acggcaagcacgtagaacgccagga

SEQ ID NO: 121695 - DNA, 25 bp, Mus musculus
acggcaagccgtccgtcacgcccag

SEQ ID NO: 121696 - DNA, 25 bp, Mus musculus
acggcaagccgtgcgtcacgcccag

SEQ ID NO: 121697 - DNA, 25 bp, Mus musculus
acggcaaggctgagtatctgataat

SEQ ID NO: 121698 - DNA, 25 bp, Mus musculus
acggcaaggctgtgtatctgataat

SEQ ID NO: 121699 - DNA, 25 bp, Mus musculus
acggcaatggaaccttgtatgggca

SEQ ID NO: 121700 - DNA, 25 bp, Mus musculus
acggcaatggaagcttgtatgggca

SEQ ID NO: 121701 - DNA, 25 bp, Mus musculus
acggcaatggcaaggtactcccaca

SEQ ID NO: 121702 - DNA, 25 bp, Mus musculus
acggcaatggcatggtactcccaca

SEQ ID NO: 121703 - DNA, 25 bp, Mus musculus
acggcaattcctagacacgtggtcc

SEQ ID NO: 121704 - DNA, 25 bp, Mus musculus
acggcaattccttgacacgtggtcc

SEQ ID NO: 121705 - DNA, 25 bp, Mus musculus
acggcacagccgcagggctgcggga

SEQ ID NO: 121706 - DNA, 25 bp, Mus musculus
acggcacagccggagggctgcggga

SEQ ID NO: 121707 - DNA, 25 bp, Mus musculus
acggcacagcttatcacaggctctg

SEQ ID NO: 121708 - DNA, 25 bp, Mus musculus
acggcacagcttttcacaggctctg

SEQ ID NO: 121709 - DNA, 25 bp, Mus musculus
acggcacagtaaactgagttggcag

SEQ ID NO: 121710 - DNA, 25 bp, Mus musculus
acggcacagtaatctgagttggcag

SEQ ID NO: 121711 - DNA, 25 bp, Mus musculus
acggcaccattcacatcaaccgggt

SEQ ID NO: 121712 - DNA, 25 bp, Mus musculus
acggcaccattctcatcaaccgggt

SEQ ID NO: 121713 - DNA, 25 bp, Mus musculus
acggcaccgcatcctaatactgaca

SEQ ID NO: 121714 - DNA, 25 bp, Mus musculus
acggcaccgcatgctaatactgaca

SEQ ID NO: 121715 - DNA, 25 bp, Mus musculus
acggcaccggctatgaagtcattac

SEQ ID NO: 121716 - DNA, 25 bp, Mus musculus
acggcaccggctttgaagtcattac

SEQ ID NO: 121717 - DNA, 25 bp, Mus musculus
acggcaccgtgcagattaacttctt

SEQ ID NO: 121718 - DNA, 25 bp, Mus musculus
acggcaccgtgctgattaacttctt

SEQ ID NO: 121719 - DNA, 25 bp, Mus musculus
acggcacctattacaacaacttctg

SEQ ID NO: 121720 - DNA, 25 bp, Mus musculus
acggcacctatttcaacaacttctg

SEQ ID NO: 121721 - DNA, 25 bp, Mus musculus
acggcacgcgttcaaacctgagttt

SEQ ID NO: 121722 - DNA, 25 bp, Mus musculus
acggcacgcgttgaaacctgagttt

SEQ ID NO: 121723 - DNA, 25 bp, Mus musculus
acggcacgctcaagaaggagaagca

SEQ ID NO: 121724 - DNA, 25 bp, Mus musculus
acggcacgctcatgaaggagaagca

SEQ ID NO: 121725 - DNA, 25 bp, Mus musculus
acggcactgtccatgtgtgacctga

SEQ ID NO: 121726 - DNA, 25 bp, Mus musculus
acggcactgtccttgtgtgacctga

SEQ ID NO: 121727 - DNA, 25 bp, Mus musculus
acggcactgtggattatgtacctat

SEQ ID NO: 121728 - DNA, 25 bp, Mus musculus
acggcactgtggtttatgtacctat

SEQ ID NO: 121729 - DNA, 25 bp, Mus musculus
acggcagacactacctctaacactg

SEQ ID NO: 121730 - DNA, 25 bp, Mus musculus
acggcagacacttcctctaacactg

SEQ ID NO: 121731 - DNA, 25 bp, Mus musculus
acggcagagtgtcagttaaatcgcc

SEQ ID NO: 121732 - DNA, 25 bp, Mus musculus
acggcagagtgtgagttaaatcgcc

SEQ ID NO: 121733 - DNA, 25 bp, Mus musculus
acggcagagttgatacagttggcac

SEQ ID NO: 121734 - DNA, 25 bp, Mus musculus
acggcagagttgttacagttggcac

SEQ ID NO: 121735 - DNA, 25 bp, Mus musculus
acggcagcacaacatccagccggag

SEQ ID NO: 121736 - DNA, 25 bp, Mus musculus
acggcagcacaagatccagccggag

SEQ ID NO: 121737 - DNA, 25 bp, Mus musculus
acggcagcacagagagtaccacagt

SEQ ID NO: 121738 - DNA, 25 bp, Mus musculus
acggcagcacagtgagtaccacagt

SEQ ID NO: 121739 - DNA, 25 bp, Mus musculus
acggcagcatggctggcttttcttt

SEQ ID NO: 121740 - DNA, 25 bp, Mus musculus
acggcagcatgggtggcttttcttt

SEQ ID NO: 121741 - DNA, 25 bp, Mus musculus
acggcagccatacctacttttgcta

SEQ ID NO: 121742 - DNA, 25 bp, Mus musculus
acggcagccatagctacttttgcta

SEQ ID NO: 121743 - DNA, 25 bp, Mus musculus
acggcagccattagtattctactca

SEQ ID NO: 121744 - DNA, 25 bp, Mus musculus
acggcagccatttgtattctactca

SEQ ID NO: 121745 - DNA, 25 bp, Mus musculus
acggcagccgacaaatgacctgttt

SEQ ID NO: 121746 - DNA, 25 bp, Mus musculus
acggcagccgactaatgacctgttt

SEQ ID NO: 121747 - DNA, 25 bp, Mus musculus
acggcagctaatattggtaccacct

SEQ ID NO: 121748 - DNA, 25 bp, Mus musculus
acggcagctaattttggtaccacct

SEQ ID NO: 121749 - DNA, 25 bp, Mus musculus
acggcagctgaacggccattttcaa

SEQ ID NO: 121750 - DNA, 25 bp, Mus musculus
acggcagctgaagggccattttcaa

SEQ ID NO: 121751 - DNA, 25 bp, Mus musculus
acggcagcttcgagctggtagatca

SEQ ID NO: 121752 - DNA, 25 bp, Mus musculus
acggcagcttcgtgctggtagatca

SEQ ID NO: 121753 - DNA, 25 bp, Mus musculus
acggcaggcagaagtttccctcagc

SEQ ID NO: 121754 - DNA, 25 bp, Mus musculus
acggcaggcagatgtttccctcagc

SEQ ID NO: 121755 - DNA, 25 bp, Mus musculus
acggcaggccaaccatgaggcacgt

SEQ ID NO: 121756 - DNA, 25 bp, Mus musculus
acggcaggccaagcatgaggcacgt

SEQ ID NO: 121757 - DNA, 25 bp, Mus musculus
acggcaggcttcctttgatctcagt

SEQ ID NO: 121758 - DNA, 25 bp, Mus musculus
acggcaggcttcgtttgatctcagt

SEQ ID NO: 121759 - DNA, 25 bp, Mus musculus
acggcagggattagtaccgctgtgc

SEQ ID NO: 121760 - DNA, 25 bp, Mus musculus
acggcagggatttgtaccgctgtgc

SEQ ID NO: 121761 - DNA, 25 bp, Mus musculus
acggcaggtggccattgagttcgat

SEQ ID NO: 121762 - DNA, 25 bp, Mus musculus
acggcaggtggcgattgagttcgat

SEQ ID NO: 121763 - DNA, 25 bp, Mus musculus
acggcagtagttaccttcaaagagg

SEQ ID NO: 121764 - DNA, 25 bp, Mus musculus
acggcagtagtttccttcaaagagg

SEQ ID NO: 121765 - DNA, 25 bp, Mus musculus
acggcagtcactagttgccctcatg

SEQ ID NO: 121766 - DNA, 25 bp, Mus musculus
acggcagtcacttgttgccctcatg

SEQ ID NO: 121767 - DNA, 25 bp, Mus musculus
acggcagtgcatccttgactttagt

SEQ ID NO: 121768 - DNA, 25 bp, Mus musculus
acggcagtgcatgcttgactttagt

SEQ ID NO: 121769 - DNA, 25 bp, Mus musculus
acggcagtgttaccaaacagtagct

SEQ ID NO: 121770 - DNA, 25 bp, Mus musculus
acggcagtgttagcaaacagtagct

SEQ ID NO: 121771 - DNA, 25 bp, Mus musculus
acggcagttggaaggagatctccca

SEQ ID NO: 121772 - DNA, 25 bp, Mus musculus
acggcagttggatggagatctccca

SEQ ID NO: 121773 - DNA, 25 bp, Mus musculus
acggcagtttccagctacaggtaga

SEQ ID NO: 121774 - DNA, 25 bp, Mus musculus
acggcagtttcctgctacaggtaga

SEQ ID NO: 121775 - DNA, 25 bp, Mus musculus
acggcatcccgcataaaatcgaaca

SEQ ID NO: 121776 - DNA, 25 bp, Mus musculus
acggcatcccgcttaaaatcgaaca

SEQ ID NO: 121777 - DNA, 25 bp, Mus musculus
acggcatccgctacgatcctgaaat

SEQ ID NO: 121778 - DNA, 25 bp, Mus musculus
acggcatccgcttcgatcctgaaat

SEQ ID NO: 121779 - DNA, 25 bp, Mus musculus
acggcatcgatgacatgctggtcat

SEQ ID NO: 121780 - DNA, 25 bp, Mus musculus
acggcatcgatgtcatgctggtcat

SEQ ID NO: 121781 - DNA, 25 bp, Mus musculus
acggcatggcaaaaagaactacttc

SEQ ID NO: 121782 - DNA, 25 bp, Mus musculus
acggcatggcaataagaactacttc

SEQ ID NO: 121783 - DNA, 25 bp, Mus musculus
acggcatttcctagctttcaaaact

SEQ ID NO: 121784 - DNA, 25 bp, Mus musculus
acggcatttccttgctttcaaaact

SEQ ID NO: 121785 - DNA, 25 bp, Mus musculus
acggccaaagtaatggatttagcag

SEQ ID NO: 121786 - DNA, 25 bp, Mus musculus
acggccaaagtattggatttagcag

SEQ ID NO: 121787 - DNA, 25 bp, Mus musculus
acggccaaggctctgctactgatgt

SEQ ID NO: 121788 - DNA, 25 bp, Mus musculus
acggccaaggctgtgctactgatgt

SEQ ID NO: 121789 - DNA, 25 bp, Mus musculus
acggccacatctccatctgggatgt

SEQ ID NO: 121790 - DNA, 25 bp, Mus musculus
acggccacatctgcatctgggatgt

SEQ ID NO: 121791 - DNA, 25 bp, Mus musculus
acggccaccgtgcaactgtgagaaa

SEQ ID NO: 121792 - DNA, 25 bp, Mus musculus
acggccaccgtggaactgtgagaaa

SEQ ID NO: 121793 - DNA, 25 bp, Mus musculus
acggccacgggcaacttgtctcttg

SEQ ID NO: 121794 - DNA, 25 bp, Mus musculus
acggccacgggctacttgtctcttg

SEQ ID NO: 121795 - DNA, 25 bp, Mus musculus
acggccatcactctagccagagaag

SEQ ID NO: 121796 - DNA, 25 bp, Mus musculus
acggccatcactgtagccagagaag

SEQ ID NO: 121797 - DNA, 25 bp, Mus musculus
acggccatctctatcaccaggagaa

SEQ ID NO: 121798 - DNA, 25 bp, Mus musculus
acggccatctctttcaccaggagaa

SEQ ID NO: 121799 - DNA, 25 bp, Mus musculus
acggccatggagcaaaaccttgtct

SEQ ID NO: 121800 - DNA, 25 bp, Mus musculus
acggccatggaggaaaaccttgtct

SEQ ID NO: 121801 - DNA, 25 bp, Mus musculus
acggccatgtgccactgaggactgt

SEQ ID NO: 121802 - DNA, 25 bp, Mus musculus
acggccatgtgcgactgaggactgt

SEQ ID NO: 121803 - DNA, 25 bp, Mus musculus
acggcccagcagccgatgagacagc

SEQ ID NO: 121804 - DNA, 25 bp, Mus musculus
acggcccagcaggcgatgagacagc

SEQ ID NO: 121805 - DNA, 25 bp, Mus musculus
acggcccaggttcccaatgtatcat

SEQ ID NO: 121806 - DNA, 25 bp, Mus musculus
acggcccaggttgccaatgtatcat

SEQ ID NO: 121807 - DNA, 25 bp, Mus musculus
acggcccatgctatagccatgatgg

SEQ ID NO: 121808 - DNA, 25 bp, Mus musculus
acggcccatgctttagccatgatgg

SEQ ID NO: 121809 - DNA, 25 bp, Mus musculus
acggccccgcacagaatacattctt

SEQ ID NO: 121810 - DNA, 25 bp, Mus musculus
acggccccgcactgaatacattctt

SEQ ID NO: 121811 - DNA, 25 bp, Mus musculus
acggccccgcttagtgaagcaagac

SEQ ID NO: 121812 - DNA, 25 bp, Mus musculus
acggccccgctttgtgaagcaagac

SEQ ID NO: 121813 - DNA, 25 bp, Mus musculus
acggcccgcaggactcactgagtgg

SEQ ID NO: 121814 - DNA, 25 bp, Mus musculus
acggcccgcaggtctcactgagtgg

SEQ ID NO: 121815 - DNA, 25 bp, Mus musculus
acggccctactactgaatattctgg

SEQ ID NO: 121816 - DNA, 25 bp, Mus musculus
acggccctactagtgaatattctgg

SEQ ID NO: 121817 - DNA, 25 bp, Mus musculus
acggccctgaatactttgtagctta

SEQ ID NO: 121818 - DNA, 25 bp, Mus musculus
acggccctgaattctttgtagctta

SEQ ID NO: 121819 - DNA, 25 bp, Mus musculus
acggccctgttaccctgtggaggaa

SEQ ID NO: 121820 - DNA, 25 bp, Mus musculus
acggccctgttagcctgtggaggaa

SEQ ID NO: 121821 - DNA, 25 bp, Mus musculus
acggcccttgaacgcaagtacttag

SEQ ID NO: 121822 - DNA, 25 bp, Mus musculus
acggcccttgaaggcaagtacttag

SEQ ID NO: 121823 - DNA, 25 bp, Mus musculus
acggcccttgtgagtttgcggaaga

SEQ ID NO: 121824 - DNA, 25 bp, Mus musculus
acggcccttgtgtgtttgcggaaga

SEQ ID NO: 121825 - DNA, 25 bp, Mus musculus
acggccgaggccatcacgaatggat

SEQ ID NO: 121826 - DNA, 25 bp, Mus musculus
acggccgaggccttcacgaatggat

SEQ ID NO: 121827 - DNA, 25 bp, Mus musculus
acggccgtctgacattttcggaagg

SEQ ID NO: 121828 - DNA, 25 bp, Mus musculus
acggccgtctgagattttcggaagg

SEQ ID NO: 121829 - DNA, 25 bp, Mus musculus
acggccgtgggaatgcttccaccag

SEQ ID NO: 121830 - DNA, 25 bp, Mus musculus
acggccgtgggattgcttccaccag

SEQ ID NO: 121831 - DNA, 25 bp, Mus musculus
acggcctagagactttgcaggtacc

SEQ ID NO: 121832 - DNA, 25 bp, Mus musculus
acggcctagagagtttgcaggtacc

SEQ ID NO: 121833 - DNA, 25 bp, Mus musculus
acggcctcattgcatgactaccatg

SEQ ID NO: 121834 - DNA, 25 bp, Mus musculus
acggcctcattggatgactaccatg

SEQ ID NO: 121835 - DNA, 25 bp, Mus musculus
acggcctccaaacccatcattgaga

SEQ ID NO: 121836 - DNA, 25 bp, Mus musculus
acggcctccaaagccatcattgaga

SEQ ID NO: 121837 - DNA, 25 bp, Mus musculus
acggcctccatcatgctgaatgacg

SEQ ID NO: 121838 - DNA, 25 bp, Mus musculus
acggcctccatcttgctgaatgacg

SEQ ID NO: 121839 - DNA, 25 bp, Mus musculus
acggcctccattcacgtgtccagaa

SEQ ID NO: 121840 - DNA, 25 bp, Mus musculus
acggcctccattgacgtgtccagaa

SEQ ID NO: 121841 - DNA, 25 bp, Mus musculus
acggcctctgctacaagtcttgcct

SEQ ID NO: 121842 - DNA, 25 bp, Mus musculus
acggcctctgcttcaagtcttgcct

SEQ ID NO: 121843 - DNA, 25 bp, Mus musculus
acggcctgacacctgttgttcagtg

SEQ ID NO: 121844 - DNA, 25 bp, Mus musculus
acggcctgacacgtgttgttcagtg

SEQ ID NO: 121845 - DNA, 25 bp, Mus musculus
acggcctgatcgagctgcggaagct

SEQ ID NO: 121846 - DNA, 25 bp, Mus musculus
acggcctgatcgtgctgcggaagct

SEQ ID NO: 121847 - DNA, 25 bp, Mus musculus
acggcctgcaggaaacagacggaga

SEQ ID NO: 121848 - DNA, 25 bp, Mus musculus
acggcctgcaggtaacagacggaga

SEQ ID NO: 121849 - DNA, 25 bp, Mus musculus
acggccttcagtctttggagtcatg

SEQ ID NO: 121850 - DNA, 25 bp, Mus musculus
acggccttcagtgtttggagtcatg

SEQ ID NO: 121851 - DNA, 25 bp, Mus musculus
acggccttcattcgtgctgcagcac

SEQ ID NO: 121852 - DNA, 25 bp, Mus musculus
acggccttcattggtgctgcagcac

SEQ ID NO: 121853 - DNA, 25 bp, Mus musculus
acggccttctcaaaaacctcagtga

SEQ ID NO: 121854 - DNA, 25 bp, Mus musculus
acggccttctcataaacctcagtga

SEQ ID NO: 121855 - DNA, 25 bp, Mus musculus
acggccttggatagtctgacctcag

SEQ ID NO: 121856 - DNA, 25 bp, Mus musculus
acggccttggattgtctgacctcag

SEQ ID NO: 121857 - DNA, 25 bp, Mus musculus
acggccttggcaattacatcactgg

SEQ ID NO: 121858 - DNA, 25 bp, Mus musculus
acggccttggcatttacatcactgg

SEQ ID NO: 121859 - DNA, 25 bp, Mus musculus
acggcctttacaagtgtgtgcagaa

SEQ ID NO: 121860 - DNA, 25 bp, Mus musculus
acggcctttacatgtgtgtgcagaa

SEQ ID NO: 121861 - DNA, 25 bp, Mus musculus
acggcctttgttagcacctggaagc

SEQ ID NO: 121862 - DNA, 25 bp, Mus musculus
acggcctttgtttgcacctggaagc

SEQ ID NO: 121863 - DNA, 25 bp, Mus musculus
acggcgacaacgctgcggaagtgta

SEQ ID NO: 121864 - DNA, 25 bp, Mus musculus
acggcgacaacggtgcggaagtgta

SEQ ID NO: 121865 - DNA, 25 bp, Mus musculus
acggcgacgactatgatgacgttga

SEQ ID NO: 121866 - DNA, 25 bp, Mus musculus
acggcgacgactttgatgacgttga

SEQ ID NO: 121867 - DNA, 25 bp, Mus musculus
acggcgaggagtctcagttcctgca

SEQ ID NO: 121868 - DNA, 25 bp, Mus musculus
acggcgaggagtgtcagttcctgca

SEQ ID NO: 121869 - DNA, 25 bp, Mus musculus
acggcggaagaccattcctccattg

SEQ ID NO: 121870 - DNA, 25 bp, Mus musculus
acggcggaagacgattcctccattg

SEQ ID NO: 121871 - DNA, 25 bp, Mus musculus
acggcggcagtaatgaagcttgtga

SEQ ID NO: 121872 - DNA, 25 bp, Mus musculus
acggcggcagtattgaagcttgtga

SEQ ID NO: 121873 - DNA, 25 bp, Mus musculus
acggcggcatgtctgatatctcctt

SEQ ID NO: 121874 - DNA, 25 bp, Mus musculus
acggcggcatgtgtgatatctcctt

SEQ ID NO: 121875 - DNA, 25 bp, Mus musculus
acggcggcctccaggagcacgtgta

SEQ ID NO: 121876 - DNA, 25 bp, Mus musculus
acggcggcctcctggagcacgtgta

SEQ ID NO: 121877 - DNA, 25 bp, Mus musculus
acggcggctcatcatcagcaagagg

SEQ ID NO: 121878 - DNA, 25 bp, Mus musculus
acggcggctcatgatcagcaagagg

SEQ ID NO: 121879 - DNA, 25 bp, Mus musculus
acggcgtactagacaaaccccaatg

SEQ ID NO: 121880 - DNA, 25 bp, Mus musculus
acggcgtactagtcaaaccccaatg

SEQ ID NO: 121881 - DNA, 25 bp, Mus musculus
acggcgtgcaccagcactaccaggg

SEQ ID NO: 121882 - DNA, 25 bp, Mus musculus
acggcgtgcacctgcactaccaggg

SEQ ID NO: 121883 - DNA, 25 bp, Mus musculus
acggcgtggcttatgttgagtgact

SEQ ID NO: 121884 - DNA, 25 bp, Mus musculus
acggcgtggcttttgttgagtgact

SEQ ID NO: 121885 - DNA, 25 bp, Mus musculus
acggcgttctttagcagtttctatt

SEQ ID NO: 121886 - DNA, 25 bp, Mus musculus
acggcgttcttttgcagtttctatt

SEQ ID NO: 121887 - DNA, 25 bp, Mus musculus
acggcgttgtgacccaggtgctcaa

SEQ ID NO: 121888 - DNA, 25 bp, Mus musculus
acggcgttgtgagccaggtgctcaa

SEQ ID NO: 121889 - DNA, 25 bp, Mus musculus
acggctaccgggagtcagtgacatc

SEQ ID NO: 121890 - DNA, 25 bp, Mus musculus
acggctaccgggtgtcagtgacatc

SEQ ID NO: 121891 - DNA, 25 bp, Mus musculus
acggctacctttatgtcctgaggtg

SEQ ID NO: 121892 - DNA, 25 bp, Mus musculus
acggctacctttttgtcctgaggtg

SEQ ID NO: 121893 - DNA, 25 bp, Mus musculus
acggctacgagtctgaactgttcca

SEQ ID NO: 121894 - DNA, 25 bp, Mus musculus
acggctacgagtgtgaactgttcca

SEQ ID NO: 121895 - DNA, 25 bp, Mus musculus
acggctactcgcagttcatctatat

SEQ ID NO: 121896 - DNA, 25 bp, Mus musculus
acggctactcgctgttcatctatat

SEQ ID NO: 121897 - DNA, 25 bp, Mus musculus
acggctactgtgcagctttgtctca

SEQ ID NO: 121898 - DNA, 25 bp, Mus musculus
acggctactgtggagctttgtctca

SEQ ID NO: 121899 - DNA, 25 bp, Mus musculus
acggctagatgaacctaccttcaag

SEQ ID NO: 121900 - DNA, 25 bp, Mus musculus
acggctagatgatcctaccttcaag

SEQ ID NO: 121901 - DNA, 25 bp, Mus musculus
acggctagtgttacttccacagatt

SEQ ID NO: 121902 - DNA, 25 bp, Mus musculus
acggctagtgtttcttccacagatt

SEQ ID NO: 121903 - DNA, 25 bp, Mus musculus
acggctataaaaactctttccattg

SEQ ID NO: 121904 - DNA, 25 bp, Mus musculus
acggctataaaatctctttccattg

SEQ ID NO: 121905 - DNA, 25 bp, Mus musculus
acggctatgcagaagggatttcgga

SEQ ID NO: 121906 - DNA, 25 bp, Mus musculus
acggctatgcagtagggatttcgga

SEQ ID NO: 121907 - DNA, 25 bp, Mus musculus
acggctatgtgcacgaaggcaagga

SEQ ID NO: 121908 - DNA, 25 bp, Mus musculus
acggctatgtgctcgaaggcaagga

SEQ ID NO: 121909 - DNA, 25 bp, Mus musculus
acggctcaagtaccaggctcctgac

SEQ ID NO: 121910 - DNA, 25 bp, Mus musculus
acggctcaagtagcaggctcctgac

SEQ ID NO: 121911 - DNA, 25 bp, Mus musculus
acggctcaccaactgctttctggga

SEQ ID NO: 121912 - DNA, 25 bp, Mus musculus
acggctcaccaagtgctttctggga

SEQ ID NO: 121913 - DNA, 25 bp, Mus musculus
acggctcacttcaaactctaggatg

SEQ ID NO: 121914 - DNA, 25 bp, Mus musculus
acggctcacttctaactctaggatg

SEQ ID NO: 121915 - DNA, 25 bp, Mus musculus
acggctccaaggacacaggctgtca

SEQ ID NO: 121916 - DNA, 25 bp, Mus musculus
acggctccaaggtcacaggctgtca

SEQ ID NO: 121917 - DNA, 25 bp, Mus musculus
acggctccatcgcttacaaagagta

SEQ ID NO: 121918 - DNA, 25 bp, Mus musculus
acggctccatcggttacaaagagta

SEQ ID NO: 121919 - DNA, 25 bp, Mus musculus
acggctcccagaatgctggacagag

SEQ ID NO: 121920 - DNA, 25 bp, Mus musculus
acggctcccagattgctggacagag

SEQ ID NO: 121921 - DNA, 25 bp, Mus musculus
acggctcctgttcgccattctggtg

SEQ ID NO: 121922 - DNA, 25 bp, Mus musculus
acggctcctgttggccattctggtg

SEQ ID NO: 121923 - DNA, 25 bp, Mus musculus
acggctctccacacttctggaggtg

SEQ ID NO: 121924 - DNA, 25 bp, Mus musculus
acggctctccactcttctggaggtg

SEQ ID NO: 121925 - DNA, 25 bp, Mus musculus
acggctctctaaagccctacagagg

SEQ ID NO: 121926 - DNA, 25 bp, Mus musculus
acggctctctaatgccctacagagg

SEQ ID NO: 121927 - DNA, 25 bp, Mus musculus
acggctctctcgctatcagggttag

SEQ ID NO: 121928 - DNA, 25 bp, Mus musculus
acggctctctcggtatcagggttag

SEQ ID NO: 121929 - DNA, 25 bp, Mus musculus
acggctctctgtaattctggcatgt

SEQ ID NO: 121930 - DNA, 25 bp, Mus musculus
acggctctctgttattctggcatgt

SEQ ID NO: 121931 - DNA, 25 bp, Mus musculus
acggctctgttcatgcatacttgaa

SEQ ID NO: 121932 - DNA, 25 bp, Mus musculus
acggctctgttcattctatactgta

SEQ ID NO: 121933 - DNA, 25 bp, Mus musculus
acggctctgttcttgcatacttgaa

SEQ ID NO: 121934 - DNA, 25 bp, Mus musculus
acggctctgttctttctatactgta

SEQ ID NO: 121935 - DNA, 25 bp, Mus musculus
acggctcttccaccgacttgtaagg

SEQ ID NO: 121936 - DNA, 25 bp, Mus musculus
acggctcttccagcgacttgtaagg

SEQ ID NO: 121937 - DNA, 25 bp, Mus musculus
acggctgaaagcatgcaataactcc

SEQ ID NO: 121938 - DNA, 25 bp, Mus musculus
acggctgaaagcttgcaataactcc

SEQ ID NO: 121939 - DNA, 25 bp, Mus musculus
acggctgacaggatcatcaattcca

SEQ ID NO: 121940 - DNA, 25 bp, Mus musculus
acggctgacaggttcatcaattcca

SEQ ID NO: 121941 - DNA, 25 bp, Mus musculus
acggctgaggttattgaggtgcctc

SEQ ID NO: 121942 - DNA, 25 bp, Mus musculus
acggctgaggtttttgaggtgcctc

SEQ ID NO: 121943 - DNA, 25 bp, Mus musculus
acggctgcccatacttgattcagat

SEQ ID NO: 121944 - DNA, 25 bp, Mus musculus
acggctgcccattcttgattcagat

SEQ ID NO: 121945 - DNA, 25 bp, Mus musculus
acggctgcgaggaggttaagatatt

SEQ ID NO: 121946 - DNA, 25 bp, Mus musculus
acggctgcgaggtggttaagatatt

SEQ ID NO: 121947 - DNA, 25 bp, Mus musculus
acggctgcttatatgtcaccacgct

SEQ ID NO: 121948 - DNA, 25 bp, Mus musculus
acggctgcttatttgtcaccacgct

SEQ ID NO: 121949 - DNA, 25 bp, Mus musculus
acggctggaaaaagagctgtgcccg

SEQ ID NO: 121950 - DNA, 25 bp, Mus musculus
acggctggaaaatgagctgtgcccg

SEQ ID NO: 121951 - DNA, 25 bp, Mus musculus
acggctggaccacagtcattacaac

SEQ ID NO: 121952 - DNA, 25 bp, Mus musculus
acggctggaccagagtcattacaac

SEQ ID NO: 121953 - DNA, 25 bp, Mus musculus
acggctgggaacaacgacgatgaag

SEQ ID NO: 121954 - DNA, 25 bp, Mus musculus
acggctgggaactacgacgatgaag

SEQ ID NO: 121955 - DNA, 25 bp, Mus musculus
acggctgggcacatgcggctcatca

SEQ ID NO: 121956 - DNA, 25 bp, Mus musculus
acggctgggcacttgcggctcatca

SEQ ID NO: 121957 - DNA, 25 bp, Mus musculus
acggctggtgcgagcagccctcctg

SEQ ID NO: 121958 - DNA, 25 bp, Mus musculus
acggctggtgcgtgcagccctcctg

SEQ ID NO: 121959 - DNA, 25 bp, Mus musculus
acggctgtacccatagattagtgaa

SEQ ID NO: 121960 - DNA, 25 bp, Mus musculus
acggctgtacccttagattagtgaa

SEQ ID NO: 121961 - DNA, 25 bp, Mus musculus
acggctgtcacacacgatgcttgga

SEQ ID NO: 121962 - DNA, 25 bp, Mus musculus
acggctgtcacagacgatgcttgga

SEQ ID NO: 121963 - DNA, 25 bp, Mus musculus
acggctgtcgcaaccatgtcattga

SEQ ID NO: 121964 - DNA, 25 bp, Mus musculus
acggctgtcgcatccatgtcattga

SEQ ID NO: 121965 - DNA, 25 bp, Mus musculus
acggctgtcttgctcactggttgga

SEQ ID NO: 121966 - DNA, 25 bp, Mus musculus
acggctgtcttggtcactggttgga

SEQ ID NO: 121967 - DNA, 25 bp, Mus musculus
acggctgtgaacacaggtcacctga

SEQ ID NO: 121968 - DNA, 25 bp, Mus musculus
acggctgtgaactcaggtcacctga

SEQ ID NO: 121969 - DNA, 25 bp, Mus musculus
acggctgtgactatcggcacctgga

SEQ ID NO: 121970 - DNA, 25 bp, Mus musculus
acggctgtgactttcggcacctgga

SEQ ID NO: 121971 - DNA, 25 bp, Mus musculus
acggctgtgcagacacaaggactat

SEQ ID NO: 121972 - DNA, 25 bp, Mus musculus
acggctgtgcagtcacaaggactat

SEQ ID NO: 121973 - DNA, 25 bp, Mus musculus
acggctgtttgtaactagctcttta

SEQ ID NO: 121974 - DNA, 25 bp, Mus musculus
acggctgtttgttactagctcttta

SEQ ID NO: 121975 - DNA, 25 bp, Mus musculus
acggcttcagagacccttttgagtg

SEQ ID NO: 121976 - DNA, 25 bp, Mus musculus
acggcttcagagtcccttttgagtg

SEQ ID NO: 121977 - DNA, 25 bp, Mus musculus
acggcttcatagagagaccccacct

SEQ ID NO: 121978 - DNA, 25 bp, Mus musculus
acggcttcatagtgagaccccacct

SEQ ID NO: 121979 - DNA, 25 bp, Mus musculus
acggcttcatctccgggtggcctgc

SEQ ID NO: 121980 - DNA, 25 bp, Mus musculus
acggcttcatctgcgggtggcctgc

SEQ ID NO: 121981 - DNA, 25 bp, Mus musculus
acggcttccactatggtccagagta

SEQ ID NO: 121982 - DNA, 25 bp, Mus musculus
acggcttccactttggtccagagta

SEQ ID NO: 121983 - DNA, 25 bp, Mus musculus
acggcttccctccaaaatgctagta

SEQ ID NO: 121984 - DNA, 25 bp, Mus musculus
acggcttccctcgaaaatgctagta

SEQ ID NO: 121985 - DNA, 25 bp, Mus musculus
acggcttccctgaaagataacttga

SEQ ID NO: 121986 - DNA, 25 bp, Mus musculus
acggcttccctgtaagataacttga

SEQ ID NO: 121987 - DNA, 25 bp, Mus musculus
acggcttctttgagacctcggtcga

SEQ ID NO: 121988 - DNA, 25 bp, Mus musculus
acggcttctttgtgacctcggtcga

SEQ ID NO: 121989 - DNA, 25 bp, Mus musculus
acggcttgctcaaccagtgttttta

SEQ ID NO: 121990 - DNA, 25 bp, Mus musculus
acggcttgctcacgttctgcttgtg

SEQ ID NO: 121991 - DNA, 25 bp, Mus musculus
acggcttgctcaggttctgcttgtg

SEQ ID NO: 121992 - DNA, 25 bp, Mus musculus
acggcttgctcatccagtgttttta

SEQ ID NO: 121993 - DNA, 25 bp, Mus musculus
acggcttgcttcagggtaagagccc

SEQ ID NO: 121994 - DNA, 25 bp, Mus musculus
acggcttgcttctgggtaagagccc

SEQ ID NO: 121995 - DNA, 25 bp, Mus musculus
acggcttggacacgagttcacctcc

SEQ ID NO: 121996 - DNA, 25 bp, Mus musculus
acggcttggacaggagttcacctcc

SEQ ID NO: 121997 - DNA, 25 bp, Mus musculus
acggcttgtaacagtatacccgcaa

SEQ ID NO: 121998 - DNA, 25 bp, Mus musculus
acggcttgtaactgtatacccgcaa

SEQ ID NO: 121999 - DNA, 25 bp, Mus musculus
acggctttcaccattgtcgtgacac

SEQ ID NO: 122000 - DNA, 25 bp, Mus musculus
acggctttcacctttgtcgtgacac

SEQ ID NO: 122001 - DNA, 25 bp, Mus musculus
acggctttggaaacggccaccatag

SEQ ID NO: 122002 - DNA, 25 bp, Mus musculus
acggctttggaatcggccaccatag

SEQ ID NO: 122003 - DNA, 25 bp, Mus musculus
acggctttgggtcaggcttccttgc

SEQ ID NO: 122004 - DNA, 25 bp, Mus musculus
acggctttgggtgaggcttccttgc

SEQ ID NO: 122005 - DNA, 25 bp, Mus musculus
acggctttgtaaacccaaatgctga

SEQ ID NO: 122006 - DNA, 25 bp, Mus musculus
acggctttgtaatcccaaatgctga

SEQ ID NO: 122007 - DNA, 25 bp, Mus musculus
acggctttgtacagtggaatgtgct

SEQ ID NO: 122008 - DNA, 25 bp, Mus musculus
acggctttgtactgtggaatgtgct

SEQ ID NO: 122009 - DNA, 25 bp, Mus musculus
acgggaaacacactcatcttcgcga

SEQ ID NO: 122010 - DNA, 25 bp, Mus musculus
acgggaaacacagtcatcttcgcga

SEQ ID NO: 122011 - DNA, 25 bp, Mus musculus
acgggaacatcaaggccttcatctc

SEQ ID NO: 122012 - DNA, 25 bp, Mus musculus
acgggaacatcatggccttcatctc

SEQ ID NO: 122013 - DNA, 25 bp, Mus musculus
acgggaaccactcgccagaaggcaa

SEQ ID NO: 122014 - DNA, 25 bp, Mus musculus
acgggaaccactggccagaaggcaa

SEQ ID NO: 122015 - DNA, 25 bp, Mus musculus
acgggaactttcaacgattaatgct

SEQ ID NO: 122016 - DNA, 25 bp, Mus musculus
acgggaactttctacgattaatgct

SEQ ID NO: 122017 - DNA, 25 bp, Mus musculus
acgggaagaactctacatcctgact

SEQ ID NO: 122018 - DNA, 25 bp, Mus musculus
acgggaagaactgtacatcctgact

SEQ ID NO: 122019 - DNA, 25 bp, Mus musculus
acgggaaggcccatgtgtttgactt

SEQ ID NO: 122020 - DNA, 25 bp, Mus musculus
acgggaaggcccttgtgtttgactt

SEQ ID NO: 122021 - DNA, 25 bp, Mus musculus
acgggaatatccaattagcaccgat

SEQ ID NO: 122022 - DNA, 25 bp, Mus musculus
acgggaatatcctattagcaccgat

SEQ ID NO: 122023 - DNA, 25 bp, Mus musculus
acgggaatgtctctggaccttactt

SEQ ID NO: 122024 - DNA, 25 bp, Mus musculus
acgggaatgtctgtggaccttactt

SEQ ID NO: 122025 - DNA, 25 bp, Mus musculus
acgggacaaactcctatgactactt

SEQ ID NO: 122026 - DNA, 25 bp, Mus musculus
acgggacaaactgctatgactactt

SEQ ID NO: 122027 - DNA, 25 bp, Mus musculus
acgggacactcgaggctttgaatgg

SEQ ID NO: 122028 - DNA, 25 bp, Mus musculus
acgggacactcgtggctttgaatgg

SEQ ID NO: 122029 - DNA, 25 bp, Mus musculus
acgggacagtaacccagctggcacc

SEQ ID NO: 122030 - DNA, 25 bp, Mus musculus
acgggacagtaagccagctggcacc

SEQ ID NO: 122031 - DNA, 25 bp, Mus musculus
acgggacagtgacccgaggaaccct

SEQ ID NO: 122032 - DNA, 25 bp, Mus musculus
acgggacagtgagccgaggaaccct

SEQ ID NO: 122033 - DNA, 25 bp, Mus musculus
acgggaccacgaaagccattgagct

SEQ ID NO: 122034 - DNA, 25 bp, Mus musculus
acgggaccacgatagccattgagct

SEQ ID NO: 122035 - DNA, 25 bp, Mus musculus
acgggaccagacagctccaaagtgc

SEQ ID NO: 122036 - DNA, 25 bp, Mus musculus
acgggaccagactgctccaaagtgc

SEQ ID NO: 122037 - DNA, 25 bp, Mus musculus
acgggacgctgcaggtcaacgacgt

SEQ ID NO: 122038 - DNA, 25 bp, Mus musculus
acgggacgctgctggtcaacgacgt

SEQ ID NO: 122039 - DNA, 25 bp, Mus musculus
acgggactcacaaaagctttgcttc

SEQ ID NO: 122040 - DNA, 25 bp, Mus musculus
acgggactcacataagctttgcttc

SEQ ID NO: 122041 - DNA, 25 bp, Mus musculus
acgggactcactcgactggacttct

SEQ ID NO: 122042 - DNA, 25 bp, Mus musculus
acgggactcactggactggacttct

SEQ ID NO: 122043 - DNA, 25 bp, Mus musculus
acgggactccccactgtgttaatat

SEQ ID NO: 122044 - DNA, 25 bp, Mus musculus
acgggactcccctctgtgttaatat

SEQ ID NO: 122045 - DNA, 25 bp, Mus musculus
acgggactctatcttcaactcaact

SEQ ID NO: 122046 - DNA, 25 bp, Mus musculus
acgggactctatgttcaactcaact

SEQ ID NO: 122047 - DNA, 25 bp, Mus musculus
acgggactctcacccgggaagattt

SEQ ID NO: 122048 - DNA, 25 bp, Mus musculus
acgggactctcagccgggaagattt

SEQ ID NO: 122049 - DNA, 25 bp, Mus musculus
acgggacttcaacatattactgata

SEQ ID NO: 122050 - DNA, 25 bp, Mus musculus
acgggacttcaagatattactgata

SEQ ID NO: 122051 - DNA, 25 bp, Mus musculus
acgggacttgttcttgtgttcacac

SEQ ID NO: 122052 - DNA, 25 bp, Mus musculus
acgggacttgttgttgtgttcacac

SEQ ID NO: 122053 - DNA, 25 bp, Mus musculus
acgggagacttcaaagcccagagtt

SEQ ID NO: 122054 - DNA, 25 bp, Mus musculus
acgggagacttctaagcccagagtt

SEQ ID NO: 122055 - DNA, 25 bp, Mus musculus
acgggagatggaaaaagctgcttca

SEQ ID NO: 122056 - DNA, 25 bp, Mus musculus
acgggagatggataaagctgcttca

SEQ ID NO: 122057 - DNA, 25 bp, Mus musculus
acgggagcctttcagctcatctata

SEQ ID NO: 122058 - DNA, 25 bp, Mus musculus
acgggagcctttgagctcatctata

SEQ ID NO: 122059 - DNA, 25 bp, Mus musculus
acgggagctggccaagacctctctg

SEQ ID NO: 122060 - DNA, 25 bp, Mus musculus
acgggagctggcgaagacctctctg

SEQ ID NO: 122061 - DNA, 25 bp, Mus musculus
acgggagctgtcataagtactaaat

SEQ ID NO: 122062 - DNA, 25 bp, Mus musculus
acgggagctgtcttaagtactaaat

SEQ ID NO: 122063 - DNA, 25 bp, Mus musculus
acgggagcttagagagacctgtgtt

SEQ ID NO: 122064 - DNA, 25 bp, Mus musculus
acgggagcttagtgagacctgtgtt

SEQ ID NO: 122065 - DNA, 25 bp, Mus musculus
acgggaggctgcatcattaagttca

SEQ ID NO: 122066 - DNA, 25 bp, Mus musculus
acgggaggctgcttcattaagttca

SEQ ID NO: 122067 - DNA, 25 bp, Mus musculus
acgggaggcttaacatatgaagaca

SEQ ID NO: 122068 - DNA, 25 bp, Mus musculus
acgggaggcttatcatatgaagaca

SEQ ID NO: 122069 - DNA, 25 bp, Mus musculus
acgggagtgaccaggaagtacaaat

SEQ ID NO: 122070 - DNA, 25 bp, Mus musculus
acgggagtgacctggaagtacaaat

SEQ ID NO: 122071 - DNA, 25 bp, Mus musculus
acgggagttattagtttcacagcaa

SEQ ID NO: 122072 - DNA, 25 bp, Mus musculus
acgggagttatttgtttcacagcaa

SEQ ID NO: 122073 - DNA, 25 bp, Mus musculus
acgggatagctgacctgttagaatc

SEQ ID NO: 122074 - DNA, 25 bp, Mus musculus
acgggatagctgtcctgttagaatc

SEQ ID NO: 122075 - DNA, 25 bp, Mus musculus
acgggatcatgcatttccatgtgaa

SEQ ID NO: 122076 - DNA, 25 bp, Mus musculus
acgggatcatgcttttccatgtgaa

SEQ ID NO: 122077 - DNA, 25 bp, Mus musculus
acgggatcgtccagagtcactcaaa

SEQ ID NO: 122078 - DNA, 25 bp, Mus musculus
acgggatcgtcctgagtcactcaaa

SEQ ID NO: 122079 - DNA, 25 bp, Mus musculus
acgggatcgtggcaaccattgtcaa

SEQ ID NO: 122080 - DNA, 25 bp, Mus musculus
acgggatcgtgggaaccattgtcaa

SEQ ID NO: 122081 - DNA, 25 bp, Mus musculus
acgggatggtgtaaggaaacacatc

SEQ ID NO: 122082 - DNA, 25 bp, Mus musculus
acgggatggtgttaggaaacacatc

SEQ ID NO: 122083 - DNA, 25 bp, Mus musculus
acgggcaaagtcagctggattggct

SEQ ID NO: 122084 - DNA, 25 bp, Mus musculus
acgggcaaagtctgctggattggct

SEQ ID NO: 122085 - DNA, 25 bp, Mus musculus
acgggcaacactcgaagtaaaagca

SEQ ID NO: 122086 - DNA, 25 bp, Mus musculus
acgggcaacactggaagtaaaagca

SEQ ID NO: 122087 - DNA, 25 bp, Mus musculus
acgggcaagtgacactgtggacctc

SEQ ID NO: 122088 - DNA, 25 bp, Mus musculus
acgggcaagtgagactgtggacctc

SEQ ID NO: 122089 - DNA, 25 bp, Mus musculus
acgggcactacccaggtcaagtcaa

SEQ ID NO: 122090 - DNA, 25 bp, Mus musculus
acgggcactaccgaggtcaagtcaa

SEQ ID NO: 122091 - DNA, 25 bp, Mus musculus
acgggcactttcatacagttcgttg

SEQ ID NO: 122092 - DNA, 25 bp, Mus musculus
acgggcactttcttacagttcgttg

SEQ ID NO: 122093 - DNA, 25 bp, Mus musculus
acgggcagagaaaaagaccaccaag

SEQ ID NO: 122094 - DNA, 25 bp, Mus musculus
acgggcagagaataagaccaccaag

SEQ ID NO: 122095 - DNA, 25 bp, Mus musculus
acgggcaggacccactgctggaaaa

SEQ ID NO: 122096 - DNA, 25 bp, Mus musculus
acgggcaggaccgactgctggaaaa

SEQ ID NO: 122097 - DNA, 25 bp, Mus musculus
acgggcatccaacgtggacatcaat

SEQ ID NO: 122098 - DNA, 25 bp, Mus musculus
acgggcatccaaggtggacatcaat

SEQ ID NO: 122099 - DNA, 25 bp, Mus musculus
acgggcatccctactccgaacaaag

SEQ ID NO: 122100 - DNA, 25 bp, Mus musculus
acgggcatcccttctccgaacaaag

SEQ ID NO: 122101 - DNA, 25 bp, Mus musculus
acgggcatcgcaactgggtgcacaa

SEQ ID NO: 122102 - DNA, 25 bp, Mus musculus
acgggcatcgcatctgggtgcacaa

SEQ ID NO: 122103 - DNA, 25 bp, Mus musculus
acgggccacgacagtgaacctggtg

SEQ ID NO: 122104 - DNA, 25 bp, Mus musculus
acgggccacgactgtgaacctggtg

SEQ ID NO: 122105 - DNA, 25 bp, Mus musculus
acgggccagaacatcacagcggagt

SEQ ID NO: 122106 - DNA, 25 bp, Mus musculus
acgggccagaacttcacagcggagt

SEQ ID NO: 122107 - DNA, 25 bp, Mus musculus
acgggccagcttatagattttcagt

SEQ ID NO: 122108 - DNA, 25 bp, Mus musculus
acgggccagcttttagattttcagt

SEQ ID NO: 122109 - DNA, 25 bp, Mus musculus
acgggccatgaaaactactggtgag

SEQ ID NO: 122110 - DNA, 25 bp, Mus musculus
acgggccatgaatactactggtgag

SEQ ID NO: 122111 - DNA, 25 bp, Mus musculus
acgggccatgtgagcaccaactcat

SEQ ID NO: 122112 - DNA, 25 bp, Mus musculus
acgggccatgtgtgcaccaactcat

SEQ ID NO: 122113 - DNA, 25 bp, Mus musculus
acgggccattgcattgcagctttca

SEQ ID NO: 122114 - DNA, 25 bp, Mus musculus
acgggccattgctttgcagctttca

SEQ ID NO: 122115 - DNA, 25 bp, Mus musculus
acgggccccttactgtcaatgtctt

SEQ ID NO: 122116 - DNA, 25 bp, Mus musculus
acgggccccttagtgtcaatgtctt

SEQ ID NO: 122117 - DNA, 25 bp, Mus musculus
acgggcccttttcagtagcggtgct

SEQ ID NO: 122118 - DNA, 25 bp, Mus musculus
acgggcccttttgagtagcggtgct

SEQ ID NO: 122119 - DNA, 25 bp, Mus musculus
acgggccggcaaacacaaaggtcaa

SEQ ID NO: 122120 - DNA, 25 bp, Mus musculus
acgggccggcaatcacaaaggtcaa

SEQ ID NO: 122121 - DNA, 25 bp, Mus musculus
acgggccgtcaacatgcctctgtag

SEQ ID NO: 122122 - DNA, 25 bp, Mus musculus
acgggccgtcaagatgcctctgtag

SEQ ID NO: 122123 - DNA, 25 bp, Mus musculus
acgggcctcataattgtgttacaat

SEQ ID NO: 122124 - DNA, 25 bp, Mus musculus
acgggcctcatatttgtgttacaat

SEQ ID NO: 122125 - DNA, 25 bp, Mus musculus
acgggcctccttcatcactgatggg

SEQ ID NO: 122126 - DNA, 25 bp, Mus musculus
acgggcctccttgatcactgatggg

SEQ ID NO: 122127 - DNA, 25 bp, Mus musculus
acgggcctgatgcacaacatgctgc

SEQ ID NO: 122128 - DNA, 25 bp, Mus musculus
acgggcctgatggacaacatgctgc

SEQ ID NO: 122129 - DNA, 25 bp, Mus musculus
acgggcctgcctagtgtgctactta

SEQ ID NO: 122130 - DNA, 25 bp, Mus musculus
acgggcctgccttgtgtgctactta

SEQ ID NO: 122131 - DNA, 25 bp, Mus musculus
acgggccttaaaccatagatattaa

SEQ ID NO: 122132 - DNA, 25 bp, Mus musculus
acgggccttaaagcatagatattaa

SEQ ID NO: 122133 - DNA, 25 bp, Mus musculus
acgggccttctaagtgaactctgca

SEQ ID NO: 122134 - DNA, 25 bp, Mus musculus
acgggccttctatgtgaactctgca

SEQ ID NO: 122135 - DNA, 25 bp, Mus musculus
acgggcgagagaagctccaaagctt

SEQ ID NO: 122136 - DNA, 25 bp, Mus musculus
acgggcgagagatgctccaaagctt

SEQ ID NO: 122137 - DNA, 25 bp, Mus musculus
acgggcgcacgcagtgcttcctgtg

SEQ ID NO: 122138 - DNA, 25 bp, Mus musculus
acgggcgcacgctgtgcttcctgtg

SEQ ID NO: 122139 - DNA, 25 bp, Mus musculus
acgggcgcccagagcaccacgtgtg

SEQ ID NO: 122140 - DNA, 25 bp, Mus musculus
acgggcgcccagtgcaccacgtgtg

SEQ ID NO: 122141 - DNA, 25 bp, Mus musculus
acgggcgcctgtcatgaacacatgg

SEQ ID NO: 122142 - DNA, 25 bp, Mus musculus
acgggcgcctgtgatgaacacatgg

SEQ ID NO: 122143 - DNA, 25 bp, Mus musculus
acgggcgtgcagcaggtcagaacca

SEQ ID NO: 122144 - DNA, 25 bp, Mus musculus
acgggcgtgcaggaggtcagaacca

SEQ ID NO: 122145 - DNA, 25 bp, Mus musculus
acgggctcaactctcctgggtgata

SEQ ID NO: 122146 - DNA, 25 bp, Mus musculus
acgggctcaactgtcctgggtgata

SEQ ID NO: 122147 - DNA, 25 bp, Mus musculus
acgggctcatgtatgccttgtattt

SEQ ID NO: 122148 - DNA, 25 bp, Mus musculus
acgggctcatgtttgccttgtattt

SEQ ID NO: 122149 - DNA, 25 bp, Mus musculus
acgggctccgcactaaggcttgctt

SEQ ID NO: 122150 - DNA, 25 bp, Mus musculus
acgggctccgcagtaaggcttgctt

SEQ ID NO: 122151 - DNA, 25 bp, Mus musculus
acgggctcgcttccttgagagaaag

SEQ ID NO: 122152 - DNA, 25 bp, Mus musculus
acgggctcgcttgcttgagagaaag

SEQ ID NO: 122153 - DNA, 25 bp, Mus musculus
acgggctctgctactctataagggc

SEQ ID NO: 122154 - DNA, 25 bp, Mus musculus
acgggctctgcttctctataagggc

SEQ ID NO: 122155 - DNA, 25 bp, Mus musculus
acgggctctggtccaagatctaatt

SEQ ID NO: 122156 - DNA, 25 bp, Mus musculus
acgggctctggtgcaagatctaatt

SEQ ID NO: 122157 - DNA, 25 bp, Mus musculus
acgggctgccaaatgtactcaggta

SEQ ID NO: 122158 - DNA, 25 bp, Mus musculus
acgggctgccaattgtactcaggta

SEQ ID NO: 122159 - DNA, 25 bp, Mus musculus
acgggctggcctacattctaaggtg

SEQ ID NO: 122160 - DNA, 25 bp, Mus musculus
acgggctggccttcattctaaggtg

SEQ ID NO: 122161 - DNA, 25 bp, Mus musculus
acgggctgggtaaagtcacatggac

SEQ ID NO: 122162 - DNA, 25 bp, Mus musculus
acgggctgggtatagtcacatggac

SEQ ID NO: 122163 - DNA, 25 bp, Mus musculus
acgggctggtgcatcctgccagttg

SEQ ID NO: 122164 - DNA, 25 bp, Mus musculus
acgggctggtgcttcctgccagttg

SEQ ID NO: 122165 - DNA, 25 bp, Mus musculus
acgggctgtggacgcttagctatcc

SEQ ID NO: 122166 - DNA, 25 bp, Mus musculus
acgggctgtggaggcttagctatcc

SEQ ID NO: 122167 - DNA, 25 bp, Mus musculus
acgggcttacaaccagatactcact

SEQ ID NO: 122168 - DNA, 25 bp, Mus musculus
acgggcttacaagcagatactcact

SEQ ID NO: 122169 - DNA, 25 bp, Mus musculus
acgggcttcacgctggagttccgct

SEQ ID NO: 122170 - DNA, 25 bp, Mus musculus
acgggcttcacggtggagttccgct

SEQ ID NO: 122171 - DNA, 25 bp, Mus musculus
acgggcttccatagatcctttgatg

SEQ ID NO: 122172 - DNA, 25 bp, Mus musculus
acgggcttccattgatcctttgatg

SEQ ID NO: 122173 - DNA, 25 bp, Mus musculus
acgggcttgcacaactaccatcagg

SEQ ID NO: 122174 - DNA, 25 bp, Mus musculus
acgggcttgcactactaccatcagg

SEQ ID NO: 122175 - DNA, 25 bp, Mus musculus
acggggcttgagaactatggtacct

SEQ ID NO: 122176 - DNA, 25 bp, Mus musculus
acggggcttgagtactatggtacct

SEQ ID NO: 122177 - DNA, 25 bp, Mus musculus
acgggggtctccctaaatagctgtg

SEQ ID NO: 122178 - DNA, 25 bp, Mus musculus
acgggggtctccgtaaatagctgtg

SEQ ID NO: 122179 - DNA, 25 bp, Mus musculus
acgggtaacagcagagtccagcgtt

SEQ ID NO: 122180 - DNA, 25 bp, Mus musculus
acgggtaacagctgagtccagcgtt

SEQ ID NO: 122181 - DNA, 25 bp, Mus musculus
acgggtaagacccttctgtgtgcat

SEQ ID NO: 122182 - DNA, 25 bp, Mus musculus
acgggtaagaccgttctgtgtgcat

SEQ ID NO: 122183 - DNA, 25 bp, Mus musculus
acgggtacaaggagcagttcctggt

SEQ ID NO: 122184 - DNA, 25 bp, Mus musculus
acgggtacaaggatatgagggctat

SEQ ID NO: 122185 - DNA, 25 bp, Mus musculus
acgggtacaaggtgcagttcctggt

SEQ ID NO: 122186 - DNA, 25 bp, Mus musculus
acgggtacaaggttatgagggctat

SEQ ID NO: 122187 - DNA, 25 bp, Mus musculus
acgggtacactcaaaatatatcatt

SEQ ID NO: 122188 - DNA, 25 bp, Mus musculus
acgggtacactctaaatatatcatt

SEQ ID NO: 122189 - DNA, 25 bp, Mus musculus
acgggtacattccaggcaagaacag

SEQ ID NO: 122190 - DNA, 25 bp, Mus musculus
acgggtacattcgaggcaagaacag

SEQ ID NO: 122191 - DNA, 25 bp, Mus musculus
acgggtacttgtattacactgtgat

SEQ ID NO: 122192 - DNA, 25 bp, Mus musculus
acgggtacttgttttacactgtgat

SEQ ID NO: 122193 - DNA, 25 bp, Mus musculus
acgggtatctgactacaagcatcat

SEQ ID NO: 122194 - DNA, 25 bp, Mus musculus
acgggtatctgagtacaagcatcat

SEQ ID NO: 122195 - DNA, 25 bp, Mus musculus
acgggtattcacaaaatactctctt

SEQ ID NO: 122196 - DNA, 25 bp, Mus musculus
acgggtattcactaaatactctctt

SEQ ID NO: 122197 - DNA, 25 bp, Mus musculus
acgggtcacatgagctgaactcatt

SEQ ID NO: 122198 - DNA, 25 bp, Mus musculus
acgggtcacatgtgctgaactcatt

SEQ ID NO: 122199 - DNA, 25 bp, Mus musculus
acgggtcactgcatagttgctttta

SEQ ID NO: 122200 - DNA, 25 bp, Mus musculus
acgggtcactgcttagttgctttta

SEQ ID NO: 122201 - DNA, 25 bp, Mus musculus
acgggtccaggtcgcccatgcaaag

SEQ ID NO: 122202 - DNA, 25 bp, Mus musculus
acgggtccaggtggcccatgcaaag

SEQ ID NO: 122203 - DNA, 25 bp, Mus musculus
acgggtcctgggacttacaatgagt

SEQ ID NO: 122204 - DNA, 25 bp, Mus musculus
acgggtcctgggtcttacaatgagt

SEQ ID NO: 122205 - DNA, 25 bp, Mus musculus
acgggtctctatcgtcactgaggaa

SEQ ID NO: 122206 - DNA, 25 bp, Mus musculus
acgggtctctatggtcactgaggaa

SEQ ID NO: 122207 - DNA, 25 bp, Mus musculus
acgggtctgaaccactccattaagt

SEQ ID NO: 122208 - DNA, 25 bp, Mus musculus
acgggtctgaacgactccattaagt

SEQ ID NO: 122209 - DNA, 25 bp, Mus musculus
acgggtctgctcctgctgtcagtac

SEQ ID NO: 122210 - DNA, 25 bp, Mus musculus
acgggtctgctcgtgctgtcagtac

SEQ ID NO: 122211 - DNA, 25 bp, Mus musculus
acgggtctggccaaggcttatagtt

SEQ ID NO: 122212 - DNA, 25 bp, Mus musculus
acgggtctggcctaggcttatagtt

SEQ ID NO: 122213 - DNA, 25 bp, Mus musculus
acgggtctgggcaaagccatacaca

SEQ ID NO: 122214 - DNA, 25 bp, Mus musculus
acgggtctgggctaagccatacaca

SEQ ID NO: 122215 - DNA, 25 bp, Mus musculus
acgggtgaactacttgtggacttga

SEQ ID NO: 122216 - DNA, 25 bp, Mus musculus
acgggtgaactagttgtggacttga

SEQ ID NO: 122217 - DNA, 25 bp, Mus musculus
acgggtgacactacagggacatgga

SEQ ID NO: 122218 - DNA, 25 bp, Mus musculus
acgggtgacacttcagggacatgga

SEQ ID NO: 122219 - DNA, 25 bp, Mus musculus
acgggtgatcttacttgaatcgctc

SEQ ID NO: 122220 - DNA, 25 bp, Mus musculus
acgggtgatctttcttgaatcgctc

SEQ ID NO: 122221 - DNA, 25 bp, Mus musculus
acgggtgcacacagatttacagaca

SEQ ID NO: 122222 - DNA, 25 bp, Mus musculus
acgggtgcacactgatttacagaca

SEQ ID NO: 122223 - DNA, 25 bp, Mus musculus
acgggtgcagcaaggctccaacagg

SEQ ID NO: 122224 - DNA, 25 bp, Mus musculus
acgggtgcagcatggctccaacagg

SEQ ID NO: 122225 - DNA, 25 bp, Mus musculus
acgggtggaggcaaaggcacttgca

SEQ ID NO: 122226 - DNA, 25 bp, Mus musculus
acgggtggaggctaaggcacttgca

SEQ ID NO: 122227 - DNA, 25 bp, Mus musculus
acgggtggccaaagtgtgcctgcct

SEQ ID NO: 122228 - DNA, 25 bp, Mus musculus
acgggtggccaatgtgtgcctgcct

SEQ ID NO: 122229 - DNA, 25 bp, Mus musculus
acgggtggctctagtaccaggagaa

SEQ ID NO: 122230 - DNA, 25 bp, Mus musculus
acgggtggctcttgtaccaggagaa

SEQ ID NO: 122231 - DNA, 25 bp, Mus musculus
acgggtgtaactagctctggaggca

SEQ ID NO: 122232 - DNA, 25 bp, Mus musculus
acgggtgtaacttgctctggaggca

SEQ ID NO: 122233 - DNA, 25 bp, Mus musculus
acgggtgtctctcatcttgtaaaaa

SEQ ID NO: 122234 - DNA, 25 bp, Mus musculus
acgggtgtctctgatcttgtaaaaa

SEQ ID NO: 122235 - DNA, 25 bp, Mus musculus
acgggtgtggaacagcaccttcatt

SEQ ID NO: 122236 - DNA, 25 bp, Mus musculus
acgggtgtggaagagcaccttcatt

SEQ ID NO: 122237 - DNA, 25 bp, Mus musculus
acgggttcatacatatattccctgt

SEQ ID NO: 122238 - DNA, 25 bp, Mus musculus
acgggttcatacttatattccctgt

SEQ ID NO: 122239 - DNA, 25 bp, Mus musculus
acgggttgtcccaggctatggccat

SEQ ID NO: 122240 - DNA, 25 bp, Mus musculus
acgggttgtccctggctatggccat

SEQ ID NO: 122241 - DNA, 25 bp, Mus musculus
acgggttttgtaagtgctgtctcaa

SEQ ID NO: 122242 - DNA, 25 bp, Mus musculus
acgggttttgtatgtgctgtctcaa

SEQ ID NO: 122243 - DNA, 25 bp, Mus musculus
acggtaaagcagcaccatgcctcaa

SEQ ID NO: 122244 - DNA, 25 bp, Mus musculus
acggtaaagcaggaccatgcctcaa

SEQ ID NO: 122245 - DNA, 25 bp, Mus musculus
acggtaaggtctctttcaaagctct

SEQ ID NO: 122246 - DNA, 25 bp, Mus musculus
acggtaaggtctgtttcaaagctct

SEQ ID NO: 122247 - DNA, 25 bp, Mus musculus
acggtacacggtcctagctgagagc

SEQ ID NO: 122248 - DNA, 25 bp, Mus musculus
acggtacacggtgctagctgagagc

SEQ ID NO: 122249 - DNA, 25 bp, Mus musculus
acggtaccacgtagattagtctgaa

SEQ ID NO: 122250 - DNA, 25 bp, Mus musculus
acggtaccacgttgattagtctgaa

SEQ ID NO: 122251 - DNA, 25 bp, Mus musculus
acggtaccagtgcaagctgcgtccg

SEQ ID NO: 122252 - DNA, 25 bp, Mus musculus
acggtaccagtggaagctgcgtccg

SEQ ID NO: 122253 - DNA, 25 bp, Mus musculus
acggtaccggcaattaggattctca

SEQ ID NO: 122254 - DNA, 25 bp, Mus musculus
acggtaccggcatttaggattctca

SEQ ID NO: 122255 - DNA, 25 bp, Mus musculus
acggtactgtggagtctggtgaaaa

SEQ ID NO: 122256 - DNA, 25 bp, Mus musculus
acggtactgtggtgtctggtgaaaa

SEQ ID NO: 122257 - DNA, 25 bp, Mus musculus
acggtactttttcctcatcattatg

SEQ ID NO: 122258 - DNA, 25 bp, Mus musculus
acggtactttttgctcatcattatg

SEQ ID NO: 122259 - DNA, 25 bp, Mus musculus
acggtagcctcccagggtcactggt

SEQ ID NO: 122260 - DNA, 25 bp, Mus musculus
acggtagcctccgagggtcactggt

SEQ ID NO: 122261 - DNA, 25 bp, Mus musculus
acggtagcgctccaagaggttcctc

SEQ ID NO: 122262 - DNA, 25 bp, Mus musculus
acggtagcgctcgaagaggttcctc

SEQ ID NO: 122263 - DNA, 25 bp, Mus musculus
acggtaggcacactggacccttcca

SEQ ID NO: 122264 - DNA, 25 bp, Mus musculus
acggtaggcacagtggacccttcca

SEQ ID NO: 122265 - DNA, 25 bp, Mus musculus
acggtagtagctcgtttgcttactg

SEQ ID NO: 122266 - DNA, 25 bp, Mus musculus
acggtagtagctggtttgcttactg

SEQ ID NO: 122267 - DNA, 25 bp, Mus musculus
acggtattcaccagccagacaaggc

SEQ ID NO: 122268 - DNA, 25 bp, Mus musculus
acggtattcacctgccagacaaggc

SEQ ID NO: 122269 - DNA, 25 bp, Mus musculus
acggtcaacgttcagagaggcaagc

SEQ ID NO: 122270 - DNA, 25 bp, Mus musculus
acggtcaacgttgagagaggcaagc

SEQ ID NO: 122271 - DNA, 25 bp, Mus musculus
acggtcaacttgctcagagcccaga

SEQ ID NO: 122272 - DNA, 25 bp, Mus musculus
acggtcaacttggtcagagcccaga

SEQ ID NO: 122273 - DNA, 25 bp, Mus musculus
acggtcaccgtgaccatggacctcg

SEQ ID NO: 122274 - DNA, 25 bp, Mus musculus
acggtcaccgtgtccatggacctcg

SEQ ID NO: 122275 - DNA, 25 bp, Mus musculus
acggtcagccacactctgggataaa

SEQ ID NO: 122276 - DNA, 25 bp, Mus musculus
acggtcagccactctctgggataaa

SEQ ID NO: 122277 - DNA, 25 bp, Mus musculus
acggtcatcgttatcagcctggtga

SEQ ID NO: 122278 - DNA, 25 bp, Mus musculus
acggtcatcgttttcagcctggtga

SEQ ID NO: 122279 - DNA, 25 bp, Mus musculus
acggtcatgaacacactgctcagga

SEQ ID NO: 122280 - DNA, 25 bp, Mus musculus
acggtcatgaactcactgctcagga

SEQ ID NO: 122281 - DNA, 25 bp, Mus musculus
acggtcattactccgaactccattt

SEQ ID NO: 122282 - DNA, 25 bp, Mus musculus
acggtcattactgcgaactccattt

SEQ ID NO: 122283 - DNA, 25 bp, Mus musculus
acggtcattgtgagcgaagtcacca

SEQ ID NO: 122284 - DNA, 25 bp, Mus musculus
acggtcattgtgtgcgaagtcacca

SEQ ID NO: 122285 - DNA, 25 bp, Mus musculus
acggtccacactatcccaaatggct

SEQ ID NO: 122286 - DNA, 25 bp, Mus musculus
acggtccacactttcccaaatggct

SEQ ID NO: 122287 - DNA, 25 bp, Mus musculus
acggtccctggacgagcagacagaa

SEQ ID NO: 122288 - DNA, 25 bp, Mus musculus
acggtccctggaggagcagacagaa

SEQ ID NO: 122289 - DNA, 25 bp, Mus musculus
acggtccgctcacacaagctgaaaa

SEQ ID NO: 122290 - DNA, 25 bp, Mus musculus
acggtccgctcagacaagctgaaaa

SEQ ID NO: 122291 - DNA, 25 bp, Mus musculus
acggtccggttcatgaatccagagg

SEQ ID NO: 122292 - DNA, 25 bp, Mus musculus
acggtccggttcttgaatccagagg

SEQ ID NO: 122293 - DNA, 25 bp, Mus musculus
acggtcctagtgagcagacgccgga

SEQ ID NO: 122294 - DNA, 25 bp, Mus musculus
acggtcctagtgtgcagacgccgga

SEQ ID NO: 122295 - DNA, 25 bp, Mus musculus
acggtcctgcagagtgggcccatgt

SEQ ID NO: 122296 - DNA, 25 bp, Mus musculus
acggtcctgcagtgtgggcccatgt

SEQ ID NO: 122297 - DNA, 25 bp, Mus musculus
acggtccttatcaacactcacagaa

SEQ ID NO: 122298 - DNA, 25 bp, Mus musculus
acggtccttatctacactcacagaa

SEQ ID NO: 122299 - DNA, 25 bp, Mus musculus
acggtcgaggtcacgctgtacactg

SEQ ID NO: 122300 - DNA, 25 bp, Mus musculus
acggtcgaggtctcgctgtacactg

SEQ ID NO: 122301 - DNA, 25 bp, Mus musculus
acggtcgcaatgctgctaatcctgc

SEQ ID NO: 122302 - DNA, 25 bp, Mus musculus
acggtcgcaatggtgctaatcctgc

SEQ ID NO: 122303 - DNA, 25 bp, Mus musculus
acggtcgccaccataggaagtttga

SEQ ID NO: 122304 - DNA, 25 bp, Mus musculus
acggtcgccaccttaggaagtttga

SEQ ID NO: 122305 - DNA, 25 bp, Mus musculus
acggtcggctcccagcactggtgct

SEQ ID NO: 122306 - DNA, 25 bp, Mus musculus
acggtcggctccgagcactggtgct

SEQ ID NO: 122307 - DNA, 25 bp, Mus musculus
acggtctacagcataggccctaaga

SEQ ID NO: 122308 - DNA, 25 bp, Mus musculus
acggtctacagcttaggccctaaga

SEQ ID NO: 122309 - DNA, 25 bp, Mus musculus
acggtctcatagagcatggcctagg

SEQ ID NO: 122310 - DNA, 25 bp, Mus musculus
acggtctcatagtgcatggcctagg

SEQ ID NO: 122311 - DNA, 25 bp, Mus musculus
acggtctctgaaaagttcctgcttg

SEQ ID NO: 122312 - DNA, 25 bp, Mus musculus
acggtctctgaatagttcctgcttg

SEQ ID NO: 122313 - DNA, 25 bp, Mus musculus
acggtctcttatatatggtgtgatc

SEQ ID NO: 122314 - DNA, 25 bp, Mus musculus
acggtctcttatttatggtgtgatc

SEQ ID NO: 122315 - DNA, 25 bp, Mus musculus
acggtctgcactaatctcacccaag

SEQ ID NO: 122316 - DNA, 25 bp, Mus musculus
acggtctgcacttatctcacccaag

SEQ ID NO: 122317 - DNA, 25 bp, Mus musculus
acggtctggtggatcgatcgaagca

SEQ ID NO: 122318 - DNA, 25 bp, Mus musculus
acggtctggtggttcgatcgaagca

SEQ ID NO: 122319 - DNA, 25 bp, Mus musculus
acggtctgtgccagagctcattgaa

SEQ ID NO: 122320 - DNA, 25 bp, Mus musculus
acggtctgtgcctgagctcattgaa

SEQ ID NO: 122321 - DNA, 25 bp, Mus musculus
acggtcttatagattccagtgttgg

SEQ ID NO: 122322 - DNA, 25 bp, Mus musculus
acggtcttatagtttccagtgttgg

SEQ ID NO: 122323 - DNA, 25 bp, Mus musculus
acggtgacaaacctgtgcgggctca

SEQ ID NO: 122324 - DNA, 25 bp, Mus musculus
acggtgacaaacgtgtgcgggctca

SEQ ID NO: 122325 - DNA, 25 bp, Mus musculus
acggtgacatgtaccctgtgacaat

SEQ ID NO: 122326 - DNA, 25 bp, Mus musculus
acggtgacatgttccctgtgacaat

SEQ ID NO: 122327 - DNA, 25 bp, Mus musculus
acggtgaccatgaatcagttttcca

SEQ ID NO: 122328 - DNA, 25 bp, Mus musculus
acggtgaccatgtatcagttttcca

SEQ ID NO: 122329 - DNA, 25 bp, Mus musculus
acggtgactgatcctggccaaacaa

SEQ ID NO: 122330 - DNA, 25 bp, Mus musculus
acggtgactgatgctggccaaacaa

SEQ ID NO: 122331 - DNA, 25 bp, Mus musculus
acggtgagagtaaccactacgcgct

SEQ ID NO: 122332 - DNA, 25 bp, Mus musculus
acggtgagagtatccactacgcgct

SEQ ID NO: 122333 - DNA, 25 bp, Mus musculus
acggtgatagctactccatcgcaga

SEQ ID NO: 122334 - DNA, 25 bp, Mus musculus
acggtgatagcttctccatcgcaga

SEQ ID NO: 122335 - DNA, 25 bp, Mus musculus
acggtgatcgtgcacgcttgaccgg

SEQ ID NO: 122336 - DNA, 25 bp, Mus musculus
acggtgatcgtggacgcttgaccgg

SEQ ID NO: 122337 - DNA, 25 bp, Mus musculus
acggtgccagcacagtccaaagact

SEQ ID NO: 122338 - DNA, 25 bp, Mus musculus
acggtgccagcagagtccaaagact

SEQ ID NO: 122339 - DNA, 25 bp, Mus musculus
acggtgccaggaaactctgaggacg

SEQ ID NO: 122340 - DNA, 25 bp, Mus musculus
acggtgccaggatactctgaggacg

SEQ ID NO: 122341 - DNA, 25 bp, Mus musculus
acggtgcctgaacatcgagtggatc

SEQ ID NO: 122342 - DNA, 25 bp, Mus musculus
acggtgcctgaagatcgagtggatc

SEQ ID NO: 122343 - DNA, 25 bp, Mus musculus
acggtgcctgtgcaaacttatttac

SEQ ID NO: 122344 - DNA, 25 bp, Mus musculus
acggtgcctgtggaaacttatttac

SEQ ID NO: 122345 - DNA, 25 bp, Mus musculus
acggtgcctttgaacctcagatatt

SEQ ID NO: 122346 - DNA, 25 bp, Mus musculus
acggtgcctttgtacctcagatatt

SEQ ID NO: 122347 - DNA, 25 bp, Mus musculus
acggtgcgacttcaaccaagaatag

SEQ ID NO: 122348 - DNA, 25 bp, Mus musculus
acggtgcgacttgaaccaagaatag

SEQ ID NO: 122349 - DNA, 25 bp, Mus musculus
acggtgctacttcatctgtgtacaa

SEQ ID NO: 122350 - DNA, 25 bp, Mus musculus
acggtgctacttgatctgtgtacaa

SEQ ID NO: 122351 - DNA, 25 bp, Mus musculus
acggtgctatccctggtgctactgg

SEQ ID NO: 122352 - DNA, 25 bp, Mus musculus
acggtgctatccgtggtgctactgg

SEQ ID NO: 122353 - DNA, 25 bp, Mus musculus
acggtgctcccgcaccttgcagggt

SEQ ID NO: 122354 - DNA, 25 bp, Mus musculus
acggtgctcccggaccttgcagggt

SEQ ID NO: 122355 - DNA, 25 bp, Mus musculus
acggtgctccggagtctagaattgg

SEQ ID NO: 122356 - DNA, 25 bp, Mus musculus
acggtgctccggtgtctagaattgg

SEQ ID NO: 122357 - DNA, 25 bp, Mus musculus
acggtgctgcgcaagaagggcccca

SEQ ID NO: 122358 - DNA, 25 bp, Mus musculus
acggtgctgcgctagaagggcccca

SEQ ID NO: 122359 - DNA, 25 bp, Mus musculus
acggtgcttcatcacttgctgtaaa

SEQ ID NO: 122360 - DNA, 25 bp, Mus musculus
acggtgcttcatgacttgctgtaaa

SEQ ID NO: 122361 - DNA, 25 bp, Mus musculus
acggtggacattcccagggctatat

SEQ ID NO: 122362 - DNA, 25 bp, Mus musculus
acggtggacattgccagggctatat

SEQ ID NO: 122363 - DNA, 25 bp, Mus musculus
acggtggatccacttgtcaagacaa

SEQ ID NO: 122364 - DNA, 25 bp, Mus musculus
acggtggatccagttgtcaagacaa

SEQ ID NO: 122365 - DNA, 25 bp, Mus musculus
acggtggatgagcactcctctggct

SEQ ID NO: 122366 - DNA, 25 bp, Mus musculus
acggtggatgaggactcctctggct

SEQ ID NO: 122367 - DNA, 25 bp, Mus musculus
acggtggcatccacaggtgttggcc

SEQ ID NO: 122368 - DNA, 25 bp, Mus musculus
acggtggcatcctcaggtgttggcc

SEQ ID NO: 122369 - DNA, 25 bp, Mus musculus
acggtggccattattcttgatcatc

SEQ ID NO: 122370 - DNA, 25 bp, Mus musculus
acggtggccatttttcttgatcatc

SEQ ID NO: 122371 - DNA, 25 bp, Mus musculus
acggtggcctgacctcttacctggt

SEQ ID NO: 122372 - DNA, 25 bp, Mus musculus
acggtggcctgagctcttacctggt

SEQ ID NO: 122373 - DNA, 25 bp, Mus musculus
acggtggcctggctgaccccagtat

SEQ ID NO: 122374 - DNA, 25 bp, Mus musculus
acggtggcctgggtgaccccagtat

SEQ ID NO: 122375 - DNA, 25 bp, Mus musculus
acggtggctttgcaatgtgtaactc

SEQ ID NO: 122376 - DNA, 25 bp, Mus musculus
acggtggctttggaatgtgtaactc

SEQ ID NO: 122377 - DNA, 25 bp, Mus musculus
acggtgggaactacgcaggcctcga

SEQ ID NO: 122378 - DNA, 25 bp, Mus musculus
acggtgggaacttcgcaggcctcga

SEQ ID NO: 122379 - DNA, 25 bp, Mus musculus
acggtgggacctattcctgcgtgat

SEQ ID NO: 122380 - DNA, 25 bp, Mus musculus
acggtgggaccttttcctgcgtgat

SEQ ID NO: 122381 - DNA, 25 bp, Mus musculus
acggtgggatgaagtcttggcttat

SEQ ID NO: 122382 - DNA, 25 bp, Mus musculus
acggtgggatgatgtcttggcttat

SEQ ID NO: 122383 - DNA, 25 bp, Mus musculus
acggtgggtagtcattcctcggtca

SEQ ID NO: 122384 - DNA, 25 bp, Mus musculus
acggtgggtagtgattcctcggtca

SEQ ID NO: 122385 - DNA, 25 bp, Mus musculus
acggtggtcttcatacttgtgagca

SEQ ID NO: 122386 - DNA, 25 bp, Mus musculus
acggtggtcttcttacttgtgagca

SEQ ID NO: 122387 - DNA, 25 bp, Mus musculus
acggtgtacagcatttcttccttgg

SEQ ID NO: 122388 - DNA, 25 bp, Mus musculus
acggtgtacagcttttcttccttgg

SEQ ID NO: 122389 - DNA, 25 bp, Mus musculus
acggtgtatctcaagtccagtgaca

SEQ ID NO: 122390 - DNA, 25 bp, Mus musculus
acggtgtatctctagtccagtgaca

SEQ ID NO: 122391 - DNA, 25 bp, Mus musculus
acggtgtccagaagtttcagtgcct

SEQ ID NO: 122392 - DNA, 25 bp, Mus musculus
acggtgtccagatgtttcagtgcct

SEQ ID NO: 122393 - DNA, 25 bp, Mus musculus
acggtgtcccctactatgtggctgc

SEQ ID NO: 122394 - DNA, 25 bp, Mus musculus
acggtgtccccttctatgtggctgc

SEQ ID NO: 122395 - DNA, 25 bp, Mus musculus
acggtgtgtagtattttcccagtca

SEQ ID NO: 122396 - DNA, 25 bp, Mus musculus
acggtgtgtagttttttcccagtca

SEQ ID NO: 122397 - DNA, 25 bp, Mus musculus
acggtgtgtcctacgtgtcttcact

SEQ ID NO: 122398 - DNA, 25 bp, Mus musculus
acggtgtgtccttcgtgtcttcact

SEQ ID NO: 122399 - DNA, 25 bp, Mus musculus
acggtgttcccgagcgcaggtacag

SEQ ID NO: 122400 - DNA, 25 bp, Mus musculus
acggtgttcccgtgcgcaggtacag

SEQ ID NO: 122401 - DNA, 25 bp, Mus musculus
acggtgttcgtgaaatctcatgctg

SEQ ID NO: 122402 - DNA, 25 bp, Mus musculus
acggtgttcgtgtaatctcatgctg

SEQ ID NO: 122403 - DNA, 25 bp, Mus musculus
acggtgttgtgcatgatgtttggat

SEQ ID NO: 122404 - DNA, 25 bp, Mus musculus
acggtgttgtgcttgatgtttggat

SEQ ID NO: 122405 - DNA, 25 bp, Mus musculus
acggtgtttcccacagatcatatac

SEQ ID NO: 122406 - DNA, 25 bp, Mus musculus
acggtgtttccctcagatcatatac

SEQ ID NO: 122407 - DNA, 25 bp, Mus musculus
acggttaaatgccaactctctgctt

SEQ ID NO: 122408 - DNA, 25 bp, Mus musculus
acggttaaatgcgaactctctgctt

SEQ ID NO: 122409 - DNA, 25 bp, Mus musculus
acggttaatagccacgcctatattc

SEQ ID NO: 122410 - DNA, 25 bp, Mus musculus
acggttaatagcgacgcctatattc

SEQ ID NO: 122411 - DNA, 25 bp, Mus musculus
acggttaatgaacgctttgctaatg

SEQ ID NO: 122412 - DNA, 25 bp, Mus musculus
acggttaatgaaggctttgctaatg

SEQ ID NO: 122413 - DNA, 25 bp, Mus musculus
acggttatgattcccagcgttttgg

SEQ ID NO: 122414 - DNA, 25 bp, Mus musculus
acggttatgattgccagcgttttgg

SEQ ID NO: 122415 - DNA, 25 bp, Mus musculus
acggttcatcggcaagatcttcacc

SEQ ID NO: 122416 - DNA, 25 bp, Mus musculus
acggttcatcgggaagatcttcacc

SEQ ID NO: 122417 - DNA, 25 bp, Mus musculus
acggttccaagacctggcagtacag

SEQ ID NO: 122418 - DNA, 25 bp, Mus musculus
acggttccaagagctggcagtacag

SEQ ID NO: 122419 - DNA, 25 bp, Mus musculus
acggttccgaggctgtcgctgctac

SEQ ID NO: 122420 - DNA, 25 bp, Mus musculus
acggttccgagggtgtcgctgctac

SEQ ID NO: 122421 - DNA, 25 bp, Mus musculus
acggttcgccttctgcattcattta

SEQ ID NO: 122422 - DNA, 25 bp, Mus musculus
acggttcgccttgtgcattcattta

SEQ ID NO: 122423 - DNA, 25 bp, Mus musculus
acggttctcaggataaactggcaga

SEQ ID NO: 122424 - DNA, 25 bp, Mus musculus
acggttctcaggttaaactggcaga

SEQ ID NO: 122425 - DNA, 25 bp, Mus musculus
acggttctggatcagacaggtctcc

SEQ ID NO: 122426 - DNA, 25 bp, Mus musculus
acggttctggatgagacaggtctcc

SEQ ID NO: 122427 - DNA, 25 bp, Mus musculus
acggttctgtccattcttgatgaga

SEQ ID NO: 122428 - DNA, 25 bp, Mus musculus
acggttctgtcctttcttgatgaga

SEQ ID NO: 122429 - DNA, 25 bp, Mus musculus
acggttgcatgcatggctagctcat

SEQ ID NO: 122430 - DNA, 25 bp, Mus musculus
acggttgcatgcttggctagctcat

SEQ ID NO: 122431 - DNA, 25 bp, Mus musculus
acggttgccttgaggatggtctatc

SEQ ID NO: 122432 - DNA, 25 bp, Mus musculus
acggttgccttgtggatggtctatc

SEQ ID NO: 122433 - DNA, 25 bp, Mus musculus
acggttgcttttccatatgggctcc

SEQ ID NO: 122434 - DNA, 25 bp, Mus musculus
acggttgcttttgcatatgggctcc

SEQ ID NO: 122435 - DNA, 25 bp, Mus musculus
acggttggcattatgtcagtgtcta

SEQ ID NO: 122436 - DNA, 25 bp, Mus musculus
acggttggcattttgtcagtgtcta

SEQ ID NO: 122437 - DNA, 25 bp, Mus musculus
acggttggccttcgtaaggctcact

SEQ ID NO: 122438 - DNA, 25 bp, Mus musculus
acggttggccttggtaaggctcact

SEQ ID NO: 122439 - DNA, 25 bp, Mus musculus
acggttgtcaggcagagctataagc

SEQ ID NO: 122440 - DNA, 25 bp, Mus musculus
acggttgtcagggagagctataagc

SEQ ID NO: 122441 - DNA, 25 bp, Mus musculus
acggttgtccacagcagcgtctgca

SEQ ID NO: 122442 - DNA, 25 bp, Mus musculus
acggttgtccactgcagcgtctgca

SEQ ID NO: 122443 - DNA, 25 bp, Mus musculus
acggttgtcctccagtgtgtcactc

SEQ ID NO: 122444 - DNA, 25 bp, Mus musculus
acggttgtcctcgagtgtgtcactc

SEQ ID NO: 122445 - DNA, 25 bp, Mus musculus
acggttgtgttgagttcccagccaa

SEQ ID NO: 122446 - DNA, 25 bp, Mus musculus
acggttgtgttgtgttcccagccaa

SEQ ID NO: 122447 - DNA, 25 bp, Mus musculus
acggttgttctgatcaaaatatatt

SEQ ID NO: 122448 - DNA, 25 bp, Mus musculus
acggttgttctgttcaaaatatatt

SEQ ID NO: 122449 - DNA, 25 bp, Mus musculus
acggtttcaagtcagaggcatatct

SEQ ID NO: 122450 - DNA, 25 bp, Mus musculus
acggtttcaagtgagaggcatatct

SEQ ID NO: 122451 - DNA, 25 bp, Mus musculus
acggtttcaatcatatgccagtgta

SEQ ID NO: 122452 - DNA, 25 bp, Mus musculus
acggtttcaatcttatgccagtgta

SEQ ID NO: 122453 - DNA, 25 bp, Mus musculus
acggtttccgtcaatagccatgttg

SEQ ID NO: 122454 - DNA, 25 bp, Mus musculus
acggtttccgtctatagccatgttg

SEQ ID NO: 122455 - DNA, 25 bp, Mus musculus
acggtttctgttctcataattggtt

SEQ ID NO: 122456 - DNA, 25 bp, Mus musculus
acggtttctgttgtcataattggtt

SEQ ID NO: 122457 - DNA, 25 bp, Mus musculus
acggtttgcaagactgatgtcagtc

SEQ ID NO: 122458 - DNA, 25 bp, Mus musculus
acggtttgcaagtctgatgtcagtc

SEQ ID NO: 122459 - DNA, 25 bp, Mus musculus
acggtttgttcactcgatgcttaga

SEQ ID NO: 122460 - DNA, 25 bp, Mus musculus
acggtttgttcagtcgatgcttaga

SEQ ID NO: 122461 - DNA, 25 bp, Mus musculus
acgtaactgcaaattaatgttggta

SEQ ID NO: 122462 - DNA, 25 bp, Mus musculus
acgtaactgcaatttaatgttggta

SEQ ID NO: 122463 - DNA, 25 bp, Mus musculus
acgtaagaattcacggctgcccaga

SEQ ID NO: 122464 - DNA, 25 bp, Mus musculus
acgtaagaattctcggctgcccaga

SEQ ID NO: 122465 - DNA, 25 bp, Mus musculus
acgtaagccctgatgatgctgctgt

SEQ ID NO: 122466 - DNA, 25 bp, Mus musculus
acgtaagccctgttgatgctgctgt

SEQ ID NO: 122467 - DNA, 25 bp, Mus musculus
acgtaagctgccaggcgggttcgta

SEQ ID NO: 122468 - DNA, 25 bp, Mus musculus
acgtaagctgcctggcgggttcgta

SEQ ID NO: 122469 - DNA, 25 bp, Mus musculus
acgtaagctgggagcctgtgctaca

SEQ ID NO: 122470 - DNA, 25 bp, Mus musculus
acgtaagctgggtgcctgtgctaca

SEQ ID NO: 122471 - DNA, 25 bp, Mus musculus
acgtaatacaatccagttcactcat

SEQ ID NO: 122472 - DNA, 25 bp, Mus musculus
acgtaatacaatgcagttcactcat

SEQ ID NO: 122473 - DNA, 25 bp, Mus musculus
acgtaatctaataaaatgcacccta

SEQ ID NO: 122474 - DNA, 25 bp, Mus musculus
acgtaatctaattaaatgcacccta

SEQ ID NO: 122475 - DNA, 25 bp, Mus musculus
acgtaatgaggaagaggattcccca

SEQ ID NO: 122476 - DNA, 25 bp, Mus musculus
acgtaatgaggatgaggattcccca

SEQ ID NO: 122477 - DNA, 25 bp, Mus musculus
acgtaattaagactgttcttgagcc

SEQ ID NO: 122478 - DNA, 25 bp, Mus musculus
acgtaattaagagtgttcttgagcc

SEQ ID NO: 122479 - DNA, 25 bp, Mus musculus
acgtaattccgtctgatgccaccag

SEQ ID NO: 122480 - DNA, 25 bp, Mus musculus
acgtaattccgtgtgatgccaccag

SEQ ID NO: 122481 - DNA, 25 bp, Mus musculus
acgtaattgcggctgcgacgctctc

SEQ ID NO: 122482 - DNA, 25 bp, Mus musculus
acgtaattgcgggtgcgacgctctc

SEQ ID NO: 122483 - DNA, 25 bp, Mus musculus
acgtacaagtggcactcctgtgccg

SEQ ID NO: 122484 - DNA, 25 bp, Mus musculus
acgtacaagtgggactcctgtgccg

SEQ ID NO: 122485 - DNA, 25 bp, Mus musculus
acgtacacacatactgtccagctta

SEQ ID NO: 122486 - DNA, 25 bp, Mus musculus
acgtacacacattctgtccagctta

SEQ ID NO: 122487 - DNA, 25 bp, Mus musculus
acgtacacatgcacgcgagcacaca

SEQ ID NO: 122488 - DNA, 25 bp, Mus musculus
acgtacacatgctcgcgagcacaca

SEQ ID NO: 122489 - DNA, 25 bp, Mus musculus
acgtacacatgtccgcgctcgtgag

SEQ ID NO: 122490 - DNA, 25 bp, Mus musculus
acgtacacatgtgcgcgctcgtgag

SEQ ID NO: 122491 - DNA, 25 bp, Mus musculus
acgtacagagcgagctgtgctcatt

SEQ ID NO: 122492 - DNA, 25 bp, Mus musculus
acgtacagagcgtgctgtgctcatt

SEQ ID NO: 122493 - DNA, 25 bp, Mus musculus
acgtacagatctctcttgtggtcag

SEQ ID NO: 122494 - DNA, 25 bp, Mus musculus
acgtacagatctgtcttgtggtcag

SEQ ID NO: 122495 - DNA, 25 bp, Mus musculus
acgtacagccacattctttcacaga

SEQ ID NO: 122496 - DNA, 25 bp, Mus musculus
acgtacagccactttctttcacaga

SEQ ID NO: 122497 - DNA, 25 bp, Mus musculus
acgtacatatacaccaaggcattgg

SEQ ID NO: 122498 - DNA, 25 bp, Mus musculus
acgtacatatactccaaggcattgg

SEQ ID NO: 122499 - DNA, 25 bp, Mus musculus
acgtaccaccctatgagtgacatgg

SEQ ID NO: 122500 - DNA, 25 bp, Mus musculus
acgtaccaccctttgagtgacatgg

SEQ ID NO: 122501 - DNA, 25 bp, Mus musculus
acgtaccagatgagctaagtgatta

SEQ ID NO: 122502 - DNA, 25 bp, Mus musculus
acgtaccagatgtgctaagtgatta

SEQ ID NO: 122503 - DNA, 25 bp, Mus musculus
acgtaccctgcactccgcgaggagg

SEQ ID NO: 122504 - DNA, 25 bp, Mus musculus
acgtaccctgcagtccgcgaggagg

SEQ ID NO: 122505 - DNA, 25 bp, Mus musculus
acgtaccggctgagcaaccagggcg

SEQ ID NO: 122506 - DNA, 25 bp, Mus musculus
acgtaccggctgtgcaaccagggcg

SEQ ID NO: 122507 - DNA, 25 bp, Mus musculus
acgtacgattcactcgctaagatcc

SEQ ID NO: 122508 - DNA, 25 bp, Mus musculus
acgtacgattcagtcgctaagatcc

SEQ ID NO: 122509 - DNA, 25 bp, Mus musculus
acgtacgcacgccagataaccggca

SEQ ID NO: 122510 - DNA, 25 bp, Mus musculus
acgtacgcacgcgagataaccggca

SEQ ID NO: 122511 - DNA, 25 bp, Mus musculus
acgtacgccttactcactttaatgc

SEQ ID NO: 122512 - DNA, 25 bp, Mus musculus
acgtacgccttagtcactttaatgc

SEQ ID NO: 122513 - DNA, 25 bp, Mus musculus
acgtacggttttcaggccacaagtg

SEQ ID NO: 122514 - DNA, 25 bp, Mus musculus
acgtacggttttgaggccacaagtg

SEQ ID NO: 122515 - DNA, 25 bp, Mus musculus
acgtacgtgcacaggctgtgttttg

SEQ ID NO: 122516 - DNA, 25 bp, Mus musculus
acgtacgtgcactggctgtgttttg

SEQ ID NO: 122517 - DNA, 25 bp, Mus musculus
acgtactcacctcctatgtaccaga

SEQ ID NO: 122518 - DNA, 25 bp, Mus musculus
acgtactcacctgctatgtaccaga

SEQ ID NO: 122519 - DNA, 25 bp, Mus musculus
acgtactgctggatgaatatctgag

SEQ ID NO: 122520 - DNA, 25 bp, Mus musculus
acgtactgctggttgaatatctgag

SEQ ID NO: 122521 - DNA, 25 bp, Mus musculus
acgtactgtctgacctcagttaaag

SEQ ID NO: 122522 - DNA, 25 bp, Mus musculus
acgtactgtctgtcctcagttaaag

SEQ ID NO: 122523 - DNA, 25 bp, Mus musculus
acgtagaagcggacgccgtggtcaa

SEQ ID NO: 122524 - DNA, 25 bp, Mus musculus
acgtagaagcggtcgccgtggtcaa

SEQ ID NO: 122525 - DNA, 25 bp, Mus musculus
acgtagacacgtacaggcaggagag

SEQ ID NO: 122526 - DNA, 25 bp, Mus musculus
acgtagacacgttcaggcaggagag

SEQ ID NO: 122527 - DNA, 25 bp, Mus musculus
acgtagatgggtaatgttgctggat

SEQ ID NO: 122528 - DNA, 25 bp, Mus musculus
acgtagatgggttatgttgctggat

SEQ ID NO: 122529 - DNA, 25 bp, Mus musculus
acgtagattacaagcgctcaccggt

SEQ ID NO: 122530 - DNA, 25 bp, Mus musculus
acgtagattacatgcgctcaccggt

SEQ ID NO: 122531 - DNA, 25 bp, Mus musculus
acgtagcagctcatctgctcaacta

SEQ ID NO: 122532 - DNA, 25 bp, Mus musculus
acgtagcagctcttctgctcaacta

SEQ ID NO: 122533 - DNA, 25 bp, Mus musculus
acgtagcaggacagatcttggtgaa

SEQ ID NO: 122534 - DNA, 25 bp, Mus musculus
acgtagcaggactgatcttggtgaa

SEQ ID NO: 122535 - DNA, 25 bp, Mus musculus
acgtagcatagtctcattggcaaat

SEQ ID NO: 122536 - DNA, 25 bp, Mus musculus
acgtagcatagtgtcattggcaaat

SEQ ID NO: 122537 - DNA, 25 bp, Mus musculus
acgtagccaagcaaccgtgtgcaga

SEQ ID NO: 122538 - DNA, 25 bp, Mus musculus
acgtagccaagctaccgtgtgcaga

SEQ ID NO: 122539 - DNA, 25 bp, Mus musculus
acgtagcccacgaatgacgagctgg

SEQ ID NO: 122540 - DNA, 25 bp, Mus musculus
acgtagcccacgtatgacgagctgg

SEQ ID NO: 122541 - DNA, 25 bp, Mus musculus
acgtagccctacagtgtgtaagtca

SEQ ID NO: 122542 - DNA, 25 bp, Mus musculus
acgtagccctactgtgtgtaagtca

SEQ ID NO: 122543 - DNA, 25 bp, Mus musculus
acgtagccgtgaccctgcgactgca

SEQ ID NO: 122544 - DNA, 25 bp, Mus musculus
acgtagccgtgagcctgcgactgca

SEQ ID NO: 122545 - DNA, 25 bp, Mus musculus
acgtagcgtcacatggtgtatatga

SEQ ID NO: 122546 - DNA, 25 bp, Mus musculus
acgtagcgtcacttggtgtatatga

SEQ ID NO: 122547 - DNA, 25 bp, Mus musculus
acgtagctctacacaaatcattttt

SEQ ID NO: 122548 - DNA, 25 bp, Mus musculus
acgtagctctactcaaatcattttt

SEQ ID NO: 122549 - DNA, 25 bp, Mus musculus
acgtagctgttacatgtagggcaat

SEQ ID NO: 122550 - DNA, 25 bp, Mus musculus
acgtagctgttagatgtagggcaat

SEQ ID NO: 122551 - DNA, 25 bp, Mus musculus
acgtaggacctcagatcatcaagaa

SEQ ID NO: 122552 - DNA, 25 bp, Mus musculus
acgtaggacctctgatcatcaagaa

SEQ ID NO: 122553 - DNA, 25 bp, Mus musculus
acgtaggcacgtaggcaagtccttc

SEQ ID NO: 122554 - DNA, 25 bp, Mus musculus
acgtaggcacgttggcaagtccttc

SEQ ID NO: 122555 - DNA, 25 bp, Mus musculus
acgtaggcgccaaattgtaagttgt

SEQ ID NO: 122556 - DNA, 25 bp, Mus musculus
acgtaggcgccatattgtaagttgt

SEQ ID NO: 122557 - DNA, 25 bp, Mus musculus
acgtagggactgaagaggactcaat

SEQ ID NO: 122558 - DNA, 25 bp, Mus musculus
acgtagggactgtagaggactcaat

SEQ ID NO: 122559 - DNA, 25 bp, Mus musculus
acgtagtggattccttcgtgtcgcg

SEQ ID NO: 122560 - DNA, 25 bp, Mus musculus
acgtagtggattgcttcgtgtcgcg

SEQ ID NO: 122561 - DNA, 25 bp, Mus musculus
acgtagtttagtaagtggttctgct

SEQ ID NO: 122562 - DNA, 25 bp, Mus musculus
acgtagtttagttagtggttctgct

SEQ ID NO: 122563 - DNA, 25 bp, Mus musculus
acgtataaaggtcaccacgcccagg

SEQ ID NO: 122564 - DNA, 25 bp, Mus musculus
acgtataaaggtgaccacgcccagg

SEQ ID NO: 122565 - DNA, 25 bp, Mus musculus
acgtataaatgtagccccagattct

SEQ ID NO: 122566 - DNA, 25 bp, Mus musculus
acgtataaatgttgccccagattct

SEQ ID NO: 122567 - DNA, 25 bp, Mus musculus
acgtatagcatcatgtagcgtctca

SEQ ID NO: 122568 - DNA, 25 bp, Mus musculus
acgtatagcatcttgtagcgtctca

SEQ ID NO: 122569 - DNA, 25 bp, Mus musculus
acgtatatcaagctcactgtgttaa

SEQ ID NO: 122570 - DNA, 25 bp, Mus musculus
acgtatatcaaggtcactgtgttaa

SEQ ID NO: 122571 - DNA, 25 bp, Mus musculus
acgtatatttacctgtgacttgtat

SEQ ID NO: 122572 - DNA, 25 bp, Mus musculus
acgtatatttacgtgtgacttgtat

SEQ ID NO: 122573 - DNA, 25 bp, Mus musculus
acgtatcatctgaatttgctgtcaa

SEQ ID NO: 122574 - DNA, 25 bp, Mus musculus
acgtatcatctgtatttgctgtcaa

SEQ ID NO: 122575 - DNA, 25 bp, Mus musculus
acgtatcctgggaatctaatccatt

SEQ ID NO: 122576 - DNA, 25 bp, Mus musculus
acgtatcctgggtatctaatccatt

SEQ ID NO: 122577 - DNA, 25 bp, Mus musculus
acgtatctgcctccttgaaacccag

SEQ ID NO: 122578 - DNA, 25 bp, Mus musculus
acgtatctgcctgcttgaaacccag

SEQ ID NO: 122579 - DNA, 25 bp, Mus musculus
acgtatctggctagtatgtggaaga

SEQ ID NO: 122580 - DNA, 25 bp, Mus musculus
acgtatctggcttgtatgtggaaga

SEQ ID NO: 122581 - DNA, 25 bp, Mus musculus
acgtatctgggtcgcattgatgaga

SEQ ID NO: 122582 - DNA, 25 bp, Mus musculus
acgtatctgggtggcattgatgaga

SEQ ID NO: 122583 - DNA, 25 bp, Mus musculus
acgtatcttcatagcagtttttggc

SEQ ID NO: 122584 - DNA, 25 bp, Mus musculus
acgtatcttcattgcagtttttggc

SEQ ID NO: 122585 - DNA, 25 bp, Mus musculus
acgtatgaatacctttgactttgat

SEQ ID NO: 122586 - DNA, 25 bp, Mus musculus
acgtatgaatacgtttgactttgat

SEQ ID NO: 122587 - DNA, 25 bp, Mus musculus
acgtatgagcgcattcagtatttcc

SEQ ID NO: 122588 - DNA, 25 bp, Mus musculus
acgtatgagcgctttcagtatttcc

SEQ ID NO: 122589 - DNA, 25 bp, Mus musculus
acgtatgcgcatcgtggaggacccc

SEQ ID NO: 122590 - DNA, 25 bp, Mus musculus
acgtatgcgcatggtggaggacccc

SEQ ID NO: 122591 - DNA, 25 bp, Mus musculus
acgtatggccctctcaaagtaattt

SEQ ID NO: 122592 - DNA, 25 bp, Mus musculus
acgtatggccctgtcaaagtaattt

SEQ ID NO: 122593 - DNA, 25 bp, Mus musculus
acgtatggtttaattgggtgctctg

SEQ ID NO: 122594 - DNA, 25 bp, Mus musculus
acgtatggtttatttgggtgctctg

SEQ ID NO: 122595 - DNA, 25 bp, Mus musculus
acgtattgatctatggagtgaccta

SEQ ID NO: 122596 - DNA, 25 bp, Mus musculus
acgtattgatctttggagtgaccta

SEQ ID NO: 122597 - DNA, 25 bp, Mus musculus
acgtatttaagaatgcccctggaca

SEQ ID NO: 122598 - DNA, 25 bp, Mus musculus
acgtatttaagattgcccctggaca

SEQ ID NO: 122599 - DNA, 25 bp, Mus musculus
acgtatttctgaacactctaagact

SEQ ID NO: 122600 - DNA, 25 bp, Mus musculus
acgtatttctgatcactctaagact

SEQ ID NO: 122601 - DNA, 25 bp, Mus musculus
acgtatttcttgaacataatggcac

SEQ ID NO: 122602 - DNA, 25 bp, Mus musculus
acgtatttcttgtacataatggcac

SEQ ID NO: 122603 - DNA, 25 bp, Mus musculus
acgtatttgatgaaaggactggcat

SEQ ID NO: 122604 - DNA, 25 bp, Mus musculus
acgtatttgatgtaaggactggcat

SEQ ID NO: 122605 - DNA, 25 bp, Mus musculus
acgtattttttgacatccatgtgtt

SEQ ID NO: 122606 - DNA, 25 bp, Mus musculus
acgtattttttgtcatccatgtgtt

SEQ ID NO: 122607 - DNA, 25 bp, Mus musculus
acgtcaaagttcatggtctccaggg

SEQ ID NO: 122608 - DNA, 25 bp, Mus musculus
acgtcaaagttcttggtctccaggg

SEQ ID NO: 122609 - DNA, 25 bp, Mus musculus
acgtcaacgcctccgcttgcgaagg

SEQ ID NO: 122610 - DNA, 25 bp, Mus musculus
acgtcaacgcctgcgcttgcgaagg

SEQ ID NO: 122611 - DNA, 25 bp, Mus musculus
acgtcaacgtcacctgcatcgtgaa

SEQ ID NO: 122612 - DNA, 25 bp, Mus musculus
acgtcaacgtcagctgcatcgtgaa

SEQ ID NO: 122613 - DNA, 25 bp, Mus musculus
acgtcaactatgctcgtgtggcttg

SEQ ID NO: 122614 - DNA, 25 bp, Mus musculus
acgtcaactatggtcgtgtggcttg

SEQ ID NO: 122615 - DNA, 25 bp, Mus musculus
acgtcaactgggacatacggcaggt

SEQ ID NO: 122616 - DNA, 25 bp, Mus musculus
acgtcaactgggtcatacggcaggt

SEQ ID NO: 122617 - DNA, 25 bp, Mus musculus
acgtcaagacttatgctggtttgta

SEQ ID NO: 122618 - DNA, 25 bp, Mus musculus
acgtcaagacttttgctggtttgta

SEQ ID NO: 122619 - DNA, 25 bp, Mus musculus
acgtcaatggctatagctttgtcaa

SEQ ID NO: 122620 - DNA, 25 bp, Mus musculus
acgtcaatggctttagctttgtcaa

SEQ ID NO: 122621 - DNA, 25 bp, Mus musculus
acgtcacagcgtaccgtgtgagtat

SEQ ID NO: 122622 - DNA, 25 bp, Mus musculus
acgtcacagcgttccgtgtgagtat

SEQ ID NO: 122623 - DNA, 25 bp, Mus musculus
acgtcacagggcacacaactgcatg

SEQ ID NO: 122624 - DNA, 25 bp, Mus musculus
acgtcacagggctcacaactgcatg

SEQ ID NO: 122625 - DNA, 25 bp, Mus musculus
acgtcacatccgaaagctgggacaa

SEQ ID NO: 122626 - DNA, 25 bp, Mus musculus
acgtcacatccgtaagctgggacaa

SEQ ID NO: 122627 - DNA, 25 bp, Mus musculus
acgtcacatgtgatcatctgattca

SEQ ID NO: 122628 - DNA, 25 bp, Mus musculus
acgtcacatgtgttcatctgattca

SEQ ID NO: 122629 - DNA, 25 bp, Mus musculus
acgtcaccatagcagttggcctatt

SEQ ID NO: 122630 - DNA, 25 bp, Mus musculus
acgtcaccataggagttggcctatt

SEQ ID NO: 122631 - DNA, 25 bp, Mus musculus
acgtcaccgccgctgaaagcagtgg

SEQ ID NO: 122632 - DNA, 25 bp, Mus musculus
acgtcaccgccggtgaaagcagtgg

SEQ ID NO: 122633 - DNA, 25 bp, Mus musculus
acgtcaccttcccaaagattcatta

SEQ ID NO: 122634 - DNA, 25 bp, Mus musculus
acgtcaccttccgaaagattcatta

SEQ ID NO: 122635 - DNA, 25 bp, Mus musculus
acgtcaccttctaccaggatctgat

SEQ ID NO: 122636 - DNA, 25 bp, Mus musculus
acgtcaccttcttccaggatctgat

SEQ ID NO: 122637 - DNA, 25 bp, Mus musculus
acgtcacgaaataaaggatcacttt

SEQ ID NO: 122638 - DNA, 25 bp, Mus musculus
acgtcacgaaattaaggatcacttt

SEQ ID NO: 122639 - DNA, 25 bp, Mus musculus
acgtcacgacggaatagtactcaag

SEQ ID NO: 122640 - DNA, 25 bp, Mus musculus
acgtcacgacggtatagtactcaag

SEQ ID NO: 122641 - DNA, 25 bp, Mus musculus
acgtcacgatgtacaattatgtttc

SEQ ID NO: 122642 - DNA, 25 bp, Mus musculus
acgtcacgatgttcaattatgtttc

SEQ ID NO: 122643 - DNA, 25 bp, Mus musculus
acgtcactccatcaacctatctggg

SEQ ID NO: 122644 - DNA, 25 bp, Mus musculus
acgtcactccatgaacctatctggg

SEQ ID NO: 122645 - DNA, 25 bp, Mus musculus
acgtcactcgccagagtcaggagga

SEQ ID NO: 122646 - DNA, 25 bp, Mus musculus
acgtcactcgcctgagtcaggagga

SEQ ID NO: 122647 - DNA, 25 bp, Mus musculus
acgtcactctggactgttcatcgtg

SEQ ID NO: 122648 - DNA, 25 bp, Mus musculus
acgtcactctggtctgttcatcgtg

SEQ ID NO: 122649 - DNA, 25 bp, Mus musculus
acgtcagaagacaaatgcgagaaag

SEQ ID NO: 122650 - DNA, 25 bp, Mus musculus
acgtcagaagactaatgcgagaaag

SEQ ID NO: 122651 - DNA, 25 bp, Mus musculus
acgtcagagcgcacggcagccagga

SEQ ID NO: 122652 - DNA, 25 bp, Mus musculus
acgtcagagcgctcggcagccagga

SEQ ID NO: 122653 - DNA, 25 bp, Mus musculus
acgtcagagggcatcctgagtgaaa

SEQ ID NO: 122654 - DNA, 25 bp, Mus musculus
acgtcagagggcttcctgagtgaaa

SEQ ID NO: 122655 - DNA, 25 bp, Mus musculus
acgtcagcggcgcaggcattttcat

SEQ ID NO: 122656 - DNA, 25 bp, Mus musculus
acgtcagcggcggaggcattttcat

SEQ ID NO: 122657 - DNA, 25 bp, Mus musculus
acgtcaggacgcattggtggacagt

SEQ ID NO: 122658 - DNA, 25 bp, Mus musculus
acgtcaggacgctttggtggacagt

SEQ ID NO: 122659 - DNA, 25 bp, Mus musculus
acgtcaggagatcactctgtcatga

SEQ ID NO: 122660 - DNA, 25 bp, Mus musculus
acgtcaggagatgactctgtcatga

SEQ ID NO: 122661 - DNA, 25 bp, Mus musculus
acgtcaggccgacgccaaccgtgtg

SEQ ID NO: 122662 - DNA, 25 bp, Mus musculus
acgtcaggccgaggccaaccgtgtg

SEQ ID NO: 122663 - DNA, 25 bp, Mus musculus
acgtcaggtgacatggccagattca

SEQ ID NO: 122664 - DNA, 25 bp, Mus musculus
acgtcaggtgacttggccagattca

SEQ ID NO: 122665 - DNA, 25 bp, Mus musculus
acgtcagtactcaccctaatgttat

SEQ ID NO: 122666 - DNA, 25 bp, Mus musculus
acgtcagtactctccctaatgttat

SEQ ID NO: 122667 - DNA, 25 bp, Mus musculus
acgtcagtagagaagtggtcacaaa

SEQ ID NO: 122668 - DNA, 25 bp, Mus musculus
acgtcagtagagtagtggtcacaaa

SEQ ID NO: 122669 - DNA, 25 bp, Mus musculus
acgtcagtagttaatgcacttgagc

SEQ ID NO: 122670 - DNA, 25 bp, Mus musculus
acgtcagtagtttatgcacttgagc

SEQ ID NO: 122671 - DNA, 25 bp, Mus musculus
acgtcagtcagtcggtagagccaac

SEQ ID NO: 122672 - DNA, 25 bp, Mus musculus
acgtcagtcagtgggtagagccaac

SEQ ID NO: 122673 - DNA, 25 bp, Mus musculus
acgtcagtcggtccctgagactcta

SEQ ID NO: 122674 - DNA, 25 bp, Mus musculus
acgtcagtcggtgcctgagactcta

SEQ ID NO: 122675 - DNA, 25 bp, Mus musculus
acgtcagtgtccatgttaagtttat

SEQ ID NO: 122676 - DNA, 25 bp, Mus musculus
acgtcagtgtccttgttaagtttat

SEQ ID NO: 122677 - DNA, 25 bp, Mus musculus
acgtcatacagcacggtgaccaagg

SEQ ID NO: 122678 - DNA, 25 bp, Mus musculus
acgtcatacagctcggtgaccaagg

SEQ ID NO: 122679 - DNA, 25 bp, Mus musculus
acgtcatccagcagccatgagactg

SEQ ID NO: 122680 - DNA, 25 bp, Mus musculus
acgtcatccagctgccatgagactg

SEQ ID NO: 122681 - DNA, 25 bp, Mus musculus
acgtcatccttgcagcagcactgaa

SEQ ID NO: 122682 - DNA, 25 bp, Mus musculus
acgtcatccttggagcagcactgaa

SEQ ID NO: 122683 - DNA, 25 bp, Mus musculus
acgtcatcctttcgtaagcgtcgca

SEQ ID NO: 122684 - DNA, 25 bp, Mus musculus
acgtcatcctttggtaagcgtcgca

SEQ ID NO: 122685 - DNA, 25 bp, Mus musculus
acgtcatcggcgagctgcgggatca

SEQ ID NO: 122686 - DNA, 25 bp, Mus musculus
acgtcatcggcgtgctgcgggatca

SEQ ID NO: 122687 - DNA, 25 bp, Mus musculus
acgtcatcgtgacaactgtgatttt

SEQ ID NO: 122688 - DNA, 25 bp, Mus musculus
acgtcatcgtgagaactgtgatttt

SEQ ID NO: 122689 - DNA, 25 bp, Mus musculus
acgtcatgaggtactgttgctgcgc

SEQ ID NO: 122690 - DNA, 25 bp, Mus musculus
acgtcatgaggttctgttgctgcgc

SEQ ID NO: 122691 - DNA, 25 bp, Mus musculus
acgtcatggacaattccaattccag

SEQ ID NO: 122692 - DNA, 25 bp, Mus musculus
acgtcatggacatttccaattccag

SEQ ID NO: 122693 - DNA, 25 bp, Mus musculus
acgtcatgggtcacttccgctggga

SEQ ID NO: 122694 - DNA, 25 bp, Mus musculus
acgtcatgggtctcttccgctggga

SEQ ID NO: 122695 - DNA, 25 bp, Mus musculus
acgtcattcaggcactgtttccttt

SEQ ID NO: 122696 - DNA, 25 bp, Mus musculus
acgtcattcagggactgtttccttt

SEQ ID NO: 122697 - DNA, 25 bp, Mus musculus
acgtccaaagctctgttcctctttg

SEQ ID NO: 122698 - DNA, 25 bp, Mus musculus
acgtccaaagctgtgttcctctttg

SEQ ID NO: 122699 - DNA, 25 bp, Mus musculus
acgtccaatccactgaagatgccct

SEQ ID NO: 122700 - DNA, 25 bp, Mus musculus
acgtccaatccagtgaagatgccct

SEQ ID NO: 122701 - DNA, 25 bp, Mus musculus
acgtccacagtcctcttaagtacag

SEQ ID NO: 122702 - DNA, 25 bp, Mus musculus
acgtccacagtcgtcttaagtacag

SEQ ID NO: 122703 - DNA, 25 bp, Mus musculus
acgtccactggtacaccaacatcag

SEQ ID NO: 122704 - DNA, 25 bp, Mus musculus
acgtccactggttcaccaacatcag

SEQ ID NO: 122705 - DNA, 25 bp, Mus musculus
acgtccagaaggaactttccacaag

SEQ ID NO: 122706 - DNA, 25 bp, Mus musculus
acgtccagaaggtactttccacaag

SEQ ID NO: 122707 - DNA, 25 bp, Mus musculus
acgtccaggcgcaggtgaacaacag

SEQ ID NO: 122708 - DNA, 25 bp, Mus musculus
acgtccaggcgctggtgaacaacag

SEQ ID NO: 122709 - DNA, 25 bp, Mus musculus
acgtccatctggcaaggcccaagtg

SEQ ID NO: 122710 - DNA, 25 bp, Mus musculus
acgtccatctgggaaggcccaagtg

SEQ ID NO: 122711 - DNA, 25 bp, Mus musculus
acgtccattgtgcatcaacttcatc

SEQ ID NO: 122712 - DNA, 25 bp, Mus musculus
acgtccattgtggatcaacttcatc

SEQ ID NO: 122713 - DNA, 25 bp, Mus musculus
acgtcccaattgagtctttcagaat

SEQ ID NO: 122714 - DNA, 25 bp, Mus musculus
acgtcccaattgtgtctttcagaat

SEQ ID NO: 122715 - DNA, 25 bp, Mus musculus
acgtcccatcccaggatcctgtttt

SEQ ID NO: 122716 - DNA, 25 bp, Mus musculus
acgtcccatccctggatcctgtttt

SEQ ID NO: 122717 - DNA, 25 bp, Mus musculus
acgtccctatgactgcacagaacag

SEQ ID NO: 122718 - DNA, 25 bp, Mus musculus
acgtccctatgagtgcacagaacag

SEQ ID NO: 122719 - DNA, 25 bp, Mus musculus
acgtccctctgtctgcaaaactgaa

SEQ ID NO: 122720 - DNA, 25 bp, Mus musculus
acgtccctctgtgtgcaaaactgaa

SEQ ID NO: 122721 - DNA, 25 bp, Mus musculus
acgtccctggatcatggcctacaag

SEQ ID NO: 122722 - DNA, 25 bp, Mus musculus
acgtccctggatgatggcctacaag

SEQ ID NO: 122723 - DNA, 25 bp, Mus musculus
acgtccgaggcgcaggacaatcctc

SEQ ID NO: 122724 - DNA, 25 bp, Mus musculus
acgtccgaggcggaggacaatcctc

SEQ ID NO: 122725 - DNA, 25 bp, Mus musculus
acgtccgctttgctgcctggttatc

SEQ ID NO: 122726 - DNA, 25 bp, Mus musculus
acgtccgctttggtgcctggttatc

SEQ ID NO: 122727 - DNA, 25 bp, Mus musculus
acgtccgtaggtcacatttggcaat

SEQ ID NO: 122728 - DNA, 25 bp, Mus musculus
acgtccgtaggtgacatttggcaat

SEQ ID NO: 122729 - DNA, 25 bp, Mus musculus
acgtccgtgggaactatatcttgcc

SEQ ID NO: 122730 - DNA, 25 bp, Mus musculus
acgtccgtgggatctatatcttgcc

SEQ ID NO: 122731 - DNA, 25 bp, Mus musculus
acgtccgtgtgaaatacccagggca

SEQ ID NO: 122732 - DNA, 25 bp, Mus musculus
acgtccgtgtgatatacccagggca

SEQ ID NO: 122733 - DNA, 25 bp, Mus musculus
acgtcctacaataccattagctcag

SEQ ID NO: 122734 - DNA, 25 bp, Mus musculus
acgtcctacaattccattagctcag

SEQ ID NO: 122735 - DNA, 25 bp, Mus musculus
acgtcctcatctccctaggatagga

SEQ ID NO: 122736 - DNA, 25 bp, Mus musculus
acgtcctcatctgcctaggatagga

SEQ ID NO: 122737 - DNA, 25 bp, Mus musculus
acgtcctcatttacactcaatggtg

SEQ ID NO: 122738 - DNA, 25 bp, Mus musculus
acgtcctcattttcactcaatggtg

SEQ ID NO: 122739 - DNA, 25 bp, Mus musculus
acgtcctgaggaactatattgcaca

SEQ ID NO: 122740 - DNA, 25 bp, Mus musculus
acgtcctgaggatctatattgcaca

SEQ ID NO: 122741 - DNA, 25 bp, Mus musculus
acgtcctggcagacttcttgaaaca

SEQ ID NO: 122742 - DNA, 25 bp, Mus musculus
acgtcctggcagtcttcttgaaaca

SEQ ID NO: 122743 - DNA, 25 bp, Mus musculus
acgtcctggtggagtcccactggct

SEQ ID NO: 122744 - DNA, 25 bp, Mus musculus
acgtcctggtggtgtcccactggct

SEQ ID NO: 122745 - DNA, 25 bp, Mus musculus
acgtccttcgtgatgcagtatttat

SEQ ID NO: 122746 - DNA, 25 bp, Mus musculus
acgtccttcgtgttgcagtatttat

SEQ ID NO: 122747 - DNA, 25 bp, Mus musculus
acgtcgaccccaaggccactgagga

SEQ ID NO: 122748 - DNA, 25 bp, Mus musculus
acgtcgaccccatggccactgagga

SEQ ID NO: 122749 - DNA, 25 bp, Mus musculus
acgtcgaccgagaccagtccagaga

SEQ ID NO: 122750 - DNA, 25 bp, Mus musculus
acgtcgaccgagtccagtccagaga

SEQ ID NO: 122751 - DNA, 25 bp, Mus musculus
acgtcgatgctgaacgtctcttatc

SEQ ID NO: 122752 - DNA, 25 bp, Mus musculus
acgtcgatgctgtacgtctcttatc

SEQ ID NO: 122753 - DNA, 25 bp, Mus musculus
acgtcgattctcactcggaatccag

SEQ ID NO: 122754 - DNA, 25 bp, Mus musculus
acgtcgattctctctcggaatccag

SEQ ID NO: 122755 - DNA, 25 bp, Mus musculus
acgtcgcgggatcgtgacaagttct

SEQ ID NO: 122756 - DNA, 25 bp, Mus musculus
acgtcgcgggatggtgacaagttct

SEQ ID NO: 122757 - DNA, 25 bp, Mus musculus
acgtcgctcaggataggaactcggc

SEQ ID NO: 122758 - DNA, 25 bp, Mus musculus
acgtcgctcaggttaggaactcggc

SEQ ID NO: 122759 - DNA, 25 bp, Mus musculus
acgtcgctgattctgcatgtgagaa

SEQ ID NO: 122760 - DNA, 25 bp, Mus musculus
acgtcgctgattgtgcatgtgagaa

SEQ ID NO: 122761 - DNA, 25 bp, Mus musculus
acgtcggcacgaacctggtcaatgg

SEQ ID NO: 122762 - DNA, 25 bp, Mus musculus
acgtcggcacgatcctggtcaatgg

SEQ ID NO: 122763 - DNA, 25 bp, Mus musculus
acgtcgggcgccacagcagaagagc

SEQ ID NO: 122764 - DNA, 25 bp, Mus musculus
acgtcgggcgcctcagcagaagagc

SEQ ID NO: 122765 - DNA, 25 bp, Mus musculus
acgtcggtgactctgtagctcttca

SEQ ID NO: 122766 - DNA, 25 bp, Mus musculus
acgtcggtgactgtgtagctcttca

SEQ ID NO: 122767 - DNA, 25 bp, Mus musculus
acgtcgtaattacccttgatctccg

SEQ ID NO: 122768 - DNA, 25 bp, Mus musculus
acgtcgtaattagccttgatctccg

SEQ ID NO: 122769 - DNA, 25 bp, Mus musculus
acgtcgtattctatagggtggatgt

SEQ ID NO: 122770 - DNA, 25 bp, Mus musculus
acgtcgtattctttagggtggatgt

SEQ ID NO: 122771 - DNA, 25 bp, Mus musculus
acgtcgtcctaaacactgtaggcca

SEQ ID NO: 122772 - DNA, 25 bp, Mus musculus
acgtcgtcctaatcactgtaggcca

SEQ ID NO: 122773 - DNA, 25 bp, Mus musculus
acgtcgtcctggctgaaggcagtac

SEQ ID NO: 122774 - DNA, 25 bp, Mus musculus
acgtcgtcctgggtgaaggcagtac

SEQ ID NO: 122775 - DNA, 25 bp, Mus musculus
acgtcgttaaagacttctgccatca

SEQ ID NO: 122776 - DNA, 25 bp, Mus musculus
acgtcgttaaagtcttctgccatca

SEQ ID NO: 122777 - DNA, 25 bp, Mus musculus
acgtcgttccttctgagccataggc

SEQ ID NO: 122778 - DNA, 25 bp, Mus musculus
acgtcgttccttgtgagccataggc

SEQ ID NO: 122779 - DNA, 25 bp, Mus musculus
acgtctaaagctacatgtgctgggc

SEQ ID NO: 122780 - DNA, 25 bp, Mus musculus
acgtctaaagcttcatgtgctgggc

SEQ ID NO: 122781 - DNA, 25 bp, Mus musculus
acgtctacagtccagtgcgtgggaa

SEQ ID NO: 122782 - DNA, 25 bp, Mus musculus
acgtctacagtcgagtgcgtgggaa

SEQ ID NO: 122783 - DNA, 25 bp, Mus musculus
acgtctaccataccttattatctct

SEQ ID NO: 122784 - DNA, 25 bp, Mus musculus
acgtctaccatagcttattatctct

SEQ ID NO: 122785 - DNA, 25 bp, Mus musculus
acgtctcaagtgaacgtgtccggga

SEQ ID NO: 122786 - DNA, 25 bp, Mus musculus
acgtctcaagtgtacgtgtccggga

SEQ ID NO: 122787 - DNA, 25 bp, Mus musculus
acgtctcagttgattgtccgatcag

SEQ ID NO: 122788 - DNA, 25 bp, Mus musculus
acgtctcagttgtttgtccgatcag

SEQ ID NO: 122789 - DNA, 25 bp, Mus musculus
acgtctcatactacatttcagcatt

SEQ ID NO: 122790 - DNA, 25 bp, Mus musculus
acgtctcatacttcatttcagcatt

SEQ ID NO: 122791 - DNA, 25 bp, Mus musculus
acgtctcatgtaatttgcatcgcat

SEQ ID NO: 122792 - DNA, 25 bp, Mus musculus
acgtctcatgtattttgcatcgcat

SEQ ID NO: 122793 - DNA, 25 bp, Mus musculus
acgtctccatcgacttccgagtgtt

SEQ ID NO: 122794 - DNA, 25 bp, Mus musculus
acgtctccatcgtcttccgagtgtt

SEQ ID NO: 122795 - DNA, 25 bp, Mus musculus
acgtctctcacacccggtgtcggtg

SEQ ID NO: 122796 - DNA, 25 bp, Mus musculus
acgtctctcacagccggtgtcggtg

SEQ ID NO: 122797 - DNA, 25 bp, Mus musculus
acgtctctgataatgtcggcccgga

SEQ ID NO: 122798 - DNA, 25 bp, Mus musculus
acgtctctgatattgtcggcccgga

SEQ ID NO: 122799 - DNA, 25 bp, Mus musculus
acgtctctggaaccactgttgcttg

SEQ ID NO: 122800 - DNA, 25 bp, Mus musculus
acgtctctggaagcactgttgcttg

SEQ ID NO: 122801 - DNA, 25 bp, Mus musculus
acgtctcttgataccttgatacctt

SEQ ID NO: 122802 - DNA, 25 bp, Mus musculus
acgtctcttgattccttgatacctt

SEQ ID NO: 122803 - DNA, 25 bp, Mus musculus
acgtctgctcttatcttagccttga

SEQ ID NO: 122804 - DNA, 25 bp, Mus musculus
acgtctgctcttttcttagccttga

SEQ ID NO: 122805 - DNA, 25 bp, Mus musculus
acgtctggacttcagcttcttgtta

SEQ ID NO: 122806 - DNA, 25 bp, Mus musculus
acgtctggacttgagcttcttgtta

SEQ ID NO: 122807 - DNA, 25 bp, Mus musculus
acgtctggcaccctgctgttgggaa

SEQ ID NO: 122808 - DNA, 25 bp, Mus musculus
acgtctggcaccgtgctgttgggaa

SEQ ID NO: 122809 - DNA, 25 bp, Mus musculus
acgtctggccttattctgtgggaca

SEQ ID NO: 122810 - DNA, 25 bp, Mus musculus
acgtctggcctttttctgtgggaca

SEQ ID NO: 122811 - DNA, 25 bp, Mus musculus
acgtctggtcctatagtctgcctag

SEQ ID NO: 122812 - DNA, 25 bp, Mus musculus
acgtctggtcctttagtctgcctag

SEQ ID NO: 122813 - DNA, 25 bp, Mus musculus
acgtctgtcagaatacggtactgca

SEQ ID NO: 122814 - DNA, 25 bp, Mus musculus
acgtctgtcagattacggtactgca

SEQ ID NO: 122815 - DNA, 25 bp, Mus musculus
acgtctgtctggctgaggcagaacc

SEQ ID NO: 122816 - DNA, 25 bp, Mus musculus
acgtctgtctgggtgaggcagaacc

SEQ ID NO: 122817 - DNA, 25 bp, Mus musculus
acgtctgtggtgctttctggcccag

SEQ ID NO: 122818 - DNA, 25 bp, Mus musculus
acgtctgtggtggtttctggcccag

SEQ ID NO: 122819 - DNA, 25 bp, Mus musculus
acgtctgtgtggcaactgtccccag

SEQ ID NO: 122820 - DNA, 25 bp, Mus musculus
acgtctgtgtgggaactgtccccag

SEQ ID NO: 122821 - DNA, 25 bp, Mus musculus
acgtcttaataaagcccagcagggt

SEQ ID NO: 122822 - DNA, 25 bp, Mus musculus
acgtcttaataatgcccagcagggt

SEQ ID NO: 122823 - DNA, 25 bp, Mus musculus
acgtcttaccaacagatttctggtg

SEQ ID NO: 122824 - DNA, 25 bp, Mus musculus
acgtcttaccaagagatttctggtg

SEQ ID NO: 122825 - DNA, 25 bp, Mus musculus
acgtcttacttcattgagcctgtgc

SEQ ID NO: 122826 - DNA, 25 bp, Mus musculus
acgtcttacttctttgagcctgtgc

SEQ ID NO: 122827 - DNA, 25 bp, Mus musculus
acgtcttaggccacctcaccatggt

SEQ ID NO: 122828 - DNA, 25 bp, Mus musculus
acgtcttaggcctcctcaccatggt

SEQ ID NO: 122829 - DNA, 25 bp, Mus musculus
acgtcttataagactgatttcctca

SEQ ID NO: 122830 - DNA, 25 bp, Mus musculus
acgtcttataagtctgatttcctca

SEQ ID NO: 122831 - DNA, 25 bp, Mus musculus
acgtcttcggtgattctagcacata

SEQ ID NO: 122832 - DNA, 25 bp, Mus musculus
acgtcttcggtgtttctagcacata

SEQ ID NO: 122833 - DNA, 25 bp, Mus musculus
acgtcttgacgtcctgtattatttg

SEQ ID NO: 122834 - DNA, 25 bp, Mus musculus
acgtcttgacgtgctgtattatttg

SEQ ID NO: 122835 - DNA, 25 bp, Mus musculus
acgtctttcttccacagtaccttgt

SEQ ID NO: 122836 - DNA, 25 bp, Mus musculus
acgtctttcttcgacagtaccttgt

SEQ ID NO: 122837 - DNA, 25 bp, Mus musculus
acgtgaaatctcacactgtgctggg

SEQ ID NO: 122838 - DNA, 25 bp, Mus musculus
acgtgaaatctctcactgtgctggg

SEQ ID NO: 122839 - DNA, 25 bp, Mus musculus
acgtgaactttacctttatcagaca

SEQ ID NO: 122840 - DNA, 25 bp, Mus musculus
acgtgaactttagctttatcagaca

SEQ ID NO: 122841 - DNA, 25 bp, Mus musculus
acgtgaagacaaatgccatcctcgg

SEQ ID NO: 122842 - DNA, 25 bp, Mus musculus
acgtgaagacaattgccatcctcgg

SEQ ID NO: 122843 - DNA, 25 bp, Mus musculus
acgtgaagcctcatggtgtcatttg

SEQ ID NO: 122844 - DNA, 25 bp, Mus musculus
acgtgaagcctcttggtgtcatttg

SEQ ID NO: 122845 - DNA, 25 bp, Mus musculus
acgtgaaggcggattctgaagtaca

SEQ ID NO: 122846 - DNA, 25 bp, Mus musculus
acgtgaaggcggtttctgaagtaca

SEQ ID NO: 122847 - DNA, 25 bp, Mus musculus
acgtgaagtcagagacagcacccta

SEQ ID NO: 122848 - DNA, 25 bp, Mus musculus
acgtgaagtcagtgacagcacccta

SEQ ID NO: 122849 - DNA, 25 bp, Mus musculus
acgtgaatcagtcctgtctttccat

SEQ ID NO: 122850 - DNA, 25 bp, Mus musculus
acgtgaatcagtgctgtctttccat

SEQ ID NO: 122851 - DNA, 25 bp, Mus musculus
acgtgaatcttcaatgtgtaccaga

SEQ ID NO: 122852 - DNA, 25 bp, Mus musculus
acgtgaatcttctatgtgtaccaga

SEQ ID NO: 122853 - DNA, 25 bp, Mus musculus
acgtgaatgacgaccctctaaggat

SEQ ID NO: 122854 - DNA, 25 bp, Mus musculus
acgtgaatgacgtccctctaaggat

SEQ ID NO: 122855 - DNA, 25 bp, Mus musculus
acgtgaatgggcatgcatcaaataa

SEQ ID NO: 122856 - DNA, 25 bp, Mus musculus
acgtgaatgggcttgcatcaaataa

SEQ ID NO: 122857 - DNA, 25 bp, Mus musculus
acgtgaatgtgtccgtcggtgacaa

SEQ ID NO: 122858 - DNA, 25 bp, Mus musculus
acgtgaatgtgtgcgtcggtgacaa

SEQ ID NO: 122859 - DNA, 25 bp, Mus musculus
acgtgacaggccacggctatccgga

SEQ ID NO: 122860 - DNA, 25 bp, Mus musculus
acgtgacaggcctcggctatccgga

SEQ ID NO: 122861 - DNA, 25 bp, Mus musculus
acgtgaccacgcagagtgttataca

SEQ ID NO: 122862 - DNA, 25 bp, Mus musculus
acgtgaccacgctgagtgttataca

SEQ ID NO: 122863 - DNA, 25 bp, Mus musculus
acgtgacccaaacccaacatacttt

SEQ ID NO: 122864 - DNA, 25 bp, Mus musculus
acgtgacccaaagccaacatacttt

SEQ ID NO: 122865 - DNA, 25 bp, Mus musculus
acgtgacctgatcctttggtgctga

SEQ ID NO: 122866 - DNA, 25 bp, Mus musculus
acgtgacctgatgctttggtgctga

SEQ ID NO: 122867 - DNA, 25 bp, Mus musculus
acgtgaccttagcaaatcgccgagc

SEQ ID NO: 122868 - DNA, 25 bp, Mus musculus
acgtgaccttaggaaatcgccgagc

SEQ ID NO: 122869 - DNA, 25 bp, Mus musculus
acgtgaccttggaccactttgagga

SEQ ID NO: 122870 - DNA, 25 bp, Mus musculus
acgtgaccttggtccactttgagga

SEQ ID NO: 122871 - DNA, 25 bp, Mus musculus
acgtgactccccagagcagttctat

SEQ ID NO: 122872 - DNA, 25 bp, Mus musculus
acgtgactcccctgagcagttctat

SEQ ID NO: 122873 - DNA, 25 bp, Mus musculus
acgtgactctctctgccatatggca

SEQ ID NO: 122874 - DNA, 25 bp, Mus musculus
acgtgactctctgtgccatatggca

SEQ ID NO: 122875 - DNA, 25 bp, Mus musculus
acgtgactgcacagctgctctgact

SEQ ID NO: 122876 - DNA, 25 bp, Mus musculus
acgtgactgcactgctgctctgact

SEQ ID NO: 122877 - DNA, 25 bp, Mus musculus
acgtgactgctgaggagcaacccat

SEQ ID NO: 122878 - DNA, 25 bp, Mus musculus
acgtgactgctgtggagcaacccat

SEQ ID NO: 122879 - DNA, 25 bp, Mus musculus
acgtgactggaaatgggctgacttt

SEQ ID NO: 122880 - DNA, 25 bp, Mus musculus
acgtgactggaattgggctgacttt

SEQ ID NO: 122881 - DNA, 25 bp, Mus musculus
acgtgactgttgacattctctgcaa

SEQ ID NO: 122882 - DNA, 25 bp, Mus musculus
acgtgactgttgtcattctctgcaa

SEQ ID NO: 122883 - DNA, 25 bp, Mus musculus
acgtgacttgggacacatacccggg

SEQ ID NO: 122884 - DNA, 25 bp, Mus musculus
acgtgacttgggtcacatacccggg

SEQ ID NO: 122885 - DNA, 25 bp, Mus musculus
acgtgagaacagcaacattcccgtt

SEQ ID NO: 122886 - DNA, 25 bp, Mus musculus
acgtgagaacaggaacattcccgtt

SEQ ID NO: 122887 - DNA, 25 bp, Mus musculus
acgtgagcagtccagacttgcctaa

SEQ ID NO: 122888 - DNA, 25 bp, Mus musculus
acgtgagcagtcgagacttgcctaa

SEQ ID NO: 122889 - DNA, 25 bp, Mus musculus
acgtgagcgtgcattcctccttgtg

SEQ ID NO: 122890 - DNA, 25 bp, Mus musculus
acgtgagcgtgctttcctccttgtg

SEQ ID NO: 122891 - DNA, 25 bp, Mus musculus
acgtgagctgccattctaacatttc

SEQ ID NO: 122892 - DNA, 25 bp, Mus musculus
acgtgagctgcctttctaacatttc

SEQ ID NO: 122893 - DNA, 25 bp, Mus musculus
acgtgagctggtccatcacagccaa

SEQ ID NO: 122894 - DNA, 25 bp, Mus musculus
acgtgagctggtgcatcacagccaa

SEQ ID NO: 122895 - DNA, 25 bp, Mus musculus
acgtgagctgtcatttctgagttca

SEQ ID NO: 122896 - DNA, 25 bp, Mus musculus
acgtgagctgtcttttctgagttca

SEQ ID NO: 122897 - DNA, 25 bp, Mus musculus
acgtgaggcacgacggctctgagcc

SEQ ID NO: 122898 - DNA, 25 bp, Mus musculus
acgtgaggcacgtcggctctgagcc

SEQ ID NO: 122899 - DNA, 25 bp, Mus musculus
acgtgaggcttgcagctgctgccca

SEQ ID NO: 122900 - DNA, 25 bp, Mus musculus
acgtgaggcttggagctgctgccca

SEQ ID NO: 122901 - DNA, 25 bp, Mus musculus
acgtgaggtcttccctgcctgggaa

SEQ ID NO: 122902 - DNA, 25 bp, Mus musculus
acgtgaggtcttgcctgcctgggaa

SEQ ID NO: 122903 - DNA, 25 bp, Mus musculus
acgtgagtgactagcccattcatta

SEQ ID NO: 122904 - DNA, 25 bp, Mus musculus
acgtgagtgactatgtgcttgtgtt

SEQ ID NO: 122905 - DNA, 25 bp, Mus musculus
acgtgagtgacttgcccattcatta

SEQ ID NO: 122906 - DNA, 25 bp, Mus musculus
acgtgagtgactttgtgcttgtgtt

SEQ ID NO: 122907 - DNA, 25 bp, Mus musculus
acgtgagtgtttacagtaggcccat

SEQ ID NO: 122908 - DNA, 25 bp, Mus musculus
acgtgagtgttttcagtaggcccat

SEQ ID NO: 122909 - DNA, 25 bp, Mus musculus
acgtgataatctctgccgtctaatc

SEQ ID NO: 122910 - DNA, 25 bp, Mus musculus
acgtgataatctgtgccgtctaatc

SEQ ID NO: 122911 - DNA, 25 bp, Mus musculus
acgtgatcagacacttcacctgtga

SEQ ID NO: 122912 - DNA, 25 bp, Mus musculus
acgtgatcagactcttcacctgtga

SEQ ID NO: 122913 - DNA, 25 bp, Mus musculus
acgtgatctggcagtacgggctact

SEQ ID NO: 122914 - DNA, 25 bp, Mus musculus
acgtgatctggctgtacgggctact

SEQ ID NO: 122915 - DNA, 25 bp, Mus musculus
acgtgatgcgggagtcacttctaga

SEQ ID NO: 122916 - DNA, 25 bp, Mus musculus
acgtgatgcgggtgtcacttctaga

SEQ ID NO: 122917 - DNA, 25 bp, Mus musculus
acgtgattaccaagcttcagtgttt

SEQ ID NO: 122918 - DNA, 25 bp, Mus musculus
acgtgattaccatgcttcagtgttt

SEQ ID NO: 122919 - DNA, 25 bp, Mus musculus
acgtgattcactatacttgcgggtc

SEQ ID NO: 122920 - DNA, 25 bp, Mus musculus
acgtgattcactttacttgcgggtc

SEQ ID NO: 122921 - DNA, 25 bp, Mus musculus
acgtgcaaaacacgctctagcgttc

SEQ ID NO: 122922 - DNA, 25 bp, Mus musculus
acgtgcaaaacaggctctagcgttc

SEQ ID NO: 122923 - DNA, 25 bp, Mus musculus
acgtgcaactatctgttgttccaat

SEQ ID NO: 122924 - DNA, 25 bp, Mus musculus
acgtgcaactatgtgttgttccaat

SEQ ID NO: 122925 - DNA, 25 bp, Mus musculus
acgtgcacacgtagacattctgtat

SEQ ID NO: 122926 - DNA, 25 bp, Mus musculus
acgtgcacacgttgacattctgtat

SEQ ID NO: 122927 - DNA, 25 bp, Mus musculus
acgtgcacgacgatgtgcggctgct

SEQ ID NO: 122928 - DNA, 25 bp, Mus musculus
acgtgcacgacgttgtgcggctgct

SEQ ID NO: 122929 - DNA, 25 bp, Mus musculus
acgtgcacgcgaagtcagagatcca

SEQ ID NO: 122930 - DNA, 25 bp, Mus musculus
acgtgcacgcgatgtcagagatcca

SEQ ID NO: 122931 - DNA, 25 bp, Mus musculus
acgtgcacttgtcgtaccgcacatg

SEQ ID NO: 122932 - DNA, 25 bp, Mus musculus
acgtgcacttgtggtaccgcacatg

SEQ ID NO: 122933 - DNA, 25 bp, Mus musculus
acgtgcaggacgacccttggagaga

SEQ ID NO: 122934 - DNA, 25 bp, Mus musculus
acgtgcaggacgtcccttggagaga

SEQ ID NO: 122935 - DNA, 25 bp, Mus musculus
acgtgcagggtcacacataggccaa

SEQ ID NO: 122936 - DNA, 25 bp, Mus musculus
acgtgcagggtctcacataggccaa

SEQ ID NO: 122937 - DNA, 25 bp, Mus musculus
acgtgcaggtggagttctcactgta

SEQ ID NO: 122938 - DNA, 25 bp, Mus musculus
acgtgcaggtggtgttctcactgta

SEQ ID NO: 122939 - DNA, 25 bp, Mus musculus
acgtgcagtcacatacactttattt

SEQ ID NO: 122940 - DNA, 25 bp, Mus musculus
acgtgcagtcacttacactttattt

SEQ ID NO: 122941 - DNA, 25 bp, Mus musculus
acgtgcagtcggctattctttcagc

SEQ ID NO: 122942 - DNA, 25 bp, Mus musculus
acgtgcagtcgggtattctttcagc

SEQ ID NO: 122943 - DNA, 25 bp, Mus musculus
acgtgcatacgtcgtgcttatggag

SEQ ID NO: 122944 - DNA, 25 bp, Mus musculus
acgtgcatacgtggtgcttatggag

SEQ ID NO: 122945 - DNA, 25 bp, Mus musculus
acgtgcatgatacctaaggcaggct

SEQ ID NO: 122946 - DNA, 25 bp, Mus musculus
acgtgcatgatagctaaggcaggct

SEQ ID NO: 122947 - DNA, 25 bp, Mus musculus
acgtgcattcatctgagtctggaca

SEQ ID NO: 122948 - DNA, 25 bp, Mus musculus
acgtgcattcatgtgagtctggaca

SEQ ID NO: 122949 - DNA, 25 bp, Mus musculus
acgtgcattgtgcttccttgagaat

SEQ ID NO: 122950 - DNA, 25 bp, Mus musculus
acgtgcattgtggttccttgagaat

SEQ ID NO: 122951 - DNA, 25 bp, Mus musculus
acgtgccagcatctgtctcatcggc

SEQ ID NO: 122952 - DNA, 25 bp, Mus musculus
acgtgccagcatgtgtctcatcggc

SEQ ID NO: 122953 - DNA, 25 bp, Mus musculus
acgtgccatcccattagtacagatt

SEQ ID NO: 122954 - DNA, 25 bp, Mus musculus
acgtgccatccctttagtacagatt

SEQ ID NO: 122955 - DNA, 25 bp, Mus musculus
acgtgcccgagaaagctccagcaaa

SEQ ID NO: 122956 - DNA, 25 bp, Mus musculus
acgtgcccgagatagctccagcaaa

SEQ ID NO: 122957 - DNA, 25 bp, Mus musculus
acgtgccctgttctatcctgacaaa

SEQ ID NO: 122958 - DNA, 25 bp, Mus musculus
acgtgccctgttgtatcctgacaaa

SEQ ID NO: 122959 - DNA, 25 bp, Mus musculus
acgtgccgtttaaaccactggatct

SEQ ID NO: 122960 - DNA, 25 bp, Mus musculus
acgtgccgtttataccactggatct

SEQ ID NO: 122961 - DNA, 25 bp, Mus musculus
acgtgccttcatcatcaaagttcga

SEQ ID NO: 122962 - DNA, 25 bp, Mus musculus
acgtgccttcatgatcaaagttcga

SEQ ID NO: 122963 - DNA, 25 bp, Mus musculus
acgtgcgaattcctttgcctaatga

SEQ ID NO: 122964 - DNA, 25 bp, Mus musculus
acgtgcgaattcgtttgcctaatga

SEQ ID NO: 122965 - DNA, 25 bp, Mus musculus
acgtgcgcaaaactggccaggaccc

SEQ ID NO: 122966 - DNA, 25 bp, Mus musculus
acgtgcgcaaaagtggccaggaccc

SEQ ID NO: 122967 - DNA, 25 bp, Mus musculus
acgtgcgccacgaatcagtctatgg

SEQ ID NO: 122968 - DNA, 25 bp, Mus musculus
acgtgcgccacgtatcagtctatgg

SEQ ID NO: 122969 - DNA, 25 bp, Mus musculus
acgtgcgcgcgcaggcttctgagat

SEQ ID NO: 122970 - DNA, 25 bp, Mus musculus
acgtgcgcgcgctggcttctgagat

SEQ ID NO: 122971 - DNA, 25 bp, Mus musculus
acgtgcgcggcaatctgagatgagc

SEQ ID NO: 122972 - DNA, 25 bp, Mus musculus
acgtgcgcggcattctgagatgagc

SEQ ID NO: 122973 - DNA, 25 bp, Mus musculus
acgtgcgcttcgaggagaatcacat

SEQ ID NO: 122974 - DNA, 25 bp, Mus musculus
acgtgcgcttcgtggagaatcacat

SEQ ID NO: 122975 - DNA, 25 bp, Mus musculus
acgtgcggaagcatagatgtctctg

SEQ ID NO: 122976 - DNA, 25 bp, Mus musculus
acgtgcggaagcttagatgtctctg

SEQ ID NO: 122977 - DNA, 25 bp, Mus musculus
acgtgcggcggcaacctgagctgaa

SEQ ID NO: 122978 - DNA, 25 bp, Mus musculus
acgtgcggcggctacctgagctgaa

SEQ ID NO: 122979 - DNA, 25 bp, Mus musculus
acgtgcgtgcgtcccaacaatagta

SEQ ID NO: 122980 - DNA, 25 bp, Mus musculus
acgtgcgtgcgtgccaacaatagta

SEQ ID NO: 122981 - DNA, 25 bp, Mus musculus
acgtgcgtgtggctcagttttatcc

SEQ ID NO: 122982 - DNA, 25 bp, Mus musculus
acgtgcgtgtgggtcagttttatcc

SEQ ID NO: 122983 - DNA, 25 bp, Mus musculus
acgtgcgttctcagtgccagaccct

SEQ ID NO: 122984 - DNA, 25 bp, Mus musculus
acgtgcgttctctgtgccagaccct

SEQ ID NO: 122985 - DNA, 25 bp, Mus musculus
acgtgctaaacaacttctcgtttgt

SEQ ID NO: 122986 - DNA, 25 bp, Mus musculus
acgtgctaaacatcttctcgtttgt

SEQ ID NO: 122987 - DNA, 25 bp, Mus musculus
acgtgctaccagaaccctgcttagg

SEQ ID NO: 122988 - DNA, 25 bp, Mus musculus
acgtgctaccagtaccctgcttagg

SEQ ID NO: 122989 - DNA, 25 bp, Mus musculus
acgtgctaccatcttagatttcctc

SEQ ID NO: 122990 - DNA, 25 bp, Mus musculus
acgtgctaccatgttagatttcctc

SEQ ID NO: 122991 - DNA, 25 bp, Mus musculus
acgtgctcacgcagaggtgtggaac

SEQ ID NO: 122992 - DNA, 25 bp, Mus musculus
acgtgctcacgctgaggtgtggaac

SEQ ID NO: 122993 - DNA, 25 bp, Mus musculus
acgtgctccaaactctaatgaccat

SEQ ID NO: 122994 - DNA, 25 bp, Mus musculus
acgtgctccaaagtctaatgaccat

SEQ ID NO: 122995 - DNA, 25 bp, Mus musculus
acgtgctcctgtctcatccagaaag

SEQ ID NO: 122996 - DNA, 25 bp, Mus musculus
acgtgctcctgtgtcatccagaaag

SEQ ID NO: 122997 - DNA, 25 bp, Mus musculus
acgtgctggagcaacgactgcgact

SEQ ID NO: 122998 - DNA, 25 bp, Mus musculus
acgtgctggagctacgactgcgact

SEQ ID NO: 122999 - DNA, 25 bp, Mus musculus
acgtgctgggcaaggcatctgtatt

SEQ ID NO: 123000 - DNA, 25 bp, Mus musculus
acgtgctgggcatggcatctgtatt

SEQ ID NO: 123001 - DNA, 25 bp, Mus musculus
acgtgctgtgtgactgaaatgtctc

SEQ ID NO: 123002 - DNA, 25 bp, Mus musculus
acgtgctgtgtgtctgaaatgtctc

SEQ ID NO: 123003 - DNA, 25 bp, Mus musculus
acgtgcttcagtatgcatagaatga

SEQ ID NO: 123004 - DNA, 25 bp, Mus musculus
acgtgcttcagtttgcatagaatga

SEQ ID NO: 123005 - DNA, 25 bp, Mus musculus
acgtgcttccgtcaatactgaatgt

SEQ ID NO: 123006 - DNA, 25 bp, Mus musculus
acgtgcttccgtgaatactgaatgt

SEQ ID NO: 123007 - DNA, 25 bp, Mus musculus
acgtgcttggacactgcatgtacac

SEQ ID NO: 123008 - DNA, 25 bp, Mus musculus
acgtgcttggactctgcatgtacac

SEQ ID NO: 123009 - DNA, 25 bp, Mus musculus
acgtgctttacaaggcagtctctga

SEQ ID NO: 123010 - DNA, 25 bp, Mus musculus
acgtgctttacatggcagtctctga

SEQ ID NO: 123011 - DNA, 25 bp, Mus musculus
acgtggaaaattccccagggctcag

SEQ ID NO: 123012 - DNA, 25 bp, Mus musculus
acgtggaaaattgcccagggctcag

SEQ ID NO: 123013 - DNA, 25 bp, Mus musculus
acgtggaaacgcataccgttcacat

SEQ ID NO: 123014 - DNA, 25 bp, Mus musculus
acgtggaaacgcttaccgttcacat

SEQ ID NO: 123015 - DNA, 25 bp, Mus musculus
acgtggaaagttctgacggctctag

SEQ ID NO: 123016 - DNA, 25 bp, Mus musculus
acgtggaaagttgtgacggctctag

SEQ ID NO: 123017 - DNA, 25 bp, Mus musculus
acgtggaagccaaggactgtctgaa

SEQ ID NO: 123018 - DNA, 25 bp, Mus musculus
acgtggaagccatggactgtctgaa

SEQ ID NO: 123019 - DNA, 25 bp, Mus musculus
acgtggaatctgctgtaatgtgtgt

SEQ ID NO: 123020 - DNA, 25 bp, Mus musculus
acgtggaatctggtgtaatgtgtgt

SEQ ID NO: 123021 - DNA, 25 bp, Mus musculus
acgtggacccaacgagtgctcgctt

SEQ ID NO: 123022 - DNA, 25 bp, Mus musculus
acgtggacccaaggagtgctcgctt

SEQ ID NO: 123023 - DNA, 25 bp, Mus musculus
acgtggactttcagcagctgaaaat

SEQ ID NO: 123024 - DNA, 25 bp, Mus musculus
acgtggactttctgcagctgaaaat

SEQ ID NO: 123025 - DNA, 25 bp, Mus musculus
acgtggaggaagacgctgactgtca

SEQ ID NO: 123026 - DNA, 25 bp, Mus musculus
acgtggaggaagtcgctgactgtca

SEQ ID NO: 123027 - DNA, 25 bp, Mus musculus
acgtggaggaccagtcttcattgga

SEQ ID NO: 123028 - DNA, 25 bp, Mus musculus
acgtggaggacctgtcttcattgga

SEQ ID NO: 123029 - DNA, 25 bp, Mus musculus
acgtggaggtccagcatgtgcgcaa

SEQ ID NO: 123030 - DNA, 25 bp, Mus musculus
acgtggaggtcctgcatgtgcgcaa

SEQ ID NO: 123031 - DNA, 25 bp, Mus musculus
acgtggatattccttatacctgaga

SEQ ID NO: 123032 - DNA, 25 bp, Mus musculus
acgtggatattcgttatacctgaga

SEQ ID NO: 123033 - DNA, 25 bp, Mus musculus
acgtggatcttaaacatgttcaata

SEQ ID NO: 123034 - DNA, 25 bp, Mus musculus
acgtggatcttatacatgttcaata

SEQ ID NO: 123035 - DNA, 25 bp, Mus musculus
acgtggatgcttcctggtggtattt

SEQ ID NO: 123036 - DNA, 25 bp, Mus musculus
acgtggatgcttgctggtggtattt

SEQ ID NO: 123037 - DNA, 25 bp, Mus musculus
acgtggatgttgctatccccttgga

SEQ ID NO: 123038 - DNA, 25 bp, Mus musculus
acgtggatgttggtatccccttgga

SEQ ID NO: 123039 - DNA, 25 bp, Mus musculus
acgtggattcggaagatctgggcca

SEQ ID NO: 123040 - DNA, 25 bp, Mus musculus
acgtggattcggtagatctgggcca

SEQ ID NO: 123041 - DNA, 25 bp, Mus musculus
acgtggcaacggcattagaacaatt

SEQ ID NO: 123042 - DNA, 25 bp, Mus musculus
acgtggcaacgggattagaacaatt

SEQ ID NO: 123043 - DNA, 25 bp, Mus musculus
acgtggcatctcacatggcagtagg

SEQ ID NO: 123044 - DNA, 25 bp, Mus musculus
acgtggcatctctcatggcagtagg

SEQ ID NO: 123045 - DNA, 25 bp, Mus musculus
acgtggccaatgctactgttgtcaa

SEQ ID NO: 123046 - DNA, 25 bp, Mus musculus
acgtggccaatggtactgttgtcaa

SEQ ID NO: 123047 - DNA, 25 bp, Mus musculus
acgtggccattcaggatcttgaggt

SEQ ID NO: 123048 - DNA, 25 bp, Mus musculus
acgtggccattctggatcttgaggt

SEQ ID NO: 123049 - DNA, 25 bp, Mus musculus
acgtggcccggaagacagcaacagg

SEQ ID NO: 123050 - DNA, 25 bp, Mus musculus
acgtggcccggatgacagcaacagg

SEQ ID NO: 123051 - DNA, 25 bp, Mus musculus
acgtggccgccgaagtaactgcaac

SEQ ID NO: 123052 - DNA, 25 bp, Mus musculus
acgtggccgccgtagtaactgcaac

SEQ ID NO: 123053 - DNA, 25 bp, Mus musculus
acgtggcgagagacccggagcaccc

SEQ ID NO: 123054 - DNA, 25 bp, Mus musculus
acgtggcgagagtcccggagcaccc

SEQ ID NO: 123055 - DNA, 25 bp, Mus musculus
acgtggcggcctcttcctgtatctg

SEQ ID NO: 123056 - DNA, 25 bp, Mus musculus
acgtggcggcctgttcctgtatctg

SEQ ID NO: 123057 - DNA, 25 bp, Mus musculus
acgtggcgtccgagatgtttgtttt

SEQ ID NO: 123058 - DNA, 25 bp, Mus musculus
acgtggcgtccgtgatgtttgtttt

SEQ ID NO: 123059 - DNA, 25 bp, Mus musculus
acgtggctaggcatcttttcctgag

SEQ ID NO: 123060 - DNA, 25 bp, Mus musculus
acgtggctaggcttcttttcctgag

SEQ ID NO: 123061 - DNA, 25 bp, Mus musculus
acgtggctccttctcacacctgtga

SEQ ID NO: 123062 - DNA, 25 bp, Mus musculus
acgtggctccttgtcacacctgtga

SEQ ID NO: 123063 - DNA, 25 bp, Mus musculus
acgtggctctggctagatggttcta

SEQ ID NO: 123064 - DNA, 25 bp, Mus musculus
acgtggctctgggtagatggttcta

SEQ ID NO: 123065 - DNA, 25 bp, Mus musculus
acgtggctggccacttgggtccttg

SEQ ID NO: 123066 - DNA, 25 bp, Mus musculus
acgtggctggcctcttgggtccttg

SEQ ID NO: 123067 - DNA, 25 bp, Mus musculus
acgtggctggctacactgtggctca

SEQ ID NO: 123068 - DNA, 25 bp, Mus musculus
acgtggctggcttcactgtggctca

SEQ ID NO: 123069 - DNA, 25 bp, Mus musculus
acgtggctgggaacaagctccggca

SEQ ID NO: 123070 - DNA, 25 bp, Mus musculus
acgtggctgggatcaagctccggca

SEQ ID NO: 123071 - DNA, 25 bp, Mus musculus
acgtggctgtacatagaaagatcta

SEQ ID NO: 123072 - DNA, 25 bp, Mus musculus
acgtggctgtacttagaaagatcta

SEQ ID NO: 123073 - DNA, 25 bp, Mus musculus
acgtgggaagacacctagcttctct

SEQ ID NO: 123074 - DNA, 25 bp, Mus musculus
acgtgggaagactcctagcttctct

SEQ ID NO: 123075 - DNA, 25 bp, Mus musculus
acgtgggagcttaggcctgttcacc

SEQ ID NO: 123076 - DNA, 25 bp, Mus musculus
acgtgggagctttggcctgttcacc

SEQ ID NO: 123077 - DNA, 25 bp, Mus musculus
acgtgggatgcgcttctcgcctagc

SEQ ID NO: 123078 - DNA, 25 bp, Mus musculus
acgtgggatgcggttctcgcctagc

SEQ ID NO: 123079 - DNA, 25 bp, Mus musculus
acgtgggatggacttctaacctcat

SEQ ID NO: 123080 - DNA, 25 bp, Mus musculus
acgtgggatggagttctaacctcat

SEQ ID NO: 123081 - DNA, 25 bp, Mus musculus
acgtgggcactgacgtcactagcca

SEQ ID NO: 123082 - DNA, 25 bp, Mus musculus
acgtgggcactgtcgtcactagcca

SEQ ID NO: 123083 - DNA, 25 bp, Mus musculus
acgtgggcagtcagccacacttcag

SEQ ID NO: 123084 - DNA, 25 bp, Mus musculus
acgtgggcagtctgccacacttcag

SEQ ID NO: 123085 - DNA, 25 bp, Mus musculus
acgtgggcatcgagtcctcacagga

SEQ ID NO: 123086 - DNA, 25 bp, Mus musculus
acgtgggcatcgtgtcctcacagga

SEQ ID NO: 123087 - DNA, 25 bp, Mus musculus
acgtgggctgcgattctgtaattgt

SEQ ID NO: 123088 - DNA, 25 bp, Mus musculus
acgtgggctgcgtttctgtaattgt

SEQ ID NO: 123089 - DNA, 25 bp, Mus musculus
acgtgggtgggaataacgacatcta

SEQ ID NO: 123090 - DNA, 25 bp, Mus musculus
acgtgggtgggattaacgacatcta

SEQ ID NO: 123091 - DNA, 25 bp, Mus musculus
acgtgggttcatagttctgtgtaga

SEQ ID NO: 123092 - DNA, 25 bp, Mus musculus
acgtgggttcattgttctgtgtaga

SEQ ID NO: 123093 - DNA, 25 bp, Mus musculus
acgtggtacgtccaggccacctgtg

SEQ ID NO: 123094 - DNA, 25 bp, Mus musculus
acgtggtacgtcgaggccacctgtg

SEQ ID NO: 123095 - DNA, 25 bp, Mus musculus
acgtggtaggagcagattcccatct

SEQ ID NO: 123096 - DNA, 25 bp, Mus musculus
acgtggtaggaggagattcccatct

SEQ ID NO: 123097 - DNA, 25 bp, Mus musculus
acgtggtcagctcccctccagagtg

SEQ ID NO: 123098 - DNA, 25 bp, Mus musculus
acgtggtcagctgccctccagagtg

SEQ ID NO: 123099 - DNA, 25 bp, Mus musculus
acgtggtccgcgagcctggccaaag

SEQ ID NO: 123100 - DNA, 25 bp, Mus musculus
acgtggtccgcgtgcctggccaaag

SEQ ID NO: 123101 - DNA, 25 bp, Mus musculus
acgtggtcggtcacgtggacagata

SEQ ID NO: 123102 - DNA, 25 bp, Mus musculus
acgtggtcggtctcgtggacagata

SEQ ID NO: 123103 - DNA, 25 bp, Mus musculus
acgtggtctttgacagagctcagag

SEQ ID NO: 123104 - DNA, 25 bp, Mus musculus
acgtggtctttgtcagagctcagag

SEQ ID NO: 123105 - DNA, 25 bp, Mus musculus
acgtggtgaggaacgccacccgcaa

SEQ ID NO: 123106 - DNA, 25 bp, Mus musculus
acgtggtgaggatcgccacccgcaa

SEQ ID NO: 123107 - DNA, 25 bp, Mus musculus
acgtggtgctgcagctaaaaatgca

SEQ ID NO: 123108 - DNA, 25 bp, Mus musculus
acgtggtgctgctgctaaaaatgca

SEQ ID NO: 123109 - DNA, 25 bp, Mus musculus
acgtggtggcttctaaggagcccaa

SEQ ID NO: 123110 - DNA, 25 bp, Mus musculus
acgtggtggcttgtaaggagcccaa

SEQ ID NO: 123111 - DNA, 25 bp, Mus musculus
acgtggttcccacacgcgggtgcaa

SEQ ID NO: 123112 - DNA, 25 bp, Mus musculus
acgtggttcccagacgcgggtgcaa

SEQ ID NO: 123113 - DNA, 25 bp, Mus musculus
acgtggttctttatatgcagttgca

SEQ ID NO: 123114 - DNA, 25 bp, Mus musculus
acgtggttctttttatgcagttgca

SEQ ID NO: 123115 - DNA, 25 bp, Mus musculus
acgtggttgtgcatggtatgctgac

SEQ ID NO: 123116 - DNA, 25 bp, Mus musculus
acgtggttgtgcttggtatgctgac

SEQ ID NO: 123117 - DNA, 25 bp, Mus musculus
acgtgtaaacgtctgcacaactgca

SEQ ID NO: 123118 - DNA, 25 bp, Mus musculus
acgtgtaaacgtgtgcacaactgca

SEQ ID NO: 123119 - DNA, 25 bp, Mus musculus
acgtgtaacctgcagcgctgtgcta

SEQ ID NO: 123120 - DNA, 25 bp, Mus musculus
acgtgtaacctggagcgctgtgcta

SEQ ID NO: 123121 - DNA, 25 bp, Mus musculus
acgtgtaagtaacctctccgtccag

SEQ ID NO: 123122 - DNA, 25 bp, Mus musculus
acgtgtaagtaagctctccgtccag

SEQ ID NO: 123123 - DNA, 25 bp, Mus musculus
acgtgtacctgtccctgtgttgaaa

SEQ ID NO: 123124 - DNA, 25 bp, Mus musculus
acgtgtacctgtgcctgtgttgaaa

SEQ ID NO: 123125 - DNA, 25 bp, Mus musculus
acgtgtacgtctatccgtgtgtgtg

SEQ ID NO: 123126 - DNA, 25 bp, Mus musculus
acgtgtacgtctttccgtgtgtgtg

SEQ ID NO: 123127 - DNA, 25 bp, Mus musculus
acgtgtagacggatccctgttctct

SEQ ID NO: 123128 - DNA, 25 bp, Mus musculus
acgtgtagacggttccctgttctct

SEQ ID NO: 123129 - DNA, 25 bp, Mus musculus
acgtgtagtctactacagcctgacc

SEQ ID NO: 123130 - DNA, 25 bp, Mus musculus
acgtgtagtctagtacagcctgacc

SEQ ID NO: 123131 - DNA, 25 bp, Mus musculus
acgtgtataaagagagttagacctg

SEQ ID NO: 123132 - DNA, 25 bp, Mus musculus
acgtgtataaagtgagttagacctg

SEQ ID NO: 123133 - DNA, 25 bp, Mus musculus
acgtgtatagcacagcgtacccctt

SEQ ID NO: 123134 - DNA, 25 bp, Mus musculus
acgtgtatagcagagcgtacccctt

SEQ ID NO: 123135 - DNA, 25 bp, Mus musculus
acgtgtatgggaatgtctatgacct

SEQ ID NO: 123136 - DNA, 25 bp, Mus musculus
acgtgtatgggattgtctatgacct

SEQ ID NO: 123137 - DNA, 25 bp, Mus musculus
acgtgtcacatgaaccccaagataa

SEQ ID NO: 123138 - DNA, 25 bp, Mus musculus
acgtgtcacatgtaccccaagataa

SEQ ID NO: 123139 - DNA, 25 bp, Mus musculus
acgtgtcagtcaacctagcagttac

SEQ ID NO: 123140 - DNA, 25 bp, Mus musculus
acgtgtcagtcatcctagcagttac

SEQ ID NO: 123141 - DNA, 25 bp, Mus musculus
acgtgtcagttaattcctgtgttca

SEQ ID NO: 123142 - DNA, 25 bp, Mus musculus
acgtgtcagttatttcctgtgttca

SEQ ID NO: 123143 - DNA, 25 bp, Mus musculus
acgtgtccaaagcactgactcactg

SEQ ID NO: 123144 - DNA, 25 bp, Mus musculus
acgtgtccaaaggactgactcactg

SEQ ID NO: 123145 - DNA, 25 bp, Mus musculus
acgtgtccacgtccccttgaaaaca

SEQ ID NO: 123146 - DNA, 25 bp, Mus musculus
acgtgtccacgtgcccttgaaaaca

SEQ ID NO: 123147 - DNA, 25 bp, Mus musculus
acgtgtccagcgcaggatcaggaaa

SEQ ID NO: 123148 - DNA, 25 bp, Mus musculus
acgtgtccagcggaggatcaggaaa

SEQ ID NO: 123149 - DNA, 25 bp, Mus musculus
acgtgtccatcgacacatcagaaga

SEQ ID NO: 123150 - DNA, 25 bp, Mus musculus
acgtgtccatcgtcacatcagaaga

SEQ ID NO: 123151 - DNA, 25 bp, Mus musculus
acgtgtcccatgatttcattctaaa

SEQ ID NO: 123152 - DNA, 25 bp, Mus musculus
acgtgtcccatgttttcattctaaa

SEQ ID NO: 123153 - DNA, 25 bp, Mus musculus
acgtgtccctccctttagtgtcaca

SEQ ID NO: 123154 - DNA, 25 bp, Mus musculus
acgtgtccctccgtttagtgtcaca

SEQ ID NO: 123155 - DNA, 25 bp, Mus musculus
acgtgtccctgactctgatgagaac

SEQ ID NO: 123156 - DNA, 25 bp, Mus musculus
acgtgtccctgagtctgatgagaac

SEQ ID NO: 123157 - DNA, 25 bp, Mus musculus
acgtgtccctgtccatagtaatcca

SEQ ID NO: 123158 - DNA, 25 bp, Mus musculus
acgtgtccctgtgcatagtaatcca

SEQ ID NO: 123159 - DNA, 25 bp, Mus musculus
acgtgtccgaccacctcaagaagag

SEQ ID NO: 123160 - DNA, 25 bp, Mus musculus
acgtgtccgacctcctcaagaagag

SEQ ID NO: 123161 - DNA, 25 bp, Mus musculus
acgtgtcgacccatgcgcggaagtt

SEQ ID NO: 123162 - DNA, 25 bp, Mus musculus
acgtgtcgacccttgcgcggaagtt

SEQ ID NO: 123163 - DNA, 25 bp, Mus musculus
acgtgtcgagcacccgcgtttgtgc

SEQ ID NO: 123164 - DNA, 25 bp, Mus musculus
acgtgtcgagcagccgcgtttgtgc

SEQ ID NO: 123165 - DNA, 25 bp, Mus musculus
acgtgtcggacactgtatgcaaaca

SEQ ID NO: 123166 - DNA, 25 bp, Mus musculus
acgtgtcggacagtgtatgcaaaca

SEQ ID NO: 123167 - DNA, 25 bp, Mus musculus
acgtgtcgtggcctttatcaaaatg

SEQ ID NO: 123168 - DNA, 25 bp, Mus musculus
acgtgtcgtggcgtttatcaaaatg

SEQ ID NO: 123169 - DNA, 25 bp, Mus musculus
acgtgtctcaaaagcttctcatata

SEQ ID NO: 123170 - DNA, 25 bp, Mus musculus
acgtgtctcaaatgcttctcatata

SEQ ID NO: 123171 - DNA, 25 bp, Mus musculus
acgtgtctccggagaccagaagggc

SEQ ID NO: 123172 - DNA, 25 bp, Mus musculus
acgtgtctccggtgaccagaagggc

SEQ ID NO: 123173 - DNA, 25 bp, Mus musculus
acgtgtctggacagtacctgattgt

SEQ ID NO: 123174 - DNA, 25 bp, Mus musculus
acgtgtctggactgtacctgattgt

SEQ ID NO: 123175 - DNA, 25 bp, Mus musculus
acgtgtctggtgacttaagccccaa

SEQ ID NO: 123176 - DNA, 25 bp, Mus musculus
acgtgtctggtgtcttaagccccaa

SEQ ID NO: 123177 - DNA, 25 bp, Mus musculus
acgtgtctgtaaaccttgtatttgt

SEQ ID NO: 123178 - DNA, 25 bp, Mus musculus
acgtgtctgtaatccttgtatttgt

SEQ ID NO: 123179 - DNA, 25 bp, Mus musculus
acgtgtcttcgtatcgcaatttagc

SEQ ID NO: 123180 - DNA, 25 bp, Mus musculus
acgtgtcttcgtttcgcaatttagc

SEQ ID NO: 123181 - DNA, 25 bp, Mus musculus
acgtgtgaaaacaccatactctctt

SEQ ID NO: 123182 - DNA, 25 bp, Mus musculus
acgtgtgaaaactccatactctctt

SEQ ID NO: 123183 - DNA, 25 bp, Mus musculus
acgtgtgaattaccctcagtcccta

SEQ ID NO: 123184 - DNA, 25 bp, Mus musculus
acgtgtgaattagcctcagtcccta

SEQ ID NO: 123185 - DNA, 25 bp, Mus musculus
acgtgtgacctaatctgtggtttgc

SEQ ID NO: 123186 - DNA, 25 bp, Mus musculus
acgtgtgacctattctgtggtttgc

SEQ ID NO: 123187 - DNA, 25 bp, Mus musculus
acgtgtgagataatgtggtaccagg

SEQ ID NO: 123188 - DNA, 25 bp, Mus musculus
acgtgtgagatattgtggtaccagg

SEQ ID NO: 123189 - DNA, 25 bp, Mus musculus
acgtgtgagattccatacttccctt

SEQ ID NO: 123190 - DNA, 25 bp, Mus musculus
acgtgtgagattgcatacttccctt

SEQ ID NO: 123191 - DNA, 25 bp, Mus musculus
acgtgtgcatgcattcggtttcacc

SEQ ID NO: 123192 - DNA, 25 bp, Mus musculus
acgtgtgcatgctttcggtttcacc

SEQ ID NO: 123193 - DNA, 25 bp, Mus musculus
acgtgtgccactagcggcaaaggtt

SEQ ID NO: 123194 - DNA, 25 bp, Mus musculus
acgtgtgccacttgcggcaaaggtt

SEQ ID NO: 123195 - DNA, 25 bp, Mus musculus
acgtgtgcccacaacatggagatgc

SEQ ID NO: 123196 - DNA, 25 bp, Mus musculus
acgtgtgcccacagctgaagtttta

SEQ ID NO: 123197 - DNA, 25 bp, Mus musculus
acgtgtgcccactacatggagatgc

SEQ ID NO: 123198 - DNA, 25 bp, Mus musculus
acgtgtgcccactgctgaagtttta

SEQ ID NO: 123199 - DNA, 25 bp, Mus musculus
acgtgtgcgctcacgtgggtgacat

SEQ ID NO: 123200 - DNA, 25 bp, Mus musculus
acgtgtgcgctctcgtgggtgacat

SEQ ID NO: 123201 - DNA, 25 bp, Mus musculus
acgtgtgctcaactttgctcttcta

SEQ ID NO: 123202 - DNA, 25 bp, Mus musculus
acgtgtgctcaagtttgctcttcta

SEQ ID NO: 123203 - DNA, 25 bp, Mus musculus
acgtgtggcagtcgtacctgagcac

SEQ ID NO: 123204 - DNA, 25 bp, Mus musculus
acgtgtggcagtggtacctgagcac

SEQ ID NO: 123205 - DNA, 25 bp, Mus musculus
acgtgtggcctgctctcatggagaa

SEQ ID NO: 123206 - DNA, 25 bp, Mus musculus
acgtgtggcctggtctcatggagaa

SEQ ID NO: 123207 - DNA, 25 bp, Mus musculus
acgtgtggtcttccagatctgggac

SEQ ID NO: 123208 - DNA, 25 bp, Mus musculus
acgtgtggtcttgcagatctgggac

SEQ ID NO: 123209 - DNA, 25 bp, Mus musculus
acgtgtgtaagtcattgtgccggat

SEQ ID NO: 123210 - DNA, 25 bp, Mus musculus
acgtgtgtaagtgattgtgccggat

SEQ ID NO: 123211 - DNA, 25 bp, Mus musculus
acgtgtgtaattaatctgcccagta

SEQ ID NO: 123212 - DNA, 25 bp, Mus musculus
acgtgtgtaatttatctgcccagta

SEQ ID NO: 123213 - DNA, 25 bp, Mus musculus
acgtgtgtccgtctgaccgttgtta

SEQ ID NO: 123214 - DNA, 25 bp, Mus musculus
acgtgtgtccgtgtgaccgttgtta

SEQ ID NO: 123215 - DNA, 25 bp, Mus musculus
acgtgtgtcctgagctgtaatttaa

SEQ ID NO: 123216 - DNA, 25 bp, Mus musculus
acgtgtgtcctgtgctgtaatttaa

SEQ ID NO: 123217 - DNA, 25 bp, Mus musculus
acgtgtgtgactcgcctcactggca

SEQ ID NO: 123218 - DNA, 25 bp, Mus musculus
acgtgtgtgactggcctcactggca

SEQ ID NO: 123219 - DNA, 25 bp, Mus musculus
acgtgtgtgcagagggttgctacct

SEQ ID NO: 123220 - DNA, 25 bp, Mus musculus
acgtgtgtgcagtgggttgctacct

SEQ ID NO: 123221 - DNA, 25 bp, Mus musculus
acgtgtgtgcccaggtgtacctatg

SEQ ID NO: 123222 - DNA, 25 bp, Mus musculus
acgtgtgtgccctggtgtacctatg

SEQ ID NO: 123223 - DNA, 25 bp, Mus musculus
acgtgtgtgcttctacaaggtgttt

SEQ ID NO: 123224 - DNA, 25 bp, Mus musculus
acgtgtgtgcttgtacaaggtgttt

SEQ ID NO: 123225 - DNA, 25 bp, Mus musculus
acgtgtgtggccctttgactgacaa

SEQ ID NO: 123226 - DNA, 25 bp, Mus musculus
acgtgtgtggccgtttgactgacaa

SEQ ID NO: 123227 - DNA, 25 bp, Mus musculus
acgtgtgttcctacggattctaagc

SEQ ID NO: 123228 - DNA, 25 bp, Mus musculus
acgtgtgttccttcggattctaagc

SEQ ID NO: 123229 - DNA, 25 bp, Mus musculus
acgtgttaactcatagtgccatcaa

SEQ ID NO: 123230 - DNA, 25 bp, Mus musculus
acgtgttaactcttagtgccatcaa

SEQ ID NO: 123231 - DNA, 25 bp, Mus musculus
acgtgttaggtcatcctcctgggcg

SEQ ID NO: 123232 - DNA, 25 bp, Mus musculus
acgtgttaggtcttcctcctgggcg

SEQ ID NO: 123233 - DNA, 25 bp, Mus musculus
acgtgttagtggagctctggtcaga

SEQ ID NO: 123234 - DNA, 25 bp, Mus musculus
acgtgttagtggtgctctggtcaga

SEQ ID NO: 123235 - DNA, 25 bp, Mus musculus
acgtgttatgctccatcttgtgaca

SEQ ID NO: 123236 - DNA, 25 bp, Mus musculus
acgtgttatgctgcatcttgtgaca

SEQ ID NO: 123237 - DNA, 25 bp, Mus musculus
acgtgttcagggatctatccgggca

SEQ ID NO: 123238 - DNA, 25 bp, Mus musculus
acgtgttcagggttctatccgggca

SEQ ID NO: 123239 - DNA, 25 bp, Mus musculus
acgtgttcattcagagctgctcaca

SEQ ID NO: 123240 - DNA, 25 bp, Mus musculus
acgtgttcattctgagctgctcaca

SEQ ID NO: 123241 - DNA, 25 bp, Mus musculus
acgtgttccctgctttttaagcgat

SEQ ID NO: 123242 - DNA, 25 bp, Mus musculus
acgtgttccctggtttttaagcgat

SEQ ID NO: 123243 - DNA, 25 bp, Mus musculus
acgtgttcccttagccaagaagaga

SEQ ID NO: 123244 - DNA, 25 bp, Mus musculus
acgtgttccctttgccaagaagaga

SEQ ID NO: 123245 - DNA, 25 bp, Mus musculus
acgtgttcctcactagaagaaaatg

SEQ ID NO: 123246 - DNA, 25 bp, Mus musculus
acgtgttcctcagtagaagaaaatg

SEQ ID NO: 123247 - DNA, 25 bp, Mus musculus
acgtgttctaagagtgattggctgg

SEQ ID NO: 123248 - DNA, 25 bp, Mus musculus
acgtgttctaagtgtgattggctgg

SEQ ID NO: 123249 - DNA, 25 bp, Mus musculus
acgtgttctattcagtgcccttatg

SEQ ID NO: 123250 - DNA, 25 bp, Mus musculus
acgtgttctattgagtgcccttatg

SEQ ID NO: 123251 - DNA, 25 bp, Mus musculus
acgtgttgaaggcatttatggaaat

SEQ ID NO: 123252 - DNA, 25 bp, Mus musculus
acgtgttgaagggatttatggaaat

SEQ ID NO: 123253 - DNA, 25 bp, Mus musculus
acgtgttgacgcatcccttggacat

SEQ ID NO: 123254 - DNA, 25 bp, Mus musculus
acgtgttgacgcttcccttggacat

SEQ ID NO: 123255 - DNA, 25 bp, Mus musculus
acgtgttgactgagggagcccctga

SEQ ID NO: 123256 - DNA, 25 bp, Mus musculus
acgtgttgactgtgggagcccctga

SEQ ID NO: 123257 - DNA, 25 bp, Mus musculus
acgtgttgattgactatgttgtgat

SEQ ID NO: 123258 - DNA, 25 bp, Mus musculus
acgtgttgattgtctatgttgtgat

SEQ ID NO: 123259 - DNA, 25 bp, Mus musculus
acgtgttggttcatactgtgtgtca

SEQ ID NO: 123260 - DNA, 25 bp, Mus musculus
acgtgttggttcttactgtgtgtca

SEQ ID NO: 123261 - DNA, 25 bp, Mus musculus
acgtgttgtcgacttctagtgttgc

SEQ ID NO: 123262 - DNA, 25 bp, Mus musculus
acgtgttgtcgagttctagtgttgc

SEQ ID NO: 123263 - DNA, 25 bp, Mus musculus
acgtgtttacctacagcttgtctgt

SEQ ID NO: 123264 - DNA, 25 bp, Mus musculus
acgtgtttaccttcagcttgtctgt

SEQ ID NO: 123265 - DNA, 25 bp, Mus musculus
acgtgtttagttctcttctagtagc

SEQ ID NO: 123266 - DNA, 25 bp, Mus musculus
acgtgtttagttgtcttctagtagc

SEQ ID NO: 123267 - DNA, 25 bp, Mus musculus
acgtgtttcagcctcttgacttcca

SEQ ID NO: 123268 - DNA, 25 bp, Mus musculus
acgtgtttcagcgtcttgacttcca

SEQ ID NO: 123269 - DNA, 25 bp, Mus musculus
acgtgtttccacaacctgggtgagt

SEQ ID NO: 123270 - DNA, 25 bp, Mus musculus
acgtgtttccactacctgggtgagt

SEQ ID NO: 123271 - DNA, 25 bp, Mus musculus
acgtgtttccgtcagatgggtgcct

SEQ ID NO: 123272 - DNA, 25 bp, Mus musculus
acgtgtttccgtgagatgggtgcct

SEQ ID NO: 123273 - DNA, 25 bp, Mus musculus
acgtgtttgatcactactctgaccc

SEQ ID NO: 123274 - DNA, 25 bp, Mus musculus
acgtgtttgatctctactctgaccc

SEQ ID NO: 123275 - DNA, 25 bp, Mus musculus
acgtgtttggagctagcggcatatc

SEQ ID NO: 123276 - DNA, 25 bp, Mus musculus
acgtgtttggaggtagcggcatatc

SEQ ID NO: 123277 - DNA, 25 bp, Mus musculus
acgtgtttggttcagtgtcacgcac

SEQ ID NO: 123278 - DNA, 25 bp, Mus musculus
acgtgtttggttgagtgtcacgcac

SEQ ID NO: 123279 - DNA, 25 bp, Mus musculus
acgtgttttcttactagaccatgtt

SEQ ID NO: 123280 - DNA, 25 bp, Mus musculus
acgtgttttctttctagaccatgtt

SEQ ID NO: 123281 - DNA, 25 bp, Mus musculus
acgttaaaccgcatctctgtgaact

SEQ ID NO: 123282 - DNA, 25 bp, Mus musculus
acgttaaaccgcttctctgtgaact

SEQ ID NO: 123283 - DNA, 25 bp, Mus musculus
acgttaatcagtcacacaaactttt

SEQ ID NO: 123284 - DNA, 25 bp, Mus musculus
acgttaatcagtgacacaaactttt

SEQ ID NO: 123285 - DNA, 25 bp, Mus musculus
acgttacacttaaacaccctcttga

SEQ ID NO: 123286 - DNA, 25 bp, Mus musculus
acgttacacttatacaccctcttga

SEQ ID NO: 123287 - DNA, 25 bp, Mus musculus
acgttaccacgtcttccctggagct

SEQ ID NO: 123288 - DNA, 25 bp, Mus musculus
acgttaccacgtgttccctggagct

SEQ ID NO: 123289 - DNA, 25 bp, Mus musculus
acgttaccctccatgaaaactacat

SEQ ID NO: 123290 - DNA, 25 bp, Mus musculus
acgttaccctccttgaaaactacat

SEQ ID NO: 123291 - DNA, 25 bp, Mus musculus
acgttaccttcaagtagcagtgcat

SEQ ID NO: 123292 - DNA, 25 bp, Mus musculus
acgttaccttcatgtagcagtgcat

SEQ ID NO: 123293 - DNA, 25 bp, Mus musculus
acgttacctttgcttctaattccat

SEQ ID NO: 123294 - DNA, 25 bp, Mus musculus
acgttacctttggttctaattccat

SEQ ID NO: 123295 - DNA, 25 bp, Mus musculus
acgttagagcacagcctttgtggtg

SEQ ID NO: 123296 - DNA, 25 bp, Mus musculus
acgttagagcactgcctttgtggtg

SEQ ID NO: 123297 - DNA, 25 bp, Mus musculus
acgttagtattaatgtggagaagcc

SEQ ID NO: 123298 - DNA, 25 bp, Mus musculus
acgttagtattattgtggagaagcc

SEQ ID NO: 123299 - DNA, 25 bp, Mus musculus
acgttatatgtaatggttccagcag

SEQ ID NO: 123300 - DNA, 25 bp, Mus musculus
acgttatatgtattggttccagcag

SEQ ID NO: 123301 - DNA, 25 bp, Mus musculus
acgttatcactacttctgggcacca

SEQ ID NO: 123302 - DNA, 25 bp, Mus musculus
acgttatcactagttctgggcacca

SEQ ID NO: 123303 - DNA, 25 bp, Mus musculus
acgttatgctcactccaatgggtgg

SEQ ID NO: 123304 - DNA, 25 bp, Mus musculus
acgttatgctcagtccaatgggtgg

SEQ ID NO: 123305 - DNA, 25 bp, Mus musculus
acgttatggatgaatgatccagtca

SEQ ID NO: 123306 - DNA, 25 bp, Mus musculus
acgttatggatgtatgatccagtca

SEQ ID NO: 123307 - DNA, 25 bp, Mus musculus
acgttattagtactgtctcgcgctg

SEQ ID NO: 123308 - DNA, 25 bp, Mus musculus
acgttattagtagtgtctcgcgctg

SEQ ID NO: 123309 - DNA, 25 bp, Mus musculus
acgttcactaatatctgcctatcag

SEQ ID NO: 123310 - DNA, 25 bp, Mus musculus
acgttcactaatttctgcctatcag

SEQ ID NO: 123311 - DNA, 25 bp, Mus musculus
acgttcagcctcagcagtgacagtg

SEQ ID NO: 123312 - DNA, 25 bp, Mus musculus
acgttcagcctctgcagtgacagtg

SEQ ID NO: 123313 - DNA, 25 bp, Mus musculus
acgttcagcctgagtgtctacccag

SEQ ID NO: 123314 - DNA, 25 bp, Mus musculus
acgttcagcctgtgtgtctacccag

SEQ ID NO: 123315 - DNA, 25 bp, Mus musculus
acgttcagcttcatgggctttgaga

SEQ ID NO: 123316 - DNA, 25 bp, Mus musculus
acgttcagcttcttgggctttgaga

SEQ ID NO: 123317 - DNA, 25 bp, Mus musculus
acgttcagtccccatgtggatgtca

SEQ ID NO: 123318 - DNA, 25 bp, Mus musculus
acgttcagtcccgatgtggatgtca

SEQ ID NO: 123319 - DNA, 25 bp, Mus musculus
acgttcatacctcggagttaccatg

SEQ ID NO: 123320 - DNA, 25 bp, Mus musculus
acgttcatacctgggagttaccatg

SEQ ID NO: 123321 - DNA, 25 bp, Mus musculus
acgttcatccttagagtgtttctgt

SEQ ID NO: 123322 - DNA, 25 bp, Mus musculus
acgttcatcctttgagtgtttctgt

SEQ ID NO: 123323 - DNA, 25 bp, Mus musculus
acgttcatgggtaaaagtctgcact

SEQ ID NO: 123324 - DNA, 25 bp, Mus musculus
acgttcatgggttaaagtctgcact

SEQ ID NO: 123325 - DNA, 25 bp, Mus musculus
acgttccacgctatttaattgcagt

SEQ ID NO: 123326 - DNA, 25 bp, Mus musculus
acgttccacgctttttaattgcagt

SEQ ID NO: 123327 - DNA, 25 bp, Mus musculus
acgttccattcccaggtggtacaat

SEQ ID NO: 123328 - DNA, 25 bp, Mus musculus
acgttccattccgaggtggtacaat

SEQ ID NO: 123329 - DNA, 25 bp, Mus musculus
acgttccccagcatttggactgaat

SEQ ID NO: 123330 - DNA, 25 bp, Mus musculus
acgttccccagcttttggactgaat

SEQ ID NO: 123331 - DNA, 25 bp, Mus musculus
acgttcccggtgctttctgaagaat

SEQ ID NO: 123332 - DNA, 25 bp, Mus musculus
acgttcccggtggtttctgaagaat

SEQ ID NO: 123333 - DNA, 25 bp, Mus musculus
acgttccgggagaagtcgcggatca

SEQ ID NO: 123334 - DNA, 25 bp, Mus musculus
acgttccgggagtagtcgcggatca

SEQ ID NO: 123335 - DNA, 25 bp, Mus musculus
acgttcgatcttccatggagcaatc

SEQ ID NO: 123336 - DNA, 25 bp, Mus musculus
acgttcgatcttgcatggagcaatc

SEQ ID NO: 123337 - DNA, 25 bp, Mus musculus
acgttcgtgtctcacggtttgttga

SEQ ID NO: 123338 - DNA, 25 bp, Mus musculus
acgttcgtgtctgacggtttgttga

SEQ ID NO: 123339 - DNA, 25 bp, Mus musculus
acgttcgttcgcatgtgcaggcaca

SEQ ID NO: 123340 - DNA, 25 bp, Mus musculus
acgttcgttcgcttgtgcaggcaca

SEQ ID NO: 123341 - DNA, 25 bp, Mus musculus
acgttctaagaacaccgttgacaga

SEQ ID NO: 123342 - DNA, 25 bp, Mus musculus
acgttctaagaagaccgttgacaga

SEQ ID NO: 123343 - DNA, 25 bp, Mus musculus
acgttctacagccatacattcggaa

SEQ ID NO: 123344 - DNA, 25 bp, Mus musculus
acgttctacagcgatacattcggaa

SEQ ID NO: 123345 - DNA, 25 bp, Mus musculus
acgttctcagagatatcagccctgc

SEQ ID NO: 123346 - DNA, 25 bp, Mus musculus
acgttctcagagttatcagccctgc

SEQ ID NO: 123347 - DNA, 25 bp, Mus musculus
acgttctccctcatacatttatatt

SEQ ID NO: 123348 - DNA, 25 bp, Mus musculus
acgttctccctcttacatttatatt

SEQ ID NO: 123349 - DNA, 25 bp, Mus musculus
acgttctccgtgattctgatgtctg

SEQ ID NO: 123350 - DNA, 25 bp, Mus musculus
acgttctccgtgtttctgatgtctg

SEQ ID NO: 123351 - DNA, 25 bp, Mus musculus
acgttctctgacaattgtatttaga

SEQ ID NO: 123352 - DNA, 25 bp, Mus musculus
acgttctctgactattgtatttaga

SEQ ID NO: 123353 - DNA, 25 bp, Mus musculus
acgttctctggaatctagattcaat

SEQ ID NO: 123354 - DNA, 25 bp, Mus musculus
acgttctctggattctagattcaat

SEQ ID NO: 123355 - DNA, 25 bp, Mus musculus
acgttctctttcaagaatgctcccc

SEQ ID NO: 123356 - DNA, 25 bp, Mus musculus
acgttctctttctagaatgctcccc

SEQ ID NO: 123357 - DNA, 25 bp, Mus musculus
acgttctgacagatttgcagggctt

SEQ ID NO: 123358 - DNA, 25 bp, Mus musculus
acgttctgacagttttgcagggctt

SEQ ID NO: 123359 - DNA, 25 bp, Mus musculus
acgttctgattgagctcacccaggc

SEQ ID NO: 123360 - DNA, 25 bp, Mus musculus
acgttctgattgtgctcacccaggc

SEQ ID NO: 123361 - DNA, 25 bp, Mus musculus
acgttctgcgaaaccggatcaatga

SEQ ID NO: 123362 - DNA, 25 bp, Mus musculus
acgttctgcgaatccggatcaatga

SEQ ID NO: 123363 - DNA, 25 bp, Mus musculus
acgttctgtcctccactttaatggg

SEQ ID NO: 123364 - DNA, 25 bp, Mus musculus
acgttctgtcctgcactttaatggg

SEQ ID NO: 123365 - DNA, 25 bp, Mus musculus
acgttcttcagaacacttaggtgag

SEQ ID NO: 123366 - DNA, 25 bp, Mus musculus
acgttcttcagatcacttaggtgag

SEQ ID NO: 123367 - DNA, 25 bp, Mus musculus
acgttcttcattaaagtcttgcttc

SEQ ID NO: 123368 - DNA, 25 bp, Mus musculus
acgttcttcatttaagtcttgcttc

SEQ ID NO: 123369 - DNA, 25 bp, Mus musculus
acgttcttcttactaccatccatga

SEQ ID NO: 123370 - DNA, 25 bp, Mus musculus
acgttcttcttagtaccatccatga

SEQ ID NO: 123371 - DNA, 25 bp, Mus musculus
acgttcttgaccattaagctctctc

SEQ ID NO: 123372 - DNA, 25 bp, Mus musculus
acgttcttgacctttaagctctctc

SEQ ID NO: 123373 - DNA, 25 bp, Mus musculus
acgttcttgcctcctacatggtgca

SEQ ID NO: 123374 - DNA, 25 bp, Mus musculus
acgttcttgcctgctacatggtgca

SEQ ID NO: 123375 - DNA, 25 bp, Mus musculus
acgttcttggtcctattgaagcatt

SEQ ID NO: 123376 - DNA, 25 bp, Mus musculus
acgttcttggtcgtattgaagcatt

SEQ ID NO: 123377 - DNA, 25 bp, Mus musculus
acgttctttattagtctggtgccaa

SEQ ID NO: 123378 - DNA, 25 bp, Mus musculus
acgttctttatttgtctggtgccaa

SEQ ID NO: 123379 - DNA, 25 bp, Mus musculus
acgttctttgtacgatgagatgcca

SEQ ID NO: 123380 - DNA, 25 bp, Mus musculus
acgttctttgtaggatgagatgcca

SEQ ID NO: 123381 - DNA, 25 bp, Mus musculus
acgttctttgtcactgtcctgtata

SEQ ID NO: 123382 - DNA, 25 bp, Mus musculus
acgttctttgtctctgtcctgtata

SEQ ID NO: 123383 - DNA, 25 bp, Mus musculus
acgttgaaccttctggagagccttc

SEQ ID NO: 123384 - DNA, 25 bp, Mus musculus
acgttgaaccttgtggagagccttc

SEQ ID NO: 123385 - DNA, 25 bp, Mus musculus
acgttgaagggaccccatgcagttc

SEQ ID NO: 123386 - DNA, 25 bp, Mus musculus
acgttgaagggagcccatgcagttc

SEQ ID NO: 123387 - DNA, 25 bp, Mus musculus
acgttgaccaagcacgagtatgaac

SEQ ID NO: 123388 - DNA, 25 bp, Mus musculus
acgttgaccaaggacgagtatgaac

SEQ ID NO: 123389 - DNA, 25 bp, Mus musculus
acgttgacgagtctgacctggtgct

SEQ ID NO: 123390 - DNA, 25 bp, Mus musculus
acgttgacgagtgtgacctggtgct

SEQ ID NO: 123391 - DNA, 25 bp, Mus musculus
acgttgagagtcacggcaaggcccc

SEQ ID NO: 123392 - DNA, 25 bp, Mus musculus
acgttgagagtctcggcaaggcccc

SEQ ID NO: 123393 - DNA, 25 bp, Mus musculus
acgttgagagtgaacccggtgcccg

SEQ ID NO: 123394 - DNA, 25 bp, Mus musculus
acgttgagagtgtacccggtgcccg

SEQ ID NO: 123395 - DNA, 25 bp, Mus musculus
acgttgattgctatctacgcctagg

SEQ ID NO: 123396 - DNA, 25 bp, Mus musculus
acgttgattgctttctacgcctagg

SEQ ID NO: 123397 - DNA, 25 bp, Mus musculus
acgttgcaggaccacatgtttcagg

SEQ ID NO: 123398 - DNA, 25 bp, Mus musculus
acgttgcaggacgacatgtttcagg

SEQ ID NO: 123399 - DNA, 25 bp, Mus musculus
acgttgccagccattgacttgacta

SEQ ID NO: 123400 - DNA, 25 bp, Mus musculus
acgttgccagcctttgacttgacta

SEQ ID NO: 123401 - DNA, 25 bp, Mus musculus
acgttgccatgcagtgtctagttta

SEQ ID NO: 123402 - DNA, 25 bp, Mus musculus
acgttgccatgctgtgtctagttta

SEQ ID NO: 123403 - DNA, 25 bp, Mus musculus
acgttgccgaaacaagccatcgctt

SEQ ID NO: 123404 - DNA, 25 bp, Mus musculus
acgttgccgaaagaagccatcgctt

SEQ ID NO: 123405 - DNA, 25 bp, Mus musculus
acgttgcctttgactttggctccta

SEQ ID NO: 123406 - DNA, 25 bp, Mus musculus
acgttgcctttgtctttggctccta

SEQ ID NO: 123407 - DNA, 25 bp, Mus musculus
acgttgcgtctcaggaaatggacgt

SEQ ID NO: 123408 - DNA, 25 bp, Mus musculus
acgttgcgtctctggaaatggacgt

SEQ ID NO: 123409 - DNA, 25 bp, Mus musculus
acgttgcttataactgatcactttt

SEQ ID NO: 123410 - DNA, 25 bp, Mus musculus
acgttgcttatatctgatcactttt

SEQ ID NO: 123411 - DNA, 25 bp, Mus musculus
acgttggagagtcattactttccca

SEQ ID NO: 123412 - DNA, 25 bp, Mus musculus
acgttggagagtgattactttccca

SEQ ID NO: 123413 - DNA, 25 bp, Mus musculus
acgttggattttctttgtcttactg

SEQ ID NO: 123414 - DNA, 25 bp, Mus musculus
acgttggattttgtttgtcttactg

SEQ ID NO: 123415 - DNA, 25 bp, Mus musculus
acgttgggaggacggctggcatgga

SEQ ID NO: 123416 - DNA, 25 bp, Mus musculus
acgttgggaggagggctggcatgga

SEQ ID NO: 123417 - DNA, 25 bp, Mus musculus
acgttgggcattaaattgctgaaga

SEQ ID NO: 123418 - DNA, 25 bp, Mus musculus
acgttgggcatttaattgctgaaga

SEQ ID NO: 123419 - DNA, 25 bp, Mus musculus
acgttggtcactctaaacctgtcaa

SEQ ID NO: 123420 - DNA, 25 bp, Mus musculus
acgttggtcactgtaaacctgtcaa

SEQ ID NO: 123421 - DNA, 25 bp, Mus musculus
acgttggtgccacccctgagcctga

SEQ ID NO: 123422 - DNA, 25 bp, Mus musculus
acgttggtgccagccctgagcctga

SEQ ID NO: 123423 - DNA, 25 bp, Mus musculus
acgttggtggagagttgtatgaaaa

SEQ ID NO: 123424 - DNA, 25 bp, Mus musculus
acgttggtggagtgttgtatgaaaa

SEQ ID NO: 123425 - DNA, 25 bp, Mus musculus
acgttggtgggaattggttcatctt

SEQ ID NO: 123426 - DNA, 25 bp, Mus musculus
acgttggtgggatttggttcatctt

SEQ ID NO: 123427 - DNA, 25 bp, Mus musculus
acgttggttcacaaagtcctagctc

SEQ ID NO: 123428 - DNA, 25 bp, Mus musculus
acgttggttcactaagtcctagctc

SEQ ID NO: 123429 - DNA, 25 bp, Mus musculus
acgttgtactgtattgtctgttcca

SEQ ID NO: 123430 - DNA, 25 bp, Mus musculus
acgttgtactgttttgtctgttcca

SEQ ID NO: 123431 - DNA, 25 bp, Mus musculus
acgttgtagcagcaaatgatcccaa

SEQ ID NO: 123432 - DNA, 25 bp, Mus musculus
acgttgtagcaggaaatgatcccaa

SEQ ID NO: 123433 - DNA, 25 bp, Mus musculus
acgttgtcaattctttacattttgt

SEQ ID NO: 123434 - DNA, 25 bp, Mus musculus
acgttgtcaattgtttacattttgt

SEQ ID NO: 123435 - DNA, 25 bp, Mus musculus
acgttgtgacccatgtgacttctgg

SEQ ID NO: 123436 - DNA, 25 bp, Mus musculus
acgttgtgacccttgtgacttctgg

SEQ ID NO: 123437 - DNA, 25 bp, Mus musculus
acgttgtgtgagctcctaattggta

SEQ ID NO: 123438 - DNA, 25 bp, Mus musculus
acgttgtgtgaggtcctaattggta

SEQ ID NO: 123439 - DNA, 25 bp, Mus musculus
acgtttacacctatgccagtgtcac

SEQ ID NO: 123440 - DNA, 25 bp, Mus musculus
acgtttacacctttgccagtgtcac

SEQ ID NO: 123441 - DNA, 25 bp, Mus musculus
acgtttacagtgacaaccctactga

SEQ ID NO: 123442 - DNA, 25 bp, Mus musculus
acgtttacagtgtcaaccctactga

SEQ ID NO: 123443 - DNA, 25 bp, Mus musculus
acgtttaccagccacaagtagttgt

SEQ ID NO: 123444 - DNA, 25 bp, Mus musculus
acgtttaccagcgacaagtagttgt

SEQ ID NO: 123445 - DNA, 25 bp, Mus musculus
acgtttacctgtcttgttgattata

SEQ ID NO: 123446 - DNA, 25 bp, Mus musculus
acgtttacctgtgttgttgattata

SEQ ID NO: 123447 - DNA, 25 bp, Mus musculus
acgtttactccgacttatggtctga

SEQ ID NO: 123448 - DNA, 25 bp, Mus musculus
acgtttactccgtcttatggtctga

SEQ ID NO: 123449 - DNA, 25 bp, Mus musculus
acgtttactggccaaagctctgcac

SEQ ID NO: 123450 - DNA, 25 bp, Mus musculus
acgtttactggcgaaagctctgcac

SEQ ID NO: 123451 - DNA, 25 bp, Mus musculus
acgtttcaacgaaatcttgggcaga

SEQ ID NO: 123452 - DNA, 25 bp, Mus musculus
acgtttcaacgatatcttgggcaga

SEQ ID NO: 123453 - DNA, 25 bp, Mus musculus
acgtttcacaggattgcaggcgaca

SEQ ID NO: 123454 - DNA, 25 bp, Mus musculus
acgtttcacaggtttgcaggcgaca

SEQ ID NO: 123455 - DNA, 25 bp, Mus musculus
acgtttccatggatgtttgttgcta

SEQ ID NO: 123456 - DNA, 25 bp, Mus musculus
acgtttccatggttgtttgttgcta

SEQ ID NO: 123457 - DNA, 25 bp, Mus musculus
acgtttcccagcagaagtcgctaga

SEQ ID NO: 123458 - DNA, 25 bp, Mus musculus
acgtttcccagctgaagtcgctaga

SEQ ID NO: 123459 - DNA, 25 bp, Mus musculus
acgtttccggccaatggacaatttg

SEQ ID NO: 123460 - DNA, 25 bp, Mus musculus
acgtttccggcctatggacaatttg

SEQ ID NO: 123461 - DNA, 25 bp, Mus musculus
acgtttcctgcacggctggccacag

SEQ ID NO: 123462 - DNA, 25 bp, Mus musculus
acgtttcctgcagggctggccacag

SEQ ID NO: 123463 - DNA, 25 bp, Mus musculus
acgtttctacatctcaccgttggta

SEQ ID NO: 123464 - DNA, 25 bp, Mus musculus
acgtttctacatgtcaccgttggta

SEQ ID NO: 123465 - DNA, 25 bp, Mus musculus
acgtttctactcaagatggcaacat

SEQ ID NO: 123466 - DNA, 25 bp, Mus musculus
acgtttctactctagatggcaacat

SEQ ID NO: 123467 - DNA, 25 bp, Mus musculus
acgtttctcataagtgtggtgtcat

SEQ ID NO: 123468 - DNA, 25 bp, Mus musculus
acgtttctcatatgtgtggtgtcat

SEQ ID NO: 123469 - DNA, 25 bp, Mus musculus
acgtttctcctgaataatcttataa

SEQ ID NO: 123470 - DNA, 25 bp, Mus musculus
acgtttctcctgtataatcttataa

SEQ ID NO: 123471 - DNA, 25 bp, Mus musculus
acgtttcttcaaaatcatccccaga

SEQ ID NO: 123472 - DNA, 25 bp, Mus musculus
acgtttcttcaatatcatccccaga

SEQ ID NO: 123473 - DNA, 25 bp, Mus musculus
acgtttcttcacaaacatcccaata

SEQ ID NO: 123474 - DNA, 25 bp, Mus musculus
acgtttcttcactaacatcccaata

SEQ ID NO: 123475 - DNA, 25 bp, Mus musculus
acgtttcttcatatgtgtagtgctg

SEQ ID NO: 123476 - DNA, 25 bp, Mus musculus
acgtttcttcatttgtgtagtgctg

SEQ ID NO: 123477 - DNA, 25 bp, Mus musculus
acgtttcttctaccttaagacatga

SEQ ID NO: 123478 - DNA, 25 bp, Mus musculus
acgtttcttctagcttaagacatga

SEQ ID NO: 123479 - DNA, 25 bp, Mus musculus
acgtttgagattatctttgaagcaa

SEQ ID NO: 123480 - DNA, 25 bp, Mus musculus
acgtttgagattttctttgaagcaa

SEQ ID NO: 123481 - DNA, 25 bp, Mus musculus
acgtttgagcaccaacaccagaaca

SEQ ID NO: 123482 - DNA, 25 bp, Mus musculus
acgtttgagcacgaacaccagaaca

SEQ ID NO: 123483 - DNA, 25 bp, Mus musculus
acgtttgattcaaggcagtgccaca

SEQ ID NO: 123484 - DNA, 25 bp, Mus musculus
acgtttgattcatggcagtgccaca

SEQ ID NO: 123485 - DNA, 25 bp, Mus musculus
acgtttgctcctctgttctgagttc

SEQ ID NO: 123486 - DNA, 25 bp, Mus musculus
acgtttgctcctgtgttctgagttc

SEQ ID NO: 123487 - DNA, 25 bp, Mus musculus
acgtttgcttctatctggtatccag

SEQ ID NO: 123488 - DNA, 25 bp, Mus musculus
acgtttgcttctttctggtatccag

SEQ ID NO: 123489 - DNA, 25 bp, Mus musculus
acgtttggacaacaacacctggcca

SEQ ID NO: 123490 - DNA, 25 bp, Mus musculus
acgtttggacaagaacacctggcca

SEQ ID NO: 123491 - DNA, 25 bp, Mus musculus
acgtttggtacaaccttgaattcag

SEQ ID NO: 123492 - DNA, 25 bp, Mus musculus
acgtttggtacatccttgaattcag

SEQ ID NO: 123493 - DNA, 25 bp, Mus musculus
acgtttggtcagcctgcatccctta

SEQ ID NO: 123494 - DNA, 25 bp, Mus musculus
acgtttggtcagcttagttctctac

SEQ ID NO: 123495 - DNA, 25 bp, Mus musculus
acgtttggtcaggctgcatccctta

SEQ ID NO: 123496 - DNA, 25 bp, Mus musculus
acgtttggtcaggttagttctctac

SEQ ID NO: 123497 - DNA, 25 bp, Mus musculus
acgtttgtgcgtcggatgattttag

SEQ ID NO: 123498 - DNA, 25 bp, Mus musculus
acgtttgtgcgtgggatgattttag

SEQ ID NO: 123499 - DNA, 25 bp, Mus musculus
acgtttgtttacactgcccctcagt

SEQ ID NO: 123500 - DNA, 25 bp, Mus musculus
acgtttgtttactctgcccctcagt

SEQ ID NO: 123501 - DNA, 25 bp, Mus musculus
acgttttaatgcacattactggcat

SEQ ID NO: 123502 - DNA, 25 bp, Mus musculus
acgttttaatgctcattactggcat

SEQ ID NO: 123503 - DNA, 25 bp, Mus musculus
acgttttcagagctgggaatacaga

SEQ ID NO: 123504 - DNA, 25 bp, Mus musculus
acgttttcagaggtgggaatacaga

SEQ ID NO: 123505 - DNA, 25 bp, Mus musculus
acgttttcaggcaccaaggtgctca

SEQ ID NO: 123506 - DNA, 25 bp, Mus musculus
acgttttcaggctccaaggtgctca

SEQ ID NO: 123507 - DNA, 25 bp, Mus musculus
acgttttcctttcacatctgggtgt

SEQ ID NO: 123508 - DNA, 25 bp, Mus musculus
acgttttcctttgacatctgggtgt

SEQ ID NO: 123509 - DNA, 25 bp, Mus musculus
acgttttctctgatgatgtcacact

SEQ ID NO: 123510 - DNA, 25 bp, Mus musculus
acgttttctctgttgatgtcacact

SEQ ID NO: 123511 - DNA, 25 bp, Mus musculus
acgttttctttcaatgcaatcctgc

SEQ ID NO: 123512 - DNA, 25 bp, Mus musculus
acgttttctttctatgcaatcctgc

SEQ ID NO: 123513 - DNA, 25 bp, Mus musculus
acgttttgatctagcattatgtgtc

SEQ ID NO: 123514 - DNA, 25 bp, Mus musculus
acgttttgatcttgcattatgtgtc

SEQ ID NO: 123515 - DNA, 25 bp, Mus musculus
acgttttgctatattcatacttgtt

SEQ ID NO: 123516 - DNA, 25 bp, Mus musculus
acgttttgctattttcatacttgtt

SEQ ID NO: 123517 - DNA, 25 bp, Mus musculus
acgttttgtcacaatctcatggtgt

SEQ ID NO: 123518 - DNA, 25 bp, Mus musculus
acgttttgtcactatctcatggtgt

SEQ ID NO: 123519 - DNA, 25 bp, Mus musculus
acgttttgtcgtatccaccagtgta

SEQ ID NO: 123520 - DNA, 25 bp, Mus musculus
acgttttgtcgtttccaccagtgta

SEQ ID NO: 123521 - DNA, 25 bp, Mus musculus
acgtttttctttctatgctctatca

SEQ ID NO: 123522 - DNA, 25 bp, Mus musculus
acgtttttctttgtatgctctatca

SEQ ID NO: 123523 - DNA, 25 bp, Mus musculus
acgttttttcaaagattggcttgtg

SEQ ID NO: 123524 - DNA, 25 bp, Mus musculus
acgttttttcaatgattggcttgtg

SEQ ID NO: 123525 - DNA, 25 bp, Mus musculus
actaaaacccctcattcagctagag

SEQ ID NO: 123526 - DNA, 25 bp, Mus musculus
actaaaacccctgattcagctagag

SEQ ID NO: 123527 - DNA, 25 bp, Mus musculus
actaaaagtcgccataactcacctg

SEQ ID NO: 123528 - DNA, 25 bp, Mus musculus
actaaaagtcgcgataactcacctg

SEQ ID NO: 123529 - DNA, 25 bp, Mus musculus
actaaaagttgtactctgatctcta

SEQ ID NO: 123530 - DNA, 25 bp, Mus musculus
actaaaagttgttctctgatctcta

SEQ ID NO: 123531 - DNA, 25 bp, Mus musculus
actaaaatatgcaagaccattcccc

SEQ ID NO: 123532 - DNA, 25 bp, Mus musculus
actaaaatatgctagaccattcccc

SEQ ID NO: 123533 - DNA, 25 bp, Mus musculus
actaaacagggcacatatggctcat

SEQ ID NO: 123534 - DNA, 25 bp, Mus musculus
actaaacagggctcatatggctcat

SEQ ID NO: 123535 - DNA, 25 bp, Mus musculus
actaaacatgttcttccgtactgct

SEQ ID NO: 123536 - DNA, 25 bp, Mus musculus
actaaacatgttgttccgtactgct

SEQ ID NO: 123537 - DNA, 25 bp, Mus musculus
actaaactgagcaaccggcgtcggg

SEQ ID NO: 123538 - DNA, 25 bp, Mus musculus
actaaactgagctaccggcgtcggg

SEQ ID NO: 123539 - DNA, 25 bp, Mus musculus
actaaactgtccacagatccgttcc

SEQ ID NO: 123540 - DNA, 25 bp, Mus musculus
actaaactgtcctcagatccgttcc

SEQ ID NO: 123541 - DNA, 25 bp, Mus musculus
actaaacttatacttttgctatctt

SEQ ID NO: 123542 - DNA, 25 bp, Mus musculus
actaaacttatagttttgctatctt

SEQ ID NO: 123543 - DNA, 25 bp, Mus musculus
actaaagaaagcaatccagttgttt

SEQ ID NO: 123544 - DNA, 25 bp, Mus musculus
actaaagaaagctatccagttgttt

SEQ ID NO: 123545 - DNA, 25 bp, Mus musculus
actaaagacaccaccatcacaatga

SEQ ID NO: 123546 - DNA, 25 bp, Mus musculus
actaaagacacctccatcacaatga

SEQ ID NO: 123547 - DNA, 25 bp, Mus musculus
actaaagatgtgagcctcctgaggt

SEQ ID NO: 123548 - DNA, 25 bp, Mus musculus
actaaagatgtgtgcctcctgaggt

SEQ ID NO: 123549 - DNA, 25 bp, Mus musculus
actaaagcagatagtcccttcactc

SEQ ID NO: 123550 - DNA, 25 bp, Mus musculus
actaaagcagattgtcccttcactc

SEQ ID NO: 123551 - DNA, 25 bp, Mus musculus
actaaagccctgcacatgtatgcaa

SEQ ID NO: 123552 - DNA, 25 bp, Mus musculus
actaaagccctggacatgtatgcaa

SEQ ID NO: 123553 - DNA, 25 bp, Mus musculus
actaaagctggtagtcatcgactga

SEQ ID NO: 123554 - DNA, 25 bp, Mus musculus
actaaagctggttgtcatcgactga

SEQ ID NO: 123555 - DNA, 25 bp, Mus musculus
actaaagctttgaaaatctgtggca

SEQ ID NO: 123556 - DNA, 25 bp, Mus musculus
actaaagctttgtaaatctgtggca

SEQ ID NO: 123557 - DNA, 25 bp, Mus musculus
actaaaggacccatggccgggtgtg

SEQ ID NO: 123558 - DNA, 25 bp, Mus musculus
actaaaggacccttggccgggtgtg

SEQ ID NO: 123559 - DNA, 25 bp, Mus musculus
actaaaggcccaaatacccaagatg

SEQ ID NO: 123560 - DNA, 25 bp, Mus musculus
actaaaggcccatatacccaagatg

SEQ ID NO: 123561 - DNA, 25 bp, Mus musculus
actaaagggcctctctctgtgggca

SEQ ID NO: 123562 - DNA, 25 bp, Mus musculus
actaaagggcctgtctctgtgggca

SEQ ID NO: 123563 - DNA, 25 bp, Mus musculus
actaaagtatctaattccctgtgct

SEQ ID NO: 123564 - DNA, 25 bp, Mus musculus
actaaagtatcttattccctgtgct

SEQ ID NO: 123565 - DNA, 25 bp, Mus musculus
actaaagtccacatatcagacgcaa

SEQ ID NO: 123566 - DNA, 25 bp, Mus musculus
actaaagtccacttatcagacgcaa

SEQ ID NO: 123567 - DNA, 25 bp, Mus musculus
actaaagtcgtcacctgtacagctc

SEQ ID NO: 123568 - DNA, 25 bp, Mus musculus
actaaagtcgtctcctgtacagctc

SEQ ID NO: 123569 - DNA, 25 bp, Mus musculus
actaaagtgaatctttccattagac

SEQ ID NO: 123570 - DNA, 25 bp, Mus musculus
actaaagtgaatgtttccattagac

SEQ ID NO: 123571 - DNA, 25 bp, Mus musculus
actaaagtggccattattaacactg

SEQ ID NO: 123572 - DNA, 25 bp, Mus musculus
actaaagtggcctttattaacactg

SEQ ID NO: 123573 - DNA, 25 bp, Mus musculus
actaaagttagtatccaaccagatg

SEQ ID NO: 123574 - DNA, 25 bp, Mus musculus
actaaagttagtttccaaccagatg

SEQ ID NO: 123575 - DNA, 25 bp, Mus musculus
actaaagttcctatccttggcatat

SEQ ID NO: 123576 - DNA, 25 bp, Mus musculus
actaaagttcctttccttggcatat

SEQ ID NO: 123577 - DNA, 25 bp, Mus musculus
actaaagttctgaccatgggaaagt

SEQ ID NO: 123578 - DNA, 25 bp, Mus musculus
actaaagttctgtccatgggaaagt

SEQ ID NO: 123579 - DNA, 25 bp, Mus musculus
actaaatatgtacaccaggaacgca

SEQ ID NO: 123580 - DNA, 25 bp, Mus musculus
actaaatatgtagaccaggaacgca

SEQ ID NO: 123581 - DNA, 25 bp, Mus musculus
actaaatatgtcaaagccgtggaga

SEQ ID NO: 123582 - DNA, 25 bp, Mus musculus
actaaatatgtctaagccgtggaga

SEQ ID NO: 123583 - DNA, 25 bp, Mus musculus
actaaatccaagaccagccactaat

SEQ ID NO: 123584 - DNA, 25 bp, Mus musculus
actaaatccaagtccagccactaat

SEQ ID NO: 123585 - DNA, 25 bp, Mus musculus
actaaatcctgtacactcttaccaa

SEQ ID NO: 123586 - DNA, 25 bp, Mus musculus
actaaatcctgttcactcttaccaa

SEQ ID NO: 123587 - DNA, 25 bp, Mus musculus
actaaatcggtgaccatcctccatc

SEQ ID NO: 123588 - DNA, 25 bp, Mus musculus
actaaatcggtgtccatcctccatc

SEQ ID NO: 123589 - DNA, 25 bp, Mus musculus
actaaatctaaaatcctgcagagaa

SEQ ID NO: 123590 - DNA, 25 bp, Mus musculus
actaaatctaaacaggcgtgcagcc

SEQ ID NO: 123591 - DNA, 25 bp, Mus musculus
actaaatctaaagaggcgtgcagcc

SEQ ID NO: 123592 - DNA, 25 bp, Mus musculus
actaaatctaaattcctgcagagaa

SEQ ID NO: 123593 - DNA, 25 bp, Mus musculus
actaaatctgtgcacctgaggtcca

SEQ ID NO: 123594 - DNA, 25 bp, Mus musculus
actaaatctgtggacctgaggtcca

SEQ ID NO: 123595 - DNA, 25 bp, Mus musculus
actaaatcttgtccttccgagactt

SEQ ID NO: 123596 - DNA, 25 bp, Mus musculus
actaaatcttgtgcttccgagactt

SEQ ID NO: 123597 - DNA, 25 bp, Mus musculus
actaaatgaactacctcactgcaaa

SEQ ID NO: 123598 - DNA, 25 bp, Mus musculus
actaaatgaacttcctcactgcaaa

SEQ ID NO: 123599 - DNA, 25 bp, Mus musculus
actaaatgatccagcctgttgtcat

SEQ ID NO: 123600 - DNA, 25 bp, Mus musculus
actaaatgatcctgcctgttgtcat

SEQ ID NO: 123601 - DNA, 25 bp, Mus musculus
actaaatgcctcctacctttgttgt

SEQ ID NO: 123602 - DNA, 25 bp, Mus musculus
actaaatgcctcgtacctttgttgt

SEQ ID NO: 123603 - DNA, 25 bp, Mus musculus
actaaatgctgtacaatgtggcttt

SEQ ID NO: 123604 - DNA, 25 bp, Mus musculus
actaaatgctgttcaatgtggcttt

SEQ ID NO: 123605 - DNA, 25 bp, Mus musculus
actaaatggaccaatcaagaatatt

SEQ ID NO: 123606 - DNA, 25 bp, Mus musculus
actaaatggacctatcaagaatatt

SEQ ID NO: 123607 - DNA, 25 bp, Mus musculus
actaaatgtcccaccaggtaaccat

SEQ ID NO: 123608 - DNA, 25 bp, Mus musculus
actaaatgtccctccaggtaaccat

SEQ ID NO: 123609 - DNA, 25 bp, Mus musculus
actaaatgtggacggcttggtatct

SEQ ID NO: 123610 - DNA, 25 bp, Mus musculus
actaaatgtggagggcttggtatct

SEQ ID NO: 123611 - DNA, 25 bp, Mus musculus
actaaattataactgaagctggcct

SEQ ID NO: 123612 - DNA, 25 bp, Mus musculus
actaaattataagtgaagctggcct

SEQ ID NO: 123613 - DNA, 25 bp, Mus musculus
actaaattcagccaagtcttccgaa

SEQ ID NO: 123614 - DNA, 25 bp, Mus musculus
actaaattcagcgaagtcttccgaa

SEQ ID NO: 123615 - DNA, 25 bp, Mus musculus
actaaattctttcatgttctcccaa

SEQ ID NO: 123616 - DNA, 25 bp, Mus musculus
actaaattctttgatgttctcccaa

SEQ ID NO: 123617 - DNA, 25 bp, Mus musculus
actaaattgtccagtcttagaagaa

SEQ ID NO: 123618 - DNA, 25 bp, Mus musculus
actaaattgtcctgtcttagaagaa

SEQ ID NO: 123619 - DNA, 25 bp, Mus musculus
actaaatttatgattcacctagaat

SEQ ID NO: 123620 - DNA, 25 bp, Mus musculus
actaaatttatgtttcacctagaat

SEQ ID NO: 123621 - DNA, 25 bp, Mus musculus
actaaatttattctcacgctctgta

SEQ ID NO: 123622 - DNA, 25 bp, Mus musculus
actaaatttattgtcacgctctgta

SEQ ID NO: 123623 - DNA, 25 bp, Mus musculus
actaacaaaccaagagcagcgtctg

SEQ ID NO: 123624 - DNA, 25 bp, Mus musculus
actaacaaaccatgagcagcgtctg

SEQ ID NO: 123625 - DNA, 25 bp, Mus musculus
actaacaatgttctctcaggcttct

SEQ ID NO: 123626 - DNA, 25 bp, Mus musculus
actaacaatgttgtctcaggcttct

SEQ ID NO: 123627 - DNA, 25 bp, Mus musculus
actaacacctgtactctatctgtaa

SEQ ID NO: 123628 - DNA, 25 bp, Mus musculus
actaacacctgttctctatctgtaa

SEQ ID NO: 123629 - DNA, 25 bp, Mus musculus
actaacacttctcgcctatgtgctg

SEQ ID NO: 123630 - DNA, 25 bp, Mus musculus
actaacacttctggcctatgtgctg

SEQ ID NO: 123631 - DNA, 25 bp, Mus musculus
actaacaggccccaagagcttgatg

SEQ ID NO: 123632 - DNA, 25 bp, Mus musculus
actaacaggcccgaagagcttgatg

SEQ ID NO: 123633 - DNA, 25 bp, Mus musculus
actaacagggatagaagctgggcca

SEQ ID NO: 123634 - DNA, 25 bp, Mus musculus
actaacagggattgaagctgggcca

SEQ ID NO: 123635 - DNA, 25 bp, Mus musculus
actaacatccttaatttggcaccaa

SEQ ID NO: 123636 - DNA, 25 bp, Mus musculus
actaacatcctttatttggcaccaa

SEQ ID NO: 123637 - DNA, 25 bp, Mus musculus
actaacatctccctgaggtgtgatg

SEQ ID NO: 123638 - DNA, 25 bp, Mus musculus
actaacatctccgtgaggtgtgatg

SEQ ID NO: 123639 - DNA, 25 bp, Mus musculus
actaacatgactactgttccttcag

SEQ ID NO: 123640 - DNA, 25 bp, Mus musculus
actaacatgacttctgttccttcag

SEQ ID NO: 123641 - DNA, 25 bp, Mus musculus
actaacatgtccagcctactttctg

SEQ ID NO: 123642 - DNA, 25 bp, Mus musculus
actaacatgtcctgcctactttctg

SEQ ID NO: 123643 - DNA, 25 bp, Mus musculus
actaacatgttacccctgagaattg

SEQ ID NO: 123644 - DNA, 25 bp, Mus musculus
actaacatgttagccctgagaattg

SEQ ID NO: 123645 - DNA, 25 bp, Mus musculus
actaacattgggatggcaggcacat

SEQ ID NO: 123646 - DNA, 25 bp, Mus musculus
actaacattgggttggcaggcacat

SEQ ID NO: 123647 - DNA, 25 bp, Mus musculus
actaaccaactaccattatgttttg

SEQ ID NO: 123648 - DNA, 25 bp, Mus musculus
actaaccaactacctatgtgacctt

SEQ ID NO: 123649 - DNA, 25 bp, Mus musculus
actaaccaactagcattatgttttg

SEQ ID NO: 123650 - DNA, 25 bp, Mus musculus
actaaccaactagctatgtgacctt

SEQ ID NO: 123651 - DNA, 25 bp, Mus musculus
actaaccagccacccaactttaaag

SEQ ID NO: 123652 - DNA, 25 bp, Mus musculus
actaaccagccagccaactttaaag

SEQ ID NO: 123653 - DNA, 25 bp, Mus musculus
actaaccagcttcactttctgtctg

SEQ ID NO: 123654 - DNA, 25 bp, Mus musculus
actaaccagcttgactttctgtctg

SEQ ID NO: 123655 - DNA, 25 bp, Mus musculus
actaaccatagtctgcagggctgtg

SEQ ID NO: 123656 - DNA, 25 bp, Mus musculus
actaaccatagtgtgcagggctgtg

SEQ ID NO: 123657 - DNA, 25 bp, Mus musculus
actaaccatgacctcatctctggga

SEQ ID NO: 123658 - DNA, 25 bp, Mus musculus
actaaccatgacgtcatctctggga

SEQ ID NO: 123659 - DNA, 25 bp, Mus musculus
actaaccatttcaagctgggcatgg

SEQ ID NO: 123660 - DNA, 25 bp, Mus musculus
actaaccatttctagctgggcatgg

SEQ ID NO: 123661 - DNA, 25 bp, Mus musculus
actaacccagagctagctcaaatgg

SEQ ID NO: 123662 - DNA, 25 bp, Mus musculus
actaacccagaggtagctcaaatgg

SEQ ID NO: 123663 - DNA, 25 bp, Mus musculus
actaacccatttacaccagttgctt

SEQ ID NO: 123664 - DNA, 25 bp, Mus musculus
actaacccattttcaccagttgctt

SEQ ID NO: 123665 - DNA, 25 bp, Mus musculus
actaaccctaagctttctgacctag

SEQ ID NO: 123666 - DNA, 25 bp, Mus musculus
actaaccctaaggtttctgacctag

SEQ ID NO: 123667 - DNA, 25 bp, Mus musculus
actaaccctatcaggcaagcctcat

SEQ ID NO: 123668 - DNA, 25 bp, Mus musculus
actaaccctatctggcaagcctcat

SEQ ID NO: 123669 - DNA, 25 bp, Mus musculus
actaaccctggcattaatccacaat

SEQ ID NO: 123670 - DNA, 25 bp, Mus musculus
actaaccctggctttaatccacaat

SEQ ID NO: 123671 - DNA, 25 bp, Mus musculus
actaaccctgtcctgtctatgaaat

SEQ ID NO: 123672 - DNA, 25 bp, Mus musculus
actaaccctgtcgtgtctatgaaat

SEQ ID NO: 123673 - DNA, 25 bp, Mus musculus
actaacctaagcaattccatactcc

SEQ ID NO: 123674 - DNA, 25 bp, Mus musculus
actaacctaagctattccatactcc

SEQ ID NO: 123675 - DNA, 25 bp, Mus musculus
actaacctacttactgtctctggcc

SEQ ID NO: 123676 - DNA, 25 bp, Mus musculus
actaacctactttctgtctctggcc

SEQ ID NO: 123677 - DNA, 25 bp, Mus musculus
actaacctaggcactatatggacca

SEQ ID NO: 123678 - DNA, 25 bp, Mus musculus
actaacctaggctctatatggacca

SEQ ID NO: 123679 - DNA, 25 bp, Mus musculus
actaacctctggactggcctgaaat

SEQ ID NO: 123680 - DNA, 25 bp, Mus musculus
actaacctctggtctggcctgaaat

SEQ ID NO: 123681 - DNA, 25 bp, Mus musculus
actaacctgccactggaatcaccta

SEQ ID NO: 123682 - DNA, 25 bp, Mus musculus
actaacctgccagtggaatcaccta

SEQ ID NO: 123683 - DNA, 25 bp, Mus musculus
actaacgagtgcagttgcaccaggc

SEQ ID NO: 123684 - DNA, 25 bp, Mus musculus
actaacgagtgctgttgcaccaggc

SEQ ID NO: 123685 - DNA, 25 bp, Mus musculus
actaacgtgtcaacttgtatttctt

SEQ ID NO: 123686 - DNA, 25 bp, Mus musculus
actaacgtgtcatcttgtatttctt

SEQ ID NO: 123687 - DNA, 25 bp, Mus musculus
actaactacactaattgccaccggg

SEQ ID NO: 123688 - DNA, 25 bp, Mus musculus
actaactacacttattgccaccggg

SEQ ID NO: 123689 - DNA, 25 bp, Mus musculus
actaactattctctggcagtcagcc

SEQ ID NO: 123690 - DNA, 25 bp, Mus musculus
actaactattctgtggcagtcagcc

SEQ ID NO: 123691 - DNA, 25 bp, Mus musculus
actaactcagcaatggataccctca

SEQ ID NO: 123692 - DNA, 25 bp, Mus musculus
actaactcagcattggataccctca

SEQ ID NO: 123693 - DNA, 25 bp, Mus musculus
actaactcatacatctttaaaggac

SEQ ID NO: 123694 - DNA, 25 bp, Mus musculus
actaactcatacttctttaaaggac

SEQ ID NO: 123695 - DNA, 25 bp, Mus musculus
actaactcgaatctggtgtcccttt

SEQ ID NO: 123696 - DNA, 25 bp, Mus musculus
actaactcgaatgtggtgtcccttt

SEQ ID NO: 123697 - DNA, 25 bp, Mus musculus
actaactctcctctttccaagtgtt

SEQ ID NO: 123698 - DNA, 25 bp, Mus musculus
actaactctcctgtttccaagtgtt

SEQ ID NO: 123699 - DNA, 25 bp, Mus musculus
actaactcttggcagtctcatccta

SEQ ID NO: 123700 - DNA, 25 bp, Mus musculus
actaactcttgggagtctcatccta

SEQ ID NO: 123701 - DNA, 25 bp, Mus musculus
actaactgacctattttctgtgaac

SEQ ID NO: 123702 - DNA, 25 bp, Mus musculus
actaactgaccttttttctgtgaac

SEQ ID NO: 123703 - DNA, 25 bp, Mus musculus
actaactgcactctgattacttggg

SEQ ID NO: 123704 - DNA, 25 bp, Mus musculus
actaactgcactgtgattacttggg

SEQ ID NO: 123705 - DNA, 25 bp, Mus musculus
actaactgtactatctggctgtgaa

SEQ ID NO: 123706 - DNA, 25 bp, Mus musculus
actaactgtactttctggctgtgaa

SEQ ID NO: 123707 - DNA, 25 bp, Mus musculus
actaactgtagtccaccatacccta

SEQ ID NO: 123708 - DNA, 25 bp, Mus musculus
actaactgtagtgcaccatacccta

SEQ ID NO: 123709 - DNA, 25 bp, Mus musculus
actaactgtatgctaatcatgattt

SEQ ID NO: 123710 - DNA, 25 bp, Mus musculus
actaactgtatggtaatcatgattt

SEQ ID NO: 123711 - DNA, 25 bp, Mus musculus
actaacttaggccttttgtgatcta

SEQ ID NO: 123712 - DNA, 25 bp, Mus musculus
actaacttaggcgttttgtgatcta

SEQ ID NO: 123713 - DNA, 25 bp, Mus musculus
actaacttcttaatcacactaccct

SEQ ID NO: 123714 - DNA, 25 bp, Mus musculus
actaacttcttattcacactaccct

SEQ ID NO: 123715 - DNA, 25 bp, Mus musculus
actaacttcttcattcagctggtgc

SEQ ID NO: 123716 - DNA, 25 bp, Mus musculus
actaacttcttctttcagctggtgc

SEQ ID NO: 123717 - DNA, 25 bp, Mus musculus
actaacttgactcgttttactgcat

SEQ ID NO: 123718 - DNA, 25 bp, Mus musculus
actaacttgactggttttactgcat

SEQ ID NO: 123719 - DNA, 25 bp, Mus musculus
actaacttggctctagtcttcggcc

SEQ ID NO: 123720 - DNA, 25 bp, Mus musculus
actaacttggctgtagtcttcggcc

SEQ ID NO: 123721 - DNA, 25 bp, Mus musculus
actaacttgttacgcctgcagatgc

SEQ ID NO: 123722 - DNA, 25 bp, Mus musculus
actaacttgttaggcctgcagatgc

SEQ ID NO: 123723 - DNA, 25 bp, Mus musculus
actaacttttgtcacttggctgaaa

SEQ ID NO: 123724 - DNA, 25 bp, Mus musculus
actaacttttgtgacttggctgaaa

SEQ ID NO: 123725 - DNA, 25 bp, Mus musculus
actaagaaatgtatggtgtgctata

SEQ ID NO: 123726 - DNA, 25 bp, Mus musculus
actaagaaatgtttggtgtgctata

SEQ ID NO: 123727 - DNA, 25 bp, Mus musculus
actaagaagaatctgcccgtgtcca

SEQ ID NO: 123728 - DNA, 25 bp, Mus musculus
actaagaagaatgtgcccgtgtcca

SEQ ID NO: 123729 - DNA, 25 bp, Mus musculus
actaagaatgttacccctggataat

SEQ ID NO: 123730 - DNA, 25 bp, Mus musculus
actaagaatgtttcccctggataat

SEQ ID NO: 123731 - DNA, 25 bp, Mus musculus
actaagaattaccagctccagtttg

SEQ ID NO: 123732 - DNA, 25 bp, Mus musculus
actaagaattacgagctccagtttg

SEQ ID NO: 123733 - DNA, 25 bp, Mus musculus
actaagacacaacacggcggctaca

SEQ ID NO: 123734 - DNA, 25 bp, Mus musculus
actaagacacaagacggcggctaca

SEQ ID NO: 123735 - DNA, 25 bp, Mus musculus
actaagactgaccagagtcccgatc

SEQ ID NO: 123736 - DNA, 25 bp, Mus musculus
actaagactgacgagagtcccgatc

SEQ ID NO: 123737 - DNA, 25 bp, Mus musculus
actaagagcccgcatccagagcctg

SEQ ID NO: 123738 - DNA, 25 bp, Mus musculus
actaagagcccggatccagagcctg

SEQ ID NO: 123739 - DNA, 25 bp, Mus musculus
actaagagctcacccctgtctgtgt

SEQ ID NO: 123740 - DNA, 25 bp, Mus musculus
actaagagctcagccctgtctgtgt

SEQ ID NO: 123741 - DNA, 25 bp, Mus musculus
actaagagtggacagcagttggcct

SEQ ID NO: 123742 - DNA, 25 bp, Mus musculus
actaagagtggagagcagttggcct

SEQ ID NO: 123743 - DNA, 25 bp, Mus musculus
actaagagttgacccactgtggact

SEQ ID NO: 123744 - DNA, 25 bp, Mus musculus
actaagagttgagccactgtggact

SEQ ID NO: 123745 - DNA, 25 bp, Mus musculus
actaagagttgcattctctcgtttt

SEQ ID NO: 123746 - DNA, 25 bp, Mus musculus
actaagagttgctttctctcgtttt

SEQ ID NO: 123747 - DNA, 25 bp, Mus musculus
actaagatagtcctgaatgctggta

SEQ ID NO: 123748 - DNA, 25 bp, Mus musculus
actaagatagtcgtgaatgctggta

SEQ ID NO: 123749 - DNA, 25 bp, Mus musculus
actaagatatatccttggccccatg

SEQ ID NO: 123750 - DNA, 25 bp, Mus musculus
actaagatatatgcttggccccatg

SEQ ID NO: 123751 - DNA, 25 bp, Mus musculus
actaagatggatctcttgtctgctg

SEQ ID NO: 123752 - DNA, 25 bp, Mus musculus
actaagatggatgtcttgtctgctg

SEQ ID NO: 123753 - DNA, 25 bp, Mus musculus
actaagatggtgagccccgagttca

SEQ ID NO: 123754 - DNA, 25 bp, Mus musculus
actaagatggtgtgccccgagttca

SEQ ID NO: 123755 - DNA, 25 bp, Mus musculus
actaagcacgaacagtcctccagtt

SEQ ID NO: 123756 - DNA, 25 bp, Mus musculus
actaagcacgaagagtcctccagtt

SEQ ID NO: 123757 - DNA, 25 bp, Mus musculus
actaagcaggctactaccacactta

SEQ ID NO: 123758 - DNA, 25 bp, Mus musculus
actaagcaggcttctaccacactta

SEQ ID NO: 123759 - DNA, 25 bp, Mus musculus
actaagcatgccacttgatgctgct

SEQ ID NO: 123760 - DNA, 25 bp, Mus musculus
actaagcatgcctcttgatgctgct

SEQ ID NO: 123761 - DNA, 25 bp, Mus musculus
actaagcattaacgccgctgatccc

SEQ ID NO: 123762 - DNA, 25 bp, Mus musculus
actaagcattaaggccgctgatccc

SEQ ID NO: 123763 - DNA, 25 bp, Mus musculus
actaagccagccaacctatttccat

SEQ ID NO: 123764 - DNA, 25 bp, Mus musculus
actaagccagcctacctatttccat

SEQ ID NO: 123765 - DNA, 25 bp, Mus musculus
actaagcccaggaccatatgactag

SEQ ID NO: 123766 - DNA, 25 bp, Mus musculus
actaagcccaggtccatatgactag

SEQ ID NO: 123767 - DNA, 25 bp, Mus musculus
actaagcctgtcacaacactgcttc

SEQ ID NO: 123768 - DNA, 25 bp, Mus musculus
actaagcctgtctcaacactgcttc

SEQ ID NO: 123769 - DNA, 25 bp, Mus musculus
actaagccttagcactttgtcctgt

SEQ ID NO: 123770 - DNA, 25 bp, Mus musculus
actaagccttaggactttgtcctgt

SEQ ID NO: 123771 - DNA, 25 bp, Mus musculus
actaagcgagcacagtcccttgggc

SEQ ID NO: 123772 - DNA, 25 bp, Mus musculus
actaagcgagcagagtcccttgggc

SEQ ID NO: 123773 - DNA, 25 bp, Mus musculus
actaagcgaggaacactaacccaat

SEQ ID NO: 123774 - DNA, 25 bp, Mus musculus
actaagcgaggatcactaacccaat

SEQ ID NO: 123775 - DNA, 25 bp, Mus musculus
actaagctagctcatgttacatgaa

SEQ ID NO: 123776 - DNA, 25 bp, Mus musculus
actaagctagctgatgttacatgaa

SEQ ID NO: 123777 - DNA, 25 bp, Mus musculus
actaagctaggtacatccacctgtc

SEQ ID NO: 123778 - DNA, 25 bp, Mus musculus
actaagctaggttcatccacctgtc

SEQ ID NO: 123779 - DNA, 25 bp, Mus musculus
actaagctattgaaccccattggtg

SEQ ID NO: 123780 - DNA, 25 bp, Mus musculus
actaagctattgtaccccattggtg

SEQ ID NO: 123781 - DNA, 25 bp, Mus musculus
actaagctgagaaaggacctgggta

SEQ ID NO: 123782 - DNA, 25 bp, Mus musculus
actaagctgagataggacctgggta

SEQ ID NO: 123783 - DNA, 25 bp, Mus musculus
actaagctggctacctttaggtcag

SEQ ID NO: 123784 - DNA, 25 bp, Mus musculus
actaagctggcttcctttaggtcag

SEQ ID NO: 123785 - DNA, 25 bp, Mus musculus
actaagctgtgtcttcattgagcac

SEQ ID NO: 123786 - DNA, 25 bp, Mus musculus
actaagctgtgtgttcattgagcac

SEQ ID NO: 123787 - DNA, 25 bp, Mus musculus
actaagcttccaacttttgaaagag

SEQ ID NO: 123788 - DNA, 25 bp, Mus musculus
actaagcttccatcttttgaaagag

SEQ ID NO: 123789 - DNA, 25 bp, Mus musculus
actaaggatccaagcaaggagtggt

SEQ ID NO: 123790 - DNA, 25 bp, Mus musculus
actaaggatccatgcaaggagtggt

SEQ ID NO: 123791 - DNA, 25 bp, Mus musculus
actaaggcaggcactgcgcggcaca

SEQ ID NO: 123792 - DNA, 25 bp, Mus musculus
actaaggcaggctctgcgcggcaca

SEQ ID NO: 123793 - DNA, 25 bp, Mus musculus
actaaggctgccaatcccatgataa

SEQ ID NO: 123794 - DNA, 25 bp, Mus musculus
actaaggctgcctatcccatgataa

SEQ ID NO: 123795 - DNA, 25 bp, Mus musculus
actaagggatcaactgcatcctgac

SEQ ID NO: 123796 - DNA, 25 bp, Mus musculus
actaagggatcatctgcatcctgac

SEQ ID NO: 123797 - DNA, 25 bp, Mus musculus
actaaggtcagtagtgctgccgtct

SEQ ID NO: 123798 - DNA, 25 bp, Mus musculus
actaaggtcagtctcgtggttcggt

SEQ ID NO: 123799 - DNA, 25 bp, Mus musculus
actaaggtcagtgtcgtggttcggt

SEQ ID NO: 123800 - DNA, 25 bp, Mus musculus
actaaggtcagttgtgctgccgtct

SEQ ID NO: 123801 - DNA, 25 bp, Mus musculus
actaaggtctctaatgtcatgctat

SEQ ID NO: 123802 - DNA, 25 bp, Mus musculus
actaaggtctcttatgtcatgctat

SEQ ID NO: 123803 - DNA, 25 bp, Mus musculus
actaaggttaagatttgatgctaca

SEQ ID NO: 123804 - DNA, 25 bp, Mus musculus
actaaggttaagttttgatgctaca

SEQ ID NO: 123805 - DNA, 25 bp, Mus musculus
actaagtaacccaccgcttgagcag

SEQ ID NO: 123806 - DNA, 25 bp, Mus musculus
actaagtaaccctccgcttgagcag

SEQ ID NO: 123807 - DNA, 25 bp, Mus musculus
actaagtacaagactgtgcctcctg

SEQ ID NO: 123808 - DNA, 25 bp, Mus musculus
actaagtacaagtctgtgcctcctg

SEQ ID NO: 123809 - DNA, 25 bp, Mus musculus
actaagtacccactctgctaagtta

SEQ ID NO: 123810 - DNA, 25 bp, Mus musculus
actaagtacccagtctgctaagtta

SEQ ID NO: 123811 - DNA, 25 bp, Mus musculus
actaagtacctcaatgcatgcattt

SEQ ID NO: 123812 - DNA, 25 bp, Mus musculus
actaagtacctctatgcatgcattt

SEQ ID NO: 123813 - DNA, 25 bp, Mus musculus
actaagtccagcaaatttcttgttc

SEQ ID NO: 123814 - DNA, 25 bp, Mus musculus
actaagtccagctaatttcttgttc

SEQ ID NO: 123815 - DNA, 25 bp, Mus musculus
actaagtccagtcagtgcagcctgt

SEQ ID NO: 123816 - DNA, 25 bp, Mus musculus
actaagtccagtgagtgcagcctgt

SEQ ID NO: 123817 - DNA, 25 bp, Mus musculus
actaagtcccatcctaggtggtgcc

SEQ ID NO: 123818 - DNA, 25 bp, Mus musculus
actaagtcccatgctaggtggtgcc

SEQ ID NO: 123819 - DNA, 25 bp, Mus musculus
actaagtcgacgatggtggctctca

SEQ ID NO: 123820 - DNA, 25 bp, Mus musculus
actaagtcgacgttggtggctctca

SEQ ID NO: 123821 - DNA, 25 bp, Mus musculus
actaagtctgtcctatattccgttt

SEQ ID NO: 123822 - DNA, 25 bp, Mus musculus
actaagtctgtcgtatattccgttt

SEQ ID NO: 123823 - DNA, 25 bp, Mus musculus
actaagtgcacaactggaactggac

SEQ ID NO: 123824 - DNA, 25 bp, Mus musculus
actaagtgcacatctggaactggac

SEQ ID NO: 123825 - DNA, 25 bp, Mus musculus
actaagtgcagaccgttgcctacaa

SEQ ID NO: 123826 - DNA, 25 bp, Mus musculus
actaagtgcagagcgttgcctacaa

SEQ ID NO: 123827 - DNA, 25 bp, Mus musculus
actaagtgctatcgctagtctcagc

SEQ ID NO: 123828 - DNA, 25 bp, Mus musculus
actaagtgctatggctagtctcagc

SEQ ID NO: 123829 - DNA, 25 bp, Mus musculus
actaagtggcctactgagaagttgt

SEQ ID NO: 123830 - DNA, 25 bp, Mus musculus
actaagtggccttctgagaagttgt

SEQ ID NO: 123831 - DNA, 25 bp, Mus musculus
actaagtgtcctactctgttaccaa

SEQ ID NO: 123832 - DNA, 25 bp, Mus musculus
actaagtgtccttctctgttaccaa

SEQ ID NO: 123833 - DNA, 25 bp, Mus musculus
actaagtgtgcactgctgtgctcac

SEQ ID NO: 123834 - DNA, 25 bp, Mus musculus
actaagtgtgcagtgctgtgctcac

SEQ ID NO: 123835 - DNA, 25 bp, Mus musculus
actaagttaactacagggtctgtgg

SEQ ID NO: 123836 - DNA, 25 bp, Mus musculus
actaagttaacttcagggtctgtgg

SEQ ID NO: 123837 - DNA, 25 bp, Mus musculus
actaagttattcagtcctgctcctc

SEQ ID NO: 123838 - DNA, 25 bp, Mus musculus
actaagttattctgtcctgctcctc

SEQ ID NO: 123839 - DNA, 25 bp, Mus musculus
actaagttcagtcttctgagccttt

SEQ ID NO: 123840 - DNA, 25 bp, Mus musculus
actaagttcagtgttctgagccttt

SEQ ID NO: 123841 - DNA, 25 bp, Mus musculus
actaagttctttcccaagtcagagt

SEQ ID NO: 123842 - DNA, 25 bp, Mus musculus
actaagttctttgccaagtcagagt

SEQ ID NO: 123843 - DNA, 25 bp, Mus musculus
actaagttgctcaggttaatcgcca

SEQ ID NO: 123844 - DNA, 25 bp, Mus musculus
actaagttgctctggttaatcgcca

SEQ ID NO: 123845 - DNA, 25 bp, Mus musculus
actaagttgggcagtctgttctaat

SEQ ID NO: 123846 - DNA, 25 bp, Mus musculus
actaagttgggctgtctgttctaat

SEQ ID NO: 123847 - DNA, 25 bp, Mus musculus
actaagttgtctatgcagccacagt

SEQ ID NO: 123848 - DNA, 25 bp, Mus musculus
actaagttgtctttgcagccacagt

SEQ ID NO: 123849 - DNA, 25 bp, Mus musculus
actaagtttcaaaggctggctgcta

SEQ ID NO: 123850 - DNA, 25 bp, Mus musculus
actaagtttcaatggctggctgcta

SEQ ID NO: 123851 - DNA, 25 bp, Mus musculus
actaataattagagccctgcttcct

SEQ ID NO: 123852 - DNA, 25 bp, Mus musculus
actaataattagtgccctgcttcct

SEQ ID NO: 123853 - DNA, 25 bp, Mus musculus
actaatacaggtacaaggttgcagt

SEQ ID NO: 123854 - DNA, 25 bp, Mus musculus
actaatacaggttcaaggttgcagt

SEQ ID NO: 123855 - DNA, 25 bp, Mus musculus
actaatacctaaatgtcactgtggg

SEQ ID NO: 123856 - DNA, 25 bp, Mus musculus
actaatacctaattgtcactgtggg

SEQ ID NO: 123857 - DNA, 25 bp, Mus musculus
actaatactgatctggactctttga

SEQ ID NO: 123858 - DNA, 25 bp, Mus musculus
actaatactgatgtggactctttga

SEQ ID NO: 123859 - DNA, 25 bp, Mus musculus
actaatatctgtcttctttcctctc

SEQ ID NO: 123860 - DNA, 25 bp, Mus musculus
actaatatctgtgttctttcctctc

SEQ ID NO: 123861 - DNA, 25 bp, Mus musculus
actaatcaagacagaccttcgaggg

SEQ ID NO: 123862 - DNA, 25 bp, Mus musculus
actaatcaagactgaccttcgaggg

SEQ ID NO: 123863 - DNA, 25 bp, Mus musculus
actaatcaagtacgccagactggct

SEQ ID NO: 123864 - DNA, 25 bp, Mus musculus
actaatcaagtaggccagactggct

SEQ ID NO: 123865 - DNA, 25 bp, Mus musculus
actaatcaagtgctccttctgctct

SEQ ID NO: 123866 - DNA, 25 bp, Mus musculus
actaatcaagtggtccttctgctct

SEQ ID NO: 123867 - DNA, 25 bp, Mus musculus
actaatccaataaaagccgccttgc

SEQ ID NO: 123868 - DNA, 25 bp, Mus musculus
actaatccaatataagccgccttgc

SEQ ID NO: 123869 - DNA, 25 bp, Mus musculus
actaatcccagaagtcactgcgcgc

SEQ ID NO: 123870 - DNA, 25 bp, Mus musculus
actaatcccagatgtcactgcgcgc

SEQ ID NO: 123871 - DNA, 25 bp, Mus musculus
actaatcccatgaccttggaactga

SEQ ID NO: 123872 - DNA, 25 bp, Mus musculus
actaatcccatgtccttggaactga

SEQ ID NO: 123873 - DNA, 25 bp, Mus musculus
actaatcccgatattgctgccaaga

SEQ ID NO: 123874 - DNA, 25 bp, Mus musculus
actaatcccgattttgctgccaaga

SEQ ID NO: 123875 - DNA, 25 bp, Mus musculus
actaatcctcaaactgtaaccaatg

SEQ ID NO: 123876 - DNA, 25 bp, Mus musculus
actaatcctcaatctgtaaccaatg

SEQ ID NO: 123877 - DNA, 25 bp, Mus musculus
actaatcggactcccaaatttcacc

SEQ ID NO: 123878 - DNA, 25 bp, Mus musculus
actaatcggactgccaaatttcacc

SEQ ID NO: 123879 - DNA, 25 bp, Mus musculus
actaatcgttttctctttcttctct

SEQ ID NO: 123880 - DNA, 25 bp, Mus musculus
actaatcgttttgtctttcttctct

SEQ ID NO: 123881 - DNA, 25 bp, Mus musculus
actaatctccatccccactcaatct

SEQ ID NO: 123882 - DNA, 25 bp, Mus musculus
actaatctccatgcccactcaatct

SEQ ID NO: 123883 - DNA, 25 bp, Mus musculus
actaatctgatcagttcaggctctt

SEQ ID NO: 123884 - DNA, 25 bp, Mus musculus
actaatctgatctgttcaggctctt

SEQ ID NO: 123885 - DNA, 25 bp, Mus musculus
actaatctgcacattttaacctttg

SEQ ID NO: 123886 - DNA, 25 bp, Mus musculus
actaatctgcactttttaacctttg

SEQ ID NO: 123887 - DNA, 25 bp, Mus musculus
actaatctggacaggtgggttggtt

SEQ ID NO: 123888 - DNA, 25 bp, Mus musculus
actaatctggactggtgggttggtt

SEQ ID NO: 123889 - DNA, 25 bp, Mus musculus
actaatctgtttaatctcctgtatg

SEQ ID NO: 123890 - DNA, 25 bp, Mus musculus
actaatctgttttatctcctgtatg

SEQ ID NO: 123891 - DNA, 25 bp, Mus musculus
actaatcttactacccactttctgg

SEQ ID NO: 123892 - DNA, 25 bp, Mus musculus
actaatcttacttcccactttctgg

SEQ ID NO: 123893 - DNA, 25 bp, Mus musculus
actaatcttgtgagttgcttggaca

SEQ ID NO: 123894 - DNA, 25 bp, Mus musculus
actaatcttgtgtgttgcttggaca

SEQ ID NO: 123895 - DNA, 25 bp, Mus musculus
actaatctttctcttctaattctaa

SEQ ID NO: 123896 - DNA, 25 bp, Mus musculus
actaatctttctgttctaattctaa

SEQ ID NO: 123897 - DNA, 25 bp, Mus musculus
actaatgaaggaccctgctgtttct

SEQ ID NO: 123898 - DNA, 25 bp, Mus musculus
actaatgaaggagcctgctgtttct

SEQ ID NO: 123899 - DNA, 25 bp, Mus musculus
actaatgacttcagcgcgcgtgtcc

SEQ ID NO: 123900 - DNA, 25 bp, Mus musculus
actaatgacttctgcgcgcgtgtcc

SEQ ID NO: 123901 - DNA, 25 bp, Mus musculus
actaatgatataaagcaactggcgg

SEQ ID NO: 123902 - DNA, 25 bp, Mus musculus
actaatgatatatagcaactggcgg

SEQ ID NO: 123903 - DNA, 25 bp, Mus musculus
actaatgcagacagttctttgtgcg

SEQ ID NO: 123904 - DNA, 25 bp, Mus musculus
actaatgcagactgttctttgtgcg

SEQ ID NO: 123905 - DNA, 25 bp, Mus musculus
actaatggacctctacttcacgctg

SEQ ID NO: 123906 - DNA, 25 bp, Mus musculus
actaatggacctgtacttcacgctg

SEQ ID NO: 123907 - DNA, 25 bp, Mus musculus
actaatggcagccattgactggctg

SEQ ID NO: 123908 - DNA, 25 bp, Mus musculus
actaatggcagcgattgactggctg

SEQ ID NO: 123909 - DNA, 25 bp, Mus musculus
actaatgggctcacttctttcattc

SEQ ID NO: 123910 - DNA, 25 bp, Mus musculus
actaatgggctctcttctttcattc

SEQ ID NO: 123911 - DNA, 25 bp, Mus musculus
actaatggtccaaggctgcaacttc

SEQ ID NO: 123912 - DNA, 25 bp, Mus musculus
actaatggtccatggctgcaacttc

SEQ ID NO: 123913 - DNA, 25 bp, Mus musculus
actaatggtggtcttgttgcggata

SEQ ID NO: 123914 - DNA, 25 bp, Mus musculus
actaatggtggtgttgttgcggata

SEQ ID NO: 123915 - DNA, 25 bp, Mus musculus
actaatgtggctactgttgtgggaa

SEQ ID NO: 123916 - DNA, 25 bp, Mus musculus
actaatgtggcttctgttgtgggaa

SEQ ID NO: 123917 - DNA, 25 bp, Mus musculus
actaatgttatgatgctgccctaca

SEQ ID NO: 123918 - DNA, 25 bp, Mus musculus
actaatgttatgttgctgccctaca

SEQ ID NO: 123919 - DNA, 25 bp, Mus musculus
actaattaccttcgaacagttgatg

SEQ ID NO: 123920 - DNA, 25 bp, Mus musculus
actaattaccttggaacagttgatg

SEQ ID NO: 123921 - DNA, 25 bp, Mus musculus
actaattaggtacagcacagcccct

SEQ ID NO: 123922 - DNA, 25 bp, Mus musculus
actaattaggtagagcacagcccct

SEQ ID NO: 123923 - DNA, 25 bp, Mus musculus
actaattcatggacaatgctgctca

SEQ ID NO: 123924 - DNA, 25 bp, Mus musculus
actaattcatggtcaatgctgctca

SEQ ID NO: 123925 - DNA, 25 bp, Mus musculus
actaattccacactttgatcttcgt

SEQ ID NO: 123926 - DNA, 25 bp, Mus musculus
actaattccacagtttgatcttcgt

SEQ ID NO: 123927 - DNA, 25 bp, Mus musculus
actaattccagtcatggtaggcagg

SEQ ID NO: 123928 - DNA, 25 bp, Mus musculus
actaattccagtgatggtaggcagg

SEQ ID NO: 123929 - DNA, 25 bp, Mus musculus
actaattccttgatcgctgtgtttc

SEQ ID NO: 123930 - DNA, 25 bp, Mus musculus
actaattccttgttcgctgtgtttc

SEQ ID NO: 123931 - DNA, 25 bp, Mus musculus
actaattcttctcctctattttcaa

SEQ ID NO: 123932 - DNA, 25 bp, Mus musculus
actaattcttctgctctattttcaa

SEQ ID NO: 123933 - DNA, 25 bp, Mus musculus
actaattgacacaccatctgccgat

SEQ ID NO: 123934 - DNA, 25 bp, Mus musculus
actaattgacactccatctgccgat

SEQ ID NO: 123935 - DNA, 25 bp, Mus musculus
actaattgcctacctttttctaatg

SEQ ID NO: 123936 - DNA, 25 bp, Mus musculus
actaattgcctagctttttctaatg

SEQ ID NO: 123937 - DNA, 25 bp, Mus musculus
actaattgctctacaggaggtcctg

SEQ ID NO: 123938 - DNA, 25 bp, Mus musculus
actaattgctcttcaggaggtcctg

SEQ ID NO: 123939 - DNA, 25 bp, Mus musculus
actaattggctaatctgggtctttt

SEQ ID NO: 123940 - DNA, 25 bp, Mus musculus
actaattggctattctgggtctttt

SEQ ID NO: 123941 - DNA, 25 bp, Mus musculus
actaattgtggcctatgttgatgac

SEQ ID NO: 123942 - DNA, 25 bp, Mus musculus
actaattgtggcgtatgttgatgac

SEQ ID NO: 123943 - DNA, 25 bp, Mus musculus
actaatttatgacttttggacacga

SEQ ID NO: 123944 - DNA, 25 bp, Mus musculus
actaatttatgagttttggacacga

SEQ ID NO: 123945 - DNA, 25 bp, Mus musculus
actaatttcccaaggtcctcattct

SEQ ID NO: 123946 - DNA, 25 bp, Mus musculus
actaatttcccatggtcctcattct

SEQ ID NO: 123947 - DNA, 25 bp, Mus musculus
actaattttgatatctttctctttg

SEQ ID NO: 123948 - DNA, 25 bp, Mus musculus
actaattttgatttctttctctttg

SEQ ID NO: 123949 - DNA, 25 bp, Mus musculus
actacaaagcgacaccctgccttaa

SEQ ID NO: 123950 - DNA, 25 bp, Mus musculus
actacaaagcgagaccctgccttaa

SEQ ID NO: 123951 - DNA, 25 bp, Mus musculus
actacaaagttgagattctcatgtt

SEQ ID NO: 123952 - DNA, 25 bp, Mus musculus
actacaaagttgtgattctcatgtt

SEQ ID NO: 123953 - DNA, 25 bp, Mus musculus
actacaaatgcactgttcccatctc

SEQ ID NO: 123954 - DNA, 25 bp, Mus musculus
actacaaatgcagtgttcccatctc

SEQ ID NO: 123955 - DNA, 25 bp, Mus musculus
actacaaatgttcggagcctctccg

SEQ ID NO: 123956 - DNA, 25 bp, Mus musculus
actacaaatgttgggagcctctccg

SEQ ID NO: 123957 - DNA, 25 bp, Mus musculus
actacaacagcgactgttccaagtt

SEQ ID NO: 123958 - DNA, 25 bp, Mus musculus
actacaacagcgtctgttccaagtt

SEQ ID NO: 123959 - DNA, 25 bp, Mus musculus
actacaacagttccgattcttgcag

SEQ ID NO: 123960 - DNA, 25 bp, Mus musculus
actacaacagttgcgattcttgcag

SEQ ID NO: 123961 - DNA, 25 bp, Mus musculus
actacaacccgaaggaggtgccgca

SEQ ID NO: 123962 - DNA, 25 bp, Mus musculus
actacaacccgatggaggtgccgca

SEQ ID NO: 123963 - DNA, 25 bp, Mus musculus
actacaacctagctttgaacccata

SEQ ID NO: 123964 - DNA, 25 bp, Mus musculus
actacaacctaggtttgaacccata

SEQ ID NO: 123965 - DNA, 25 bp, Mus musculus
actacaacctgcagctgctagaaaa

SEQ ID NO: 123966 - DNA, 25 bp, Mus musculus
actacaacctgctgctgctagaaaa

SEQ ID NO: 123967 - DNA, 25 bp, Mus musculus
actacaactaaccatgtctctgctg

SEQ ID NO: 123968 - DNA, 25 bp, Mus musculus
actacaactaacgatgtctctgctg

SEQ ID NO: 123969 - DNA, 25 bp, Mus musculus
actacaactacgaagtgggcagtgt

SEQ ID NO: 123970 - DNA, 25 bp, Mus musculus
actacaactacgtagtgggcagtgt

SEQ ID NO: 123971 - DNA, 25 bp, Mus musculus
actacaactagtactaccatccaaa

SEQ ID NO: 123972 - DNA, 25 bp, Mus musculus
actacaactagttctaccatccaaa

SEQ ID NO: 123973 - DNA, 25 bp, Mus musculus
actacaactttaagggtgttcgaca

SEQ ID NO: 123974 - DNA, 25 bp, Mus musculus
actacaactttatgggtgttcgaca

SEQ ID NO: 123975 - DNA, 25 bp, Mus musculus
actacaactttgagtttggaccatg

SEQ ID NO: 123976 - DNA, 25 bp, Mus musculus
actacaactttgtgtttggaccatg

SEQ ID NO: 123977 - DNA, 25 bp, Mus musculus
actacaaggctaagcatggtagctt

SEQ ID NO: 123978 - DNA, 25 bp, Mus musculus
actacaaggctatgcatggtagctt

SEQ ID NO: 123979 - DNA, 25 bp, Mus musculus
actacaagtgagagcgctctcgggt

SEQ ID NO: 123980 - DNA, 25 bp, Mus musculus
actacaagtgagtgcgctctcgggt

SEQ ID NO: 123981 - DNA, 25 bp, Mus musculus
actacaagttcgcatgggcccagag

SEQ ID NO: 123982 - DNA, 25 bp, Mus musculus
actacaagttcggatgggcccagag

SEQ ID NO: 123983 - DNA, 25 bp, Mus musculus
actacaatagggatcaggttaccat

SEQ ID NO: 123984 - DNA, 25 bp, Mus musculus
actacaatagggttcaggttaccat

SEQ ID NO: 123985 - DNA, 25 bp, Mus musculus
actacaatcaatcctgcccgtttta

SEQ ID NO: 123986 - DNA, 25 bp, Mus musculus
actacaatcaatgctgcccgtttta

SEQ ID NO: 123987 - DNA, 25 bp, Mus musculus
actacaatccatatctgagccacag

SEQ ID NO: 123988 - DNA, 25 bp, Mus musculus
actacaatccatttctgagccacag

SEQ ID NO: 123989 - DNA, 25 bp, Mus musculus
actacaatgggcagtgacacacacc

SEQ ID NO: 123990 - DNA, 25 bp, Mus musculus
actacaatgggctgtgacacacacc

SEQ ID NO: 123991 - DNA, 25 bp, Mus musculus
actacaattttcaaaggcggtggtg

SEQ ID NO: 123992 - DNA, 25 bp, Mus musculus
actacaattttctaaggcggtggtg

SEQ ID NO: 123993 - DNA, 25 bp, Mus musculus
actacacaaactcacccttttggag

SEQ ID NO: 123994 - DNA, 25 bp, Mus musculus
actacacaaactgacccttttggag

SEQ ID NO: 123995 - DNA, 25 bp, Mus musculus
actacacactgcacctttgaaattt

SEQ ID NO: 123996 - DNA, 25 bp, Mus musculus
actacacactgctcctttgaaattt

SEQ ID NO: 123997 - DNA, 25 bp, Mus musculus
actacacagatgaacccggctggaa

SEQ ID NO: 123998 - DNA, 25 bp, Mus musculus
actacacagatgtacccggctggaa

SEQ ID NO: 123999 - DNA, 25 bp, Mus musculus
actacacagccaatgactcaacatc

SEQ ID NO: 124000 - DNA, 25 bp, Mus musculus
actacacagccattgactcaacatc

SEQ ID NO: 124001 - DNA, 25 bp, Mus musculus
actacacagcttcgcggcatatatt

SEQ ID NO: 124002 - DNA, 25 bp, Mus musculus
actacacagcttggcggcatatatt

SEQ ID NO: 124003 - DNA, 25 bp, Mus musculus
actacacagtcacatcgccgaggtt

SEQ ID NO: 124004 - DNA, 25 bp, Mus musculus
actacacagtcagatcgccgaggtt

SEQ ID NO: 124005 - DNA, 25 bp, Mus musculus
actacacatggcagttgtctgtctt

SEQ ID NO: 124006 - DNA, 25 bp, Mus musculus
actacacatggctgttgtctgtctt

SEQ ID NO: 124007 - DNA, 25 bp, Mus musculus
actacaccacagaattacttccctt

SEQ ID NO: 124008 - DNA, 25 bp, Mus musculus
actacaccacagtattacttccctt

SEQ ID NO: 124009 - DNA, 25 bp, Mus musculus
actacacctcatactctggagacat

SEQ ID NO: 124010 - DNA, 25 bp, Mus musculus
actacacctcattctctggagacat

SEQ ID NO: 124011 - DNA, 25 bp, Mus musculus
actacacgaacccttcctcaaagtg

SEQ ID NO: 124012 - DNA, 25 bp, Mus musculus
actacacgaaccgttcctcaaagtg

SEQ ID NO: 124013 - DNA, 25 bp, Mus musculus
actacacgcagaaactcaggtgcta

SEQ ID NO: 124014 - DNA, 25 bp, Mus musculus
actacacgcagatactcaggtgcta

SEQ ID NO: 124015 - DNA, 25 bp, Mus musculus
actacacggcatcggtttgttgaca

SEQ ID NO: 124016 - DNA, 25 bp, Mus musculus
actacacggcatgggtttgttgaca

SEQ ID NO: 124017 - DNA, 25 bp, Mus musculus
actacactagatacactgtggttgg

SEQ ID NO: 124018 - DNA, 25 bp, Mus musculus
actacactagattcactgtggttgg

SEQ ID NO: 124019 - DNA, 25 bp, Mus musculus
actacactctacattgcttcagtta

SEQ ID NO: 124020 - DNA, 25 bp, Mus musculus
actacactctactttgcttcagtta

SEQ ID NO: 124021 - DNA, 25 bp, Mus musculus
actacactctgacttgcattcttaa

SEQ ID NO: 124022 - DNA, 25 bp, Mus musculus
actacactctgagttgcattcttaa

SEQ ID NO: 124023 - DNA, 25 bp, Mus musculus
actacactgccaactttgccagatg

SEQ ID NO: 124024 - DNA, 25 bp, Mus musculus
actacactgccatctttgccagatg

SEQ ID NO: 124025 - DNA, 25 bp, Mus musculus
actacactggtaactgatatcagag

SEQ ID NO: 124026 - DNA, 25 bp, Mus musculus
actacactggtatctgatatcagag

SEQ ID NO: 124027 - DNA, 25 bp, Mus musculus
actacacttcccagcttccttggaa

SEQ ID NO: 124028 - DNA, 25 bp, Mus musculus
actacacttccctgcttccttggaa

SEQ ID NO: 124029 - DNA, 25 bp, Mus musculus
actacagaacggaagccagtggctt

SEQ ID NO: 124030 - DNA, 25 bp, Mus musculus
actacagaacggtagccagtggctt

SEQ ID NO: 124031 - DNA, 25 bp, Mus musculus
actacagacactagggtggcctcct

SEQ ID NO: 124032 - DNA, 25 bp, Mus musculus
actacagacacttgggtggcctcct

SEQ ID NO: 124033 - DNA, 25 bp, Mus musculus
actacagagccactaatacaagtct

SEQ ID NO: 124034 - DNA, 25 bp, Mus musculus
actacagagccagtaatacaagtct

SEQ ID NO: 124035 - DNA, 25 bp, Mus musculus
actacagatagcattttcaggacaa

SEQ ID NO: 124036 - DNA, 25 bp, Mus musculus
actacagatagctttttcaggacaa

SEQ ID NO: 124037 - DNA, 25 bp, Mus musculus
actacagatgcacatcaccacactt

SEQ ID NO: 124038 - DNA, 25 bp, Mus musculus
actacagatgcagatcaccacactt

SEQ ID NO: 124039 - DNA, 25 bp, Mus musculus
actacagcaccacccatgaatcata

SEQ ID NO: 124040 - DNA, 25 bp, Mus musculus
actacagcaccagccatgaatcata

SEQ ID NO: 124041 - DNA, 25 bp, Mus musculus
actacagcatcgacaaggagctgct

SEQ ID NO: 124042 - DNA, 25 bp, Mus musculus
actacagcatcgtcaaggagctgct

SEQ ID NO: 124043 - DNA, 25 bp, Mus musculus
actacagcatctaccaacatttcct

SEQ ID NO: 124044 - DNA, 25 bp, Mus musculus
actacagcatcttccaacatttcct

SEQ ID NO: 124045 - DNA, 25 bp, Mus musculus
actacagccatgatttggccaccat

SEQ ID NO: 124046 - DNA, 25 bp, Mus musculus
actacagccatgttttggccaccat

SEQ ID NO: 124047 - DNA, 25 bp, Mus musculus
actacagccctaattatttcagcat

SEQ ID NO: 124048 - DNA, 25 bp, Mus musculus
actacagccctatttatttcagcat

SEQ ID NO: 124049 - DNA, 25 bp, Mus musculus
actacagcctggctatattcggtcc

SEQ ID NO: 124050 - DNA, 25 bp, Mus musculus
actacagcctgggtatattcggtcc

SEQ ID NO: 124051 - DNA, 25 bp, Mus musculus
actacagcgtctagaggttgccttc

SEQ ID NO: 124052 - DNA, 25 bp, Mus musculus
actacagcgtcttgaggttgccttc

SEQ ID NO: 124053 - DNA, 25 bp, Mus musculus
actacagctaccaaagtgtgactct

SEQ ID NO: 124054 - DNA, 25 bp, Mus musculus
actacagctaccaggcaagttcaaa

SEQ ID NO: 124055 - DNA, 25 bp, Mus musculus
actacagctacctaagtgtgactct

SEQ ID NO: 124056 - DNA, 25 bp, Mus musculus
actacagctacctggcaagttcaaa

SEQ ID NO: 124057 - DNA, 25 bp, Mus musculus
actacagctcatacctggagtacat

SEQ ID NO: 124058 - DNA, 25 bp, Mus musculus
actacagctcattcctggagtacat

SEQ ID NO: 124059 - DNA, 25 bp, Mus musculus
actacagcttccaatgtctggactg

SEQ ID NO: 124060 - DNA, 25 bp, Mus musculus
actacagcttcctatgtctggactg

SEQ ID NO: 124061 - DNA, 25 bp, Mus musculus
actacaggcctgaatgttgcaaaca

SEQ ID NO: 124062 - DNA, 25 bp, Mus musculus
actacaggcctgtatgttgcaaaca

SEQ ID NO: 124063 - DNA, 25 bp, Mus musculus
actacaggcggtacctgggagagcc

SEQ ID NO: 124064 - DNA, 25 bp, Mus musculus
actacaggcggttcctgggagagcc

SEQ ID NO: 124065 - DNA, 25 bp, Mus musculus
actacagggagcacccagctgaggt

SEQ ID NO: 124066 - DNA, 25 bp, Mus musculus
actacagggagctcccagctgaggt

SEQ ID NO: 124067 - DNA, 25 bp, Mus musculus
actacagggcttactaatcaggatg

SEQ ID NO: 124068 - DNA, 25 bp, Mus musculus
actacagggctttctaatcaggatg

SEQ ID NO: 124069 - DNA, 25 bp, Mus musculus
actacaggtgccaggaattctgatt

SEQ ID NO: 124070 - DNA, 25 bp, Mus musculus
actacaggtgcctggaattctgatt

SEQ ID NO: 124071 - DNA, 25 bp, Mus musculus
actacagtactccagaatgcacaag

SEQ ID NO: 124072 - DNA, 25 bp, Mus musculus
actacagtactcgagaatgcacaag

SEQ ID NO: 124073 - DNA, 25 bp, Mus musculus
actacagtagtaactggggcctcgg

SEQ ID NO: 124074 - DNA, 25 bp, Mus musculus
actacagtagtatctggggcctcgg

SEQ ID NO: 124075 - DNA, 25 bp, Mus musculus
actacagtagttctgataccttgct

SEQ ID NO: 124076 - DNA, 25 bp, Mus musculus
actacagtagttgtgataccttgct

SEQ ID NO: 124077 - DNA, 25 bp, Mus musculus
actacagtatagatttctctcttct

SEQ ID NO: 124078 - DNA, 25 bp, Mus musculus
actacagtatagttttctctcttct

SEQ ID NO: 124079 - DNA, 25 bp, Mus musculus
actacagtccagagaccatcggcaa

SEQ ID NO: 124080 - DNA, 25 bp, Mus musculus
actacagtccagtgaccatcggcaa

SEQ ID NO: 124081 - DNA, 25 bp, Mus musculus
actacagtcgtgcaggatacaggtc

SEQ ID NO: 124082 - DNA, 25 bp, Mus musculus
actacagtcgtggaggatacaggtc

SEQ ID NO: 124083 - DNA, 25 bp, Mus musculus
actacagtctctactgtgttataac

SEQ ID NO: 124084 - DNA, 25 bp, Mus musculus
actacagtctcttctgtgttataac

SEQ ID NO: 124085 - DNA, 25 bp, Mus musculus
actacagtggtgacacttactacaa

SEQ ID NO: 124086 - DNA, 25 bp, Mus musculus
actacagtggtgtcacttactacaa

SEQ ID NO: 124087 - DNA, 25 bp, Mus musculus
actacagtgtaaataagcttccagg

SEQ ID NO: 124088 - DNA, 25 bp, Mus musculus
actacagtgtaattaagcttccagg

SEQ ID NO: 124089 - DNA, 25 bp, Mus musculus
actacagttaagcatgttcggaaca

SEQ ID NO: 124090 - DNA, 25 bp, Mus musculus
actacagttaaggatgttcggaaca

SEQ ID NO: 124091 - DNA, 25 bp, Mus musculus
actacagttctcagttaagtcagga

SEQ ID NO: 124092 - DNA, 25 bp, Mus musculus
actacagttctctgttaagtcagga

SEQ ID NO: 124093 - DNA, 25 bp, Mus musculus
actacagttgttcggcttggtggca

SEQ ID NO: 124094 - DNA, 25 bp, Mus musculus
actacagttgttgggcttggtggca

SEQ ID NO: 124095 - DNA, 25 bp, Mus musculus
actacagttttcaatctcttcataa

SEQ ID NO: 124096 - DNA, 25 bp, Mus musculus
actacagttttcagccatgcacaga

SEQ ID NO: 124097 - DNA, 25 bp, Mus musculus
actacagttttctatctcttcataa

SEQ ID NO: 124098 - DNA, 25 bp, Mus musculus
actacagttttctgccatgcacaga

SEQ ID NO: 124099 - DNA, 25 bp, Mus musculus
actacatacaggacagggtcctctg

SEQ ID NO: 124100 - DNA, 25 bp, Mus musculus
actacatacaggtcagggtcctctg

SEQ ID NO: 124101 - DNA, 25 bp, Mus musculus
actacataccctcctgcttatttaa

SEQ ID NO: 124102 - DNA, 25 bp, Mus musculus
actacataccctgctgcttatttaa

SEQ ID NO: 124103 - DNA, 25 bp, Mus musculus
actacatagtcactcacaaagcaag

SEQ ID NO: 124104 - DNA, 25 bp, Mus musculus
actacatagtcagtcacaaagcaag

SEQ ID NO: 124105 - DNA, 25 bp, Mus musculus
actacatatgcgcttcaagttttat

SEQ ID NO: 124106 - DNA, 25 bp, Mus musculus
actacatatgcggttcaagttttat

SEQ ID NO: 124107 - DNA, 25 bp, Mus musculus
actacatatggcctctgcactgggt

SEQ ID NO: 124108 - DNA, 25 bp, Mus musculus
actacatatggcgtctgcactgggt

SEQ ID NO: 124109 - DNA, 25 bp, Mus musculus
actacatcaccgcagcatatgtgga

SEQ ID NO: 124110 - DNA, 25 bp, Mus musculus
actacatcaccggagcatatgtgga

SEQ ID NO: 124111 - DNA, 25 bp, Mus musculus
actacatcatgaacaaggacttgct

SEQ ID NO: 124112 - DNA, 25 bp, Mus musculus
actacatcatgatcaaggacttgct

SEQ ID NO: 124113 - DNA, 25 bp, Mus musculus
actacatcatttcatccttgaaggg

SEQ ID NO: 124114 - DNA, 25 bp, Mus musculus
actacatcatttgatccttgaaggg

SEQ ID NO: 124115 - DNA, 25 bp, Mus musculus
actacatcctggcaaccatatggta

SEQ ID NO: 124116 - DNA, 25 bp, Mus musculus
actacatcctgggaaccatatggta

SEQ ID NO: 124117 - DNA, 25 bp, Mus musculus
actacatcctgtctgtgatcagcgg

SEQ ID NO: 124118 - DNA, 25 bp, Mus musculus
actacatcctgtgtgtgatcagcgg

SEQ ID NO: 124119 - DNA, 25 bp, Mus musculus
actacatcgaatattgttttgtgaa

SEQ ID NO: 124120 - DNA, 25 bp, Mus musculus
actacatcgaattttgttttgtgaa

SEQ ID NO: 124121 - DNA, 25 bp, Mus musculus
actacatcgatcctccagcagaaat

SEQ ID NO: 124122 - DNA, 25 bp, Mus musculus
actacatcgatcgtccagcagaaat

SEQ ID NO: 124123 - DNA, 25 bp, Mus musculus
actacatctcaactgttacagactc

SEQ ID NO: 124124 - DNA, 25 bp, Mus musculus
actacatctcaagtgttacagactc

SEQ ID NO: 124125 - DNA, 25 bp, Mus musculus
actacatctgaaaccctgtgactga

SEQ ID NO: 124126 - DNA, 25 bp, Mus musculus
actacatctgaatccctgtgactga

SEQ ID NO: 124127 - DNA, 25 bp, Mus musculus
actacatctgtgcatgggacctgga

SEQ ID NO: 124128 - DNA, 25 bp, Mus musculus
actacatctgtggatgggacctgga

SEQ ID NO: 124129 - DNA, 25 bp, Mus musculus
actacatgatgtattctctcttccc

SEQ ID NO: 124130 - DNA, 25 bp, Mus musculus
actacatgatgttttctctcttccc

SEQ ID NO: 124131 - DNA, 25 bp, Mus musculus
actacatgctgcacgccgaggaggg

SEQ ID NO: 124132 - DNA, 25 bp, Mus musculus
actacatgctgctcgccgaggaggg

SEQ ID NO: 124133 - DNA, 25 bp, Mus musculus
actacatgctgtcctttaaggtcta

SEQ ID NO: 124134 - DNA, 25 bp, Mus musculus
actacatgctgtgctttaaggtcta

SEQ ID NO: 124135 - DNA, 25 bp, Mus musculus
actacatgggtcatttcttgttttg

SEQ ID NO: 124136 - DNA, 25 bp, Mus musculus
actacatgggtcttttcttgttttg

SEQ ID NO: 124137 - DNA, 25 bp, Mus musculus
actacatggtctacatgttccagta

SEQ ID NO: 124138 - DNA, 25 bp, Mus musculus
actacatggtcttcatgttccagta

SEQ ID NO: 124139 - DNA, 25 bp, Mus musculus
actacatggttaattttgctctgaa

SEQ ID NO: 124140 - DNA, 25 bp, Mus musculus
actacatggttatttttgctctgaa

SEQ ID NO: 124141 - DNA, 25 bp, Mus musculus
actacatggttcactcctgcagtcc

SEQ ID NO: 124142 - DNA, 25 bp, Mus musculus
actacatggttctctcctgcagtcc

SEQ ID NO: 124143 - DNA, 25 bp, Mus musculus
actacatgtaccaagtcccagacaa

SEQ ID NO: 124144 - DNA, 25 bp, Mus musculus
actacatgtacctagtcccagacaa

SEQ ID NO: 124145 - DNA, 25 bp, Mus musculus
actacatgtactctgcctttactcg

SEQ ID NO: 124146 - DNA, 25 bp, Mus musculus
actacatgtactgtgcctttactcg

SEQ ID NO: 124147 - DNA, 25 bp, Mus musculus
actacatgtgggattgagtgcacct

SEQ ID NO: 124148 - DNA, 25 bp, Mus musculus
actacatgtgggtttgagtgcacct

SEQ ID NO: 124149 - DNA, 25 bp, Mus musculus
actacatgttgtacacctgatttta

SEQ ID NO: 124150 - DNA, 25 bp, Mus musculus
actacatgttgtacagtcctaaacc

SEQ ID NO: 124151 - DNA, 25 bp, Mus musculus
actacatgttgttcacctgatttta

SEQ ID NO: 124152 - DNA, 25 bp, Mus musculus
actacatgttgttcagtcctaaacc

SEQ ID NO: 124153 - DNA, 25 bp, Mus musculus
actacattagacagtgacacccaaa

SEQ ID NO: 124154 - DNA, 25 bp, Mus musculus
actacattagactgtgacacccaaa

SEQ ID NO: 124155 - DNA, 25 bp, Mus musculus
actacattcaggacccagacagcat

SEQ ID NO: 124156 - DNA, 25 bp, Mus musculus
actacattcaggtcccagacagcat

SEQ ID NO: 124157 - DNA, 25 bp, Mus musculus
actacattccttcggaaactgcttt

SEQ ID NO: 124158 - DNA, 25 bp, Mus musculus
actacattccttgggaaactgcttt

SEQ ID NO: 124159 - DNA, 25 bp, Mus musculus
actacatttatgatctgcagaatag

SEQ ID NO: 124160 - DNA, 25 bp, Mus musculus
actacatttatgttctgcagaatag

SEQ ID NO: 124161 - DNA, 25 bp, Mus musculus
actaccaacgccagggactgccttg

SEQ ID NO: 124162 - DNA, 25 bp, Mus musculus
actaccaacgcctgggactgccttg

SEQ ID NO: 124163 - DNA, 25 bp, Mus musculus
actaccaatcagctgccaggcaagt

SEQ ID NO: 124164 - DNA, 25 bp, Mus musculus
actaccaatcaggtgccaggcaagt

SEQ ID NO: 124165 - DNA, 25 bp, Mus musculus
actaccacaagacagtaccacctta

SEQ ID NO: 124166 - DNA, 25 bp, Mus musculus
actaccacaagagagtaccacctta

SEQ ID NO: 124167 - DNA, 25 bp, Mus musculus
actaccacagggacagacagggtct

SEQ ID NO: 124168 - DNA, 25 bp, Mus musculus
actaccacagggtcagacagggtct

SEQ ID NO: 124169 - DNA, 25 bp, Mus musculus
actaccacatataagcacaccatgc

SEQ ID NO: 124170 - DNA, 25 bp, Mus musculus
actaccacatattagcacaccatgc

SEQ ID NO: 124171 - DNA, 25 bp, Mus musculus
actaccaccagaactgcatttaata

SEQ ID NO: 124172 - DNA, 25 bp, Mus musculus
actaccaccagatctgcatttaata

SEQ ID NO: 124173 - DNA, 25 bp, Mus musculus
actaccaccttgaagttaatcccag

SEQ ID NO: 124174 - DNA, 25 bp, Mus musculus
actaccaccttgtagttaatcccag

SEQ ID NO: 124175 - DNA, 25 bp, Mus musculus
actaccagcagtcgatgaaccccac

SEQ ID NO: 124176 - DNA, 25 bp, Mus musculus
actaccagcagtggatgaaccccac

SEQ ID NO: 124177 - DNA, 25 bp, Mus musculus
actaccagccccagtgctaatcaat

SEQ ID NO: 124178 - DNA, 25 bp, Mus musculus
actaccagcccctgtgctaatcaat

SEQ ID NO: 124179 - DNA, 25 bp, Mus musculus
actaccagcttcagcttccactttg

SEQ ID NO: 124180 - DNA, 25 bp, Mus musculus
actaccagcttctgcttccactttg

SEQ ID NO: 124181 - DNA, 25 bp, Mus musculus
actaccagtaaccaggttgcctctt

SEQ ID NO: 124182 - DNA, 25 bp, Mus musculus
actaccagtaacgaggttgcctctt

SEQ ID NO: 124183 - DNA, 25 bp, Mus musculus
actaccatcaggattgtctttcacc

SEQ ID NO: 124184 - DNA, 25 bp, Mus musculus
actaccatcaggtttgtctttcacc

SEQ ID NO: 124185 - DNA, 25 bp, Mus musculus
actaccatgctaatccagttccagg

SEQ ID NO: 124186 - DNA, 25 bp, Mus musculus
actaccatgctattccagttccagg

SEQ ID NO: 124187 - DNA, 25 bp, Mus musculus
actaccatgcttaggtttgcttctt

SEQ ID NO: 124188 - DNA, 25 bp, Mus musculus
actaccatgctttggtttgcttctt

SEQ ID NO: 124189 - DNA, 25 bp, Mus musculus
actaccattataactagatctacac

SEQ ID NO: 124190 - DNA, 25 bp, Mus musculus
actaccattatatctagatctacac

SEQ ID NO: 124191 - DNA, 25 bp, Mus musculus
actaccattcctaagctcagttgta

SEQ ID NO: 124192 - DNA, 25 bp, Mus musculus
actaccattccttagctcagttgta

SEQ ID NO: 124193 - DNA, 25 bp, Mus musculus
actacccaagggagcagaggctttg

SEQ ID NO: 124194 - DNA, 25 bp, Mus musculus
actacccaagggtgcagaggctttg

SEQ ID NO: 124195 - DNA, 25 bp, Mus musculus
actacccaataaagtcgcagccaaa

SEQ ID NO: 124196 - DNA, 25 bp, Mus musculus
actacccaataatgtcgcagccaaa

SEQ ID NO: 124197 - DNA, 25 bp, Mus musculus
actacccacagtccaggcctgatga

SEQ ID NO: 124198 - DNA, 25 bp, Mus musculus
actacccacagtgcaggcctgatga

SEQ ID NO: 124199 - DNA, 25 bp, Mus musculus
actacccacataattttggattttg

SEQ ID NO: 124200 - DNA, 25 bp, Mus musculus
actacccacatatttttggattttg

SEQ ID NO: 124201 - DNA, 25 bp, Mus musculus
actacccacattccttgtactgtat

SEQ ID NO: 124202 - DNA, 25 bp, Mus musculus
actacccacattgcttgtactgtat

SEQ ID NO: 124203 - DNA, 25 bp, Mus musculus
actacccaccttatgcaggaggcgg

SEQ ID NO: 124204 - DNA, 25 bp, Mus musculus
actacccaccttttgcaggaggcgg

SEQ ID NO: 124205 - DNA, 25 bp, Mus musculus
actacccaggctattgggtgctggt

SEQ ID NO: 124206 - DNA, 25 bp, Mus musculus
actacccaggcttttgggtgctggt

SEQ ID NO: 124207 - DNA, 25 bp, Mus musculus
actacccagtgtctgatccctagac

SEQ ID NO: 124208 - DNA, 25 bp, Mus musculus
actacccagtgtgtgatccctagac

SEQ ID NO: 124209 - DNA, 25 bp, Mus musculus
actacccatcttcaggtcgaactaa

SEQ ID NO: 124210 - DNA, 25 bp, Mus musculus
actacccatcttgaggtcgaactaa

SEQ ID NO: 124211 - DNA, 25 bp, Mus musculus
actacccatgataacatgccatatt

SEQ ID NO: 124212 - DNA, 25 bp, Mus musculus
actacccatgattacatgccatatt

SEQ ID NO: 124213 - DNA, 25 bp, Mus musculus
actaccccgaaaacagaggtgtcag

SEQ ID NO: 124214 - DNA, 25 bp, Mus musculus
actaccccgaaatcagaggtgtcag

SEQ ID NO: 124215 - DNA, 25 bp, Mus musculus
actacccctctcatgatttagggat

SEQ ID NO: 124216 - DNA, 25 bp, Mus musculus
actacccctctcttgatttagggat

SEQ ID NO: 124217 - DNA, 25 bp, Mus musculus
actaccccttgcaaagaaagctctc

SEQ ID NO: 124218 - DNA, 25 bp, Mus musculus
actaccccttgctaagaaagctctc

SEQ ID NO: 124219 - DNA, 25 bp, Mus musculus
actacccgatggaactggacgacgt

SEQ ID NO: 124220 - DNA, 25 bp, Mus musculus
actacccgatggtactggacgacgt

SEQ ID NO: 124221 - DNA, 25 bp, Mus musculus
actacccggtgtcttcagatgctgt

SEQ ID NO: 124222 - DNA, 25 bp, Mus musculus
actacccggtgtgttcagatgctgt

SEQ ID NO: 124223 - DNA, 25 bp, Mus musculus
actacccgtcagacaattgagcagc

SEQ ID NO: 124224 - DNA, 25 bp, Mus musculus
actacccgtcagtcaattgagcagc

SEQ ID NO: 124225 - DNA, 25 bp, Mus musculus
actaccctaagcagtagccaatgat

SEQ ID NO: 124226 - DNA, 25 bp, Mus musculus
actaccctaagctgtagccaatgat

SEQ ID NO: 124227 - DNA, 25 bp, Mus musculus
actaccctcttgacacttttccatc

SEQ ID NO: 124228 - DNA, 25 bp, Mus musculus
actaccctcttgtcacttttccatc

SEQ ID NO: 124229 - DNA, 25 bp, Mus musculus
actacccttgagagggtggtccctg

SEQ ID NO: 124230 - DNA, 25 bp, Mus musculus
actacccttgagtgggtggtccctg

SEQ ID NO: 124231 - DNA, 25 bp, Mus musculus
actacccttgtaccactggagttta

SEQ ID NO: 124232 - DNA, 25 bp, Mus musculus
actacccttgtagcactggagttta

SEQ ID NO: 124233 - DNA, 25 bp, Mus musculus
actaccgcccttagttgaaagagct

SEQ ID NO: 124234 - DNA, 25 bp, Mus musculus
actaccgccctttgttgaaagagct

SEQ ID NO: 124235 - DNA, 25 bp, Mus musculus
actaccgtagtaatgtcttgcacag

SEQ ID NO: 124236 - DNA, 25 bp, Mus musculus
actaccgtagtattgtcttgcacag

SEQ ID NO: 124237 - DNA, 25 bp, Mus musculus
actaccgtggcacacagtatcttct

SEQ ID NO: 124238 - DNA, 25 bp, Mus musculus
actaccgtggcagacagtatcttct

SEQ ID NO: 124239 - DNA, 25 bp, Mus musculus
actaccgtgtcaagtatgcagttat

SEQ ID NO: 124240 - DNA, 25 bp, Mus musculus
actaccgtgtcatgtatgcagttat

SEQ ID NO: 124241 - DNA, 25 bp, Mus musculus
actaccgtgtggaagctgtgcatat

SEQ ID NO: 124242 - DNA, 25 bp, Mus musculus
actaccgtgtggtagctgtgcatat

SEQ ID NO: 124243 - DNA, 25 bp, Mus musculus
actacctaccggcaactttgattga

SEQ ID NO: 124244 - DNA, 25 bp, Mus musculus
actacctaccgggaactttgattga

SEQ ID NO: 124245 - DNA, 25 bp, Mus musculus
actacctcatgaagatcctgaccga

SEQ ID NO: 124246 - DNA, 25 bp, Mus musculus
actacctcatgatgatcctgaccga

SEQ ID NO: 124247 - DNA, 25 bp, Mus musculus
actacctcatgccacagaacattag

SEQ ID NO: 124248 - DNA, 25 bp, Mus musculus
actacctcatgcgacagaacattag

SEQ ID NO: 124249 - DNA, 25 bp, Mus musculus
actacctgaagcatttcggcaccct

SEQ ID NO: 124250 - DNA, 25 bp, Mus musculus
actacctgaagcttttcggcaccct

SEQ ID NO: 124251 - DNA, 25 bp, Mus musculus
actacctgaattatgtgcatgttac

SEQ ID NO: 124252 - DNA, 25 bp, Mus musculus
actacctgaattttgtgcatgttac

SEQ ID NO: 124253 - DNA, 25 bp, Mus musculus
actacctgatctatgaaaggtttgc

SEQ ID NO: 124254 - DNA, 25 bp, Mus musculus
actacctgatctttgaaaggtttgc

SEQ ID NO: 124255 - DNA, 25 bp, Mus musculus
actacctgccagagttgacaataag

SEQ ID NO: 124256 - DNA, 25 bp, Mus musculus
actacctgccagtgttgacaataag

SEQ ID NO: 124257 - DNA, 25 bp, Mus musculus
actacctgctaactgctggcatgaa

SEQ ID NO: 124258 - DNA, 25 bp, Mus musculus
actacctgctaagtgctggcatgaa

SEQ ID NO: 124259 - DNA, 25 bp, Mus musculus
actacctggatgactgaggccggct

SEQ ID NO: 124260 - DNA, 25 bp, Mus musculus
actacctggatgtctgaggccggct

SEQ ID NO: 124261 - DNA, 25 bp, Mus musculus
actacctggccgagcatggacctat

SEQ ID NO: 124262 - DNA, 25 bp, Mus musculus
actacctggccgtgcatggacctat

SEQ ID NO: 124263 - DNA, 25 bp, Mus musculus
actacctggctaagctgttattttc

SEQ ID NO: 124264 - DNA, 25 bp, Mus musculus
actacctggctatgctgttattttc

SEQ ID NO: 124265 - DNA, 25 bp, Mus musculus
actacctggtttcttgggtctccat

SEQ ID NO: 124266 - DNA, 25 bp, Mus musculus
actacctggtttgttgggtctccat

SEQ ID NO: 124267 - DNA, 25 bp, Mus musculus
actacctgtatcacaccggcgtgtg

SEQ ID NO: 124268 - DNA, 25 bp, Mus musculus
actacctgtatctcaccggcgtgtg

SEQ ID NO: 124269 - DNA, 25 bp, Mus musculus
actacctgtgatacccacgaaggtg

SEQ ID NO: 124270 - DNA, 25 bp, Mus musculus
actacctgtgattcccacgaaggtg

SEQ ID NO: 124271 - DNA, 25 bp, Mus musculus
actacctgtgccaaagactccagat

SEQ ID NO: 124272 - DNA, 25 bp, Mus musculus
actacctgtgcctaagactccagat

SEQ ID NO: 124273 - DNA, 25 bp, Mus musculus
actaccttattcagactcctagaga

SEQ ID NO: 124274 - DNA, 25 bp, Mus musculus
actaccttattctgactcctagaga

SEQ ID NO: 124275 - DNA, 25 bp, Mus musculus
actaccttccacaagtgtgttacat

SEQ ID NO: 124276 - DNA, 25 bp, Mus musculus
actaccttccactagtgtgttacat

SEQ ID NO: 124277 - DNA, 25 bp, Mus musculus
actaccttcgctcttactgtttagg

SEQ ID NO: 124278 - DNA, 25 bp, Mus musculus
actaccttcgctgttactgtttagg

SEQ ID NO: 124279 - DNA, 25 bp, Mus musculus
actaccttctacagggcccttggag

SEQ ID NO: 124280 - DNA, 25 bp, Mus musculus
actaccttctactgggcccttggag

SEQ ID NO: 124281 - DNA, 25 bp, Mus musculus
actaccttctgaacttgtattttga

SEQ ID NO: 124282 - DNA, 25 bp, Mus musculus
actaccttctgatcttgtattttga

SEQ ID NO: 124283 - DNA, 25 bp, Mus musculus
actaccttctgtactaaaggatact

SEQ ID NO: 124284 - DNA, 25 bp, Mus musculus
actaccttctgttctaaaggatact

SEQ ID NO: 124285 - DNA, 25 bp, Mus musculus
actaccttgcagaaagatgaaatct

SEQ ID NO: 124286 - DNA, 25 bp, Mus musculus
actaccttgcagtaagatgaaatct

SEQ ID NO: 124287 - DNA, 25 bp, Mus musculus
actacctttataatatccaccacag

SEQ ID NO: 124288 - DNA, 25 bp, Mus musculus
actacctttatattatccaccacag

SEQ ID NO: 124289 - DNA, 25 bp, Mus musculus
actacctttccacatgttggcatag

SEQ ID NO: 124290 - DNA, 25 bp, Mus musculus
actacctttccagatgttggcatag

SEQ ID NO: 124291 - DNA, 25 bp, Mus musculus
actacctttggcctctgattcaaga

SEQ ID NO: 124292 - DNA, 25 bp, Mus musculus
actacctttggcgtctgattcaaga

SEQ ID NO: 124293 - DNA, 25 bp, Mus musculus
actacctttttcagccggtgatgga

SEQ ID NO: 124294 - DNA, 25 bp, Mus musculus
actacctttttctgccggtgatgga

SEQ ID NO: 124295 - DNA, 25 bp, Mus musculus
actacgacaagcatgtctcctacaa

SEQ ID NO: 124296 - DNA, 25 bp, Mus musculus
actacgacaagcttgtctcctacaa

SEQ ID NO: 124297 - DNA, 25 bp, Mus musculus
actacgacgaggctgccatggctat

SEQ ID NO: 124298 - DNA, 25 bp, Mus musculus
actacgacgagggtgccatggctat

SEQ ID NO: 124299 - DNA, 25 bp, Mus musculus
actacgagagtcaccggctgcagag

SEQ ID NO: 124300 - DNA, 25 bp, Mus musculus
actacgagagtctccggctgcagag

SEQ ID NO: 124301 - DNA, 25 bp, Mus musculus
actacgagccctcagaaatgtgttg

SEQ ID NO: 124302 - DNA, 25 bp, Mus musculus
actacgagccctgagaaatgtgttg

SEQ ID NO: 124303 - DNA, 25 bp, Mus musculus
actacgagtatgactgggccggcaa

SEQ ID NO: 124304 - DNA, 25 bp, Mus musculus
actacgagtatgtctgggccggcaa

SEQ ID NO: 124305 - DNA, 25 bp, Mus musculus
actacgatcggcagcagactgatgg

SEQ ID NO: 124306 - DNA, 25 bp, Mus musculus
actacgatcggctgcagactgatgg

SEQ ID NO: 124307 - DNA, 25 bp, Mus musculus
actacgcaggccagtgtccatgtgg

SEQ ID NO: 124308 - DNA, 25 bp, Mus musculus
actacgcaggcctgtgtccatgtgg

SEQ ID NO: 124309 - DNA, 25 bp, Mus musculus
actacgcatggcattgaggaggcgt

SEQ ID NO: 124310 - DNA, 25 bp, Mus musculus
actacgcatggctttgaggaggcgt

SEQ ID NO: 124311 - DNA, 25 bp, Mus musculus
actacgccaaggatgagctggttcc

SEQ ID NO: 124312 - DNA, 25 bp, Mus musculus
actacgccaaggttgagctggttcc

SEQ ID NO: 124313 - DNA, 25 bp, Mus musculus
actacgcgctcaagggtgccttgga

SEQ ID NO: 124314 - DNA, 25 bp, Mus musculus
actacgcgctcatgggtgccttgga

SEQ ID NO: 124315 - DNA, 25 bp, Mus musculus
actacgcggggaaggagaacttctg

SEQ ID NO: 124316 - DNA, 25 bp, Mus musculus
actacgcggggatggagaacttctg

SEQ ID NO: 124317 - DNA, 25 bp, Mus musculus
actacggaattgcatgccttgaaat

SEQ ID NO: 124318 - DNA, 25 bp, Mus musculus
actacggaattggatgccttgaaat

SEQ ID NO: 124319 - DNA, 25 bp, Mus musculus
actacggatatcacatggcttaatt

SEQ ID NO: 124320 - DNA, 25 bp, Mus musculus
actacggatatctcatggcttaatt

SEQ ID NO: 124321 - DNA, 25 bp, Mus musculus
actacggcaaggaccctgtggagct

SEQ ID NO: 124322 - DNA, 25 bp, Mus musculus
actacggcaaggtccctgtggagct

SEQ ID NO: 124323 - DNA, 25 bp, Mus musculus
actacggcagctactacggaggtct

SEQ ID NO: 124324 - DNA, 25 bp, Mus musculus
actacggcagcttctacggaggtct

SEQ ID NO: 124325 - DNA, 25 bp, Mus musculus
actacggctggcatcctaagacatc

SEQ ID NO: 124326 - DNA, 25 bp, Mus musculus
actacggctggcttcctaagacatc

SEQ ID NO: 124327 - DNA, 25 bp, Mus musculus
actacgggaggccagtgatctagca

SEQ ID NO: 124328 - DNA, 25 bp, Mus musculus
actacgggaggcgagtgatctagca

SEQ ID NO: 124329 - DNA, 25 bp, Mus musculus
actacggtagtacctcgtttgctta

SEQ ID NO: 124330 - DNA, 25 bp, Mus musculus
actacggtagtagctcgtttgctta

SEQ ID NO: 124331 - DNA, 25 bp, Mus musculus
actacggtagttcctttgcttactg

SEQ ID NO: 124332 - DNA, 25 bp, Mus musculus
actacggtagttgctttgcttactg

SEQ ID NO: 124333 - DNA, 25 bp, Mus musculus
actacgtacgcgacgtgagccggaa

SEQ ID NO: 124334 - DNA, 25 bp, Mus musculus
actacgtacgcgtcgtgagccggaa

SEQ ID NO: 124335 - DNA, 25 bp, Mus musculus
actacgtagtctaggctgaccttaa

SEQ ID NO: 124336 - DNA, 25 bp, Mus musculus
actacgtagtcttggctgaccttaa

SEQ ID NO: 124337 - DNA, 25 bp, Mus musculus
actacgtctgccaatatctgcctgc

SEQ ID NO: 124338 - DNA, 25 bp, Mus musculus
actacgtctgcctatatctgcctgc

SEQ ID NO: 124339 - DNA, 25 bp, Mus musculus
actacgtgattcaccaggaacttat

SEQ ID NO: 124340 - DNA, 25 bp, Mus musculus
actacgtgattctccaggaacttat

SEQ ID NO: 124341 - DNA, 25 bp, Mus musculus
actacgtgcaatatttccagaccca

SEQ ID NO: 124342 - DNA, 25 bp, Mus musculus
actacgtgcaatttttccagaccca

SEQ ID NO: 124343 - DNA, 25 bp, Mus musculus
actacgtggtataccccagcggtag

SEQ ID NO: 124344 - DNA, 25 bp, Mus musculus
actacgtggtattccccagcggtag

SEQ ID NO: 124345 - DNA, 25 bp, Mus musculus
actacgtgtttgctgagaatgggac

SEQ ID NO: 124346 - DNA, 25 bp, Mus musculus
actacgtgtttggtgagaatgggac

SEQ ID NO: 124347 - DNA, 25 bp, Mus musculus
actacgttgaccagcgtgaggattt

SEQ ID NO: 124348 - DNA, 25 bp, Mus musculus
actacgttgacctgcgtgaggattt

SEQ ID NO: 124349 - DNA, 25 bp, Mus musculus
actacgtttgtaatcacttctccct

SEQ ID NO: 124350 - DNA, 25 bp, Mus musculus
actacgtttgtattcacttctccct

SEQ ID NO: 124351 - DNA, 25 bp, Mus musculus
actactaactctagatggtacagtt

SEQ ID NO: 124352 - DNA, 25 bp, Mus musculus
actactaactcttgatggtacagtt

SEQ ID NO: 124353 - DNA, 25 bp, Mus musculus
actactaagactaccagttcttcct

SEQ ID NO: 124354 - DNA, 25 bp, Mus musculus
actactaagacttccagttcttcct

SEQ ID NO: 124355 - DNA, 25 bp, Mus musculus
actactacaacacctgagatcacaa

SEQ ID NO: 124356 - DNA, 25 bp, Mus musculus
actactacaacagctgagatcacaa

SEQ ID NO: 124357 - DNA, 25 bp, Mus musculus
actactacaagcacaagtaccctcg

SEQ ID NO: 124358 - DNA, 25 bp, Mus musculus
actactacaagcactccagtaacaa

SEQ ID NO: 124359 - DNA, 25 bp, Mus musculus
actactacaagctcaagtaccctcg

SEQ ID NO: 124360 - DNA, 25 bp, Mus musculus
actactacaagctctccagtaacaa

SEQ ID NO: 124361 - DNA, 25 bp, Mus musculus
actactaccaagaggaaccgatcat

SEQ ID NO: 124362 - DNA, 25 bp, Mus musculus
actactaccaagtggaaccgatcat

SEQ ID NO: 124363 - DNA, 25 bp, Mus musculus
actactaccaccacagagctgttgt

SEQ ID NO: 124364 - DNA, 25 bp, Mus musculus
actactaccacctcagagctgttgt

SEQ ID NO: 124365 - DNA, 25 bp, Mus musculus
actactaccactaccaaacaatgac

SEQ ID NO: 124366 - DNA, 25 bp, Mus musculus
actactaccactacgggaagctcgt

SEQ ID NO: 124367 - DNA, 25 bp, Mus musculus
actactaccacttccaaacaatgac

SEQ ID NO: 124368 - DNA, 25 bp, Mus musculus
actactaccacttcgggaagctcgt

SEQ ID NO: 124369 - DNA, 25 bp, Mus musculus
actactacccgactatcatcaaatt

SEQ ID NO: 124370 - DNA, 25 bp, Mus musculus
actactacccgagtatcatcaaatt

SEQ ID NO: 124371 - DNA, 25 bp, Mus musculus
actactacctgaaccgaaggtctct

SEQ ID NO: 124372 - DNA, 25 bp, Mus musculus
actactacctgatccgaaggtctct

SEQ ID NO: 124373 - DNA, 25 bp, Mus musculus
actactactgtgagtgcgacttgtg

SEQ ID NO: 124374 - DNA, 25 bp, Mus musculus
actactactgtgtgtgcgacttgtg

SEQ ID NO: 124375 - DNA, 25 bp, Mus musculus
actactacttgcactttttcacatt

SEQ ID NO: 124376 - DNA, 25 bp, Mus musculus
actactacttgctctttttcacatt

SEQ ID NO: 124377 - DNA, 25 bp, Mus musculus
actactaggactcctatattcagga

SEQ ID NO: 124378 - DNA, 25 bp, Mus musculus
actactaggactgctatattcagga

SEQ ID NO: 124379 - DNA, 25 bp, Mus musculus
actactaggtagacgacatgggtcc

SEQ ID NO: 124380 - DNA, 25 bp, Mus musculus
actactaggtagtcgacatgggtcc

SEQ ID NO: 124381 - DNA, 25 bp, Mus musculus
actactatctcacatccgatggaag

SEQ ID NO: 124382 - DNA, 25 bp, Mus musculus
actactatctcagatccgatggaag

SEQ ID NO: 124383 - DNA, 25 bp, Mus musculus
actactatgcaaccatggctctccg

SEQ ID NO: 124384 - DNA, 25 bp, Mus musculus
actactatgcaagcatggctctccg

SEQ ID NO: 124385 - DNA, 25 bp, Mus musculus
actactatgtgcagatggtgttatc

SEQ ID NO: 124386 - DNA, 25 bp, Mus musculus
actactatgtgctgatggtgttatc

SEQ ID NO: 124387 - DNA, 25 bp, Mus musculus
actactatgtgtcccatgagttcag

SEQ ID NO: 124388 - DNA, 25 bp, Mus musculus
actactatgtgtgccatgagttcag

SEQ ID NO: 124389 - DNA, 25 bp, Mus musculus
actactatgttacgagtctgagctc

SEQ ID NO: 124390 - DNA, 25 bp, Mus musculus
actactatgttaggagtctgagctc

SEQ ID NO: 124391 - DNA, 25 bp, Mus musculus
actactattcctcctggtttattgg

SEQ ID NO: 124392 - DNA, 25 bp, Mus musculus
actactattcctgctggtttattgg

SEQ ID NO: 124393 - DNA, 25 bp, Mus musculus
actactattgctactgctggcatct

SEQ ID NO: 124394 - DNA, 25 bp, Mus musculus
actactattgcttctgctggcatct

SEQ ID NO: 124395 - DNA, 25 bp, Mus musculus
actactcagtttacttcctcttaag

SEQ ID NO: 124396 - DNA, 25 bp, Mus musculus
actactcagttttcttcctcttaag

SEQ ID NO: 124397 - DNA, 25 bp, Mus musculus
actactccaagaaggtcttcgaaac

SEQ ID NO: 124398 - DNA, 25 bp, Mus musculus
actactccaagatggtcttcgaaac

SEQ ID NO: 124399 - DNA, 25 bp, Mus musculus
actactccctagaacatacactcat

SEQ ID NO: 124400 - DNA, 25 bp, Mus musculus
actactccctagtacatacactcat

SEQ ID NO: 124401 - DNA, 25 bp, Mus musculus
actactcctgttagaatgtttgaac

SEQ ID NO: 124402 - DNA, 25 bp, Mus musculus
actactcctgtttgaatgtttgaac

SEQ ID NO: 124403 - DNA, 25 bp, Mus musculus
actactcgaaatcagcaccccaggg

SEQ ID NO: 124404 - DNA, 25 bp, Mus musculus
actactcgaaatgagcaccccaggg

SEQ ID NO: 124405 - DNA, 25 bp, Mus musculus
actactcggccaacactaggaagag

SEQ ID NO: 124406 - DNA, 25 bp, Mus musculus
actactcggccatcactaggaagag

SEQ ID NO: 124407 - DNA, 25 bp, Mus musculus
actactctaagaacgccgagcagct

SEQ ID NO: 124408 - DNA, 25 bp, Mus musculus
actactctaagatcgccgagcagct

SEQ ID NO: 124409 - DNA, 25 bp, Mus musculus
actactctacctcgtaccatatctg

SEQ ID NO: 124410 - DNA, 25 bp, Mus musculus
actactctacctggtaccatatctg

SEQ ID NO: 124411 - DNA, 25 bp, Mus musculus
actactctcagtctttgtctttggg

SEQ ID NO: 124412 - DNA, 25 bp, Mus musculus
actactctcagtgtttgtctttggg

SEQ ID NO: 124413 - DNA, 25 bp, Mus musculus
actactctcgatcctgggacaacat

SEQ ID NO: 124414 - DNA, 25 bp, Mus musculus
actactctcgatgctgggacaacat

SEQ ID NO: 124415 - DNA, 25 bp, Mus musculus
actactctctaaatgctaccaggat

SEQ ID NO: 124416 - DNA, 25 bp, Mus musculus
actactctctaattgctaccaggat

SEQ ID NO: 124417 - DNA, 25 bp, Mus musculus
actactctgctactctgcttaagtg

SEQ ID NO: 124418 - DNA, 25 bp, Mus musculus
actactctgctagtctgcttaagtg

SEQ ID NO: 124419 - DNA, 25 bp, Mus musculus
actactgaattaaactcaagttctt

SEQ ID NO: 124420 - DNA, 25 bp, Mus musculus
actactgaattatactcaagttctt

SEQ ID NO: 124421 - DNA, 25 bp, Mus musculus
actactgacatcatgtcatgcccaa

SEQ ID NO: 124422 - DNA, 25 bp, Mus musculus
actactgacatcttgtcatgcccaa

SEQ ID NO: 124423 - DNA, 25 bp, Mus musculus
actactgaccctcagcatagtggct

SEQ ID NO: 124424 - DNA, 25 bp, Mus musculus
actactgaccctgagcatagtggct

SEQ ID NO: 124425 - DNA, 25 bp, Mus musculus
actactgacgtactggtctactgta

SEQ ID NO: 124426 - DNA, 25 bp, Mus musculus
actactgacgtagtggtctactgta

SEQ ID NO: 124427 - DNA, 25 bp, Mus musculus
actactgagacaagtttccatcctc

SEQ ID NO: 124428 - DNA, 25 bp, Mus musculus
actactgagacatgtttccatcctc

SEQ ID NO: 124429 - DNA, 25 bp, Mus musculus
actactgagtgcattctgtgtgtgt

SEQ ID NO: 124430 - DNA, 25 bp, Mus musculus
actactgagtgctttctgtgtgtgt

SEQ ID NO: 124431 - DNA, 25 bp, Mus musculus
actactgataataatgtcaccattt

SEQ ID NO: 124432 - DNA, 25 bp, Mus musculus
actactgataattatgtcaccattt

SEQ ID NO: 124433 - DNA, 25 bp, Mus musculus
actactgatcagatatctaggttaa

SEQ ID NO: 124434 - DNA, 25 bp, Mus musculus
actactgatcagttatctaggttaa

SEQ ID NO: 124435 - DNA, 25 bp, Mus musculus
actactgatggccaaggaccgtata

SEQ ID NO: 124436 - DNA, 25 bp, Mus musculus
actactgatggcgaaggaccgtata

SEQ ID NO: 124437 - DNA, 25 bp, Mus musculus
actactgatgttattgttctactgc

SEQ ID NO: 124438 - DNA, 25 bp, Mus musculus
actactgatgtttttgttctactgc

SEQ ID NO: 124439 - DNA, 25 bp, Mus musculus
actactgattctagctgtgtggact

SEQ ID NO: 124440 - DNA, 25 bp, Mus musculus
actactgattcttgctgtgtggact

SEQ ID NO: 124441 - DNA, 25 bp, Mus musculus
actactgatttcctgggcatccacc

SEQ ID NO: 124442 - DNA, 25 bp, Mus musculus
actactgatttcgtgggcatccacc

SEQ ID NO: 124443 - DNA, 25 bp, Mus musculus
actactgcaagtctgccctgcggag

SEQ ID NO: 124444 - DNA, 25 bp, Mus musculus
actactgcaagtgtgccctgcggag

SEQ ID NO: 124445 - DNA, 25 bp, Mus musculus
actactgcacccatgagaggatcat

SEQ ID NO: 124446 - DNA, 25 bp, Mus musculus
actactgcacccttgagaggatcat

SEQ ID NO: 124447 - DNA, 25 bp, Mus musculus
actactgcaggcaaagcagggaggt

SEQ ID NO: 124448 - DNA, 25 bp, Mus musculus
actactgcaggctaagcagggaggt

SEQ ID NO: 124449 - DNA, 25 bp, Mus musculus
actactgcagtaaagattctcaaca

SEQ ID NO: 124450 - DNA, 25 bp, Mus musculus
actactgcagtatagattctcaaca

SEQ ID NO: 124451 - DNA, 25 bp, Mus musculus
actactgccagtccctgctgaagaa

SEQ ID NO: 124452 - DNA, 25 bp, Mus musculus
actactgccagtgcctgctgaagaa

SEQ ID NO: 124453 - DNA, 25 bp, Mus musculus
actactgcgaggatttcctgcacgc

SEQ ID NO: 124454 - DNA, 25 bp, Mus musculus
actactgcgaggttttcctgcacgc

SEQ ID NO: 124455 - DNA, 25 bp, Mus musculus
actactgctcagaaaagttgtttaa

SEQ ID NO: 124456 - DNA, 25 bp, Mus musculus
actactgctcagtaaagttgtttaa

SEQ ID NO: 124457 - DNA, 25 bp, Mus musculus
actactgctcctactttattttcta

SEQ ID NO: 124458 - DNA, 25 bp, Mus musculus
actactgctccttctttattttcta

SEQ ID NO: 124459 - DNA, 25 bp, Mus musculus
actactgctcttacctgtgatcaga

SEQ ID NO: 124460 - DNA, 25 bp, Mus musculus
actactgctctttcctgtgatcaga

SEQ ID NO: 124461 - DNA, 25 bp, Mus musculus
actactgctttcaggatcctggaga

SEQ ID NO: 124462 - DNA, 25 bp, Mus musculus
actactgctttctggatcctggaga

SEQ ID NO: 124463 - DNA, 25 bp, Mus musculus
actactggacagatatgggcccaca

SEQ ID NO: 124464 - DNA, 25 bp, Mus musculus
actactggacagttatgggcccaca

SEQ ID NO: 124465 - DNA, 25 bp, Mus musculus
actactggacgtccgtgaccaatga

SEQ ID NO: 124466 - DNA, 25 bp, Mus musculus
actactggacgtgcgtgaccaatga

SEQ ID NO: 124467 - DNA, 25 bp, Mus musculus
actactggagtgagtgcgcctacgc

SEQ ID NO: 124468 - DNA, 25 bp, Mus musculus
actactggagtgtgtgcgcctacgc

SEQ ID NO: 124469 - DNA, 25 bp, Mus musculus
actactgggactaacaggttgggat

SEQ ID NO: 124470 - DNA, 25 bp, Mus musculus
actactgggacttacaggttgggat

SEQ ID NO: 124471 - DNA, 25 bp, Mus musculus
actactggtcggaggatcctttgga

SEQ ID NO: 124472 - DNA, 25 bp, Mus musculus
actactggtcggtggatcctttgga

SEQ ID NO: 124473 - DNA, 25 bp, Mus musculus
actactggtggcatcggatgcagat

SEQ ID NO: 124474 - DNA, 25 bp, Mus musculus
actactggtggcttcggatgcagat

SEQ ID NO: 124475 - DNA, 25 bp, Mus musculus
actactgtactcctgatggccgccg

SEQ ID NO: 124476 - DNA, 25 bp, Mus musculus
actactgtactcgtgatggccgccg

SEQ ID NO: 124477 - DNA, 25 bp, Mus musculus
actactgtagtcagcagatacctga

SEQ ID NO: 124478 - DNA, 25 bp, Mus musculus
actactgtagtctgcagatacctga

SEQ ID NO: 124479 - DNA, 25 bp, Mus musculus
actactgtatctatgttgagcgacc

SEQ ID NO: 124480 - DNA, 25 bp, Mus musculus
actactgtatctttgttgagcgacc

SEQ ID NO: 124481 - DNA, 25 bp, Mus musculus
actactgtcataatgtacttgctat

SEQ ID NO: 124482 - DNA, 25 bp, Mus musculus
actactgtcatattgtacttgctat

SEQ ID NO: 124483 - DNA, 25 bp, Mus musculus
actactgtctgccaggtctgcactg

SEQ ID NO: 124484 - DNA, 25 bp, Mus musculus
actactgtctgcgaggtctgcactg

SEQ ID NO: 124485 - DNA, 25 bp, Mus musculus
actactgtctttaatctaatctgca

SEQ ID NO: 124486 - DNA, 25 bp, Mus musculus
actactgtcttttatctaatctgca

SEQ ID NO: 124487 - DNA, 25 bp, Mus musculus
actactgtgggcaccatgtcgcctt

SEQ ID NO: 124488 - DNA, 25 bp, Mus musculus
actactgtgggctccatgtcgcctt

SEQ ID NO: 124489 - DNA, 25 bp, Mus musculus
actactgtggtgatctatgctttca

SEQ ID NO: 124490 - DNA, 25 bp, Mus musculus
actactgtggtgttctatgctttca

SEQ ID NO: 124491 - DNA, 25 bp, Mus musculus
actactgtgtgtctatacctgtgat

SEQ ID NO: 124492 - DNA, 25 bp, Mus musculus
actactgtgtgtgtatacctgtgat

SEQ ID NO: 124493 - DNA, 25 bp, Mus musculus
actactgtgttcatctgtgcccatt

SEQ ID NO: 124494 - DNA, 25 bp, Mus musculus
actactgtgttcttctgtgcccatt

SEQ ID NO: 124495 - DNA, 25 bp, Mus musculus
actactgtgttgagctgcatattgg

SEQ ID NO: 124496 - DNA, 25 bp, Mus musculus
actactgtgttgtgctgcatattgg

SEQ ID NO: 124497 - DNA, 25 bp, Mus musculus
actactgttagcacctctcaaggtt

SEQ ID NO: 124498 - DNA, 25 bp, Mus musculus
actactgttagctcctctcaaggtt

SEQ ID NO: 124499 - DNA, 25 bp, Mus musculus
actactgttccaaaggagtcccaat

SEQ ID NO: 124500 - DNA, 25 bp, Mus musculus
actactgttccataggagtcccaat

SEQ ID NO: 124501 - DNA, 25 bp, Mus musculus
actactgttgaaagtctctgttttg

SEQ ID NO: 124502 - DNA, 25 bp, Mus musculus
actactgttgaatgtctctgttttg

SEQ ID NO: 124503 - DNA, 25 bp, Mus musculus
actactgttgtgactaaaaagtcgg

SEQ ID NO: 124504 - DNA, 25 bp, Mus musculus
actactgttgtgtctaaaaagtcgg

SEQ ID NO: 124505 - DNA, 25 bp, Mus musculus
actactgtttttcaagtgtcaggac

SEQ ID NO: 124506 - DNA, 25 bp, Mus musculus
actactgtttttgaagtgtcaggac

SEQ ID NO: 124507 - DNA, 25 bp, Mus musculus
actacttaaagaactgtccccagac

SEQ ID NO: 124508 - DNA, 25 bp, Mus musculus
actacttaaagatctgtccccagac

SEQ ID NO: 124509 - DNA, 25 bp, Mus musculus
actacttaataaatgtgtggatctt

SEQ ID NO: 124510 - DNA, 25 bp, Mus musculus
actacttaataattgtgtggatctt

SEQ ID NO: 124511 - DNA, 25 bp, Mus musculus
actacttactatcctgtggttctct

SEQ ID NO: 124512 - DNA, 25 bp, Mus musculus
actacttactatgctgtggttctct

SEQ ID NO: 124513 - DNA, 25 bp, Mus musculus
actacttacttgatactcatgtaat

SEQ ID NO: 124514 - DNA, 25 bp, Mus musculus
actacttacttgttactcatgtaat

SEQ ID NO: 124515 - DNA, 25 bp, Mus musculus
actacttatctgagtgctgcctgat

SEQ ID NO: 124516 - DNA, 25 bp, Mus musculus
actacttatctgtgtgctgcctgat

SEQ ID NO: 124517 - DNA, 25 bp, Mus musculus
actacttcaacaaaccatattttgg

SEQ ID NO: 124518 - DNA, 25 bp, Mus musculus
actacttcaacataccatattttgg

SEQ ID NO: 124519 - DNA, 25 bp, Mus musculus
actacttcagccacatgaactgcaa

SEQ ID NO: 124520 - DNA, 25 bp, Mus musculus
actacttcagcctcatgaactgcaa

SEQ ID NO: 124521 - DNA, 25 bp, Mus musculus
actacttccgccatacaaccacctg

SEQ ID NO: 124522 - DNA, 25 bp, Mus musculus
actacttccgccttacaaccacctg

SEQ ID NO: 124523 - DNA, 25 bp, Mus musculus
actacttccgtaacttcagcgagaa

SEQ ID NO: 124524 - DNA, 25 bp, Mus musculus
actacttccgtatcttcagcgagaa

SEQ ID NO: 124525 - DNA, 25 bp, Mus musculus
actacttcgccccagagcctggaag

SEQ ID NO: 124526 - DNA, 25 bp, Mus musculus
actacttcgcccgagagcctggaag

SEQ ID NO: 124527 - DNA, 25 bp, Mus musculus
actacttcggccagtcagtggtggg

SEQ ID NO: 124528 - DNA, 25 bp, Mus musculus
actacttcggcctgtcagtggtggg

SEQ ID NO: 124529 - DNA, 25 bp, Mus musculus
actacttctagaagagttttctctg

SEQ ID NO: 124530 - DNA, 25 bp, Mus musculus
actacttctagatgagttttctctg

SEQ ID NO: 124531 - DNA, 25 bp, Mus musculus
actacttctatcctagggcgagtct

SEQ ID NO: 124532 - DNA, 25 bp, Mus musculus
actacttctatcgtagggcgagtct

SEQ ID NO: 124533 - DNA, 25 bp, Mus musculus
actacttctctgacatgcactttat

SEQ ID NO: 124534 - DNA, 25 bp, Mus musculus
actacttctctgtcatgcactttat

SEQ ID NO: 124535 - DNA, 25 bp, Mus musculus
actacttcttggagtggactggcct

SEQ ID NO: 124536 - DNA, 25 bp, Mus musculus
actacttcttggtgtggactggcct

SEQ ID NO: 124537 - DNA, 25 bp, Mus musculus
actacttgagccacaactctcagag

SEQ ID NO: 124538 - DNA, 25 bp, Mus musculus
actacttgagccatttacctctgcc

SEQ ID NO: 124539 - DNA, 25 bp, Mus musculus
actacttgagcctcaactctcagag

SEQ ID NO: 124540 - DNA, 25 bp, Mus musculus
actacttgagccttttacctctgcc

SEQ ID NO: 124541 - DNA, 25 bp, Mus musculus
actacttgagttcctaacctggctt

SEQ ID NO: 124542 - DNA, 25 bp, Mus musculus
actacttgagttgctaacctggctt

SEQ ID NO: 124543 - DNA, 25 bp, Mus musculus
actacttgctagatactttctcagg

SEQ ID NO: 124544 - DNA, 25 bp, Mus musculus
actacttgctagttactttctcagg

SEQ ID NO: 124545 - DNA, 25 bp, Mus musculus
actacttgcttacttccggactggg

SEQ ID NO: 124546 - DNA, 25 bp, Mus musculus
actacttgcttagttccggactggg

SEQ ID NO: 124547 - DNA, 25 bp, Mus musculus
actacttggagtacgctcctgtttg

SEQ ID NO: 124548 - DNA, 25 bp, Mus musculus
actacttggagttcgctcctgtttg

SEQ ID NO: 124549 - DNA, 25 bp, Mus musculus
actacttgtatgatttcctattgag

SEQ ID NO: 124550 - DNA, 25 bp, Mus musculus
actacttgtatgttttcctattgag

SEQ ID NO: 124551 - DNA, 25 bp, Mus musculus
actacttgtcagatgtcgaggccgg

SEQ ID NO: 124552 - DNA, 25 bp, Mus musculus
actacttgtcagttgtcgaggccgg

SEQ ID NO: 124553 - DNA, 25 bp, Mus musculus
actactttaatcattgcatgcctta

SEQ ID NO: 124554 - DNA, 25 bp, Mus musculus
actactttaatctttgcatgcctta

SEQ ID NO: 124555 - DNA, 25 bp, Mus musculus
actactttatccactgagcagcaac

SEQ ID NO: 124556 - DNA, 25 bp, Mus musculus
actactttatcctctgagcagcaac

SEQ ID NO: 124557 - DNA, 25 bp, Mus musculus
actactttcaaaactgtactagcag

SEQ ID NO: 124558 - DNA, 25 bp, Mus musculus
actactttcaaatctgtactagcag

SEQ ID NO: 124559 - DNA, 25 bp, Mus musculus
actactttcagtaggatgcctttcc

SEQ ID NO: 124560 - DNA, 25 bp, Mus musculus
actactttcagttggatgcctttcc

SEQ ID NO: 124561 - DNA, 25 bp, Mus musculus
actactttccctcaggtaaatcttg

SEQ ID NO: 124562 - DNA, 25 bp, Mus musculus
actactttccctgaggtaaatcttg

SEQ ID NO: 124563 - DNA, 25 bp, Mus musculus
actactttgcacaagtcgactgcag

SEQ ID NO: 124564 - DNA, 25 bp, Mus musculus
actactttgcactagtcgactgcag

SEQ ID NO: 124565 - DNA, 25 bp, Mus musculus
actactttgttgcatctggacagct

SEQ ID NO: 124566 - DNA, 25 bp, Mus musculus
actactttgttggatctggacagct

SEQ ID NO: 124567 - DNA, 25 bp, Mus musculus
actacttttcataaactgtgttatc

SEQ ID NO: 124568 - DNA, 25 bp, Mus musculus
actacttttcattaactgtgttatc

SEQ ID NO: 124569 - DNA, 25 bp, Mus musculus
actagaaaagtgctccagcgctgac

SEQ ID NO: 124570 - DNA, 25 bp, Mus musculus
actagaaaagtggtccagcgctgac

SEQ ID NO: 124571 - DNA, 25 bp, Mus musculus
actagaaaccagactgggatggaca

SEQ ID NO: 124572 - DNA, 25 bp, Mus musculus
actagaaaccagtctgggatggaca

SEQ ID NO: 124573 - DNA, 25 bp, Mus musculus
actagaaaccccagagcttaaacat

SEQ ID NO: 124574 - DNA, 25 bp, Mus musculus
actagaaacccctgagcttaaacat

SEQ ID NO: 124575 - DNA, 25 bp, Mus musculus
actagaaactcactgggttctcctt

SEQ ID NO: 124576 - DNA, 25 bp, Mus musculus
actagaaactcagtgggttctcctt

SEQ ID NO: 124577 - DNA, 25 bp, Mus musculus
actagaaccttcattcaactctctg

SEQ ID NO: 124578 - DNA, 25 bp, Mus musculus
actagaaccttctttcaactctctg

SEQ ID NO: 124579 - DNA, 25 bp, Mus musculus
actagaacggcaaaccagtccaggt

SEQ ID NO: 124580 - DNA, 25 bp, Mus musculus
actagaacggcataccagtccaggt

SEQ ID NO: 124581 - DNA, 25 bp, Mus musculus
actagaatccaactgccaggtcctg

SEQ ID NO: 124582 - DNA, 25 bp, Mus musculus
actagaatccaagtgccaggtcctg

SEQ ID NO: 124583 - DNA, 25 bp, Mus musculus
actagaatcgagctcactgtccacc

SEQ ID NO: 124584 - DNA, 25 bp, Mus musculus
actagaatcgaggtcactgtccacc

SEQ ID NO: 124585 - DNA, 25 bp, Mus musculus
actagaatgtcgatgctggagggca

SEQ ID NO: 124586 - DNA, 25 bp, Mus musculus
actagaatgtcgttgctggagggca

SEQ ID NO: 124587 - DNA, 25 bp, Mus musculus
actagaattccaacactcacagctt

SEQ ID NO: 124588 - DNA, 25 bp, Mus musculus
actagaattccatcactcacagctt

SEQ ID NO: 124589 - DNA, 25 bp, Mus musculus
actagaatttcgagtggcgcgtggc

SEQ ID NO: 124590 - DNA, 25 bp, Mus musculus
actagaatttcgtgtggcgcgtggc

SEQ ID NO: 124591 - DNA, 25 bp, Mus musculus
actagacacacaccttcacaaagag

SEQ ID NO: 124592 - DNA, 25 bp, Mus musculus
actagacacacagcttcacaaagag

SEQ ID NO: 124593 - DNA, 25 bp, Mus musculus
actagacacatgatgctggctctgc

SEQ ID NO: 124594 - DNA, 25 bp, Mus musculus
actagacacatgttgctggctctgc

SEQ ID NO: 124595 - DNA, 25 bp, Mus musculus
actagacagcgtcggcatcgaagcg

SEQ ID NO: 124596 - DNA, 25 bp, Mus musculus
actagacagcgtgggcatcgaagcg

SEQ ID NO: 124597 - DNA, 25 bp, Mus musculus
actagacagtgaccctaacccttgg

SEQ ID NO: 124598 - DNA, 25 bp, Mus musculus
actagacagtgagcctaacccttgg

SEQ ID NO: 124599 - DNA, 25 bp, Mus musculus
actagacatgccatctaacgctact

SEQ ID NO: 124600 - DNA, 25 bp, Mus musculus
actagacatgccttctaacgctact

SEQ ID NO: 124601 - DNA, 25 bp, Mus musculus
actagacccaggcactgagtccagt

SEQ ID NO: 124602 - DNA, 25 bp, Mus musculus
actagacccagggactgagtccagt

SEQ ID NO: 124603 - DNA, 25 bp, Mus musculus
actagaccgtcacgctggcgtgagc

SEQ ID NO: 124604 - DNA, 25 bp, Mus musculus
actagaccgtcaggctggcgtgagc

SEQ ID NO: 124605 - DNA, 25 bp, Mus musculus
actagacctaccattcacagagcat

SEQ ID NO: 124606 - DNA, 25 bp, Mus musculus
actagacctacctttcacagagcat

SEQ ID NO: 124607 - DNA, 25 bp, Mus musculus
actagacctctcaagtttactgtaa

SEQ ID NO: 124608 - DNA, 25 bp, Mus musculus
actagacctctctagtttactgtaa

SEQ ID NO: 124609 - DNA, 25 bp, Mus musculus
actagaccttagacttgggacagca

SEQ ID NO: 124610 - DNA, 25 bp, Mus musculus
actagaccttagtcttgggacagca

SEQ ID NO: 124611 - DNA, 25 bp, Mus musculus
actagactaaccctgtccgccaggg

SEQ ID NO: 124612 - DNA, 25 bp, Mus musculus
actagactaaccgtgtccgccaggg

SEQ ID NO: 124613 - DNA, 25 bp, Mus musculus
actagactcagcactttgttatgaa

SEQ ID NO: 124614 - DNA, 25 bp, Mus musculus
actagactcagctctttgttatgaa

SEQ ID NO: 124615 - DNA, 25 bp, Mus musculus
actagactcagtacatttcacaaat

SEQ ID NO: 124616 - DNA, 25 bp, Mus musculus
actagactcagttcatttcacaaat

SEQ ID NO: 124617 - DNA, 25 bp, Mus musculus
actagactgccaaacctgtgtgaag

SEQ ID NO: 124618 - DNA, 25 bp, Mus musculus
actagactgccatacctgtgtgaag

SEQ ID NO: 124619 - DNA, 25 bp, Mus musculus
actagactgtcgcttccttgggagc

SEQ ID NO: 124620 - DNA, 25 bp, Mus musculus
actagactgtcggttccttgggagc

SEQ ID NO: 124621 - DNA, 25 bp, Mus musculus
actagactgtgcagtactttaaaac

SEQ ID NO: 124622 - DNA, 25 bp, Mus musculus
actagactgtgctgtactttaaaac

SEQ ID NO: 124623 - DNA, 25 bp, Mus musculus
actagacttgagctcagaggtgacc

SEQ ID NO: 124624 - DNA, 25 bp, Mus musculus
actagacttgaggtcagaggtgacc

SEQ ID NO: 124625 - DNA, 25 bp, Mus musculus
actagagaattccactggtggctga

SEQ ID NO: 124626 - DNA, 25 bp, Mus musculus
actagagaattcgactggtggctga

SEQ ID NO: 124627 - DNA, 25 bp, Mus musculus
actagagacgacctgcttgaccacg

SEQ ID NO: 124628 - DNA, 25 bp, Mus musculus
actagagacgacgtgcttgaccacg

SEQ ID NO: 124629 - DNA, 25 bp, Mus musculus
actagagactgcagggcgtcatgac

SEQ ID NO: 124630 - DNA, 25 bp, Mus musculus
actagagactgctgggcgtcatgac

SEQ ID NO: 124631 - DNA, 25 bp, Mus musculus
actagagatctgcttgttcgccttc

SEQ ID NO: 124632 - DNA, 25 bp, Mus musculus
actagagatctggttgttcgccttc

SEQ ID NO: 124633 - DNA, 25 bp, Mus musculus
actagagccctgctaggctgagcac

SEQ ID NO: 124634 - DNA, 25 bp, Mus musculus
actagagccctggtaggctgagcac

SEQ ID NO: 124635 - DNA, 25 bp, Mus musculus
actagagcgatcactaggatctccc

SEQ ID NO: 124636 - DNA, 25 bp, Mus musculus
actagagcgatctctaggatctccc

SEQ ID NO: 124637 - DNA, 25 bp, Mus musculus
actagagctgagaggaaagttctta

SEQ ID NO: 124638 - DNA, 25 bp, Mus musculus
actagagctgagtggaaagttctta

SEQ ID NO: 124639 - DNA, 25 bp, Mus musculus
actagagggacacagctgaactagc

SEQ ID NO: 124640 - DNA, 25 bp, Mus musculus
actagagggacagagctgaactagc

SEQ ID NO: 124641 - DNA, 25 bp, Mus musculus
actagaggtatcagtcggtttgcaa

SEQ ID NO: 124642 - DNA, 25 bp, Mus musculus
actagaggtatctgtcggtttgcaa

SEQ ID NO: 124643 - DNA, 25 bp, Mus musculus
actagaggtgacaagcagtattgtg

SEQ ID NO: 124644 - DNA, 25 bp, Mus musculus
actagaggtgactagcagtattgtg

SEQ ID NO: 124645 - DNA, 25 bp, Mus musculus
actagagtgctacagatggaccgtg

SEQ ID NO: 124646 - DNA, 25 bp, Mus musculus
actagagtgctagagatggaccgtg

SEQ ID NO: 124647 - DNA, 25 bp, Mus musculus
actagagtgttcctgagatcatttg

SEQ ID NO: 124648 - DNA, 25 bp, Mus musculus
actagagtgttcgtgagatcatttg

SEQ ID NO: 124649 - DNA, 25 bp, Mus musculus
actagagttcttcaggcacagacca

SEQ ID NO: 124650 - DNA, 25 bp, Mus musculus
actagagttcttgaggcacagacca

SEQ ID NO: 124651 - DNA, 25 bp, Mus musculus
actagagttgagctgcatctgtact

SEQ ID NO: 124652 - DNA, 25 bp, Mus musculus
actagagttgaggtgcatctgtact

SEQ ID NO: 124653 - DNA, 25 bp, Mus musculus
actagagttgtgctcttatggagaa

SEQ ID NO: 124654 - DNA, 25 bp, Mus musculus
actagagttgtggtcttatggagaa

SEQ ID NO: 124655 - DNA, 25 bp, Mus musculus
actagagttgttactgggagggact

SEQ ID NO: 124656 - DNA, 25 bp, Mus musculus
actagagttgtttctgggagggact

SEQ ID NO: 124657 - DNA, 25 bp, Mus musculus
actagatacaatactcagtcagagg

SEQ ID NO: 124658 - DNA, 25 bp, Mus musculus
actagatacaattctcagtcagagg

SEQ ID NO: 124659 - DNA, 25 bp, Mus musculus
actagatcacacagaacgctggctt

SEQ ID NO: 124660 - DNA, 25 bp, Mus musculus
actagatcacactgaacgctggctt

SEQ ID NO: 124661 - DNA, 25 bp, Mus musculus
actagatcagtgcatccagactgga

SEQ ID NO: 124662 - DNA, 25 bp, Mus musculus
actagatcagtggatccagactgga

SEQ ID NO: 124663 - DNA, 25 bp, Mus musculus
actagatcctacagagaaactccat

SEQ ID NO: 124664 - DNA, 25 bp, Mus musculus
actagatcctactgagaaactccat

SEQ ID NO: 124665 - DNA, 25 bp, Mus musculus
actagatctgtcatgggcttttgaa

SEQ ID NO: 124666 - DNA, 25 bp, Mus musculus
actagatctgtcttgggcttttgaa

SEQ ID NO: 124667 - DNA, 25 bp, Mus musculus
actagatgactccacagagctgttt

SEQ ID NO: 124668 - DNA, 25 bp, Mus musculus
actagatgactcgacagagctgttt

SEQ ID NO: 124669 - DNA, 25 bp, Mus musculus
actagatgatggctacagtcctcca

SEQ ID NO: 124670 - DNA, 25 bp, Mus musculus
actagatgatgggtacagtcctcca

SEQ ID NO: 124671 - DNA, 25 bp, Mus musculus
actagatgctagcacttaacttgtt

SEQ ID NO: 124672 - DNA, 25 bp, Mus musculus
actagatgctaggacttaacttgtt

SEQ ID NO: 124673 - DNA, 25 bp, Mus musculus
actagatggtacaacccacgcagct

SEQ ID NO: 124674 - DNA, 25 bp, Mus musculus
actagatggtactacccacgcagct

SEQ ID NO: 124675 - DNA, 25 bp, Mus musculus
actagatgtttgctttggctggatt

SEQ ID NO: 124676 - DNA, 25 bp, Mus musculus
actagatgtttggtttggctggatt

SEQ ID NO: 124677 - DNA, 25 bp, Mus musculus
actagattattaagcattatttcct

SEQ ID NO: 124678 - DNA, 25 bp, Mus musculus
actagattattatgcattatttcct

SEQ ID NO: 124679 - DNA, 25 bp, Mus musculus
actagattccatcgcaaagcacgaa

SEQ ID NO: 124680 - DNA, 25 bp, Mus musculus
actagattccatggcaaagcacgaa

SEQ ID NO: 124681 - DNA, 25 bp, Mus musculus
actagattctctataggactctgca

SEQ ID NO: 124682 - DNA, 25 bp, Mus musculus
actagattctctttaggactctgca

SEQ ID NO: 124683 - DNA, 25 bp, Mus musculus
actagattgcctatataagagtcaa

SEQ ID NO: 124684 - DNA, 25 bp, Mus musculus
actagattgcctttataagagtcaa

SEQ ID NO: 124685 - DNA, 25 bp, Mus musculus
actagatttcacatggattcttcca

SEQ ID NO: 124686 - DNA, 25 bp, Mus musculus
actagatttcacttggattcttcca

SEQ ID NO: 124687 - DNA, 25 bp, Mus musculus
actagatttgttcatgccatgttac

SEQ ID NO: 124688 - DNA, 25 bp, Mus musculus
actagatttgttgatgccatgttac

SEQ ID NO: 124689 - DNA, 25 bp, Mus musculus
actagcaactctctcatctttttct

SEQ ID NO: 124690 - DNA, 25 bp, Mus musculus
actagcaactctgtcatctttttct

SEQ ID NO: 124691 - DNA, 25 bp, Mus musculus
actagcaagtttaatgtcacctgat

SEQ ID NO: 124692 - DNA, 25 bp, Mus musculus
actagcaagttttatgtcacctgat

SEQ ID NO: 124693 - DNA, 25 bp, Mus musculus
actagcacaggcactgccacataaa

SEQ ID NO: 124694 - DNA, 25 bp, Mus musculus
actagcacaggctctgccacataaa

SEQ ID NO: 124695 - DNA, 25 bp, Mus musculus
actagcacagtgcccgtctcagggc

SEQ ID NO: 124696 - DNA, 25 bp, Mus musculus
actagcacagtggccgtctcagggc

SEQ ID NO: 124697 - DNA, 25 bp, Mus musculus
actagcacatggctgtcgggttttc

SEQ ID NO: 124698 - DNA, 25 bp, Mus musculus
actagcacatgggtgtcgggttttc

SEQ ID NO: 124699 - DNA, 25 bp, Mus musculus
actagcacccagagacctaccagga

SEQ ID NO: 124700 - DNA, 25 bp, Mus musculus
actagcacccagtgacctaccagga

SEQ ID NO: 124701 - DNA, 25 bp, Mus musculus
actagcaccctcaaggagccaggaa

SEQ ID NO: 124702 - DNA, 25 bp, Mus musculus
actagcaccctctaggagccaggaa

SEQ ID NO: 124703 - DNA, 25 bp, Mus musculus
actagcacttcaagagccaatgaaa

SEQ ID NO: 124704 - DNA, 25 bp, Mus musculus
actagcacttcatgagccaatgaaa

SEQ ID NO: 124705 - DNA, 25 bp, Mus musculus
actagcagatgtcagttgcacattc

SEQ ID NO: 124706 - DNA, 25 bp, Mus musculus
actagcagatgtgagttgcacattc

SEQ ID NO: 124707 - DNA, 25 bp, Mus musculus
actagcagcagtatccccggagtgg

SEQ ID NO: 124708 - DNA, 25 bp, Mus musculus
actagcagcagtttccccggagtgg

SEQ ID NO: 124709 - DNA, 25 bp, Mus musculus
actagcagcctgcatgcacttgtct

SEQ ID NO: 124710 - DNA, 25 bp, Mus musculus
actagcagcctggatgcacttgtct

SEQ ID NO: 124711 - DNA, 25 bp, Mus musculus
actagcagcttaagtgtgtgccctg

SEQ ID NO: 124712 - DNA, 25 bp, Mus musculus
actagcagcttatgtgtgtgccctg

SEQ ID NO: 124713 - DNA, 25 bp, Mus musculus
actagcaggagcatcgttgctttgg

SEQ ID NO: 124714 - DNA, 25 bp, Mus musculus
actagcaggagcttcgttgctttgg

SEQ ID NO: 124715 - DNA, 25 bp, Mus musculus
actagcagggacatggcacaggaca

SEQ ID NO: 124716 - DNA, 25 bp, Mus musculus
actagcagggacttggcacaggaca

SEQ ID NO: 124717 - DNA, 25 bp, Mus musculus
actagcaggtggaggctcacgatgc

SEQ ID NO: 124718 - DNA, 25 bp, Mus musculus
actagcaggtggtggctcacgatgc

SEQ ID NO: 124719 - DNA, 25 bp, Mus musculus
actagcagtaacagctctggactct

SEQ ID NO: 124720 - DNA, 25 bp, Mus musculus
actagcagtaactgctctggactct

SEQ ID NO: 124721 - DNA, 25 bp, Mus musculus
actagcatctgcattatttggtctt

SEQ ID NO: 124722 - DNA, 25 bp, Mus musculus
actagcatctgctttatttggtctt

SEQ ID NO: 124723 - DNA, 25 bp, Mus musculus
actagcatgatgatataggcagtct

SEQ ID NO: 124724 - DNA, 25 bp, Mus musculus
actagcatgatgttataggcagtct

SEQ ID NO: 124725 - DNA, 25 bp, Mus musculus
actagcatgttcagtctcattttca

SEQ ID NO: 124726 - DNA, 25 bp, Mus musculus
actagcatgttctgtctcattttca

SEQ ID NO: 124727 - DNA, 25 bp, Mus musculus
actagcattactatgactgtcctct

SEQ ID NO: 124728 - DNA, 25 bp, Mus musculus
actagcattactttgactgtcctct

SEQ ID NO: 124729 - DNA, 25 bp, Mus musculus
actagcattggacacgttacgaaga

SEQ ID NO: 124730 - DNA, 25 bp, Mus musculus
actagcattggagacgttacgaaga

SEQ ID NO: 124731 - DNA, 25 bp, Mus musculus
actagcattgttccaggcaattttg

SEQ ID NO: 124732 - DNA, 25 bp, Mus musculus
actagcattgttgcaggcaattttg

SEQ ID NO: 124733 - DNA, 25 bp, Mus musculus
actagcatttacatctgttgagaaa

SEQ ID NO: 124734 - DNA, 25 bp, Mus musculus
actagcatttacttctgttgagaaa

SEQ ID NO: 124735 - DNA, 25 bp, Mus musculus
actagccaatagaagtacgacaagc

SEQ ID NO: 124736 - DNA, 25 bp, Mus musculus
actagccaatagtagtacgacaagc

SEQ ID NO: 124737 - DNA, 25 bp, Mus musculus
actagccagaggatgtactttaata

SEQ ID NO: 124738 - DNA, 25 bp, Mus musculus
actagccagaggttgtactttaata

SEQ ID NO: 124739 - DNA, 25 bp, Mus musculus
actagccagcacaatgatcctgtac

SEQ ID NO: 124740 - DNA, 25 bp, Mus musculus
actagccagcactatgatcctgtac

SEQ ID NO: 124741 - DNA, 25 bp, Mus musculus
actagccagccaattgttggaaaat

SEQ ID NO: 124742 - DNA, 25 bp, Mus musculus
actagccagccatttgttggaaaat

SEQ ID NO: 124743 - DNA, 25 bp, Mus musculus
actagccagcgtaaactgtgtgcaa

SEQ ID NO: 124744 - DNA, 25 bp, Mus musculus
actagccagcgttaactgtgtgcaa

SEQ ID NO: 124745 - DNA, 25 bp, Mus musculus
actagccaggctattaccaaggtag

SEQ ID NO: 124746 - DNA, 25 bp, Mus musculus
actagccaggcttttaccaaggtag

SEQ ID NO: 124747 - DNA, 25 bp, Mus musculus
actagccagggcctgtcagatgtgc

SEQ ID NO: 124748 - DNA, 25 bp, Mus musculus
actagccagggcgtgtcagatgtgc

SEQ ID NO: 124749 - DNA, 25 bp, Mus musculus
actagccatgtacttcagtgagctt

SEQ ID NO: 124750 - DNA, 25 bp, Mus musculus
actagccatgtagttcagtgagctt

SEQ ID NO: 124751 - DNA, 25 bp, Mus musculus
actagcccaacacaagacaaagcaa

SEQ ID NO: 124752 - DNA, 25 bp, Mus musculus
actagcccaacagaagacaaagcaa

SEQ ID NO: 124753 - DNA, 25 bp, Mus musculus
actagcccaaggagactgtatttat

SEQ ID NO: 124754 - DNA, 25 bp, Mus musculus
actagcccaaggtgactgtatttat

SEQ ID NO: 124755 - DNA, 25 bp, Mus musculus
actagcccaccccatttagagtggt

SEQ ID NO: 124756 - DNA, 25 bp, Mus musculus
actagcccacccgatttagagtggt

SEQ ID NO: 124757 - DNA, 25 bp, Mus musculus
actagcccagttcacctttttgaag

SEQ ID NO: 124758 - DNA, 25 bp, Mus musculus
actagcccagttgacctttttgaag

SEQ ID NO: 124759 - DNA, 25 bp, Mus musculus
actagccccatccactgtaggtagg

SEQ ID NO: 124760 - DNA, 25 bp, Mus musculus
actagccccatcgactgtaggtagg

SEQ ID NO: 124761 - DNA, 25 bp, Mus musculus
actagcccccagctttttaagtgag

SEQ ID NO: 124762 - DNA, 25 bp, Mus musculus
actagcccccaggtttttaagtgag

SEQ ID NO: 124763 - DNA, 25 bp, Mus musculus
actagcccctagcaagtctttcata

SEQ ID NO: 124764 - DNA, 25 bp, Mus musculus
actagcccctaggaagtctttcata

SEQ ID NO: 124765 - DNA, 25 bp, Mus musculus
actagccccttcagagaagcagaca

SEQ ID NO: 124766 - DNA, 25 bp, Mus musculus
actagccccttctgagaagcagaca

SEQ ID NO: 124767 - DNA, 25 bp, Mus musculus
actagccctgctccttgagagcaaa

SEQ ID NO: 124768 - DNA, 25 bp, Mus musculus
actagccctgctgcttgagagcaaa

SEQ ID NO: 124769 - DNA, 25 bp, Mus musculus
actagccgggtgctacagcgtaaca

SEQ ID NO: 124770 - DNA, 25 bp, Mus musculus
actagccgggtggtacagcgtaaca

SEQ ID NO: 124771 - DNA, 25 bp, Mus musculus
actagccgttccatattctatgccc

SEQ ID NO: 124772 - DNA, 25 bp, Mus musculus
actagccgttccttattctatgccc

SEQ ID NO: 124773 - DNA, 25 bp, Mus musculus
actagcctaaatcagagcccagatt

SEQ ID NO: 124774 - DNA, 25 bp, Mus musculus
actagcctaaatgagagcccagatt

SEQ ID NO: 124775 - DNA, 25 bp, Mus musculus
actagcctagttcattatcacctct

SEQ ID NO: 124776 - DNA, 25 bp, Mus musculus
actagcctagttgattatcacctct

SEQ ID NO: 124777 - DNA, 25 bp, Mus musculus
actagcctccaaaccattaccaatt

SEQ ID NO: 124778 - DNA, 25 bp, Mus musculus
actagcctccaatccattaccaatt

SEQ ID NO: 124779 - DNA, 25 bp, Mus musculus
actagcctcctgcagccagagaatg

SEQ ID NO: 124780 - DNA, 25 bp, Mus musculus
actagcctcctggagccagagaatg

SEQ ID NO: 124781 - DNA, 25 bp, Mus musculus
actagcctgatactaatcctgtctc

SEQ ID NO: 124782 - DNA, 25 bp, Mus musculus
actagcctgatagtaatcctgtctc

SEQ ID NO: 124783 - DNA, 25 bp, Mus musculus
actagcctggcaagtggtagctgct

SEQ ID NO: 124784 - DNA, 25 bp, Mus musculus
actagcctggcatgtggtagctgct

SEQ ID NO: 124785 - DNA, 25 bp, Mus musculus
actagcctgtctattgaccaccggc

SEQ ID NO: 124786 - DNA, 25 bp, Mus musculus
actagcctgtcttttgaccaccggc

SEQ ID NO: 124787 - DNA, 25 bp, Mus musculus
actagccttggaagtctgccctact

SEQ ID NO: 124788 - DNA, 25 bp, Mus musculus
actagccttggatgtctgccctact

SEQ ID NO: 124789 - DNA, 25 bp, Mus musculus
actagcgaccttctgtgagacatta

SEQ ID NO: 124790 - DNA, 25 bp, Mus musculus
actagcgaccttgtgtgagacatta

SEQ ID NO: 124791 - DNA, 25 bp, Mus musculus
actagcgccacacaggaaaccctgt

SEQ ID NO: 124792 - DNA, 25 bp, Mus musculus
actagcgccacagaggaaaccctgt

SEQ ID NO: 124793 - DNA, 25 bp, Mus musculus
actagcgcctacagtggtgcagact

SEQ ID NO: 124794 - DNA, 25 bp, Mus musculus
actagcgcctactgtggtgcagact

SEQ ID NO: 124795 - DNA, 25 bp, Mus musculus
actagcgcttgcatttgataataac

SEQ ID NO: 124796 - DNA, 25 bp, Mus musculus
actagcgcttgcttttgataataac

SEQ ID NO: 124797 - DNA, 25 bp, Mus musculus
actagcgtttagacctttggtcatt

SEQ ID NO: 124798 - DNA, 25 bp, Mus musculus
actagcgtttagtcctttggtcatt

SEQ ID NO: 124799 - DNA, 25 bp, Mus musculus
actagctaccttcactgtaacagaa

SEQ ID NO: 124800 - DNA, 25 bp, Mus musculus
actagctaccttgactgtaacagaa

SEQ ID NO: 124801 - DNA, 25 bp, Mus musculus
actagctagcttattcaggtacaat

SEQ ID NO: 124802 - DNA, 25 bp, Mus musculus
actagctagctttttcaggtacaat

SEQ ID NO: 124803 - DNA, 25 bp, Mus musculus
actagctaggtcattggaaggtctt

SEQ ID NO: 124804 - DNA, 25 bp, Mus musculus
actagctaggtctttggaaggtctt

SEQ ID NO: 124805 - DNA, 25 bp, Mus musculus
actagctagtgactgggtatatcta

SEQ ID NO: 124806 - DNA, 25 bp, Mus musculus
actagctagtgagtgggtatatcta

SEQ ID NO: 124807 - DNA, 25 bp, Mus musculus
actagctatgctatactccaagaga

SEQ ID NO: 124808 - DNA, 25 bp, Mus musculus
actagctatgctttactccaagaga

SEQ ID NO: 124809 - DNA, 25 bp, Mus musculus
actagctcactcactgtgcctgatc

SEQ ID NO: 124810 - DNA, 25 bp, Mus musculus
actagctcactctctgtgcctgatc

SEQ ID NO: 124811 - DNA, 25 bp, Mus musculus
actagctcagcaagtccagacaagt

SEQ ID NO: 124812 - DNA, 25 bp, Mus musculus
actagctcagcatgtccagacaagt

SEQ ID NO: 124813 - DNA, 25 bp, Mus musculus
actagctcatgaaactgtcctcaaa

SEQ ID NO: 124814 - DNA, 25 bp, Mus musculus
actagctcatgatactgtcctcaaa

SEQ ID NO: 124815 - DNA, 25 bp, Mus musculus
actagctcctttcattgtgttgatg

SEQ ID NO: 124816 - DNA, 25 bp, Mus musculus
actagctcctttgattgtgttgatg

SEQ ID NO: 124817 - DNA, 25 bp, Mus musculus
actagctctatcatgtgttttgggt

SEQ ID NO: 124818 - DNA, 25 bp, Mus musculus
actagctctatcttgtgttttgggt

SEQ ID NO: 124819 - DNA, 25 bp, Mus musculus
actagctctgctctttggaactcac

SEQ ID NO: 124820 - DNA, 25 bp, Mus musculus
actagctctgctgtttggaactcac

SEQ ID NO: 124821 - DNA, 25 bp, Mus musculus
actagctctggtacaacaaatgtaa

SEQ ID NO: 124822 - DNA, 25 bp, Mus musculus
actagctctggtatcggatgcggta

SEQ ID NO: 124823 - DNA, 25 bp, Mus musculus
actagctctggttcaacaaatgtaa

SEQ ID NO: 124824 - DNA, 25 bp, Mus musculus
actagctctggtttcggatgcggta

SEQ ID NO: 124825 - DNA, 25 bp, Mus musculus
actagctgacgactatgaggccaaa

SEQ ID NO: 124826 - DNA, 25 bp, Mus musculus
actagctgacgagtatgaggccaaa

SEQ ID NO: 124827 - DNA, 25 bp, Mus musculus
actagctgacttctacttgaattaa

SEQ ID NO: 124828 - DNA, 25 bp, Mus musculus
actagctgacttgtacttgaattaa

SEQ ID NO: 124829 - DNA, 25 bp, Mus musculus
actagctgatctctgatggcgtccc

SEQ ID NO: 124830 - DNA, 25 bp, Mus musculus
actagctgatctgtgatggcgtccc

SEQ ID NO: 124831 - DNA, 25 bp, Mus musculus
actagctgcatgaaactttctatga

SEQ ID NO: 124832 - DNA, 25 bp, Mus musculus
actagctgcatgtaactttctatga

SEQ ID NO: 124833 - DNA, 25 bp, Mus musculus
actagctgccagagatgtttcattg

SEQ ID NO: 124834 - DNA, 25 bp, Mus musculus
actagctgccagtgatgtttcattg

SEQ ID NO: 124835 - DNA, 25 bp, Mus musculus
actagctgcccgcttgaaatggaaa

SEQ ID NO: 124836 - DNA, 25 bp, Mus musculus
actagctgcccggttgaaatggaaa

SEQ ID NO: 124837 - DNA, 25 bp, Mus musculus
actagctgctatcaggttccaggta

SEQ ID NO: 124838 - DNA, 25 bp, Mus musculus
actagctgctatgaggttccaggta

SEQ ID NO: 124839 - DNA, 25 bp, Mus musculus
actagctggtctcttaccagcagga

SEQ ID NO: 124840 - DNA, 25 bp, Mus musculus
actagctggtctgttaccagcagga

SEQ ID NO: 124841 - DNA, 25 bp, Mus musculus
actagctgtaagcatttcccagtga

SEQ ID NO: 124842 - DNA, 25 bp, Mus musculus
actagctgtaaggatttcccagtga

SEQ ID NO: 124843 - DNA, 25 bp, Mus musculus
actagctgtgaaacctcgtgcaggt

SEQ ID NO: 124844 - DNA, 25 bp, Mus musculus
actagctgtgaatcctcgtgcaggt

SEQ ID NO: 124845 - DNA, 25 bp, Mus musculus
actagcttctagatttactttgcag

SEQ ID NO: 124846 - DNA, 25 bp, Mus musculus
actagcttctagttttactttgcag

SEQ ID NO: 124847 - DNA, 25 bp, Mus musculus
actagcttctgcatgcactacagag

SEQ ID NO: 124848 - DNA, 25 bp, Mus musculus
actagcttctgcttgcactacagag

SEQ ID NO: 124849 - DNA, 25 bp, Mus musculus
actagcttgcctactgagtcggttt

SEQ ID NO: 124850 - DNA, 25 bp, Mus musculus
actagcttgccttctgagtcggttt

SEQ ID NO: 124851 - DNA, 25 bp, Mus musculus
actagcttggacaacgtctgcaaaa

SEQ ID NO: 124852 - DNA, 25 bp, Mus musculus
actagcttggactacgtctgcaaaa

SEQ ID NO: 124853 - DNA, 25 bp, Mus musculus
actagctttcaacatgtgtgcaggt

SEQ ID NO: 124854 - DNA, 25 bp, Mus musculus
actagctttcaagatgtgtgcaggt

SEQ ID NO: 124855 - DNA, 25 bp, Mus musculus
actagctttctcagaagattccctg

SEQ ID NO: 124856 - DNA, 25 bp, Mus musculus
actagctttctctgaagattccctg

SEQ ID NO: 124857 - DNA, 25 bp, Mus musculus
actagcttttcccattcatgacatt

SEQ ID NO: 124858 - DNA, 25 bp, Mus musculus
actagcttttccgattcatgacatt

SEQ ID NO: 124859 - DNA, 25 bp, Mus musculus
actagcttttgacacgagctcttga

SEQ ID NO: 124860 - DNA, 25 bp, Mus musculus
actagcttttgagacgagctcttga

SEQ ID NO: 124861 - DNA, 25 bp, Mus musculus
actaggaaagtacagccaggagcct

SEQ ID NO: 124862 - DNA, 25 bp, Mus musculus
actaggaaagtagagccaggagcct

SEQ ID NO: 124863 - DNA, 25 bp, Mus musculus
actaggaagtacatgtcagtgtcaa

SEQ ID NO: 124864 - DNA, 25 bp, Mus musculus
actaggaagtacttgtcagtgtcaa

SEQ ID NO: 124865 - DNA, 25 bp, Mus musculus
actaggaattgtctctcttcttctg

SEQ ID NO: 124866 - DNA, 25 bp, Mus musculus
actaggaattgtgtctcttcttctg

SEQ ID NO: 124867 - DNA, 25 bp, Mus musculus
actaggactttgataactgttatat

SEQ ID NO: 124868 - DNA, 25 bp, Mus musculus
actaggactttgttaactgttatat

SEQ ID NO: 124869 - DNA, 25 bp, Mus musculus
actaggagaaccactgactgcttga

SEQ ID NO: 124870 - DNA, 25 bp, Mus musculus
actaggagaacctctgactgcttga

SEQ ID NO: 124871 - DNA, 25 bp, Mus musculus
actaggagcatacacacttcctgcc

SEQ ID NO: 124872 - DNA, 25 bp, Mus musculus
actaggagcatagacacttcctgcc

SEQ ID NO: 124873 - DNA, 25 bp, Mus musculus
actaggaggaccagtccacactggg

SEQ ID NO: 124874 - DNA, 25 bp, Mus musculus
actaggaggacctgtccacactggg

SEQ ID NO: 124875 - DNA, 25 bp, Mus musculus
actaggagtccacacgaaaggtgct

SEQ ID NO: 124876 - DNA, 25 bp, Mus musculus
actaggagtccagacgaaaggtgct

SEQ ID NO: 124877 - DNA, 25 bp, Mus musculus
actaggatagaaacatcattcacac

SEQ ID NO: 124878 - DNA, 25 bp, Mus musculus
actaggatagaatcatcattcacac

SEQ ID NO: 124879 - DNA, 25 bp, Mus musculus
actaggatcaccattctgcagatgg

SEQ ID NO: 124880 - DNA, 25 bp, Mus musculus
actaggatcacctttctgcagatgg

SEQ ID NO: 124881 - DNA, 25 bp, Mus musculus
actaggatcagcatagtatgatgaa

SEQ ID NO: 124882 - DNA, 25 bp, Mus musculus
actaggatcagcttagtatgatgaa

SEQ ID NO: 124883 - DNA, 25 bp, Mus musculus
actaggatcatgaatctgttgtcag

SEQ ID NO: 124884 - DNA, 25 bp, Mus musculus
actaggatcatgtatctgttgtcag

SEQ ID NO: 124885 - DNA, 25 bp, Mus musculus
actaggatccttactgtcagcacaa

SEQ ID NO: 124886 - DNA, 25 bp, Mus musculus
actaggatcctttctgtcagcacaa

SEQ ID NO: 124887 - DNA, 25 bp, Mus musculus
actaggattgtacgcatatgtcacc

SEQ ID NO: 124888 - DNA, 25 bp, Mus musculus
actaggattgtaggcatatgtcacc

SEQ ID NO: 124889 - DNA, 25 bp, Mus musculus
actaggcaagcaccttagcagctaa

SEQ ID NO: 124890 - DNA, 25 bp, Mus musculus
actaggcaagcagcttagcagctaa

SEQ ID NO: 124891 - DNA, 25 bp, Mus musculus
actaggcaagccaactgcgggcagc

SEQ ID NO: 124892 - DNA, 25 bp, Mus musculus
actaggcaagcctactgcgggcagc

SEQ ID NO: 124893 - DNA, 25 bp, Mus musculus
actaggcagagcaaatttcaagtct

SEQ ID NO: 124894 - DNA, 25 bp, Mus musculus
actaggcagagctaatttcaagtct

SEQ ID NO: 124895 - DNA, 25 bp, Mus musculus
actaggcataatcgccaccttgcca

SEQ ID NO: 124896 - DNA, 25 bp, Mus musculus
actaggcataatggccaccttgcca

SEQ ID NO: 124897 - DNA, 25 bp, Mus musculus
actaggcattcacatttcttttgga

SEQ ID NO: 124898 - DNA, 25 bp, Mus musculus
actaggcattcagatttcttttgga

SEQ ID NO: 124899 - DNA, 25 bp, Mus musculus
actaggcatttgctctggtaatact

SEQ ID NO: 124900 - DNA, 25 bp, Mus musculus
actaggcatttggtctggtaatact

SEQ ID NO: 124901 - DNA, 25 bp, Mus musculus
actaggccatcccttactattgatt

SEQ ID NO: 124902 - DNA, 25 bp, Mus musculus
actaggccatccgttactattgatt

SEQ ID NO: 124903 - DNA, 25 bp, Mus musculus
actaggcccaggatttagatgacaa

SEQ ID NO: 124904 - DNA, 25 bp, Mus musculus
actaggcccaggttttagatgacaa

SEQ ID NO: 124905 - DNA, 25 bp, Mus musculus
actaggccctagacgatggtgtgtt

SEQ ID NO: 124906 - DNA, 25 bp, Mus musculus
actaggccctagtcgatggtgtgtt

SEQ ID NO: 124907 - DNA, 25 bp, Mus musculus
actaggccctgtaaatctcacaagt

SEQ ID NO: 124908 - DNA, 25 bp, Mus musculus
actaggccctgttaatctcacaagt

SEQ ID NO: 124909 - DNA, 25 bp, Mus musculus
actaggcctagcacagtgtgttgat

SEQ ID NO: 124910 - DNA, 25 bp, Mus musculus
actaggcctagctcagtgtgttgat

SEQ ID NO: 124911 - DNA, 25 bp, Mus musculus
actaggcctaggatatcagaagcag

SEQ ID NO: 124912 - DNA, 25 bp, Mus musculus
actaggcctaggttatcagaagcag

SEQ ID NO: 124913 - DNA, 25 bp, Mus musculus
actaggcctctgagccttccaaggg

SEQ ID NO: 124914 - DNA, 25 bp, Mus musculus
actaggcctctgtgccttccaaggg

SEQ ID NO: 124915 - DNA, 25 bp, Mus musculus
actaggcctgatattaatgtggtaa

SEQ ID NO: 124916 - DNA, 25 bp, Mus musculus
actaggcctgattttaatgtggtaa

SEQ ID NO: 124917 - DNA, 25 bp, Mus musculus
actaggccttgccatctctctggat

SEQ ID NO: 124918 - DNA, 25 bp, Mus musculus
actaggccttgcgatctctctggat

SEQ ID NO: 124919 - DNA, 25 bp, Mus musculus
actaggctaaggctggatcagtcca

SEQ ID NO: 124920 - DNA, 25 bp, Mus musculus
actaggctaagggtggatcagtcca

SEQ ID NO: 124921 - DNA, 25 bp, Mus musculus
actaggctagcacttctaatgcaac

SEQ ID NO: 124922 - DNA, 25 bp, Mus musculus
actaggctagcagttctaatgcaac

SEQ ID NO: 124923 - DNA, 25 bp, Mus musculus
actaggctcctacgatggcttctat

SEQ ID NO: 124924 - DNA, 25 bp, Mus musculus
actaggctcctaggatggcttctat

SEQ ID NO: 124925 - DNA, 25 bp, Mus musculus
actaggctgaggagtgatgccctcc

SEQ ID NO: 124926 - DNA, 25 bp, Mus musculus
actaggctgaggtgtgatgccctcc

SEQ ID NO: 124927 - DNA, 25 bp, Mus musculus
actaggctgagtccttcaggttaca

SEQ ID NO: 124928 - DNA, 25 bp, Mus musculus
actaggctgagtgcttcaggttaca

SEQ ID NO: 124929 - DNA, 25 bp, Mus musculus
actaggctgataaagtctgccttta

SEQ ID NO: 124930 - DNA, 25 bp, Mus musculus
actaggctgatatagtctgccttta

SEQ ID NO: 124931 - DNA, 25 bp, Mus musculus
actaggctgcttcgtttcttacatg

SEQ ID NO: 124932 - DNA, 25 bp, Mus musculus
actaggctgcttggtttcttacatg

SEQ ID NO: 124933 - DNA, 25 bp, Mus musculus
actaggctggctatctgtctgtcca

SEQ ID NO: 124934 - DNA, 25 bp, Mus musculus
actaggctggctttctgtctgtcca

SEQ ID NO: 124935 - DNA, 25 bp, Mus musculus
actaggctgtctcactttacttgtt

SEQ ID NO: 124936 - DNA, 25 bp, Mus musculus
actaggctgtctgactttacttgtt

SEQ ID NO: 124937 - DNA, 25 bp, Mus musculus
actaggctgtggacctggcggttcc

SEQ ID NO: 124938 - DNA, 25 bp, Mus musculus
actaggctgtggtcctggcggttcc

SEQ ID NO: 124939 - DNA, 25 bp, Mus musculus
actagggaagagagactccgcctaa

SEQ ID NO: 124940 - DNA, 25 bp, Mus musculus
actagggaagagtgactccgcctaa

SEQ ID NO: 124941 - DNA, 25 bp, Mus musculus
actagggaatgcagttaggaagtta

SEQ ID NO: 124942 - DNA, 25 bp, Mus musculus
actagggaatgctgttaggaagtta

SEQ ID NO: 124943 - DNA, 25 bp, Mus musculus
actagggacgcacccaatcagagca

SEQ ID NO: 124944 - DNA, 25 bp, Mus musculus
actagggacgcagccaatcagagca

SEQ ID NO: 124945 - DNA, 25 bp, Mus musculus
actagggacttgatactgattcaaa

SEQ ID NO: 124946 - DNA, 25 bp, Mus musculus
actagggacttgttactgattcaaa

SEQ ID NO: 124947 - DNA, 25 bp, Mus musculus
actagggagcctattgcagtgagcc

SEQ ID NO: 124948 - DNA, 25 bp, Mus musculus
actagggagccttttgcagtgagcc

SEQ ID NO: 124949 - DNA, 25 bp, Mus musculus
actagggagctgactctcagagtgt

SEQ ID NO: 124950 - DNA, 25 bp, Mus musculus
actagggagctgtctctcagagtgt

SEQ ID NO: 124951 - DNA, 25 bp, Mus musculus
actagggcaactcgagtgcgccgca

SEQ ID NO: 124952 - DNA, 25 bp, Mus musculus
actagggcaactggagtgcgccgca

SEQ ID NO: 124953 - DNA, 25 bp, Mus musculus
actagggcatttagctaggtaagct

SEQ ID NO: 124954 - DNA, 25 bp, Mus musculus
actagggcattttgctaggtaagct

SEQ ID NO: 124955 - DNA, 25 bp, Mus musculus
actagggccgctctcaggcttagca

SEQ ID NO: 124956 - DNA, 25 bp, Mus musculus
actagggccgctgtcaggcttagca

SEQ ID NO: 124957 - DNA, 25 bp, Mus musculus
actagggcgtttatgaactggctct

SEQ ID NO: 124958 - DNA, 25 bp, Mus musculus
actagggcgtttttgaactggctct

SEQ ID NO: 124959 - DNA, 25 bp, Mus musculus
actagggctttgcaagagtgtgaac

SEQ ID NO: 124960 - DNA, 25 bp, Mus musculus
actagggctttggaagagtgtgaac

SEQ ID NO: 124961 - DNA, 25 bp, Mus musculus
actagggtcgatatcacgtacctct

SEQ ID NO: 124962 - DNA, 25 bp, Mus musculus
actagggtcgatttcacgtacctct

SEQ ID NO: 124963 - DNA, 25 bp, Mus musculus
actagggtctttataatggctccat

SEQ ID NO: 124964 - DNA, 25 bp, Mus musculus
actagggtctttttaatggctccat

SEQ ID NO: 124965 - DNA, 25 bp, Mus musculus
actaggtaaaacagagtgatgctaa

SEQ ID NO: 124966 - DNA, 25 bp, Mus musculus
actaggtaaaactgagtgatgctaa

SEQ ID NO: 124967 - DNA, 25 bp, Mus musculus
actaggtacctgcaagccagtcagt

SEQ ID NO: 124968 - DNA, 25 bp, Mus musculus
actaggtacctggaagccagtcagt

SEQ ID NO: 124969 - DNA, 25 bp, Mus musculus
actaggtatcgtaacggcatctcaa

SEQ ID NO: 124970 - DNA, 25 bp, Mus musculus
actaggtatcgttacggcatctcaa

SEQ ID NO: 124971 - DNA, 25 bp, Mus musculus
actaggtcacccaggcaaagccagt

SEQ ID NO: 124972 - DNA, 25 bp, Mus musculus
actaggtcaccctggcaaagccagt

SEQ ID NO: 124973 - DNA, 25 bp, Mus musculus
actaggtcatgtcgtaatgggcaac

SEQ ID NO: 124974 - DNA, 25 bp, Mus musculus
actaggtcatgtggtaatgggcaac

SEQ ID NO: 124975 - DNA, 25 bp, Mus musculus
actaggtctatgctggttcaatcaa

SEQ ID NO: 124976 - DNA, 25 bp, Mus musculus
actaggtctatggtggttcaatcaa

SEQ ID NO: 124977 - DNA, 25 bp, Mus musculus
actaggtgacacatggcttcagatc

SEQ ID NO: 124978 - DNA, 25 bp, Mus musculus
actaggtgacacttggcttcagatc

SEQ ID NO: 124979 - DNA, 25 bp, Mus musculus
actaggtgaggtcccataaggttct

SEQ ID NO: 124980 - DNA, 25 bp, Mus musculus
actaggtgaggtgccataaggttct

SEQ ID NO: 124981 - DNA, 25 bp, Mus musculus
actaggtggcctaactacaacatta

SEQ ID NO: 124982 - DNA, 25 bp, Mus musculus
actaggtggccttactacaacatta

SEQ ID NO: 124983 - DNA, 25 bp, Mus musculus
actaggtggtttcggctcagtcaat

SEQ ID NO: 124984 - DNA, 25 bp, Mus musculus
actaggtggtttgggctcagtcaat

SEQ ID NO: 124985 - DNA, 25 bp, Mus musculus
actaggtgtcacagctagagcccta

SEQ ID NO: 124986 - DNA, 25 bp, Mus musculus
actaggtgtcactgctagagcccta

SEQ ID NO: 124987 - DNA, 25 bp, Mus musculus
actagtaaactcatttctctctggg

SEQ ID NO: 124988 - DNA, 25 bp, Mus musculus
actagtaaactcttttctctctggg

SEQ ID NO: 124989 - DNA, 25 bp, Mus musculus
actagtaacatcattggtctgacaa

SEQ ID NO: 124990 - DNA, 25 bp, Mus musculus
actagtaacatctttggtctgacaa

SEQ ID NO: 124991 - DNA, 25 bp, Mus musculus
actagtaaccatactgtgtcagcct

SEQ ID NO: 124992 - DNA, 25 bp, Mus musculus
actagtaaccattctgtgtcagcct

SEQ ID NO: 124993 - DNA, 25 bp, Mus musculus
actagtaactggacaccgctcaagg

SEQ ID NO: 124994 - DNA, 25 bp, Mus musculus
actagtaactggtcaccgctcaagg

SEQ ID NO: 124995 - DNA, 25 bp, Mus musculus
actagtaattatcgtgccgcaggta

SEQ ID NO: 124996 - DNA, 25 bp, Mus musculus
actagtaattatggtgccgcaggta

SEQ ID NO: 124997 - DNA, 25 bp, Mus musculus
actagtacagcgctgacggacggca

SEQ ID NO: 124998 - DNA, 25 bp, Mus musculus
actagtacagcggtgacggacggca

SEQ ID NO: 124999 - DNA, 25 bp, Mus musculus
actagtacataactctaaacagtag

SEQ ID NO: 125000 - DNA, 25 bp, Mus musculus
actagtacataagtctaaacagtag

SEQ ID NO: 125001 - DNA, 25 bp, Mus musculus
actagtacatgcactgagcaccgca

SEQ ID NO: 125002 - DNA, 25 bp, Mus musculus
actagtacatgctctgagcaccgca

SEQ ID NO: 125003 - DNA, 25 bp, Mus musculus
actagtacttaccatgaccttgtga

SEQ ID NO: 125004 - DNA, 25 bp, Mus musculus
actagtacttacgatgaccttgtga

SEQ ID NO: 125005 - DNA, 25 bp, Mus musculus
actagtagtctcagtgcattttggc

SEQ ID NO: 125006 - DNA, 25 bp, Mus musculus
actagtagtctctgtgcattttggc

SEQ ID NO: 125007 - DNA, 25 bp, Mus musculus
actagtagttgcagaatcacttctc

SEQ ID NO: 125008 - DNA, 25 bp, Mus musculus
actagtagttgctgaatcacttctc

SEQ ID NO: 125009 - DNA, 25 bp, Mus musculus
actagtatccagctctgtgggctta

SEQ ID NO: 125010 - DNA, 25 bp, Mus musculus
actagtatccaggtctgtgggctta

SEQ ID NO: 125011 - DNA, 25 bp, Mus musculus
actagtatcccaccaacatcagaaa

SEQ ID NO: 125012 - DNA, 25 bp, Mus musculus
actagtatcccagcaacatcagaaa

SEQ ID NO: 125013 - DNA, 25 bp, Mus musculus
actagtatcggtactgcactaggcc

SEQ ID NO: 125014 - DNA, 25 bp, Mus musculus
actagtatcggttctgcactaggcc

SEQ ID NO: 125015 - DNA, 25 bp, Mus musculus
actagtattactccacagctttctg

SEQ ID NO: 125016 - DNA, 25 bp, Mus musculus
actagtattactgcacagctttctg

SEQ ID NO: 125017 - DNA, 25 bp, Mus musculus
actagtattcataaggtcctgggtt

SEQ ID NO: 125018 - DNA, 25 bp, Mus musculus
actagtattcattaggtcctgggtt

SEQ ID NO: 125019 - DNA, 25 bp, Mus musculus
actagtattggtactcactctctca

SEQ ID NO: 125020 - DNA, 25 bp, Mus musculus
actagtattggttctcactctctca

SEQ ID NO: 125021 - DNA, 25 bp, Mus musculus
actagtcaccttccagtctggaaat

SEQ ID NO: 125022 - DNA, 25 bp, Mus musculus
actagtcaccttgcagtctggaaat

SEQ ID NO: 125023 - DNA, 25 bp, Mus musculus
actagtcactgaatacatttgtcac

SEQ ID NO: 125024 - DNA, 25 bp, Mus musculus
actagtcactgattacatttgtcac

SEQ ID NO: 125025 - DNA, 25 bp, Mus musculus
actagtcagagactgcttggcagag

SEQ ID NO: 125026 - DNA, 25 bp, Mus musculus
actagtcagagagtgcttggcagag

SEQ ID NO: 125027 - DNA, 25 bp, Mus musculus
actagtcaggtaccaaagccacagg

SEQ ID NO: 125028 - DNA, 25 bp, Mus musculus
actagtcaggtagcaaagccacagg

SEQ ID NO: 125029 - DNA, 25 bp, Mus musculus
actagtcattgaattgtgcctttct

SEQ ID NO: 125030 - DNA, 25 bp, Mus musculus
actagtcattgatttgtgcctttct

SEQ ID NO: 125031 - DNA, 25 bp, Mus musculus
actagtcgagacatttctgatcaaa

SEQ ID NO: 125032 - DNA, 25 bp, Mus musculus
actagtcgagacttttctgatcaaa

SEQ ID NO: 125033 - DNA, 25 bp, Mus musculus
actagtcggaataactgttctcagg

SEQ ID NO: 125034 - DNA, 25 bp, Mus musculus
actagtcggaattactgttctcagg

SEQ ID NO: 125035 - DNA, 25 bp, Mus musculus
actagtctagtcaccttattttctg

SEQ ID NO: 125036 - DNA, 25 bp, Mus musculus
actagtctagtctccttattttctg

SEQ ID NO: 125037 - DNA, 25 bp, Mus musculus
actagtctataaacttaagctttat

SEQ ID NO: 125038 - DNA, 25 bp, Mus musculus
actagtctataatcttaagctttat

SEQ ID NO: 125039 - DNA, 25 bp, Mus musculus
actagtctcttcaatgtctcccttt

SEQ ID NO: 125040 - DNA, 25 bp, Mus musculus
actagtctcttctatgtctcccttt

SEQ ID NO: 125041 - DNA, 25 bp, Mus musculus
actagtctgccacgtggctggaacc

SEQ ID NO: 125042 - DNA, 25 bp, Mus musculus
actagtctgccaggtggctggaacc

SEQ ID NO: 125043 - DNA, 25 bp, Mus musculus
actagtcttgggatcctgcaggctg

SEQ ID NO: 125044 - DNA, 25 bp, Mus musculus
actagtcttgggttcctgcaggctg

SEQ ID NO: 125045 - DNA, 25 bp, Mus musculus
actagtgacgtacgctgtgctgctt

SEQ ID NO: 125046 - DNA, 25 bp, Mus musculus
actagtgacgtaggctgtgctgctt

SEQ ID NO: 125047 - DNA, 25 bp, Mus musculus
actagtgagaacaacgaagacgtct

SEQ ID NO: 125048 - DNA, 25 bp, Mus musculus
actagtgagaactacgaagacgtct

SEQ ID NO: 125049 - DNA, 25 bp, Mus musculus
actagtgagagtccaacagaactga

SEQ ID NO: 125050 - DNA, 25 bp, Mus musculus
actagtgagagtgcaacagaactga

SEQ ID NO: 125051 - DNA, 25 bp, Mus musculus
actagtgatctacccaggtggtagt

SEQ ID NO: 125052 - DNA, 25 bp, Mus musculus
actagtgatctagccaggtggtagt

SEQ ID NO: 125053 - DNA, 25 bp, Mus musculus
actagtgatttacctgtgccgacgg

SEQ ID NO: 125054 - DNA, 25 bp, Mus musculus
actagtgatttagctgtgccgacgg

SEQ ID NO: 125055 - DNA, 25 bp, Mus musculus
actagtgccagtcgctccaagacca

SEQ ID NO: 125056 - DNA, 25 bp, Mus musculus
actagtgccagtggctccaagacca

SEQ ID NO: 125057 - DNA, 25 bp, Mus musculus
actagtgcgctgagaagtctctacc

SEQ ID NO: 125058 - DNA, 25 bp, Mus musculus
actagtgcgctgtgaagtctctacc

SEQ ID NO: 125059 - DNA, 25 bp, Mus musculus
actagtgcggttagtagtgcctgct

SEQ ID NO: 125060 - DNA, 25 bp, Mus musculus
actagtgcggtttgtagtgcctgct

SEQ ID NO: 125061 - DNA, 25 bp, Mus musculus
actagtgctgggaataggactaaag

SEQ ID NO: 125062 - DNA, 25 bp, Mus musculus
actagtgctgggtataggactaaag

SEQ ID NO: 125063 - DNA, 25 bp, Mus musculus
actagtggctatcatacccttgtcc

SEQ ID NO: 125064 - DNA, 25 bp, Mus musculus
actagtggctatgatacccttgtcc

SEQ ID NO: 125065 - DNA, 25 bp, Mus musculus
actagtgggagcactgccagaagtt

SEQ ID NO: 125066 - DNA, 25 bp, Mus musculus
actagtgggagctctgccagaagtt

SEQ ID NO: 125067 - DNA, 25 bp, Mus musculus
actagtgggctcagctgtcattcta

SEQ ID NO: 125068 - DNA, 25 bp, Mus musculus
actagtgggctctgctgtcattcta

SEQ ID NO: 125069 - DNA, 25 bp, Mus musculus
actagtggtgatctcctaaggccaa

SEQ ID NO: 125070 - DNA, 25 bp, Mus musculus
actagtggtgatgtcctaaggccaa

SEQ ID NO: 125071 - DNA, 25 bp, Mus musculus
actagtgtcactcaaaggcaaccct

SEQ ID NO: 125072 - DNA, 25 bp, Mus musculus
actagtgtcactgaaaggcaaccct

SEQ ID NO: 125073 - DNA, 25 bp, Mus musculus
actagtgtctctaacaggagcacag

SEQ ID NO: 125074 - DNA, 25 bp, Mus musculus
actagtgtctcttacaggagcacag

SEQ ID NO: 125075 - DNA, 25 bp, Mus musculus
actagtgtgcgaagtgtccccagac

SEQ ID NO: 125076 - DNA, 25 bp, Mus musculus
actagtgtgcgatgtgtccccagac

SEQ ID NO: 125077 - DNA, 25 bp, Mus musculus
actagtgttttcaccaaagctcttt

SEQ ID NO: 125078 - DNA, 25 bp, Mus musculus
actagtgttttctccaaagctcttt

SEQ ID NO: 125079 - DNA, 25 bp, Mus musculus
actagttaccctcactttgatttca

SEQ ID NO: 125080 - DNA, 25 bp, Mus musculus
actagttaccctgactttgatttca

SEQ ID NO: 125081 - DNA, 25 bp, Mus musculus
actagttatggaaagtcccagatgt

SEQ ID NO: 125082 - DNA, 25 bp, Mus musculus
actagttatggatagtcccagatgt

SEQ ID NO: 125083 - DNA, 25 bp, Mus musculus
actagttcacctaaagccttatcag

SEQ ID NO: 125084 - DNA, 25 bp, Mus musculus
actagttcaccttaagccttatcag

SEQ ID NO: 125085 - DNA, 25 bp, Mus musculus
actagttcagacaactttccctgtt

SEQ ID NO: 125086 - DNA, 25 bp, Mus musculus
actagttcagactactttccctgtt

SEQ ID NO: 125087 - DNA, 25 bp, Mus musculus
actagttcattgattggcacctcct

SEQ ID NO: 125088 - DNA, 25 bp, Mus musculus
actagttcattgtttggcacctcct

SEQ ID NO: 125089 - DNA, 25 bp, Mus musculus
actagttccccactgacaggagtta

SEQ ID NO: 125090 - DNA, 25 bp, Mus musculus
actagttccccagtgacaggagtta

SEQ ID NO: 125091 - DNA, 25 bp, Mus musculus
actagttggctaaggctttacagga

SEQ ID NO: 125092 - DNA, 25 bp, Mus musculus
actagttggctatggctttacagga

SEQ ID NO: 125093 - DNA, 25 bp, Mus musculus
actagtttaattcagctggtcttga

SEQ ID NO: 125094 - DNA, 25 bp, Mus musculus
actagtttaattgagctggtcttga

SEQ ID NO: 125095 - DNA, 25 bp, Mus musculus
actagtttcctgactatttccggat

SEQ ID NO: 125096 - DNA, 25 bp, Mus musculus
actagtttcctgtctatttccggat

SEQ ID NO: 125097 - DNA, 25 bp, Mus musculus
actagttttcgcatgaaccacttga

SEQ ID NO: 125098 - DNA, 25 bp, Mus musculus
actagttttcgcttgaaccacttga

SEQ ID NO: 125099 - DNA, 25 bp, Mus musculus
actataaacacccattcctgtgttt

SEQ ID NO: 125100 - DNA, 25 bp, Mus musculus
actataaacaccgattcctgtgttt

SEQ ID NO: 125101 - DNA, 25 bp, Mus musculus
actataaacactcgaagacactgga

SEQ ID NO: 125102 - DNA, 25 bp, Mus musculus
actataaacactggaagacactgga

SEQ ID NO: 125103 - DNA, 25 bp, Mus musculus
actataacacacacctactgaactg

SEQ ID NO: 125104 - DNA, 25 bp, Mus musculus
actataacacactcctactgaactg

SEQ ID NO: 125105 - DNA, 25 bp, Mus musculus
actataagcactcaggcaggttcct

SEQ ID NO: 125106 - DNA, 25 bp, Mus musculus
actataagcactgaggcaggttcct

SEQ ID NO: 125107 - DNA, 25 bp, Mus musculus
actataatctaaagcagcggttctc

SEQ ID NO: 125108 - DNA, 25 bp, Mus musculus
actataatctaatgcagcggttctc

SEQ ID NO: 125109 - DNA, 25 bp, Mus musculus
actataatcttgctgctgtaaaggg

SEQ ID NO: 125110 - DNA, 25 bp, Mus musculus
actataatcttggtgctgtaaaggg

SEQ ID NO: 125111 - DNA, 25 bp, Mus musculus
actataatgagtcacctgatgatgg

SEQ ID NO: 125112 - DNA, 25 bp, Mus musculus
actataatgagtgacctgatgatgg

SEQ ID NO: 125113 - DNA, 25 bp, Mus musculus
actataattcatcatttttaggcag

SEQ ID NO: 125114 - DNA, 25 bp, Mus musculus
actataattcatgatttttaggcag

SEQ ID NO: 125115 - DNA, 25 bp, Mus musculus
actataattgtcaggcacatattaa

SEQ ID NO: 125116 - DNA, 25 bp, Mus musculus
actataattgtctggcacatattaa

SEQ ID NO: 125117 - DNA, 25 bp, Mus musculus
actatacactctctgggactcctaa

SEQ ID NO: 125118 - DNA, 25 bp, Mus musculus
actatacactctgtgggactcctaa

SEQ ID NO: 125119 - DNA, 25 bp, Mus musculus
actatacccagcattacactacttt

SEQ ID NO: 125120 - DNA, 25 bp, Mus musculus
actatacccagctttacactacttt

SEQ ID NO: 125121 - DNA, 25 bp, Mus musculus
actatactgggacggttgtctttgc

SEQ ID NO: 125122 - DNA, 25 bp, Mus musculus
actatactgggagggttgtctttgc

SEQ ID NO: 125123 - DNA, 25 bp, Mus musculus
actatactgtgacagctgtcctcat

SEQ ID NO: 125124 - DNA, 25 bp, Mus musculus
actatactgtgagagctgtcctcat

SEQ ID NO: 125125 - DNA, 25 bp, Mus musculus
actatagaagtacctctgtggtaca

SEQ ID NO: 125126 - DNA, 25 bp, Mus musculus
actatagaagtagctctgtggtaca

SEQ ID NO: 125127 - DNA, 25 bp, Mus musculus
actatagcaacaacctgcactctgt

SEQ ID NO: 125128 - DNA, 25 bp, Mus musculus
actatagcaacatcctgcactctgt

SEQ ID NO: 125129 - DNA, 25 bp, Mus musculus
actatagcagctcaggtgcacccct

SEQ ID NO: 125130 - DNA, 25 bp, Mus musculus
actatagcagctgaggtgcacccct

SEQ ID NO: 125131 - DNA, 25 bp, Mus musculus
actatagctgctatctatcctgtgc

SEQ ID NO: 125132 - DNA, 25 bp, Mus musculus
actatagctgctttctatcctgtgc

SEQ ID NO: 125133 - DNA, 25 bp, Mus musculus
actatagggcataccatttctctct

SEQ ID NO: 125134 - DNA, 25 bp, Mus musculus
actatagggcattccatttctctct

SEQ ID NO: 125135 - DNA, 25 bp, Mus musculus
actataggtcccctgatggcagagc

SEQ ID NO: 125136 - DNA, 25 bp, Mus musculus
actataggtcccgtgatggcagagc

SEQ ID NO: 125137 - DNA, 25 bp, Mus musculus
actataggtgatctcgcacagcccc

SEQ ID NO: 125138 - DNA, 25 bp, Mus musculus
actataggtgatgtcgcacagcccc

SEQ ID NO: 125139 - DNA, 25 bp, Mus musculus
actatagtatttactcatggctgga

SEQ ID NO: 125140 - DNA, 25 bp, Mus musculus
actatagtattttctcatggctgga

SEQ ID NO: 125141 - DNA, 25 bp, Mus musculus
actatagtcagtcccaagtgctttt

SEQ ID NO: 125142 - DNA, 25 bp, Mus musculus
actatagtcagtgccaagtgctttt

SEQ ID NO: 125143 - DNA, 25 bp, Mus musculus
actatagttctcacagcagagtgga

SEQ ID NO: 125144 - DNA, 25 bp, Mus musculus
actatagttctctcagcagagtgga

SEQ ID NO: 125145 - DNA, 25 bp, Mus musculus
actatataacccatgacctgcgttg

SEQ ID NO: 125146 - DNA, 25 bp, Mus musculus
actatataacccttgacctgcgttg

SEQ ID NO: 125147 - DNA, 25 bp, Mus musculus
actatatataccagggaccccaggc

SEQ ID NO: 125148 - DNA, 25 bp, Mus musculus
actatatatacctgggaccccaggc

SEQ ID NO: 125149 - DNA, 25 bp, Mus musculus
actatatgagaactccgccacagcg

SEQ ID NO: 125150 - DNA, 25 bp, Mus musculus
actatatgagaagtccgccacagcg

SEQ ID NO: 125151 - DNA, 25 bp, Mus musculus
actatatgccatcactgtacaccgg

SEQ ID NO: 125152 - DNA, 25 bp, Mus musculus
actatatgccatgactgtacaccgg

SEQ ID NO: 125153 - DNA, 25 bp, Mus musculus
actatatggccccagcatgcgacct

SEQ ID NO: 125154 - DNA, 25 bp, Mus musculus
actatatggcccgagcatgcgacct

SEQ ID NO: 125155 - DNA, 25 bp, Mus musculus
actatatggttgctgtatatttaca

SEQ ID NO: 125156 - DNA, 25 bp, Mus musculus
actatatggttggtgtatatttaca

SEQ ID NO: 125157 - DNA, 25 bp, Mus musculus
actatattcaagctatcctttcccc

SEQ ID NO: 125158 - DNA, 25 bp, Mus musculus
actatattcaaggtatcctttcccc

SEQ ID NO: 125159 - DNA, 25 bp, Mus musculus
actatatttggcagcagattcgaac

SEQ ID NO: 125160 - DNA, 25 bp, Mus musculus
actatatttggctgcagattcgaac

SEQ ID NO: 125161 - DNA, 25 bp, Mus musculus
actatattttctcacctcaaagcac

SEQ ID NO: 125162 - DNA, 25 bp, Mus musculus
actatattttctgacctcaaagcac

SEQ ID NO: 125163 - DNA, 25 bp, Mus musculus
actatcaataacaacagttctaggg

SEQ ID NO: 125164 - DNA, 25 bp, Mus musculus
actatcaataactacagttctaggg

SEQ ID NO: 125165 - DNA, 25 bp, Mus musculus
actatcaattagctcttttctcata

SEQ ID NO: 125166 - DNA, 25 bp, Mus musculus
actatcaattaggtcttttctcata

SEQ ID NO: 125167 - DNA, 25 bp, Mus musculus
actatcacacctactacgacttcat

SEQ ID NO: 125168 - DNA, 25 bp, Mus musculus
actatcacaccttctacgacttcat

SEQ ID NO: 125169 - DNA, 25 bp, Mus musculus
actatcacatgccttttattctctt

SEQ ID NO: 125170 - DNA, 25 bp, Mus musculus
actatcacatgcgttttattctctt

SEQ ID NO: 125171 - DNA, 25 bp, Mus musculus
actatcaccagcagacttcacagtg

SEQ ID NO: 125172 - DNA, 25 bp, Mus musculus
actatcaccagctgacttcacagtg

SEQ ID NO: 125173 - DNA, 25 bp, Mus musculus
actatcactgtcactctatatggag

SEQ ID NO: 125174 - DNA, 25 bp, Mus musculus
actatcactgtctctctatatggag

SEQ ID NO: 125175 - DNA, 25 bp, Mus musculus
actatcagctctattttagaaaatc

SEQ ID NO: 125176 - DNA, 25 bp, Mus musculus
actatcagctcttttttagaaaatc

SEQ ID NO: 125177 - DNA, 25 bp, Mus musculus
actatcaggactaagaaggtaacac

SEQ ID NO: 125178 - DNA, 25 bp, Mus musculus
actatcaggacttagaaggtaacac

SEQ ID NO: 125179 - DNA, 25 bp, Mus musculus
actatcaggcagagtaaccgggtaa

SEQ ID NO: 125180 - DNA, 25 bp, Mus musculus
actatcaggcagtgtaaccgggtaa

SEQ ID NO: 125181 - DNA, 25 bp, Mus musculus
actatcagttctcttgttatggccc

SEQ ID NO: 125182 - DNA, 25 bp, Mus musculus
actatcagttctgttgttatggccc

SEQ ID NO: 125183 - DNA, 25 bp, Mus musculus
actatcatatgcacagtcttctctc

SEQ ID NO: 125184 - DNA, 25 bp, Mus musculus
actatcatatgctcagtcttctctc

SEQ ID NO: 125185 - DNA, 25 bp, Mus musculus
actatcatgtagagtctccacccaa

SEQ ID NO: 125186 - DNA, 25 bp, Mus musculus
actatcatgtagtgtctccacccaa

SEQ ID NO: 125187 - DNA, 25 bp, Mus musculus
actatcatttctctggtttctctat

SEQ ID NO: 125188 - DNA, 25 bp, Mus musculus
actatcatttctgtggtttctctat

SEQ ID NO: 125189 - DNA, 25 bp, Mus musculus
actatccaatttccaccccttaatg

SEQ ID NO: 125190 - DNA, 25 bp, Mus musculus
actatccaatttgcaccccttaatg

SEQ ID NO: 125191 - DNA, 25 bp, Mus musculus
actatccaccatcctggctagtttt

SEQ ID NO: 125192 - DNA, 25 bp, Mus musculus
actatccaccatgctggctagtttt

SEQ ID NO: 125193 - DNA, 25 bp, Mus musculus
actatccacgatcacacgaaggctt

SEQ ID NO: 125194 - DNA, 25 bp, Mus musculus
actatccacgatgacacgaaggctt

SEQ ID NO: 125195 - DNA, 25 bp, Mus musculus
actatccacgttaacattgcacact

SEQ ID NO: 125196 - DNA, 25 bp, Mus musculus
actatccacgtttacattgcacact

SEQ ID NO: 125197 - DNA, 25 bp, Mus musculus
actatccagggacacctttggcaaa

SEQ ID NO: 125198 - DNA, 25 bp, Mus musculus
actatccagggagacctttggcaaa

SEQ ID NO: 125199 - DNA, 25 bp, Mus musculus
actatccatgtgatgtttctgtctg

SEQ ID NO: 125200 - DNA, 25 bp, Mus musculus
actatccatgtgttgtttctgtctg

SEQ ID NO: 125201 - DNA, 25 bp, Mus musculus
actatcccaagaccatttgcctgga

SEQ ID NO: 125202 - DNA, 25 bp, Mus musculus
actatcccaagagcatttgcctgga

SEQ ID NO: 125203 - DNA, 25 bp, Mus musculus
actatccccagtatgtaatggctga

SEQ ID NO: 125204 - DNA, 25 bp, Mus musculus
actatccccagtttgtaatggctga

SEQ ID NO: 125205 - DNA, 25 bp, Mus musculus
actatccctactattgtggttcata

SEQ ID NO: 125206 - DNA, 25 bp, Mus musculus
actatccctacttttgtggttcata

SEQ ID NO: 125207 - DNA, 25 bp, Mus musculus
actatcccttatactatgccgtgtt

SEQ ID NO: 125208 - DNA, 25 bp, Mus musculus
actatcccttattctatgccgtgtt

SEQ ID NO: 125209 - DNA, 25 bp, Mus musculus
actatccgcaggcagatgtccactt

SEQ ID NO: 125210 - DNA, 25 bp, Mus musculus
actatccgcagggagatgtccactt

SEQ ID NO: 125211 - DNA, 25 bp, Mus musculus
actatcctcctgcttgaacttgata

SEQ ID NO: 125212 - DNA, 25 bp, Mus musculus
actatcctcctggttgaacttgata

SEQ ID NO: 125213 - DNA, 25 bp, Mus musculus
actatcctctcaatcttaagatcct

SEQ ID NO: 125214 - DNA, 25 bp, Mus musculus
actatcctctcattcttaagatcct

SEQ ID NO: 125215 - DNA, 25 bp, Mus musculus
actatcctgcagactcctgaataag

SEQ ID NO: 125216 - DNA, 25 bp, Mus musculus
actatcctgcagtctcctgaataag

SEQ ID NO: 125217 - DNA, 25 bp, Mus musculus
actatcctgggcagccgtgttcgga

SEQ ID NO: 125218 - DNA, 25 bp, Mus musculus
actatcctgggctgccgtgttcgga

SEQ ID NO: 125219 - DNA, 25 bp, Mus musculus
actatccttagcagagctttcacca

SEQ ID NO: 125220 - DNA, 25 bp, Mus musculus
actatccttagctgagctttcacca

SEQ ID NO: 125221 - DNA, 25 bp, Mus musculus
actatcctttttaatgcttggagac

SEQ ID NO: 125222 - DNA, 25 bp, Mus musculus
actatccttttttatgcttggagac

SEQ ID NO: 125223 - DNA, 25 bp, Mus musculus
actatcgcctttcaagctctatgct

SEQ ID NO: 125224 - DNA, 25 bp, Mus musculus
actatcgcctttgaagctctatgct

SEQ ID NO: 125225 - DNA, 25 bp, Mus musculus
actatcgctgggatcctcttcatct

SEQ ID NO: 125226 - DNA, 25 bp, Mus musculus
actatcgctgggttcctcttcatct

SEQ ID NO: 125227 - DNA, 25 bp, Mus musculus
actatcggctgtctgatgctaacta

SEQ ID NO: 125228 - DNA, 25 bp, Mus musculus
actatcggctgtgtgatgctaacta

SEQ ID NO: 125229 - DNA, 25 bp, Mus musculus
actatcgtactgataggcccttgga

SEQ ID NO: 125230 - DNA, 25 bp, Mus musculus
actatcgtactgttaggcccttgga

SEQ ID NO: 125231 - DNA, 25 bp, Mus musculus
actatcgtccatacaaacatacact

SEQ ID NO: 125232 - DNA, 25 bp, Mus musculus
actatcgtccattcaaacatacact

SEQ ID NO: 125233 - DNA, 25 bp, Mus musculus
actatcgtgccgatttatgtgatgc

SEQ ID NO: 125234 - DNA, 25 bp, Mus musculus
actatcgtgccgttttatgtgatgc

SEQ ID NO: 125235 - DNA, 25 bp, Mus musculus
actatctactaacgccttgtcgcag

SEQ ID NO: 125236 - DNA, 25 bp, Mus musculus
actatctactaaggccttgtcgcag

SEQ ID NO: 125237 - DNA, 25 bp, Mus musculus
actatctatcagctttggagttcaa

SEQ ID NO: 125238 - DNA, 25 bp, Mus musculus
actatctatcaggtttggagttcaa

SEQ ID NO: 125239 - DNA, 25 bp, Mus musculus
actatctatgacactacttccaggg

SEQ ID NO: 125240 - DNA, 25 bp, Mus musculus
actatctatgactctacttccaggg

SEQ ID NO: 125241 - DNA, 25 bp, Mus musculus
actatctattagacaccctggtgca

SEQ ID NO: 125242 - DNA, 25 bp, Mus musculus
actatctattagtcaccctggtgca

SEQ ID NO: 125243 - DNA, 25 bp, Mus musculus
actatctcagaacgtccaggcatgt

SEQ ID NO: 125244 - DNA, 25 bp, Mus musculus
actatctcagaaggtccaggcatgt

SEQ ID NO: 125245 - DNA, 25 bp, Mus musculus
actatctcagcaccctgtgcagggt

SEQ ID NO: 125246 - DNA, 25 bp, Mus musculus
actatctcagcagcctgtgcagggt

SEQ ID NO: 125247 - DNA, 25 bp, Mus musculus
actatctcatggaggcaagccttca

SEQ ID NO: 125248 - DNA, 25 bp, Mus musculus
actatctcatggtggcaagccttca

SEQ ID NO: 125249 - DNA, 25 bp, Mus musculus
actatctccatacataccaagcttg

SEQ ID NO: 125250 - DNA, 25 bp, Mus musculus
actatctccatagataccaagcttg

SEQ ID NO: 125251 - DNA, 25 bp, Mus musculus
actatctcctcacgtgtgaccagag

SEQ ID NO: 125252 - DNA, 25 bp, Mus musculus
actatctcctcaggtgtgaccagag

SEQ ID NO: 125253 - DNA, 25 bp, Mus musculus
actatctcgctgaattgcttataac

SEQ ID NO: 125254 - DNA, 25 bp, Mus musculus
actatctcgctgtattgcttataac

SEQ ID NO: 125255 - DNA, 25 bp, Mus musculus
actatctgaaatctgctgtgcggtt

SEQ ID NO: 125256 - DNA, 25 bp, Mus musculus
actatctgaaatgtgctgtgcggtt

SEQ ID NO: 125257 - DNA, 25 bp, Mus musculus
actatctgatccagagagctgcctt

SEQ ID NO: 125258 - DNA, 25 bp, Mus musculus
actatctgatcctgagagctgcctt

SEQ ID NO: 125259 - DNA, 25 bp, Mus musculus
actatctgatgcctatacttttccc

SEQ ID NO: 125260 - DNA, 25 bp, Mus musculus
actatctgatgcgtatacttttccc

SEQ ID NO: 125261 - DNA, 25 bp, Mus musculus
actatctgcatgaagcattccttgg

SEQ ID NO: 125262 - DNA, 25 bp, Mus musculus
actatctgcatgtagcattccttgg

SEQ ID NO: 125263 - DNA, 25 bp, Mus musculus
actatctggtcaagtacagagcgct

SEQ ID NO: 125264 - DNA, 25 bp, Mus musculus
actatctggtcatgtacagagcgct

SEQ ID NO: 125265 - DNA, 25 bp, Mus musculus
actatctgtaacaatctagtcccag

SEQ ID NO: 125266 - DNA, 25 bp, Mus musculus
actatctgtaactatctagtcccag

SEQ ID NO: 125267 - DNA, 25 bp, Mus musculus
actatctgtaggataggattctgac

SEQ ID NO: 125268 - DNA, 25 bp, Mus musculus
actatctgtaggttaggattctgac

SEQ ID NO: 125269 - DNA, 25 bp, Mus musculus
actatcttgcatctgttgtttacaa

SEQ ID NO: 125270 - DNA, 25 bp, Mus musculus
actatcttgcatgtgttgtttacaa

SEQ ID NO: 125271 - DNA, 25 bp, Mus musculus
actatcttgtttcgcttgattgagc

SEQ ID NO: 125272 - DNA, 25 bp, Mus musculus
actatcttgtttggcttgattgagc

SEQ ID NO: 125273 - DNA, 25 bp, Mus musculus
actatctttgatagtcctatggcca

SEQ ID NO: 125274 - DNA, 25 bp, Mus musculus
actatctttgattgtcctatggcca

SEQ ID NO: 125275 - DNA, 25 bp, Mus musculus
actatctttgtccttgctctggctg

SEQ ID NO: 125276 - DNA, 25 bp, Mus musculus
actatctttgtcgttgctctggctg

SEQ ID NO: 125277 - DNA, 25 bp, Mus musculus
actatgaactgtacactcttaagct

SEQ ID NO: 125278 - DNA, 25 bp, Mus musculus
actatgaactgttcactcttaagct

SEQ ID NO: 125279 - DNA, 25 bp, Mus musculus
actatgaatcgtcgttccggccgac

SEQ ID NO: 125280 - DNA, 25 bp, Mus musculus
actatgaatcgtggttccggccgac

SEQ ID NO: 125281 - DNA, 25 bp, Mus musculus
actatgacagatatcccagcaggct

SEQ ID NO: 125282 - DNA, 25 bp, Mus musculus
actatgacagatttcccagcaggct

SEQ ID NO: 125283 - DNA, 25 bp, Mus musculus
actatgacatgtcacatctccgcac

SEQ ID NO: 125284 - DNA, 25 bp, Mus musculus
actatgacatgtgacatctccgcac

SEQ ID NO: 125285 - DNA, 25 bp, Mus musculus
actatgacctgcattctctaccttt

SEQ ID NO: 125286 - DNA, 25 bp, Mus musculus
actatgacctgctttctctaccttt

SEQ ID NO: 125287 - DNA, 25 bp, Mus musculus
actatgacgctaatcgagttactca

SEQ ID NO: 125288 - DNA, 25 bp, Mus musculus
actatgacgctattcgagttactca

SEQ ID NO: 125289 - DNA, 25 bp, Mus musculus
actatgactaccatcggctctggga

SEQ ID NO: 125290 - DNA, 25 bp, Mus musculus
actatgactaccttcggctctggga

SEQ ID NO: 125291 - DNA, 25 bp, Mus musculus
actatgaggctgcgaaggcagatgc

SEQ ID NO: 125292 - DNA, 25 bp, Mus musculus
actatgaggctgggaaggcagatgc

SEQ ID NO: 125293 - DNA, 25 bp, Mus musculus
actatgagtcagcatcaccaggtcc

SEQ ID NO: 125294 - DNA, 25 bp, Mus musculus
actatgagtcaggatcaccaggtcc

SEQ ID NO: 125295 - DNA, 25 bp, Mus musculus
actatgagtcccagaaatgtaacgg

SEQ ID NO: 125296 - DNA, 25 bp, Mus musculus
actatgagtccctgaaatgtaacgg

SEQ ID NO: 125297 - DNA, 25 bp, Mus musculus
actatgataatcatggactggcaac

SEQ ID NO: 125298 - DNA, 25 bp, Mus musculus
actatgataatcttggactggcaac

SEQ ID NO: 125299 - DNA, 25 bp, Mus musculus
actatgatgagtccccgaaaggtcc

SEQ ID NO: 125300 - DNA, 25 bp, Mus musculus
actatgatgagtgcccgaaaggtcc

SEQ ID NO: 125301 - DNA, 25 bp, Mus musculus
actatgattcacaagctggcagccc

SEQ ID NO: 125302 - DNA, 25 bp, Mus musculus
actatgattcacatgtctctgcgtc

SEQ ID NO: 125303 - DNA, 25 bp, Mus musculus
actatgattcactagctggcagccc

SEQ ID NO: 125304 - DNA, 25 bp, Mus musculus
actatgattcacttgtctctgcgtc

SEQ ID NO: 125305 - DNA, 25 bp, Mus musculus
actatgatttttactcatcccatct

SEQ ID NO: 125306 - DNA, 25 bp, Mus musculus
actatgattttttctcatcccatct

SEQ ID NO: 125307 - DNA, 25 bp, Mus musculus
actatgcaagttcatttctaggagc

SEQ ID NO: 125308 - DNA, 25 bp, Mus musculus
actatgcaagttgatttctaggagc

SEQ ID NO: 125309 - DNA, 25 bp, Mus musculus
actatgcacacacctctacagagat

SEQ ID NO: 125310 - DNA, 25 bp, Mus musculus
actatgcacacagctctacagagat

SEQ ID NO: 125311 - DNA, 25 bp, Mus musculus
actatgcaggctcagaacactcaag

SEQ ID NO: 125312 - DNA, 25 bp, Mus musculus
actatgcaggctgagaacactcaag

SEQ ID NO: 125313 - DNA, 25 bp, Mus musculus
actatgcatggtcttttcccagtga

SEQ ID NO: 125314 - DNA, 25 bp, Mus musculus
actatgcatggtgttttcccagtga

SEQ ID NO: 125315 - DNA, 25 bp, Mus musculus
actatgccaacaagccctggatctt

SEQ ID NO: 125316 - DNA, 25 bp, Mus musculus
actatgccaacatgccctggatctt

SEQ ID NO: 125317 - DNA, 25 bp, Mus musculus
actatgccctaaaatcacagtccca

SEQ ID NO: 125318 - DNA, 25 bp, Mus musculus
actatgccctaatatcacagtccca

SEQ ID NO: 125319 - DNA, 25 bp, Mus musculus
actatgccctcaattcagtgcaaac

SEQ ID NO: 125320 - DNA, 25 bp, Mus musculus
actatgccctcatttcagtgcaaac

SEQ ID NO: 125321 - DNA, 25 bp, Mus musculus
actatgcggttaccctctgaggata

SEQ ID NO: 125322 - DNA, 25 bp, Mus musculus
actatgcggttagcctctgaggata

SEQ ID NO: 125323 - DNA, 25 bp, Mus musculus
actatgcgttgcactggctttaaca

SEQ ID NO: 125324 - DNA, 25 bp, Mus musculus
actatgcgttgctctggctttaaca

SEQ ID NO: 125325 - DNA, 25 bp, Mus musculus
actatgctagctctcttttctgttg

SEQ ID NO: 125326 - DNA, 25 bp, Mus musculus
actatgctagctgtcttttctgttg

SEQ ID NO: 125327 - DNA, 25 bp, Mus musculus
actatgctcaccagtgaacggctgg

SEQ ID NO: 125328 - DNA, 25 bp, Mus musculus
actatgctcacctgtgaacggctgg

SEQ ID NO: 125329 - DNA, 25 bp, Mus musculus
actatgctcagaaccctgattttag

SEQ ID NO: 125330 - DNA, 25 bp, Mus musculus
actatgctcagatccctgattttag

SEQ ID NO: 125331 - DNA, 25 bp, Mus musculus
actatgctcagcctaacctgtttta

SEQ ID NO: 125332 - DNA, 25 bp, Mus musculus
actatgctcagcgtaacctgtttta

SEQ ID NO: 125333 - DNA, 25 bp, Mus musculus
actatgctctcgctggaggcagcaa

SEQ ID NO: 125334 - DNA, 25 bp, Mus musculus
actatgctctcggtggaggcagcaa

SEQ ID NO: 125335 - DNA, 25 bp, Mus musculus
actatgctgaaaagtcactcctcct

SEQ ID NO: 125336 - DNA, 25 bp, Mus musculus
actatgctgaaatgtcactcctcct

SEQ ID NO: 125337 - DNA, 25 bp, Mus musculus
actatgctgtatctggtgctctacc

SEQ ID NO: 125338 - DNA, 25 bp, Mus musculus
actatgctgtatgtggtgctctacc

SEQ ID NO: 125339 - DNA, 25 bp, Mus musculus
actatgcttggaaagaacttgttct

SEQ ID NO: 125340 - DNA, 25 bp, Mus musculus
actatgcttggatagaacttgttct

SEQ ID NO: 125341 - DNA, 25 bp, Mus musculus
actatgctttgtattcaacactgat

SEQ ID NO: 125342 - DNA, 25 bp, Mus musculus
actatgctttgtcgtgctctcatca

SEQ ID NO: 125343 - DNA, 25 bp, Mus musculus
actatgctttgtggtgctctcatca

SEQ ID NO: 125344 - DNA, 25 bp, Mus musculus
actatgctttgttttcaacactgat

SEQ ID NO: 125345 - DNA, 25 bp, Mus musculus
actatggacttcaagcaccggcatc

SEQ ID NO: 125346 - DNA, 25 bp, Mus musculus
actatggacttctagcaccggcatc

SEQ ID NO: 125347 - DNA, 25 bp, Mus musculus
actatggactttaacttgattttga

SEQ ID NO: 125348 - DNA, 25 bp, Mus musculus
actatggacttttacttgattttga

SEQ ID NO: 125349 - DNA, 25 bp, Mus musculus
actatggagattcccttgtggttct

SEQ ID NO: 125350 - DNA, 25 bp, Mus musculus
actatggagattgccttgtggttct

SEQ ID NO: 125351 - DNA, 25 bp, Mus musculus
actatggagctactagtgccttttg

SEQ ID NO: 125352 - DNA, 25 bp, Mus musculus
actatggagctagtagtgccttttg

SEQ ID NO: 125353 - DNA, 25 bp, Mus musculus
actatggagggacggcttcatcatg

SEQ ID NO: 125354 - DNA, 25 bp, Mus musculus
actatggagggagggcttcatcatg

SEQ ID NO: 125355 - DNA, 25 bp, Mus musculus
actatggcaaagcagcatagccctt

SEQ ID NO: 125356 - DNA, 25 bp, Mus musculus
actatggcaaaggagcatagccctt

SEQ ID NO: 125357 - DNA, 25 bp, Mus musculus
actatggcgccaagtcttgttctac

SEQ ID NO: 125358 - DNA, 25 bp, Mus musculus
actatggcgccatgtcttgttctac

SEQ ID NO: 125359 - DNA, 25 bp, Mus musculus
actatggcttagcagtgtcctcatc

SEQ ID NO: 125360 - DNA, 25 bp, Mus musculus
actatggcttaggagtgtcctcatc

SEQ ID NO: 125361 - DNA, 25 bp, Mus musculus
actatggcttctcgtgtacctctaa

SEQ ID NO: 125362 - DNA, 25 bp, Mus musculus
actatggcttctggtgtacctctaa

SEQ ID NO: 125363 - DNA, 25 bp, Mus musculus
actatgggctcaatattcgtgtgta

SEQ ID NO: 125364 - DNA, 25 bp, Mus musculus
actatgggctcattattcgtgtgta

SEQ ID NO: 125365 - DNA, 25 bp, Mus musculus
actatgggctgtcgtaagtggtcct

SEQ ID NO: 125366 - DNA, 25 bp, Mus musculus
actatgggctgtggtaagtggtcct

SEQ ID NO: 125367 - DNA, 25 bp, Mus musculus
actatgggtggtctcattcttctgg

SEQ ID NO: 125368 - DNA, 25 bp, Mus musculus
actatgggtggtgtcattcttctgg

SEQ ID NO: 125369 - DNA, 25 bp, Mus musculus
actatggtaaggagggcgcgccggc

SEQ ID NO: 125370 - DNA, 25 bp, Mus musculus
actatggtaaggtgggcgcgccggc

SEQ ID NO: 125371 - DNA, 25 bp, Mus musculus
actatggtctctacatcaactcctg

SEQ ID NO: 125372 - DNA, 25 bp, Mus musculus
actatggtctcttcatcaactcctg

SEQ ID NO: 125373 - DNA, 25 bp, Mus musculus
actatggtggttcgccggcttcctt

SEQ ID NO: 125374 - DNA, 25 bp, Mus musculus
actatggtggttggccggcttcctt

SEQ ID NO: 125375 - DNA, 25 bp, Mus musculus
actatggtgtctatctcagaagcct

SEQ ID NO: 125376 - DNA, 25 bp, Mus musculus
actatggtgtctttctcagaagcct

SEQ ID NO: 125377 - DNA, 25 bp, Mus musculus
actatggttaagcagtgaccccttc

SEQ ID NO: 125378 - DNA, 25 bp, Mus musculus
actatggttaaggagtgaccccttc

SEQ ID NO: 125379 - DNA, 25 bp, Mus musculus
actatggttgagaccattccttcat

SEQ ID NO: 125380 - DNA, 25 bp, Mus musculus
actatggttgagtccattccttcat

SEQ ID NO: 125381 - DNA, 25 bp, Mus musculus
actatggtttggaactttgtggctg

SEQ ID NO: 125382 - DNA, 25 bp, Mus musculus
actatggtttggtactttgtggctg

SEQ ID NO: 125383 - DNA, 25 bp, Mus musculus
actatggttttgaactcttcctcct

SEQ ID NO: 125384 - DNA, 25 bp, Mus musculus
actatggttttgtactcttcctcct

SEQ ID NO: 125385 - DNA, 25 bp, Mus musculus
actatgtaaccaaagttggccttga

SEQ ID NO: 125386 - DNA, 25 bp, Mus musculus
actatgtaaccatagttggccttga

SEQ ID NO: 125387 - DNA, 25 bp, Mus musculus
actatgtacgagcaggccggccttg

SEQ ID NO: 125388 - DNA, 25 bp, Mus musculus
actatgtacgaggaggccggccttg

SEQ ID NO: 125389 - DNA, 25 bp, Mus musculus
actatgtagccgagctgcccttcct

SEQ ID NO: 125390 - DNA, 25 bp, Mus musculus
actatgtagccgtgctgcccttcct

SEQ ID NO: 125391 - DNA, 25 bp, Mus musculus
actatgtaggttagactccatatga

SEQ ID NO: 125392 - DNA, 25 bp, Mus musculus
actatgtaggtttgactccatatga

SEQ ID NO: 125393 - DNA, 25 bp, Mus musculus
actatgtagtccagggtaacctaga

SEQ ID NO: 125394 - DNA, 25 bp, Mus musculus
actatgtagtccatcctgagtttgt

SEQ ID NO: 125395 - DNA, 25 bp, Mus musculus
actatgtagtcctgggtaacctaga

SEQ ID NO: 125396 - DNA, 25 bp, Mus musculus
actatgtagtccttcctgagtttgt

SEQ ID NO: 125397 - DNA, 25 bp, Mus musculus
actatgtatggtcaccacagcctct

SEQ ID NO: 125398 - DNA, 25 bp, Mus musculus
actatgtatggtgaccacagcctct

SEQ ID NO: 125399 - DNA, 25 bp, Mus musculus
actatgtcagataaaggaaaccttt

SEQ ID NO: 125400 - DNA, 25 bp, Mus musculus
actatgtcagattaaggaaaccttt

SEQ ID NO: 125401 - DNA, 25 bp, Mus musculus
actatgtcagttccaccattgttaa

SEQ ID NO: 125402 - DNA, 25 bp, Mus musculus
actatgtcagttgcaccattgttaa

SEQ ID NO: 125403 - DNA, 25 bp, Mus musculus
actatgtccggcatggcgtgtttct

SEQ ID NO: 125404 - DNA, 25 bp, Mus musculus
actatgtccggcttggcgtgtttct

SEQ ID NO: 125405 - DNA, 25 bp, Mus musculus
actatgtcctgtacagctgaggcag

SEQ ID NO: 125406 - DNA, 25 bp, Mus musculus
actatgtcctgttcagctgaggcag

SEQ ID NO: 125407 - DNA, 25 bp, Mus musculus
actatgtctccaactttacatcatg

SEQ ID NO: 125408 - DNA, 25 bp, Mus musculus
actatgtctccatctttacatcatg

SEQ ID NO: 125409 - DNA, 25 bp, Mus musculus
actatgtctggcagatttttataca

SEQ ID NO: 125410 - DNA, 25 bp, Mus musculus
actatgtctggctgatttttataca

SEQ ID NO: 125411 - DNA, 25 bp, Mus musculus
actatgtgagatacagcctgaggca

SEQ ID NO: 125412 - DNA, 25 bp, Mus musculus
actatgtgagattcagcctgaggca

SEQ ID NO: 125413 - DNA, 25 bp, Mus musculus
actatgtgatctattcctcaaccct

SEQ ID NO: 125414 - DNA, 25 bp, Mus musculus
actatgtgatcttttcctcaaccct

SEQ ID NO: 125415 - DNA, 25 bp, Mus musculus
actatgtgtgctatcttagtgcagc

SEQ ID NO: 125416 - DNA, 25 bp, Mus musculus
actatgtgtgctttcttagtgcagc

SEQ ID NO: 125417 - DNA, 25 bp, Mus musculus
actatgtgtgttcttcccaaaagaa

SEQ ID NO: 125418 - DNA, 25 bp, Mus musculus
actatgtgtgttgttcccaaaagaa

SEQ ID NO: 125419 - DNA, 25 bp, Mus musculus
actatgttacaaatccaggtgcttt

SEQ ID NO: 125420 - DNA, 25 bp, Mus musculus
actatgttacaattccaggtgcttt

SEQ ID NO: 125421 - DNA, 25 bp, Mus musculus
actatgttacttaccatgtgtcagt

SEQ ID NO: 125422 - DNA, 25 bp, Mus musculus
actatgttactttccatgtgtcagt

SEQ ID NO: 125423 - DNA, 25 bp, Mus musculus
actatgttcatgagtactcgtgtta

SEQ ID NO: 125424 - DNA, 25 bp, Mus musculus
actatgttcatgtgtactcgtgtta

SEQ ID NO: 125425 - DNA, 25 bp, Mus musculus
actatgttgatcaaaggtctccttg

SEQ ID NO: 125426 - DNA, 25 bp, Mus musculus
actatgttgatctaaggtctccttg

SEQ ID NO: 125427 - DNA, 25 bp, Mus musculus
actatgttgcttaagaaacccgtgg

SEQ ID NO: 125428 - DNA, 25 bp, Mus musculus
actatgttgctttagaaacccgtgg

SEQ ID NO: 125429 - DNA, 25 bp, Mus musculus
actatgttgtagaagccggactctt

SEQ ID NO: 125430 - DNA, 25 bp, Mus musculus
actatgttgtagtagccggactctt

SEQ ID NO: 125431 - DNA, 25 bp, Mus musculus
actatgtttctgatgtgtgcacact

SEQ ID NO: 125432 - DNA, 25 bp, Mus musculus
actatgtttctgttgtgtgcacact

SEQ ID NO: 125433 - DNA, 25 bp, Mus musculus
actattaacattccctaagatgctt

SEQ ID NO: 125434 - DNA, 25 bp, Mus musculus
actattaacattgcctaagatgctt

SEQ ID NO: 125435 - DNA, 25 bp, Mus musculus
actattacctcacttgacttccttt

SEQ ID NO: 125436 - DNA, 25 bp, Mus musculus
actattacctcagttgacttccttt

SEQ ID NO: 125437 - DNA, 25 bp, Mus musculus
actattactcttctccagtgcttta

SEQ ID NO: 125438 - DNA, 25 bp, Mus musculus
actattactcttctgactttcaaca

SEQ ID NO: 125439 - DNA, 25 bp, Mus musculus
actattactcttgtccagtgcttta

SEQ ID NO: 125440 - DNA, 25 bp, Mus musculus
actattactcttgtgactttcaaca

SEQ ID NO: 125441 - DNA, 25 bp, Mus musculus
actattagaccacgtattctatacg

SEQ ID NO: 125442 - DNA, 25 bp, Mus musculus
actattagaccaggtattctatacg

SEQ ID NO: 125443 - DNA, 25 bp, Mus musculus
actattagcgtccgtgctatatcct

SEQ ID NO: 125444 - DNA, 25 bp, Mus musculus
actattagcgtcggtgctatatcct

SEQ ID NO: 125445 - DNA, 25 bp, Mus musculus
actattagggaaaacttctgggttg

SEQ ID NO: 125446 - DNA, 25 bp, Mus musculus
actattagggaatacttctgggttg

SEQ ID NO: 125447 - DNA, 25 bp, Mus musculus
actattatcaaaacaggtgctgcct

SEQ ID NO: 125448 - DNA, 25 bp, Mus musculus
actattatcaaatcaggtgctgcct

SEQ ID NO: 125449 - DNA, 25 bp, Mus musculus
actattattgttcctgtatgttcta

SEQ ID NO: 125450 - DNA, 25 bp, Mus musculus
actattattgttgctgtatgttcta

SEQ ID NO: 125451 - DNA, 25 bp, Mus musculus
actattattttcattgctgtgcaga

SEQ ID NO: 125452 - DNA, 25 bp, Mus musculus
actattattttctttgctgtgcaga

SEQ ID NO: 125453 - DNA, 25 bp, Mus musculus
actattattttgctgctctgactaa

SEQ ID NO: 125454 - DNA, 25 bp, Mus musculus
actattattttggtgctctgactaa

SEQ ID NO: 125455 - DNA, 25 bp, Mus musculus
actattcaaactacaggagccagag

SEQ ID NO: 125456 - DNA, 25 bp, Mus musculus
actattcaaacttcaggagccagag

SEQ ID NO: 125457 - DNA, 25 bp, Mus musculus
actattcacagacaccacttgggtg

SEQ ID NO: 125458 - DNA, 25 bp, Mus musculus
actattcacagagaccacttgggtg

SEQ ID NO: 125459 - DNA, 25 bp, Mus musculus
actattcattccctagatcccggtt

SEQ ID NO: 125460 - DNA, 25 bp, Mus musculus
actattcattccgtagatcccggtt

SEQ ID NO: 125461 - DNA, 25 bp, Mus musculus
actattccagctaaccctgctggga

SEQ ID NO: 125462 - DNA, 25 bp, Mus musculus
actattccagcttaccctgctggga

SEQ ID NO: 125463 - DNA, 25 bp, Mus musculus
actattccaggaagcgcgacagaca

SEQ ID NO: 125464 - DNA, 25 bp, Mus musculus
actattccaggatgcgcgacagaca

SEQ ID NO: 125465 - DNA, 25 bp, Mus musculus
actattcctaaacttgtgtgctaca

SEQ ID NO: 125466 - DNA, 25 bp, Mus musculus
actattcctaaagttgtgtgctaca

SEQ ID NO: 125467 - DNA, 25 bp, Mus musculus
actattcctattatctgcagatgct

SEQ ID NO: 125468 - DNA, 25 bp, Mus musculus
actattcctattttctgcagatgct

SEQ ID NO: 125469 - DNA, 25 bp, Mus musculus
actattcgtgacatcctaggaggca

SEQ ID NO: 125470 - DNA, 25 bp, Mus musculus
actattcgtgacttcctaggaggca

SEQ ID NO: 125471 - DNA, 25 bp, Mus musculus
actattctaatacttgggcatctaa

SEQ ID NO: 125472 - DNA, 25 bp, Mus musculus
actattctaatagttgggcatctaa

SEQ ID NO: 125473 - DNA, 25 bp, Mus musculus
actattctcccaaagccacaaagct

SEQ ID NO: 125474 - DNA, 25 bp, Mus musculus
actattctcccatagccacaaagct

SEQ ID NO: 125475 - DNA, 25 bp, Mus musculus
actattctgactaccaattcttggg

SEQ ID NO: 125476 - DNA, 25 bp, Mus musculus
actattctgacttccaattcttggg

SEQ ID NO: 125477 - DNA, 25 bp, Mus musculus
actattctgggaatcacgggtgttt

SEQ ID NO: 125478 - DNA, 25 bp, Mus musculus
actattctgggattcacgggtgttt

SEQ ID NO: 125479 - DNA, 25 bp, Mus musculus
actattcttaccagttgctttgcaa

SEQ ID NO: 125480 - DNA, 25 bp, Mus musculus
actattcttacctgttgctttgcaa

SEQ ID NO: 125481 - DNA, 25 bp, Mus musculus
actattcttattctgtgcctttgag

SEQ ID NO: 125482 - DNA, 25 bp, Mus musculus
actattcttattgtgtgcctttgag

SEQ ID NO: 125483 - DNA, 25 bp, Mus musculus
actattcttgatatgtgagggtaaa

SEQ ID NO: 125484 - DNA, 25 bp, Mus musculus
actattcttgatttgtgagggtaaa

SEQ ID NO: 125485 - DNA, 25 bp, Mus musculus
actattctttgccagagtctgctat

SEQ ID NO: 125486 - DNA, 25 bp, Mus musculus
actattctttgcgagagtctgctat

SEQ ID NO: 125487 - DNA, 25 bp, Mus musculus
actattgatgttcctggttatgtta

SEQ ID NO: 125488 - DNA, 25 bp, Mus musculus
actattgatgttgctggttatgtta

SEQ ID NO: 125489 - DNA, 25 bp, Mus musculus
actattgcaaatactgtgttcccta

SEQ ID NO: 125490 - DNA, 25 bp, Mus musculus
actattgcaaattctgtgttcccta

SEQ ID NO: 125491 - DNA, 25 bp, Mus musculus
actattgcaatcaggtaaccccttg

SEQ ID NO: 125492 - DNA, 25 bp, Mus musculus
actattgcaatctggtaaccccttg

SEQ ID NO: 125493 - DNA, 25 bp, Mus musculus
actattgcaggtcccttattggtag

SEQ ID NO: 125494 - DNA, 25 bp, Mus musculus
actattgcaggtgccttattggtag

SEQ ID NO: 125495 - DNA, 25 bp, Mus musculus
actattgcatacattcttcggtcct

SEQ ID NO: 125496 - DNA, 25 bp, Mus musculus
actattgcatactttcttcggtcct

SEQ ID NO: 125497 - DNA, 25 bp, Mus musculus
actattgccacacagcccataagta

SEQ ID NO: 125498 - DNA, 25 bp, Mus musculus
actattgccacagagcccataagta

SEQ ID NO: 125499 - DNA, 25 bp, Mus musculus
actattgccagtcacttggtctaat

SEQ ID NO: 125500 - DNA, 25 bp, Mus musculus
actattgccagtgacttggtctaat

SEQ ID NO: 125501 - DNA, 25 bp, Mus musculus
actattgctgcaacaggattttctt

SEQ ID NO: 125502 - DNA, 25 bp, Mus musculus
actattgctgcatcaggattttctt

SEQ ID NO: 125503 - DNA, 25 bp, Mus musculus
actattgcttcacctccacagagaa

SEQ ID NO: 125504 - DNA, 25 bp, Mus musculus
actattgcttcagctccacagagaa

SEQ ID NO: 125505 - DNA, 25 bp, Mus musculus
actattgctttgctgatgctatttg

SEQ ID NO: 125506 - DNA, 25 bp, Mus musculus
actattgctttggtgatgctatttg

SEQ ID NO: 125507 - DNA, 25 bp, Mus musculus
actattggcataacactgtgttaaa

SEQ ID NO: 125508 - DNA, 25 bp, Mus musculus
actattggcatatcactgtgttaaa

SEQ ID NO: 125509 - DNA, 25 bp, Mus musculus
actattggccacagaagggagaaac

SEQ ID NO: 125510 - DNA, 25 bp, Mus musculus
actattggccactgaagggagaaac

SEQ ID NO: 125511 - DNA, 25 bp, Mus musculus
actattgggcctcatgaacattgta

SEQ ID NO: 125512 - DNA, 25 bp, Mus musculus
actattgggcctgatgaacattgta

SEQ ID NO: 125513 - DNA, 25 bp, Mus musculus
actattggtgacagaaagcccttgt

SEQ ID NO: 125514 - DNA, 25 bp, Mus musculus
actattggtgactgaaagcccttgt

SEQ ID NO: 125515 - DNA, 25 bp, Mus musculus
actattggtgatctctgggctgctc

SEQ ID NO: 125516 - DNA, 25 bp, Mus musculus
actattggtgatgtctgggctgctc

SEQ ID NO: 125517 - DNA, 25 bp, Mus musculus
actattgtatttaggtacactttag

SEQ ID NO: 125518 - DNA, 25 bp, Mus musculus
actattgtattttggtacactttag

SEQ ID NO: 125519 - DNA, 25 bp, Mus musculus
actattgtgcagaagtatttttcaa

SEQ ID NO: 125520 - DNA, 25 bp, Mus musculus
actattgtgcagtagtatttttcaa

SEQ ID NO: 125521 - DNA, 25 bp, Mus musculus
actattgttcttcgcaaaattgtgc

SEQ ID NO: 125522 - DNA, 25 bp, Mus musculus
actattgttcttggcaaaattgtgc

SEQ ID NO: 125523 - DNA, 25 bp, Mus musculus
actattgtttaaagctcctgacttg

SEQ ID NO: 125524 - DNA, 25 bp, Mus musculus
actattgtttaatgctcctgacttg

SEQ ID NO: 125525 - DNA, 25 bp, Mus musculus
actatttacacacagcagctgcgca

SEQ ID NO: 125526 - DNA, 25 bp, Mus musculus
actatttacacagagcagctgcgca

SEQ ID NO: 125527 - DNA, 25 bp, Mus musculus
actatttacctgcaagcacttggca

SEQ ID NO: 125528 - DNA, 25 bp, Mus musculus
actatttacctggaagcacttggca

SEQ ID NO: 125529 - DNA, 25 bp, Mus musculus
actatttagccaatgctcttgcttt

SEQ ID NO: 125530 - DNA, 25 bp, Mus musculus
actatttagccattgctcttgcttt

SEQ ID NO: 125531 - DNA, 25 bp, Mus musculus
actatttaggacctgtgctgcccta

SEQ ID NO: 125532 - DNA, 25 bp, Mus musculus
actatttaggacgtgtgctgcccta

SEQ ID NO: 125533 - DNA, 25 bp, Mus musculus
actatttagttcacctttctattca

SEQ ID NO: 125534 - DNA, 25 bp, Mus musculus
actatttagttctcctttctattca

SEQ ID NO: 125535 - DNA, 25 bp, Mus musculus
actatttatgatctatttaagtgtt

SEQ ID NO: 125536 - DNA, 25 bp, Mus musculus
actatttatgatgtatttaagtgtt

SEQ ID NO: 125537 - DNA, 25 bp, Mus musculus
actatttattccagtgcgtcatctg

SEQ ID NO: 125538 - DNA, 25 bp, Mus musculus
actatttattcctgtgcgtcatctg

SEQ ID NO: 125539 - DNA, 25 bp, Mus musculus
actatttcccacatgtatatctagc

SEQ ID NO: 125540 - DNA, 25 bp, Mus musculus
actatttcccacttgtatatctagc

SEQ ID NO: 125541 - DNA, 25 bp, Mus musculus
actatttcctatcggattccatcgg

SEQ ID NO: 125542 - DNA, 25 bp, Mus musculus
actatttcctatgggattccatcgg

SEQ ID NO: 125543 - DNA, 25 bp, Mus musculus
actatttctcaaccttgatgttttc

SEQ ID NO: 125544 - DNA, 25 bp, Mus musculus
actatttctcaagcttgatgttttc

SEQ ID NO: 125545 - DNA, 25 bp, Mus musculus
actatttctcccatcatgaggaaag

SEQ ID NO: 125546 - DNA, 25 bp, Mus musculus
actatttctcccttcatgaggaaag

SEQ ID NO: 125547 - DNA, 25 bp, Mus musculus
actatttctcgtcaaagctgaggag

SEQ ID NO: 125548 - DNA, 25 bp, Mus musculus
actatttctcgtgaaagctgaggag

SEQ ID NO: 125549 - DNA, 25 bp, Mus musculus
actatttgaatcagtgtccatccta

SEQ ID NO: 125550 - DNA, 25 bp, Mus musculus
actatttgaatctgtgtccatccta

SEQ ID NO: 125551 - DNA, 25 bp, Mus musculus
actatttgagttccatggttctaat

SEQ ID NO: 125552 - DNA, 25 bp, Mus musculus
actatttgagttgcatggttctaat

SEQ ID NO: 125553 - DNA, 25 bp, Mus musculus
actatttgcagtattgtcaccagga

SEQ ID NO: 125554 - DNA, 25 bp, Mus musculus
actatttgcagttttgtcaccagga

SEQ ID NO: 125555 - DNA, 25 bp, Mus musculus
actatttgctgtcgttattttctat

SEQ ID NO: 125556 - DNA, 25 bp, Mus musculus
actatttgctgtggttattttctat

SEQ ID NO: 125557 - DNA, 25 bp, Mus musculus
actatttgtcttcttagcttgtata

SEQ ID NO: 125558 - DNA, 25 bp, Mus musculus
actatttgtcttgttagcttgtata

SEQ ID NO: 125559 - DNA, 25 bp, Mus musculus
actattttaagtattgcgtctgtat

SEQ ID NO: 125560 - DNA, 25 bp, Mus musculus
actattttaagttttgcgtctgtat

SEQ ID NO: 125561 - DNA, 25 bp, Mus musculus
actattttatatacactggctgtag

SEQ ID NO: 125562 - DNA, 25 bp, Mus musculus
actattttatattcactggctgtag

SEQ ID NO: 125563 - DNA, 25 bp, Mus musculus
actattttcttcaactacccaatca

SEQ ID NO: 125564 - DNA, 25 bp, Mus musculus
actattttcttctactacccaatca

SEQ ID NO: 125565 - DNA, 25 bp, Mus musculus
actattttgaagctgtccattctcc

SEQ ID NO: 125566 - DNA, 25 bp, Mus musculus
actattttgaaggtgtccattctcc

SEQ ID NO: 125567 - DNA, 25 bp, Mus musculus
actatttttataactctgtgagcga

SEQ ID NO: 125568 - DNA, 25 bp, Mus musculus
actatttttatatctctgtgagcga

SEQ ID NO: 125569 - DNA, 25 bp, Mus musculus
actatttttcctcaactttgcccag

SEQ ID NO: 125570 - DNA, 25 bp, Mus musculus
actatttttcctgaactttgcccag

SEQ ID NO: 125571 - DNA, 25 bp, Mus musculus
actcaaaactcccagcagtgcatgt

SEQ ID NO: 125572 - DNA, 25 bp, Mus musculus
actcaaaactccgagcagtgcatgt

SEQ ID NO: 125573 - DNA, 25 bp, Mus musculus
actcaaaacttgatgccctgggcat

SEQ ID NO: 125574 - DNA, 25 bp, Mus musculus
actcaaaacttgcatactactactt

SEQ ID NO: 125575 - DNA, 25 bp, Mus musculus
actcaaaacttggatactactactt

SEQ ID NO: 125576 - DNA, 25 bp, Mus musculus
actcaaaacttgttgccctgggcat

SEQ ID NO: 125577 - DNA, 25 bp, Mus musculus
actcaaaatgatacccacactctgg

SEQ ID NO: 125578 - DNA, 25 bp, Mus musculus
actcaaaatgattcccacactctgg

SEQ ID NO: 125579 - DNA, 25 bp, Mus musculus
actcaaaatttgagccgggccaggt

SEQ ID NO: 125580 - DNA, 25 bp, Mus musculus
actcaaaatttgtgccgggccaggt

SEQ ID NO: 125581 - DNA, 25 bp, Mus musculus
actcaaacatgtcaccctttaacct

SEQ ID NO: 125582 - DNA, 25 bp, Mus musculus
actcaaacatgtgaccctttaacct

SEQ ID NO: 125583 - DNA, 25 bp, Mus musculus
actcaaacccagacctcctagaaag

SEQ ID NO: 125584 - DNA, 25 bp, Mus musculus
actcaaacccagtcctcctagaaag

SEQ ID NO: 125585 - DNA, 25 bp, Mus musculus
actcaaacccgaagggctccaggag

SEQ ID NO: 125586 - DNA, 25 bp, Mus musculus
actcaaacccgatgggctccaggag

SEQ ID NO: 125587 - DNA, 25 bp, Mus musculus
actcaaacggagcaaagatgtggat

SEQ ID NO: 125588 - DNA, 25 bp, Mus musculus
actcaaacggaggaaagatgtggat

SEQ ID NO: 125589 - DNA, 25 bp, Mus musculus
actcaaactcagagcctctcacttg

SEQ ID NO: 125590 - DNA, 25 bp, Mus musculus
actcaaactcagtgcctctcacttg

SEQ ID NO: 125591 - DNA, 25 bp, Mus musculus
actcaaactccgctctctggaagag

SEQ ID NO: 125592 - DNA, 25 bp, Mus musculus
actcaaactccggtctctggaagag

SEQ ID NO: 125593 - DNA, 25 bp, Mus musculus
actcaaagcacaagaagatcacctt

SEQ ID NO: 125594 - DNA, 25 bp, Mus musculus
actcaaagcacatgaagatcacctt

SEQ ID NO: 125595 - DNA, 25 bp, Mus musculus
actcaaagctaacgtacctgtaact

SEQ ID NO: 125596 - DNA, 25 bp, Mus musculus
actcaaagctaaggtacctgtaact

SEQ ID NO: 125597 - DNA, 25 bp, Mus musculus
actcaaagctacatcatcacttctg

SEQ ID NO: 125598 - DNA, 25 bp, Mus musculus
actcaaagctacttcatcacttctg

SEQ ID NO: 125599 - DNA, 25 bp, Mus musculus
actcaaagctttagaattcccctca

SEQ ID NO: 125600 - DNA, 25 bp, Mus musculus
actcaaagcttttgaattcccctca

SEQ ID NO: 125601 - DNA, 25 bp, Mus musculus
actcaaaggaccactgctacagatc

SEQ ID NO: 125602 - DNA, 25 bp, Mus musculus
actcaaaggacctctgctacagatc

SEQ ID NO: 125603 - DNA, 25 bp, Mus musculus
actcaaaggtgcctctctcaggaga

SEQ ID NO: 125604 - DNA, 25 bp, Mus musculus
actcaaaggtgcgtctctcaggaga

SEQ ID NO: 125605 - DNA, 25 bp, Mus musculus
actcaaagtgtgctcattggtcaac

SEQ ID NO: 125606 - DNA, 25 bp, Mus musculus
actcaaagtgtggtcattggtcaac

SEQ ID NO: 125607 - DNA, 25 bp, Mus musculus
actcaaagttgtctggcatctggaa

SEQ ID NO: 125608 - DNA, 25 bp, Mus musculus
actcaaagttgtgtggcatctggaa

SEQ ID NO: 125609 - DNA, 25 bp, Mus musculus
actcaaatagtgagcagacattttc

SEQ ID NO: 125610 - DNA, 25 bp, Mus musculus
actcaaatagtgtgcagacattttc

SEQ ID NO: 125611 - DNA, 25 bp, Mus musculus
actcaaatctccagtcagacgtcgc

SEQ ID NO: 125612 - DNA, 25 bp, Mus musculus
actcaaatctcctgtcagacgtcgc

SEQ ID NO: 125613 - DNA, 25 bp, Mus musculus
actcaaatgcctcaagttccttcca

SEQ ID NO: 125614 - DNA, 25 bp, Mus musculus
actcaaatgcctgaagttccttcca

SEQ ID NO: 125615 - DNA, 25 bp, Mus musculus
actcaaatgcttactccttatggaa

SEQ ID NO: 125616 - DNA, 25 bp, Mus musculus
actcaaatgctttctccttatggaa

SEQ ID NO: 125617 - DNA, 25 bp, Mus musculus
actcaacagaccctgtaccaggaca

SEQ ID NO: 125618 - DNA, 25 bp, Mus musculus
actcaacagaccgtgtaccaggaca

SEQ ID NO: 125619 - DNA, 25 bp, Mus musculus
actcaacagcaacagctccaagatt

SEQ ID NO: 125620 - DNA, 25 bp, Mus musculus
actcaacagcaagagctccaagatt

SEQ ID NO: 125621 - DNA, 25 bp, Mus musculus
actcaacattgccttcacttcttaa

SEQ ID NO: 125622 - DNA, 25 bp, Mus musculus
actcaacattgcgttcacttcttaa

SEQ ID NO: 125623 - DNA, 25 bp, Mus musculus
actcaacccacaacctggtatttga

SEQ ID NO: 125624 - DNA, 25 bp, Mus musculus
actcaacccacatcctggtatttga

SEQ ID NO: 125625 - DNA, 25 bp, Mus musculus
actcaaccccagctgcaaaaagact

SEQ ID NO: 125626 - DNA, 25 bp, Mus musculus
actcaaccccaggtgcaaaaagact

SEQ ID NO: 125627 - DNA, 25 bp, Mus musculus
actcaacctaagctgctgagagcac

SEQ ID NO: 125628 - DNA, 25 bp, Mus musculus
actcaacctaaggtgctgagagcac

SEQ ID NO: 125629 - DNA, 25 bp, Mus musculus
actcaacctgtgctataccttacat

SEQ ID NO: 125630 - DNA, 25 bp, Mus musculus
actcaacctgtggtataccttacat

SEQ ID NO: 125631 - DNA, 25 bp, Mus musculus
actcaacgaggaacgtgggcttctt

SEQ ID NO: 125632 - DNA, 25 bp, Mus musculus
actcaacgaggatcgtgggcttctt

SEQ ID NO: 125633 - DNA, 25 bp, Mus musculus
actcaactaggtctgtagcgttctt

SEQ ID NO: 125634 - DNA, 25 bp, Mus musculus
actcaactaggtgtgtagcgttctt

SEQ ID NO: 125635 - DNA, 25 bp, Mus musculus
actcaactagtaactattatgacca

SEQ ID NO: 125636 - DNA, 25 bp, Mus musculus
actcaactagtatctattatgacca

SEQ ID NO: 125637 - DNA, 25 bp, Mus musculus
actcaactatccaccatctgttata

SEQ ID NO: 125638 - DNA, 25 bp, Mus musculus
actcaactatcctccatctgttata

SEQ ID NO: 125639 - DNA, 25 bp, Mus musculus
actcaacttccaattcttcagtgac

SEQ ID NO: 125640 - DNA, 25 bp, Mus musculus
actcaacttccatttcttcagtgac

SEQ ID NO: 125641 - DNA, 25 bp, Mus musculus
actcaacttgttatacttgcacatt

SEQ ID NO: 125642 - DNA, 25 bp, Mus musculus
actcaacttgttttacttgcacatt

SEQ ID NO: 125643 - DNA, 25 bp, Mus musculus
actcaacttttcatatgtggacaaa

SEQ ID NO: 125644 - DNA, 25 bp, Mus musculus
actcaacttttcttatgtggacaaa

SEQ ID NO: 125645 - DNA, 25 bp, Mus musculus
actcaactttttcacttacgtacag

SEQ ID NO: 125646 - DNA, 25 bp, Mus musculus
actcaactttttgacttacgtacag

SEQ ID NO: 125647 - DNA, 25 bp, Mus musculus
actcaagaactgctgatgccgggcg

SEQ ID NO: 125648 - DNA, 25 bp, Mus musculus
actcaagaactggtgatgccgggcg

SEQ ID NO: 125649 - DNA, 25 bp, Mus musculus
actcaagaacttagcctctgtgtct

SEQ ID NO: 125650 - DNA, 25 bp, Mus musculus
actcaagaactttgcctctgtgtct

SEQ ID NO: 125651 - DNA, 25 bp, Mus musculus
actcaagaagcaagtggctacccat

SEQ ID NO: 125652 - DNA, 25 bp, Mus musculus
actcaagaagcatgtggctacccat

SEQ ID NO: 125653 - DNA, 25 bp, Mus musculus
actcaagaaggcagtgcggcttgcc

SEQ ID NO: 125654 - DNA, 25 bp, Mus musculus
actcaagaaggctgtgcggcttgcc

SEQ ID NO: 125655 - DNA, 25 bp, Mus musculus
actcaagacaggagccgagtggctt

SEQ ID NO: 125656 - DNA, 25 bp, Mus musculus
actcaagacaggtgccgagtggctt

SEQ ID NO: 125657 - DNA, 25 bp, Mus musculus
actcaagaccccatgagtgtcctgc

SEQ ID NO: 125658 - DNA, 25 bp, Mus musculus
actcaagaccccttgagtgtcctgc

SEQ ID NO: 125659 - DNA, 25 bp, Mus musculus
actcaagaccgcaaacttcattttc

SEQ ID NO: 125660 - DNA, 25 bp, Mus musculus
actcaagaccgctaacttcattttc

SEQ ID NO: 125661 - DNA, 25 bp, Mus musculus
actcaagacctgactgctggaggat

SEQ ID NO: 125662 - DNA, 25 bp, Mus musculus
actcaagacctgtctgctggaggat

SEQ ID NO: 125663 - DNA, 25 bp, Mus musculus
actcaagagggcagcctccggacaa

SEQ ID NO: 125664 - DNA, 25 bp, Mus musculus
actcaagagggctgcctccggacaa

SEQ ID NO: 125665 - DNA, 25 bp, Mus musculus
actcaagatatccacttggtgtctg

SEQ ID NO: 125666 - DNA, 25 bp, Mus musculus
actcaagatatcgacttggtgtctg

SEQ ID NO: 125667 - DNA, 25 bp, Mus musculus
actcaagcaactcccatcttggtag

SEQ ID NO: 125668 - DNA, 25 bp, Mus musculus
actcaagcaactgccatcttggtag

SEQ ID NO: 125669 - DNA, 25 bp, Mus musculus
actcaagcagggattgcttctgcca

SEQ ID NO: 125670 - DNA, 25 bp, Mus musculus
actcaagcagggtttgcttctgcca

SEQ ID NO: 125671 - DNA, 25 bp, Mus musculus
actcaagcaggtctgaccgacagca

SEQ ID NO: 125672 - DNA, 25 bp, Mus musculus
actcaagcaggtgtgaccgacagca

SEQ ID NO: 125673 - DNA, 25 bp, Mus musculus
actcaagccaggcttgctcctgaaa

SEQ ID NO: 125674 - DNA, 25 bp, Mus musculus
actcaagccagggttgctcctgaaa

SEQ ID NO: 125675 - DNA, 25 bp, Mus musculus
actcaagcccaaatcagtcagcaaa

SEQ ID NO: 125676 - DNA, 25 bp, Mus musculus
actcaagcccaattcagtcagcaaa

SEQ ID NO: 125677 - DNA, 25 bp, Mus musculus
actcaagccctgactgacactgtgg

SEQ ID NO: 125678 - DNA, 25 bp, Mus musculus
actcaagccctgtctgacactgtgg

SEQ ID NO: 125679 - DNA, 25 bp, Mus musculus
actcaagcgaagctcatctcaggtg

SEQ ID NO: 125680 - DNA, 25 bp, Mus musculus
actcaagcgaaggtcatctcaggtg

SEQ ID NO: 125681 - DNA, 25 bp, Mus musculus
actcaagctgctactgatagctcag

SEQ ID NO: 125682 - DNA, 25 bp, Mus musculus
actcaagctgcttctgatagctcag

SEQ ID NO: 125683 - DNA, 25 bp, Mus musculus
actcaagctgttctgcatgttgggc

SEQ ID NO: 125684 - DNA, 25 bp, Mus musculus
actcaagctgttgtgcatgttgggc

SEQ ID NO: 125685 - DNA, 25 bp, Mus musculus
actcaaggccagagggagtctctcc

SEQ ID NO: 125686 - DNA, 25 bp, Mus musculus
actcaaggccagtgggagtctctcc

SEQ ID NO: 125687 - DNA, 25 bp, Mus musculus
actcaagggctcactcaagctttgg

SEQ ID NO: 125688 - DNA, 25 bp, Mus musculus
actcaagggctctctcaagctttgg

SEQ ID NO: 125689 - DNA, 25 bp, Mus musculus
actcaaggtgttctgcctgtaccca

SEQ ID NO: 125690 - DNA, 25 bp, Mus musculus
actcaaggtgttgtgcctgtaccca

SEQ ID NO: 125691 - DNA, 25 bp, Mus musculus
actcaagtattcaaggcatatgtgt

SEQ ID NO: 125692 - DNA, 25 bp, Mus musculus
actcaagtattctaggcatatgtgt

SEQ ID NO: 125693 - DNA, 25 bp, Mus musculus
actcaagtctaaatttctcgtctac

SEQ ID NO: 125694 - DNA, 25 bp, Mus musculus
actcaagtctaattttctcgtctac

SEQ ID NO: 125695 - DNA, 25 bp, Mus musculus
actcaagttagtctacctgatggat

SEQ ID NO: 125696 - DNA, 25 bp, Mus musculus
actcaagttagtgtacctgatggat

SEQ ID NO: 125697 - DNA, 25 bp, Mus musculus
actcaagttctgagtatattgcgat

SEQ ID NO: 125698 - DNA, 25 bp, Mus musculus
actcaagttctgtgtatattgcgat

SEQ ID NO: 125699 - DNA, 25 bp, Mus musculus
actcaataggagacgacagcccact

SEQ ID NO: 125700 - DNA, 25 bp, Mus musculus
actcaataggagtcgacagcccact

SEQ ID NO: 125701 - DNA, 25 bp, Mus musculus
actcaatatcgaagcaagggcaggc

SEQ ID NO: 125702 - DNA, 25 bp, Mus musculus
actcaatatcgatgcaagggcaggc

SEQ ID NO: 125703 - DNA, 25 bp, Mus musculus
actcaatctcctcttttcggaaata

SEQ ID NO: 125704 - DNA, 25 bp, Mus musculus
actcaatctcctgttttcggaaata

SEQ ID NO: 125705 - DNA, 25 bp, Mus musculus
actcaatgacctcaaaacctgtctg

SEQ ID NO: 125706 - DNA, 25 bp, Mus musculus
actcaatgacctgaaaacctgtctg

SEQ ID NO: 125707 - DNA, 25 bp, Mus musculus
actcaatgctttcttgctgccaatt

SEQ ID NO: 125708 - DNA, 25 bp, Mus musculus
actcaatgctttgttgctgccaatt

SEQ ID NO: 125709 - DNA, 25 bp, Mus musculus
actcaatggatactgggcatgctac

SEQ ID NO: 125710 - DNA, 25 bp, Mus musculus
actcaatggatagtgggcatgctac

SEQ ID NO: 125711 - DNA, 25 bp, Mus musculus
actcaattaatcattccttgcctga

SEQ ID NO: 125712 - DNA, 25 bp, Mus musculus
actcaattaatctttccttgcctga

SEQ ID NO: 125713 - DNA, 25 bp, Mus musculus
actcaattaccacccatggccagat

SEQ ID NO: 125714 - DNA, 25 bp, Mus musculus
actcaattaccagccatggccagat

SEQ ID NO: 125715 - DNA, 25 bp, Mus musculus
actcaattaggaatgtaattctcag

SEQ ID NO: 125716 - DNA, 25 bp, Mus musculus
actcaattaggattgtaattctcag

SEQ ID NO: 125717 - DNA, 25 bp, Mus musculus
actcaattagttacacatgttgccc

SEQ ID NO: 125718 - DNA, 25 bp, Mus musculus
actcaattagtttcacatgttgccc

SEQ ID NO: 125719 - DNA, 25 bp, Mus musculus
actcaattctgccacctgctggttg

SEQ ID NO: 125720 - DNA, 25 bp, Mus musculus
actcaattctgcgacctgctggttg

SEQ ID NO: 125721 - DNA, 25 bp, Mus musculus
actcaatttcccatggagcagatgc

SEQ ID NO: 125722 - DNA, 25 bp, Mus musculus
actcaatttcccttggagcagatgc

SEQ ID NO: 125723 - DNA, 25 bp, Mus musculus
actcacaaaacgactatcagaaatg

SEQ ID NO: 125724 - DNA, 25 bp, Mus musculus
actcacaaaacgtctatcagaaatg

SEQ ID NO: 125725 - DNA, 25 bp, Mus musculus
actcacaaagatccgagggcctctg

SEQ ID NO: 125726 - DNA, 25 bp, Mus musculus
actcacaaagatgcgagggcctctg

SEQ ID NO: 125727 - DNA, 25 bp, Mus musculus
actcacaagaggctgtcatgtataa

SEQ ID NO: 125728 - DNA, 25 bp, Mus musculus
actcacaagagggtgtcatgtataa

SEQ ID NO: 125729 - DNA, 25 bp, Mus musculus
actcacaatagccatgtctcagcct

SEQ ID NO: 125730 - DNA, 25 bp, Mus musculus
actcacaatagcgatgtctcagcct

SEQ ID NO: 125731 - DNA, 25 bp, Mus musculus
actcacaattatagaaggctttcct

SEQ ID NO: 125732 - DNA, 25 bp, Mus musculus
actcacaattattgaaggctttcct

SEQ ID NO: 125733 - DNA, 25 bp, Mus musculus
actcacacaagcacatgcacatgca

SEQ ID NO: 125734 - DNA, 25 bp, Mus musculus
actcacacaagctcatgcacatgca

SEQ ID NO: 125735 - DNA, 25 bp, Mus musculus
actcacacaccactctgttaatgga

SEQ ID NO: 125736 - DNA, 25 bp, Mus musculus
actcacacaccagtctgttaatgga

SEQ ID NO: 125737 - DNA, 25 bp, Mus musculus
actcacacagtgcattctcatatat

SEQ ID NO: 125738 - DNA, 25 bp, Mus musculus
actcacacagtggattctcatatat

SEQ ID NO: 125739 - DNA, 25 bp, Mus musculus
actcacaccattcctgactatgaag

SEQ ID NO: 125740 - DNA, 25 bp, Mus musculus
actcacaccattgctgactatgaag

SEQ ID NO: 125741 - DNA, 25 bp, Mus musculus
actcacacctgaagtggccggccta

SEQ ID NO: 125742 - DNA, 25 bp, Mus musculus
actcacacctgatgtggccggccta

SEQ ID NO: 125743 - DNA, 25 bp, Mus musculus
actcacacctgcatggctacagaaa

SEQ ID NO: 125744 - DNA, 25 bp, Mus musculus
actcacacctgcttggctacagaaa

SEQ ID NO: 125745 - DNA, 25 bp, Mus musculus
actcacactcacacagaactaattg

SEQ ID NO: 125746 - DNA, 25 bp, Mus musculus
actcacactcactcagaactaattg

SEQ ID NO: 125747 - DNA, 25 bp, Mus musculus
actcacactggcatctccaagtctg

SEQ ID NO: 125748 - DNA, 25 bp, Mus musculus
actcacactggcttctccaagtctg

SEQ ID NO: 125749 - DNA, 25 bp, Mus musculus
actcacagcaagatcaggcgctcat

SEQ ID NO: 125750 - DNA, 25 bp, Mus musculus
actcacagcaagttcaggcgctcat

SEQ ID NO: 125751 - DNA, 25 bp, Mus musculus
actcacagcagaccctttcagtcat

SEQ ID NO: 125752 - DNA, 25 bp, Mus musculus
actcacagcagagcctttcagtcat

SEQ ID NO: 125753 - DNA, 25 bp, Mus musculus
actcacagccttccaatataaattg

SEQ ID NO: 125754 - DNA, 25 bp, Mus musculus
actcacagccttgcaatataaattg

SEQ ID NO: 125755 - DNA, 25 bp, Mus musculus
actcacagcggccatgtccagacag

SEQ ID NO: 125756 - DNA, 25 bp, Mus musculus
actcacagcggcgatgtccagacag

SEQ ID NO: 125757 - DNA, 25 bp, Mus musculus
actcacagctagcactgcaagtctc

SEQ ID NO: 125758 - DNA, 25 bp, Mus musculus
actcacagctaggactgcaagtctc

SEQ ID NO: 125759 - DNA, 25 bp, Mus musculus
actcacagctggagcacttgctgga

SEQ ID NO: 125760 - DNA, 25 bp, Mus musculus
actcacagctggtgcacttgctgga

SEQ ID NO: 125761 - DNA, 25 bp, Mus musculus
actcacaggcctactgtgggactgg

SEQ ID NO: 125762 - DNA, 25 bp, Mus musculus
actcacaggccttctgtgggactgg

SEQ ID NO: 125763 - DNA, 25 bp, Mus musculus
actcacaggtaacgtcagcacgcat

SEQ ID NO: 125764 - DNA, 25 bp, Mus musculus
actcacaggtaaggtcagcacgcat

SEQ ID NO: 125765 - DNA, 25 bp, Mus musculus
actcacataaatccatctgcctgtc

SEQ ID NO: 125766 - DNA, 25 bp, Mus musculus
actcacataaatgcatctgcctgtc

SEQ ID NO: 125767 - DNA, 25 bp, Mus musculus
actcacatgctaaatagtatgctgc

SEQ ID NO: 125768 - DNA, 25 bp, Mus musculus
actcacatgctatatagtatgctgc

SEQ ID NO: 125769 - DNA, 25 bp, Mus musculus
actcacatgggaccccacaattgta

SEQ ID NO: 125770 - DNA, 25 bp, Mus musculus
actcacatgggagcccacaattgta

SEQ ID NO: 125771 - DNA, 25 bp, Mus musculus
actcacatggtaccttgtagccatt

SEQ ID NO: 125772 - DNA, 25 bp, Mus musculus
actcacatggtagcttgtagccatt

SEQ ID NO: 125773 - DNA, 25 bp, Mus musculus
actcacatgtacatgggcactggca

SEQ ID NO: 125774 - DNA, 25 bp, Mus musculus
actcacatgtacttgggcactggca

SEQ ID NO: 125775 - DNA, 25 bp, Mus musculus
actcacatgtttcttgggtcacctg

SEQ ID NO: 125776 - DNA, 25 bp, Mus musculus
actcacatgtttgttgggtcacctg

SEQ ID NO: 125777 - DNA, 25 bp, Mus musculus
actcacattatgattttgcgtatga

SEQ ID NO: 125778 - DNA, 25 bp, Mus musculus
actcacattatgtttttgcgtatga

SEQ ID NO: 125779 - DNA, 25 bp, Mus musculus
actcacattccgcacactgggagcg

SEQ ID NO: 125780 - DNA, 25 bp, Mus musculus
actcacattccggacactgggagcg

SEQ ID NO: 125781 - DNA, 25 bp, Mus musculus
actcacattctaccctggtctgaaa

SEQ ID NO: 125782 - DNA, 25 bp, Mus musculus
actcacattctagcctggtctgaaa

SEQ ID NO: 125783 - DNA, 25 bp, Mus musculus
actcacattgcgcacccaggaggtg

SEQ ID NO: 125784 - DNA, 25 bp, Mus musculus
actcacattgcggacccaggaggtg

SEQ ID NO: 125785 - DNA, 25 bp, Mus musculus
actcacatttcactgtggtgtccct

SEQ ID NO: 125786 - DNA, 25 bp, Mus musculus
actcacatttcagtgtggtgtccct

SEQ ID NO: 125787 - DNA, 25 bp, Mus musculus
actcaccaagcccaaacacatgaaa

SEQ ID NO: 125788 - DNA, 25 bp, Mus musculus
actcaccaagccgaaacacatgaaa

SEQ ID NO: 125789 - DNA, 25 bp, Mus musculus
actcaccacatgattccaatgcaga

SEQ ID NO: 125790 - DNA, 25 bp, Mus musculus
actcaccacatgtttccaatgcaga

SEQ ID NO: 125791 - DNA, 25 bp, Mus musculus
actcaccaccttaatccttatctaa

SEQ ID NO: 125792 - DNA, 25 bp, Mus musculus
actcaccacctttatccttatctaa

SEQ ID NO: 125793 - DNA, 25 bp, Mus musculus
actcaccagattaagttctcctttg

SEQ ID NO: 125794 - DNA, 25 bp, Mus musculus
actcaccagatttagttctcctttg

SEQ ID NO: 125795 - DNA, 25 bp, Mus musculus
actcaccagtgtctgtcttagcctg

SEQ ID NO: 125796 - DNA, 25 bp, Mus musculus
actcaccagtgtgtgtcttagcctg

SEQ ID NO: 125797 - DNA, 25 bp, Mus musculus
actcaccatctcaaccttggagaag

SEQ ID NO: 125798 - DNA, 25 bp, Mus musculus
actcaccatctctaccttggagaag

SEQ ID NO: 125799 - DNA, 25 bp, Mus musculus
actcaccatctgcaattaagtgaca

SEQ ID NO: 125800 - DNA, 25 bp, Mus musculus
actcaccatctggaattaagtgaca

SEQ ID NO: 125801 - DNA, 25 bp, Mus musculus
actcaccatgcaattattcccatat

SEQ ID NO: 125802 - DNA, 25 bp, Mus musculus
actcaccatgcatttattcccatat

SEQ ID NO: 125803 - DNA, 25 bp, Mus musculus
actcacccacgtcaggaaggaatct

SEQ ID NO: 125804 - DNA, 25 bp, Mus musculus
actcacccacgtgaggaaggaatct

SEQ ID NO: 125805 - DNA, 25 bp, Mus musculus
actcaccccaagattattacgcatt

SEQ ID NO: 125806 - DNA, 25 bp, Mus musculus
actcaccccaagtttattacgcatt

SEQ ID NO: 125807 - DNA, 25 bp, Mus musculus
actcaccctactacacagtgttgaa

SEQ ID NO: 125808 - DNA, 25 bp, Mus musculus
actcaccctacttcacagtgttgaa

SEQ ID NO: 125809 - DNA, 25 bp, Mus musculus
actcaccctgctacagaaagtcttt

SEQ ID NO: 125810 - DNA, 25 bp, Mus musculus
actcaccctgcttcagaaagtcttt

SEQ ID NO: 125811 - DNA, 25 bp, Mus musculus
actcaccgcactcctgtggaacaat

SEQ ID NO: 125812 - DNA, 25 bp, Mus musculus
actcaccgcactgctgtggaacaat

SEQ ID NO: 125813 - DNA, 25 bp, Mus musculus
actcaccgggagcatccaggaggct

SEQ ID NO: 125814 - DNA, 25 bp, Mus musculus
actcaccgggaggatccaggaggct

SEQ ID NO: 125815 - DNA, 25 bp, Mus musculus
actcaccgtcgacgcctgtgaaaaa

SEQ ID NO: 125816 - DNA, 25 bp, Mus musculus
actcaccgtcgaggcctgtgaaaaa

SEQ ID NO: 125817 - DNA, 25 bp, Mus musculus
actcaccgttctagcacaagtttgg

SEQ ID NO: 125818 - DNA, 25 bp, Mus musculus
actcaccgttcttgcacaagtttgg

SEQ ID NO: 125819 - DNA, 25 bp, Mus musculus
actcacctacccagcaaagtgggag

SEQ ID NO: 125820 - DNA, 25 bp, Mus musculus
actcacctaccctgcaaagtgggag

SEQ ID NO: 125821 - DNA, 25 bp, Mus musculus
actcacctatacacaaacctcttat

SEQ ID NO: 125822 - DNA, 25 bp, Mus musculus
actcacctatacacccatttttaat

SEQ ID NO: 125823 - DNA, 25 bp, Mus musculus
actcacctatactcaaacctcttat

SEQ ID NO: 125824 - DNA, 25 bp, Mus musculus
actcacctatactcccatttttaat

SEQ ID NO: 125825 - DNA, 25 bp, Mus musculus
actcacctctgtacgattttgctga

SEQ ID NO: 125826 - DNA, 25 bp, Mus musculus
actcacctctgttcgattttgctga

SEQ ID NO: 125827 - DNA, 25 bp, Mus musculus
actcacctcttgctgcctgttgact

SEQ ID NO: 125828 - DNA, 25 bp, Mus musculus
actcacctcttggtgcctgttgact

SEQ ID NO: 125829 - DNA, 25 bp, Mus musculus
actcacctgcaccttcattattcaa

SEQ ID NO: 125830 - DNA, 25 bp, Mus musculus
actcacctgcacgttcattattcaa

SEQ ID NO: 125831 - DNA, 25 bp, Mus musculus
actcacctgcttctggtgcaggctt

SEQ ID NO: 125832 - DNA, 25 bp, Mus musculus
actcacctgcttgtggtgcaggctt

SEQ ID NO: 125833 - DNA, 25 bp, Mus musculus
actcacctgttgatcctcagatcag

SEQ ID NO: 125834 - DNA, 25 bp, Mus musculus
actcacctgttgctaggcactgaag

SEQ ID NO: 125835 - DNA, 25 bp, Mus musculus
actcacctgttggtaggcactgaag

SEQ ID NO: 125836 - DNA, 25 bp, Mus musculus
actcacctgttgttcctcagatcag

SEQ ID NO: 125837 - DNA, 25 bp, Mus musculus
actcaccttatgagggtgccggcaa

SEQ ID NO: 125838 - DNA, 25 bp, Mus musculus
actcaccttatgtgggtgccggcaa

SEQ ID NO: 125839 - DNA, 25 bp, Mus musculus
actcaccttcttacatgacgcagat

SEQ ID NO: 125840 - DNA, 25 bp, Mus musculus
actcaccttctttcatgacgcagat

SEQ ID NO: 125841 - DNA, 25 bp, Mus musculus
actcaccttgtaaacactgtgtaca

SEQ ID NO: 125842 - DNA, 25 bp, Mus musculus
actcaccttgtatacactgtgtaca

SEQ ID NO: 125843 - DNA, 25 bp, Mus musculus
actcacgacactactggtctcacgg

SEQ ID NO: 125844 - DNA, 25 bp, Mus musculus
actcacgacacttctggtctcacgg

SEQ ID NO: 125845 - DNA, 25 bp, Mus musculus
actcacgatggcaaatagttcctgt

SEQ ID NO: 125846 - DNA, 25 bp, Mus musculus
actcacgatggctaatagttcctgt

SEQ ID NO: 125847 - DNA, 25 bp, Mus musculus
actcacgcaacacagttaccaggtt

SEQ ID NO: 125848 - DNA, 25 bp, Mus musculus
actcacgcaacagagttaccaggtt

SEQ ID NO: 125849 - DNA, 25 bp, Mus musculus
actcacgcaggcaagggcttctgtt

SEQ ID NO: 125850 - DNA, 25 bp, Mus musculus
actcacgcaggctagggcttctgtt

SEQ ID NO: 125851 - DNA, 25 bp, Mus musculus
actcacgctcccagggtggattcag

SEQ ID NO: 125852 - DNA, 25 bp, Mus musculus
actcacgctccctgggtggattcag

SEQ ID NO: 125853 - DNA, 25 bp, Mus musculus
actcacgctctgaaaggaagccaaa

SEQ ID NO: 125854 - DNA, 25 bp, Mus musculus
actcacgctctgtaaggaagccaaa

SEQ ID NO: 125855 - DNA, 25 bp, Mus musculus
actcacggatgtcaatatgtacata

SEQ ID NO: 125856 - DNA, 25 bp, Mus musculus
actcacggatgtgaatatgtacata

SEQ ID NO: 125857 - DNA, 25 bp, Mus musculus
actcacggctctctggagctgaaga

SEQ ID NO: 125858 - DNA, 25 bp, Mus musculus
actcacggctctgtggagctgaaga

SEQ ID NO: 125859 - DNA, 25 bp, Mus musculus
actcacggcttgatatcctctgatg

SEQ ID NO: 125860 - DNA, 25 bp, Mus musculus
actcacggcttgttatcctctgatg

SEQ ID NO: 125861 - DNA, 25 bp, Mus musculus
actcacgtatgacgagtttcatcct

SEQ ID NO: 125862 - DNA, 25 bp, Mus musculus
actcacgtatgaggagtttcatcct

SEQ ID NO: 125863 - DNA, 25 bp, Mus musculus
actcacgtctaaactgcagctctaa

SEQ ID NO: 125864 - DNA, 25 bp, Mus musculus
actcacgtctaatctgcagctctaa

SEQ ID NO: 125865 - DNA, 25 bp, Mus musculus
actcacgtctcaccttcattataac

SEQ ID NO: 125866 - DNA, 25 bp, Mus musculus
actcacgtctcagcttcattataac

SEQ ID NO: 125867 - DNA, 25 bp, Mus musculus
actcacgtctttctgtgctggatgc

SEQ ID NO: 125868 - DNA, 25 bp, Mus musculus
actcacgtctttgtgtgctggatgc

SEQ ID NO: 125869 - DNA, 25 bp, Mus musculus
actcacgttgcacagacagctggga

SEQ ID NO: 125870 - DNA, 25 bp, Mus musculus
actcacgttgcagagacagctggga

SEQ ID NO: 125871 - DNA, 25 bp, Mus musculus
actcacgttgtcagggtttggaggc

SEQ ID NO: 125872 - DNA, 25 bp, Mus musculus
actcacgttgtctgggtttggaggc

SEQ ID NO: 125873 - DNA, 25 bp, Mus musculus
actcactaatgtccagatcctcctg

SEQ ID NO: 125874 - DNA, 25 bp, Mus musculus
actcactaatgtgcagatcctcctg

SEQ ID NO: 125875 - DNA, 25 bp, Mus musculus
actcactacagtatagacgccctaa

SEQ ID NO: 125876 - DNA, 25 bp, Mus musculus
actcactacagtttagacgccctaa

SEQ ID NO: 125877 - DNA, 25 bp, Mus musculus
actcactacataatatattccccaa

SEQ ID NO: 125878 - DNA, 25 bp, Mus musculus
actcactacatattatattccccaa

SEQ ID NO: 125879 - DNA, 25 bp, Mus musculus
actcactagccccattatggtttgg

SEQ ID NO: 125880 - DNA, 25 bp, Mus musculus
actcactagcccgattatggtttgg

SEQ ID NO: 125881 - DNA, 25 bp, Mus musculus
actcactagctaagggaccgtaaca

SEQ ID NO: 125882 - DNA, 25 bp, Mus musculus
actcactagctatgggaccgtaaca

SEQ ID NO: 125883 - DNA, 25 bp, Mus musculus
actcactatctgacctttcttgata

SEQ ID NO: 125884 - DNA, 25 bp, Mus musculus
actcactatctgtcctttcttgata

SEQ ID NO: 125885 - DNA, 25 bp, Mus musculus
actcactattggattgacactgaat

SEQ ID NO: 125886 - DNA, 25 bp, Mus musculus
actcactattggtttgacactgaat

SEQ ID NO: 125887 - DNA, 25 bp, Mus musculus
actcactattgtccttttgctttca

SEQ ID NO: 125888 - DNA, 25 bp, Mus musculus
actcactattgtgcttttgctttca

SEQ ID NO: 125889 - DNA, 25 bp, Mus musculus
actcactcaaccagtaagactaacc

SEQ ID NO: 125890 - DNA, 25 bp, Mus musculus
actcactcaacctgtaagactaacc

SEQ ID NO: 125891 - DNA, 25 bp, Mus musculus
actcactcaataaggctcccactgt

SEQ ID NO: 125892 - DNA, 25 bp, Mus musculus
actcactcaatatggctcccactgt

SEQ ID NO: 125893 - DNA, 25 bp, Mus musculus
actcactcagccacgtatacgtaat

SEQ ID NO: 125894 - DNA, 25 bp, Mus musculus
actcactcagcctcgtatacgtaat

SEQ ID NO: 125895 - DNA, 25 bp, Mus musculus
actcactcatctccttgatctggag

SEQ ID NO: 125896 - DNA, 25 bp, Mus musculus
actcactcatctgcttgatctggag

SEQ ID NO: 125897 - DNA, 25 bp, Mus musculus
actcactcctaaatactcctggctg

SEQ ID NO: 125898 - DNA, 25 bp, Mus musculus
actcactcctaattactcctggctg

SEQ ID NO: 125899 - DNA, 25 bp, Mus musculus
actcactcttagcaggtccagtgcc

SEQ ID NO: 125900 - DNA, 25 bp, Mus musculus
actcactcttaggaggtccagtgcc

SEQ ID NO: 125901 - DNA, 25 bp, Mus musculus
actcactgataaagtttctcccaac

SEQ ID NO: 125902 - DNA, 25 bp, Mus musculus
actcactgataatgtttctcccaac

SEQ ID NO: 125903 - DNA, 25 bp, Mus musculus
actcactgccagaatgggaagtcaa

SEQ ID NO: 125904 - DNA, 25 bp, Mus musculus
actcactgccagtatgggaagtcaa

SEQ ID NO: 125905 - DNA, 25 bp, Mus musculus
actcactggcttagaccttcaactg

SEQ ID NO: 125906 - DNA, 25 bp, Mus musculus
actcactggctttgaccttcaactg

SEQ ID NO: 125907 - DNA, 25 bp, Mus musculus
actcactgtaagaccacactggcct

SEQ ID NO: 125908 - DNA, 25 bp, Mus musculus
actcactgtaagtccacactggcct

SEQ ID NO: 125909 - DNA, 25 bp, Mus musculus
actcactgtagcaagtgggactcag

SEQ ID NO: 125910 - DNA, 25 bp, Mus musculus
actcactgtagctagtgggactcag

SEQ ID NO: 125911 - DNA, 25 bp, Mus musculus
actcactgtcgcactgctttcttgg

SEQ ID NO: 125912 - DNA, 25 bp, Mus musculus
actcactgtcgctctgctttcttgg

SEQ ID NO: 125913 - DNA, 25 bp, Mus musculus
actcactgtcttctcttggttgaat

SEQ ID NO: 125914 - DNA, 25 bp, Mus musculus
actcactgtcttgtcttggttgaat

SEQ ID NO: 125915 - DNA, 25 bp, Mus musculus
actcactgtggtacatcaaataaaa

SEQ ID NO: 125916 - DNA, 25 bp, Mus musculus
actcactgtggttcatcaaataaaa

SEQ ID NO: 125917 - DNA, 25 bp, Mus musculus
actcactgtgtgctgctccttggct

SEQ ID NO: 125918 - DNA, 25 bp, Mus musculus
actcactgtgtggtgctccttggct

SEQ ID NO: 125919 - DNA, 25 bp, Mus musculus
actcactgttggcatgcacacggta

SEQ ID NO: 125920 - DNA, 25 bp, Mus musculus
actcactgttgggatgcacacggta

SEQ ID NO: 125921 - DNA, 25 bp, Mus musculus
actcacttaacgaagaccctgcagg

SEQ ID NO: 125922 - DNA, 25 bp, Mus musculus
actcacttaacgtagaccctgcagg

SEQ ID NO: 125923 - DNA, 25 bp, Mus musculus
actcacttcagccttgactgctgct

SEQ ID NO: 125924 - DNA, 25 bp, Mus musculus
actcacttcagcgttgactgctgct

SEQ ID NO: 125925 - DNA, 25 bp, Mus musculus
actcacttccagatgtgctgtgcaa

SEQ ID NO: 125926 - DNA, 25 bp, Mus musculus
actcacttccagttgtgctgtgcaa

SEQ ID NO: 125927 - DNA, 25 bp, Mus musculus
actcacttccgcacaaattattcaa

SEQ ID NO: 125928 - DNA, 25 bp, Mus musculus
actcacttccgctcaaattattcaa

SEQ ID NO: 125929 - DNA, 25 bp, Mus musculus
actcacttccttaacccaatgtagc

SEQ ID NO: 125930 - DNA, 25 bp, Mus musculus
actcacttcctttacccaatgtagc

SEQ ID NO: 125931 - DNA, 25 bp, Mus musculus
actcacttgagtatgcctctgttta

SEQ ID NO: 125932 - DNA, 25 bp, Mus musculus
actcacttgagtttgcctctgttta

SEQ ID NO: 125933 - DNA, 25 bp, Mus musculus
actcacttggctatgagcagctcag

SEQ ID NO: 125934 - DNA, 25 bp, Mus musculus
actcacttggctttgagcagctcag

SEQ ID NO: 125935 - DNA, 25 bp, Mus musculus
actcacttgtaccagtagctctgtg

SEQ ID NO: 125936 - DNA, 25 bp, Mus musculus
actcacttgtacgagtagctctgtg

SEQ ID NO: 125937 - DNA, 25 bp, Mus musculus
actcacttgtcgctcaagtactggg

SEQ ID NO: 125938 - DNA, 25 bp, Mus musculus
actcacttgtcggtcaagtactggg

SEQ ID NO: 125939 - DNA, 25 bp, Mus musculus
actcactttaggattataggcataa

SEQ ID NO: 125940 - DNA, 25 bp, Mus musculus
actcactttaggtttataggcataa

SEQ ID NO: 125941 - DNA, 25 bp, Mus musculus
actcactttcttcattgtctgtaga

SEQ ID NO: 125942 - DNA, 25 bp, Mus musculus
actcactttcttgattgtctgtaga

SEQ ID NO: 125943 - DNA, 25 bp, Mus musculus
actcacttttagcagctgtggcagg

SEQ ID NO: 125944 - DNA, 25 bp, Mus musculus
actcacttttaggagctgtggcagg

SEQ ID NO: 125945 - DNA, 25 bp, Mus musculus
actcagaaaactctgatgccacctg

SEQ ID NO: 125946 - DNA, 25 bp, Mus musculus
actcagaaaactgtgatgccacctg

SEQ ID NO: 125947 - DNA, 25 bp, Mus musculus
actcagaagtgcaacctaacaggga

SEQ ID NO: 125948 - DNA, 25 bp, Mus musculus
actcagaagtgctacctaacaggga

SEQ ID NO: 125949 - DNA, 25 bp, Mus musculus
actcagacaaggagtaaataaattc

SEQ ID NO: 125950 - DNA, 25 bp, Mus musculus
actcagacaaggtgtaaataaattc

SEQ ID NO: 125951 - DNA, 25 bp, Mus musculus
actcagacacgtatacttcagcatg

SEQ ID NO: 125952 - DNA, 25 bp, Mus musculus
actcagacacgtttacttcagcatg

SEQ ID NO: 125953 - DNA, 25 bp, Mus musculus
actcagacagagatccagatgtggt

SEQ ID NO: 125954 - DNA, 25 bp, Mus musculus
actcagacagagttccagatgtggt

SEQ ID NO: 125955 - DNA, 25 bp, Mus musculus
actcagaccacacatattcacagta

SEQ ID NO: 125956 - DNA, 25 bp, Mus musculus
actcagaccacagatattcacagta

SEQ ID NO: 125957 - DNA, 25 bp, Mus musculus
actcagaccagaacagcagcctaga

SEQ ID NO: 125958 - DNA, 25 bp, Mus musculus
actcagaccagatcagcagcctaga

SEQ ID NO: 125959 - DNA, 25 bp, Mus musculus
actcagacctgacaactgttacctg

SEQ ID NO: 125960 - DNA, 25 bp, Mus musculus
actcagacctgagaactgttacctg

SEQ ID NO: 125961 - DNA, 25 bp, Mus musculus
actcagacctgcattgtggtactac

SEQ ID NO: 125962 - DNA, 25 bp, Mus musculus
actcagacctgctttgtggtactac

SEQ ID NO: 125963 - DNA, 25 bp, Mus musculus
actcagacgctgacaacttccggaa

SEQ ID NO: 125964 - DNA, 25 bp, Mus musculus
actcagacgctgtcaacttccggaa

SEQ ID NO: 125965 - DNA, 25 bp, Mus musculus
actcagacggctcctagattcattt

SEQ ID NO: 125966 - DNA, 25 bp, Mus musculus
actcagacggctgctagattcattt

SEQ ID NO: 125967 - DNA, 25 bp, Mus musculus
actcagactctgacatctagcatca

SEQ ID NO: 125968 - DNA, 25 bp, Mus musculus
actcagactctgtcatctagcatca

SEQ ID NO: 125969 - DNA, 25 bp, Mus musculus
actcagactgtgacaagcactcaga

SEQ ID NO: 125970 - DNA, 25 bp, Mus musculus
actcagactgtgtcaagcactcaga

SEQ ID NO: 125971 - DNA, 25 bp, Mus musculus
actcagactttgcacatatatttat

SEQ ID NO: 125972 - DNA, 25 bp, Mus musculus
actcagactttggacatatatttat

SEQ ID NO: 125973 - DNA, 25 bp, Mus musculus
actcagacttttctaataaatggac

SEQ ID NO: 125974 - DNA, 25 bp, Mus musculus
actcagacttttgtaataaatggac

SEQ ID NO: 125975 - DNA, 25 bp, Mus musculus
actcagagaatgctacctgactgct

SEQ ID NO: 125976 - DNA, 25 bp, Mus musculus
actcagagaatggtacctgactgct

SEQ ID NO: 125977 - DNA, 25 bp, Mus musculus
actcagagatacacgtacacttacc

SEQ ID NO: 125978 - DNA, 25 bp, Mus musculus
actcagagatactcgtacacttacc

SEQ ID NO: 125979 - DNA, 25 bp, Mus musculus
actcagagattgaagcgcccaagag

SEQ ID NO: 125980 - DNA, 25 bp, Mus musculus
actcagagattgtagcgcccaagag

SEQ ID NO: 125981 - DNA, 25 bp, Mus musculus
actcagagcctcatgatgctaagca

SEQ ID NO: 125982 - DNA, 25 bp, Mus musculus
actcagagcctcttgatgctaagca

SEQ ID NO: 125983 - DNA, 25 bp, Mus musculus
actcagagggctatgtagggacttt

SEQ ID NO: 125984 - DNA, 25 bp, Mus musculus
actcagagggctttgtagggacttt

SEQ ID NO: 125985 - DNA, 25 bp, Mus musculus
actcagagtcttagtgactgggcta

SEQ ID NO: 125986 - DNA, 25 bp, Mus musculus
actcagagtctttgtgactgggcta

SEQ ID NO: 125987 - DNA, 25 bp, Mus musculus
actcagagtgagactttccctcaag

SEQ ID NO: 125988 - DNA, 25 bp, Mus musculus
actcagagtgagtctttccctcaag

SEQ ID NO: 125989 - DNA, 25 bp, Mus musculus
actcagagtgttctcgactgtccga

SEQ ID NO: 125990 - DNA, 25 bp, Mus musculus
actcagagtgttgtcgactgtccga

SEQ ID NO: 125991 - DNA, 25 bp, Mus musculus
actcagatatagaattgggcaacaa

SEQ ID NO: 125992 - DNA, 25 bp, Mus musculus
actcagatatagtattgggcaacaa

SEQ ID NO: 125993 - DNA, 25 bp, Mus musculus
actcagatatgtatcctgggctcaa

SEQ ID NO: 125994 - DNA, 25 bp, Mus musculus
actcagatatgtttcctgggctcaa

SEQ ID NO: 125995 - DNA, 25 bp, Mus musculus
actcagattacactcccaggtttaa

SEQ ID NO: 125996 - DNA, 25 bp, Mus musculus
actcagattacagtcccaggtttaa

SEQ ID NO: 125997 - DNA, 25 bp, Mus musculus
actcagattagaagactaaggtgct

SEQ ID NO: 125998 - DNA, 25 bp, Mus musculus
actcagattagatgactaaggtgct

SEQ ID NO: 125999 - DNA, 25 bp, Mus musculus
actcagattcagatcacctgcttca

SEQ ID NO: 126000 - DNA, 25 bp, Mus musculus
actcagattcagttcacctgcttca

SEQ ID NO: 126001 - DNA, 25 bp, Mus musculus
actcagattcgacgcctccttttac

SEQ ID NO: 126002 - DNA, 25 bp, Mus musculus
actcagattcgaggcctccttttac

SEQ ID NO: 126003 - DNA, 25 bp, Mus musculus
actcagattctgaaaacatccacat

SEQ ID NO: 126004 - DNA, 25 bp, Mus musculus
actcagattctgtaaacatccacat

SEQ ID NO: 126005 - DNA, 25 bp, Mus musculus
actcagattttactcccatggcctt

SEQ ID NO: 126006 - DNA, 25 bp, Mus musculus
actcagattttagtcccatggcctt

SEQ ID NO: 126007 - DNA, 25 bp, Mus musculus
actcagcaacacaggtcacgtttgg

SEQ ID NO: 126008 - DNA, 25 bp, Mus musculus
actcagcaacactggtcacgtttgg

SEQ ID NO: 126009 - DNA, 25 bp, Mus musculus
actcagcaagtgctatgccactgaa

SEQ ID NO: 126010 - DNA, 25 bp, Mus musculus
actcagcaagtggtatgccactgaa

SEQ ID NO: 126011 - DNA, 25 bp, Mus musculus
actcagcagatacaatggtccaggc

SEQ ID NO: 126012 - DNA, 25 bp, Mus musculus
actcagcagatagaatggtccaggc

SEQ ID NO: 126013 - DNA, 25 bp, Mus musculus
actcagcagggcaatccttatctac

SEQ ID NO: 126014 - DNA, 25 bp, Mus musculus
actcagcagggctatccttatctac

SEQ ID NO: 126015 - DNA, 25 bp, Mus musculus
actcagcagtgcagtcatttataca

SEQ ID NO: 126016 - DNA, 25 bp, Mus musculus
actcagcagtgctgtcatttataca

SEQ ID NO: 126017 - DNA, 25 bp, Mus musculus
actcagcagtggacagctcagcttt

SEQ ID NO: 126018 - DNA, 25 bp, Mus musculus
actcagcagtggtcagctcagcttt

SEQ ID NO: 126019 - DNA, 25 bp, Mus musculus
actcagcagttaacgtctttagaaa

SEQ ID NO: 126020 - DNA, 25 bp, Mus musculus
actcagcagttatcgtctttagaaa

SEQ ID NO: 126021 - DNA, 25 bp, Mus musculus
actcagcatctccagcaggttcgaa

SEQ ID NO: 126022 - DNA, 25 bp, Mus musculus
actcagcatctcgagcaggttcgaa

SEQ ID NO: 126023 - DNA, 25 bp, Mus musculus
actcagcatgccaatctgatgaaat

SEQ ID NO: 126024 - DNA, 25 bp, Mus musculus
actcagcatgcctatctgatgaaat

SEQ ID NO: 126025 - DNA, 25 bp, Mus musculus
actcagcccacactatgaaatagtt

SEQ ID NO: 126026 - DNA, 25 bp, Mus musculus
actcagcccacagtatgaaatagtt

SEQ ID NO: 126027 - DNA, 25 bp, Mus musculus
actcagccccgtctaacgaatggag

SEQ ID NO: 126028 - DNA, 25 bp, Mus musculus
actcagccccgtgtaacgaatggag

SEQ ID NO: 126029 - DNA, 25 bp, Mus musculus
actcagccctgtatatttgtgtaat

SEQ ID NO: 126030 - DNA, 25 bp, Mus musculus
actcagccctgtttatttgtgtaat

SEQ ID NO: 126031 - DNA, 25 bp, Mus musculus
actcagccgcgtaaacaacttggaa

SEQ ID NO: 126032 - DNA, 25 bp, Mus musculus
actcagccgcgttaacaacttggaa

SEQ ID NO: 126033 - DNA, 25 bp, Mus musculus
actcagccggctagcttcagtattt

SEQ ID NO: 126034 - DNA, 25 bp, Mus musculus
actcagccggcttgcttcagtattt

SEQ ID NO: 126035 - DNA, 25 bp, Mus musculus
actcagcctccaataaatctcaaga

SEQ ID NO: 126036 - DNA, 25 bp, Mus musculus
actcagcctccattaaatctcaaga

SEQ ID NO: 126037 - DNA, 25 bp, Mus musculus
actcagcctgatatgcagtgatctt

SEQ ID NO: 126038 - DNA, 25 bp, Mus musculus
actcagcctgatttgcagtgatctt

SEQ ID NO: 126039 - DNA, 25 bp, Mus musculus
actcagcctgcacagtgcgggaccg

SEQ ID NO: 126040 - DNA, 25 bp, Mus musculus
actcagcctgcagagtgcgggaccg

SEQ ID NO: 126041 - DNA, 25 bp, Mus musculus
actcagcctggtactcatggattct

SEQ ID NO: 126042 - DNA, 25 bp, Mus musculus
actcagcctggttctcatggattct

SEQ ID NO: 126043 - DNA, 25 bp, Mus musculus
actcagcctttacaccttgatgtga

SEQ ID NO: 126044 - DNA, 25 bp, Mus musculus
actcagcctttagaccttgatgtga

SEQ ID NO: 126045 - DNA, 25 bp, Mus musculus
actcagcgagtgattattggccgca

SEQ ID NO: 126046 - DNA, 25 bp, Mus musculus
actcagcgagtgtttattggccgca

SEQ ID NO: 126047 - DNA, 25 bp, Mus musculus
actcagcgatgtaacaccaaaggcg

SEQ ID NO: 126048 - DNA, 25 bp, Mus musculus
actcagcgatgttacaccaaaggcg

SEQ ID NO: 126049 - DNA, 25 bp, Mus musculus
actcagcgtctactgttgctgggct

SEQ ID NO: 126050 - DNA, 25 bp, Mus musculus
actcagcgtctagtgttgctgggct

SEQ ID NO: 126051 - DNA, 25 bp, Mus musculus
actcagctaacactggtaccagtgg

SEQ ID NO: 126052 - DNA, 25 bp, Mus musculus
actcagctaacagtggtaccagtgg

SEQ ID NO: 126053 - DNA, 25 bp, Mus musculus
actcagctaccaactgaagctttgg

SEQ ID NO: 126054 - DNA, 25 bp, Mus musculus
actcagctaccatctgaagctttgg

SEQ ID NO: 126055 - DNA, 25 bp, Mus musculus
actcagctagtaatttggaatttgt

SEQ ID NO: 126056 - DNA, 25 bp, Mus musculus
actcagctagtattttggaatttgt

SEQ ID NO: 126057 - DNA, 25 bp, Mus musculus
actcagctatgtaacattgtaaatg

SEQ ID NO: 126058 - DNA, 25 bp, Mus musculus
actcagctatgttacattgtaaatg

SEQ ID NO: 126059 - DNA, 25 bp, Mus musculus
actcagctctgaatgtttagggcct

SEQ ID NO: 126060 - DNA, 25 bp, Mus musculus
actcagctctgattgtttagggcct

SEQ ID NO: 126061 - DNA, 25 bp, Mus musculus
actcagctcttcataatgccttaat

SEQ ID NO: 126062 - DNA, 25 bp, Mus musculus
actcagctcttcttaatgccttaat

SEQ ID NO: 126063 - DNA, 25 bp, Mus musculus
actcagctgcagaagcagttacagt

SEQ ID NO: 126064 - DNA, 25 bp, Mus musculus
actcagctgcagtagcagttacagt

SEQ ID NO: 126065 - DNA, 25 bp, Mus musculus
actcagctgcatcaattaactcctc

SEQ ID NO: 126066 - DNA, 25 bp, Mus musculus
actcagctgcatgaattaactcctc

SEQ ID NO: 126067 - DNA, 25 bp, Mus musculus
actcagctgggtctctgcttctggg

SEQ ID NO: 126068 - DNA, 25 bp, Mus musculus
actcagctgggtgtctgcttctggg

SEQ ID NO: 126069 - DNA, 25 bp, Mus musculus
actcagctgtgcaaagtgacccagt

SEQ ID NO: 126070 - DNA, 25 bp, Mus musculus
actcagctgtgctaagtgacccagt

SEQ ID NO: 126071 - DNA, 25 bp, Mus musculus
actcagcttctcaaagggtcacctt

SEQ ID NO: 126072 - DNA, 25 bp, Mus musculus
actcagcttctctaagggtcacctt

SEQ ID NO: 126073 - DNA, 25 bp, Mus musculus
actcagcttctgcatttcaagtaga

SEQ ID NO: 126074 - DNA, 25 bp, Mus musculus
actcagcttctggatttcaagtaga

SEQ ID NO: 126075 - DNA, 25 bp, Mus musculus
actcagcttggacgctatccctttg

SEQ ID NO: 126076 - DNA, 25 bp, Mus musculus
actcagcttggaggctatccctttg

SEQ ID NO: 126077 - DNA, 25 bp, Mus musculus
actcagcttggcagctggagttgct

SEQ ID NO: 126078 - DNA, 25 bp, Mus musculus
actcagcttggctgctggagttgct

SEQ ID NO: 126079 - DNA, 25 bp, Mus musculus
actcagcttttactgacgtcaggca

SEQ ID NO: 126080 - DNA, 25 bp, Mus musculus
actcagcttttagtgacgtcaggca

SEQ ID NO: 126081 - DNA, 25 bp, Mus musculus
actcaggaactgcttttcattcacg

SEQ ID NO: 126082 - DNA, 25 bp, Mus musculus
actcaggaactggttttcattcacg

SEQ ID NO: 126083 - DNA, 25 bp, Mus musculus
actcaggacacactttgatcttctg

SEQ ID NO: 126084 - DNA, 25 bp, Mus musculus
actcaggacacagtttgatcttctg

SEQ ID NO: 126085 - DNA, 25 bp, Mus musculus
actcaggacagaaggcaccattcag

SEQ ID NO: 126086 - DNA, 25 bp, Mus musculus
actcaggacagatggcaccattcag

SEQ ID NO: 126087 - DNA, 25 bp, Mus musculus
actcaggagggtcggacttctccaa

SEQ ID NO: 126088 - DNA, 25 bp, Mus musculus
actcaggagggtgggacttctccaa

SEQ ID NO: 126089 - DNA, 25 bp, Mus musculus
actcaggaggtcatgttttttggtt

SEQ ID NO: 126090 - DNA, 25 bp, Mus musculus
actcaggaggtcttgttttttggtt

SEQ ID NO: 126091 - DNA, 25 bp, Mus musculus
actcaggattgtcaccgttctttca

SEQ ID NO: 126092 - DNA, 25 bp, Mus musculus
actcaggattgtgaccgttctttca

SEQ ID NO: 126093 - DNA, 25 bp, Mus musculus
actcaggcaatgatatgcatacata

SEQ ID NO: 126094 - DNA, 25 bp, Mus musculus
actcaggcaatgttatgcatacata

SEQ ID NO: 126095 - DNA, 25 bp, Mus musculus
actcaggcacaccacagtaacagtc

SEQ ID NO: 126096 - DNA, 25 bp, Mus musculus
actcaggcacacgacagtaacagtc

SEQ ID NO: 126097 - DNA, 25 bp, Mus musculus
actcaggcaccccaaacattctgta

SEQ ID NO: 126098 - DNA, 25 bp, Mus musculus
actcaggcacccgaaacattctgta

SEQ ID NO: 126099 - DNA, 25 bp, Mus musculus
actcaggcggcaactcggacagcga

SEQ ID NO: 126100 - DNA, 25 bp, Mus musculus
actcaggcggcatctcggacagcga

SEQ ID NO: 126101 - DNA, 25 bp, Mus musculus
actcaggctccacggaccaaataaa

SEQ ID NO: 126102 - DNA, 25 bp, Mus musculus
actcaggctccagggaccaaataaa

SEQ ID NO: 126103 - DNA, 25 bp, Mus musculus
actcaggctgccagggttagcagca

SEQ ID NO: 126104 - DNA, 25 bp, Mus musculus
actcaggctgcctgggttagcagca

SEQ ID NO: 126105 - DNA, 25 bp, Mus musculus
actcaggctggtatcattgtgactc

SEQ ID NO: 126106 - DNA, 25 bp, Mus musculus
actcaggctggtccccgaagtggac

SEQ ID NO: 126107 - DNA, 25 bp, Mus musculus
actcaggctggtgcccgaagtggac

SEQ ID NO: 126108 - DNA, 25 bp, Mus musculus
actcaggctggtttcattgtgactc

SEQ ID NO: 126109 - DNA, 25 bp, Mus musculus
actcaggctgtaaacaattaatgat

SEQ ID NO: 126110 - DNA, 25 bp, Mus musculus
actcaggctgtatacaattaatgat

SEQ ID NO: 126111 - DNA, 25 bp, Mus musculus
actcaggctttcaattggcaggact

SEQ ID NO: 126112 - DNA, 25 bp, Mus musculus
actcaggctttctattggcaggact

SEQ ID NO: 126113 - DNA, 25 bp, Mus musculus
actcagggagagatctgcgtcagct

SEQ ID NO: 126114 - DNA, 25 bp, Mus musculus
actcagggagagttctgcgtcagct

SEQ ID NO: 126115 - DNA, 25 bp, Mus musculus
actcagggcttgatggtttctgtac

SEQ ID NO: 126116 - DNA, 25 bp, Mus musculus
actcagggcttgttggtttctgtac

SEQ ID NO: 126117 - DNA, 25 bp, Mus musculus
actcagggctttcattcttgtatcc

SEQ ID NO: 126118 - DNA, 25 bp, Mus musculus
actcagggctttgattcttgtatcc

SEQ ID NO: 126119 - DNA, 25 bp, Mus musculus
actcaggtaacgactgcctgggtag

SEQ ID NO: 126120 - DNA, 25 bp, Mus musculus
actcaggtaacgtctgcctgggtag

SEQ ID NO: 126121 - DNA, 25 bp, Mus musculus
actcaggtaccaaggactgctctga

SEQ ID NO: 126122 - DNA, 25 bp, Mus musculus
actcaggtaccatggactgctctga

SEQ ID NO: 126123 - DNA, 25 bp, Mus musculus
actcaggtactgctatggcacaccc

SEQ ID NO: 126124 - DNA, 25 bp, Mus musculus
actcaggtactggtatggcacaccc

SEQ ID NO: 126125 - DNA, 25 bp, Mus musculus
actcaggtagataagatttggtggc

SEQ ID NO: 126126 - DNA, 25 bp, Mus musculus
actcaggtagattagatttggtggc

SEQ ID NO: 126127 - DNA, 25 bp, Mus musculus
actcaggtatacacaggtccaggac

SEQ ID NO: 126128 - DNA, 25 bp, Mus musculus
actcaggtatactcaggtccaggac

SEQ ID NO: 126129 - DNA, 25 bp, Mus musculus
actcaggtcatcaggtttatctgta

SEQ ID NO: 126130 - DNA, 25 bp, Mus musculus
actcaggtcatctggtttatctgta

SEQ ID NO: 126131 - DNA, 25 bp, Mus musculus
actcaggtcattaagctgtgacaag

SEQ ID NO: 126132 - DNA, 25 bp, Mus musculus
actcaggtcatttagctgtgacaag

SEQ ID NO: 126133 - DNA, 25 bp, Mus musculus
actcaggtcctccagcttgcaaggc

SEQ ID NO: 126134 - DNA, 25 bp, Mus musculus
actcaggtcctcgagcttgcaaggc

SEQ ID NO: 126135 - DNA, 25 bp, Mus musculus
actcaggtcgtcatgcttggtggca

SEQ ID NO: 126136 - DNA, 25 bp, Mus musculus
actcaggtcgtcttgcttggtggca

SEQ ID NO: 126137 - DNA, 25 bp, Mus musculus
actcaggtctgtattccaaggtggc

SEQ ID NO: 126138 - DNA, 25 bp, Mus musculus
actcaggtctgttttccaaggtggc

SEQ ID NO: 126139 - DNA, 25 bp, Mus musculus
actcaggtcttcaggatcggtggta

SEQ ID NO: 126140 - DNA, 25 bp, Mus musculus
actcaggtcttctggatcggtggta

SEQ ID NO: 126141 - DNA, 25 bp, Mus musculus
actcaggtctttaggcttgcgcaca

SEQ ID NO: 126142 - DNA, 25 bp, Mus musculus
actcaggtctttatgcttgcacagc

SEQ ID NO: 126143 - DNA, 25 bp, Mus musculus
actcaggtcttttggcttgcgcaca

SEQ ID NO: 126144 - DNA, 25 bp, Mus musculus
actcaggtctttttgcttgcacagc

SEQ ID NO: 126145 - DNA, 25 bp, Mus musculus
actcaggtgaccacaaagcactttc

SEQ ID NO: 126146 - DNA, 25 bp, Mus musculus
actcaggtgacctcaaagcactttc

SEQ ID NO: 126147 - DNA, 25 bp, Mus musculus
actcaggtgactaccgcatggtgat

SEQ ID NO: 126148 - DNA, 25 bp, Mus musculus
actcaggtgactccctgcttgtcac

SEQ ID NO: 126149 - DNA, 25 bp, Mus musculus
actcaggtgactgcctgcttgtcac

SEQ ID NO: 126150 - DNA, 25 bp, Mus musculus
actcaggtgacttccgcatggtgat

SEQ ID NO: 126151 - DNA, 25 bp, Mus musculus
actcaggtgatacgatgctgtccca

SEQ ID NO: 126152 - DNA, 25 bp, Mus musculus
actcaggtgataggatgctgtccca

SEQ ID NO: 126153 - DNA, 25 bp, Mus musculus
actcaggtgctgaaaaagtcctcta

SEQ ID NO: 126154 - DNA, 25 bp, Mus musculus
actcaggtgctgtaaaagtcctcta

SEQ ID NO: 126155 - DNA, 25 bp, Mus musculus
actcaggttattacactctacaaat

SEQ ID NO: 126156 - DNA, 25 bp, Mus musculus
actcaggttatttcactctacaaat

SEQ ID NO: 126157 - DNA, 25 bp, Mus musculus
actcaggttggcagccatccctgct

SEQ ID NO: 126158 - DNA, 25 bp, Mus musculus
actcaggttggctgccatccctgct

SEQ ID NO: 126159 - DNA, 25 bp, Mus musculus
actcagtagactacctgtagaccaa

SEQ ID NO: 126160 - DNA, 25 bp, Mus musculus
actcagtagacttcctgtagaccaa

SEQ ID NO: 126161 - DNA, 25 bp, Mus musculus
actcagtattccagcagacgctcag

SEQ ID NO: 126162 - DNA, 25 bp, Mus musculus
actcagtattcctgcagacgctcag

SEQ ID NO: 126163 - DNA, 25 bp, Mus musculus
actcagtcagagctttatcccattt

SEQ ID NO: 126164 - DNA, 25 bp, Mus musculus
actcagtcagaggtttatcccattt

SEQ ID NO: 126165 - DNA, 25 bp, Mus musculus
actcagtcccagcaggatttctcaa

SEQ ID NO: 126166 - DNA, 25 bp, Mus musculus
actcagtcccaggaggatttctcaa

SEQ ID NO: 126167 - DNA, 25 bp, Mus musculus
actcagtcctagaaccagtgtggca

SEQ ID NO: 126168 - DNA, 25 bp, Mus musculus
actcagtcctagtaccagtgtggca

SEQ ID NO: 126169 - DNA, 25 bp, Mus musculus
actcagtctaagctagccagcttgt

SEQ ID NO: 126170 - DNA, 25 bp, Mus musculus
actcagtctaaggtagccagcttgt

SEQ ID NO: 126171 - DNA, 25 bp, Mus musculus
actcagtctctaaatagttcctaac

SEQ ID NO: 126172 - DNA, 25 bp, Mus musculus
actcagtctctatatagttcctaac

SEQ ID NO: 126173 - DNA, 25 bp, Mus musculus
actcagtcttagaccaagttttctt

SEQ ID NO: 126174 - DNA, 25 bp, Mus musculus
actcagtcttagtccaagttttctt

SEQ ID NO: 126175 - DNA, 25 bp, Mus musculus
actcagtgacatcgtacaaatctac

SEQ ID NO: 126176 - DNA, 25 bp, Mus musculus
actcagtgacatggtacaaatctac

SEQ ID NO: 126177 - DNA, 25 bp, Mus musculus
actcagtgaccacgtgtgtgcacct

SEQ ID NO: 126178 - DNA, 25 bp, Mus musculus
actcagtgaccaggtgtgtgcacct

SEQ ID NO: 126179 - DNA, 25 bp, Mus musculus
actcagtgaggtcttcttctccctt

SEQ ID NO: 126180 - DNA, 25 bp, Mus musculus
actcagtgaggtgttcttctccctt

SEQ ID NO: 126181 - DNA, 25 bp, Mus musculus
actcagtgagtacttgacttgtcat

SEQ ID NO: 126182 - DNA, 25 bp, Mus musculus
actcagtgagtagttgacttgtcat

SEQ ID NO: 126183 - DNA, 25 bp, Mus musculus
actcagtgcttccttagcctctaag

SEQ ID NO: 126184 - DNA, 25 bp, Mus musculus
actcagtgcttcgttagcctctaag

SEQ ID NO: 126185 - DNA, 25 bp, Mus musculus
actcagtggcccatgtgtcatagaa

SEQ ID NO: 126186 - DNA, 25 bp, Mus musculus
actcagtggcccttgtgtcatagaa

SEQ ID NO: 126187 - DNA, 25 bp, Mus musculus
actcagtgtcagacctaacagcagg

SEQ ID NO: 126188 - DNA, 25 bp, Mus musculus
actcagtgtcagtcctaacagcagg

SEQ ID NO: 126189 - DNA, 25 bp, Mus musculus
actcagtgttggcttaagtttccct

SEQ ID NO: 126190 - DNA, 25 bp, Mus musculus
actcagtgttgggttaagtttccct

SEQ ID NO: 126191 - DNA, 25 bp, Mus musculus
actcagttcaatatcttggatccat

SEQ ID NO: 126192 - DNA, 25 bp, Mus musculus
actcagttcaatttcttggatccat

SEQ ID NO: 126193 - DNA, 25 bp, Mus musculus
actcagttcagaatactgcccttcc

SEQ ID NO: 126194 - DNA, 25 bp, Mus musculus
actcagttcagattactgcccttcc

SEQ ID NO: 126195 - DNA, 25 bp, Mus musculus
actcagttctcgcttcttaagcttc

SEQ ID NO: 126196 - DNA, 25 bp, Mus musculus
actcagttctcggttcttaagcttc

SEQ ID NO: 126197 - DNA, 25 bp, Mus musculus
actcagttgttgcttgtcattccag

SEQ ID NO: 126198 - DNA, 25 bp, Mus musculus
actcagttgttggttgtcattccag

SEQ ID NO: 126199 - DNA, 25 bp, Mus musculus
actcagtttcaacaggtgcctatct

SEQ ID NO: 126200 - DNA, 25 bp, Mus musculus
actcagtttcaagaggtgcctatct

SEQ ID NO: 126201 - DNA, 25 bp, Mus musculus
actcagtttcccaataagtggttct

SEQ ID NO: 126202 - DNA, 25 bp, Mus musculus
actcagtttccctataagtggttct

SEQ ID NO: 126203 - DNA, 25 bp, Mus musculus
actcagtttgacactgtaggcagaa

SEQ ID NO: 126204 - DNA, 25 bp, Mus musculus
actcagtttgactctgtaggcagaa

SEQ ID NO: 126205 - DNA, 25 bp, Mus musculus
actcagtttgtaaccaaagctggcc

SEQ ID NO: 126206 - DNA, 25 bp, Mus musculus
actcagtttgtatccaaagctggcc

SEQ ID NO: 126207 - DNA, 25 bp, Mus musculus
actcagttttcaccagacacaggag

SEQ ID NO: 126208 - DNA, 25 bp, Mus musculus
actcagttttcagcagacacaggag

SEQ ID NO: 126209 - DNA, 25 bp, Mus musculus
actcagttttgcatccaaacacaaa

SEQ ID NO: 126210 - DNA, 25 bp, Mus musculus
actcagttttgcttccaaacacaaa

SEQ ID NO: 126211 - DNA, 25 bp, Mus musculus
actcataacattatcacttcagagg

SEQ ID NO: 126212 - DNA, 25 bp, Mus musculus
actcataacattttcacttcagagg

SEQ ID NO: 126213 - DNA, 25 bp, Mus musculus
actcatacagaactgtacgcaacag

SEQ ID NO: 126214 - DNA, 25 bp, Mus musculus
actcatacagaagtgtacgcaacag

SEQ ID NO: 126215 - DNA, 25 bp, Mus musculus
actcataccacactactccaagatg

SEQ ID NO: 126216 - DNA, 25 bp, Mus musculus
actcataccacagtactccaagatg

SEQ ID NO: 126217 - DNA, 25 bp, Mus musculus
actcatagaatacccctaccagtta

SEQ ID NO: 126218 - DNA, 25 bp, Mus musculus
actcatagaatagccctaccagtta

SEQ ID NO: 126219 - DNA, 25 bp, Mus musculus
actcatagtccaaccatctgggagg

SEQ ID NO: 126220 - DNA, 25 bp, Mus musculus
actcatagtccatccatctgggagg

SEQ ID NO: 126221 - DNA, 25 bp, Mus musculus
actcatatcagcattgggaggttat

SEQ ID NO: 126222 - DNA, 25 bp, Mus musculus
actcatatcagctttgggaggttat

SEQ ID NO: 126223 - DNA, 25 bp, Mus musculus
actcatatcatcagttttcaagatt

SEQ ID NO: 126224 - DNA, 25 bp, Mus musculus
actcatatcatctgttttcaagatt

SEQ ID NO: 126225 - DNA, 25 bp, Mus musculus
actcatatcgtaacgtgtcagctca

SEQ ID NO: 126226 - DNA, 25 bp, Mus musculus
actcatatcgtatcgtgtcagctca

SEQ ID NO: 126227 - DNA, 25 bp, Mus musculus
actcatattcccaaagcacaggctt

SEQ ID NO: 126228 - DNA, 25 bp, Mus musculus
actcatattccctaagcacaggctt

SEQ ID NO: 126229 - DNA, 25 bp, Mus musculus
actcatattctacatatcttggcca

SEQ ID NO: 126230 - DNA, 25 bp, Mus musculus
actcatattctagatatcttggcca

SEQ ID NO: 126231 - DNA, 25 bp, Mus musculus
actcatcaaatgacgccttaagtac

SEQ ID NO: 126232 - DNA, 25 bp, Mus musculus
actcatcaaatgtcgccttaagtac

SEQ ID NO: 126233 - DNA, 25 bp, Mus musculus
actcatcaactcctagtagctctgt

SEQ ID NO: 126234 - DNA, 25 bp, Mus musculus
actcatcaactcgtagtagctctgt

SEQ ID NO: 126235 - DNA, 25 bp, Mus musculus
actcatcaccttattggcctatgca

SEQ ID NO: 126236 - DNA, 25 bp, Mus musculus
actcatcacctttttggcctatgca

SEQ ID NO: 126237 - DNA, 25 bp, Mus musculus
actcatcagcctaatgttcccaaag

SEQ ID NO: 126238 - DNA, 25 bp, Mus musculus
actcatcagccttatgttcccaaag

SEQ ID NO: 126239 - DNA, 25 bp, Mus musculus
actcatcaggatattcagtgccacc

SEQ ID NO: 126240 - DNA, 25 bp, Mus musculus
actcatcaggattttcagtgccacc

SEQ ID NO: 126241 - DNA, 25 bp, Mus musculus
actcatcatctacggttctggtctt

SEQ ID NO: 126242 - DNA, 25 bp, Mus musculus
actcatcatctagggttctggtctt

SEQ ID NO: 126243 - DNA, 25 bp, Mus musculus
actcatccagccaccaggtaaagta

SEQ ID NO: 126244 - DNA, 25 bp, Mus musculus
actcatccagcctccaggtaaagta

SEQ ID NO: 126245 - DNA, 25 bp, Mus musculus
actcatcctcccattttgctgtttt

SEQ ID NO: 126246 - DNA, 25 bp, Mus musculus
actcatcctccctttttgctgtttt

SEQ ID NO: 126247 - DNA, 25 bp, Mus musculus
actcatcctgttaattgttccccag

SEQ ID NO: 126248 - DNA, 25 bp, Mus musculus
actcatcctgtttattgttccccag

SEQ ID NO: 126249 - DNA, 25 bp, Mus musculus
actcatccttagaagtgcgttgtgg

SEQ ID NO: 126250 - DNA, 25 bp, Mus musculus
actcatccttagtagtgcgttgtgg

SEQ ID NO: 126251 - DNA, 25 bp, Mus musculus
actcatcctttcatctggtgtttga

SEQ ID NO: 126252 - DNA, 25 bp, Mus musculus
actcatcctttcttctggtgtttga

SEQ ID NO: 126253 - DNA, 25 bp, Mus musculus
actcatcgccatccagtgacaacgt

SEQ ID NO: 126254 - DNA, 25 bp, Mus musculus
actcatcgccatgcagtgacaacgt

SEQ ID NO: 126255 - DNA, 25 bp, Mus musculus
actcatcgcccacaacaagcagtaa

SEQ ID NO: 126256 - DNA, 25 bp, Mus musculus
actcatcgcccagaacaagcagtaa

SEQ ID NO: 126257 - DNA, 25 bp, Mus musculus
actcatctactgatgctgcggagcg

SEQ ID NO: 126258 - DNA, 25 bp, Mus musculus
actcatctactgttgctgcggagcg

SEQ ID NO: 126259 - DNA, 25 bp, Mus musculus
actcatctatttctgtcttggctac

SEQ ID NO: 126260 - DNA, 25 bp, Mus musculus
actcatctatttgtgtcttggctac

SEQ ID NO: 126261 - DNA, 25 bp, Mus musculus
actcatctcacaagggaggctgctg

SEQ ID NO: 126262 - DNA, 25 bp, Mus musculus
actcatctcacatgggaggctgctg

SEQ ID NO: 126263 - DNA, 25 bp, Mus musculus
actcatctcagtaaggtcgggtgtg

SEQ ID NO: 126264 - DNA, 25 bp, Mus musculus
actcatctcagttaggtcgggtgtg

SEQ ID NO: 126265 - DNA, 25 bp, Mus musculus
actcatctcataattctcgtttgtt

SEQ ID NO: 126266 - DNA, 25 bp, Mus musculus
actcatctcatatttctcgtttgtt

SEQ ID NO: 126267 - DNA, 25 bp, Mus musculus
actcatctccagagactgtgtatta

SEQ ID NO: 126268 - DNA, 25 bp, Mus musculus
actcatctccagtgactgtgtatta

SEQ ID NO: 126269 - DNA, 25 bp, Mus musculus
actcatctctctctgcctttgtatc

SEQ ID NO: 126270 - DNA, 25 bp, Mus musculus
actcatctctctgtgcctttgtatc

SEQ ID NO: 126271 - DNA, 25 bp, Mus musculus
actcatctctgaccattgtagacca

SEQ ID NO: 126272 - DNA, 25 bp, Mus musculus
actcatctctgagcattgtagacca

SEQ ID NO: 126273 - DNA, 25 bp, Mus musculus
actcatctctgcatttgttagtgga

SEQ ID NO: 126274 - DNA, 25 bp, Mus musculus
actcatctctgcttttgttagtgga

SEQ ID NO: 126275 - DNA, 25 bp, Mus musculus
actcatctctttccgctttaataat

SEQ ID NO: 126276 - DNA, 25 bp, Mus musculus
actcatctctttcctaactttgtgt

SEQ ID NO: 126277 - DNA, 25 bp, Mus musculus
actcatctctttgcgctttaataat

SEQ ID NO: 126278 - DNA, 25 bp, Mus musculus
actcatctctttgctaactttgtgt

SEQ ID NO: 126279 - DNA, 25 bp, Mus musculus
actcatctgaagactatgtctccag

SEQ ID NO: 126280 - DNA, 25 bp, Mus musculus
actcatctgaagagaatgtgcggca

SEQ ID NO: 126281 - DNA, 25 bp, Mus musculus
actcatctgaagtctatgtctccag

SEQ ID NO: 126282 - DNA, 25 bp, Mus musculus
actcatctgaagtgaatgtgcggca

SEQ ID NO: 126283 - DNA, 25 bp, Mus musculus
actcatctgattccttctgtgtctg

SEQ ID NO: 126284 - DNA, 25 bp, Mus musculus
actcatctgattgcttctgtgtctg

SEQ ID NO: 126285 - DNA, 25 bp, Mus musculus
actcatctgctacagctctggtgtt

SEQ ID NO: 126286 - DNA, 25 bp, Mus musculus
actcatctgctagagctctggtgtt

SEQ ID NO: 126287 - DNA, 25 bp, Mus musculus
actcatctgggcaggtccatgtaaa

SEQ ID NO: 126288 - DNA, 25 bp, Mus musculus
actcatctgggctggtccatgtaaa

SEQ ID NO: 126289 - DNA, 25 bp, Mus musculus
actcatcttgttctgtcagaaataa

SEQ ID NO: 126290 - DNA, 25 bp, Mus musculus
actcatcttgttgtgtcagaaataa

SEQ ID NO: 126291 - DNA, 25 bp, Mus musculus
actcatgacaggctttggctttctt

SEQ ID NO: 126292 - DNA, 25 bp, Mus musculus
actcatgacagggtttggctttctt

SEQ ID NO: 126293 - DNA, 25 bp, Mus musculus
actcatgaccagctgtacttctatg

SEQ ID NO: 126294 - DNA, 25 bp, Mus musculus
actcatgaccaggtgtacttctatg

SEQ ID NO: 126295 - DNA, 25 bp, Mus musculus
actcatgagcacaccgttcatgtga

SEQ ID NO: 126296 - DNA, 25 bp, Mus musculus
actcatgagcactccgttcatgtga

SEQ ID NO: 126297 - DNA, 25 bp, Mus musculus
actcatgagcttaagagctcttcct

SEQ ID NO: 126298 - DNA, 25 bp, Mus musculus
actcatgagctttagagctcttcct

SEQ ID NO: 126299 - DNA, 25 bp, Mus musculus
actcatgagtggctattttacttca

SEQ ID NO: 126300 - DNA, 25 bp, Mus musculus
actcatgagtgggtattttacttca

SEQ ID NO: 126301 - DNA, 25 bp, Mus musculus
actcatgagtgtatactagattgca

SEQ ID NO: 126302 - DNA, 25 bp, Mus musculus
actcatgagtgtttactagattgca

SEQ ID NO: 126303 - DNA, 25 bp, Mus musculus
actcatgcattcctactgcttggag

SEQ ID NO: 126304 - DNA, 25 bp, Mus musculus
actcatgcattcgtactgcttggag

SEQ ID NO: 126305 - DNA, 25 bp, Mus musculus
actcatgcctgacaatcagcggctg

SEQ ID NO: 126306 - DNA, 25 bp, Mus musculus
actcatgcctgagaatcagcggctg

SEQ ID NO: 126307 - DNA, 25 bp, Mus musculus
actcatgcttgcctttggcccaggg

SEQ ID NO: 126308 - DNA, 25 bp, Mus musculus
actcatgcttgcgtttggcccaggg

SEQ ID NO: 126309 - DNA, 25 bp, Mus musculus
actcatgctttcaagtgaactccag

SEQ ID NO: 126310 - DNA, 25 bp, Mus musculus
actcatgctttctagtgaactccag

SEQ ID NO: 126311 - DNA, 25 bp, Mus musculus
actcatggaagtcagtgcagacaaa

SEQ ID NO: 126312 - DNA, 25 bp, Mus musculus
actcatggaagtgagtgcagacaaa

SEQ ID NO: 126313 - DNA, 25 bp, Mus musculus
actcatgggagcaactggccagtta

SEQ ID NO: 126314 - DNA, 25 bp, Mus musculus
actcatgggagctactggccagtta

SEQ ID NO: 126315 - DNA, 25 bp, Mus musculus
actcatgggaggactgcttgaagcc

SEQ ID NO: 126316 - DNA, 25 bp, Mus musculus
actcatgggaggtctgcttgaagcc

SEQ ID NO: 126317 - DNA, 25 bp, Mus musculus
actcatgggcagcaggtcttccagc

SEQ ID NO: 126318 - DNA, 25 bp, Mus musculus
actcatgggcaggaggtcttccagc

SEQ ID NO: 126319 - DNA, 25 bp, Mus musculus
actcatgggccgcttcatgaggagc

SEQ ID NO: 126320 - DNA, 25 bp, Mus musculus
actcatgggccggttcatgaggagc

SEQ ID NO: 126321 - DNA, 25 bp, Mus musculus
actcatggtgacacacacctgttat

SEQ ID NO: 126322 - DNA, 25 bp, Mus musculus
actcatggtgactcacacctgttat

SEQ ID NO: 126323 - DNA, 25 bp, Mus musculus
actcatggttttcagtgtgagacaa

SEQ ID NO: 126324 - DNA, 25 bp, Mus musculus
actcatggttttgagtgtgagacaa

SEQ ID NO: 126325 - DNA, 25 bp, Mus musculus
actcatgtaataattctgctgcaga

SEQ ID NO: 126326 - DNA, 25 bp, Mus musculus
actcatgtaatatttctgctgcaga

SEQ ID NO: 126327 - DNA, 25 bp, Mus musculus
actcatgtatgtatcccacctgatt

SEQ ID NO: 126328 - DNA, 25 bp, Mus musculus
actcatgtatgtcaagcggcttcag

SEQ ID NO: 126329 - DNA, 25 bp, Mus musculus
actcatgtatgtgaagcggcttcag

SEQ ID NO: 126330 - DNA, 25 bp, Mus musculus
actcatgtatgtttcccacctgatt

SEQ ID NO: 126331 - DNA, 25 bp, Mus musculus
actcatgtgaagatgacacgctaat

SEQ ID NO: 126332 - DNA, 25 bp, Mus musculus
actcatgtgaagttgacacgctaat

SEQ ID NO: 126333 - DNA, 25 bp, Mus musculus
actcatgtgcataccagtgtgttca

SEQ ID NO: 126334 - DNA, 25 bp, Mus musculus
actcatgtgcattccagtgtgttca

SEQ ID NO: 126335 - DNA, 25 bp, Mus musculus
actcatgtgctgacccataagcact

SEQ ID NO: 126336 - DNA, 25 bp, Mus musculus
actcatgtgctgtcccataagcact

SEQ ID NO: 126337 - DNA, 25 bp, Mus musculus
actcatgtggacctcatataaggga

SEQ ID NO: 126338 - DNA, 25 bp, Mus musculus
actcatgtggacgtcatataaggga

SEQ ID NO: 126339 - DNA, 25 bp, Mus musculus
actcatgtgttcatcctttctttga

SEQ ID NO: 126340 - DNA, 25 bp, Mus musculus
actcatgtgttcttcctttctttga

SEQ ID NO: 126341 - DNA, 25 bp, Mus musculus
actcatgttattacttctgctttcc

SEQ ID NO: 126342 - DNA, 25 bp, Mus musculus
actcatgttatttcttctgctttcc

SEQ ID NO: 126343 - DNA, 25 bp, Mus musculus
actcatgttgcaaaaacattttctg

SEQ ID NO: 126344 - DNA, 25 bp, Mus musculus
actcatgttgcataaacattttctg

SEQ ID NO: 126345 - DNA, 25 bp, Mus musculus
actcatgttgtaccgcactgtgaaa

SEQ ID NO: 126346 - DNA, 25 bp, Mus musculus
actcatgttgtagcgcactgtgaaa

SEQ ID NO: 126347 - DNA, 25 bp, Mus musculus
actcatgtttacagctggcccaaga

SEQ ID NO: 126348 - DNA, 25 bp, Mus musculus
actcatgtttactgctggcccaaga

SEQ ID NO: 126349 - DNA, 25 bp, Mus musculus
actcattaccgcatcagtttctcac

SEQ ID NO: 126350 - DNA, 25 bp, Mus musculus
actcattaccgcttcagtttctcac

SEQ ID NO: 126351 - DNA, 25 bp, Mus musculus
actcattatgctctgtgggatttcc

SEQ ID NO: 126352 - DNA, 25 bp, Mus musculus
actcattatgctgtgtgggatttcc

SEQ ID NO: 126353 - DNA, 25 bp, Mus musculus
actcattcacgtataaaactttggg

SEQ ID NO: 126354 - DNA, 25 bp, Mus musculus
actcattcacgtttaaaactttggg

SEQ ID NO: 126355 - DNA, 25 bp, Mus musculus
actcattcactgaagtccatcctaa

SEQ ID NO: 126356 - DNA, 25 bp, Mus musculus
actcattcactgtagtccatcctaa

SEQ ID NO: 126357 - DNA, 25 bp, Mus musculus
actcattcatggcaaccttcggaaa

SEQ ID NO: 126358 - DNA, 25 bp, Mus musculus
actcattcatgggaaccttcggaaa

SEQ ID NO: 126359 - DNA, 25 bp, Mus musculus
actcattccctacatggcatagaac

SEQ ID NO: 126360 - DNA, 25 bp, Mus musculus
actcattccctagatggcatagaac

SEQ ID NO: 126361 - DNA, 25 bp, Mus musculus
actcattccctgacgtgatcaagaa

SEQ ID NO: 126362 - DNA, 25 bp, Mus musculus
actcattccctgtcgtgatcaagaa

SEQ ID NO: 126363 - DNA, 25 bp, Mus musculus
actcattcccttcctgtggccatag

SEQ ID NO: 126364 - DNA, 25 bp, Mus musculus
actcattcccttgctgtggccatag

SEQ ID NO: 126365 - DNA, 25 bp, Mus musculus
actcattgcagaaaactggccctta

SEQ ID NO: 126366 - DNA, 25 bp, Mus musculus
actcattgcagataactggccctta

SEQ ID NO: 126367 - DNA, 25 bp, Mus musculus
actcattgccgtcggttccatttcc

SEQ ID NO: 126368 - DNA, 25 bp, Mus musculus
actcattgccgtgggttccatttcc

SEQ ID NO: 126369 - DNA, 25 bp, Mus musculus
actcattgctcgcaatgtcagacac

SEQ ID NO: 126370 - DNA, 25 bp, Mus musculus
actcattgctcggaatgtcagacac

SEQ ID NO: 126371 - DNA, 25 bp, Mus musculus
actcattgcttgaggctctgctctg

SEQ ID NO: 126372 - DNA, 25 bp, Mus musculus
actcattgcttgtggctctgctctg

SEQ ID NO: 126373 - DNA, 25 bp, Mus musculus
actcattggttcatcctgacttggt

SEQ ID NO: 126374 - DNA, 25 bp, Mus musculus
actcattggttcttcctgacttggt

SEQ ID NO: 126375 - DNA, 25 bp, Mus musculus
actcattgtaagatgccactaccaa

SEQ ID NO: 126376 - DNA, 25 bp, Mus musculus
actcattgtaagttgccactaccaa

SEQ ID NO: 126377 - DNA, 25 bp, Mus musculus
actcattgtcacctttctttttggc

SEQ ID NO: 126378 - DNA, 25 bp, Mus musculus
actcattgtcacgtttctttttggc

SEQ ID NO: 126379 - DNA, 25 bp, Mus musculus
actcatttatgtacacctcattcac

SEQ ID NO: 126380 - DNA, 25 bp, Mus musculus
actcatttatgttcacctcattcac

SEQ ID NO: 126381 - DNA, 25 bp, Mus musculus
actcatttcacacttagccctaggc

SEQ ID NO: 126382 - DNA, 25 bp, Mus musculus
actcatttcacagttagccctaggc

SEQ ID NO: 126383 - DNA, 25 bp, Mus musculus
actcatttcactaccataccttgga

SEQ ID NO: 126384 - DNA, 25 bp, Mus musculus
actcatttcacttccataccttgga

SEQ ID NO: 126385 - DNA, 25 bp, Mus musculus
actcatttctgaatcatctgaccct

SEQ ID NO: 126386 - DNA, 25 bp, Mus musculus
actcatttctgattcatctgaccct

SEQ ID NO: 126387 - DNA, 25 bp, Mus musculus
actcatttgcagacatttatttcaa

SEQ ID NO: 126388 - DNA, 25 bp, Mus musculus
actcatttgcagtcatttatttcaa

SEQ ID NO: 126389 - DNA, 25 bp, Mus musculus
actcatttgctaactgcctctggag

SEQ ID NO: 126390 - DNA, 25 bp, Mus musculus
actcatttgctatctgcctctggag

SEQ ID NO: 126391 - DNA, 25 bp, Mus musculus
actcatttggttactggtaatttct

SEQ ID NO: 126392 - DNA, 25 bp, Mus musculus
actcatttggtttctggtaatttct

SEQ ID NO: 126393 - DNA, 25 bp, Mus musculus
actcatttgttaagggctgtctcac

SEQ ID NO: 126394 - DNA, 25 bp, Mus musculus
actcatttgttatgggctgtctcac

SEQ ID NO: 126395 - DNA, 25 bp, Mus musculus
actcatttgttcagttgccactaag

SEQ ID NO: 126396 - DNA, 25 bp, Mus musculus
actcatttgttctgttgccactaag

SEQ ID NO: 126397 - DNA, 25 bp, Mus musculus
actcattttcaaattgcctgaccaa

SEQ ID NO: 126398 - DNA, 25 bp, Mus musculus
actcattttcaatttgcctgaccaa

SEQ ID NO: 126399 - DNA, 25 bp, Mus musculus
actcattttcttacactgtgtcttc

SEQ ID NO: 126400 - DNA, 25 bp, Mus musculus
actcattttctttcactgtgtcttc

SEQ ID NO: 126401 - DNA, 25 bp, Mus musculus
actcattttgagaaggagcttcaga

SEQ ID NO: 126402 - DNA, 25 bp, Mus musculus
actcattttgagtaggagcttcaga

SEQ ID NO: 126403 - DNA, 25 bp, Mus musculus
actcatttttacacaacaaggcgga

SEQ ID NO: 126404 - DNA, 25 bp, Mus musculus
actcatttttactcaacaaggcgga

SEQ ID NO: 126405 - DNA, 25 bp, Mus musculus
actcatttttctagacttttctcga

SEQ ID NO: 126406 - DNA, 25 bp, Mus musculus
actcatttttcttgacttttctcga

SEQ ID NO: 126407 - DNA, 25 bp, Mus musculus
actccaaaaggcattggtggctatg

SEQ ID NO: 126408 - DNA, 25 bp, Mus musculus
actccaaaaggctttggtggctatg

SEQ ID NO: 126409 - DNA, 25 bp, Mus musculus
actccaaacaccaagcagaaatgct

SEQ ID NO: 126410 - DNA, 25 bp, Mus musculus
actccaaacacctagcagaaatgct

SEQ ID NO: 126411 - DNA, 25 bp, Mus musculus
actccaaagccaaaggaatttccat

SEQ ID NO: 126412 - DNA, 25 bp, Mus musculus
actccaaagccataggaatttccat

SEQ ID NO: 126413 - DNA, 25 bp, Mus musculus
actccaaaggttacacaacttctca

SEQ ID NO: 126414 - DNA, 25 bp, Mus musculus
actccaaaggtttcacaacttctca

SEQ ID NO: 126415 - DNA, 25 bp, Mus musculus
actccaaatcctagaggtgggtgtt

SEQ ID NO: 126416 - DNA, 25 bp, Mus musculus
actccaaatccttgaggtgggtgtt

SEQ ID NO: 126417 - DNA, 25 bp, Mus musculus
actccaaccattactttgcttttgc

SEQ ID NO: 126418 - DNA, 25 bp, Mus musculus
actccaaccatttctttgcttttgc

SEQ ID NO: 126419 - DNA, 25 bp, Mus musculus
actccaaccgttccagctacattga

SEQ ID NO: 126420 - DNA, 25 bp, Mus musculus
actccaaccgttgcagctacattga

SEQ ID NO: 126421 - DNA, 25 bp, Mus musculus
actccaacgtgaatgaagtccaggg

SEQ ID NO: 126422 - DNA, 25 bp, Mus musculus
actccaacgtgattgaagtccaggg

SEQ ID NO: 126423 - DNA, 25 bp, Mus musculus
actccaactgccctacagatgttag

SEQ ID NO: 126424 - DNA, 25 bp, Mus musculus
actccaactgccgtacagatgttag

SEQ ID NO: 126425 - DNA, 25 bp, Mus musculus
actccaagcctacagcagtgcagga

SEQ ID NO: 126426 - DNA, 25 bp, Mus musculus
actccaagcctagagcagtgcagga

SEQ ID NO: 126427 - DNA, 25 bp, Mus musculus
actccaagtctgctgaggccaagga

SEQ ID NO: 126428 - DNA, 25 bp, Mus musculus
actccaagtctggtgaggccaagga

SEQ ID NO: 126429 - DNA, 25 bp, Mus musculus
actccaagtgaacactaccggtctt

SEQ ID NO: 126430 - DNA, 25 bp, Mus musculus
actccaagtgaagactaccggtctt

SEQ ID NO: 126431 - DNA, 25 bp, Mus musculus
actccaatactaccccaacagaaga

SEQ ID NO: 126432 - DNA, 25 bp, Mus musculus
actccaatactagcccaacagaaga

SEQ ID NO: 126433 - DNA, 25 bp, Mus musculus
actccaatgcctcttctgtatgtgg

SEQ ID NO: 126434 - DNA, 25 bp, Mus musculus
actccaatgcctgttctgtatgtgg

SEQ ID NO: 126435 - DNA, 25 bp, Mus musculus
actccaattgcaacgggcgctctag

SEQ ID NO: 126436 - DNA, 25 bp, Mus musculus
actccaattgcatcgggcgctctag

SEQ ID NO: 126437 - DNA, 25 bp, Mus musculus
actccacaaaccatgtctgtttcaa

SEQ ID NO: 126438 - DNA, 25 bp, Mus musculus
actccacaaaccttgtctgtttcaa

SEQ ID NO: 126439 - DNA, 25 bp, Mus musculus
actccacaaccaaactcagatttac

SEQ ID NO: 126440 - DNA, 25 bp, Mus musculus
actccacaaccatactcagatttac

SEQ ID NO: 126441 - DNA, 25 bp, Mus musculus
actccacaaggcagtaagtcggcaa

SEQ ID NO: 126442 - DNA, 25 bp, Mus musculus
actccacaaggctgtaagtcggcaa

SEQ ID NO: 126443 - DNA, 25 bp, Mus musculus
actccacaatgaattacctcccagg

SEQ ID NO: 126444 - DNA, 25 bp, Mus musculus
actccacaatgatttacctcccagg

SEQ ID NO: 126445 - DNA, 25 bp, Mus musculus
actccacacaatctaggtccgttct

SEQ ID NO: 126446 - DNA, 25 bp, Mus musculus
actccacacaatgtaggtccgttct

SEQ ID NO: 126447 - DNA, 25 bp, Mus musculus
actccacacgagaggctcacaatat

SEQ ID NO: 126448 - DNA, 25 bp, Mus musculus
actccacacgagtggctcacaatat

SEQ ID NO: 126449 - DNA, 25 bp, Mus musculus
actccacatactatcagttcagaat

SEQ ID NO: 126450 - DNA, 25 bp, Mus musculus
actccacatactttcagttcagaat

SEQ ID NO: 126451 - DNA, 25 bp, Mus musculus
actccacatcctaatgccgtttagg

SEQ ID NO: 126452 - DNA, 25 bp, Mus musculus
actccacatccttatgccgtttagg

SEQ ID NO: 126453 - DNA, 25 bp, Mus musculus
actccacatggactgcagttcttgt

SEQ ID NO: 126454 - DNA, 25 bp, Mus musculus
actccacatggagtgcagttcttgt

SEQ ID NO: 126455 - DNA, 25 bp, Mus musculus
actccacatgtcaccaggcgagtag

SEQ ID NO: 126456 - DNA, 25 bp, Mus musculus
actccacatgtctccaggcgagtag

SEQ ID NO: 126457 - DNA, 25 bp, Mus musculus
actccacatttaaacttgatctcta

SEQ ID NO: 126458 - DNA, 25 bp, Mus musculus
actccacatttatacttgatctcta

SEQ ID NO: 126459 - DNA, 25 bp, Mus musculus
actccaccagctacttataatgcag

SEQ ID NO: 126460 - DNA, 25 bp, Mus musculus
actccaccagcttcttataatgcag

SEQ ID NO: 126461 - DNA, 25 bp, Mus musculus
actccaccctagatctcgcatggtt

SEQ ID NO: 126462 - DNA, 25 bp, Mus musculus
actccaccctagttctcgcatggtt

SEQ ID NO: 126463 - DNA, 25 bp, Mus musculus
actccacctcacatgaagtacctat

SEQ ID NO: 126464 - DNA, 25 bp, Mus musculus
actccacctcacttgaagtacctat

SEQ ID NO: 126465 - DNA, 25 bp, Mus musculus
actccacctccacctgtaggcagag

SEQ ID NO: 126466 - DNA, 25 bp, Mus musculus
actccacctccagctgtaggcagag

SEQ ID NO: 126467 - DNA, 25 bp, Mus musculus
actccacgggacatgggtctgggac

SEQ ID NO: 126468 - DNA, 25 bp, Mus musculus
actccacgggacttgggtctgggac

SEQ ID NO: 126469 - DNA, 25 bp, Mus musculus
actccacggtgcattcctaatggtg

SEQ ID NO: 126470 - DNA, 25 bp, Mus musculus
actccacggtgctttcctaatggtg

SEQ ID NO: 126471 - DNA, 25 bp, Mus musculus
actccacgtactcaagaggcggctt

SEQ ID NO: 126472 - DNA, 25 bp, Mus musculus
actccacgtactgaagaggcggctt

SEQ ID NO: 126473 - DNA, 25 bp, Mus musculus
actccactacccactgtatattaga

SEQ ID NO: 126474 - DNA, 25 bp, Mus musculus
actccactaccctctgtatattaga

SEQ ID NO: 126475 - DNA, 25 bp, Mus musculus
actccactagtgcatgaaggcactt

SEQ ID NO: 126476 - DNA, 25 bp, Mus musculus
actccactagtggatgaaggcactt

SEQ ID NO: 126477 - DNA, 25 bp, Mus musculus
actccactctgtacttctacaatgt

SEQ ID NO: 126478 - DNA, 25 bp, Mus musculus
actccactctgttcttctacaatgt

SEQ ID NO: 126479 - DNA, 25 bp, Mus musculus
actccactgagtagccctcgaatac

SEQ ID NO: 126480 - DNA, 25 bp, Mus musculus
actccactgagttgccctcgaatac

SEQ ID NO: 126481 - DNA, 25 bp, Mus musculus
actccactgattcccaaatctgtgt

SEQ ID NO: 126482 - DNA, 25 bp, Mus musculus
actccactgattgccaaatctgtgt

SEQ ID NO: 126483 - DNA, 25 bp, Mus musculus
actccactgccccattgtcataaag

SEQ ID NO: 126484 - DNA, 25 bp, Mus musculus
actccactgcccgattgtcataaag

SEQ ID NO: 126485 - DNA, 25 bp, Mus musculus
actccactggagaatgtaataacaa

SEQ ID NO: 126486 - DNA, 25 bp, Mus musculus
actccactggagtatgtaataacaa

SEQ ID NO: 126487 - DNA, 25 bp, Mus musculus
actccactgtgccactgaagtttat

SEQ ID NO: 126488 - DNA, 25 bp, Mus musculus
actccactgtgcgactgaagtttat

SEQ ID NO: 126489 - DNA, 25 bp, Mus musculus
actccactgtttaacctgcataact

SEQ ID NO: 126490 - DNA, 25 bp, Mus musculus
actccactgttttacctgcataact

SEQ ID NO: 126491 - DNA, 25 bp, Mus musculus
actccacttaccatgtgcatttttg

SEQ ID NO: 126492 - DNA, 25 bp, Mus musculus
actccacttaccttgtgcatttttg

SEQ ID NO: 126493 - DNA, 25 bp, Mus musculus
actccagaatccaagcgggcatatt

SEQ ID NO: 126494 - DNA, 25 bp, Mus musculus
actccagaatcctagcgggcatatt

SEQ ID NO: 126495 - DNA, 25 bp, Mus musculus
actccagacagcagctcatcaggga

SEQ ID NO: 126496 - DNA, 25 bp, Mus musculus
actccagacagctgctcatcaggga

SEQ ID NO: 126497 - DNA, 25 bp, Mus musculus
actccagaggtacttgggccagcca

SEQ ID NO: 126498 - DNA, 25 bp, Mus musculus
actccagaggtagttgggccagcca

SEQ ID NO: 126499 - DNA, 25 bp, Mus musculus
actccagagtcaattccatagcact

SEQ ID NO: 126500 - DNA, 25 bp, Mus musculus
actccagagtcatttccatagcact

SEQ ID NO: 126501 - DNA, 25 bp, Mus musculus
actccagatcacagtggctcacgtc

SEQ ID NO: 126502 - DNA, 25 bp, Mus musculus
actccagatcactgtggctcacgtc

SEQ ID NO: 126503 - DNA, 25 bp, Mus musculus
actccagatctaagaccaagcacct

SEQ ID NO: 126504 - DNA, 25 bp, Mus musculus
actccagatctatgaccaagcacct

SEQ ID NO: 126505 - DNA, 25 bp, Mus musculus
actccagatggtatcttcccatttt

SEQ ID NO: 126506 - DNA, 25 bp, Mus musculus
actccagatggtttcttcccatttt

SEQ ID NO: 126507 - DNA, 25 bp, Mus musculus
actccagcactcctaagaacttatt

SEQ ID NO: 126508 - DNA, 25 bp, Mus musculus
actccagcactcgtaagaacttatt

SEQ ID NO: 126509 - DNA, 25 bp, Mus musculus
actccagcagttccagtggaggttt

SEQ ID NO: 126510 - DNA, 25 bp, Mus musculus
actccagcagttgcagtggaggttt

SEQ ID NO: 126511 - DNA, 25 bp, Mus musculus
actccagcatacctgagtctggtct

SEQ ID NO: 126512 - DNA, 25 bp, Mus musculus
actccagcatacgtgagtctggtct

SEQ ID NO: 126513 - DNA, 25 bp, Mus musculus
actccagccaccatttctttaggca

SEQ ID NO: 126514 - DNA, 25 bp, Mus musculus
actccagccaccttttctttaggca

SEQ ID NO: 126515 - DNA, 25 bp, Mus musculus
actccagcgagaatatgtacaccat

SEQ ID NO: 126516 - DNA, 25 bp, Mus musculus
actccagcgagattatgtacaccat

SEQ ID NO: 126517 - DNA, 25 bp, Mus musculus
actccagcgtccaaggaagagtcta

SEQ ID NO: 126518 - DNA, 25 bp, Mus musculus
actccagcgtcctaggaagagtcta

SEQ ID NO: 126519 - DNA, 25 bp, Mus musculus
actccagctgcccatgttcaattgg

SEQ ID NO: 126520 - DNA, 25 bp, Mus musculus
actccagctgccgatgttcaattgg

SEQ ID NO: 126521 - DNA, 25 bp, Mus musculus
actccaggactaccaagtgtaacgt

SEQ ID NO: 126522 - DNA, 25 bp, Mus musculus
actccaggactagcaagtgtaacgt

SEQ ID NO: 126523 - DNA, 25 bp, Mus musculus
actccaggactgaatttgtgactaa

SEQ ID NO: 126524 - DNA, 25 bp, Mus musculus
actccaggactgtatttgtgactaa

SEQ ID NO: 126525 - DNA, 25 bp, Mus musculus
actccaggccatcgataagaggctg

SEQ ID NO: 126526 - DNA, 25 bp, Mus musculus
actccaggccatggataagaggctg

SEQ ID NO: 126527 - DNA, 25 bp, Mus musculus
actccaggcccaactttataactgt

SEQ ID NO: 126528 - DNA, 25 bp, Mus musculus
actccaggcccatctttataactgt

SEQ ID NO: 126529 - DNA, 25 bp, Mus musculus
actccaggcgctccaagcagtgaga

SEQ ID NO: 126530 - DNA, 25 bp, Mus musculus
actccaggcgctgcaagcagtgaga

SEQ ID NO: 126531 - DNA, 25 bp, Mus musculus
actccaggctggctctgccactgag

SEQ ID NO: 126532 - DNA, 25 bp, Mus musculus
actccaggctgggtctgccactgag

SEQ ID NO: 126533 - DNA, 25 bp, Mus musculus
actccagggctaccatgtagtagta

SEQ ID NO: 126534 - DNA, 25 bp, Mus musculus
actccagggctagcatgtagtagta

SEQ ID NO: 126535 - DNA, 25 bp, Mus musculus
actccagggctcctcacaacagggt

SEQ ID NO: 126536 - DNA, 25 bp, Mus musculus
actccagggctcgtcacaacagggt

SEQ ID NO: 126537 - DNA, 25 bp, Mus musculus
actccagggcttacaaccactgtgg

SEQ ID NO: 126538 - DNA, 25 bp, Mus musculus
actccagggctttcaaccactgtgg

SEQ ID NO: 126539 - DNA, 25 bp, Mus musculus
actccaggtagcacactagggcaat

SEQ ID NO: 126540 - DNA, 25 bp, Mus musculus
actccaggtagctcactagggcaat

SEQ ID NO: 126541 - DNA, 25 bp, Mus musculus
actccaggtccaagttgtcagatta

SEQ ID NO: 126542 - DNA, 25 bp, Mus musculus
actccaggtccatgttgtcagatta

SEQ ID NO: 126543 - DNA, 25 bp, Mus musculus
actccaggtcctctgcgcctgagga

SEQ ID NO: 126544 - DNA, 25 bp, Mus musculus
actccaggtcctgtgcgcctgagga

SEQ ID NO: 126545 - DNA, 25 bp, Mus musculus
actccaggtgccaagctgtgattgc

SEQ ID NO: 126546 - DNA, 25 bp, Mus musculus
actccaggtgcctagctgtgattgc

SEQ ID NO: 126547 - DNA, 25 bp, Mus musculus
actccaggttagaagggcacaggtg

SEQ ID NO: 126548 - DNA, 25 bp, Mus musculus
actccaggttagtagggcacaggtg

SEQ ID NO: 126549 - DNA, 25 bp, Mus musculus
actccagtatacagaactcgcccaa

SEQ ID NO: 126550 - DNA, 25 bp, Mus musculus
actccagtatactgaactcgcccaa

SEQ ID NO: 126551 - DNA, 25 bp, Mus musculus
actccagtatccaacacagtcattc

SEQ ID NO: 126552 - DNA, 25 bp, Mus musculus
actccagtatcctacacagtcattc

SEQ ID NO: 126553 - DNA, 25 bp, Mus musculus
actccagtcagaattggcagcggtt

SEQ ID NO: 126554 - DNA, 25 bp, Mus musculus
actccagtcagatttggcagcggtt

SEQ ID NO: 126555 - DNA, 25 bp, Mus musculus
actccagtccctccaagagaagctt

SEQ ID NO: 126556 - DNA, 25 bp, Mus musculus
actccagtccctgcaagagaagctt

SEQ ID NO: 126557 - DNA, 25 bp, Mus musculus
actccagtcgggagtcattgtaact

SEQ ID NO: 126558 - DNA, 25 bp, Mus musculus
actccagtcgggtgtcattgtaact

SEQ ID NO: 126559 - DNA, 25 bp, Mus musculus
actccagtgaccctacttttagtgg

SEQ ID NO: 126560 - DNA, 25 bp, Mus musculus
actccagtgaccgtacttttagtgg

SEQ ID NO: 126561 - DNA, 25 bp, Mus musculus
actccagtgcaaatgtacacacaca

SEQ ID NO: 126562 - DNA, 25 bp, Mus musculus
actccagtgcaattgtacacacaca

SEQ ID NO: 126563 - DNA, 25 bp, Mus musculus
actccagtgcggcagagttctgtca

SEQ ID NO: 126564 - DNA, 25 bp, Mus musculus
actccagtgcgggagagttctgtca

SEQ ID NO: 126565 - DNA, 25 bp, Mus musculus
actccagtggagagctcatgttcct

SEQ ID NO: 126566 - DNA, 25 bp, Mus musculus
actccagtggagtgctcatgttcct

SEQ ID NO: 126567 - DNA, 25 bp, Mus musculus
actccagtgggaagggtcaagccct

SEQ ID NO: 126568 - DNA, 25 bp, Mus musculus
actccagtgggatgggtcaagccct

SEQ ID NO: 126569 - DNA, 25 bp, Mus musculus
actccagtgggcacccaagattcac

SEQ ID NO: 126570 - DNA, 25 bp, Mus musculus
actccagtgggctcccaagattcac

SEQ ID NO: 126571 - DNA, 25 bp, Mus musculus
actccagtgggtatccaagttcagt

SEQ ID NO: 126572 - DNA, 25 bp, Mus musculus
actccagtgggtttccaagttcagt

SEQ ID NO: 126573 - DNA, 25 bp, Mus musculus
actccagtggtcatttctagaccat

SEQ ID NO: 126574 - DNA, 25 bp, Mus musculus
actccagtggtcttttctagaccat

SEQ ID NO: 126575 - DNA, 25 bp, Mus musculus
actccagttattatcagcccttgaa

SEQ ID NO: 126576 - DNA, 25 bp, Mus musculus
actccagttattttcagcccttgaa

SEQ ID NO: 126577 - DNA, 25 bp, Mus musculus
actccagttctgatgggtagactct

SEQ ID NO: 126578 - DNA, 25 bp, Mus musculus
actccagttctgttgggtagactct

SEQ ID NO: 126579 - DNA, 25 bp, Mus musculus
actccagttcttatgtatgttgatg

SEQ ID NO: 126580 - DNA, 25 bp, Mus musculus
actccagttcttttgtatgttgatg

SEQ ID NO: 126581 - DNA, 25 bp, Mus musculus
actccagtttcacgacacgatgtcc

SEQ ID NO: 126582 - DNA, 25 bp, Mus musculus
actccagtttcaggacacgatgtcc

SEQ ID NO: 126583 - DNA, 25 bp, Mus musculus
actccagtttgcaactgcacgtgaa

SEQ ID NO: 126584 - DNA, 25 bp, Mus musculus
actccagtttgcaggatctacctta

SEQ ID NO: 126585 - DNA, 25 bp, Mus musculus
actccagtttgctactgcacgtgaa

SEQ ID NO: 126586 - DNA, 25 bp, Mus musculus
actccagtttgctggatctacctta

SEQ ID NO: 126587 - DNA, 25 bp, Mus musculus
actccatacagtcaagtccatattt

SEQ ID NO: 126588 - DNA, 25 bp, Mus musculus
actccatacagtgaagtccatattt

SEQ ID NO: 126589 - DNA, 25 bp, Mus musculus
actccatacctcacagctagaataa

SEQ ID NO: 126590 - DNA, 25 bp, Mus musculus
actccatacctctcagctagaataa

SEQ ID NO: 126591 - DNA, 25 bp, Mus musculus
actccatagctcagcatatctgcat

SEQ ID NO: 126592 - DNA, 25 bp, Mus musculus
actccatagctctgcatatctgcat

SEQ ID NO: 126593 - DNA, 25 bp, Mus musculus
actccatatgatatagggctcctcc

SEQ ID NO: 126594 - DNA, 25 bp, Mus musculus
actccatatgatttagggctcctcc

SEQ ID NO: 126595 - DNA, 25 bp, Mus musculus
actccatcaaccatgtgtgcatgtg

SEQ ID NO: 126596 - DNA, 25 bp, Mus musculus
actccatcaaccttgtgtgcatgtg

SEQ ID NO: 126597 - DNA, 25 bp, Mus musculus
actccatcaccaaaccagcagaaga

SEQ ID NO: 126598 - DNA, 25 bp, Mus musculus
actccatcaccataccagcagaaga

SEQ ID NO: 126599 - DNA, 25 bp, Mus musculus
actccatcacccacttatatttatt

SEQ ID NO: 126600 - DNA, 25 bp, Mus musculus
actccatcaccctcttatatttatt

SEQ ID NO: 126601 - DNA, 25 bp, Mus musculus
actccatcactgacgataactgcaa

SEQ ID NO: 126602 - DNA, 25 bp, Mus musculus
actccatcactgtcgataactgcaa

SEQ ID NO: 126603 - DNA, 25 bp, Mus musculus
actccatccagcactgtgtgggaaa

SEQ ID NO: 126604 - DNA, 25 bp, Mus musculus
actccatccagctctgtgtgggaaa

SEQ ID NO: 126605 - DNA, 25 bp, Mus musculus
actccatccctgagaactgtagctg

SEQ ID NO: 126606 - DNA, 25 bp, Mus musculus
actccatccctgtgaactgtagctg

SEQ ID NO: 126607 - DNA, 25 bp, Mus musculus
actccatcctccatatgaaagcgtt

SEQ ID NO: 126608 - DNA, 25 bp, Mus musculus
actccatcctccttatgaaagcgtt

SEQ ID NO: 126609 - DNA, 25 bp, Mus musculus
actccatcctgcagagtttgctgga

SEQ ID NO: 126610 - DNA, 25 bp, Mus musculus
actccatcctgctgagtttgctgga

SEQ ID NO: 126611 - DNA, 25 bp, Mus musculus
actccatcgaccagggtgcagagga

SEQ ID NO: 126612 - DNA, 25 bp, Mus musculus
actccatcgacctgggtgcagagga

SEQ ID NO: 126613 - DNA, 25 bp, Mus musculus
actccatctatgaagtgctgtgttg

SEQ ID NO: 126614 - DNA, 25 bp, Mus musculus
actccatctatgtagtgctgtgttg

SEQ ID NO: 126615 - DNA, 25 bp, Mus musculus
actccatctctaaacagagtgagtg

SEQ ID NO: 126616 - DNA, 25 bp, Mus musculus
actccatctctatacagagtgagtg

SEQ ID NO: 126617 - DNA, 25 bp, Mus musculus
actccatctgcacttaccgggattc

SEQ ID NO: 126618 - DNA, 25 bp, Mus musculus
actccatctgcagttaccgggattc

SEQ ID NO: 126619 - DNA, 25 bp, Mus musculus
actccatctggacacctactggtag

SEQ ID NO: 126620 - DNA, 25 bp, Mus musculus
actccatctggagacctactggtag

SEQ ID NO: 126621 - DNA, 25 bp, Mus musculus
actccatctgttagcatctacggaa

SEQ ID NO: 126622 - DNA, 25 bp, Mus musculus
actccatctgtttgcatctacggaa

SEQ ID NO: 126623 - DNA, 25 bp, Mus musculus
actccatgactgacctttagctttg

SEQ ID NO: 126624 - DNA, 25 bp, Mus musculus
actccatgactgtcctttagctttg

SEQ ID NO: 126625 - DNA, 25 bp, Mus musculus
actccatgacttcactcccaattga

SEQ ID NO: 126626 - DNA, 25 bp, Mus musculus
actccatgacttgactcccaattga

SEQ ID NO: 126627 - DNA, 25 bp, Mus musculus
actccatgagccagcagtggcgacc

SEQ ID NO: 126628 - DNA, 25 bp, Mus musculus
actccatgagcctgcagtggcgacc

SEQ ID NO: 126629 - DNA, 25 bp, Mus musculus
actccatgagtgaaactgtgcggct

SEQ ID NO: 126630 - DNA, 25 bp, Mus musculus
actccatgagtgtaactgtgcggct

SEQ ID NO: 126631 - DNA, 25 bp, Mus musculus
actccatgatccatcgttttacgac

SEQ ID NO: 126632 - DNA, 25 bp, Mus musculus
actccatgatccttcgttttacgac

SEQ ID NO: 126633 - DNA, 25 bp, Mus musculus
actccatgcacacatacggcttggg

SEQ ID NO: 126634 - DNA, 25 bp, Mus musculus
actccatgcacagatacggcttggg

SEQ ID NO: 126635 - DNA, 25 bp, Mus musculus
actccatgcaggagcggactttgct

SEQ ID NO: 126636 - DNA, 25 bp, Mus musculus
actccatgcaggtgcggactttgct

SEQ ID NO: 126637 - DNA, 25 bp, Mus musculus
actccatgccagatccatcataaga

SEQ ID NO: 126638 - DNA, 25 bp, Mus musculus
actccatgccagttccatcataaga

SEQ ID NO: 126639 - DNA, 25 bp, Mus musculus
actccatgcctgagtagtcatcata

SEQ ID NO: 126640 - DNA, 25 bp, Mus musculus
actccatgcctgtgtagtcatcata

SEQ ID NO: 126641 - DNA, 25 bp, Mus musculus
actccatgctttccaaaaggcttag

SEQ ID NO: 126642 - DNA, 25 bp, Mus musculus
actccatgctttgcaaaaggcttag

SEQ ID NO: 126643 - DNA, 25 bp, Mus musculus
actccatggcgactctctagaaggc

SEQ ID NO: 126644 - DNA, 25 bp, Mus musculus
actccatggcgagtctctagaaggc

SEQ ID NO: 126645 - DNA, 25 bp, Mus musculus
actccatggcggctgctggttcaga

SEQ ID NO: 126646 - DNA, 25 bp, Mus musculus
actccatggcgggtgctggttcaga

SEQ ID NO: 126647 - DNA, 25 bp, Mus musculus
actccatgtggaaacccctgaacta

SEQ ID NO: 126648 - DNA, 25 bp, Mus musculus
actccatgtggacaccgtggcggaa

SEQ ID NO: 126649 - DNA, 25 bp, Mus musculus
actccatgtggagaccgtggcggaa

SEQ ID NO: 126650 - DNA, 25 bp, Mus musculus
actccatgtggatacccctgaacta

SEQ ID NO: 126651 - DNA, 25 bp, Mus musculus
actccattaagtcggtgaaactgtg

SEQ ID NO: 126652 - DNA, 25 bp, Mus musculus
actccattaagtgggtgaaactgtg

SEQ ID NO: 126653 - DNA, 25 bp, Mus musculus
actccattcagacagtctgagtcat

SEQ ID NO: 126654 - DNA, 25 bp, Mus musculus
actccattcagagagtctgagtcat

SEQ ID NO: 126655 - DNA, 25 bp, Mus musculus
actccattcaggctgtgtgatatat

SEQ ID NO: 126656 - DNA, 25 bp, Mus musculus
actccattcagggtgtgtgatatat

SEQ ID NO: 126657 - DNA, 25 bp, Mus musculus
actccattccgaagccaaccttgat

SEQ ID NO: 126658 - DNA, 25 bp, Mus musculus
actccattccgatgccaaccttgat

SEQ ID NO: 126659 - DNA, 25 bp, Mus musculus
actccattgattctgctgcccacag

SEQ ID NO: 126660 - DNA, 25 bp, Mus musculus
actccattgattgtgctgcccacag

SEQ ID NO: 126661 - DNA, 25 bp, Mus musculus
actccattgcttcatgtacaccaga

SEQ ID NO: 126662 - DNA, 25 bp, Mus musculus
actccattgcttgatgtacaccaga

SEQ ID NO: 126663 - DNA, 25 bp, Mus musculus
actccattgtcaactcaatttccag

SEQ ID NO: 126664 - DNA, 25 bp, Mus musculus
actccattgtcatctcaatttccag

SEQ ID NO: 126665 - DNA, 25 bp, Mus musculus
actccattgttgagtttgtctgtca

SEQ ID NO: 126666 - DNA, 25 bp, Mus musculus
actccattgttgtgtttgtctgtca

SEQ ID NO: 126667 - DNA, 25 bp, Mus musculus
actccatttacccatcaagccagta

SEQ ID NO: 126668 - DNA, 25 bp, Mus musculus
actccatttaccgatcaagccagta

SEQ ID NO: 126669 - DNA, 25 bp, Mus musculus
actccatttcctctctctgtaagag

SEQ ID NO: 126670 - DNA, 25 bp, Mus musculus
actccatttcctgtctctgtaagag

SEQ ID NO: 126671 - DNA, 25 bp, Mus musculus
actccatttgagctaggatccgggt

SEQ ID NO: 126672 - DNA, 25 bp, Mus musculus
actccatttgaggtaggatccgggt

SEQ ID NO: 126673 - DNA, 25 bp, Mus musculus
actccatttgggactgtattgtata

SEQ ID NO: 126674 - DNA, 25 bp, Mus musculus
actccatttgggtctgtattgtata

SEQ ID NO: 126675 - DNA, 25 bp, Mus musculus
actccattttacatacgaatcccaa

SEQ ID NO: 126676 - DNA, 25 bp, Mus musculus
actccattttacttacgaatcccaa

SEQ ID NO: 126677 - DNA, 25 bp, Mus musculus
actccattttccaccattatacaag

SEQ ID NO: 126678 - DNA, 25 bp, Mus musculus
actccattttcctccattatacaag

SEQ ID NO: 126679 - DNA, 25 bp, Mus musculus
actcccaaaagcaactctgttggtt

SEQ ID NO: 126680 - DNA, 25 bp, Mus musculus
actcccaaaagctactctgttggtt

SEQ ID NO: 126681 - DNA, 25 bp, Mus musculus
actcccaaaatcatcagactgcagg

SEQ ID NO: 126682 - DNA, 25 bp, Mus musculus
actcccaaaatcttcagactgcagg

SEQ ID NO: 126683 - DNA, 25 bp, Mus musculus
actcccaaacctattcagtgtcatt

SEQ ID NO: 126684 - DNA, 25 bp, Mus musculus
actcccaaaccttttcagtgtcatt

SEQ ID NO: 126685 - DNA, 25 bp, Mus musculus
actcccaacccaagttttcatgaat

SEQ ID NO: 126686 - DNA, 25 bp, Mus musculus
actcccaacccatgttttcatgaat

SEQ ID NO: 126687 - DNA, 25 bp, Mus musculus
actcccaaccctagttaggcttgtg

SEQ ID NO: 126688 - DNA, 25 bp, Mus musculus
actcccaacccttgttaggcttgtg

SEQ ID NO: 126689 - DNA, 25 bp, Mus musculus
actcccaatgctatttagtgtgtga

SEQ ID NO: 126690 - DNA, 25 bp, Mus musculus
actcccaatgctttttagtgtgtga

SEQ ID NO: 126691 - DNA, 25 bp, Mus musculus
actcccacaccgacttgatgacaag

SEQ ID NO: 126692 - DNA, 25 bp, Mus musculus
actcccacaccgtcttgatgacaag

SEQ ID NO: 126693 - DNA, 25 bp, Mus musculus
actcccacaggaccgtgcatgcaga

SEQ ID NO: 126694 - DNA, 25 bp, Mus musculus
actcccacaggagcgtgcatgcaga

SEQ ID NO: 126695 - DNA, 25 bp, Mus musculus
actcccacagtgcatctacatgatg

SEQ ID NO: 126696 - DNA, 25 bp, Mus musculus
actcccacagtggatctacatgatg

SEQ ID NO: 126697 - DNA, 25 bp, Mus musculus
actcccacatgtctctattcagtta

SEQ ID NO: 126698 - DNA, 25 bp, Mus musculus
actcccacatgtgtctattcagtta

SEQ ID NO: 126699 - DNA, 25 bp, Mus musculus
actcccacattgatgtttatgtcat

SEQ ID NO: 126700 - DNA, 25 bp, Mus musculus
actcccacattgttgtttatgtcat

SEQ ID NO: 126701 - DNA, 25 bp, Mus musculus
actcccacggctaggctttgatgct

SEQ ID NO: 126702 - DNA, 25 bp, Mus musculus
actcccacggcttggctttgatgct

SEQ ID NO: 126703 - DNA, 25 bp, Mus musculus
actcccacggtgagcctgggaaggt

SEQ ID NO: 126704 - DNA, 25 bp, Mus musculus
actcccacggtgtgcctgggaaggt

SEQ ID NO: 126705 - DNA, 25 bp, Mus musculus
actcccactggaagctagagtccaa

SEQ ID NO: 126706 - DNA, 25 bp, Mus musculus
actcccactggatgctagagtccaa

SEQ ID NO: 126707 - DNA, 25 bp, Mus musculus
actcccacttttacacctttgatgc

SEQ ID NO: 126708 - DNA, 25 bp, Mus musculus
actcccactttttcacctttgatgc

SEQ ID NO: 126709 - DNA, 25 bp, Mus musculus
actcccagactgctgaggtaactac

SEQ ID NO: 126710 - DNA, 25 bp, Mus musculus
actcccagactggtgaggtaactac

SEQ ID NO: 126711 - DNA, 25 bp, Mus musculus
actcccagagccagtttggtagaca

SEQ ID NO: 126712 - DNA, 25 bp, Mus musculus
actcccagagcctgtttggtagaca

SEQ ID NO: 126713 - DNA, 25 bp, Mus musculus
actcccagaggactcacaggttgaa

SEQ ID NO: 126714 - DNA, 25 bp, Mus musculus
actcccagaggagtcacaggttgaa

SEQ ID NO: 126715 - DNA, 25 bp, Mus musculus
actcccagcatgcaagtggccacaa

SEQ ID NO: 126716 - DNA, 25 bp, Mus musculus
actcccagcatggaagtggccacaa

SEQ ID NO: 126717 - DNA, 25 bp, Mus musculus
actcccagccatagacagttgcaaa

SEQ ID NO: 126718 - DNA, 25 bp, Mus musculus
actcccagccattgacagttgcaaa

SEQ ID NO: 126719 - DNA, 25 bp, Mus musculus
actcccagcctaaccattttgatgt

SEQ ID NO: 126720 - DNA, 25 bp, Mus musculus
actcccagcctatccattttgatgt

SEQ ID NO: 126721 - DNA, 25 bp, Mus musculus
actcccagctcactgattttctata

SEQ ID NO: 126722 - DNA, 25 bp, Mus musculus
actcccagctcagtgattttctata

SEQ ID NO: 126723 - DNA, 25 bp, Mus musculus
actcccaggagccaagtcaggcaca

SEQ ID NO: 126724 - DNA, 25 bp, Mus musculus
actcccaggagcgaagtcaggcaca

SEQ ID NO: 126725 - DNA, 25 bp, Mus musculus
actcccagtgggagggctccgacgc

SEQ ID NO: 126726 - DNA, 25 bp, Mus musculus
actcccagtgggtgggctccgacgc

SEQ ID NO: 126727 - DNA, 25 bp, Mus musculus
actcccagtgtgctggtccacgtgt

SEQ ID NO: 126728 - DNA, 25 bp, Mus musculus
actcccagtgtggtggtccacgtgt

SEQ ID NO: 126729 - DNA, 25 bp, Mus musculus
actcccatagcgctctgtaaacatg

SEQ ID NO: 126730 - DNA, 25 bp, Mus musculus
actcccatagcggtctgtaaacatg

SEQ ID NO: 126731 - DNA, 25 bp, Mus musculus
actcccatcagtagctgaatgaagt

SEQ ID NO: 126732 - DNA, 25 bp, Mus musculus
actcccatcagttgctgaatgaagt

SEQ ID NO: 126733 - DNA, 25 bp, Mus musculus
actcccatccagcaagtctgcgtgg

SEQ ID NO: 126734 - DNA, 25 bp, Mus musculus
actcccatccaggaagtctgcgtgg

SEQ ID NO: 126735 - DNA, 25 bp, Mus musculus
actcccatccctagatctttgggaa

SEQ ID NO: 126736 - DNA, 25 bp, Mus musculus
actcccatcccttgatctttgggaa

SEQ ID NO: 126737 - DNA, 25 bp, Mus musculus
actcccatgccaaggtctgtgatct

SEQ ID NO: 126738 - DNA, 25 bp, Mus musculus
actcccatgccatggtctgtgatct

SEQ ID NO: 126739 - DNA, 25 bp, Mus musculus
actcccattctgagtattatatccc

SEQ ID NO: 126740 - DNA, 25 bp, Mus musculus
actcccattctgtgtattatatccc

SEQ ID NO: 126741 - DNA, 25 bp, Mus musculus
actcccattgtaaactctgtgtctt

SEQ ID NO: 126742 - DNA, 25 bp, Mus musculus
actcccattgtatactctgtgtctt

SEQ ID NO: 126743 - DNA, 25 bp, Mus musculus
actccccaaaaacgccttgcatgaa

SEQ ID NO: 126744 - DNA, 25 bp, Mus musculus
actccccaaaaaggccttgcatgaa

SEQ ID NO: 126745 - DNA, 25 bp, Mus musculus
actccccaagctccagtgagtaaga

SEQ ID NO: 126746 - DNA, 25 bp, Mus musculus
actccccaagctgcagtgagtaaga

SEQ ID NO: 126747 - DNA, 25 bp, Mus musculus
actccccacattctgatcttgtaag

SEQ ID NO: 126748 - DNA, 25 bp, Mus musculus
actccccacattgtgatcttgtaag

SEQ ID NO: 126749 - DNA, 25 bp, Mus musculus
actccccacgctcatgcaaggatta

SEQ ID NO: 126750 - DNA, 25 bp, Mus musculus
actccccacgctgatgcaaggatta

SEQ ID NO: 126751 - DNA, 25 bp, Mus musculus
actccccagactcctatgaatatag

SEQ ID NO: 126752 - DNA, 25 bp, Mus musculus
actccccagactgctatgaatatag

SEQ ID NO: 126753 - DNA, 25 bp, Mus musculus
actccccagagaatctacccaaggg

SEQ ID NO: 126754 - DNA, 25 bp, Mus musculus
actccccagagattctacccaaggg

SEQ ID NO: 126755 - DNA, 25 bp, Mus musculus
actccccagcggagagcatgatccg

SEQ ID NO: 126756 - DNA, 25 bp, Mus musculus
actccccagcggtgagcatgatccg

SEQ ID NO: 126757 - DNA, 25 bp, Mus musculus
actccccagtggacctgtagtggaa

SEQ ID NO: 126758 - DNA, 25 bp, Mus musculus
actccccagtggtcctgtagtggaa

SEQ ID NO: 126759 - DNA, 25 bp, Mus musculus
actccccatcgtatagttctgtaga

SEQ ID NO: 126760 - DNA, 25 bp, Mus musculus
actccccatcgtttagttctgtaga

SEQ ID NO: 126761 - DNA, 25 bp, Mus musculus
actccccattcaaggtttcctaatg

SEQ ID NO: 126762 - DNA, 25 bp, Mus musculus
actccccattcatggtttcctaatg

SEQ ID NO: 126763 - DNA, 25 bp, Mus musculus
actcccctaaagatatgctgtaccc

SEQ ID NO: 126764 - DNA, 25 bp, Mus musculus
actcccctaaagttatgctgtaccc

SEQ ID NO: 126765 - DNA, 25 bp, Mus musculus
actcccctgagcagtcttttggtct

SEQ ID NO: 126766 - DNA, 25 bp, Mus musculus
actcccctgagctgtcttttggtct

SEQ ID NO: 126767 - DNA, 25 bp, Mus musculus
actcccctgcatcatgcggtgatga

SEQ ID NO: 126768 - DNA, 25 bp, Mus musculus
actcccctgcatgatgcggtgatga

SEQ ID NO: 126769 - DNA, 25 bp, Mus musculus
actcccctgggaactgaacaataga

SEQ ID NO: 126770 - DNA, 25 bp, Mus musculus
actcccctgggatctgaacaataga

SEQ ID NO: 126771 - DNA, 25 bp, Mus musculus
actccccttctgaggacagttttat

SEQ ID NO: 126772 - DNA, 25 bp, Mus musculus
actccccttctgtggacagttttat

SEQ ID NO: 126773 - DNA, 25 bp, Mus musculus
actcccgcatatatcaaccgtatag

SEQ ID NO: 126774 - DNA, 25 bp, Mus musculus
actcccgcatatttcaaccgtatag

SEQ ID NO: 126775 - DNA, 25 bp, Mus musculus
actcccgccggaagggtgtgtacca

SEQ ID NO: 126776 - DNA, 25 bp, Mus musculus
actcccgccggatgggtgtgtacca

SEQ ID NO: 126777 - DNA, 25 bp, Mus musculus
actcccgctcatacaattgatctag

SEQ ID NO: 126778 - DNA, 25 bp, Mus musculus
actcccgctcattcaattgatctag

SEQ ID NO: 126779 - DNA, 25 bp, Mus musculus
actcccgctctgaccagtggaggga

SEQ ID NO: 126780 - DNA, 25 bp, Mus musculus
actcccgctctgtccagtggaggga

SEQ ID NO: 126781 - DNA, 25 bp, Mus musculus
actcccggacgaactgtgtgaatat

SEQ ID NO: 126782 - DNA, 25 bp, Mus musculus
actcccggacgatctgtgtgaatat

SEQ ID NO: 126783 - DNA, 25 bp, Mus musculus
actcccggatcacgctttttcaagg

SEQ ID NO: 126784 - DNA, 25 bp, Mus musculus
actcccggatcaggctttttcaagg

SEQ ID NO: 126785 - DNA, 25 bp, Mus musculus
actcccgttcatatttatactcact

SEQ ID NO: 126786 - DNA, 25 bp, Mus musculus
actcccgttcatcactacagtgttg

SEQ ID NO: 126787 - DNA, 25 bp, Mus musculus
actcccgttcatgactacagtgttg

SEQ ID NO: 126788 - DNA, 25 bp, Mus musculus
actcccgttcatttttatactcact

SEQ ID NO: 126789 - DNA, 25 bp, Mus musculus
actcccgttcttagtatgtagaatt

SEQ ID NO: 126790 - DNA, 25 bp, Mus musculus
actcccgttctttgtatgtagaatt

SEQ ID NO: 126791 - DNA, 25 bp, Mus musculus
actcccgttgagagggcacccaaga

SEQ ID NO: 126792 - DNA, 25 bp, Mus musculus
actcccgttgagtgggcacccaaga

SEQ ID NO: 126793 - DNA, 25 bp, Mus musculus
actcccgtttagagactgcagcacg

SEQ ID NO: 126794 - DNA, 25 bp, Mus musculus
actcccgtttagtgactgcagcacg

SEQ ID NO: 126795 - DNA, 25 bp, Mus musculus
actccctaaaggagtgtctcagttg

SEQ ID NO: 126796 - DNA, 25 bp, Mus musculus
actccctaaaggtgtgtctcagttg

SEQ ID NO: 126797 - DNA, 25 bp, Mus musculus
actccctaactgacctgtttagaat

SEQ ID NO: 126798 - DNA, 25 bp, Mus musculus
actccctaactgtcctgtttagaat

SEQ ID NO: 126799 - DNA, 25 bp, Mus musculus
actccctaatagcttttatgtggta

SEQ ID NO: 126800 - DNA, 25 bp, Mus musculus
actccctaataggttttatgtggta

SEQ ID NO: 126801 - DNA, 25 bp, Mus musculus
actccctacattccttatttgtatt

SEQ ID NO: 126802 - DNA, 25 bp, Mus musculus
actccctacattgcttatttgtatt

SEQ ID NO: 126803 - DNA, 25 bp, Mus musculus
actccctagctcagagaagcgctta

SEQ ID NO: 126804 - DNA, 25 bp, Mus musculus
actccctagctcagtggctttaagc

SEQ ID NO: 126805 - DNA, 25 bp, Mus musculus
actccctagctctgagaagcgctta

SEQ ID NO: 126806 - DNA, 25 bp, Mus musculus
actccctagctctgtggctttaagc

SEQ ID NO: 126807 - DNA, 25 bp, Mus musculus
actccctaggaaagtgctttctgtc

SEQ ID NO: 126808 - DNA, 25 bp, Mus musculus
actccctaggaatgtgctttctgtc

SEQ ID NO: 126809 - DNA, 25 bp, Mus musculus
actccctagggtccttaaagatgtc

SEQ ID NO: 126810 - DNA, 25 bp, Mus musculus
actccctagggtgcttaaagatgtc

SEQ ID NO: 126811 - DNA, 25 bp, Mus musculus
actccctatagtcatgatggtccgg

SEQ ID NO: 126812 - DNA, 25 bp, Mus musculus
actccctatagtctgttcctctgat

SEQ ID NO: 126813 - DNA, 25 bp, Mus musculus
actccctatagtgatgatggtccgg

SEQ ID NO: 126814 - DNA, 25 bp, Mus musculus
actccctatagtgtgttcctctgat

SEQ ID NO: 126815 - DNA, 25 bp, Mus musculus
actccctatcttcggtgccagagat

SEQ ID NO: 126816 - DNA, 25 bp, Mus musculus
actccctatcttgggtgccagagat

SEQ ID NO: 126817 - DNA, 25 bp, Mus musculus
actccctccaacactgtgatttaga

SEQ ID NO: 126818 - DNA, 25 bp, Mus musculus
actccctccaacagaggaagctatt

SEQ ID NO: 126819 - DNA, 25 bp, Mus musculus
actccctccaactctgtgatttaga

SEQ ID NO: 126820 - DNA, 25 bp, Mus musculus
actccctccaactgaggaagctatt

SEQ ID NO: 126821 - DNA, 25 bp, Mus musculus
actccctcgaggaaatgtatttcag

SEQ ID NO: 126822 - DNA, 25 bp, Mus musculus
actccctcgaggtaatgtatttcag

SEQ ID NO: 126823 - DNA, 25 bp, Mus musculus
actccctctcatcatgtctgcagag

SEQ ID NO: 126824 - DNA, 25 bp, Mus musculus
actccctctcatgatgtctgcagag

SEQ ID NO: 126825 - DNA, 25 bp, Mus musculus
actccctctctaaataaatgtgcta

SEQ ID NO: 126826 - DNA, 25 bp, Mus musculus
actccctctctatataaatgtgcta

SEQ ID NO: 126827 - DNA, 25 bp, Mus musculus
actccctcttgacctatgcatcttt

SEQ ID NO: 126828 - DNA, 25 bp, Mus musculus
actccctcttgagctatgcatcttt

SEQ ID NO: 126829 - DNA, 25 bp, Mus musculus
actccctcttgccaggaagagctat

SEQ ID NO: 126830 - DNA, 25 bp, Mus musculus
actccctcttgcgaggaagagctat

SEQ ID NO: 126831 - DNA, 25 bp, Mus musculus
actccctgaagaaggtcctgctcga

SEQ ID NO: 126832 - DNA, 25 bp, Mus musculus
actccctgaagatggtcctgctcga

SEQ ID NO: 126833 - DNA, 25 bp, Mus musculus
actccctgagctattgctgccttaa

SEQ ID NO: 126834 - DNA, 25 bp, Mus musculus
actccctgagcttttgctgccttaa

SEQ ID NO: 126835 - DNA, 25 bp, Mus musculus
actccctgcattctgactcagtagg

SEQ ID NO: 126836 - DNA, 25 bp, Mus musculus
actccctgcattgtgactcagtagg

SEQ ID NO: 126837 - DNA, 25 bp, Mus musculus
actccctgccccatgtataaattgg

SEQ ID NO: 126838 - DNA, 25 bp, Mus musculus
actccctgccccttgtataaattgg

SEQ ID NO: 126839 - DNA, 25 bp, Mus musculus
actccctgctccaagaactgtgaag

SEQ ID NO: 126840 - DNA, 25 bp, Mus musculus
actccctgctcctagaactgtgaag

SEQ ID NO: 126841 - DNA, 25 bp, Mus musculus
actccctggagacacaaattttgca

SEQ ID NO: 126842 - DNA, 25 bp, Mus musculus
actccctggagactgcacactagag

SEQ ID NO: 126843 - DNA, 25 bp, Mus musculus
actccctggagagacaaattttgca

SEQ ID NO: 126844 - DNA, 25 bp, Mus musculus
actccctggagagtgcacactagag

SEQ ID NO: 126845 - DNA, 25 bp, Mus musculus
actccctggcttagaaccagctggc

SEQ ID NO: 126846 - DNA, 25 bp, Mus musculus
actccctggctttgaaccagctggc

SEQ ID NO: 126847 - DNA, 25 bp, Mus musculus
actccctgggcaagttcagtgtggc

SEQ ID NO: 126848 - DNA, 25 bp, Mus musculus
actccctgggcatgttcagtgtggc

SEQ ID NO: 126849 - DNA, 25 bp, Mus musculus
actccctgtaacattcattgcaatc

SEQ ID NO: 126850 - DNA, 25 bp, Mus musculus
actccctgtaactttcattgcaatc

SEQ ID NO: 126851 - DNA, 25 bp, Mus musculus
actccctgtgctaatgttcatgctg

SEQ ID NO: 126852 - DNA, 25 bp, Mus musculus
actccctgtgctataagtgcgcttt

SEQ ID NO: 126853 - DNA, 25 bp, Mus musculus
actccctgtgcttatgttcatgctg

SEQ ID NO: 126854 - DNA, 25 bp, Mus musculus
actccctgtgctttaagtgcgcttt

SEQ ID NO: 126855 - DNA, 25 bp, Mus musculus
actccctgttggctgctacagcagg

SEQ ID NO: 126856 - DNA, 25 bp, Mus musculus
actccctgttgggtgctacagcagg

SEQ ID NO: 126857 - DNA, 25 bp, Mus musculus
actcccttaagtcttctgtttcaat

SEQ ID NO: 126858 - DNA, 25 bp, Mus musculus
actcccttaagtgttctgtttcaat

SEQ ID NO: 126859 - DNA, 25 bp, Mus musculus
actcccttcagtactcccttaggct

SEQ ID NO: 126860 - DNA, 25 bp, Mus musculus
actcccttcagttctcccttaggct

SEQ ID NO: 126861 - DNA, 25 bp, Mus musculus
actcccttctttaacagcttaccat

SEQ ID NO: 126862 - DNA, 25 bp, Mus musculus
actcccttcttttacagcttaccat

SEQ ID NO: 126863 - DNA, 25 bp, Mus musculus
actcccttgaagcagagtctcgctg

SEQ ID NO: 126864 - DNA, 25 bp, Mus musculus
actcccttgaaggagagtctcgctg

SEQ ID NO: 126865 - DNA, 25 bp, Mus musculus
actcccttgactacttgattactgc

SEQ ID NO: 126866 - DNA, 25 bp, Mus musculus
actcccttgacttcttgattactgc

SEQ ID NO: 126867 - DNA, 25 bp, Mus musculus
actcccttgatgcacctcttacaaa

SEQ ID NO: 126868 - DNA, 25 bp, Mus musculus
actcccttgatggacctcttacaaa

SEQ ID NO: 126869 - DNA, 25 bp, Mus musculus
actcccttgcataatttctttgttt

SEQ ID NO: 126870 - DNA, 25 bp, Mus musculus
actcccttgcattatttctttgttt

SEQ ID NO: 126871 - DNA, 25 bp, Mus musculus
actcccttgctgaagtgacttgctt

SEQ ID NO: 126872 - DNA, 25 bp, Mus musculus
actcccttgctgtagtgacttgctt

SEQ ID NO: 126873 - DNA, 25 bp, Mus musculus
actcccttggcaagctagacagtaa

SEQ ID NO: 126874 - DNA, 25 bp, Mus musculus
actcccttggcatgctagacagtaa

SEQ ID NO: 126875 - DNA, 25 bp, Mus musculus
actcccttgggcaaagttactgata

SEQ ID NO: 126876 - DNA, 25 bp, Mus musculus
actcccttgggctaagttactgata

SEQ ID NO: 126877 - DNA, 25 bp, Mus musculus
actcccttgtaccaacactgagata

SEQ ID NO: 126878 - DNA, 25 bp, Mus musculus
actcccttgtacgaacactgagata

SEQ ID NO: 126879 - DNA, 25 bp, Mus musculus
actccctttcagagacttgttagct

SEQ ID NO: 126880 - DNA, 25 bp, Mus musculus
actccctttcagtgacttgttagct

SEQ ID NO: 126881 - DNA, 25 bp, Mus musculus
actccctttgtgcacagttgacatt

SEQ ID NO: 126882 - DNA, 25 bp, Mus musculus
actccctttgtggacagttgacatt

SEQ ID NO: 126883 - DNA, 25 bp, Mus musculus
actccgaaaagcaatgcatatcaag

SEQ ID NO: 126884 - DNA, 25 bp, Mus musculus
actccgaaaagctatgcatatcaag

SEQ ID NO: 126885 - DNA, 25 bp, Mus musculus
actccgaaagtgagtattaccttgt

SEQ ID NO: 126886 - DNA, 25 bp, Mus musculus
actccgaaagtgtgtattaccttgt

SEQ ID NO: 126887 - DNA, 25 bp, Mus musculus
actccgaacaaacctgcggcttctg

SEQ ID NO: 126888 - DNA, 25 bp, Mus musculus
actccgaacaaagctgcggcttctg

SEQ ID NO: 126889 - DNA, 25 bp, Mus musculus
actccgaagaggctgaggtgttcca

SEQ ID NO: 126890 - DNA, 25 bp, Mus musculus
actccgaagagggtgaggtgttcca

SEQ ID NO: 126891 - DNA, 25 bp, Mus musculus
actccgaagcaaccctacaatgatg

SEQ ID NO: 126892 - DNA, 25 bp, Mus musculus
actccgaagcaagcctacaatgatg

SEQ ID NO: 126893 - DNA, 25 bp, Mus musculus
actccgaagtgcatcatttacctgg

SEQ ID NO: 126894 - DNA, 25 bp, Mus musculus
actccgaagtgcttcatttacctgg

SEQ ID NO: 126895 - DNA, 25 bp, Mus musculus
actccgaataccatcaattcttggg

SEQ ID NO: 126896 - DNA, 25 bp, Mus musculus
actccgaataccttcaattcttggg

SEQ ID NO: 126897 - DNA, 25 bp, Mus musculus
actccgacaacccatctgaagaggg

SEQ ID NO: 126898 - DNA, 25 bp, Mus musculus
actccgacaaccgatctgaagaggg

SEQ ID NO: 126899 - DNA, 25 bp, Mus musculus
actccgaccagcctatagtactgta

SEQ ID NO: 126900 - DNA, 25 bp, Mus musculus
actccgaccagcgtatagtactgta

SEQ ID NO: 126901 - DNA, 25 bp, Mus musculus
actccgactatgcagagtccacaga

SEQ ID NO: 126902 - DNA, 25 bp, Mus musculus
actccgactatggagagtccacaga

SEQ ID NO: 126903 - DNA, 25 bp, Mus musculus
actccgacttcactgctttgttaag

SEQ ID NO: 126904 - DNA, 25 bp, Mus musculus
actccgacttcagtgctttgttaag

SEQ ID NO: 126905 - DNA, 25 bp, Mus musculus
actccgagaagtccttgcctgttgc

SEQ ID NO: 126906 - DNA, 25 bp, Mus musculus
actccgagaagtgcttgcctgttgc

SEQ ID NO: 126907 - DNA, 25 bp, Mus musculus
actccgagtgccctgtaactattag

SEQ ID NO: 126908 - DNA, 25 bp, Mus musculus
actccgagtgccgtgtaactattag

SEQ ID NO: 126909 - DNA, 25 bp, Mus musculus
actccgatctgtcgcgacattttaa

SEQ ID NO: 126910 - DNA, 25 bp, Mus musculus
actccgatctgtggcgacattttaa

SEQ ID NO: 126911 - DNA, 25 bp, Mus musculus
actccgcacggtattctgcgtgtaa

SEQ ID NO: 126912 - DNA, 25 bp, Mus musculus
actccgcacggttttctgcgtgtaa

SEQ ID NO: 126913 - DNA, 25 bp, Mus musculus
actccgccaggaacaggtctagagg

SEQ ID NO: 126914 - DNA, 25 bp, Mus musculus
actccgccaggatcaggtctagagg

SEQ ID NO: 126915 - DNA, 25 bp, Mus musculus
actccgctagggaagaggactctcc

SEQ ID NO: 126916 - DNA, 25 bp, Mus musculus
actccgctagggtagaggactctcc

SEQ ID NO: 126917 - DNA, 25 bp, Mus musculus
actccgctcattctgtatggtttct

SEQ ID NO: 126918 - DNA, 25 bp, Mus musculus
actccgctcattgtgtatggtttct

SEQ ID NO: 126919 - DNA, 25 bp, Mus musculus
actccgctctctattgtggattcag

SEQ ID NO: 126920 - DNA, 25 bp, Mus musculus
actccgctctcttttgtggattcag

SEQ ID NO: 126921 - DNA, 25 bp, Mus musculus
actccgctcttcacacagtgtagaa

SEQ ID NO: 126922 - DNA, 25 bp, Mus musculus
actccgctcttctcacagtgtagaa

SEQ ID NO: 126923 - DNA, 25 bp, Mus musculus
actccgctgggacaagtggacctaa

SEQ ID NO: 126924 - DNA, 25 bp, Mus musculus
actccgctgggagaagtggacctaa

SEQ ID NO: 126925 - DNA, 25 bp, Mus musculus
actccgctgtggattgcctgtagac

SEQ ID NO: 126926 - DNA, 25 bp, Mus musculus
actccgctgtggtttgcctgtagac

SEQ ID NO: 126927 - DNA, 25 bp, Mus musculus
actccggagagacctatacctgtgt

SEQ ID NO: 126928 - DNA, 25 bp, Mus musculus
actccggagagagctatacctgtgt

SEQ ID NO: 126929 - DNA, 25 bp, Mus musculus
actccggagagtagcttctcagcaa

SEQ ID NO: 126930 - DNA, 25 bp, Mus musculus
actccggagagttgcttctcagcaa

SEQ ID NO: 126931 - DNA, 25 bp, Mus musculus
actccggattgaattgtgccatgaa

SEQ ID NO: 126932 - DNA, 25 bp, Mus musculus
actccggattgatttgtgccatgaa

SEQ ID NO: 126933 - DNA, 25 bp, Mus musculus
actccggctcatacagagacagcat

SEQ ID NO: 126934 - DNA, 25 bp, Mus musculus
actccggctcattcagagacagcat

SEQ ID NO: 126935 - DNA, 25 bp, Mus musculus
actccggctggacgtagacacacag

SEQ ID NO: 126936 - DNA, 25 bp, Mus musculus
actccggctggaggtagacacacag

SEQ ID NO: 126937 - DNA, 25 bp, Mus musculus
actccgggattgctcttgttattgc

SEQ ID NO: 126938 - DNA, 25 bp, Mus musculus
actccgggattggtcttgttattgc

SEQ ID NO: 126939 - DNA, 25 bp, Mus musculus
actccgggcgagagggtgacaagca

SEQ ID NO: 126940 - DNA, 25 bp, Mus musculus
actccgggcgagtgggtgacaagca

SEQ ID NO: 126941 - DNA, 25 bp, Mus musculus
actccgggctgacctagctgaagaa

SEQ ID NO: 126942 - DNA, 25 bp, Mus musculus
actccgggctgagctagctgaagaa

SEQ ID NO: 126943 - DNA, 25 bp, Mus musculus
actccggtattacttcgctcaatga

SEQ ID NO: 126944 - DNA, 25 bp, Mus musculus
actccggtattagttcgctcaatga

SEQ ID NO: 126945 - DNA, 25 bp, Mus musculus
actccggtctcacgagcaggagcga

SEQ ID NO: 126946 - DNA, 25 bp, Mus musculus
actccggtctcaggagcaggagcga

SEQ ID NO: 126947 - DNA, 25 bp, Mus musculus
actccggtctctacagtgggaaaag

SEQ ID NO: 126948 - DNA, 25 bp, Mus musculus
actccggtctcttcagtgggaaaag

SEQ ID NO: 126949 - DNA, 25 bp, Mus musculus
actccggttttacggcatctgacac

SEQ ID NO: 126950 - DNA, 25 bp, Mus musculus
actccggttttagggcatctgacac

SEQ ID NO: 126951 - DNA, 25 bp, Mus musculus
actccgtaccatctcctgtagtgac

SEQ ID NO: 126952 - DNA, 25 bp, Mus musculus
actccgtaccatgtcctgtagtgac

SEQ ID NO: 126953 - DNA, 25 bp, Mus musculus
actccgtagagcaagacttccagct

SEQ ID NO: 126954 - DNA, 25 bp, Mus musculus
actccgtagagctagacttccagct

SEQ ID NO: 126955 - DNA, 25 bp, Mus musculus
actccgtcaaatattttatactaat

SEQ ID NO: 126956 - DNA, 25 bp, Mus musculus
actccgtcaaattttttatactaat

SEQ ID NO: 126957 - DNA, 25 bp, Mus musculus
actccgtccttcatgtatccacttg

SEQ ID NO: 126958 - DNA, 25 bp, Mus musculus
actccgtccttcttgtatccacttg

SEQ ID NO: 126959 - DNA, 25 bp, Mus musculus
actccgtcgtatccagtgctgagga

SEQ ID NO: 126960 - DNA, 25 bp, Mus musculus
actccgtcgtatgcagtgctgagga

SEQ ID NO: 126961 - DNA, 25 bp, Mus musculus
actccgtctgaacctaggctgctgc

SEQ ID NO: 126962 - DNA, 25 bp, Mus musculus
actccgtctgaagctaggctgctgc

SEQ ID NO: 126963 - DNA, 25 bp, Mus musculus
actccgtgagaccagctttcattaa

SEQ ID NO: 126964 - DNA, 25 bp, Mus musculus
actccgtgagacgagctttcattaa

SEQ ID NO: 126965 - DNA, 25 bp, Mus musculus
actccgtgcagtaatgcccacaata

SEQ ID NO: 126966 - DNA, 25 bp, Mus musculus
actccgtgcagttatgcccacaata

SEQ ID NO: 126967 - DNA, 25 bp, Mus musculus
actccgtggagccagcttagggcta

SEQ ID NO: 126968 - DNA, 25 bp, Mus musculus
actccgtggagcgagcttagggcta

SEQ ID NO: 126969 - DNA, 25 bp, Mus musculus
actccgtggcacagataatgggcac

SEQ ID NO: 126970 - DNA, 25 bp, Mus musculus
actccgtggcactgataatgggcac

SEQ ID NO: 126971 - DNA, 25 bp, Mus musculus
actccgtggcagacctggctgcggt

SEQ ID NO: 126972 - DNA, 25 bp, Mus musculus
actccgtggcagtcctggctgcggt

SEQ ID NO: 126973 - DNA, 25 bp, Mus musculus
actccgtgtccaacagagaatatgg

SEQ ID NO: 126974 - DNA, 25 bp, Mus musculus
actccgtgtccatcagagaatatgg

SEQ ID NO: 126975 - DNA, 25 bp, Mus musculus
actccgtgtcttcagtggtttgtta

SEQ ID NO: 126976 - DNA, 25 bp, Mus musculus
actccgtgtcttgagtggtttgtta

SEQ ID NO: 126977 - DNA, 25 bp, Mus musculus
actccgtgtgttctacagtgctgag

SEQ ID NO: 126978 - DNA, 25 bp, Mus musculus
actccgtgtgttgtacagtgctgag

SEQ ID NO: 126979 - DNA, 25 bp, Mus musculus
actccgttaatccatgcactccaga

SEQ ID NO: 126980 - DNA, 25 bp, Mus musculus
actccgttaatcgatgcactccaga

SEQ ID NO: 126981 - DNA, 25 bp, Mus musculus
actccgtttcagatttgtgttgctt

SEQ ID NO: 126982 - DNA, 25 bp, Mus musculus
actccgtttcagttttgtgttgctt

SEQ ID NO: 126983 - DNA, 25 bp, Mus musculus
actcctaaagtgatgtctcgaagct

SEQ ID NO: 126984 - DNA, 25 bp, Mus musculus
actcctaaagtgttgtctcgaagct

SEQ ID NO: 126985 - DNA, 25 bp, Mus musculus
actcctaagcaacctgcaggcagta

SEQ ID NO: 126986 - DNA, 25 bp, Mus musculus
actcctaagcaagctgcaggcagta

SEQ ID NO: 126987 - DNA, 25 bp, Mus musculus
actcctaagcgtagttggacaatgc

SEQ ID NO: 126988 - DNA, 25 bp, Mus musculus
actcctaagcgttgttggacaatgc

SEQ ID NO: 126989 - DNA, 25 bp, Mus musculus
actcctaataaaactgttgcattcc

SEQ ID NO: 126990 - DNA, 25 bp, Mus musculus
actcctaataaatctgttgcattcc

SEQ ID NO: 126991 - DNA, 25 bp, Mus musculus
actcctaatataaagctacccacga

SEQ ID NO: 126992 - DNA, 25 bp, Mus musculus
actcctaatatatagctacccacga

SEQ ID NO: 126993 - DNA, 25 bp, Mus musculus
actcctaatcatctgctttttctcc

SEQ ID NO: 126994 - DNA, 25 bp, Mus musculus
actcctaatcatgtgctttttctcc

SEQ ID NO: 126995 - DNA, 25 bp, Mus musculus
actcctaatgagatcatgctttgag

SEQ ID NO: 126996 - DNA, 25 bp, Mus musculus
actcctaatgagttcatgctttgag

SEQ ID NO: 126997 - DNA, 25 bp, Mus musculus
actcctacacaaagcgcttctgtgg

SEQ ID NO: 126998 - DNA, 25 bp, Mus musculus
actcctacacaatgcgcttctgtgg

SEQ ID NO: 126999 - DNA, 25 bp, Mus musculus
actcctacactaagactgcattcat

SEQ ID NO: 127000 - DNA, 25 bp, Mus musculus
actcctacactatgactgcattcat

SEQ ID NO: 127001 - DNA, 25 bp, Mus musculus
actcctacacttcggttataattgc

SEQ ID NO: 127002 - DNA, 25 bp, Mus musculus
actcctacacttgggttataattgc

SEQ ID NO: 127003 - DNA, 25 bp, Mus musculus
actcctacagatcatgaacaacttc

SEQ ID NO: 127004 - DNA, 25 bp, Mus musculus
actcctacagatgatgaacaacttc

SEQ ID NO: 127005 - DNA, 25 bp, Mus musculus
actcctacagctccgtgagaatggg

SEQ ID NO: 127006 - DNA, 25 bp, Mus musculus
actcctacagctgcgtgagaatggg

SEQ ID NO: 127007 - DNA, 25 bp, Mus musculus
actcctacaggacctgtcagtgact

SEQ ID NO: 127008 - DNA, 25 bp, Mus musculus
actcctacaggagctgtcagtgact

SEQ ID NO: 127009 - DNA, 25 bp, Mus musculus
actcctaccacacaagcttgtgtgt

SEQ ID NO: 127010 - DNA, 25 bp, Mus musculus
actcctaccacagaagcttgtgtgt

SEQ ID NO: 127011 - DNA, 25 bp, Mus musculus
actcctacccataggtctaagcttg

SEQ ID NO: 127012 - DNA, 25 bp, Mus musculus
actcctacccattggtctaagcttg

SEQ ID NO: 127013 - DNA, 25 bp, Mus musculus
actcctaccggaacttttgtgtcaa

SEQ ID NO: 127014 - DNA, 25 bp, Mus musculus
actcctaccggatcttttgtgtcaa

SEQ ID NO: 127015 - DNA, 25 bp, Mus musculus
actcctacctggatctttgatcaga

SEQ ID NO: 127016 - DNA, 25 bp, Mus musculus
actcctacctggttctttgatcaga

SEQ ID NO: 127017 - DNA, 25 bp, Mus musculus
actcctactaggattagatgactat

SEQ ID NO: 127018 - DNA, 25 bp, Mus musculus
actcctactaggtttagatgactat

SEQ ID NO: 127019 - DNA, 25 bp, Mus musculus
actcctactcacagatgatgctcta

SEQ ID NO: 127020 - DNA, 25 bp, Mus musculus
actcctactcactgatgatgctcta

SEQ ID NO: 127021 - DNA, 25 bp, Mus musculus
actcctactggacctcaatttgtaa

SEQ ID NO: 127022 - DNA, 25 bp, Mus musculus
actcctactggagctcaatttgtaa

SEQ ID NO: 127023 - DNA, 25 bp, Mus musculus
actcctagaaatctacttgcctctg

SEQ ID NO: 127024 - DNA, 25 bp, Mus musculus
actcctagaaatgtacttgcctctg

SEQ ID NO: 127025 - DNA, 25 bp, Mus musculus
actcctagaaccattagtctctcaa

SEQ ID NO: 127026 - DNA, 25 bp, Mus musculus
actcctagaacctttagtctctcaa

SEQ ID NO: 127027 - DNA, 25 bp, Mus musculus
actcctagagatccacttacctgct

SEQ ID NO: 127028 - DNA, 25 bp, Mus musculus
actcctagagatgcacttacctgct

SEQ ID NO: 127029 - DNA, 25 bp, Mus musculus
actcctagatacatactgttggtgt

SEQ ID NO: 127030 - DNA, 25 bp, Mus musculus
actcctagatacttactgttggtgt

SEQ ID NO: 127031 - DNA, 25 bp, Mus musculus
actcctagcactcaattagttgggt

SEQ ID NO: 127032 - DNA, 25 bp, Mus musculus
actcctagcactgaattagttgggt

SEQ ID NO: 127033 - DNA, 25 bp, Mus musculus
actcctagcgctcgagttaggctgt

SEQ ID NO: 127034 - DNA, 25 bp, Mus musculus
actcctagcgctggagttaggctgt

SEQ ID NO: 127035 - DNA, 25 bp, Mus musculus
actcctagggcaaaacgcttaaaca

SEQ ID NO: 127036 - DNA, 25 bp, Mus musculus
actcctagggcataacgcttaaaca

SEQ ID NO: 127037 - DNA, 25 bp, Mus musculus
actcctagttttacaccagcctggg

SEQ ID NO: 127038 - DNA, 25 bp, Mus musculus
actcctagtttttcaccagcctggg

SEQ ID NO: 127039 - DNA, 25 bp, Mus musculus
actcctatacctcctctttgtaaga

SEQ ID NO: 127040 - DNA, 25 bp, Mus musculus
actcctatacctgctctttgtaaga

SEQ ID NO: 127041 - DNA, 25 bp, Mus musculus
actcctatagcaatatgtttggaat

SEQ ID NO: 127042 - DNA, 25 bp, Mus musculus
actcctatagcattatgtttggaat

SEQ ID NO: 127043 - DNA, 25 bp, Mus musculus
actcctatcatgaactggtttccag

SEQ ID NO: 127044 - DNA, 25 bp, Mus musculus
actcctatcatgtactggtttccag

SEQ ID NO: 127045 - DNA, 25 bp, Mus musculus
actcctatcgtgatctgtgtaggtg

SEQ ID NO: 127046 - DNA, 25 bp, Mus musculus
actcctatcgtgttctgtgtaggtg

SEQ ID NO: 127047 - DNA, 25 bp, Mus musculus
actcctattgcaagtctccaaatct

SEQ ID NO: 127048 - DNA, 25 bp, Mus musculus
actcctattgcatgtctccaaatct

SEQ ID NO: 127049 - DNA, 25 bp, Mus musculus
actcctcaactaaggctacagctga

SEQ ID NO: 127050 - DNA, 25 bp, Mus musculus
actcctcaactatggctacagctga

SEQ ID NO: 127051 - DNA, 25 bp, Mus musculus
actcctcaaggcataagatatgtgg

SEQ ID NO: 127052 - DNA, 25 bp, Mus musculus
actcctcaaggcttaagatatgtgg

SEQ ID NO: 127053 - DNA, 25 bp, Mus musculus
actcctcaatgcaggatcagttcca

SEQ ID NO: 127054 - DNA, 25 bp, Mus musculus
actcctcaatgctggatcagttcca

SEQ ID NO: 127055 - DNA, 25 bp, Mus musculus
actcctcacacacgtgacttggtgt

SEQ ID NO: 127056 - DNA, 25 bp, Mus musculus
actcctcacacaggtgacttggtgt

SEQ ID NO: 127057 - DNA, 25 bp, Mus musculus
actcctcagaatatggtctgttcca

SEQ ID NO: 127058 - DNA, 25 bp, Mus musculus
actcctcagaatttggtctgttcca

SEQ ID NO: 127059 - DNA, 25 bp, Mus musculus
actcctcagagacccttgggattct

SEQ ID NO: 127060 - DNA, 25 bp, Mus musculus
actcctcagagagccttgggattct

SEQ ID NO: 127061 - DNA, 25 bp, Mus musculus
actcctcagagcagagccaggcgga

SEQ ID NO: 127062 - DNA, 25 bp, Mus musculus
actcctcagagctgagccaggcgga

SEQ ID NO: 127063 - DNA, 25 bp, Mus musculus
actcctcagcagcttttccaaatgg

SEQ ID NO: 127064 - DNA, 25 bp, Mus musculus
actcctcagcaggttttccaaatgg

SEQ ID NO: 127065 - DNA, 25 bp, Mus musculus
actcctcaggtcaccagggtattaa

SEQ ID NO: 127066 - DNA, 25 bp, Mus musculus
actcctcaggtctccagggtattaa

SEQ ID NO: 127067 - DNA, 25 bp, Mus musculus
actcctcaggttcagatattcttga

SEQ ID NO: 127068 - DNA, 25 bp, Mus musculus
actcctcaggttgagatattcttga

SEQ ID NO: 127069 - DNA, 25 bp, Mus musculus
actcctcagtgaaccccatcgatag

SEQ ID NO: 127070 - DNA, 25 bp, Mus musculus
actcctcagtgatccccatcgatag

SEQ ID NO: 127071 - DNA, 25 bp, Mus musculus
actcctcatctgcagccacgatgga

SEQ ID NO: 127072 - DNA, 25 bp, Mus musculus
actcctcatctggagccacgatgga

SEQ ID NO: 127073 - DNA, 25 bp, Mus musculus
actcctcatgccatgtaattttacc

SEQ ID NO: 127074 - DNA, 25 bp, Mus musculus
actcctcatgccttgtaattttacc

SEQ ID NO: 127075 - DNA, 25 bp, Mus musculus
actcctcattgaccagcggaagctg

SEQ ID NO: 127076 - DNA, 25 bp, Mus musculus
actcctcattgagcagcggaagctg

SEQ ID NO: 127077 - DNA, 25 bp, Mus musculus
actcctccaattaacaagcctttga

SEQ ID NO: 127078 - DNA, 25 bp, Mus musculus
actcctccaatttacaagcctttga

SEQ ID NO: 127079 - DNA, 25 bp, Mus musculus
actcctccagatcgctcagaagtaa

SEQ ID NO: 127080 - DNA, 25 bp, Mus musculus
actcctccagatggctcagaagtaa

SEQ ID NO: 127081 - DNA, 25 bp, Mus musculus
actcctccagtgacttggactatga

SEQ ID NO: 127082 - DNA, 25 bp, Mus musculus
actcctccagtgtcttggactatga

SEQ ID NO: 127083 - DNA, 25 bp, Mus musculus
actcctcccactaatatagatacac

SEQ ID NO: 127084 - DNA, 25 bp, Mus musculus
actcctcccacttatatagatacac

SEQ ID NO: 127085 - DNA, 25 bp, Mus musculus
actcctcccatcagtagcaatacaa

SEQ ID NO: 127086 - DNA, 25 bp, Mus musculus
actcctcccatctgtagcaatacaa

SEQ ID NO: 127087 - DNA, 25 bp, Mus musculus
actcctccccatcactaaggaatgt

SEQ ID NO: 127088 - DNA, 25 bp, Mus musculus
actcctccccatgactaaggaatgt

SEQ ID NO: 127089 - DNA, 25 bp, Mus musculus
actcctccgactctctgtattggaa

SEQ ID NO: 127090 - DNA, 25 bp, Mus musculus
actcctccgactgtctgtattggaa

SEQ ID NO: 127091 - DNA, 25 bp, Mus musculus
actcctccgatgcaattatttccta

SEQ ID NO: 127092 - DNA, 25 bp, Mus musculus
actcctccgatggaattatttccta

SEQ ID NO: 127093 - DNA, 25 bp, Mus musculus
actcctccggccaggaatgtgaagt

SEQ ID NO: 127094 - DNA, 25 bp, Mus musculus
actcctccggcctggaatgtgaagt

SEQ ID NO: 127095 - DNA, 25 bp, Mus musculus
actcctcctattatccagaagtgaa

SEQ ID NO: 127096 - DNA, 25 bp, Mus musculus
actcctcctattttccagaagtgaa

SEQ ID NO: 127097 - DNA, 25 bp, Mus musculus
actcctcctctaagaacgactttat

SEQ ID NO: 127098 - DNA, 25 bp, Mus musculus
actcctcctctatgaacgactttat

SEQ ID NO: 127099 - DNA, 25 bp, Mus musculus
actcctcctggaattactctgctgg

SEQ ID NO: 127100 - DNA, 25 bp, Mus musculus
actcctcctggatttactctgctgg

SEQ ID NO: 127101 - DNA, 25 bp, Mus musculus
actcctcctggcaggatactttatg

SEQ ID NO: 127102 - DNA, 25 bp, Mus musculus
actcctcctggctggatactttatg

SEQ ID NO: 127103 - DNA, 25 bp, Mus musculus
actcctcctgtaagctgggtagaaa

SEQ ID NO: 127104 - DNA, 25 bp, Mus musculus
actcctcctgtatgctgggtagaaa

SEQ ID NO: 127105 - DNA, 25 bp, Mus musculus
actcctcggtctattattctatgaa

SEQ ID NO: 127106 - DNA, 25 bp, Mus musculus
actcctcggtcttttattctatgaa

SEQ ID NO: 127107 - DNA, 25 bp, Mus musculus
actcctcgtcttcaatttgccatta

SEQ ID NO: 127108 - DNA, 25 bp, Mus musculus
actcctcgtcttgaatttgccatta

SEQ ID NO: 127109 - DNA, 25 bp, Mus musculus
actcctctacaaccataagccaaaa

SEQ ID NO: 127110 - DNA, 25 bp, Mus musculus
actcctctacaagcataagccaaaa

SEQ ID NO: 127111 - DNA, 25 bp, Mus musculus
actcctctaggtcttaatcttggta

SEQ ID NO: 127112 - DNA, 25 bp, Mus musculus
actcctctaggtgttaatcttggta

SEQ ID NO: 127113 - DNA, 25 bp, Mus musculus
actcctctagtccattcacgatgtt

SEQ ID NO: 127114 - DNA, 25 bp, Mus musculus
actcctctagtcgattcacgatgtt

SEQ ID NO: 127115 - DNA, 25 bp, Mus musculus
actcctctcatcatcctgatggaag

SEQ ID NO: 127116 - DNA, 25 bp, Mus musculus
actcctctcatcttcctgatggaag

SEQ ID NO: 127117 - DNA, 25 bp, Mus musculus
actcctctcggaacttgctgatgag

SEQ ID NO: 127118 - DNA, 25 bp, Mus musculus
actcctctcggatcttgctgatgag

SEQ ID NO: 127119 - DNA, 25 bp, Mus musculus
actcctctgaacaggcgctgccaga

SEQ ID NO: 127120 - DNA, 25 bp, Mus musculus
actcctctgaactggcgctgccaga

SEQ ID NO: 127121 - DNA, 25 bp, Mus musculus
actcctctgattatcgccgcaaagg

SEQ ID NO: 127122 - DNA, 25 bp, Mus musculus
actcctctgattattggcagcctct

SEQ ID NO: 127123 - DNA, 25 bp, Mus musculus
actcctctgattttcgccgcaaagg

SEQ ID NO: 127124 - DNA, 25 bp, Mus musculus
actcctctgatttttggcagcctct

SEQ ID NO: 127125 - DNA, 25 bp, Mus musculus
actcctctgcaaattcacagcattc

SEQ ID NO: 127126 - DNA, 25 bp, Mus musculus
actcctctgcaatttcacagcattc

SEQ ID NO: 127127 - DNA, 25 bp, Mus musculus
actcctctgtgcagttactagctga

SEQ ID NO: 127128 - DNA, 25 bp, Mus musculus
actcctctgtgctgttactagctga

SEQ ID NO: 127129 - DNA, 25 bp, Mus musculus
actcctcttagaaaaccacagcctg

SEQ ID NO: 127130 - DNA, 25 bp, Mus musculus
actcctcttagataaccacagcctg

SEQ ID NO: 127131 - DNA, 25 bp, Mus musculus
actcctcttgacagagaactgaggc

SEQ ID NO: 127132 - DNA, 25 bp, Mus musculus
actcctcttgactgagaactgaggc

SEQ ID NO: 127133 - DNA, 25 bp, Mus musculus
actcctcttttcaaggtttgattct

SEQ ID NO: 127134 - DNA, 25 bp, Mus musculus
actcctcttttctaggtttgattct

SEQ ID NO: 127135 - DNA, 25 bp, Mus musculus
actcctgaatgcatactccagtttc

SEQ ID NO: 127136 - DNA, 25 bp, Mus musculus
actcctgaatgcttactccagtttc

SEQ ID NO: 127137 - DNA, 25 bp, Mus musculus
actcctgaattccagcttgtcaaga

SEQ ID NO: 127138 - DNA, 25 bp, Mus musculus
actcctgaattcgagcttgtcaaga

SEQ ID NO: 127139 - DNA, 25 bp, Mus musculus
actcctgacatcatgccaatgtgga

SEQ ID NO: 127140 - DNA, 25 bp, Mus musculus
actcctgacatcttgccaatgtgga

SEQ ID NO: 127141 - DNA, 25 bp, Mus musculus
actcctgacgttcaagttcgcaggg

SEQ ID NO: 127142 - DNA, 25 bp, Mus musculus
actcctgacgttgaagttcgcaggg

SEQ ID NO: 127143 - DNA, 25 bp, Mus musculus
actcctgactccagagacatcagag

SEQ ID NO: 127144 - DNA, 25 bp, Mus musculus
actcctgactcctgagacatcagag

SEQ ID NO: 127145 - DNA, 25 bp, Mus musculus
actcctgattaaagccctgctaatg

SEQ ID NO: 127146 - DNA, 25 bp, Mus musculus
actcctgattaatgccctgctaatg

SEQ ID NO: 127147 - DNA, 25 bp, Mus musculus
actcctgcaaaacttgttcctatga

SEQ ID NO: 127148 - DNA, 25 bp, Mus musculus
actcctgcaaaagttgttcctatga

SEQ ID NO: 127149 - DNA, 25 bp, Mus musculus
actcctgcaaatagtcaactgacca

SEQ ID NO: 127150 - DNA, 25 bp, Mus musculus
actcctgcaaattgtcaactgacca

SEQ ID NO: 127151 - DNA, 25 bp, Mus musculus
actcctgcaaccaaccttatttgaa

SEQ ID NO: 127152 - DNA, 25 bp, Mus musculus
actcctgcaaccacggtgcgtggga

SEQ ID NO: 127153 - DNA, 25 bp, Mus musculus
actcctgcaacctaccttatttgaa

SEQ ID NO: 127154 - DNA, 25 bp, Mus musculus
actcctgcaacctcggtgcgtggga

SEQ ID NO: 127155 - DNA, 25 bp, Mus musculus
actcctgcactcaggctagcacagt

SEQ ID NO: 127156 - DNA, 25 bp, Mus musculus
actcctgcactctggctagcacagt

SEQ ID NO: 127157 - DNA, 25 bp, Mus musculus
actcctgcagacaggcataacactg

SEQ ID NO: 127158 - DNA, 25 bp, Mus musculus
actcctgcagactggcataacactg

SEQ ID NO: 127159 - DNA, 25 bp, Mus musculus
actcctgcagatataccagatgata

SEQ ID NO: 127160 - DNA, 25 bp, Mus musculus
actcctgcagatttaccagatgata

SEQ ID NO: 127161 - DNA, 25 bp, Mus musculus
actcctgcagcgcttgcactgactg

SEQ ID NO: 127162 - DNA, 25 bp, Mus musculus
actcctgcagcggttgcactgactg

SEQ ID NO: 127163 - DNA, 25 bp, Mus musculus
actcctgcatctattatgaagtttg

SEQ ID NO: 127164 - DNA, 25 bp, Mus musculus
actcctgcatcttttatgaagtttg

SEQ ID NO: 127165 - DNA, 25 bp, Mus musculus
actcctgccattcttgcattgttgt

SEQ ID NO: 127166 - DNA, 25 bp, Mus musculus
actcctgccattgttgcattgttgt

SEQ ID NO: 127167 - DNA, 25 bp, Mus musculus
actcctgcctacagcggtattagag

SEQ ID NO: 127168 - DNA, 25 bp, Mus musculus
actcctgcctactgcggtattagag

SEQ ID NO: 127169 - DNA, 25 bp, Mus musculus
actcctgcctctagtcaatggtgtt

SEQ ID NO: 127170 - DNA, 25 bp, Mus musculus
actcctgcctcttgtcaatggtgtt

SEQ ID NO: 127171 - DNA, 25 bp, Mus musculus
actcctgcgaccactattgggacat

SEQ ID NO: 127172 - DNA, 25 bp, Mus musculus
actcctgcgacctctattgggacat

SEQ ID NO: 127173 - DNA, 25 bp, Mus musculus
actcctgcgctcaggcttaggaaga

SEQ ID NO: 127174 - DNA, 25 bp, Mus musculus
actcctgcgctctggcttaggaaga

SEQ ID NO: 127175 - DNA, 25 bp, Mus musculus
actcctgcgttgagtaaggaccgga

SEQ ID NO: 127176 - DNA, 25 bp, Mus musculus
actcctgcgttgtgtaaggaccgga

SEQ ID NO: 127177 - DNA, 25 bp, Mus musculus
actcctgctcgccattttcaagaaa

SEQ ID NO: 127178 - DNA, 25 bp, Mus musculus
actcctgctcgcgattttcaagaaa

SEQ ID NO: 127179 - DNA, 25 bp, Mus musculus
actcctgcttacaccgtgacagaag

SEQ ID NO: 127180 - DNA, 25 bp, Mus musculus
actcctgcttactccgtgacagaag

SEQ ID NO: 127181 - DNA, 25 bp, Mus musculus
actcctgcttctatgatttgctttt

SEQ ID NO: 127182 - DNA, 25 bp, Mus musculus
actcctgcttctttgatttgctttt

SEQ ID NO: 127183 - DNA, 25 bp, Mus musculus
actcctgcttgtatggccaatgtgg

SEQ ID NO: 127184 - DNA, 25 bp, Mus musculus
actcctgcttgtccactgaagaagg

SEQ ID NO: 127185 - DNA, 25 bp, Mus musculus
actcctgcttgtgcactgaagaagg

SEQ ID NO: 127186 - DNA, 25 bp, Mus musculus
actcctgcttgtttggccaatgtgg

SEQ ID NO: 127187 - DNA, 25 bp, Mus musculus
actcctggaatcatgtctactttta

SEQ ID NO: 127188 - DNA, 25 bp, Mus musculus
actcctggaatcttgtctactttta

SEQ ID NO: 127189 - DNA, 25 bp, Mus musculus
actcctggaggccaacacagtcgaa

SEQ ID NO: 127190 - DNA, 25 bp, Mus musculus
actcctggaggcgaacacagtcgaa

SEQ ID NO: 127191 - DNA, 25 bp, Mus musculus
actcctggaggtatgaatggtttct

SEQ ID NO: 127192 - DNA, 25 bp, Mus musculus
actcctggaggtttgaatggtttct

SEQ ID NO: 127193 - DNA, 25 bp, Mus musculus
actcctggagtcaacatggccaaca

SEQ ID NO: 127194 - DNA, 25 bp, Mus musculus
actcctggagtctacatggccaaca

SEQ ID NO: 127195 - DNA, 25 bp, Mus musculus
actcctggataaattaccctcatgg

SEQ ID NO: 127196 - DNA, 25 bp, Mus musculus
actcctggataatttaccctcatgg

SEQ ID NO: 127197 - DNA, 25 bp, Mus musculus
actcctggccttacacgaagcgtga

SEQ ID NO: 127198 - DNA, 25 bp, Mus musculus
actcctggcctttcacgaagcgtga

SEQ ID NO: 127199 - DNA, 25 bp, Mus musculus
actcctggcttactctgatttttaa

SEQ ID NO: 127200 - DNA, 25 bp, Mus musculus
actcctggcttagtctgatttttaa

SEQ ID NO: 127201 - DNA, 25 bp, Mus musculus
actcctgggagacacttagcccaca

SEQ ID NO: 127202 - DNA, 25 bp, Mus musculus
actcctgggagagacttagcccaca

SEQ ID NO: 127203 - DNA, 25 bp, Mus musculus
actcctgggcgcaggagagcgatca

SEQ ID NO: 127204 - DNA, 25 bp, Mus musculus
actcctgggcgctggagagcgatca

SEQ ID NO: 127205 - DNA, 25 bp, Mus musculus
actcctggtgacattgttcttttgc

SEQ ID NO: 127206 - DNA, 25 bp, Mus musculus
actcctggtgactttgttcttttgc

SEQ ID NO: 127207 - DNA, 25 bp, Mus musculus
actcctggtgctatgtactactggt

SEQ ID NO: 127208 - DNA, 25 bp, Mus musculus
actcctggtgctttgtactactggt

SEQ ID NO: 127209 - DNA, 25 bp, Mus musculus
actcctggtgtgctatgaatattat

SEQ ID NO: 127210 - DNA, 25 bp, Mus musculus
actcctggtgtggtatgaatattat

SEQ ID NO: 127211 - DNA, 25 bp, Mus musculus
actcctgtattcagcctcagtagaa

SEQ ID NO: 127212 - DNA, 25 bp, Mus musculus
actcctgtattctgcctcagtagaa

SEQ ID NO: 127213 - DNA, 25 bp, Mus musculus
actcctgtcaggcataaacactttt

SEQ ID NO: 127214 - DNA, 25 bp, Mus musculus
actcctgtcagggataaacactttt

SEQ ID NO: 127215 - DNA, 25 bp, Mus musculus
actcctgtcatcattcctattacaa

SEQ ID NO: 127216 - DNA, 25 bp, Mus musculus
actcctgtcatctttcctattacaa

SEQ ID NO: 127217 - DNA, 25 bp, Mus musculus
actcctgtccgaccccaggatgttt

SEQ ID NO: 127218 - DNA, 25 bp, Mus musculus
actcctgtccgagcccaggatgttt

SEQ ID NO: 127219 - DNA, 25 bp, Mus musculus
actcctgtctgcaagtataacagag

SEQ ID NO: 127220 - DNA, 25 bp, Mus musculus
actcctgtctgctagtataacagag

SEQ ID NO: 127221 - DNA, 25 bp, Mus musculus
actcctgtggaacctgaagcatcca

SEQ ID NO: 127222 - DNA, 25 bp, Mus musculus
actcctgtggaagctgaagcatcca

SEQ ID NO: 127223 - DNA, 25 bp, Mus musculus
actcctgtggagattgatacctgga

SEQ ID NO: 127224 - DNA, 25 bp, Mus musculus
actcctgtggagtttgatacctgga

SEQ ID NO: 127225 - DNA, 25 bp, Mus musculus
actcctgttcccacaacaacatgaa

SEQ ID NO: 127226 - DNA, 25 bp, Mus musculus
actcctgttccccatactctttggg

SEQ ID NO: 127227 - DNA, 25 bp, Mus musculus
actcctgttcccgatactctttggg

SEQ ID NO: 127228 - DNA, 25 bp, Mus musculus
actcctgttccctcaacaacatgaa

SEQ ID NO: 127229 - DNA, 25 bp, Mus musculus
actcctgttgtaatggctaaaatca

SEQ ID NO: 127230 - DNA, 25 bp, Mus musculus
actcctgttgtattggctaaaatca

SEQ ID NO: 127231 - DNA, 25 bp, Mus musculus
actcctgttttcagacgtgtgcctt

SEQ ID NO: 127232 - DNA, 25 bp, Mus musculus
actcctgttttctgacgtgtgcctt

SEQ ID NO: 127233 - DNA, 25 bp, Mus musculus
actccttaatgtacctccagagcca

SEQ ID NO: 127234 - DNA, 25 bp, Mus musculus
actccttaatgttcctccagagcca

SEQ ID NO: 127235 - DNA, 25 bp, Mus musculus
actccttaccaaccctggataaatg

SEQ ID NO: 127236 - DNA, 25 bp, Mus musculus
actccttaccaagcctggataaatg

SEQ ID NO: 127237 - DNA, 25 bp, Mus musculus
actccttacggactgcaactcagaa

SEQ ID NO: 127238 - DNA, 25 bp, Mus musculus
actccttacggagtgcaactcagaa

SEQ ID NO: 127239 - DNA, 25 bp, Mus musculus
actccttactgcatcaaccggcttt

SEQ ID NO: 127240 - DNA, 25 bp, Mus musculus
actccttactgcttcaaccggcttt

SEQ ID NO: 127241 - DNA, 25 bp, Mus musculus
actccttagccacgctgcagggagg

SEQ ID NO: 127242 - DNA, 25 bp, Mus musculus
actccttagccaggctgcagggagg

SEQ ID NO: 127243 - DNA, 25 bp, Mus musculus
actccttagtcacccaggttaagca

SEQ ID NO: 127244 - DNA, 25 bp, Mus musculus
actccttagtcagccaggttaagca

SEQ ID NO: 127245 - DNA, 25 bp, Mus musculus
actccttataccatacctcacatag

SEQ ID NO: 127246 - DNA, 25 bp, Mus musculus
actccttataccttacctcacatag

SEQ ID NO: 127247 - DNA, 25 bp, Mus musculus
actccttatcatactcttgtcttat

SEQ ID NO: 127248 - DNA, 25 bp, Mus musculus
actccttatcattctcttgtcttat

SEQ ID NO: 127249 - DNA, 25 bp, Mus musculus
actccttcaacaacctgtatttcta

SEQ ID NO: 127250 - DNA, 25 bp, Mus musculus
actccttcaacatcctgtatttcta

SEQ ID NO: 127251 - DNA, 25 bp, Mus musculus
actccttcagtgacttgatgctcct

SEQ ID NO: 127252 - DNA, 25 bp, Mus musculus
actccttcagtgtcttgatgctcct

SEQ ID NO: 127253 - DNA, 25 bp, Mus musculus
actccttcattacttgcttcctgta

SEQ ID NO: 127254 - DNA, 25 bp, Mus musculus
actccttcattagttgcttcctgta

SEQ ID NO: 127255 - DNA, 25 bp, Mus musculus
actccttccaaacagctgtatgcaa

SEQ ID NO: 127256 - DNA, 25 bp, Mus musculus
actccttccaaagagctgtatgcaa

SEQ ID NO: 127257 - DNA, 25 bp, Mus musculus
actccttcccttatgagtctaactt

SEQ ID NO: 127258 - DNA, 25 bp, Mus musculus
actccttcccttttgagtctaactt

SEQ ID NO: 127259 - DNA, 25 bp, Mus musculus
actccttcctatattctagacagta

SEQ ID NO: 127260 - DNA, 25 bp, Mus musculus
actccttcctattttctagacagta

SEQ ID NO: 127261 - DNA, 25 bp, Mus musculus
actccttcctgccagtaagtcaagg

SEQ ID NO: 127262 - DNA, 25 bp, Mus musculus
actccttcctgcgagtaagtcaagg

SEQ ID NO: 127263 - DNA, 25 bp, Mus musculus
actccttctagacccggagctcggg

SEQ ID NO: 127264 - DNA, 25 bp, Mus musculus
actccttctagagccggagctcggg

SEQ ID NO: 127265 - DNA, 25 bp, Mus musculus
actccttctgagaggtccatgatgc

SEQ ID NO: 127266 - DNA, 25 bp, Mus musculus
actccttctgagtggtccatgatgc

SEQ ID NO: 127267 - DNA, 25 bp, Mus musculus
actccttcttgtactcttagtgtaa

SEQ ID NO: 127268 - DNA, 25 bp, Mus musculus
actccttcttgttctcttagtgtaa

SEQ ID NO: 127269 - DNA, 25 bp, Mus musculus
actccttctttcagagatgggctcg

SEQ ID NO: 127270 - DNA, 25 bp, Mus musculus
actccttctttctgagatgggctcg

SEQ ID NO: 127271 - DNA, 25 bp, Mus musculus
actccttctttgctgacagcttggc

SEQ ID NO: 127272 - DNA, 25 bp, Mus musculus
actccttctttggtgacagcttggc

SEQ ID NO: 127273 - DNA, 25 bp, Mus musculus
actccttgatgccagttcactggag

SEQ ID NO: 127274 - DNA, 25 bp, Mus musculus
actccttgatgcgagttcactggag

SEQ ID NO: 127275 - DNA, 25 bp, Mus musculus
actccttggttgactgaagctatgc

SEQ ID NO: 127276 - DNA, 25 bp, Mus musculus
actccttggttgtctgaagctatgc

SEQ ID NO: 127277 - DNA, 25 bp, Mus musculus
actccttgtaaccttctgtaactat

SEQ ID NO: 127278 - DNA, 25 bp, Mus musculus
actccttgtaacgttctgtaactat

SEQ ID NO: 127279 - DNA, 25 bp, Mus musculus
actccttgtagtagcaaccagtcta

SEQ ID NO: 127280 - DNA, 25 bp, Mus musculus
actccttgtagttgcaaccagtcta

SEQ ID NO: 127281 - DNA, 25 bp, Mus musculus
actcctttaatcctgtgtgaatctc

SEQ ID NO: 127282 - DNA, 25 bp, Mus musculus
actcctttaatcgtgtgtgaatctc

SEQ ID NO: 127283 - DNA, 25 bp, Mus musculus
actcctttacgcagttcacacagaa

SEQ ID NO: 127284 - DNA, 25 bp, Mus musculus
actcctttacgctgttcacacagaa

SEQ ID NO: 127285 - DNA, 25 bp, Mus musculus
actcctttatatatcacctaagaca

SEQ ID NO: 127286 - DNA, 25 bp, Mus musculus
actcctttatatttcacctaagaca

SEQ ID NO: 127287 - DNA, 25 bp, Mus musculus
actcctttcatcacaatttccttat

SEQ ID NO: 127288 - DNA, 25 bp, Mus musculus
actcctttcatctcaatttccttat

SEQ ID NO: 127289 - DNA, 25 bp, Mus musculus
actcctttccacatctctgaagata

SEQ ID NO: 127290 - DNA, 25 bp, Mus musculus
actcctttccacttctctgaagata

SEQ ID NO: 127291 - DNA, 25 bp, Mus musculus
actcctttcctgctactaacattat

SEQ ID NO: 127292 - DNA, 25 bp, Mus musculus
actcctttcctggtactaacattat

SEQ ID NO: 127293 - DNA, 25 bp, Mus musculus
actcctttctgtatactaccagtgg

SEQ ID NO: 127294 - DNA, 25 bp, Mus musculus
actcctttctgtttactaccagtgg

SEQ ID NO: 127295 - DNA, 25 bp, Mus musculus
actcctttcttcagtcagacagtca

SEQ ID NO: 127296 - DNA, 25 bp, Mus musculus
actcctttcttctgtcagacagtca

SEQ ID NO: 127297 - DNA, 25 bp, Mus musculus
actcctttgtgtaagccctgccagg

SEQ ID NO: 127298 - DNA, 25 bp, Mus musculus
actcctttgtgttagccctgccagg

SEQ ID NO: 127299 - DNA, 25 bp, Mus musculus
actccttttattactcagctctaaa

SEQ ID NO: 127300 - DNA, 25 bp, Mus musculus
actccttttatttctcagctctaaa

SEQ ID NO: 127301 - DNA, 25 bp, Mus musculus
actccttttgacaacagtaggtagc

SEQ ID NO: 127302 - DNA, 25 bp, Mus musculus
actccttttgactacagtaggtagc

SEQ ID NO: 127303 - DNA, 25 bp, Mus musculus
actcgaaccatacaagaatccccat

SEQ ID NO: 127304 - DNA, 25 bp, Mus musculus
actcgaaccatagaagaatccccat

SEQ ID NO: 127305 - DNA, 25 bp, Mus musculus
actcgaagccatacgaagtgccctt

SEQ ID NO: 127306 - DNA, 25 bp, Mus musculus
actcgaagccattcgaagtgccctt

SEQ ID NO: 127307 - DNA, 25 bp, Mus musculus
actcgaaggaagcactcccgggctg

SEQ ID NO: 127308 - DNA, 25 bp, Mus musculus
actcgaaggaaggactcccgggctg

SEQ ID NO: 127309 - DNA, 25 bp, Mus musculus
actcgaagtcggacttgtctgtctt

SEQ ID NO: 127310 - DNA, 25 bp, Mus musculus
actcgaagtcggtcttgtctgtctt

SEQ ID NO: 127311 - DNA, 25 bp, Mus musculus
actcgaatgcctcccacatctgtat

SEQ ID NO: 127312 - DNA, 25 bp, Mus musculus
actcgaatgcctgccacatctgtat

SEQ ID NO: 127313 - DNA, 25 bp, Mus musculus
actcgacctgagactgtagttacag

SEQ ID NO: 127314 - DNA, 25 bp, Mus musculus
actcgacctgagtctgtagttacag

SEQ ID NO: 127315 - DNA, 25 bp, Mus musculus
actcgactctcgagtgagggctcgg

SEQ ID NO: 127316 - DNA, 25 bp, Mus musculus
actcgactctcgtgtgagggctcgg

SEQ ID NO: 127317 - DNA, 25 bp, Mus musculus
actcgacttattaatcaggtgttgg

SEQ ID NO: 127318 - DNA, 25 bp, Mus musculus
actcgacttatttatcaggtgttgg

SEQ ID NO: 127319 - DNA, 25 bp, Mus musculus
actcgacttccacttcttttattat

SEQ ID NO: 127320 - DNA, 25 bp, Mus musculus
actcgacttccagttcttttattat

SEQ ID NO: 127321 - DNA, 25 bp, Mus musculus
actcgactttgtaagatgtatctac

SEQ ID NO: 127322 - DNA, 25 bp, Mus musculus
actcgactttgttagatgtatctac

SEQ ID NO: 127323 - DNA, 25 bp, Mus musculus
actcgagaccaccttactttatgat

SEQ ID NO: 127324 - DNA, 25 bp, Mus musculus
actcgagaccacgttactttatgat

SEQ ID NO: 127325 - DNA, 25 bp, Mus musculus
actcgagagagtaatgggacgctta

SEQ ID NO: 127326 - DNA, 25 bp, Mus musculus
actcgagagagttatgggacgctta

SEQ ID NO: 127327 - DNA, 25 bp, Mus musculus
actcgagcctctcttctgaccatag

SEQ ID NO: 127328 - DNA, 25 bp, Mus musculus
actcgagcctctgttctgaccatag

SEQ ID NO: 127329 - DNA, 25 bp, Mus musculus
actcgagccttaatggtggtgtccc

SEQ ID NO: 127330 - DNA, 25 bp, Mus musculus
actcgagccttattggtggtgtccc

SEQ ID NO: 127331 - DNA, 25 bp, Mus musculus
actcgagcggtacctccatagcgga

SEQ ID NO: 127332 - DNA, 25 bp, Mus musculus
actcgagcggtagctccatagcgga

SEQ ID NO: 127333 - DNA, 25 bp, Mus musculus
actcgagctgcgcttgacttggaag

SEQ ID NO: 127334 - DNA, 25 bp, Mus musculus
actcgagctgcggttgacttggaag

SEQ ID NO: 127335 - DNA, 25 bp, Mus musculus
actcgaggaaaaaggccaaggcgtc

SEQ ID NO: 127336 - DNA, 25 bp, Mus musculus
actcgaggaaaatggccaaggcgtc

SEQ ID NO: 127337 - DNA, 25 bp, Mus musculus
actcgaggactgacctacacagttt

SEQ ID NO: 127338 - DNA, 25 bp, Mus musculus
actcgaggactgtcctacacagttt

SEQ ID NO: 127339 - DNA, 25 bp, Mus musculus
actcgaggcccgagccagaagctgc

SEQ ID NO: 127340 - DNA, 25 bp, Mus musculus
actcgaggcccgtgccagaagctgc

SEQ ID NO: 127341 - DNA, 25 bp, Mus musculus
actcgaggctatctgtgctcctaaa

SEQ ID NO: 127342 - DNA, 25 bp, Mus musculus
actcgaggctatgtgtgctcctaaa

SEQ ID NO: 127343 - DNA, 25 bp, Mus musculus
actcgaggcttcagatgtattgggc

SEQ ID NO: 127344 - DNA, 25 bp, Mus musculus
actcgaggcttctgatgtattgggc

SEQ ID NO: 127345 - DNA, 25 bp, Mus musculus
actcgaggctttcaatgggacaccc

SEQ ID NO: 127346 - DNA, 25 bp, Mus musculus
actcgaggctttgaatgggacaccc

SEQ ID NO: 127347 - DNA, 25 bp, Mus musculus
actcgagtagcacgtaattgttttc

SEQ ID NO: 127348 - DNA, 25 bp, Mus musculus
actcgagtagcaggtaattgttttc

SEQ ID NO: 127349 - DNA, 25 bp, Mus musculus
actcgagtcaccagagtcaccaggg

SEQ ID NO: 127350 - DNA, 25 bp, Mus musculus
actcgagtcacctgagtcaccaggg

SEQ ID NO: 127351 - DNA, 25 bp, Mus musculus
actcgagtgagtatcagtgcccaaa

SEQ ID NO: 127352 - DNA, 25 bp, Mus musculus
actcgagtgagtttcagtgcccaaa

SEQ ID NO: 127353 - DNA, 25 bp, Mus musculus
actcgagtggacatacaactgttaa

SEQ ID NO: 127354 - DNA, 25 bp, Mus musculus
actcgagtggacttacaactgttaa

SEQ ID NO: 127355 - DNA, 25 bp, Mus musculus
actcgatcctgactccgttggtgag

SEQ ID NO: 127356 - DNA, 25 bp, Mus musculus
actcgatcctgagtccgttggtgag

SEQ ID NO: 127357 - DNA, 25 bp, Mus musculus
actcgatccttgcattgtcttgtag

SEQ ID NO: 127358 - DNA, 25 bp, Mus musculus
actcgatccttggattgtcttgtag

SEQ ID NO: 127359 - DNA, 25 bp, Mus musculus
actcgatgacccagttgcagagcga

SEQ ID NO: 127360 - DNA, 25 bp, Mus musculus
actcgatgaccctgttgcagagcga

SEQ ID NO: 127361 - DNA, 25 bp, Mus musculus
actcgatgacggacagtttgaccag

SEQ ID NO: 127362 - DNA, 25 bp, Mus musculus
actcgatgacggtcagtttgaccag

SEQ ID NO: 127363 - DNA, 25 bp, Mus musculus
actcgattgctgctaagccctggta

SEQ ID NO: 127364 - DNA, 25 bp, Mus musculus
actcgattgctggtaagccctggta

SEQ ID NO: 127365 - DNA, 25 bp, Mus musculus
actcgattttgtcttccgtacagga

SEQ ID NO: 127366 - DNA, 25 bp, Mus musculus
actcgattttgtgttccgtacagga

SEQ ID NO: 127367 - DNA, 25 bp, Mus musculus
actcgcacctggaaaacctgcagag

SEQ ID NO: 127368 - DNA, 25 bp, Mus musculus
actcgcacctggtaaacctgcagag

SEQ ID NO: 127369 - DNA, 25 bp, Mus musculus
actcgcactatgatttttactcatc

SEQ ID NO: 127370 - DNA, 25 bp, Mus musculus
actcgcactatgttttttactcatc

SEQ ID NO: 127371 - DNA, 25 bp, Mus musculus
actcgcataaacacgccgtacttgt

SEQ ID NO: 127372 - DNA, 25 bp, Mus musculus
actcgcataaactcgccgtacttgt

SEQ ID NO: 127373 - DNA, 25 bp, Mus musculus
actcgcatagggatgacactgtaag

SEQ ID NO: 127374 - DNA, 25 bp, Mus musculus
actcgcatagggttgacactgtaag

SEQ ID NO: 127375 - DNA, 25 bp, Mus musculus
actcgcatccgaatttctgtttgtt

SEQ ID NO: 127376 - DNA, 25 bp, Mus musculus
actcgcatccgattttctgtttgtt

SEQ ID NO: 127377 - DNA, 25 bp, Mus musculus
actcgcatgtccactgtctcagaag

SEQ ID NO: 127378 - DNA, 25 bp, Mus musculus
actcgcatgtcctctgtctcagaag

SEQ ID NO: 127379 - DNA, 25 bp, Mus musculus
actcgcatgttgactgttgtgtgga

SEQ ID NO: 127380 - DNA, 25 bp, Mus musculus
actcgcatgttgtctgttgtgtgga

SEQ ID NO: 127381 - DNA, 25 bp, Mus musculus
actcgccaccttagtgatggatgtt

SEQ ID NO: 127382 - DNA, 25 bp, Mus musculus
actcgccacctttgtgatggatgtt

SEQ ID NO: 127383 - DNA, 25 bp, Mus musculus
actcgccagcctattggagatctga

SEQ ID NO: 127384 - DNA, 25 bp, Mus musculus
actcgccagccttttggagatctga

SEQ ID NO: 127385 - DNA, 25 bp, Mus musculus
actcgcccctttacaaatacatgga

SEQ ID NO: 127386 - DNA, 25 bp, Mus musculus
actcgccccttttcaaatacatgga

SEQ ID NO: 127387 - DNA, 25 bp, Mus musculus
actcgccgctacacggatggctggt

SEQ ID NO: 127388 - DNA, 25 bp, Mus musculus
actcgccgctactcggatggctggt

SEQ ID NO: 127389 - DNA, 25 bp, Mus musculus
actcgcctcccacaaaagatgggtt

SEQ ID NO: 127390 - DNA, 25 bp, Mus musculus
actcgcctcccagaaaagatgggtt

SEQ ID NO: 127391 - DNA, 25 bp, Mus musculus
actcgcctctctatgattcaacatg

SEQ ID NO: 127392 - DNA, 25 bp, Mus musculus
actcgcctctctttgattcaacatg

SEQ ID NO: 127393 - DNA, 25 bp, Mus musculus
actcgcctgtgaagccgttcaagtg

SEQ ID NO: 127394 - DNA, 25 bp, Mus musculus
actcgcctgtgatgccgttcaagtg

SEQ ID NO: 127395 - DNA, 25 bp, Mus musculus
actcgcgacctcatcaacgttggtg

SEQ ID NO: 127396 - DNA, 25 bp, Mus musculus
actcgcgacctcttcaacgttggtg

SEQ ID NO: 127397 - DNA, 25 bp, Mus musculus
actcgcgtccagaaaggtctttgca

SEQ ID NO: 127398 - DNA, 25 bp, Mus musculus
actcgcgtccagtaaggtctttgca

SEQ ID NO: 127399 - DNA, 25 bp, Mus musculus
actcgcgttatccaaaagctgcgga

SEQ ID NO: 127400 - DNA, 25 bp, Mus musculus
actcgcgttatcgaaaagctgcgga

SEQ ID NO: 127401 - DNA, 25 bp, Mus musculus
actcgctagtccatataggattcct

SEQ ID NO: 127402 - DNA, 25 bp, Mus musculus
actcgctagtccttataggattcct

SEQ ID NO: 127403 - DNA, 25 bp, Mus musculus
actcgctcaactcaagatagttgga

SEQ ID NO: 127404 - DNA, 25 bp, Mus musculus
actcgctcaactgaagatagttgga

SEQ ID NO: 127405 - DNA, 25 bp, Mus musculus
actcgctcagccctagctcatagat

SEQ ID NO: 127406 - DNA, 25 bp, Mus musculus
actcgctcagccgtagctcatagat

SEQ ID NO: 127407 - DNA, 25 bp, Mus musculus
actcgctgacatatttggagcatca

SEQ ID NO: 127408 - DNA, 25 bp, Mus musculus
actcgctgacatttttggagcatca

SEQ ID NO: 127409 - DNA, 25 bp, Mus musculus
actcgcttaaaacgcactggctgta

SEQ ID NO: 127410 - DNA, 25 bp, Mus musculus
actcgcttaaaaggcactggctgta

SEQ ID NO: 127411 - DNA, 25 bp, Mus musculus
actcgcttatagagattcattaata

SEQ ID NO: 127412 - DNA, 25 bp, Mus musculus
actcgcttatagtgattcattaata

SEQ ID NO: 127413 - DNA, 25 bp, Mus musculus
actcgctttagtccctagtacagtg

SEQ ID NO: 127414 - DNA, 25 bp, Mus musculus
actcgctttagtgcctagtacagtg

SEQ ID NO: 127415 - DNA, 25 bp, Mus musculus
actcggaaagttagtgtctgcacgg

SEQ ID NO: 127416 - DNA, 25 bp, Mus musculus
actcggaaagtttgtgtctgcacgg

SEQ ID NO: 127417 - DNA, 25 bp, Mus musculus
actcggaagtagactgtgcagttta

SEQ ID NO: 127418 - DNA, 25 bp, Mus musculus
actcggaagtagtctgtgcagttta

SEQ ID NO: 127419 - DNA, 25 bp, Mus musculus
actcggaagtcaacatcctgggctt

SEQ ID NO: 127420 - DNA, 25 bp, Mus musculus
actcggaagtcatcatcctgggctt

SEQ ID NO: 127421 - DNA, 25 bp, Mus musculus
actcggaatataaacccatctgcaa

SEQ ID NO: 127422 - DNA, 25 bp, Mus musculus
actcggaatatatacccatctgcaa

SEQ ID NO: 127423 - DNA, 25 bp, Mus musculus
actcggagagcccagaaaacagact

SEQ ID NO: 127424 - DNA, 25 bp, Mus musculus
actcggagagccgagaaaacagact

SEQ ID NO: 127425 - DNA, 25 bp, Mus musculus
actcggagcacgacgggttacataa

SEQ ID NO: 127426 - DNA, 25 bp, Mus musculus
actcggagcacgtcgggttacataa

SEQ ID NO: 127427 - DNA, 25 bp, Mus musculus
actcggagcgacctttggctacgtg

SEQ ID NO: 127428 - DNA, 25 bp, Mus musculus
actcggagcgacgtttggctacgtg

SEQ ID NO: 127429 - DNA, 25 bp, Mus musculus
actcggagtcggagcagctgctgct

SEQ ID NO: 127430 - DNA, 25 bp, Mus musculus
actcggagtcggtgcagctgctgct

SEQ ID NO: 127431 - DNA, 25 bp, Mus musculus
actcggagtctgaagtcgggaccac

SEQ ID NO: 127432 - DNA, 25 bp, Mus musculus
actcggagtctgtagtcgggaccac

SEQ ID NO: 127433 - DNA, 25 bp, Mus musculus
actcggatcacaagtgggcgccact

SEQ ID NO: 127434 - DNA, 25 bp, Mus musculus
actcggatcacatgtgggcgccact

SEQ ID NO: 127435 - DNA, 25 bp, Mus musculus
actcggatccggagctgatgcagca

SEQ ID NO: 127436 - DNA, 25 bp, Mus musculus
actcggatccggtgctgatgcagca

SEQ ID NO: 127437 - DNA, 25 bp, Mus musculus
actcggatctttaccacacagttgc

SEQ ID NO: 127438 - DNA, 25 bp, Mus musculus
actcggatcttttccacacagttgc

SEQ ID NO: 127439 - DNA, 25 bp, Mus musculus
actcggatgcgccagctgagctatt

SEQ ID NO: 127440 - DNA, 25 bp, Mus musculus
actcggatgcgcgagctgagctatt

SEQ ID NO: 127441 - DNA, 25 bp, Mus musculus
actcggatggagatgtagcgctgac

SEQ ID NO: 127442 - DNA, 25 bp, Mus musculus
actcggatggagttgtagcgctgac

SEQ ID NO: 127443 - DNA, 25 bp, Mus musculus
actcggccaactaacgtcggcgtgc

SEQ ID NO: 127444 - DNA, 25 bp, Mus musculus
actcggccaacttacgtcggcgtgc

SEQ ID NO: 127445 - DNA, 25 bp, Mus musculus
actcggccatccaggaggtcaagga

SEQ ID NO: 127446 - DNA, 25 bp, Mus musculus
actcggccatcctggaggtcaagga

SEQ ID NO: 127447 - DNA, 25 bp, Mus musculus
actcggcctggcagttggttatgga

SEQ ID NO: 127448 - DNA, 25 bp, Mus musculus
actcggcctggctgttggttatgga

SEQ ID NO: 127449 - DNA, 25 bp, Mus musculus
actcggcgacttcaaattcagcagc

SEQ ID NO: 127450 - DNA, 25 bp, Mus musculus
actcggcgacttgaaattcagcagc

SEQ ID NO: 127451 - DNA, 25 bp, Mus musculus
actcggctctagagatacgggccaa

SEQ ID NO: 127452 - DNA, 25 bp, Mus musculus
actcggctctagtgatacgggccaa

SEQ ID NO: 127453 - DNA, 25 bp, Mus musculus
actcggcttgaaagtgcatgcaaaa

SEQ ID NO: 127454 - DNA, 25 bp, Mus musculus
actcggcttgaatgtgcatgcaaaa

SEQ ID NO: 127455 - DNA, 25 bp, Mus musculus
actcggctttctaattctctgatgg

SEQ ID NO: 127456 - DNA, 25 bp, Mus musculus
actcggctttcttattctctgatgg

SEQ ID NO: 127457 - DNA, 25 bp, Mus musculus
actcggctttggatgatcatcattg

SEQ ID NO: 127458 - DNA, 25 bp, Mus musculus
actcggctttggttgatcatcattg

SEQ ID NO: 127459 - DNA, 25 bp, Mus musculus
actcgggaagaaatgctttgcgttg

SEQ ID NO: 127460 - DNA, 25 bp, Mus musculus
actcgggaagaattgctttgcgttg

SEQ ID NO: 127461 - DNA, 25 bp, Mus musculus
actcgggacaccaagagcctgcagt

SEQ ID NO: 127462 - DNA, 25 bp, Mus musculus
actcgggacacctagagcctgcagt

SEQ ID NO: 127463 - DNA, 25 bp, Mus musculus
actcgggactgacacgattgcttct

SEQ ID NO: 127464 - DNA, 25 bp, Mus musculus
actcgggactgagacgattgcttct

SEQ ID NO: 127465 - DNA, 25 bp, Mus musculus
actcgggcaatcacaagtctcaaca

SEQ ID NO: 127466 - DNA, 25 bp, Mus musculus
actcgggcaatctcaagtctcaaca

SEQ ID NO: 127467 - DNA, 25 bp, Mus musculus
actcgggcacacagcaggtgtttgt

SEQ ID NO: 127468 - DNA, 25 bp, Mus musculus
actcgggcacactgcaggtgtttgt

SEQ ID NO: 127469 - DNA, 25 bp, Mus musculus
actcgggcatatctgtagctgttct

SEQ ID NO: 127470 - DNA, 25 bp, Mus musculus
actcgggcatatgtgtagctgttct

SEQ ID NO: 127471 - DNA, 25 bp, Mus musculus
actcgggccactcaacctgatgaaa

SEQ ID NO: 127472 - DNA, 25 bp, Mus musculus
actcgggccactgaacctgatgaaa

SEQ ID NO: 127473 - DNA, 25 bp, Mus musculus
actcgggccagactacagggacatg

SEQ ID NO: 127474 - DNA, 25 bp, Mus musculus
actcgggccagagtacagggacatg

SEQ ID NO: 127475 - DNA, 25 bp, Mus musculus
actcgggtctctacgtgtcattctt

SEQ ID NO: 127476 - DNA, 25 bp, Mus musculus
actcgggtctcttcgtgtcattctt

SEQ ID NO: 127477 - DNA, 25 bp, Mus musculus
actcgggtgaagaacgttcttcctg

SEQ ID NO: 127478 - DNA, 25 bp, Mus musculus
actcgggtgaagtacgttcttcctg

SEQ ID NO: 127479 - DNA, 25 bp, Mus musculus
actcgggtgatgacttctttggtta

SEQ ID NO: 127480 - DNA, 25 bp, Mus musculus
actcgggtgatgtcttctttggtta

SEQ ID NO: 127481 - DNA, 25 bp, Mus musculus
actcggtagacacgcaggcacctca

SEQ ID NO: 127482 - DNA, 25 bp, Mus musculus
actcggtagacaggcaggcacctca

SEQ ID NO: 127483 - DNA, 25 bp, Mus musculus
actcggtagagtcgatctggtgcta

SEQ ID NO: 127484 - DNA, 25 bp, Mus musculus
actcggtagagtggatctggtgcta

SEQ ID NO: 127485 - DNA, 25 bp, Mus musculus
actcggtagctcatatactggatca

SEQ ID NO: 127486 - DNA, 25 bp, Mus musculus
actcggtagctcttatactggatca

SEQ ID NO: 127487 - DNA, 25 bp, Mus musculus
actcggtatgtaagttaggctgaac

SEQ ID NO: 127488 - DNA, 25 bp, Mus musculus
actcggtatgtatgttaggctgaac

SEQ ID NO: 127489 - DNA, 25 bp, Mus musculus
actcggtcacttcgcctttcataat

SEQ ID NO: 127490 - DNA, 25 bp, Mus musculus
actcggtcacttggcctttcataat

SEQ ID NO: 127491 - DNA, 25 bp, Mus musculus
actcggtcagacagtatggtttttg

SEQ ID NO: 127492 - DNA, 25 bp, Mus musculus
actcggtcagactgtatggtttttg

SEQ ID NO: 127493 - DNA, 25 bp, Mus musculus
actcggtcatcgaggtgctgcggaa

SEQ ID NO: 127494 - DNA, 25 bp, Mus musculus
actcggtcatcgtggtgctgcggaa

SEQ ID NO: 127495 - DNA, 25 bp, Mus musculus
actcggtccagtaatcctcaagaaa

SEQ ID NO: 127496 - DNA, 25 bp, Mus musculus
actcggtccagttatcctcaagaaa

SEQ ID NO: 127497 - DNA, 25 bp, Mus musculus
actcggtccctaaacggcagaggat

SEQ ID NO: 127498 - DNA, 25 bp, Mus musculus
actcggtccctatacggcagaggat

SEQ ID NO: 127499 - DNA, 25 bp, Mus musculus
actcggtctcttcgctgtggttctg

SEQ ID NO: 127500 - DNA, 25 bp, Mus musculus
actcggtctcttggctgtggttctg

SEQ ID NO: 127501 - DNA, 25 bp, Mus musculus
actcggtgatacagaagcggcctat

SEQ ID NO: 127502 - DNA, 25 bp, Mus musculus
actcggtgatactgaagcggcctat

SEQ ID NO: 127503 - DNA, 25 bp, Mus musculus
actcggtgatggaggttctcctttg

SEQ ID NO: 127504 - DNA, 25 bp, Mus musculus
actcggtgatggtggttctcctttg

SEQ ID NO: 127505 - DNA, 25 bp, Mus musculus
actcggtgctgacgctgcatccaaa

SEQ ID NO: 127506 - DNA, 25 bp, Mus musculus
actcggtgctgaggctgcatccaaa

SEQ ID NO: 127507 - DNA, 25 bp, Mus musculus
actcggtggcttatcctgaacagga

SEQ ID NO: 127508 - DNA, 25 bp, Mus musculus
actcggtggcttttcctgaacagga

SEQ ID NO: 127509 - DNA, 25 bp, Mus musculus
actcggtgtatgcatctgtggtcat

SEQ ID NO: 127510 - DNA, 25 bp, Mus musculus
actcggtgtatggatctgtggtcat

SEQ ID NO: 127511 - DNA, 25 bp, Mus musculus
actcggtgtgccagtgatatctcca

SEQ ID NO: 127512 - DNA, 25 bp, Mus musculus
actcggtgtgcctgtgatatctcca

SEQ ID NO: 127513 - DNA, 25 bp, Mus musculus
actcggtgttggagcattcttaggg

SEQ ID NO: 127514 - DNA, 25 bp, Mus musculus
actcggtgttggtgcattcttaggg

SEQ ID NO: 127515 - DNA, 25 bp, Mus musculus
actcggttactcaaagtgcaccttc

SEQ ID NO: 127516 - DNA, 25 bp, Mus musculus
actcggttactctaagtgcaccttc

SEQ ID NO: 127517 - DNA, 25 bp, Mus musculus
actcggttatagaaggagctgaaat

SEQ ID NO: 127518 - DNA, 25 bp, Mus musculus
actcggttatagtaggagctgaaat

SEQ ID NO: 127519 - DNA, 25 bp, Mus musculus
actcggttcttgcttgcacacagaa

SEQ ID NO: 127520 - DNA, 25 bp, Mus musculus
actcggttcttggttgcacacagaa

SEQ ID NO: 127521 - DNA, 25 bp, Mus musculus
actcggttggccaaagtcgtgaaag

SEQ ID NO: 127522 - DNA, 25 bp, Mus musculus
actcggttggcctaagtcgtgaaag

SEQ ID NO: 127523 - DNA, 25 bp, Mus musculus
actcggttttgaatgtctctatggt

SEQ ID NO: 127524 - DNA, 25 bp, Mus musculus
actcggttttgattgtctctatggt

SEQ ID NO: 127525 - DNA, 25 bp, Mus musculus
actcgtacatttcatgcattgtgtt

SEQ ID NO: 127526 - DNA, 25 bp, Mus musculus
actcgtacatttgatgcattgtgtt

SEQ ID NO: 127527 - DNA, 25 bp, Mus musculus
actcgtagcccaaagctgtgatcaa

SEQ ID NO: 127528 - DNA, 25 bp, Mus musculus
actcgtagcccatagctgtgatcaa

SEQ ID NO: 127529 - DNA, 25 bp, Mus musculus
actcgtatgcttatgaatcttctag

SEQ ID NO: 127530 - DNA, 25 bp, Mus musculus
actcgtatgcttttgaatcttctag

SEQ ID NO: 127531 - DNA, 25 bp, Mus musculus
actcgtcagcgacatccggagtcac

SEQ ID NO: 127532 - DNA, 25 bp, Mus musculus
actcgtcagcgagatccggagtcac

SEQ ID NO: 127533 - DNA, 25 bp, Mus musculus
actcgtcctcataaactgtcaacat

SEQ ID NO: 127534 - DNA, 25 bp, Mus musculus
actcgtcctcattaactgtcaacat

SEQ ID NO: 127535 - DNA, 25 bp, Mus musculus
actcgtcggacacgtgctaggtgcc

SEQ ID NO: 127536 - DNA, 25 bp, Mus musculus
actcgtcggacaggtgctaggtgcc

SEQ ID NO: 127537 - DNA, 25 bp, Mus musculus
actcgtcgggtaacacatactaggt

SEQ ID NO: 127538 - DNA, 25 bp, Mus musculus
actcgtcgggtatcacatactaggt

SEQ ID NO: 127539 - DNA, 25 bp, Mus musculus
actcgtctgcatatgttctttggga

SEQ ID NO: 127540 - DNA, 25 bp, Mus musculus
actcgtctgcatttgttctttggga

SEQ ID NO: 127541 - DNA, 25 bp, Mus musculus
actcgtctgtccctgtgcctgggaa

SEQ ID NO: 127542 - DNA, 25 bp, Mus musculus
actcgtctgtccgtgtgcctgggaa

SEQ ID NO: 127543 - DNA, 25 bp, Mus musculus
actcgtcttgccaaggaagtgcaat

SEQ ID NO: 127544 - DNA, 25 bp, Mus musculus
actcgtcttgcctaggaagtgcaat

SEQ ID NO: 127545 - DNA, 25 bp, Mus musculus
actcgtgaggagagtttaccagcta

SEQ ID NO: 127546 - DNA, 25 bp, Mus musculus
actcgtgaggagtgtttaccagcta

SEQ ID NO: 127547 - DNA, 25 bp, Mus musculus
actcgtgaggtacaatgcattattt

SEQ ID NO: 127548 - DNA, 25 bp, Mus musculus
actcgtgaggtagaatgcattattt

SEQ ID NO: 127549 - DNA, 25 bp, Mus musculus
actcgtgaggtgcaaggactgctac

SEQ ID NO: 127550 - DNA, 25 bp, Mus musculus
actcgtgaggtggaaggactgctac

SEQ ID NO: 127551 - DNA, 25 bp, Mus musculus
actcgtgccaagctcattaagcttt

SEQ ID NO: 127552 - DNA, 25 bp, Mus musculus
actcgtgccaaggtcattaagcttt

SEQ ID NO: 127553 - DNA, 25 bp, Mus musculus
actcgtgcccttaatgagatgttgc

SEQ ID NO: 127554 - DNA, 25 bp, Mus musculus
actcgtgccctttatgagatgttgc

SEQ ID NO: 127555 - DNA, 25 bp, Mus musculus
actcgtgcgtgaagccggatttgat

SEQ ID NO: 127556 - DNA, 25 bp, Mus musculus
actcgtgcgtgatgccggatttgat

SEQ ID NO: 127557 - DNA, 25 bp, Mus musculus
actcgtgctttgctgacaagtgctt

SEQ ID NO: 127558 - DNA, 25 bp, Mus musculus
actcgtgctttggtgacaagtgctt

SEQ ID NO: 127559 - DNA, 25 bp, Mus musculus
actcgtggaactacgtctttggaca

SEQ ID NO: 127560 - DNA, 25 bp, Mus musculus
actcgtggaacttcgtctttggaca

SEQ ID NO: 127561 - DNA, 25 bp, Mus musculus
actcgtggtgatattaagattggaa

SEQ ID NO: 127562 - DNA, 25 bp, Mus musculus
actcgtggtgattttaagattggaa

SEQ ID NO: 127563 - DNA, 25 bp, Mus musculus
actcgtgtatcaagttgctttccat

SEQ ID NO: 127564 - DNA, 25 bp, Mus musculus
actcgtgtatcatgttgctttccat

SEQ ID NO: 127565 - DNA, 25 bp, Mus musculus
actcgtgtcccaaaacgatggtctt

SEQ ID NO: 127566 - DNA, 25 bp, Mus musculus
actcgtgtcccataacgatggtctt

SEQ ID NO: 127567 - DNA, 25 bp, Mus musculus
actcgtgttcacacaggcaaccata

SEQ ID NO: 127568 - DNA, 25 bp, Mus musculus
actcgtgttcactcaggcaaccata

SEQ ID NO: 127569 - DNA, 25 bp, Mus musculus
actcgtgttcccagatgactcggaa

SEQ ID NO: 127570 - DNA, 25 bp, Mus musculus
actcgtgttccctgatgactcggaa

SEQ ID NO: 127571 - DNA, 25 bp, Mus musculus
actcgtgttgagaagcaatgcttct

SEQ ID NO: 127572 - DNA, 25 bp, Mus musculus
actcgtgttgagtagcaatgcttct

SEQ ID NO: 127573 - DNA, 25 bp, Mus musculus
actcgttaccagaggcattaaggaa

SEQ ID NO: 127574 - DNA, 25 bp, Mus musculus
actcgttaccagtggcattaaggaa

SEQ ID NO: 127575 - DNA, 25 bp, Mus musculus
actcgttaggccaggcttttgttag

SEQ ID NO: 127576 - DNA, 25 bp, Mus musculus
actcgttaggcctggcttttgttag

SEQ ID NO: 127577 - DNA, 25 bp, Mus musculus
actcgttcctacatcaacatggtgt

SEQ ID NO: 127578 - DNA, 25 bp, Mus musculus
actcgttcctacttcaacatggtgt

SEQ ID NO: 127579 - DNA, 25 bp, Mus musculus
actcgttcctcaagtgtgaatgttt

SEQ ID NO: 127580 - DNA, 25 bp, Mus musculus
actcgttcctcatgtgtgaatgttt

SEQ ID NO: 127581 - DNA, 25 bp, Mus musculus
actcgttctcttcaagcttgggcca

SEQ ID NO: 127582 - DNA, 25 bp, Mus musculus
actcgttctcttgaagcttgggcca

SEQ ID NO: 127583 - DNA, 25 bp, Mus musculus
actcgttctgtcactttctgctttt

SEQ ID NO: 127584 - DNA, 25 bp, Mus musculus
actcgttctgtctctttctgctttt

SEQ ID NO: 127585 - DNA, 25 bp, Mus musculus
actcgttgatagacaaccaagctcg

SEQ ID NO: 127586 - DNA, 25 bp, Mus musculus
actcgttgatagtcaaccaagctcg

SEQ ID NO: 127587 - DNA, 25 bp, Mus musculus
actcgtttcataatgcttgtggtca

SEQ ID NO: 127588 - DNA, 25 bp, Mus musculus
actcgtttcatattgcttgtggtca

SEQ ID NO: 127589 - DNA, 25 bp, Mus musculus
actctaaaagccatatggtccccat

SEQ ID NO: 127590 - DNA, 25 bp, Mus musculus
actctaaaagccttatggtccccat

SEQ ID NO: 127591 - DNA, 25 bp, Mus musculus
actctaaacaggagtccatgggcaa

SEQ ID NO: 127592 - DNA, 25 bp, Mus musculus
actctaaacaggtgtccatgggcaa

SEQ ID NO: 127593 - DNA, 25 bp, Mus musculus
actctaaagtttcgctgaagaccta

SEQ ID NO: 127594 - DNA, 25 bp, Mus musculus
actctaaagtttggctgaagaccta

SEQ ID NO: 127595 - DNA, 25 bp, Mus musculus
actctaacaacacctcgctgtatct

SEQ ID NO: 127596 - DNA, 25 bp, Mus musculus
actctaacaacagctcgctgtatct

SEQ ID NO: 127597 - DNA, 25 bp, Mus musculus
actctaactgtgagcctggatccag

SEQ ID NO: 127598 - DNA, 25 bp, Mus musculus
actctaactgtgtgcctggatccag

SEQ ID NO: 127599 - DNA, 25 bp, Mus musculus
actctaagaactactggcccatgaa

SEQ ID NO: 127600 - DNA, 25 bp, Mus musculus
actctaagaacttctggcccatgaa

SEQ ID NO: 127601 - DNA, 25 bp, Mus musculus
actctaagctacatatctcccaaag

SEQ ID NO: 127602 - DNA, 25 bp, Mus musculus
actctaagctacttatctcccaaag

SEQ ID NO: 127603 - DNA, 25 bp, Mus musculus
actctaagttccaagaagccctttg

SEQ ID NO: 127604 - DNA, 25 bp, Mus musculus
actctaagttccctgtttacttctg

SEQ ID NO: 127605 - DNA, 25 bp, Mus musculus
actctaagttccgtgtttacttctg

SEQ ID NO: 127606 - DNA, 25 bp, Mus musculus
actctaagttcctagaagccctttg

SEQ ID NO: 127607 - DNA, 25 bp, Mus musculus
actctaattgtcaacaccagtgcca

SEQ ID NO: 127608 - DNA, 25 bp, Mus musculus
actctaattgtctacaccagtgcca

SEQ ID NO: 127609 - DNA, 25 bp, Mus musculus
actctacagctaaaggccctggcag

SEQ ID NO: 127610 - DNA, 25 bp, Mus musculus
actctacagctataggccctggcag

SEQ ID NO: 127611 - DNA, 25 bp, Mus musculus
actctacagtccatatggcaatcgg

SEQ ID NO: 127612 - DNA, 25 bp, Mus musculus
actctacagtccttatggcaatcgg

SEQ ID NO: 127613 - DNA, 25 bp, Mus musculus
actctacatatgctgaactccgctt

SEQ ID NO: 127614 - DNA, 25 bp, Mus musculus
actctacatatggtgaactccgctt

SEQ ID NO: 127615 - DNA, 25 bp, Mus musculus
actctacattttcctgtttcagttt

SEQ ID NO: 127616 - DNA, 25 bp, Mus musculus
actctacattttgctgtttcagttt

SEQ ID NO: 127617 - DNA, 25 bp, Mus musculus
actctaccacatatctagtccaaag

SEQ ID NO: 127618 - DNA, 25 bp, Mus musculus
actctaccacatttctagtccaaag

SEQ ID NO: 127619 - DNA, 25 bp, Mus musculus
actctaccctggctttattgtgtct

SEQ ID NO: 127620 - DNA, 25 bp, Mus musculus
actctaccctgggtttattgtgtct

SEQ ID NO: 127621 - DNA, 25 bp, Mus musculus
actctacctctcagggctgacattt

SEQ ID NO: 127622 - DNA, 25 bp, Mus musculus
actctacctctctgggctgacattt

SEQ ID NO: 127623 - DNA, 25 bp, Mus musculus
actctacctggtaccatatctgtgg

SEQ ID NO: 127624 - DNA, 25 bp, Mus musculus
actctacctggttccatatctgtgg

SEQ ID NO: 127625 - DNA, 25 bp, Mus musculus
actctaccttgtcatctagccagat

SEQ ID NO: 127626 - DNA, 25 bp, Mus musculus
actctaccttgtgatctagccagat

SEQ ID NO: 127627 - DNA, 25 bp, Mus musculus
actctacgtacaaaatgtcccctgt

SEQ ID NO: 127628 - DNA, 25 bp, Mus musculus
actctacgtacataatgtcccctgt

SEQ ID NO: 127629 - DNA, 25 bp, Mus musculus
actctactatcacaaacccttcaaa

SEQ ID NO: 127630 - DNA, 25 bp, Mus musculus
actctactatcagaaacccttcaaa

SEQ ID NO: 127631 - DNA, 25 bp, Mus musculus
actctactcagacaactcttcctgg

SEQ ID NO: 127632 - DNA, 25 bp, Mus musculus
actctactcagagaactcttcctgg

SEQ ID NO: 127633 - DNA, 25 bp, Mus musculus
actctactcccactgttttgacgaa

SEQ ID NO: 127634 - DNA, 25 bp, Mus musculus
actctactcccagtgttttgacgaa

SEQ ID NO: 127635 - DNA, 25 bp, Mus musculus
actctactcgcactcctcagatggt

SEQ ID NO: 127636 - DNA, 25 bp, Mus musculus
actctactcgcagtcctcagatggt

SEQ ID NO: 127637 - DNA, 25 bp, Mus musculus
actctactgctgacaactaagccgc

SEQ ID NO: 127638 - DNA, 25 bp, Mus musculus
actctactgctgtcaactaagccgc

SEQ ID NO: 127639 - DNA, 25 bp, Mus musculus
actctactgcttccgcgtgactaat

SEQ ID NO: 127640 - DNA, 25 bp, Mus musculus
actctactgcttgcgcgtgactaat

SEQ ID NO: 127641 - DNA, 25 bp, Mus musculus
actctactgtagactgccttgagca

SEQ ID NO: 127642 - DNA, 25 bp, Mus musculus
actctactgtagtctgccttgagca

SEQ ID NO: 127643 - DNA, 25 bp, Mus musculus
actctactgtgtacccttgctgcag

SEQ ID NO: 127644 - DNA, 25 bp, Mus musculus
actctactgtgttcccttgctgcag

SEQ ID NO: 127645 - DNA, 25 bp, Mus musculus
actctacttctcagttggttctttt

SEQ ID NO: 127646 - DNA, 25 bp, Mus musculus
actctacttctctgttggttctttt

SEQ ID NO: 127647 - DNA, 25 bp, Mus musculus
actctactttctcggttcgtatcct

SEQ ID NO: 127648 - DNA, 25 bp, Mus musculus
actctactttctgggttcgtatcct

SEQ ID NO: 127649 - DNA, 25 bp, Mus musculus
actctagacagacccctgaaagcac

SEQ ID NO: 127650 - DNA, 25 bp, Mus musculus
actctagacagagccctgaaagcac

SEQ ID NO: 127651 - DNA, 25 bp, Mus musculus
actctagaccatcacgtcagccatg

SEQ ID NO: 127652 - DNA, 25 bp, Mus musculus
actctagaccatgacgtcagccatg

SEQ ID NO: 127653 - DNA, 25 bp, Mus musculus
actctagactctatggaggagccca

SEQ ID NO: 127654 - DNA, 25 bp, Mus musculus
actctagactctttggaggagccca

SEQ ID NO: 127655 - DNA, 25 bp, Mus musculus
actctagatgtcagtgtggtaccaa

SEQ ID NO: 127656 - DNA, 25 bp, Mus musculus
actctagatgtctgtgtggtaccaa

SEQ ID NO: 127657 - DNA, 25 bp, Mus musculus
actctagccactatctgtcctgttg

SEQ ID NO: 127658 - DNA, 25 bp, Mus musculus
actctagccactttctgtcctgttg

SEQ ID NO: 127659 - DNA, 25 bp, Mus musculus
actctagcctcaaagaaagtcccag

SEQ ID NO: 127660 - DNA, 25 bp, Mus musculus
actctagcctcatagaaagtcccag

SEQ ID NO: 127661 - DNA, 25 bp, Mus musculus
actctagcctgtcctgagaacatct

SEQ ID NO: 127662 - DNA, 25 bp, Mus musculus
actctagcctgtgctgagaacatct

SEQ ID NO: 127663 - DNA, 25 bp, Mus musculus
actctagcttgtctcccattgacat

SEQ ID NO: 127664 - DNA, 25 bp, Mus musculus
actctagcttgtgtcccattgacat

SEQ ID NO: 127665 - DNA, 25 bp, Mus musculus
actctaggcgtgagcagctcatgtg

SEQ ID NO: 127666 - DNA, 25 bp, Mus musculus
actctaggcgtgtgcagctcatgtg

SEQ ID NO: 127667 - DNA, 25 bp, Mus musculus
actctaggctctcggaggctgcatc

SEQ ID NO: 127668 - DNA, 25 bp, Mus musculus
actctaggctctgggaggctgcatc

SEQ ID NO: 127669 - DNA, 25 bp, Mus musculus
actctaggctgtcagcaggctgcca

SEQ ID NO: 127670 - DNA, 25 bp, Mus musculus
actctaggctgtgagcaggctgcca

SEQ ID NO: 127671 - DNA, 25 bp, Mus musculus
actctagggcccaatgtgctgccag

SEQ ID NO: 127672 - DNA, 25 bp, Mus musculus
actctagggccctatgtgctgccag

SEQ ID NO: 127673 - DNA, 25 bp, Mus musculus
actctagtccccaaatgccaaatat

SEQ ID NO: 127674 - DNA, 25 bp, Mus musculus
actctagtcccctaatgccaaatat

SEQ ID NO: 127675 - DNA, 25 bp, Mus musculus
actctagttgtcagttgctgctcac

SEQ ID NO: 127676 - DNA, 25 bp, Mus musculus
actctagttgtctgttgctgctcac

SEQ ID NO: 127677 - DNA, 25 bp, Mus musculus
actctataagtcagtgagggctgca

SEQ ID NO: 127678 - DNA, 25 bp, Mus musculus
actctataagtctgtgagggctgca

SEQ ID NO: 127679 - DNA, 25 bp, Mus musculus
actctataattccagatgcctccga

SEQ ID NO: 127680 - DNA, 25 bp, Mus musculus
actctataattcgagatgcctccga

SEQ ID NO: 127681 - DNA, 25 bp, Mus musculus
actctatacacacaggaccgcctgg

SEQ ID NO: 127682 - DNA, 25 bp, Mus musculus
actctatacacagaggaccgcctgg

SEQ ID NO: 127683 - DNA, 25 bp, Mus musculus
actctatagaggaattttcttcctt

SEQ ID NO: 127684 - DNA, 25 bp, Mus musculus
actctatagaggtattttcttcctt

SEQ ID NO: 127685 - DNA, 25 bp, Mus musculus
actctatagcttcaagtctgccttc

SEQ ID NO: 127686 - DNA, 25 bp, Mus musculus
actctatagcttgaagtctgccttc

SEQ ID NO: 127687 - DNA, 25 bp, Mus musculus
actctatcagttaggttctgttttg

SEQ ID NO: 127688 - DNA, 25 bp, Mus musculus
actctatcagtttggttctgttttg

SEQ ID NO: 127689 - DNA, 25 bp, Mus musculus
actctatctatgactcttacttcgt

SEQ ID NO: 127690 - DNA, 25 bp, Mus musculus
actctatctatgtctcttacttcgt

SEQ ID NO: 127691 - DNA, 25 bp, Mus musculus
actctatgcccgacaacaatacatg

SEQ ID NO: 127692 - DNA, 25 bp, Mus musculus
actctatgcccgtcaacaatacatg

SEQ ID NO: 127693 - DNA, 25 bp, Mus musculus
actctatgtgagattccgagatctg

SEQ ID NO: 127694 - DNA, 25 bp, Mus musculus
actctatgtgagtttccgagatctg

SEQ ID NO: 127695 - DNA, 25 bp, Mus musculus
actctatgtgtactttatcctcctc

SEQ ID NO: 127696 - DNA, 25 bp, Mus musculus
actctatgtgtagtttatcctcctc

SEQ ID NO: 127697 - DNA, 25 bp, Mus musculus
actctatgttgactttgcgatgccc

SEQ ID NO: 127698 - DNA, 25 bp, Mus musculus
actctatgttgagtttgcgatgccc

SEQ ID NO: 127699 - DNA, 25 bp, Mus musculus
actctattccatactatatccgttg

SEQ ID NO: 127700 - DNA, 25 bp, Mus musculus
actctattccattctatatccgttg

SEQ ID NO: 127701 - DNA, 25 bp, Mus musculus
actctatttgagatgctggttatta

SEQ ID NO: 127702 - DNA, 25 bp, Mus musculus
actctatttgagttgctggttatta

SEQ ID NO: 127703 - DNA, 25 bp, Mus musculus
actctatttttcatcattcccttat

SEQ ID NO: 127704 - DNA, 25 bp, Mus musculus
actctatttttcttcattcccttat

SEQ ID NO: 127705 - DNA, 25 bp, Mus musculus
actctcaacaaaattttccagccca

SEQ ID NO: 127706 - DNA, 25 bp, Mus musculus
actctcaacaaatttttccagccca

SEQ ID NO: 127707 - DNA, 25 bp, Mus musculus
actctcaacattaccatctatctaa

SEQ ID NO: 127708 - DNA, 25 bp, Mus musculus
actctcaacatttccatctatctaa

SEQ ID NO: 127709 - DNA, 25 bp, Mus musculus
actctcaaccagatattcttatttt

SEQ ID NO: 127710 - DNA, 25 bp, Mus musculus
actctcaaccagttattcttatttt

SEQ ID NO: 127711 - DNA, 25 bp, Mus musculus
actctcaaccatactctgttcctgt

SEQ ID NO: 127712 - DNA, 25 bp, Mus musculus
actctcaaccattctctgttcctgt

SEQ ID NO: 127713 - DNA, 25 bp, Mus musculus
actctcaacttcatcagtgtcatgt

SEQ ID NO: 127714 - DNA, 25 bp, Mus musculus
actctcaacttcttcagtgtcatgt

SEQ ID NO: 127715 - DNA, 25 bp, Mus musculus
actctcaaggacacttctttctttc

SEQ ID NO: 127716 - DNA, 25 bp, Mus musculus
actctcaaggactcttctttctttc

SEQ ID NO: 127717 - DNA, 25 bp, Mus musculus
actctcaagggcattgcgttcgtag

SEQ ID NO: 127718 - DNA, 25 bp, Mus musculus
actctcaagggctttgcgttcgtag

SEQ ID NO: 127719 - DNA, 25 bp, Mus musculus
actctcaagtgcagatatactggcc

SEQ ID NO: 127720 - DNA, 25 bp, Mus musculus
actctcaagtgctgatatactggcc

SEQ ID NO: 127721 - DNA, 25 bp, Mus musculus
actctcaatcacctttggttttgtg

SEQ ID NO: 127722 - DNA, 25 bp, Mus musculus
actctcaatcacgtttggttttgtg

SEQ ID NO: 127723 - DNA, 25 bp, Mus musculus
actctcaatgacactgatctccggt

SEQ ID NO: 127724 - DNA, 25 bp, Mus musculus
actctcaatgactctgatctccggt

SEQ ID NO: 127725 - DNA, 25 bp, Mus musculus
actctcaatgctaccatctttaggc

SEQ ID NO: 127726 - DNA, 25 bp, Mus musculus
actctcaatgcttccatctttaggc

SEQ ID NO: 127727 - DNA, 25 bp, Mus musculus
actctcacaattcacgggaaaacag

SEQ ID NO: 127728 - DNA, 25 bp, Mus musculus
actctcacaattgacgggaaaacag

SEQ ID NO: 127729 - DNA, 25 bp, Mus musculus
actctcaccactcttcaatctgaaa

SEQ ID NO: 127730 - DNA, 25 bp, Mus musculus
actctcaccactgttcaatctgaaa

SEQ ID NO: 127731 - DNA, 25 bp, Mus musculus
actctcacccgaactgcgacagatt

SEQ ID NO: 127732 - DNA, 25 bp, Mus musculus
actctcacccgatctgcgacagatt

SEQ ID NO: 127733 - DNA, 25 bp, Mus musculus
actctcaccttcctctgtaaaaata

SEQ ID NO: 127734 - DNA, 25 bp, Mus musculus
actctcaccttcgtctgtaaaaata

SEQ ID NO: 127735 - DNA, 25 bp, Mus musculus
actctcacgtatctcattccttcat

SEQ ID NO: 127736 - DNA, 25 bp, Mus musculus
actctcacgtatgtcattccttcat

SEQ ID NO: 127737 - DNA, 25 bp, Mus musculus
actctcacgtcactggagactgtgt

SEQ ID NO: 127738 - DNA, 25 bp, Mus musculus
actctcacgtcagtggagactgtgt

SEQ ID NO: 127739 - DNA, 25 bp, Mus musculus
actctcactccacagtttgtacaga

SEQ ID NO: 127740 - DNA, 25 bp, Mus musculus
actctcactccagagtttgtacaga

SEQ ID NO: 127741 - DNA, 25 bp, Mus musculus
actctcactgagctccgtgtagata

SEQ ID NO: 127742 - DNA, 25 bp, Mus musculus
actctcactgaggtccgtgtagata

SEQ ID NO: 127743 - DNA, 25 bp, Mus musculus
actctcactgggattcaaaggcgtt

SEQ ID NO: 127744 - DNA, 25 bp, Mus musculus
actctcactgggtttcaaaggcgtt

SEQ ID NO: 127745 - DNA, 25 bp, Mus musculus
actctcacttgactggcatccagag

SEQ ID NO: 127746 - DNA, 25 bp, Mus musculus
actctcacttgagtggcatccagag

SEQ ID NO: 127747 - DNA, 25 bp, Mus musculus
actctcagagaaaagcgtaccccag

SEQ ID NO: 127748 - DNA, 25 bp, Mus musculus
actctcagagaatagcgtaccccag

SEQ ID NO: 127749 - DNA, 25 bp, Mus musculus
actctcagagcactgtggtgtcctt

SEQ ID NO: 127750 - DNA, 25 bp, Mus musculus
actctcagagcagtgtggtgtcctt

SEQ ID NO: 127751 - DNA, 25 bp, Mus musculus
actctcagcatacgtctcaggacgg

SEQ ID NO: 127752 - DNA, 25 bp, Mus musculus
actctcagcataggtctcaggacgg

SEQ ID NO: 127753 - DNA, 25 bp, Mus musculus
actctcaggagtcgcaagccccata

SEQ ID NO: 127754 - DNA, 25 bp, Mus musculus
actctcaggagtggcaagccccata

SEQ ID NO: 127755 - DNA, 25 bp, Mus musculus
actctcaggctgagactgtccagaa

SEQ ID NO: 127756 - DNA, 25 bp, Mus musculus
actctcaggctgtgactgtccagaa

SEQ ID NO: 127757 - DNA, 25 bp, Mus musculus
actctcaggtggacgacatggatgt

SEQ ID NO: 127758 - DNA, 25 bp, Mus musculus
actctcaggtggtcgacatggatgt

SEQ ID NO: 127759 - DNA, 25 bp, Mus musculus
actctcatcacacaatctcgttggc

SEQ ID NO: 127760 - DNA, 25 bp, Mus musculus
actctcatcacagaatctcgttggc

SEQ ID NO: 127761 - DNA, 25 bp, Mus musculus
actctcatcagacgcacattggtgc

SEQ ID NO: 127762 - DNA, 25 bp, Mus musculus
actctcatcagaggcacattggtgc

SEQ ID NO: 127763 - DNA, 25 bp, Mus musculus
actctcatgctcaaagtggaactta

SEQ ID NO: 127764 - DNA, 25 bp, Mus musculus
actctcatgctctaagtggaactta

SEQ ID NO: 127765 - DNA, 25 bp, Mus musculus
actctcatgtgacctgatagacttt

SEQ ID NO: 127766 - DNA, 25 bp, Mus musculus
actctcatgtgagctgatagacttt

SEQ ID NO: 127767 - DNA, 25 bp, Mus musculus
actctcattgcaacttgtcactttg

SEQ ID NO: 127768 - DNA, 25 bp, Mus musculus
actctcattgcatcttgtcactttg

SEQ ID NO: 127769 - DNA, 25 bp, Mus musculus
actctcatttccaacagttctgaac

SEQ ID NO: 127770 - DNA, 25 bp, Mus musculus
actctcatttcctacagttctgaac

SEQ ID NO: 127771 - DNA, 25 bp, Mus musculus
actctccacctgcttgaacttgttg

SEQ ID NO: 127772 - DNA, 25 bp, Mus musculus
actctccacctggttgaacttgttg

SEQ ID NO: 127773 - DNA, 25 bp, Mus musculus
actctccagattactaccaggtggc

SEQ ID NO: 127774 - DNA, 25 bp, Mus musculus
actctccagatttctaccaggtggc

SEQ ID NO: 127775 - DNA, 25 bp, Mus musculus
actctccaggtacatcattcattcc

SEQ ID NO: 127776 - DNA, 25 bp, Mus musculus
actctccaggtagatcattcattcc

SEQ ID NO: 127777 - DNA, 25 bp, Mus musculus
actctccatactctcattcagctaa

SEQ ID NO: 127778 - DNA, 25 bp, Mus musculus
actctccatactgtcattcagctaa

SEQ ID NO: 127779 - DNA, 25 bp, Mus musculus
actctccatctaaatggtggtagac

SEQ ID NO: 127780 - DNA, 25 bp, Mus musculus
actctccatctatatggtggtagac

SEQ ID NO: 127781 - DNA, 25 bp, Mus musculus
actctcccaaggcagagctgttgca

SEQ ID NO: 127782 - DNA, 25 bp, Mus musculus
actctcccaagggagagctgttgca

SEQ ID NO: 127783 - DNA, 25 bp, Mus musculus
actctcccagcgaggtcactagcaa

SEQ ID NO: 127784 - DNA, 25 bp, Mus musculus
actctcccagcgtggtcactagcaa

SEQ ID NO: 127785 - DNA, 25 bp, Mus musculus
actctcccagtgatactattgtgtg

SEQ ID NO: 127786 - DNA, 25 bp, Mus musculus
actctcccagtgttactattgtgtg

SEQ ID NO: 127787 - DNA, 25 bp, Mus musculus
actctcccagttcctatgcaggtta

SEQ ID NO: 127788 - DNA, 25 bp, Mus musculus
actctcccagttgctatgcaggtta

SEQ ID NO: 127789 - DNA, 25 bp, Mus musculus
actctccccaggctgctaagaatga

SEQ ID NO: 127790 - DNA, 25 bp, Mus musculus
actctccccagggtgctaagaatga

SEQ ID NO: 127791 - DNA, 25 bp, Mus musculus
actctcccctttattggtactatag

SEQ ID NO: 127792 - DNA, 25 bp, Mus musculus
actctccccttttttggtactatag

SEQ ID NO: 127793 - DNA, 25 bp, Mus musculus
actctcccgtgtaggcatgcatgag

SEQ ID NO: 127794 - DNA, 25 bp, Mus musculus
actctcccgtgttggcatgcatgag

SEQ ID NO: 127795 - DNA, 25 bp, Mus musculus
actctcccgttgagtctgaagtgtc

SEQ ID NO: 127796 - DNA, 25 bp, Mus musculus
actctcccgttgtgtctgaagtgtc

SEQ ID NO: 127797 - DNA, 25 bp, Mus musculus
actctccctacacagaggatgcggg

SEQ ID NO: 127798 - DNA, 25 bp, Mus musculus
actctccctacagagaggatgcggg

SEQ ID NO: 127799 - DNA, 25 bp, Mus musculus
actctccctagccatttactaaaga

SEQ ID NO: 127800 - DNA, 25 bp, Mus musculus
actctccctagcgatttactaaaga

SEQ ID NO: 127801 - DNA, 25 bp, Mus musculus
actctcccttcacgctatggtctgg

SEQ ID NO: 127802 - DNA, 25 bp, Mus musculus
actctcccttcaggctatggtctgg

SEQ ID NO: 127803 - DNA, 25 bp, Mus musculus
actctcccttttcggattgttgacg

SEQ ID NO: 127804 - DNA, 25 bp, Mus musculus
actctcccttttcttgccaatgatc

SEQ ID NO: 127805 - DNA, 25 bp, Mus musculus
actctcccttttgggattgttgacg

SEQ ID NO: 127806 - DNA, 25 bp, Mus musculus
actctcccttttgttgccaatgatc

SEQ ID NO: 127807 - DNA, 25 bp, Mus musculus
actctccggtgtacttttgatatca

SEQ ID NO: 127808 - DNA, 25 bp, Mus musculus
actctccggtgttcttttgatatca

SEQ ID NO: 127809 - DNA, 25 bp, Mus musculus
actctcctaacaaggatctcaccat

SEQ ID NO: 127810 - DNA, 25 bp, Mus musculus
actctcctaacatggatctcaccat

SEQ ID NO: 127811 - DNA, 25 bp, Mus musculus
actctcctagagaataaaatgtgaa

SEQ ID NO: 127812 - DNA, 25 bp, Mus musculus
actctcctagagtataaaatgtgaa

SEQ ID NO: 127813 - DNA, 25 bp, Mus musculus
actctcctattactttcgcctggaa

SEQ ID NO: 127814 - DNA, 25 bp, Mus musculus
actctcctattagtttcgcctggaa

SEQ ID NO: 127815 - DNA, 25 bp, Mus musculus
actctcctcctcaggaattgactta

SEQ ID NO: 127816 - DNA, 25 bp, Mus musculus
actctcctcctctggaattgactta

SEQ ID NO: 127817 - DNA, 25 bp, Mus musculus
actctcctctgtccatattgatgtg

SEQ ID NO: 127818 - DNA, 25 bp, Mus musculus
actctcctctgtgcatattgatgtg

SEQ ID NO: 127819 - DNA, 25 bp, Mus musculus
actctcctgagtataatttgctctt

SEQ ID NO: 127820 - DNA, 25 bp, Mus musculus
actctcctgagtttaatttgctctt

SEQ ID NO: 127821 - DNA, 25 bp, Mus musculus
actctcctgatgagatggctgctca

SEQ ID NO: 127822 - DNA, 25 bp, Mus musculus
actctcctgatgtgatggctgctca

SEQ ID NO: 127823 - DNA, 25 bp, Mus musculus
actctcctgtatccacttctcagaa

SEQ ID NO: 127824 - DNA, 25 bp, Mus musculus
actctcctgtatgcacttctcagaa

SEQ ID NO: 127825 - DNA, 25 bp, Mus musculus
actctcctgtgtatgcttaccagta

SEQ ID NO: 127826 - DNA, 25 bp, Mus musculus
actctcctgtgtttgcttaccagta

SEQ ID NO: 127827 - DNA, 25 bp, Mus musculus
actctcctgttgcacttaaaaccat

SEQ ID NO: 127828 - DNA, 25 bp, Mus musculus
actctcctgttggacttaaaaccat

SEQ ID NO: 127829 - DNA, 25 bp, Mus musculus
actctcctgtttactattccagagc

SEQ ID NO: 127830 - DNA, 25 bp, Mus musculus
actctcctgttttctattccagagc

SEQ ID NO: 127831 - DNA, 25 bp, Mus musculus
actctccttgtcattatacatccaa

SEQ ID NO: 127832 - DNA, 25 bp, Mus musculus
actctccttgtctttatacatccaa

SEQ ID NO: 127833 - DNA, 25 bp, Mus musculus
actctccttttgcatgtcttgtaaa

SEQ ID NO: 127834 - DNA, 25 bp, Mus musculus
actctccttttggatgtcttgtaaa

SEQ ID NO: 127835 - DNA, 25 bp, Mus musculus
actctcgatagaccagtatgagcta

SEQ ID NO: 127836 - DNA, 25 bp, Mus musculus
actctcgatagagcagtatgagcta

SEQ ID NO: 127837 - DNA, 25 bp, Mus musculus
actctcggaatgcttttctgtcttc

SEQ ID NO: 127838 - DNA, 25 bp, Mus musculus
actctcggaatggttttctgtcttc

SEQ ID NO: 127839 - DNA, 25 bp, Mus musculus
actctcggctgccaatgtgtgtctg

SEQ ID NO: 127840 - DNA, 25 bp, Mus musculus
actctcggctgcgaatgtgtgtctg

SEQ ID NO: 127841 - DNA, 25 bp, Mus musculus
actctcgggatgctgctctgatcat

SEQ ID NO: 127842 - DNA, 25 bp, Mus musculus
actctcgggatggtgctctgatcat

SEQ ID NO: 127843 - DNA, 25 bp, Mus musculus
actctcgggattctgtcaatgtcac

SEQ ID NO: 127844 - DNA, 25 bp, Mus musculus
actctcgggattgtgtcaatgtcac

SEQ ID NO: 127845 - DNA, 25 bp, Mus musculus
actctcggtggacgctcaagcccag

SEQ ID NO: 127846 - DNA, 25 bp, Mus musculus
actctcggtggaggctcaagcccag

SEQ ID NO: 127847 - DNA, 25 bp, Mus musculus
actctcggttggctgtggctcaaag

SEQ ID NO: 127848 - DNA, 25 bp, Mus musculus
actctcggttgggtgtggctcaaag

SEQ ID NO: 127849 - DNA, 25 bp, Mus musculus
actctcgtattaccttcctctgagt

SEQ ID NO: 127850 - DNA, 25 bp, Mus musculus
actctcgtattagcttcctctgagt

SEQ ID NO: 127851 - DNA, 25 bp, Mus musculus
actctcgtcattctccaagaagcat

SEQ ID NO: 127852 - DNA, 25 bp, Mus musculus
actctcgtcattgtccaagaagcat

SEQ ID NO: 127853 - DNA, 25 bp, Mus musculus
actctcgtccttagcttggatgcaa

SEQ ID NO: 127854 - DNA, 25 bp, Mus musculus
actctcgtcctttgcttggatgcaa

SEQ ID NO: 127855 - DNA, 25 bp, Mus musculus
actctcgtggatacgtacggtggat

SEQ ID NO: 127856 - DNA, 25 bp, Mus musculus
actctcgtggattcgtacggtggat

SEQ ID NO: 127857 - DNA, 25 bp, Mus musculus
actctctaatggataatttcttcgg

SEQ ID NO: 127858 - DNA, 25 bp, Mus musculus
actctctaatggttaatttcttcgg

SEQ ID NO: 127859 - DNA, 25 bp, Mus musculus
actctctacatcactttttgtctga

SEQ ID NO: 127860 - DNA, 25 bp, Mus musculus
actctctacatctctttttgtctga

SEQ ID NO: 127861 - DNA, 25 bp, Mus musculus
actctctaccacagtcttctaaaaa

SEQ ID NO: 127862 - DNA, 25 bp, Mus musculus
actctctaccactgtcttctaaaaa

SEQ ID NO: 127863 - DNA, 25 bp, Mus musculus
actctctaccttagttactacttca

SEQ ID NO: 127864 - DNA, 25 bp, Mus musculus
actctctacctttgttactacttca

SEQ ID NO: 127865 - DNA, 25 bp, Mus musculus
actctctagccgatcatttttgtga

SEQ ID NO: 127866 - DNA, 25 bp, Mus musculus
actctctagccgttcatttttgtga

SEQ ID NO: 127867 - DNA, 25 bp, Mus musculus
actctctcatttccatcctagaaaa

SEQ ID NO: 127868 - DNA, 25 bp, Mus musculus
actctctcatttgcatcctagaaaa

SEQ ID NO: 127869 - DNA, 25 bp, Mus musculus
actctctccgtgacttaacagaaca

SEQ ID NO: 127870 - DNA, 25 bp, Mus musculus
actctctccgtgtcttaacagaaca

SEQ ID NO: 127871 - DNA, 25 bp, Mus musculus
actctctcgatgactgtgcagcaag

SEQ ID NO: 127872 - DNA, 25 bp, Mus musculus
actctctcgatgtctgtgcagcaag

SEQ ID NO: 127873 - DNA, 25 bp, Mus musculus
actctctctgagaatcacacacgat

SEQ ID NO: 127874 - DNA, 25 bp, Mus musculus
actctctctgagtatcacacacgat

SEQ ID NO: 127875 - DNA, 25 bp, Mus musculus
actctctctggcaaaagatcaaggt

SEQ ID NO: 127876 - DNA, 25 bp, Mus musculus
actctctctggcaaagaatcaggtc

SEQ ID NO: 127877 - DNA, 25 bp, Mus musculus
actctctctggctaaagatcaaggt

SEQ ID NO: 127878 - DNA, 25 bp, Mus musculus
actctctctggctaagaatcaggtc

SEQ ID NO: 127879 - DNA, 25 bp, Mus musculus
actctctctgtaattatgcacctgc

SEQ ID NO: 127880 - DNA, 25 bp, Mus musculus
actctctctgtatttatgcacctgc

SEQ ID NO: 127881 - DNA, 25 bp, Mus musculus
actctctgacaactgttaaaggtaa

SEQ ID NO: 127882 - DNA, 25 bp, Mus musculus
actctctgacaagtgttaaaggtaa

SEQ ID NO: 127883 - DNA, 25 bp, Mus musculus
actctctgactaagtggccactgct

SEQ ID NO: 127884 - DNA, 25 bp, Mus musculus
actctctgactatgtggccactgct

SEQ ID NO: 127885 - DNA, 25 bp, Mus musculus
actctctgatccattggttggtgac

SEQ ID NO: 127886 - DNA, 25 bp, Mus musculus
actctctgatcctttggttggtgac

SEQ ID NO: 127887 - DNA, 25 bp, Mus musculus
actctctgcattaagatcccctaag

SEQ ID NO: 127888 - DNA, 25 bp, Mus musculus
actctctgcattctcttctattgac

SEQ ID NO: 127889 - DNA, 25 bp, Mus musculus
actctctgcattgtcttctattgac

SEQ ID NO: 127890 - DNA, 25 bp, Mus musculus
actctctgcatttagatcccctaag

SEQ ID NO: 127891 - DNA, 25 bp, Mus musculus
actctctgccaacttcaactttatc

SEQ ID NO: 127892 - DNA, 25 bp, Mus musculus
actctctgccaagttcaactttatc

SEQ ID NO: 127893 - DNA, 25 bp, Mus musculus
actctctggcatctttaccttggta

SEQ ID NO: 127894 - DNA, 25 bp, Mus musculus
actctctggcatgtttaccttggta

SEQ ID NO: 127895 - DNA, 25 bp, Mus musculus
actctctgtatcacccctatttttt

SEQ ID NO: 127896 - DNA, 25 bp, Mus musculus
actctctgtatctcccctatttttt

SEQ ID NO: 127897 - DNA, 25 bp, Mus musculus
actctcttaagtaatgggatggtgg

SEQ ID NO: 127898 - DNA, 25 bp, Mus musculus
actctcttaagtccctggtggttat

SEQ ID NO: 127899 - DNA, 25 bp, Mus musculus
actctcttaagtgcctggtggttat

SEQ ID NO: 127900 - DNA, 25 bp, Mus musculus
actctcttaagttatgggatggtgg

SEQ ID NO: 127901 - DNA, 25 bp, Mus musculus
actctcttagtaacggaatttctta

SEQ ID NO: 127902 - DNA, 25 bp, Mus musculus
actctcttagtatcggaatttctta

SEQ ID NO: 127903 - DNA, 25 bp, Mus musculus
actctcttccctcttattttatgtt

SEQ ID NO: 127904 - DNA, 25 bp, Mus musculus
actctcttccctgttattttatgtt

SEQ ID NO: 127905 - DNA, 25 bp, Mus musculus
actctcttctatcctatgtgtaccc

SEQ ID NO: 127906 - DNA, 25 bp, Mus musculus
actctcttctatcggcctaagggta

SEQ ID NO: 127907 - DNA, 25 bp, Mus musculus
actctcttctatgctatgtgtaccc

SEQ ID NO: 127908 - DNA, 25 bp, Mus musculus
actctcttctatgggcctaagggta

SEQ ID NO: 127909 - DNA, 25 bp, Mus musculus
actctcttctcaagggtcatttcta

SEQ ID NO: 127910 - DNA, 25 bp, Mus musculus
actctcttctcatgggtcatttcta

SEQ ID NO: 127911 - DNA, 25 bp, Mus musculus
actctcttcttactggatagctgcc

SEQ ID NO: 127912 - DNA, 25 bp, Mus musculus
actctcttcttagtggatagctgcc

SEQ ID NO: 127913 - DNA, 25 bp, Mus musculus
actctcttgcacacacatatgctga

SEQ ID NO: 127914 - DNA, 25 bp, Mus musculus
actctcttgcactcacatatgctga

SEQ ID NO: 127915 - DNA, 25 bp, Mus musculus
actctcttgcctagtaaaacctcag

SEQ ID NO: 127916 - DNA, 25 bp, Mus musculus
actctcttgccttgtaaaacctcag

SEQ ID NO: 127917 - DNA, 25 bp, Mus musculus
actctcttgtgtagcagtcactata

SEQ ID NO: 127918 - DNA, 25 bp, Mus musculus
actctcttgtgtcgcaaccactata

SEQ ID NO: 127919 - DNA, 25 bp, Mus musculus
actctcttgtgtggcaaccactata

SEQ ID NO: 127920 - DNA, 25 bp, Mus musculus
actctcttgtgttgcagtcactata

SEQ ID NO: 127921 - DNA, 25 bp, Mus musculus
actctctttcatctgatcaccaaga

SEQ ID NO: 127922 - DNA, 25 bp, Mus musculus
actctctttcatgtgatcaccaaga

SEQ ID NO: 127923 - DNA, 25 bp, Mus musculus
actctctttccaccatgcattggta

SEQ ID NO: 127924 - DNA, 25 bp, Mus musculus
actctctttccagcatgcattggta

SEQ ID NO: 127925 - DNA, 25 bp, Mus musculus
actctctttcctccattctgtagag

SEQ ID NO: 127926 - DNA, 25 bp, Mus musculus
actctctttcctgcattctgtagag

SEQ ID NO: 127927 - DNA, 25 bp, Mus musculus
actctcttttggctaatggatacaa

SEQ ID NO: 127928 - DNA, 25 bp, Mus musculus
actctcttttgggtaatggatacaa

SEQ ID NO: 127929 - DNA, 25 bp, Mus musculus
actctgaaagtgagctttacccgca

SEQ ID NO: 127930 - DNA, 25 bp, Mus musculus
actctgaaagtgtgctttacccgca

SEQ ID NO: 127931 - DNA, 25 bp, Mus musculus
actctgaacttaatggccagccacc

SEQ ID NO: 127932 - DNA, 25 bp, Mus musculus
actctgaacttattggccagccacc

SEQ ID NO: 127933 - DNA, 25 bp, Mus musculus
actctgaagaccatgctctttgggt

SEQ ID NO: 127934 - DNA, 25 bp, Mus musculus
actctgaagaccttgctctttgggt

SEQ ID NO: 127935 - DNA, 25 bp, Mus musculus
actctgaagcgacccagcggttctg

SEQ ID NO: 127936 - DNA, 25 bp, Mus musculus
actctgaagcgagccagcggttctg

SEQ ID NO: 127937 - DNA, 25 bp, Mus musculus
actctgaagggcatggtcactggat

SEQ ID NO: 127938 - DNA, 25 bp, Mus musculus
actctgaagggcttggtcactggat

SEQ ID NO: 127939 - DNA, 25 bp, Mus musculus
actctgaatgtgcatgctgtagaca

SEQ ID NO: 127940 - DNA, 25 bp, Mus musculus
actctgaatgtggatgctgtagaca

SEQ ID NO: 127941 - DNA, 25 bp, Mus musculus
actctgacaataccggctggaccga

SEQ ID NO: 127942 - DNA, 25 bp, Mus musculus
actctgacaatagcggctggaccga

SEQ ID NO: 127943 - DNA, 25 bp, Mus musculus
actctgacacggaggctagggagct

SEQ ID NO: 127944 - DNA, 25 bp, Mus musculus
actctgacacggtggctagggagct

SEQ ID NO: 127945 - DNA, 25 bp, Mus musculus
actctgacagtacctagtggcgcta

SEQ ID NO: 127946 - DNA, 25 bp, Mus musculus
actctgacagtagctagtggcgcta

SEQ ID NO: 127947 - DNA, 25 bp, Mus musculus
actctgacattgcagacaccttctt

SEQ ID NO: 127948 - DNA, 25 bp, Mus musculus
actctgacattggagacaccttctt

SEQ ID NO: 127949 - DNA, 25 bp, Mus musculus
actctgaccagtatttgttatcttt

SEQ ID NO: 127950 - DNA, 25 bp, Mus musculus
actctgaccagtctgccgaggctaa

SEQ ID NO: 127951 - DNA, 25 bp, Mus musculus
actctgaccagtgtgccgaggctaa

SEQ ID NO: 127952 - DNA, 25 bp, Mus musculus
actctgaccagtttttgttatcttt

SEQ ID NO: 127953 - DNA, 25 bp, Mus musculus
actctgaccctacgtgtgcagtgtg

SEQ ID NO: 127954 - DNA, 25 bp, Mus musculus
actctgaccctaggtgtgcagtgtg

SEQ ID NO: 127955 - DNA, 25 bp, Mus musculus
actctgacctctaatctcgatatca

SEQ ID NO: 127956 - DNA, 25 bp, Mus musculus
actctgacctcttatctcgatatca

SEQ ID NO: 127957 - DNA, 25 bp, Mus musculus
actctgacgtcacatacttgtggac

SEQ ID NO: 127958 - DNA, 25 bp, Mus musculus
actctgacgtcagatacttgtggac

SEQ ID NO: 127959 - DNA, 25 bp, Mus musculus
actctgacgttgagattctttccca

SEQ ID NO: 127960 - DNA, 25 bp, Mus musculus
actctgacgttgtgattctttccca

SEQ ID NO: 127961 - DNA, 25 bp, Mus musculus
actctgactcttatgaagtgtgccc

SEQ ID NO: 127962 - DNA, 25 bp, Mus musculus
actctgactcttttgaagtgtgccc

SEQ ID NO: 127963 - DNA, 25 bp, Mus musculus
actctgactgctcgtgcctctttag

SEQ ID NO: 127964 - DNA, 25 bp, Mus musculus
actctgactgctggtgcctctttag

SEQ ID NO: 127965 - DNA, 25 bp, Mus musculus
actctgactgtgctcattttttaaa

SEQ ID NO: 127966 - DNA, 25 bp, Mus musculus
actctgactgtggtcattttttaaa

SEQ ID NO: 127967 - DNA, 25 bp, Mus musculus
actctgacttgaaagaccagtgttt

SEQ ID NO: 127968 - DNA, 25 bp, Mus musculus
actctgacttgatagaccagtgttt

SEQ ID NO: 127969 - DNA, 25 bp, Mus musculus
actctgagcagaagcaacttgtgta

SEQ ID NO: 127970 - DNA, 25 bp, Mus musculus
actctgagcagatgcaacttgtgta

SEQ ID NO: 127971 - DNA, 25 bp, Mus musculus
actctgagcaggatgactcctctga

SEQ ID NO: 127972 - DNA, 25 bp, Mus musculus
actctgagcaggttgactcctctga

SEQ ID NO: 127973 - DNA, 25 bp, Mus musculus
actctgagcttcacaggctataccc

SEQ ID NO: 127974 - DNA, 25 bp, Mus musculus
actctgagcttctcaggctataccc

SEQ ID NO: 127975 - DNA, 25 bp, Mus musculus
actctgagctttatatccgtgtcga

SEQ ID NO: 127976 - DNA, 25 bp, Mus musculus
actctgagctttttatccgtgtcga

SEQ ID NO: 127977 - DNA, 25 bp, Mus musculus
actctgaggaacacttggcctttaa

SEQ ID NO: 127978 - DNA, 25 bp, Mus musculus
actctgaggaactcttggcctttaa

SEQ ID NO: 127979 - DNA, 25 bp, Mus musculus
actctgagggtcaggttggtgatat

SEQ ID NO: 127980 - DNA, 25 bp, Mus musculus
actctgagggtctggttggtgatat

SEQ ID NO: 127981 - DNA, 25 bp, Mus musculus
actctgagtggcacttttgaaaact

SEQ ID NO: 127982 - DNA, 25 bp, Mus musculus
actctgagtggctcttttgaaaact

SEQ ID NO: 127983 - DNA, 25 bp, Mus musculus
actctgagtggtattttctgtgcac

SEQ ID NO: 127984 - DNA, 25 bp, Mus musculus
actctgagtggttttttctgtgcac

SEQ ID NO: 127985 - DNA, 25 bp, Mus musculus
actctgagtgtactgtgtcccctgt

SEQ ID NO: 127986 - DNA, 25 bp, Mus musculus
actctgagtgtagtgtgtcccctgt

SEQ ID NO: 127987 - DNA, 25 bp, Mus musculus
actctgagttccagctactacttag

SEQ ID NO: 127988 - DNA, 25 bp, Mus musculus
actctgagttcctgctactacttag

SEQ ID NO: 127989 - DNA, 25 bp, Mus musculus
actctgatatccagacttccctggg

SEQ ID NO: 127990 - DNA, 25 bp, Mus musculus
actctgatatcctgacttccctggg

SEQ ID NO: 127991 - DNA, 25 bp, Mus musculus
actctgatgcctcattcctgtagta

SEQ ID NO: 127992 - DNA, 25 bp, Mus musculus
actctgatgcctgattcctgtagta

SEQ ID NO: 127993 - DNA, 25 bp, Mus musculus
actctgcacaacaggatcgacatga

SEQ ID NO: 127994 - DNA, 25 bp, Mus musculus
actctgcacaactggatcgacatga

SEQ ID NO: 127995 - DNA, 25 bp, Mus musculus
actctgcactcaccctagttagtga

SEQ ID NO: 127996 - DNA, 25 bp, Mus musculus
actctgcactcagcctagttagtga

SEQ ID NO: 127997 - DNA, 25 bp, Mus musculus
actctgcagagcaccaggctgagct

SEQ ID NO: 127998 - DNA, 25 bp, Mus musculus
actctgcagagctccaggctgagct

SEQ ID NO: 127999 - DNA, 25 bp, Mus musculus
actctgcaggagctgactcacatgg

SEQ ID NO: 128000 - DNA, 25 bp, Mus musculus
actctgcaggaggtgactcacatgg

SEQ ID NO: 128001 - DNA, 25 bp, Mus musculus
actctgcagggcacatggtctaaat

SEQ ID NO: 128002 - DNA, 25 bp, Mus musculus
actctgcagggcactttttctaaat

SEQ ID NO: 128003 - DNA, 25 bp, Mus musculus
actctgcagggcagggtactgtgta

SEQ ID NO: 128004 - DNA, 25 bp, Mus musculus
actctgcagggctcatggtctaaat

SEQ ID NO: 128005 - DNA, 25 bp, Mus musculus
actctgcagggctctttttctaaat

SEQ ID NO: 128006 - DNA, 25 bp, Mus musculus
actctgcagggctgggtactgtgta

SEQ ID NO: 128007 - DNA, 25 bp, Mus musculus
actctgcatgtgaccttggtcagga

SEQ ID NO: 128008 - DNA, 25 bp, Mus musculus
actctgcatgtgtccttggtcagga

SEQ ID NO: 128009 - DNA, 25 bp, Mus musculus
actctgccaccccaaaatgaactag

SEQ ID NO: 128010 - DNA, 25 bp, Mus musculus
actctgccacccgaaaatgaactag

SEQ ID NO: 128011 - DNA, 25 bp, Mus musculus
actctgccagtcagttcccacggag

SEQ ID NO: 128012 - DNA, 25 bp, Mus musculus
actctgccagtctgttcccacggag

SEQ ID NO: 128013 - DNA, 25 bp, Mus musculus
actctgccatttacatcatgttaac

SEQ ID NO: 128014 - DNA, 25 bp, Mus musculus
actctgccattttcatcatgttaac

SEQ ID NO: 128015 - DNA, 25 bp, Mus musculus
actctgccccttaaacatggcgccc

SEQ ID NO: 128016 - DNA, 25 bp, Mus musculus
actctgcccctttaacatggcgccc

SEQ ID NO: 128017 - DNA, 25 bp, Mus musculus
actctgccgtctatccaacaggcat

SEQ ID NO: 128018 - DNA, 25 bp, Mus musculus
actctgccgtctttccaacaggcat

SEQ ID NO: 128019 - DNA, 25 bp, Mus musculus
actctgcgcagtcatgagaccatat

SEQ ID NO: 128020 - DNA, 25 bp, Mus musculus
actctgcgcagtgatgagaccatat

SEQ ID NO: 128021 - DNA, 25 bp, Mus musculus
actctgcgcgacacttcagaatgtt

SEQ ID NO: 128022 - DNA, 25 bp, Mus musculus
actctgcgcgactcttcagaatgtt

SEQ ID NO: 128023 - DNA, 25 bp, Mus musculus
actctgctagccctaggtagtgcta

SEQ ID NO: 128024 - DNA, 25 bp, Mus musculus
actctgctagccgtaggtagtgcta

SEQ ID NO: 128025 - DNA, 25 bp, Mus musculus
actctgctagctatggcatatgcac

SEQ ID NO: 128026 - DNA, 25 bp, Mus musculus
actctgctagctttggcatatgcac

SEQ ID NO: 128027 - DNA, 25 bp, Mus musculus
actctgctcatgagacgaacatccg

SEQ ID NO: 128028 - DNA, 25 bp, Mus musculus
actctgctcatgtgacgaacatccg

SEQ ID NO: 128029 - DNA, 25 bp, Mus musculus
actctgctgaatactcttgtttgta

SEQ ID NO: 128030 - DNA, 25 bp, Mus musculus
actctgctgaattctcttgtttgta

SEQ ID NO: 128031 - DNA, 25 bp, Mus musculus
actctgctgcacagtttgagcttgg

SEQ ID NO: 128032 - DNA, 25 bp, Mus musculus
actctgctgcactgtttgagcttgg

SEQ ID NO: 128033 - DNA, 25 bp, Mus musculus
actctgctggtcaggtgttttgaga

SEQ ID NO: 128034 - DNA, 25 bp, Mus musculus
actctgctggtctggtgttttgaga

SEQ ID NO: 128035 - DNA, 25 bp, Mus musculus
actctgctgtagcactgcaactgtg

SEQ ID NO: 128036 - DNA, 25 bp, Mus musculus
actctgctgtaggactgcaactgtg

SEQ ID NO: 128037 - DNA, 25 bp, Mus musculus
actctgcttcaacctaaactttctt

SEQ ID NO: 128038 - DNA, 25 bp, Mus musculus
actctgcttcaagctaaactttctt

SEQ ID NO: 128039 - DNA, 25 bp, Mus musculus
actctgcttgatagtaaacctgcca

SEQ ID NO: 128040 - DNA, 25 bp, Mus musculus
actctgcttgatcgtaatgtgttta

SEQ ID NO: 128041 - DNA, 25 bp, Mus musculus
actctgcttgatggtaatgtgttta

SEQ ID NO: 128042 - DNA, 25 bp, Mus musculus
actctgcttgattgtaaacctgcca

SEQ ID NO: 128043 - DNA, 25 bp, Mus musculus
actctgctttatcgcctgttgtcaa

SEQ ID NO: 128044 - DNA, 25 bp, Mus musculus
actctgctttatggcctgttgtcaa

SEQ ID NO: 128045 - DNA, 25 bp, Mus musculus
actctgctttgcagctattgcacta

SEQ ID NO: 128046 - DNA, 25 bp, Mus musculus
actctgctttgctgctattgcacta

SEQ ID NO: 128047 - DNA, 25 bp, Mus musculus
actctggaaggcaggcgggcaactc

SEQ ID NO: 128048 - DNA, 25 bp, Mus musculus
actctggaaggctggcgggcaactc

SEQ ID NO: 128049 - DNA, 25 bp, Mus musculus
actctggaagtaccaggccgcatgc

SEQ ID NO: 128050 - DNA, 25 bp, Mus musculus
actctggaagtagcaggccgcatgc

SEQ ID NO: 128051 - DNA, 25 bp, Mus musculus
actctggacaacatcaatgctcttt

SEQ ID NO: 128052 - DNA, 25 bp, Mus musculus
actctggacaacttcaatgctcttt

SEQ ID NO: 128053 - DNA, 25 bp, Mus musculus
actctggacgtgagtttcggctgca

SEQ ID NO: 128054 - DNA, 25 bp, Mus musculus
actctggacgtgtgtttcggctgca

SEQ ID NO: 128055 - DNA, 25 bp, Mus musculus
actctggagccaattatatgttttg

SEQ ID NO: 128056 - DNA, 25 bp, Mus musculus
actctggagccatttatatgttttg

SEQ ID NO: 128057 - DNA, 25 bp, Mus musculus
actctggaggcccagtgtctgctac

SEQ ID NO: 128058 - DNA, 25 bp, Mus musculus
actctggaggccgagtgtctgctac

SEQ ID NO: 128059 - DNA, 25 bp, Mus musculus
actctggagggtattgtcaatcaaa

SEQ ID NO: 128060 - DNA, 25 bp, Mus musculus
actctggagggttttgtcaatcaaa

SEQ ID NO: 128061 - DNA, 25 bp, Mus musculus
actctggatactctctgcctgggat

SEQ ID NO: 128062 - DNA, 25 bp, Mus musculus
actctggatactgtctgcctgggat

SEQ ID NO: 128063 - DNA, 25 bp, Mus musculus
actctggatcagacctggctggtga

SEQ ID NO: 128064 - DNA, 25 bp, Mus musculus
actctggatcagtcctggctggtga

SEQ ID NO: 128065 - DNA, 25 bp, Mus musculus
actctggatgagacgttcttctggt

SEQ ID NO: 128066 - DNA, 25 bp, Mus musculus
actctggatgagtcgttcttctggt

SEQ ID NO: 128067 - DNA, 25 bp, Mus musculus
actctggccattagttctaacttct

SEQ ID NO: 128068 - DNA, 25 bp, Mus musculus
actctggccatttgttctaacttct

SEQ ID NO: 128069 - DNA, 25 bp, Mus musculus
actctggccccacgcaaatggaatt

SEQ ID NO: 128070 - DNA, 25 bp, Mus musculus
actctggccccaggcaaatggaatt

SEQ ID NO: 128071 - DNA, 25 bp, Mus musculus
actctggccctaattccatcatgat

SEQ ID NO: 128072 - DNA, 25 bp, Mus musculus
actctggccctatttccatcatgat

SEQ ID NO: 128073 - DNA, 25 bp, Mus musculus
actctggcgcttctgtattatgttg

SEQ ID NO: 128074 - DNA, 25 bp, Mus musculus
actctggcgcttgtgtattatgttg

SEQ ID NO: 128075 - DNA, 25 bp, Mus musculus
actctggctcagaatgaaaggtacg

SEQ ID NO: 128076 - DNA, 25 bp, Mus musculus
actctggctcagtatgaaaggtacg

SEQ ID NO: 128077 - DNA, 25 bp, Mus musculus
actctggctgttcactatggattcg

SEQ ID NO: 128078 - DNA, 25 bp, Mus musculus
actctggctgttgactatggattcg

SEQ ID NO: 128079 - DNA, 25 bp, Mus musculus
actctggcttttaatctcggctgtg

SEQ ID NO: 128080 - DNA, 25 bp, Mus musculus
actctggctttttatctcggctgtg

SEQ ID NO: 128081 - DNA, 25 bp, Mus musculus
actctgggaaccaagctgaaatcac

SEQ ID NO: 128082 - DNA, 25 bp, Mus musculus
actctgggaacctagctgaaatcac

SEQ ID NO: 128083 - DNA, 25 bp, Mus musculus
actctgggactgctagtgaatctac

SEQ ID NO: 128084 - DNA, 25 bp, Mus musculus
actctgggactggtagtgaatctac

SEQ ID NO: 128085 - DNA, 25 bp, Mus musculus
actctgggacttcggatgcctgcaa

SEQ ID NO: 128086 - DNA, 25 bp, Mus musculus
actctgggacttgggatgcctgcaa

SEQ ID NO: 128087 - DNA, 25 bp, Mus musculus
actctgggaggtacatttatactta

SEQ ID NO: 128088 - DNA, 25 bp, Mus musculus
actctgggaggttcatttatactta

SEQ ID NO: 128089 - DNA, 25 bp, Mus musculus
actctgggagtcaggtcactgaatt

SEQ ID NO: 128090 - DNA, 25 bp, Mus musculus
actctgggagtctggtcactgaatt

SEQ ID NO: 128091 - DNA, 25 bp, Mus musculus
actctgggatggcagcaggctccaa

SEQ ID NO: 128092 - DNA, 25 bp, Mus musculus
actctgggatgggagcaggctccaa

SEQ ID NO: 128093 - DNA, 25 bp, Mus musculus
actctgggatttctgtatgatttac

SEQ ID NO: 128094 - DNA, 25 bp, Mus musculus
actctgggatttgtgtatgatttac

SEQ ID NO: 128095 - DNA, 25 bp, Mus musculus
actctgggcagtattattcctgaga

SEQ ID NO: 128096 - DNA, 25 bp, Mus musculus
actctgggcagttttattcctgaga

SEQ ID NO: 128097 - DNA, 25 bp, Mus musculus
actctgggctaacctctgggcgcgc

SEQ ID NO: 128098 - DNA, 25 bp, Mus musculus
actctgggctaagctctgggcgcgc

SEQ ID NO: 128099 - DNA, 25 bp, Mus musculus
actctgggctccatttcagattgat

SEQ ID NO: 128100 - DNA, 25 bp, Mus musculus
actctgggctccttttcagattgat

SEQ ID NO: 128101 - DNA, 25 bp, Mus musculus
actctgggctctactgctgcttgga

SEQ ID NO: 128102 - DNA, 25 bp, Mus musculus
actctgggctcttctgctgcttgga

SEQ ID NO: 128103 - DNA, 25 bp, Mus musculus
actctgggtggcagtgttcgtgtcc

SEQ ID NO: 128104 - DNA, 25 bp, Mus musculus
actctgggtggcatttaactccgca

SEQ ID NO: 128105 - DNA, 25 bp, Mus musculus
actctgggtggctgtgttcgtgtcc

SEQ ID NO: 128106 - DNA, 25 bp, Mus musculus
actctgggtggcttttaactccgca

SEQ ID NO: 128107 - DNA, 25 bp, Mus musculus
actctggtgaccaggaaagcctctt

SEQ ID NO: 128108 - DNA, 25 bp, Mus musculus
actctggtgacctggaaagcctctt

SEQ ID NO: 128109 - DNA, 25 bp, Mus musculus
actctggtgactcttgacccccaga

SEQ ID NO: 128110 - DNA, 25 bp, Mus musculus
actctggtgactgttgacccccaga

SEQ ID NO: 128111 - DNA, 25 bp, Mus musculus
actctggtgattctcaggtgaccat

SEQ ID NO: 128112 - DNA, 25 bp, Mus musculus
actctggtgattgtcaggtgaccat

SEQ ID NO: 128113 - DNA, 25 bp, Mus musculus
actctggtgtttctgttatctcttc

SEQ ID NO: 128114 - DNA, 25 bp, Mus musculus
actctggtgtttgtgttatctcttc

SEQ ID NO: 128115 - DNA, 25 bp, Mus musculus
actctggttcgtactcaatttctca

SEQ ID NO: 128116 - DNA, 25 bp, Mus musculus
actctggttcgttctcaatttctca

SEQ ID NO: 128117 - DNA, 25 bp, Mus musculus
actctggttctaaagacttgtgcta

SEQ ID NO: 128118 - DNA, 25 bp, Mus musculus
actctggttctatagacttgtgcta

SEQ ID NO: 128119 - DNA, 25 bp, Mus musculus
actctggttggtatgtgggcttcac

SEQ ID NO: 128120 - DNA, 25 bp, Mus musculus
actctggttggtttgtgggcttcac

SEQ ID NO: 128121 - DNA, 25 bp, Mus musculus
actctgtaaggaagttcccaactat

SEQ ID NO: 128122 - DNA, 25 bp, Mus musculus
actctgtaaggatgttcccaactat

SEQ ID NO: 128123 - DNA, 25 bp, Mus musculus
actctgtacagtattttcaatccct

SEQ ID NO: 128124 - DNA, 25 bp, Mus musculus
actctgtacagttttttcaatccct

SEQ ID NO: 128125 - DNA, 25 bp, Mus musculus
actctgtacatcctaatctttgtcc

SEQ ID NO: 128126 - DNA, 25 bp, Mus musculus
actctgtacatcgtaatctttgtcc

SEQ ID NO: 128127 - DNA, 25 bp, Mus musculus
actctgtagatcaaactgtagctgg

SEQ ID NO: 128128 - DNA, 25 bp, Mus musculus
actctgtagatctaactgtagctgg

SEQ ID NO: 128129 - DNA, 25 bp, Mus musculus
actctgtagatgaagcccggcagaa

SEQ ID NO: 128130 - DNA, 25 bp, Mus musculus
actctgtagatgtagcccggcagaa

SEQ ID NO: 128131 - DNA, 25 bp, Mus musculus
actctgtagcgtcttgcctttggat

SEQ ID NO: 128132 - DNA, 25 bp, Mus musculus
actctgtagcgtgttgcctttggat

SEQ ID NO: 128133 - DNA, 25 bp, Mus musculus
actctgtagctgagggatgttgcag

SEQ ID NO: 128134 - DNA, 25 bp, Mus musculus
actctgtagctgtgggatgttgcag

SEQ ID NO: 128135 - DNA, 25 bp, Mus musculus
actctgtagggcatcggtctcttgg

SEQ ID NO: 128136 - DNA, 25 bp, Mus musculus
actctgtagggcttcggtctcttgg

SEQ ID NO: 128137 - DNA, 25 bp, Mus musculus
actctgtaggttcgactctggtcac

SEQ ID NO: 128138 - DNA, 25 bp, Mus musculus
actctgtaggttggactctggtcac

SEQ ID NO: 128139 - DNA, 25 bp, Mus musculus
actctgtagtagactcaactcccaa

SEQ ID NO: 128140 - DNA, 25 bp, Mus musculus
actctgtagtagtctcaactcccaa

SEQ ID NO: 128141 - DNA, 25 bp, Mus musculus
actctgtagttaagcctcttcacca

SEQ ID NO: 128142 - DNA, 25 bp, Mus musculus
actctgtagttatgcctcttcacca

SEQ ID NO: 128143 - DNA, 25 bp, Mus musculus
actctgtatcagattttcctggcct

SEQ ID NO: 128144 - DNA, 25 bp, Mus musculus
actctgtatcagtttttcctggcct

SEQ ID NO: 128145 - DNA, 25 bp, Mus musculus
actctgtatcctaatgtgtcttatg

SEQ ID NO: 128146 - DNA, 25 bp, Mus musculus
actctgtatccttatgtgtcttatg

SEQ ID NO: 128147 - DNA, 25 bp, Mus musculus
actctgtcaacgctgttgtctccga

SEQ ID NO: 128148 - DNA, 25 bp, Mus musculus
actctgtcaacggtgttgtctccga

SEQ ID NO: 128149 - DNA, 25 bp, Mus musculus
actctgtcaccgagttacattccta

SEQ ID NO: 128150 - DNA, 25 bp, Mus musculus
actctgtcaccgtgttacattccta

SEQ ID NO: 128151 - DNA, 25 bp, Mus musculus
actctgtcagctctgcaactgagac

SEQ ID NO: 128152 - DNA, 25 bp, Mus musculus
actctgtcagctgtgcaactgagac

SEQ ID NO: 128153 - DNA, 25 bp, Mus musculus
actctgtcattcagtgccagtctta

SEQ ID NO: 128154 - DNA, 25 bp, Mus musculus
actctgtcattctgtgccagtctta

SEQ ID NO: 128155 - DNA, 25 bp, Mus musculus
actctgtccccgaactgaaattaat

SEQ ID NO: 128156 - DNA, 25 bp, Mus musculus
actctgtccccgtactgaaattaat

SEQ ID NO: 128157 - DNA, 25 bp, Mus musculus
actctgtcccgtctagggaggacat

SEQ ID NO: 128158 - DNA, 25 bp, Mus musculus
actctgtcccgtgtagggaggacat

SEQ ID NO: 128159 - DNA, 25 bp, Mus musculus
actctgtcccttagcggtataccat

SEQ ID NO: 128160 - DNA, 25 bp, Mus musculus
actctgtccctttgcggtataccat

SEQ ID NO: 128161 - DNA, 25 bp, Mus musculus
actctgtccggccagtgtctgttca

SEQ ID NO: 128162 - DNA, 25 bp, Mus musculus
actctgtccggcgagtgtctgttca

SEQ ID NO: 128163 - DNA, 25 bp, Mus musculus
actctgtcctacattaaagcctggg

SEQ ID NO: 128164 - DNA, 25 bp, Mus musculus
actctgtcctactttaaagcctggg

SEQ ID NO: 128165 - DNA, 25 bp, Mus musculus
actctgtccttgctgtgatgatcac

SEQ ID NO: 128166 - DNA, 25 bp, Mus musculus
actctgtccttggtgtgatgatcac

SEQ ID NO: 128167 - DNA, 25 bp, Mus musculus
actctgtctctgaagcgtcgtgcgg

SEQ ID NO: 128168 - DNA, 25 bp, Mus musculus
actctgtctctgtagcgtcgtgcgg

SEQ ID NO: 128169 - DNA, 25 bp, Mus musculus
actctgtcttctagtcacttgatgt

SEQ ID NO: 128170 - DNA, 25 bp, Mus musculus
actctgtcttcttgtcacttgatgt

SEQ ID NO: 128171 - DNA, 25 bp, Mus musculus
actctgtcttgccatcctaggatat

SEQ ID NO: 128172 - DNA, 25 bp, Mus musculus
actctgtcttgcgatcctaggatat

SEQ ID NO: 128173 - DNA, 25 bp, Mus musculus
actctgtgaaatcgtctgatggtct

SEQ ID NO: 128174 - DNA, 25 bp, Mus musculus
actctgtgaaatggtctgatggtct

SEQ ID NO: 128175 - DNA, 25 bp, Mus musculus
actctgtgactcagttagtcccaat

SEQ ID NO: 128176 - DNA, 25 bp, Mus musculus
actctgtgactctgttagtcccaat

SEQ ID NO: 128177 - DNA, 25 bp, Mus musculus
actctgtgcagaacatgcccagtca

SEQ ID NO: 128178 - DNA, 25 bp, Mus musculus
actctgtgcagatcatgcccagtca

SEQ ID NO: 128179 - DNA, 25 bp, Mus musculus
actctgtgcatgctctggaacttta

SEQ ID NO: 128180 - DNA, 25 bp, Mus musculus
actctgtgcatggtctggaacttta

SEQ ID NO: 128181 - DNA, 25 bp, Mus musculus
actctgtgcattcgatggacctgtt

SEQ ID NO: 128182 - DNA, 25 bp, Mus musculus
actctgtgcattggatggacctgtt

SEQ ID NO: 128183 - DNA, 25 bp, Mus musculus
actctgtggctgctggattcttttc

SEQ ID NO: 128184 - DNA, 25 bp, Mus musculus
actctgtggctggtggattcttttc

SEQ ID NO: 128185 - DNA, 25 bp, Mus musculus
actctgtgggtcagtctgcttggca

SEQ ID NO: 128186 - DNA, 25 bp, Mus musculus
actctgtgggtctgtctgcttggca

SEQ ID NO: 128187 - DNA, 25 bp, Mus musculus
actctgtggttacgaggatcacctt

SEQ ID NO: 128188 - DNA, 25 bp, Mus musculus
actctgtggttaggaggatcacctt

SEQ ID NO: 128189 - DNA, 25 bp, Mus musculus
actctgtgtagtcattcctaagccc

SEQ ID NO: 128190 - DNA, 25 bp, Mus musculus
actctgtgtagtgattcctaagccc

SEQ ID NO: 128191 - DNA, 25 bp, Mus musculus
actctgtgtccgcactgcttattgt

SEQ ID NO: 128192 - DNA, 25 bp, Mus musculus
actctgtgtccggactgcttattgt

SEQ ID NO: 128193 - DNA, 25 bp, Mus musculus
actctgtgtgccatgagaaccgctc

SEQ ID NO: 128194 - DNA, 25 bp, Mus musculus
actctgtgtgccttgagaaccgctc

SEQ ID NO: 128195 - DNA, 25 bp, Mus musculus
actctgtgtggcaactgtcggactc

SEQ ID NO: 128196 - DNA, 25 bp, Mus musculus
actctgtgtggctactgtcggactc

SEQ ID NO: 128197 - DNA, 25 bp, Mus musculus
actctgtgtttccacaccttagtgg

SEQ ID NO: 128198 - DNA, 25 bp, Mus musculus
actctgtgtttcgacaccttagtgg

SEQ ID NO: 128199 - DNA, 25 bp, Mus musculus
actctgttaccaattctggatccag

SEQ ID NO: 128200 - DNA, 25 bp, Mus musculus
actctgttaccatttctggatccag

SEQ ID NO: 128201 - DNA, 25 bp, Mus musculus
actctgttcaggaccactaaatgtt

SEQ ID NO: 128202 - DNA, 25 bp, Mus musculus
actctgttcaggtccactaaatgtt

SEQ ID NO: 128203 - DNA, 25 bp, Mus musculus
actctgttccgccatggttggctct

SEQ ID NO: 128204 - DNA, 25 bp, Mus musculus
actctgttccgcgatggttggctct

SEQ ID NO: 128205 - DNA, 25 bp, Mus musculus
actctgttgccaatagatcttacaa

SEQ ID NO: 128206 - DNA, 25 bp, Mus musculus
actctgttgccattagatcttacaa

SEQ ID NO: 128207 - DNA, 25 bp, Mus musculus
actctgttggcaatcgtaggctaat

SEQ ID NO: 128208 - DNA, 25 bp, Mus musculus
actctgttggcattcgtaggctaat

SEQ ID NO: 128209 - DNA, 25 bp, Mus musculus
actctgtttgcactgagctttactt

SEQ ID NO: 128210 - DNA, 25 bp, Mus musculus
actctgtttgcagtgagctttactt

SEQ ID NO: 128211 - DNA, 25 bp, Mus musculus
actctgtttgtactctgggctgaat

SEQ ID NO: 128212 - DNA, 25 bp, Mus musculus
actctgtttgtagtctgggctgaat

SEQ ID NO: 128213 - DNA, 25 bp, Mus musculus
actctgtttgttacagttgagactg

SEQ ID NO: 128214 - DNA, 25 bp, Mus musculus
actctgtttgtttcagttgagactg

SEQ ID NO: 128215 - DNA, 25 bp, Mus musculus
actctgttttgtactcataactttg

SEQ ID NO: 128216 - DNA, 25 bp, Mus musculus
actctgttttgttctcataactttg

SEQ ID NO: 128217 - DNA, 25 bp, Mus musculus
actcttaaactgctggctccagtgt

SEQ ID NO: 128218 - DNA, 25 bp, Mus musculus
actcttaaactggtggctccagtgt

SEQ ID NO: 128219 - DNA, 25 bp, Mus musculus
actcttaaatagcagctgcgatgct

SEQ ID NO: 128220 - DNA, 25 bp, Mus musculus
actcttaaataggagctgcgatgct

SEQ ID NO: 128221 - DNA, 25 bp, Mus musculus
actcttaaccctcagcagtctccag

SEQ ID NO: 128222 - DNA, 25 bp, Mus musculus
actcttaaccctgagcagtctccag

SEQ ID NO: 128223 - DNA, 25 bp, Mus musculus
actcttaactcccacatagggctgg

SEQ ID NO: 128224 - DNA, 25 bp, Mus musculus
actcttaactccgacatagggctgg

SEQ ID NO: 128225 - DNA, 25 bp, Mus musculus
actcttacagttactgtctcttcag

SEQ ID NO: 128226 - DNA, 25 bp, Mus musculus
actcttacagtttctgtctcttcag

SEQ ID NO: 128227 - DNA, 25 bp, Mus musculus
actcttacatgaacagtattgccct

SEQ ID NO: 128228 - DNA, 25 bp, Mus musculus
actcttacatgatcagtattgccct

SEQ ID NO: 128229 - DNA, 25 bp, Mus musculus
actcttacccacaggcctacagtag

SEQ ID NO: 128230 - DNA, 25 bp, Mus musculus
actcttacccactggcctacagtag

SEQ ID NO: 128231 - DNA, 25 bp, Mus musculus
actcttacctgtatttgccctctgt

SEQ ID NO: 128232 - DNA, 25 bp, Mus musculus
actcttacctgtttttgccctctgt

SEQ ID NO: 128233 - DNA, 25 bp, Mus musculus
actcttacggaacacactcctggat

SEQ ID NO: 128234 - DNA, 25 bp, Mus musculus
actcttacggaagacactcctggat

SEQ ID NO: 128235 - DNA, 25 bp, Mus musculus
actcttacgtacattccaaagacgt

SEQ ID NO: 128236 - DNA, 25 bp, Mus musculus
actcttacgtactttccaaagacgt

SEQ ID NO: 128237 - DNA, 25 bp, Mus musculus
actcttactatgaacctctttctca

SEQ ID NO: 128238 - DNA, 25 bp, Mus musculus
actcttactatgtacctctttctca

SEQ ID NO: 128239 - DNA, 25 bp, Mus musculus
actcttactgctcctgacataaatt

SEQ ID NO: 128240 - DNA, 25 bp, Mus musculus
actcttactgctgctgacataaatt

SEQ ID NO: 128241 - DNA, 25 bp, Mus musculus
actcttactggcaagttcatctagt

SEQ ID NO: 128242 - DNA, 25 bp, Mus musculus
actcttactggctagttcatctagt

SEQ ID NO: 128243 - DNA, 25 bp, Mus musculus
actcttacttagcacccatgattca

SEQ ID NO: 128244 - DNA, 25 bp, Mus musculus
actcttacttaggacccatgattca

SEQ ID NO: 128245 - DNA, 25 bp, Mus musculus
actcttagatccctgaagtgcatca

SEQ ID NO: 128246 - DNA, 25 bp, Mus musculus
actcttagatccgtgaagtgcatca

SEQ ID NO: 128247 - DNA, 25 bp, Mus musculus
actcttagccctagttacttgctgt

SEQ ID NO: 128248 - DNA, 25 bp, Mus musculus
actcttagcccttgttacttgctgt

SEQ ID NO: 128249 - DNA, 25 bp, Mus musculus
actcttagcctcattgattgtgtgt

SEQ ID NO: 128250 - DNA, 25 bp, Mus musculus
actcttagcctctttgattgtgtgt

SEQ ID NO: 128251 - DNA, 25 bp, Mus musculus
actcttagctgcagtcttgccagag

SEQ ID NO: 128252 - DNA, 25 bp, Mus musculus
actcttagctgctgtcttgccagag

SEQ ID NO: 128253 - DNA, 25 bp, Mus musculus
actcttagctttcgtgtcagtgaac

SEQ ID NO: 128254 - DNA, 25 bp, Mus musculus
actcttagctttggtgtcagtgaac

SEQ ID NO: 128255 - DNA, 25 bp, Mus musculus
actcttaggtctattccattcttag

SEQ ID NO: 128256 - DNA, 25 bp, Mus musculus
actcttaggtcttttccattcttag

SEQ ID NO: 128257 - DNA, 25 bp, Mus musculus
actcttagtttcaggcaacctcaag

SEQ ID NO: 128258 - DNA, 25 bp, Mus musculus
actcttagtttctggcaacctcaag

SEQ ID NO: 128259 - DNA, 25 bp, Mus musculus
actcttagttttcgatcggatgatc

SEQ ID NO: 128260 - DNA, 25 bp, Mus musculus
actcttagttttggatcggatgatc

SEQ ID NO: 128261 - DNA, 25 bp, Mus musculus
actcttatcagaacacaagcctcac

SEQ ID NO: 128262 - DNA, 25 bp, Mus musculus
actcttatcagatcacaagcctcac

SEQ ID NO: 128263 - DNA, 25 bp, Mus musculus
actcttatccttcgaggccacaaca

SEQ ID NO: 128264 - DNA, 25 bp, Mus musculus
actcttatccttggaggccacaaca

SEQ ID NO: 128265 - DNA, 25 bp, Mus musculus
actcttatcgataactgcttctctg

SEQ ID NO: 128266 - DNA, 25 bp, Mus musculus
actcttatcgattactgcttctctg

SEQ ID NO: 128267 - DNA, 25 bp, Mus musculus
actcttatgatcagttactgtttga

SEQ ID NO: 128268 - DNA, 25 bp, Mus musculus
actcttatgatctgttactgtttga

SEQ ID NO: 128269 - DNA, 25 bp, Mus musculus
actcttatgtaacggtttggcttca

SEQ ID NO: 128270 - DNA, 25 bp, Mus musculus
actcttatgtaagggtttggcttca

SEQ ID NO: 128271 - DNA, 25 bp, Mus musculus
actcttattatacccggcggctgtt

SEQ ID NO: 128272 - DNA, 25 bp, Mus musculus
actcttattatagccggcggctgtt

SEQ ID NO: 128273 - DNA, 25 bp, Mus musculus
actcttattgggaccacaattcttc

SEQ ID NO: 128274 - DNA, 25 bp, Mus musculus
actcttattgggtccacaattcttc

SEQ ID NO: 128275 - DNA, 25 bp, Mus musculus
actcttcaatcccataattcctttc

SEQ ID NO: 128276 - DNA, 25 bp, Mus musculus
actcttcaatccgataattcctttc

SEQ ID NO: 128277 - DNA, 25 bp, Mus musculus
actcttcaatctctactttctgtgc

SEQ ID NO: 128278 - DNA, 25 bp, Mus musculus
actcttcaatctgtactttctgtgc

SEQ ID NO: 128279 - DNA, 25 bp, Mus musculus
actcttcaatggaccagatgccaac

SEQ ID NO: 128280 - DNA, 25 bp, Mus musculus
actcttcaatggtccagatgccaac

SEQ ID NO: 128281 - DNA, 25 bp, Mus musculus
actcttcacagtccgcaggacagac

SEQ ID NO: 128282 - DNA, 25 bp, Mus musculus
actcttcacagtgcgcaggacagac

SEQ ID NO: 128283 - DNA, 25 bp, Mus musculus
actcttcaccccagaatgcattcct

SEQ ID NO: 128284 - DNA, 25 bp, Mus musculus
actcttcacccctgaatgcattcct

SEQ ID NO: 128285 - DNA, 25 bp, Mus musculus
actcttcacttcagtctttgtatgg

SEQ ID NO: 128286 - DNA, 25 bp, Mus musculus
actcttcacttctgtctttgtatgg

SEQ ID NO: 128287 - DNA, 25 bp, Mus musculus
actcttcactttatatctccgtgtt

SEQ ID NO: 128288 - DNA, 25 bp, Mus musculus
actcttcactttttatctccgtgtt

SEQ ID NO: 128289 - DNA, 25 bp, Mus musculus
actcttcagaatcttctccggaaag

SEQ ID NO: 128290 - DNA, 25 bp, Mus musculus
actcttcagaatgttctccggaaag

SEQ ID NO: 128291 - DNA, 25 bp, Mus musculus
actcttcatgagagttggcagtgac

SEQ ID NO: 128292 - DNA, 25 bp, Mus musculus
actcttcatgagtgttggcagtgac

SEQ ID NO: 128293 - DNA, 25 bp, Mus musculus
actcttcatgtcaacttctactatg

SEQ ID NO: 128294 - DNA, 25 bp, Mus musculus
actcttcatgtctacttctactatg

SEQ ID NO: 128295 - DNA, 25 bp, Mus musculus
actcttcattgtagccatcacatac

SEQ ID NO: 128296 - DNA, 25 bp, Mus musculus
actcttcattgttgccatcacatac

SEQ ID NO: 128297 - DNA, 25 bp, Mus musculus
actcttcatttgctcattgcttttc

SEQ ID NO: 128298 - DNA, 25 bp, Mus musculus
actcttcatttggtcattgcttttc

SEQ ID NO: 128299 - DNA, 25 bp, Mus musculus
actcttccactgagtttgcagcagt

SEQ ID NO: 128300 - DNA, 25 bp, Mus musculus
actcttccactgtgtttgcagcagt

SEQ ID NO: 128301 - DNA, 25 bp, Mus musculus
actcttccatgcactgggtgacaga

SEQ ID NO: 128302 - DNA, 25 bp, Mus musculus
actcttccatgctctgggtgacaga

SEQ ID NO: 128303 - DNA, 25 bp, Mus musculus
actcttcccaatacatttttcataa

SEQ ID NO: 128304 - DNA, 25 bp, Mus musculus
actcttcccaatcgtgctatgaaaa

SEQ ID NO: 128305 - DNA, 25 bp, Mus musculus
actcttcccaatggtgctatgaaaa

SEQ ID NO: 128306 - DNA, 25 bp, Mus musculus
actcttcccaattcatttttcataa

SEQ ID NO: 128307 - DNA, 25 bp, Mus musculus
actcttcccggtatattgcaactta

SEQ ID NO: 128308 - DNA, 25 bp, Mus musculus
actcttcccggtttattgcaactta

SEQ ID NO: 128309 - DNA, 25 bp, Mus musculus
actcttccctaaacaagctctaaat

SEQ ID NO: 128310 - DNA, 25 bp, Mus musculus
actcttccctaatcaagctctaaat

SEQ ID NO: 128311 - DNA, 25 bp, Mus musculus
actcttcccttcaaaatgctgatga

SEQ ID NO: 128312 - DNA, 25 bp, Mus musculus
actcttcccttctaaatgctgatga

SEQ ID NO: 128313 - DNA, 25 bp, Mus musculus
actcttcctcttagtacttgtattc

SEQ ID NO: 128314 - DNA, 25 bp, Mus musculus
actcttcctctttgtacttgtattc

SEQ ID NO: 128315 - DNA, 25 bp, Mus musculus
actcttcctggtatgtgctttgcta

SEQ ID NO: 128316 - DNA, 25 bp, Mus musculus
actcttcctggtttgtgctttgcta

SEQ ID NO: 128317 - DNA, 25 bp, Mus musculus
actcttcctttcagagtcttgctga

SEQ ID NO: 128318 - DNA, 25 bp, Mus musculus
actcttcctttctgagtcttgctga

SEQ ID NO: 128319 - DNA, 25 bp, Mus musculus
actcttcgctggacagcagcaagtt

SEQ ID NO: 128320 - DNA, 25 bp, Mus musculus
actcttcgctggtcagcagcaagtt

SEQ ID NO: 128321 - DNA, 25 bp, Mus musculus
actcttctaaaaacaggtctcaagt

SEQ ID NO: 128322 - DNA, 25 bp, Mus musculus
actcttctaaaatcaggtctcaagt

SEQ ID NO: 128323 - DNA, 25 bp, Mus musculus
actcttctaattagttccttcttag

SEQ ID NO: 128324 - DNA, 25 bp, Mus musculus
actcttctaatttgttccttcttag

SEQ ID NO: 128325 - DNA, 25 bp, Mus musculus
actcttctagaaatttcgtcctctc

SEQ ID NO: 128326 - DNA, 25 bp, Mus musculus
actcttctagaattttcgtcctctc

SEQ ID NO: 128327 - DNA, 25 bp, Mus musculus
actcttctaggaagtcagtcacctc

SEQ ID NO: 128328 - DNA, 25 bp, Mus musculus
actcttctaggatgtcagtcacctc

SEQ ID NO: 128329 - DNA, 25 bp, Mus musculus
actcttctatggcatgagctcagac

SEQ ID NO: 128330 - DNA, 25 bp, Mus musculus
actcttctatgggatgagctcagac

SEQ ID NO: 128331 - DNA, 25 bp, Mus musculus
actcttctatgtcgtgagtccaaga

SEQ ID NO: 128332 - DNA, 25 bp, Mus musculus
actcttctatgtggtgagtccaaga

SEQ ID NO: 128333 - DNA, 25 bp, Mus musculus
actcttctcattaatagctcaaagc

SEQ ID NO: 128334 - DNA, 25 bp, Mus musculus
actcttctcatttatagctcaaagc

SEQ ID NO: 128335 - DNA, 25 bp, Mus musculus
actcttctccagaagcagtagacaa

SEQ ID NO: 128336 - DNA, 25 bp, Mus musculus
actcttctccagtagcagtagacaa

SEQ ID NO: 128337 - DNA, 25 bp, Mus musculus
actcttctcgtacgtgtggctggca

SEQ ID NO: 128338 - DNA, 25 bp, Mus musculus
actcttctcgtaggtgtggctggca

SEQ ID NO: 128339 - DNA, 25 bp, Mus musculus
actcttctctttccagggaaacatg

SEQ ID NO: 128340 - DNA, 25 bp, Mus musculus
actcttctctttgcagggaaacatg

SEQ ID NO: 128341 - DNA, 25 bp, Mus musculus
actcttctgcctattctgtgtaata

SEQ ID NO: 128342 - DNA, 25 bp, Mus musculus
actcttctgccttttctgtgtaata

SEQ ID NO: 128343 - DNA, 25 bp, Mus musculus
actcttctgctaacgatccacactg

SEQ ID NO: 128344 - DNA, 25 bp, Mus musculus
actcttctgctatcgatccacactg

SEQ ID NO: 128345 - DNA, 25 bp, Mus musculus
actcttctgcttcttttgttctatc

SEQ ID NO: 128346 - DNA, 25 bp, Mus musculus
actcttctgcttgttttgttctatc

SEQ ID NO: 128347 - DNA, 25 bp, Mus musculus
actcttctgggacgtgagtccctgt

SEQ ID NO: 128348 - DNA, 25 bp, Mus musculus
actcttctgggaggtgagtccctgt

SEQ ID NO: 128349 - DNA, 25 bp, Mus musculus
actcttctggtgattggcttataaa

SEQ ID NO: 128350 - DNA, 25 bp, Mus musculus
actcttctggtgtttggcttataaa

SEQ ID NO: 128351 - DNA, 25 bp, Mus musculus
actcttctgtatccttggctgggaa

SEQ ID NO: 128352 - DNA, 25 bp, Mus musculus
actcttctgtatcgtcatgcttagg

SEQ ID NO: 128353 - DNA, 25 bp, Mus musculus
actcttctgtatgcttggctgggaa

SEQ ID NO: 128354 - DNA, 25 bp, Mus musculus
actcttctgtatggtcatgcttagg

SEQ ID NO: 128355 - DNA, 25 bp, Mus musculus
actcttcttgcacggtcccagatct

SEQ ID NO: 128356 - DNA, 25 bp, Mus musculus
actcttcttgcagggtcccagatct

SEQ ID NO: 128357 - DNA, 25 bp, Mus musculus
actcttgaaaatctgtgtggtcctg

SEQ ID NO: 128358 - DNA, 25 bp, Mus musculus
actcttgaaaatgtgtgtggtcctg

SEQ ID NO: 128359 - DNA, 25 bp, Mus musculus
actcttgaagtgactctttccatcc

SEQ ID NO: 128360 - DNA, 25 bp, Mus musculus
actcttgaagtgtctctttccatcc

SEQ ID NO: 128361 - DNA, 25 bp, Mus musculus
actcttgaattcagacctgtccact

SEQ ID NO: 128362 - DNA, 25 bp, Mus musculus
actcttgaattctgacctgtccact

SEQ ID NO: 128363 - DNA, 25 bp, Mus musculus
actcttgacccccagacttattgct

SEQ ID NO: 128364 - DNA, 25 bp, Mus musculus
actcttgaccccgagacttattgct

SEQ ID NO: 128365 - DNA, 25 bp, Mus musculus
actcttgacttaatgatatctgaac

SEQ ID NO: 128366 - DNA, 25 bp, Mus musculus
actcttgacttattgatatctgaac

SEQ ID NO: 128367 - DNA, 25 bp, Mus musculus
actcttgactttcatatctgtacac

SEQ ID NO: 128368 - DNA, 25 bp, Mus musculus
actcttgactttgatatctgtacac

SEQ ID NO: 128369 - DNA, 25 bp, Mus musculus
actcttgagctgaggccttgtggga

SEQ ID NO: 128370 - DNA, 25 bp, Mus musculus
actcttgagctgtggccttgtggga

SEQ ID NO: 128371 - DNA, 25 bp, Mus musculus
actcttgagggcctcactgacttaa

SEQ ID NO: 128372 - DNA, 25 bp, Mus musculus
actcttgagggcgtcactgacttaa

SEQ ID NO: 128373 - DNA, 25 bp, Mus musculus
actcttgagtgaagcttctttaaaa

SEQ ID NO: 128374 - DNA, 25 bp, Mus musculus
actcttgagtgatgcttctttaaaa

SEQ ID NO: 128375 - DNA, 25 bp, Mus musculus
actcttgatattattgtcatgcctt

SEQ ID NO: 128376 - DNA, 25 bp, Mus musculus
actcttgatatttttgtcatgcctt

SEQ ID NO: 128377 - DNA, 25 bp, Mus musculus
actcttgatcttactgcctccatct

SEQ ID NO: 128378 - DNA, 25 bp, Mus musculus
actcttgatctttctgcctccatct

SEQ ID NO: 128379 - DNA, 25 bp, Mus musculus
actcttgatgagcagggccggccca

SEQ ID NO: 128380 - DNA, 25 bp, Mus musculus
actcttgatgaggagggccggccca

SEQ ID NO: 128381 - DNA, 25 bp, Mus musculus
actcttgcagggatttgtaagcagc

SEQ ID NO: 128382 - DNA, 25 bp, Mus musculus
actcttgcagggttttgtaagcagc

SEQ ID NO: 128383 - DNA, 25 bp, Mus musculus
actcttgcctgaaccttgcttaatg

SEQ ID NO: 128384 - DNA, 25 bp, Mus musculus
actcttgcctgatccttgcttaatg

SEQ ID NO: 128385 - DNA, 25 bp, Mus musculus
actcttgctcttactagctctgaac

SEQ ID NO: 128386 - DNA, 25 bp, Mus musculus
actcttgctctttctagctctgaac

SEQ ID NO: 128387 - DNA, 25 bp, Mus musculus
actcttggaccaacttaactctggt

SEQ ID NO: 128388 - DNA, 25 bp, Mus musculus
actcttggaccatcttaactctggt

SEQ ID NO: 128389 - DNA, 25 bp, Mus musculus
actcttggacgtctactggttgtac

SEQ ID NO: 128390 - DNA, 25 bp, Mus musculus
actcttggacgtgtactggttgtac

SEQ ID NO: 128391 - DNA, 25 bp, Mus musculus
actcttggatccagcccagattgag

SEQ ID NO: 128392 - DNA, 25 bp, Mus musculus
actcttggatcctgcccagattgag

SEQ ID NO: 128393 - DNA, 25 bp, Mus musculus
actcttggattccagaatgtcagct

SEQ ID NO: 128394 - DNA, 25 bp, Mus musculus
actcttggattcgagaatgtcagct

SEQ ID NO: 128395 - DNA, 25 bp, Mus musculus
actcttggtcttaatcacagcagca

SEQ ID NO: 128396 - DNA, 25 bp, Mus musculus
actcttggtctttatcacagcagca

SEQ ID NO: 128397 - DNA, 25 bp, Mus musculus
actcttgtaaagaaccagtgctgtg

SEQ ID NO: 128398 - DNA, 25 bp, Mus musculus
actcttgtaaagtaccagtgctgtg

SEQ ID NO: 128399 - DNA, 25 bp, Mus musculus
actcttgtaaccacagcgtttggga

SEQ ID NO: 128400 - DNA, 25 bp, Mus musculus
actcttgtaacctcagcgtttggga

SEQ ID NO: 128401 - DNA, 25 bp, Mus musculus
actcttgtaatgactttctcttcca

SEQ ID NO: 128402 - DNA, 25 bp, Mus musculus
actcttgtaatgtctttctcttcca

SEQ ID NO: 128403 - DNA, 25 bp, Mus musculus
actcttgtcatcacttctctcttaa

SEQ ID NO: 128404 - DNA, 25 bp, Mus musculus
actcttgtcatctcttctctcttaa

SEQ ID NO: 128405 - DNA, 25 bp, Mus musculus
actcttgtctccaacctgaagacaa

SEQ ID NO: 128406 - DNA, 25 bp, Mus musculus
actcttgtctcctacctgaagacaa

SEQ ID NO: 128407 - DNA, 25 bp, Mus musculus
actcttgtctggaccacctggagga

SEQ ID NO: 128408 - DNA, 25 bp, Mus musculus
actcttgtctggtccacctggagga

SEQ ID NO: 128409 - DNA, 25 bp, Mus musculus
actcttgtgcctaggttgtgtgtta

SEQ ID NO: 128410 - DNA, 25 bp, Mus musculus
actcttgtgccttggttgtgtgtta

SEQ ID NO: 128411 - DNA, 25 bp, Mus musculus
actcttgtgcttctgggcatgtgca

SEQ ID NO: 128412 - DNA, 25 bp, Mus musculus
actcttgtgcttgtgggcatgtgca

SEQ ID NO: 128413 - DNA, 25 bp, Mus musculus
actcttgtggttatttgctgactca

SEQ ID NO: 128414 - DNA, 25 bp, Mus musculus
actcttgtggttttttgctgactca

SEQ ID NO: 128415 - DNA, 25 bp, Mus musculus
actcttgttattatgtgttttaata

SEQ ID NO: 128416 - DNA, 25 bp, Mus musculus
actcttgttattttgtgttttaata

SEQ ID NO: 128417 - DNA, 25 bp, Mus musculus
actcttgttcaacactcatagtcta

SEQ ID NO: 128418 - DNA, 25 bp, Mus musculus
actcttgttcaagactcatagtcta

SEQ ID NO: 128419 - DNA, 25 bp, Mus musculus
actcttgtttctctgttttcttgca

SEQ ID NO: 128420 - DNA, 25 bp, Mus musculus
actcttgtttctgtgttttcttgca

SEQ ID NO: 128421 - DNA, 25 bp, Mus musculus
actcttgtttggcttgacttggctt

SEQ ID NO: 128422 - DNA, 25 bp, Mus musculus
actcttgtttgggttgacttggctt

SEQ ID NO: 128423 - DNA, 25 bp, Mus musculus
actctttacaggatccaggcaacag

SEQ ID NO: 128424 - DNA, 25 bp, Mus musculus
actctttacaggttccaggcaacag

SEQ ID NO: 128425 - DNA, 25 bp, Mus musculus
actctttacctaccctgtatttatt

SEQ ID NO: 128426 - DNA, 25 bp, Mus musculus
actctttacctagcctgtatttatt

SEQ ID NO: 128427 - DNA, 25 bp, Mus musculus
actctttaccttacacaagccttga

SEQ ID NO: 128428 - DNA, 25 bp, Mus musculus
actctttacctttcacaagccttga

SEQ ID NO: 128429 - DNA, 25 bp, Mus musculus
actctttagaaaatctccagttttg

SEQ ID NO: 128430 - DNA, 25 bp, Mus musculus
actctttagaaattctccagttttg

SEQ ID NO: 128431 - DNA, 25 bp, Mus musculus
actctttagtttactggctttgctc

SEQ ID NO: 128432 - DNA, 25 bp, Mus musculus
actctttagttttctggctttgctc

SEQ ID NO: 128433 - DNA, 25 bp, Mus musculus
actctttcattaaatctcactgcct

SEQ ID NO: 128434 - DNA, 25 bp, Mus musculus
actctttcattatatctcactgcct

SEQ ID NO: 128435 - DNA, 25 bp, Mus musculus
actctttccagaatcgtggcccagg

SEQ ID NO: 128436 - DNA, 25 bp, Mus musculus
actctttccagattcgtggcccagg

SEQ ID NO: 128437 - DNA, 25 bp, Mus musculus
actctttcgaaactccagaacctgt

SEQ ID NO: 128438 - DNA, 25 bp, Mus musculus
actctttcgaaagtccagaacctgt

SEQ ID NO: 128439 - DNA, 25 bp, Mus musculus
actctttcgctcatgttagtttggt

SEQ ID NO: 128440 - DNA, 25 bp, Mus musculus
actctttcgctcttgttagtttggt

SEQ ID NO: 128441 - DNA, 25 bp, Mus musculus
actctttctaccagtaggtatggct

SEQ ID NO: 128442 - DNA, 25 bp, Mus musculus
actctttctacctgtaggtatggct

SEQ ID NO: 128443 - DNA, 25 bp, Mus musculus
actctttctgcaaaccagcttctga

SEQ ID NO: 128444 - DNA, 25 bp, Mus musculus
actctttctgcataccagcttctga

SEQ ID NO: 128445 - DNA, 25 bp, Mus musculus
actctttctgtaaatcatttggttt

SEQ ID NO: 128446 - DNA, 25 bp, Mus musculus
actctttctgtatatcatttggttt

SEQ ID NO: 128447 - DNA, 25 bp, Mus musculus
actctttgacctcgtgtgccatgaa

SEQ ID NO: 128448 - DNA, 25 bp, Mus musculus
actctttgacctggtgtgccatgaa

SEQ ID NO: 128449 - DNA, 25 bp, Mus musculus
actctttgatacatagtctcttttc

SEQ ID NO: 128450 - DNA, 25 bp, Mus musculus
actctttgatacttagtctcttttc

SEQ ID NO: 128451 - DNA, 25 bp, Mus musculus
actctttgattcctcgtactccaga

SEQ ID NO: 128452 - DNA, 25 bp, Mus musculus
actctttgattcgtcgtactccaga

SEQ ID NO: 128453 - DNA, 25 bp, Mus musculus
actctttggataccatgtgttcttc

SEQ ID NO: 128454 - DNA, 25 bp, Mus musculus
actctttggatagcatgtgttcttc

SEQ ID NO: 128455 - DNA, 25 bp, Mus musculus
actctttgggatcgttcttggttct

SEQ ID NO: 128456 - DNA, 25 bp, Mus musculus
actctttgggatggttcttggttct

SEQ ID NO: 128457 - DNA, 25 bp, Mus musculus
actctttgggctcccaccgatatgg

SEQ ID NO: 128458 - DNA, 25 bp, Mus musculus
actctttgggctgccaccgatatgg

SEQ ID NO: 128459 - DNA, 25 bp, Mus musculus
actctttggtagacagatcctatat

SEQ ID NO: 128460 - DNA, 25 bp, Mus musculus
actctttggtagtcagatcctatat

SEQ ID NO: 128461 - DNA, 25 bp, Mus musculus
actctttggtgtactcgtagttctt

SEQ ID NO: 128462 - DNA, 25 bp, Mus musculus
actctttggtgttctcgtagttctt

SEQ ID NO: 128463 - DNA, 25 bp, Mus musculus
actctttggtttatctgttcttgaa

SEQ ID NO: 128464 - DNA, 25 bp, Mus musculus
actctttggtttttctgttcttgaa

SEQ ID NO: 128465 - DNA, 25 bp, Mus musculus
actctttgtgtcaattggtctcagc

SEQ ID NO: 128466 - DNA, 25 bp, Mus musculus
actctttgtgtctattggtctcagc

SEQ ID NO: 128467 - DNA, 25 bp, Mus musculus
actctttgttgtaggctgggttgaa

SEQ ID NO: 128468 - DNA, 25 bp, Mus musculus
actctttgttgttggctgggttgaa

SEQ ID NO: 128469 - DNA, 25 bp, Mus musculus
actctttgtttcaagggtctagcgc

SEQ ID NO: 128470 - DNA, 25 bp, Mus musculus
actctttgtttctagggtctagcgc

SEQ ID NO: 128471 - DNA, 25 bp, Mus musculus
actcttttacttagcttgttatatg

SEQ ID NO: 128472 - DNA, 25 bp, Mus musculus
actcttttactttgcttgttatatg

SEQ ID NO: 128473 - DNA, 25 bp, Mus musculus
actcttttcaccctcacaggtgaac

SEQ ID NO: 128474 - DNA, 25 bp, Mus musculus
actcttttcaccgtcacaggtgaac

SEQ ID NO: 128475 - DNA, 25 bp, Mus musculus
actcttttccaaaactggaccaatg

SEQ ID NO: 128476 - DNA, 25 bp, Mus musculus
actcttttccaatactggaccaatg

SEQ ID NO: 128477 - DNA, 25 bp, Mus musculus
actcttttccttcataggagcctgt

SEQ ID NO: 128478 - DNA, 25 bp, Mus musculus
actcttttccttgataggagcctgt

SEQ ID NO: 128479 - DNA, 25 bp, Mus musculus
actcttttgaatcagtgcttcccat

SEQ ID NO: 128480 - DNA, 25 bp, Mus musculus
actcttttgaatgagtgcttcccat

SEQ ID NO: 128481 - DNA, 25 bp, Mus musculus
actcttttgcacatatctttatcta

SEQ ID NO: 128482 - DNA, 25 bp, Mus musculus
actcttttgcacttatctttatcta

SEQ ID NO: 128483 - DNA, 25 bp, Mus musculus
actcttttgtgcactccagtgaact

SEQ ID NO: 128484 - DNA, 25 bp, Mus musculus
actcttttgtgctctccagtgaact

SEQ ID NO: 128485 - DNA, 25 bp, Mus musculus
actcttttgtgtctgacgtcaatgg

SEQ ID NO: 128486 - DNA, 25 bp, Mus musculus
actcttttgtgtgtgacgtcaatgg

SEQ ID NO: 128487 - DNA, 25 bp, Mus musculus
actcttttttgcaatgataggccat

SEQ ID NO: 128488 - DNA, 25 bp, Mus musculus
actcttttttgctatgataggccat

SEQ ID NO: 128489 - DNA, 25 bp, Mus musculus
actgaaaactgcctctctagctgtg

SEQ ID NO: 128490 - DNA, 25 bp, Mus musculus
actgaaaactgcgtctctagctgtg

SEQ ID NO: 128491 - DNA, 25 bp, Mus musculus
actgaaaactggactttactgtata

SEQ ID NO: 128492 - DNA, 25 bp, Mus musculus
actgaaaactggtctttactgtata

SEQ ID NO: 128493 - DNA, 25 bp, Mus musculus
actgaaaattggcacctacacgggc

SEQ ID NO: 128494 - DNA, 25 bp, Mus musculus
actgaaaattgggacctacacgggc

SEQ ID NO: 128495 - DNA, 25 bp, Mus musculus
actgaaacccctactagcatctttg

SEQ ID NO: 128496 - DNA, 25 bp, Mus musculus
actgaaaccccttctagcatctttg

SEQ ID NO: 128497 - DNA, 25 bp, Mus musculus
actgaaactagtagtccttttctag

SEQ ID NO: 128498 - DNA, 25 bp, Mus musculus
actgaaactagttgtccttttctag

SEQ ID NO: 128499 - DNA, 25 bp, Mus musculus
actgaaactcaaataccgctgctcc

SEQ ID NO: 128500 - DNA, 25 bp, Mus musculus
actgaaactcaattaccgctgctcc

SEQ ID NO: 128501 - DNA, 25 bp, Mus musculus
actgaaactgcaatattcatcgctg

SEQ ID NO: 128502 - DNA, 25 bp, Mus musculus
actgaaactgcattattcatcgctg

SEQ ID NO: 128503 - DNA, 25 bp, Mus musculus
actgaaactggacatcaagactgac

SEQ ID NO: 128504 - DNA, 25 bp, Mus musculus
actgaaactggagatcaagactgac

SEQ ID NO: 128505 - DNA, 25 bp, Mus musculus
actgaaactgttaactattgaggca

SEQ ID NO: 128506 - DNA, 25 bp, Mus musculus
actgaaactgtttactattgaggca

SEQ ID NO: 128507 - DNA, 25 bp, Mus musculus
actgaaagacttcaggtaacctgga

SEQ ID NO: 128508 - DNA, 25 bp, Mus musculus
actgaaagacttgaggtaacctgga

SEQ ID NO: 128509 - DNA, 25 bp, Mus musculus
actgaaagccccagattgaagatga

SEQ ID NO: 128510 - DNA, 25 bp, Mus musculus
actgaaagcccctgattgaagatga

SEQ ID NO: 128511 - DNA, 25 bp, Mus musculus
actgaaagctttactagcgcatact

SEQ ID NO: 128512 - DNA, 25 bp, Mus musculus
actgaaagcttttctagcgcatact

SEQ ID NO: 128513 - DNA, 25 bp, Mus musculus
actgaaatacagagctttgggttaa

SEQ ID NO: 128514 - DNA, 25 bp, Mus musculus
actgaaatacagtgctttgggttaa

SEQ ID NO: 128515 - DNA, 25 bp, Mus musculus
actgaaatagatacgcagccgcctc

SEQ ID NO: 128516 - DNA, 25 bp, Mus musculus
actgaaatagattcgcagccgcctc

SEQ ID NO: 128517 - DNA, 25 bp, Mus musculus
actgaaatatgcacctggtagcaga

SEQ ID NO: 128518 - DNA, 25 bp, Mus musculus
actgaaatatgctcctggtagcaga

SEQ ID NO: 128519 - DNA, 25 bp, Mus musculus
actgaaatcagcaagcccaggagat

SEQ ID NO: 128520 - DNA, 25 bp, Mus musculus
actgaaatcagctagcccaggagat

SEQ ID NO: 128521 - DNA, 25 bp, Mus musculus
actgaaatccaaagtcgtaccaatt

SEQ ID NO: 128522 - DNA, 25 bp, Mus musculus
actgaaatccaatgtcgtaccaatt

SEQ ID NO: 128523 - DNA, 25 bp, Mus musculus
actgaaatgatcagtgtatacccca

SEQ ID NO: 128524 - DNA, 25 bp, Mus musculus
actgaaatgatctgtgtatacccca

SEQ ID NO: 128525 - DNA, 25 bp, Mus musculus
actgaaatgtgcagaaccccatggt

SEQ ID NO: 128526 - DNA, 25 bp, Mus musculus
actgaaatgtgctgaaccccatggt

SEQ ID NO: 128527 - DNA, 25 bp, Mus musculus
actgaaattcctcttgagtgctcct

SEQ ID NO: 128528 - DNA, 25 bp, Mus musculus
actgaaattcctgttgagtgctcct

SEQ ID NO: 128529 - DNA, 25 bp, Mus musculus
actgaaattctcacttgtctcctaa

SEQ ID NO: 128530 - DNA, 25 bp, Mus musculus
actgaaattctctcttgtctcctaa

SEQ ID NO: 128531 - DNA, 25 bp, Mus musculus
actgaacaatgtacgatatccctta

SEQ ID NO: 128532 - DNA, 25 bp, Mus musculus
actgaacaatgttcgatatccctta

SEQ ID NO: 128533 - DNA, 25 bp, Mus musculus
actgaacaccgtctggtcctcacgg

SEQ ID NO: 128534 - DNA, 25 bp, Mus musculus
actgaacaccgtgtggtcctcacgg

SEQ ID NO: 128535 - DNA, 25 bp, Mus musculus
actgaacagaacctctctacacatg

SEQ ID NO: 128536 - DNA, 25 bp, Mus musculus
actgaacagaacgtctctacacatg

SEQ ID NO: 128537 - DNA, 25 bp, Mus musculus
actgaacatgggaatctgaaggtgg

SEQ ID NO: 128538 - DNA, 25 bp, Mus musculus
actgaacatgggtatctgaaggtgg

SEQ ID NO: 128539 - DNA, 25 bp, Mus musculus
actgaaccaaatagcactgaagttt

SEQ ID NO: 128540 - DNA, 25 bp, Mus musculus
actgaaccaaattgcactgaagttt

SEQ ID NO: 128541 - DNA, 25 bp, Mus musculus
actgaaccaggacgcccactgaggt

SEQ ID NO: 128542 - DNA, 25 bp, Mus musculus
actgaaccaggaggcccactgaggt

SEQ ID NO: 128543 - DNA, 25 bp, Mus musculus
actgaaccatatctttagctccaca

SEQ ID NO: 128544 - DNA, 25 bp, Mus musculus
actgaaccatatgtttagctccaca

SEQ ID NO: 128545 - DNA, 25 bp, Mus musculus
actgaacccactccctgaatgtttt

SEQ ID NO: 128546 - DNA, 25 bp, Mus musculus
actgaacccactgcctgaatgtttt

SEQ ID NO: 128547 - DNA, 25 bp, Mus musculus
actgaacccagaaaactacctgcct

SEQ ID NO: 128548 - DNA, 25 bp, Mus musculus
actgaacccagataactacctgcct

SEQ ID NO: 128549 - DNA, 25 bp, Mus musculus
actgaacctcagagggtgccatcca

SEQ ID NO: 128550 - DNA, 25 bp, Mus musculus
actgaacctcagatcccagggaaaa

SEQ ID NO: 128551 - DNA, 25 bp, Mus musculus
actgaacctcagtgggtgccatcca

SEQ ID NO: 128552 - DNA, 25 bp, Mus musculus
actgaacctcagttcccagggaaaa

SEQ ID NO: 128553 - DNA, 25 bp, Mus musculus
actgaacctgaacctccatgatttt

SEQ ID NO: 128554 - DNA, 25 bp, Mus musculus
actgaacctgaagctccatgatttt

SEQ ID NO: 128555 - DNA, 25 bp, Mus musculus
actgaacctggtacttctgacatcg

SEQ ID NO: 128556 - DNA, 25 bp, Mus musculus
actgaacctggttcttctgacatcg

SEQ ID NO: 128557 - DNA, 25 bp, Mus musculus
actgaacctgtcagggaccccagaa

SEQ ID NO: 128558 - DNA, 25 bp, Mus musculus
actgaacctgtctgggaccccagaa

SEQ ID NO: 128559 - DNA, 25 bp, Mus musculus
actgaacctgtgaatctgtaccttc

SEQ ID NO: 128560 - DNA, 25 bp, Mus musculus
actgaacctgtgtatctgtaccttc

SEQ ID NO: 128561 - DNA, 25 bp, Mus musculus
actgaaccttgaaggcacaccatct

SEQ ID NO: 128562 - DNA, 25 bp, Mus musculus
actgaaccttgatggcacaccatct

SEQ ID NO: 128563 - DNA, 25 bp, Mus musculus
actgaacgggccattgaacaagtat

SEQ ID NO: 128564 - DNA, 25 bp, Mus musculus
actgaacgggcctttgaacaagtat

SEQ ID NO: 128565 - DNA, 25 bp, Mus musculus
actgaactaattcggcagccatctc

SEQ ID NO: 128566 - DNA, 25 bp, Mus musculus
actgaactaattgggcagccatctc

SEQ ID NO: 128567 - DNA, 25 bp, Mus musculus
actgaactacatctctggtccattt

SEQ ID NO: 128568 - DNA, 25 bp, Mus musculus
actgaactacatgtctggtccattt

SEQ ID NO: 128569 - DNA, 25 bp, Mus musculus
actgaactatacacaaaggcacttg

SEQ ID NO: 128570 - DNA, 25 bp, Mus musculus
actgaactatactcaaaggcacttg

SEQ ID NO: 128571 - DNA, 25 bp, Mus musculus
actgaactccttcaagacatgcttt

SEQ ID NO: 128572 - DNA, 25 bp, Mus musculus
actgaactccttgaagacatgcttt

SEQ ID NO: 128573 - DNA, 25 bp, Mus musculus
actgaactcgagacgccaggcttgg

SEQ ID NO: 128574 - DNA, 25 bp, Mus musculus
actgaactcgagtcgccaggcttgg

SEQ ID NO: 128575 - DNA, 25 bp, Mus musculus
actgaactggccagtctactattaa

SEQ ID NO: 128576 - DNA, 25 bp, Mus musculus
actgaactggcctgtctactattaa

SEQ ID NO: 128577 - DNA, 25 bp, Mus musculus
actgaactgggaatacaatatggca

SEQ ID NO: 128578 - DNA, 25 bp, Mus musculus
actgaactgggattacaatatggca

SEQ ID NO: 128579 - DNA, 25 bp, Mus musculus
actgaactgtatcctctagacactc

SEQ ID NO: 128580 - DNA, 25 bp, Mus musculus
actgaactgtatgctctagacactc

SEQ ID NO: 128581 - DNA, 25 bp, Mus musculus
actgaacttggcaacaaagagcttt

SEQ ID NO: 128582 - DNA, 25 bp, Mus musculus
actgaacttggctacaaagagcttt

SEQ ID NO: 128583 - DNA, 25 bp, Mus musculus
actgaagaacttccactgtgactga

SEQ ID NO: 128584 - DNA, 25 bp, Mus musculus
actgaagaacttgcactgtgactga

SEQ ID NO: 128585 - DNA, 25 bp, Mus musculus
actgaagacactagcagcttttgga

SEQ ID NO: 128586 - DNA, 25 bp, Mus musculus
actgaagacacttgcagcttttgga

SEQ ID NO: 128587 - DNA, 25 bp, Mus musculus
actgaagacattatcaatttttcct

SEQ ID NO: 128588 - DNA, 25 bp, Mus musculus
actgaagacattttcaatttttcct

SEQ ID NO: 128589 - DNA, 25 bp, Mus musculus
actgaagactggctgttgccacaca

SEQ ID NO: 128590 - DNA, 25 bp, Mus musculus
actgaagactgggtgttgccacaca

SEQ ID NO: 128591 - DNA, 25 bp, Mus musculus
actgaagacttcagggctccgtgtg

SEQ ID NO: 128592 - DNA, 25 bp, Mus musculus
actgaagacttctgggctccgtgtg

SEQ ID NO: 128593 - DNA, 25 bp, Mus musculus
actgaagagctcctgtatttggcgg

SEQ ID NO: 128594 - DNA, 25 bp, Mus musculus
actgaagagctcgtgtatttggcgg

SEQ ID NO: 128595 - DNA, 25 bp, Mus musculus
actgaagagcttccccaacattggc

SEQ ID NO: 128596 - DNA, 25 bp, Mus musculus
actgaagagcttgcccaacattggc

SEQ ID NO: 128597 - DNA, 25 bp, Mus musculus
actgaagaggtcctttcccctgatg

SEQ ID NO: 128598 - DNA, 25 bp, Mus musculus
actgaagaggtcgtttcccctgatg

SEQ ID NO: 128599 - DNA, 25 bp, Mus musculus
actgaagataggctagcagtgagac

SEQ ID NO: 128600 - DNA, 25 bp, Mus musculus
actgaagatagggtagcagtgagac

SEQ ID NO: 128601 - DNA, 25 bp, Mus musculus
actgaagatcatccttccctcgaac

SEQ ID NO: 128602 - DNA, 25 bp, Mus musculus
actgaagatcatgcttccctcgaac

SEQ ID NO: 128603 - DNA, 25 bp, Mus musculus
actgaagatgagcaggcaacctgga

SEQ ID NO: 128604 - DNA, 25 bp, Mus musculus
actgaagatgaggaggcaacctgga

SEQ ID NO: 128605 - DNA, 25 bp, Mus musculus
actgaagatgtcctatccacctaaa

SEQ ID NO: 128606 - DNA, 25 bp, Mus musculus
actgaagatgtcgtatccacctaaa

SEQ ID NO: 128607 - DNA, 25 bp, Mus musculus
actgaagcactgaagcacgttctct

SEQ ID NO: 128608 - DNA, 25 bp, Mus musculus
actgaagcactgtagcacgttctct

SEQ ID NO: 128609 - DNA, 25 bp, Mus musculus
actgaagcagtcatttagaccggga

SEQ ID NO: 128610 - DNA, 25 bp, Mus musculus
actgaagcagtcttttagaccggga

SEQ ID NO: 128611 - DNA, 25 bp, Mus musculus
actgaagccaagctctcattccttc

SEQ ID NO: 128612 - DNA, 25 bp, Mus musculus
actgaagccaaggtctcattccttc

SEQ ID NO: 128613 - DNA, 25 bp, Mus musculus
actgaagccagacaggactccagca

SEQ ID NO: 128614 - DNA, 25 bp, Mus musculus
actgaagccagagaggactccagca

SEQ ID NO: 128615 - DNA, 25 bp, Mus musculus
actgaagccagtatgacttgtgaga

SEQ ID NO: 128616 - DNA, 25 bp, Mus musculus
actgaagccagtttgacttgtgaga

SEQ ID NO: 128617 - DNA, 25 bp, Mus musculus
actgaagcccaacatacctgaacat

SEQ ID NO: 128618 - DNA, 25 bp, Mus musculus
actgaagcccaagatacctgaacat

SEQ ID NO: 128619 - DNA, 25 bp, Mus musculus
actgaagccgagctcgggtgaccct

SEQ ID NO: 128620 - DNA, 25 bp, Mus musculus
actgaagccgaggtcgggtgaccct

SEQ ID NO: 128621 - DNA, 25 bp, Mus musculus
actgaagcctctctcgcttaagtgt

SEQ ID NO: 128622 - DNA, 25 bp, Mus musculus
actgaagcctctgtcgcttaagtgt

SEQ ID NO: 128623 - DNA, 25 bp, Mus musculus
actgaagcgatccacctcaaaaggg

SEQ ID NO: 128624 - DNA, 25 bp, Mus musculus
actgaagcgatcgacctcaaaaggg

SEQ ID NO: 128625 - DNA, 25 bp, Mus musculus
actgaagctccgatcctcagggaca

SEQ ID NO: 128626 - DNA, 25 bp, Mus musculus
actgaagctccgttcctcagggaca

SEQ ID NO: 128627 - DNA, 25 bp, Mus musculus
actgaagctcggacttaaacggcgc

SEQ ID NO: 128628 - DNA, 25 bp, Mus musculus
actgaagctcggtcttaaacggcgc

SEQ ID NO: 128629 - DNA, 25 bp, Mus musculus
actgaagctctgagtcgaatcctgt

SEQ ID NO: 128630 - DNA, 25 bp, Mus musculus
actgaagctctgtgtcgaatcctgt

SEQ ID NO: 128631 - DNA, 25 bp, Mus musculus
actgaagctggtagaaagcaccatg

SEQ ID NO: 128632 - DNA, 25 bp, Mus musculus
actgaagctggtagagagcatcttg

SEQ ID NO: 128633 - DNA, 25 bp, Mus musculus
actgaagctggttgaaagcaccatg

SEQ ID NO: 128634 - DNA, 25 bp, Mus musculus
actgaagctggttgagagcatcttg

SEQ ID NO: 128635 - DNA, 25 bp, Mus musculus
actgaagcttttacttatgtcttac

SEQ ID NO: 128636 - DNA, 25 bp, Mus musculus
actgaagctttttcttatgtcttac

SEQ ID NO: 128637 - DNA, 25 bp, Mus musculus
actgaaggagcaaaggtggccctgt

SEQ ID NO: 128638 - DNA, 25 bp, Mus musculus
actgaaggagcataggtggccctgt

SEQ ID NO: 128639 - DNA, 25 bp, Mus musculus
actgaaggccatccgttacttggag

SEQ ID NO: 128640 - DNA, 25 bp, Mus musculus
actgaaggccatgcgttacttggag

SEQ ID NO: 128641 - DNA, 25 bp, Mus musculus
actgaaggcctacttgcagcagcat

SEQ ID NO: 128642 - DNA, 25 bp, Mus musculus
actgaaggcctagttgcagcagcat

SEQ ID NO: 128643 - DNA, 25 bp, Mus musculus
actgaaggccttcccatatagacgg

SEQ ID NO: 128644 - DNA, 25 bp, Mus musculus
actgaaggccttgccatatagacgg

SEQ ID NO: 128645 - DNA, 25 bp, Mus musculus
actgaaggctcacgacgctacattc

SEQ ID NO: 128646 - DNA, 25 bp, Mus musculus
actgaaggctcaggacgctacattc

SEQ ID NO: 128647 - DNA, 25 bp, Mus musculus
actgaaggctctctttgtgggactg

SEQ ID NO: 128648 - DNA, 25 bp, Mus musculus
actgaaggctctgtttgtgggactg

SEQ ID NO: 128649 - DNA, 25 bp, Mus musculus
actgaagggcagctctcatgcccag

SEQ ID NO: 128650 - DNA, 25 bp, Mus musculus
actgaagggcaggtctcatgcccag

SEQ ID NO: 128651 - DNA, 25 bp, Mus musculus
actgaagggctgctcatgaactcgg

SEQ ID NO: 128652 - DNA, 25 bp, Mus musculus
actgaagggctggtcatgaactcgg

SEQ ID NO: 128653 - DNA, 25 bp, Mus musculus
actgaaggtacaccactgggcgtct

SEQ ID NO: 128654 - DNA, 25 bp, Mus musculus
actgaaggtacagcactgggcgtct

SEQ ID NO: 128655 - DNA, 25 bp, Mus musculus
actgaaggtatgattgtctgatttt

SEQ ID NO: 128656 - DNA, 25 bp, Mus musculus
actgaaggtatgtttgtctgatttt

SEQ ID NO: 128657 - DNA, 25 bp, Mus musculus
actgaaggtcccaggtgtggcctgt

SEQ ID NO: 128658 - DNA, 25 bp, Mus musculus
actgaaggtccctggtgtggcctgt

SEQ ID NO: 128659 - DNA, 25 bp, Mus musculus
actgaaggtcttagctatatgatag

SEQ ID NO: 128660 - DNA, 25 bp, Mus musculus
actgaaggtctttgctatatgatag

SEQ ID NO: 128661 - DNA, 25 bp, Mus musculus
actgaaggttctcagaacgtgggct

SEQ ID NO: 128662 - DNA, 25 bp, Mus musculus
actgaaggttctgagaacgtgggct

SEQ ID NO: 128663 - DNA, 25 bp, Mus musculus
actgaagtactacttttgccctatt

SEQ ID NO: 128664 - DNA, 25 bp, Mus musculus
actgaagtactagttttgccctatt

SEQ ID NO: 128665 - DNA, 25 bp, Mus musculus
actgaagtcaaaccgtcttccaatg

SEQ ID NO: 128666 - DNA, 25 bp, Mus musculus
actgaagtcaaagcgtcttccaatg

SEQ ID NO: 128667 - DNA, 25 bp, Mus musculus
actgaagtcagtctctctggtgctt

SEQ ID NO: 128668 - DNA, 25 bp, Mus musculus
actgaagtcagtgtctctggtgctt

SEQ ID NO: 128669 - DNA, 25 bp, Mus musculus
actgaagtcccgagccaagtggcgc

SEQ ID NO: 128670 - DNA, 25 bp, Mus musculus
actgaagtcccgtgccaagtggcgc

SEQ ID NO: 128671 - DNA, 25 bp, Mus musculus
actgaagtcttcaacctgattgatc

SEQ ID NO: 128672 - DNA, 25 bp, Mus musculus
actgaagtcttctacctgattgatc

SEQ ID NO: 128673 - DNA, 25 bp, Mus musculus
actgaagtgagcatctatctacaac

SEQ ID NO: 128674 - DNA, 25 bp, Mus musculus
actgaagtgagcttctatctacaac

SEQ ID NO: 128675 - DNA, 25 bp, Mus musculus
actgaagtgatcaggactcgtgaga

SEQ ID NO: 128676 - DNA, 25 bp, Mus musculus
actgaagtgatctggactcgtgaga

SEQ ID NO: 128677 - DNA, 25 bp, Mus musculus
actgaagtgctaatcctgcctttgg

SEQ ID NO: 128678 - DNA, 25 bp, Mus musculus
actgaagtgctattcctgcctttgg

SEQ ID NO: 128679 - DNA, 25 bp, Mus musculus
actgaagtggacagagcagcttccc

SEQ ID NO: 128680 - DNA, 25 bp, Mus musculus
actgaagtggactgagcagcttccc

SEQ ID NO: 128681 - DNA, 25 bp, Mus musculus
actgaagtgggaatttctagtttct

SEQ ID NO: 128682 - DNA, 25 bp, Mus musculus
actgaagtgggattttctagtttct

SEQ ID NO: 128683 - DNA, 25 bp, Mus musculus
actgaagtgggcaggatgtctgtac

SEQ ID NO: 128684 - DNA, 25 bp, Mus musculus
actgaagtgggctggatgtctgtac

SEQ ID NO: 128685 - DNA, 25 bp, Mus musculus
actgaagtgtggatagcccttgctc

SEQ ID NO: 128686 - DNA, 25 bp, Mus musculus
actgaagtgtggctccaaagactca

SEQ ID NO: 128687 - DNA, 25 bp, Mus musculus
actgaagtgtgggtccaaagactca

SEQ ID NO: 128688 - DNA, 25 bp, Mus musculus
actgaagtgtggttagcccttgctc

SEQ ID NO: 128689 - DNA, 25 bp, Mus musculus
actgaagtttcacctgtgcactatt

SEQ ID NO: 128690 - DNA, 25 bp, Mus musculus
actgaagtttcagctgtgcactatt

SEQ ID NO: 128691 - DNA, 25 bp, Mus musculus
actgaagtttttctcctggtctgtt

SEQ ID NO: 128692 - DNA, 25 bp, Mus musculus
actgaagtttttgtcctggtctgtt

SEQ ID NO: 128693 - DNA, 25 bp, Mus musculus
actgaataagttagttccactctac

SEQ ID NO: 128694 - DNA, 25 bp, Mus musculus
actgaataagtttgttccactctac

SEQ ID NO: 128695 - DNA, 25 bp, Mus musculus
actgaatacatgaggccctacctca

SEQ ID NO: 128696 - DNA, 25 bp, Mus musculus
actgaatacatgtggccctacctca

SEQ ID NO: 128697 - DNA, 25 bp, Mus musculus
actgaatagcttcttacatccaggc

SEQ ID NO: 128698 - DNA, 25 bp, Mus musculus
actgaatagcttgttacatccaggc

SEQ ID NO: 128699 - DNA, 25 bp, Mus musculus
actgaatatgcactgtctcttggtc

SEQ ID NO: 128700 - DNA, 25 bp, Mus musculus
actgaatatgcagtgtctcttggtc

SEQ ID NO: 128701 - DNA, 25 bp, Mus musculus
actgaatatgccagtctctgtgcta

SEQ ID NO: 128702 - DNA, 25 bp, Mus musculus
actgaatatgcctgtctctgtgcta

SEQ ID NO: 128703 - DNA, 25 bp, Mus musculus
actgaatccaggctctctgcaagag

SEQ ID NO: 128704 - DNA, 25 bp, Mus musculus
actgaatccagggtctctgcaagag

SEQ ID NO: 128705 - DNA, 25 bp, Mus musculus
actgaatcccgtccaaacttttccg

SEQ ID NO: 128706 - DNA, 25 bp, Mus musculus
actgaatcccgtgcaaacttttccg

SEQ ID NO: 128707 - DNA, 25 bp, Mus musculus
actgaatccggaacccatttgtgaa

SEQ ID NO: 128708 - DNA, 25 bp, Mus musculus
actgaatccggatcccatttgtgaa

SEQ ID NO: 128709 - DNA, 25 bp, Mus musculus
actgaatcctccaggttaggtaggc

SEQ ID NO: 128710 - DNA, 25 bp, Mus musculus
actgaatcctcctggttaggtaggc

SEQ ID NO: 128711 - DNA, 25 bp, Mus musculus
actgaatcgagtcgctgccctggat

SEQ ID NO: 128712 - DNA, 25 bp, Mus musculus
actgaatcgagtggctgccctggat

SEQ ID NO: 128713 - DNA, 25 bp, Mus musculus
actgaatcgcagctaccatttgtat

SEQ ID NO: 128714 - DNA, 25 bp, Mus musculus
actgaatcgcaggtaccatttgtat

SEQ ID NO: 128715 - DNA, 25 bp, Mus musculus
actgaatctcctaccttgttttgaa

SEQ ID NO: 128716 - DNA, 25 bp, Mus musculus
actgaatctccttccttgttttgaa

SEQ ID NO: 128717 - DNA, 25 bp, Mus musculus
actgaatctctgagggcgctccaat

SEQ ID NO: 128718 - DNA, 25 bp, Mus musculus
actgaatctctgtgggcgctccaat

SEQ ID NO: 128719 - DNA, 25 bp, Mus musculus
actgaatcttctctgtactggccaa

SEQ ID NO: 128720 - DNA, 25 bp, Mus musculus
actgaatcttctgtgtactggccaa

SEQ ID NO: 128721 - DNA, 25 bp, Mus musculus
actgaatgacacattacctccacgc

SEQ ID NO: 128722 - DNA, 25 bp, Mus musculus
actgaatgacactttacctccacgc

SEQ ID NO: 128723 - DNA, 25 bp, Mus musculus
actgaatgatgcatatatcccttgt

SEQ ID NO: 128724 - DNA, 25 bp, Mus musculus
actgaatgatgcttatatcccttgt

SEQ ID NO: 128725 - DNA, 25 bp, Mus musculus
actgaatgccatccccgatttaaaa

SEQ ID NO: 128726 - DNA, 25 bp, Mus musculus
actgaatgccatgcccgatttaaaa

SEQ ID NO: 128727 - DNA, 25 bp, Mus musculus
actgaatggatgcatgctcactgaa

SEQ ID NO: 128728 - DNA, 25 bp, Mus musculus
actgaatggatggatgctcactgaa

SEQ ID NO: 128729 - DNA, 25 bp, Mus musculus
actgaatggcgtcatcttgcctgga

SEQ ID NO: 128730 - DNA, 25 bp, Mus musculus
actgaatggcgtgatcttgcctgga

SEQ ID NO: 128731 - DNA, 25 bp, Mus musculus
actgaatgtactcatctagaagata

SEQ ID NO: 128732 - DNA, 25 bp, Mus musculus
actgaatgtactccaacgagtggtt

SEQ ID NO: 128733 - DNA, 25 bp, Mus musculus
actgaatgtactgatctagaagata

SEQ ID NO: 128734 - DNA, 25 bp, Mus musculus
actgaatgtactgcaacgagtggtt

SEQ ID NO: 128735 - DNA, 25 bp, Mus musculus
actgaatgtatgagaagctggtgct

SEQ ID NO: 128736 - DNA, 25 bp, Mus musculus
actgaatgtatgtgaagctggtgct

SEQ ID NO: 128737 - DNA, 25 bp, Mus musculus
actgaatgttgaccacaggtgccca

SEQ ID NO: 128738 - DNA, 25 bp, Mus musculus
actgaatgttgagcacaggtgccca

SEQ ID NO: 128739 - DNA, 25 bp, Mus musculus
actgaatgttggctactcgtgcttt

SEQ ID NO: 128740 - DNA, 25 bp, Mus musculus
actgaatgttgggtactcgtgcttt

SEQ ID NO: 128741 - DNA, 25 bp, Mus musculus
actgaatgtttccatgtgcctctcg

SEQ ID NO: 128742 - DNA, 25 bp, Mus musculus
actgaatgtttcgatgtgcctctcg

SEQ ID NO: 128743 - DNA, 25 bp, Mus musculus
actgaatgttttccttgctccttgg

SEQ ID NO: 128744 - DNA, 25 bp, Mus musculus
actgaatgttttgcttgctccttgg

SEQ ID NO: 128745 - DNA, 25 bp, Mus musculus
actgaattactacctccacagagag

SEQ ID NO: 128746 - DNA, 25 bp, Mus musculus
actgaattactagctccacagagag

SEQ ID NO: 128747 - DNA, 25 bp, Mus musculus
actgaattcctgctctagtattggg

SEQ ID NO: 128748 - DNA, 25 bp, Mus musculus
actgaattcctggtctagtattggg

SEQ ID NO: 128749 - DNA, 25 bp, Mus musculus
actgaattctgtattgtatagctat

SEQ ID NO: 128750 - DNA, 25 bp, Mus musculus
actgaattctgttttgtatagctat

SEQ ID NO: 128751 - DNA, 25 bp, Mus musculus
actgaattcttactacactgttaca

SEQ ID NO: 128752 - DNA, 25 bp, Mus musculus
actgaattcttagtacactgttaca

SEQ ID NO: 128753 - DNA, 25 bp, Mus musculus
actgaatttaaaccctactgcctta

SEQ ID NO: 128754 - DNA, 25 bp, Mus musculus
actgaatttaaagcctactgcctta

SEQ ID NO: 128755 - DNA, 25 bp, Mus musculus
actgaatttgtactctgttgccatt

SEQ ID NO: 128756 - DNA, 25 bp, Mus musculus
actgaatttgtagtctgttgccatt

SEQ ID NO: 128757 - DNA, 25 bp, Mus musculus
actgacaagaagcttggagccctca

SEQ ID NO: 128758 - DNA, 25 bp, Mus musculus
actgacaagaaggttggagccctca

SEQ ID NO: 128759 - DNA, 25 bp, Mus musculus
actgacaagccaactgcgtggtcat

SEQ ID NO: 128760 - DNA, 25 bp, Mus musculus
actgacaagccatctgcgtggtcat

SEQ ID NO: 128761 - DNA, 25 bp, Mus musculus
actgacaagctcaccgtgtgaggag

SEQ ID NO: 128762 - DNA, 25 bp, Mus musculus
actgacaagctctccgtgtgaggag

SEQ ID NO: 128763 - DNA, 25 bp, Mus musculus
actgacaagtctagcttagagtgcc

SEQ ID NO: 128764 - DNA, 25 bp, Mus musculus
actgacaagtcttgcttagagtgcc

SEQ ID NO: 128765 - DNA, 25 bp, Mus musculus
actgacaatggccttcttctgaaag

SEQ ID NO: 128766 - DNA, 25 bp, Mus musculus
actgacaatggcgttcttctgaaag

SEQ ID NO: 128767 - DNA, 25 bp, Mus musculus
actgacacatctctagctgttgccg

SEQ ID NO: 128768 - DNA, 25 bp, Mus musculus
actgacacatctgtagctgttgccg

SEQ ID NO: 128769 - DNA, 25 bp, Mus musculus
actgacacctgtcgcatatgggtgc

SEQ ID NO: 128770 - DNA, 25 bp, Mus musculus
actgacacctgtggcatatgggtgc

SEQ ID NO: 128771 - DNA, 25 bp, Mus musculus
actgacactactactcattctagga

SEQ ID NO: 128772 - DNA, 25 bp, Mus musculus
actgacactacttctcattctagga

SEQ ID NO: 128773 - DNA, 25 bp, Mus musculus
actgacactcacaatggacacctgc

SEQ ID NO: 128774 - DNA, 25 bp, Mus musculus
actgacactcactatggacacctgc

SEQ ID NO: 128775 - DNA, 25 bp, Mus musculus
actgacactggtaaggaagcctccc

SEQ ID NO: 128776 - DNA, 25 bp, Mus musculus
actgacactggttaggaagcctccc

SEQ ID NO: 128777 - DNA, 25 bp, Mus musculus
actgacagagccaacatttctccat

SEQ ID NO: 128778 - DNA, 25 bp, Mus musculus
actgacagagcctacatttctccat

SEQ ID NO: 128779 - DNA, 25 bp, Mus musculus
actgacagcggcattgttcaacttg

SEQ ID NO: 128780 - DNA, 25 bp, Mus musculus
actgacagcggctttgttcaacttg

SEQ ID NO: 128781 - DNA, 25 bp, Mus musculus
actgacagctggatctcagacttct

SEQ ID NO: 128782 - DNA, 25 bp, Mus musculus
actgacagctggttctcagacttct

SEQ ID NO: 128783 - DNA, 25 bp, Mus musculus
actgacagggacagggatgagaaaa

SEQ ID NO: 128784 - DNA, 25 bp, Mus musculus
actgacagggactgggatgagaaaa

SEQ ID NO: 128785 - DNA, 25 bp, Mus musculus
actgacaggtgcaattccagtgagc

SEQ ID NO: 128786 - DNA, 25 bp, Mus musculus
actgacaggtgctattccagtgagc

SEQ ID NO: 128787 - DNA, 25 bp, Mus musculus
actgacagtgcgagtaccagggaca

SEQ ID NO: 128788 - DNA, 25 bp, Mus musculus
actgacagtgcgtgtaccagggaca

SEQ ID NO: 128789 - DNA, 25 bp, Mus musculus
actgacagttcacacaaggcccctg

SEQ ID NO: 128790 - DNA, 25 bp, Mus musculus
actgacagttcagacaaggcccctg

SEQ ID NO: 128791 - DNA, 25 bp, Mus musculus
actgacatatcacgtgttcaccttt

SEQ ID NO: 128792 - DNA, 25 bp, Mus musculus
actgacatatcaggtgttcaccttt

SEQ ID NO: 128793 - DNA, 25 bp, Mus musculus
actgacatattcatctcctttctgt

SEQ ID NO: 128794 - DNA, 25 bp, Mus musculus
actgacatattcttctcctttctgt

SEQ ID NO: 128795 - DNA, 25 bp, Mus musculus
actgacatccggagttctaactggt

SEQ ID NO: 128796 - DNA, 25 bp, Mus musculus
actgacatccggtgttctaactggt

SEQ ID NO: 128797 - DNA, 25 bp, Mus musculus
actgacatgacaattggctccacac

SEQ ID NO: 128798 - DNA, 25 bp, Mus musculus
actgacatgacatttggctccacac

SEQ ID NO: 128799 - DNA, 25 bp, Mus musculus
actgacatgtatctcttctctattg

SEQ ID NO: 128800 - DNA, 25 bp, Mus musculus
actgacatgtatgtcttctctattg

SEQ ID NO: 128801 - DNA, 25 bp, Mus musculus
actgacatgtgcagctgttgagcct

SEQ ID NO: 128802 - DNA, 25 bp, Mus musculus
actgacatgtgccatcatgatggtt

SEQ ID NO: 128803 - DNA, 25 bp, Mus musculus
actgacatgtgcgatcatgatggtt

SEQ ID NO: 128804 - DNA, 25 bp, Mus musculus
actgacatgtgctgctgttgagcct

SEQ ID NO: 128805 - DNA, 25 bp, Mus musculus
actgacatgtgtattattaaggaat

SEQ ID NO: 128806 - DNA, 25 bp, Mus musculus
actgacatgtgttttattaaggaat

SEQ ID NO: 128807 - DNA, 25 bp, Mus musculus
actgaccaacagagcctcgggacta

SEQ ID NO: 128808 - DNA, 25 bp, Mus musculus
actgaccaacagtgcctcgggacta

SEQ ID NO: 128809 - DNA, 25 bp, Mus musculus
actgaccaagtcacaatgtattccg

SEQ ID NO: 128810 - DNA, 25 bp, Mus musculus
actgaccaagtctcaatgtattccg

SEQ ID NO: 128811 - DNA, 25 bp, Mus musculus
actgaccacatcaggaggcgacata

SEQ ID NO: 128812 - DNA, 25 bp, Mus musculus
actgaccacatctggaggcgacata

SEQ ID NO: 128813 - DNA, 25 bp, Mus musculus
actgaccacttgatagagcgcctat

SEQ ID NO: 128814 - DNA, 25 bp, Mus musculus
actgaccacttgttagagcgcctat

SEQ ID NO: 128815 - DNA, 25 bp, Mus musculus
actgaccagcagagatgaggacaca

SEQ ID NO: 128816 - DNA, 25 bp, Mus musculus
actgaccagcagtgatgaggacaca

SEQ ID NO: 128817 - DNA, 25 bp, Mus musculus
actgaccagggtccccacatggtgg

SEQ ID NO: 128818 - DNA, 25 bp, Mus musculus
actgaccagggtgcccacatggtgg

SEQ ID NO: 128819 - DNA, 25 bp, Mus musculus
actgaccagtagcaggagtcttcat

SEQ ID NO: 128820 - DNA, 25 bp, Mus musculus
actgaccagtaggaggagtcttcat

SEQ ID NO: 128821 - DNA, 25 bp, Mus musculus
actgaccatataatctgtttacaaa

SEQ ID NO: 128822 - DNA, 25 bp, Mus musculus
actgaccatatattctgtttacaaa

SEQ ID NO: 128823 - DNA, 25 bp, Mus musculus
actgaccatggtctttcagactaga

SEQ ID NO: 128824 - DNA, 25 bp, Mus musculus
actgaccatggtgtttcagactaga

SEQ ID NO: 128825 - DNA, 25 bp, Mus musculus
actgaccattctatgctggagtctt

SEQ ID NO: 128826 - DNA, 25 bp, Mus musculus
actgaccattctttgctggagtctt

SEQ ID NO: 128827 - DNA, 25 bp, Mus musculus
actgacccactgagtgacctgaaga

SEQ ID NO: 128828 - DNA, 25 bp, Mus musculus
actgacccactgtgtgacctgaaga

SEQ ID NO: 128829 - DNA, 25 bp, Mus musculus
actgacccagcaatagaagtgttga

SEQ ID NO: 128830 - DNA, 25 bp, Mus musculus
actgacccagcattagaagtgttga

SEQ ID NO: 128831 - DNA, 25 bp, Mus musculus
actgacccagtcagaacaacacatc

SEQ ID NO: 128832 - DNA, 25 bp, Mus musculus
actgacccagtctgaacaacacatc

SEQ ID NO: 128833 - DNA, 25 bp, Mus musculus
actgacccatctctacagaccttcc

SEQ ID NO: 128834 - DNA, 25 bp, Mus musculus
actgacccatctgtacagaccttcc

SEQ ID NO: 128835 - DNA, 25 bp, Mus musculus
actgacccatggctgcctagggttg

SEQ ID NO: 128836 - DNA, 25 bp, Mus musculus
actgacccatgggtgcctagggttg

SEQ ID NO: 128837 - DNA, 25 bp, Mus musculus
actgaccccagtcaggaccttgtaa

SEQ ID NO: 128838 - DNA, 25 bp, Mus musculus
actgaccccagtcctagaagcgtga

SEQ ID NO: 128839 - DNA, 25 bp, Mus musculus
actgaccccagtgaggaccttgtaa

SEQ ID NO: 128840 - DNA, 25 bp, Mus musculus
actgaccccagtgctagaagcgtga

SEQ ID NO: 128841 - DNA, 25 bp, Mus musculus
actgaccctctgagtcacgtgaatg

SEQ ID NO: 128842 - DNA, 25 bp, Mus musculus
actgaccctctgtgtcacgtgaatg

SEQ ID NO: 128843 - DNA, 25 bp, Mus musculus
actgaccctggaatgggcctcataa

SEQ ID NO: 128844 - DNA, 25 bp, Mus musculus
actgaccctggattgggcctcataa

SEQ ID NO: 128845 - DNA, 25 bp, Mus musculus
actgaccctgtgaaatcctcctccg

SEQ ID NO: 128846 - DNA, 25 bp, Mus musculus
actgaccctgtgtaatcctcctccg

SEQ ID NO: 128847 - DNA, 25 bp, Mus musculus
actgacccttgcaaacaggaccaga

SEQ ID NO: 128848 - DNA, 25 bp, Mus musculus
actgacccttgctaacaggaccaga

SEQ ID NO: 128849 - DNA, 25 bp, Mus musculus
actgacccttttcagagtcgcctgg

SEQ ID NO: 128850 - DNA, 25 bp, Mus musculus
actgacccttttgagagtcgcctgg

SEQ ID NO: 128851 - DNA, 25 bp, Mus musculus
actgacctaagcagcctggacatga

SEQ ID NO: 128852 - DNA, 25 bp, Mus musculus
actgacctaagctgcctggacatga

SEQ ID NO: 128853 - DNA, 25 bp, Mus musculus
actgacctaattaggatctactgag

SEQ ID NO: 128854 - DNA, 25 bp, Mus musculus
actgacctaatttggatctactgag

SEQ ID NO: 128855 - DNA, 25 bp, Mus musculus
actgacctaggcagactcggaagac

SEQ ID NO: 128856 - DNA, 25 bp, Mus musculus
actgacctaggctgactcggaagac

SEQ ID NO: 128857 - DNA, 25 bp, Mus musculus
actgacctagtgactttatgtgtga

SEQ ID NO: 128858 - DNA, 25 bp, Mus musculus
actgacctagtgtctttatgtgtga

SEQ ID NO: 128859 - DNA, 25 bp, Mus musculus
actgacctatagacagtaccaggtt

SEQ ID NO: 128860 - DNA, 25 bp, Mus musculus
actgacctatagtcagtaccaggtt

SEQ ID NO: 128861 - DNA, 25 bp, Mus musculus
actgacctcaggcagtacaggcgct

SEQ ID NO: 128862 - DNA, 25 bp, Mus musculus
actgacctcagggagtacaggcgct

SEQ ID NO: 128863 - DNA, 25 bp, Mus musculus
actgacctcagtacttggtttacca

SEQ ID NO: 128864 - DNA, 25 bp, Mus musculus
actgacctcagttcttggtttacca

SEQ ID NO: 128865 - DNA, 25 bp, Mus musculus
actgacctccccacggaagaagatt

SEQ ID NO: 128866 - DNA, 25 bp, Mus musculus
actgacctcccctcggaagaagatt

SEQ ID NO: 128867 - DNA, 25 bp, Mus musculus
actgacctctgccaggttgtacaaa

SEQ ID NO: 128868 - DNA, 25 bp, Mus musculus
actgacctctgcgaggttgtacaaa

SEQ ID NO: 128869 - DNA, 25 bp, Mus musculus
actgacctggtaactctaaggattt

SEQ ID NO: 128870 - DNA, 25 bp, Mus musculus
actgacctggtatctctaaggattt

SEQ ID NO: 128871 - DNA, 25 bp, Mus musculus
actgacctgtaaatcgtcctttagg

SEQ ID NO: 128872 - DNA, 25 bp, Mus musculus
actgacctgtaacttcttgacccca

SEQ ID NO: 128873 - DNA, 25 bp, Mus musculus
actgacctgtaagttcttgacccca

SEQ ID NO: 128874 - DNA, 25 bp, Mus musculus
actgacctgtaattcgtcctttagg

SEQ ID NO: 128875 - DNA, 25 bp, Mus musculus
actgacctgtgcctccaagtgatgt

SEQ ID NO: 128876 - DNA, 25 bp, Mus musculus
actgacctgtgcgtccaagtgatgt

SEQ ID NO: 128877 - DNA, 25 bp, Mus musculus
actgacctgttgctgtgactagcta

SEQ ID NO: 128878 - DNA, 25 bp, Mus musculus
actgacctgttggtgtgactagcta

SEQ ID NO: 128879 - DNA, 25 bp, Mus musculus
actgaccttacaacactaatggata

SEQ ID NO: 128880 - DNA, 25 bp, Mus musculus
actgaccttacatcactaatggata

SEQ ID NO: 128881 - DNA, 25 bp, Mus musculus
actgacgcgactacactatgtacaa

SEQ ID NO: 128882 - DNA, 25 bp, Mus musculus
actgacgcgacttcactatgtacaa

SEQ ID NO: 128883 - DNA, 25 bp, Mus musculus
actgacggagtgaagactggtttca

SEQ ID NO: 128884 - DNA, 25 bp, Mus musculus
actgacggagtgtagactggtttca

SEQ ID NO: 128885 - DNA, 25 bp, Mus musculus
actgacgtaccacacttgcagctga

SEQ ID NO: 128886 - DNA, 25 bp, Mus musculus
actgacgtaccagacttgcagctga

SEQ ID NO: 128887 - DNA, 25 bp, Mus musculus
actgacgtcctgcttggcaagctaa

SEQ ID NO: 128888 - DNA, 25 bp, Mus musculus
actgacgtcctggttggcaagctaa

SEQ ID NO: 128889 - DNA, 25 bp, Mus musculus
actgacgtgagtccctgcagtgcaa

SEQ ID NO: 128890 - DNA, 25 bp, Mus musculus
actgacgtgagtgcctgcagtgcaa

SEQ ID NO: 128891 - DNA, 25 bp, Mus musculus
actgacgttagtcagctcctaaaga

SEQ ID NO: 128892 - DNA, 25 bp, Mus musculus
actgacgttagtgagctcctaaaga

SEQ ID NO: 128893 - DNA, 25 bp, Mus musculus
actgactaacagagtttacttaatt

SEQ ID NO: 128894 - DNA, 25 bp, Mus musculus
actgactaacagtgtttacttaatt

SEQ ID NO: 128895 - DNA, 25 bp, Mus musculus
actgactagcagaccctgacctttg

SEQ ID NO: 128896 - DNA, 25 bp, Mus musculus
actgactagcagtccctgacctttg

SEQ ID NO: 128897 - DNA, 25 bp, Mus musculus
actgactaggcgcacacaggtgacc

SEQ ID NO: 128898 - DNA, 25 bp, Mus musculus
actgactaggcggacacaggtgacc

SEQ ID NO: 128899 - DNA, 25 bp, Mus musculus
actgactatccacaggctatacctt

SEQ ID NO: 128900 - DNA, 25 bp, Mus musculus
actgactatccagaggctatacctt

SEQ ID NO: 128901 - DNA, 25 bp, Mus musculus
actgactatgacctgtataaagtga

SEQ ID NO: 128902 - DNA, 25 bp, Mus musculus
actgactatgacgtgtataaagtga

SEQ ID NO: 128903 - DNA, 25 bp, Mus musculus
actgactatgtcaccactgtatgtg

SEQ ID NO: 128904 - DNA, 25 bp, Mus musculus
actgactatgtctccactgtatgtg

SEQ ID NO: 128905 - DNA, 25 bp, Mus musculus
actgactcagagagccagagactgt

SEQ ID NO: 128906 - DNA, 25 bp, Mus musculus
actgactcagagtgccagagactgt

SEQ ID NO: 128907 - DNA, 25 bp, Mus musculus
actgactcaggcattcctagagcct

SEQ ID NO: 128908 - DNA, 25 bp, Mus musculus
actgactcaggctttcctagagcct

SEQ ID NO: 128909 - DNA, 25 bp, Mus musculus
actgactcccagcactgtagtgtga

SEQ ID NO: 128910 - DNA, 25 bp, Mus musculus
actgactcccaggactgtagtgtga

SEQ ID NO: 128911 - DNA, 25 bp, Mus musculus
actgactcccctcagtgtggaactg

SEQ ID NO: 128912 - DNA, 25 bp, Mus musculus
actgactcccctgagtgtggaactg

SEQ ID NO: 128913 - DNA, 25 bp, Mus musculus
actgactcgagtctttgggacacat

SEQ ID NO: 128914 - DNA, 25 bp, Mus musculus
actgactcgagtgtttgggacacat

SEQ ID NO: 128915 - DNA, 25 bp, Mus musculus
actgactcgattccaaagcaacctt

SEQ ID NO: 128916 - DNA, 25 bp, Mus musculus
actgactcgattgcaaagcaacctt

SEQ ID NO: 128917 - DNA, 25 bp, Mus musculus
actgactctcctaccttagataaaa

SEQ ID NO: 128918 - DNA, 25 bp, Mus musculus
actgactctccttccttagataaaa

SEQ ID NO: 128919 - DNA, 25 bp, Mus musculus
actgactctggcagctatgaattct

SEQ ID NO: 128920 - DNA, 25 bp, Mus musculus
actgactctggctgctatgaattct

SEQ ID NO: 128921 - DNA, 25 bp, Mus musculus
actgactctgtacttatgcctcttc

SEQ ID NO: 128922 - DNA, 25 bp, Mus musculus
actgactctgtagttatgcctcttc

SEQ ID NO: 128923 - DNA, 25 bp, Mus musculus
actgactgaaacatcctggaagccc

SEQ ID NO: 128924 - DNA, 25 bp, Mus musculus
actgactgaaacttcctggaagccc

SEQ ID NO: 128925 - DNA, 25 bp, Mus musculus
actgactgacacactccgtatgagg

SEQ ID NO: 128926 - DNA, 25 bp, Mus musculus
actgactgacactctccgtatgagg

SEQ ID NO: 128927 - DNA, 25 bp, Mus musculus
actgactgacctctgctgtgagtct

SEQ ID NO: 128928 - DNA, 25 bp, Mus musculus
actgactgacctgtgctgtgagtct

SEQ ID NO: 128929 - DNA, 25 bp, Mus musculus
actgactgacttacctatgatctgc

SEQ ID NO: 128930 - DNA, 25 bp, Mus musculus
actgactgactttcctatgatctgc

SEQ ID NO: 128931 - DNA, 25 bp, Mus musculus
actgactgagcgcagatgagtgact

SEQ ID NO: 128932 - DNA, 25 bp, Mus musculus
actgactgagcggagatgagtgact

SEQ ID NO: 128933 - DNA, 25 bp, Mus musculus
actgactgagtcacactgcatagga

SEQ ID NO: 128934 - DNA, 25 bp, Mus musculus
actgactgagtctcactgcatagga

SEQ ID NO: 128935 - DNA, 25 bp, Mus musculus
actgactgagttacagtttccccag

SEQ ID NO: 128936 - DNA, 25 bp, Mus musculus
actgactgagtttcagtttccccag

SEQ ID NO: 128937 - DNA, 25 bp, Mus musculus
actgactgcagacttgggccaaggc

SEQ ID NO: 128938 - DNA, 25 bp, Mus musculus
actgactgcagagttgggccaaggc

SEQ ID NO: 128939 - DNA, 25 bp, Mus musculus
actgactgctcaatgtggatagaaa

SEQ ID NO: 128940 - DNA, 25 bp, Mus musculus
actgactgctcattgtggatagaaa

SEQ ID NO: 128941 - DNA, 25 bp, Mus musculus
actgactgctggctcacttgaggtg

SEQ ID NO: 128942 - DNA, 25 bp, Mus musculus
actgactgctgggtcacttgaggtg

SEQ ID NO: 128943 - DNA, 25 bp, Mus musculus
actgactggccactgctgcctttga

SEQ ID NO: 128944 - DNA, 25 bp, Mus musculus
actgactggccagtgctgcctttga

SEQ ID NO: 128945 - DNA, 25 bp, Mus musculus
actgactgtctgactccttctgtag

SEQ ID NO: 128946 - DNA, 25 bp, Mus musculus
actgactgtctgtctccttctgtag

SEQ ID NO: 128947 - DNA, 25 bp, Mus musculus
actgactgtggtctgttgaatgcga

SEQ ID NO: 128948 - DNA, 25 bp, Mus musculus
actgactgtggtgtgttgaatgcga

SEQ ID NO: 128949 - DNA, 25 bp, Mus musculus
actgactgtgtcatgaactttgaaa

SEQ ID NO: 128950 - DNA, 25 bp, Mus musculus
actgactgtgtcttgaactttgaaa

SEQ ID NO: 128951 - DNA, 25 bp, Mus musculus
actgacttaatcattccccaaatct

SEQ ID NO: 128952 - DNA, 25 bp, Mus musculus
actgacttaatctttccccaaatct

SEQ ID NO: 128953 - DNA, 25 bp, Mus musculus
actgacttacagattatccggcccc

SEQ ID NO: 128954 - DNA, 25 bp, Mus musculus
actgacttacagtttatccggcccc

SEQ ID NO: 128955 - DNA, 25 bp, Mus musculus
actgacttacttaccatgacacacg

SEQ ID NO: 128956 - DNA, 25 bp, Mus musculus
actgacttactttccatgacacacg

SEQ ID NO: 128957 - DNA, 25 bp, Mus musculus
actgacttcaacatgtactgggtga

SEQ ID NO: 128958 - DNA, 25 bp, Mus musculus
actgacttcaacttgtactgggtga

SEQ ID NO: 128959 - DNA, 25 bp, Mus musculus
actgacttcagacatcacttgcgga

SEQ ID NO: 128960 - DNA, 25 bp, Mus musculus
actgacttcagagatcacttgcgga

SEQ ID NO: 128961 - DNA, 25 bp, Mus musculus
actgacttcccacacctaaaagcga

SEQ ID NO: 128962 - DNA, 25 bp, Mus musculus
actgacttcccagacctaaaagcga

SEQ ID NO: 128963 - DNA, 25 bp, Mus musculus
actgacttccggcagtggatcttca

SEQ ID NO: 128964 - DNA, 25 bp, Mus musculus
actgacttccgggagtggatcttca

SEQ ID NO: 128965 - DNA, 25 bp, Mus musculus
actgacttccttctgttagacttga

SEQ ID NO: 128966 - DNA, 25 bp, Mus musculus
actgacttccttgtgttagacttga

SEQ ID NO: 128967 - DNA, 25 bp, Mus musculus
actgacttcggcatgtctaaggtgg

SEQ ID NO: 128968 - DNA, 25 bp, Mus musculus
actgacttcggcttgtctaaggtgg

SEQ ID NO: 128969 - DNA, 25 bp, Mus musculus
actgacttctggatgttctgaggcc

SEQ ID NO: 128970 - DNA, 25 bp, Mus musculus
actgacttctggttgttctgaggcc

SEQ ID NO: 128971 - DNA, 25 bp, Mus musculus
actgacttcttgctgtggtactgca

SEQ ID NO: 128972 - DNA, 25 bp, Mus musculus
actgacttcttggtgtggtactgca

SEQ ID NO: 128973 - DNA, 25 bp, Mus musculus
actgacttgaaaaattggtggcttt

SEQ ID NO: 128974 - DNA, 25 bp, Mus musculus
actgacttgaaatattggtggcttt

SEQ ID NO: 128975 - DNA, 25 bp, Mus musculus
actgacttgaagacaacctctttta

SEQ ID NO: 128976 - DNA, 25 bp, Mus musculus
actgacttgaagtcaacctctttta

SEQ ID NO: 128977 - DNA, 25 bp, Mus musculus
actgacttgcatctgagtgctgtat

SEQ ID NO: 128978 - DNA, 25 bp, Mus musculus
actgacttgcatgtgagtgctgtat

SEQ ID NO: 128979 - DNA, 25 bp, Mus musculus
actgacttggtacatcttttccttt

SEQ ID NO: 128980 - DNA, 25 bp, Mus musculus
actgacttggtagatcttttccttt

SEQ ID NO: 128981 - DNA, 25 bp, Mus musculus
actgacttgtatagacattgttctt

SEQ ID NO: 128982 - DNA, 25 bp, Mus musculus
actgacttgtattgacattgttctt

SEQ ID NO: 128983 - DNA, 25 bp, Mus musculus
actgacttgtgaaagctctccaggc

SEQ ID NO: 128984 - DNA, 25 bp, Mus musculus
actgacttgtgatagctctccaggc

SEQ ID NO: 128985 - DNA, 25 bp, Mus musculus
actgactttgacacggtcttctgga

SEQ ID NO: 128986 - DNA, 25 bp, Mus musculus
actgactttgactcggtcttctgga

SEQ ID NO: 128987 - DNA, 25 bp, Mus musculus
actgagaaagccacccttctggaga

SEQ ID NO: 128988 - DNA, 25 bp, Mus musculus
actgagaaagcctcccttctggaga

SEQ ID NO: 128989 - DNA, 25 bp, Mus musculus
actgagaaaggcatcttcccgcagt

SEQ ID NO: 128990 - DNA, 25 bp, Mus musculus
actgagaaaggcttcttcccgcagt

SEQ ID NO: 128991 - DNA, 25 bp, Mus musculus
actgagaacataatcccgggtctgg

SEQ ID NO: 128992 - DNA, 25 bp, Mus musculus
actgagaacatattcccgggtctgg

SEQ ID NO: 128993 - DNA, 25 bp, Mus musculus
actgagaagctaatccgggagaaag

SEQ ID NO: 128994 - DNA, 25 bp, Mus musculus
actgagaagctattccgggagaaag

SEQ ID NO: 128995 - DNA, 25 bp, Mus musculus
actgagaagggcaatataaacctga

SEQ ID NO: 128996 - DNA, 25 bp, Mus musculus
actgagaagggctatataaacctga

SEQ ID NO: 128997 - DNA, 25 bp, Mus musculus
actgagaaggttcatttcctaaatt

SEQ ID NO: 128998 - DNA, 25 bp, Mus musculus
actgagaaggttgatttcctaaatt

SEQ ID NO: 128999 - DNA, 25 bp, Mus musculus
actgagaagtcgctttccctgccca

SEQ ID NO: 129000 - DNA, 25 bp, Mus musculus
actgagaagtcggtttccctgccca

SEQ ID NO: 129001 - DNA, 25 bp, Mus musculus
actgagaagtggagcacaggtgact

SEQ ID NO: 129002 - DNA, 25 bp, Mus musculus
actgagaagtggtgcacaggtgact

SEQ ID NO: 129003 - DNA, 25 bp, Mus musculus
actgagacagaccacaaggaagttc

SEQ ID NO: 129004 - DNA, 25 bp, Mus musculus
actgagacagacgacaaggaagttc

SEQ ID NO: 129005 - DNA, 25 bp, Mus musculus
actgagacagcgcagtggtcgcctt

SEQ ID NO: 129006 - DNA, 25 bp, Mus musculus
actgagacagcggagtggtcgcctt

SEQ ID NO: 129007 - DNA, 25 bp, Mus musculus
actgagacccgtagagacattcctt

SEQ ID NO: 129008 - DNA, 25 bp, Mus musculus
actgagacccgttgagacattcctt

SEQ ID NO: 129009 - DNA, 25 bp, Mus musculus
actgagacctgaagtcatgtgccta

SEQ ID NO: 129010 - DNA, 25 bp, Mus musculus
actgagacctgatgtcatgtgccta

SEQ ID NO: 129011 - DNA, 25 bp, Mus musculus
actgagacgtaaccttgctagccgc

SEQ ID NO: 129012 - DNA, 25 bp, Mus musculus
actgagacgtaagcttgctagccgc

SEQ ID NO: 129013 - DNA, 25 bp, Mus musculus
actgagactaaacacacccacctat

SEQ ID NO: 129014 - DNA, 25 bp, Mus musculus
actgagactaaagacacccacctat

SEQ ID NO: 129015 - DNA, 25 bp, Mus musculus
actgagactctcatgcatttacctc

SEQ ID NO: 129016 - DNA, 25 bp, Mus musculus
actgagactctcttgcatttacctc

SEQ ID NO: 129017 - DNA, 25 bp, Mus musculus
actgagactgcccaggtagctccag

SEQ ID NO: 129018 - DNA, 25 bp, Mus musculus
actgagactgccgaggtagctccag

SEQ ID NO: 129019 - DNA, 25 bp, Mus musculus
actgagactttacctgttcccaaac

SEQ ID NO: 129020 - DNA, 25 bp, Mus musculus
actgagactttagctgttcccaaac

SEQ ID NO: 129021 - DNA, 25 bp, Mus musculus
actgagagatttactgctgcagcag

SEQ ID NO: 129022 - DNA, 25 bp, Mus musculus
actgagagattttctgctgcagcag

SEQ ID NO: 129023 - DNA, 25 bp, Mus musculus
actgagagcctacaggtgccctgag

SEQ ID NO: 129024 - DNA, 25 bp, Mus musculus
actgagagcctagaggtgccctgag

SEQ ID NO: 129025 - DNA, 25 bp, Mus musculus
actgagagcggcatgggacttaacc

SEQ ID NO: 129026 - DNA, 25 bp, Mus musculus
actgagagcggcttgggacttaacc

SEQ ID NO: 129027 - DNA, 25 bp, Mus musculus
actgagagcttccctcgggagggca

SEQ ID NO: 129028 - DNA, 25 bp, Mus musculus
actgagagcttcgctcgggagggca

SEQ ID NO: 129029 - DNA, 25 bp, Mus musculus
actgagaggcatcggtggtgctttt

SEQ ID NO: 129030 - DNA, 25 bp, Mus musculus
actgagaggcatgggtggtgctttt

SEQ ID NO: 129031 - DNA, 25 bp, Mus musculus
actgagagtaccacctctgatgctt

SEQ ID NO: 129032 - DNA, 25 bp, Mus musculus
actgagagtacctcctctgatgctt

SEQ ID NO: 129033 - DNA, 25 bp, Mus musculus
actgagagtcatccgttctgttaat

SEQ ID NO: 129034 - DNA, 25 bp, Mus musculus
actgagagtcatgcgttctgttaat

SEQ ID NO: 129035 - DNA, 25 bp, Mus musculus
actgagagttttaattctggctttg

SEQ ID NO: 129036 - DNA, 25 bp, Mus musculus
actgagagtttttattctggctttg

SEQ ID NO: 129037 - DNA, 25 bp, Mus musculus
actgagatacgcagtggtgctcaac

SEQ ID NO: 129038 - DNA, 25 bp, Mus musculus
actgagatacgctgtggtgctcaac

SEQ ID NO: 129039 - DNA, 25 bp, Mus musculus
actgagatatatacttgcccctctg

SEQ ID NO: 129040 - DNA, 25 bp, Mus musculus
actgagatatattcttgcccctctg

SEQ ID NO: 129041 - DNA, 25 bp, Mus musculus
actgagatcatccagtcacgtggaa

SEQ ID NO: 129042 - DNA, 25 bp, Mus musculus
actgagatcatcgagtcacgtggaa

SEQ ID NO: 129043 - DNA, 25 bp, Mus musculus
actgagatccagctttttcctaata

SEQ ID NO: 129044 - DNA, 25 bp, Mus musculus
actgagatccaggtttttcctaata

SEQ ID NO: 129045 - DNA, 25 bp, Mus musculus
actgagatctacctacttctgcttc

SEQ ID NO: 129046 - DNA, 25 bp, Mus musculus
actgagatctacctgtgctaataaa

SEQ ID NO: 129047 - DNA, 25 bp, Mus musculus
actgagatctacgtacttctgcttc

SEQ ID NO: 129048 - DNA, 25 bp, Mus musculus
actgagatctacgtgtgctaataaa

SEQ ID NO: 129049 - DNA, 25 bp, Mus musculus
actgagatctgacttgagctttgca

SEQ ID NO: 129050 - DNA, 25 bp, Mus musculus
actgagatctgagttgagctttgca

SEQ ID NO: 129051 - DNA, 25 bp, Mus musculus
actgagatgacccttccaataaaag

SEQ ID NO: 129052 - DNA, 25 bp, Mus musculus
actgagatgaccgttccaataaaag

SEQ ID NO: 129053 - DNA, 25 bp, Mus musculus
actgagatgactctaagttggaaat

SEQ ID NO: 129054 - DNA, 25 bp, Mus musculus
actgagatgactgtaagttggaaat

SEQ ID NO: 129055 - DNA, 25 bp, Mus musculus
actgagatgcatcacaaaggcccta

SEQ ID NO: 129056 - DNA, 25 bp, Mus musculus
actgagatgcatgacaaaggcccta

SEQ ID NO: 129057 - DNA, 25 bp, Mus musculus
actgagatgcttccagagcctccga

SEQ ID NO: 129058 - DNA, 25 bp, Mus musculus
actgagatgcttgcagagcctccga

SEQ ID NO: 129059 - DNA, 25 bp, Mus musculus
actgagatgtgactcccatggaaga

SEQ ID NO: 129060 - DNA, 25 bp, Mus musculus
actgagatgtgagtcccatggaaga

SEQ ID NO: 129061 - DNA, 25 bp, Mus musculus
actgagattctacatggtccacctt

SEQ ID NO: 129062 - DNA, 25 bp, Mus musculus
actgagattctagatggtccacctt

SEQ ID NO: 129063 - DNA, 25 bp, Mus musculus
actgagcaacagcttggtgccttgg

SEQ ID NO: 129064 - DNA, 25 bp, Mus musculus
actgagcaacaggttggtgccttgg

SEQ ID NO: 129065 - DNA, 25 bp, Mus musculus
actgagcaagagactttgcaggcaa

SEQ ID NO: 129066 - DNA, 25 bp, Mus musculus
actgagcaagagtctttgcaggcaa

SEQ ID NO: 129067 - DNA, 25 bp, Mus musculus
actgagcacggaatgaggctgtcct

SEQ ID NO: 129068 - DNA, 25 bp, Mus musculus
actgagcacggattgaggctgtcct

SEQ ID NO: 129069 - DNA, 25 bp, Mus musculus
actgagcagatgactcccttgctgc

SEQ ID NO: 129070 - DNA, 25 bp, Mus musculus
actgagcagatgtctcccttgctgc

SEQ ID NO: 129071 - DNA, 25 bp, Mus musculus
actgagcagctgctattcttttgtt

SEQ ID NO: 129072 - DNA, 25 bp, Mus musculus
actgagcagctggtattcttttgtt

SEQ ID NO: 129073 - DNA, 25 bp, Mus musculus
actgagcagttacaagtacctctga

SEQ ID NO: 129074 - DNA, 25 bp, Mus musculus
actgagcagttagaagtacctctga

SEQ ID NO: 129075 - DNA, 25 bp, Mus musculus
actgagcatgagctgtccaatggag

SEQ ID NO: 129076 - DNA, 25 bp, Mus musculus
actgagcatgaggtgtccaatggag

SEQ ID NO: 129077 - DNA, 25 bp, Mus musculus
actgagcatgctacattcaatacag

SEQ ID NO: 129078 - DNA, 25 bp, Mus musculus
actgagcatgcttcattcaatacag

SEQ ID NO: 129079 - DNA, 25 bp, Mus musculus
actgagcattgaaggccctggaaag

SEQ ID NO: 129080 - DNA, 25 bp, Mus musculus
actgagcattgatggccctggaaag

SEQ ID NO: 129081 - DNA, 25 bp, Mus musculus
actgagccaagacgatcccaagttc

SEQ ID NO: 129082 - DNA, 25 bp, Mus musculus
actgagccaagaggatcccaagttc

SEQ ID NO: 129083 - DNA, 25 bp, Mus musculus
actgagccacccatgcgttagggaa

SEQ ID NO: 129084 - DNA, 25 bp, Mus musculus
actgagccacccttgcgttagggaa

SEQ ID NO: 129085 - DNA, 25 bp, Mus musculus
actgagccagctcggagcctgacaa

SEQ ID NO: 129086 - DNA, 25 bp, Mus musculus
actgagccagctgggagcctgacaa

SEQ ID NO: 129087 - DNA, 25 bp, Mus musculus
actgagccaggaactttggctgctt

SEQ ID NO: 129088 - DNA, 25 bp, Mus musculus
actgagccaggacgttggaccttgt

SEQ ID NO: 129089 - DNA, 25 bp, Mus musculus
actgagccaggaggttggaccttgt

SEQ ID NO: 129090 - DNA, 25 bp, Mus musculus
actgagccaggatctttggctgctt

SEQ ID NO: 129091 - DNA, 25 bp, Mus musculus
actgagccaggcagtcgaggtcgca

SEQ ID NO: 129092 - DNA, 25 bp, Mus musculus
actgagccaggctgtcgaggtcgca

SEQ ID NO: 129093 - DNA, 25 bp, Mus musculus
actgagccagggagtttcttgtttt

SEQ ID NO: 129094 - DNA, 25 bp, Mus musculus
actgagccagggtgtttcttgtttt

SEQ ID NO: 129095 - DNA, 25 bp, Mus musculus
actgagccagttcagtctccgtgcc

SEQ ID NO: 129096 - DNA, 25 bp, Mus musculus
actgagccagttgagtctccgtgcc

SEQ ID NO: 129097 - DNA, 25 bp, Mus musculus
actgagccatcacggcagccctaat

SEQ ID NO: 129098 - DNA, 25 bp, Mus musculus
actgagccatcagggcagccctaat

SEQ ID NO: 129099 - DNA, 25 bp, Mus musculus
actgagccatcccatatactttcat

SEQ ID NO: 129100 - DNA, 25 bp, Mus musculus
actgagccatccgatatactttcat

SEQ ID NO: 129101 - DNA, 25 bp, Mus musculus
actgagcccaggctctgacctgcta

SEQ ID NO: 129102 - DNA, 25 bp, Mus musculus
actgagcccagggtctgacctgcta

SEQ ID NO: 129103 - DNA, 25 bp, Mus musculus
actgagcccatccaaagactgcgga

SEQ ID NO: 129104 - DNA, 25 bp, Mus musculus
actgagcccatcgaaagactgcgga

SEQ ID NO: 129105 - DNA, 25 bp, Mus musculus
actgagcccggtctgtggcacaata

SEQ ID NO: 129106 - DNA, 25 bp, Mus musculus
actgagcccggtgtgtggcacaata

SEQ ID NO: 129107 - DNA, 25 bp, Mus musculus
actgagcctacactagccagtgtgg

SEQ ID NO: 129108 - DNA, 25 bp, Mus musculus
actgagcctacagtagccagtgtgg

SEQ ID NO: 129109 - DNA, 25 bp, Mus musculus
actgagcctgctctcggtgaaagac

SEQ ID NO: 129110 - DNA, 25 bp, Mus musculus
actgagcctgctctgtagtaggtca

SEQ ID NO: 129111 - DNA, 25 bp, Mus musculus
actgagcctgctgtcggtgaaagac

SEQ ID NO: 129112 - DNA, 25 bp, Mus musculus
actgagcctgctgtgtagtaggtca

SEQ ID NO: 129113 - DNA, 25 bp, Mus musculus
actgagcgctcacctaacttggtgt

SEQ ID NO: 129114 - DNA, 25 bp, Mus musculus
actgagcgctcagctaacttggtgt

SEQ ID NO: 129115 - DNA, 25 bp, Mus musculus
actgagctagcacgcagtgggtctt

SEQ ID NO: 129116 - DNA, 25 bp, Mus musculus
actgagctagcaggcagtgggtctt

SEQ ID NO: 129117 - DNA, 25 bp, Mus musculus
actgagctatagcatcacctgcatc

SEQ ID NO: 129118 - DNA, 25 bp, Mus musculus
actgagctataggatcacctgcatc

SEQ ID NO: 129119 - DNA, 25 bp, Mus musculus
actgagctatgcctactagagatga

SEQ ID NO: 129120 - DNA, 25 bp, Mus musculus
actgagctatgcgtactagagatga

SEQ ID NO: 129121 - DNA, 25 bp, Mus musculus
actgagctatgtcctcagtcaccta

SEQ ID NO: 129122 - DNA, 25 bp, Mus musculus
actgagctatgtgctcagtcaccta

SEQ ID NO: 129123 - DNA, 25 bp, Mus musculus
actgagctcagaagccaaacttcat

SEQ ID NO: 129124 - DNA, 25 bp, Mus musculus
actgagctcagatgccaaacttcat

SEQ ID NO: 129125 - DNA, 25 bp, Mus musculus
actgagctgcatccactgctagtga

SEQ ID NO: 129126 - DNA, 25 bp, Mus musculus
actgagctgcatgcactgctagtga

SEQ ID NO: 129127 - DNA, 25 bp, Mus musculus
actgagctgtccaggtctatggaga

SEQ ID NO: 129128 - DNA, 25 bp, Mus musculus
actgagctgtcctggtctatggaga

SEQ ID NO: 129129 - DNA, 25 bp, Mus musculus
actgagcttctgctttgagacccat

SEQ ID NO: 129130 - DNA, 25 bp, Mus musculus
actgagcttctggtttgagacccat

SEQ ID NO: 129131 - DNA, 25 bp, Mus musculus
actgagcttgctcttctgagtttga

SEQ ID NO: 129132 - DNA, 25 bp, Mus musculus
actgagcttgctgttctgagtttga

SEQ ID NO: 129133 - DNA, 25 bp, Mus musculus
actgagctttcacgaggagccattt

SEQ ID NO: 129134 - DNA, 25 bp, Mus musculus
actgagctttcaggaggagccattt

SEQ ID NO: 129135 - DNA, 25 bp, Mus musculus
actgagcttttacgcataagccacc

SEQ ID NO: 129136 - DNA, 25 bp, Mus musculus
actgagcttttaggcataagccacc

SEQ ID NO: 129137 - DNA, 25 bp, Mus musculus
actgaggaatctcaaatgactttga

SEQ ID NO: 129138 - DNA, 25 bp, Mus musculus
actgaggaatctgaaatgactttga

SEQ ID NO: 129139 - DNA, 25 bp, Mus musculus
actgaggaccagcttgtctcctgcg

SEQ ID NO: 129140 - DNA, 25 bp, Mus musculus
actgaggaccaggttgtctcctgcg

SEQ ID NO: 129141 - DNA, 25 bp, Mus musculus
actgaggaccttcgtgagttcccgg

SEQ ID NO: 129142 - DNA, 25 bp, Mus musculus
actgaggaccttggtgagttcccgg

SEQ ID NO: 129143 - DNA, 25 bp, Mus musculus
actgaggacttacggccacatcagg

SEQ ID NO: 129144 - DNA, 25 bp, Mus musculus
actgaggacttagggccacatcagg

SEQ ID NO: 129145 - DNA, 25 bp, Mus musculus
actgaggagaggctaagctgtctca

SEQ ID NO: 129146 - DNA, 25 bp, Mus musculus
actgaggagagggtaagctgtctca

SEQ ID NO: 129147 - DNA, 25 bp, Mus musculus
actgaggaggccagcatgtttgctg

SEQ ID NO: 129148 - DNA, 25 bp, Mus musculus
actgaggaggcctgcatgtttgctg

SEQ ID NO: 129149 - DNA, 25 bp, Mus musculus
actgaggagggcagctgttcaccaa

SEQ ID NO: 129150 - DNA, 25 bp, Mus musculus
actgaggagggctgctgttcaccaa

SEQ ID NO: 129151 - DNA, 25 bp, Mus musculus
actgaggagtttcggatagcatgtt

SEQ ID NO: 129152 - DNA, 25 bp, Mus musculus
actgaggagtttgggatagcatgtt

SEQ ID NO: 129153 - DNA, 25 bp, Mus musculus
actgaggatcatccaactgatggag

SEQ ID NO: 129154 - DNA, 25 bp, Mus musculus
actgaggatcatgcaactgatggag

SEQ ID NO: 129155 - DNA, 25 bp, Mus musculus
actgaggatctacagtctctgggtt

SEQ ID NO: 129156 - DNA, 25 bp, Mus musculus
actgaggatctagagtctctgggtt

SEQ ID NO: 129157 - DNA, 25 bp, Mus musculus
actgaggatctcattttaactatgg

SEQ ID NO: 129158 - DNA, 25 bp, Mus musculus
actgaggatctctttttaactatgg

SEQ ID NO: 129159 - DNA, 25 bp, Mus musculus
actgaggatctgaaatatgggtgtc

SEQ ID NO: 129160 - DNA, 25 bp, Mus musculus
actgaggatctgtaatatgggtgtc

SEQ ID NO: 129161 - DNA, 25 bp, Mus musculus
actgaggcacctccagatgttaact

SEQ ID NO: 129162 - DNA, 25 bp, Mus musculus
actgaggcacctgcagatgttaact

SEQ ID NO: 129163 - DNA, 25 bp, Mus musculus
actgaggcagcaccgcttggtacgt

SEQ ID NO: 129164 - DNA, 25 bp, Mus musculus
actgaggcagcagcgcttggtacgt

SEQ ID NO: 129165 - DNA, 25 bp, Mus musculus
actgaggcaggtctctccatcaaac

SEQ ID NO: 129166 - DNA, 25 bp, Mus musculus
actgaggcaggtgtctccatcaaac

SEQ ID NO: 129167 - DNA, 25 bp, Mus musculus
actgaggcagtcattctctagcagc

SEQ ID NO: 129168 - DNA, 25 bp, Mus musculus
actgaggcagtctttctctagcagc

SEQ ID NO: 129169 - DNA, 25 bp, Mus musculus
actgaggccaggcttttgttcattg

SEQ ID NO: 129170 - DNA, 25 bp, Mus musculus
actgaggccagggttttgttcattg

SEQ ID NO: 129171 - DNA, 25 bp, Mus musculus
actgaggcccagagcgactagctag

SEQ ID NO: 129172 - DNA, 25 bp, Mus musculus
actgaggcccagtgcgactagctag

SEQ ID NO: 129173 - DNA, 25 bp, Mus musculus
actgaggccttgagttctgccagcc

SEQ ID NO: 129174 - DNA, 25 bp, Mus musculus
actgaggccttgtgttctgccagcc

SEQ ID NO: 129175 - DNA, 25 bp, Mus musculus
actgaggcgcctagctgaggagatc

SEQ ID NO: 129176 - DNA, 25 bp, Mus musculus
actgaggcgccttgctgaggagatc

SEQ ID NO: 129177 - DNA, 25 bp, Mus musculus
actgaggctgacagactgctggcat

SEQ ID NO: 129178 - DNA, 25 bp, Mus musculus
actgaggctgactgactgctggcat

SEQ ID NO: 129179 - DNA, 25 bp, Mus musculus
actgaggctgatctacccaggacaa

SEQ ID NO: 129180 - DNA, 25 bp, Mus musculus
actgaggctgatgtacccaggacaa

SEQ ID NO: 129181 - DNA, 25 bp, Mus musculus
actgaggctggaacagcgggaccta

SEQ ID NO: 129182 - DNA, 25 bp, Mus musculus
actgaggctggatcagcgggaccta

SEQ ID NO: 129183 - DNA, 25 bp, Mus musculus
actgaggcttttagccacaccttta

SEQ ID NO: 129184 - DNA, 25 bp, Mus musculus
actgaggctttttgccacaccttta

SEQ ID NO: 129185 - DNA, 25 bp, Mus musculus
actgagggaccgaggctaggctcca

SEQ ID NO: 129186 - DNA, 25 bp, Mus musculus
actgagggaccgtggctaggctcca

SEQ ID NO: 129187 - DNA, 25 bp, Mus musculus
actgagggagttctcacccagctca

SEQ ID NO: 129188 - DNA, 25 bp, Mus musculus
actgagggagttgtcacccagctca

SEQ ID NO: 129189 - DNA, 25 bp, Mus musculus
actgagggatacaaaagctcttctt

SEQ ID NO: 129190 - DNA, 25 bp, Mus musculus
actgagggatacaggaccatcggtc

SEQ ID NO: 129191 - DNA, 25 bp, Mus musculus
actgagggatactaaagctcttctt

SEQ ID NO: 129192 - DNA, 25 bp, Mus musculus
actgagggatactggaccatcggtc

SEQ ID NO: 129193 - DNA, 25 bp, Mus musculus
actgagggcgtgacttggtgctact

SEQ ID NO: 129194 - DNA, 25 bp, Mus musculus
actgagggcgtgtcttggtgctact

SEQ ID NO: 129195 - DNA, 25 bp, Mus musculus
actgaggtcacaccccggatggaga

SEQ ID NO: 129196 - DNA, 25 bp, Mus musculus
actgaggtcacagcccggatggaga

SEQ ID NO: 129197 - DNA, 25 bp, Mus musculus
actgaggtccttcaccagtccaagc

SEQ ID NO: 129198 - DNA, 25 bp, Mus musculus
actgaggtccttgaccagtccaagc

SEQ ID NO: 129199 - DNA, 25 bp, Mus musculus
actgaggtctgcactcatgatgcaa

SEQ ID NO: 129200 - DNA, 25 bp, Mus musculus
actgaggtctgctctcatgatgcaa

SEQ ID NO: 129201 - DNA, 25 bp, Mus musculus
actgaggtgacaattagaggtcttt

SEQ ID NO: 129202 - DNA, 25 bp, Mus musculus
actgaggtgacactcccctgaggga

SEQ ID NO: 129203 - DNA, 25 bp, Mus musculus
actgaggtgacagtcccctgaggga

SEQ ID NO: 129204 - DNA, 25 bp, Mus musculus
actgaggtgacatttagaggtcttt

SEQ ID NO: 129205 - DNA, 25 bp, Mus musculus
actgaggttcccaagagcggcaagg

SEQ ID NO: 129206 - DNA, 25 bp, Mus musculus
actgaggttccctagagcggcaagg

SEQ ID NO: 129207 - DNA, 25 bp, Mus musculus
actgaggttggtatagcttatggct

SEQ ID NO: 129208 - DNA, 25 bp, Mus musculus
actgaggttggtttagcttatggct

SEQ ID NO: 129209 - DNA, 25 bp, Mus musculus
actgaggtttaaagctagcctgggc

SEQ ID NO: 129210 - DNA, 25 bp, Mus musculus
actgaggtttaatgctagcctgggc

SEQ ID NO: 129211 - DNA, 25 bp, Mus musculus
actgaggtttctaggtaatgctttg

SEQ ID NO: 129212 - DNA, 25 bp, Mus musculus
actgaggtttcttggtaatgctttg

SEQ ID NO: 129213 - DNA, 25 bp, Mus musculus
actgaggtttgcactgggatgctct

SEQ ID NO: 129214 - DNA, 25 bp, Mus musculus
actgaggtttgctctgggatgctct

SEQ ID NO: 129215 - DNA, 25 bp, Mus musculus
actgagtacccaccatcaacttttt

SEQ ID NO: 129216 - DNA, 25 bp, Mus musculus
actgagtacccagcatcaacttttt

SEQ ID NO: 129217 - DNA, 25 bp, Mus musculus
actgagtagcacagcttccttggaa

SEQ ID NO: 129218 - DNA, 25 bp, Mus musculus
actgagtagcactgcttccttggaa

SEQ ID NO: 129219 - DNA, 25 bp, Mus musculus
actgagtcagttcgcctctactgca

SEQ ID NO: 129220 - DNA, 25 bp, Mus musculus
actgagtcagttggcctctactgca

SEQ ID NO: 129221 - DNA, 25 bp, Mus musculus
actgagtcatttacttgccctttat

SEQ ID NO: 129222 - DNA, 25 bp, Mus musculus
actgagtcattttcttgccctttat

SEQ ID NO: 129223 - DNA, 25 bp, Mus musculus
actgagtccaagagttcccaattca

SEQ ID NO: 129224 - DNA, 25 bp, Mus musculus
actgagtccaagtgttcccaattca

SEQ ID NO: 129225 - DNA, 25 bp, Mus musculus
actgagtccagaaggctaattctaa

SEQ ID NO: 129226 - DNA, 25 bp, Mus musculus
actgagtccagatggctaattctaa

SEQ ID NO: 129227 - DNA, 25 bp, Mus musculus
actgagtcctgacgtttccgagtcc

SEQ ID NO: 129228 - DNA, 25 bp, Mus musculus
actgagtcctgaggtttccgagtcc

SEQ ID NO: 129229 - DNA, 25 bp, Mus musculus
actgagtcctgccaaggtcaaccaa

SEQ ID NO: 129230 - DNA, 25 bp, Mus musculus
actgagtcctgcgaaggtcaaccaa

SEQ ID NO: 129231 - DNA, 25 bp, Mus musculus
actgagtccttactgtctgtttagt

SEQ ID NO: 129232 - DNA, 25 bp, Mus musculus
actgagtccttagtgtctgtttagt

SEQ ID NO: 129233 - DNA, 25 bp, Mus musculus
actgagtctcacaaatttccttttt

SEQ ID NO: 129234 - DNA, 25 bp, Mus musculus
actgagtctcactaatttccttttt

SEQ ID NO: 129235 - DNA, 25 bp, Mus musculus
actgagtctgaacgcttgccaggta

SEQ ID NO: 129236 - DNA, 25 bp, Mus musculus
actgagtctgaaggcttgccaggta

SEQ ID NO: 129237 - DNA, 25 bp, Mus musculus
actgagtcttttagtgtcataccaa

SEQ ID NO: 129238 - DNA, 25 bp, Mus musculus
actgagtctttttgtgtcataccaa

SEQ ID NO: 129239 - DNA, 25 bp, Mus musculus
actgagtgacagaagctgtgccgac

SEQ ID NO: 129240 - DNA, 25 bp, Mus musculus
actgagtgacagtagctgtgccgac

SEQ ID NO: 129241 - DNA, 25 bp, Mus musculus
actgagtgactcaagcaagcaaggc

SEQ ID NO: 129242 - DNA, 25 bp, Mus musculus
actgagtgactctagcaagcaaggc

SEQ ID NO: 129243 - DNA, 25 bp, Mus musculus
actgagtgatttctccctctaatcg

SEQ ID NO: 129244 - DNA, 25 bp, Mus musculus
actgagtgatttgtccctctaatcg

SEQ ID NO: 129245 - DNA, 25 bp, Mus musculus
actgagtgcgcccagtcttcaaaca

SEQ ID NO: 129246 - DNA, 25 bp, Mus musculus
actgagtgcgccgagtcttcaaaca

SEQ ID NO: 129247 - DNA, 25 bp, Mus musculus
actgagtggaccctgaattccttgt

SEQ ID NO: 129248 - DNA, 25 bp, Mus musculus
actgagtggaccgtgaattccttgt

SEQ ID NO: 129249 - DNA, 25 bp, Mus musculus
actgagtggactaaggctctcgctg

SEQ ID NO: 129250 - DNA, 25 bp, Mus musculus
actgagtggacttaggctctcgctg

SEQ ID NO: 129251 - DNA, 25 bp, Mus musculus
actgagtggcagcttgacagaatcc

SEQ ID NO: 129252 - DNA, 25 bp, Mus musculus
actgagtggcaggttgacagaatcc

SEQ ID NO: 129253 - DNA, 25 bp, Mus musculus
actgagtggctgcagtgcgtttact

SEQ ID NO: 129254 - DNA, 25 bp, Mus musculus
actgagtggctggagtgcgtttact

SEQ ID NO: 129255 - DNA, 25 bp, Mus musculus
actgagtggtggctcgttcccgctt

SEQ ID NO: 129256 - DNA, 25 bp, Mus musculus
actgagtggtgggtcgttcccgctt

SEQ ID NO: 129257 - DNA, 25 bp, Mus musculus
actgagtggtttccattctgctact

SEQ ID NO: 129258 - DNA, 25 bp, Mus musculus
actgagtggtttgcattctgctact

SEQ ID NO: 129259 - DNA, 25 bp, Mus musculus
actgagtgtatgatttcgttctgtg

SEQ ID NO: 129260 - DNA, 25 bp, Mus musculus
actgagtgtatgttttcgttctgtg

SEQ ID NO: 129261 - DNA, 25 bp, Mus musculus
actgagtgtcacattgctgcagctc

SEQ ID NO: 129262 - DNA, 25 bp, Mus musculus
actgagtgtcactttgctgcagctc

SEQ ID NO: 129263 - DNA, 25 bp, Mus musculus
actgagttacataccttgctccttg

SEQ ID NO: 129264 - DNA, 25 bp, Mus musculus
actgagttacattccttgctccttg

SEQ ID NO: 129265 - DNA, 25 bp, Mus musculus
actgagttactcatatgtatatgat

SEQ ID NO: 129266 - DNA, 25 bp, Mus musculus
actgagttactcttatgtatatgat

SEQ ID NO: 129267 - DNA, 25 bp, Mus musculus
actgagttatttaatacgttgggca

SEQ ID NO: 129268 - DNA, 25 bp, Mus musculus
actgagttattttatacgttgggca

SEQ ID NO: 129269 - DNA, 25 bp, Mus musculus
actgagttccagatgagattgttat

SEQ ID NO: 129270 - DNA, 25 bp, Mus musculus
actgagttccagttgagattgttat

SEQ ID NO: 129271 - DNA, 25 bp, Mus musculus
actgagttctgtacacacttgtttg

SEQ ID NO: 129272 - DNA, 25 bp, Mus musculus
actgagttctgttcacacttgtttg

SEQ ID NO: 129273 - DNA, 25 bp, Mus musculus
actgagttgactccaatgccgcctg

SEQ ID NO: 129274 - DNA, 25 bp, Mus musculus
actgagttgactgcaatgccgcctg

SEQ ID NO: 129275 - DNA, 25 bp, Mus musculus
actgagttgctgattaaatcttggt

SEQ ID NO: 129276 - DNA, 25 bp, Mus musculus
actgagttgctgtttaaatcttggt

SEQ ID NO: 129277 - DNA, 25 bp, Mus musculus
actgagtttcaaaggatcttccatt

SEQ ID NO: 129278 - DNA, 25 bp, Mus musculus
actgagtttcaatggatcttccatt

SEQ ID NO: 129279 - DNA, 25 bp, Mus musculus
actgagtttcctattggcattacta

SEQ ID NO: 129280 - DNA, 25 bp, Mus musculus
actgagtttccttttggcattacta

SEQ ID NO: 129281 - DNA, 25 bp, Mus musculus
actgagtttctcatgacctgtgtgt

SEQ ID NO: 129282 - DNA, 25 bp, Mus musculus
actgagtttctcttgacctgtgtgt

SEQ ID NO: 129283 - DNA, 25 bp, Mus musculus
actgataaagacatgggccctccat

SEQ ID NO: 129284 - DNA, 25 bp, Mus musculus
actgataaagacttgggccctccat

SEQ ID NO: 129285 - DNA, 25 bp, Mus musculus
actgataagggccaacagactgtgg

SEQ ID NO: 129286 - DNA, 25 bp, Mus musculus
actgataagggcgaacagactgtgg

SEQ ID NO: 129287 - DNA, 25 bp, Mus musculus
actgataatatgctgggtcctccca

SEQ ID NO: 129288 - DNA, 25 bp, Mus musculus
actgataatatggtgggtcctccca

SEQ ID NO: 129289 - DNA, 25 bp, Mus musculus
actgatacactgctagacatgctgt

SEQ ID NO: 129290 - DNA, 25 bp, Mus musculus
actgatacactggtagacatgctgt

SEQ ID NO: 129291 - DNA, 25 bp, Mus musculus
actgatacctggcatgagacataaa

SEQ ID NO: 129292 - DNA, 25 bp, Mus musculus
actgatacctgggatgagacataaa

SEQ ID NO: 129293 - DNA, 25 bp, Mus musculus
actgatactagcagttaagggtgaa

SEQ ID NO: 129294 - DNA, 25 bp, Mus musculus
actgatactagctgttaagggtgaa

SEQ ID NO: 129295 - DNA, 25 bp, Mus musculus
actgatactcagctcctaaggactt

SEQ ID NO: 129296 - DNA, 25 bp, Mus musculus
actgatactcaggtcctaaggactt

SEQ ID NO: 129297 - DNA, 25 bp, Mus musculus
actgatagcgttcctgcagggtttt

SEQ ID NO: 129298 - DNA, 25 bp, Mus musculus
actgatagcgttgctgcagggtttt

SEQ ID NO: 129299 - DNA, 25 bp, Mus musculus
actgatagtctgatggtgtgaattc

SEQ ID NO: 129300 - DNA, 25 bp, Mus musculus
actgatagtctgttggtgtgaattc

SEQ ID NO: 129301 - DNA, 25 bp, Mus musculus
actgatatctttattaaatgcctac

SEQ ID NO: 129302 - DNA, 25 bp, Mus musculus
actgatatcttttttaaatgcctac

SEQ ID NO: 129303 - DNA, 25 bp, Mus musculus
actgatatggctatgatgttacaca

SEQ ID NO: 129304 - DNA, 25 bp, Mus musculus
actgatatggctttgatgttacaca

SEQ ID NO: 129305 - DNA, 25 bp, Mus musculus
actgatatgggcattcctgaaggaa

SEQ ID NO: 129306 - DNA, 25 bp, Mus musculus
actgatatgggctttcctgaaggaa

SEQ ID NO: 129307 - DNA, 25 bp, Mus musculus
actgatcaacccagtgccacgtggt

SEQ ID NO: 129308 - DNA, 25 bp, Mus musculus
actgatcaaccctgtgccacgtggt

SEQ ID NO: 129309 - DNA, 25 bp, Mus musculus
actgatcacaccacagggctatgag

SEQ ID NO: 129310 - DNA, 25 bp, Mus musculus
actgatcacacctcagggctatgag

SEQ ID NO: 129311 - DNA, 25 bp, Mus musculus
actgatcacattatgaaatgcctaa

SEQ ID NO: 129312 - DNA, 25 bp, Mus musculus
actgatcacattttgaaatgcctaa

SEQ ID NO: 129313 - DNA, 25 bp, Mus musculus
actgatcatattctctggctaaagg

SEQ ID NO: 129314 - DNA, 25 bp, Mus musculus
actgatcatattgtctggctaaagg

SEQ ID NO: 129315 - DNA, 25 bp, Mus musculus
actgatcccaaaccaccattaaacg

SEQ ID NO: 129316 - DNA, 25 bp, Mus musculus
actgatcccaaagcaccattaaacg

SEQ ID NO: 129317 - DNA, 25 bp, Mus musculus
actgatcccagaagccgtgatagct

SEQ ID NO: 129318 - DNA, 25 bp, Mus musculus
actgatcccagatgccgtgatagct

SEQ ID NO: 129319 - DNA, 25 bp, Mus musculus
actgatcccagcacctgctgttttc

SEQ ID NO: 129320 - DNA, 25 bp, Mus musculus
actgatcccagctcctgctgttttc

SEQ ID NO: 129321 - DNA, 25 bp, Mus musculus
actgatcccatgagttacagatcca

SEQ ID NO: 129322 - DNA, 25 bp, Mus musculus
actgatcccatgtgttacagatcca

SEQ ID NO: 129323 - DNA, 25 bp, Mus musculus
actgatccccacattaggctactat

SEQ ID NO: 129324 - DNA, 25 bp, Mus musculus
actgatccccactttaggctactat

SEQ ID NO: 129325 - DNA, 25 bp, Mus musculus
actgatccccagaacccttgaaggt

SEQ ID NO: 129326 - DNA, 25 bp, Mus musculus
actgatccccagtacccttgaaggt

SEQ ID NO: 129327 - DNA, 25 bp, Mus musculus
actgatccgggaccacatgatattt

SEQ ID NO: 129328 - DNA, 25 bp, Mus musculus
actgatccgggagcacatgatattt

SEQ ID NO: 129329 - DNA, 25 bp, Mus musculus
actgatcctgaactctgcagaccaa

SEQ ID NO: 129330 - DNA, 25 bp, Mus musculus
actgatcctgaagtctgcagaccaa

SEQ ID NO: 129331 - DNA, 25 bp, Mus musculus
actgatcgcagtactgtaaataaca

SEQ ID NO: 129332 - DNA, 25 bp, Mus musculus
actgatcgcagttctgtaaataaca

SEQ ID NO: 129333 - DNA, 25 bp, Mus musculus
actgatcgtattaatcgtctctaca

SEQ ID NO: 129334 - DNA, 25 bp, Mus musculus
actgatcgtatttatcgtctctaca

SEQ ID NO: 129335 - DNA, 25 bp, Mus musculus
actgatctcacaccagagcggtcag

SEQ ID NO: 129336 - DNA, 25 bp, Mus musculus
actgatctcacagcagagcggtcag

SEQ ID NO: 129337 - DNA, 25 bp, Mus musculus
actgatctcagtactttttaaattg

SEQ ID NO: 129338 - DNA, 25 bp, Mus musculus
actgatctcagttctttttaaattg

SEQ ID NO: 129339 - DNA, 25 bp, Mus musculus
actgatctctgaccacatgaacaca

SEQ ID NO: 129340 - DNA, 25 bp, Mus musculus
actgatctctgagcacatgaacaca

SEQ ID NO: 129341 - DNA, 25 bp, Mus musculus
actgatctgagtccacccttagaaa

SEQ ID NO: 129342 - DNA, 25 bp, Mus musculus
actgatctgagtgcacccttagaaa

SEQ ID NO: 129343 - DNA, 25 bp, Mus musculus
actgatctggatagcatctgtaacc

SEQ ID NO: 129344 - DNA, 25 bp, Mus musculus
actgatctggattgcatctgtaacc

SEQ ID NO: 129345 - DNA, 25 bp, Mus musculus
actgatctggcaccttgctgtggtc

SEQ ID NO: 129346 - DNA, 25 bp, Mus musculus
actgatctggcagcttgctgtggtc

SEQ ID NO: 129347 - DNA, 25 bp, Mus musculus
actgatctgggactggcagtcctct

SEQ ID NO: 129348 - DNA, 25 bp, Mus musculus
actgatctgggagtggcagtcctct

SEQ ID NO: 129349 - DNA, 25 bp, Mus musculus
actgatctgtgcacagccaggaacc

SEQ ID NO: 129350 - DNA, 25 bp, Mus musculus
actgatctgtgctcagccaggaacc

SEQ ID NO: 129351 - DNA, 25 bp, Mus musculus
actgatctgtgtctacctttaggac

SEQ ID NO: 129352 - DNA, 25 bp, Mus musculus
actgatctgtgtgtacctttaggac

SEQ ID NO: 129353 - DNA, 25 bp, Mus musculus
actgatcttcagcagatattagaaa

SEQ ID NO: 129354 - DNA, 25 bp, Mus musculus
actgatcttcaggagatattagaaa

SEQ ID NO: 129355 - DNA, 25 bp, Mus musculus
actgatcttgataacctgtccaatg

SEQ ID NO: 129356 - DNA, 25 bp, Mus musculus
actgatcttgattacctgtccaatg

SEQ ID NO: 129357 - DNA, 25 bp, Mus musculus
actgatcttgttaatactagcttta

SEQ ID NO: 129358 - DNA, 25 bp, Mus musculus
actgatcttgtttatactagcttta

SEQ ID NO: 129359 - DNA, 25 bp, Mus musculus
actgatctttacaggttcactctgt

SEQ ID NO: 129360 - DNA, 25 bp, Mus musculus
actgatctttactggttcactctgt

SEQ ID NO: 129361 - DNA, 25 bp, Mus musculus
actgatctttatcaaatgctcccaa

SEQ ID NO: 129362 - DNA, 25 bp, Mus musculus
actgatctttatgaaatgctcccaa

SEQ ID NO: 129363 - DNA, 25 bp, Mus musculus
actgatgaacaaccccatggtcgac

SEQ ID NO: 129364 - DNA, 25 bp, Mus musculus
actgatgaacaagcccatggtcgac

SEQ ID NO: 129365 - DNA, 25 bp, Mus musculus
actgatgaacacctgaaccctatca

SEQ ID NO: 129366 - DNA, 25 bp, Mus musculus
actgatgaacacgtgaaccctatca

SEQ ID NO: 129367 - DNA, 25 bp, Mus musculus
actgatgaacccaccaggctagagt

SEQ ID NO: 129368 - DNA, 25 bp, Mus musculus
actgatgaaccctccaggctagagt

SEQ ID NO: 129369 - DNA, 25 bp, Mus musculus
actgatgaaggcactggcttccttg

SEQ ID NO: 129370 - DNA, 25 bp, Mus musculus
actgatgaaggctctggcttccttg

SEQ ID NO: 129371 - DNA, 25 bp, Mus musculus
actgatgacatcacctttgctatac

SEQ ID NO: 129372 - DNA, 25 bp, Mus musculus
actgatgacatctcctttgctatac

SEQ ID NO: 129373 - DNA, 25 bp, Mus musculus
actgatgactctcaaagaccccagg

SEQ ID NO: 129374 - DNA, 25 bp, Mus musculus
actgatgactctgaaagaccccagg

SEQ ID NO: 129375 - DNA, 25 bp, Mus musculus
actgatgagctgatgtttcctttaa

SEQ ID NO: 129376 - DNA, 25 bp, Mus musculus
actgatgagctgttgtttcctttaa

SEQ ID NO: 129377 - DNA, 25 bp, Mus musculus
actgatgatagcaaacgtcgatttc

SEQ ID NO: 129378 - DNA, 25 bp, Mus musculus
actgatgatagctaacgtcgatttc

SEQ ID NO: 129379 - DNA, 25 bp, Mus musculus
actgatgatgaaatccttcacgcat

SEQ ID NO: 129380 - DNA, 25 bp, Mus musculus
actgatgatgaattccttcacgcat

SEQ ID NO: 129381 - DNA, 25 bp, Mus musculus
actgatgattcaattgtctgtccaa

SEQ ID NO: 129382 - DNA, 25 bp, Mus musculus
actgatgattcatttgtctgtccaa

SEQ ID NO: 129383 - DNA, 25 bp, Mus musculus
actgatgcagctaaagtatgcccaa

SEQ ID NO: 129384 - DNA, 25 bp, Mus musculus
actgatgcagcttaagtatgcccaa

SEQ ID NO: 129385 - DNA, 25 bp, Mus musculus
actgatgcatccctcattgtgggta

SEQ ID NO: 129386 - DNA, 25 bp, Mus musculus
actgatgcatccgtcattgtgggta

SEQ ID NO: 129387 - DNA, 25 bp, Mus musculus
actgatgccagtcctctcaacaggc

SEQ ID NO: 129388 - DNA, 25 bp, Mus musculus
actgatgccagtgctctcaacaggc

SEQ ID NO: 129389 - DNA, 25 bp, Mus musculus
actgatgccatcaagcaactaacaa

SEQ ID NO: 129390 - DNA, 25 bp, Mus musculus
actgatgccatctagcaactaacaa

SEQ ID NO: 129391 - DNA, 25 bp, Mus musculus
actgatgcgttcctgatgctgtatt

SEQ ID NO: 129392 - DNA, 25 bp, Mus musculus
actgatgcgttcgtgatgctgtatt

SEQ ID NO: 129393 - DNA, 25 bp, Mus musculus
actgatgctaaaagcttacgacggt

SEQ ID NO: 129394 - DNA, 25 bp, Mus musculus
actgatgctaaatgcttacgacggt

SEQ ID NO: 129395 - DNA, 25 bp, Mus musculus
actgatgctcatatgtgaccttatg

SEQ ID NO: 129396 - DNA, 25 bp, Mus musculus
actgatgctcatttgtgaccttatg

SEQ ID NO: 129397 - DNA, 25 bp, Mus musculus
actgatgctgctattcttgaagatc

SEQ ID NO: 129398 - DNA, 25 bp, Mus musculus
actgatgctgcttttcttgaagatc

SEQ ID NO: 129399 - DNA, 25 bp, Mus musculus
actgatgctttgcacccagtgactt

SEQ ID NO: 129400 - DNA, 25 bp, Mus musculus
actgatgctttggacccagtgactt

SEQ ID NO: 129401 - DNA, 25 bp, Mus musculus
actgatggaacgaagaatccggcca

SEQ ID NO: 129402 - DNA, 25 bp, Mus musculus
actgatggaacgtagaatccggcca

SEQ ID NO: 129403 - DNA, 25 bp, Mus musculus
actgatggaataaaccccgtgaaac

SEQ ID NO: 129404 - DNA, 25 bp, Mus musculus
actgatggaatataccccgtgaaac

SEQ ID NO: 129405 - DNA, 25 bp, Mus musculus
actgatggatgacgctcccagtgcc

SEQ ID NO: 129406 - DNA, 25 bp, Mus musculus
actgatggatgaggctcccagtgcc

SEQ ID NO: 129407 - DNA, 25 bp, Mus musculus
actgatggcaaaaatccccactttt

SEQ ID NO: 129408 - DNA, 25 bp, Mus musculus
actgatggcaaatatccccactttt

SEQ ID NO: 129409 - DNA, 25 bp, Mus musculus
actgatggcaatcttctgaatttcc

SEQ ID NO: 129410 - DNA, 25 bp, Mus musculus
actgatggcaatgttctgaatttcc

SEQ ID NO: 129411 - DNA, 25 bp, Mus musculus
actgatggccagcttcttgttagaa

SEQ ID NO: 129412 - DNA, 25 bp, Mus musculus
actgatggccaggttcttgttagaa

SEQ ID NO: 129413 - DNA, 25 bp, Mus musculus
actgatggcccgagatcgtctttca

SEQ ID NO: 129414 - DNA, 25 bp, Mus musculus
actgatggcccgtgatcgtctttca

SEQ ID NO: 129415 - DNA, 25 bp, Mus musculus
actgatggcgatctgctggctaaca

SEQ ID NO: 129416 - DNA, 25 bp, Mus musculus
actgatggcgatgtgctggctaaca

SEQ ID NO: 129417 - DNA, 25 bp, Mus musculus
actgatggcgttcctgttcccagga

SEQ ID NO: 129418 - DNA, 25 bp, Mus musculus
actgatggcgttgctgttcccagga

SEQ ID NO: 129419 - DNA, 25 bp, Mus musculus
actgatggctctctaggcagtactc

SEQ ID NO: 129420 - DNA, 25 bp, Mus musculus
actgatggctctgtaggcagtactc

SEQ ID NO: 129421 - DNA, 25 bp, Mus musculus
actgatggctggacaagaggactcc

SEQ ID NO: 129422 - DNA, 25 bp, Mus musculus
actgatggctggtcaagaggactcc

SEQ ID NO: 129423 - DNA, 25 bp, Mus musculus
actgatgggatcacacacaccagcg

SEQ ID NO: 129424 - DNA, 25 bp, Mus musculus
actgatgggatctcacacaccagcg

SEQ ID NO: 129425 - DNA, 25 bp, Mus musculus
actgatggtcatcggtgctataaaa

SEQ ID NO: 129426 - DNA, 25 bp, Mus musculus
actgatggtcatgggtgctataaaa

SEQ ID NO: 129427 - DNA, 25 bp, Mus musculus
actgatggtgctcagaagctttgga

SEQ ID NO: 129428 - DNA, 25 bp, Mus musculus
actgatggtgctgagaagctttgga

SEQ ID NO: 129429 - DNA, 25 bp, Mus musculus
actgatggttaaaggtccgatttgg

SEQ ID NO: 129430 - DNA, 25 bp, Mus musculus
actgatggttaatggtccgatttgg

SEQ ID NO: 129431 - DNA, 25 bp, Mus musculus
actgatgtcctgaagtcttggttct

SEQ ID NO: 129432 - DNA, 25 bp, Mus musculus
actgatgtcctgtagtcttggttct

SEQ ID NO: 129433 - DNA, 25 bp, Mus musculus
actgatgtctgtctacagccaggcc

SEQ ID NO: 129434 - DNA, 25 bp, Mus musculus
actgatgtctgtgtacagccaggcc

SEQ ID NO: 129435 - DNA, 25 bp, Mus musculus
actgatgtctttagctaacttccgt

SEQ ID NO: 129436 - DNA, 25 bp, Mus musculus
actgatgtcttttgctaacttccgt

SEQ ID NO: 129437 - DNA, 25 bp, Mus musculus
actgatgtgatgactaagctgttac

SEQ ID NO: 129438 - DNA, 25 bp, Mus musculus
actgatgtgatgtctaagctgttac

SEQ ID NO: 129439 - DNA, 25 bp, Mus musculus
actgatgtggatagtctcaaagcct

SEQ ID NO: 129440 - DNA, 25 bp, Mus musculus
actgatgtggattgtctcaaagcct

SEQ ID NO: 129441 - DNA, 25 bp, Mus musculus
actgatgtgggtacctgctcaggaa

SEQ ID NO: 129442 - DNA, 25 bp, Mus musculus
actgatgtgggttcctgctcaggaa

SEQ ID NO: 129443 - DNA, 25 bp, Mus musculus
actgatgtgtcactgatgcctttct

SEQ ID NO: 129444 - DNA, 25 bp, Mus musculus
actgatgtgtcagtgatgcctttct

SEQ ID NO: 129445 - DNA, 25 bp, Mus musculus
actgatgtgtctatcccacagtctt

SEQ ID NO: 129446 - DNA, 25 bp, Mus musculus
actgatgtgtctttcccacagtctt

SEQ ID NO: 129447 - DNA, 25 bp, Mus musculus
actgatgtgtgaaatctgttgtatt

SEQ ID NO: 129448 - DNA, 25 bp, Mus musculus
actgatgtgtgatatctgttgtatt

SEQ ID NO: 129449 - DNA, 25 bp, Mus musculus
actgatgttaccacttatgtttcca

SEQ ID NO: 129450 - DNA, 25 bp, Mus musculus
actgatgttacctcttatgtttcca

SEQ ID NO: 129451 - DNA, 25 bp, Mus musculus
actgatgttactaccaaccagagaa

SEQ ID NO: 129452 - DNA, 25 bp, Mus musculus
actgatgttacttccaaccagagaa

SEQ ID NO: 129453 - DNA, 25 bp, Mus musculus
actgatgttattcgcctcgttgaga

SEQ ID NO: 129454 - DNA, 25 bp, Mus musculus
actgatgttattggcctcgttgaga

SEQ ID NO: 129455 - DNA, 25 bp, Mus musculus
actgatgttctcactatagttttat

SEQ ID NO: 129456 - DNA, 25 bp, Mus musculus
actgatgttctctctatagttttat

SEQ ID NO: 129457 - DNA, 25 bp, Mus musculus
actgatgttctgacagatcctccac

SEQ ID NO: 129458 - DNA, 25 bp, Mus musculus
actgatgttctgtcagatcctccac

SEQ ID NO: 129459 - DNA, 25 bp, Mus musculus
actgatgtttggacacctggccctg

SEQ ID NO: 129460 - DNA, 25 bp, Mus musculus
actgatgtttggtcacctggccctg

SEQ ID NO: 129461 - DNA, 25 bp, Mus musculus
actgattaaattagtggatgctccc

SEQ ID NO: 129462 - DNA, 25 bp, Mus musculus
actgattaaatttgtggatgctccc

SEQ ID NO: 129463 - DNA, 25 bp, Mus musculus
actgattaatttcatggccatgcca

SEQ ID NO: 129464 - DNA, 25 bp, Mus musculus
actgattaatttgatggccatgcca

SEQ ID NO: 129465 - DNA, 25 bp, Mus musculus
actgattacctcaagctcttcatat

SEQ ID NO: 129466 - DNA, 25 bp, Mus musculus
actgattacctctagctcttcatat

SEQ ID NO: 129467 - DNA, 25 bp, Mus musculus
actgattatctcacatgctgactta

SEQ ID NO: 129468 - DNA, 25 bp, Mus musculus
actgattatctctcatgctgactta

SEQ ID NO: 129469 - DNA, 25 bp, Mus musculus
actgattattcaaggccatggcact

SEQ ID NO: 129470 - DNA, 25 bp, Mus musculus
actgattattcatggccatggcact

SEQ ID NO: 129471 - DNA, 25 bp, Mus musculus
actgattcagtgcatataggttttt

SEQ ID NO: 129472 - DNA, 25 bp, Mus musculus
actgattcagtggatataggttttt

SEQ ID NO: 129473 - DNA, 25 bp, Mus musculus
actgattccagcaactcgtcctctg

SEQ ID NO: 129474 - DNA, 25 bp, Mus musculus
actgattccagctactcgtcctctg

SEQ ID NO: 129475 - DNA, 25 bp, Mus musculus
actgattcctgacttacgtgataac

SEQ ID NO: 129476 - DNA, 25 bp, Mus musculus
actgattcctgagttacgtgataac

SEQ ID NO: 129477 - DNA, 25 bp, Mus musculus
actgattctaagcacagactcggga

SEQ ID NO: 129478 - DNA, 25 bp, Mus musculus
actgattctaaggacagactcggga

SEQ ID NO: 129479 - DNA, 25 bp, Mus musculus
actgattctgagcatgcatcggcaa

SEQ ID NO: 129480 - DNA, 25 bp, Mus musculus
actgattctgaggatgcatcggcaa

SEQ ID NO: 129481 - DNA, 25 bp, Mus musculus
actgattcttgtatggcttatggta

SEQ ID NO: 129482 - DNA, 25 bp, Mus musculus
actgattcttgtttggcttatggta

SEQ ID NO: 129483 - DNA, 25 bp, Mus musculus
actgattgaaaaacacttccctgct

SEQ ID NO: 129484 - DNA, 25 bp, Mus musculus
actgattgaaaatcacttccctgct

SEQ ID NO: 129485 - DNA, 25 bp, Mus musculus
actgattgacagcagacggacacca

SEQ ID NO: 129486 - DNA, 25 bp, Mus musculus
actgattgacaggagacggacacca

SEQ ID NO: 129487 - DNA, 25 bp, Mus musculus
actgattgatggctctgacctcttc

SEQ ID NO: 129488 - DNA, 25 bp, Mus musculus
actgattgatgggtctgacctcttc

SEQ ID NO: 129489 - DNA, 25 bp, Mus musculus
actgattgcacaagtggctttggtg

SEQ ID NO: 129490 - DNA, 25 bp, Mus musculus
actgattgcacatgtggctttggtg

SEQ ID NO: 129491 - DNA, 25 bp, Mus musculus
actgattgctgaagtctggctctta

SEQ ID NO: 129492 - DNA, 25 bp, Mus musculus
actgattgctgatgtctggctctta

SEQ ID NO: 129493 - DNA, 25 bp, Mus musculus
actgattggttactacttgcctata

SEQ ID NO: 129494 - DNA, 25 bp, Mus musculus
actgattggttagtacttgcctata

SEQ ID NO: 129495 - DNA, 25 bp, Mus musculus
actgattgtagtcgcacttgccttt

SEQ ID NO: 129496 - DNA, 25 bp, Mus musculus
actgattgtagtggcacttgccttt

SEQ ID NO: 129497 - DNA, 25 bp, Mus musculus
actgattgtgcactaacctccccag

SEQ ID NO: 129498 - DNA, 25 bp, Mus musculus
actgattgtgcagtaacctccccag

SEQ ID NO: 129499 - DNA, 25 bp, Mus musculus
actgattgtgttctgactgccctaa

SEQ ID NO: 129500 - DNA, 25 bp, Mus musculus
actgattgtgttgtgactgccctaa

SEQ ID NO: 129501 - DNA, 25 bp, Mus musculus
actgattgttagaacaaaattgtga

SEQ ID NO: 129502 - DNA, 25 bp, Mus musculus
actgattgttagtacaaaattgtga

SEQ ID NO: 129503 - DNA, 25 bp, Mus musculus
actgatttactgctgcatgcaattc

SEQ ID NO: 129504 - DNA, 25 bp, Mus musculus
actgatttactggtgcatgcaattc

SEQ ID NO: 129505 - DNA, 25 bp, Mus musculus
actgatttccgactgcattgctgtt

SEQ ID NO: 129506 - DNA, 25 bp, Mus musculus
actgatttccgagtgcattgctgtt

SEQ ID NO: 129507 - DNA, 25 bp, Mus musculus
actgatttcttcattgagactggac

SEQ ID NO: 129508 - DNA, 25 bp, Mus musculus
actgatttcttctttgagactggac

SEQ ID NO: 129509 - DNA, 25 bp, Mus musculus
actgatttgctgaaggagggtctcc

SEQ ID NO: 129510 - DNA, 25 bp, Mus musculus
actgatttgctgtaggagggtctcc

SEQ ID NO: 129511 - DNA, 25 bp, Mus musculus
actgatttgtaaacactagcaactg

SEQ ID NO: 129512 - DNA, 25 bp, Mus musculus
actgatttgtaatcactagcaactg

SEQ ID NO: 129513 - DNA, 25 bp, Mus musculus
actgatttgtcacagagtcccaaaa

SEQ ID NO: 129514 - DNA, 25 bp, Mus musculus
actgatttgtcagagagtcccaaaa

SEQ ID NO: 129515 - DNA, 25 bp, Mus musculus
actgatttgtttctggtggtagctt

SEQ ID NO: 129516 - DNA, 25 bp, Mus musculus
actgatttgtttgtggtggtagctt

SEQ ID NO: 129517 - DNA, 25 bp, Mus musculus
actgattttgcactctttcctatga

SEQ ID NO: 129518 - DNA, 25 bp, Mus musculus
actgattttgcagtctttcctatga

SEQ ID NO: 129519 - DNA, 25 bp, Mus musculus
actgattttgctctgtagctttggc

SEQ ID NO: 129520 - DNA, 25 bp, Mus musculus
actgattttgctgtgtagctttggc

SEQ ID NO: 129521 - DNA, 25 bp, Mus musculus
actgcaaaaagcctgaatctgtaca

SEQ ID NO: 129522 - DNA, 25 bp, Mus musculus
actgcaaaaagcgtgaatctgtaca

SEQ ID NO: 129523 - DNA, 25 bp, Mus musculus
actgcaaaatttaccgaaccatcac

SEQ ID NO: 129524 - DNA, 25 bp, Mus musculus
actgcaaaattttccgaaccatcac

SEQ ID NO: 129525 - DNA, 25 bp, Mus musculus
actgcaaacaggcacttccagaata

SEQ ID NO: 129526 - DNA, 25 bp, Mus musculus
actgcaaacagggacttccagaata

SEQ ID NO: 129527 - DNA, 25 bp, Mus musculus
actgcaaaccatactacctaagtgc

SEQ ID NO: 129528 - DNA, 25 bp, Mus musculus
actgcaaaccattctacctaagtgc

SEQ ID NO: 129529 - DNA, 25 bp, Mus musculus
actgcaaactgtctggattcctctg

SEQ ID NO: 129530 - DNA, 25 bp, Mus musculus
actgcaaactgtgtggattcctctg

SEQ ID NO: 129531 - DNA, 25 bp, Mus musculus
actgcaaagagaatcgccgtgaagg

SEQ ID NO: 129532 - DNA, 25 bp, Mus musculus
actgcaaagagattcgccgtgaagg

SEQ ID NO: 129533 - DNA, 25 bp, Mus musculus
actgcaaagcaaatccagtttgtga

SEQ ID NO: 129534 - DNA, 25 bp, Mus musculus
actgcaaagcaacgccgctctggaa

SEQ ID NO: 129535 - DNA, 25 bp, Mus musculus
actgcaaagcaaggccgctctggaa

SEQ ID NO: 129536 - DNA, 25 bp, Mus musculus
actgcaaagcaattccagtttgtga

SEQ ID NO: 129537 - DNA, 25 bp, Mus musculus
actgcaaagctcagatcctgggcat

SEQ ID NO: 129538 - DNA, 25 bp, Mus musculus
actgcaaagctctgatcctgggcat

SEQ ID NO: 129539 - DNA, 25 bp, Mus musculus
actgcaaaggttacccactggtgtc

SEQ ID NO: 129540 - DNA, 25 bp, Mus musculus
actgcaaaggtttcccactggtgtc

SEQ ID NO: 129541 - DNA, 25 bp, Mus musculus
actgcaaagtccagcttgctttgtg

SEQ ID NO: 129542 - DNA, 25 bp, Mus musculus
actgcaaagtcctgcttgctttgtg

SEQ ID NO: 129543 - DNA, 25 bp, Mus musculus
actgcaaagttacttttagctcttg

SEQ ID NO: 129544 - DNA, 25 bp, Mus musculus
actgcaaagttagttttagctcttg

SEQ ID NO: 129545 - DNA, 25 bp, Mus musculus
actgcaaagttcacacccggtgtaa

SEQ ID NO: 129546 - DNA, 25 bp, Mus musculus
actgcaaagttctcacccggtgtaa

SEQ ID NO: 129547 - DNA, 25 bp, Mus musculus
actgcaaatgctaaaccgggaacct

SEQ ID NO: 129548 - DNA, 25 bp, Mus musculus
actgcaaatgcttaaccgggaacct

SEQ ID NO: 129549 - DNA, 25 bp, Mus musculus
actgcaaatgtgataacgttttatt

SEQ ID NO: 129550 - DNA, 25 bp, Mus musculus
actgcaaatgtgttaacgttttatt

SEQ ID NO: 129551 - DNA, 25 bp, Mus musculus
actgcaacaacgattgcgttcgtga

SEQ ID NO: 129552 - DNA, 25 bp, Mus musculus
actgcaacaacgtttgcgttcgtga

SEQ ID NO: 129553 - DNA, 25 bp, Mus musculus
actgcaacaatacttcccatggagc

SEQ ID NO: 129554 - DNA, 25 bp, Mus musculus
actgcaacaatagttcccatggagc

SEQ ID NO: 129555 - DNA, 25 bp, Mus musculus
actgcaacagagaggcctttgacgt

SEQ ID NO: 129556 - DNA, 25 bp, Mus musculus
actgcaacagagtggcctttgacgt

SEQ ID NO: 129557 - DNA, 25 bp, Mus musculus
actgcaacagttcgagcccagagcc

SEQ ID NO: 129558 - DNA, 25 bp, Mus musculus
actgcaacagttggagcccagagcc

SEQ ID NO: 129559 - DNA, 25 bp, Mus musculus
actgcaaccactatcagaatcctgt

SEQ ID NO: 129560 - DNA, 25 bp, Mus musculus
actgcaaccactttcagaatcctgt

SEQ ID NO: 129561 - DNA, 25 bp, Mus musculus
actgcaacctcactgagtgtggccg

SEQ ID NO: 129562 - DNA, 25 bp, Mus musculus
actgcaacctcagtgagtgtggccg

SEQ ID NO: 129563 - DNA, 25 bp, Mus musculus
actgcaaccttgaacctgtattagt

SEQ ID NO: 129564 - DNA, 25 bp, Mus musculus
actgcaaccttgtacctgtattagt

SEQ ID NO: 129565 - DNA, 25 bp, Mus musculus
actgcaactgttaccatagttcctg

SEQ ID NO: 129566 - DNA, 25 bp, Mus musculus
actgcaactgtttccatagttcctg

SEQ ID NO: 129567 - DNA, 25 bp, Mus musculus
actgcaagagcaactgggaaatgat

SEQ ID NO: 129568 - DNA, 25 bp, Mus musculus
actgcaagagcatctgggaaatgat

SEQ ID NO: 129569 - DNA, 25 bp, Mus musculus
actgcaagatctagatggcgcccca

SEQ ID NO: 129570 - DNA, 25 bp, Mus musculus
actgcaagatcttgatggcgcccca

SEQ ID NO: 129571 - DNA, 25 bp, Mus musculus
actgcaagcaccaaacatcatcatg

SEQ ID NO: 129572 - DNA, 25 bp, Mus musculus
actgcaagcacctaacatcatcatg

SEQ ID NO: 129573 - DNA, 25 bp, Mus musculus
actgcaagccctattgttgactaaa

SEQ ID NO: 129574 - DNA, 25 bp, Mus musculus
actgcaagcccttttgttgactaaa

SEQ ID NO: 129575 - DNA, 25 bp, Mus musculus
actgcaagcctgctgatactcacat

SEQ ID NO: 129576 - DNA, 25 bp, Mus musculus
actgcaagcctggtgatactcacat

SEQ ID NO: 129577 - DNA, 25 bp, Mus musculus
actgcaaggcccaagacccatgatc

SEQ ID NO: 129578 - DNA, 25 bp, Mus musculus
actgcaaggccctagacccatgatc

SEQ ID NO: 129579 - DNA, 25 bp, Mus musculus
actgcaagttaaagtgggttgtaaa

SEQ ID NO: 129580 - DNA, 25 bp, Mus musculus
actgcaagttaatgtgggttgtaaa

SEQ ID NO: 129581 - DNA, 25 bp, Mus musculus
actgcaagttgtactccagctttta

SEQ ID NO: 129582 - DNA, 25 bp, Mus musculus
actgcaagttgttctccagctttta

SEQ ID NO: 129583 - DNA, 25 bp, Mus musculus
actgcaataaacaggccagtgtggc

SEQ ID NO: 129584 - DNA, 25 bp, Mus musculus
actgcaataaactggccagtgtggc

SEQ ID NO: 129585 - DNA, 25 bp, Mus musculus
actgcaatactacctgtgtcgtgaa

SEQ ID NO: 129586 - DNA, 25 bp, Mus musculus
actgcaatactacgtgtgagccacg

SEQ ID NO: 129587 - DNA, 25 bp, Mus musculus
actgcaatactagctgtgtcgtgaa

SEQ ID NO: 129588 - DNA, 25 bp, Mus musculus
actgcaatactaggtgtgagccacg

SEQ ID NO: 129589 - DNA, 25 bp, Mus musculus
actgcaatagctaacaggcaccacc

SEQ ID NO: 129590 - DNA, 25 bp, Mus musculus
actgcaatagcttacaggcaccacc

SEQ ID NO: 129591 - DNA, 25 bp, Mus musculus
actgcaatagttatctcaaggatat

SEQ ID NO: 129592 - DNA, 25 bp, Mus musculus
actgcaatagttttctcaaggatat

SEQ ID NO: 129593 - DNA, 25 bp, Mus musculus
actgcaatgcacctaggctcagatt

SEQ ID NO: 129594 - DNA, 25 bp, Mus musculus
actgcaatgcacgtaggctcagatt

SEQ ID NO: 129595 - DNA, 25 bp, Mus musculus
actgcaatgctcagtattctacttc

SEQ ID NO: 129596 - DNA, 25 bp, Mus musculus
actgcaatgctctgtattctacttc

SEQ ID NO: 129597 - DNA, 25 bp, Mus musculus
actgcaatgctgaggagtttcttct

SEQ ID NO: 129598 - DNA, 25 bp, Mus musculus
actgcaatgctgtggagtttcttct

SEQ ID NO: 129599 - DNA, 25 bp, Mus musculus
actgcaattattcgcgtgtacccca

SEQ ID NO: 129600 - DNA, 25 bp, Mus musculus
actgcaattattggcgtgtacccca

SEQ ID NO: 129601 - DNA, 25 bp, Mus musculus
actgcacaacacctgtacacttagt

SEQ ID NO: 129602 - DNA, 25 bp, Mus musculus
actgcacaacacgtgtacacttagt

SEQ ID NO: 129603 - DNA, 25 bp, Mus musculus
actgcacaagccagccttcaaaagc

SEQ ID NO: 129604 - DNA, 25 bp, Mus musculus
actgcacaagcctgccttcaaaagc

SEQ ID NO: 129605 - DNA, 25 bp, Mus musculus
actgcacacgtgaagcacccaggtg

SEQ ID NO: 129606 - DNA, 25 bp, Mus musculus
actgcacacgtgtagcacccaggtg

SEQ ID NO: 129607 - DNA, 25 bp, Mus musculus
actgcacagaaacccttcacactgg

SEQ ID NO: 129608 - DNA, 25 bp, Mus musculus
actgcacagaaagccttcacactgg

SEQ ID NO: 129609 - DNA, 25 bp, Mus musculus
actgcacagcttaggagacacctgt

SEQ ID NO: 129610 - DNA, 25 bp, Mus musculus
actgcacagctttggagacacctgt

SEQ ID NO: 129611 - DNA, 25 bp, Mus musculus
actgcacagtgcaaagatggtccta

SEQ ID NO: 129612 - DNA, 25 bp, Mus musculus
actgcacagtgctaagatggtccta

SEQ ID NO: 129613 - DNA, 25 bp, Mus musculus
actgcacatccaaacccatgataca

SEQ ID NO: 129614 - DNA, 25 bp, Mus musculus
actgcacatccatacccatgataca

SEQ ID NO: 129615 - DNA, 25 bp, Mus musculus
actgcacatgacaggaggttacggt

SEQ ID NO: 129616 - DNA, 25 bp, Mus musculus
actgcacatgactggaggttacggt

SEQ ID NO: 129617 - DNA, 25 bp, Mus musculus
actgcacatgttaattttccctatt

SEQ ID NO: 129618 - DNA, 25 bp, Mus musculus
actgcacatgtttattttccctatt

SEQ ID NO: 129619 - DNA, 25 bp, Mus musculus
actgcaccacacatgttcatgttta

SEQ ID NO: 129620 - DNA, 25 bp, Mus musculus
actgcaccacacttgttcatgttta

SEQ ID NO: 129621 - DNA, 25 bp, Mus musculus
actgcaccactgaccatataggtca

SEQ ID NO: 129622 - DNA, 25 bp, Mus musculus
actgcaccactgtccatataggtca

SEQ ID NO: 129623 - DNA, 25 bp, Mus musculus
actgcaccagacctgtacccgaggt

SEQ ID NO: 129624 - DNA, 25 bp, Mus musculus
actgcaccagacgtgtacccgaggt

SEQ ID NO: 129625 - DNA, 25 bp, Mus musculus
actgcaccatccaaggtgtctaagg

SEQ ID NO: 129626 - DNA, 25 bp, Mus musculus
actgcaccatcctaggtgtctaagg

SEQ ID NO: 129627 - DNA, 25 bp, Mus musculus
actgcaccatgaataccaacactga

SEQ ID NO: 129628 - DNA, 25 bp, Mus musculus
actgcaccatgattaccaacactga

SEQ ID NO: 129629 - DNA, 25 bp, Mus musculus
actgcacccacaagggtaatgttag

SEQ ID NO: 129630 - DNA, 25 bp, Mus musculus
actgcacccacatgggtaatgttag

SEQ ID NO: 129631 - DNA, 25 bp, Mus musculus
actgcaccccacacttgaaaagaca

SEQ ID NO: 129632 - DNA, 25 bp, Mus musculus
actgcaccccactcttgaaaagaca

SEQ ID NO: 129633 - DNA, 25 bp, Mus musculus
actgcacccgtcaggaggtatccat

SEQ ID NO: 129634 - DNA, 25 bp, Mus musculus
actgcacccgtctggaggtatccat

SEQ ID NO: 129635 - DNA, 25 bp, Mus musculus
actgcaccctccaatatgaagctct

SEQ ID NO: 129636 - DNA, 25 bp, Mus musculus
actgcaccctcctatatgaagctct

SEQ ID NO: 129637 - DNA, 25 bp, Mus musculus
actgcaccgaggaccttttatctga

SEQ ID NO: 129638 - DNA, 25 bp, Mus musculus
actgcaccgaggtccttttatctga

SEQ ID NO: 129639 - DNA, 25 bp, Mus musculus
actgcacctcctcatttactttaaa

SEQ ID NO: 129640 - DNA, 25 bp, Mus musculus
actgcacctcctgatttactttaaa

SEQ ID NO: 129641 - DNA, 25 bp, Mus musculus
actgcaccttcaactacttcaaaaa

SEQ ID NO: 129642 - DNA, 25 bp, Mus musculus
actgcaccttcatctacttcaaaaa

SEQ ID NO: 129643 - DNA, 25 bp, Mus musculus
actgcacgagtgagccttttgttct

SEQ ID NO: 129644 - DNA, 25 bp, Mus musculus
actgcacgagtgtgccttttgttct

SEQ ID NO: 129645 - DNA, 25 bp, Mus musculus
actgcacgccttcaaagtgtttgac

SEQ ID NO: 129646 - DNA, 25 bp, Mus musculus
actgcacgccttgaaagtgtttgac

SEQ ID NO: 129647 - DNA, 25 bp, Mus musculus
actgcacggcgaactggcgcgagaa

SEQ ID NO: 129648 - DNA, 25 bp, Mus musculus
actgcacggcgatctggcgcgagaa

SEQ ID NO: 129649 - DNA, 25 bp, Mus musculus
actgcacgtttccatttagattcac

SEQ ID NO: 129650 - DNA, 25 bp, Mus musculus
actgcacgtttcgatttagattcac

SEQ ID NO: 129651 - DNA, 25 bp, Mus musculus
actgcactaaatctcgatcccaaag

SEQ ID NO: 129652 - DNA, 25 bp, Mus musculus
actgcactaaatgtcgatcccaaag

SEQ ID NO: 129653 - DNA, 25 bp, Mus musculus
actgcactcaccctgtagaagatgg

SEQ ID NO: 129654 - DNA, 25 bp, Mus musculus
actgcactcaccgtgtagaagatgg

SEQ ID NO: 129655 - DNA, 25 bp, Mus musculus
actgcactccttcatcttgatctat

SEQ ID NO: 129656 - DNA, 25 bp, Mus musculus
actgcactccttgatcttgatctat

SEQ ID NO: 129657 - DNA, 25 bp, Mus musculus
actgcactcttccaccaaaatgaaa

SEQ ID NO: 129658 - DNA, 25 bp, Mus musculus
actgcactcttcgaccaaaatgaaa

SEQ ID NO: 129659 - DNA, 25 bp, Mus musculus
actgcactgcacatgctgaggaggg

SEQ ID NO: 129660 - DNA, 25 bp, Mus musculus
actgcactgcacctgatgagatcag

SEQ ID NO: 129661 - DNA, 25 bp, Mus musculus
actgcactgcacgtgatgagatcag

SEQ ID NO: 129662 - DNA, 25 bp, Mus musculus
actgcactgcacttgctgaggaggg

SEQ ID NO: 129663 - DNA, 25 bp, Mus musculus
actgcactgcctctcaaacgctgat

SEQ ID NO: 129664 - DNA, 25 bp, Mus musculus
actgcactgcctgtcaaacgctgat

SEQ ID NO: 129665 - DNA, 25 bp, Mus musculus
actgcactgctgataatgccgtggc

SEQ ID NO: 129666 - DNA, 25 bp, Mus musculus
actgcactgctgttaatgccgtggc

SEQ ID NO: 129667 - DNA, 25 bp, Mus musculus
actgcactggctactttgggtcaag

SEQ ID NO: 129668 - DNA, 25 bp, Mus musculus
actgcactggcttctttgggtcaag

SEQ ID NO: 129669 - DNA, 25 bp, Mus musculus
actgcactgggccacctctaaaggc

SEQ ID NO: 129670 - DNA, 25 bp, Mus musculus
actgcactgggcgacctctaaaggc

SEQ ID NO: 129671 - DNA, 25 bp, Mus musculus
actgcactggtcagttctgtgacta

SEQ ID NO: 129672 - DNA, 25 bp, Mus musculus
actgcactggtctgttctgtgacta

SEQ ID NO: 129673 - DNA, 25 bp, Mus musculus
actgcactgtatccgaagcacttac

SEQ ID NO: 129674 - DNA, 25 bp, Mus musculus
actgcactgtatgcgaagcacttac

SEQ ID NO: 129675 - DNA, 25 bp, Mus musculus
actgcactgtggacttgtattggtt

SEQ ID NO: 129676 - DNA, 25 bp, Mus musculus
actgcactgtggtcttgtattggtt

SEQ ID NO: 129677 - DNA, 25 bp, Mus musculus
actgcactgttcctaacatctcggg

SEQ ID NO: 129678 - DNA, 25 bp, Mus musculus
actgcactgttcgtaacatctcggg

SEQ ID NO: 129679 - DNA, 25 bp, Mus musculus
actgcacttcttaggttcatcaact

SEQ ID NO: 129680 - DNA, 25 bp, Mus musculus
actgcacttctttggttcatcaact

SEQ ID NO: 129681 - DNA, 25 bp, Mus musculus
actgcacttgttaggtggccccaat

SEQ ID NO: 129682 - DNA, 25 bp, Mus musculus
actgcacttgtttggtggccccaat

SEQ ID NO: 129683 - DNA, 25 bp, Mus musculus
actgcactttctagctgggatgaag

SEQ ID NO: 129684 - DNA, 25 bp, Mus musculus
actgcactttcttgctgggatgaag

SEQ ID NO: 129685 - DNA, 25 bp, Mus musculus
actgcactttggaaaccaagcaagg

SEQ ID NO: 129686 - DNA, 25 bp, Mus musculus
actgcactttggtaaccaagcaagg

SEQ ID NO: 129687 - DNA, 25 bp, Mus musculus
actgcacttttcaaggtcttctttt

SEQ ID NO: 129688 - DNA, 25 bp, Mus musculus
actgcacttttctaggtcttctttt

SEQ ID NO: 129689 - DNA, 25 bp, Mus musculus
actgcagaaagaaccgttgtcgccc

SEQ ID NO: 129690 - DNA, 25 bp, Mus musculus
actgcagaaagatccgttgtcgccc

SEQ ID NO: 129691 - DNA, 25 bp, Mus musculus
actgcagaagagctggcaacagcca

SEQ ID NO: 129692 - DNA, 25 bp, Mus musculus
actgcagaagaggtggcaacagcca

SEQ ID NO: 129693 - DNA, 25 bp, Mus musculus
actgcagaaggcctcccgtgagtcc

SEQ ID NO: 129694 - DNA, 25 bp, Mus musculus
actgcagaaggcgtcccgtgagtcc

SEQ ID NO: 129695 - DNA, 25 bp, Mus musculus
actgcagaatcaccagccagcctag

SEQ ID NO: 129696 - DNA, 25 bp, Mus musculus
actgcagaatcagcagccagcctag

SEQ ID NO: 129697 - DNA, 25 bp, Mus musculus
actgcagaatgcctactcgttaact

SEQ ID NO: 129698 - DNA, 25 bp, Mus musculus
actgcagaatgcgtactcgttaact

SEQ ID NO: 129699 - DNA, 25 bp, Mus musculus
actgcagacctacctgcctgtgagg

SEQ ID NO: 129700 - DNA, 25 bp, Mus musculus
actgcagacctagctgcctgtgagg

SEQ ID NO: 129701 - DNA, 25 bp, Mus musculus
actgcagactccatcttcagtggga

SEQ ID NO: 129702 - DNA, 25 bp, Mus musculus
actgcagactccttcttcagtggga

SEQ ID NO: 129703 - DNA, 25 bp, Mus musculus
actgcagagcacctctctgttctaa

SEQ ID NO: 129704 - DNA, 25 bp, Mus musculus
actgcagagcacgtctctgttctaa

SEQ ID NO: 129705 - DNA, 25 bp, Mus musculus
actgcagagccaagagaagcccttg

SEQ ID NO: 129706 - DNA, 25 bp, Mus musculus
actgcagagccatgagaagcccttg

SEQ ID NO: 129707 - DNA, 25 bp, Mus musculus
actgcagagctgcagcccttagctg

SEQ ID NO: 129708 - DNA, 25 bp, Mus musculus
actgcagagctggagcccttagctg

SEQ ID NO: 129709 - DNA, 25 bp, Mus musculus
actgcagagggcacctgacttgaga

SEQ ID NO: 129710 - DNA, 25 bp, Mus musculus
actgcagagggctcctgacttgaga

SEQ ID NO: 129711 - DNA, 25 bp, Mus musculus
actgcagataagatgttcccgaaat

SEQ ID NO: 129712 - DNA, 25 bp, Mus musculus
actgcagataagttgttcccgaaat

SEQ ID NO: 129713 - DNA, 25 bp, Mus musculus
actgcagatttcacgggccttttgg

SEQ ID NO: 129714 - DNA, 25 bp, Mus musculus
actgcagatttctcgggccttttgg

SEQ ID NO: 129715 - DNA, 25 bp, Mus musculus
actgcagcactgcaggagcctgtga

SEQ ID NO: 129716 - DNA, 25 bp, Mus musculus
actgcagcactggaggagcctgtga

SEQ ID NO: 129717 - DNA, 25 bp, Mus musculus
actgcagcagtcattccttggtgaa

SEQ ID NO: 129718 - DNA, 25 bp, Mus musculus
actgcagcagtctttccttggtgaa

SEQ ID NO: 129719 - DNA, 25 bp, Mus musculus
actgcagcattgctgctatgcctgt

SEQ ID NO: 129720 - DNA, 25 bp, Mus musculus
actgcagcattggtgctatgcctgt

SEQ ID NO: 129721 - DNA, 25 bp, Mus musculus
actgcagccatcaaaaccggtttaa

SEQ ID NO: 129722 - DNA, 25 bp, Mus musculus
actgcagccatctaaaccggtttaa

SEQ ID NO: 129723 - DNA, 25 bp, Mus musculus
actgcagcccagaatcaatatattt

SEQ ID NO: 129724 - DNA, 25 bp, Mus musculus
actgcagcccagtatcaatatattt

SEQ ID NO: 129725 - DNA, 25 bp, Mus musculus
actgcagccgaaagcgtcactgtgt

SEQ ID NO: 129726 - DNA, 25 bp, Mus musculus
actgcagccgaatgcgtcactgtgt

SEQ ID NO: 129727 - DNA, 25 bp, Mus musculus
actgcagccgcaatttcatggtcat

SEQ ID NO: 129728 - DNA, 25 bp, Mus musculus
actgcagccgcattttcatggtcat

SEQ ID NO: 129729 - DNA, 25 bp, Mus musculus
actgcagccgctatgggagaaaaaa

SEQ ID NO: 129730 - DNA, 25 bp, Mus musculus
actgcagccgctttgggagaaaaaa

SEQ ID NO: 129731 - DNA, 25 bp, Mus musculus
actgcagccggtatgaaagaacctg

SEQ ID NO: 129732 - DNA, 25 bp, Mus musculus
actgcagccggtttgaaagaacctg

SEQ ID NO: 129733 - DNA, 25 bp, Mus musculus
actgcagcctgacaccgagggtacc

SEQ ID NO: 129734 - DNA, 25 bp, Mus musculus
actgcagcctgagaccgagggtacc

SEQ ID NO: 129735 - DNA, 25 bp, Mus musculus
actgcagcctgcaactggcaaacat

SEQ ID NO: 129736 - DNA, 25 bp, Mus musculus
actgcagcctgctactggcaaacat

SEQ ID NO: 129737 - DNA, 25 bp, Mus musculus
actgcagcgcgccacgaggacaatg

SEQ ID NO: 129738 - DNA, 25 bp, Mus musculus
actgcagcgcgcgacgaggacaatg

SEQ ID NO: 129739 - DNA, 25 bp, Mus musculus
actgcagcggcacagatggacagct

SEQ ID NO: 129740 - DNA, 25 bp, Mus musculus
actgcagcggcagagatggacagct

SEQ ID NO: 129741 - DNA, 25 bp, Mus musculus
actgcagcgtgcatgtatctcttca

SEQ ID NO: 129742 - DNA, 25 bp, Mus musculus
actgcagcgtgcttgtatctcttca

SEQ ID NO: 129743 - DNA, 25 bp, Mus musculus
actgcagcgtgtactgggtgcacaa

SEQ ID NO: 129744 - DNA, 25 bp, Mus musculus
actgcagcgtgttctgggtgcacaa

SEQ ID NO: 129745 - DNA, 25 bp, Mus musculus
actgcagctcagaaggctttggcta

SEQ ID NO: 129746 - DNA, 25 bp, Mus musculus
actgcagctcagtaggctttggcta

SEQ ID NO: 129747 - DNA, 25 bp, Mus musculus
actgcagctgggatgcattgctctc

SEQ ID NO: 129748 - DNA, 25 bp, Mus musculus
actgcagctgggttgcattgctctc

SEQ ID NO: 129749 - DNA, 25 bp, Mus musculus
actgcagctgtgcttggtgttctca

SEQ ID NO: 129750 - DNA, 25 bp, Mus musculus
actgcagctgtggttggtgttctca

SEQ ID NO: 129751 - DNA, 25 bp, Mus musculus
actgcagcttcactctacatagtgt

SEQ ID NO: 129752 - DNA, 25 bp, Mus musculus
actgcagcttcagtctacatagtgt

SEQ ID NO: 129753 - DNA, 25 bp, Mus musculus
actgcaggaaatactaaaccaccac

SEQ ID NO: 129754 - DNA, 25 bp, Mus musculus
actgcaggaaattctaaaccaccac

SEQ ID NO: 129755 - DNA, 25 bp, Mus musculus
actgcaggactgctgaagcgctacc

SEQ ID NO: 129756 - DNA, 25 bp, Mus musculus
actgcaggactggtgaagcgctacc

SEQ ID NO: 129757 - DNA, 25 bp, Mus musculus
actgcaggaggacagtcgctaccta

SEQ ID NO: 129758 - DNA, 25 bp, Mus musculus
actgcaggaggagagtcgctaccta

SEQ ID NO: 129759 - DNA, 25 bp, Mus musculus
actgcaggagtccacttccaccaga

SEQ ID NO: 129760 - DNA, 25 bp, Mus musculus
actgcaggagtcgacttccaccaga

SEQ ID NO: 129761 - DNA, 25 bp, Mus musculus
actgcaggcacgagtttgtatagac

SEQ ID NO: 129762 - DNA, 25 bp, Mus musculus
actgcaggcacgtgtttgtatagac

SEQ ID NO: 129763 - DNA, 25 bp, Mus musculus
actgcaggcaggagcctcgcagttt

SEQ ID NO: 129764 - DNA, 25 bp, Mus musculus
actgcaggcaggtgcctcgcagttt

SEQ ID NO: 129765 - DNA, 25 bp, Mus musculus
actgcaggctgtagatcttgaggga

SEQ ID NO: 129766 - DNA, 25 bp, Mus musculus
actgcaggctgttgatcttgaggga

SEQ ID NO: 129767 - DNA, 25 bp, Mus musculus
actgcagggaatatcagatgaccta

SEQ ID NO: 129768 - DNA, 25 bp, Mus musculus
actgcagggaatttcagatgaccta

SEQ ID NO: 129769 - DNA, 25 bp, Mus musculus
actgcagggagcagttttgcgaagc

SEQ ID NO: 129770 - DNA, 25 bp, Mus musculus
actgcagggagctgttttgcgaagc

SEQ ID NO: 129771 - DNA, 25 bp, Mus musculus
actgcagggatgcaggaactttttc

SEQ ID NO: 129772 - DNA, 25 bp, Mus musculus
actgcagggatggaggaactttttc

SEQ ID NO: 129773 - DNA, 25 bp, Mus musculus
actgcagggcgcatatctgactttc

SEQ ID NO: 129774 - DNA, 25 bp, Mus musculus
actgcagggcgcttatctgactttc

SEQ ID NO: 129775 - DNA, 25 bp, Mus musculus
actgcagggtgaagggaccagccct

SEQ ID NO: 129776 - DNA, 25 bp, Mus musculus
actgcagggtgatgggaccagccct

SEQ ID NO: 129777 - DNA, 25 bp, Mus musculus
actgcagggttaactgttactgtgg

SEQ ID NO: 129778 - DNA, 25 bp, Mus musculus
actgcagggttatctgttactgtgg

SEQ ID NO: 129779 - DNA, 25 bp, Mus musculus
actgcaggtttcatcaaggctgaat

SEQ ID NO: 129780 - DNA, 25 bp, Mus musculus
actgcaggtttcttcaaggctgaat

SEQ ID NO: 129781 - DNA, 25 bp, Mus musculus
actgcagtagcacaaataattcctg

SEQ ID NO: 129782 - DNA, 25 bp, Mus musculus
actgcagtagcagaaataattcctg

SEQ ID NO: 129783 - DNA, 25 bp, Mus musculus
actgcagtcactagcctgtggcaaa

SEQ ID NO: 129784 - DNA, 25 bp, Mus musculus
actgcagtcacttgcctgtggcaaa

SEQ ID NO: 129785 - DNA, 25 bp, Mus musculus
actgcagtcagtcggtattggattt

SEQ ID NO: 129786 - DNA, 25 bp, Mus musculus
actgcagtcagtgggtattggattt

SEQ ID NO: 129787 - DNA, 25 bp, Mus musculus
actgcagtcctcacttcttgggaga

SEQ ID NO: 129788 - DNA, 25 bp, Mus musculus
actgcagtcctctcttcttgggaga

SEQ ID NO: 129789 - DNA, 25 bp, Mus musculus
actgcagtctatattcagctggtga

SEQ ID NO: 129790 - DNA, 25 bp, Mus musculus
actgcagtctattttcagctggtga

SEQ ID NO: 129791 - DNA, 25 bp, Mus musculus
actgcagtgaccacatcctgagcgt

SEQ ID NO: 129792 - DNA, 25 bp, Mus musculus
actgcagtgacctcatcctgagcgt

SEQ ID NO: 129793 - DNA, 25 bp, Mus musculus
actgcagtgctcatacattagggac

SEQ ID NO: 129794 - DNA, 25 bp, Mus musculus
actgcagtgctcttacattagggac

SEQ ID NO: 129795 - DNA, 25 bp, Mus musculus
actgcagtgcttcccaacaatgaaa

SEQ ID NO: 129796 - DNA, 25 bp, Mus musculus
actgcagtgcttgccaacaatgaaa

SEQ ID NO: 129797 - DNA, 25 bp, Mus musculus
actgcagtgtagctcctttagtggt

SEQ ID NO: 129798 - DNA, 25 bp, Mus musculus
actgcagtgtaggtcctttagtggt

SEQ ID NO: 129799 - DNA, 25 bp, Mus musculus
actgcagtgtcacagggcctggctt

SEQ ID NO: 129800 - DNA, 25 bp, Mus musculus
actgcagtgtcagagggcctggctt

SEQ ID NO: 129801 - DNA, 25 bp, Mus musculus
actgcagtgtggaagggtttcctcc

SEQ ID NO: 129802 - DNA, 25 bp, Mus musculus
actgcagtgtggtagggtttcctcc

SEQ ID NO: 129803 - DNA, 25 bp, Mus musculus
actgcagtgtgtaacagtgtgtccc

SEQ ID NO: 129804 - DNA, 25 bp, Mus musculus
actgcagtgtgttacagtgtgtccc

SEQ ID NO: 129805 - DNA, 25 bp, Mus musculus
actgcagtgttgaggcgtctgattt

SEQ ID NO: 129806 - DNA, 25 bp, Mus musculus
actgcagtgttgtggcgtctgattt

SEQ ID NO: 129807 - DNA, 25 bp, Mus musculus
actgcagtgtttctagaggcctcaa

SEQ ID NO: 129808 - DNA, 25 bp, Mus musculus
actgcagtgtttgtagaggcctcaa

SEQ ID NO: 129809 - DNA, 25 bp, Mus musculus
actgcagttactcatgtccccagtg

SEQ ID NO: 129810 - DNA, 25 bp, Mus musculus
actgcagttactgatgtccccagtg

SEQ ID NO: 129811 - DNA, 25 bp, Mus musculus
actgcagttcccactaaccaaggtt

SEQ ID NO: 129812 - DNA, 25 bp, Mus musculus
actgcagttcccattggtgctgtaa

SEQ ID NO: 129813 - DNA, 25 bp, Mus musculus
actgcagttccctctaaccaaggtt

SEQ ID NO: 129814 - DNA, 25 bp, Mus musculus
actgcagttccctttggtgctgtaa

SEQ ID NO: 129815 - DNA, 25 bp, Mus musculus
actgcagttctgacatctggatctg

SEQ ID NO: 129816 - DNA, 25 bp, Mus musculus
actgcagttctgtcatctggatctg

SEQ ID NO: 129817 - DNA, 25 bp, Mus musculus
actgcagttgacaatttctctcctt

SEQ ID NO: 129818 - DNA, 25 bp, Mus musculus
actgcagttgactatttctctcctt

SEQ ID NO: 129819 - DNA, 25 bp, Mus musculus
actgcagttgagacccatgtgttat

SEQ ID NO: 129820 - DNA, 25 bp, Mus musculus
actgcagttgagtcccatgtgttat

SEQ ID NO: 129821 - DNA, 25 bp, Mus musculus
actgcagttggtcctggccccactg

SEQ ID NO: 129822 - DNA, 25 bp, Mus musculus
actgcagttggtgctggccccactg

SEQ ID NO: 129823 - DNA, 25 bp, Mus musculus
actgcagttgtaataagtcttccac

SEQ ID NO: 129824 - DNA, 25 bp, Mus musculus
actgcagttgtacagattcccgtct

SEQ ID NO: 129825 - DNA, 25 bp, Mus musculus
actgcagttgtagagattcccgtct

SEQ ID NO: 129826 - DNA, 25 bp, Mus musculus
actgcagttgtattaagtcttccac

SEQ ID NO: 129827 - DNA, 25 bp, Mus musculus
actgcagtttacattgtgtctgaaa

SEQ ID NO: 129828 - DNA, 25 bp, Mus musculus
actgcagtttactttgtgtctgaaa

SEQ ID NO: 129829 - DNA, 25 bp, Mus musculus
actgcagtttggagtctctctgggt

SEQ ID NO: 129830 - DNA, 25 bp, Mus musculus
actgcagtttggtgtctctctgggt

SEQ ID NO: 129831 - DNA, 25 bp, Mus musculus
actgcataaaacatccttcattggg

SEQ ID NO: 129832 - DNA, 25 bp, Mus musculus
actgcataaaacttccttcattggg

SEQ ID NO: 129833 - DNA, 25 bp, Mus musculus
actgcataagcgcacacctgctgga

SEQ ID NO: 129834 - DNA, 25 bp, Mus musculus
actgcataagcggacacctgctgga

SEQ ID NO: 129835 - DNA, 25 bp, Mus musculus
actgcatacattccatgcccttaaa

SEQ ID NO: 129836 - DNA, 25 bp, Mus musculus
actgcatacattgcatgcccttaaa

SEQ ID NO: 129837 - DNA, 25 bp, Mus musculus
actgcatacgatctggcaccggtga

SEQ ID NO: 129838 - DNA, 25 bp, Mus musculus
actgcatacgatgtggcaccggtga

SEQ ID NO: 129839 - DNA, 25 bp, Mus musculus
actgcatagggcatgaacttgtata

SEQ ID NO: 129840 - DNA, 25 bp, Mus musculus
actgcatagggcttgaacttgtata

SEQ ID NO: 129841 - DNA, 25 bp, Mus musculus
actgcatatcaaagtttatcacaca

SEQ ID NO: 129842 - DNA, 25 bp, Mus musculus
actgcatatcaatgtttatcacaca

SEQ ID NO: 129843 - DNA, 25 bp, Mus musculus
actgcatcacaccttcgcatgtgta

SEQ ID NO: 129844 - DNA, 25 bp, Mus musculus
actgcatcacacgttcgcatgtgta

SEQ ID NO: 129845 - DNA, 25 bp, Mus musculus
actgcatcactgaccttacaaatgt

SEQ ID NO: 129846 - DNA, 25 bp, Mus musculus
actgcatcactgtccttacaaatgt

SEQ ID NO: 129847 - DNA, 25 bp, Mus musculus
actgcatcatgcatgactcactcag

SEQ ID NO: 129848 - DNA, 25 bp, Mus musculus
actgcatcatgcttgactcactcag

SEQ ID NO: 129849 - DNA, 25 bp, Mus musculus
actgcatcatgtcgtttgatccctc

SEQ ID NO: 129850 - DNA, 25 bp, Mus musculus
actgcatcatgtggtttgatccctc

SEQ ID NO: 129851 - DNA, 25 bp, Mus musculus
actgcatccactcggctggccaaat

SEQ ID NO: 129852 - DNA, 25 bp, Mus musculus
actgcatccactgggctggccaaat

SEQ ID NO: 129853 - DNA, 25 bp, Mus musculus
actgcatcccatattttctagcatg

SEQ ID NO: 129854 - DNA, 25 bp, Mus musculus
actgcatcccattttttctagcatg

SEQ ID NO: 129855 - DNA, 25 bp, Mus musculus
actgcatccgacagagtgtagagaa

SEQ ID NO: 129856 - DNA, 25 bp, Mus musculus
actgcatccgactgagtgtagagaa

SEQ ID NO: 129857 - DNA, 25 bp, Mus musculus
actgcatcctccattctattgtata

SEQ ID NO: 129858 - DNA, 25 bp, Mus musculus
actgcatcctcctttctattgtata

SEQ ID NO: 129859 - DNA, 25 bp, Mus musculus
actgcatcctgaacccttggtgtgt

SEQ ID NO: 129860 - DNA, 25 bp, Mus musculus
actgcatcctgatcccttggtgtgt

SEQ ID NO: 129861 - DNA, 25 bp, Mus musculus
actgcatccttgagctgctgacttt

SEQ ID NO: 129862 - DNA, 25 bp, Mus musculus
actgcatccttgtgctgctgacttt

SEQ ID NO: 129863 - DNA, 25 bp, Mus musculus
actgcatcgtctctggtagtgggcc

SEQ ID NO: 129864 - DNA, 25 bp, Mus musculus
actgcatcgtctgtggtagtgggcc

SEQ ID NO: 129865 - DNA, 25 bp, Mus musculus
actgcatctctccatggctcaaaac

SEQ ID NO: 129866 - DNA, 25 bp, Mus musculus
actgcatctctcgatggctcaaaac

SEQ ID NO: 129867 - DNA, 25 bp, Mus musculus
actgcatcttgtaaatctgttctaa

SEQ ID NO: 129868 - DNA, 25 bp, Mus musculus
actgcatcttgttaatctgttctaa

SEQ ID NO: 129869 - DNA, 25 bp, Mus musculus
actgcatgacatccttgagatccac

SEQ ID NO: 129870 - DNA, 25 bp, Mus musculus
actgcatgacatgcttgagatccac

SEQ ID NO: 129871 - DNA, 25 bp, Mus musculus
actgcatgagtgatgtgtcttttct

SEQ ID NO: 129872 - DNA, 25 bp, Mus musculus
actgcatgagtgttgtgtcttttct

SEQ ID NO: 129873 - DNA, 25 bp, Mus musculus
actgcatgcgaacatcgacgtggct

SEQ ID NO: 129874 - DNA, 25 bp, Mus musculus
actgcatgcgaagatcgacgtggct

SEQ ID NO: 129875 - DNA, 25 bp, Mus musculus
actgcatgctggagtgtgtctaatc

SEQ ID NO: 129876 - DNA, 25 bp, Mus musculus
actgcatgctggtgtgtgtctaatc

SEQ ID NO: 129877 - DNA, 25 bp, Mus musculus
actgcatgtgacactagttacagga

SEQ ID NO: 129878 - DNA, 25 bp, Mus musculus
actgcatgtgactctagttacagga

SEQ ID NO: 129879 - DNA, 25 bp, Mus musculus
actgcatgttcccagcttcgaaaaa

SEQ ID NO: 129880 - DNA, 25 bp, Mus musculus
actgcatgttccgagcttcgaaaaa

SEQ ID NO: 129881 - DNA, 25 bp, Mus musculus
actgcattattcatcgctgtctttg

SEQ ID NO: 129882 - DNA, 25 bp, Mus musculus
actgcattattcttcgctgtctttg

SEQ ID NO: 129883 - DNA, 25 bp, Mus musculus
actgcattcatgagtctaaggacca

SEQ ID NO: 129884 - DNA, 25 bp, Mus musculus
actgcattcatgtgtctaaggacca

SEQ ID NO: 129885 - DNA, 25 bp, Mus musculus
actgcattccagataagacgtgtag

SEQ ID NO: 129886 - DNA, 25 bp, Mus musculus
actgcattccagttaagacgtgtag

SEQ ID NO: 129887 - DNA, 25 bp, Mus musculus
actgcattgcacagggtgtatagat

SEQ ID NO: 129888 - DNA, 25 bp, Mus musculus
actgcattgcactgggtgtatagat

SEQ ID NO: 129889 - DNA, 25 bp, Mus musculus
actgcattgcatatcatctttaaaa

SEQ ID NO: 129890 - DNA, 25 bp, Mus musculus
actgcattgcatttcatctttaaaa

SEQ ID NO: 129891 - DNA, 25 bp, Mus musculus
actgcattgctcctggcactaggga

SEQ ID NO: 129892 - DNA, 25 bp, Mus musculus
actgcattgctcgtggcactaggga

SEQ ID NO: 129893 - DNA, 25 bp, Mus musculus
actgcattgcttaaggtcgtattca

SEQ ID NO: 129894 - DNA, 25 bp, Mus musculus
actgcattgctttaggtcgtattca

SEQ ID NO: 129895 - DNA, 25 bp, Mus musculus
actgcattgggcatctgtgattcaa

SEQ ID NO: 129896 - DNA, 25 bp, Mus musculus
actgcattgggcttctgtgattcaa

SEQ ID NO: 129897 - DNA, 25 bp, Mus musculus
actgcattgtatactggatactacc

SEQ ID NO: 129898 - DNA, 25 bp, Mus musculus
actgcattgtattctggatactacc

SEQ ID NO: 129899 - DNA, 25 bp, Mus musculus
actgcatttataccttcagattaaa

SEQ ID NO: 129900 - DNA, 25 bp, Mus musculus
actgcatttatagcttcagattaaa

SEQ ID NO: 129901 - DNA, 25 bp, Mus musculus
actgcatttcttagcttctttagtg

SEQ ID NO: 129902 - DNA, 25 bp, Mus musculus
actgcatttctttgcttctttagtg

SEQ ID NO: 129903 - DNA, 25 bp, Mus musculus
actgccaaatgtcccagggtgattt

SEQ ID NO: 129904 - DNA, 25 bp, Mus musculus
actgccaaatgtgccagggtgattt

SEQ ID NO: 129905 - DNA, 25 bp, Mus musculus
actgccaaccgtcggatggaccata

SEQ ID NO: 129906 - DNA, 25 bp, Mus musculus
actgccaaccgtgggatggaccata

SEQ ID NO: 129907 - DNA, 25 bp, Mus musculus
actgccaatggaaagctgtgcctct

SEQ ID NO: 129908 - DNA, 25 bp, Mus musculus
actgccaatggactgttagtgtgga

SEQ ID NO: 129909 - DNA, 25 bp, Mus musculus
actgccaatggagtgttagtgtgga

SEQ ID NO: 129910 - DNA, 25 bp, Mus musculus
actgccaatggatagctgtgcctct

SEQ ID NO: 129911 - DNA, 25 bp, Mus musculus
actgccaattccagaaagcaccagg

SEQ ID NO: 129912 - DNA, 25 bp, Mus musculus
actgccaattcctgaaagcaccagg

SEQ ID NO: 129913 - DNA, 25 bp, Mus musculus
actgccacaaacagttgttttccgc

SEQ ID NO: 129914 - DNA, 25 bp, Mus musculus
actgccacaaactgttgttttccgc

SEQ ID NO: 129915 - DNA, 25 bp, Mus musculus
actgccacaggtaggcgtgtaacga

SEQ ID NO: 129916 - DNA, 25 bp, Mus musculus
actgccacaggttggcgtgtaacga

SEQ ID NO: 129917 - DNA, 25 bp, Mus musculus
actgccacagtgctatttgtttacc

SEQ ID NO: 129918 - DNA, 25 bp, Mus musculus
actgccacagtggtatttgtttacc

SEQ ID NO: 129919 - DNA, 25 bp, Mus musculus
actgccacatacacagtctcacatt

SEQ ID NO: 129920 - DNA, 25 bp, Mus musculus
actgccacatactcagtctcacatt

SEQ ID NO: 129921 - DNA, 25 bp, Mus musculus
actgccaccaagactactctaatat

SEQ ID NO: 129922 - DNA, 25 bp, Mus musculus
actgccaccaagtctactctaatat

SEQ ID NO: 129923 - DNA, 25 bp, Mus musculus
actgccaccctgattgtgtatcata

SEQ ID NO: 129924 - DNA, 25 bp, Mus musculus
actgccaccctgtttgtgtatcata

SEQ ID NO: 129925 - DNA, 25 bp, Mus musculus
actgccaccggacgagatagggtct

SEQ ID NO: 129926 - DNA, 25 bp, Mus musculus
actgccaccggaggagatagggtct

SEQ ID NO: 129927 - DNA, 25 bp, Mus musculus
actgccacctccagattgaatctaa

SEQ ID NO: 129928 - DNA, 25 bp, Mus musculus
actgccacctcctgattgaatctaa

SEQ ID NO: 129929 - DNA, 25 bp, Mus musculus
actgccacgaccacagtgtctaaag

SEQ ID NO: 129930 - DNA, 25 bp, Mus musculus
actgccacgacctcagtgtctaaag

SEQ ID NO: 129931 - DNA, 25 bp, Mus musculus
actgccacgttcagaggctaggatt

SEQ ID NO: 129932 - DNA, 25 bp, Mus musculus
actgccacgttctgaggctaggatt

SEQ ID NO: 129933 - DNA, 25 bp, Mus musculus
actgccactaggctctctaggcaaa

SEQ ID NO: 129934 - DNA, 25 bp, Mus musculus
actgccactagggtctctaggcaaa

SEQ ID NO: 129935 - DNA, 25 bp, Mus musculus
actgccactctgcaaattgccacgg

SEQ ID NO: 129936 - DNA, 25 bp, Mus musculus
actgccactctggaaattgccacgg

SEQ ID NO: 129937 - DNA, 25 bp, Mus musculus
actgccactgccagtctctgggttt

SEQ ID NO: 129938 - DNA, 25 bp, Mus musculus
actgccactgcctgtctctgggttt

SEQ ID NO: 129939 - DNA, 25 bp, Mus musculus
actgccacttctcggtcatagtgat

SEQ ID NO: 129940 - DNA, 25 bp, Mus musculus
actgccacttctgggtcatagtgat

SEQ ID NO: 129941 - DNA, 25 bp, Mus musculus
actgccagaacccacagagtagctc

SEQ ID NO: 129942 - DNA, 25 bp, Mus musculus
actgccagaaccgacagagtagctc

SEQ ID NO: 129943 - DNA, 25 bp, Mus musculus
actgccagagccaggcattggttct

SEQ ID NO: 129944 - DNA, 25 bp, Mus musculus
actgccagagcctggcattggttct

SEQ ID NO: 129945 - DNA, 25 bp, Mus musculus
actgccaggacaagacctgctgtgt

SEQ ID NO: 129946 - DNA, 25 bp, Mus musculus
actgccaggacatgacctgctgtgt

SEQ ID NO: 129947 - DNA, 25 bp, Mus musculus
actgccaggccgagaggaccatgga

SEQ ID NO: 129948 - DNA, 25 bp, Mus musculus
actgccaggccgtgaggaccatgga

SEQ ID NO: 129949 - DNA, 25 bp, Mus musculus
actgccagggtgatcttgaagcttt

SEQ ID NO: 129950 - DNA, 25 bp, Mus musculus
actgccagggtgttcttgaagcttt

SEQ ID NO: 129951 - DNA, 25 bp, Mus musculus
actgccagtatacacgagtgaagct

SEQ ID NO: 129952 - DNA, 25 bp, Mus musculus
actgccagtatagacgagtgaagct

SEQ ID NO: 129953 - DNA, 25 bp, Mus musculus
actgccagtgaaagactctgtcctg

SEQ ID NO: 129954 - DNA, 25 bp, Mus musculus
actgccagtgaatgactctgtcctg

SEQ ID NO: 129955 - DNA, 25 bp, Mus musculus
actgccagtggcatgcgtgtttaat

SEQ ID NO: 129956 - DNA, 25 bp, Mus musculus
actgccagtggcttgcgtgtttaat

SEQ ID NO: 129957 - DNA, 25 bp, Mus musculus
actgccatacccagagtgtgtagtt

SEQ ID NO: 129958 - DNA, 25 bp, Mus musculus
actgccataccctgagtgtgtagtt

SEQ ID NO: 129959 - DNA, 25 bp, Mus musculus
actgccatccatatttgtgggttat

SEQ ID NO: 129960 - DNA, 25 bp, Mus musculus
actgccatccatttttgtgggttat

SEQ ID NO: 129961 - DNA, 25 bp, Mus musculus
actgccatcccaagctagtttaaag

SEQ ID NO: 129962 - DNA, 25 bp, Mus musculus
actgccatcccatgctagtttaaag

SEQ ID NO: 129963 - DNA, 25 bp, Mus musculus
actgccatgcagatgggttttagct

SEQ ID NO: 129964 - DNA, 25 bp, Mus musculus
actgccatgcagttgggttttagct

SEQ ID NO: 129965 - DNA, 25 bp, Mus musculus
actgccatgcatccaccatttgaaa

SEQ ID NO: 129966 - DNA, 25 bp, Mus musculus
actgccatgcatgcaccatttgaaa

SEQ ID NO: 129967 - DNA, 25 bp, Mus musculus
actgccatgctcagggtgtttatgc

SEQ ID NO: 129968 - DNA, 25 bp, Mus musculus
actgccatgctctgggtgtttatgc

SEQ ID NO: 129969 - DNA, 25 bp, Mus musculus
actgccatggtcatttctgaccaca

SEQ ID NO: 129970 - DNA, 25 bp, Mus musculus
actgccatggtcttttctgaccaca

SEQ ID NO: 129971 - DNA, 25 bp, Mus musculus
actgccattacactgctctatttcc

SEQ ID NO: 129972 - DNA, 25 bp, Mus musculus
actgccattacagtgctctatttcc

SEQ ID NO: 129973 - DNA, 25 bp, Mus musculus
actgccattctactctaacaaatcc

SEQ ID NO: 129974 - DNA, 25 bp, Mus musculus
actgccattctagtctaacaaatcc

SEQ ID NO: 129975 - DNA, 25 bp, Mus musculus
actgccattgaacctcctaagggag

SEQ ID NO: 129976 - DNA, 25 bp, Mus musculus
actgccattgaagctcctaagggag

SEQ ID NO: 129977 - DNA, 25 bp, Mus musculus
actgccattgtgagcctttcctggg

SEQ ID NO: 129978 - DNA, 25 bp, Mus musculus
actgccattgtgtgcctttcctggg

SEQ ID NO: 129979 - DNA, 25 bp, Mus musculus
actgccattgttatggcagccagct

SEQ ID NO: 129980 - DNA, 25 bp, Mus musculus
actgccattgttttggcagccagct

SEQ ID NO: 129981 - DNA, 25 bp, Mus musculus
actgccatttgacatttagctgctg

SEQ ID NO: 129982 - DNA, 25 bp, Mus musculus
actgccatttgagatttagctgctg

SEQ ID NO: 129983 - DNA, 25 bp, Mus musculus
actgccattttgagcctttgttttc

SEQ ID NO: 129984 - DNA, 25 bp, Mus musculus
actgccattttgtgcctttgttttc

SEQ ID NO: 129985 - DNA, 25 bp, Mus musculus
actgcccaatgcagccctggtcggg

SEQ ID NO: 129986 - DNA, 25 bp, Mus musculus
actgcccaatgctgccctggtcggg

SEQ ID NO: 129987 - DNA, 25 bp, Mus musculus
actgcccacagactcttacgggtaa

SEQ ID NO: 129988 - DNA, 25 bp, Mus musculus
actgcccacagagtcttacgggtaa

SEQ ID NO: 129989 - DNA, 25 bp, Mus musculus
actgcccacctgacatttgaatgta

SEQ ID NO: 129990 - DNA, 25 bp, Mus musculus
actgcccacctgtcatttgaatgta

SEQ ID NO: 129991 - DNA, 25 bp, Mus musculus
actgcccacttcctctggaaaatag

SEQ ID NO: 129992 - DNA, 25 bp, Mus musculus
actgcccacttcgtctggaaaatag

SEQ ID NO: 129993 - DNA, 25 bp, Mus musculus
actgcccagcccatgcctagatttt

SEQ ID NO: 129994 - DNA, 25 bp, Mus musculus
actgcccagcccttgcctagatttt

SEQ ID NO: 129995 - DNA, 25 bp, Mus musculus
actgcccaggtgacaagatgagacc

SEQ ID NO: 129996 - DNA, 25 bp, Mus musculus
actgcccaggtgtcaagatgagacc

SEQ ID NO: 129997 - DNA, 25 bp, Mus musculus
actgcccaggttctcttcttagatc

SEQ ID NO: 129998 - DNA, 25 bp, Mus musculus
actgcccaggttgtcttcttagatc

SEQ ID NO: 129999 - DNA, 25 bp, Mus musculus
actgcccatgcaatgtatgatcata

SEQ ID NO: 130000 - DNA, 25 bp, Mus musculus
actgcccatgcattgtatgatcata

SEQ ID NO: 130001 - DNA, 25 bp, Mus musculus
actgccccaactcagtattggtcat

SEQ ID NO: 130002 - DNA, 25 bp, Mus musculus
actgccccaactgagtattggtcat

SEQ ID NO: 130003 - DNA, 25 bp, Mus musculus
actgccccaatccacagggtctggg

SEQ ID NO: 130004 - DNA, 25 bp, Mus musculus
actgccccaatcgacagggtctggg

SEQ ID NO: 130005 - DNA, 25 bp, Mus musculus
actgccccactgaaagtgtaccttt

SEQ ID NO: 130006 - DNA, 25 bp, Mus musculus
actgccccactgtaagtgtaccttt

SEQ ID NO: 130007 - DNA, 25 bp, Mus musculus
actgccccagtcatggccagagata

SEQ ID NO: 130008 - DNA, 25 bp, Mus musculus
actgccccagtcttggccagagata

SEQ ID NO: 130009 - DNA, 25 bp, Mus musculus
actgccccatgtattgtagagtgtt

SEQ ID NO: 130010 - DNA, 25 bp, Mus musculus
actgccccatgtctcgccaggagtg

SEQ ID NO: 130011 - DNA, 25 bp, Mus musculus
actgccccatgtgtcgccaggagtg

SEQ ID NO: 130012 - DNA, 25 bp, Mus musculus
actgccccatgttttgtagagtgtt

SEQ ID NO: 130013 - DNA, 25 bp, Mus musculus
actgccccggccagaggagtacaga

SEQ ID NO: 130014 - DNA, 25 bp, Mus musculus
actgccccggcctgaggagtacaga

SEQ ID NO: 130015 - DNA, 25 bp, Mus musculus
actgcccctagaatttccactttat

SEQ ID NO: 130016 - DNA, 25 bp, Mus musculus
actgcccctagattttccactttat

SEQ ID NO: 130017 - DNA, 25 bp, Mus musculus
actgcccctagcagtagtactggct

SEQ ID NO: 130018 - DNA, 25 bp, Mus musculus
actgcccctagctgtagtactggct

SEQ ID NO: 130019 - DNA, 25 bp, Mus musculus
actgcccctatgagactgattgtca

SEQ ID NO: 130020 - DNA, 25 bp, Mus musculus
actgcccctatgtgactgattgtca

SEQ ID NO: 130021 - DNA, 25 bp, Mus musculus
actgcccctcaacctaggtggattt

SEQ ID NO: 130022 - DNA, 25 bp, Mus musculus
actgcccctcaagctaggtggattt

SEQ ID NO: 130023 - DNA, 25 bp, Mus musculus
actgcccctcagatacaatttcaaa

SEQ ID NO: 130024 - DNA, 25 bp, Mus musculus
actgcccctcagttacaatttcaaa

SEQ ID NO: 130025 - DNA, 25 bp, Mus musculus
actgcccctgtgatggttttaagct

SEQ ID NO: 130026 - DNA, 25 bp, Mus musculus
actgcccctgtgttggttttaagct

SEQ ID NO: 130027 - DNA, 25 bp, Mus musculus
actgcccgaatccatgtgtgaagcc

SEQ ID NO: 130028 - DNA, 25 bp, Mus musculus
actgcccgaatcgatgtgtgaagcc

SEQ ID NO: 130029 - DNA, 25 bp, Mus musculus
actgcccgacatctgtggccctggg

SEQ ID NO: 130030 - DNA, 25 bp, Mus musculus
actgcccgacatgtgtggccctggg

SEQ ID NO: 130031 - DNA, 25 bp, Mus musculus
actgcccgagatcggtcgctttctg

SEQ ID NO: 130032 - DNA, 25 bp, Mus musculus
actgcccgagatgggtcgctttctg

SEQ ID NO: 130033 - DNA, 25 bp, Mus musculus
actgcccggaggacatggagttcta

SEQ ID NO: 130034 - DNA, 25 bp, Mus musculus
actgcccggaggtcatggagttcta

SEQ ID NO: 130035 - DNA, 25 bp, Mus musculus
actgcccggcggacatttgtatttt

SEQ ID NO: 130036 - DNA, 25 bp, Mus musculus
actgcccggcggtcatttgtatttt

SEQ ID NO: 130037 - DNA, 25 bp, Mus musculus
actgcccggctacgtaccatttcat

SEQ ID NO: 130038 - DNA, 25 bp, Mus musculus
actgcccggctaggtaccatttcat

SEQ ID NO: 130039 - DNA, 25 bp, Mus musculus
actgcccggctcaggtggatctctt

SEQ ID NO: 130040 - DNA, 25 bp, Mus musculus
actgcccggctctggtggatctctt

SEQ ID NO: 130041 - DNA, 25 bp, Mus musculus
actgcccgtgtgagccgcgtcagtc

SEQ ID NO: 130042 - DNA, 25 bp, Mus musculus
actgcccgtgtgtgccgcgtcagtc

SEQ ID NO: 130043 - DNA, 25 bp, Mus musculus
actgccctaagtatctttctgtggg

SEQ ID NO: 130044 - DNA, 25 bp, Mus musculus
actgccctaagtttctttctgtggg

SEQ ID NO: 130045 - DNA, 25 bp, Mus musculus
actgccctacaacaagctctcatga

SEQ ID NO: 130046 - DNA, 25 bp, Mus musculus
actgccctacaagaagctctcatga

SEQ ID NO: 130047 - DNA, 25 bp, Mus musculus
actgccctaggactagaggttggcc

SEQ ID NO: 130048 - DNA, 25 bp, Mus musculus
actgccctaggagtagaggttggcc

SEQ ID NO: 130049 - DNA, 25 bp, Mus musculus
actgccctcaagcactccattaaag

SEQ ID NO: 130050 - DNA, 25 bp, Mus musculus
actgccctcaaggactccattaaag

SEQ ID NO: 130051 - DNA, 25 bp, Mus musculus
actgccctcctactcagagtctatg

SEQ ID NO: 130052 - DNA, 25 bp, Mus musculus
actgccctcctagtcagagtctatg

SEQ ID NO: 130053 - DNA, 25 bp, Mus musculus
actgccctcgggagcctgtgctaag

SEQ ID NO: 130054 - DNA, 25 bp, Mus musculus
actgccctcgggtgcctgtgctaag

SEQ ID NO: 130055 - DNA, 25 bp, Mus musculus
actgccctgaaaaggatgctgacaa

SEQ ID NO: 130056 - DNA, 25 bp, Mus musculus
actgccctgaaatggatgctgacaa

SEQ ID NO: 130057 - DNA, 25 bp, Mus musculus
actgccctgcatacagtgtttgccc

SEQ ID NO: 130058 - DNA, 25 bp, Mus musculus
actgccctgcattcagtgtttgccc

SEQ ID NO: 130059 - DNA, 25 bp, Mus musculus
actgccctgcttcagataacaccta

SEQ ID NO: 130060 - DNA, 25 bp, Mus musculus
actgccctgcttgagataacaccta

SEQ ID NO: 130061 - DNA, 25 bp, Mus musculus
actgccctggtcagtgccgacggtg

SEQ ID NO: 130062 - DNA, 25 bp, Mus musculus
actgccctggtctgtgccgacggtg

SEQ ID NO: 130063 - DNA, 25 bp, Mus musculus
actgccctggtgcacaatatgtgga

SEQ ID NO: 130064 - DNA, 25 bp, Mus musculus
actgccctggtggacaatatgtgga

SEQ ID NO: 130065 - DNA, 25 bp, Mus musculus
actgcccttcacctcagggatgata

SEQ ID NO: 130066 - DNA, 25 bp, Mus musculus
actgcccttcacgtcagggatgata

SEQ ID NO: 130067 - DNA, 25 bp, Mus musculus
actgcccttgttagccgtaggtaag

SEQ ID NO: 130068 - DNA, 25 bp, Mus musculus
actgcccttgtttgccgtaggtaag

SEQ ID NO: 130069 - DNA, 25 bp, Mus musculus
actgccctttagctctgaactctag

SEQ ID NO: 130070 - DNA, 25 bp, Mus musculus
actgccctttaggtctgaactctag

SEQ ID NO: 130071 - DNA, 25 bp, Mus musculus
actgccgacctaaaattgtccagca

SEQ ID NO: 130072 - DNA, 25 bp, Mus musculus
actgccgacctataattgtccagca

SEQ ID NO: 130073 - DNA, 25 bp, Mus musculus
actgccgaccttctggtaattggtt

SEQ ID NO: 130074 - DNA, 25 bp, Mus musculus
actgccgaccttgtggtaattggtt

SEQ ID NO: 130075 - DNA, 25 bp, Mus musculus
actgccgagatcatagtagtgaaga

SEQ ID NO: 130076 - DNA, 25 bp, Mus musculus
actgccgagatcttagtagtgaaga

SEQ ID NO: 130077 - DNA, 25 bp, Mus musculus
actgccgagcctactttctgagggt

SEQ ID NO: 130078 - DNA, 25 bp, Mus musculus
actgccgagccttctttctgagggt

SEQ ID NO: 130079 - DNA, 25 bp, Mus musculus
actgccgagcttccggacagggctt

SEQ ID NO: 130080 - DNA, 25 bp, Mus musculus
actgccgagcttgcggacagggctt

SEQ ID NO: 130081 - DNA, 25 bp, Mus musculus
actgccgccccgcacagagaaggtg

SEQ ID NO: 130082 - DNA, 25 bp, Mus musculus
actgccgccccggacagagaaggtg

SEQ ID NO: 130083 - DNA, 25 bp, Mus musculus
actgccgcccgcaggtgtgtgagaa

SEQ ID NO: 130084 - DNA, 25 bp, Mus musculus
actgccgcccgctggtgtgtgagaa

SEQ ID NO: 130085 - DNA, 25 bp, Mus musculus
actgccgctcttacaggagacttta

SEQ ID NO: 130086 - DNA, 25 bp, Mus musculus
actgccgctctttcaggagacttta

SEQ ID NO: 130087 - DNA, 25 bp, Mus musculus
actgccgctgccatattgaccaggg

SEQ ID NO: 130088 - DNA, 25 bp, Mus musculus
actgccgctgccttattgaccaggg

SEQ ID NO: 130089 - DNA, 25 bp, Mus musculus
actgccggaatcagaagggctccag

SEQ ID NO: 130090 - DNA, 25 bp, Mus musculus
actgccggaatctgaagggctccag

SEQ ID NO: 130091 - DNA, 25 bp, Mus musculus
actgccggcaagctgactgttgtca

SEQ ID NO: 130092 - DNA, 25 bp, Mus musculus
actgccggcaaggtgactgttgtca

SEQ ID NO: 130093 - DNA, 25 bp, Mus musculus
actgccgggctgatgttagagacac

SEQ ID NO: 130094 - DNA, 25 bp, Mus musculus
actgccgggctgttgttagagacac

SEQ ID NO: 130095 - DNA, 25 bp, Mus musculus
actgccgtctgactgtatcgcacaa

SEQ ID NO: 130096 - DNA, 25 bp, Mus musculus
actgccgtctgagtgtatcgcacaa

SEQ ID NO: 130097 - DNA, 25 bp, Mus musculus
actgccgtggctactcagagaatgc

SEQ ID NO: 130098 - DNA, 25 bp, Mus musculus
actgccgtggcttctcagagaatgc

SEQ ID NO: 130099 - DNA, 25 bp, Mus musculus
actgccgtgtggcaaaggcccagca

SEQ ID NO: 130100 - DNA, 25 bp, Mus musculus
actgccgtgtgggaaaggcccagca

SEQ ID NO: 130101 - DNA, 25 bp, Mus musculus
actgcctaacatctgctgtcccaag

SEQ ID NO: 130102 - DNA, 25 bp, Mus musculus
actgcctaacatgtgctgtcccaag

SEQ ID NO: 130103 - DNA, 25 bp, Mus musculus
actgcctaaggtcgccccagagttt

SEQ ID NO: 130104 - DNA, 25 bp, Mus musculus
actgcctaaggtggccccagagttt

SEQ ID NO: 130105 - DNA, 25 bp, Mus musculus
actgcctaatgacagggaggtacct

SEQ ID NO: 130106 - DNA, 25 bp, Mus musculus
actgcctaatgagagggaggtacct

SEQ ID NO: 130107 - DNA, 25 bp, Mus musculus
actgcctaatgcaaccaagaacggt

SEQ ID NO: 130108 - DNA, 25 bp, Mus musculus
actgcctaatgctaccaagaacggt

SEQ ID NO: 130109 - DNA, 25 bp, Mus musculus
actgcctacaatattgacaacatcg

SEQ ID NO: 130110 - DNA, 25 bp, Mus musculus
actgcctacaattttgacaacatcg

SEQ ID NO: 130111 - DNA, 25 bp, Mus musculus
actgcctacggccacattagttacg

SEQ ID NO: 130112 - DNA, 25 bp, Mus musculus
actgcctacggcgacattagttacg

SEQ ID NO: 130113 - DNA, 25 bp, Mus musculus
actgcctactgcaacaattccgaag

SEQ ID NO: 130114 - DNA, 25 bp, Mus musculus
actgcctactgcatatactgcttgg

SEQ ID NO: 130115 - DNA, 25 bp, Mus musculus
actgcctactgctacaattccgaag

SEQ ID NO: 130116 - DNA, 25 bp, Mus musculus
actgcctactgcttatactgcttgg

SEQ ID NO: 130117 - DNA, 25 bp, Mus musculus
actgcctacttcaggaaccgcttga

SEQ ID NO: 130118 - DNA, 25 bp, Mus musculus
actgcctacttctggaaccgcttga

SEQ ID NO: 130119 - DNA, 25 bp, Mus musculus
actgcctagccaatgccatttctgt

SEQ ID NO: 130120 - DNA, 25 bp, Mus musculus
actgcctagccattgccatttctgt

SEQ ID NO: 130121 - DNA, 25 bp, Mus musculus
actgcctaggcaaatacgttttaat

SEQ ID NO: 130122 - DNA, 25 bp, Mus musculus
actgcctaggcatatacgttttaat

SEQ ID NO: 130123 - DNA, 25 bp, Mus musculus
actgcctagggtcctcgaagtcctt

SEQ ID NO: 130124 - DNA, 25 bp, Mus musculus
actgcctagggtgctcgaagtcctt

SEQ ID NO: 130125 - DNA, 25 bp, Mus musculus
actgcctagtgcacagtgtgctcag

SEQ ID NO: 130126 - DNA, 25 bp, Mus musculus
actgcctagtgctcagtgtgctcag

SEQ ID NO: 130127 - DNA, 25 bp, Mus musculus
actgcctatgccaggttgagaggga

SEQ ID NO: 130128 - DNA, 25 bp, Mus musculus
actgcctatgcccaaaggagcttta

SEQ ID NO: 130129 - DNA, 25 bp, Mus musculus
actgcctatgccgaaaggagcttta

SEQ ID NO: 130130 - DNA, 25 bp, Mus musculus
actgcctatgcctggttgagaggga

SEQ ID NO: 130131 - DNA, 25 bp, Mus musculus
actgcctatgtgctaatgcttgtac

SEQ ID NO: 130132 - DNA, 25 bp, Mus musculus
actgcctatgtggtaatgcttgtac

SEQ ID NO: 130133 - DNA, 25 bp, Mus musculus
actgcctattaaacagactatttta

SEQ ID NO: 130134 - DNA, 25 bp, Mus musculus
actgcctattaatcagactatttta

SEQ ID NO: 130135 - DNA, 25 bp, Mus musculus
actgcctatttgattgtctgtattg

SEQ ID NO: 130136 - DNA, 25 bp, Mus musculus
actgcctatttgtttgtctgtattg

SEQ ID NO: 130137 - DNA, 25 bp, Mus musculus
actgcctcaataccctcgttcaagg

SEQ ID NO: 130138 - DNA, 25 bp, Mus musculus
actgcctcaatagcctcgttcaagg

SEQ ID NO: 130139 - DNA, 25 bp, Mus musculus
actgcctcatacaaactattcctga

SEQ ID NO: 130140 - DNA, 25 bp, Mus musculus
actgcctcatactaactattcctga

SEQ ID NO: 130141 - DNA, 25 bp, Mus musculus
actgcctcatggcttgtggatttgc

SEQ ID NO: 130142 - DNA, 25 bp, Mus musculus
actgcctcatgggttgtggatttgc

SEQ ID NO: 130143 - DNA, 25 bp, Mus musculus
actgcctccctgaggcttaatgaga

SEQ ID NO: 130144 - DNA, 25 bp, Mus musculus
actgcctccctgtggcttaatgaga

SEQ ID NO: 130145 - DNA, 25 bp, Mus musculus
actgcctccggacccagaaagtgga

SEQ ID NO: 130146 - DNA, 25 bp, Mus musculus
actgcctccggagccagaaagtgga

SEQ ID NO: 130147 - DNA, 25 bp, Mus musculus
actgcctcgagaatggagtccactg

SEQ ID NO: 130148 - DNA, 25 bp, Mus musculus
actgcctcgagattggagtccactg

SEQ ID NO: 130149 - DNA, 25 bp, Mus musculus
actgcctctcacagtgtgcaatagg

SEQ ID NO: 130150 - DNA, 25 bp, Mus musculus
actgcctctcactgtgtgcaatagg

SEQ ID NO: 130151 - DNA, 25 bp, Mus musculus
actgcctctctaaaggaaattttgg

SEQ ID NO: 130152 - DNA, 25 bp, Mus musculus
actgcctctctataggaaattttgg

SEQ ID NO: 130153 - DNA, 25 bp, Mus musculus
actgcctctgaaatccacgaactca

SEQ ID NO: 130154 - DNA, 25 bp, Mus musculus
actgcctctgaattccacgaactca

SEQ ID NO: 130155 - DNA, 25 bp, Mus musculus
actgcctctttcctcatagcattta

SEQ ID NO: 130156 - DNA, 25 bp, Mus musculus
actgcctctttcgtcatagcattta

SEQ ID NO: 130157 - DNA, 25 bp, Mus musculus
actgcctgacagcagctgagccagt

SEQ ID NO: 130158 - DNA, 25 bp, Mus musculus
actgcctgacaggagctgagccagt

SEQ ID NO: 130159 - DNA, 25 bp, Mus musculus
actgcctgacccactggagtgatga

SEQ ID NO: 130160 - DNA, 25 bp, Mus musculus
actgcctgaccctctggagtgatga

SEQ ID NO: 130161 - DNA, 25 bp, Mus musculus
actgcctgacgtcctgggaactgag

SEQ ID NO: 130162 - DNA, 25 bp, Mus musculus
actgcctgacgtgctgggaactgag

SEQ ID NO: 130163 - DNA, 25 bp, Mus musculus
actgcctgcgctacatagtcctttg

SEQ ID NO: 130164 - DNA, 25 bp, Mus musculus
actgcctgcgcttcatagtcctttg

SEQ ID NO: 130165 - DNA, 25 bp, Mus musculus
actgcctgctgtcattttgtggata

SEQ ID NO: 130166 - DNA, 25 bp, Mus musculus
actgcctgctgtgattttgtggata

SEQ ID NO: 130167 - DNA, 25 bp, Mus musculus
actgcctggagcacaaaaccaaggg

SEQ ID NO: 130168 - DNA, 25 bp, Mus musculus
actgcctggagctcaaaaccaaggg

SEQ ID NO: 130169 - DNA, 25 bp, Mus musculus
actgcctggcaaccttaaatgttcc

SEQ ID NO: 130170 - DNA, 25 bp, Mus musculus
actgcctggcaagcttaaatgttcc

SEQ ID NO: 130171 - DNA, 25 bp, Mus musculus
actgcctggcctagcactcactgtg

SEQ ID NO: 130172 - DNA, 25 bp, Mus musculus
actgcctggccttgcactcactgtg

SEQ ID NO: 130173 - DNA, 25 bp, Mus musculus
actgcctgggatattttaacagctc

SEQ ID NO: 130174 - DNA, 25 bp, Mus musculus
actgcctgggattttttaacagctc

SEQ ID NO: 130175 - DNA, 25 bp, Mus musculus
actgcctggtcgaatgtcaacttga

SEQ ID NO: 130176 - DNA, 25 bp, Mus musculus
actgcctggtcgtatgtcaacttga

SEQ ID NO: 130177 - DNA, 25 bp, Mus musculus
actgcctggtttatgatggtgcacc

SEQ ID NO: 130178 - DNA, 25 bp, Mus musculus
actgcctggtttttgatggtgcacc

SEQ ID NO: 130179 - DNA, 25 bp, Mus musculus
actgcctgtagaacatggctgacac

SEQ ID NO: 130180 - DNA, 25 bp, Mus musculus
actgcctgtagatcatggctgacac

SEQ ID NO: 130181 - DNA, 25 bp, Mus musculus
actgcctgtgagacttgctatccag

SEQ ID NO: 130182 - DNA, 25 bp, Mus musculus
actgcctgtgagtcttgctatccag

SEQ ID NO: 130183 - DNA, 25 bp, Mus musculus
actgcctgtgatagctactctgagg

SEQ ID NO: 130184 - DNA, 25 bp, Mus musculus
actgcctgtgattgctactctgagg

SEQ ID NO: 130185 - DNA, 25 bp, Mus musculus
actgcctgtggtcgtgcagctacag

SEQ ID NO: 130186 - DNA, 25 bp, Mus musculus
actgcctgtggtggtgcagctacag

SEQ ID NO: 130187 - DNA, 25 bp, Mus musculus
actgccttacaccagggatgcatga

SEQ ID NO: 130188 - DNA, 25 bp, Mus musculus
actgccttacacgagggatgcatga

SEQ ID NO: 130189 - DNA, 25 bp, Mus musculus
actgccttacccaaggcctcagttt

SEQ ID NO: 130190 - DNA, 25 bp, Mus musculus
actgccttaccctaggcctcagttt

SEQ ID NO: 130191 - DNA, 25 bp, Mus musculus
actgccttcactacatgtttttggg

SEQ ID NO: 130192 - DNA, 25 bp, Mus musculus
actgccttcacttcatgtttttggg

SEQ ID NO: 130193 - DNA, 25 bp, Mus musculus
actgccttcagacaacaccacatgt

SEQ ID NO: 130194 - DNA, 25 bp, Mus musculus
actgccttcagagaacaccacatgt

SEQ ID NO: 130195 - DNA, 25 bp, Mus musculus
actgccttccatcagggtgggctaa

SEQ ID NO: 130196 - DNA, 25 bp, Mus musculus
actgccttccatgagggtgggctaa

SEQ ID NO: 130197 - DNA, 25 bp, Mus musculus
actgccttcccaagttgatgttttt

SEQ ID NO: 130198 - DNA, 25 bp, Mus musculus
actgccttcccatgttgatgttttt

SEQ ID NO: 130199 - DNA, 25 bp, Mus musculus
actgccttccttatttctccaaaga

SEQ ID NO: 130200 - DNA, 25 bp, Mus musculus
actgccttccttttttctccaaaga

SEQ ID NO: 130201 - DNA, 25 bp, Mus musculus
actgccttctacatgctatgcaaag

SEQ ID NO: 130202 - DNA, 25 bp, Mus musculus
actgccttctacttgctatgcaaag

SEQ ID NO: 130203 - DNA, 25 bp, Mus musculus
actgccttcttcagtgacatcatgc

SEQ ID NO: 130204 - DNA, 25 bp, Mus musculus
actgccttcttctgtgacatcatgc

SEQ ID NO: 130205 - DNA, 25 bp, Mus musculus
actgccttgagtatgtctcctagca

SEQ ID NO: 130206 - DNA, 25 bp, Mus musculus
actgccttgagtttgtctcctagca

SEQ ID NO: 130207 - DNA, 25 bp, Mus musculus
actgccttgatcaatccatcctatg

SEQ ID NO: 130208 - DNA, 25 bp, Mus musculus
actgccttgatctatccatcctatg

SEQ ID NO: 130209 - DNA, 25 bp, Mus musculus
actgccttgcctagagtctatgaag

SEQ ID NO: 130210 - DNA, 25 bp, Mus musculus
actgccttgccttgagtctatgaag

SEQ ID NO: 130211 - DNA, 25 bp, Mus musculus
actgccttggacattgccaagtagg

SEQ ID NO: 130212 - DNA, 25 bp, Mus musculus
actgccttggactttgccaagtagg

SEQ ID NO: 130213 - DNA, 25 bp, Mus musculus
actgccttggagatcggtttgtgta

SEQ ID NO: 130214 - DNA, 25 bp, Mus musculus
actgccttggagttcggtttgtgta

SEQ ID NO: 130215 - DNA, 25 bp, Mus musculus
actgccttggatcccctgaagcaaa

SEQ ID NO: 130216 - DNA, 25 bp, Mus musculus
actgccttggatgccctgaagcaaa

SEQ ID NO: 130217 - DNA, 25 bp, Mus musculus
actgccttggttctttctatctgaa

SEQ ID NO: 130218 - DNA, 25 bp, Mus musculus
actgccttggttgtttctatctgaa

SEQ ID NO: 130219 - DNA, 25 bp, Mus musculus
actgccttgtgtaatagctttctga

SEQ ID NO: 130220 - DNA, 25 bp, Mus musculus
actgccttgtgttatagctttctga

SEQ ID NO: 130221 - DNA, 25 bp, Mus musculus
actgcctttcaccagagggagagcc

SEQ ID NO: 130222 - DNA, 25 bp, Mus musculus
actgcctttcacgagagggagagcc

SEQ ID NO: 130223 - DNA, 25 bp, Mus musculus
actgcctttccacaggcgtggagag

SEQ ID NO: 130224 - DNA, 25 bp, Mus musculus
actgcctttccagaggcgtggagag

SEQ ID NO: 130225 - DNA, 25 bp, Mus musculus
actgcctttcgtagtgggcttcagg

SEQ ID NO: 130226 - DNA, 25 bp, Mus musculus
actgcctttcgttgtgggcttcagg

SEQ ID NO: 130227 - DNA, 25 bp, Mus musculus
actgcctttctcaaataggtgaaca

SEQ ID NO: 130228 - DNA, 25 bp, Mus musculus
actgcctttctctaataggtgaaca

SEQ ID NO: 130229 - DNA, 25 bp, Mus musculus
actgcctttcttagcactgatgtag

SEQ ID NO: 130230 - DNA, 25 bp, Mus musculus
actgcctttctttgcactgatgtag

SEQ ID NO: 130231 - DNA, 25 bp, Mus musculus
actgcctttgatcttgaagtcccga

SEQ ID NO: 130232 - DNA, 25 bp, Mus musculus
actgcctttgatgttgaagtcccga

SEQ ID NO: 130233 - DNA, 25 bp, Mus musculus
actgcctttgcactgactgacttgg

SEQ ID NO: 130234 - DNA, 25 bp, Mus musculus
actgcctttgcagtgactgacttgg

SEQ ID NO: 130235 - DNA, 25 bp, Mus musculus
actgcctttgggagtgggcctgctc

SEQ ID NO: 130236 - DNA, 25 bp, Mus musculus
actgcctttgggattgtaactgctc

SEQ ID NO: 130237 - DNA, 25 bp, Mus musculus
actgcctttgggtgtgggcctgctc

SEQ ID NO: 130238 - DNA, 25 bp, Mus musculus
actgcctttgggtttgtaactgctc

SEQ ID NO: 130239 - DNA, 25 bp, Mus musculus
actgccttttgccagcattctaaat

SEQ ID NO: 130240 - DNA, 25 bp, Mus musculus
actgccttttgcgagcattctaaat

SEQ ID NO: 130241 - DNA, 25 bp, Mus musculus
actgccttttggaggtgctggagat

SEQ ID NO: 130242 - DNA, 25 bp, Mus musculus
actgccttttggtggtgctggagat

SEQ ID NO: 130243 - DNA, 25 bp, Mus musculus
actgcgaactttctaaagctccgcg

SEQ ID NO: 130244 - DNA, 25 bp, Mus musculus
actgcgaactttgtaaagctccgcg

SEQ ID NO: 130245 - DNA, 25 bp, Mus musculus
actgcgaaggaacacagctggaagc

SEQ ID NO: 130246 - DNA, 25 bp, Mus musculus
actgcgaaggaagacagctggaagc

SEQ ID NO: 130247 - DNA, 25 bp, Mus musculus
actgcgaagtctatgttagctctgc

SEQ ID NO: 130248 - DNA, 25 bp, Mus musculus
actgcgaagtctttgttagctctgc

SEQ ID NO: 130249 - DNA, 25 bp, Mus musculus
actgcgacagatatactgcagccca

SEQ ID NO: 130250 - DNA, 25 bp, Mus musculus
actgcgacagatttactgcagccca

SEQ ID NO: 130251 - DNA, 25 bp, Mus musculus
actgcgaccgaactcctacgtgaag

SEQ ID NO: 130252 - DNA, 25 bp, Mus musculus
actgcgaccgaagtcctacgtgaag

SEQ ID NO: 130253 - DNA, 25 bp, Mus musculus
actgcgacgcagagtagttgcttct

SEQ ID NO: 130254 - DNA, 25 bp, Mus musculus
actgcgacgcagtgtagttgcttct

SEQ ID NO: 130255 - DNA, 25 bp, Mus musculus
actgcgactgtactggatgttttgg

SEQ ID NO: 130256 - DNA, 25 bp, Mus musculus
actgcgactgtagtggatgttttgg

SEQ ID NO: 130257 - DNA, 25 bp, Mus musculus
actgcgagaaagctgtttattaaat

SEQ ID NO: 130258 - DNA, 25 bp, Mus musculus
actgcgagaaaggtgtttattaaat

SEQ ID NO: 130259 - DNA, 25 bp, Mus musculus
actgcgagaggaacgggacgtccaa

SEQ ID NO: 130260 - DNA, 25 bp, Mus musculus
actgcgagaggatcgggacgtccaa

SEQ ID NO: 130261 - DNA, 25 bp, Mus musculus
actgcgagcaatctcttaaggaaga

SEQ ID NO: 130262 - DNA, 25 bp, Mus musculus
actgcgagcaatgtcttaaggaaga

SEQ ID NO: 130263 - DNA, 25 bp, Mus musculus
actgcgagcaccaggattacgtgaa

SEQ ID NO: 130264 - DNA, 25 bp, Mus musculus
actgcgagcacctggattacgtgaa

SEQ ID NO: 130265 - DNA, 25 bp, Mus musculus
actgcgaggtttacctgcacgcggc

SEQ ID NO: 130266 - DNA, 25 bp, Mus musculus
actgcgaggttttcctgcacgcggc

SEQ ID NO: 130267 - DNA, 25 bp, Mus musculus
actgcgataccaaaggccaagccaa

SEQ ID NO: 130268 - DNA, 25 bp, Mus musculus
actgcgataccataggccaagccaa

SEQ ID NO: 130269 - DNA, 25 bp, Mus musculus
actgcgatcagcacttacaaaccat

SEQ ID NO: 130270 - DNA, 25 bp, Mus musculus
actgcgatcagctcttacaaaccat

SEQ ID NO: 130271 - DNA, 25 bp, Mus musculus
actgcgattacgattgttttctaga

SEQ ID NO: 130272 - DNA, 25 bp, Mus musculus
actgcgattacgtttgttttctaga

SEQ ID NO: 130273 - DNA, 25 bp, Mus musculus
actgcgcaatggattcaccatcact

SEQ ID NO: 130274 - DNA, 25 bp, Mus musculus
actgcgcaatggtttcaccatcact

SEQ ID NO: 130275 - DNA, 25 bp, Mus musculus
actgcgccttgcacatacatgtggg

SEQ ID NO: 130276 - DNA, 25 bp, Mus musculus
actgcgccttgctcatacatgtggg

SEQ ID NO: 130277 - DNA, 25 bp, Mus musculus
actgcgctaccaagacaaccttttt

SEQ ID NO: 130278 - DNA, 25 bp, Mus musculus
actgcgctaccatgacaaccttttt

SEQ ID NO: 130279 - DNA, 25 bp, Mus musculus
actgcgctcacacacaggcgaggag

SEQ ID NO: 130280 - DNA, 25 bp, Mus musculus
actgcgctcacagacaggcgaggag

SEQ ID NO: 130281 - DNA, 25 bp, Mus musculus
actgcgctcagtctcacattttcag

SEQ ID NO: 130282 - DNA, 25 bp, Mus musculus
actgcgctcagtgtcacattttcag

SEQ ID NO: 130283 - DNA, 25 bp, Mus musculus
actgcgctgcgtacagattcatgag

SEQ ID NO: 130284 - DNA, 25 bp, Mus musculus
actgcgctgcgttcagattcatgag

SEQ ID NO: 130285 - DNA, 25 bp, Mus musculus
actgcgcttgctctatttgaaccca

SEQ ID NO: 130286 - DNA, 25 bp, Mus musculus
actgcgcttgctgtatttgaaccca

SEQ ID NO: 130287 - DNA, 25 bp, Mus musculus
actgcggatcctccaggctctgggt

SEQ ID NO: 130288 - DNA, 25 bp, Mus musculus
actgcggatcctgcaggctctgggt

SEQ ID NO: 130289 - DNA, 25 bp, Mus musculus
actgcggattccacttgagtcagac

SEQ ID NO: 130290 - DNA, 25 bp, Mus musculus
actgcggattcctcttgagtcagac

SEQ ID NO: 130291 - DNA, 25 bp, Mus musculus
actgcggccaagcagagatcataca

SEQ ID NO: 130292 - DNA, 25 bp, Mus musculus
actgcggccaaggagagatcataca

SEQ ID NO: 130293 - DNA, 25 bp, Mus musculus
actgcggcctctctggtgagtccat

SEQ ID NO: 130294 - DNA, 25 bp, Mus musculus
actgcggcctctgtggtgagtccat

SEQ ID NO: 130295 - DNA, 25 bp, Mus musculus
actgcggcgaaaacacgtgacctta

SEQ ID NO: 130296 - DNA, 25 bp, Mus musculus
actgcggcgaaatcacgtgacctta

SEQ ID NO: 130297 - DNA, 25 bp, Mus musculus
actgcggctaccatgcacaggacga

SEQ ID NO: 130298 - DNA, 25 bp, Mus musculus
actgcggctaccttgcacaggacga

SEQ ID NO: 130299 - DNA, 25 bp, Mus musculus
actgcggctcctatgtgttgaatat

SEQ ID NO: 130300 - DNA, 25 bp, Mus musculus
actgcggctcctttgtgttgaatat

SEQ ID NO: 130301 - DNA, 25 bp, Mus musculus
actgcggctgccatagagagcacat

SEQ ID NO: 130302 - DNA, 25 bp, Mus musculus
actgcggctgccttagagagcacat

SEQ ID NO: 130303 - DNA, 25 bp, Mus musculus
actgcgggcagccattctgaacacg

SEQ ID NO: 130304 - DNA, 25 bp, Mus musculus
actgcgggcagcgattctgaacacg

SEQ ID NO: 130305 - DNA, 25 bp, Mus musculus
actgcgggcgtgcagctgtttcctc

SEQ ID NO: 130306 - DNA, 25 bp, Mus musculus
actgcgggcgtggagctgtttcctc

SEQ ID NO: 130307 - DNA, 25 bp, Mus musculus
actgcgggctttatctaagctgaga

SEQ ID NO: 130308 - DNA, 25 bp, Mus musculus
actgcgggctttttctaagctgaga

SEQ ID NO: 130309 - DNA, 25 bp, Mus musculus
actgcggtacttctgtggttcactg

SEQ ID NO: 130310 - DNA, 25 bp, Mus musculus
actgcggtacttgtgtggttcactg

SEQ ID NO: 130311 - DNA, 25 bp, Mus musculus
actgcggtagccctcattggagtct

SEQ ID NO: 130312 - DNA, 25 bp, Mus musculus
actgcggtagccgtcattggagtct

SEQ ID NO: 130313 - DNA, 25 bp, Mus musculus
actgcgtatcccaaggcactgaaga

SEQ ID NO: 130314 - DNA, 25 bp, Mus musculus
actgcgtatccctaggcactgaaga

SEQ ID NO: 130315 - DNA, 25 bp, Mus musculus
actgcgtctgccctttgtagagcac

SEQ ID NO: 130316 - DNA, 25 bp, Mus musculus
actgcgtctgccgtttgtagagcac

SEQ ID NO: 130317 - DNA, 25 bp, Mus musculus
actgcgtgcaatctgcagaagcaga

SEQ ID NO: 130318 - DNA, 25 bp, Mus musculus
actgcgtgcaatgtgcagaagcaga

SEQ ID NO: 130319 - DNA, 25 bp, Mus musculus
actgcgtgccacatagtttctcagt

SEQ ID NO: 130320 - DNA, 25 bp, Mus musculus
actgcgtgccacttagtttctcagt

SEQ ID NO: 130321 - DNA, 25 bp, Mus musculus
actgcgtggtgtaaactgttgttaa

SEQ ID NO: 130322 - DNA, 25 bp, Mus musculus
actgcgtggtgttaactgttgttaa

SEQ ID NO: 130323 - DNA, 25 bp, Mus musculus
actgcgtgtccgctgccaggtaaca

SEQ ID NO: 130324 - DNA, 25 bp, Mus musculus
actgcgtgtccggtgccaggtaaca

SEQ ID NO: 130325 - DNA, 25 bp, Mus musculus
actgcgttctctcgaacctggtgcc

SEQ ID NO: 130326 - DNA, 25 bp, Mus musculus
actgcgttctctggaacctggtgcc

SEQ ID NO: 130327 - DNA, 25 bp, Mus musculus
actgcgttgtgtcgaggactgcttc

SEQ ID NO: 130328 - DNA, 25 bp, Mus musculus
actgcgttgtgtggaggactgcttc

SEQ ID NO: 130329 - DNA, 25 bp, Mus musculus
actgctaaaactacctactgtgatg

SEQ ID NO: 130330 - DNA, 25 bp, Mus musculus
actgctaaaacttcctactgtgatg

SEQ ID NO: 130331 - DNA, 25 bp, Mus musculus
actgctaaagtccactgccaggtgt

SEQ ID NO: 130332 - DNA, 25 bp, Mus musculus
actgctaaagtcgactgccaggtgt

SEQ ID NO: 130333 - DNA, 25 bp, Mus musculus
actgctaactacacaaacggctata

SEQ ID NO: 130334 - DNA, 25 bp, Mus musculus
actgctaactactcaaacggctata

SEQ ID NO: 130335 - DNA, 25 bp, Mus musculus
actgctaagaagctactagaaaagg

SEQ ID NO: 130336 - DNA, 25 bp, Mus musculus
actgctaagaaggtactagaaaagg

SEQ ID NO: 130337 - DNA, 25 bp, Mus musculus
actgctaagcagagtgttgtattat

SEQ ID NO: 130338 - DNA, 25 bp, Mus musculus
actgctaagcagtgtgttgtattat

SEQ ID NO: 130339 - DNA, 25 bp, Mus musculus
actgctaagccaatctcatgcacat

SEQ ID NO: 130340 - DNA, 25 bp, Mus musculus
actgctaagccattctcatgcacat

SEQ ID NO: 130341 - DNA, 25 bp, Mus musculus
actgctaagttccatgtgattccaa

SEQ ID NO: 130342 - DNA, 25 bp, Mus musculus
actgctaagttcgatgtgattccaa

SEQ ID NO: 130343 - DNA, 25 bp, Mus musculus
actgctacaagcaactcttcagcta

SEQ ID NO: 130344 - DNA, 25 bp, Mus musculus
actgctacaagctactcttcagcta

SEQ ID NO: 130345 - DNA, 25 bp, Mus musculus
actgctacagcaactcaccgaggaa

SEQ ID NO: 130346 - DNA, 25 bp, Mus musculus
actgctacagcatctcaccgaggaa

SEQ ID NO: 130347 - DNA, 25 bp, Mus musculus
actgctacatagagggagcccgctg

SEQ ID NO: 130348 - DNA, 25 bp, Mus musculus
actgctacatagtgggagcccgctg

SEQ ID NO: 130349 - DNA, 25 bp, Mus musculus
actgctacatccctggagttcaagg

SEQ ID NO: 130350 - DNA, 25 bp, Mus musculus
actgctacatccgtggagttcaagg

SEQ ID NO: 130351 - DNA, 25 bp, Mus musculus
actgctaccacgatcctttcttggg

SEQ ID NO: 130352 - DNA, 25 bp, Mus musculus
actgctaccacgttcctttcttggg

SEQ ID NO: 130353 - DNA, 25 bp, Mus musculus
actgctaccatcagtaaactccaaa

SEQ ID NO: 130354 - DNA, 25 bp, Mus musculus
actgctaccatctgtaaactccaaa

SEQ ID NO: 130355 - DNA, 25 bp, Mus musculus
actgctaccatgaatgcctgtgtgc

SEQ ID NO: 130356 - DNA, 25 bp, Mus musculus
actgctaccatgtatgcctgtgtgc

SEQ ID NO: 130357 - DNA, 25 bp, Mus musculus
actgctactgaaattcccagtgctg

SEQ ID NO: 130358 - DNA, 25 bp, Mus musculus
actgctactgaatttcccagtgctg

SEQ ID NO: 130359 - DNA, 25 bp, Mus musculus
actgctagagagcctgtgtgtgaca

SEQ ID NO: 130360 - DNA, 25 bp, Mus musculus
actgctagagaggctgtgtgtgaca

SEQ ID NO: 130361 - DNA, 25 bp, Mus musculus
actgctagagcaacatcctgaaaat

SEQ ID NO: 130362 - DNA, 25 bp, Mus musculus
actgctagagcatcatcctgaaaat

SEQ ID NO: 130363 - DNA, 25 bp, Mus musculus
actgctagctttaattcttggctta

SEQ ID NO: 130364 - DNA, 25 bp, Mus musculus
actgctagcttttattcttggctta

SEQ ID NO: 130365 - DNA, 25 bp, Mus musculus
actgctaggcagcttgatttgggcc

SEQ ID NO: 130366 - DNA, 25 bp, Mus musculus
actgctaggcaggttgatttgggcc

SEQ ID NO: 130367 - DNA, 25 bp, Mus musculus
actgctaggcgcctcttggagctgc

SEQ ID NO: 130368 - DNA, 25 bp, Mus musculus
actgctaggcgcgtcttggagctgc

SEQ ID NO: 130369 - DNA, 25 bp, Mus musculus
actgctagggacaccgactgaggaa

SEQ ID NO: 130370 - DNA, 25 bp, Mus musculus
actgctagggactccgactgaggaa

SEQ ID NO: 130371 - DNA, 25 bp, Mus musculus
actgctagtgtgacctgggttccca

SEQ ID NO: 130372 - DNA, 25 bp, Mus musculus
actgctagtgtgtcctgggttccca

SEQ ID NO: 130373 - DNA, 25 bp, Mus musculus
actgctatatccctagctactagta

SEQ ID NO: 130374 - DNA, 25 bp, Mus musculus
actgctatatccctgaggtgttttc

SEQ ID NO: 130375 - DNA, 25 bp, Mus musculus
actgctatatccgtagctactagta

SEQ ID NO: 130376 - DNA, 25 bp, Mus musculus
actgctatatccgtgaggtgttttc

SEQ ID NO: 130377 - DNA, 25 bp, Mus musculus
actgctatatttcgcctgtgttctt

SEQ ID NO: 130378 - DNA, 25 bp, Mus musculus
actgctatatttggcctgtgttctt

SEQ ID NO: 130379 - DNA, 25 bp, Mus musculus
actgctatcatcctactcagatgcg

SEQ ID NO: 130380 - DNA, 25 bp, Mus musculus
actgctatcatcgtactcagatgcg

SEQ ID NO: 130381 - DNA, 25 bp, Mus musculus
actgctatccataccagatgcattt

SEQ ID NO: 130382 - DNA, 25 bp, Mus musculus
actgctatccattccagatgcattt

SEQ ID NO: 130383 - DNA, 25 bp, Mus musculus
actgctatccctctaggctatggtg

SEQ ID NO: 130384 - DNA, 25 bp, Mus musculus
actgctatccctgtaggctatggtg

SEQ ID NO: 130385 - DNA, 25 bp, Mus musculus
actgctatgcctagtttcagatacc

SEQ ID NO: 130386 - DNA, 25 bp, Mus musculus
actgctatgccttgtttcagatacc

SEQ ID NO: 130387 - DNA, 25 bp, Mus musculus
actgctatggatatgataaaaactg

SEQ ID NO: 130388 - DNA, 25 bp, Mus musculus
actgctatggatttgataaaaactg

SEQ ID NO: 130389 - DNA, 25 bp, Mus musculus
actgctattaaacccctcgctgata

SEQ ID NO: 130390 - DNA, 25 bp, Mus musculus
actgctattaaagccctcgctgata

SEQ ID NO: 130391 - DNA, 25 bp, Mus musculus
actgctattatactcattgtgttgt

SEQ ID NO: 130392 - DNA, 25 bp, Mus musculus
actgctattatagtcattgtgttgt

SEQ ID NO: 130393 - DNA, 25 bp, Mus musculus
actgctcaacgtattcccaaatgtg

SEQ ID NO: 130394 - DNA, 25 bp, Mus musculus
actgctcaacgttttcccaaatgtg

SEQ ID NO: 130395 - DNA, 25 bp, Mus musculus
actgctcacattcatgtcttcttgt

SEQ ID NO: 130396 - DNA, 25 bp, Mus musculus
actgctcacattgatgtcttcttgt

SEQ ID NO: 130397 - DNA, 25 bp, Mus musculus
actgctcactcactgtctccagtta

SEQ ID NO: 130398 - DNA, 25 bp, Mus musculus
actgctcactcagtgtctccagtta

SEQ ID NO: 130399 - DNA, 25 bp, Mus musculus
actgctcagcatctgcatctacaga

SEQ ID NO: 130400 - DNA, 25 bp, Mus musculus
actgctcagcatgtgcatctacaga

SEQ ID NO: 130401 - DNA, 25 bp, Mus musculus
actgctcagcttacttggagaccag

SEQ ID NO: 130402 - DNA, 25 bp, Mus musculus
actgctcagctttcttggagaccag

SEQ ID NO: 130403 - DNA, 25 bp, Mus musculus
actgctcagtctccacagctaatgg

SEQ ID NO: 130404 - DNA, 25 bp, Mus musculus
actgctcagtctgcacagctaatgg

SEQ ID NO: 130405 - DNA, 25 bp, Mus musculus
actgctcagttgacttattgtccac

SEQ ID NO: 130406 - DNA, 25 bp, Mus musculus
actgctcagttgtcttattgtccac

SEQ ID NO: 130407 - DNA, 25 bp, Mus musculus
actgctcatgacacatttgatatta

SEQ ID NO: 130408 - DNA, 25 bp, Mus musculus
actgctcatgactcatttgatatta

SEQ ID NO: 130409 - DNA, 25 bp, Mus musculus
actgctcatgcccatatcttacagg

SEQ ID NO: 130410 - DNA, 25 bp, Mus musculus
actgctcatgccgatatcttacagg

SEQ ID NO: 130411 - DNA, 25 bp, Mus musculus
actgctccagcaaaacatcatgtag

SEQ ID NO: 130412 - DNA, 25 bp, Mus musculus
actgctccagcataacatcatgtag

SEQ ID NO: 130413 - DNA, 25 bp, Mus musculus
actgctccagggaatacgatgacct

SEQ ID NO: 130414 - DNA, 25 bp, Mus musculus
actgctccagggtatacgatgacct

SEQ ID NO: 130415 - DNA, 25 bp, Mus musculus
actgctccagttctgtcctttttcc

SEQ ID NO: 130416 - DNA, 25 bp, Mus musculus
actgctccagttgtgtcctttttcc

SEQ ID NO: 130417 - DNA, 25 bp, Mus musculus
actgctccatcactttagtagacag

SEQ ID NO: 130418 - DNA, 25 bp, Mus musculus
actgctccatcagtttagtagacag

SEQ ID NO: 130419 - DNA, 25 bp, Mus musculus
actgctcccatcagtccggtgagag

SEQ ID NO: 130420 - DNA, 25 bp, Mus musculus
actgctcccatctgtccggtgagag

SEQ ID NO: 130421 - DNA, 25 bp, Mus musculus
actgctccggaaacacgggcgcgtt

SEQ ID NO: 130422 - DNA, 25 bp, Mus musculus
actgctccggaatcacgggcgcgtt

SEQ ID NO: 130423 - DNA, 25 bp, Mus musculus
actgctccgtgtcgtcatggaaggc

SEQ ID NO: 130424 - DNA, 25 bp, Mus musculus
actgctccgtgtggtcatggaaggc

SEQ ID NO: 130425 - DNA, 25 bp, Mus musculus
actgctcctacaagggccacttcga

SEQ ID NO: 130426 - DNA, 25 bp, Mus musculus
actgctcctacatgggccacttcga

SEQ ID NO: 130427 - DNA, 25 bp, Mus musculus
actgctcctgagacttatttataag

SEQ ID NO: 130428 - DNA, 25 bp, Mus musculus
actgctcctgagtcttatttataag

SEQ ID NO: 130429 - DNA, 25 bp, Mus musculus
actgctcctgcccaaggtgtattat

SEQ ID NO: 130430 - DNA, 25 bp, Mus musculus
actgctcctgccgaaggtgtattat

SEQ ID NO: 130431 - DNA, 25 bp, Mus musculus
actgctcctgttatctccttggaga

SEQ ID NO: 130432 - DNA, 25 bp, Mus musculus
actgctcctgttttctccttggaga

SEQ ID NO: 130433 - DNA, 25 bp, Mus musculus
actgctcctttaacagctttgccaa

SEQ ID NO: 130434 - DNA, 25 bp, Mus musculus
actgctcctttatcagctttgccaa

SEQ ID NO: 130435 - DNA, 25 bp, Mus musculus
actgctcctttcacactttcgtttt

SEQ ID NO: 130436 - DNA, 25 bp, Mus musculus
actgctcctttctcactttcgtttt

SEQ ID NO: 130437 - DNA, 25 bp, Mus musculus
actgctcgtattatttctgctcacc

SEQ ID NO: 130438 - DNA, 25 bp, Mus musculus
actgctcgtattttttctgctcacc

SEQ ID NO: 130439 - DNA, 25 bp, Mus musculus
actgctctaatcaatcaatgcctac

SEQ ID NO: 130440 - DNA, 25 bp, Mus musculus
actgctctaatctatcaatgcctac

SEQ ID NO: 130441 - DNA, 25 bp, Mus musculus
actgctctacaacaggtgctgaaga

SEQ ID NO: 130442 - DNA, 25 bp, Mus musculus
actgctctacaagaggtgctgaaga

SEQ ID NO: 130443 - DNA, 25 bp, Mus musculus
actgctctaccaattgatgcctctt

SEQ ID NO: 130444 - DNA, 25 bp, Mus musculus
actgctctaccatttgatgcctctt

SEQ ID NO: 130445 - DNA, 25 bp, Mus musculus
actgctctaccgatacatcaacaaa

SEQ ID NO: 130446 - DNA, 25 bp, Mus musculus
actgctctaccgttacatcaacaaa

SEQ ID NO: 130447 - DNA, 25 bp, Mus musculus
actgctctactcagggtttccagat

SEQ ID NO: 130448 - DNA, 25 bp, Mus musculus
actgctctactctgggtttccagat

SEQ ID NO: 130449 - DNA, 25 bp, Mus musculus
actgctctactgatgagcctggaca

SEQ ID NO: 130450 - DNA, 25 bp, Mus musculus
actgctctactgttgagcctggaca

SEQ ID NO: 130451 - DNA, 25 bp, Mus musculus
actgctctagacagtgggctctgcc

SEQ ID NO: 130452 - DNA, 25 bp, Mus musculus
actgctctagacatccatagtagga

SEQ ID NO: 130453 - DNA, 25 bp, Mus musculus
actgctctagactgtgggctctgcc

SEQ ID NO: 130454 - DNA, 25 bp, Mus musculus
actgctctagacttccatagtagga

SEQ ID NO: 130455 - DNA, 25 bp, Mus musculus
actgctctagatattgctccagaaa

SEQ ID NO: 130456 - DNA, 25 bp, Mus musculus
actgctctagattttgctccagaaa

SEQ ID NO: 130457 - DNA, 25 bp, Mus musculus
actgctctatttcttgggagaccca

SEQ ID NO: 130458 - DNA, 25 bp, Mus musculus
actgctctatttgttgggagaccca

SEQ ID NO: 130459 - DNA, 25 bp, Mus musculus
actgctctcaatctggatcaacaca

SEQ ID NO: 130460 - DNA, 25 bp, Mus musculus
actgctctcaatgtggatcaacaca

SEQ ID NO: 130461 - DNA, 25 bp, Mus musculus
actgctctctgacgcaagtttccag

SEQ ID NO: 130462 - DNA, 25 bp, Mus musculus
actgctctctgaggcaagtttccag

SEQ ID NO: 130463 - DNA, 25 bp, Mus musculus
actgctctctgtccaataggcatga

SEQ ID NO: 130464 - DNA, 25 bp, Mus musculus
actgctctctgtgcaataggcatga

SEQ ID NO: 130465 - DNA, 25 bp, Mus musculus
actgctctcttgcagaagtgcccac

SEQ ID NO: 130466 - DNA, 25 bp, Mus musculus
actgctctcttggagaagtgcccac

SEQ ID NO: 130467 - DNA, 25 bp, Mus musculus
actgctctctttcggacctggccgt

SEQ ID NO: 130468 - DNA, 25 bp, Mus musculus
actgctctctttgggacctggccgt

SEQ ID NO: 130469 - DNA, 25 bp, Mus musculus
actgctctgactatctgagatcggc

SEQ ID NO: 130470 - DNA, 25 bp, Mus musculus
actgctctgactttctgagatcggc

SEQ ID NO: 130471 - DNA, 25 bp, Mus musculus
actgctctgctgattccagtctgta

SEQ ID NO: 130472 - DNA, 25 bp, Mus musculus
actgctctgctgtttccagtctgta

SEQ ID NO: 130473 - DNA, 25 bp, Mus musculus
actgctctggctcctagcaccatga

SEQ ID NO: 130474 - DNA, 25 bp, Mus musculus
actgctctggctgctagcaccatga

SEQ ID NO: 130475 - DNA, 25 bp, Mus musculus
actgctctgggcactaagactaagg

SEQ ID NO: 130476 - DNA, 25 bp, Mus musculus
actgctctgggctctaagactaagg

SEQ ID NO: 130477 - DNA, 25 bp, Mus musculus
actgctctgttgagatgaaatgtgc

SEQ ID NO: 130478 - DNA, 25 bp, Mus musculus
actgctctgttgtgatgaaatgtgc

SEQ ID NO: 130479 - DNA, 25 bp, Mus musculus
actgctcttaccaggatcccctaaa

SEQ ID NO: 130480 - DNA, 25 bp, Mus musculus
actgctcttacctggatcccctaaa

SEQ ID NO: 130481 - DNA, 25 bp, Mus musculus
actgctcttagtcccaaatgtagtg

SEQ ID NO: 130482 - DNA, 25 bp, Mus musculus
actgctcttagtgccaaatgtagtg

SEQ ID NO: 130483 - DNA, 25 bp, Mus musculus
actgctcttccacccttataagtaa

SEQ ID NO: 130484 - DNA, 25 bp, Mus musculus
actgctcttccagccttataagtaa

SEQ ID NO: 130485 - DNA, 25 bp, Mus musculus
actgctcttgagacagaactcgccc

SEQ ID NO: 130486 - DNA, 25 bp, Mus musculus
actgctcttgagtcagaactcgccc

SEQ ID NO: 130487 - DNA, 25 bp, Mus musculus
actgctcttgctcagaacccaagtt

SEQ ID NO: 130488 - DNA, 25 bp, Mus musculus
actgctcttgctgagaacccaagtt

SEQ ID NO: 130489 - DNA, 25 bp, Mus musculus
actgctcttggaagccctggctttc

SEQ ID NO: 130490 - DNA, 25 bp, Mus musculus
actgctcttggatgccctggctttc

SEQ ID NO: 130491 - DNA, 25 bp, Mus musculus
actgctcttgtcattaagacttcac

SEQ ID NO: 130492 - DNA, 25 bp, Mus musculus
actgctcttgtctttaagacttcac

SEQ ID NO: 130493 - DNA, 25 bp, Mus musculus
actgctcttgtgaagggtgtgagtt

SEQ ID NO: 130494 - DNA, 25 bp, Mus musculus
actgctcttgtgtagggtgtgagtt

SEQ ID NO: 130495 - DNA, 25 bp, Mus musculus
actgctcttgttcatgccttttaaa

SEQ ID NO: 130496 - DNA, 25 bp, Mus musculus
actgctcttgttgatgccttttaaa

SEQ ID NO: 130497 - DNA, 25 bp, Mus musculus
actgctctttaactgttctattgga

SEQ ID NO: 130498 - DNA, 25 bp, Mus musculus
actgctctttaagtgttctattgga

SEQ ID NO: 130499 - DNA, 25 bp, Mus musculus
actgctctttcacccaagtttcaga

SEQ ID NO: 130500 - DNA, 25 bp, Mus musculus
actgctctttcagccaagtttcaga

SEQ ID NO: 130501 - DNA, 25 bp, Mus musculus
actgctctttctatctccagaattg

SEQ ID NO: 130502 - DNA, 25 bp, Mus musculus
actgctctttctttctccagaattg

SEQ ID NO: 130503 - DNA, 25 bp, Mus musculus
actgctgaacctcatccagaatgat

SEQ ID NO: 130504 - DNA, 25 bp, Mus musculus
actgctgaacctgatccagaatgat

SEQ ID NO: 130505 - DNA, 25 bp, Mus musculus
actgctgaaggcaggcattgcctca

SEQ ID NO: 130506 - DNA, 25 bp, Mus musculus
actgctgaaggctggcattgcctca

SEQ ID NO: 130507 - DNA, 25 bp, Mus musculus
actgctgaagggaagcgctctgcct

SEQ ID NO: 130508 - DNA, 25 bp, Mus musculus
actgctgaagggtagcgctctgcct

SEQ ID NO: 130509 - DNA, 25 bp, Mus musculus
actgctgaagtacgaccactgtgtg

SEQ ID NO: 130510 - DNA, 25 bp, Mus musculus
actgctgaagtaggaccactgtgtg

SEQ ID NO: 130511 - DNA, 25 bp, Mus musculus
actgctgaagtgaaatcttgctgac

SEQ ID NO: 130512 - DNA, 25 bp, Mus musculus
actgctgaagtgtaatcttgctgac

SEQ ID NO: 130513 - DNA, 25 bp, Mus musculus
actgctgacaaactatggctatttt

SEQ ID NO: 130514 - DNA, 25 bp, Mus musculus
actgctgacaaagtatggctatttt

SEQ ID NO: 130515 - DNA, 25 bp, Mus musculus
actgctgacactactgcaatccaga

SEQ ID NO: 130516 - DNA, 25 bp, Mus musculus
actgctgacacttctgcaatccaga

SEQ ID NO: 130517 - DNA, 25 bp, Mus musculus
actgctgacaggcaccaggctttct

SEQ ID NO: 130518 - DNA, 25 bp, Mus musculus
actgctgacagggaccaggctttct

SEQ ID NO: 130519 - DNA, 25 bp, Mus musculus
actgctgacagtcccacggcctttg

SEQ ID NO: 130520 - DNA, 25 bp, Mus musculus
actgctgacagtgccacggcctttg

SEQ ID NO: 130521 - DNA, 25 bp, Mus musculus
actgctgacccgatttttgaggtgc

SEQ ID NO: 130522 - DNA, 25 bp, Mus musculus
actgctgacccgttttttgaggtgc

SEQ ID NO: 130523 - DNA, 25 bp, Mus musculus
actgctgaccgacatccggaagaca

SEQ ID NO: 130524 - DNA, 25 bp, Mus musculus
actgctgaccgagatccggaagaca

SEQ ID NO: 130525 - DNA, 25 bp, Mus musculus
actgctgacgctaggctgggtcgat

SEQ ID NO: 130526 - DNA, 25 bp, Mus musculus
actgctgacgcttggctgggtcgat

SEQ ID NO: 130527 - DNA, 25 bp, Mus musculus
actgctgactggagcttggcaggca

SEQ ID NO: 130528 - DNA, 25 bp, Mus musculus
actgctgactggtgcttggcaggca

SEQ ID NO: 130529 - DNA, 25 bp, Mus musculus
actgctgacttcaagtgtggaggtt

SEQ ID NO: 130530 - DNA, 25 bp, Mus musculus
actgctgacttctagtgtggaggtt

SEQ ID NO: 130531 - DNA, 25 bp, Mus musculus
actgctgagaggctaaggtctcact

SEQ ID NO: 130532 - DNA, 25 bp, Mus musculus
actgctgagagggtaaggtctcact

SEQ ID NO: 130533 - DNA, 25 bp, Mus musculus
actgctgagcaaagataaccgcttc

SEQ ID NO: 130534 - DNA, 25 bp, Mus musculus
actgctgagcaatgataaccgcttc

SEQ ID NO: 130535 - DNA, 25 bp, Mus musculus
actgctgagtagacaggccttttct

SEQ ID NO: 130536 - DNA, 25 bp, Mus musculus
actgctgagtagtcaggccttttct

SEQ ID NO: 130537 - DNA, 25 bp, Mus musculus
actgctgagtcgcacacttggaaaa

SEQ ID NO: 130538 - DNA, 25 bp, Mus musculus
actgctgagtcggacacttggaaaa

SEQ ID NO: 130539 - DNA, 25 bp, Mus musculus
actgctgagttcaacatctatagag

SEQ ID NO: 130540 - DNA, 25 bp, Mus musculus
actgctgagttctacatctatagag

SEQ ID NO: 130541 - DNA, 25 bp, Mus musculus
actgctgatacgactttgaggccaa

SEQ ID NO: 130542 - DNA, 25 bp, Mus musculus
actgctgatacgtctttgaggccaa

SEQ ID NO: 130543 - DNA, 25 bp, Mus musculus
actgctgatcttcagactatcatca

SEQ ID NO: 130544 - DNA, 25 bp, Mus musculus
actgctgatcttgagactatcatca

SEQ ID NO: 130545 - DNA, 25 bp, Mus musculus
actgctgattggagactctggtctg

SEQ ID NO: 130546 - DNA, 25 bp, Mus musculus
actgctgattggtgactctggtctg

SEQ ID NO: 130547 - DNA, 25 bp, Mus musculus
actgctgcaaggaaaggccctcttt

SEQ ID NO: 130548 - DNA, 25 bp, Mus musculus
actgctgcaaggcagtctgggacac

SEQ ID NO: 130549 - DNA, 25 bp, Mus musculus
actgctgcaagggagtctgggacac

SEQ ID NO: 130550 - DNA, 25 bp, Mus musculus
actgctgcaaggtaaggccctcttt

SEQ ID NO: 130551 - DNA, 25 bp, Mus musculus
actgctgcaatcactacctaagttg

SEQ ID NO: 130552 - DNA, 25 bp, Mus musculus
actgctgcaatccttactccagaaa

SEQ ID NO: 130553 - DNA, 25 bp, Mus musculus
actgctgcaatcgttactccagaaa

SEQ ID NO: 130554 - DNA, 25 bp, Mus musculus
actgctgcaatctctacctaagttg

SEQ ID NO: 130555 - DNA, 25 bp, Mus musculus
actgctgcagagctctttgttttgc

SEQ ID NO: 130556 - DNA, 25 bp, Mus musculus
actgctgcagaggtctttgttttgc

SEQ ID NO: 130557 - DNA, 25 bp, Mus musculus
actgctgcagccacagatcatgtca

SEQ ID NO: 130558 - DNA, 25 bp, Mus musculus
actgctgcagcctcagatcatgtca

SEQ ID NO: 130559 - DNA, 25 bp, Mus musculus
actgctgcatatcaagactctgccc

SEQ ID NO: 130560 - DNA, 25 bp, Mus musculus
actgctgcatatgaagactctgccc

SEQ ID NO: 130561 - DNA, 25 bp, Mus musculus
actgctgcattgaggcaatccctat

SEQ ID NO: 130562 - DNA, 25 bp, Mus musculus
actgctgcattgtggcaatccctat

SEQ ID NO: 130563 - DNA, 25 bp, Mus musculus
actgctgcccttcagaatgggttct

SEQ ID NO: 130564 - DNA, 25 bp, Mus musculus
actgctgcccttgagaatgggttct

SEQ ID NO: 130565 - DNA, 25 bp, Mus musculus
actgctgccgttagaaatcctgttt

SEQ ID NO: 130566 - DNA, 25 bp, Mus musculus
actgctgccgtttgaaatcctgttt

SEQ ID NO: 130567 - DNA, 25 bp, Mus musculus
actgctgcctagagtgctgcctgta

SEQ ID NO: 130568 - DNA, 25 bp, Mus musculus
actgctgcctagtgtgctgcctgta

SEQ ID NO: 130569 - DNA, 25 bp, Mus musculus
actgctgcgcatctttccgaaagag

SEQ ID NO: 130570 - DNA, 25 bp, Mus musculus
actgctgcgcatgtttccgaaagag

SEQ ID NO: 130571 - DNA, 25 bp, Mus musculus
actgctgcgtccactgtggagggtc

SEQ ID NO: 130572 - DNA, 25 bp, Mus musculus
actgctgcgtcctctgtggagggtc

SEQ ID NO: 130573 - DNA, 25 bp, Mus musculus
actgctgctcatagctatcttatca

SEQ ID NO: 130574 - DNA, 25 bp, Mus musculus
actgctgctcattgctatcttatca

SEQ ID NO: 130575 - DNA, 25 bp, Mus musculus
actgctgctccaatctttcacggga

SEQ ID NO: 130576 - DNA, 25 bp, Mus musculus
actgctgctccattctttcacggga

SEQ ID NO: 130577 - DNA, 25 bp, Mus musculus
actgctgctctgaatactcgggcac

SEQ ID NO: 130578 - DNA, 25 bp, Mus musculus
actgctgctctgtatactcgggcac

SEQ ID NO: 130579 - DNA, 25 bp, Mus musculus
actgctgctgacacgagaaactgaa

SEQ ID NO: 130580 - DNA, 25 bp, Mus musculus
actgctgctgacagggctgcgcaga

SEQ ID NO: 130581 - DNA, 25 bp, Mus musculus
actgctgctgacataactcctcaag

SEQ ID NO: 130582 - DNA, 25 bp, Mus musculus
actgctgctgactcgagaaactgaa

SEQ ID NO: 130583 - DNA, 25 bp, Mus musculus
actgctgctgactgggctgcgcaga

SEQ ID NO: 130584 - DNA, 25 bp, Mus musculus
actgctgctgacttaactcctcaag

SEQ ID NO: 130585 - DNA, 25 bp, Mus musculus
actgctgctgatcatcgaaccgtga

SEQ ID NO: 130586 - DNA, 25 bp, Mus musculus
actgctgctgatgatcgaaccgtga

SEQ ID NO: 130587 - DNA, 25 bp, Mus musculus
actgctgctgccagagaccaagaac

SEQ ID NO: 130588 - DNA, 25 bp, Mus musculus
actgctgctgccattcatttataat

SEQ ID NO: 130589 - DNA, 25 bp, Mus musculus
actgctgctgcctgagaccaagaac

SEQ ID NO: 130590 - DNA, 25 bp, Mus musculus
actgctgctgcctttcatttataat

SEQ ID NO: 130591 - DNA, 25 bp, Mus musculus
actgctgctggacctgatttttacc

SEQ ID NO: 130592 - DNA, 25 bp, Mus musculus
actgctgctggagctgatttttacc

SEQ ID NO: 130593 - DNA, 25 bp, Mus musculus
actgctgctgttaacccgggaggtc

SEQ ID NO: 130594 - DNA, 25 bp, Mus musculus
actgctgctgtttacccgggaggtc

SEQ ID NO: 130595 - DNA, 25 bp, Mus musculus
actgctgcttacaggcgggttgtgt

SEQ ID NO: 130596 - DNA, 25 bp, Mus musculus
actgctgcttactggcgggttgtgt

SEQ ID NO: 130597 - DNA, 25 bp, Mus musculus
actgctgcttccctggaaggaccac

SEQ ID NO: 130598 - DNA, 25 bp, Mus musculus
actgctgcttccgtggaaggaccac

SEQ ID NO: 130599 - DNA, 25 bp, Mus musculus
actgctgctttgatactttcttgag

SEQ ID NO: 130600 - DNA, 25 bp, Mus musculus
actgctgctttgttactttcttgag

SEQ ID NO: 130601 - DNA, 25 bp, Mus musculus
actgctggagacaccccatggaaat

SEQ ID NO: 130602 - DNA, 25 bp, Mus musculus
actgctggagactccccatggaaat

SEQ ID NO: 130603 - DNA, 25 bp, Mus musculus
actgctggagttaacgcctggctga

SEQ ID NO: 130604 - DNA, 25 bp, Mus musculus
actgctggagttctatttcttctgc

SEQ ID NO: 130605 - DNA, 25 bp, Mus musculus
actgctggagttgtatttcttctgc

SEQ ID NO: 130606 - DNA, 25 bp, Mus musculus
actgctggagtttacgcctggctga

SEQ ID NO: 130607 - DNA, 25 bp, Mus musculus
actgctggatgactgcagtgtttct

SEQ ID NO: 130608 - DNA, 25 bp, Mus musculus
actgctggatgagtgcagtgtttct

SEQ ID NO: 130609 - DNA, 25 bp, Mus musculus
actgctggcaagcttggtgtcacta

SEQ ID NO: 130610 - DNA, 25 bp, Mus musculus
actgctggcaaggttggtgtcacta

SEQ ID NO: 130611 - DNA, 25 bp, Mus musculus
actgctggcatgacttagatatctt

SEQ ID NO: 130612 - DNA, 25 bp, Mus musculus
actgctggcatgtcttagatatctt

SEQ ID NO: 130613 - DNA, 25 bp, Mus musculus
actgctggcgtacgtgacttagtca

SEQ ID NO: 130614 - DNA, 25 bp, Mus musculus
actgctggcgtaggtgacttagtca

SEQ ID NO: 130615 - DNA, 25 bp, Mus musculus
actgctggctggaactatgatatca

SEQ ID NO: 130616 - DNA, 25 bp, Mus musculus
actgctggctggtactatgatatca

SEQ ID NO: 130617 - DNA, 25 bp, Mus musculus
actgctgggaaaacacatgttctta

SEQ ID NO: 130618 - DNA, 25 bp, Mus musculus
actgctgggaaacacacctatcacc

SEQ ID NO: 130619 - DNA, 25 bp, Mus musculus
actgctgggaaagacacctatcacc

SEQ ID NO: 130620 - DNA, 25 bp, Mus musculus
actgctgggaaatcacatgttctta

SEQ ID NO: 130621 - DNA, 25 bp, Mus musculus
actgctgggacacatctgtgcctta

SEQ ID NO: 130622 - DNA, 25 bp, Mus musculus
actgctgggacagatctgtgcctta

SEQ ID NO: 130623 - DNA, 25 bp, Mus musculus
actgctgggcagcagcgataccaca

SEQ ID NO: 130624 - DNA, 25 bp, Mus musculus
actgctgggcaggagcgataccaca

SEQ ID NO: 130625 - DNA, 25 bp, Mus musculus
actgctgggccaaagaaaactgttt

SEQ ID NO: 130626 - DNA, 25 bp, Mus musculus
actgctgggccatagaaaactgttt

SEQ ID NO: 130627 - DNA, 25 bp, Mus musculus
actgctgggcccactgtttatgaag

SEQ ID NO: 130628 - DNA, 25 bp, Mus musculus
actgctgggccctctgtttatgaag

SEQ ID NO: 130629 - DNA, 25 bp, Mus musculus
actgctgggctcctctgtggagtgg

SEQ ID NO: 130630 - DNA, 25 bp, Mus musculus
actgctgggctcgtctgtggagtgg

SEQ ID NO: 130631 - DNA, 25 bp, Mus musculus
actgctggtcgtcacataaacttgt

SEQ ID NO: 130632 - DNA, 25 bp, Mus musculus
actgctggtcgtgacataaacttgt

SEQ ID NO: 130633 - DNA, 25 bp, Mus musculus
actgctgtaggtctgaattctcaaa

SEQ ID NO: 130634 - DNA, 25 bp, Mus musculus
actgctgtaggtgtgaattctcaaa

SEQ ID NO: 130635 - DNA, 25 bp, Mus musculus
actgctgtagtgaatggaccttctg

SEQ ID NO: 130636 - DNA, 25 bp, Mus musculus
actgctgtagtgtatggaccttctg

SEQ ID NO: 130637 - DNA, 25 bp, Mus musculus
actgctgtattccagatgctgccca

SEQ ID NO: 130638 - DNA, 25 bp, Mus musculus
actgctgtattcgagatgctgccca

SEQ ID NO: 130639 - DNA, 25 bp, Mus musculus
actgctgtccctaattagtgtacac

SEQ ID NO: 130640 - DNA, 25 bp, Mus musculus
actgctgtcccttattagtgtacac

SEQ ID NO: 130641 - DNA, 25 bp, Mus musculus
actgctgtcctcaggcttatgacca

SEQ ID NO: 130642 - DNA, 25 bp, Mus musculus
actgctgtcctctggcttatgacca

SEQ ID NO: 130643 - DNA, 25 bp, Mus musculus
actgctgtctatcactctgcttcag

SEQ ID NO: 130644 - DNA, 25 bp, Mus musculus
actgctgtctatgactctgcttcag

SEQ ID NO: 130645 - DNA, 25 bp, Mus musculus
actgctgtgcttatgggatttaagt

SEQ ID NO: 130646 - DNA, 25 bp, Mus musculus
actgctgtgcttttgggatttaagt

SEQ ID NO: 130647 - DNA, 25 bp, Mus musculus
actgctgtggtcagaagaggcccgt

SEQ ID NO: 130648 - DNA, 25 bp, Mus musculus
actgctgtggtctgaagaggcccgt

SEQ ID NO: 130649 - DNA, 25 bp, Mus musculus
actgctgtgtctcagaggaagccct

SEQ ID NO: 130650 - DNA, 25 bp, Mus musculus
actgctgtgtctgagaggaagccct

SEQ ID NO: 130651 - DNA, 25 bp, Mus musculus
actgctgtgtggaaccaggctcgga

SEQ ID NO: 130652 - DNA, 25 bp, Mus musculus
actgctgtgtggtaccaggctcgga

SEQ ID NO: 130653 - DNA, 25 bp, Mus musculus
actgctgtgtgtcagaatcgacaag

SEQ ID NO: 130654 - DNA, 25 bp, Mus musculus
actgctgtgtgtgagaatcgacaag

SEQ ID NO: 130655 - DNA, 25 bp, Mus musculus
actgctgtgttactctagactggac

SEQ ID NO: 130656 - DNA, 25 bp, Mus musculus
actgctgtgttagtctagactggac

SEQ ID NO: 130657 - DNA, 25 bp, Mus musculus
actgctgtgttcatcttgctagaga

SEQ ID NO: 130658 - DNA, 25 bp, Mus musculus
actgctgtgttcttcttgctagaga

SEQ ID NO: 130659 - DNA, 25 bp, Mus musculus
actgctgttaccatttgcagtcggt

SEQ ID NO: 130660 - DNA, 25 bp, Mus musculus
actgctgttaccttttgcagtcggt

SEQ ID NO: 130661 - DNA, 25 bp, Mus musculus
actgctgttcatcttggtcacggac

SEQ ID NO: 130662 - DNA, 25 bp, Mus musculus
actgctgttcatgttggtcacggac

SEQ ID NO: 130663 - DNA, 25 bp, Mus musculus
actgctgttcctagctgaattggat

SEQ ID NO: 130664 - DNA, 25 bp, Mus musculus
actgctgttccttgctgaattggat

SEQ ID NO: 130665 - DNA, 25 bp, Mus musculus
actgctgttcgtatgtatttgtgaa

SEQ ID NO: 130666 - DNA, 25 bp, Mus musculus
actgctgttcgtttgtatttgtgaa

SEQ ID NO: 130667 - DNA, 25 bp, Mus musculus
actgctgttggcacctggttaaaga

SEQ ID NO: 130668 - DNA, 25 bp, Mus musculus
actgctgttggctcctggttaaaga

SEQ ID NO: 130669 - DNA, 25 bp, Mus musculus
actgctgttgtaccactcggttgaa

SEQ ID NO: 130670 - DNA, 25 bp, Mus musculus
actgctgttgtagcactcggttgaa

SEQ ID NO: 130671 - DNA, 25 bp, Mus musculus
actgctgttgtcaggctctggagca

SEQ ID NO: 130672 - DNA, 25 bp, Mus musculus
actgctgttgtcaggttagaaactc

SEQ ID NO: 130673 - DNA, 25 bp, Mus musculus
actgctgttgtctggctctggagca

SEQ ID NO: 130674 - DNA, 25 bp, Mus musculus
actgctgttgtctggttagaaactc

SEQ ID NO: 130675 - DNA, 25 bp, Mus musculus
actgctgttgtgctgattttgaata

SEQ ID NO: 130676 - DNA, 25 bp, Mus musculus
actgctgttgtggtgattttgaata

SEQ ID NO: 130677 - DNA, 25 bp, Mus musculus
actgctgttgttaacctgacttaca

SEQ ID NO: 130678 - DNA, 25 bp, Mus musculus
actgctgttgtttacctgacttaca

SEQ ID NO: 130679 - DNA, 25 bp, Mus musculus
actgctgtttgacctaggcctataa

SEQ ID NO: 130680 - DNA, 25 bp, Mus musculus
actgctgtttgagctaggcctataa

SEQ ID NO: 130681 - DNA, 25 bp, Mus musculus
actgctgtttggactcactcagctt

SEQ ID NO: 130682 - DNA, 25 bp, Mus musculus
actgctgtttggtctcactcagctt

SEQ ID NO: 130683 - DNA, 25 bp, Mus musculus
actgcttaagaacgtgctccatcct

SEQ ID NO: 130684 - DNA, 25 bp, Mus musculus
actgcttaagaaggtgctccatcct

SEQ ID NO: 130685 - DNA, 25 bp, Mus musculus
actgcttaatccattttgatgtaag

SEQ ID NO: 130686 - DNA, 25 bp, Mus musculus
actgcttaatcctttttgatgtaag

SEQ ID NO: 130687 - DNA, 25 bp, Mus musculus
actgcttaatggatgtttctctgtg

SEQ ID NO: 130688 - DNA, 25 bp, Mus musculus
actgcttaatggttgtttctctgtg

SEQ ID NO: 130689 - DNA, 25 bp, Mus musculus
actgcttactctccaatttcatcag

SEQ ID NO: 130690 - DNA, 25 bp, Mus musculus
actgcttactctgcaatttcatcag

SEQ ID NO: 130691 - DNA, 25 bp, Mus musculus
actgcttagagcactgtcctagagg

SEQ ID NO: 130692 - DNA, 25 bp, Mus musculus
actgcttagagctctgtcctagagg

SEQ ID NO: 130693 - DNA, 25 bp, Mus musculus
actgcttagctcagttctgactgat

SEQ ID NO: 130694 - DNA, 25 bp, Mus musculus
actgcttagctctgttctgactgat

SEQ ID NO: 130695 - DNA, 25 bp, Mus musculus
actgcttaggagctgttatcgacta

SEQ ID NO: 130696 - DNA, 25 bp, Mus musculus
actgcttaggaggtgttatcgacta

SEQ ID NO: 130697 - DNA, 25 bp, Mus musculus
actgcttagttcctgcacagtggaa

SEQ ID NO: 130698 - DNA, 25 bp, Mus musculus
actgcttagttcgtgcacagtggaa

SEQ ID NO: 130699 - DNA, 25 bp, Mus musculus
actgcttatcagattgagcctcaga

SEQ ID NO: 130700 - DNA, 25 bp, Mus musculus
actgcttatcagtttgagcctcaga

SEQ ID NO: 130701 - DNA, 25 bp, Mus musculus
actgcttatcgcattggttcttcaa

SEQ ID NO: 130702 - DNA, 25 bp, Mus musculus
actgcttatcgctttggttcttcaa

SEQ ID NO: 130703 - DNA, 25 bp, Mus musculus
actgcttattcaacctacaagtcca

SEQ ID NO: 130704 - DNA, 25 bp, Mus musculus
actgcttattcatcctacaagtcca

SEQ ID NO: 130705 - DNA, 25 bp, Mus musculus
actgcttcacacaggctatgatgag

SEQ ID NO: 130706 - DNA, 25 bp, Mus musculus
actgcttcacactggctatgatgag

SEQ ID NO: 130707 - DNA, 25 bp, Mus musculus
actgcttcagaccttgctaaccaga

SEQ ID NO: 130708 - DNA, 25 bp, Mus musculus
actgcttcagacgttgctaaccaga

SEQ ID NO: 130709 - DNA, 25 bp, Mus musculus
actgcttcaggtaagttctagtcca

SEQ ID NO: 130710 - DNA, 25 bp, Mus musculus
actgcttcaggttagttctagtcca

SEQ ID NO: 130711 - DNA, 25 bp, Mus musculus
actgcttccaaacactgacagggat

SEQ ID NO: 130712 - DNA, 25 bp, Mus musculus
actgcttccaaagactgacagggat

SEQ ID NO: 130713 - DNA, 25 bp, Mus musculus
actgcttccagaatgctggttccag

SEQ ID NO: 130714 - DNA, 25 bp, Mus musculus
actgcttccagattgctggttccag

SEQ ID NO: 130715 - DNA, 25 bp, Mus musculus
actgcttccccacagtctgaggtta

SEQ ID NO: 130716 - DNA, 25 bp, Mus musculus
actgcttccccagagtctgaggtta

SEQ ID NO: 130717 - DNA, 25 bp, Mus musculus
actgcttcccttagggtagctgtga

SEQ ID NO: 130718 - DNA, 25 bp, Mus musculus
actgcttcccttattacactttctg

SEQ ID NO: 130719 - DNA, 25 bp, Mus musculus
actgcttcccttcttgattgtggag

SEQ ID NO: 130720 - DNA, 25 bp, Mus musculus
actgcttcccttgttgattgtggag

SEQ ID NO: 130721 - DNA, 25 bp, Mus musculus
actgcttccctttgggtagctgtga

SEQ ID NO: 130722 - DNA, 25 bp, Mus musculus
actgcttccctttttacactttctg

SEQ ID NO: 130723 - DNA, 25 bp, Mus musculus
actgcttcctgaacccaaacagaag

SEQ ID NO: 130724 - DNA, 25 bp, Mus musculus
actgcttcctgatcccaaacagaag

SEQ ID NO: 130725 - DNA, 25 bp, Mus musculus
actgcttcgagcacacgattgggac

SEQ ID NO: 130726 - DNA, 25 bp, Mus musculus
actgcttcgagctcacgattgggac

SEQ ID NO: 130727 - DNA, 25 bp, Mus musculus
actgcttcgtaacggcatttgtctt

SEQ ID NO: 130728 - DNA, 25 bp, Mus musculus
actgcttcgtaagggcatttgtctt

SEQ ID NO: 130729 - DNA, 25 bp, Mus musculus
actgcttctaagattggttgtcctt

SEQ ID NO: 130730 - DNA, 25 bp, Mus musculus
actgcttctaagtttggttgtcctt

SEQ ID NO: 130731 - DNA, 25 bp, Mus musculus
actgcttctctgaatttgacttcag

SEQ ID NO: 130732 - DNA, 25 bp, Mus musculus
actgcttctctgtatttgacttcag

SEQ ID NO: 130733 - DNA, 25 bp, Mus musculus
actgcttctgaactctgcactgatt

SEQ ID NO: 130734 - DNA, 25 bp, Mus musculus
actgcttctgaagtctgcactgatt

SEQ ID NO: 130735 - DNA, 25 bp, Mus musculus
actgcttctggtcttggttctttgc

SEQ ID NO: 130736 - DNA, 25 bp, Mus musculus
actgcttctggtgttggttctttgc

SEQ ID NO: 130737 - DNA, 25 bp, Mus musculus
actgcttcttatcctagagtcctat

SEQ ID NO: 130738 - DNA, 25 bp, Mus musculus
actgcttcttatgctagagtcctat

SEQ ID NO: 130739 - DNA, 25 bp, Mus musculus
actgcttcttcaatggagaggtgcg

SEQ ID NO: 130740 - DNA, 25 bp, Mus musculus
actgcttcttcattggagaggtgcg

SEQ ID NO: 130741 - DNA, 25 bp, Mus musculus
actgcttcttgaaccctatcattaa

SEQ ID NO: 130742 - DNA, 25 bp, Mus musculus
actgcttcttgatccctatcattaa

SEQ ID NO: 130743 - DNA, 25 bp, Mus musculus
actgcttcttgtatacactggtaat

SEQ ID NO: 130744 - DNA, 25 bp, Mus musculus
actgcttcttgtttacactggtaat

SEQ ID NO: 130745 - DNA, 25 bp, Mus musculus
actgcttctttgagagtacttgcct

SEQ ID NO: 130746 - DNA, 25 bp, Mus musculus
actgcttctttgtgagtacttgcct

SEQ ID NO: 130747 - DNA, 25 bp, Mus musculus
actgcttgaaagcttttgctgggat

SEQ ID NO: 130748 - DNA, 25 bp, Mus musculus
actgcttgaaaggttttgctgggat

SEQ ID NO: 130749 - DNA, 25 bp, Mus musculus
actgcttgatgtagtgttttgaata

SEQ ID NO: 130750 - DNA, 25 bp, Mus musculus
actgcttgatgttgtgttttgaata

SEQ ID NO: 130751 - DNA, 25 bp, Mus musculus
actgcttgattcctgtgtgctctgt

SEQ ID NO: 130752 - DNA, 25 bp, Mus musculus
actgcttgattcgtgtgtgctctgt

SEQ ID NO: 130753 - DNA, 25 bp, Mus musculus
actgcttgcactatgggctgattaa

SEQ ID NO: 130754 - DNA, 25 bp, Mus musculus
actgcttgcactctctgaggtgaaa

SEQ ID NO: 130755 - DNA, 25 bp, Mus musculus
actgcttgcactgtctgaggtgaaa

SEQ ID NO: 130756 - DNA, 25 bp, Mus musculus
actgcttgcactttgggctgattaa

SEQ ID NO: 130757 - DNA, 25 bp, Mus musculus
actgcttgcagcatttctgtgtgct

SEQ ID NO: 130758 - DNA, 25 bp, Mus musculus
actgcttgcagcttttctgtgtgct

SEQ ID NO: 130759 - DNA, 25 bp, Mus musculus
actgcttgctataggtaactctatc

SEQ ID NO: 130760 - DNA, 25 bp, Mus musculus
actgcttgctattggtaactctatc

SEQ ID NO: 130761 - DNA, 25 bp, Mus musculus
actgcttggaccagtgagccttata

SEQ ID NO: 130762 - DNA, 25 bp, Mus musculus
actgcttggacctgtgagccttata

SEQ ID NO: 130763 - DNA, 25 bp, Mus musculus
actgcttggactcgtctttgttggt

SEQ ID NO: 130764 - DNA, 25 bp, Mus musculus
actgcttggactggtctttgttggt

SEQ ID NO: 130765 - DNA, 25 bp, Mus musculus
actgcttggagacctgaaactcagg

SEQ ID NO: 130766 - DNA, 25 bp, Mus musculus
actgcttggagagctgaaactcagg

SEQ ID NO: 130767 - DNA, 25 bp, Mus musculus
actgcttggcagaaacaggtttagg

SEQ ID NO: 130768 - DNA, 25 bp, Mus musculus
actgcttggcagtaacaggtttagg

SEQ ID NO: 130769 - DNA, 25 bp, Mus musculus
actgcttggctacacatccacaggg

SEQ ID NO: 130770 - DNA, 25 bp, Mus musculus
actgcttggctagacatccacaggg

SEQ ID NO: 130771 - DNA, 25 bp, Mus musculus
actgcttggctgaaaaggtgtagca

SEQ ID NO: 130772 - DNA, 25 bp, Mus musculus
actgcttggctgtaaaggtgtagca

SEQ ID NO: 130773 - DNA, 25 bp, Mus musculus
actgcttggcttctaagtgtcagaa

SEQ ID NO: 130774 - DNA, 25 bp, Mus musculus
actgcttggcttgtaagtgtcagaa

SEQ ID NO: 130775 - DNA, 25 bp, Mus musculus
actgcttggtgcactgtctttgaga

SEQ ID NO: 130776 - DNA, 25 bp, Mus musculus
actgcttggtgctctgtctttgaga

SEQ ID NO: 130777 - DNA, 25 bp, Mus musculus
actgcttggtgtcccgtgcaaccct

SEQ ID NO: 130778 - DNA, 25 bp, Mus musculus
actgcttggtgtgccgtgcaaccct

SEQ ID NO: 130779 - DNA, 25 bp, Mus musculus
actgcttggtttcattggatttaaa

SEQ ID NO: 130780 - DNA, 25 bp, Mus musculus
actgcttggtttgattggatttaaa

SEQ ID NO: 130781 - DNA, 25 bp, Mus musculus
actgcttgtatgcaaaacctgtgga

SEQ ID NO: 130782 - DNA, 25 bp, Mus musculus
actgcttgtatggaaaacctgtgga

SEQ ID NO: 130783 - DNA, 25 bp, Mus musculus
actgcttgtgatatgactgttgata

SEQ ID NO: 130784 - DNA, 25 bp, Mus musculus
actgcttgtgatttgactgttgata

SEQ ID NO: 130785 - DNA, 25 bp, Mus musculus
actgcttgttgcatatgtgtagaaa

SEQ ID NO: 130786 - DNA, 25 bp, Mus musculus
actgcttgttgcttatgtgtagaaa

SEQ ID NO: 130787 - DNA, 25 bp, Mus musculus
actgcttgtttcaaatgcttccgga

SEQ ID NO: 130788 - DNA, 25 bp, Mus musculus
actgcttgtttctaatgcttccgga

SEQ ID NO: 130789 - DNA, 25 bp, Mus musculus
actgctttactaactatgtctattg

SEQ ID NO: 130790 - DNA, 25 bp, Mus musculus
actgctttactatctatgtctattg

SEQ ID NO: 130791 - DNA, 25 bp, Mus musculus
actgctttactgaatccaaacttaa

SEQ ID NO: 130792 - DNA, 25 bp, Mus musculus
actgctttactgtatccaaacttaa

SEQ ID NO: 130793 - DNA, 25 bp, Mus musculus
actgctttaggtagtcagggaagac

SEQ ID NO: 130794 - DNA, 25 bp, Mus musculus
actgctttaggttgtcagggaagac

SEQ ID NO: 130795 - DNA, 25 bp, Mus musculus
actgctttcagcaggtgtgcaagag

SEQ ID NO: 130796 - DNA, 25 bp, Mus musculus
actgctttcagctggtgtgcaagag

SEQ ID NO: 130797 - DNA, 25 bp, Mus musculus
actgctttcatacctagctaggctg

SEQ ID NO: 130798 - DNA, 25 bp, Mus musculus
actgctttcatagctagctaggctg

SEQ ID NO: 130799 - DNA, 25 bp, Mus musculus
actgctttccatactgaacacactg

SEQ ID NO: 130800 - DNA, 25 bp, Mus musculus
actgctttccattctgaacacactg

SEQ ID NO: 130801 - DNA, 25 bp, Mus musculus
actgctttcccacgtgagtgaaatc

SEQ ID NO: 130802 - DNA, 25 bp, Mus musculus
actgctttcccaggtgagtgaaatc

SEQ ID NO: 130803 - DNA, 25 bp, Mus musculus
actgctttcccgagctgctttgtaa

SEQ ID NO: 130804 - DNA, 25 bp, Mus musculus
actgctttcccgtgctgctttgtaa

SEQ ID NO: 130805 - DNA, 25 bp, Mus musculus
actgctttccctagtaactcagcaa

SEQ ID NO: 130806 - DNA, 25 bp, Mus musculus
actgctttccctagtgctcttggtt

SEQ ID NO: 130807 - DNA, 25 bp, Mus musculus
actgctttcccttgtaactcagcaa

SEQ ID NO: 130808 - DNA, 25 bp, Mus musculus
actgctttcccttgtgctcttggtt

SEQ ID NO: 130809 - DNA, 25 bp, Mus musculus
actgctttctccaggaattgcaggt

SEQ ID NO: 130810 - DNA, 25 bp, Mus musculus
actgctttctcctggaattgcaggt

SEQ ID NO: 130811 - DNA, 25 bp, Mus musculus
actgctttctgcacccaaatttcac

SEQ ID NO: 130812 - DNA, 25 bp, Mus musculus
actgctttctgctcccaaatttcac

SEQ ID NO: 130813 - DNA, 25 bp, Mus musculus
actgctttctggactgtacgacact

SEQ ID NO: 130814 - DNA, 25 bp, Mus musculus
actgctttctggtctgtacgacact

SEQ ID NO: 130815 - DNA, 25 bp, Mus musculus
actgctttgagcagtccatctacgt

SEQ ID NO: 130816 - DNA, 25 bp, Mus musculus
actgctttgagctgtccatctacgt

SEQ ID NO: 130817 - DNA, 25 bp, Mus musculus
actgctttgccaattaccttgtttc

SEQ ID NO: 130818 - DNA, 25 bp, Mus musculus
actgctttgccatttaccttgtttc

SEQ ID NO: 130819 - DNA, 25 bp, Mus musculus
actgctttgctcaagaagggctttt

SEQ ID NO: 130820 - DNA, 25 bp, Mus musculus
actgctttgctctagaagggctttt

SEQ ID NO: 130821 - DNA, 25 bp, Mus musculus
actgctttggttcaactctgcttcc

SEQ ID NO: 130822 - DNA, 25 bp, Mus musculus
actgctttggttgaactctgcttcc

SEQ ID NO: 130823 - DNA, 25 bp, Mus musculus
actgctttgtaaattctccggtgac

SEQ ID NO: 130824 - DNA, 25 bp, Mus musculus
actgctttgtaatttctccggtgac

SEQ ID NO: 130825 - DNA, 25 bp, Mus musculus
actgctttgttcaggacaacgggct

SEQ ID NO: 130826 - DNA, 25 bp, Mus musculus
actgctttgttctggacaacgggct

SEQ ID NO: 130827 - DNA, 25 bp, Mus musculus
actgcttttccaagctgcactgtgt

SEQ ID NO: 130828 - DNA, 25 bp, Mus musculus
actgcttttccatgctgcactgtgt

SEQ ID NO: 130829 - DNA, 25 bp, Mus musculus
actgcttttctaagggagacactct

SEQ ID NO: 130830 - DNA, 25 bp, Mus musculus
actgcttttctatgggagacactct

SEQ ID NO: 130831 - DNA, 25 bp, Mus musculus
actgcttttctcagagaccttgtac

SEQ ID NO: 130832 - DNA, 25 bp, Mus musculus
actgcttttctctgagaccttgtac

SEQ ID NO: 130833 - DNA, 25 bp, Mus musculus
actgcttttgatcttctgattcctc

SEQ ID NO: 130834 - DNA, 25 bp, Mus musculus
actgcttttgatgttctgattcctc

SEQ ID NO: 130835 - DNA, 25 bp, Mus musculus
actgcttttgttatgctcatcattg

SEQ ID NO: 130836 - DNA, 25 bp, Mus musculus
actgcttttgttttgctcatcattg

SEQ ID NO: 130837 - DNA, 25 bp, Mus musculus
actgctttttcaatgaaggtataag

SEQ ID NO: 130838 - DNA, 25 bp, Mus musculus
actgctttttcattgaaggtataag

SEQ ID NO: 130839 - DNA, 25 bp, Mus musculus
actgcttttttacctcattttcctg

SEQ ID NO: 130840 - DNA, 25 bp, Mus musculus
actgcttttttagctcattttcctg

SEQ ID NO: 130841 - DNA, 25 bp, Mus musculus
actggaaaagccctggcactgagga

SEQ ID NO: 130842 - DNA, 25 bp, Mus musculus
actggaaaagccgtggcactgagga

SEQ ID NO: 130843 - DNA, 25 bp, Mus musculus
actggaaaattgctcctggtttcta

SEQ ID NO: 130844 - DNA, 25 bp, Mus musculus
actggaaaattggtcctggtttcta

SEQ ID NO: 130845 - DNA, 25 bp, Mus musculus
actggaaactacagagcgagatctc

SEQ ID NO: 130846 - DNA, 25 bp, Mus musculus
actggaaactactgagcgagatctc

SEQ ID NO: 130847 - DNA, 25 bp, Mus musculus
actggaaagaatcaatgtatactac

SEQ ID NO: 130848 - DNA, 25 bp, Mus musculus
actggaaagaatgaatgtatactac

SEQ ID NO: 130849 - DNA, 25 bp, Mus musculus
actggaaagccgaggttcatctggg

SEQ ID NO: 130850 - DNA, 25 bp, Mus musculus
actggaaagccgtggttcatctggg

SEQ ID NO: 130851 - DNA, 25 bp, Mus musculus
actggaaaggacacggtcacttggc

SEQ ID NO: 130852 - DNA, 25 bp, Mus musculus
actggaaaggactcggtcacttggc

SEQ ID NO: 130853 - DNA, 25 bp, Mus musculus
actggaaaggtaccacttacgtgaa

SEQ ID NO: 130854 - DNA, 25 bp, Mus musculus
actggaaaggtagcacttacgtgaa

SEQ ID NO: 130855 - DNA, 25 bp, Mus musculus
actggaaattacacccggccattgg

SEQ ID NO: 130856 - DNA, 25 bp, Mus musculus
actggaaattactcccggccattgg

SEQ ID NO: 130857 - DNA, 25 bp, Mus musculus
actggaaattttcgcactttgtgct

SEQ ID NO: 130858 - DNA, 25 bp, Mus musculus
actggaaattttggcactttgtgct

SEQ ID NO: 130859 - DNA, 25 bp, Mus musculus
actggaacacaccatttgccactat

SEQ ID NO: 130860 - DNA, 25 bp, Mus musculus
actggaacacacgatttgccactat

SEQ ID NO: 130861 - DNA, 25 bp, Mus musculus
actggaacactacgtgctggctacc

SEQ ID NO: 130862 - DNA, 25 bp, Mus musculus
actggaacactaggtgctggctacc

SEQ ID NO: 130863 - DNA, 25 bp, Mus musculus
actggaaccccaaagagacttgagc

SEQ ID NO: 130864 - DNA, 25 bp, Mus musculus
actggaaccccatagagacttgagc

SEQ ID NO: 130865 - DNA, 25 bp, Mus musculus
actggaaccctgcattgttagacat

SEQ ID NO: 130866 - DNA, 25 bp, Mus musculus
actggaaccctggattgttagacat

SEQ ID NO: 130867 - DNA, 25 bp, Mus musculus
actggaaccggaagcgagagatctt

SEQ ID NO: 130868 - DNA, 25 bp, Mus musculus
actggaaccggatgcgagagatctt

SEQ ID NO: 130869 - DNA, 25 bp, Mus musculus
actggaacctgcattagagctaggt

SEQ ID NO: 130870 - DNA, 25 bp, Mus musculus
actggaacctgctttagagctaggt

SEQ ID NO: 130871 - DNA, 25 bp, Mus musculus
actggaacctttcaagcctcataaa

SEQ ID NO: 130872 - DNA, 25 bp, Mus musculus
actggaacctttgaagcctcataaa

SEQ ID NO: 130873 - DNA, 25 bp, Mus musculus
actggaacgcaccattgtgacataa

SEQ ID NO: 130874 - DNA, 25 bp, Mus musculus
actggaacgcacgattgtgacataa

SEQ ID NO: 130875 - DNA, 25 bp, Mus musculus
actggaacggacataattttggtgt

SEQ ID NO: 130876 - DNA, 25 bp, Mus musculus
actggaacggacttaattttggtgt

SEQ ID NO: 130877 - DNA, 25 bp, Mus musculus
actggaactatacccggatatcacg

SEQ ID NO: 130878 - DNA, 25 bp, Mus musculus
actggaactatagccggatatcacg

SEQ ID NO: 130879 - DNA, 25 bp, Mus musculus
actggaactcataccctaacactgg

SEQ ID NO: 130880 - DNA, 25 bp, Mus musculus
actggaactcatactgcaccacgac

SEQ ID NO: 130881 - DNA, 25 bp, Mus musculus
actggaactcattccctaacactgg

SEQ ID NO: 130882 - DNA, 25 bp, Mus musculus
actggaactcattctgcaccacgac

SEQ ID NO: 130883 - DNA, 25 bp, Mus musculus
actggaactccaacgtgaatgaagt

SEQ ID NO: 130884 - DNA, 25 bp, Mus musculus
actggaactccatcgtgaatgaagt

SEQ ID NO: 130885 - DNA, 25 bp, Mus musculus
actggaactcggcagctggcctgct

SEQ ID NO: 130886 - DNA, 25 bp, Mus musculus
actggaactcgggagctggcctgct

SEQ ID NO: 130887 - DNA, 25 bp, Mus musculus
actggaagacacaggatgacctcaa

SEQ ID NO: 130888 - DNA, 25 bp, Mus musculus
actggaagacactggatgacctcaa

SEQ ID NO: 130889 - DNA, 25 bp, Mus musculus
actggaagacatcgtgcgcctgcgc

SEQ ID NO: 130890 - DNA, 25 bp, Mus musculus
actggaagacatggtgcgcctgcgc

SEQ ID NO: 130891 - DNA, 25 bp, Mus musculus
actggaagattgcagctaccattaa

SEQ ID NO: 130892 - DNA, 25 bp, Mus musculus
actggaagattggagctaccattaa

SEQ ID NO: 130893 - DNA, 25 bp, Mus musculus
actggaagcaaaattaggttcatac

SEQ ID NO: 130894 - DNA, 25 bp, Mus musculus
actggaagcaaatttaggttcatac

SEQ ID NO: 130895 - DNA, 25 bp, Mus musculus
actggaagcccaaagcaatgcacaa

SEQ ID NO: 130896 - DNA, 25 bp, Mus musculus
actggaagcccatagcaatgcacaa

SEQ ID NO: 130897 - DNA, 25 bp, Mus musculus
actggaagcttccaagagccatcga

SEQ ID NO: 130898 - DNA, 25 bp, Mus musculus
actggaagcttcgaagagccatcga

SEQ ID NO: 130899 - DNA, 25 bp, Mus musculus
actggaaggtgcacacgtggctccg

SEQ ID NO: 130900 - DNA, 25 bp, Mus musculus
actggaaggtgctcacgtggctccg

SEQ ID NO: 130901 - DNA, 25 bp, Mus musculus
actggaatcggaccacctgtgttaa

SEQ ID NO: 130902 - DNA, 25 bp, Mus musculus
actggaatcggagcacctgtgttaa

SEQ ID NO: 130903 - DNA, 25 bp, Mus musculus
actggaatgaatattctgtacatgt

SEQ ID NO: 130904 - DNA, 25 bp, Mus musculus
actggaatgaattttctgtacatgt

SEQ ID NO: 130905 - DNA, 25 bp, Mus musculus
actggaatgcaacatctgtggctac

SEQ ID NO: 130906 - DNA, 25 bp, Mus musculus
actggaatgcaagatctgtggctac

SEQ ID NO: 130907 - DNA, 25 bp, Mus musculus
actggaatgcatatgcccaattgac

SEQ ID NO: 130908 - DNA, 25 bp, Mus musculus
actggaatgcatttgcccaattgac

SEQ ID NO: 130909 - DNA, 25 bp, Mus musculus
actggaatggagcatgtcttgaacc

SEQ ID NO: 130910 - DNA, 25 bp, Mus musculus
actggaatggaggatgtcttgaacc

SEQ ID NO: 130911 - DNA, 25 bp, Mus musculus
actggaatggcactgtgacatcctc

SEQ ID NO: 130912 - DNA, 25 bp, Mus musculus
actggaatggcagtgtgacatcctc

SEQ ID NO: 130913 - DNA, 25 bp, Mus musculus
actggaatttaccttgatgtgtata

SEQ ID NO: 130914 - DNA, 25 bp, Mus musculus
actggaatttacgttgatgtgtata

SEQ ID NO: 130915 - DNA, 25 bp, Mus musculus
actggaatttccaacagcagcgtct

SEQ ID NO: 130916 - DNA, 25 bp, Mus musculus
actggaatttcctacagcagcgtct

SEQ ID NO: 130917 - DNA, 25 bp, Mus musculus
actggacaaaagatcgggcaagcct

SEQ ID NO: 130918 - DNA, 25 bp, Mus musculus
actggacaaaagttcgggcaagcct

SEQ ID NO: 130919 - DNA, 25 bp, Mus musculus
actggacaaactaggcctctggcgt

SEQ ID NO: 130920 - DNA, 25 bp, Mus musculus
actggacaaacttggcctctggcgt

SEQ ID NO: 130921 - DNA, 25 bp, Mus musculus
actggacaaggcctgtgcagaggag

SEQ ID NO: 130922 - DNA, 25 bp, Mus musculus
actggacaaggcgtgtgcagaggag

SEQ ID NO: 130923 - DNA, 25 bp, Mus musculus
actggacacattccgtttgttcacc

SEQ ID NO: 130924 - DNA, 25 bp, Mus musculus
actggacacattgcgtttgttcacc

SEQ ID NO: 130925 - DNA, 25 bp, Mus musculus
actggacacttcagcatgggccaaa

SEQ ID NO: 130926 - DNA, 25 bp, Mus musculus
actggacacttctgcatgggccaaa

SEQ ID NO: 130927 - DNA, 25 bp, Mus musculus
actggacagcaacagcatttggctt

SEQ ID NO: 130928 - DNA, 25 bp, Mus musculus
actggacagcaagagcatttggctt

SEQ ID NO: 130929 - DNA, 25 bp, Mus musculus
actggacagcgtcgaggtaccctaa

SEQ ID NO: 130930 - DNA, 25 bp, Mus musculus
actggacagcgtggaggtaccctaa

SEQ ID NO: 130931 - DNA, 25 bp, Mus musculus
actggacagctcagcccctcagttg

SEQ ID NO: 130932 - DNA, 25 bp, Mus musculus
actggacagctcatgagaaaggtac

SEQ ID NO: 130933 - DNA, 25 bp, Mus musculus
actggacagctctgcccctcagttg

SEQ ID NO: 130934 - DNA, 25 bp, Mus musculus
actggacagctcttgagaaaggtac

SEQ ID NO: 130935 - DNA, 25 bp, Mus musculus
actggacaggaaactgcagtctcag

SEQ ID NO: 130936 - DNA, 25 bp, Mus musculus
actggacaggaatctgcagtctcag

SEQ ID NO: 130937 - DNA, 25 bp, Mus musculus
actggacaggtaatggctgcccttc

SEQ ID NO: 130938 - DNA, 25 bp, Mus musculus
actggacaggtattggctgcccttc

SEQ ID NO: 130939 - DNA, 25 bp, Mus musculus
actggacagtggctaccatcttctt

SEQ ID NO: 130940 - DNA, 25 bp, Mus musculus
actggacagtgggtaccatcttctt

SEQ ID NO: 130941 - DNA, 25 bp, Mus musculus
actggacataggcatggtggctaaa

SEQ ID NO: 130942 - DNA, 25 bp, Mus musculus
actggacatagggatggtggctaaa

SEQ ID NO: 130943 - DNA, 25 bp, Mus musculus
actggacatgtgattcctggcatcc

SEQ ID NO: 130944 - DNA, 25 bp, Mus musculus
actggacatgtgtttcctggcatcc

SEQ ID NO: 130945 - DNA, 25 bp, Mus musculus
actggacatgttccagagggctgct

SEQ ID NO: 130946 - DNA, 25 bp, Mus musculus
actggacatgttgcagagggctgct

SEQ ID NO: 130947 - DNA, 25 bp, Mus musculus
actggacattttccaacgccaaagg

SEQ ID NO: 130948 - DNA, 25 bp, Mus musculus
actggacattttgcaacgccaaagg

SEQ ID NO: 130949 - DNA, 25 bp, Mus musculus
actggaccacctcactgtttcagga

SEQ ID NO: 130950 - DNA, 25 bp, Mus musculus
actggaccacctgactgtttcagga

SEQ ID NO: 130951 - DNA, 25 bp, Mus musculus
actggacccaggcagcttccaggaa

SEQ ID NO: 130952 - DNA, 25 bp, Mus musculus
actggacccagggagcttccaggaa

SEQ ID NO: 130953 - DNA, 25 bp, Mus musculus
actggacccatcacttgttgaaagt

SEQ ID NO: 130954 - DNA, 25 bp, Mus musculus
actggacccatctcttgttgaaagt

SEQ ID NO: 130955 - DNA, 25 bp, Mus musculus
actggaccctctagctcctctgaga

SEQ ID NO: 130956 - DNA, 25 bp, Mus musculus
actggaccctcttgctcctctgaga

SEQ ID NO: 130957 - DNA, 25 bp, Mus musculus
actggaccgacgagccacttagttt

SEQ ID NO: 130958 - DNA, 25 bp, Mus musculus
actggaccgacgtgccacttagttt

SEQ ID NO: 130959 - DNA, 25 bp, Mus musculus
actggacctcatcatgtgcttccgc

SEQ ID NO: 130960 - DNA, 25 bp, Mus musculus
actggacctcatgatgtgcttccgc

SEQ ID NO: 130961 - DNA, 25 bp, Mus musculus
actggacctcccacacaggtgagat

SEQ ID NO: 130962 - DNA, 25 bp, Mus musculus
actggacctccctcacaggtgagat

SEQ ID NO: 130963 - DNA, 25 bp, Mus musculus
actggacctgcgctgttgttagagc

SEQ ID NO: 130964 - DNA, 25 bp, Mus musculus
actggacctgcggtgttgttagagc

SEQ ID NO: 130965 - DNA, 25 bp, Mus musculus
actggacctgtgaaattttcatgca

SEQ ID NO: 130966 - DNA, 25 bp, Mus musculus
actggacctgtgtaattttcatgca

SEQ ID NO: 130967 - DNA, 25 bp, Mus musculus
actggaccttccaggtcctggtcat

SEQ ID NO: 130968 - DNA, 25 bp, Mus musculus
actggaccttcctggtcctggtcat

SEQ ID NO: 130969 - DNA, 25 bp, Mus musculus
actggacctttgcaccccaagatat

SEQ ID NO: 130970 - DNA, 25 bp, Mus musculus
actggacctttggaccccaagatat

SEQ ID NO: 130971 - DNA, 25 bp, Mus musculus
actggacgagtcctgcttcagatta

SEQ ID NO: 130972 - DNA, 25 bp, Mus musculus
actggacgagtcgtgcttcagatta

SEQ ID NO: 130973 - DNA, 25 bp, Mus musculus
actggacgttctcagggagctgcac

SEQ ID NO: 130974 - DNA, 25 bp, Mus musculus
actggacgttctgagggagctgcac

SEQ ID NO: 130975 - DNA, 25 bp, Mus musculus
actggactaagaaccttctgggcca

SEQ ID NO: 130976 - DNA, 25 bp, Mus musculus
actggactaagatccttctgggcca

SEQ ID NO: 130977 - DNA, 25 bp, Mus musculus
actggactagataacgtgactggat

SEQ ID NO: 130978 - DNA, 25 bp, Mus musculus
actggactagattacgtgactggat

SEQ ID NO: 130979 - DNA, 25 bp, Mus musculus
actggactatgaacttggaccgcta

SEQ ID NO: 130980 - DNA, 25 bp, Mus musculus
actggactatgatcttggaccgcta

SEQ ID NO: 130981 - DNA, 25 bp, Mus musculus
actggactcccaagtcacgagagta

SEQ ID NO: 130982 - DNA, 25 bp, Mus musculus
actggactcccatgtcacgagagta

SEQ ID NO: 130983 - DNA, 25 bp, Mus musculus
actggactctagacatgtcttctgc

SEQ ID NO: 130984 - DNA, 25 bp, Mus musculus
actggactctagtcatgtcttctgc

SEQ ID NO: 130985 - DNA, 25 bp, Mus musculus
actggactctgaccttagcttgctt

SEQ ID NO: 130986 - DNA, 25 bp, Mus musculus
actggactctgagcttagcttgctt

SEQ ID NO: 130987 - DNA, 25 bp, Mus musculus
actggactcttcagctaatcttgat

SEQ ID NO: 130988 - DNA, 25 bp, Mus musculus
actggactcttcatcggtgtggatc

SEQ ID NO: 130989 - DNA, 25 bp, Mus musculus
actggactcttctgctaatcttgat

SEQ ID NO: 130990 - DNA, 25 bp, Mus musculus
actggactcttcttcggtgtggatc

SEQ ID NO: 130991 - DNA, 25 bp, Mus musculus
actggactgctgctctagtcgtgaa

SEQ ID NO: 130992 - DNA, 25 bp, Mus musculus
actggactgctggtctagtcgtgaa

SEQ ID NO: 130993 - DNA, 25 bp, Mus musculus
actggacttactaggctgtgagaca

SEQ ID NO: 130994 - DNA, 25 bp, Mus musculus
actggacttacttggctgtgagaca

SEQ ID NO: 130995 - DNA, 25 bp, Mus musculus
actggacttagactgaatgttggca

SEQ ID NO: 130996 - DNA, 25 bp, Mus musculus
actggacttagagtgaatgttggca

SEQ ID NO: 130997 - DNA, 25 bp, Mus musculus
actggacttccgacgttttctacag

SEQ ID NO: 130998 - DNA, 25 bp, Mus musculus
actggacttccgtcgttttctacag

SEQ ID NO: 130999 - DNA, 25 bp, Mus musculus
actggacttcctatatgttcctctt

SEQ ID NO: 131000 - DNA, 25 bp, Mus musculus
actggacttcctttatgttcctctt

SEQ ID NO: 131001 - DNA, 25 bp, Mus musculus
actggacttgatcatgcgtgtgaat

SEQ ID NO: 131002 - DNA, 25 bp, Mus musculus
actggacttgatgatgcgtgtgaat

SEQ ID NO: 131003 - DNA, 25 bp, Mus musculus
actggacttgtgacctggcattgcc

SEQ ID NO: 131004 - DNA, 25 bp, Mus musculus
actggacttgtgtcctggcattgcc

SEQ ID NO: 131005 - DNA, 25 bp, Mus musculus
actggactttacagcagctgctttc

SEQ ID NO: 131006 - DNA, 25 bp, Mus musculus
actggactttactgcagctgctttc

SEQ ID NO: 131007 - DNA, 25 bp, Mus musculus
actggagaattcaaatggtgtgcaa

SEQ ID NO: 131008 - DNA, 25 bp, Mus musculus
actggagaattctaatggtgtgcaa

SEQ ID NO: 131009 - DNA, 25 bp, Mus musculus
actggagacacgcatcagagagctg

SEQ ID NO: 131010 - DNA, 25 bp, Mus musculus
actggagacacggatcagagagctg

SEQ ID NO: 131011 - DNA, 25 bp, Mus musculus
actggagactggattcaaatgatca

SEQ ID NO: 131012 - DNA, 25 bp, Mus musculus
actggagactggtttcaaatgatca

SEQ ID NO: 131013 - DNA, 25 bp, Mus musculus
actggagagcagctgagggcaacaa

SEQ ID NO: 131014 - DNA, 25 bp, Mus musculus
actggagagcaggtgagggcaacaa

SEQ ID NO: 131015 - DNA, 25 bp, Mus musculus
actggagagctgagtcaatggagat

SEQ ID NO: 131016 - DNA, 25 bp, Mus musculus
actggagagctgtgtcaatggagat

SEQ ID NO: 131017 - DNA, 25 bp, Mus musculus
actggagataatcagaatcttgtca

SEQ ID NO: 131018 - DNA, 25 bp, Mus musculus
actggagataatgagaatcttgtca

SEQ ID NO: 131019 - DNA, 25 bp, Mus musculus
actggagatcccattacccaatcgt

SEQ ID NO: 131020 - DNA, 25 bp, Mus musculus
actggagatccctttacccaatcgt

SEQ ID NO: 131021 - DNA, 25 bp, Mus musculus
actggagatgctacgtgcctcggga

SEQ ID NO: 131022 - DNA, 25 bp, Mus musculus
actggagatgcttcgtgcctcggga

SEQ ID NO: 131023 - DNA, 25 bp, Mus musculus
actggagcaagcaccccacagcagt

SEQ ID NO: 131024 - DNA, 25 bp, Mus musculus
actggagcaagctccccacagcagt

SEQ ID NO: 131025 - DNA, 25 bp, Mus musculus
actggagcaggaatacaagaacact

SEQ ID NO: 131026 - DNA, 25 bp, Mus musculus
actggagcaggaatatttgtcactt

SEQ ID NO: 131027 - DNA, 25 bp, Mus musculus
actggagcaggattacaagaacact

SEQ ID NO: 131028 - DNA, 25 bp, Mus musculus
actggagcaggattatttgtcactt

SEQ ID NO: 131029 - DNA, 25 bp, Mus musculus
actggagcatggacgtcctgaggat

SEQ ID NO: 131030 - DNA, 25 bp, Mus musculus
actggagcatggtcgtcctgaggat

SEQ ID NO: 131031 - DNA, 25 bp, Mus musculus
actggagcatttacatttcgattct

SEQ ID NO: 131032 - DNA, 25 bp, Mus musculus
actggagcattttcatttcgattct

SEQ ID NO: 131033 - DNA, 25 bp, Mus musculus
actggagcccttacagtgatgctga

SEQ ID NO: 131034 - DNA, 25 bp, Mus musculus
actggagccctttcagtgatgctga

SEQ ID NO: 131035 - DNA, 25 bp, Mus musculus
actggagcggatctcagggtatcat

SEQ ID NO: 131036 - DNA, 25 bp, Mus musculus
actggagcggatgtcagggtatcat

SEQ ID NO: 131037 - DNA, 25 bp, Mus musculus
actggagctgctaaacggtttgata

SEQ ID NO: 131038 - DNA, 25 bp, Mus musculus
actggagctgcttaacggtttgata

SEQ ID NO: 131039 - DNA, 25 bp, Mus musculus
actggagctgttagcccatggattg

SEQ ID NO: 131040 - DNA, 25 bp, Mus musculus
actggagctgttctttgggttcttc

SEQ ID NO: 131041 - DNA, 25 bp, Mus musculus
actggagctgttgtttgggttcttc

SEQ ID NO: 131042 - DNA, 25 bp, Mus musculus
actggagctgtttgcccatggattg

SEQ ID NO: 131043 - DNA, 25 bp, Mus musculus
actggagcttctccaagagggactt

SEQ ID NO: 131044 - DNA, 25 bp, Mus musculus
actggagcttctgcaagagggactt

SEQ ID NO: 131045 - DNA, 25 bp, Mus musculus
actggaggaacgaacttgatgactg

SEQ ID NO: 131046 - DNA, 25 bp, Mus musculus
actggaggaacgtacttgatgactg

SEQ ID NO: 131047 - DNA, 25 bp, Mus musculus
actggaggaaggcaagccctgccct

SEQ ID NO: 131048 - DNA, 25 bp, Mus musculus
actggaggaagggaagccctgccct

SEQ ID NO: 131049 - DNA, 25 bp, Mus musculus
actggaggaagtatttcagacaaca

SEQ ID NO: 131050 - DNA, 25 bp, Mus musculus
actggaggaagtttttcagacaaca

SEQ ID NO: 131051 - DNA, 25 bp, Mus musculus
actggaggacaaaacccaatttgag

SEQ ID NO: 131052 - DNA, 25 bp, Mus musculus
actggaggacaatacccaatttgag

SEQ ID NO: 131053 - DNA, 25 bp, Mus musculus
actggaggataactctcacctctac

SEQ ID NO: 131054 - DNA, 25 bp, Mus musculus
actggaggataagtctcacctctac

SEQ ID NO: 131055 - DNA, 25 bp, Mus musculus
actggaggccaacatggctggctct

SEQ ID NO: 131056 - DNA, 25 bp, Mus musculus
actggaggccaagatggctggctct

SEQ ID NO: 131057 - DNA, 25 bp, Mus musculus
actggaggcccacgtcaaaggttga

SEQ ID NO: 131058 - DNA, 25 bp, Mus musculus
actggaggcccaggtcaaaggttga

SEQ ID NO: 131059 - DNA, 25 bp, Mus musculus
actggaggcgtgatgctgtgtatcc

SEQ ID NO: 131060 - DNA, 25 bp, Mus musculus
actggaggcgtgttgctgtgtatcc

SEQ ID NO: 131061 - DNA, 25 bp, Mus musculus
actggaggctgtagccctggagcat

SEQ ID NO: 131062 - DNA, 25 bp, Mus musculus
actggaggctgttgccctggagcat

SEQ ID NO: 131063 - DNA, 25 bp, Mus musculus
actggaggctttagagtctgagagc

SEQ ID NO: 131064 - DNA, 25 bp, Mus musculus
actggaggcttttgagtctgagagc

SEQ ID NO: 131065 - DNA, 25 bp, Mus musculus
actggagggcagcagctgattcatt

SEQ ID NO: 131066 - DNA, 25 bp, Mus musculus
actggagggcaggagctgattcatt

SEQ ID NO: 131067 - DNA, 25 bp, Mus musculus
actggagggccaagttaaaagcttt

SEQ ID NO: 131068 - DNA, 25 bp, Mus musculus
actggagggccatgttaaaagcttt

SEQ ID NO: 131069 - DNA, 25 bp, Mus musculus
actggagggctgaagaagtcaatac

SEQ ID NO: 131070 - DNA, 25 bp, Mus musculus
actggagggctgagtgtgttcattt

SEQ ID NO: 131071 - DNA, 25 bp, Mus musculus
actggagggctgtagaagtcaatac

SEQ ID NO: 131072 - DNA, 25 bp, Mus musculus
actggagggctgtgtgtgttcattt

SEQ ID NO: 131073 - DNA, 25 bp, Mus musculus
actggaggtaccacccaggacattg

SEQ ID NO: 131074 - DNA, 25 bp, Mus musculus
actggaggtacctcccaggacattg

SEQ ID NO: 131075 - DNA, 25 bp, Mus musculus
actggaggtctgactgcaaccatac

SEQ ID NO: 131076 - DNA, 25 bp, Mus musculus
actggaggtctgtctgcaaccatac

SEQ ID NO: 131077 - DNA, 25 bp, Mus musculus
actggaggtgggaagtgccattctc

SEQ ID NO: 131078 - DNA, 25 bp, Mus musculus
actggaggtgggtagtgccattctc

SEQ ID NO: 131079 - DNA, 25 bp, Mus musculus
actggagtacaaacccctttcataa

SEQ ID NO: 131080 - DNA, 25 bp, Mus musculus
actggagtacaatcccctttcataa

SEQ ID NO: 131081 - DNA, 25 bp, Mus musculus
actggagtaccacatatgtcccact

SEQ ID NO: 131082 - DNA, 25 bp, Mus musculus
actggagtaccagatatgtcccact

SEQ ID NO: 131083 - DNA, 25 bp, Mus musculus
actggagtatgtcgaggagaaaacc

SEQ ID NO: 131084 - DNA, 25 bp, Mus musculus
actggagtatgtggaggagaaaacc

SEQ ID NO: 131085 - DNA, 25 bp, Mus musculus
actggagtcaatcgacctgatgccc

SEQ ID NO: 131086 - DNA, 25 bp, Mus musculus
actggagtcaatggacctgatgccc

SEQ ID NO: 131087 - DNA, 25 bp, Mus musculus
actggagtcagcacaagtctcagat

SEQ ID NO: 131088 - DNA, 25 bp, Mus musculus
actggagtcagctcaagtctcagat

SEQ ID NO: 131089 - DNA, 25 bp, Mus musculus
actggagtccaacagctcttcggag

SEQ ID NO: 131090 - DNA, 25 bp, Mus musculus
actggagtccaacattcagtgcttg

SEQ ID NO: 131091 - DNA, 25 bp, Mus musculus
actggagtccaagagctcttcggag

SEQ ID NO: 131092 - DNA, 25 bp, Mus musculus
actggagtccaagattcagtgcttg

SEQ ID NO: 131093 - DNA, 25 bp, Mus musculus
actggagtccaccaagaagccactg

SEQ ID NO: 131094 - DNA, 25 bp, Mus musculus
actggagtccacgaagaagccactg

SEQ ID NO: 131095 - DNA, 25 bp, Mus musculus
actggagtccggattgcgttttgtt

SEQ ID NO: 131096 - DNA, 25 bp, Mus musculus
actggagtccggtttgcgttttgtt

SEQ ID NO: 131097 - DNA, 25 bp, Mus musculus
actggagtcgccagtatttaccggg

SEQ ID NO: 131098 - DNA, 25 bp, Mus musculus
actggagtcgcctgtatttaccggg

SEQ ID NO: 131099 - DNA, 25 bp, Mus musculus
actggagtctttatgttgtcatctg

SEQ ID NO: 131100 - DNA, 25 bp, Mus musculus
actggagtctttttgttgtcatctg

SEQ ID NO: 131101 - DNA, 25 bp, Mus musculus
actggagtgacgacacagttggact

SEQ ID NO: 131102 - DNA, 25 bp, Mus musculus
actggagtgacgtcacagttggact

SEQ ID NO: 131103 - DNA, 25 bp, Mus musculus
actggagtgagcctttacgtttctc

SEQ ID NO: 131104 - DNA, 25 bp, Mus musculus
actggagtgagcgtttacgtttctc

SEQ ID NO: 131105 - DNA, 25 bp, Mus musculus
actggagtgctcctgttctaagctc

SEQ ID NO: 131106 - DNA, 25 bp, Mus musculus
actggagtgctcgtgttctaagctc

SEQ ID NO: 131107 - DNA, 25 bp, Mus musculus
actggagtggcaactggcttatgtc

SEQ ID NO: 131108 - DNA, 25 bp, Mus musculus
actggagtggcatctggcttatgtc

SEQ ID NO: 131109 - DNA, 25 bp, Mus musculus
actggagtgtttacttgagtactaa

SEQ ID NO: 131110 - DNA, 25 bp, Mus musculus
actggagtgttttcttgagtactaa

SEQ ID NO: 131111 - DNA, 25 bp, Mus musculus
actggagttccgattctgctggagt

SEQ ID NO: 131112 - DNA, 25 bp, Mus musculus
actggagttccgtttctgctggagt

SEQ ID NO: 131113 - DNA, 25 bp, Mus musculus
actggagttcctcgactgtggtaag

SEQ ID NO: 131114 - DNA, 25 bp, Mus musculus
actggagttcctggactgtggtaag

SEQ ID NO: 131115 - DNA, 25 bp, Mus musculus
actggagtttatcttgtcttgccct

SEQ ID NO: 131116 - DNA, 25 bp, Mus musculus
actggagtttatgttgtcttgccct

SEQ ID NO: 131117 - DNA, 25 bp, Mus musculus
actggataccagattcgtcttcaaa

SEQ ID NO: 131118 - DNA, 25 bp, Mus musculus
actggataccagtttcgtcttcaaa

SEQ ID NO: 131119 - DNA, 25 bp, Mus musculus
actggataccccaaatgctctttat

SEQ ID NO: 131120 - DNA, 25 bp, Mus musculus
actggatacccctaatgctctttat

SEQ ID NO: 131121 - DNA, 25 bp, Mus musculus
actggatactgcctaacctaacctt

SEQ ID NO: 131122 - DNA, 25 bp, Mus musculus
actggatactgcgtaacctaacctt

SEQ ID NO: 131123 - DNA, 25 bp, Mus musculus
actggatagattagtacgacgagcc

SEQ ID NO: 131124 - DNA, 25 bp, Mus musculus
actggatagatttgtacgacgagcc

SEQ ID NO: 131125 - DNA, 25 bp, Mus musculus
actggatagcttagggagttcctca

SEQ ID NO: 131126 - DNA, 25 bp, Mus musculus
actggatagctttgggagttcctca

SEQ ID NO: 131127 - DNA, 25 bp, Mus musculus
actggatagtggaagtgcgtgcctt

SEQ ID NO: 131128 - DNA, 25 bp, Mus musculus
actggatagtggtagtgcgtgcctt

SEQ ID NO: 131129 - DNA, 25 bp, Mus musculus
actggatcatgaatttccctcagaa

SEQ ID NO: 131130 - DNA, 25 bp, Mus musculus
actggatcatgattttccctcagaa

SEQ ID NO: 131131 - DNA, 25 bp, Mus musculus
actggatcccaaacatttgtcggaa

SEQ ID NO: 131132 - DNA, 25 bp, Mus musculus
actggatcccaatcatttgtcggaa

SEQ ID NO: 131133 - DNA, 25 bp, Mus musculus
actggatccgctattgtattttcta

SEQ ID NO: 131134 - DNA, 25 bp, Mus musculus
actggatccgcttttgtattttcta

SEQ ID NO: 131135 - DNA, 25 bp, Mus musculus
actggatcctaaaggccggtcacat

SEQ ID NO: 131136 - DNA, 25 bp, Mus musculus
actggatcctaatggccggtcacat

SEQ ID NO: 131137 - DNA, 25 bp, Mus musculus
actggatctaatagtgttcccctgc

SEQ ID NO: 131138 - DNA, 25 bp, Mus musculus
actggatctaattgtgttcccctgc

SEQ ID NO: 131139 - DNA, 25 bp, Mus musculus
actggatctcaactgaagctctttc

SEQ ID NO: 131140 - DNA, 25 bp, Mus musculus
actggatctcaagtgaagctctttc

SEQ ID NO: 131141 - DNA, 25 bp, Mus musculus
actggatctctaacctaacgtccat

SEQ ID NO: 131142 - DNA, 25 bp, Mus musculus
actggatctctatcctaacgtccat

SEQ ID NO: 131143 - DNA, 25 bp, Mus musculus
actggatctgtcatgtgaaccaagc

SEQ ID NO: 131144 - DNA, 25 bp, Mus musculus
actggatctgtcttgtgaaccaagc

SEQ ID NO: 131145 - DNA, 25 bp, Mus musculus
actggatcttctccattacaacatt

SEQ ID NO: 131146 - DNA, 25 bp, Mus musculus
actggatcttctgcattacaacatt

SEQ ID NO: 131147 - DNA, 25 bp, Mus musculus
actggatgaaggaaggctcccgctc

SEQ ID NO: 131148 - DNA, 25 bp, Mus musculus
actggatgaaggtaggctcccgctc

SEQ ID NO: 131149 - DNA, 25 bp, Mus musculus
actggatgatgccaatgatgctggt

SEQ ID NO: 131150 - DNA, 25 bp, Mus musculus
actggatgatgcgaatgatgctggt

SEQ ID NO: 131151 - DNA, 25 bp, Mus musculus
actggatgcagtacgaatgatgatc

SEQ ID NO: 131152 - DNA, 25 bp, Mus musculus
actggatgcagttcgaatgatgatc

SEQ ID NO: 131153 - DNA, 25 bp, Mus musculus
actggatgctgtcgactgtctgcaa

SEQ ID NO: 131154 - DNA, 25 bp, Mus musculus
actggatgctgtggactgtctgcaa

SEQ ID NO: 131155 - DNA, 25 bp, Mus musculus
actggatggaataccgtgtctcgca

SEQ ID NO: 131156 - DNA, 25 bp, Mus musculus
actggatggaattccgtgtctcgca

SEQ ID NO: 131157 - DNA, 25 bp, Mus musculus
actggatggcagagaagtcggttac

SEQ ID NO: 131158 - DNA, 25 bp, Mus musculus
actggatggcagtgaagtcggttac

SEQ ID NO: 131159 - DNA, 25 bp, Mus musculus
actggatgggtgaccgtaaaattct

SEQ ID NO: 131160 - DNA, 25 bp, Mus musculus
actggatgggtgtccgtaaaattct

SEQ ID NO: 131161 - DNA, 25 bp, Mus musculus
actggatgggttacatggtgtctgt

SEQ ID NO: 131162 - DNA, 25 bp, Mus musculus
actggatgggtttcatggtgtctgt

SEQ ID NO: 131163 - DNA, 25 bp, Mus musculus
actggatgtactaccacaggtcctg

SEQ ID NO: 131164 - DNA, 25 bp, Mus musculus
actggatgtacttccacaggtcctg

SEQ ID NO: 131165 - DNA, 25 bp, Mus musculus
actggatgtcctcctgtcctcgagg

SEQ ID NO: 131166 - DNA, 25 bp, Mus musculus
actggatgtcctgctgtcctcgagg

SEQ ID NO: 131167 - DNA, 25 bp, Mus musculus
actggatgtctcagcttctccttag

SEQ ID NO: 131168 - DNA, 25 bp, Mus musculus
actggatgtctctgcttctccttag

SEQ ID NO: 131169 - DNA, 25 bp, Mus musculus
actggatgtgacatcataccaaggt

SEQ ID NO: 131170 - DNA, 25 bp, Mus musculus
actggatgtgacttcataccaaggt

SEQ ID NO: 131171 - DNA, 25 bp, Mus musculus
actggatgtgtacatggcccacgct

SEQ ID NO: 131172 - DNA, 25 bp, Mus musculus
actggatgtgtagatggcccacgct

SEQ ID NO: 131173 - DNA, 25 bp, Mus musculus
actggatgttatctcaagggaaaaa

SEQ ID NO: 131174 - DNA, 25 bp, Mus musculus
actggatgttatgtcaagggaaaaa

SEQ ID NO: 131175 - DNA, 25 bp, Mus musculus
actggattacgtagtgtttgtgtgc

SEQ ID NO: 131176 - DNA, 25 bp, Mus musculus
actggattacgttgtgtttgtgtgc

SEQ ID NO: 131177 - DNA, 25 bp, Mus musculus
actggattcaacatctggaaggccc

SEQ ID NO: 131178 - DNA, 25 bp, Mus musculus
actggattcaacttctggaaggccc

SEQ ID NO: 131179 - DNA, 25 bp, Mus musculus
actggattcgcaacagtgagatgct

SEQ ID NO: 131180 - DNA, 25 bp, Mus musculus
actggattcgcatcagtgagatgct

SEQ ID NO: 131181 - DNA, 25 bp, Mus musculus
actggattctagcttaaacaccttg

SEQ ID NO: 131182 - DNA, 25 bp, Mus musculus
actggattctaggttaaacaccttg

SEQ ID NO: 131183 - DNA, 25 bp, Mus musculus
actggattctttagcccagtcttcc

SEQ ID NO: 131184 - DNA, 25 bp, Mus musculus
actggattcttttgcccagtcttcc

SEQ ID NO: 131185 - DNA, 25 bp, Mus musculus
actggattgcggaggagccacctgc

SEQ ID NO: 131186 - DNA, 25 bp, Mus musculus
actggattgcggtggagccacctgc

SEQ ID NO: 131187 - DNA, 25 bp, Mus musculus
actggatttcatcatgttctggcta

SEQ ID NO: 131188 - DNA, 25 bp, Mus musculus
actggatttcatgatgttctggcta

SEQ ID NO: 131189 - DNA, 25 bp, Mus musculus
actggatttgatcccttcttgacaa

SEQ ID NO: 131190 - DNA, 25 bp, Mus musculus
actggatttgatgccttcttgacaa

SEQ ID NO: 131191 - DNA, 25 bp, Mus musculus
actggattttacatggcttctttgc

SEQ ID NO: 131192 - DNA, 25 bp, Mus musculus
actggattttacttggcttctttgc

SEQ ID NO: 131193 - DNA, 25 bp, Mus musculus
actggattttggctgttcttcttcc

SEQ ID NO: 131194 - DNA, 25 bp, Mus musculus
actggattttgggtgttcttcttcc

SEQ ID NO: 131195 - DNA, 25 bp, Mus musculus
actggcaactgcaccgtggtttttc

SEQ ID NO: 131196 - DNA, 25 bp, Mus musculus
actggcaactgctccgtggtttttc

SEQ ID NO: 131197 - DNA, 25 bp, Mus musculus
actggcaatgaacaattccgacctg

SEQ ID NO: 131198 - DNA, 25 bp, Mus musculus
actggcaatgaagaattccgacctg

SEQ ID NO: 131199 - DNA, 25 bp, Mus musculus
actggcacaataaaacctaattctg

SEQ ID NO: 131200 - DNA, 25 bp, Mus musculus
actggcacaatataacctaattctg

SEQ ID NO: 131201 - DNA, 25 bp, Mus musculus
actggcacagagaagagtgagctcc

SEQ ID NO: 131202 - DNA, 25 bp, Mus musculus
actggcacagagagggctcagtaaa

SEQ ID NO: 131203 - DNA, 25 bp, Mus musculus
actggcacagagtagagtgagctcc

SEQ ID NO: 131204 - DNA, 25 bp, Mus musculus
actggcacagagtgggctcagtaaa

SEQ ID NO: 131205 - DNA, 25 bp, Mus musculus
actggcacagctaccctgcttttta

SEQ ID NO: 131206 - DNA, 25 bp, Mus musculus
actggcacagcttccctgcttttta

SEQ ID NO: 131207 - DNA, 25 bp, Mus musculus
actggcacaggaagcatccatgtgg

SEQ ID NO: 131208 - DNA, 25 bp, Mus musculus
actggcacaggatgcatccatgtgg

SEQ ID NO: 131209 - DNA, 25 bp, Mus musculus
actggcacagtgcatagtaactttg

SEQ ID NO: 131210 - DNA, 25 bp, Mus musculus
actggcacagtggatagtaactttg

SEQ ID NO: 131211 - DNA, 25 bp, Mus musculus
actggcaccctaatgattttcatga

SEQ ID NO: 131212 - DNA, 25 bp, Mus musculus
actggcaccctattgattttcatga

SEQ ID NO: 131213 - DNA, 25 bp, Mus musculus
actggcacctgaattgttccttcca

SEQ ID NO: 131214 - DNA, 25 bp, Mus musculus
actggcacctgatttgttccttcca

SEQ ID NO: 131215 - DNA, 25 bp, Mus musculus
actggcaccttgcacccaggagaaa

SEQ ID NO: 131216 - DNA, 25 bp, Mus musculus
actggcaccttggacccaggagaaa

SEQ ID NO: 131217 - DNA, 25 bp, Mus musculus
actggcacctttactctatgatggt

SEQ ID NO: 131218 - DNA, 25 bp, Mus musculus
actggcaccttttctctatgatggt

SEQ ID NO: 131219 - DNA, 25 bp, Mus musculus
actggcacgactcactggttcggaa

SEQ ID NO: 131220 - DNA, 25 bp, Mus musculus
actggcacgactgactggttcggaa

SEQ ID NO: 131221 - DNA, 25 bp, Mus musculus
actggcacgtaaattcgaagatttt

SEQ ID NO: 131222 - DNA, 25 bp, Mus musculus
actggcacgtaatttcgaagatttt

SEQ ID NO: 131223 - DNA, 25 bp, Mus musculus
actggcactccaactttacaagaca

SEQ ID NO: 131224 - DNA, 25 bp, Mus musculus
actggcactccatctttacaagaca

SEQ ID NO: 131225 - DNA, 25 bp, Mus musculus
actggcactcttcacttataatttt

SEQ ID NO: 131226 - DNA, 25 bp, Mus musculus
actggcactcttgacttataatttt

SEQ ID NO: 131227 - DNA, 25 bp, Mus musculus
actggcactgcacaagactttgtga

SEQ ID NO: 131228 - DNA, 25 bp, Mus musculus
actggcactgcagaagactttgtga

SEQ ID NO: 131229 - DNA, 25 bp, Mus musculus
actggcactggtataggcactggct

SEQ ID NO: 131230 - DNA, 25 bp, Mus musculus
actggcactggtttaggcactggct

SEQ ID NO: 131231 - DNA, 25 bp, Mus musculus
actggcagaataattctttcttgtt

SEQ ID NO: 131232 - DNA, 25 bp, Mus musculus
actggcagaatatttctttcttgtt

SEQ ID NO: 131233 - DNA, 25 bp, Mus musculus
actggcagacagatgctgtttttct

SEQ ID NO: 131234 - DNA, 25 bp, Mus musculus
actggcagacagttgctgtttttct

SEQ ID NO: 131235 - DNA, 25 bp, Mus musculus
actggcagacgtccaagaggctctt

SEQ ID NO: 131236 - DNA, 25 bp, Mus musculus
actggcagacgtgcaagaggctctt

SEQ ID NO: 131237 - DNA, 25 bp, Mus musculus
actggcagagctaggactcgcggcc

SEQ ID NO: 131238 - DNA, 25 bp, Mus musculus
actggcagagcttggactcgcggcc

SEQ ID NO: 131239 - DNA, 25 bp, Mus musculus
actggcagagttccgcctcggcctt

SEQ ID NO: 131240 - DNA, 25 bp, Mus musculus
actggcagagttgcgcctcggcctt

SEQ ID NO: 131241 - DNA, 25 bp, Mus musculus
actggcagatgtcgttttgttaaca

SEQ ID NO: 131242 - DNA, 25 bp, Mus musculus
actggcagatgtggttttgttaaca

SEQ ID NO: 131243 - DNA, 25 bp, Mus musculus
actggcagcactacaaggcgggctt

SEQ ID NO: 131244 - DNA, 25 bp, Mus musculus
actggcagcactcatgactctggaa

SEQ ID NO: 131245 - DNA, 25 bp, Mus musculus
actggcagcactgatgactctggaa

SEQ ID NO: 131246 - DNA, 25 bp, Mus musculus
actggcagcacttcaaggcgggctt

SEQ ID NO: 131247 - DNA, 25 bp, Mus musculus
actggcagccctccaattggtagtg

SEQ ID NO: 131248 - DNA, 25 bp, Mus musculus
actggcagccctgcaattggtagtg

SEQ ID NO: 131249 - DNA, 25 bp, Mus musculus
actggcagctagagacttggtatgt

SEQ ID NO: 131250 - DNA, 25 bp, Mus musculus
actggcagctagtgacttggtatgt

SEQ ID NO: 131251 - DNA, 25 bp, Mus musculus
actggcaggagcactcactgtggag

SEQ ID NO: 131252 - DNA, 25 bp, Mus musculus
actggcaggagctctcactgtggag

SEQ ID NO: 131253 - DNA, 25 bp, Mus musculus
actggcaggctgcattttgaagttt

SEQ ID NO: 131254 - DNA, 25 bp, Mus musculus
actggcaggctggattttgaagttt

SEQ ID NO: 131255 - DNA, 25 bp, Mus musculus
actggcagggccatgcacagcaaag

SEQ ID NO: 131256 - DNA, 25 bp, Mus musculus
actggcagggccttgcacagcaaag

SEQ ID NO: 131257 - DNA, 25 bp, Mus musculus
actggcagggtgaactcggacaata

SEQ ID NO: 131258 - DNA, 25 bp, Mus musculus
actggcagggtgtactcggacaata

SEQ ID NO: 131259 - DNA, 25 bp, Mus musculus
actggcagtactaggacgtttttat

SEQ ID NO: 131260 - DNA, 25 bp, Mus musculus
actggcagtacttggacgtttttat

SEQ ID NO: 131261 - DNA, 25 bp, Mus musculus
actggcagtgatattgtctttctct

SEQ ID NO: 131262 - DNA, 25 bp, Mus musculus
actggcagtgattttgtctttctct

SEQ ID NO: 131263 - DNA, 25 bp, Mus musculus
actggcatagaaaattcccaaaacc

SEQ ID NO: 131264 - DNA, 25 bp, Mus musculus
actggcatagaaaccttacctgtaa

SEQ ID NO: 131265 - DNA, 25 bp, Mus musculus
actggcatagaatattcccaaaacc

SEQ ID NO: 131266 - DNA, 25 bp, Mus musculus
actggcatagaatccttacctgtaa

SEQ ID NO: 131267 - DNA, 25 bp, Mus musculus
actggcataggacttgccttttcta

SEQ ID NO: 131268 - DNA, 25 bp, Mus musculus
actggcataggagttgccttttcta

SEQ ID NO: 131269 - DNA, 25 bp, Mus musculus
actggcatcagtctgctcacagtat

SEQ ID NO: 131270 - DNA, 25 bp, Mus musculus
actggcatcagtgtgctcacagtat

SEQ ID NO: 131271 - DNA, 25 bp, Mus musculus
actggcatcatcaagaaagtgtttt

SEQ ID NO: 131272 - DNA, 25 bp, Mus musculus
actggcatcatctagaaagtgtttt

SEQ ID NO: 131273 - DNA, 25 bp, Mus musculus
actggcatcgacaaggtcccactga

SEQ ID NO: 131274 - DNA, 25 bp, Mus musculus
actggcatcgactaggtcccactga

SEQ ID NO: 131275 - DNA, 25 bp, Mus musculus
actggcatcttgctgtgttttggaa

SEQ ID NO: 131276 - DNA, 25 bp, Mus musculus
actggcatcttggtgtgttttggaa

SEQ ID NO: 131277 - DNA, 25 bp, Mus musculus
actggcatgattacagcctgccttt

SEQ ID NO: 131278 - DNA, 25 bp, Mus musculus
actggcatgatttcagcctgccttt

SEQ ID NO: 131279 - DNA, 25 bp, Mus musculus
actggcatggatcctatgcacccca

SEQ ID NO: 131280 - DNA, 25 bp, Mus musculus
actggcatggatgctatgcacccca

SEQ ID NO: 131281 - DNA, 25 bp, Mus musculus
actggcattcccatatatgacagaa

SEQ ID NO: 131282 - DNA, 25 bp, Mus musculus
actggcattcccttatatgacagaa

SEQ ID NO: 131283 - DNA, 25 bp, Mus musculus
actggcattccgcatatgagtgaca

SEQ ID NO: 131284 - DNA, 25 bp, Mus musculus
actggcattccggatatgagtgaca

SEQ ID NO: 131285 - DNA, 25 bp, Mus musculus
actggcattcttccctaatgatgtt

SEQ ID NO: 131286 - DNA, 25 bp, Mus musculus
actggcattcttgcctaatgatgtt

SEQ ID NO: 131287 - DNA, 25 bp, Mus musculus
actggcattgccatccaagccactt

SEQ ID NO: 131288 - DNA, 25 bp, Mus musculus
actggcattgccttccaagccactt

SEQ ID NO: 131289 - DNA, 25 bp, Mus musculus
actggcatttggaggacttcttaca

SEQ ID NO: 131290 - DNA, 25 bp, Mus musculus
actggcatttggtggacttcttaca

SEQ ID NO: 131291 - DNA, 25 bp, Mus musculus
actggcattttaattgacctctaac

SEQ ID NO: 131292 - DNA, 25 bp, Mus musculus
actggcattttatttgacctctaac

SEQ ID NO: 131293 - DNA, 25 bp, Mus musculus
actggcattttcatgcctccaagag

SEQ ID NO: 131294 - DNA, 25 bp, Mus musculus
actggcattttcttgcctccaagag

SEQ ID NO: 131295 - DNA, 25 bp, Mus musculus
actggccaaatcaggcctgctttca

SEQ ID NO: 131296 - DNA, 25 bp, Mus musculus
actggccaaatctggcctgctttca

SEQ ID NO: 131297 - DNA, 25 bp, Mus musculus
actggccaactgagaggacattctc

SEQ ID NO: 131298 - DNA, 25 bp, Mus musculus
actggccaactgtgaggacattctc

SEQ ID NO: 131299 - DNA, 25 bp, Mus musculus
actggccaagtcaccgttgaggctg

SEQ ID NO: 131300 - DNA, 25 bp, Mus musculus
actggccaagtctccgttgaggctg

SEQ ID NO: 131301 - DNA, 25 bp, Mus musculus
actggccaccatcaatgctcgctgg

SEQ ID NO: 131302 - DNA, 25 bp, Mus musculus
actggccaccatgaatgctcgctgg

SEQ ID NO: 131303 - DNA, 25 bp, Mus musculus
actggccacccaaaaagatctcact

SEQ ID NO: 131304 - DNA, 25 bp, Mus musculus
actggccacccataaagatctcact

SEQ ID NO: 131305 - DNA, 25 bp, Mus musculus
actggccaccttcctcagggatgga

SEQ ID NO: 131306 - DNA, 25 bp, Mus musculus
actggccaccttgctcagggatgga

SEQ ID NO: 131307 - DNA, 25 bp, Mus musculus
actggccacgtgaatgcttagttct

SEQ ID NO: 131308 - DNA, 25 bp, Mus musculus
actggccacgtgtatgcttagttct

SEQ ID NO: 131309 - DNA, 25 bp, Mus musculus
actggccactttcttgtcataggtc

SEQ ID NO: 131310 - DNA, 25 bp, Mus musculus
actggccactttgttgtcataggtc

SEQ ID NO: 131311 - DNA, 25 bp, Mus musculus
actggccagaccctggaatggagct

SEQ ID NO: 131312 - DNA, 25 bp, Mus musculus
actggccagaccgtggaatggagct

SEQ ID NO: 131313 - DNA, 25 bp, Mus musculus
actggccagagtaagccctgcaggc

SEQ ID NO: 131314 - DNA, 25 bp, Mus musculus
actggccagagttagccctgcaggc

SEQ ID NO: 131315 - DNA, 25 bp, Mus musculus
actggccagctacccaggtgagttc

SEQ ID NO: 131316 - DNA, 25 bp, Mus musculus
actggccagctagccaggtgagttc

SEQ ID NO: 131317 - DNA, 25 bp, Mus musculus
actggccaggatataagtgatttcc

SEQ ID NO: 131318 - DNA, 25 bp, Mus musculus
actggccaggatttaagtgatttcc

SEQ ID NO: 131319 - DNA, 25 bp, Mus musculus
actggccagtgcatacaagcttgct

SEQ ID NO: 131320 - DNA, 25 bp, Mus musculus
actggccagtgcttacaagcttgct

SEQ ID NO: 131321 - DNA, 25 bp, Mus musculus
actggccatcacagtccctgggtcg

SEQ ID NO: 131322 - DNA, 25 bp, Mus musculus
actggccatcactgtccctgggtcg

SEQ ID NO: 131323 - DNA, 25 bp, Mus musculus
actggccatggaacaaatttatttc

SEQ ID NO: 131324 - DNA, 25 bp, Mus musculus
actggccatggatcaaatttatttc

SEQ ID NO: 131325 - DNA, 25 bp, Mus musculus
actggccattcaaggtcactgtcag

SEQ ID NO: 131326 - DNA, 25 bp, Mus musculus
actggccattcatggtcactgtcag

SEQ ID NO: 131327 - DNA, 25 bp, Mus musculus
actggccatttcactgcttgagcta

SEQ ID NO: 131328 - DNA, 25 bp, Mus musculus
actggccatttctctgcttgagcta

SEQ ID NO: 131329 - DNA, 25 bp, Mus musculus
actggcccaacacgtagcatcctgt

SEQ ID NO: 131330 - DNA, 25 bp, Mus musculus
actggcccaacaggtagcatcctgt

SEQ ID NO: 131331 - DNA, 25 bp, Mus musculus
actggcccaagaacttattttcatc

SEQ ID NO: 131332 - DNA, 25 bp, Mus musculus
actggcccaagatcttattttcatc

SEQ ID NO: 131333 - DNA, 25 bp, Mus musculus
actggcccagagaatgtgctaatta

SEQ ID NO: 131334 - DNA, 25 bp, Mus musculus
actggcccagagtatgtgctaatta

SEQ ID NO: 131335 - DNA, 25 bp, Mus musculus
actggcccagcaagagcactgttag

SEQ ID NO: 131336 - DNA, 25 bp, Mus musculus
actggcccagcatgagcactgttag

SEQ ID NO: 131337 - DNA, 25 bp, Mus musculus
actggcccagtcatggctcacagag

SEQ ID NO: 131338 - DNA, 25 bp, Mus musculus
actggcccagtcttggctcacagag

SEQ ID NO: 131339 - DNA, 25 bp, Mus musculus
actggcccatgtctgtataaaactt

SEQ ID NO: 131340 - DNA, 25 bp, Mus musculus
actggcccatgtgtgtataaaactt

SEQ ID NO: 131341 - DNA, 25 bp, Mus musculus
actggccccagaactactatgtttg

SEQ ID NO: 131342 - DNA, 25 bp, Mus musculus
actggccccagatctactatgtttg

SEQ ID NO: 131343 - DNA, 25 bp, Mus musculus
actggccccagtcgtaactagacca

SEQ ID NO: 131344 - DNA, 25 bp, Mus musculus
actggccccagtggtaactagacca

SEQ ID NO: 131345 - DNA, 25 bp, Mus musculus
actggccccgagagatgtgttttgc

SEQ ID NO: 131346 - DNA, 25 bp, Mus musculus
actggccccgagtgatgtgttttgc

SEQ ID NO: 131347 - DNA, 25 bp, Mus musculus
actggcccctttaattggctgttct

SEQ ID NO: 131348 - DNA, 25 bp, Mus musculus
actggccccttttattggctgttct

SEQ ID NO: 131349 - DNA, 25 bp, Mus musculus
actggcccgcggacgacatgtttga

SEQ ID NO: 131350 - DNA, 25 bp, Mus musculus
actggcccgcggtcgacatgtttga

SEQ ID NO: 131351 - DNA, 25 bp, Mus musculus
actggccctgttccaaagttgggtg

SEQ ID NO: 131352 - DNA, 25 bp, Mus musculus
actggccctgttgcaaagttgggtg

SEQ ID NO: 131353 - DNA, 25 bp, Mus musculus
actggccggccaatgataacgtcaa

SEQ ID NO: 131354 - DNA, 25 bp, Mus musculus
actggccggccattgataacgtcaa

SEQ ID NO: 131355 - DNA, 25 bp, Mus musculus
actggcctacgtctagacttttgat

SEQ ID NO: 131356 - DNA, 25 bp, Mus musculus
actggcctacgtgtagacttttgat

SEQ ID NO: 131357 - DNA, 25 bp, Mus musculus
actggcctcagactctgtttccagc

SEQ ID NO: 131358 - DNA, 25 bp, Mus musculus
actggcctcagagtctgtttccagc

SEQ ID NO: 131359 - DNA, 25 bp, Mus musculus
actggcctccaacaacagatttagg

SEQ ID NO: 131360 - DNA, 25 bp, Mus musculus
actggcctccaagaacagatttagg

SEQ ID NO: 131361 - DNA, 25 bp, Mus musculus
actggcctctacaatgggttatcat

SEQ ID NO: 131362 - DNA, 25 bp, Mus musculus
actggcctctacacgggagatgatt

SEQ ID NO: 131363 - DNA, 25 bp, Mus musculus
actggcctctactatgggttatcat

SEQ ID NO: 131364 - DNA, 25 bp, Mus musculus
actggcctctactcgggagatgatt

SEQ ID NO: 131365 - DNA, 25 bp, Mus musculus
actggcctgaagctaggctgaccaa

SEQ ID NO: 131366 - DNA, 25 bp, Mus musculus
actggcctgaaggtaggctgaccaa

SEQ ID NO: 131367 - DNA, 25 bp, Mus musculus
actggcctgcaacctactgtataga

SEQ ID NO: 131368 - DNA, 25 bp, Mus musculus
actggcctgcaagctactgtataga

SEQ ID NO: 131369 - DNA, 25 bp, Mus musculus
actggcctgctgattttgtcattaa

SEQ ID NO: 131370 - DNA, 25 bp, Mus musculus
actggcctgctgtttttgtcattaa

SEQ ID NO: 131371 - DNA, 25 bp, Mus musculus
actggcctgcttaatcagtgcccat

SEQ ID NO: 131372 - DNA, 25 bp, Mus musculus
actggcctgctttatcagtgcccat

SEQ ID NO: 131373 - DNA, 25 bp, Mus musculus
actggcctggccaatgtaaggagtt

SEQ ID NO: 131374 - DNA, 25 bp, Mus musculus
actggcctggcctatgtaaggagtt

SEQ ID NO: 131375 - DNA, 25 bp, Mus musculus
actggcctgggcataaattctgtga

SEQ ID NO: 131376 - DNA, 25 bp, Mus musculus
actggcctgggccatatgacactat

SEQ ID NO: 131377 - DNA, 25 bp, Mus musculus
actggcctgggcgatatgacactat

SEQ ID NO: 131378 - DNA, 25 bp, Mus musculus
actggcctgggcttaaattctgtga

SEQ ID NO: 131379 - DNA, 25 bp, Mus musculus
actggccttataaaaactctactgc

SEQ ID NO: 131380 - DNA, 25 bp, Mus musculus
actggccttatataaactctactgc

SEQ ID NO: 131381 - DNA, 25 bp, Mus musculus
actggccttcaacacatcttttacc

SEQ ID NO: 131382 - DNA, 25 bp, Mus musculus
actggccttcaagacatcttttacc

SEQ ID NO: 131383 - DNA, 25 bp, Mus musculus
actggccttgagagctttgcattgt

SEQ ID NO: 131384 - DNA, 25 bp, Mus musculus
actggccttgagtgctttgcattgt

SEQ ID NO: 131385 - DNA, 25 bp, Mus musculus
actggccttgcacttccagagggtt

SEQ ID NO: 131386 - DNA, 25 bp, Mus musculus
actggccttgcagttccagagggtt

SEQ ID NO: 131387 - DNA, 25 bp, Mus musculus
actggcctttcgcacactgttagtg

SEQ ID NO: 131388 - DNA, 25 bp, Mus musculus
actggcctttcggacactgttagtg

SEQ ID NO: 131389 - DNA, 25 bp, Mus musculus
actggcctttttaatgtgtcatgac

SEQ ID NO: 131390 - DNA, 25 bp, Mus musculus
actggccttttttatgtgtcatgac

SEQ ID NO: 131391 - DNA, 25 bp, Mus musculus
actggcgaagtaatttattagctgt

SEQ ID NO: 131392 - DNA, 25 bp, Mus musculus
actggcgaagtattttattagctgt

SEQ ID NO: 131393 - DNA, 25 bp, Mus musculus
actggcgacaacctaggacctctga

SEQ ID NO: 131394 - DNA, 25 bp, Mus musculus
actggcgacaacgtaggacctctga

SEQ ID NO: 131395 - DNA, 25 bp, Mus musculus
actggcgatagcacattttttaaaa

SEQ ID NO: 131396 - DNA, 25 bp, Mus musculus
actggcgatagctcattttttaaaa

SEQ ID NO: 131397 - DNA, 25 bp, Mus musculus
actggcgctctacgctcggcgttgc

SEQ ID NO: 131398 - DNA, 25 bp, Mus musculus
actggcgctctaggctcggcgttgc

SEQ ID NO: 131399 - DNA, 25 bp, Mus musculus
actggcggcggaagctcaacactca

SEQ ID NO: 131400 - DNA, 25 bp, Mus musculus
actggcggcggatgctcaacactca

SEQ ID NO: 131401 - DNA, 25 bp, Mus musculus
actggcggttctacctctggaaagc

SEQ ID NO: 131402 - DNA, 25 bp, Mus musculus
actggcggttcttcctctggaaagc

SEQ ID NO: 131403 - DNA, 25 bp, Mus musculus
actggcgtcagaagctggactctca

SEQ ID NO: 131404 - DNA, 25 bp, Mus musculus
actggcgtcagatgctggactctca

SEQ ID NO: 131405 - DNA, 25 bp, Mus musculus
actggcgtgcctattgcagcaacag

SEQ ID NO: 131406 - DNA, 25 bp, Mus musculus
actggcgtgccttttgcagcaacag

SEQ ID NO: 131407 - DNA, 25 bp, Mus musculus
actggcgtgtgcagtccaaagactg

SEQ ID NO: 131408 - DNA, 25 bp, Mus musculus
actggcgtgtgctgtccaaagactg

SEQ ID NO: 131409 - DNA, 25 bp, Mus musculus
actggctaaatcagtctccttgtct

SEQ ID NO: 131410 - DNA, 25 bp, Mus musculus
actggctaaatctgtctccttgtct

SEQ ID NO: 131411 - DNA, 25 bp, Mus musculus
actggctaattactcttctgtccgc

SEQ ID NO: 131412 - DNA, 25 bp, Mus musculus
actggctaattagtcttctgtccgc

SEQ ID NO: 131413 - DNA, 25 bp, Mus musculus
actggctacacgagcctttgtgtta

SEQ ID NO: 131414 - DNA, 25 bp, Mus musculus
actggctacacgtgcctttgtgtta

SEQ ID NO: 131415 - DNA, 25 bp, Mus musculus
actggctaccttcattttgacactt

SEQ ID NO: 131416 - DNA, 25 bp, Mus musculus
actggctaccttgattttgacactt

SEQ ID NO: 131417 - DNA, 25 bp, Mus musculus
actggctacgatcctacttctatga

SEQ ID NO: 131418 - DNA, 25 bp, Mus musculus
actggctacgatgctacttctatga

SEQ ID NO: 131419 - DNA, 25 bp, Mus musculus
actggctacgtgctcaacactataa

SEQ ID NO: 131420 - DNA, 25 bp, Mus musculus
actggctacgtggtcaacactataa

SEQ ID NO: 131421 - DNA, 25 bp, Mus musculus
actggctactgcacgcctatggcat

SEQ ID NO: 131422 - DNA, 25 bp, Mus musculus
actggctactgctcgcctatggcat

SEQ ID NO: 131423 - DNA, 25 bp, Mus musculus
actggctagaccaaaacatctctct

SEQ ID NO: 131424 - DNA, 25 bp, Mus musculus
actggctagacctaaacatctctct

SEQ ID NO: 131425 - DNA, 25 bp, Mus musculus
actggctagagcatcattgtgagac

SEQ ID NO: 131426 - DNA, 25 bp, Mus musculus
actggctagagcttcattgtgagac

SEQ ID NO: 131427 - DNA, 25 bp, Mus musculus
actggctaggtgattgtcccttgca

SEQ ID NO: 131428 - DNA, 25 bp, Mus musculus
actggctaggtgtttgtcccttgca

SEQ ID NO: 131429 - DNA, 25 bp, Mus musculus
actggctaggttccagaggtcctgt

SEQ ID NO: 131430 - DNA, 25 bp, Mus musculus
actggctaggttgcagaggtcctgt

SEQ ID NO: 131431 - DNA, 25 bp, Mus musculus
actggctatctgattgtgacacttc

SEQ ID NO: 131432 - DNA, 25 bp, Mus musculus
actggctatctgcacgaacagctgt

SEQ ID NO: 131433 - DNA, 25 bp, Mus musculus
actggctatctggacgaacagctgt

SEQ ID NO: 131434 - DNA, 25 bp, Mus musculus
actggctatctgtttgtgacacttc

SEQ ID NO: 131435 - DNA, 25 bp, Mus musculus
actggctatgagactcttgatgcta

SEQ ID NO: 131436 - DNA, 25 bp, Mus musculus
actggctatgagtctcttgatgcta

SEQ ID NO: 131437 - DNA, 25 bp, Mus musculus
actggctattggactttggcttaac

SEQ ID NO: 131438 - DNA, 25 bp, Mus musculus
actggctattggtctttggcttaac

SEQ ID NO: 131439 - DNA, 25 bp, Mus musculus
actggctcaagaattaggtcctcaa

SEQ ID NO: 131440 - DNA, 25 bp, Mus musculus
actggctcaagatttaggtcctcaa

SEQ ID NO: 131441 - DNA, 25 bp, Mus musculus
actggctcagcgagtgcctaccctg

SEQ ID NO: 131442 - DNA, 25 bp, Mus musculus
actggctcagcgtgtgcctaccctg

SEQ ID NO: 131443 - DNA, 25 bp, Mus musculus
actggctcatgacagtggccgagct

SEQ ID NO: 131444 - DNA, 25 bp, Mus musculus
actggctcatgagagtggccgagct

SEQ ID NO: 131445 - DNA, 25 bp, Mus musculus
actggctcccagaagacaagtgagt

SEQ ID NO: 131446 - DNA, 25 bp, Mus musculus
actggctcccagtagacaagtgagt

SEQ ID NO: 131447 - DNA, 25 bp, Mus musculus
actggctcctagagacttgtgaatc

SEQ ID NO: 131448 - DNA, 25 bp, Mus musculus
actggctcctagtgacttgtgaatc

SEQ ID NO: 131449 - DNA, 25 bp, Mus musculus
actggctcctggcttctggctctag

SEQ ID NO: 131450 - DNA, 25 bp, Mus musculus
actggctcctgggttctggctctag

SEQ ID NO: 131451 - DNA, 25 bp, Mus musculus
actggctccttaagctagcactgga

SEQ ID NO: 131452 - DNA, 25 bp, Mus musculus
actggctccttatgctagcactgga

SEQ ID NO: 131453 - DNA, 25 bp, Mus musculus
actggctcctttctcataatttgac

SEQ ID NO: 131454 - DNA, 25 bp, Mus musculus
actggctcctttgtcataatttgac

SEQ ID NO: 131455 - DNA, 25 bp, Mus musculus
actggctcgatcactgcagattagt

SEQ ID NO: 131456 - DNA, 25 bp, Mus musculus
actggctcgatctctgcagattagt

SEQ ID NO: 131457 - DNA, 25 bp, Mus musculus
actggctcggctccttcgaagagga

SEQ ID NO: 131458 - DNA, 25 bp, Mus musculus
actggctcggctgcttcgaagagga

SEQ ID NO: 131459 - DNA, 25 bp, Mus musculus
actggctctactctgttcagtgagg

SEQ ID NO: 131460 - DNA, 25 bp, Mus musculus
actggctctactgtgttcagtgagg

SEQ ID NO: 131461 - DNA, 25 bp, Mus musculus
actggctctcggacacgaggcaggt

SEQ ID NO: 131462 - DNA, 25 bp, Mus musculus
actggctctcggtcacgaggcaggt

SEQ ID NO: 131463 - DNA, 25 bp, Mus musculus
actggctctgatcttgaccttataa

SEQ ID NO: 131464 - DNA, 25 bp, Mus musculus
actggctctgatgttgaccttataa

SEQ ID NO: 131465 - DNA, 25 bp, Mus musculus
actggctcttagcaagatggctgcc

SEQ ID NO: 131466 - DNA, 25 bp, Mus musculus
actggctcttagctatttgttatgg

SEQ ID NO: 131467 - DNA, 25 bp, Mus musculus
actggctcttaggaagatggctgcc

SEQ ID NO: 131468 - DNA, 25 bp, Mus musculus
actggctcttaggtatttgttatgg

SEQ ID NO: 131469 - DNA, 25 bp, Mus musculus
actggctcttgtacattctcaacct

SEQ ID NO: 131470 - DNA, 25 bp, Mus musculus
actggctcttgtccttttgttgtga

SEQ ID NO: 131471 - DNA, 25 bp, Mus musculus
actggctcttgtgcttttgttgtga

SEQ ID NO: 131472 - DNA, 25 bp, Mus musculus
actggctcttgttcattctcaacct

SEQ ID NO: 131473 - DNA, 25 bp, Mus musculus
actggctgactcctggtactgtaga

SEQ ID NO: 131474 - DNA, 25 bp, Mus musculus
actggctgactcgtggtactgtaga

SEQ ID NO: 131475 - DNA, 25 bp, Mus musculus
actggctgagccagctgaaggccaa

SEQ ID NO: 131476 - DNA, 25 bp, Mus musculus
actggctgagcctgctgaaggccaa

SEQ ID NO: 131477 - DNA, 25 bp, Mus musculus
actggctgagggactcctgcaattc

SEQ ID NO: 131478 - DNA, 25 bp, Mus musculus
actggctgagggtctcctgcaattc

SEQ ID NO: 131479 - DNA, 25 bp, Mus musculus
actggctgatgtagcttctgtttgc

SEQ ID NO: 131480 - DNA, 25 bp, Mus musculus
actggctgatgtctccttatcagga

SEQ ID NO: 131481 - DNA, 25 bp, Mus musculus
actggctgatgtgtccttatcagga

SEQ ID NO: 131482 - DNA, 25 bp, Mus musculus
actggctgatgttgcttctgtttgc

SEQ ID NO: 131483 - DNA, 25 bp, Mus musculus
actggctgcaatctgtttgtcactg

SEQ ID NO: 131484 - DNA, 25 bp, Mus musculus
actggctgcaatgtgtttgtcactg

SEQ ID NO: 131485 - DNA, 25 bp, Mus musculus
actggctgcatcctgagcaaggcaa

SEQ ID NO: 131486 - DNA, 25 bp, Mus musculus
actggctgcatcgtgagcaaggcaa

SEQ ID NO: 131487 - DNA, 25 bp, Mus musculus
actggctgcattacaagatcctcac

SEQ ID NO: 131488 - DNA, 25 bp, Mus musculus
actggctgcatttcaagatcctcac

SEQ ID NO: 131489 - DNA, 25 bp, Mus musculus
actggctgccagagtttcctgcatc

SEQ ID NO: 131490 - DNA, 25 bp, Mus musculus
actggctgccagctatttttactag

SEQ ID NO: 131491 - DNA, 25 bp, Mus musculus
actggctgccaggtatttttactag

SEQ ID NO: 131492 - DNA, 25 bp, Mus musculus
actggctgccagtgtttcctgcatc

SEQ ID NO: 131493 - DNA, 25 bp, Mus musculus
actggctgcccaccatgggatcaga

SEQ ID NO: 131494 - DNA, 25 bp, Mus musculus
actggctgcccagcatgggatcaga

SEQ ID NO: 131495 - DNA, 25 bp, Mus musculus
actggctgctgcagtgtctgccaca

SEQ ID NO: 131496 - DNA, 25 bp, Mus musculus
actggctgctgctgtgtctgccaca

SEQ ID NO: 131497 - DNA, 25 bp, Mus musculus
actggctgctggctctctgatggtc

SEQ ID NO: 131498 - DNA, 25 bp, Mus musculus
actggctgctgggtctctgatggtc

SEQ ID NO: 131499 - DNA, 25 bp, Mus musculus
actggctgctttccttcctatggag

SEQ ID NO: 131500 - DNA, 25 bp, Mus musculus
actggctgctttgcttcctatggag

SEQ ID NO: 131501 - DNA, 25 bp, Mus musculus
actggctggactcggtgtacacgtt

SEQ ID NO: 131502 - DNA, 25 bp, Mus musculus
actggctggactgggtgtacacgtt

SEQ ID NO: 131503 - DNA, 25 bp, Mus musculus
actggctggagaacttgcaggccct

SEQ ID NO: 131504 - DNA, 25 bp, Mus musculus
actggctggagatcttgcaggccct

SEQ ID NO: 131505 - DNA, 25 bp, Mus musculus
actggctggatccaaagtcacacct

SEQ ID NO: 131506 - DNA, 25 bp, Mus musculus
actggctggatcgaaagtcacacct

SEQ ID NO: 131507 - DNA, 25 bp, Mus musculus
actggctggctgcttttgtccctga

SEQ ID NO: 131508 - DNA, 25 bp, Mus musculus
actggctggctggttttgtccctga

SEQ ID NO: 131509 - DNA, 25 bp, Mus musculus
actggctgggcaatggttccttcat

SEQ ID NO: 131510 - DNA, 25 bp, Mus musculus
actggctgggcattggttccttcat

SEQ ID NO: 131511 - DNA, 25 bp, Mus musculus
actggctgggctcccactagaacat

SEQ ID NO: 131512 - DNA, 25 bp, Mus musculus
actggctgggctgccactagaacat

SEQ ID NO: 131513 - DNA, 25 bp, Mus musculus
actggctggttaacaccgctgagcg

SEQ ID NO: 131514 - DNA, 25 bp, Mus musculus
actggctggttatcaccgctgagcg

SEQ ID NO: 131515 - DNA, 25 bp, Mus musculus
actggctgtctcaggttagctgtac

SEQ ID NO: 131516 - DNA, 25 bp, Mus musculus
actggctgtctctggttagctgtac

SEQ ID NO: 131517 - DNA, 25 bp, Mus musculus
actggctgtcttcctaactgacaca

SEQ ID NO: 131518 - DNA, 25 bp, Mus musculus
actggctgtcttgctaactgacaca

SEQ ID NO: 131519 - DNA, 25 bp, Mus musculus
actggctgtggaatcttttcttgat

SEQ ID NO: 131520 - DNA, 25 bp, Mus musculus
actggctgtggattcttttcttgat

SEQ ID NO: 131521 - DNA, 25 bp, Mus musculus
actggctgtgtcaagcgcatgcatg

SEQ ID NO: 131522 - DNA, 25 bp, Mus musculus
actggctgtgtctagcgcatgcatg

SEQ ID NO: 131523 - DNA, 25 bp, Mus musculus
actggctgttagatggattcccgag

SEQ ID NO: 131524 - DNA, 25 bp, Mus musculus
actggctgttagttggattcccgag

SEQ ID NO: 131525 - DNA, 25 bp, Mus musculus
actggcttcatgcaatatgcctcat

SEQ ID NO: 131526 - DNA, 25 bp, Mus musculus
actggcttcatggaatatgcctcat

SEQ ID NO: 131527 - DNA, 25 bp, Mus musculus
actggcttccagagcttgtataatg

SEQ ID NO: 131528 - DNA, 25 bp, Mus musculus
actggcttccagtgcttgtataatg

SEQ ID NO: 131529 - DNA, 25 bp, Mus musculus
actggcttcctgatacttggctatt

SEQ ID NO: 131530 - DNA, 25 bp, Mus musculus
actggcttcctgttacttggctatt

SEQ ID NO: 131531 - DNA, 25 bp, Mus musculus
actggcttctagagcaggctgtcac

SEQ ID NO: 131532 - DNA, 25 bp, Mus musculus
actggcttctagtgcaggctgtcac

SEQ ID NO: 131533 - DNA, 25 bp, Mus musculus
actggcttctatattgcagcagaaa

SEQ ID NO: 131534 - DNA, 25 bp, Mus musculus
actggcttctattttgcagcagaaa

SEQ ID NO: 131535 - DNA, 25 bp, Mus musculus
actggcttctcactggcttttcttc

SEQ ID NO: 131536 - DNA, 25 bp, Mus musculus
actggcttctcagtggcttttcttc

SEQ ID NO: 131537 - DNA, 25 bp, Mus musculus
actggcttctgacctcgaatccatt

SEQ ID NO: 131538 - DNA, 25 bp, Mus musculus
actggcttctgagctcgaatccatt

SEQ ID NO: 131539 - DNA, 25 bp, Mus musculus
actggcttctgcaaggtgattgtgg

SEQ ID NO: 131540 - DNA, 25 bp, Mus musculus
actggcttctgcaatgtttcttctg

SEQ ID NO: 131541 - DNA, 25 bp, Mus musculus
actggcttctgctaggtgattgtgg

SEQ ID NO: 131542 - DNA, 25 bp, Mus musculus
actggcttctgctatgtttcttctg

SEQ ID NO: 131543 - DNA, 25 bp, Mus musculus
actggcttctgtatccagagtttta

SEQ ID NO: 131544 - DNA, 25 bp, Mus musculus
actggcttctgtttccagagtttta

SEQ ID NO: 131545 - DNA, 25 bp, Mus musculus
actggcttgaaaactcccgatggag

SEQ ID NO: 131546 - DNA, 25 bp, Mus musculus
actggcttgaaacgcagctcctgga

SEQ ID NO: 131547 - DNA, 25 bp, Mus musculus
actggcttgaaaggcagctcctgga

SEQ ID NO: 131548 - DNA, 25 bp, Mus musculus
actggcttgaaatctcccgatggag

SEQ ID NO: 131549 - DNA, 25 bp, Mus musculus
actggcttgctcatgaagctcattt

SEQ ID NO: 131550 - DNA, 25 bp, Mus musculus
actggcttgctcttgaagctcattt

SEQ ID NO: 131551 - DNA, 25 bp, Mus musculus
actggcttgcttaggtactagaact

SEQ ID NO: 131552 - DNA, 25 bp, Mus musculus
actggcttgctttggtactagaact

SEQ ID NO: 131553 - DNA, 25 bp, Mus musculus
actggcttggtcattgtggcatatc

SEQ ID NO: 131554 - DNA, 25 bp, Mus musculus
actggcttggtctttgtggcatatc

SEQ ID NO: 131555 - DNA, 25 bp, Mus musculus
actggcttggtgctacattcctgta

SEQ ID NO: 131556 - DNA, 25 bp, Mus musculus
actggcttggtggtacattcctgta

SEQ ID NO: 131557 - DNA, 25 bp, Mus musculus
actggctttaagctctgtgttacaa

SEQ ID NO: 131558 - DNA, 25 bp, Mus musculus
actggctttaaggtctgtgttacaa

SEQ ID NO: 131559 - DNA, 25 bp, Mus musculus
actggcttttctaagctcatatgat

SEQ ID NO: 131560 - DNA, 25 bp, Mus musculus
actggcttttcttagctcatatgat

SEQ ID NO: 131561 - DNA, 25 bp, Mus musculus
actggcttttggacctgaatattta

SEQ ID NO: 131562 - DNA, 25 bp, Mus musculus
actggcttttggtcctgaatattta

SEQ ID NO: 131563 - DNA, 25 bp, Mus musculus
actggcttttgtatgcatgccatgt

SEQ ID NO: 131564 - DNA, 25 bp, Mus musculus
actggcttttgtttgcatgccatgt

SEQ ID NO: 131565 - DNA, 25 bp, Mus musculus
actgggaaatacaacctgcaacatt

SEQ ID NO: 131566 - DNA, 25 bp, Mus musculus
actgggaaatacagactcaacttct

SEQ ID NO: 131567 - DNA, 25 bp, Mus musculus
actgggaaatactacctgcaacatt

SEQ ID NO: 131568 - DNA, 25 bp, Mus musculus
actgggaaatactgactcaacttct

SEQ ID NO: 131569 - DNA, 25 bp, Mus musculus
actgggaaattgctggcattttagt

SEQ ID NO: 131570 - DNA, 25 bp, Mus musculus
actgggaaattggtggcattttagt

SEQ ID NO: 131571 - DNA, 25 bp, Mus musculus
actgggaacatacacacctaggtgt

SEQ ID NO: 131572 - DNA, 25 bp, Mus musculus
actgggaacatagacacctaggtgt

SEQ ID NO: 131573 - DNA, 25 bp, Mus musculus
actgggaaccagagctggcgcctga

SEQ ID NO: 131574 - DNA, 25 bp, Mus musculus
actgggaaccagtgctggcgcctga

SEQ ID NO: 131575 - DNA, 25 bp, Mus musculus
actgggaacgctattgagccaaatc

SEQ ID NO: 131576 - DNA, 25 bp, Mus musculus
actgggaacgcttttgagccaaatc

SEQ ID NO: 131577 - DNA, 25 bp, Mus musculus
actgggaactagagggcctcataca

SEQ ID NO: 131578 - DNA, 25 bp, Mus musculus
actgggaactagtgggcctcataca

SEQ ID NO: 131579 - DNA, 25 bp, Mus musculus
actgggaagcaacctcaggtcctga

SEQ ID NO: 131580 - DNA, 25 bp, Mus musculus
actgggaagcaagctcaggtcctga

SEQ ID NO: 131581 - DNA, 25 bp, Mus musculus
actgggaagttccttttggctgact

SEQ ID NO: 131582 - DNA, 25 bp, Mus musculus
actgggaagttcgttttggctgact

SEQ ID NO: 131583 - DNA, 25 bp, Mus musculus
actgggaatcccaggctgcggttat

SEQ ID NO: 131584 - DNA, 25 bp, Mus musculus
actgggaatccctggctgcggttat

SEQ ID NO: 131585 - DNA, 25 bp, Mus musculus
actgggaatggcaagcatttgagaa

SEQ ID NO: 131586 - DNA, 25 bp, Mus musculus
actgggaatggctagcatttgagaa

SEQ ID NO: 131587 - DNA, 25 bp, Mus musculus
actgggacaccgcagatgttgttta

SEQ ID NO: 131588 - DNA, 25 bp, Mus musculus
actgggacaccgcaggacataccgg

SEQ ID NO: 131589 - DNA, 25 bp, Mus musculus
actgggacaccggagatgttgttta

SEQ ID NO: 131590 - DNA, 25 bp, Mus musculus
actgggacaccggaggacataccgg

SEQ ID NO: 131591 - DNA, 25 bp, Mus musculus
actgggacatacacgtgagcatgca

SEQ ID NO: 131592 - DNA, 25 bp, Mus musculus
actgggacatactcgtgagcatgca

SEQ ID NO: 131593 - DNA, 25 bp, Mus musculus
actgggaccaatactacctttgctg

SEQ ID NO: 131594 - DNA, 25 bp, Mus musculus
actgggaccaattctacctttgctg

SEQ ID NO: 131595 - DNA, 25 bp, Mus musculus
actgggaccagaatgagcgttacct

SEQ ID NO: 131596 - DNA, 25 bp, Mus musculus
actgggaccagattgagcgttacct

SEQ ID NO: 131597 - DNA, 25 bp, Mus musculus
actgggacccagaatggagctgcag

SEQ ID NO: 131598 - DNA, 25 bp, Mus musculus
actgggacccagtatggagctgcag

SEQ ID NO: 131599 - DNA, 25 bp, Mus musculus
actgggaccctgactcggagaataa

SEQ ID NO: 131600 - DNA, 25 bp, Mus musculus
actgggaccctgtctcggagaataa

SEQ ID NO: 131601 - DNA, 25 bp, Mus musculus
actgggaccttgcaagtgccttctt

SEQ ID NO: 131602 - DNA, 25 bp, Mus musculus
actgggaccttggaagtgccttctt

SEQ ID NO: 131603 - DNA, 25 bp, Mus musculus
actgggacggtacacatttctggaa

SEQ ID NO: 131604 - DNA, 25 bp, Mus musculus
actgggacggtagacatttctggaa

SEQ ID NO: 131605 - DNA, 25 bp, Mus musculus
actgggactcaaagctatcttgaca

SEQ ID NO: 131606 - DNA, 25 bp, Mus musculus
actgggactcaatgctatcttgaca

SEQ ID NO: 131607 - DNA, 25 bp, Mus musculus
actgggactcataacatttatacaa

SEQ ID NO: 131608 - DNA, 25 bp, Mus musculus
actgggactcattacatttatacaa

SEQ ID NO: 131609 - DNA, 25 bp, Mus musculus
actgggactggcatcaagttcctcc

SEQ ID NO: 131610 - DNA, 25 bp, Mus musculus
actgggactggcttcaagttcctcc

SEQ ID NO: 131611 - DNA, 25 bp, Mus musculus
actgggactgtcctgtcatgttaaa

SEQ ID NO: 131612 - DNA, 25 bp, Mus musculus
actgggactgtcgtgtcatgttaaa

SEQ ID NO: 131613 - DNA, 25 bp, Mus musculus
actgggagaaccaacatgctcttta

SEQ ID NO: 131614 - DNA, 25 bp, Mus musculus
actgggagaacctacatgctcttta

SEQ ID NO: 131615 - DNA, 25 bp, Mus musculus
actgggagacgcagcgcagatacac

SEQ ID NO: 131616 - DNA, 25 bp, Mus musculus
actgggagacgctgcgcagatacac

SEQ ID NO: 131617 - DNA, 25 bp, Mus musculus
actgggagacgtctgccctgtccct

SEQ ID NO: 131618 - DNA, 25 bp, Mus musculus
actgggagacgtgtgccctgtccct

SEQ ID NO: 131619 - DNA, 25 bp, Mus musculus
actgggagacttagcccagaagagc

SEQ ID NO: 131620 - DNA, 25 bp, Mus musculus
actgggagactttgcccagaagagc

SEQ ID NO: 131621 - DNA, 25 bp, Mus musculus
actgggagaggcagtgttcatgtga

SEQ ID NO: 131622 - DNA, 25 bp, Mus musculus
actgggagaggctgtgttcatgtga

SEQ ID NO: 131623 - DNA, 25 bp, Mus musculus
actgggagcagcctctcgttggatc

SEQ ID NO: 131624 - DNA, 25 bp, Mus musculus
actgggagcagcgtctcgttggatc

SEQ ID NO: 131625 - DNA, 25 bp, Mus musculus
actgggagccatatggtctatcctg

SEQ ID NO: 131626 - DNA, 25 bp, Mus musculus
actgggagccatttggtctatcctg

SEQ ID NO: 131627 - DNA, 25 bp, Mus musculus
actgggagcgctcctgggtaagcca

SEQ ID NO: 131628 - DNA, 25 bp, Mus musculus
actgggagcgctgctgggtaagcca

SEQ ID NO: 131629 - DNA, 25 bp, Mus musculus
actgggagctagacctgggctctga

SEQ ID NO: 131630 - DNA, 25 bp, Mus musculus
actgggagctagtcctgggctctga

SEQ ID NO: 131631 - DNA, 25 bp, Mus musculus
actgggaggcaacacttttggaaat

SEQ ID NO: 131632 - DNA, 25 bp, Mus musculus
actgggaggcaagacttttggaaat

SEQ ID NO: 131633 - DNA, 25 bp, Mus musculus
actgggaggcagcaaatactttcac

SEQ ID NO: 131634 - DNA, 25 bp, Mus musculus
actgggaggcaggaaatactttcac

SEQ ID NO: 131635 - DNA, 25 bp, Mus musculus
actgggaggccaagaactgttcaca

SEQ ID NO: 131636 - DNA, 25 bp, Mus musculus
actgggaggccatgaactgttcaca

SEQ ID NO: 131637 - DNA, 25 bp, Mus musculus
actgggagtaccatggaagccctca

SEQ ID NO: 131638 - DNA, 25 bp, Mus musculus
actgggagtaccttggaagccctca

SEQ ID NO: 131639 - DNA, 25 bp, Mus musculus
actgggagtagcagtggtcttcact

SEQ ID NO: 131640 - DNA, 25 bp, Mus musculus
actgggagtagctgtggtcttcact

SEQ ID NO: 131641 - DNA, 25 bp, Mus musculus
actgggagtattaatgtagccataa

SEQ ID NO: 131642 - DNA, 25 bp, Mus musculus
actgggagtatttatgtagccataa

SEQ ID NO: 131643 - DNA, 25 bp, Mus musculus
actgggagtgcgctgtcacataata

SEQ ID NO: 131644 - DNA, 25 bp, Mus musculus
actgggagtgcggtgtcacataata

SEQ ID NO: 131645 - DNA, 25 bp, Mus musculus
actgggagttcaatgtgatccttga

SEQ ID NO: 131646 - DNA, 25 bp, Mus musculus
actgggagttcattgtgatccttga

SEQ ID NO: 131647 - DNA, 25 bp, Mus musculus
actgggagttgaactaggccctcat

SEQ ID NO: 131648 - DNA, 25 bp, Mus musculus
actgggagttgatctaggccctcat

SEQ ID NO: 131649 - DNA, 25 bp, Mus musculus
actgggatcattaaccaggagagtg

SEQ ID NO: 131650 - DNA, 25 bp, Mus musculus
actgggatcatttaccaggagagtg

SEQ ID NO: 131651 - DNA, 25 bp, Mus musculus
actgggatctcaaagccctgcccaa

SEQ ID NO: 131652 - DNA, 25 bp, Mus musculus
actgggatctcatagccctgcccaa

SEQ ID NO: 131653 - DNA, 25 bp, Mus musculus
actgggatgtccatactcaagaccg

SEQ ID NO: 131654 - DNA, 25 bp, Mus musculus
actgggatgtccttactcaagaccg

SEQ ID NO: 131655 - DNA, 25 bp, Mus musculus
actgggatttcgattctgatggaca

SEQ ID NO: 131656 - DNA, 25 bp, Mus musculus
actgggatttcgtttctgatggaca

SEQ ID NO: 131657 - DNA, 25 bp, Mus musculus
actgggatttgtctttatgctggca

SEQ ID NO: 131658 - DNA, 25 bp, Mus musculus
actgggatttgtgtttatgctggca

SEQ ID NO: 131659 - DNA, 25 bp, Mus musculus
actgggattttgaatgtggctctac

SEQ ID NO: 131660 - DNA, 25 bp, Mus musculus
actgggattttgtatgtggctctac

SEQ ID NO: 131661 - DNA, 25 bp, Mus musculus
actgggcaaaacctcagcttgtggc

SEQ ID NO: 131662 - DNA, 25 bp, Mus musculus
actgggcaaaacgtcagcttgtggc

SEQ ID NO: 131663 - DNA, 25 bp, Mus musculus
actgggcaacccaagactctggctt

SEQ ID NO: 131664 - DNA, 25 bp, Mus musculus
actgggcaaccctagactctggctt

SEQ ID NO: 131665 - DNA, 25 bp, Mus musculus
actgggcaacgcacaactacctgta

SEQ ID NO: 131666 - DNA, 25 bp, Mus musculus
actgggcaacgctcaactacctgta

SEQ ID NO: 131667 - DNA, 25 bp, Mus musculus
actgggcaatgacatgctcctttgt

SEQ ID NO: 131668 - DNA, 25 bp, Mus musculus
actgggcaatgagatgctcctttgt

SEQ ID NO: 131669 - DNA, 25 bp, Mus musculus
actgggcaatttcctttttcaggtt

SEQ ID NO: 131670 - DNA, 25 bp, Mus musculus
actgggcaatttgctttttcaggtt

SEQ ID NO: 131671 - DNA, 25 bp, Mus musculus
actgggcacatgaggtgagctgaca

SEQ ID NO: 131672 - DNA, 25 bp, Mus musculus
actgggcacatgtggtgagctgaca

SEQ ID NO: 131673 - DNA, 25 bp, Mus musculus
actgggcacccacctggcctgatgt

SEQ ID NO: 131674 - DNA, 25 bp, Mus musculus
actgggcacccagctggcctgatgt

SEQ ID NO: 131675 - DNA, 25 bp, Mus musculus
actgggcactggcaacgacctcagt

SEQ ID NO: 131676 - DNA, 25 bp, Mus musculus
actgggcactgggaacgacctcagt

SEQ ID NO: 131677 - DNA, 25 bp, Mus musculus
actgggcagagcaggcactcatttc

SEQ ID NO: 131678 - DNA, 25 bp, Mus musculus
actgggcagagctggcactcatttc

SEQ ID NO: 131679 - DNA, 25 bp, Mus musculus
actgggcagcttctaccttccaagg

SEQ ID NO: 131680 - DNA, 25 bp, Mus musculus
actgggcagcttgtaccttccaagg

SEQ ID NO: 131681 - DNA, 25 bp, Mus musculus
actgggcagtccaagggttttgctt

SEQ ID NO: 131682 - DNA, 25 bp, Mus musculus
actgggcagtcctagggttttgctt

SEQ ID NO: 131683 - DNA, 25 bp, Mus musculus
actgggcatcctctgtactgtttgt

SEQ ID NO: 131684 - DNA, 25 bp, Mus musculus
actgggcatcctgtgtactgtttgt

SEQ ID NO: 131685 - DNA, 25 bp, Mus musculus
actgggcatcttagacttggtcaca

SEQ ID NO: 131686 - DNA, 25 bp, Mus musculus
actgggcatctttgacttggtcaca

SEQ ID NO: 131687 - DNA, 25 bp, Mus musculus
actgggccacggacctgatctctgg

SEQ ID NO: 131688 - DNA, 25 bp, Mus musculus
actgggccacggtcctgatctctgg

SEQ ID NO: 131689 - DNA, 25 bp, Mus musculus
actgggccaggaaaacttagctgaa

SEQ ID NO: 131690 - DNA, 25 bp, Mus musculus
actgggccaggacgtagtttctcat

SEQ ID NO: 131691 - DNA, 25 bp, Mus musculus
actgggccaggaggtagtttctcat

SEQ ID NO: 131692 - DNA, 25 bp, Mus musculus
actgggccaggataacttagctgaa

SEQ ID NO: 131693 - DNA, 25 bp, Mus musculus
actgggccagtgagtctatgtgcat

SEQ ID NO: 131694 - DNA, 25 bp, Mus musculus
actgggccagtgtgtctatgtgcat

SEQ ID NO: 131695 - DNA, 25 bp, Mus musculus
actgggccatcaagtgaagtcactt

SEQ ID NO: 131696 - DNA, 25 bp, Mus musculus
actgggccatcatgtgaagtcactt

SEQ ID NO: 131697 - DNA, 25 bp, Mus musculus
actgggccatctataaatgtccttg

SEQ ID NO: 131698 - DNA, 25 bp, Mus musculus
actgggccatctttaaatgtccttg

SEQ ID NO: 131699 - DNA, 25 bp, Mus musculus
actgggcccagtagtcagtcccaca

SEQ ID NO: 131700 - DNA, 25 bp, Mus musculus
actgggcccagttgtcagtcccaca

SEQ ID NO: 131701 - DNA, 25 bp, Mus musculus
actgggccctatacagtggcagctt

SEQ ID NO: 131702 - DNA, 25 bp, Mus musculus
actgggccctattcagtggcagctt

SEQ ID NO: 131703 - DNA, 25 bp, Mus musculus
actgggccgggccaaggactgtgat

SEQ ID NO: 131704 - DNA, 25 bp, Mus musculus
actgggccgggcgaaggactgtgat

SEQ ID NO: 131705 - DNA, 25 bp, Mus musculus
actgggcctaggatcacctttgtaa

SEQ ID NO: 131706 - DNA, 25 bp, Mus musculus
actgggcctaggttcacctttgtaa

SEQ ID NO: 131707 - DNA, 25 bp, Mus musculus
actgggcctggactttgagatcgct

SEQ ID NO: 131708 - DNA, 25 bp, Mus musculus
actgggcctggagtttgagatcgct

SEQ ID NO: 131709 - DNA, 25 bp, Mus musculus
actgggcgctctaacagcggaggaa

SEQ ID NO: 131710 - DNA, 25 bp, Mus musculus
actgggcgctcttacagcggaggaa

SEQ ID NO: 131711 - DNA, 25 bp, Mus musculus
actgggcgtaacaaggacttccgtg

SEQ ID NO: 131712 - DNA, 25 bp, Mus musculus
actgggcgtaactaggacttccgtg

SEQ ID NO: 131713 - DNA, 25 bp, Mus musculus
actgggcgtgaacccgacatcggaa

SEQ ID NO: 131714 - DNA, 25 bp, Mus musculus
actgggcgtgaagccgacatcggaa

SEQ ID NO: 131715 - DNA, 25 bp, Mus musculus
actgggcgtgatccttacgtaggca

SEQ ID NO: 131716 - DNA, 25 bp, Mus musculus
actgggcgtgatgcttacgtaggca

SEQ ID NO: 131717 - DNA, 25 bp, Mus musculus
actgggcgtggaattcgatgaaatc

SEQ ID NO: 131718 - DNA, 25 bp, Mus musculus
actgggcgtggatttcgatgaaatc

SEQ ID NO: 131719 - DNA, 25 bp, Mus musculus
actgggctaggaattgcaagactct

SEQ ID NO: 131720 - DNA, 25 bp, Mus musculus
actgggctaggatttgcaagactct

SEQ ID NO: 131721 - DNA, 25 bp, Mus musculus
actgggctagtgactcacaaataac

SEQ ID NO: 131722 - DNA, 25 bp, Mus musculus
actgggctagtgtctcacaaataac

SEQ ID NO: 131723 - DNA, 25 bp, Mus musculus
actgggctattgctgtgaactattt

SEQ ID NO: 131724 - DNA, 25 bp, Mus musculus
actgggctattggtgtgaactattt

SEQ ID NO: 131725 - DNA, 25 bp, Mus musculus
actgggctcccgaggcatatataaa

SEQ ID NO: 131726 - DNA, 25 bp, Mus musculus
actgggctcccgtggcatatataaa

SEQ ID NO: 131727 - DNA, 25 bp, Mus musculus
actgggctcctgagcctcgcagcat

SEQ ID NO: 131728 - DNA, 25 bp, Mus musculus
actgggctcctgtgcctcgcagcat

SEQ ID NO: 131729 - DNA, 25 bp, Mus musculus
actgggctctaacctcacatgttga

SEQ ID NO: 131730 - DNA, 25 bp, Mus musculus
actgggctctaagctcacatgttga

SEQ ID NO: 131731 - DNA, 25 bp, Mus musculus
actgggctctctctggtttgggatc

SEQ ID NO: 131732 - DNA, 25 bp, Mus musculus
actgggctctctgtggtttgggatc

SEQ ID NO: 131733 - DNA, 25 bp, Mus musculus
actgggctcttaatttaccaacaag

SEQ ID NO: 131734 - DNA, 25 bp, Mus musculus
actgggctcttattttaccaacaag

SEQ ID NO: 131735 - DNA, 25 bp, Mus musculus
actgggctcttgcaagtcatttcac

SEQ ID NO: 131736 - DNA, 25 bp, Mus musculus
actgggctcttggaagtcatttcac

SEQ ID NO: 131737 - DNA, 25 bp, Mus musculus
actgggctgaatccaacctgttggt

SEQ ID NO: 131738 - DNA, 25 bp, Mus musculus
actgggctgaatgcaacctgttggt

SEQ ID NO: 131739 - DNA, 25 bp, Mus musculus
actgggctgcagatgtaatgcttac

SEQ ID NO: 131740 - DNA, 25 bp, Mus musculus
actgggctgcagttgtaatgcttac

SEQ ID NO: 131741 - DNA, 25 bp, Mus musculus
actgggctggctaagatgaagatga

SEQ ID NO: 131742 - DNA, 25 bp, Mus musculus
actgggctggcttagatgaagatga

SEQ ID NO: 131743 - DNA, 25 bp, Mus musculus
actgggctgggtctagctttgcttc

SEQ ID NO: 131744 - DNA, 25 bp, Mus musculus
actgggctgggtgtagctttgcttc

SEQ ID NO: 131745 - DNA, 25 bp, Mus musculus
actgggctgtctctccagtgggaaa

SEQ ID NO: 131746 - DNA, 25 bp, Mus musculus
actgggctgtctgtccagtgggaaa

SEQ ID NO: 131747 - DNA, 25 bp, Mus musculus
actgggcttccaaaacttgggtacg

SEQ ID NO: 131748 - DNA, 25 bp, Mus musculus
actgggcttccaaccactggagagc

SEQ ID NO: 131749 - DNA, 25 bp, Mus musculus
actgggcttccataacttgggtacg

SEQ ID NO: 131750 - DNA, 25 bp, Mus musculus
actgggcttccatccactggagagc

SEQ ID NO: 131751 - DNA, 25 bp, Mus musculus
actgggcttgaaatcacttcagaga

SEQ ID NO: 131752 - DNA, 25 bp, Mus musculus
actgggcttgaattcacttcagaga

SEQ ID NO: 131753 - DNA, 25 bp, Mus musculus
actgggcttgggaacagcttaccat

SEQ ID NO: 131754 - DNA, 25 bp, Mus musculus
actgggcttgggtacagcttaccat

SEQ ID NO: 131755 - DNA, 25 bp, Mus musculus
actgggctttcaacttatatgacct

SEQ ID NO: 131756 - DNA, 25 bp, Mus musculus
actgggctttcatcttatatgacct

SEQ ID NO: 131757 - DNA, 25 bp, Mus musculus
actggggccacgactggaggtcaga

SEQ ID NO: 131758 - DNA, 25 bp, Mus musculus
actggggccacgtctggaggtcaga

SEQ ID NO: 131759 - DNA, 25 bp, Mus musculus
actggggctaaaaccgcagcaaact

SEQ ID NO: 131760 - DNA, 25 bp, Mus musculus
actggggctaaatccgcagcaaact

SEQ ID NO: 131761 - DNA, 25 bp, Mus musculus
actggggtccagctgcgctgtctca

SEQ ID NO: 131762 - DNA, 25 bp, Mus musculus
actggggtccaggtgcgctgtctca

SEQ ID NO: 131763 - DNA, 25 bp, Mus musculus
actgggtaaacacctgcttccttaa

SEQ ID NO: 131764 - DNA, 25 bp, Mus musculus
actgggtaaacagctgcttccttaa

SEQ ID NO: 131765 - DNA, 25 bp, Mus musculus
actgggtaagcactccccactgatg

SEQ ID NO: 131766 - DNA, 25 bp, Mus musculus
actgggtaagcagtccccactgatg

SEQ ID NO: 131767 - DNA, 25 bp, Mus musculus
actgggtagatgcttcacctctgac

SEQ ID NO: 131768 - DNA, 25 bp, Mus musculus
actgggtagatggttcacctctgac

SEQ ID NO: 131769 - DNA, 25 bp, Mus musculus
actgggtagtggaagatctctgctt

SEQ ID NO: 131770 - DNA, 25 bp, Mus musculus
actgggtagtggtagatctctgctt

SEQ ID NO: 131771 - DNA, 25 bp, Mus musculus
actgggtatgagcacttcatggtca

SEQ ID NO: 131772 - DNA, 25 bp, Mus musculus
actgggtatgaggacttcatggtca

SEQ ID NO: 131773 - DNA, 25 bp, Mus musculus
actgggtattgcatggctcttcaaa

SEQ ID NO: 131774 - DNA, 25 bp, Mus musculus
actgggtattgcttggctcttcaaa

SEQ ID NO: 131775 - DNA, 25 bp, Mus musculus
actgggtcatagagtacaactgtga

SEQ ID NO: 131776 - DNA, 25 bp, Mus musculus
actgggtcatagtgtacaactgtga

SEQ ID NO: 131777 - DNA, 25 bp, Mus musculus
actgggtcattgagaaccacggaga

SEQ ID NO: 131778 - DNA, 25 bp, Mus musculus
actgggtcattgtgaaccacggaga

SEQ ID NO: 131779 - DNA, 25 bp, Mus musculus
actgggtccccaacaggagagcctg

SEQ ID NO: 131780 - DNA, 25 bp, Mus musculus
actgggtccccaagttctggctgta

SEQ ID NO: 131781 - DNA, 25 bp, Mus musculus
actgggtccccatcaggagagcctg

SEQ ID NO: 131782 - DNA, 25 bp, Mus musculus
actgggtccccatgttctggctgta

SEQ ID NO: 131783 - DNA, 25 bp, Mus musculus
actgggtccgccaacttaagtatca

SEQ ID NO: 131784 - DNA, 25 bp, Mus musculus
actgggtccgcctacttaagtatca

SEQ ID NO: 131785 - DNA, 25 bp, Mus musculus
actgggtcgggcagcgctgcgagca

SEQ ID NO: 131786 - DNA, 25 bp, Mus musculus
actgggtcgggctgcgctgcgagca

SEQ ID NO: 131787 - DNA, 25 bp, Mus musculus
actgggtctgtgcttgggtcattat

SEQ ID NO: 131788 - DNA, 25 bp, Mus musculus
actgggtctgtggttgggtcattat

SEQ ID NO: 131789 - DNA, 25 bp, Mus musculus
actgggtgaatgacctcccgagagc

SEQ ID NO: 131790 - DNA, 25 bp, Mus musculus
actgggtgaatgtcctcccgagagc

SEQ ID NO: 131791 - DNA, 25 bp, Mus musculus
actgggtgacctatctctaaggact

SEQ ID NO: 131792 - DNA, 25 bp, Mus musculus
actgggtgacctttctctaaggact

SEQ ID NO: 131793 - DNA, 25 bp, Mus musculus
actgggtgactcattaatatatttc

SEQ ID NO: 131794 - DNA, 25 bp, Mus musculus
actgggtgactctttaatatatttc

SEQ ID NO: 131795 - DNA, 25 bp, Mus musculus
actgggtgactgatggactgtaact

SEQ ID NO: 131796 - DNA, 25 bp, Mus musculus
actgggtgactgttggactgtaact

SEQ ID NO: 131797 - DNA, 25 bp, Mus musculus
actgggtgacttagcagtgtctgct

SEQ ID NO: 131798 - DNA, 25 bp, Mus musculus
actgggtgactttgcagtgtctgct

SEQ ID NO: 131799 - DNA, 25 bp, Mus musculus
actgggtgcagacagggttcatttc

SEQ ID NO: 131800 - DNA, 25 bp, Mus musculus
actgggtgcagagagggttcatttc

SEQ ID NO: 131801 - DNA, 25 bp, Mus musculus
actgggtgctggaaattacacttgt

SEQ ID NO: 131802 - DNA, 25 bp, Mus musculus
actgggtgctggtaattacacttgt

SEQ ID NO: 131803 - DNA, 25 bp, Mus musculus
actgggtggaaacaaatagctactc

SEQ ID NO: 131804 - DNA, 25 bp, Mus musculus
actgggtggaaagaaatagctactc

SEQ ID NO: 131805 - DNA, 25 bp, Mus musculus
actgggtggctcacaacagcttgta

SEQ ID NO: 131806 - DNA, 25 bp, Mus musculus
actgggtggctctcaacagcttgta

SEQ ID NO: 131807 - DNA, 25 bp, Mus musculus
actgggtggctgagcttccacttac

SEQ ID NO: 131808 - DNA, 25 bp, Mus musculus
actgggtggctgtgcttccacttac

SEQ ID NO: 131809 - DNA, 25 bp, Mus musculus
actgggtggtcacaggatcagcctc

SEQ ID NO: 131810 - DNA, 25 bp, Mus musculus
actgggtggtcagaggatcagcctc

SEQ ID NO: 131811 - DNA, 25 bp, Mus musculus
actgggtgtctgaacattttgtggt

SEQ ID NO: 131812 - DNA, 25 bp, Mus musculus
actgggtgtctgtacattttgtggt

SEQ ID NO: 131813 - DNA, 25 bp, Mus musculus
actgggtgtggcacgtcctcttcat

SEQ ID NO: 131814 - DNA, 25 bp, Mus musculus
actgggtgtggctcgtcctcttcat

SEQ ID NO: 131815 - DNA, 25 bp, Mus musculus
actgggttcagtcaacttgcgatac

SEQ ID NO: 131816 - DNA, 25 bp, Mus musculus
actgggttcagtgaacttgcgatac

SEQ ID NO: 131817 - DNA, 25 bp, Mus musculus
actgggttcggtccccggacaacag

SEQ ID NO: 131818 - DNA, 25 bp, Mus musculus
actgggttcggtgcccggacaacag

SEQ ID NO: 131819 - DNA, 25 bp, Mus musculus
actgggttcttcacagtgcagtata

SEQ ID NO: 131820 - DNA, 25 bp, Mus musculus
actgggttcttctcagtgcagtata

SEQ ID NO: 131821 - DNA, 25 bp, Mus musculus
actgggttggtgaagattccacata

SEQ ID NO: 131822 - DNA, 25 bp, Mus musculus
actgggttggtgtagattccacata

SEQ ID NO: 131823 - DNA, 25 bp, Mus musculus
actgggtttgaaaacatgccaagag

SEQ ID NO: 131824 - DNA, 25 bp, Mus musculus
actgggtttgaatacatgccaagag

SEQ ID NO: 131825 - DNA, 25 bp, Mus musculus
actgggttttaactcaaactgcact

SEQ ID NO: 131826 - DNA, 25 bp, Mus musculus
actgggttttaagtcaaactgcact

SEQ ID NO: 131827 - DNA, 25 bp, Mus musculus
actgggttttcaaccctaatgatta

SEQ ID NO: 131828 - DNA, 25 bp, Mus musculus
actgggttttcatccctaatgatta

SEQ ID NO: 131829 - DNA, 25 bp, Mus musculus
actggtaaccacaatgtggtatatg

SEQ ID NO: 131830 - DNA, 25 bp, Mus musculus
actggtaaccacaggccacagcctg

SEQ ID NO: 131831 - DNA, 25 bp, Mus musculus
actggtaaccactatgtggtatatg

SEQ ID NO: 131832 - DNA, 25 bp, Mus musculus
actggtaaccactggccacagcctg

SEQ ID NO: 131833 - DNA, 25 bp, Mus musculus
actggtaactaactgttctgcatgc

SEQ ID NO: 131834 - DNA, 25 bp, Mus musculus
actggtaactaagtgttctgcatgc

SEQ ID NO: 131835 - DNA, 25 bp, Mus musculus
actggtaactgccacagaacctcag

SEQ ID NO: 131836 - DNA, 25 bp, Mus musculus
actggtaactgcgacagaacctcag

SEQ ID NO: 131837 - DNA, 25 bp, Mus musculus
actggtaactttatgcttctcagga

SEQ ID NO: 131838 - DNA, 25 bp, Mus musculus
actggtaactttttgcttctcagga

SEQ ID NO: 131839 - DNA, 25 bp, Mus musculus
actggtaagcttcatcttgctggaa

SEQ ID NO: 131840 - DNA, 25 bp, Mus musculus
actggtaagcttgatcttgctggaa

SEQ ID NO: 131841 - DNA, 25 bp, Mus musculus
actggtacacaccttttgaagagac

SEQ ID NO: 131842 - DNA, 25 bp, Mus musculus
actggtacacacgttttgaagagac

SEQ ID NO: 131843 - DNA, 25 bp, Mus musculus
actggtacatttataccttctgcag

SEQ ID NO: 131844 - DNA, 25 bp, Mus musculus
actggtacatttttaccttctgcag

SEQ ID NO: 131845 - DNA, 25 bp, Mus musculus
actggtaccaagatactcatccctg

SEQ ID NO: 131846 - DNA, 25 bp, Mus musculus
actggtaccaagcacaagttgtttg

SEQ ID NO: 131847 - DNA, 25 bp, Mus musculus
actggtaccaaggacaagttgtttg

SEQ ID NO: 131848 - DNA, 25 bp, Mus musculus
actggtaccaagttactcatccctg

SEQ ID NO: 131849 - DNA, 25 bp, Mus musculus
actggtacctgaaggaaatcgaatc

SEQ ID NO: 131850 - DNA, 25 bp, Mus musculus
actggtacctgatggaaatcgaatc

SEQ ID NO: 131851 - DNA, 25 bp, Mus musculus
actggtacctttactatgtaatgta

SEQ ID NO: 131852 - DNA, 25 bp, Mus musculus
actggtaccttttctatgtaatgta

SEQ ID NO: 131853 - DNA, 25 bp, Mus musculus
actggtactttcagtttcggagtca

SEQ ID NO: 131854 - DNA, 25 bp, Mus musculus
actggtactttctgtttcggagtca

SEQ ID NO: 131855 - DNA, 25 bp, Mus musculus
actggtagcgtaagccttgaggctt

SEQ ID NO: 131856 - DNA, 25 bp, Mus musculus
actggtagcgtatgccttgaggctt

SEQ ID NO: 131857 - DNA, 25 bp, Mus musculus
actggtagtgttcggcaccaagctt

SEQ ID NO: 131858 - DNA, 25 bp, Mus musculus
actggtagtgttgggcaccaagctt

SEQ ID NO: 131859 - DNA, 25 bp, Mus musculus
actggtatatcaacatctgtcccct

SEQ ID NO: 131860 - DNA, 25 bp, Mus musculus
actggtatatcatcatctgtcccct

SEQ ID NO: 131861 - DNA, 25 bp, Mus musculus
actggtatcaaaccgagtctcacgt

SEQ ID NO: 131862 - DNA, 25 bp, Mus musculus
actggtatcaaagcgagtctcacgt

SEQ ID NO: 131863 - DNA, 25 bp, Mus musculus
actggtatccgtattgcagagtgat

SEQ ID NO: 131864 - DNA, 25 bp, Mus musculus
actggtatccgttttgcagagtgat

SEQ ID NO: 131865 - DNA, 25 bp, Mus musculus
actggtatctaactccctcatgatg

SEQ ID NO: 131866 - DNA, 25 bp, Mus musculus
actggtatctaagtccctcatgatg

SEQ ID NO: 131867 - DNA, 25 bp, Mus musculus
actggtatgacacctagcccaccag

SEQ ID NO: 131868 - DNA, 25 bp, Mus musculus
actggtatgacagctagcccaccag

SEQ ID NO: 131869 - DNA, 25 bp, Mus musculus
actggtatgtcccagcacacgtaga

SEQ ID NO: 131870 - DNA, 25 bp, Mus musculus
actggtatgtccgagcacacgtaga

SEQ ID NO: 131871 - DNA, 25 bp, Mus musculus
actggtatgtctagtcacgggagca

SEQ ID NO: 131872 - DNA, 25 bp, Mus musculus
actggtatgtcttgtcacgggagca

SEQ ID NO: 131873 - DNA, 25 bp, Mus musculus
actggtcacagcacgttcataatca

SEQ ID NO: 131874 - DNA, 25 bp, Mus musculus
actggtcacagctcgttcataatca

SEQ ID NO: 131875 - DNA, 25 bp, Mus musculus
actggtcacctaagagggatctctc

SEQ ID NO: 131876 - DNA, 25 bp, Mus musculus
actggtcacctatgagggatctctc

SEQ ID NO: 131877 - DNA, 25 bp, Mus musculus
actggtcactgtattttgctcctct

SEQ ID NO: 131878 - DNA, 25 bp, Mus musculus
actggtcactgttttttgctcctct

SEQ ID NO: 131879 - DNA, 25 bp, Mus musculus
actggtcacttgaaggcttgctcta

SEQ ID NO: 131880 - DNA, 25 bp, Mus musculus
actggtcacttgtaggcttgctcta

SEQ ID NO: 131881 - DNA, 25 bp, Mus musculus
actggtcagatcacctcacaggaga

SEQ ID NO: 131882 - DNA, 25 bp, Mus musculus
actggtcagatctcctcacaggaga

SEQ ID NO: 131883 - DNA, 25 bp, Mus musculus
actggtcagcctagtgtatcctcac

SEQ ID NO: 131884 - DNA, 25 bp, Mus musculus
actggtcagcctctcaaatcgtggt

SEQ ID NO: 131885 - DNA, 25 bp, Mus musculus
actggtcagcctgtcaaatcgtggt

SEQ ID NO: 131886 - DNA, 25 bp, Mus musculus
actggtcagccttgtgtatcctcac

SEQ ID NO: 131887 - DNA, 25 bp, Mus musculus
actggtcagtacacacaggtatttg

SEQ ID NO: 131888 - DNA, 25 bp, Mus musculus
actggtcagtactcacaggtatttg

SEQ ID NO: 131889 - DNA, 25 bp, Mus musculus
actggtcagtcaacctggctgaatt

SEQ ID NO: 131890 - DNA, 25 bp, Mus musculus
actggtcagtcatcctggctgaatt

SEQ ID NO: 131891 - DNA, 25 bp, Mus musculus
actggtcagttaacaggatcctggc

SEQ ID NO: 131892 - DNA, 25 bp, Mus musculus
actggtcagttatcaggatcctggc

SEQ ID NO: 131893 - DNA, 25 bp, Mus musculus
actggtcagttcaagagctgcctgg

SEQ ID NO: 131894 - DNA, 25 bp, Mus musculus
actggtcagttctagagctgcctgg

SEQ ID NO: 131895 - DNA, 25 bp, Mus musculus
actggtcagtttactaaaggtgtgc

SEQ ID NO: 131896 - DNA, 25 bp, Mus musculus
actggtcagtttctgcagtcaccca

SEQ ID NO: 131897 - DNA, 25 bp, Mus musculus
actggtcagtttgtgcagtcaccca

SEQ ID NO: 131898 - DNA, 25 bp, Mus musculus
actggtcagttttctaaaggtgtgc

SEQ ID NO: 131899 - DNA, 25 bp, Mus musculus
actggtcatgcaccctccatgtgag

SEQ ID NO: 131900 - DNA, 25 bp, Mus musculus
actggtcatgcagcctccatgtgag

SEQ ID NO: 131901 - DNA, 25 bp, Mus musculus
actggtcatggtccctggtggtcta

SEQ ID NO: 131902 - DNA, 25 bp, Mus musculus
actggtcatggtgcctggtggtcta

SEQ ID NO: 131903 - DNA, 25 bp, Mus musculus
actggtcatgtcacaactatctctc

SEQ ID NO: 131904 - DNA, 25 bp, Mus musculus
actggtcatgtctcaactatctctc

SEQ ID NO: 131905 - DNA, 25 bp, Mus musculus
actggtccaccaagatctaattaat

SEQ ID NO: 131906 - DNA, 25 bp, Mus musculus
actggtccaccatgatctaattaat

SEQ ID NO: 131907 - DNA, 25 bp, Mus musculus
actggtccactcagtttctgcttct

SEQ ID NO: 131908 - DNA, 25 bp, Mus musculus
actggtccactctgtttctgcttct

SEQ ID NO: 131909 - DNA, 25 bp, Mus musculus
actggtccatagatcataccaacaa

SEQ ID NO: 131910 - DNA, 25 bp, Mus musculus
actggtccatagttcataccaacaa

SEQ ID NO: 131911 - DNA, 25 bp, Mus musculus
actggtccatctatccaactttata

SEQ ID NO: 131912 - DNA, 25 bp, Mus musculus
actggtccatctttccaactttata

SEQ ID NO: 131913 - DNA, 25 bp, Mus musculus
actggtcccatgacctgggtagggt

SEQ ID NO: 131914 - DNA, 25 bp, Mus musculus
actggtcccatgtcctgggtagggt

SEQ ID NO: 131915 - DNA, 25 bp, Mus musculus
actggtccctcaactacatagacaa

SEQ ID NO: 131916 - DNA, 25 bp, Mus musculus
actggtccctcatctacatagacaa

SEQ ID NO: 131917 - DNA, 25 bp, Mus musculus
actggtcccttgctctacaagcaga

SEQ ID NO: 131918 - DNA, 25 bp, Mus musculus
actggtcccttggtctacaagcaga

SEQ ID NO: 131919 - DNA, 25 bp, Mus musculus
actggtccgggtcggcatcataaga

SEQ ID NO: 131920 - DNA, 25 bp, Mus musculus
actggtccgggtgggcatcataaga

SEQ ID NO: 131921 - DNA, 25 bp, Mus musculus
actggtcctagtaacatcactctaa

SEQ ID NO: 131922 - DNA, 25 bp, Mus musculus
actggtcctagttacatcactctaa

SEQ ID NO: 131923 - DNA, 25 bp, Mus musculus
actggtcctccccagggaatgaaga

SEQ ID NO: 131924 - DNA, 25 bp, Mus musculus
actggtcctcccgagggaatgaaga

SEQ ID NO: 131925 - DNA, 25 bp, Mus musculus
actggtcgctttctttggatgtctc

SEQ ID NO: 131926 - DNA, 25 bp, Mus musculus
actggtcgctttgtttggatgtctc

SEQ ID NO: 131927 - DNA, 25 bp, Mus musculus
actggtcgtctaagctcagcttgga

SEQ ID NO: 131928 - DNA, 25 bp, Mus musculus
actggtcgtctatgctcagcttgga

SEQ ID NO: 131929 - DNA, 25 bp, Mus musculus
actggtctacaaccggttttagttg

SEQ ID NO: 131930 - DNA, 25 bp, Mus musculus
actggtctacaagcggttttagttg

SEQ ID NO: 131931 - DNA, 25 bp, Mus musculus
actggtctaggaaaaagcttggtgt

SEQ ID NO: 131932 - DNA, 25 bp, Mus musculus
actggtctaggataaagcttggtgt

SEQ ID NO: 131933 - DNA, 25 bp, Mus musculus
actggtctcaggatccatgtctaga

SEQ ID NO: 131934 - DNA, 25 bp, Mus musculus
actggtctcaggttccatgtctaga

SEQ ID NO: 131935 - DNA, 25 bp, Mus musculus
actggtctccctaagtaaggaaatg

SEQ ID NO: 131936 - DNA, 25 bp, Mus musculus
actggtctcccttagtaaggaaatg

SEQ ID NO: 131937 - DNA, 25 bp, Mus musculus
actggtctcctgacaatgtcttgtt

SEQ ID NO: 131938 - DNA, 25 bp, Mus musculus
actggtctcctgtcaatgtcttgtt

SEQ ID NO: 131939 - DNA, 25 bp, Mus musculus
actggtctctaactggtttggcaac

SEQ ID NO: 131940 - DNA, 25 bp, Mus musculus
actggtctctaagtggtttggcaac

SEQ ID NO: 131941 - DNA, 25 bp, Mus musculus
actggtctctatcggcactaggaat

SEQ ID NO: 131942 - DNA, 25 bp, Mus musculus
actggtctctatgggcactaggaat

SEQ ID NO: 131943 - DNA, 25 bp, Mus musculus
actggtctctccagtgatgtaagtg

SEQ ID NO: 131944 - DNA, 25 bp, Mus musculus
actggtctctcctgtgatgtaagtg

SEQ ID NO: 131945 - DNA, 25 bp, Mus musculus
actggtctctgtaaatacccacact

SEQ ID NO: 131946 - DNA, 25 bp, Mus musculus
actggtctctgttaatacccacact

SEQ ID NO: 131947 - DNA, 25 bp, Mus musculus
actggtctcttgatcaaactggcct

SEQ ID NO: 131948 - DNA, 25 bp, Mus musculus
actggtctcttgttcaaactggcct

SEQ ID NO: 131949 - DNA, 25 bp, Mus musculus
actggtctgatgaaacctgccctga

SEQ ID NO: 131950 - DNA, 25 bp, Mus musculus
actggtctgatgtaacctgccctga

SEQ ID NO: 131951 - DNA, 25 bp, Mus musculus
actggtctgcatcctctggaggaca

SEQ ID NO: 131952 - DNA, 25 bp, Mus musculus
actggtctgcatgctctggaggaca

SEQ ID NO: 131953 - DNA, 25 bp, Mus musculus
actggtctgcctcaatgtgcacgat

SEQ ID NO: 131954 - DNA, 25 bp, Mus musculus
actggtctgcctgaatgtgcacgat

SEQ ID NO: 131955 - DNA, 25 bp, Mus musculus
actggtctgggaaagcatcccttca

SEQ ID NO: 131956 - DNA, 25 bp, Mus musculus
actggtctgggatagcatcccttca

SEQ ID NO: 131957 - DNA, 25 bp, Mus musculus
actggtctgggcagtattgctccta

SEQ ID NO: 131958 - DNA, 25 bp, Mus musculus
actggtctgggctgtattgctccta

SEQ ID NO: 131959 - DNA, 25 bp, Mus musculus
actggtctgttcaagccacagtaga

SEQ ID NO: 131960 - DNA, 25 bp, Mus musculus
actggtctgttctagccacagtaga

SEQ ID NO: 131961 - DNA, 25 bp, Mus musculus
actggtcttagacttgagatcctcc

SEQ ID NO: 131962 - DNA, 25 bp, Mus musculus
actggtcttagagttgagatcctcc

SEQ ID NO: 131963 - DNA, 25 bp, Mus musculus
actggtcttagcaatgttctgctac

SEQ ID NO: 131964 - DNA, 25 bp, Mus musculus
actggtcttagctatgttctgctac

SEQ ID NO: 131965 - DNA, 25 bp, Mus musculus
actggtcttctcaaaggtggctaag

SEQ ID NO: 131966 - DNA, 25 bp, Mus musculus
actggtcttctctaaggtggctaag

SEQ ID NO: 131967 - DNA, 25 bp, Mus musculus
actggtcttgtacttgctgaataaa

SEQ ID NO: 131968 - DNA, 25 bp, Mus musculus
actggtcttgtagttgctgaataaa

SEQ ID NO: 131969 - DNA, 25 bp, Mus musculus
actggtgacacaagggcaaacatct

SEQ ID NO: 131970 - DNA, 25 bp, Mus musculus
actggtgacacatgggcaaacatct

SEQ ID NO: 131971 - DNA, 25 bp, Mus musculus
actggtgacacgagaggtgcccttt

SEQ ID NO: 131972 - DNA, 25 bp, Mus musculus
actggtgacacgtgaggtgcccttt

SEQ ID NO: 131973 - DNA, 25 bp, Mus musculus
actggtgacctacgacttggagcaa

SEQ ID NO: 131974 - DNA, 25 bp, Mus musculus
actggtgacctaggacttggagcaa

SEQ ID NO: 131975 - DNA, 25 bp, Mus musculus
actggtgagagacaagcccttgccc

SEQ ID NO: 131976 - DNA, 25 bp, Mus musculus
actggtgagagagaagcccttgccc

SEQ ID NO: 131977 - DNA, 25 bp, Mus musculus
actggtgagattaaccttgcacaaa

SEQ ID NO: 131978 - DNA, 25 bp, Mus musculus
actggtgagatttaccttgcacaaa

SEQ ID NO: 131979 - DNA, 25 bp, Mus musculus
actggtgaggcacgagctctaccct

SEQ ID NO: 131980 - DNA, 25 bp, Mus musculus
actggtgaggcaggagctctaccct

SEQ ID NO: 131981 - DNA, 25 bp, Mus musculus
actggtgatcctaggctgtgttaac

SEQ ID NO: 131982 - DNA, 25 bp, Mus musculus
actggtgatccttggctgtgttaac

SEQ ID NO: 131983 - DNA, 25 bp, Mus musculus
actggtgattgaacctgttgcctga

SEQ ID NO: 131984 - DNA, 25 bp, Mus musculus
actggtgattgatcctgttgcctga

SEQ ID NO: 131985 - DNA, 25 bp, Mus musculus
actggtgcaaagactgcaataccac

SEQ ID NO: 131986 - DNA, 25 bp, Mus musculus
actggtgcaaagtctgcaataccac

SEQ ID NO: 131987 - DNA, 25 bp, Mus musculus
actggtgcacacagaaaccttactt

SEQ ID NO: 131988 - DNA, 25 bp, Mus musculus
actggtgcacactgaaaccttactt

SEQ ID NO: 131989 - DNA, 25 bp, Mus musculus
actggtgcagacaccaactgatgtg

SEQ ID NO: 131990 - DNA, 25 bp, Mus musculus
actggtgcagactccaactgatgtg

SEQ ID NO: 131991 - DNA, 25 bp, Mus musculus
actggtgccctaatacaccgatgca

SEQ ID NO: 131992 - DNA, 25 bp, Mus musculus
actggtgccctattacaccgatgca

SEQ ID NO: 131993 - DNA, 25 bp, Mus musculus
actggtgcccttcttctgttttatg

SEQ ID NO: 131994 - DNA, 25 bp, Mus musculus
actggtgcccttgttctgttttatg

SEQ ID NO: 131995 - DNA, 25 bp, Mus musculus
actggtgccttgcaagattagcccc

SEQ ID NO: 131996 - DNA, 25 bp, Mus musculus
actggtgccttggaagattagcccc

SEQ ID NO: 131997 - DNA, 25 bp, Mus musculus
actggtgctactactttggtggctg

SEQ ID NO: 131998 - DNA, 25 bp, Mus musculus
actggtgctacttctttggtggctg

SEQ ID NO: 131999 - DNA, 25 bp, Mus musculus
actggtgctagtctttgctgatact

SEQ ID NO: 132000 - DNA, 25 bp, Mus musculus
actggtgctagtgtttgctgatact

SEQ ID NO: 132001 - DNA, 25 bp, Mus musculus
actggtgctcaccagaatgccagca

SEQ ID NO: 132002 - DNA, 25 bp, Mus musculus
actggtgctcacgagaatgccagca

SEQ ID NO: 132003 - DNA, 25 bp, Mus musculus
actggtgctgcgaggtgcaatgcca

SEQ ID NO: 132004 - DNA, 25 bp, Mus musculus
actggtgctgcgtggtgcaatgcca

SEQ ID NO: 132005 - DNA, 25 bp, Mus musculus
actggtgctgttcctcctggtcaca

SEQ ID NO: 132006 - DNA, 25 bp, Mus musculus
actggtgctgttgctcctggtcaca

SEQ ID NO: 132007 - DNA, 25 bp, Mus musculus
actggtggacagattgagtgctcga

SEQ ID NO: 132008 - DNA, 25 bp, Mus musculus
actggtggacagtttgagtgctcga

SEQ ID NO: 132009 - DNA, 25 bp, Mus musculus
actggtggagagatcctctgctggc

SEQ ID NO: 132010 - DNA, 25 bp, Mus musculus
actggtggagagttcctctgctggc

SEQ ID NO: 132011 - DNA, 25 bp, Mus musculus
actggtggctcaccacttgctacca

SEQ ID NO: 132012 - DNA, 25 bp, Mus musculus
actggtggctcagcacttgctacca

SEQ ID NO: 132013 - DNA, 25 bp, Mus musculus
actggtggcttgagatccactgcca

SEQ ID NO: 132014 - DNA, 25 bp, Mus musculus
actggtggcttgtgatccactgcca

SEQ ID NO: 132015 - DNA, 25 bp, Mus musculus
actggtggtctcatcttaacggaat

SEQ ID NO: 132016 - DNA, 25 bp, Mus musculus
actggtggtctcttcttaacggaat

SEQ ID NO: 132017 - DNA, 25 bp, Mus musculus
actggtggtgaacagccccatagga

SEQ ID NO: 132018 - DNA, 25 bp, Mus musculus
actggtggtgaagagccccatagga

SEQ ID NO: 132019 - DNA, 25 bp, Mus musculus
actggtggttcaacaaggtccggga

SEQ ID NO: 132020 - DNA, 25 bp, Mus musculus
actggtggttcacacattcaagccc

SEQ ID NO: 132021 - DNA, 25 bp, Mus musculus
actggtggttcagacattcaagccc

SEQ ID NO: 132022 - DNA, 25 bp, Mus musculus
actggtggttcatcaaggtccggga

SEQ ID NO: 132023 - DNA, 25 bp, Mus musculus
actggtggtttcctgagtccttgga

SEQ ID NO: 132024 - DNA, 25 bp, Mus musculus
actggtggtttcgtgagtccttgga

SEQ ID NO: 132025 - DNA, 25 bp, Mus musculus
actggtgtagaaattaatgcctttt

SEQ ID NO: 132026 - DNA, 25 bp, Mus musculus
actggtgtagaatttaatgcctttt

SEQ ID NO: 132027 - DNA, 25 bp, Mus musculus
actggtgtccagacagtagtttggc

SEQ ID NO: 132028 - DNA, 25 bp, Mus musculus
actggtgtccagtcagtagtttggc

SEQ ID NO: 132029 - DNA, 25 bp, Mus musculus
actggtgtccctaacatcctaaaat

SEQ ID NO: 132030 - DNA, 25 bp, Mus musculus
actggtgtcccttacatcctaaaat

SEQ ID NO: 132031 - DNA, 25 bp, Mus musculus
actggtgtgatgaccagagtgtcac

SEQ ID NO: 132032 - DNA, 25 bp, Mus musculus
actggtgtgatgtccagagtgtcac

SEQ ID NO: 132033 - DNA, 25 bp, Mus musculus
actggtgtggcaacccttctcccat

SEQ ID NO: 132034 - DNA, 25 bp, Mus musculus
actggtgtggcatcccttctcccat

SEQ ID NO: 132035 - DNA, 25 bp, Mus musculus
actggtgtggctcaccaccgtggca

SEQ ID NO: 132036 - DNA, 25 bp, Mus musculus
actggtgtggctgaccaccgtggca

SEQ ID NO: 132037 - DNA, 25 bp, Mus musculus
actggtgtgtctcatttccaacttt

SEQ ID NO: 132038 - DNA, 25 bp, Mus musculus
actggtgtgtctgatttccaacttt

SEQ ID NO: 132039 - DNA, 25 bp, Mus musculus
actggtgtgtgtagtcactgtagcc

SEQ ID NO: 132040 - DNA, 25 bp, Mus musculus
actggtgtgtgttgtcactgtagcc

SEQ ID NO: 132041 - DNA, 25 bp, Mus musculus
actggtgttccaactgtctaaattg

SEQ ID NO: 132042 - DNA, 25 bp, Mus musculus
actggtgttccacaagagcacatca

SEQ ID NO: 132043 - DNA, 25 bp, Mus musculus
actggtgttccagaagagcacatca

SEQ ID NO: 132044 - DNA, 25 bp, Mus musculus
actggtgttccatctgtctaaattg

SEQ ID NO: 132045 - DNA, 25 bp, Mus musculus
actggtgttctcagacttcttgtga

SEQ ID NO: 132046 - DNA, 25 bp, Mus musculus
actggtgttctctgacttcttgtga

SEQ ID NO: 132047 - DNA, 25 bp, Mus musculus
actggtgttgctacgtcaagtgcaa

SEQ ID NO: 132048 - DNA, 25 bp, Mus musculus
actggtgttgcttcgtcaagtgcaa

SEQ ID NO: 132049 - DNA, 25 bp, Mus musculus
actggtgttgtacctgatcacaggt

SEQ ID NO: 132050 - DNA, 25 bp, Mus musculus
actggtgttgtagctgatcacaggt

SEQ ID NO: 132051 - DNA, 25 bp, Mus musculus
actggtgtttgtcgatgtgacagca

SEQ ID NO: 132052 - DNA, 25 bp, Mus musculus
actggtgtttgtctttaattctcct

SEQ ID NO: 132053 - DNA, 25 bp, Mus musculus
actggtgtttgtggatgtgacagca

SEQ ID NO: 132054 - DNA, 25 bp, Mus musculus
actggtgtttgtgtttaattctcct

SEQ ID NO: 132055 - DNA, 25 bp, Mus musculus
actggttaaaacaagcccctctgat

SEQ ID NO: 132056 - DNA, 25 bp, Mus musculus
actggttaaaactagcccctctgat

SEQ ID NO: 132057 - DNA, 25 bp, Mus musculus
actggttaagggatgcatcctccca

SEQ ID NO: 132058 - DNA, 25 bp, Mus musculus
actggttaagggttgcatcctccca

SEQ ID NO: 132059 - DNA, 25 bp, Mus musculus
actggttacaacatagacattgcaa

SEQ ID NO: 132060 - DNA, 25 bp, Mus musculus
actggttacaacttagacattgcaa

SEQ ID NO: 132061 - DNA, 25 bp, Mus musculus
actggttacaccacagacctaacag

SEQ ID NO: 132062 - DNA, 25 bp, Mus musculus
actggttacacctcagacctaacag

SEQ ID NO: 132063 - DNA, 25 bp, Mus musculus
actggttacggtccagaattcatct

SEQ ID NO: 132064 - DNA, 25 bp, Mus musculus
actggttacggtgcagaattcatct

SEQ ID NO: 132065 - DNA, 25 bp, Mus musculus
actggttagcagatctacttctagg

SEQ ID NO: 132066 - DNA, 25 bp, Mus musculus
actggttagcagttctacttctagg

SEQ ID NO: 132067 - DNA, 25 bp, Mus musculus
actggttcactgagagctgtcttca

SEQ ID NO: 132068 - DNA, 25 bp, Mus musculus
actggttcactgtgagctgtcttca

SEQ ID NO: 132069 - DNA, 25 bp, Mus musculus
actggttcagtaacatgatggattc

SEQ ID NO: 132070 - DNA, 25 bp, Mus musculus
actggttcagtatcatgatggattc

SEQ ID NO: 132071 - DNA, 25 bp, Mus musculus
actggttccatccttcattgtcagg

SEQ ID NO: 132072 - DNA, 25 bp, Mus musculus
actggttccatcgttcattgtcagg

SEQ ID NO: 132073 - DNA, 25 bp, Mus musculus
actggttcccctatcagactgaaga

SEQ ID NO: 132074 - DNA, 25 bp, Mus musculus
actggttcccctttcagactgaaga

SEQ ID NO: 132075 - DNA, 25 bp, Mus musculus
actggttccctgcttcagtcctgat

SEQ ID NO: 132076 - DNA, 25 bp, Mus musculus
actggttccctggttcagtcctgat

SEQ ID NO: 132077 - DNA, 25 bp, Mus musculus
actggttccttgctaactatcttca

SEQ ID NO: 132078 - DNA, 25 bp, Mus musculus
actggttccttggtaactatcttca

SEQ ID NO: 132079 - DNA, 25 bp, Mus musculus
actggttcggctcctcatgtacaaa

SEQ ID NO: 132080 - DNA, 25 bp, Mus musculus
actggttcggctgctcatgtacaaa

SEQ ID NO: 132081 - DNA, 25 bp, Mus musculus
actggttcttagatccttccttgtc

SEQ ID NO: 132082 - DNA, 25 bp, Mus musculus
actggttcttagttccttccttgtc

SEQ ID NO: 132083 - DNA, 25 bp, Mus musculus
actggttgccaaacatcatgtagct

SEQ ID NO: 132084 - DNA, 25 bp, Mus musculus
actggttgccaatcatcatgtagct

SEQ ID NO: 132085 - DNA, 25 bp, Mus musculus
actggttgctccataaatctgtcat

SEQ ID NO: 132086 - DNA, 25 bp, Mus musculus
actggttgctccttaaatctgtcat

SEQ ID NO: 132087 - DNA, 25 bp, Mus musculus
actggttgctgacgcctctgcagct

SEQ ID NO: 132088 - DNA, 25 bp, Mus musculus
actggttgctgaggcctctgcagct

SEQ ID NO: 132089 - DNA, 25 bp, Mus musculus
actggttgcttcatggactgggtca

SEQ ID NO: 132090 - DNA, 25 bp, Mus musculus
actggttgcttcttggactgggtca

SEQ ID NO: 132091 - DNA, 25 bp, Mus musculus
actggttggatgattattctcctga

SEQ ID NO: 132092 - DNA, 25 bp, Mus musculus
actggttggatgtttattctcctga

SEQ ID NO: 132093 - DNA, 25 bp, Mus musculus
actggttggcagatggactgtccgt

SEQ ID NO: 132094 - DNA, 25 bp, Mus musculus
actggttggcagttggactgtccgt

SEQ ID NO: 132095 - DNA, 25 bp, Mus musculus
actggttggctaaacctgtggttta

SEQ ID NO: 132096 - DNA, 25 bp, Mus musculus
actggttggctatacctgtggttta

SEQ ID NO: 132097 - DNA, 25 bp, Mus musculus
actggttggctcagttatgctgcgt

SEQ ID NO: 132098 - DNA, 25 bp, Mus musculus
actggttggctctgttatgctgcgt

SEQ ID NO: 132099 - DNA, 25 bp, Mus musculus
actggttgggacagtgcctaaggca

SEQ ID NO: 132100 - DNA, 25 bp, Mus musculus
actggttgggactgtgcctaaggca

SEQ ID NO: 132101 - DNA, 25 bp, Mus musculus
actggttgtcttctcgcctctgaag

SEQ ID NO: 132102 - DNA, 25 bp, Mus musculus
actggttgtcttgtcgcctctgaag

SEQ ID NO: 132103 - DNA, 25 bp, Mus musculus
actggttgtggtattcggcatctgc

SEQ ID NO: 132104 - DNA, 25 bp, Mus musculus
actggttgtggttttcggcatctgc

SEQ ID NO: 132105 - DNA, 25 bp, Mus musculus
actggttgttcacaagcgggtgcac

SEQ ID NO: 132106 - DNA, 25 bp, Mus musculus
actggttgttcagaagcgggtgcac

SEQ ID NO: 132107 - DNA, 25 bp, Mus musculus
actggtttactgcaagtccattaaa

SEQ ID NO: 132108 - DNA, 25 bp, Mus musculus
actggtttactggaagtccattaaa

SEQ ID NO: 132109 - DNA, 25 bp, Mus musculus
actggtttatatagatctgccgcaa

SEQ ID NO: 132110 - DNA, 25 bp, Mus musculus
actggtttatattgatctgccgcaa

SEQ ID NO: 132111 - DNA, 25 bp, Mus musculus
actggtttcaggaaatcaagaagtt

SEQ ID NO: 132112 - DNA, 25 bp, Mus musculus
actggtttcaggtaatcaagaagtt

SEQ ID NO: 132113 - DNA, 25 bp, Mus musculus
actggtttcatgagcgaggacttcc

SEQ ID NO: 132114 - DNA, 25 bp, Mus musculus
actggtttcatgtgcgaggacttcc

SEQ ID NO: 132115 - DNA, 25 bp, Mus musculus
actggtttcctgatgggcggcatag

SEQ ID NO: 132116 - DNA, 25 bp, Mus musculus
actggtttcctgttgggcggcatag

SEQ ID NO: 132117 - DNA, 25 bp, Mus musculus
actggtttcgctcctcctgaaggga

SEQ ID NO: 132118 - DNA, 25 bp, Mus musculus
actggtttcgctgctcctgaaggga

SEQ ID NO: 132119 - DNA, 25 bp, Mus musculus
actggtttgaccacatgaacacgtg

SEQ ID NO: 132120 - DNA, 25 bp, Mus musculus
actggtttgacctcatgaacacgtg

SEQ ID NO: 132121 - DNA, 25 bp, Mus musculus
actggtttgagtacccgaggccaag

SEQ ID NO: 132122 - DNA, 25 bp, Mus musculus
actggtttgagttcccgaggccaag

SEQ ID NO: 132123 - DNA, 25 bp, Mus musculus
actggtttgcccatgtgatcttgga

SEQ ID NO: 132124 - DNA, 25 bp, Mus musculus
actggtttgcccttgtgatcttgga

SEQ ID NO: 132125 - DNA, 25 bp, Mus musculus
actggtttggacactactcaaatac

SEQ ID NO: 132126 - DNA, 25 bp, Mus musculus
actggtttggacacttatcttctgt

SEQ ID NO: 132127 - DNA, 25 bp, Mus musculus
actggtttggactctactcaaatac

SEQ ID NO: 132128 - DNA, 25 bp, Mus musculus
actggtttggactcttatcttctgt

SEQ ID NO: 132129 - DNA, 25 bp, Mus musculus
actggtttgttaatgcttcacttca

SEQ ID NO: 132130 - DNA, 25 bp, Mus musculus
actggtttgttattgcttcacttca

SEQ ID NO: 132131 - DNA, 25 bp, Mus musculus
actggttttagcaccaatgtagaga

SEQ ID NO: 132132 - DNA, 25 bp, Mus musculus
actggttttagcatacactgaggta

SEQ ID NO: 132133 - DNA, 25 bp, Mus musculus
actggttttagctccaatgtagaga

SEQ ID NO: 132134 - DNA, 25 bp, Mus musculus
actggttttagcttacactgaggta

SEQ ID NO: 132135 - DNA, 25 bp, Mus musculus
actggttttattccctgctattgtg

SEQ ID NO: 132136 - DNA, 25 bp, Mus musculus
actggttttattgcctgctattgtg

SEQ ID NO: 132137 - DNA, 25 bp, Mus musculus
actggttttgtcacattcgttcata

SEQ ID NO: 132138 - DNA, 25 bp, Mus musculus
actggttttgtctcattcgttcata

SEQ ID NO: 132139 - DNA, 25 bp, Mus musculus
actgtaaaaccaccactgcgcctaa

SEQ ID NO: 132140 - DNA, 25 bp, Mus musculus
actgtaaaaccagcactgcgcctaa

SEQ ID NO: 132141 - DNA, 25 bp, Mus musculus
actgtaaagaggcttgttgcccaga

SEQ ID NO: 132142 - DNA, 25 bp, Mus musculus
actgtaaagagggttgttgcccaga

SEQ ID NO: 132143 - DNA, 25 bp, Mus musculus
actgtaaagcgcaaggagggtcctc

SEQ ID NO: 132144 - DNA, 25 bp, Mus musculus
actgtaaagcgctaggagggtcctc

SEQ ID NO: 132145 - DNA, 25 bp, Mus musculus
actgtaaagtgtcgtaagcgctgta

SEQ ID NO: 132146 - DNA, 25 bp, Mus musculus
actgtaaagtgtggtaagcgctgta

SEQ ID NO: 132147 - DNA, 25 bp, Mus musculus
actgtaaataccatgatgtgagcct

SEQ ID NO: 132148 - DNA, 25 bp, Mus musculus
actgtaaataccttgatgtgagcct

SEQ ID NO: 132149 - DNA, 25 bp, Mus musculus
actgtaaatccacggctgtgcgcca

SEQ ID NO: 132150 - DNA, 25 bp, Mus musculus
actgtaaatccagggctgtgcgcca

SEQ ID NO: 132151 - DNA, 25 bp, Mus musculus
actgtaaatcttctggctgacctct

SEQ ID NO: 132152 - DNA, 25 bp, Mus musculus
actgtaaatcttgtggctgacctct

SEQ ID NO: 132153 - DNA, 25 bp, Mus musculus
actgtaaatgcaagaagcactggtt

SEQ ID NO: 132154 - DNA, 25 bp, Mus musculus
actgtaaatgcatgaagcactggtt

SEQ ID NO: 132155 - DNA, 25 bp, Mus musculus
actgtaacagtcaaatggagagcct

SEQ ID NO: 132156 - DNA, 25 bp, Mus musculus
actgtaacagtctaatggagagcct

SEQ ID NO: 132157 - DNA, 25 bp, Mus musculus
actgtaacatttctgtatcttgctg

SEQ ID NO: 132158 - DNA, 25 bp, Mus musculus
actgtaacatttgtgtatcttgctg

SEQ ID NO: 132159 - DNA, 25 bp, Mus musculus
actgtaaccggcacaccaagttgat

SEQ ID NO: 132160 - DNA, 25 bp, Mus musculus
actgtaaccggctcaccaagttgat

SEQ ID NO: 132161 - DNA, 25 bp, Mus musculus
actgtaaccttcagtccttgattgt

SEQ ID NO: 132162 - DNA, 25 bp, Mus musculus
actgtaaccttctgtccttgattgt

SEQ ID NO: 132163 - DNA, 25 bp, Mus musculus
actgtaacttgcctctgtaatccca

SEQ ID NO: 132164 - DNA, 25 bp, Mus musculus
actgtaacttgcgtctgtaatccca

SEQ ID NO: 132165 - DNA, 25 bp, Mus musculus
actgtaagccggcaagcatctctgg

SEQ ID NO: 132166 - DNA, 25 bp, Mus musculus
actgtaagccgggaagcatctctgg

SEQ ID NO: 132167 - DNA, 25 bp, Mus musculus
actgtaaggatgagggtgtcaaata

SEQ ID NO: 132168 - DNA, 25 bp, Mus musculus
actgtaaggatgtgggtgtcaaata

SEQ ID NO: 132169 - DNA, 25 bp, Mus musculus
actgtaaggcccctgacatcctgca

SEQ ID NO: 132170 - DNA, 25 bp, Mus musculus
actgtaaggcccgtgacatcctgca

SEQ ID NO: 132171 - DNA, 25 bp, Mus musculus
actgtaagtaccattgtggctgtcc

SEQ ID NO: 132172 - DNA, 25 bp, Mus musculus
actgtaagtacctttgtggctgtcc

SEQ ID NO: 132173 - DNA, 25 bp, Mus musculus
actgtaagtatgaaagtcaagcact

SEQ ID NO: 132174 - DNA, 25 bp, Mus musculus
actgtaagtatgtaagtcaagcact

SEQ ID NO: 132175 - DNA, 25 bp, Mus musculus
actgtaagtctgaggttcggttgga

SEQ ID NO: 132176 - DNA, 25 bp, Mus musculus
actgtaagtctgtggttcggttgga

SEQ ID NO: 132177 - DNA, 25 bp, Mus musculus
actgtaagttttctactgtactggc

SEQ ID NO: 132178 - DNA, 25 bp, Mus musculus
actgtaagttttgtactgtactggc

SEQ ID NO: 132179 - DNA, 25 bp, Mus musculus
actgtaataattcccactactgtat

SEQ ID NO: 132180 - DNA, 25 bp, Mus musculus
actgtaataattgccactactgtat

SEQ ID NO: 132181 - DNA, 25 bp, Mus musculus
actgtaatacttctgttggcactgt

SEQ ID NO: 132182 - DNA, 25 bp, Mus musculus
actgtaatacttgtgttggcactgt

SEQ ID NO: 132183 - DNA, 25 bp, Mus musculus
actgtaatatctctgtctctagcca

SEQ ID NO: 132184 - DNA, 25 bp, Mus musculus
actgtaatatctgtgtctctagcca

SEQ ID NO: 132185 - DNA, 25 bp, Mus musculus
actgtaatatgcatggtggttggtt

SEQ ID NO: 132186 - DNA, 25 bp, Mus musculus
actgtaatatgcttggtggttggtt

SEQ ID NO: 132187 - DNA, 25 bp, Mus musculus
actgtaatgctactgtgctggccca

SEQ ID NO: 132188 - DNA, 25 bp, Mus musculus
actgtaatgctagtgtgctggccca

SEQ ID NO: 132189 - DNA, 25 bp, Mus musculus
actgtaatgctgataccgaccagga

SEQ ID NO: 132190 - DNA, 25 bp, Mus musculus
actgtaatgctgttaccgaccagga

SEQ ID NO: 132191 - DNA, 25 bp, Mus musculus
actgtaattcatctaatgtatgtta

SEQ ID NO: 132192 - DNA, 25 bp, Mus musculus
actgtaattcatgtaatgtatgtta

SEQ ID NO: 132193 - DNA, 25 bp, Mus musculus
actgtacaagtccatgaagggtgct

SEQ ID NO: 132194 - DNA, 25 bp, Mus musculus
actgtacaagtcgatgaagggtgct

SEQ ID NO: 132195 - DNA, 25 bp, Mus musculus
actgtacacatgcaatcttccacat

SEQ ID NO: 132196 - DNA, 25 bp, Mus musculus
actgtacacatggaatcttccacat

SEQ ID NO: 132197 - DNA, 25 bp, Mus musculus
actgtacacggactggagccacgga

SEQ ID NO: 132198 - DNA, 25 bp, Mus musculus
actgtacacggagtggagccacgga

SEQ ID NO: 132199 - DNA, 25 bp, Mus musculus
actgtacagattcctgcttctgctc

SEQ ID NO: 132200 - DNA, 25 bp, Mus musculus
actgtacagattgctgcttctgctc

SEQ ID NO: 132201 - DNA, 25 bp, Mus musculus
actgtacagcccaaggacataggca

SEQ ID NO: 132202 - DNA, 25 bp, Mus musculus
actgtacagccctaggacataggca

SEQ ID NO: 132203 - DNA, 25 bp, Mus musculus
actgtacataagagtctctcagcct

SEQ ID NO: 132204 - DNA, 25 bp, Mus musculus
actgtacataagtgtctctcagcct

SEQ ID NO: 132205 - DNA, 25 bp, Mus musculus
actgtacatccccaggttgacttaa

SEQ ID NO: 132206 - DNA, 25 bp, Mus musculus
actgtacatcccgaggttgacttaa

SEQ ID NO: 132207 - DNA, 25 bp, Mus musculus
actgtacattacagtttgtggttat

SEQ ID NO: 132208 - DNA, 25 bp, Mus musculus
actgtacattactgtttgtggttat

SEQ ID NO: 132209 - DNA, 25 bp, Mus musculus
actgtacattgtcagctctggttat

SEQ ID NO: 132210 - DNA, 25 bp, Mus musculus
actgtacattgtgagctctggttat

SEQ ID NO: 132211 - DNA, 25 bp, Mus musculus
actgtacattttactcgctgttgga

SEQ ID NO: 132212 - DNA, 25 bp, Mus musculus
actgtacatttttctcgctgttgga

SEQ ID NO: 132213 - DNA, 25 bp, Mus musculus
actgtaccatatatcagactctgat

SEQ ID NO: 132214 - DNA, 25 bp, Mus musculus
actgtaccatatttcagactctgat

SEQ ID NO: 132215 - DNA, 25 bp, Mus musculus
actgtaccatgcaattgtttttcca

SEQ ID NO: 132216 - DNA, 25 bp, Mus musculus
actgtaccatgctattgtttttcca

SEQ ID NO: 132217 - DNA, 25 bp, Mus musculus
actgtacccagtaactcatgaaata

SEQ ID NO: 132218 - DNA, 25 bp, Mus musculus
actgtacccagttactcatgaaata

SEQ ID NO: 132219 - DNA, 25 bp, Mus musculus
actgtaccctgtcattcctgattct

SEQ ID NO: 132220 - DNA, 25 bp, Mus musculus
actgtaccctgtgattcctgattct

SEQ ID NO: 132221 - DNA, 25 bp, Mus musculus
actgtaccgtggagtgctgtactgt

SEQ ID NO: 132222 - DNA, 25 bp, Mus musculus
actgtaccgtggtgtgctgtactgt

SEQ ID NO: 132223 - DNA, 25 bp, Mus musculus
actgtacctagcaccatacatgaag

SEQ ID NO: 132224 - DNA, 25 bp, Mus musculus
actgtacctagctccatacatgaag

SEQ ID NO: 132225 - DNA, 25 bp, Mus musculus
actgtacctgtcctatgtgcaaact

SEQ ID NO: 132226 - DNA, 25 bp, Mus musculus
actgtacctgtcgtatgtgcaaact

SEQ ID NO: 132227 - DNA, 25 bp, Mus musculus
actgtacctgtgattggaggagctt

SEQ ID NO: 132228 - DNA, 25 bp, Mus musculus
actgtacctgtgtttggaggagctt

SEQ ID NO: 132229 - DNA, 25 bp, Mus musculus
actgtaccttgtatggtggctctga

SEQ ID NO: 132230 - DNA, 25 bp, Mus musculus
actgtaccttgtttggtggctctga

SEQ ID NO: 132231 - DNA, 25 bp, Mus musculus
actgtacgcctaaaccgagtcggaa

SEQ ID NO: 132232 - DNA, 25 bp, Mus musculus
actgtacgcctataccgagtcggaa

SEQ ID NO: 132233 - DNA, 25 bp, Mus musculus
actgtacgtgagagtggcagccaca

SEQ ID NO: 132234 - DNA, 25 bp, Mus musculus
actgtacgtgagtgtggcagccaca

SEQ ID NO: 132235 - DNA, 25 bp, Mus musculus
actgtacgtgcaattcatcctcttt

SEQ ID NO: 132236 - DNA, 25 bp, Mus musculus
actgtacgtgcatttcatcctcttt

SEQ ID NO: 132237 - DNA, 25 bp, Mus musculus
actgtactagctctgagtcctgtgc

SEQ ID NO: 132238 - DNA, 25 bp, Mus musculus
actgtactagctgtgagtcctgtgc

SEQ ID NO: 132239 - DNA, 25 bp, Mus musculus
actgtactccttagcggctgagaaa

SEQ ID NO: 132240 - DNA, 25 bp, Mus musculus
actgtactcctttgcggctgagaaa

SEQ ID NO: 132241 - DNA, 25 bp, Mus musculus
actgtactctccaatctatcttgac

SEQ ID NO: 132242 - DNA, 25 bp, Mus musculus
actgtactctcctatctatcttgac

SEQ ID NO: 132243 - DNA, 25 bp, Mus musculus
actgtactctgaacacactggctac

SEQ ID NO: 132244 - DNA, 25 bp, Mus musculus
actgtactctgatcacactggctac

SEQ ID NO: 132245 - DNA, 25 bp, Mus musculus
actgtactctttacttgcctgtgaa

SEQ ID NO: 132246 - DNA, 25 bp, Mus musculus
actgtactcttttcttgcctgtgaa

SEQ ID NO: 132247 - DNA, 25 bp, Mus musculus
actgtactgacaatgaaacgtgtgt

SEQ ID NO: 132248 - DNA, 25 bp, Mus musculus
actgtactgacattgaaacgtgtgt

SEQ ID NO: 132249 - DNA, 25 bp, Mus musculus
actgtactgagtatcagctctgcca

SEQ ID NO: 132250 - DNA, 25 bp, Mus musculus
actgtactgagtcgtctcttggcaa

SEQ ID NO: 132251 - DNA, 25 bp, Mus musculus
actgtactgagtggtctcttggcaa

SEQ ID NO: 132252 - DNA, 25 bp, Mus musculus
actgtactgagtttcagctctgcca

SEQ ID NO: 132253 - DNA, 25 bp, Mus musculus
actgtactgattaactggtgcatgc

SEQ ID NO: 132254 - DNA, 25 bp, Mus musculus
actgtactgatttactggtgcatgc

SEQ ID NO: 132255 - DNA, 25 bp, Mus musculus
actgtactgcatagcctctgtgtgt

SEQ ID NO: 132256 - DNA, 25 bp, Mus musculus
actgtactgcattgcctctgtgtgt

SEQ ID NO: 132257 - DNA, 25 bp, Mus musculus
actgtactgcctacctttgattttt

SEQ ID NO: 132258 - DNA, 25 bp, Mus musculus
actgtactgccttcctttgattttt

SEQ ID NO: 132259 - DNA, 25 bp, Mus musculus
actgtactgcttacaattcatccca

SEQ ID NO: 132260 - DNA, 25 bp, Mus musculus
actgtactgctttcaattcatccca

SEQ ID NO: 132261 - DNA, 25 bp, Mus musculus
actgtactggcaacacattcacatg

SEQ ID NO: 132262 - DNA, 25 bp, Mus musculus
actgtactggcatcacattcacatg

SEQ ID NO: 132263 - DNA, 25 bp, Mus musculus
actgtactgtaaacgctctatgcaa

SEQ ID NO: 132264 - DNA, 25 bp, Mus musculus
actgtactgtaatcgctctatgcaa

SEQ ID NO: 132265 - DNA, 25 bp, Mus musculus
actgtactgtggcttagggagctca

SEQ ID NO: 132266 - DNA, 25 bp, Mus musculus
actgtactgtgggttagggagctca

SEQ ID NO: 132267 - DNA, 25 bp, Mus musculus
actgtactttacctatgagcgcatt

SEQ ID NO: 132268 - DNA, 25 bp, Mus musculus
actgtactttacgtatgagcgcatt

SEQ ID NO: 132269 - DNA, 25 bp, Mus musculus
actgtactttgccttattcagccag

SEQ ID NO: 132270 - DNA, 25 bp, Mus musculus
actgtactttgcgttattcagccag

SEQ ID NO: 132271 - DNA, 25 bp, Mus musculus
actgtagaaaccagggcaggtcagt

SEQ ID NO: 132272 - DNA, 25 bp, Mus musculus
actgtagaaacctgggcaggtcagt

SEQ ID NO: 132273 - DNA, 25 bp, Mus musculus
actgtagaactacctgtgacctgag

SEQ ID NO: 132274 - DNA, 25 bp, Mus musculus
actgtagaactagctgtgacctgag

SEQ ID NO: 132275 - DNA, 25 bp, Mus musculus
actgtagaacttctgaaccctcagg

SEQ ID NO: 132276 - DNA, 25 bp, Mus musculus
actgtagaacttgtgaaccctcagg

SEQ ID NO: 132277 - DNA, 25 bp, Mus musculus
actgtagaattcacttaaggtgcat

SEQ ID NO: 132278 - DNA, 25 bp, Mus musculus
actgtagaattctcttaaggtgcat

SEQ ID NO: 132279 - DNA, 25 bp, Mus musculus
actgtagaccccaagtcagactggg

SEQ ID NO: 132280 - DNA, 25 bp, Mus musculus
actgtagacccctagtcagactggg

SEQ ID NO: 132281 - DNA, 25 bp, Mus musculus
actgtagacggcacatgctcagact

SEQ ID NO: 132282 - DNA, 25 bp, Mus musculus
actgtagacggctcatgctcagact

SEQ ID NO: 132283 - DNA, 25 bp, Mus musculus
actgtagacttacttcattgccatt

SEQ ID NO: 132284 - DNA, 25 bp, Mus musculus
actgtagacttagttcattgccatt

SEQ ID NO: 132285 - DNA, 25 bp, Mus musculus
actgtagactttcttcatcaacttg

SEQ ID NO: 132286 - DNA, 25 bp, Mus musculus
actgtagactttgttcatcaacttg

SEQ ID NO: 132287 - DNA, 25 bp, Mus musculus
actgtagatgctataggctgtagaa

SEQ ID NO: 132288 - DNA, 25 bp, Mus musculus
actgtagatgctttaggctgtagaa

SEQ ID NO: 132289 - DNA, 25 bp, Mus musculus
actgtagatgtgcttccacccgata

SEQ ID NO: 132290 - DNA, 25 bp, Mus musculus
actgtagatgtggttccacccgata

SEQ ID NO: 132291 - DNA, 25 bp, Mus musculus
actgtagcaccacttgtgcctgatt

SEQ ID NO: 132292 - DNA, 25 bp, Mus musculus
actgtagcaccagttgtgcctgatt

SEQ ID NO: 132293 - DNA, 25 bp, Mus musculus
actgtagcagcaatttgagaacttc

SEQ ID NO: 132294 - DNA, 25 bp, Mus musculus
actgtagcagcattttgagaacttc

SEQ ID NO: 132295 - DNA, 25 bp, Mus musculus
actgtagccagtccttttcaaaact

SEQ ID NO: 132296 - DNA, 25 bp, Mus musculus
actgtagccagtgcttttcaaaact

SEQ ID NO: 132297 - DNA, 25 bp, Mus musculus
actgtagcccataaactgtttacta

SEQ ID NO: 132298 - DNA, 25 bp, Mus musculus
actgtagcccattaactgtttacta

SEQ ID NO: 132299 - DNA, 25 bp, Mus musculus
actgtagccgctatatggctcggga

SEQ ID NO: 132300 - DNA, 25 bp, Mus musculus
actgtagccgctttatggctcggga

SEQ ID NO: 132301 - DNA, 25 bp, Mus musculus
actgtagcctcacgaacctgtccag

SEQ ID NO: 132302 - DNA, 25 bp, Mus musculus
actgtagcctcaggaacctgtccag

SEQ ID NO: 132303 - DNA, 25 bp, Mus musculus
actgtagcgcgtctgtggccctgtc

SEQ ID NO: 132304 - DNA, 25 bp, Mus musculus
actgtagcgcgtgtgtggccctgtc

SEQ ID NO: 132305 - DNA, 25 bp, Mus musculus
actgtagcggttagcatatacttgt

SEQ ID NO: 132306 - DNA, 25 bp, Mus musculus
actgtagcggtttgcatatacttgt

SEQ ID NO: 132307 - DNA, 25 bp, Mus musculus
actgtagctattagtggctcctcgc

SEQ ID NO: 132308 - DNA, 25 bp, Mus musculus
actgtagctatttgtggctcctcgc

SEQ ID NO: 132309 - DNA, 25 bp, Mus musculus
actgtagctcagaggtgtcgtgtac

SEQ ID NO: 132310 - DNA, 25 bp, Mus musculus
actgtagctcagtggtgtcgtgtac

SEQ ID NO: 132311 - DNA, 25 bp, Mus musculus
actgtagctgtaaaagatgttttct

SEQ ID NO: 132312 - DNA, 25 bp, Mus musculus
actgtagctgtataagatgttttct

SEQ ID NO: 132313 - DNA, 25 bp, Mus musculus
actgtagcttctcatgaggccgcag

SEQ ID NO: 132314 - DNA, 25 bp, Mus musculus
actgtagcttctgatgaggccgcag

SEQ ID NO: 132315 - DNA, 25 bp, Mus musculus
actgtagctttcactccctggatat

SEQ ID NO: 132316 - DNA, 25 bp, Mus musculus
actgtagctttctctccctggatat

SEQ ID NO: 132317 - DNA, 25 bp, Mus musculus
actgtaggaaagagatcatgctgtc

SEQ ID NO: 132318 - DNA, 25 bp, Mus musculus
actgtaggaaagtgatcatgctgtc

SEQ ID NO: 132319 - DNA, 25 bp, Mus musculus
actgtaggaattcgtgagcccttga

SEQ ID NO: 132320 - DNA, 25 bp, Mus musculus
actgtaggaattggtgagcccttga

SEQ ID NO: 132321 - DNA, 25 bp, Mus musculus
actgtaggagtcattgctcagccct

SEQ ID NO: 132322 - DNA, 25 bp, Mus musculus
actgtaggagtctttgctcagccct

SEQ ID NO: 132323 - DNA, 25 bp, Mus musculus
actgtaggagttactgttgcttttg

SEQ ID NO: 132324 - DNA, 25 bp, Mus musculus
actgtaggagtttctgttgcttttg

SEQ ID NO: 132325 - DNA, 25 bp, Mus musculus
actgtaggccatccatcagtggcta

SEQ ID NO: 132326 - DNA, 25 bp, Mus musculus
actgtaggccatgcatcagtggcta

SEQ ID NO: 132327 - DNA, 25 bp, Mus musculus
actgtaggccgacctgttctgtgga

SEQ ID NO: 132328 - DNA, 25 bp, Mus musculus
actgtaggccgagctgttctgtgga

SEQ ID NO: 132329 - DNA, 25 bp, Mus musculus
actgtaggctcaatcttgtgcccta

SEQ ID NO: 132330 - DNA, 25 bp, Mus musculus
actgtaggctcattcttgtgcccta

SEQ ID NO: 132331 - DNA, 25 bp, Mus musculus
actgtagtacagcttcaccttgaac

SEQ ID NO: 132332 - DNA, 25 bp, Mus musculus
actgtagtacaggttcaccttgaac

SEQ ID NO: 132333 - DNA, 25 bp, Mus musculus
actgtagtaggcaagatttatcgtc

SEQ ID NO: 132334 - DNA, 25 bp, Mus musculus
actgtagtaggctagatttatcgtc

SEQ ID NO: 132335 - DNA, 25 bp, Mus musculus
actgtagtcattcttctgtgcaact

SEQ ID NO: 132336 - DNA, 25 bp, Mus musculus
actgtagtcattgttctgtgcaact

SEQ ID NO: 132337 - DNA, 25 bp, Mus musculus
actgtagtctgcagactagctgctt

SEQ ID NO: 132338 - DNA, 25 bp, Mus musculus
actgtagtctgctgactagctgctt

SEQ ID NO: 132339 - DNA, 25 bp, Mus musculus
actgtagtgacaagtggccttgcct

SEQ ID NO: 132340 - DNA, 25 bp, Mus musculus
actgtagtgacatgtggccttgcct

SEQ ID NO: 132341 - DNA, 25 bp, Mus musculus
actgtagtgcaacctgctaccagct

SEQ ID NO: 132342 - DNA, 25 bp, Mus musculus
actgtagtgcaagctgctaccagct

SEQ ID NO: 132343 - DNA, 25 bp, Mus musculus
actgtagtgtgcacccaagtctcca

SEQ ID NO: 132344 - DNA, 25 bp, Mus musculus
actgtagtgtgctcccaagtctcca

SEQ ID NO: 132345 - DNA, 25 bp, Mus musculus
actgtagtgttgaatctgtttcctg

SEQ ID NO: 132346 - DNA, 25 bp, Mus musculus
actgtagtgttgtatctgtttcctg

SEQ ID NO: 132347 - DNA, 25 bp, Mus musculus
actgtagttcttatccggtagatgc

SEQ ID NO: 132348 - DNA, 25 bp, Mus musculus
actgtagttcttttccggtagatgc

SEQ ID NO: 132349 - DNA, 25 bp, Mus musculus
actgtataacctcgcaatcctgaca

SEQ ID NO: 132350 - DNA, 25 bp, Mus musculus
actgtataacctggcaatcctgaca

SEQ ID NO: 132351 - DNA, 25 bp, Mus musculus
actgtatacctgagggcgatgagat

SEQ ID NO: 132352 - DNA, 25 bp, Mus musculus
actgtatacctgtgggcgatgagat

SEQ ID NO: 132353 - DNA, 25 bp, Mus musculus
actgtatactttaacacaccccata

SEQ ID NO: 132354 - DNA, 25 bp, Mus musculus
actgtatacttttacacaccccata

SEQ ID NO: 132355 - DNA, 25 bp, Mus musculus
actgtatagcacaagctggcctccc

SEQ ID NO: 132356 - DNA, 25 bp, Mus musculus
actgtatagcactagctggcctccc

SEQ ID NO: 132357 - DNA, 25 bp, Mus musculus
actgtatatctacaatgtgcaatga

SEQ ID NO: 132358 - DNA, 25 bp, Mus musculus
actgtatatctagaatgtgcaatga

SEQ ID NO: 132359 - DNA, 25 bp, Mus musculus
actgtatcagatctgtggcctgtcc

SEQ ID NO: 132360 - DNA, 25 bp, Mus musculus
actgtatcagatgtgtggcctgtcc

SEQ ID NO: 132361 - DNA, 25 bp, Mus musculus
actgtatcattcctgcttgctgttt

SEQ ID NO: 132362 - DNA, 25 bp, Mus musculus
actgtatcattcgtgcttgctgttt

SEQ ID NO: 132363 - DNA, 25 bp, Mus musculus
actgtatcctctctggccttgctgg

SEQ ID NO: 132364 - DNA, 25 bp, Mus musculus
actgtatcctctgtggccttgctgg

SEQ ID NO: 132365 - DNA, 25 bp, Mus musculus
actgtatcgactcctttgttactca

SEQ ID NO: 132366 - DNA, 25 bp, Mus musculus
actgtatcgactgctttgttactca

SEQ ID NO: 132367 - DNA, 25 bp, Mus musculus
actgtatcgcagacggtgtcgggta

SEQ ID NO: 132368 - DNA, 25 bp, Mus musculus
actgtatcgcagtcggtgtcgggta

SEQ ID NO: 132369 - DNA, 25 bp, Mus musculus
actgtatctacaaatgctctaatta

SEQ ID NO: 132370 - DNA, 25 bp, Mus musculus
actgtatctacatatgctctaatta

SEQ ID NO: 132371 - DNA, 25 bp, Mus musculus
actgtatctctgcagccccaataca

SEQ ID NO: 132372 - DNA, 25 bp, Mus musculus
actgtatctctggagccccaataca

SEQ ID NO: 132373 - DNA, 25 bp, Mus musculus
actgtatgagcgctgcccaaaggct

SEQ ID NO: 132374 - DNA, 25 bp, Mus musculus
actgtatgagcggtgcccaaaggct

SEQ ID NO: 132375 - DNA, 25 bp, Mus musculus
actgtatgctcacttctttccttga

SEQ ID NO: 132376 - DNA, 25 bp, Mus musculus
actgtatgctcagttctttccttga

SEQ ID NO: 132377 - DNA, 25 bp, Mus musculus
actgtatgctttaccctttaatcac

SEQ ID NO: 132378 - DNA, 25 bp, Mus musculus
actgtatgcttttccctttaatcac

SEQ ID NO: 132379 - DNA, 25 bp, Mus musculus
actgtatggcttactttcgtcgttg

SEQ ID NO: 132380 - DNA, 25 bp, Mus musculus
actgtatggctttctttcgtcgttg

SEQ ID NO: 132381 - DNA, 25 bp, Mus musculus
actgtattaagtccgcttgaatgga

SEQ ID NO: 132382 - DNA, 25 bp, Mus musculus
actgtattaagtgcgcttgaatgga

SEQ ID NO: 132383 - DNA, 25 bp, Mus musculus
actgtattacatcccagggctggaa

SEQ ID NO: 132384 - DNA, 25 bp, Mus musculus
actgtattacatgccagggctggaa

SEQ ID NO: 132385 - DNA, 25 bp, Mus musculus
actgtattagtcaccaaaccaattg

SEQ ID NO: 132386 - DNA, 25 bp, Mus musculus
actgtattagtctccaaaccaattg

SEQ ID NO: 132387 - DNA, 25 bp, Mus musculus
actgtattcagtccacggagaggga

SEQ ID NO: 132388 - DNA, 25 bp, Mus musculus
actgtattcagtgcacggagaggga

SEQ ID NO: 132389 - DNA, 25 bp, Mus musculus
actgtattcattatgtttgcgtttt

SEQ ID NO: 132390 - DNA, 25 bp, Mus musculus
actgtattcattttgtttgcgtttt

SEQ ID NO: 132391 - DNA, 25 bp, Mus musculus
actgtattcctaattttcttctcaa

SEQ ID NO: 132392 - DNA, 25 bp, Mus musculus
actgtattcctatttttcttctcaa

SEQ ID NO: 132393 - DNA, 25 bp, Mus musculus
actgtattcgagcacaccgtgttgt

SEQ ID NO: 132394 - DNA, 25 bp, Mus musculus
actgtattcgagctgcccgagggat

SEQ ID NO: 132395 - DNA, 25 bp, Mus musculus
actgtattcgaggacaccgtgttgt

SEQ ID NO: 132396 - DNA, 25 bp, Mus musculus
actgtattcgaggtgcccgagggat

SEQ ID NO: 132397 - DNA, 25 bp, Mus musculus
actgtattctggatgtgtttgtata

SEQ ID NO: 132398 - DNA, 25 bp, Mus musculus
actgtattctggttgtgtttgtata

SEQ ID NO: 132399 - DNA, 25 bp, Mus musculus
actgtattcttgatctgtggttgga

SEQ ID NO: 132400 - DNA, 25 bp, Mus musculus
actgtattcttgttctgtggttgga

SEQ ID NO: 132401 - DNA, 25 bp, Mus musculus
actgtattgccaactgttgacgtta

SEQ ID NO: 132402 - DNA, 25 bp, Mus musculus
actgtattgccatctgttgacgtta

SEQ ID NO: 132403 - DNA, 25 bp, Mus musculus
actgtattgcgtactaccgactagt

SEQ ID NO: 132404 - DNA, 25 bp, Mus musculus
actgtattgcgttctaccgactagt

SEQ ID NO: 132405 - DNA, 25 bp, Mus musculus
actgtattgggaatgtaatgtctca

SEQ ID NO: 132406 - DNA, 25 bp, Mus musculus
actgtattgggattgtaatgtctca

SEQ ID NO: 132407 - DNA, 25 bp, Mus musculus
actgtatttattctaacgcctttca

SEQ ID NO: 132408 - DNA, 25 bp, Mus musculus
actgtatttattgtaacgcctttca

SEQ ID NO: 132409 - DNA, 25 bp, Mus musculus
actgtatttgctcccttctgacttc

SEQ ID NO: 132410 - DNA, 25 bp, Mus musculus
actgtatttgctgccttctgacttc

SEQ ID NO: 132411 - DNA, 25 bp, Mus musculus
actgtattttctctccattccttct

SEQ ID NO: 132412 - DNA, 25 bp, Mus musculus
actgtattttctgtccattccttct

SEQ ID NO: 132413 - DNA, 25 bp, Mus musculus
actgtattttggagtctgtaccgca

SEQ ID NO: 132414 - DNA, 25 bp, Mus musculus
actgtattttggtgtctgtaccgca

SEQ ID NO: 132415 - DNA, 25 bp, Mus musculus
actgtcaaaacacctgaccctggaa

SEQ ID NO: 132416 - DNA, 25 bp, Mus musculus
actgtcaaaacagctgaccctggaa

SEQ ID NO: 132417 - DNA, 25 bp, Mus musculus
actgtcaaatatctacctttccctc

SEQ ID NO: 132418 - DNA, 25 bp, Mus musculus
actgtcaaatatgtacctttccctc

SEQ ID NO: 132419 - DNA, 25 bp, Mus musculus
actgtcaacaatctttatggcttga

SEQ ID NO: 132420 - DNA, 25 bp, Mus musculus
actgtcaacaatgtttatggcttga

SEQ ID NO: 132421 - DNA, 25 bp, Mus musculus
actgtcaacaggagctgccacacat

SEQ ID NO: 132422 - DNA, 25 bp, Mus musculus
actgtcaacaggtgctgccacacat

SEQ ID NO: 132423 - DNA, 25 bp, Mus musculus
actgtcaacatgcatggcactgcac

SEQ ID NO: 132424 - DNA, 25 bp, Mus musculus
actgtcaacatggatggcactgcac

SEQ ID NO: 132425 - DNA, 25 bp, Mus musculus
actgtcaacctcaagctgatatcag

SEQ ID NO: 132426 - DNA, 25 bp, Mus musculus
actgtcaacctcagacgttcgttcg

SEQ ID NO: 132427 - DNA, 25 bp, Mus musculus
actgtcaacctctagctgatatcag

SEQ ID NO: 132428 - DNA, 25 bp, Mus musculus
actgtcaacctctgacgttcgttcg

SEQ ID NO: 132429 - DNA, 25 bp, Mus musculus
actgtcaacttcatgtacctgtggg

SEQ ID NO: 132430 - DNA, 25 bp, Mus musculus
actgtcaacttcttgtacctgtggg

SEQ ID NO: 132431 - DNA, 25 bp, Mus musculus
actgtcaagcttctgctgcacaaaa

SEQ ID NO: 132432 - DNA, 25 bp, Mus musculus
actgtcaagcttgtgctgcacaaaa

SEQ ID NO: 132433 - DNA, 25 bp, Mus musculus
actgtcaagtacataaaactgagac

SEQ ID NO: 132434 - DNA, 25 bp, Mus musculus
actgtcaagtacttaaaactgagac

SEQ ID NO: 132435 - DNA, 25 bp, Mus musculus
actgtcaagttcagtgtggtaacca

SEQ ID NO: 132436 - DNA, 25 bp, Mus musculus
actgtcaagttctgtgtggtaacca

SEQ ID NO: 132437 - DNA, 25 bp, Mus musculus
actgtcacagatacttagagttgct

SEQ ID NO: 132438 - DNA, 25 bp, Mus musculus
actgtcacagattcttagagttgct

SEQ ID NO: 132439 - DNA, 25 bp, Mus musculus
actgtcacccatacgaagaactggt

SEQ ID NO: 132440 - DNA, 25 bp, Mus musculus
actgtcacccattcgaagaactggt

SEQ ID NO: 132441 - DNA, 25 bp, Mus musculus
actgtcaccctcaatgtcgcagaaa

SEQ ID NO: 132442 - DNA, 25 bp, Mus musculus
actgtcaccctctatgtcgcagaaa

SEQ ID NO: 132443 - DNA, 25 bp, Mus musculus
actgtcacctggatctttttatcca

SEQ ID NO: 132444 - DNA, 25 bp, Mus musculus
actgtcacctggttctttttatcca

SEQ ID NO: 132445 - DNA, 25 bp, Mus musculus
actgtcactgtaaggaccctcgggt

SEQ ID NO: 132446 - DNA, 25 bp, Mus musculus
actgtcactgtatggaccctcgggt

SEQ ID NO: 132447 - DNA, 25 bp, Mus musculus
actgtcacttctacatgttccttaa

SEQ ID NO: 132448 - DNA, 25 bp, Mus musculus
actgtcacttcttcatgttccttaa

SEQ ID NO: 132449 - DNA, 25 bp, Mus musculus
actgtcagagacattggtcccttta

SEQ ID NO: 132450 - DNA, 25 bp, Mus musculus
actgtcagagactttggtcccttta

SEQ ID NO: 132451 - DNA, 25 bp, Mus musculus
actgtcagatggaccgttacttctt

SEQ ID NO: 132452 - DNA, 25 bp, Mus musculus
actgtcagatggtccgttacttctt

SEQ ID NO: 132453 - DNA, 25 bp, Mus musculus
actgtcagcactcttctgaggctgc

SEQ ID NO: 132454 - DNA, 25 bp, Mus musculus
actgtcagcactgttctgaggctgc

SEQ ID NO: 132455 - DNA, 25 bp, Mus musculus
actgtcagcatgagtgtccagtcca

SEQ ID NO: 132456 - DNA, 25 bp, Mus musculus
actgtcagcatgtgtgtccagtcca

SEQ ID NO: 132457 - DNA, 25 bp, Mus musculus
actgtcagctctacagaatcttctg

SEQ ID NO: 132458 - DNA, 25 bp, Mus musculus
actgtcagctcttcagaatcttctg

SEQ ID NO: 132459 - DNA, 25 bp, Mus musculus
actgtcaggcggctttcctatctca

SEQ ID NO: 132460 - DNA, 25 bp, Mus musculus
actgtcaggcgggtttcctatctca

SEQ ID NO: 132461 - DNA, 25 bp, Mus musculus
actgtcaggcttcttcttaattcac

SEQ ID NO: 132462 - DNA, 25 bp, Mus musculus
actgtcaggcttgttcttaattcac

SEQ ID NO: 132463 - DNA, 25 bp, Mus musculus
actgtcagtaggcaacggaatgaaa

SEQ ID NO: 132464 - DNA, 25 bp, Mus musculus
actgtcagtagggaacggaatgaaa

SEQ ID NO: 132465 - DNA, 25 bp, Mus musculus
actgtcagtgaaagcagggccttga

SEQ ID NO: 132466 - DNA, 25 bp, Mus musculus
actgtcagtgaatgcagggccttga

SEQ ID NO: 132467 - DNA, 25 bp, Mus musculus
actgtcagttgaacctggaggtgcc

SEQ ID NO: 132468 - DNA, 25 bp, Mus musculus
actgtcagttgatcctggaggtgcc

SEQ ID NO: 132469 - DNA, 25 bp, Mus musculus
actgtcagttttcttaagcttaatt

SEQ ID NO: 132470 - DNA, 25 bp, Mus musculus
actgtcagttttgttaagcttaatt

SEQ ID NO: 132471 - DNA, 25 bp, Mus musculus
actgtcataaaaaccaacgtgcctt

SEQ ID NO: 132472 - DNA, 25 bp, Mus musculus
actgtcataaaatccaacgtgcctt

SEQ ID NO: 132473 - DNA, 25 bp, Mus musculus
actgtcataatacttcatctcgggt

SEQ ID NO: 132474 - DNA, 25 bp, Mus musculus
actgtcataatagttcatctcgggt

SEQ ID NO: 132475 - DNA, 25 bp, Mus musculus
actgtcatacgtatgggacctacac

SEQ ID NO: 132476 - DNA, 25 bp, Mus musculus
actgtcatacgtttgggacctacac

SEQ ID NO: 132477 - DNA, 25 bp, Mus musculus
actgtcatcttcacactgaattttt

SEQ ID NO: 132478 - DNA, 25 bp, Mus musculus
actgtcatcttctcactgaattttt

SEQ ID NO: 132479 - DNA, 25 bp, Mus musculus
actgtcatgcttctccggcaaacaa

SEQ ID NO: 132480 - DNA, 25 bp, Mus musculus
actgtcatgcttgtccggcaaacaa

SEQ ID NO: 132481 - DNA, 25 bp, Mus musculus
actgtcatgtgcctttgcctttcct

SEQ ID NO: 132482 - DNA, 25 bp, Mus musculus
actgtcatgtgcgtttgcctttcct

SEQ ID NO: 132483 - DNA, 25 bp, Mus musculus
actgtcattatcatttgccttttta

SEQ ID NO: 132484 - DNA, 25 bp, Mus musculus
actgtcattatcttttgccttttta

SEQ ID NO: 132485 - DNA, 25 bp, Mus musculus
actgtcattgtgctgaagaatgggc

SEQ ID NO: 132486 - DNA, 25 bp, Mus musculus
actgtcattgtggtgaagaatgggc

SEQ ID NO: 132487 - DNA, 25 bp, Mus musculus
actgtcatttagcactgggtttgtc

SEQ ID NO: 132488 - DNA, 25 bp, Mus musculus
actgtcatttaggactgggtttgtc

SEQ ID NO: 132489 - DNA, 25 bp, Mus musculus
actgtcatttcaacactatctctta

SEQ ID NO: 132490 - DNA, 25 bp, Mus musculus
actgtcatttcatcactatctctta

SEQ ID NO: 132491 - DNA, 25 bp, Mus musculus
actgtcatttccaccactttttgtt

SEQ ID NO: 132492 - DNA, 25 bp, Mus musculus
actgtcatttcctccactttttgtt

SEQ ID NO: 132493 - DNA, 25 bp, Mus musculus
actgtcattttcaacctttaatcag

SEQ ID NO: 132494 - DNA, 25 bp, Mus musculus
actgtcattttctacctttaatcag

SEQ ID NO: 132495 - DNA, 25 bp, Mus musculus
actgtccaatccagtgtaatgttta

SEQ ID NO: 132496 - DNA, 25 bp, Mus musculus
actgtccaatcctgtgtaatgttta

SEQ ID NO: 132497 - DNA, 25 bp, Mus musculus
actgtccaccatccaagttgcaagg

SEQ ID NO: 132498 - DNA, 25 bp, Mus musculus
actgtccaccatgcaagttgcaagg

SEQ ID NO: 132499 - DNA, 25 bp, Mus musculus
actgtccaccctagccaggtatgga

SEQ ID NO: 132500 - DNA, 25 bp, Mus musculus
actgtccacccttgccaggtatgga

SEQ ID NO: 132501 - DNA, 25 bp, Mus musculus
actgtccagaaaagtcctataatta

SEQ ID NO: 132502 - DNA, 25 bp, Mus musculus
actgtccagaaatgtcctataatta

SEQ ID NO: 132503 - DNA, 25 bp, Mus musculus
actgtccagccgaatgtgtttctta

SEQ ID NO: 132504 - DNA, 25 bp, Mus musculus
actgtccagccgtatgtgtttctta

SEQ ID NO: 132505 - DNA, 25 bp, Mus musculus
actgtccaggcacctagtggtctct

SEQ ID NO: 132506 - DNA, 25 bp, Mus musculus
actgtccaggcagctagtggtctct

SEQ ID NO: 132507 - DNA, 25 bp, Mus musculus
actgtcccaactataagtgccatct

SEQ ID NO: 132508 - DNA, 25 bp, Mus musculus
actgtcccaactttaagtgccatct

SEQ ID NO: 132509 - DNA, 25 bp, Mus musculus
actgtcccaatccagtagcatttgg

SEQ ID NO: 132510 - DNA, 25 bp, Mus musculus
actgtcccaatcgagtagcatttgg

SEQ ID NO: 132511 - DNA, 25 bp, Mus musculus
actgtcccaatgacctaatcccttt

SEQ ID NO: 132512 - DNA, 25 bp, Mus musculus
actgtcccaatgtcctaatcccttt

SEQ ID NO: 132513 - DNA, 25 bp, Mus musculus
actgtcccagatccgctcgcaaggt

SEQ ID NO: 132514 - DNA, 25 bp, Mus musculus
actgtcccagatctcaagatccact

SEQ ID NO: 132515 - DNA, 25 bp, Mus musculus
actgtcccagatgcgctcgcaaggt

SEQ ID NO: 132516 - DNA, 25 bp, Mus musculus
actgtcccagatgtcaagatccact

SEQ ID NO: 132517 - DNA, 25 bp, Mus musculus
actgtccccacacattttggattca

SEQ ID NO: 132518 - DNA, 25 bp, Mus musculus
actgtccccacagattttggattca

SEQ ID NO: 132519 - DNA, 25 bp, Mus musculus
actgtccccatacggtttagtgcaa

SEQ ID NO: 132520 - DNA, 25 bp, Mus musculus
actgtccccatagggtttagtgcaa

SEQ ID NO: 132521 - DNA, 25 bp, Mus musculus
actgtccccatgattccaaaggata

SEQ ID NO: 132522 - DNA, 25 bp, Mus musculus
actgtccccatgtttccaaaggata

SEQ ID NO: 132523 - DNA, 25 bp, Mus musculus
actgtcccctacattgcagaaggct

SEQ ID NO: 132524 - DNA, 25 bp, Mus musculus
actgtcccctactttgcagaaggct

SEQ ID NO: 132525 - DNA, 25 bp, Mus musculus
actgtcccctcgcagtgtcaggcgg

SEQ ID NO: 132526 - DNA, 25 bp, Mus musculus
actgtcccctcggagtgtcaggcgg

SEQ ID NO: 132527 - DNA, 25 bp, Mus musculus
actgtcccctggagacatgtttgaa

SEQ ID NO: 132528 - DNA, 25 bp, Mus musculus
actgtcccctggtgacatgtttgaa

SEQ ID NO: 132529 - DNA, 25 bp, Mus musculus
actgtcccgcaaacacagggcaaga

SEQ ID NO: 132530 - DNA, 25 bp, Mus musculus
actgtcccgcaatcacagggcaaga

SEQ ID NO: 132531 - DNA, 25 bp, Mus musculus
actgtccctccaactgttgttggtc

SEQ ID NO: 132532 - DNA, 25 bp, Mus musculus
actgtccctccatctgttgttggtc

SEQ ID NO: 132533 - DNA, 25 bp, Mus musculus
actgtccctctaacccaggaatatg

SEQ ID NO: 132534 - DNA, 25 bp, Mus musculus
actgtccctctatcccaggaatatg

SEQ ID NO: 132535 - DNA, 25 bp, Mus musculus
actgtccctgtcaactttgtgtagg

SEQ ID NO: 132536 - DNA, 25 bp, Mus musculus
actgtccctgtctactttgtgtagg

SEQ ID NO: 132537 - DNA, 25 bp, Mus musculus
actgtcccttgcaattctattcttg

SEQ ID NO: 132538 - DNA, 25 bp, Mus musculus
actgtcccttgctattctattcttg

SEQ ID NO: 132539 - DNA, 25 bp, Mus musculus
actgtccctttaatatgtatgtttg

SEQ ID NO: 132540 - DNA, 25 bp, Mus musculus
actgtccctttattatgtatgtttg

SEQ ID NO: 132541 - DNA, 25 bp, Mus musculus
actgtcccttttaagtttgctgcct

SEQ ID NO: 132542 - DNA, 25 bp, Mus musculus
actgtccctttttagtttgctgcct

SEQ ID NO: 132543 - DNA, 25 bp, Mus musculus
actgtccgcgttagggatatttctg

SEQ ID NO: 132544 - DNA, 25 bp, Mus musculus
actgtccgcgtttgggatatttctg

SEQ ID NO: 132545 - DNA, 25 bp, Mus musculus
actgtccgctgcattcaaatcaagt

SEQ ID NO: 132546 - DNA, 25 bp, Mus musculus
actgtccgctgctttcaaatcaagt

SEQ ID NO: 132547 - DNA, 25 bp, Mus musculus
actgtccgggacaccggttacatag

SEQ ID NO: 132548 - DNA, 25 bp, Mus musculus
actgtccgggactccggttacatag

SEQ ID NO: 132549 - DNA, 25 bp, Mus musculus
actgtccgggctagacactgaattg

SEQ ID NO: 132550 - DNA, 25 bp, Mus musculus
actgtccgggcttgacactgaattg

SEQ ID NO: 132551 - DNA, 25 bp, Mus musculus
actgtcctaaataaccttcgtctga

SEQ ID NO: 132552 - DNA, 25 bp, Mus musculus
actgtcctaaattaccttcgtctga

SEQ ID NO: 132553 - DNA, 25 bp, Mus musculus
actgtcctaagccaaacgtttatat

SEQ ID NO: 132554 - DNA, 25 bp, Mus musculus
actgtcctaagcgaaacgtttatat

SEQ ID NO: 132555 - DNA, 25 bp, Mus musculus
actgtcctacaacacgttcttaatt

SEQ ID NO: 132556 - DNA, 25 bp, Mus musculus
actgtcctacaagacgttcttaatt

SEQ ID NO: 132557 - DNA, 25 bp, Mus musculus
actgtcctactgatatttcttgctg

SEQ ID NO: 132558 - DNA, 25 bp, Mus musculus
actgtcctactgttatttcttgctg

SEQ ID NO: 132559 - DNA, 25 bp, Mus musculus
actgtcctagagctgtaaccttact

SEQ ID NO: 132560 - DNA, 25 bp, Mus musculus
actgtcctagaggtgtaaccttact

SEQ ID NO: 132561 - DNA, 25 bp, Mus musculus
actgtcctatttactcttgagatcc

SEQ ID NO: 132562 - DNA, 25 bp, Mus musculus
actgtcctatttctcaactgataag

SEQ ID NO: 132563 - DNA, 25 bp, Mus musculus
actgtcctatttgtcaactgataag

SEQ ID NO: 132564 - DNA, 25 bp, Mus musculus
actgtcctattttctcttgagatcc

SEQ ID NO: 132565 - DNA, 25 bp, Mus musculus
actgtcctcaggagccaggcatcct

SEQ ID NO: 132566 - DNA, 25 bp, Mus musculus
actgtcctcaggtgccaggcatcct

SEQ ID NO: 132567 - DNA, 25 bp, Mus musculus
actgtcctccaaatttgcaatgttc

SEQ ID NO: 132568 - DNA, 25 bp, Mus musculus
actgtcctccaattttgcaatgttc

SEQ ID NO: 132569 - DNA, 25 bp, Mus musculus
actgtcctctcgacctatcttgaca

SEQ ID NO: 132570 - DNA, 25 bp, Mus musculus
actgtcctctcgtcctatcttgaca

SEQ ID NO: 132571 - DNA, 25 bp, Mus musculus
actgtcctctgaatctactgatgtc

SEQ ID NO: 132572 - DNA, 25 bp, Mus musculus
actgtcctctgattctactgatgtc

SEQ ID NO: 132573 - DNA, 25 bp, Mus musculus
actgtcctctgcagaaggccaggga

SEQ ID NO: 132574 - DNA, 25 bp, Mus musculus
actgtcctctgcctgtcgacactga

SEQ ID NO: 132575 - DNA, 25 bp, Mus musculus
actgtcctctgcgtgtcgacactga

SEQ ID NO: 132576 - DNA, 25 bp, Mus musculus
actgtcctctgctgaaggccaggga

SEQ ID NO: 132577 - DNA, 25 bp, Mus musculus
actgtcctcttaaagcgccgggcgg

SEQ ID NO: 132578 - DNA, 25 bp, Mus musculus
actgtcctcttatagcgccgggcgg

SEQ ID NO: 132579 - DNA, 25 bp, Mus musculus
actgtcctgactactggcagcgtgt

SEQ ID NO: 132580 - DNA, 25 bp, Mus musculus
actgtcctgacttctggcagcgtgt

SEQ ID NO: 132581 - DNA, 25 bp, Mus musculus
actgtcctggaaatggcgggtcatg

SEQ ID NO: 132582 - DNA, 25 bp, Mus musculus
actgtcctggaattggcgggtcatg

SEQ ID NO: 132583 - DNA, 25 bp, Mus musculus
actgtcctggatatactctgtgtac

SEQ ID NO: 132584 - DNA, 25 bp, Mus musculus
actgtcctggatttactctgtgtac

SEQ ID NO: 132585 - DNA, 25 bp, Mus musculus
actgtcctggtgatttctgatgtaa

SEQ ID NO: 132586 - DNA, 25 bp, Mus musculus
actgtcctggtgttttctgatgtaa

SEQ ID NO: 132587 - DNA, 25 bp, Mus musculus
actgtcctgtcaataactgtgcctg

SEQ ID NO: 132588 - DNA, 25 bp, Mus musculus
actgtcctgtcattaactgtgcctg

SEQ ID NO: 132589 - DNA, 25 bp, Mus musculus
actgtcctgtgtatgactacgtgcc

SEQ ID NO: 132590 - DNA, 25 bp, Mus musculus
actgtcctgtgtttgactacgtgcc

SEQ ID NO: 132591 - DNA, 25 bp, Mus musculus
actgtccttcatagggtctggtgta

SEQ ID NO: 132592 - DNA, 25 bp, Mus musculus
actgtccttcattgggtctggtgta

SEQ ID NO: 132593 - DNA, 25 bp, Mus musculus
actgtccttcctatctgcaagtcag

SEQ ID NO: 132594 - DNA, 25 bp, Mus musculus
actgtccttcctttctgcaagtcag

SEQ ID NO: 132595 - DNA, 25 bp, Mus musculus
actgtcctttcaatctgttgttctg

SEQ ID NO: 132596 - DNA, 25 bp, Mus musculus
actgtcctttcattctgttgttctg

SEQ ID NO: 132597 - DNA, 25 bp, Mus musculus
actgtcgaatctcctgcctgtcata

SEQ ID NO: 132598 - DNA, 25 bp, Mus musculus
actgtcgaatctgctgcctgtcata

SEQ ID NO: 132599 - DNA, 25 bp, Mus musculus
actgtcgacaggaggcggaattttc

SEQ ID NO: 132600 - DNA, 25 bp, Mus musculus
actgtcgacaggtggcggaattttc

SEQ ID NO: 132601 - DNA, 25 bp, Mus musculus
actgtcgacctcagaaatcattata

SEQ ID NO: 132602 - DNA, 25 bp, Mus musculus
actgtcgacctctgaaatcattata

SEQ ID NO: 132603 - DNA, 25 bp, Mus musculus
actgtcgatatcagtgtgagcactg

SEQ ID NO: 132604 - DNA, 25 bp, Mus musculus
actgtcgatatctgtgtgagcactg

SEQ ID NO: 132605 - DNA, 25 bp, Mus musculus
actgtcgcccaactgttttgtatat

SEQ ID NO: 132606 - DNA, 25 bp, Mus musculus
actgtcgcccaagtgttttgtatat

SEQ ID NO: 132607 - DNA, 25 bp, Mus musculus
actgtcgcccctaaaagtagtcatt

SEQ ID NO: 132608 - DNA, 25 bp, Mus musculus
actgtcgcccctacaagggatctag

SEQ ID NO: 132609 - DNA, 25 bp, Mus musculus
actgtcgccccttaaagtagtcatt

SEQ ID NO: 132610 - DNA, 25 bp, Mus musculus
actgtcgccccttcaagggatctag

SEQ ID NO: 132611 - DNA, 25 bp, Mus musculus
actgtcgctcatcgctggcatggag

SEQ ID NO: 132612 - DNA, 25 bp, Mus musculus
actgtcgctcatggctggcatggag

SEQ ID NO: 132613 - DNA, 25 bp, Mus musculus
actgtcggatgtatatgcattttgc

SEQ ID NO: 132614 - DNA, 25 bp, Mus musculus
actgtcggatgtttatgcattttgc

SEQ ID NO: 132615 - DNA, 25 bp, Mus musculus
actgtcggtagtaatttgtcactta

SEQ ID NO: 132616 - DNA, 25 bp, Mus musculus
actgtcggtagttatttgtcactta

SEQ ID NO: 132617 - DNA, 25 bp, Mus musculus
actgtcggtggcatccctgcatatt

SEQ ID NO: 132618 - DNA, 25 bp, Mus musculus
actgtcggtggcatctcatacagca

SEQ ID NO: 132619 - DNA, 25 bp, Mus musculus
actgtcggtggcttccctgcatatt

SEQ ID NO: 132620 - DNA, 25 bp, Mus musculus
actgtcggtggcttctcatacagca

SEQ ID NO: 132621 - DNA, 25 bp, Mus musculus
actgtcgtgtctcagtgtgttcact

SEQ ID NO: 132622 - DNA, 25 bp, Mus musculus
actgtcgtgtctgagtgtgttcact

SEQ ID NO: 132623 - DNA, 25 bp, Mus musculus
actgtcgttctcagtcgaatctatt

SEQ ID NO: 132624 - DNA, 25 bp, Mus musculus
actgtcgttctctgtcgaatctatt

SEQ ID NO: 132625 - DNA, 25 bp, Mus musculus
actgtcgttgctctcgttgttgctg

SEQ ID NO: 132626 - DNA, 25 bp, Mus musculus
actgtcgttgctgtcgttgttgctg

SEQ ID NO: 132627 - DNA, 25 bp, Mus musculus
actgtcgtttccactggtgctgtta

SEQ ID NO: 132628 - DNA, 25 bp, Mus musculus
actgtcgtttcctctggtgctgtta

SEQ ID NO: 132629 - DNA, 25 bp, Mus musculus
actgtctaaaggattcttatcatag

SEQ ID NO: 132630 - DNA, 25 bp, Mus musculus
actgtctaaaggtttcttatcatag

SEQ ID NO: 132631 - DNA, 25 bp, Mus musculus
actgtctaccagctctgactagtga

SEQ ID NO: 132632 - DNA, 25 bp, Mus musculus
actgtctaccaggtctgactagtga

SEQ ID NO: 132633 - DNA, 25 bp, Mus musculus
actgtctactgaccgacctggataa

SEQ ID NO: 132634 - DNA, 25 bp, Mus musculus
actgtctactgagcgacctggataa

SEQ ID NO: 132635 - DNA, 25 bp, Mus musculus
actgtctaggctctctggtggaatc

SEQ ID NO: 132636 - DNA, 25 bp, Mus musculus
actgtctaggctgtctggtggaatc

SEQ ID NO: 132637 - DNA, 25 bp, Mus musculus
actgtctagggcaacgtggtatcct

SEQ ID NO: 132638 - DNA, 25 bp, Mus musculus
actgtctagggctacgtggtatcct

SEQ ID NO: 132639 - DNA, 25 bp, Mus musculus
actgtctatagcaccagttccaaaa

SEQ ID NO: 132640 - DNA, 25 bp, Mus musculus
actgtctatagctccagttccaaaa

SEQ ID NO: 132641 - DNA, 25 bp, Mus musculus
actgtctattttcttgtgtgcctta

SEQ ID NO: 132642 - DNA, 25 bp, Mus musculus
actgtctattttgttgtgtgcctta

SEQ ID NO: 132643 - DNA, 25 bp, Mus musculus
actgtctcaaacataagagtttcaa

SEQ ID NO: 132644 - DNA, 25 bp, Mus musculus
actgtctcaaacttaagagtttcaa

SEQ ID NO: 132645 - DNA, 25 bp, Mus musculus
actgtctcaaagaatcatgctcatg

SEQ ID NO: 132646 - DNA, 25 bp, Mus musculus
actgtctcaaagtatcatgctcatg

SEQ ID NO: 132647 - DNA, 25 bp, Mus musculus
actgtctcacagatagatttaattt

SEQ ID NO: 132648 - DNA, 25 bp, Mus musculus
actgtctcacagttagatttaattt

SEQ ID NO: 132649 - DNA, 25 bp, Mus musculus
actgtctcaggcctcaagccaggca

SEQ ID NO: 132650 - DNA, 25 bp, Mus musculus
actgtctcaggcgtcaagccaggca

SEQ ID NO: 132651 - DNA, 25 bp, Mus musculus
actgtctcagtcactaaaacatcaa

SEQ ID NO: 132652 - DNA, 25 bp, Mus musculus
actgtctcagtctctaaaacatcaa

SEQ ID NO: 132653 - DNA, 25 bp, Mus musculus
actgtctcatgtagtgcttcttaaa

SEQ ID NO: 132654 - DNA, 25 bp, Mus musculus
actgtctcatgttgtgcttcttaaa

SEQ ID NO: 132655 - DNA, 25 bp, Mus musculus
actgtctccaacacggtaactcatt

SEQ ID NO: 132656 - DNA, 25 bp, Mus musculus
actgtctccaactcggtaactcatt

SEQ ID NO: 132657 - DNA, 25 bp, Mus musculus
actgtctccacaaaggtgcatggtg

SEQ ID NO: 132658 - DNA, 25 bp, Mus musculus
actgtctccacataggtgcatggtg

SEQ ID NO: 132659 - DNA, 25 bp, Mus musculus
actgtctcccggacagtttgcaggg

SEQ ID NO: 132660 - DNA, 25 bp, Mus musculus
actgtctcccggtcagtttgcaggg

SEQ ID NO: 132661 - DNA, 25 bp, Mus musculus
actgtctcctatatgccattttatg

SEQ ID NO: 132662 - DNA, 25 bp, Mus musculus
actgtctcctatttgccattttatg

SEQ ID NO: 132663 - DNA, 25 bp, Mus musculus
actgtctcctgtaactgttggttca

SEQ ID NO: 132664 - DNA, 25 bp, Mus musculus
actgtctcctgttactgttggttca

SEQ ID NO: 132665 - DNA, 25 bp, Mus musculus
actgtctccttacgtgtcaaaccaa

SEQ ID NO: 132666 - DNA, 25 bp, Mus musculus
actgtctccttaggtgtcaaaccaa

SEQ ID NO: 132667 - DNA, 25 bp, Mus musculus
actgtctctgaaaggagtccggttt

SEQ ID NO: 132668 - DNA, 25 bp, Mus musculus
actgtctctgaatggagtccggttt

SEQ ID NO: 132669 - DNA, 25 bp, Mus musculus
actgtctctgcacagtctgcgagaa

SEQ ID NO: 132670 - DNA, 25 bp, Mus musculus
actgtctctgcagagtctgcgagaa

SEQ ID NO: 132671 - DNA, 25 bp, Mus musculus
actgtctctgtaagggtggttctga

SEQ ID NO: 132672 - DNA, 25 bp, Mus musculus
actgtctctgtatgggtggttctga

SEQ ID NO: 132673 - DNA, 25 bp, Mus musculus
actgtctcttgaatctataacaatt

SEQ ID NO: 132674 - DNA, 25 bp, Mus musculus
actgtctcttgattctataacaatt

SEQ ID NO: 132675 - DNA, 25 bp, Mus musculus
actgtctgcagactagggcaaagag

SEQ ID NO: 132676 - DNA, 25 bp, Mus musculus
actgtctgcagagtagggcaaagag

SEQ ID NO: 132677 - DNA, 25 bp, Mus musculus
actgtctgcccaactagatgtcaag

SEQ ID NO: 132678 - DNA, 25 bp, Mus musculus
actgtctgcccatctagatgtcaag

SEQ ID NO: 132679 - DNA, 25 bp, Mus musculus
actgtctggaatagtatttgatgaa

SEQ ID NO: 132680 - DNA, 25 bp, Mus musculus
actgtctggaattgtatttgatgaa

SEQ ID NO: 132681 - DNA, 25 bp, Mus musculus
actgtctggcacaagatttccttta

SEQ ID NO: 132682 - DNA, 25 bp, Mus musculus
actgtctggcactagatttccttta

SEQ ID NO: 132683 - DNA, 25 bp, Mus musculus
actgtctggcataaataagtactca

SEQ ID NO: 132684 - DNA, 25 bp, Mus musculus
actgtctggcattaataagtactca

SEQ ID NO: 132685 - DNA, 25 bp, Mus musculus
actgtctggccaagcagttctacca

SEQ ID NO: 132686 - DNA, 25 bp, Mus musculus
actgtctggccatgcagttctacca

SEQ ID NO: 132687 - DNA, 25 bp, Mus musculus
actgtctgggtcagtttatcatctt

SEQ ID NO: 132688 - DNA, 25 bp, Mus musculus
actgtctgggtctgtttatcatctt

SEQ ID NO: 132689 - DNA, 25 bp, Mus musculus
actgtctggtcgctttgtctttttt

SEQ ID NO: 132690 - DNA, 25 bp, Mus musculus
actgtctggtcggtttgtctttttt

SEQ ID NO: 132691 - DNA, 25 bp, Mus musculus
actgtctggttgactccatctgatc

SEQ ID NO: 132692 - DNA, 25 bp, Mus musculus
actgtctggttgtctccatctgatc

SEQ ID NO: 132693 - DNA, 25 bp, Mus musculus
actgtctgtcttcaatcatgtctgc

SEQ ID NO: 132694 - DNA, 25 bp, Mus musculus
actgtctgtcttgaatcatgtctgc

SEQ ID NO: 132695 - DNA, 25 bp, Mus musculus
actgtctgtgcccacgaggaacttc

SEQ ID NO: 132696 - DNA, 25 bp, Mus musculus
actgtctgtgccgacgaggaacttc

SEQ ID NO: 132697 - DNA, 25 bp, Mus musculus
actgtctgtgtacttgtgctttaaa

SEQ ID NO: 132698 - DNA, 25 bp, Mus musculus
actgtctgtgtagttgtgctttaaa

SEQ ID NO: 132699 - DNA, 25 bp, Mus musculus
actgtctgttctctaggcccagcat

SEQ ID NO: 132700 - DNA, 25 bp, Mus musculus
actgtctgttctgtaggcccagcat

SEQ ID NO: 132701 - DNA, 25 bp, Mus musculus
actgtcttagcacgttgtcagctcc

SEQ ID NO: 132702 - DNA, 25 bp, Mus musculus
actgtcttagcaggttgtcagctcc

SEQ ID NO: 132703 - DNA, 25 bp, Mus musculus
actgtcttatttcgaagaatcatgc

SEQ ID NO: 132704 - DNA, 25 bp, Mus musculus
actgtcttatttggaagaatcatgc

SEQ ID NO: 132705 - DNA, 25 bp, Mus musculus
actgtcttcattcggcacttcctca

SEQ ID NO: 132706 - DNA, 25 bp, Mus musculus
actgtcttcattgggcacttcctca

SEQ ID NO: 132707 - DNA, 25 bp, Mus musculus
actgtcttccagaatccagtgggct

SEQ ID NO: 132708 - DNA, 25 bp, Mus musculus
actgtcttccagtatccagtgggct

SEQ ID NO: 132709 - DNA, 25 bp, Mus musculus
actgtcttcccgctgagtgtatcac

SEQ ID NO: 132710 - DNA, 25 bp, Mus musculus
actgtcttcccggtgagtgtatcac

SEQ ID NO: 132711 - DNA, 25 bp, Mus musculus
actgtcttccctaactagaatccaa

SEQ ID NO: 132712 - DNA, 25 bp, Mus musculus
actgtcttcccttactagaatccaa

SEQ ID NO: 132713 - DNA, 25 bp, Mus musculus
actgtcttcctgctcatacctgaag

SEQ ID NO: 132714 - DNA, 25 bp, Mus musculus
actgtcttcctggtcatacctgaag

SEQ ID NO: 132715 - DNA, 25 bp, Mus musculus
actgtcttgactatcctcttacatt

SEQ ID NO: 132716 - DNA, 25 bp, Mus musculus
actgtcttgactttcctcttacatt

SEQ ID NO: 132717 - DNA, 25 bp, Mus musculus
actgtcttgagtctggatctcctac

SEQ ID NO: 132718 - DNA, 25 bp, Mus musculus
actgtcttgagtgtggatctcctac

SEQ ID NO: 132719 - DNA, 25 bp, Mus musculus
actgtctttaatctcgtgttaactg

SEQ ID NO: 132720 - DNA, 25 bp, Mus musculus
actgtctttaatgtcgtgttaactg

SEQ ID NO: 132721 - DNA, 25 bp, Mus musculus
actgtctttaccctgcactgcagaa

SEQ ID NO: 132722 - DNA, 25 bp, Mus musculus
actgtctttaccgtgcactgcagaa

SEQ ID NO: 132723 - DNA, 25 bp, Mus musculus
actgtctttcagagtccaaggagca

SEQ ID NO: 132724 - DNA, 25 bp, Mus musculus
actgtctttcagtgtccaaggagca

SEQ ID NO: 132725 - DNA, 25 bp, Mus musculus
actgtctttcctcgtacaacaataa

SEQ ID NO: 132726 - DNA, 25 bp, Mus musculus
actgtctttcctggtacaacaataa

SEQ ID NO: 132727 - DNA, 25 bp, Mus musculus
actgtctttctaccttgtctggaaa

SEQ ID NO: 132728 - DNA, 25 bp, Mus musculus
actgtctttctagcttgtctggaaa

SEQ ID NO: 132729 - DNA, 25 bp, Mus musculus
actgtctttcttcacatgtgaaaag

SEQ ID NO: 132730 - DNA, 25 bp, Mus musculus
actgtctttcttgacatgtgaaaag

SEQ ID NO: 132731 - DNA, 25 bp, Mus musculus
actgtctttgtaaaacctgctccac

SEQ ID NO: 132732 - DNA, 25 bp, Mus musculus
actgtctttgtataacctgctccac

SEQ ID NO: 132733 - DNA, 25 bp, Mus musculus
actgtctttgtccttatggaacatt

SEQ ID NO: 132734 - DNA, 25 bp, Mus musculus
actgtctttgtcgttatggaacatt

SEQ ID NO: 132735 - DNA, 25 bp, Mus musculus
actgtgaaaacgatcctgtggccat

SEQ ID NO: 132736 - DNA, 25 bp, Mus musculus
actgtgaaaacgttcctgtggccat

SEQ ID NO: 132737 - DNA, 25 bp, Mus musculus
actgtgaaacccaggctaatctgga

SEQ ID NO: 132738 - DNA, 25 bp, Mus musculus
actgtgaaaccctggctaatctgga

SEQ ID NO: 132739 - DNA, 25 bp, Mus musculus
actgtgaaagcgcaggttcctccca

SEQ ID NO: 132740 - DNA, 25 bp, Mus musculus
actgtgaaagcggaggttcctccca

SEQ ID NO: 132741 - DNA, 25 bp, Mus musculus
actgtgaaagtccttctgctgtccc

SEQ ID NO: 132742 - DNA, 25 bp, Mus musculus
actgtgaaagtcgttctgctgtccc

SEQ ID NO: 132743 - DNA, 25 bp, Mus musculus
actgtgaaccacataagactcgatc

SEQ ID NO: 132744 - DNA, 25 bp, Mus musculus
actgtgaaccacttaagactcgatc

SEQ ID NO: 132745 - DNA, 25 bp, Mus musculus
actgtgaacctgagagatttgtgaa

SEQ ID NO: 132746 - DNA, 25 bp, Mus musculus
actgtgaacctgtgagatttgtgaa

SEQ ID NO: 132747 - DNA, 25 bp, Mus musculus
actgtgaacgaaacctgccgccagc

SEQ ID NO: 132748 - DNA, 25 bp, Mus musculus
actgtgaacgaatcctgccgccagc

SEQ ID NO: 132749 - DNA, 25 bp, Mus musculus
actgtgaacttgctataatcctgcc

SEQ ID NO: 132750 - DNA, 25 bp, Mus musculus
actgtgaacttggtataatcctgcc

SEQ ID NO: 132751 - DNA, 25 bp, Mus musculus
actgtgaactttcgcctagcctgtg

SEQ ID NO: 132752 - DNA, 25 bp, Mus musculus
actgtgaactttggcctagcctgtg

SEQ ID NO: 132753 - DNA, 25 bp, Mus musculus
actgtgaagagcaaaggtcggcctg

SEQ ID NO: 132754 - DNA, 25 bp, Mus musculus
actgtgaagagctaaggtcggcctg

SEQ ID NO: 132755 - DNA, 25 bp, Mus musculus
actgtgaagggcaccgctgcgagaa

SEQ ID NO: 132756 - DNA, 25 bp, Mus musculus
actgtgaagggctccgctgcgagaa

SEQ ID NO: 132757 - DNA, 25 bp, Mus musculus
actgtgaatctgaatataaggccca

SEQ ID NO: 132758 - DNA, 25 bp, Mus musculus
actgtgaatctgtatataaggccca

SEQ ID NO: 132759 - DNA, 25 bp, Mus musculus
actgtgaatggcagagcctgcttct

SEQ ID NO: 132760 - DNA, 25 bp, Mus musculus
actgtgaatggctgagcctgcttct

SEQ ID NO: 132761 - DNA, 25 bp, Mus musculus
actgtgaatttgctggtggtcttcc

SEQ ID NO: 132762 - DNA, 25 bp, Mus musculus
actgtgaatttggtggtggtcttcc

SEQ ID NO: 132763 - DNA, 25 bp, Mus musculus
actgtgaattttacggattcggaag

SEQ ID NO: 132764 - DNA, 25 bp, Mus musculus
actgtgaatttttcggattcggaag

SEQ ID NO: 132765 - DNA, 25 bp, Mus musculus
actgtgacacagatcccaattcttt

SEQ ID NO: 132766 - DNA, 25 bp, Mus musculus
actgtgacacagttcccaattcttt

SEQ ID NO: 132767 - DNA, 25 bp, Mus musculus
actgtgacagacattccagtcctgt

SEQ ID NO: 132768 - DNA, 25 bp, Mus musculus
actgtgacagaccttacgccaatgg

SEQ ID NO: 132769 - DNA, 25 bp, Mus musculus
actgtgacagacgttacgccaatgg

SEQ ID NO: 132770 - DNA, 25 bp, Mus musculus
actgtgacagactttccagtcctgt

SEQ ID NO: 132771 - DNA, 25 bp, Mus musculus
actgtgacagcaacctccgggagat

SEQ ID NO: 132772 - DNA, 25 bp, Mus musculus
actgtgacagcatcctccgggagat

SEQ ID NO: 132773 - DNA, 25 bp, Mus musculus
actgtgacaggcctacgtgggcttt

SEQ ID NO: 132774 - DNA, 25 bp, Mus musculus
actgtgacaggcgtacgtgggcttt

SEQ ID NO: 132775 - DNA, 25 bp, Mus musculus
actgtgacatgcatggatccgcctt

SEQ ID NO: 132776 - DNA, 25 bp, Mus musculus
actgtgacatgcttggatccgcctt

SEQ ID NO: 132777 - DNA, 25 bp, Mus musculus
actgtgacatggaactgatgagtgt

SEQ ID NO: 132778 - DNA, 25 bp, Mus musculus
actgtgacatggtactgatgagtgt

SEQ ID NO: 132779 - DNA, 25 bp, Mus musculus
actgtgaccaggctatgggatcctt

SEQ ID NO: 132780 - DNA, 25 bp, Mus musculus
actgtgaccagggtatgggatcctt

SEQ ID NO: 132781 - DNA, 25 bp, Mus musculus
actgtgaccagtcacgacaacgaca

SEQ ID NO: 132782 - DNA, 25 bp, Mus musculus
actgtgaccagtgacgacaacgaca

SEQ ID NO: 132783 - DNA, 25 bp, Mus musculus
actgtgaccatgacctgagcccctt

SEQ ID NO: 132784 - DNA, 25 bp, Mus musculus
actgtgaccatgtcctgagcccctt

SEQ ID NO: 132785 - DNA, 25 bp, Mus musculus
actgtgaccgggactgaccacctgt

SEQ ID NO: 132786 - DNA, 25 bp, Mus musculus
actgtgaccgggtctgaccacctgt

SEQ ID NO: 132787 - DNA, 25 bp, Mus musculus
actgtgacgatccatgggccgaact

SEQ ID NO: 132788 - DNA, 25 bp, Mus musculus
actgtgacgatcgatgggccgaact

SEQ ID NO: 132789 - DNA, 25 bp, Mus musculus
actgtgacggctactgcttcggtga

SEQ ID NO: 132790 - DNA, 25 bp, Mus musculus
actgtgacggcttctgcttcggtga

SEQ ID NO: 132791 - DNA, 25 bp, Mus musculus
actgtgactacaatacctcttcaac

SEQ ID NO: 132792 - DNA, 25 bp, Mus musculus
actgtgactacattacctcttcaac

SEQ ID NO: 132793 - DNA, 25 bp, Mus musculus
actgtgactcccagcggtgtgtccc

SEQ ID NO: 132794 - DNA, 25 bp, Mus musculus
actgtgactccctgcggtgtgtccc

SEQ ID NO: 132795 - DNA, 25 bp, Mus musculus
actgtgactcgtctgcagtccaaac

SEQ ID NO: 132796 - DNA, 25 bp, Mus musculus
actgtgactcgtgtgcagtccaaac

SEQ ID NO: 132797 - DNA, 25 bp, Mus musculus
actgtgacttgcagagctgtgctcc

SEQ ID NO: 132798 - DNA, 25 bp, Mus musculus
actgtgacttgctgagctgtgctcc

SEQ ID NO: 132799 - DNA, 25 bp, Mus musculus
actgtgacttgtcagttcttcgaat

SEQ ID NO: 132800 - DNA, 25 bp, Mus musculus
actgtgacttgtgagttcttcgaat

SEQ ID NO: 132801 - DNA, 25 bp, Mus musculus
actgtgagacttatgtaactttgtt

SEQ ID NO: 132802 - DNA, 25 bp, Mus musculus
actgtgagacttttgtaactttgtt

SEQ ID NO: 132803 - DNA, 25 bp, Mus musculus
actgtgagcatgagtcctgaaggaa

SEQ ID NO: 132804 - DNA, 25 bp, Mus musculus
actgtgagcatgtgtcctgaaggaa

SEQ ID NO: 132805 - DNA, 25 bp, Mus musculus
actgtgagcgctctgggaaagcttt

SEQ ID NO: 132806 - DNA, 25 bp, Mus musculus
actgtgagcgctgtgggaaagcttt

SEQ ID NO: 132807 - DNA, 25 bp, Mus musculus
actgtgagctaacctggacacttca

SEQ ID NO: 132808 - DNA, 25 bp, Mus musculus
actgtgagctaagctggacacttca

SEQ ID NO: 132809 - DNA, 25 bp, Mus musculus
actgtgagctgtcggctatggtcta

SEQ ID NO: 132810 - DNA, 25 bp, Mus musculus
actgtgagctgtgggctatggtcta

SEQ ID NO: 132811 - DNA, 25 bp, Mus musculus
actgtgaggcctccttatcctggaa

SEQ ID NO: 132812 - DNA, 25 bp, Mus musculus
actgtgaggcctgcttatcctggaa

SEQ ID NO: 132813 - DNA, 25 bp, Mus musculus
actgtgaggtgaacgtgcccgtgcc

SEQ ID NO: 132814 - DNA, 25 bp, Mus musculus
actgtgaggtgatcgtgcccgtgcc

SEQ ID NO: 132815 - DNA, 25 bp, Mus musculus
actgtgagtacaacatcagggtcag

SEQ ID NO: 132816 - DNA, 25 bp, Mus musculus
actgtgagtacatcatcagggtcag

SEQ ID NO: 132817 - DNA, 25 bp, Mus musculus
actgtgagtctactgctttcccttc

SEQ ID NO: 132818 - DNA, 25 bp, Mus musculus
actgtgagtctagtgctttcccttc

SEQ ID NO: 132819 - DNA, 25 bp, Mus musculus
actgtgagtgttcctctgttttgga

SEQ ID NO: 132820 - DNA, 25 bp, Mus musculus
actgtgagtgttgctctgttttgga

SEQ ID NO: 132821 - DNA, 25 bp, Mus musculus
actgtgagttgtctgtacactgaac

SEQ ID NO: 132822 - DNA, 25 bp, Mus musculus
actgtgagttgtgtgtacactgaac

SEQ ID NO: 132823 - DNA, 25 bp, Mus musculus
actgtgataaatcccctgagacgac

SEQ ID NO: 132824 - DNA, 25 bp, Mus musculus
actgtgataaatgccctgagacgac

SEQ ID NO: 132825 - DNA, 25 bp, Mus musculus
actgtgatctagcttcctcatgaac

SEQ ID NO: 132826 - DNA, 25 bp, Mus musculus
actgtgatctaggttcctcatgaac

SEQ ID NO: 132827 - DNA, 25 bp, Mus musculus
actgtgatctttcttgtttctataa

SEQ ID NO: 132828 - DNA, 25 bp, Mus musculus
actgtgatctttgttgtttctataa

SEQ ID NO: 132829 - DNA, 25 bp, Mus musculus
actgtgatgattaagcttagctgtc

SEQ ID NO: 132830 - DNA, 25 bp, Mus musculus
actgtgatgatttagcttagctgtc

SEQ ID NO: 132831 - DNA, 25 bp, Mus musculus
actgtgatgtgacactccctttgcc

SEQ ID NO: 132832 - DNA, 25 bp, Mus musculus
actgtgatgtgagactccctttgcc

SEQ ID NO: 132833 - DNA, 25 bp, Mus musculus
actgtgatgtgtaccaggtttagcc

SEQ ID NO: 132834 - DNA, 25 bp, Mus musculus
actgtgatgtgttccaggtttagcc

SEQ ID NO: 132835 - DNA, 25 bp, Mus musculus
actgtgatgtttccaccttgctcct

SEQ ID NO: 132836 - DNA, 25 bp, Mus musculus
actgtgatgtttgcaccttgctcct

SEQ ID NO: 132837 - DNA, 25 bp, Mus musculus
actgtgattcacacgtttacttaat

SEQ ID NO: 132838 - DNA, 25 bp, Mus musculus
actgtgattcacagtttccttgttt

SEQ ID NO: 132839 - DNA, 25 bp, Mus musculus
actgtgattcactcgtttacttaat

SEQ ID NO: 132840 - DNA, 25 bp, Mus musculus
actgtgattcactgtttccttgttt

SEQ ID NO: 132841 - DNA, 25 bp, Mus musculus
actgtgattgccctgtcttgtattg

SEQ ID NO: 132842 - DNA, 25 bp, Mus musculus
actgtgattgccgtgtcttgtattg

SEQ ID NO: 132843 - DNA, 25 bp, Mus musculus
actgtgattgttaccccatttgcat

SEQ ID NO: 132844 - DNA, 25 bp, Mus musculus
actgtgattgtttccccatttgcat

SEQ ID NO: 132845 - DNA, 25 bp, Mus musculus
actgtgcaaactatctttctagagc

SEQ ID NO: 132846 - DNA, 25 bp, Mus musculus
actgtgcaaactttctttctagagc

SEQ ID NO: 132847 - DNA, 25 bp, Mus musculus
actgtgcaaccaagttctcatatat

SEQ ID NO: 132848 - DNA, 25 bp, Mus musculus
actgtgcaaccatgttctcatatat

SEQ ID NO: 132849 - DNA, 25 bp, Mus musculus
actgtgcaactgaatcccttccaga

SEQ ID NO: 132850 - DNA, 25 bp, Mus musculus
actgtgcaactgtatcccttccaga

SEQ ID NO: 132851 - DNA, 25 bp, Mus musculus
actgtgcaagggactataggtacga

SEQ ID NO: 132852 - DNA, 25 bp, Mus musculus
actgtgcaagggtctataggtacga

SEQ ID NO: 132853 - DNA, 25 bp, Mus musculus
actgtgcaccaactgtagtggattt

SEQ ID NO: 132854 - DNA, 25 bp, Mus musculus
actgtgcaccaagtgtagtggattt

SEQ ID NO: 132855 - DNA, 25 bp, Mus musculus
actgtgcacctcctcactggtgcag

SEQ ID NO: 132856 - DNA, 25 bp, Mus musculus
actgtgcacctcgtcactggtgcag

SEQ ID NO: 132857 - DNA, 25 bp, Mus musculus
actgtgcaggctagtactctgcgca

SEQ ID NO: 132858 - DNA, 25 bp, Mus musculus
actgtgcaggcttgtactctgcgca

SEQ ID NO: 132859 - DNA, 25 bp, Mus musculus
actgtgcatctgcattctaacggca

SEQ ID NO: 132860 - DNA, 25 bp, Mus musculus
actgtgcatctggattctaacggca

SEQ ID NO: 132861 - DNA, 25 bp, Mus musculus
actgtgcatgtcagtcgtctctgcg

SEQ ID NO: 132862 - DNA, 25 bp, Mus musculus
actgtgcatgtctgtcgtctctgcg

SEQ ID NO: 132863 - DNA, 25 bp, Mus musculus
actgtgcattacagagaccctgtca

SEQ ID NO: 132864 - DNA, 25 bp, Mus musculus
actgtgcattactgagaccctgtca

SEQ ID NO: 132865 - DNA, 25 bp, Mus musculus
actgtgcattgtacatagttctaac

SEQ ID NO: 132866 - DNA, 25 bp, Mus musculus
actgtgcattgttcatagttctaac

SEQ ID NO: 132867 - DNA, 25 bp, Mus musculus
actgtgccaaagagtttagaaaaca

SEQ ID NO: 132868 - DNA, 25 bp, Mus musculus
actgtgccaaagtgtttagaaaaca

SEQ ID NO: 132869 - DNA, 25 bp, Mus musculus
actgtgccagagacctagtcatgga

SEQ ID NO: 132870 - DNA, 25 bp, Mus musculus
actgtgccagagtcctagtcatgga

SEQ ID NO: 132871 - DNA, 25 bp, Mus musculus
actgtgccatgcagacaggcgttgc

SEQ ID NO: 132872 - DNA, 25 bp, Mus musculus
actgtgccatgctgacaggcgttgc

SEQ ID NO: 132873 - DNA, 25 bp, Mus musculus
actgtgcccaaactgaaacctgact

SEQ ID NO: 132874 - DNA, 25 bp, Mus musculus
actgtgcccaaagtgaaacctgact

SEQ ID NO: 132875 - DNA, 25 bp, Mus musculus
actgtgcccagcaattgtgatattt

SEQ ID NO: 132876 - DNA, 25 bp, Mus musculus
actgtgcccagctattgtgatattt

SEQ ID NO: 132877 - DNA, 25 bp, Mus musculus
actgtgcccatcacaacaggaggca

SEQ ID NO: 132878 - DNA, 25 bp, Mus musculus
actgtgcccatctcaacaggaggca

SEQ ID NO: 132879 - DNA, 25 bp, Mus musculus
actgtgccctgcatgattgtgttgc

SEQ ID NO: 132880 - DNA, 25 bp, Mus musculus
actgtgccctgcttgattgtgttgc

SEQ ID NO: 132881 - DNA, 25 bp, Mus musculus
actgtgcccttaaccacattgtgaa

SEQ ID NO: 132882 - DNA, 25 bp, Mus musculus
actgtgcccttaagtgccagaaact

SEQ ID NO: 132883 - DNA, 25 bp, Mus musculus
actgtgcccttatccacattgtgaa

SEQ ID NO: 132884 - DNA, 25 bp, Mus musculus
actgtgcccttatgtgccagaaact

SEQ ID NO: 132885 - DNA, 25 bp, Mus musculus
actgtgccggccagtcaacgcaact

SEQ ID NO: 132886 - DNA, 25 bp, Mus musculus
actgtgccggcctgtcaacgcaact

SEQ ID NO: 132887 - DNA, 25 bp, Mus musculus
actgtgcctaggacgtggactggtt

SEQ ID NO: 132888 - DNA, 25 bp, Mus musculus
actgtgcctaggtcgtggactggtt

SEQ ID NO: 132889 - DNA, 25 bp, Mus musculus
actgtgcctccccagatcaggatgg

SEQ ID NO: 132890 - DNA, 25 bp, Mus musculus
actgtgcctcccgagatcaggatgg

SEQ ID NO: 132891 - DNA, 25 bp, Mus musculus
actgtgcctgagaagcccgttagag

SEQ ID NO: 132892 - DNA, 25 bp, Mus musculus
actgtgcctgagtagcccgttagag

SEQ ID NO: 132893 - DNA, 25 bp, Mus musculus
actgtgccttgcatagagccagaag

SEQ ID NO: 132894 - DNA, 25 bp, Mus musculus
actgtgccttgcttagagccagaag

SEQ ID NO: 132895 - DNA, 25 bp, Mus musculus
actgtgcgaaagaccctcgagggca

SEQ ID NO: 132896 - DNA, 25 bp, Mus musculus
actgtgcgaaagtccctcgagggca

SEQ ID NO: 132897 - DNA, 25 bp, Mus musculus
actgtgcgaccacctgctgacttgg

SEQ ID NO: 132898 - DNA, 25 bp, Mus musculus
actgtgcgaccagctgctgacttgg

SEQ ID NO: 132899 - DNA, 25 bp, Mus musculus
actgtgcgcagacccaaagcggcca

SEQ ID NO: 132900 - DNA, 25 bp, Mus musculus
actgtgcgcagagccaaagcggcca

SEQ ID NO: 132901 - DNA, 25 bp, Mus musculus
actgtgcgggccatcgcgatggaga

SEQ ID NO: 132902 - DNA, 25 bp, Mus musculus
actgtgcgggccttcgcgatggaga

SEQ ID NO: 132903 - DNA, 25 bp, Mus musculus
actgtgcgtcagctttttaaattgt

SEQ ID NO: 132904 - DNA, 25 bp, Mus musculus
actgtgcgtcaggtttttaaattgt

SEQ ID NO: 132905 - DNA, 25 bp, Mus musculus
actgtgcgtcccacaaatatgctgg

SEQ ID NO: 132906 - DNA, 25 bp, Mus musculus
actgtgcgtccctcaaatatgctgg

SEQ ID NO: 132907 - DNA, 25 bp, Mus musculus
actgtgctagttatgtaccctccga

SEQ ID NO: 132908 - DNA, 25 bp, Mus musculus
actgtgctagttttgtaccctccga

SEQ ID NO: 132909 - DNA, 25 bp, Mus musculus
actgtgctattccttcttgattttc

SEQ ID NO: 132910 - DNA, 25 bp, Mus musculus
actgtgctattcgttcttgattttc

SEQ ID NO: 132911 - DNA, 25 bp, Mus musculus
actgtgctcactagcctttgaggag

SEQ ID NO: 132912 - DNA, 25 bp, Mus musculus
actgtgctcacttgcctttgaggag

SEQ ID NO: 132913 - DNA, 25 bp, Mus musculus
actgtgctcagccacaaagcaatgg

SEQ ID NO: 132914 - DNA, 25 bp, Mus musculus
actgtgctcagcgacaaagcaatgg

SEQ ID NO: 132915 - DNA, 25 bp, Mus musculus
actgtgctccatacgtccggcggga

SEQ ID NO: 132916 - DNA, 25 bp, Mus musculus
actgtgctccattcgtccggcggga

SEQ ID NO: 132917 - DNA, 25 bp, Mus musculus
actgtgctcctaacctgggttgagt

SEQ ID NO: 132918 - DNA, 25 bp, Mus musculus
actgtgctcctatcctgggttgagt

SEQ ID NO: 132919 - DNA, 25 bp, Mus musculus
actgtgctcctcagtctgctaaaca

SEQ ID NO: 132920 - DNA, 25 bp, Mus musculus
actgtgctcctctgtctgctaaaca

SEQ ID NO: 132921 - DNA, 25 bp, Mus musculus
actgtgctggacacgggcatctctg

SEQ ID NO: 132922 - DNA, 25 bp, Mus musculus
actgtgctggactcgggcatctctg

SEQ ID NO: 132923 - DNA, 25 bp, Mus musculus
actgtgctgggccttgcctctactg

SEQ ID NO: 132924 - DNA, 25 bp, Mus musculus
actgtgctgggcgttgcctctactg

SEQ ID NO: 132925 - DNA, 25 bp, Mus musculus
actgtgctggtgagatcctttcaca

SEQ ID NO: 132926 - DNA, 25 bp, Mus musculus
actgtgctggtgtgatcctttcaca

SEQ ID NO: 132927 - DNA, 25 bp, Mus musculus
actgtgctgtaaccgcctacctaat

SEQ ID NO: 132928 - DNA, 25 bp, Mus musculus
actgtgctgtaagcgcctacctaat

SEQ ID NO: 132929 - DNA, 25 bp, Mus musculus
actgtgctgtgtcgaaatgaccaaa

SEQ ID NO: 132930 - DNA, 25 bp, Mus musculus
actgtgctgtgtggaaatgaccaaa

SEQ ID NO: 132931 - DNA, 25 bp, Mus musculus
actgtgcttcctactgactcagtag

SEQ ID NO: 132932 - DNA, 25 bp, Mus musculus
actgtgcttccttctgactcagtag

SEQ ID NO: 132933 - DNA, 25 bp, Mus musculus
actgtgctttgtcgtattacgctgg

SEQ ID NO: 132934 - DNA, 25 bp, Mus musculus
actgtgctttgtggtattacgctgg

SEQ ID NO: 132935 - DNA, 25 bp, Mus musculus
actgtggaacccattacaagctggt

SEQ ID NO: 132936 - DNA, 25 bp, Mus musculus
actgtggaaccctttacaagctggt

SEQ ID NO: 132937 - DNA, 25 bp, Mus musculus
actgtggaagtgactgctatctctg

SEQ ID NO: 132938 - DNA, 25 bp, Mus musculus
actgtggaagtgtctgctatctctg

SEQ ID NO: 132939 - DNA, 25 bp, Mus musculus
actgtggaatatcacttctggttga

SEQ ID NO: 132940 - DNA, 25 bp, Mus musculus
actgtggaatatgacttctggttga

SEQ ID NO: 132941 - DNA, 25 bp, Mus musculus
actgtggaatctcttatgcccgtca

SEQ ID NO: 132942 - DNA, 25 bp, Mus musculus
actgtggaatctgttatgcccgtca

SEQ ID NO: 132943 - DNA, 25 bp, Mus musculus
actgtggaatgtccttaataaaaac

SEQ ID NO: 132944 - DNA, 25 bp, Mus musculus
actgtggaatgtgcttaataaaaac

SEQ ID NO: 132945 - DNA, 25 bp, Mus musculus
actgtggacaatcagagccttccta

SEQ ID NO: 132946 - DNA, 25 bp, Mus musculus
actgtggacaatgagagccttccta

SEQ ID NO: 132947 - DNA, 25 bp, Mus musculus
actgtggacagtcactagctaccca

SEQ ID NO: 132948 - DNA, 25 bp, Mus musculus
actgtggacagtgactagctaccca

SEQ ID NO: 132949 - DNA, 25 bp, Mus musculus
actgtggacatcacttttgtggtga

SEQ ID NO: 132950 - DNA, 25 bp, Mus musculus
actgtggacatctcttttgtggtga

SEQ ID NO: 132951 - DNA, 25 bp, Mus musculus
actgtggaccagcatcttgggtgcc

SEQ ID NO: 132952 - DNA, 25 bp, Mus musculus
actgtggaccaggatcttgggtgcc

SEQ ID NO: 132953 - DNA, 25 bp, Mus musculus
actgtggacgacatggtcaccctgg

SEQ ID NO: 132954 - DNA, 25 bp, Mus musculus
actgtggacgacttggtcaccctgg

SEQ ID NO: 132955 - DNA, 25 bp, Mus musculus
actgtggactgactgctgagcactg

SEQ ID NO: 132956 - DNA, 25 bp, Mus musculus
actgtggactgagtgctgagcactg

SEQ ID NO: 132957 - DNA, 25 bp, Mus musculus
actgtggacttgacttgcatctggc

SEQ ID NO: 132958 - DNA, 25 bp, Mus musculus
actgtggacttgctgttcgttttaa

SEQ ID NO: 132959 - DNA, 25 bp, Mus musculus
actgtggacttggtgttcgttttaa

SEQ ID NO: 132960 - DNA, 25 bp, Mus musculus
actgtggacttgtcttgcatctggc

SEQ ID NO: 132961 - DNA, 25 bp, Mus musculus
actgtggagaagaggtaccagccct

SEQ ID NO: 132962 - DNA, 25 bp, Mus musculus
actgtggagaagtggtaccagccct

SEQ ID NO: 132963 - DNA, 25 bp, Mus musculus
actgtggagactaggcctgagctgt

SEQ ID NO: 132964 - DNA, 25 bp, Mus musculus
actgtggagacttggcctgagctgt

SEQ ID NO: 132965 - DNA, 25 bp, Mus musculus
actgtggagccgagcatcatgtgtg

SEQ ID NO: 132966 - DNA, 25 bp, Mus musculus
actgtggagccgtgcatcatgtgtg

SEQ ID NO: 132967 - DNA, 25 bp, Mus musculus
actgtggagcttacatgtttactgt

SEQ ID NO: 132968 - DNA, 25 bp, Mus musculus
actgtggagcttccttgttcgaaag

SEQ ID NO: 132969 - DNA, 25 bp, Mus musculus
actgtggagcttgcttgttcgaaag

SEQ ID NO: 132970 - DNA, 25 bp, Mus musculus
actgtggagctttcatgtttactgt

SEQ ID NO: 132971 - DNA, 25 bp, Mus musculus
actgtggaggctcagaccatggcac

SEQ ID NO: 132972 - DNA, 25 bp, Mus musculus
actgtggaggctgagaccatggcac

SEQ ID NO: 132973 - DNA, 25 bp, Mus musculus
actgtggagggccacattccctagg

SEQ ID NO: 132974 - DNA, 25 bp, Mus musculus
actgtggagggcgacattccctagg

SEQ ID NO: 132975 - DNA, 25 bp, Mus musculus
actgtggaggttatctgctaatagc

SEQ ID NO: 132976 - DNA, 25 bp, Mus musculus
actgtggaggttttctgctaatagc

SEQ ID NO: 132977 - DNA, 25 bp, Mus musculus
actgtggagtttcatttgttcgttt

SEQ ID NO: 132978 - DNA, 25 bp, Mus musculus
actgtggagtttgatttgttcgttt

SEQ ID NO: 132979 - DNA, 25 bp, Mus musculus
actgtggatcagcacttgcctggaa

SEQ ID NO: 132980 - DNA, 25 bp, Mus musculus
actgtggatcaggacttgcctggaa

SEQ ID NO: 132981 - DNA, 25 bp, Mus musculus
actgtggatgagaaacacctcagta

SEQ ID NO: 132982 - DNA, 25 bp, Mus musculus
actgtggatgagtaacacctcagta

SEQ ID NO: 132983 - DNA, 25 bp, Mus musculus
actgtggatgggaccgtatcctgat

SEQ ID NO: 132984 - DNA, 25 bp, Mus musculus
actgtggatgggtccgtatcctgat

SEQ ID NO: 132985 - DNA, 25 bp, Mus musculus
actgtggcaagaagagctgaatgaa

SEQ ID NO: 132986 - DNA, 25 bp, Mus musculus
actgtggcaagatgagctgaatgaa

SEQ ID NO: 132987 - DNA, 25 bp, Mus musculus
actgtggcactgaaacatagtaggt

SEQ ID NO: 132988 - DNA, 25 bp, Mus musculus
actgtggcactgtaacatagtaggt

SEQ ID NO: 132989 - DNA, 25 bp, Mus musculus
actgtggcagatcgacacggttcct

SEQ ID NO: 132990 - DNA, 25 bp, Mus musculus
actgtggcagatggacacggttcct

SEQ ID NO: 132991 - DNA, 25 bp, Mus musculus
actgtggcattcaatcagcctgtta

SEQ ID NO: 132992 - DNA, 25 bp, Mus musculus
actgtggcattctatcagcctgtta

SEQ ID NO: 132993 - DNA, 25 bp, Mus musculus
actgtggcattgataagctctttga

SEQ ID NO: 132994 - DNA, 25 bp, Mus musculus
actgtggcattgattttctggatga

SEQ ID NO: 132995 - DNA, 25 bp, Mus musculus
actgtggcattgttaagctctttga

SEQ ID NO: 132996 - DNA, 25 bp, Mus musculus
actgtggcattgtttttctggatga

SEQ ID NO: 132997 - DNA, 25 bp, Mus musculus
actgtggccatacacttgccttagc

SEQ ID NO: 132998 - DNA, 25 bp, Mus musculus
actgtggccatagacttgccttagc

SEQ ID NO: 132999 - DNA, 25 bp, Mus musculus
actgtggcccacactgtgctaacag

SEQ ID NO: 133000 - DNA, 25 bp, Mus musculus
actgtggcccactctgtgctaacag

SEQ ID NO: 133001 - DNA, 25 bp, Mus musculus
actgtggccctgagtcagcagaagt

SEQ ID NO: 133002 - DNA, 25 bp, Mus musculus
actgtggccctgtgtcagcagaagt

SEQ ID NO: 133003 - DNA, 25 bp, Mus musculus
actgtggccgacatttggcgcatgg

SEQ ID NO: 133004 - DNA, 25 bp, Mus musculus
actgtggccgacttttggcgcatgg

SEQ ID NO: 133005 - DNA, 25 bp, Mus musculus
actgtggccttcctggttagtaaga

SEQ ID NO: 133006 - DNA, 25 bp, Mus musculus
actgtggccttcgtggttagtaaga

SEQ ID NO: 133007 - DNA, 25 bp, Mus musculus
actgtggctctcagtgccagcagaa

SEQ ID NO: 133008 - DNA, 25 bp, Mus musculus
actgtggctctctgtgccagcagaa

SEQ ID NO: 133009 - DNA, 25 bp, Mus musculus
actgtggctcttagaaatcctgtag

SEQ ID NO: 133010 - DNA, 25 bp, Mus musculus
actgtggctctttgaaatcctgtag

SEQ ID NO: 133011 - DNA, 25 bp, Mus musculus
actgtggctgctagggactccacgg

SEQ ID NO: 133012 - DNA, 25 bp, Mus musculus
actgtggctgcttgggactccacgg

SEQ ID NO: 133013 - DNA, 25 bp, Mus musculus
actgtggctggactaggttctctct

SEQ ID NO: 133014 - DNA, 25 bp, Mus musculus
actgtggctggagtaggttctctct

SEQ ID NO: 133015 - DNA, 25 bp, Mus musculus
actgtggctgttcctcttcaatata

SEQ ID NO: 133016 - DNA, 25 bp, Mus musculus
actgtggctgttgctcttcaatata

SEQ ID NO: 133017 - DNA, 25 bp, Mus musculus
actgtggcttcaaagaagctattga

SEQ ID NO: 133018 - DNA, 25 bp, Mus musculus
actgtggcttcatagaagctattga

SEQ ID NO: 133019 - DNA, 25 bp, Mus musculus
actgtgggaaacctctgtccattga

SEQ ID NO: 133020 - DNA, 25 bp, Mus musculus
actgtgggaaacgtctgtccattga

SEQ ID NO: 133021 - DNA, 25 bp, Mus musculus
actgtgggaattatgcttagaactc

SEQ ID NO: 133022 - DNA, 25 bp, Mus musculus
actgtgggaattttgcttagaactc

SEQ ID NO: 133023 - DNA, 25 bp, Mus musculus
actgtgggagcacgctcactggcca

SEQ ID NO: 133024 - DNA, 25 bp, Mus musculus
actgtgggagcaggctcactggcca

SEQ ID NO: 133025 - DNA, 25 bp, Mus musculus
actgtgggagctcaactccgtccct

SEQ ID NO: 133026 - DNA, 25 bp, Mus musculus
actgtgggagctcccatccccgggt

SEQ ID NO: 133027 - DNA, 25 bp, Mus musculus
actgtgggagctgaactccgtccct

SEQ ID NO: 133028 - DNA, 25 bp, Mus musculus
actgtgggagctgccatccccgggt

SEQ ID NO: 133029 - DNA, 25 bp, Mus musculus
actgtgggatgcatccctttttgaa

SEQ ID NO: 133030 - DNA, 25 bp, Mus musculus
actgtgggatgcctgattactatca

SEQ ID NO: 133031 - DNA, 25 bp, Mus musculus
actgtgggatgcgtgattactatca

SEQ ID NO: 133032 - DNA, 25 bp, Mus musculus
actgtgggatgcttccctttttgaa

SEQ ID NO: 133033 - DNA, 25 bp, Mus musculus
actgtgggccagctcgcctgatgta

SEQ ID NO: 133034 - DNA, 25 bp, Mus musculus
actgtgggccagcttggtacaagcc

SEQ ID NO: 133035 - DNA, 25 bp, Mus musculus
actgtgggccaggtcgcctgatgta

SEQ ID NO: 133036 - DNA, 25 bp, Mus musculus
actgtgggccaggttggtacaagcc

SEQ ID NO: 133037 - DNA, 25 bp, Mus musculus
actgtgggccatacatcatgtttgc

SEQ ID NO: 133038 - DNA, 25 bp, Mus musculus
actgtgggccattcatcatgtttgc

SEQ ID NO: 133039 - DNA, 25 bp, Mus musculus
actgtgggctttaggcttctcttgg

SEQ ID NO: 133040 - DNA, 25 bp, Mus musculus
actgtgggcttttggcttctcttgg

SEQ ID NO: 133041 - DNA, 25 bp, Mus musculus
actgtgggtgacatagtccagggac

SEQ ID NO: 133042 - DNA, 25 bp, Mus musculus
actgtgggtgacttagtccagggac

SEQ ID NO: 133043 - DNA, 25 bp, Mus musculus
actgtgggttctcgacctaggccag

SEQ ID NO: 133044 - DNA, 25 bp, Mus musculus
actgtgggttctggacctaggccag

SEQ ID NO: 133045 - DNA, 25 bp, Mus musculus
actgtggtaagtcatgacgagccgt

SEQ ID NO: 133046 - DNA, 25 bp, Mus musculus
actgtggtaagtgatgacgagccgt

SEQ ID NO: 133047 - DNA, 25 bp, Mus musculus
actgtggtagtcataccctctgtga

SEQ ID NO: 133048 - DNA, 25 bp, Mus musculus
actgtggtagtcttaccctctgtga

SEQ ID NO: 133049 - DNA, 25 bp, Mus musculus
actgtggtagttcggtatgttctca

SEQ ID NO: 133050 - DNA, 25 bp, Mus musculus
actgtggtagttgggtatgttctca

SEQ ID NO: 133051 - DNA, 25 bp, Mus musculus
actgtggtcccaagcatacattaac

SEQ ID NO: 133052 - DNA, 25 bp, Mus musculus
actgtggtcccatgcatacattaac

SEQ ID NO: 133053 - DNA, 25 bp, Mus musculus
actgtggtccggcatgaatttttct

SEQ ID NO: 133054 - DNA, 25 bp, Mus musculus
actgtggtccgggatgaatttttct

SEQ ID NO: 133055 - DNA, 25 bp, Mus musculus
actgtggtgaataccgagccgtgcg

SEQ ID NO: 133056 - DNA, 25 bp, Mus musculus
actgtggtgaattccgagccgtgcg

SEQ ID NO: 133057 - DNA, 25 bp, Mus musculus
actgtggtgaccacagggtgtgccc

SEQ ID NO: 133058 - DNA, 25 bp, Mus musculus
actgtggtgacctcagggtgtgccc

SEQ ID NO: 133059 - DNA, 25 bp, Mus musculus
actgtggtgattaaacatttcatag

SEQ ID NO: 133060 - DNA, 25 bp, Mus musculus
actgtggtgatttaacatttcatag

SEQ ID NO: 133061 - DNA, 25 bp, Mus musculus
actgtggtgtctatttctgacttgc

SEQ ID NO: 133062 - DNA, 25 bp, Mus musculus
actgtggtgtctttttctgacttgc

SEQ ID NO: 133063 - DNA, 25 bp, Mus musculus
actgtggtgtttatactgagcgtat

SEQ ID NO: 133064 - DNA, 25 bp, Mus musculus
actgtggtgtttttactgagcgtat

SEQ ID NO: 133065 - DNA, 25 bp, Mus musculus
actgtggttcaaccctcctcggtgg

SEQ ID NO: 133066 - DNA, 25 bp, Mus musculus
actgtggttcaagcctcctcggtgg

SEQ ID NO: 133067 - DNA, 25 bp, Mus musculus
actgtggttcctccatgaaaacagt

SEQ ID NO: 133068 - DNA, 25 bp, Mus musculus
actgtggttcctgcatgaaaacagt

SEQ ID NO: 133069 - DNA, 25 bp, Mus musculus
actgtggttctgatccgaccttgaa

SEQ ID NO: 133070 - DNA, 25 bp, Mus musculus
actgtggttctgttccgaccttgaa

SEQ ID NO: 133071 - DNA, 25 bp, Mus musculus
actgtggttgctagagtgctttcac

SEQ ID NO: 133072 - DNA, 25 bp, Mus musculus
actgtggttgcttgagtgctttcac

SEQ ID NO: 133073 - DNA, 25 bp, Mus musculus
actgtggttgttctatgggtcctcc

SEQ ID NO: 133074 - DNA, 25 bp, Mus musculus
actgtggttgttgtatgggtcctcc

SEQ ID NO: 133075 - DNA, 25 bp, Mus musculus
actgtggtttggattcagaatggct

SEQ ID NO: 133076 - DNA, 25 bp, Mus musculus
actgtggtttggtttcagaatggct

SEQ ID NO: 133077 - DNA, 25 bp, Mus musculus
actgtggtttttcagagcctgccgt

SEQ ID NO: 133078 - DNA, 25 bp, Mus musculus
actgtggtttttgagagcctgccgt

SEQ ID NO: 133079 - DNA, 25 bp, Mus musculus
actgtgtaaccaagagccctgaata

SEQ ID NO: 133080 - DNA, 25 bp, Mus musculus
actgtgtaaccatgagccctgaata

SEQ ID NO: 133081 - DNA, 25 bp, Mus musculus
actgtgtaagacctcctgttttaag

SEQ ID NO: 133082 - DNA, 25 bp, Mus musculus
actgtgtaagacgtcctgttttaag

SEQ ID NO: 133083 - DNA, 25 bp, Mus musculus
actgtgtaagtaattcactgtgaga

SEQ ID NO: 133084 - DNA, 25 bp, Mus musculus
actgtgtaagtatttcactgtgaga

SEQ ID NO: 133085 - DNA, 25 bp, Mus musculus
actgtgtaccaaaatacggcctcct

SEQ ID NO: 133086 - DNA, 25 bp, Mus musculus
actgtgtaccaatatacggcctcct

SEQ ID NO: 133087 - DNA, 25 bp, Mus musculus
actgtgtagcttaccctgctgcctt

SEQ ID NO: 133088 - DNA, 25 bp, Mus musculus
actgtgtagcttagactgaccttga

SEQ ID NO: 133089 - DNA, 25 bp, Mus musculus
actgtgtagctttccctgctgcctt

SEQ ID NO: 133090 - DNA, 25 bp, Mus musculus
actgtgtagctttgactgaccttga

SEQ ID NO: 133091 - DNA, 25 bp, Mus musculus
actgtgtatctacgctgggtggttc

SEQ ID NO: 133092 - DNA, 25 bp, Mus musculus
actgtgtatctaggctgggtggttc

SEQ ID NO: 133093 - DNA, 25 bp, Mus musculus
actgtgtatctcagtctctgtacag

SEQ ID NO: 133094 - DNA, 25 bp, Mus musculus
actgtgtatctctgtctctgtacag

SEQ ID NO: 133095 - DNA, 25 bp, Mus musculus
actgtgtattatcctcatcttctgt

SEQ ID NO: 133096 - DNA, 25 bp, Mus musculus
actgtgtattatgctcatcttctgt

SEQ ID NO: 133097 - DNA, 25 bp, Mus musculus
actgtgtattcgaggctgctctgga

SEQ ID NO: 133098 - DNA, 25 bp, Mus musculus
actgtgtattcgtggctgctctgga

SEQ ID NO: 133099 - DNA, 25 bp, Mus musculus
actgtgtcactgacgaggaactctg

SEQ ID NO: 133100 - DNA, 25 bp, Mus musculus
actgtgtcactgtcgaggaactctg

SEQ ID NO: 133101 - DNA, 25 bp, Mus musculus
actgtgtcatctcattgtaatgaca

SEQ ID NO: 133102 - DNA, 25 bp, Mus musculus
actgtgtcatctgattgtaatgaca

SEQ ID NO: 133103 - DNA, 25 bp, Mus musculus
actgtgtcccctcagccaggaaagg

SEQ ID NO: 133104 - DNA, 25 bp, Mus musculus
actgtgtcccctgagccaggaaagg

SEQ ID NO: 133105 - DNA, 25 bp, Mus musculus
actgtgtcctcaccgaagtctggcc

SEQ ID NO: 133106 - DNA, 25 bp, Mus musculus
actgtgtcctcagcgaagtctggcc

SEQ ID NO: 133107 - DNA, 25 bp, Mus musculus
actgtgtcgctgaacggaggccact

SEQ ID NO: 133108 - DNA, 25 bp, Mus musculus
actgtgtcgctgtacggaggccact

SEQ ID NO: 133109 - DNA, 25 bp, Mus musculus
actgtgtctcaaattgctgccaaga

SEQ ID NO: 133110 - DNA, 25 bp, Mus musculus
actgtgtctcaatttgctgccaaga

SEQ ID NO: 133111 - DNA, 25 bp, Mus musculus
actgtgtctcagactctaagccatt

SEQ ID NO: 133112 - DNA, 25 bp, Mus musculus
actgtgtctcagtctctaagccatt

SEQ ID NO: 133113 - DNA, 25 bp, Mus musculus
actgtgtctgtacgacgtggtcaga

SEQ ID NO: 133114 - DNA, 25 bp, Mus musculus
actgtgtctgtaggacgtggtcaga

SEQ ID NO: 133115 - DNA, 25 bp, Mus musculus
actgtgtctgtcacaggctaggcac

SEQ ID NO: 133116 - DNA, 25 bp, Mus musculus
actgtgtctgtctcaggctaggcac

SEQ ID NO: 133117 - DNA, 25 bp, Mus musculus
actgtgtgaacaatgccactgtgct

SEQ ID NO: 133118 - DNA, 25 bp, Mus musculus
actgtgtgaacattgccactgtgct

SEQ ID NO: 133119 - DNA, 25 bp, Mus musculus
actgtgtgaagcaatgtgtgtctaa

SEQ ID NO: 133120 - DNA, 25 bp, Mus musculus
actgtgtgaagctatgtgtgtctaa

SEQ ID NO: 133121 - DNA, 25 bp, Mus musculus
actgtgtgacaactggtagccaatt

SEQ ID NO: 133122 - DNA, 25 bp, Mus musculus
actgtgtgacaagtggtagccaatt

SEQ ID NO: 133123 - DNA, 25 bp, Mus musculus
actgtgtgcagaagcctcacaagca

SEQ ID NO: 133124 - DNA, 25 bp, Mus musculus
actgtgtgcagatgcctcacaagca

SEQ ID NO: 133125 - DNA, 25 bp, Mus musculus
actgtgtgccacatagttgagagct

SEQ ID NO: 133126 - DNA, 25 bp, Mus musculus
actgtgtgccacttagttgagagct

SEQ ID NO: 133127 - DNA, 25 bp, Mus musculus
actgtgtgcccaccttgacctggaa

SEQ ID NO: 133128 - DNA, 25 bp, Mus musculus
actgtgtgcccagcttgacctggaa

SEQ ID NO: 133129 - DNA, 25 bp, Mus musculus
actgtgtgccggcacatgcttgctt

SEQ ID NO: 133130 - DNA, 25 bp, Mus musculus
actgtgtgccgggacatgcttgctt

SEQ ID NO: 133131 - DNA, 25 bp, Mus musculus
actgtgtgcggccacatcatatttg

SEQ ID NO: 133132 - DNA, 25 bp, Mus musculus
actgtgtgcggcgacatcatatttg

SEQ ID NO: 133133 - DNA, 25 bp, Mus musculus
actgtgtgctgaacggagggccact

SEQ ID NO: 133134 - DNA, 25 bp, Mus musculus
actgtgtgctgatcggagggccact

SEQ ID NO: 133135 - DNA, 25 bp, Mus musculus
actgtgtgctggagcctcagcggat

SEQ ID NO: 133136 - DNA, 25 bp, Mus musculus
actgtgtgctggtgcctcagcggat

SEQ ID NO: 133137 - DNA, 25 bp, Mus musculus
actgtgtgctttcataacatctgga

SEQ ID NO: 133138 - DNA, 25 bp, Mus musculus
actgtgtgctttgataacatctgga

SEQ ID NO: 133139 - DNA, 25 bp, Mus musculus
actgtgtggaccaaggctcgctcta

SEQ ID NO: 133140 - DNA, 25 bp, Mus musculus
actgtgtggacctaggctcgctcta

SEQ ID NO: 133141 - DNA, 25 bp, Mus musculus
actgtgtggcacaggcttaaagcaa

SEQ ID NO: 133142 - DNA, 25 bp, Mus musculus
actgtgtggcactggcttaaagcaa

SEQ ID NO: 133143 - DNA, 25 bp, Mus musculus
actgtgtgggtacatgctcatggaa

SEQ ID NO: 133144 - DNA, 25 bp, Mus musculus
actgtgtgggtagatgctcatggaa

SEQ ID NO: 133145 - DNA, 25 bp, Mus musculus
actgtgtgggttagttcctgaagtc

SEQ ID NO: 133146 - DNA, 25 bp, Mus musculus
actgtgtgggtttgttcctgaagtc

SEQ ID NO: 133147 - DNA, 25 bp, Mus musculus
actgtgtggtacctcactggcggac

SEQ ID NO: 133148 - DNA, 25 bp, Mus musculus
actgtgtggtacgtcactggcggac

SEQ ID NO: 133149 - DNA, 25 bp, Mus musculus
actgtgtggtgtaactgtgctgata

SEQ ID NO: 133150 - DNA, 25 bp, Mus musculus
actgtgtggtgttactgtgctgata

SEQ ID NO: 133151 - DNA, 25 bp, Mus musculus
actgtgtggtttcaactgttctgcc

SEQ ID NO: 133152 - DNA, 25 bp, Mus musculus
actgtgtggtttgaactgttctgcc

SEQ ID NO: 133153 - DNA, 25 bp, Mus musculus
actgtgtgtattcactcatccgttg

SEQ ID NO: 133154 - DNA, 25 bp, Mus musculus
actgtgtgtattgactcatccgttg

SEQ ID NO: 133155 - DNA, 25 bp, Mus musculus
actgtgtgtgcgagtcctgtggaca

SEQ ID NO: 133156 - DNA, 25 bp, Mus musculus
actgtgtgtgcgtgtcctgtggaca

SEQ ID NO: 133157 - DNA, 25 bp, Mus musculus
actgtgtgtgtaaattctcatgcta

SEQ ID NO: 133158 - DNA, 25 bp, Mus musculus
actgtgtgtgtacatgctggtctta

SEQ ID NO: 133159 - DNA, 25 bp, Mus musculus
actgtgtgtgtagatgctggtctta

SEQ ID NO: 133160 - DNA, 25 bp, Mus musculus
actgtgtgtgtatattctcatgcta

SEQ ID NO: 133161 - DNA, 25 bp, Mus musculus
actgtgtgtttcagttgtacggtct

SEQ ID NO: 133162 - DNA, 25 bp, Mus musculus
actgtgtgtttctgttgtacggtct

SEQ ID NO: 133163 - DNA, 25 bp, Mus musculus
actgtgttaccgagtctgatataga

SEQ ID NO: 133164 - DNA, 25 bp, Mus musculus
actgtgttaccgtgtctgatataga

SEQ ID NO: 133165 - DNA, 25 bp, Mus musculus
actgtgttacttactccttcatttt

SEQ ID NO: 133166 - DNA, 25 bp, Mus musculus
actgtgttacttagcgaagctggat

SEQ ID NO: 133167 - DNA, 25 bp, Mus musculus
actgtgttactttctccttcatttt

SEQ ID NO: 133168 - DNA, 25 bp, Mus musculus
actgtgttactttgcgaagctggat

SEQ ID NO: 133169 - DNA, 25 bp, Mus musculus
actgtgttagtcatttttctgctgc

SEQ ID NO: 133170 - DNA, 25 bp, Mus musculus
actgtgttagtcttttttctgctgc

SEQ ID NO: 133171 - DNA, 25 bp, Mus musculus
actgtgttataaccactgaccctaa

SEQ ID NO: 133172 - DNA, 25 bp, Mus musculus
actgtgttataagcactgaccctaa

SEQ ID NO: 133173 - DNA, 25 bp, Mus musculus
actgtgttcaacaagaattcctatt

SEQ ID NO: 133174 - DNA, 25 bp, Mus musculus
actgtgttcaactagaattcctatt

SEQ ID NO: 133175 - DNA, 25 bp, Mus musculus
actgtgttcaagacgtctggtattg

SEQ ID NO: 133176 - DNA, 25 bp, Mus musculus
actgtgttcaagcttggcaaccacc

SEQ ID NO: 133177 - DNA, 25 bp, Mus musculus
actgtgttcaaggttggcaaccacc

SEQ ID NO: 133178 - DNA, 25 bp, Mus musculus
actgtgttcaagtcgtctggtattg

SEQ ID NO: 133179 - DNA, 25 bp, Mus musculus
actgtgttcactcagagtaccacct

SEQ ID NO: 133180 - DNA, 25 bp, Mus musculus
actgtgttcactgagagtaccacct

SEQ ID NO: 133181 - DNA, 25 bp, Mus musculus
actgtgttcctcattagttcaatag

SEQ ID NO: 133182 - DNA, 25 bp, Mus musculus
actgtgttcctctttagttcaatag

SEQ ID NO: 133183 - DNA, 25 bp, Mus musculus
actgtgttcctgagcactgtggaga

SEQ ID NO: 133184 - DNA, 25 bp, Mus musculus
actgtgttcctgtgcactgtggaga

SEQ ID NO: 133185 - DNA, 25 bp, Mus musculus
actgtgttcggtagtgtgattctga

SEQ ID NO: 133186 - DNA, 25 bp, Mus musculus
actgtgttcggttgtgtgattctga

SEQ ID NO: 133187 - DNA, 25 bp, Mus musculus
actgtgttctccctggcattcagag

SEQ ID NO: 133188 - DNA, 25 bp, Mus musculus
actgtgttctccgtggcattcagag

SEQ ID NO: 133189 - DNA, 25 bp, Mus musculus
actgtgttctgacgcatcgctctaa

SEQ ID NO: 133190 - DNA, 25 bp, Mus musculus
actgtgttctgaggcatcgctctaa

SEQ ID NO: 133191 - DNA, 25 bp, Mus musculus
actgtgttctggcagttcatctaca

SEQ ID NO: 133192 - DNA, 25 bp, Mus musculus
actgtgttctgggagttcatctaca

SEQ ID NO: 133193 - DNA, 25 bp, Mus musculus
actgtgttcttgaatcatcgtcctt

SEQ ID NO: 133194 - DNA, 25 bp, Mus musculus
actgtgttcttgtatcatcgtcctt

SEQ ID NO: 133195 - DNA, 25 bp, Mus musculus
actgtgttgacaccatgggcagaca

SEQ ID NO: 133196 - DNA, 25 bp, Mus musculus
actgtgttgacagcatgggcagaca

SEQ ID NO: 133197 - DNA, 25 bp, Mus musculus
actgtgttgactaactagggctttt

SEQ ID NO: 133198 - DNA, 25 bp, Mus musculus
actgtgttgacttactagggctttt

SEQ ID NO: 133199 - DNA, 25 bp, Mus musculus
actgtgttgccaaacaaaccttggg

SEQ ID NO: 133200 - DNA, 25 bp, Mus musculus
actgtgttgccatacaaaccttggg

SEQ ID NO: 133201 - DNA, 25 bp, Mus musculus
actgtgttgcccaaactggttttct

SEQ ID NO: 133202 - DNA, 25 bp, Mus musculus
actgtgttgcccaaattggccatga

SEQ ID NO: 133203 - DNA, 25 bp, Mus musculus
actgtgttgccctaactggttttct

SEQ ID NO: 133204 - DNA, 25 bp, Mus musculus
actgtgttgccctaattggccatga

SEQ ID NO: 133205 - DNA, 25 bp, Mus musculus
actgtgttgctcaggaatttgattt

SEQ ID NO: 133206 - DNA, 25 bp, Mus musculus
actgtgttgctctggaatttgattt

SEQ ID NO: 133207 - DNA, 25 bp, Mus musculus
actgtgttgggcatcagtgagcccc

SEQ ID NO: 133208 - DNA, 25 bp, Mus musculus
actgtgttgggcttcagtgagcccc

SEQ ID NO: 133209 - DNA, 25 bp, Mus musculus
actgtgttggtcactcttcttcaaa

SEQ ID NO: 133210 - DNA, 25 bp, Mus musculus
actgtgttggtctctcttcttcaaa

SEQ ID NO: 133211 - DNA, 25 bp, Mus musculus
actgtgttgtaaattcggtgctcta

SEQ ID NO: 133212 - DNA, 25 bp, Mus musculus
actgtgttgtaatttcggtgctcta

SEQ ID NO: 133213 - DNA, 25 bp, Mus musculus
actgtgttgtggaatcactgggccc

SEQ ID NO: 133214 - DNA, 25 bp, Mus musculus
actgtgttgtggtatcactgggccc

SEQ ID NO: 133215 - DNA, 25 bp, Mus musculus
actgtgtttggtaccagcatttgtt

SEQ ID NO: 133216 - DNA, 25 bp, Mus musculus
actgtgtttggtcagccccaggcta

SEQ ID NO: 133217 - DNA, 25 bp, Mus musculus
actgtgtttggtgagccccaggcta

SEQ ID NO: 133218 - DNA, 25 bp, Mus musculus
actgtgtttggttccagcatttgtt

SEQ ID NO: 133219 - DNA, 25 bp, Mus musculus
actgtgttttctctcgcctcttttt

SEQ ID NO: 133220 - DNA, 25 bp, Mus musculus
actgtgttttctgtcgcctcttttt

SEQ ID NO: 133221 - DNA, 25 bp, Mus musculus
actgtgttttgcattgagcttcgaa

SEQ ID NO: 133222 - DNA, 25 bp, Mus musculus
actgtgttttgctttgagcttcgaa

SEQ ID NO: 133223 - DNA, 25 bp, Mus musculus
actgtgtttttacctcagagtgaag

SEQ ID NO: 133224 - DNA, 25 bp, Mus musculus
actgtgtttttagctcagagtgaag

SEQ ID NO: 133225 - DNA, 25 bp, Mus musculus
actgttaaaagtatcattcctgagg

SEQ ID NO: 133226 - DNA, 25 bp, Mus musculus
actgttaaaagtttcattcctgagg

SEQ ID NO: 133227 - DNA, 25 bp, Mus musculus
actgttaacctgacccctggtgaga

SEQ ID NO: 133228 - DNA, 25 bp, Mus musculus
actgttaacctgtcccctggtgaga

SEQ ID NO: 133229 - DNA, 25 bp, Mus musculus
actgttaagaatcattcctagtgct

SEQ ID NO: 133230 - DNA, 25 bp, Mus musculus
actgttaagaatgattcctagtgct

SEQ ID NO: 133231 - DNA, 25 bp, Mus musculus
actgttaagatgaagttgctgacac

SEQ ID NO: 133232 - DNA, 25 bp, Mus musculus
actgttaagatgtagttgctgacac

SEQ ID NO: 133233 - DNA, 25 bp, Mus musculus
actgttacacagacttggatcaagg

SEQ ID NO: 133234 - DNA, 25 bp, Mus musculus
actgttacacagtcttggatcaagg

SEQ ID NO: 133235 - DNA, 25 bp, Mus musculus
actgttacctgaacttatgctaaat

SEQ ID NO: 133236 - DNA, 25 bp, Mus musculus
actgttacctgatcttatgctaaat

SEQ ID NO: 133237 - DNA, 25 bp, Mus musculus
actgttacggtacgtgaccctcaca

SEQ ID NO: 133238 - DNA, 25 bp, Mus musculus
actgttacggtaggtgaccctcaca

SEQ ID NO: 133239 - DNA, 25 bp, Mus musculus
actgttactctgaccttaggctatc

SEQ ID NO: 133240 - DNA, 25 bp, Mus musculus
actgttactctgtccttaggctatc

SEQ ID NO: 133241 - DNA, 25 bp, Mus musculus
actgttagacagacacctgggagac

SEQ ID NO: 133242 - DNA, 25 bp, Mus musculus
actgttagacagtcacctgggagac

SEQ ID NO: 133243 - DNA, 25 bp, Mus musculus
actgttagctagacatgctccccaa

SEQ ID NO: 133244 - DNA, 25 bp, Mus musculus
actgttagctagtcatgctccccaa

SEQ ID NO: 133245 - DNA, 25 bp, Mus musculus
actgttagtgctaacttctatggga

SEQ ID NO: 133246 - DNA, 25 bp, Mus musculus
actgttagtgcttacttctatggga

SEQ ID NO: 133247 - DNA, 25 bp, Mus musculus
actgttataacaactttgctgcttg

SEQ ID NO: 133248 - DNA, 25 bp, Mus musculus
actgttataacatctttgctgcttg

SEQ ID NO: 133249 - DNA, 25 bp, Mus musculus
actgttataattactgtgcactgaa

SEQ ID NO: 133250 - DNA, 25 bp, Mus musculus
actgttataatttctgtgcactgaa

SEQ ID NO: 133251 - DNA, 25 bp, Mus musculus
actgttatccggactggctttgaac

SEQ ID NO: 133252 - DNA, 25 bp, Mus musculus
actgttatccggtctggctttgaac

SEQ ID NO: 133253 - DNA, 25 bp, Mus musculus
actgttatccgtattgcttcatcta

SEQ ID NO: 133254 - DNA, 25 bp, Mus musculus
actgttatccgttttgcttcatcta

SEQ ID NO: 133255 - DNA, 25 bp, Mus musculus
actgttatgggtctttggtatagcc

SEQ ID NO: 133256 - DNA, 25 bp, Mus musculus
actgttatgggtgtttggtatagcc

SEQ ID NO: 133257 - DNA, 25 bp, Mus musculus
actgttatgtagatcggatagctta

SEQ ID NO: 133258 - DNA, 25 bp, Mus musculus
actgttatgtagttcggatagctta

SEQ ID NO: 133259 - DNA, 25 bp, Mus musculus
actgttattcatacacgtgtccatg

SEQ ID NO: 133260 - DNA, 25 bp, Mus musculus
actgttattcattcacgtgtccatg

SEQ ID NO: 133261 - DNA, 25 bp, Mus musculus
actgttattcctctctattcattat

SEQ ID NO: 133262 - DNA, 25 bp, Mus musculus
actgttattcctgtctattcattat

SEQ ID NO: 133263 - DNA, 25 bp, Mus musculus
actgttatttacattctacattaga

SEQ ID NO: 133264 - DNA, 25 bp, Mus musculus
actgttatttactttctacattaga

SEQ ID NO: 133265 - DNA, 25 bp, Mus musculus
actgttatttcaccaccatgacatc

SEQ ID NO: 133266 - DNA, 25 bp, Mus musculus
actgttatttcagcaccatgacatc

SEQ ID NO: 133267 - DNA, 25 bp, Mus musculus
actgttcaacttaccaaaatgcctt

SEQ ID NO: 133268 - DNA, 25 bp, Mus musculus
actgttcaactttccaaaatgcctt

SEQ ID NO: 133269 - DNA, 25 bp, Mus musculus
actgttcaatggacttcacaaccca

SEQ ID NO: 133270 - DNA, 25 bp, Mus musculus
actgttcaatggtcttcacaaccca

SEQ ID NO: 133271 - DNA, 25 bp, Mus musculus
actgttcacctaccatctaaccatg

SEQ ID NO: 133272 - DNA, 25 bp, Mus musculus
actgttcacctagcatctaaccatg

SEQ ID NO: 133273 - DNA, 25 bp, Mus musculus
actgttcacgcaactgctgtagcag

SEQ ID NO: 133274 - DNA, 25 bp, Mus musculus
actgttcacgcatctgctgtagcag

SEQ ID NO: 133275 - DNA, 25 bp, Mus musculus
actgttcagggtaggtggagtccat

SEQ ID NO: 133276 - DNA, 25 bp, Mus musculus
actgttcagggttggtggagtccat

SEQ ID NO: 133277 - DNA, 25 bp, Mus musculus
actgttcagttaactaaggaacaat

SEQ ID NO: 133278 - DNA, 25 bp, Mus musculus
actgttcagttatctaaggaacaat

SEQ ID NO: 133279 - DNA, 25 bp, Mus musculus
actgttcatatcattggttcattct

SEQ ID NO: 133280 - DNA, 25 bp, Mus musculus
actgttcatatctttggttcattct

SEQ ID NO: 133281 - DNA, 25 bp, Mus musculus
actgttcatcgcagtagcaacaaaa

SEQ ID NO: 133282 - DNA, 25 bp, Mus musculus
actgttcatcgctgtagcaacaaaa

SEQ ID NO: 133283 - DNA, 25 bp, Mus musculus
actgttcatgacattaactatctaa

SEQ ID NO: 133284 - DNA, 25 bp, Mus musculus
actgttcatgactttaactatctaa

SEQ ID NO: 133285 - DNA, 25 bp, Mus musculus
actgttcatgatattcttcctttag

SEQ ID NO: 133286 - DNA, 25 bp, Mus musculus
actgttcatgattttcttcctttag

SEQ ID NO: 133287 - DNA, 25 bp, Mus musculus
actgttcattccatgtctgatgtga

SEQ ID NO: 133288 - DNA, 25 bp, Mus musculus
actgttcattccttgtctgatgtga

SEQ ID NO: 133289 - DNA, 25 bp, Mus musculus
actgttcattggactgtgtgtgcac

SEQ ID NO: 133290 - DNA, 25 bp, Mus musculus
actgttcattggtctgtgtgtgcac

SEQ ID NO: 133291 - DNA, 25 bp, Mus musculus
actgttccaatgagcacgtcttcta

SEQ ID NO: 133292 - DNA, 25 bp, Mus musculus
actgttccaatgtgcacgtcttcta

SEQ ID NO: 133293 - DNA, 25 bp, Mus musculus
actgttccaccaagactgtgtgttt

SEQ ID NO: 133294 - DNA, 25 bp, Mus musculus
actgttccaccatgactgtgtgttt

SEQ ID NO: 133295 - DNA, 25 bp, Mus musculus
actgttccaccgatttctgcatatg

SEQ ID NO: 133296 - DNA, 25 bp, Mus musculus
actgttccaccgttttctgcatatg

SEQ ID NO: 133297 - DNA, 25 bp, Mus musculus
actgttccagaacgttgcaaatgaa

SEQ ID NO: 133298 - DNA, 25 bp, Mus musculus
actgttccagaaggttgcaaatgaa

SEQ ID NO: 133299 - DNA, 25 bp, Mus musculus
actgttccaggtcctgggaccccgg

SEQ ID NO: 133300 - DNA, 25 bp, Mus musculus
actgttccaggtgctgggaccccgg

SEQ ID NO: 133301 - DNA, 25 bp, Mus musculus
actgttccctctatctacaaagtct

SEQ ID NO: 133302 - DNA, 25 bp, Mus musculus
actgttccctctttctacaaagtct

SEQ ID NO: 133303 - DNA, 25 bp, Mus musculus
actgttccggaaatcacgcctggta

SEQ ID NO: 133304 - DNA, 25 bp, Mus musculus
actgttccggaattcacgcctggta

SEQ ID NO: 133305 - DNA, 25 bp, Mus musculus
actgttcctaaacttacccactgag

SEQ ID NO: 133306 - DNA, 25 bp, Mus musculus
actgttcctaaagttacccactgag

SEQ ID NO: 133307 - DNA, 25 bp, Mus musculus
actgttcctatgagaagtaaattgc

SEQ ID NO: 133308 - DNA, 25 bp, Mus musculus
actgttcctatgtgaagtaaattgc

SEQ ID NO: 133309 - DNA, 25 bp, Mus musculus
actgttcctccgaggtctgagttca

SEQ ID NO: 133310 - DNA, 25 bp, Mus musculus
actgttcctccgcaggattgtagcc

SEQ ID NO: 133311 - DNA, 25 bp, Mus musculus
actgttcctccggaggattgtagcc

SEQ ID NO: 133312 - DNA, 25 bp, Mus musculus
actgttcctccgtggtctgagttca

SEQ ID NO: 133313 - DNA, 25 bp, Mus musculus
actgttcctgatcggtaattgggct

SEQ ID NO: 133314 - DNA, 25 bp, Mus musculus
actgttcctgatgggtaattgggct

SEQ ID NO: 133315 - DNA, 25 bp, Mus musculus
actgttcctgcaaccacgatcgctt

SEQ ID NO: 133316 - DNA, 25 bp, Mus musculus
actgttcctgcatccacgatcgctt

SEQ ID NO: 133317 - DNA, 25 bp, Mus musculus
actgttccttatatcatactgtccc

SEQ ID NO: 133318 - DNA, 25 bp, Mus musculus
actgttccttatttcatactgtccc

SEQ ID NO: 133319 - DNA, 25 bp, Mus musculus
actgttccttgaaagcacatcatgt

SEQ ID NO: 133320 - DNA, 25 bp, Mus musculus
actgttccttgatagcacatcatgt

SEQ ID NO: 133321 - DNA, 25 bp, Mus musculus
actgttcgttccaaaagctgctatc

SEQ ID NO: 133322 - DNA, 25 bp, Mus musculus
actgttcgttcctaaagctgctatc

SEQ ID NO: 133323 - DNA, 25 bp, Mus musculus
actgttctaattctctatttccttg

SEQ ID NO: 133324 - DNA, 25 bp, Mus musculus
actgttctaattgtctatttccttg

SEQ ID NO: 133325 - DNA, 25 bp, Mus musculus
actgttctcacacactacatgcata

SEQ ID NO: 133326 - DNA, 25 bp, Mus musculus
actgttctcacagactacatgcata

SEQ ID NO: 133327 - DNA, 25 bp, Mus musculus
actgttctcagaacctatggtggtc

SEQ ID NO: 133328 - DNA, 25 bp, Mus musculus
actgttctcagatcctatggtggtc

SEQ ID NO: 133329 - DNA, 25 bp, Mus musculus
actgttctccaacgcttcgtgttga

SEQ ID NO: 133330 - DNA, 25 bp, Mus musculus
actgttctccaaggcttcgtgttga

SEQ ID NO: 133331 - DNA, 25 bp, Mus musculus
actgttctcctgaggcactgactat

SEQ ID NO: 133332 - DNA, 25 bp, Mus musculus
actgttctcctgtggcactgactat

SEQ ID NO: 133333 - DNA, 25 bp, Mus musculus
actgttctcttgaaccgctgtatta

SEQ ID NO: 133334 - DNA, 25 bp, Mus musculus
actgttctcttgtaccgctgtatta

SEQ ID NO: 133335 - DNA, 25 bp, Mus musculus
actgttctgcctagaaaggctaatg

SEQ ID NO: 133336 - DNA, 25 bp, Mus musculus
actgttctgccttgaaaggctaatg

SEQ ID NO: 133337 - DNA, 25 bp, Mus musculus
actgttctggtgactataagatgtc

SEQ ID NO: 133338 - DNA, 25 bp, Mus musculus
actgttctggtgtctataagatgtc

SEQ ID NO: 133339 - DNA, 25 bp, Mus musculus
actgttctgtcaatgcttggcatgt

SEQ ID NO: 133340 - DNA, 25 bp, Mus musculus
actgttctgtcattgcttggcatgt

SEQ ID NO: 133341 - DNA, 25 bp, Mus musculus
actgttctgtgactccctgggtgag

SEQ ID NO: 133342 - DNA, 25 bp, Mus musculus
actgttctgtgagtccctgggtgag

SEQ ID NO: 133343 - DNA, 25 bp, Mus musculus
actgttctgtggcactcataatctg

SEQ ID NO: 133344 - DNA, 25 bp, Mus musculus
actgttctgtgggactcataatctg

SEQ ID NO: 133345 - DNA, 25 bp, Mus musculus
actgttctgttgaatcttctgtcta

SEQ ID NO: 133346 - DNA, 25 bp, Mus musculus
actgttctgttgtatcttctgtcta

SEQ ID NO: 133347 - DNA, 25 bp, Mus musculus
actgttcttatgatttcctccaagg

SEQ ID NO: 133348 - DNA, 25 bp, Mus musculus
actgttcttatgttttcctccaagg

SEQ ID NO: 133349 - DNA, 25 bp, Mus musculus
actgttcttcataccttatgacttg

SEQ ID NO: 133350 - DNA, 25 bp, Mus musculus
actgttcttcattccttatgacttg

SEQ ID NO: 133351 - DNA, 25 bp, Mus musculus
actgttcttctgaatgttcctgggt

SEQ ID NO: 133352 - DNA, 25 bp, Mus musculus
actgttcttctgtatgttcctgggt

SEQ ID NO: 133353 - DNA, 25 bp, Mus musculus
actgttcttgccactggtgagatat

SEQ ID NO: 133354 - DNA, 25 bp, Mus musculus
actgttcttgcctctggtgagatat

SEQ ID NO: 133355 - DNA, 25 bp, Mus musculus
actgttgaacagactcttcagccca

SEQ ID NO: 133356 - DNA, 25 bp, Mus musculus
actgttgaacagtctcttcagccca

SEQ ID NO: 133357 - DNA, 25 bp, Mus musculus
actgttgaataaaacctaggattag

SEQ ID NO: 133358 - DNA, 25 bp, Mus musculus
actgttgaataatacctaggattag

SEQ ID NO: 133359 - DNA, 25 bp, Mus musculus
actgttgacaggatttctgattcca

SEQ ID NO: 133360 - DNA, 25 bp, Mus musculus
actgttgacaggttttctgattcca

SEQ ID NO: 133361 - DNA, 25 bp, Mus musculus
actgttgagctgaagttagaatact

SEQ ID NO: 133362 - DNA, 25 bp, Mus musculus
actgttgagctgtagttagaatact

SEQ ID NO: 133363 - DNA, 25 bp, Mus musculus
actgttgatcggagctttctgtaaa

SEQ ID NO: 133364 - DNA, 25 bp, Mus musculus
actgttgatcggtgctttctgtaaa

SEQ ID NO: 133365 - DNA, 25 bp, Mus musculus
actgttgatgtcaaagtatgcctca

SEQ ID NO: 133366 - DNA, 25 bp, Mus musculus
actgttgatgtctaagtatgcctca

SEQ ID NO: 133367 - DNA, 25 bp, Mus musculus
actgttgatgtgattgggtgtttcc

SEQ ID NO: 133368 - DNA, 25 bp, Mus musculus
actgttgatgtgtttgggtgtttcc

SEQ ID NO: 133369 - DNA, 25 bp, Mus musculus
actgttgcaacactgccctgaaaca

SEQ ID NO: 133370 - DNA, 25 bp, Mus musculus
actgttgcaacagtgccctgaaaca

SEQ ID NO: 133371 - DNA, 25 bp, Mus musculus
actgttgcattgatggcaataacga

SEQ ID NO: 133372 - DNA, 25 bp, Mus musculus
actgttgcattgttggcaataacga

SEQ ID NO: 133373 - DNA, 25 bp, Mus musculus
actgttgccaacacctagcattaag

SEQ ID NO: 133374 - DNA, 25 bp, Mus musculus
actgttgccaactcctagcattaag

SEQ ID NO: 133375 - DNA, 25 bp, Mus musculus
actgttgccacaatagcactgtcta

SEQ ID NO: 133376 - DNA, 25 bp, Mus musculus
actgttgccacattagcactgtcta

SEQ ID NO: 133377 - DNA, 25 bp, Mus musculus
actgttgccagtcgatgtcatccaa

SEQ ID NO: 133378 - DNA, 25 bp, Mus musculus
actgttgccagtggatgtcatccaa

SEQ ID NO: 133379 - DNA, 25 bp, Mus musculus
actgttgccccaattggctttgagg

SEQ ID NO: 133380 - DNA, 25 bp, Mus musculus
actgttgccccatttggctttgagg

SEQ ID NO: 133381 - DNA, 25 bp, Mus musculus
actgttgccttgaactgaagactga

SEQ ID NO: 133382 - DNA, 25 bp, Mus musculus
actgttgccttgtactgaagactga

SEQ ID NO: 133383 - DNA, 25 bp, Mus musculus
actgttgctcacctctgaggcaaaa

SEQ ID NO: 133384 - DNA, 25 bp, Mus musculus
actgttgctcacgtctgaggcaaaa

SEQ ID NO: 133385 - DNA, 25 bp, Mus musculus
actgttgctcagcagcttctgcaga

SEQ ID NO: 133386 - DNA, 25 bp, Mus musculus
actgttgctcaggagcttctgcaga

SEQ ID NO: 133387 - DNA, 25 bp, Mus musculus
actgttgctcttatgtgtattctcg

SEQ ID NO: 133388 - DNA, 25 bp, Mus musculus
actgttgctcttttgtgtattctcg

SEQ ID NO: 133389 - DNA, 25 bp, Mus musculus
actgttgctgccctttcatgacttt

SEQ ID NO: 133390 - DNA, 25 bp, Mus musculus
actgttgctgccgtttcatgacttt

SEQ ID NO: 133391 - DNA, 25 bp, Mus musculus
actgttgctgctctcatctggccta

SEQ ID NO: 133392 - DNA, 25 bp, Mus musculus
actgttgctgctgtcatctggccta

SEQ ID NO: 133393 - DNA, 25 bp, Mus musculus
actgttgctggtcttctctagagac

SEQ ID NO: 133394 - DNA, 25 bp, Mus musculus
actgttgctggtgttctctagagac

SEQ ID NO: 133395 - DNA, 25 bp, Mus musculus
actgttgctgttcttagttcttagc

SEQ ID NO: 133396 - DNA, 25 bp, Mus musculus
actgttgctgttgttagttcttagc

SEQ ID NO: 133397 - DNA, 25 bp, Mus musculus
actgttgcttagacgggaggctggt

SEQ ID NO: 133398 - DNA, 25 bp, Mus musculus
actgttgcttagtcgggaggctggt

SEQ ID NO: 133399 - DNA, 25 bp, Mus musculus
actgttggacatcgccgaacttttc

SEQ ID NO: 133400 - DNA, 25 bp, Mus musculus
actgttggacatggccgaacttttc

SEQ ID NO: 133401 - DNA, 25 bp, Mus musculus
actgttggactaccggttcaggaag

SEQ ID NO: 133402 - DNA, 25 bp, Mus musculus
actgttggactagcggttcaggaag

SEQ ID NO: 133403 - DNA, 25 bp, Mus musculus
actgttggattcaaggcattcctga

SEQ ID NO: 133404 - DNA, 25 bp, Mus musculus
actgttggattctaggcattcctga

SEQ ID NO: 133405 - DNA, 25 bp, Mus musculus
actgttggcaggctttaagcataaa

SEQ ID NO: 133406 - DNA, 25 bp, Mus musculus
actgttggcagggtttaagcataaa

SEQ ID NO: 133407 - DNA, 25 bp, Mus musculus
actgttggctggaagtgcttccatt

SEQ ID NO: 133408 - DNA, 25 bp, Mus musculus
actgttggctggctgaattcacatc

SEQ ID NO: 133409 - DNA, 25 bp, Mus musculus
actgttggctgggtgaattcacatc

SEQ ID NO: 133410 - DNA, 25 bp, Mus musculus
actgttggctggtagtgcttccatt

SEQ ID NO: 133411 - DNA, 25 bp, Mus musculus
actgttgggaaaagtgggccacttg

SEQ ID NO: 133412 - DNA, 25 bp, Mus musculus
actgttgggaaatgtgggccacttg

SEQ ID NO: 133413 - DNA, 25 bp, Mus musculus
actgttgggttgactggccttagca

SEQ ID NO: 133414 - DNA, 25 bp, Mus musculus
actgttgggttgtctggccttagca

SEQ ID NO: 133415 - DNA, 25 bp, Mus musculus
actgttggtaggatcttcatctcac

SEQ ID NO: 133416 - DNA, 25 bp, Mus musculus
actgttggtaggttcttcatctcac

SEQ ID NO: 133417 - DNA, 25 bp, Mus musculus
actgttggttcacgccattgagctt

SEQ ID NO: 133418 - DNA, 25 bp, Mus musculus
actgttggttcaggccattgagctt

SEQ ID NO: 133419 - DNA, 25 bp, Mus musculus
actgttggttgaactatgctgaaga

SEQ ID NO: 133420 - DNA, 25 bp, Mus musculus
actgttggttgatctatgctgaaga

SEQ ID NO: 133421 - DNA, 25 bp, Mus musculus
actgttgtaaaacaatgggtatcca

SEQ ID NO: 133422 - DNA, 25 bp, Mus musculus
actgttgtaaaagaatgggtatcca

SEQ ID NO: 133423 - DNA, 25 bp, Mus musculus
actgttgtaataattctggtgtcac

SEQ ID NO: 133424 - DNA, 25 bp, Mus musculus
actgttgtaatatttctggtgtcac

SEQ ID NO: 133425 - DNA, 25 bp, Mus musculus
actgttgtatggctcctggtgtttg

SEQ ID NO: 133426 - DNA, 25 bp, Mus musculus
actgttgtatgggtcctggtgtttg

SEQ ID NO: 133427 - DNA, 25 bp, Mus musculus
actgttgtcataccccagagcatgg

SEQ ID NO: 133428 - DNA, 25 bp, Mus musculus
actgttgtcatagcccagagcatgg

SEQ ID NO: 133429 - DNA, 25 bp, Mus musculus
actgttgtcctcatcacacaagtat

SEQ ID NO: 133430 - DNA, 25 bp, Mus musculus
actgttgtcctcttcacacaagtat

SEQ ID NO: 133431 - DNA, 25 bp, Mus musculus
actgttgtcctgaggaatgatggca

SEQ ID NO: 133432 - DNA, 25 bp, Mus musculus
actgttgtcctgtggaatgatggca

SEQ ID NO: 133433 - DNA, 25 bp, Mus musculus
actgttgtccttcaagtgtcttttt

SEQ ID NO: 133434 - DNA, 25 bp, Mus musculus
actgttgtccttgaagtgtcttttt

SEQ ID NO: 133435 - DNA, 25 bp, Mus musculus
actgttgtgataaatgttcttgtta

SEQ ID NO: 133436 - DNA, 25 bp, Mus musculus
actgttgtgatatatgttcttgtta

SEQ ID NO: 133437 - DNA, 25 bp, Mus musculus
actgttgttccgaaaacctgaggtg

SEQ ID NO: 133438 - DNA, 25 bp, Mus musculus
actgttgttccgtaaacctgaggtg

SEQ ID NO: 133439 - DNA, 25 bp, Mus musculus
actgttgttgaactacctatcccat

SEQ ID NO: 133440 - DNA, 25 bp, Mus musculus
actgttgttgaagtacctatcccat

SEQ ID NO: 133441 - DNA, 25 bp, Mus musculus
actgttgttggtacatttgccttgt

SEQ ID NO: 133442 - DNA, 25 bp, Mus musculus
actgttgttggttcatttgccttgt

SEQ ID NO: 133443 - DNA, 25 bp, Mus musculus
actgttgttttaactgcacatatgt

SEQ ID NO: 133444 - DNA, 25 bp, Mus musculus
actgttgttttatctgcacatatgt

SEQ ID NO: 133445 - DNA, 25 bp, Mus musculus
actgtttaacaacctgtgcatcccc

SEQ ID NO: 133446 - DNA, 25 bp, Mus musculus
actgtttaacaagctgtgcatcccc

SEQ ID NO: 133447 - DNA, 25 bp, Mus musculus
actgtttacctgcttattgttgaaa

SEQ ID NO: 133448 - DNA, 25 bp, Mus musculus
actgtttacctggttattgttgaaa

SEQ ID NO: 133449 - DNA, 25 bp, Mus musculus
actgtttactaacgaaatgttcact

SEQ ID NO: 133450 - DNA, 25 bp, Mus musculus
actgtttactaaggaaatgttcact

SEQ ID NO: 133451 - DNA, 25 bp, Mus musculus
actgtttagaccactgacgtttctt

SEQ ID NO: 133452 - DNA, 25 bp, Mus musculus
actgtttagacctctgacgtttctt

SEQ ID NO: 133453 - DNA, 25 bp, Mus musculus
actgtttagctaagttcaagcgcaa

SEQ ID NO: 133454 - DNA, 25 bp, Mus musculus
actgtttagctatgttcaagcgcaa

SEQ ID NO: 133455 - DNA, 25 bp, Mus musculus
actgtttaggtcaagtcttccttct

SEQ ID NO: 133456 - DNA, 25 bp, Mus musculus
actgtttaggtctagtcttccttct

SEQ ID NO: 133457 - DNA, 25 bp, Mus musculus
actgtttattctcatgcattctgat

SEQ ID NO: 133458 - DNA, 25 bp, Mus musculus
actgtttattctgatgcattctgat

SEQ ID NO: 133459 - DNA, 25 bp, Mus musculus
actgtttattgaacgcctgtccttt

SEQ ID NO: 133460 - DNA, 25 bp, Mus musculus
actgtttattgatcgcctgtccttt

SEQ ID NO: 133461 - DNA, 25 bp, Mus musculus
actgtttcaaaccaccctgggctat

SEQ ID NO: 133462 - DNA, 25 bp, Mus musculus
actgtttcaaacgaccctgggctat

SEQ ID NO: 133463 - DNA, 25 bp, Mus musculus
actgtttcaatgattacaccactct

SEQ ID NO: 133464 - DNA, 25 bp, Mus musculus
actgtttcaatgtttacaccactct

SEQ ID NO: 133465 - DNA, 25 bp, Mus musculus
actgtttccacgcctgaagttgcgg

SEQ ID NO: 133466 - DNA, 25 bp, Mus musculus
actgtttccacggctgaagttgcgg

SEQ ID NO: 133467 - DNA, 25 bp, Mus musculus
actgtttccccaaggacttgaatgt

SEQ ID NO: 133468 - DNA, 25 bp, Mus musculus
actgtttccccatggacttgaatgt

SEQ ID NO: 133469 - DNA, 25 bp, Mus musculus
actgtttccctgcataatacagaat

SEQ ID NO: 133470 - DNA, 25 bp, Mus musculus
actgtttccctggataatacagaat

SEQ ID NO: 133471 - DNA, 25 bp, Mus musculus
actgtttcgcatagcttgtagctat

SEQ ID NO: 133472 - DNA, 25 bp, Mus musculus
actgtttcgcattgcttgtagctat

SEQ ID NO: 133473 - DNA, 25 bp, Mus musculus
actgtttctaagaccagggagccca

SEQ ID NO: 133474 - DNA, 25 bp, Mus musculus
actgtttctaagtccagggagccca

SEQ ID NO: 133475 - DNA, 25 bp, Mus musculus
actgtttctcagctccaattgttag

SEQ ID NO: 133476 - DNA, 25 bp, Mus musculus
actgtttctcaggtccaattgttag

SEQ ID NO: 133477 - DNA, 25 bp, Mus musculus
actgtttctccgaggacagacaaca

SEQ ID NO: 133478 - DNA, 25 bp, Mus musculus
actgtttctccgtggacagacaaca

SEQ ID NO: 133479 - DNA, 25 bp, Mus musculus
actgtttctctaatcacgaactcct

SEQ ID NO: 133480 - DNA, 25 bp, Mus musculus
actgtttctctattcacgaactcct

SEQ ID NO: 133481 - DNA, 25 bp, Mus musculus
actgtttctgccatgcacggagata

SEQ ID NO: 133482 - DNA, 25 bp, Mus musculus
actgtttctgccttgcacggagata

SEQ ID NO: 133483 - DNA, 25 bp, Mus musculus
actgtttcttcccaaatatgcactc

SEQ ID NO: 133484 - DNA, 25 bp, Mus musculus
actgtttcttccgaaatatgcactc

SEQ ID NO: 133485 - DNA, 25 bp, Mus musculus
actgtttgaaacagtgtgtagaggc

SEQ ID NO: 133486 - DNA, 25 bp, Mus musculus
actgtttgaaactgtgtgtagaggc

SEQ ID NO: 133487 - DNA, 25 bp, Mus musculus
actgtttgacagaggtgccctatgg

SEQ ID NO: 133488 - DNA, 25 bp, Mus musculus
actgtttgacagtggtgccctatgg

SEQ ID NO: 133489 - DNA, 25 bp, Mus musculus
actgtttgagtcagtggcatgcccg

SEQ ID NO: 133490 - DNA, 25 bp, Mus musculus
actgtttgagtcatgatgccctggc

SEQ ID NO: 133491 - DNA, 25 bp, Mus musculus
actgtttgagtctgtggcatgcccg

SEQ ID NO: 133492 - DNA, 25 bp, Mus musculus
actgtttgagtcttgatgccctggc

SEQ ID NO: 133493 - DNA, 25 bp, Mus musculus
actgtttgcagtaaatgttcttgtt

SEQ ID NO: 133494 - DNA, 25 bp, Mus musculus
actgtttgcagttaatgttcttgtt

SEQ ID NO: 133495 - DNA, 25 bp, Mus musculus
actgtttgctgtactgtctttgtca

SEQ ID NO: 133496 - DNA, 25 bp, Mus musculus
actgtttgctgttctgtctttgtca

SEQ ID NO: 133497 - DNA, 25 bp, Mus musculus
actgtttgcttgacctcaaggtacc

SEQ ID NO: 133498 - DNA, 25 bp, Mus musculus
actgtttgcttgtcctcaaggtacc

SEQ ID NO: 133499 - DNA, 25 bp, Mus musculus
actgtttggcagcagtctgactggc

SEQ ID NO: 133500 - DNA, 25 bp, Mus musculus
actgtttggcaggagtctgactggc

SEQ ID NO: 133501 - DNA, 25 bp, Mus musculus
actgtttggcttcatctattcccat

SEQ ID NO: 133502 - DNA, 25 bp, Mus musculus
actgtttggcttgatctattcccat

SEQ ID NO: 133503 - DNA, 25 bp, Mus musculus
actgtttgggacacagaccttagcc

SEQ ID NO: 133504 - DNA, 25 bp, Mus musculus
actgtttgggactcagaccttagcc

SEQ ID NO: 133505 - DNA, 25 bp, Mus musculus
actgtttggtcaaccttggaagcca

SEQ ID NO: 133506 - DNA, 25 bp, Mus musculus
actgtttggtcatccttggaagcca

SEQ ID NO: 133507 - DNA, 25 bp, Mus musculus
actgtttgtcgcatgtgactcactg

SEQ ID NO: 133508 - DNA, 25 bp, Mus musculus
actgtttgtcgcttgtgactcactg

SEQ ID NO: 133509 - DNA, 25 bp, Mus musculus
actgtttgtgtcatcactttgggag

SEQ ID NO: 133510 - DNA, 25 bp, Mus musculus
actgtttgtgtcttcactttgggag

SEQ ID NO: 133511 - DNA, 25 bp, Mus musculus
actgtttgttgactaggtttttgat

SEQ ID NO: 133512 - DNA, 25 bp, Mus musculus
actgtttgttgagtaggtttttgat

SEQ ID NO: 133513 - DNA, 25 bp, Mus musculus
actgttttaaacctttgtgtgctgg

SEQ ID NO: 133514 - DNA, 25 bp, Mus musculus
actgttttaaacgtttgtgtgctgg

SEQ ID NO: 133515 - DNA, 25 bp, Mus musculus
actgttttaattatactgttcttca

SEQ ID NO: 133516 - DNA, 25 bp, Mus musculus
actgttttaattttactgttcttca

SEQ ID NO: 133517 - DNA, 25 bp, Mus musculus
actgttttacagatctcttgttcag

SEQ ID NO: 133518 - DNA, 25 bp, Mus musculus
actgttttacagttctcttgttcag

SEQ ID NO: 133519 - DNA, 25 bp, Mus musculus
actgttttaccacccaagcttgtgc

SEQ ID NO: 133520 - DNA, 25 bp, Mus musculus
actgttttaccagccaagcttgtgc

SEQ ID NO: 133521 - DNA, 25 bp, Mus musculus
actgttttagcactgcacgttcact

SEQ ID NO: 133522 - DNA, 25 bp, Mus musculus
actgttttagcagtgcacgttcact

SEQ ID NO: 133523 - DNA, 25 bp, Mus musculus
actgttttagttcttccaaggatgg

SEQ ID NO: 133524 - DNA, 25 bp, Mus musculus
actgttttagttgttccaaggatgg

SEQ ID NO: 133525 - DNA, 25 bp, Mus musculus
actgttttcacaactaacttgtctc

SEQ ID NO: 133526 - DNA, 25 bp, Mus musculus
actgttttcacatctaacttgtctc

SEQ ID NO: 133527 - DNA, 25 bp, Mus musculus
actgttttcaggagagccgggtgaa

SEQ ID NO: 133528 - DNA, 25 bp, Mus musculus
actgttttcaggtgagccgggtgaa

SEQ ID NO: 133529 - DNA, 25 bp, Mus musculus
actgttttcagtatccaagatggtg

SEQ ID NO: 133530 - DNA, 25 bp, Mus musculus
actgttttcagtttccaagatggtg

SEQ ID NO: 133531 - DNA, 25 bp, Mus musculus
actgttttctgtctgcttatttgcg

SEQ ID NO: 133532 - DNA, 25 bp, Mus musculus
actgttttctgtgtgcttatttgcg

SEQ ID NO: 133533 - DNA, 25 bp, Mus musculus
actgttttgattctgtcccatctga

SEQ ID NO: 133534 - DNA, 25 bp, Mus musculus
actgttttgattgtgtcccatctga

SEQ ID NO: 133535 - DNA, 25 bp, Mus musculus
actgttttgtacctctcattgcttt

SEQ ID NO: 133536 - DNA, 25 bp, Mus musculus
actgttttgtacgtctcattgcttt

SEQ ID NO: 133537 - DNA, 25 bp, Mus musculus
actgttttgtctcttccatgtatag

SEQ ID NO: 133538 - DNA, 25 bp, Mus musculus
actgttttgtctgttccatgtatag

SEQ ID NO: 133539 - DNA, 25 bp, Mus musculus
actgtttttaacactaagccacagt

SEQ ID NO: 133540 - DNA, 25 bp, Mus musculus
actgtttttaactctaagccacagt

SEQ ID NO: 133541 - DNA, 25 bp, Mus musculus
actgtttttaagaatctgtgactgt

SEQ ID NO: 133542 - DNA, 25 bp, Mus musculus
actgtttttaagtatctgtgactgt

SEQ ID NO: 133543 - DNA, 25 bp, Mus musculus
actgtttttacaccacactgtacta

SEQ ID NO: 133544 - DNA, 25 bp, Mus musculus
actgtttttacacgcaatgtggaaa

SEQ ID NO: 133545 - DNA, 25 bp, Mus musculus
actgtttttacagcacactgtacta

SEQ ID NO: 133546 - DNA, 25 bp, Mus musculus
actgtttttacaggcaatgtggaaa

SEQ ID NO: 133547 - DNA, 25 bp, Mus musculus
actgtttttggtaatacatgcctcc

SEQ ID NO: 133548 - DNA, 25 bp, Mus musculus
actgtttttggttatacatgcctcc

SEQ ID NO: 133549 - DNA, 25 bp, Mus musculus
actgtttttgtcctgtctctacttt

SEQ ID NO: 133550 - DNA, 25 bp, Mus musculus
actgtttttgtcgtgtctctacttt

SEQ ID NO: 133551 - DNA, 25 bp, Mus musculus
acttaaaatctgaagaaggcaacat

SEQ ID NO: 133552 - DNA, 25 bp, Mus musculus
acttaaaatctgtagaaggcaacat

SEQ ID NO: 133553 - DNA, 25 bp, Mus musculus
acttaaactctactcagtctcacag

SEQ ID NO: 133554 - DNA, 25 bp, Mus musculus
acttaaactctagtcagtctcacag

SEQ ID NO: 133555 - DNA, 25 bp, Mus musculus
acttaaagactaagccccaccttca

SEQ ID NO: 133556 - DNA, 25 bp, Mus musculus
acttaaagactatgccccaccttca

SEQ ID NO: 133557 - DNA, 25 bp, Mus musculus
acttaaagatgtcaactccaggtca

SEQ ID NO: 133558 - DNA, 25 bp, Mus musculus
acttaaagatgtgaactccaggtca

SEQ ID NO: 133559 - DNA, 25 bp, Mus musculus
acttaaagcacgatccccagcgagc

SEQ ID NO: 133560 - DNA, 25 bp, Mus musculus
acttaaagcacgttccccagcgagc

SEQ ID NO: 133561 - DNA, 25 bp, Mus musculus
acttaaagctccagcaaaggaccca

SEQ ID NO: 133562 - DNA, 25 bp, Mus musculus
acttaaagctcctgcaaaggaccca

SEQ ID NO: 133563 - DNA, 25 bp, Mus musculus
acttaaaggcccaccagaggactca

SEQ ID NO: 133564 - DNA, 25 bp, Mus musculus
acttaaaggccctccagaggactca

SEQ ID NO: 133565 - DNA, 25 bp, Mus musculus
acttaaagggtcagggcatcatgtc

SEQ ID NO: 133566 - DNA, 25 bp, Mus musculus
acttaaagggtctgggcatcatgtc

SEQ ID NO: 133567 - DNA, 25 bp, Mus musculus
acttaaagtctcagctgtctatgga

SEQ ID NO: 133568 - DNA, 25 bp, Mus musculus
acttaaagtctctgctgtctatgga

SEQ ID NO: 133569 - DNA, 25 bp, Mus musculus
acttaaatactcacagggctcctat

SEQ ID NO: 133570 - DNA, 25 bp, Mus musculus
acttaaatactctcagggctcctat

SEQ ID NO: 133571 - DNA, 25 bp, Mus musculus
acttaaatcaaaccagctggctcag

SEQ ID NO: 133572 - DNA, 25 bp, Mus musculus
acttaaatcaaagcagctggctcag

SEQ ID NO: 133573 - DNA, 25 bp, Mus musculus
acttaaatcactccactgtatgctc

SEQ ID NO: 133574 - DNA, 25 bp, Mus musculus
acttaaatcactgcactgtatgctc

SEQ ID NO: 133575 - DNA, 25 bp, Mus musculus
acttaaatccgcagcacttaccact

SEQ ID NO: 133576 - DNA, 25 bp, Mus musculus
acttaaatccgctgcacttaccact

SEQ ID NO: 133577 - DNA, 25 bp, Mus musculus
acttaaatcggtacactgtatgctt

SEQ ID NO: 133578 - DNA, 25 bp, Mus musculus
acttaaatcggttcactgtatgctt

SEQ ID NO: 133579 - DNA, 25 bp, Mus musculus
acttaaatggctccctttacagaag

SEQ ID NO: 133580 - DNA, 25 bp, Mus musculus
acttaaatggctgcctttacagaag

SEQ ID NO: 133581 - DNA, 25 bp, Mus musculus
acttaaatgtgactgcttagaactg

SEQ ID NO: 133582 - DNA, 25 bp, Mus musculus
acttaaatgtgagtgcttagaactg

SEQ ID NO: 133583 - DNA, 25 bp, Mus musculus
acttaaattcgaacatgcaacccct

SEQ ID NO: 133584 - DNA, 25 bp, Mus musculus
acttaaattcgatcatgcaacccct

SEQ ID NO: 133585 - DNA, 25 bp, Mus musculus
acttaacaaatcatcaccctaacac

SEQ ID NO: 133586 - DNA, 25 bp, Mus musculus
acttaacaaatcttcaccctaacac

SEQ ID NO: 133587 - DNA, 25 bp, Mus musculus
acttaacacattatcgagcccttgg

SEQ ID NO: 133588 - DNA, 25 bp, Mus musculus
acttaacacattttcgagcccttgg

SEQ ID NO: 133589 - DNA, 25 bp, Mus musculus
acttaacagactagtgtaacagcac

SEQ ID NO: 133590 - DNA, 25 bp, Mus musculus
acttaacagacttgtgtaacagcac

SEQ ID NO: 133591 - DNA, 25 bp, Mus musculus
acttaacatttgagagctttctctt

SEQ ID NO: 133592 - DNA, 25 bp, Mus musculus
acttaacatttgtgagctttctctt

SEQ ID NO: 133593 - DNA, 25 bp, Mus musculus
acttaaccaagaagggctgggctcc

SEQ ID NO: 133594 - DNA, 25 bp, Mus musculus
acttaaccaagatgggctgggctcc

SEQ ID NO: 133595 - DNA, 25 bp, Mus musculus
acttaaccagcaaatttgttttctg

SEQ ID NO: 133596 - DNA, 25 bp, Mus musculus
acttaaccagcatatttgttttctg

SEQ ID NO: 133597 - DNA, 25 bp, Mus musculus
acttaacccaagatccactgacaat

SEQ ID NO: 133598 - DNA, 25 bp, Mus musculus
acttaacccaagttccactgacaat

SEQ ID NO: 133599 - DNA, 25 bp, Mus musculus
acttaacctcagaaatgtagtgggt

SEQ ID NO: 133600 - DNA, 25 bp, Mus musculus
acttaacctcagactcatctttgat

SEQ ID NO: 133601 - DNA, 25 bp, Mus musculus
acttaacctcagtaatgtagtgggt

SEQ ID NO: 133602 - DNA, 25 bp, Mus musculus
acttaacctcagtctcatctttgat

SEQ ID NO: 133603 - DNA, 25 bp, Mus musculus
acttaaccttatactcagctctgga

SEQ ID NO: 133604 - DNA, 25 bp, Mus musculus
acttaaccttattctcagctctgga

SEQ ID NO: 133605 - DNA, 25 bp, Mus musculus
acttaaccttgcagagttccttaat

SEQ ID NO: 133606 - DNA, 25 bp, Mus musculus
acttaaccttgctgagttccttaat

SEQ ID NO: 133607 - DNA, 25 bp, Mus musculus
acttaactacctagtcaagggcttg

SEQ ID NO: 133608 - DNA, 25 bp, Mus musculus
acttaactaccttgtcaagggcttg

SEQ ID NO: 133609 - DNA, 25 bp, Mus musculus
acttaactcactcaatctcacacca

SEQ ID NO: 133610 - DNA, 25 bp, Mus musculus
acttaactcactgaatctcacacca

SEQ ID NO: 133611 - DNA, 25 bp, Mus musculus
acttaactggccatgtgaccttgga

SEQ ID NO: 133612 - DNA, 25 bp, Mus musculus
acttaactggccttgtgaccttgga

SEQ ID NO: 133613 - DNA, 25 bp, Mus musculus
acttaactgttgcattagcttctaa

SEQ ID NO: 133614 - DNA, 25 bp, Mus musculus
acttaactgttggattagcttctaa

SEQ ID NO: 133615 - DNA, 25 bp, Mus musculus
acttaactttgaacccgctggcata

SEQ ID NO: 133616 - DNA, 25 bp, Mus musculus
acttaactttgatcccgctggcata

SEQ ID NO: 133617 - DNA, 25 bp, Mus musculus
acttaagacagccaggtgacgacga

SEQ ID NO: 133618 - DNA, 25 bp, Mus musculus
acttaagacagcgaggtgacgacga

SEQ ID NO: 133619 - DNA, 25 bp, Mus musculus
acttaagagtatctgtgtcccggct

SEQ ID NO: 133620 - DNA, 25 bp, Mus musculus
acttaagagtatgtgtgtcccggct

SEQ ID NO: 133621 - DNA, 25 bp, Mus musculus
acttaagagtgtaggttgctcttcc

SEQ ID NO: 133622 - DNA, 25 bp, Mus musculus
acttaagagtgttggttgctcttcc

SEQ ID NO: 133623 - DNA, 25 bp, Mus musculus
acttaagatagtctgcagggcctgt

SEQ ID NO: 133624 - DNA, 25 bp, Mus musculus
acttaagatagtgtgcagggcctgt

SEQ ID NO: 133625 - DNA, 25 bp, Mus musculus
acttaagcccatccttcctgatagc

SEQ ID NO: 133626 - DNA, 25 bp, Mus musculus
acttaagcccatgcttcctgatagc

SEQ ID NO: 133627 - DNA, 25 bp, Mus musculus
acttaagcctatactgtagtccaga

SEQ ID NO: 133628 - DNA, 25 bp, Mus musculus
acttaagcctattctgtagtccaga

SEQ ID NO: 133629 - DNA, 25 bp, Mus musculus
acttaagcgagaagccagcaggcct

SEQ ID NO: 133630 - DNA, 25 bp, Mus musculus
acttaagcgagatgccagcaggcct

SEQ ID NO: 133631 - DNA, 25 bp, Mus musculus
acttaagctgttcttgggctctgaa

SEQ ID NO: 133632 - DNA, 25 bp, Mus musculus
acttaagctgttgttgggctctgaa

SEQ ID NO: 133633 - DNA, 25 bp, Mus musculus
acttaaggccctcaattcctctatt

SEQ ID NO: 133634 - DNA, 25 bp, Mus musculus
acttaaggccctgaattcctctatt

SEQ ID NO: 133635 - DNA, 25 bp, Mus musculus
acttaagggtctccgcgaggtacag

SEQ ID NO: 133636 - DNA, 25 bp, Mus musculus
acttaagggtctgcgcgaggtacag

SEQ ID NO: 133637 - DNA, 25 bp, Mus musculus
acttaagtacatctagcctggagga

SEQ ID NO: 133638 - DNA, 25 bp, Mus musculus
acttaagtacatgtagcctggagga

SEQ ID NO: 133639 - DNA, 25 bp, Mus musculus
acttaagtccagcagcagtcttgct

SEQ ID NO: 133640 - DNA, 25 bp, Mus musculus
acttaagtccaggagcagtcttgct

SEQ ID NO: 133641 - DNA, 25 bp, Mus musculus
acttaagtgcacaagctggtttgat

SEQ ID NO: 133642 - DNA, 25 bp, Mus musculus
acttaagtgcacatacctgccacac

SEQ ID NO: 133643 - DNA, 25 bp, Mus musculus
acttaagtgcactagctggtttgat

SEQ ID NO: 133644 - DNA, 25 bp, Mus musculus
acttaagtgcacttacctgccacac

SEQ ID NO: 133645 - DNA, 25 bp, Mus musculus
acttaagttttactgttctcaacat

SEQ ID NO: 133646 - DNA, 25 bp, Mus musculus
acttaagttttagtgttctcaacat

SEQ ID NO: 133647 - DNA, 25 bp, Mus musculus
acttaataagcaccactccacaaaa

SEQ ID NO: 133648 - DNA, 25 bp, Mus musculus
acttaataagcagcactccacaaaa

SEQ ID NO: 133649 - DNA, 25 bp, Mus musculus
acttaatacagtctgtgtcaccttt

SEQ ID NO: 133650 - DNA, 25 bp, Mus musculus
acttaatacagtgtgtgtcaccttt

SEQ ID NO: 133651 - DNA, 25 bp, Mus musculus
acttaatagaacaacccaggtgact

SEQ ID NO: 133652 - DNA, 25 bp, Mus musculus
acttaatagaactacccaggtgact

SEQ ID NO: 133653 - DNA, 25 bp, Mus musculus
acttaatagtacattcatgtgtttt

SEQ ID NO: 133654 - DNA, 25 bp, Mus musculus
acttaatagtactttcatgtgtttt

SEQ ID NO: 133655 - DNA, 25 bp, Mus musculus
acttaatattttcttaggatgaata

SEQ ID NO: 133656 - DNA, 25 bp, Mus musculus
acttaatattttgttaggatgaata

SEQ ID NO: 133657 - DNA, 25 bp, Mus musculus
acttaatgacctactgcgttcacgt

SEQ ID NO: 133658 - DNA, 25 bp, Mus musculus
acttaatgaccttctgcgttcacgt

SEQ ID NO: 133659 - DNA, 25 bp, Mus musculus
acttaatgatgcagggaggtgaccc

SEQ ID NO: 133660 - DNA, 25 bp, Mus musculus
acttaatgatgctgggaggtgaccc

SEQ ID NO: 133661 - DNA, 25 bp, Mus musculus
acttaatgccttacctcactaagga

SEQ ID NO: 133662 - DNA, 25 bp, Mus musculus
acttaatgcctttcctcactaagga

SEQ ID NO: 133663 - DNA, 25 bp, Mus musculus
acttaatgctctaagggaggaccca

SEQ ID NO: 133664 - DNA, 25 bp, Mus musculus
acttaatgctcttagggaggaccca

SEQ ID NO: 133665 - DNA, 25 bp, Mus musculus
acttaattcattatacgggtcactg

SEQ ID NO: 133666 - DNA, 25 bp, Mus musculus
acttaattcattttacgggtcactg

SEQ ID NO: 133667 - DNA, 25 bp, Mus musculus
acttaattccctaatagccaacgat

SEQ ID NO: 133668 - DNA, 25 bp, Mus musculus
acttaattcccttatagccaacgat

SEQ ID NO: 133669 - DNA, 25 bp, Mus musculus
acttaattcctgagtagatagctga

SEQ ID NO: 133670 - DNA, 25 bp, Mus musculus
acttaattcctgtgtagatagctga

SEQ ID NO: 133671 - DNA, 25 bp, Mus musculus
acttaattgccgaggtggagctgac

SEQ ID NO: 133672 - DNA, 25 bp, Mus musculus
acttaattgccgtggtggagctgac

SEQ ID NO: 133673 - DNA, 25 bp, Mus musculus
acttaatttttgacctgccattcac

SEQ ID NO: 133674 - DNA, 25 bp, Mus musculus
acttaatttttgtcctgccattcac

SEQ ID NO: 133675 - DNA, 25 bp, Mus musculus
acttacaaatacataccctcagcca

SEQ ID NO: 133676 - DNA, 25 bp, Mus musculus
acttacaaatacttaccctcagcca

SEQ ID NO: 133677 - DNA, 25 bp, Mus musculus
acttacaagggcaaccagaccctgg

SEQ ID NO: 133678 - DNA, 25 bp, Mus musculus
acttacaagggctaccagaccctgg

SEQ ID NO: 133679 - DNA, 25 bp, Mus musculus
acttacaattctccccttgatctag

SEQ ID NO: 133680 - DNA, 25 bp, Mus musculus
acttacaattctgcccttgatctag

SEQ ID NO: 133681 - DNA, 25 bp, Mus musculus
acttacacatacaagcagcactaat

SEQ ID NO: 133682 - DNA, 25 bp, Mus musculus
acttacacatactagcagcactaat

SEQ ID NO: 133683 - DNA, 25 bp, Mus musculus
acttacacgtgtcagccatatctgt

SEQ ID NO: 133684 - DNA, 25 bp, Mus musculus
acttacacgtgtgagccatatctgt

SEQ ID NO: 133685 - DNA, 25 bp, Mus musculus
acttacactataccccattgagccg

SEQ ID NO: 133686 - DNA, 25 bp, Mus musculus
acttacactatagcccattgagccg

SEQ ID NO: 133687 - DNA, 25 bp, Mus musculus
acttacactcttagtttatccacct

SEQ ID NO: 133688 - DNA, 25 bp, Mus musculus
acttacactctttgtttatccacct

SEQ ID NO: 133689 - DNA, 25 bp, Mus musculus
acttacactttaccccttgctgtag

SEQ ID NO: 133690 - DNA, 25 bp, Mus musculus
acttacactttagcccttgctgtag

SEQ ID NO: 133691 - DNA, 25 bp, Mus musculus
acttacagagataggcccctcgtgc

SEQ ID NO: 133692 - DNA, 25 bp, Mus musculus
acttacagagattggcccctcgtgc

SEQ ID NO: 133693 - DNA, 25 bp, Mus musculus
acttacagagttattcagtcataat

SEQ ID NO: 133694 - DNA, 25 bp, Mus musculus
acttacagagtttttcagtcataat

SEQ ID NO: 133695 - DNA, 25 bp, Mus musculus
acttacaggcttacttgtgtttgct

SEQ ID NO: 133696 - DNA, 25 bp, Mus musculus
acttacaggctttcttgtgtttgct

SEQ ID NO: 133697 - DNA, 25 bp, Mus musculus
acttacaggttcattctggctcttt

SEQ ID NO: 133698 - DNA, 25 bp, Mus musculus
acttacaggttctttctggctcttt

SEQ ID NO: 133699 - DNA, 25 bp, Mus musculus
acttacagtatgagctggcccgggt

SEQ ID NO: 133700 - DNA, 25 bp, Mus musculus
acttacagtatgtgctggcccgggt

SEQ ID NO: 133701 - DNA, 25 bp, Mus musculus
acttacataagcatctgtcacctca

SEQ ID NO: 133702 - DNA, 25 bp, Mus musculus
acttacataagcttctgtcacctca

SEQ ID NO: 133703 - DNA, 25 bp, Mus musculus
acttacatacgccacggccatgcgt

SEQ ID NO: 133704 - DNA, 25 bp, Mus musculus
acttacatacgcgacggccatgcgt

SEQ ID NO: 133705 - DNA, 25 bp, Mus musculus
acttacatagcaattgtcacctcag

SEQ ID NO: 133706 - DNA, 25 bp, Mus musculus
acttacatagcatttgtcacctcag

SEQ ID NO: 133707 - DNA, 25 bp, Mus musculus
acttacatccttctctaaaacctga

SEQ ID NO: 133708 - DNA, 25 bp, Mus musculus
acttacatccttgtctaaaacctga

SEQ ID NO: 133709 - DNA, 25 bp, Mus musculus
acttacatgatcaatttgttcagta

SEQ ID NO: 133710 - DNA, 25 bp, Mus musculus
acttacatgatctatttgttcagta

SEQ ID NO: 133711 - DNA, 25 bp, Mus musculus
acttacatgcggacattctttgaga

SEQ ID NO: 133712 - DNA, 25 bp, Mus musculus
acttacatgcggtcattctttgaga

SEQ ID NO: 133713 - DNA, 25 bp, Mus musculus
acttacattacaagctctcatccaa

SEQ ID NO: 133714 - DNA, 25 bp, Mus musculus
acttacattacatgctctcatccaa

SEQ ID NO: 133715 - DNA, 25 bp, Mus musculus
acttacattcaccacacggactgtg

SEQ ID NO: 133716 - DNA, 25 bp, Mus musculus
acttacattcacgacacggactgtg

SEQ ID NO: 133717 - DNA, 25 bp, Mus musculus
acttacattgtaatagcatccccaa

SEQ ID NO: 133718 - DNA, 25 bp, Mus musculus
acttacattgtattagcatccccaa

SEQ ID NO: 133719 - DNA, 25 bp, Mus musculus
acttacatttggctggcattactaa

SEQ ID NO: 133720 - DNA, 25 bp, Mus musculus
acttacatttgggtggcattactaa

SEQ ID NO: 133721 - DNA, 25 bp, Mus musculus
acttaccacctgacttaccttacag

SEQ ID NO: 133722 - DNA, 25 bp, Mus musculus
acttaccacctgtcttaccttacag

SEQ ID NO: 133723 - DNA, 25 bp, Mus musculus
acttaccatactctgccttgtatta

SEQ ID NO: 133724 - DNA, 25 bp, Mus musculus
acttaccatactgtgccttgtatta

SEQ ID NO: 133725 - DNA, 25 bp, Mus musculus
acttaccatagcacctggatttctc

SEQ ID NO: 133726 - DNA, 25 bp, Mus musculus
acttaccatagctcctggatttctc

SEQ ID NO: 133727 - DNA, 25 bp, Mus musculus
acttaccatcgtcacctgaggaatt

SEQ ID NO: 133728 - DNA, 25 bp, Mus musculus
acttaccatcgtgacctgaggaatt

SEQ ID NO: 133729 - DNA, 25 bp, Mus musculus
acttaccatgggaaggtgtcttgct

SEQ ID NO: 133730 - DNA, 25 bp, Mus musculus
acttaccatgggtaggtgtcttgct

SEQ ID NO: 133731 - DNA, 25 bp, Mus musculus
acttaccccacacgatgcttcagag

SEQ ID NO: 133732 - DNA, 25 bp, Mus musculus
acttaccccacaggatgcttcagag

SEQ ID NO: 133733 - DNA, 25 bp, Mus musculus
acttaccctggtcgctggagagacg

SEQ ID NO: 133734 - DNA, 25 bp, Mus musculus
acttaccctggtggctggagagacg

SEQ ID NO: 133735 - DNA, 25 bp, Mus musculus
acttacccttagcagctaaggatag

SEQ ID NO: 133736 - DNA, 25 bp, Mus musculus
acttacccttaggagctaaggatag

SEQ ID NO: 133737 - DNA, 25 bp, Mus musculus
acttacccttctctcaagtgacaac

SEQ ID NO: 133738 - DNA, 25 bp, Mus musculus
acttacccttctgtcaagtgacaac

SEQ ID NO: 133739 - DNA, 25 bp, Mus musculus
acttacccttggctagagtcatctg

SEQ ID NO: 133740 - DNA, 25 bp, Mus musculus
acttacccttgggtagagtcatctg

SEQ ID NO: 133741 - DNA, 25 bp, Mus musculus
acttacctactgacagctgatcaca

SEQ ID NO: 133742 - DNA, 25 bp, Mus musculus
acttacctactgtcagctgatcaca

SEQ ID NO: 133743 - DNA, 25 bp, Mus musculus
acttacctaggcagaatctgactga

SEQ ID NO: 133744 - DNA, 25 bp, Mus musculus
acttacctaggctgaatctgactga

SEQ ID NO: 133745 - DNA, 25 bp, Mus musculus
acttacctaggtcggctttgaatat

SEQ ID NO: 133746 - DNA, 25 bp, Mus musculus
acttacctaggtgggctttgaatat

SEQ ID NO: 133747 - DNA, 25 bp, Mus musculus
acttacctcagtcagctggctttta

SEQ ID NO: 133748 - DNA, 25 bp, Mus musculus
acttacctcagtgagctggctttta

SEQ ID NO: 133749 - DNA, 25 bp, Mus musculus
acttacctctgtctgctttattcca

SEQ ID NO: 133750 - DNA, 25 bp, Mus musculus
acttacctctgtgtgctttattcca

SEQ ID NO: 133751 - DNA, 25 bp, Mus musculus
acttacctgacccagaaatgcccta

SEQ ID NO: 133752 - DNA, 25 bp, Mus musculus
acttacctgaccgagaaatgcccta

SEQ ID NO: 133753 - DNA, 25 bp, Mus musculus
acttacctgacgatgcctcatataa

SEQ ID NO: 133754 - DNA, 25 bp, Mus musculus
acttacctgacgttgcctcatataa

SEQ ID NO: 133755 - DNA, 25 bp, Mus musculus
acttacctgagtatgtcatgcgact

SEQ ID NO: 133756 - DNA, 25 bp, Mus musculus
acttacctgagtttgtcatgcgact

SEQ ID NO: 133757 - DNA, 25 bp, Mus musculus
acttacctgtcaaatttcctgtctc

SEQ ID NO: 133758 - DNA, 25 bp, Mus musculus
acttacctgtcatatttcctgtctc

SEQ ID NO: 133759 - DNA, 25 bp, Mus musculus
acttacctgttgagtggattctgta

SEQ ID NO: 133760 - DNA, 25 bp, Mus musculus
acttacctgttgcttgtttggataa

SEQ ID NO: 133761 - DNA, 25 bp, Mus musculus
acttacctgttggttgtttggataa

SEQ ID NO: 133762 - DNA, 25 bp, Mus musculus
acttacctgttgtgtggattctgta

SEQ ID NO: 133763 - DNA, 25 bp, Mus musculus
acttaccttatacagcacaacgtta

SEQ ID NO: 133764 - DNA, 25 bp, Mus musculus
acttaccttatagagcacaacgtta

SEQ ID NO: 133765 - DNA, 25 bp, Mus musculus
acttaccttttacggcacaggcaga

SEQ ID NO: 133766 - DNA, 25 bp, Mus musculus
acttaccttttagggcacaggcaga

SEQ ID NO: 133767 - DNA, 25 bp, Mus musculus
acttacgaaatgatccatgttgtca

SEQ ID NO: 133768 - DNA, 25 bp, Mus musculus
acttacgaaatgttccatgttgtca

SEQ ID NO: 133769 - DNA, 25 bp, Mus musculus
acttacgacgtcatccacttgagct

SEQ ID NO: 133770 - DNA, 25 bp, Mus musculus
acttacgacgtcttccacttgagct

SEQ ID NO: 133771 - DNA, 25 bp, Mus musculus
acttacgcccagatagcacagaagg

SEQ ID NO: 133772 - DNA, 25 bp, Mus musculus
acttacgcccagttagcacagaagg

SEQ ID NO: 133773 - DNA, 25 bp, Mus musculus
acttacggtatgctgtttgctcaac

SEQ ID NO: 133774 - DNA, 25 bp, Mus musculus
acttacggtatggtgtttgctcaac

SEQ ID NO: 133775 - DNA, 25 bp, Mus musculus
acttacgtgtacaagacattgggca

SEQ ID NO: 133776 - DNA, 25 bp, Mus musculus
acttacgtgtacatttccatctcaa

SEQ ID NO: 133777 - DNA, 25 bp, Mus musculus
acttacgtgtactagacattgggca

SEQ ID NO: 133778 - DNA, 25 bp, Mus musculus
acttacgtgtacttttccatctcaa

SEQ ID NO: 133779 - DNA, 25 bp, Mus musculus
acttacgttgcaattcacatttgga

SEQ ID NO: 133780 - DNA, 25 bp, Mus musculus
acttacgttgcatttcacatttgga

SEQ ID NO: 133781 - DNA, 25 bp, Mus musculus
acttactaacagctgacatcactgg

SEQ ID NO: 133782 - DNA, 25 bp, Mus musculus
acttactaacaggtgacatcactgg

SEQ ID NO: 133783 - DNA, 25 bp, Mus musculus
acttactagcttacaattacacttt

SEQ ID NO: 133784 - DNA, 25 bp, Mus musculus
acttactagctttcaattacacttt

SEQ ID NO: 133785 - DNA, 25 bp, Mus musculus
acttactccacccagatcttttttg

SEQ ID NO: 133786 - DNA, 25 bp, Mus musculus
acttactccaccgagatcttttttg

SEQ ID NO: 133787 - DNA, 25 bp, Mus musculus
acttactgatcacctaactgagcca

SEQ ID NO: 133788 - DNA, 25 bp, Mus musculus
acttactgatcagctaactgagcca

SEQ ID NO: 133789 - DNA, 25 bp, Mus musculus
acttactgatgaagctcgctttctg

SEQ ID NO: 133790 - DNA, 25 bp, Mus musculus
acttactgatgatgctcgctttctg

SEQ ID NO: 133791 - DNA, 25 bp, Mus musculus
acttactgcccaaggtgacaactat

SEQ ID NO: 133792 - DNA, 25 bp, Mus musculus
acttactgcccatggtgacaactat

SEQ ID NO: 133793 - DNA, 25 bp, Mus musculus
acttactggccgaggtttccctgtg

SEQ ID NO: 133794 - DNA, 25 bp, Mus musculus
acttactggccgtggtttccctgtg

SEQ ID NO: 133795 - DNA, 25 bp, Mus musculus
acttactggctgaatgtgattgtta

SEQ ID NO: 133796 - DNA, 25 bp, Mus musculus
acttactggctgtatgtgattgtta

SEQ ID NO: 133797 - DNA, 25 bp, Mus musculus
acttactggtacactaagatggcag

SEQ ID NO: 133798 - DNA, 25 bp, Mus musculus
acttactggtactctaagatggcag

SEQ ID NO: 133799 - DNA, 25 bp, Mus musculus
acttactgtcttcctttaagaaaag

SEQ ID NO: 133800 - DNA, 25 bp, Mus musculus
acttactgtcttgctttaagaaaag

SEQ ID NO: 133801 - DNA, 25 bp, Mus musculus
acttactgttatagacagctgtgta

SEQ ID NO: 133802 - DNA, 25 bp, Mus musculus
acttactgttattgacagctgtgta

SEQ ID NO: 133803 - DNA, 25 bp, Mus musculus
acttacttacggatatagcatctgg

SEQ ID NO: 133804 - DNA, 25 bp, Mus musculus
acttacttacggttatagcatctgg

SEQ ID NO: 133805 - DNA, 25 bp, Mus musculus
acttacttccagactgcgtgtttta

SEQ ID NO: 133806 - DNA, 25 bp, Mus musculus
acttacttccagagctcttgtgttg

SEQ ID NO: 133807 - DNA, 25 bp, Mus musculus
acttacttccagtctgcgtgtttta

SEQ ID NO: 133808 - DNA, 25 bp, Mus musculus
acttacttccagtgctcttgtgttg

SEQ ID NO: 133809 - DNA, 25 bp, Mus musculus
acttacttgcttagttttaggaatg

SEQ ID NO: 133810 - DNA, 25 bp, Mus musculus
acttacttgctttgttttaggaatg

SEQ ID NO: 133811 - DNA, 25 bp, Mus musculus
acttacttgtgaatgttgtcctcaa

SEQ ID NO: 133812 - DNA, 25 bp, Mus musculus
acttacttgtgattgttgtcctcaa

SEQ ID NO: 133813 - DNA, 25 bp, Mus musculus
acttagaaatctaccctctgaattt

SEQ ID NO: 133814 - DNA, 25 bp, Mus musculus
acttagaaatcttccctctgaattt

SEQ ID NO: 133815 - DNA, 25 bp, Mus musculus
acttagaaatgtatggatatgccac

SEQ ID NO: 133816 - DNA, 25 bp, Mus musculus
acttagaaatgtttggatatgccac

SEQ ID NO: 133817 - DNA, 25 bp, Mus musculus
acttagaatgttacagggtgagtgg

SEQ ID NO: 133818 - DNA, 25 bp, Mus musculus
acttagaatgtttcagggtgagtgg

SEQ ID NO: 133819 - DNA, 25 bp, Mus musculus
acttagaattatagtccctgaggac

SEQ ID NO: 133820 - DNA, 25 bp, Mus musculus
acttagaattattgtccctgaggac

SEQ ID NO: 133821 - DNA, 25 bp, Mus musculus
acttagacaggtcctgccagactca

SEQ ID NO: 133822 - DNA, 25 bp, Mus musculus
acttagacaggtgctgccagactca

SEQ ID NO: 133823 - DNA, 25 bp, Mus musculus
acttagaccaccaatatagctattt

SEQ ID NO: 133824 - DNA, 25 bp, Mus musculus
acttagaccacctatatagctattt

SEQ ID NO: 133825 - DNA, 25 bp, Mus musculus
acttagactcaacacaatttagcta

SEQ ID NO: 133826 - DNA, 25 bp, Mus musculus
acttagactcaagacaatttagcta

SEQ ID NO: 133827 - DNA, 25 bp, Mus musculus
acttagactttcagagcctctttaa

SEQ ID NO: 133828 - DNA, 25 bp, Mus musculus
acttagactttctgagcctctttaa

SEQ ID NO: 133829 - DNA, 25 bp, Mus musculus
acttagagaagcagctggttgagaa

SEQ ID NO: 133830 - DNA, 25 bp, Mus musculus
acttagagaagctgctggttgagaa

SEQ ID NO: 133831 - DNA, 25 bp, Mus musculus
acttagagactaccacccagtgacc

SEQ ID NO: 133832 - DNA, 25 bp, Mus musculus
acttagagactagcacccagtgacc

SEQ ID NO: 133833 - DNA, 25 bp, Mus musculus
acttagaggttcctccatggactcc

SEQ ID NO: 133834 - DNA, 25 bp, Mus musculus
acttagaggttcgtccatggactcc

SEQ ID NO: 133835 - DNA, 25 bp, Mus musculus
acttagagtagtccctgccttacag

SEQ ID NO: 133836 - DNA, 25 bp, Mus musculus
acttagagtagtgcctgccttacag

SEQ ID NO: 133837 - DNA, 25 bp, Mus musculus
acttagatattcagttcccatgtca

SEQ ID NO: 133838 - DNA, 25 bp, Mus musculus
acttagatattctgttcccatgtca

SEQ ID NO: 133839 - DNA, 25 bp, Mus musculus
acttagatggagctgggcaccactc

SEQ ID NO: 133840 - DNA, 25 bp, Mus musculus
acttagatggaggtgggcaccactc

SEQ ID NO: 133841 - DNA, 25 bp, Mus musculus
acttagatgtggagaacctcagaat

SEQ ID NO: 133842 - DNA, 25 bp, Mus musculus
acttagatgtggtgaacctcagaat

SEQ ID NO: 133843 - DNA, 25 bp, Mus musculus
acttagcaagctatatccatcagaa

SEQ ID NO: 133844 - DNA, 25 bp, Mus musculus
acttagcaagctttatccatcagaa

SEQ ID NO: 133845 - DNA, 25 bp, Mus musculus
acttagcacatacccctgtgctgtg

SEQ ID NO: 133846 - DNA, 25 bp, Mus musculus
acttagcacatagccctgtgctgtg

SEQ ID NO: 133847 - DNA, 25 bp, Mus musculus
acttagcagagtaggctgttgcagc

SEQ ID NO: 133848 - DNA, 25 bp, Mus musculus
acttagcagagttggctgttgcagc

SEQ ID NO: 133849 - DNA, 25 bp, Mus musculus
acttagcagtctaggaagccgttga

SEQ ID NO: 133850 - DNA, 25 bp, Mus musculus
acttagcagtcttggaagccgttga

SEQ ID NO: 133851 - DNA, 25 bp, Mus musculus
acttagcatctgaaactcctgttag

SEQ ID NO: 133852 - DNA, 25 bp, Mus musculus
acttagcatctgtaactcctgttag

SEQ ID NO: 133853 - DNA, 25 bp, Mus musculus
acttagcatgtaatgtctccaggaa

SEQ ID NO: 133854 - DNA, 25 bp, Mus musculus
acttagcatgtattgtctccaggaa

SEQ ID NO: 133855 - DNA, 25 bp, Mus musculus
acttagcatttcactaggtgcgccc

SEQ ID NO: 133856 - DNA, 25 bp, Mus musculus
acttagcatttctctaggtgcgccc

SEQ ID NO: 133857 - DNA, 25 bp, Mus musculus
acttagccaatacccatagccaagg

SEQ ID NO: 133858 - DNA, 25 bp, Mus musculus
acttagccaatagccatagccaagg

SEQ ID NO: 133859 - DNA, 25 bp, Mus musculus
acttagccacccacacaaatcatgg

SEQ ID NO: 133860 - DNA, 25 bp, Mus musculus
acttagccaccctcacaaatcatgg

SEQ ID NO: 133861 - DNA, 25 bp, Mus musculus
acttagccatatcttctgtgttgga

SEQ ID NO: 133862 - DNA, 25 bp, Mus musculus
acttagccatatgttctgtgttgga

SEQ ID NO: 133863 - DNA, 25 bp, Mus musculus
acttagccattgatctcatattgta

SEQ ID NO: 133864 - DNA, 25 bp, Mus musculus
acttagccattgttctcatattgta

SEQ ID NO: 133865 - DNA, 25 bp, Mus musculus
acttagccctctacatttctccagt

SEQ ID NO: 133866 - DNA, 25 bp, Mus musculus
acttagccctcttcatttctccagt

SEQ ID NO: 133867 - DNA, 25 bp, Mus musculus
acttagccctttactgcactaatta

SEQ ID NO: 133868 - DNA, 25 bp, Mus musculus
acttagcccttttctgcactaatta

SEQ ID NO: 133869 - DNA, 25 bp, Mus musculus
acttagcctcccagatcagtaattt

SEQ ID NO: 133870 - DNA, 25 bp, Mus musculus
acttagcctccctgatcagtaattt

SEQ ID NO: 133871 - DNA, 25 bp, Mus musculus
acttagccttctccaacgacaggag

SEQ ID NO: 133872 - DNA, 25 bp, Mus musculus
acttagccttctgcaacgacaggag

SEQ ID NO: 133873 - DNA, 25 bp, Mus musculus
acttagctactaaacaatcctttgg

SEQ ID NO: 133874 - DNA, 25 bp, Mus musculus
acttagctactatacaatcctttgg

SEQ ID NO: 133875 - DNA, 25 bp, Mus musculus
acttagctcagtactcggggcgttc

SEQ ID NO: 133876 - DNA, 25 bp, Mus musculus
acttagctcagttctcggggcgttc

SEQ ID NO: 133877 - DNA, 25 bp, Mus musculus
acttagctcctgaggccagcagttc

SEQ ID NO: 133878 - DNA, 25 bp, Mus musculus
acttagctcctgtggccagcagttc

SEQ ID NO: 133879 - DNA, 25 bp, Mus musculus
acttagctcttcagctaccttacaa

SEQ ID NO: 133880 - DNA, 25 bp, Mus musculus
acttagctcttctgctaccttacaa

SEQ ID NO: 133881 - DNA, 25 bp, Mus musculus
acttagctgcagaagcctgtcatgc

SEQ ID NO: 133882 - DNA, 25 bp, Mus musculus
acttagctgcagtagcctgtcatgc

SEQ ID NO: 133883 - DNA, 25 bp, Mus musculus
acttagctgcgcaggctttctgtgc

SEQ ID NO: 133884 - DNA, 25 bp, Mus musculus
acttagctgcgctggctttctgtgc

SEQ ID NO: 133885 - DNA, 25 bp, Mus musculus
acttagctttcaaaatgccttacat

SEQ ID NO: 133886 - DNA, 25 bp, Mus musculus
acttagctttcataatgccttacat

SEQ ID NO: 133887 - DNA, 25 bp, Mus musculus
acttagctttctcactactgatttt

SEQ ID NO: 133888 - DNA, 25 bp, Mus musculus
acttagctttctgactactgatttt

SEQ ID NO: 133889 - DNA, 25 bp, Mus musculus
acttagcttttcctatctcagggct

SEQ ID NO: 133890 - DNA, 25 bp, Mus musculus
acttagcttttcgtatctcagggct

SEQ ID NO: 133891 - DNA, 25 bp, Mus musculus
acttaggaccaacagttctttgtgg

SEQ ID NO: 133892 - DNA, 25 bp, Mus musculus
acttaggaccaagagttctttgtgg

SEQ ID NO: 133893 - DNA, 25 bp, Mus musculus
acttaggaccctaatactgtagcat

SEQ ID NO: 133894 - DNA, 25 bp, Mus musculus
acttaggacccttatactgtagcat

SEQ ID NO: 133895 - DNA, 25 bp, Mus musculus
acttaggacgtcatgcttgctgggc

SEQ ID NO: 133896 - DNA, 25 bp, Mus musculus
acttaggacgtcttgcttgctgggc

SEQ ID NO: 133897 - DNA, 25 bp, Mus musculus
acttaggagagccaaagacagggtt

SEQ ID NO: 133898 - DNA, 25 bp, Mus musculus
acttaggagagcgaaagacagggtt

SEQ ID NO: 133899 - DNA, 25 bp, Mus musculus
acttaggagctactgctctttccac

SEQ ID NO: 133900 - DNA, 25 bp, Mus musculus
acttaggagctagtgctctttccac

SEQ ID NO: 133901 - DNA, 25 bp, Mus musculus
acttaggatatcagggctttgcccc

SEQ ID NO: 133902 - DNA, 25 bp, Mus musculus
acttaggatatctgggctttgcccc

SEQ ID NO: 133903 - DNA, 25 bp, Mus musculus
acttaggcccagcaaataaatgctg

SEQ ID NO: 133904 - DNA, 25 bp, Mus musculus
acttaggcccaggaaataaatgctg

SEQ ID NO: 133905 - DNA, 25 bp, Mus musculus
acttaggctgaacatgcggctggct

SEQ ID NO: 133906 - DNA, 25 bp, Mus musculus
acttaggctgaagatgcggctggct

SEQ ID NO: 133907 - DNA, 25 bp, Mus musculus
acttaggctttgaaccgattggagg

SEQ ID NO: 133908 - DNA, 25 bp, Mus musculus
acttaggctttgtaccgattggagg

SEQ ID NO: 133909 - DNA, 25 bp, Mus musculus
acttagggacatacctgtcgatgac

SEQ ID NO: 133910 - DNA, 25 bp, Mus musculus
acttagggacattcctgtcgatgac

SEQ ID NO: 133911 - DNA, 25 bp, Mus musculus
acttagggactgaagttgctcgtga

SEQ ID NO: 133912 - DNA, 25 bp, Mus musculus
acttagggactgtagttgctcgtga

SEQ ID NO: 133913 - DNA, 25 bp, Mus musculus
acttagggctgaacataggatttat

SEQ ID NO: 133914 - DNA, 25 bp, Mus musculus
acttagggctgatcataggatttat

SEQ ID NO: 133915 - DNA, 25 bp, Mus musculus
acttaggtatctctgtatcggccga

SEQ ID NO: 133916 - DNA, 25 bp, Mus musculus
acttaggtatctgtgtatcggccga

SEQ ID NO: 133917 - DNA, 25 bp, Mus musculus
acttaggtggttcgaatctggacaa

SEQ ID NO: 133918 - DNA, 25 bp, Mus musculus
acttaggtggttggaatctggacaa

SEQ ID NO: 133919 - DNA, 25 bp, Mus musculus
acttaggttgtcaggcttatgcagc

SEQ ID NO: 133920 - DNA, 25 bp, Mus musculus
acttaggttgtctggcttatgcagc

SEQ ID NO: 133921 - DNA, 25 bp, Mus musculus
acttagtacgatcaaacaaccttag

SEQ ID NO: 133922 - DNA, 25 bp, Mus musculus
acttagtacgatgaaacaaccttag

SEQ ID NO: 133923 - DNA, 25 bp, Mus musculus
acttagtagattagacatccttgga

SEQ ID NO: 133924 - DNA, 25 bp, Mus musculus
acttagtagatttgacatccttgga

SEQ ID NO: 133925 - DNA, 25 bp, Mus musculus
acttagtagtacatgcttagttata

SEQ ID NO: 133926 - DNA, 25 bp, Mus musculus
acttagtagtacttgcttagttata

SEQ ID NO: 133927 - DNA, 25 bp, Mus musculus
acttagtagtgaacatctgggtaga

SEQ ID NO: 133928 - DNA, 25 bp, Mus musculus
acttagtagtgatcatctgggtaga

SEQ ID NO: 133929 - DNA, 25 bp, Mus musculus
acttagtcatgtcgtctgggttaca

SEQ ID NO: 133930 - DNA, 25 bp, Mus musculus
acttagtcatgtggtctgggttaca

SEQ ID NO: 133931 - DNA, 25 bp, Mus musculus
acttagtctccgagtgaagctccag

SEQ ID NO: 133932 - DNA, 25 bp, Mus musculus
acttagtctccgtgtgaagctccag

SEQ ID NO: 133933 - DNA, 25 bp, Mus musculus
acttagtgctctctgttttgttgct

SEQ ID NO: 133934 - DNA, 25 bp, Mus musculus
acttagtgctctgtgttttgttgct

SEQ ID NO: 133935 - DNA, 25 bp, Mus musculus
acttagttcacaagggttccctgat

SEQ ID NO: 133936 - DNA, 25 bp, Mus musculus
acttagttcacatgggttccctgat

SEQ ID NO: 133937 - DNA, 25 bp, Mus musculus
acttagttctcactgtcaggcgact

SEQ ID NO: 133938 - DNA, 25 bp, Mus musculus
acttagttctcagtgtcaggcgact

SEQ ID NO: 133939 - DNA, 25 bp, Mus musculus
acttagttgccacaccttggtccag

SEQ ID NO: 133940 - DNA, 25 bp, Mus musculus
acttagttgccagaccttggtccag

SEQ ID NO: 133941 - DNA, 25 bp, Mus musculus
acttagtttcttcgtgacaccactc

SEQ ID NO: 133942 - DNA, 25 bp, Mus musculus
acttagtttcttggtgacaccactc

SEQ ID NO: 133943 - DNA, 25 bp, Mus musculus
acttataacttcagagaggagctca

SEQ ID NO: 133944 - DNA, 25 bp, Mus musculus
acttataacttctgagaggagctca

SEQ ID NO: 133945 - DNA, 25 bp, Mus musculus
acttataatgacaactttaacagga

SEQ ID NO: 133946 - DNA, 25 bp, Mus musculus
acttataatgactactttaacagga

SEQ ID NO: 133947 - DNA, 25 bp, Mus musculus
acttatacacccacttgacgaactc

SEQ ID NO: 133948 - DNA, 25 bp, Mus musculus
acttatacaccctcttgacgaactc

SEQ ID NO: 133949 - DNA, 25 bp, Mus musculus
acttatacctctcagttacttcaga

SEQ ID NO: 133950 - DNA, 25 bp, Mus musculus
acttatacctctgagttacttcaga

SEQ ID NO: 133951 - DNA, 25 bp, Mus musculus
acttatagtttgctgtatatgtgac

SEQ ID NO: 133952 - DNA, 25 bp, Mus musculus
acttatagtttggtgtatatgtgac

SEQ ID NO: 133953 - DNA, 25 bp, Mus musculus
acttatatgataactccgaggtggt

SEQ ID NO: 133954 - DNA, 25 bp, Mus musculus
acttatatgatatctccgaggtggt

SEQ ID NO: 133955 - DNA, 25 bp, Mus musculus
acttatatggtgacagcacgcccac

SEQ ID NO: 133956 - DNA, 25 bp, Mus musculus
acttatatggtgtcagcacgcccac

SEQ ID NO: 133957 - DNA, 25 bp, Mus musculus
acttatcactgcaaattctgccctg

SEQ ID NO: 133958 - DNA, 25 bp, Mus musculus
acttatcactgctaattctgccctg

SEQ ID NO: 133959 - DNA, 25 bp, Mus musculus
acttatcagacacggcttttacaca

SEQ ID NO: 133960 - DNA, 25 bp, Mus musculus
acttatcagacagggcttttacaca

SEQ ID NO: 133961 - DNA, 25 bp, Mus musculus
acttatcagactagcttcacactaa

SEQ ID NO: 133962 - DNA, 25 bp, Mus musculus
acttatcagacttgcttcacactaa

SEQ ID NO: 133963 - DNA, 25 bp, Mus musculus
acttatcatgcaattgcttagttaa

SEQ ID NO: 133964 - DNA, 25 bp, Mus musculus
acttatcatgcatttgcttagttaa

SEQ ID NO: 133965 - DNA, 25 bp, Mus musculus
acttatcattgaatctgccccttat

SEQ ID NO: 133966 - DNA, 25 bp, Mus musculus
acttatcattgattctgccccttat

SEQ ID NO: 133967 - DNA, 25 bp, Mus musculus
acttatcccatcacatttattgaaa

SEQ ID NO: 133968 - DNA, 25 bp, Mus musculus
acttatcccatctcatttattgaaa

SEQ ID NO: 133969 - DNA, 25 bp, Mus musculus
acttatcccattactagagctagct

SEQ ID NO: 133970 - DNA, 25 bp, Mus musculus
acttatcccatttctagagctagct

SEQ ID NO: 133971 - DNA, 25 bp, Mus musculus
acttatccccagcatctggattacc

SEQ ID NO: 133972 - DNA, 25 bp, Mus musculus
acttatccccaggatctggattacc

SEQ ID NO: 133973 - DNA, 25 bp, Mus musculus
acttatccgaggcttagggctgcta

SEQ ID NO: 133974 - DNA, 25 bp, Mus musculus
acttatccgagggttagggctgcta

SEQ ID NO: 133975 - DNA, 25 bp, Mus musculus
acttatcctcttcttgttcacatct

SEQ ID NO: 133976 - DNA, 25 bp, Mus musculus
acttatcctcttgttgttcacatct

SEQ ID NO: 133977 - DNA, 25 bp, Mus musculus
acttatcgagttcctgactagccag

SEQ ID NO: 133978 - DNA, 25 bp, Mus musculus
acttatcgagttgctgactagccag

SEQ ID NO: 133979 - DNA, 25 bp, Mus musculus
acttatcggacgcttgactcctaga

SEQ ID NO: 133980 - DNA, 25 bp, Mus musculus
acttatcggacggttgactcctaga

SEQ ID NO: 133981 - DNA, 25 bp, Mus musculus
acttatctctaacctgaattcagga

SEQ ID NO: 133982 - DNA, 25 bp, Mus musculus
acttatctctaagctgaattcagga

SEQ ID NO: 133983 - DNA, 25 bp, Mus musculus
acttatctcttaacagtcaccttac

SEQ ID NO: 133984 - DNA, 25 bp, Mus musculus
acttatctcttatcagtcaccttac

SEQ ID NO: 133985 - DNA, 25 bp, Mus musculus
acttatctggacagtcacccgcaac

SEQ ID NO: 133986 - DNA, 25 bp, Mus musculus
acttatctggactgtcacccgcaac

SEQ ID NO: 133987 - DNA, 25 bp, Mus musculus
acttatctgttacttaatagcttat

SEQ ID NO: 133988 - DNA, 25 bp, Mus musculus
acttatctgttagttaatagcttat

SEQ ID NO: 133989 - DNA, 25 bp, Mus musculus
acttatgaaacacagcgacgttgct

SEQ ID NO: 133990 - DNA, 25 bp, Mus musculus
acttatgaaacagagcgacgttgct

SEQ ID NO: 133991 - DNA, 25 bp, Mus musculus
acttatgacagacccagtgtctggt

SEQ ID NO: 133992 - DNA, 25 bp, Mus musculus
acttatgacagagccagtgtctggt

SEQ ID NO: 133993 - DNA, 25 bp, Mus musculus
acttatgacgccatgaagcactggg

SEQ ID NO: 133994 - DNA, 25 bp, Mus musculus
acttatgacgccttgaagcactggg

SEQ ID NO: 133995 - DNA, 25 bp, Mus musculus
acttatgactttagccccagggtat

SEQ ID NO: 133996 - DNA, 25 bp, Mus musculus
acttatgacttttgccccagggtat

SEQ ID NO: 133997 - DNA, 25 bp, Mus musculus
acttatgaggtaaaggccagctggt

SEQ ID NO: 133998 - DNA, 25 bp, Mus musculus
acttatgaggtataggccagctggt

SEQ ID NO: 133999 - DNA, 25 bp, Mus musculus
acttatgagtacatttgggaaatgc

SEQ ID NO: 134000 - DNA, 25 bp, Mus musculus
acttatgagtacttttgggaaatgc

SEQ ID NO: 134001 - DNA, 25 bp, Mus musculus
acttatgattctatggatgtgacac

SEQ ID NO: 134002 - DNA, 25 bp, Mus musculus
acttatgattctttggatgtgacac

SEQ ID NO: 134003 - DNA, 25 bp, Mus musculus
acttatgattttaagggccttcctg

SEQ ID NO: 134004 - DNA, 25 bp, Mus musculus
acttatgatttttagggccttcctg

SEQ ID NO: 134005 - DNA, 25 bp, Mus musculus
acttatgcagcaactgactcagcat

SEQ ID NO: 134006 - DNA, 25 bp, Mus musculus
acttatgcagcatctgactcagcat

SEQ ID NO: 134007 - DNA, 25 bp, Mus musculus
acttatgccaaaacagttgtgtttc

SEQ ID NO: 134008 - DNA, 25 bp, Mus musculus
acttatgccaaatcagttgtgtttc

SEQ ID NO: 134009 - DNA, 25 bp, Mus musculus
acttatggactcatttgatagctga

SEQ ID NO: 134010 - DNA, 25 bp, Mus musculus
acttatggactcttttgatagctga

SEQ ID NO: 134011 - DNA, 25 bp, Mus musculus
acttatggatctctgtaatgggcaa

SEQ ID NO: 134012 - DNA, 25 bp, Mus musculus
acttatggatctgtgtaatgggcaa

SEQ ID NO: 134013 - DNA, 25 bp, Mus musculus
acttatgggcatatcttcctagctg

SEQ ID NO: 134014 - DNA, 25 bp, Mus musculus
acttatgggcatttcttcctagctg

SEQ ID NO: 134015 - DNA, 25 bp, Mus musculus
acttatgtaaaaatatgtgccttct

SEQ ID NO: 134016 - DNA, 25 bp, Mus musculus
acttatgtaaaattatgtgccttct

SEQ ID NO: 134017 - DNA, 25 bp, Mus musculus
acttatgtatgtcttccacgtgtgt

SEQ ID NO: 134018 - DNA, 25 bp, Mus musculus
acttatgtatgtgttccacgtgtgt

SEQ ID NO: 134019 - DNA, 25 bp, Mus musculus
acttatgtatttcaatgggtgccag

SEQ ID NO: 134020 - DNA, 25 bp, Mus musculus
acttatgtatttgaatgggtgccag

SEQ ID NO: 134021 - DNA, 25 bp, Mus musculus
acttatgtcaaaatgtctgcagcag

SEQ ID NO: 134022 - DNA, 25 bp, Mus musculus
acttatgtcaaattgtctgcagcag

SEQ ID NO: 134023 - DNA, 25 bp, Mus musculus
acttatgtcttccaaatccgagctc

SEQ ID NO: 134024 - DNA, 25 bp, Mus musculus
acttatgtcttcgaaatccgagctc

SEQ ID NO: 134025 - DNA, 25 bp, Mus musculus
acttatgtgaccaggctaccagcta

SEQ ID NO: 134026 - DNA, 25 bp, Mus musculus
acttatgtgacctggctaccagcta

SEQ ID NO: 134027 - DNA, 25 bp, Mus musculus
acttatgtgttgagtgatccaggaa

SEQ ID NO: 134028 - DNA, 25 bp, Mus musculus
acttatgtgttgtgtgatccaggaa

SEQ ID NO: 134029 - DNA, 25 bp, Mus musculus
acttatgttaagatcagcccaggga

SEQ ID NO: 134030 - DNA, 25 bp, Mus musculus
acttatgttaagttcagcccaggga

SEQ ID NO: 134031 - DNA, 25 bp, Mus musculus
acttatgttttgctttagctcaagt

SEQ ID NO: 134032 - DNA, 25 bp, Mus musculus
acttatgttttggtttagctcaagt

SEQ ID NO: 134033 - DNA, 25 bp, Mus musculus
acttattaaaagcaagccaggcgtg

SEQ ID NO: 134034 - DNA, 25 bp, Mus musculus
acttattaaaaggaagccaggcgtg

SEQ ID NO: 134035 - DNA, 25 bp, Mus musculus
acttattaaactagccccacagtgc

SEQ ID NO: 134036 - DNA, 25 bp, Mus musculus
acttattaaacttgccccacagtgc

SEQ ID NO: 134037 - DNA, 25 bp, Mus musculus
acttattaagtcagtcaagttgtgc

SEQ ID NO: 134038 - DNA, 25 bp, Mus musculus
acttattaagtctgtcaagttgtgc

SEQ ID NO: 134039 - DNA, 25 bp, Mus musculus
acttattaatggctgagggcagtca

SEQ ID NO: 134040 - DNA, 25 bp, Mus musculus
acttattaatgggtgagggcagtca

SEQ ID NO: 134041 - DNA, 25 bp, Mus musculus
acttattactaaagtgccctcctag

SEQ ID NO: 134042 - DNA, 25 bp, Mus musculus
acttattactaatgtgccctcctag

SEQ ID NO: 134043 - DNA, 25 bp, Mus musculus
acttattactgccagcagtggtgtg

SEQ ID NO: 134044 - DNA, 25 bp, Mus musculus
acttattactgcgagcagtggtgtg

SEQ ID NO: 134045 - DNA, 25 bp, Mus musculus
acttattaggtgagccaagttggct

SEQ ID NO: 134046 - DNA, 25 bp, Mus musculus
acttattaggtgtgccaagttggct

SEQ ID NO: 134047 - DNA, 25 bp, Mus musculus
acttattcatgaacactactgccca

SEQ ID NO: 134048 - DNA, 25 bp, Mus musculus
acttattcatgatcactactgccca

SEQ ID NO: 134049 - DNA, 25 bp, Mus musculus
acttattccgaactgtgaaggacac

SEQ ID NO: 134050 - DNA, 25 bp, Mus musculus
acttattccgaagtgtgaaggacac

SEQ ID NO: 134051 - DNA, 25 bp, Mus musculus
acttattctgtcaggtctttgtgaa

SEQ ID NO: 134052 - DNA, 25 bp, Mus musculus
acttattctgtctggtctttgtgaa

SEQ ID NO: 134053 - DNA, 25 bp, Mus musculus
acttattgattcacttctacccctg

SEQ ID NO: 134054 - DNA, 25 bp, Mus musculus
acttattgattctcttctacccctg

SEQ ID NO: 134055 - DNA, 25 bp, Mus musculus
acttattgtgtcctcttgtagtata

SEQ ID NO: 134056 - DNA, 25 bp, Mus musculus
acttattgtgtcgtcttgtagtata

SEQ ID NO: 134057 - DNA, 25 bp, Mus musculus
acttatttaacacggctcagtctcc

SEQ ID NO: 134058 - DNA, 25 bp, Mus musculus
acttatttaacagggctcagtctcc

SEQ ID NO: 134059 - DNA, 25 bp, Mus musculus
acttatttacccactctgagtttgt

SEQ ID NO: 134060 - DNA, 25 bp, Mus musculus
acttatttaccctctctgagtttgt

SEQ ID NO: 134061 - DNA, 25 bp, Mus musculus
acttatttcaacatggctcactgcc

SEQ ID NO: 134062 - DNA, 25 bp, Mus musculus
acttatttcaacctatgattgagag

SEQ ID NO: 134063 - DNA, 25 bp, Mus musculus
acttatttcaacgtatgattgagag

SEQ ID NO: 134064 - DNA, 25 bp, Mus musculus
acttatttcaacttggctcactgcc

SEQ ID NO: 134065 - DNA, 25 bp, Mus musculus
acttatttcctgatctgaccctgca

SEQ ID NO: 134066 - DNA, 25 bp, Mus musculus
acttatttcctgttctgaccctgca

SEQ ID NO: 134067 - DNA, 25 bp, Mus musculus
acttatttctcccattactgcctgg

SEQ ID NO: 134068 - DNA, 25 bp, Mus musculus
acttatttctccgattactgcctgg

SEQ ID NO: 134069 - DNA, 25 bp, Mus musculus
acttatttgcttcttgatcccagga

SEQ ID NO: 134070 - DNA, 25 bp, Mus musculus
acttatttgcttgttgatcccagga

SEQ ID NO: 134071 - DNA, 25 bp, Mus musculus
acttatttgtcaccgagtgtctttc

SEQ ID NO: 134072 - DNA, 25 bp, Mus musculus
acttatttgtcagcgagtgtctttc

SEQ ID NO: 134073 - DNA, 25 bp, Mus musculus
acttatttgttgagctaccatggga

SEQ ID NO: 134074 - DNA, 25 bp, Mus musculus
acttatttgttgtgctaccatggga

SEQ ID NO: 134075 - DNA, 25 bp, Mus musculus
acttattttcatctgtgctctggct

SEQ ID NO: 134076 - DNA, 25 bp, Mus musculus
acttattttcatgtgtgctctggct

SEQ ID NO: 134077 - DNA, 25 bp, Mus musculus
acttattttgagataattcactgtc

SEQ ID NO: 134078 - DNA, 25 bp, Mus musculus
acttattttgagttaattcactgtc

SEQ ID NO: 134079 - DNA, 25 bp, Mus musculus
acttattttgcacggcctttgagaa

SEQ ID NO: 134080 - DNA, 25 bp, Mus musculus
acttattttgcagggcctttgagaa

SEQ ID NO: 134081 - DNA, 25 bp, Mus musculus
acttcaaaaaacagcccggtggcat

SEQ ID NO: 134082 - DNA, 25 bp, Mus musculus
acttcaaaaaactgcccggtggcat

SEQ ID NO: 134083 - DNA, 25 bp, Mus musculus
acttcaaaagcccaagcaaggccca

SEQ ID NO: 134084 - DNA, 25 bp, Mus musculus
acttcaaaagccgaagcaaggccca

SEQ ID NO: 134085 - DNA, 25 bp, Mus musculus
acttcaaaaggactggagggtagca

SEQ ID NO: 134086 - DNA, 25 bp, Mus musculus
acttcaaaaggagtggagggtagca

SEQ ID NO: 134087 - DNA, 25 bp, Mus musculus
acttcaaatgttatgggcccttatt

SEQ ID NO: 134088 - DNA, 25 bp, Mus musculus
acttcaaatgttttgggcccttatt

SEQ ID NO: 134089 - DNA, 25 bp, Mus musculus
acttcaaattgacaggacttccagg

SEQ ID NO: 134090 - DNA, 25 bp, Mus musculus
acttcaaattgagaggacttccagg

SEQ ID NO: 134091 - DNA, 25 bp, Mus musculus
acttcaacaccaactccaggaggcc

SEQ ID NO: 134092 - DNA, 25 bp, Mus musculus
acttcaacaccatctccaggaggcc

SEQ ID NO: 134093 - DNA, 25 bp, Mus musculus
acttcaacacttatgcatctttctt

SEQ ID NO: 134094 - DNA, 25 bp, Mus musculus
acttcaacacttttgcatctttctt

SEQ ID NO: 134095 - DNA, 25 bp, Mus musculus
acttcaacagaacggtcccagctat

SEQ ID NO: 134096 - DNA, 25 bp, Mus musculus
acttcaacagaagggtcccagctat

SEQ ID NO: 134097 - DNA, 25 bp, Mus musculus
acttcaacatacatgggctgcacca

SEQ ID NO: 134098 - DNA, 25 bp, Mus musculus
acttcaacatacttgggctgcacca

SEQ ID NO: 134099 - DNA, 25 bp, Mus musculus
acttcaacgaaaacaggcggcgggt

SEQ ID NO: 134100 - DNA, 25 bp, Mus musculus
acttcaacgaaatcaggcggcgggt

SEQ ID NO: 134101 - DNA, 25 bp, Mus musculus
acttcaacgactctggtcatttccc

SEQ ID NO: 134102 - DNA, 25 bp, Mus musculus
acttcaacgactgtggtcatttccc

SEQ ID NO: 134103 - DNA, 25 bp, Mus musculus
acttcaactaatcaggctaaccatg

SEQ ID NO: 134104 - DNA, 25 bp, Mus musculus
acttcaactaatgaggctaaccatg

SEQ ID NO: 134105 - DNA, 25 bp, Mus musculus
acttcaagaagactggtggttccca

SEQ ID NO: 134106 - DNA, 25 bp, Mus musculus
acttcaagaagagtggtggttccca

SEQ ID NO: 134107 - DNA, 25 bp, Mus musculus
acttcaagcaagatcttttgcggga

SEQ ID NO: 134108 - DNA, 25 bp, Mus musculus
acttcaagcaagttcttttgcggga

SEQ ID NO: 134109 - DNA, 25 bp, Mus musculus
acttcaagccctcttgcattagcat

SEQ ID NO: 134110 - DNA, 25 bp, Mus musculus
acttcaagccctgttgcattagcat

SEQ ID NO: 134111 - DNA, 25 bp, Mus musculus
acttcaaggaacctgcgcatgcaaa

SEQ ID NO: 134112 - DNA, 25 bp, Mus musculus
acttcaaggaacgtgcgcatgcaaa

SEQ ID NO: 134113 - DNA, 25 bp, Mus musculus
acttcaaggcaacatcaatgatgag

SEQ ID NO: 134114 - DNA, 25 bp, Mus musculus
acttcaaggcaagatcaatgatgag

SEQ ID NO: 134115 - DNA, 25 bp, Mus musculus
acttcaaggtcgcagagggcttcga

SEQ ID NO: 134116 - DNA, 25 bp, Mus musculus
acttcaaggtcggagagggcttcga

SEQ ID NO: 134117 - DNA, 25 bp, Mus musculus
acttcaagtcgtcgatgcggaccca

SEQ ID NO: 134118 - DNA, 25 bp, Mus musculus
acttcaagtcgtggatgcggaccca

SEQ ID NO: 134119 - DNA, 25 bp, Mus musculus
acttcaagtcttcgagctcggaact

SEQ ID NO: 134120 - DNA, 25 bp, Mus musculus
acttcaagtcttggagctcggaact

SEQ ID NO: 134121 - DNA, 25 bp, Mus musculus
acttcaagttttctgacagaatctc

SEQ ID NO: 134122 - DNA, 25 bp, Mus musculus
acttcaagttttgtgacagaatctc

SEQ ID NO: 134123 - DNA, 25 bp, Mus musculus
acttcaatagttacgggtgtcatgg

SEQ ID NO: 134124 - DNA, 25 bp, Mus musculus
acttcaatagtttcgggtgtcatgg

SEQ ID NO: 134125 - DNA, 25 bp, Mus musculus
acttcaatcctaatctgaacaccgg

SEQ ID NO: 134126 - DNA, 25 bp, Mus musculus
acttcaatcctattctgaacaccgg

SEQ ID NO: 134127 - DNA, 25 bp, Mus musculus
acttcaatctgaatcctgtgggact

SEQ ID NO: 134128 - DNA, 25 bp, Mus musculus
acttcaatctgattcctgtgggact

SEQ ID NO: 134129 - DNA, 25 bp, Mus musculus
acttcaatctgtatggctggcttgc

SEQ ID NO: 134130 - DNA, 25 bp, Mus musculus
acttcaatctgtttggctggcttgc

SEQ ID NO: 134131 - DNA, 25 bp, Mus musculus
acttcaatgagaccgtgcttactgt

SEQ ID NO: 134132 - DNA, 25 bp, Mus musculus
acttcaatgagagcgtgcttactgt

SEQ ID NO: 134133 - DNA, 25 bp, Mus musculus
acttcaatgctaagttccaaccgtc

SEQ ID NO: 134134 - DNA, 25 bp, Mus musculus
acttcaatgctatgttccaaccgtc

SEQ ID NO: 134135 - DNA, 25 bp, Mus musculus
acttcaattattatgttccacactg

SEQ ID NO: 134136 - DNA, 25 bp, Mus musculus
acttcaattattttgttccacactg

SEQ ID NO: 134137 - DNA, 25 bp, Mus musculus
acttcacaaaacatgaaagggctct

SEQ ID NO: 134138 - DNA, 25 bp, Mus musculus
acttcacaaaacttgaaagggctct

SEQ ID NO: 134139 - DNA, 25 bp, Mus musculus
acttcacaacgcagcgtcttatggg

SEQ ID NO: 134140 - DNA, 25 bp, Mus musculus
acttcacaacgctgcgtcttatggg

SEQ ID NO: 134141 - DNA, 25 bp, Mus musculus
acttcacaaggtcttcgctacaggc

SEQ ID NO: 134142 - DNA, 25 bp, Mus musculus
acttcacaaggtgttcgctacaggc

SEQ ID NO: 134143 - DNA, 25 bp, Mus musculus
acttcacaatcaactatttttccta

SEQ ID NO: 134144 - DNA, 25 bp, Mus musculus
acttcacaatcatctatttttccta

SEQ ID NO: 134145 - DNA, 25 bp, Mus musculus
acttcacagcggagtccaaggttgt

SEQ ID NO: 134146 - DNA, 25 bp, Mus musculus
acttcacagcggtgtccaaggttgt

SEQ ID NO: 134147 - DNA, 25 bp, Mus musculus
acttcacaggaaccacaggccgatt

SEQ ID NO: 134148 - DNA, 25 bp, Mus musculus
acttcacaggaagcacaggccgatt

SEQ ID NO: 134149 - DNA, 25 bp, Mus musculus
acttcacaggttcgactttgggact

SEQ ID NO: 134150 - DNA, 25 bp, Mus musculus
acttcacaggttggactttgggact

SEQ ID NO: 134151 - DNA, 25 bp, Mus musculus
acttcacatcggaaacatgcagcta

SEQ ID NO: 134152 - DNA, 25 bp, Mus musculus
acttcacatcggtaacatgcagcta

SEQ ID NO: 134153 - DNA, 25 bp, Mus musculus
acttcacatttgagcagtgactgca

SEQ ID NO: 134154 - DNA, 25 bp, Mus musculus
acttcacatttgtgcagtgactgca

SEQ ID NO: 134155 - DNA, 25 bp, Mus musculus
acttcaccatccatcagctgaggga

SEQ ID NO: 134156 - DNA, 25 bp, Mus musculus
acttcaccatccttcagctgaggga

SEQ ID NO: 134157 - DNA, 25 bp, Mus musculus
acttcacccatccagtatttcttga

SEQ ID NO: 134158 - DNA, 25 bp, Mus musculus
acttcacccatcgagtatttcttga

SEQ ID NO: 134159 - DNA, 25 bp, Mus musculus
acttcaccccacagcaattaggtaa

SEQ ID NO: 134160 - DNA, 25 bp, Mus musculus
acttcaccccactgcaattaggtaa

SEQ ID NO: 134161 - DNA, 25 bp, Mus musculus
acttcaccctgcacatttctacatg

SEQ ID NO: 134162 - DNA, 25 bp, Mus musculus
acttcaccctgctcatttctacatg

SEQ ID NO: 134163 - DNA, 25 bp, Mus musculus
acttcaccctggctgtagaggtcaa

SEQ ID NO: 134164 - DNA, 25 bp, Mus musculus
acttcaccctgggtgtagaggtcaa

SEQ ID NO: 134165 - DNA, 25 bp, Mus musculus
acttcacccttgctgacttgtggtg

SEQ ID NO: 134166 - DNA, 25 bp, Mus musculus
acttcacccttggtgacttgtggtg

SEQ ID NO: 134167 - DNA, 25 bp, Mus musculus
acttcaccgaatactttctggagat

SEQ ID NO: 134168 - DNA, 25 bp, Mus musculus
acttcaccgaattctttctggagat

SEQ ID NO: 134169 - DNA, 25 bp, Mus musculus
acttcacctatgaaccccatgaggt

SEQ ID NO: 134170 - DNA, 25 bp, Mus musculus
acttcacctatgtaccccatgaggt

SEQ ID NO: 134171 - DNA, 25 bp, Mus musculus
acttcacctggtcaagatgccgagc

SEQ ID NO: 134172 - DNA, 25 bp, Mus musculus
acttcacctggtgaagatgccgagc

SEQ ID NO: 134173 - DNA, 25 bp, Mus musculus
acttcaccttatattataacctgtg

SEQ ID NO: 134174 - DNA, 25 bp, Mus musculus
acttcaccttattttataacctgtg

SEQ ID NO: 134175 - DNA, 25 bp, Mus musculus
acttcacgcggaacctgcagatgga

SEQ ID NO: 134176 - DNA, 25 bp, Mus musculus
acttcacgcggatcctgcagatgga

SEQ ID NO: 134177 - DNA, 25 bp, Mus musculus
acttcacgggataagcactgcgaga

SEQ ID NO: 134178 - DNA, 25 bp, Mus musculus
acttcacgggattagcactgcgaga

SEQ ID NO: 134179 - DNA, 25 bp, Mus musculus
acttcacgtgcactttgtccagtta

SEQ ID NO: 134180 - DNA, 25 bp, Mus musculus
acttcacgtgcagtttgtccagtta

SEQ ID NO: 134181 - DNA, 25 bp, Mus musculus
acttcactacagagtggctgtgata

SEQ ID NO: 134182 - DNA, 25 bp, Mus musculus
acttcactacagtgtggctgtgata

SEQ ID NO: 134183 - DNA, 25 bp, Mus musculus
acttcactcacgctgtgtccaacat

SEQ ID NO: 134184 - DNA, 25 bp, Mus musculus
acttcactcacggtgtgtccaacat

SEQ ID NO: 134185 - DNA, 25 bp, Mus musculus
acttcactctaaccctggtgacctg

SEQ ID NO: 134186 - DNA, 25 bp, Mus musculus
acttcactctaagcctggtgacctg

SEQ ID NO: 134187 - DNA, 25 bp, Mus musculus
acttcactctggacttcagacatta

SEQ ID NO: 134188 - DNA, 25 bp, Mus musculus
acttcactctggtcttcagacatta

SEQ ID NO: 134189 - DNA, 25 bp, Mus musculus
acttcactgaggacacttggtaact

SEQ ID NO: 134190 - DNA, 25 bp, Mus musculus
acttcactgaggtcacttggtaact

SEQ ID NO: 134191 - DNA, 25 bp, Mus musculus
acttcactgagtcacttcatccatt

SEQ ID NO: 134192 - DNA, 25 bp, Mus musculus
acttcactgagtgacttcatccatt

SEQ ID NO: 134193 - DNA, 25 bp, Mus musculus
acttcactgatgcttgtctggtaat

SEQ ID NO: 134194 - DNA, 25 bp, Mus musculus
acttcactgatggttgtctggtaat

SEQ ID NO: 134195 - DNA, 25 bp, Mus musculus
acttcactgcatagtgcctatccgg

SEQ ID NO: 134196 - DNA, 25 bp, Mus musculus
acttcactgcattgtgcctatccgg

SEQ ID NO: 134197 - DNA, 25 bp, Mus musculus
acttcactgggcacaggtacctgct

SEQ ID NO: 134198 - DNA, 25 bp, Mus musculus
acttcactgggctcaggtacctgct

SEQ ID NO: 134199 - DNA, 25 bp, Mus musculus
acttcactggtcctagaacttctag

SEQ ID NO: 134200 - DNA, 25 bp, Mus musculus
acttcactggtcgtagaacttctag

SEQ ID NO: 134201 - DNA, 25 bp, Mus musculus
acttcactgttcaggtggtactcca

SEQ ID NO: 134202 - DNA, 25 bp, Mus musculus
acttcactgttctggtggtactcca

SEQ ID NO: 134203 - DNA, 25 bp, Mus musculus
acttcacttcggacagagccttaag

SEQ ID NO: 134204 - DNA, 25 bp, Mus musculus
acttcacttcggtcagagccttaag

SEQ ID NO: 134205 - DNA, 25 bp, Mus musculus
acttcacttctaactgtggcctgaa

SEQ ID NO: 134206 - DNA, 25 bp, Mus musculus
acttcacttctatctgtggcctgaa

SEQ ID NO: 134207 - DNA, 25 bp, Mus musculus
acttcacttctccatggctattgca

SEQ ID NO: 134208 - DNA, 25 bp, Mus musculus
acttcacttctcgatggctattgca

SEQ ID NO: 134209 - DNA, 25 bp, Mus musculus
acttcacttgaacctggaagcattt

SEQ ID NO: 134210 - DNA, 25 bp, Mus musculus
acttcacttgaagctggaagcattt

SEQ ID NO: 134211 - DNA, 25 bp, Mus musculus
acttcacttgggagtaaatcttgag

SEQ ID NO: 134212 - DNA, 25 bp, Mus musculus
acttcacttgggtgtaaatcttgag

SEQ ID NO: 134213 - DNA, 25 bp, Mus musculus
acttcacttgtgctacagacaccga

SEQ ID NO: 134214 - DNA, 25 bp, Mus musculus
acttcacttgtggtacagacaccga

SEQ ID NO: 134215 - DNA, 25 bp, Mus musculus
acttcactttaaattcctgtgcagt

SEQ ID NO: 134216 - DNA, 25 bp, Mus musculus
acttcactttaatttcctgtgcagt

SEQ ID NO: 134217 - DNA, 25 bp, Mus musculus
acttcagaagcaaaattgcagcctg

SEQ ID NO: 134218 - DNA, 25 bp, Mus musculus
acttcagaagcataattgcagcctg

SEQ ID NO: 134219 - DNA, 25 bp, Mus musculus
acttcagaaggaatctcatttctct

SEQ ID NO: 134220 - DNA, 25 bp, Mus musculus
acttcagaaggattctcatttctct

SEQ ID NO: 134221 - DNA, 25 bp, Mus musculus
acttcagacattagatcttcctccc

SEQ ID NO: 134222 - DNA, 25 bp, Mus musculus
acttcagacatttgatcttcctccc

SEQ ID NO: 134223 - DNA, 25 bp, Mus musculus
acttcagactctacattggtgggaa

SEQ ID NO: 134224 - DNA, 25 bp, Mus musculus
acttcagactcttcattggtgggaa

SEQ ID NO: 134225 - DNA, 25 bp, Mus musculus
acttcagagatcacacagggagcac

SEQ ID NO: 134226 - DNA, 25 bp, Mus musculus
acttcagagatctcacagggagcac

SEQ ID NO: 134227 - DNA, 25 bp, Mus musculus
acttcagagatgacaatgcctcttt

SEQ ID NO: 134228 - DNA, 25 bp, Mus musculus
acttcagagatgtcaatgcctcttt

SEQ ID NO: 134229 - DNA, 25 bp, Mus musculus
acttcagagctgattatcatccttt

SEQ ID NO: 134230 - DNA, 25 bp, Mus musculus
acttcagagctgtttatcatccttt

SEQ ID NO: 134231 - DNA, 25 bp, Mus musculus
acttcagagcttaccttgttaacag

SEQ ID NO: 134232 - DNA, 25 bp, Mus musculus
acttcagagctttccttgttaacag

SEQ ID NO: 134233 - DNA, 25 bp, Mus musculus
acttcagagggacttagcaactttc

SEQ ID NO: 134234 - DNA, 25 bp, Mus musculus
acttcagagggagttagcaactttc

SEQ ID NO: 134235 - DNA, 25 bp, Mus musculus
acttcagatgcacattgcccaccag

SEQ ID NO: 134236 - DNA, 25 bp, Mus musculus
acttcagatgcagattgcccaccag

SEQ ID NO: 134237 - DNA, 25 bp, Mus musculus
acttcagattttcaggacccctctt

SEQ ID NO: 134238 - DNA, 25 bp, Mus musculus
acttcagattttgaggacccctctt

SEQ ID NO: 134239 - DNA, 25 bp, Mus musculus
acttcagcaacacccctgagtcgaa

SEQ ID NO: 134240 - DNA, 25 bp, Mus musculus
acttcagcaacagccctgagtcgaa

SEQ ID NO: 134241 - DNA, 25 bp, Mus musculus
acttcagcacctccctagagcttgg

SEQ ID NO: 134242 - DNA, 25 bp, Mus musculus
acttcagcacctgcctagagcttgg

SEQ ID NO: 134243 - DNA, 25 bp, Mus musculus
acttcagcatcactagttgtgagac

SEQ ID NO: 134244 - DNA, 25 bp, Mus musculus
acttcagcatcagtagttgtgagac

SEQ ID NO: 134245 - DNA, 25 bp, Mus musculus
acttcagcatccatagttcctccag

SEQ ID NO: 134246 - DNA, 25 bp, Mus musculus
acttcagcatccttagttcctccag

SEQ ID NO: 134247 - DNA, 25 bp, Mus musculus
acttcagcatttctaacatggtgca

SEQ ID NO: 134248 - DNA, 25 bp, Mus musculus
acttcagcatttgtaacatggtgca

SEQ ID NO: 134249 - DNA, 25 bp, Mus musculus
acttcagcccatcggaacttgagtg

SEQ ID NO: 134250 - DNA, 25 bp, Mus musculus
acttcagcccatgggaacttgagtg

SEQ ID NO: 134251 - DNA, 25 bp, Mus musculus
acttcagcccttaagattggattgc

SEQ ID NO: 134252 - DNA, 25 bp, Mus musculus
acttcagccctttagattggattgc

SEQ ID NO: 134253 - DNA, 25 bp, Mus musculus
acttcagcctcaagaactgcaaccg

SEQ ID NO: 134254 - DNA, 25 bp, Mus musculus
acttcagcctcatgaactgcaaccg

SEQ ID NO: 134255 - DNA, 25 bp, Mus musculus
acttcagcctgtatctagcacgtgg

SEQ ID NO: 134256 - DNA, 25 bp, Mus musculus
acttcagcctgtttctagcacgtgg

SEQ ID NO: 134257 - DNA, 25 bp, Mus musculus
acttcagccttacactttcctggaa

SEQ ID NO: 134258 - DNA, 25 bp, Mus musculus
acttcagccttagactttcctggaa

SEQ ID NO: 134259 - DNA, 25 bp, Mus musculus
acttcagctagtctcagcgtcagcg

SEQ ID NO: 134260 - DNA, 25 bp, Mus musculus
acttcagctagtgtcagcgtcagcg

SEQ ID NO: 134261 - DNA, 25 bp, Mus musculus
acttcagctgctctaggtgctacag

SEQ ID NO: 134262 - DNA, 25 bp, Mus musculus
acttcagctgctgtaggtgctacag

SEQ ID NO: 134263 - DNA, 25 bp, Mus musculus
acttcagctggcagagaccatctca

SEQ ID NO: 134264 - DNA, 25 bp, Mus musculus
acttcagctggctgagaccatctca

SEQ ID NO: 134265 - DNA, 25 bp, Mus musculus
acttcagcttacagcttacacttcc

SEQ ID NO: 134266 - DNA, 25 bp, Mus musculus
acttcagcttactgcttacacttcc

SEQ ID NO: 134267 - DNA, 25 bp, Mus musculus
acttcagctttgctactactgcagc

SEQ ID NO: 134268 - DNA, 25 bp, Mus musculus
acttcagctttggtactactgcagc

SEQ ID NO: 134269 - DNA, 25 bp, Mus musculus
acttcaggaaaacccgcactttata

SEQ ID NO: 134270 - DNA, 25 bp, Mus musculus
acttcaggaaaagccgcactttata

SEQ ID NO: 134271 - DNA, 25 bp, Mus musculus
acttcaggacctcgtatgcctcaag

SEQ ID NO: 134272 - DNA, 25 bp, Mus musculus
acttcaggacctcttttctaagcag

SEQ ID NO: 134273 - DNA, 25 bp, Mus musculus
acttcaggacctggtatgcctcaag

SEQ ID NO: 134274 - DNA, 25 bp, Mus musculus
acttcaggacctgttttctaagcag

SEQ ID NO: 134275 - DNA, 25 bp, Mus musculus
acttcaggatgtactctggtttcct

SEQ ID NO: 134276 - DNA, 25 bp, Mus musculus
acttcaggatgttctctggtttcct

SEQ ID NO: 134277 - DNA, 25 bp, Mus musculus
acttcaggatttacttcagcatttg

SEQ ID NO: 134278 - DNA, 25 bp, Mus musculus
acttcaggattttcttcagcatttg

SEQ ID NO: 134279 - DNA, 25 bp, Mus musculus
acttcaggccgacccatcttgcggt

SEQ ID NO: 134280 - DNA, 25 bp, Mus musculus
acttcaggccgagccatcttgcggt

SEQ ID NO: 134281 - DNA, 25 bp, Mus musculus
acttcaggctccagtggaccactta

SEQ ID NO: 134282 - DNA, 25 bp, Mus musculus
acttcaggctcctgtggaccactta

SEQ ID NO: 134283 - DNA, 25 bp, Mus musculus
acttcagggctcaacagtttcaacc

SEQ ID NO: 134284 - DNA, 25 bp, Mus musculus
acttcagggctctacagtttcaacc

SEQ ID NO: 134285 - DNA, 25 bp, Mus musculus
acttcagggcttcacttttgtacaa

SEQ ID NO: 134286 - DNA, 25 bp, Mus musculus
acttcagggcttgacttttgtacaa

SEQ ID NO: 134287 - DNA, 25 bp, Mus musculus
acttcagggttgagcagcacttggg

SEQ ID NO: 134288 - DNA, 25 bp, Mus musculus
acttcagggttgtgcagcacttggg

SEQ ID NO: 134289 - DNA, 25 bp, Mus musculus
acttcaggtgtacctcagattttgg

SEQ ID NO: 134290 - DNA, 25 bp, Mus musculus
acttcaggtgtagctcagattttgg

SEQ ID NO: 134291 - DNA, 25 bp, Mus musculus
acttcaggttcaccatctctaaggc

SEQ ID NO: 134292 - DNA, 25 bp, Mus musculus
acttcaggttcagcatctctaaggc

SEQ ID NO: 134293 - DNA, 25 bp, Mus musculus
acttcagtaaacaggcttggttcct

SEQ ID NO: 134294 - DNA, 25 bp, Mus musculus
acttcagtaaactggcttggttcct

SEQ ID NO: 134295 - DNA, 25 bp, Mus musculus
acttcagtaaccaccgttcggtgtg

SEQ ID NO: 134296 - DNA, 25 bp, Mus musculus
acttcagtaacctccgttcggtgtg

SEQ ID NO: 134297 - DNA, 25 bp, Mus musculus
acttcagtcaccctgtgaacagacc

SEQ ID NO: 134298 - DNA, 25 bp, Mus musculus
acttcagtcaccgtgtgaacagacc

SEQ ID NO: 134299 - DNA, 25 bp, Mus musculus
acttcagtccaacattgcccaatga

SEQ ID NO: 134300 - DNA, 25 bp, Mus musculus
acttcagtccaagattgcccaatga

SEQ ID NO: 134301 - DNA, 25 bp, Mus musculus
acttcagtccagcagagtgggctct

SEQ ID NO: 134302 - DNA, 25 bp, Mus musculus
acttcagtccaggagagtgggctct

SEQ ID NO: 134303 - DNA, 25 bp, Mus musculus
acttcagtccctctggattcataag

SEQ ID NO: 134304 - DNA, 25 bp, Mus musculus
acttcagtccctgtggattcataag

SEQ ID NO: 134305 - DNA, 25 bp, Mus musculus
acttcagtctagagtcagccaagaa

SEQ ID NO: 134306 - DNA, 25 bp, Mus musculus
acttcagtctagtgtcagccaagaa

SEQ ID NO: 134307 - DNA, 25 bp, Mus musculus
acttcagtctcacgaaccagcgtgg

SEQ ID NO: 134308 - DNA, 25 bp, Mus musculus
acttcagtctcaggaaccagcgtgg

SEQ ID NO: 134309 - DNA, 25 bp, Mus musculus
acttcagtctgccatctcagtaagt

SEQ ID NO: 134310 - DNA, 25 bp, Mus musculus
acttcagtctgcgatctcagtaagt

SEQ ID NO: 134311 - DNA, 25 bp, Mus musculus
acttcagtcttaatgtgtttgtcct

SEQ ID NO: 134312 - DNA, 25 bp, Mus musculus
acttcagtcttattgtgtttgtcct

SEQ ID NO: 134313 - DNA, 25 bp, Mus musculus
acttcagtgcacaatgttcttcggg

SEQ ID NO: 134314 - DNA, 25 bp, Mus musculus
acttcagtgcactatgttcttcggg

SEQ ID NO: 134315 - DNA, 25 bp, Mus musculus
acttcagtgcagatgtgagcctctc

SEQ ID NO: 134316 - DNA, 25 bp, Mus musculus
acttcagtgcagttgtgagcctctc

SEQ ID NO: 134317 - DNA, 25 bp, Mus musculus
acttcagtgctgattcagcccagag

SEQ ID NO: 134318 - DNA, 25 bp, Mus musculus
acttcagtgctgtttcagcccagag

SEQ ID NO: 134319 - DNA, 25 bp, Mus musculus
acttcagtggaaccaagatttggat

SEQ ID NO: 134320 - DNA, 25 bp, Mus musculus
acttcagtggaagcaagatttggat

SEQ ID NO: 134321 - DNA, 25 bp, Mus musculus
acttcagtggccaaggcttcagcga

SEQ ID NO: 134322 - DNA, 25 bp, Mus musculus
acttcagtggcctaggcttcagcga

SEQ ID NO: 134323 - DNA, 25 bp, Mus musculus
acttcagtgtgcataatggctgcca

SEQ ID NO: 134324 - DNA, 25 bp, Mus musculus
acttcagtgtgcttaatggctgcca

SEQ ID NO: 134325 - DNA, 25 bp, Mus musculus
acttcagttatgatgtttggacctt

SEQ ID NO: 134326 - DNA, 25 bp, Mus musculus
acttcagttatgcagtaggcgtctg

SEQ ID NO: 134327 - DNA, 25 bp, Mus musculus
acttcagttatggagtaggcgtctg

SEQ ID NO: 134328 - DNA, 25 bp, Mus musculus
acttcagttatgttgtttggacctt

SEQ ID NO: 134329 - DNA, 25 bp, Mus musculus
acttcagttcagcatctctgacaga

SEQ ID NO: 134330 - DNA, 25 bp, Mus musculus
acttcagttcaggatctctgacaga

SEQ ID NO: 134331 - DNA, 25 bp, Mus musculus
acttcagttccacagaatcaatgcc

SEQ ID NO: 134332 - DNA, 25 bp, Mus musculus
acttcagttccagagaatcaatgcc

SEQ ID NO: 134333 - DNA, 25 bp, Mus musculus
acttcagttggtcatttttgagctt

SEQ ID NO: 134334 - DNA, 25 bp, Mus musculus
acttcagttggtgatttttgagctt

SEQ ID NO: 134335 - DNA, 25 bp, Mus musculus
acttcagttgttaaggtgtgcagcc

SEQ ID NO: 134336 - DNA, 25 bp, Mus musculus
acttcagttgtttaggtgtgcagcc

SEQ ID NO: 134337 - DNA, 25 bp, Mus musculus
acttcagttttcactcattaagagt

SEQ ID NO: 134338 - DNA, 25 bp, Mus musculus
acttcagttttctctcattaagagt

SEQ ID NO: 134339 - DNA, 25 bp, Mus musculus
acttcatacatgctggccctcttgt

SEQ ID NO: 134340 - DNA, 25 bp, Mus musculus
acttcatacatggtggccctcttgt

SEQ ID NO: 134341 - DNA, 25 bp, Mus musculus
acttcatacctcaggattaccagga

SEQ ID NO: 134342 - DNA, 25 bp, Mus musculus
acttcatacctctggattaccagga

SEQ ID NO: 134343 - DNA, 25 bp, Mus musculus
acttcatatacaccaagctcgatat

SEQ ID NO: 134344 - DNA, 25 bp, Mus musculus
acttcatatacagcaagctcgatat

SEQ ID NO: 134345 - DNA, 25 bp, Mus musculus
acttcatataccacacgagactctt

SEQ ID NO: 134346 - DNA, 25 bp, Mus musculus
acttcatatacctcacgagactctt

SEQ ID NO: 134347 - DNA, 25 bp, Mus musculus
acttcatatccactctgatgtcctt

SEQ ID NO: 134348 - DNA, 25 bp, Mus musculus
acttcatatccagtctgatgtcctt

SEQ ID NO: 134349 - DNA, 25 bp, Mus musculus
acttcatatgtgacctgttcagttg

SEQ ID NO: 134350 - DNA, 25 bp, Mus musculus
acttcatatgtgtcctgttcagttg

SEQ ID NO: 134351 - DNA, 25 bp, Mus musculus
acttcatattagcatgtggtggcct

SEQ ID NO: 134352 - DNA, 25 bp, Mus musculus
acttcatattaggatgtggtggcct

SEQ ID NO: 134353 - DNA, 25 bp, Mus musculus
acttcatatttcactaattctctgg

SEQ ID NO: 134354 - DNA, 25 bp, Mus musculus
acttcatatttctctaattctctgg

SEQ ID NO: 134355 - DNA, 25 bp, Mus musculus
acttcatcaacacacaatgtgtata

SEQ ID NO: 134356 - DNA, 25 bp, Mus musculus
acttcatcaacagacaatgtgtata

SEQ ID NO: 134357 - DNA, 25 bp, Mus musculus
acttcatcacacaccagaggacgca

SEQ ID NO: 134358 - DNA, 25 bp, Mus musculus
acttcatcacactccagaggacgca

SEQ ID NO: 134359 - DNA, 25 bp, Mus musculus
acttcatcatgtctgatttgtctag

SEQ ID NO: 134360 - DNA, 25 bp, Mus musculus
acttcatcatgtgtgatttgtctag

SEQ ID NO: 134361 - DNA, 25 bp, Mus musculus
acttcatccaacatcattgtgtagt

SEQ ID NO: 134362 - DNA, 25 bp, Mus musculus
acttcatccaacttcattgtgtagt

SEQ ID NO: 134363 - DNA, 25 bp, Mus musculus
acttcatccacaacgcggacgagcg

SEQ ID NO: 134364 - DNA, 25 bp, Mus musculus
acttcatccacatcgcggacgagcg

SEQ ID NO: 134365 - DNA, 25 bp, Mus musculus
acttcatccagtagattggcttgcc

SEQ ID NO: 134366 - DNA, 25 bp, Mus musculus
acttcatccagttgattggcttgcc

SEQ ID NO: 134367 - DNA, 25 bp, Mus musculus
acttcatcctgtcctctgactatgt

SEQ ID NO: 134368 - DNA, 25 bp, Mus musculus
acttcatcctgtgctctgactatgt

SEQ ID NO: 134369 - DNA, 25 bp, Mus musculus
acttcatcgtaactactatgtacag

SEQ ID NO: 134370 - DNA, 25 bp, Mus musculus
acttcatcgtaagtactatgtacag

SEQ ID NO: 134371 - DNA, 25 bp, Mus musculus
acttcatctcctatattactcttcc

SEQ ID NO: 134372 - DNA, 25 bp, Mus musculus
acttcatctcctttattactcttcc

SEQ ID NO: 134373 - DNA, 25 bp, Mus musculus
acttcatctctcctattgtttacta

SEQ ID NO: 134374 - DNA, 25 bp, Mus musculus
acttcatctctcgtattgtttacta

SEQ ID NO: 134375 - DNA, 25 bp, Mus musculus
acttcatctgcaattgtattgtttg

SEQ ID NO: 134376 - DNA, 25 bp, Mus musculus
acttcatctgcatttgtattgtttg

SEQ ID NO: 134377 - DNA, 25 bp, Mus musculus
acttcatctgtgctgattttgcatt

SEQ ID NO: 134378 - DNA, 25 bp, Mus musculus
acttcatctgtggtgattttgcatt

SEQ ID NO: 134379 - DNA, 25 bp, Mus musculus
acttcatgaaacatttctgtgaggt

SEQ ID NO: 134380 - DNA, 25 bp, Mus musculus
acttcatgaaacttttctgtgaggt

SEQ ID NO: 134381 - DNA, 25 bp, Mus musculus
acttcatgaagtagacggtagcctt

SEQ ID NO: 134382 - DNA, 25 bp, Mus musculus
acttcatgaagttgacggtagcctt

SEQ ID NO: 134383 - DNA, 25 bp, Mus musculus
acttcatgcataattgtgtccaatg

SEQ ID NO: 134384 - DNA, 25 bp, Mus musculus
acttcatgcatatttgtgtccaatg

SEQ ID NO: 134385 - DNA, 25 bp, Mus musculus
acttcatgccacctgggttttgata

SEQ ID NO: 134386 - DNA, 25 bp, Mus musculus
acttcatgccacgtgggttttgata

SEQ ID NO: 134387 - DNA, 25 bp, Mus musculus
acttcatgctttaagttggcactca

SEQ ID NO: 134388 - DNA, 25 bp, Mus musculus
acttcatgcttttagttggcactca

SEQ ID NO: 134389 - DNA, 25 bp, Mus musculus
acttcatggcatagagtttcccaca

SEQ ID NO: 134390 - DNA, 25 bp, Mus musculus
acttcatggcattgagtttcccaca

SEQ ID NO: 134391 - DNA, 25 bp, Mus musculus
acttcatggtttacacatgctagca

SEQ ID NO: 134392 - DNA, 25 bp, Mus musculus
acttcatggttttcacatgctagca

SEQ ID NO: 134393 - DNA, 25 bp, Mus musculus
acttcatgttagctgctccaactgg

SEQ ID NO: 134394 - DNA, 25 bp, Mus musculus
acttcatgttaggtgctccaactgg

SEQ ID NO: 134395 - DNA, 25 bp, Mus musculus
acttcattaagcacgggtctctgga

SEQ ID NO: 134396 - DNA, 25 bp, Mus musculus
acttcattaagctcgggtctctgga

SEQ ID NO: 134397 - DNA, 25 bp, Mus musculus
acttcattactgatatgtgcactct

SEQ ID NO: 134398 - DNA, 25 bp, Mus musculus
acttcattactgctgactctgctaa

SEQ ID NO: 134399 - DNA, 25 bp, Mus musculus
acttcattactggtgactctgctaa

SEQ ID NO: 134400 - DNA, 25 bp, Mus musculus
acttcattactgttatgtgcactct

SEQ ID NO: 134401 - DNA, 25 bp, Mus musculus
acttcattcatgctaacagtttcca

SEQ ID NO: 134402 - DNA, 25 bp, Mus musculus
acttcattcatggtaacagtttcca

SEQ ID NO: 134403 - DNA, 25 bp, Mus musculus
acttcattctagaccaagggagaaa

SEQ ID NO: 134404 - DNA, 25 bp, Mus musculus
acttcattctagtccaagggagaaa

SEQ ID NO: 134405 - DNA, 25 bp, Mus musculus
acttcattctccatcatttaaccat

SEQ ID NO: 134406 - DNA, 25 bp, Mus musculus
acttcattctccttcatttaaccat

SEQ ID NO: 134407 - DNA, 25 bp, Mus musculus
acttcattgcacaccagaggacaca

SEQ ID NO: 134408 - DNA, 25 bp, Mus musculus
acttcattgcacaggcttttgaggt

SEQ ID NO: 134409 - DNA, 25 bp, Mus musculus
acttcattgcactccagaggacaca

SEQ ID NO: 134410 - DNA, 25 bp, Mus musculus
acttcattgcactggcttttgaggt

SEQ ID NO: 134411 - DNA, 25 bp, Mus musculus
acttcattggcaactgctttagccg

SEQ ID NO: 134412 - DNA, 25 bp, Mus musculus
acttcattggcatctgctttagccg

SEQ ID NO: 134413 - DNA, 25 bp, Mus musculus
acttcattgtgcctaacattcctga

SEQ ID NO: 134414 - DNA, 25 bp, Mus musculus
acttcattgtgcgtaacattcctga

SEQ ID NO: 134415 - DNA, 25 bp, Mus musculus
acttcatttagtacaggttcttaat

SEQ ID NO: 134416 - DNA, 25 bp, Mus musculus
acttcatttagtcctttctgtccat

SEQ ID NO: 134417 - DNA, 25 bp, Mus musculus
acttcatttagtgctttctgtccat

SEQ ID NO: 134418 - DNA, 25 bp, Mus musculus
acttcatttagttcaggttcttaat

SEQ ID NO: 134419 - DNA, 25 bp, Mus musculus
acttcatttctaatcctgggatcca

SEQ ID NO: 134420 - DNA, 25 bp, Mus musculus
acttcatttctattcctgggatcca

SEQ ID NO: 134421 - DNA, 25 bp, Mus musculus
acttcatttgttcccttgtcttcct

SEQ ID NO: 134422 - DNA, 25 bp, Mus musculus
acttcatttgttgccttgtcttcct

SEQ ID NO: 134423 - DNA, 25 bp, Mus musculus
acttccaagaacctgcttctactag

SEQ ID NO: 134424 - DNA, 25 bp, Mus musculus
acttccaagaacgtgcttctactag

SEQ ID NO: 134425 - DNA, 25 bp, Mus musculus
acttccaagcctactgcagatcaga

SEQ ID NO: 134426 - DNA, 25 bp, Mus musculus
acttccaagccttctgcagatcaga

SEQ ID NO: 134427 - DNA, 25 bp, Mus musculus
acttccaatatgaaggccttccctg

SEQ ID NO: 134428 - DNA, 25 bp, Mus musculus
acttccaatatgtaggccttccctg

SEQ ID NO: 134429 - DNA, 25 bp, Mus musculus
acttccaatccaaaacggagctttg

SEQ ID NO: 134430 - DNA, 25 bp, Mus musculus
acttccaatccataacggagctttg

SEQ ID NO: 134431 - DNA, 25 bp, Mus musculus
acttccaatcttctacagcattctc

SEQ ID NO: 134432 - DNA, 25 bp, Mus musculus
acttccaatcttgtacagcattctc

SEQ ID NO: 134433 - DNA, 25 bp, Mus musculus
acttccaattataatgctctgccct

SEQ ID NO: 134434 - DNA, 25 bp, Mus musculus
acttccaattattatgctctgccct

SEQ ID NO: 134435 - DNA, 25 bp, Mus musculus
acttccaatttcctctttcaacaat

SEQ ID NO: 134436 - DNA, 25 bp, Mus musculus
acttccaatttcgtctttcaacaat

SEQ ID NO: 134437 - DNA, 25 bp, Mus musculus
acttccacagcgctcagagttctga

SEQ ID NO: 134438 - DNA, 25 bp, Mus musculus
acttccacagcggtcagagttctga

SEQ ID NO: 134439 - DNA, 25 bp, Mus musculus
acttccactcgcaggagcacgagga

SEQ ID NO: 134440 - DNA, 25 bp, Mus musculus
acttccactcgctggagcacgagga

SEQ ID NO: 134441 - DNA, 25 bp, Mus musculus
acttccacttgacctccttatggag

SEQ ID NO: 134442 - DNA, 25 bp, Mus musculus
acttccacttgagctccttatggag

SEQ ID NO: 134443 - DNA, 25 bp, Mus musculus
acttccagaaccagcttgggtaaca

SEQ ID NO: 134444 - DNA, 25 bp, Mus musculus
acttccagaacctgcttgggtaaca

SEQ ID NO: 134445 - DNA, 25 bp, Mus musculus
acttccagatccattttctcacaag

SEQ ID NO: 134446 - DNA, 25 bp, Mus musculus
acttccagatcctttttctcacaag

SEQ ID NO: 134447 - DNA, 25 bp, Mus musculus
acttccagcccacgcttaggagtta

SEQ ID NO: 134448 - DNA, 25 bp, Mus musculus
acttccagcccaggcttaggagtta

SEQ ID NO: 134449 - DNA, 25 bp, Mus musculus
acttccagctgcctggcactttcgg

SEQ ID NO: 134450 - DNA, 25 bp, Mus musculus
acttccagctgcgtggcactttcgg

SEQ ID NO: 134451 - DNA, 25 bp, Mus musculus
acttccaggagcatagccgtgatga

SEQ ID NO: 134452 - DNA, 25 bp, Mus musculus
acttccaggagcttagccgtgatga

SEQ ID NO: 134453 - DNA, 25 bp, Mus musculus
acttccaggagtactgtgtcttcct

SEQ ID NO: 134454 - DNA, 25 bp, Mus musculus
acttccaggagttctgtgtcttcct

SEQ ID NO: 134455 - DNA, 25 bp, Mus musculus
acttccaggcagaggtagaaccgct

SEQ ID NO: 134456 - DNA, 25 bp, Mus musculus
acttccaggcagtggtagaaccgct

SEQ ID NO: 134457 - DNA, 25 bp, Mus musculus
acttccaggcctcgattgcggacgc

SEQ ID NO: 134458 - DNA, 25 bp, Mus musculus
acttccaggcctggattgcggacgc

SEQ ID NO: 134459 - DNA, 25 bp, Mus musculus
acttccaggtcaatgggccaggctg

SEQ ID NO: 134460 - DNA, 25 bp, Mus musculus
acttccaggtcattgggccaggctg

SEQ ID NO: 134461 - DNA, 25 bp, Mus musculus
acttccagtggcatttgcctgccta

SEQ ID NO: 134462 - DNA, 25 bp, Mus musculus
acttccagtggcttttgcctgccta

SEQ ID NO: 134463 - DNA, 25 bp, Mus musculus
acttccagtgtaatcatggtactct

SEQ ID NO: 134464 - DNA, 25 bp, Mus musculus
acttccagtgtattcatggtactct

SEQ ID NO: 134465 - DNA, 25 bp, Mus musculus
acttccagttggataactccgtctc

SEQ ID NO: 134466 - DNA, 25 bp, Mus musculus
acttccagttggttaactccgtctc

SEQ ID NO: 134467 - DNA, 25 bp, Mus musculus
acttccataagacaggtacagcaaa

SEQ ID NO: 134468 - DNA, 25 bp, Mus musculus
acttccataagagaggtacagcaaa

SEQ ID NO: 134469 - DNA, 25 bp, Mus musculus
acttccatcctcctgactggtgttt

SEQ ID NO: 134470 - DNA, 25 bp, Mus musculus
acttccatcctcctttgaaagcctg

SEQ ID NO: 134471 - DNA, 25 bp, Mus musculus
acttccatcctcgtgactggtgttt

SEQ ID NO: 134472 - DNA, 25 bp, Mus musculus
acttccatcctcgtttgaaagcctg

SEQ ID NO: 134473 - DNA, 25 bp, Mus musculus
acttccatctgcagccaacaatgga

SEQ ID NO: 134474 - DNA, 25 bp, Mus musculus
acttccatctgctgccaacaatgga

SEQ ID NO: 134475 - DNA, 25 bp, Mus musculus
acttccatctgtcttgctattaggt

SEQ ID NO: 134476 - DNA, 25 bp, Mus musculus
acttccatctgtgttgctattaggt

SEQ ID NO: 134477 - DNA, 25 bp, Mus musculus
acttccatcttactggtgtgcaatt

SEQ ID NO: 134478 - DNA, 25 bp, Mus musculus
acttccatcttagtggtgtgcaatt

SEQ ID NO: 134479 - DNA, 25 bp, Mus musculus
acttccatgcaacacgttctacaga

SEQ ID NO: 134480 - DNA, 25 bp, Mus musculus
acttccatgcaagacgttctacaga

SEQ ID NO: 134481 - DNA, 25 bp, Mus musculus
acttccatggtaaggtgccgttctc

SEQ ID NO: 134482 - DNA, 25 bp, Mus musculus
acttccatggtatggtgccgttctc

SEQ ID NO: 134483 - DNA, 25 bp, Mus musculus
acttccatggtcacctcagatccta

SEQ ID NO: 134484 - DNA, 25 bp, Mus musculus
acttccatggtctcctcagatccta

SEQ ID NO: 134485 - DNA, 25 bp, Mus musculus
acttccatgtgcacaagtacttcac

SEQ ID NO: 134486 - DNA, 25 bp, Mus musculus
acttccatgtgctcaagtacttcac

SEQ ID NO: 134487 - DNA, 25 bp, Mus musculus
acttccatgtttcaagatcctgttg

SEQ ID NO: 134488 - DNA, 25 bp, Mus musculus
acttccatgtttgaagatcctgttg

SEQ ID NO: 134489 - DNA, 25 bp, Mus musculus
acttccattgtgagtgagcttaata

SEQ ID NO: 134490 - DNA, 25 bp, Mus musculus
acttccattgtgtgtgagcttaata

SEQ ID NO: 134491 - DNA, 25 bp, Mus musculus
acttcccaagggatgcagagcatct

SEQ ID NO: 134492 - DNA, 25 bp, Mus musculus
acttcccaagggttgcagagcatct

SEQ ID NO: 134493 - DNA, 25 bp, Mus musculus
acttcccacaagctaaactcttttg

SEQ ID NO: 134494 - DNA, 25 bp, Mus musculus
acttcccacaaggtaaactcttttg

SEQ ID NO: 134495 - DNA, 25 bp, Mus musculus
acttcccacagaatgcttctagcat

SEQ ID NO: 134496 - DNA, 25 bp, Mus musculus
acttcccacagattgcttctagcat

SEQ ID NO: 134497 - DNA, 25 bp, Mus musculus
acttcccacaggacagactcagtgt

SEQ ID NO: 134498 - DNA, 25 bp, Mus musculus
acttcccacaggtcagactcagtgt

SEQ ID NO: 134499 - DNA, 25 bp, Mus musculus
acttcccagaagaagtcgccattgc

SEQ ID NO: 134500 - DNA, 25 bp, Mus musculus
acttcccagaagtagtcgccattgc

SEQ ID NO: 134501 - DNA, 25 bp, Mus musculus
acttcccagcatcatgcatgttcga

SEQ ID NO: 134502 - DNA, 25 bp, Mus musculus
acttcccagcatgatgcatgttcga

SEQ ID NO: 134503 - DNA, 25 bp, Mus musculus
acttcccagctcagaatgcagaggc

SEQ ID NO: 134504 - DNA, 25 bp, Mus musculus
acttcccagctctgaatgcagaggc

SEQ ID NO: 134505 - DNA, 25 bp, Mus musculus
acttcccagctgcagctgtcacaaa

SEQ ID NO: 134506 - DNA, 25 bp, Mus musculus
acttcccagctggagctgtcacaaa

SEQ ID NO: 134507 - DNA, 25 bp, Mus musculus
acttcccaggaccacagatgagcag

SEQ ID NO: 134508 - DNA, 25 bp, Mus musculus
acttcccaggacgacagatgagcag

SEQ ID NO: 134509 - DNA, 25 bp, Mus musculus
acttcccaggatatattctctcaga

SEQ ID NO: 134510 - DNA, 25 bp, Mus musculus
acttcccaggatttattctctcaga

SEQ ID NO: 134511 - DNA, 25 bp, Mus musculus
acttcccaggctagttcgagcttcc

SEQ ID NO: 134512 - DNA, 25 bp, Mus musculus
acttcccaggcttgttcgagcttcc

SEQ ID NO: 134513 - DNA, 25 bp, Mus musculus
acttcccaggtaccaaaggattcta

SEQ ID NO: 134514 - DNA, 25 bp, Mus musculus
acttcccaggtagcaaaggattcta

SEQ ID NO: 134515 - DNA, 25 bp, Mus musculus
acttcccagtctctcactataatat

SEQ ID NO: 134516 - DNA, 25 bp, Mus musculus
acttcccagtctgtcactataatat

SEQ ID NO: 134517 - DNA, 25 bp, Mus musculus
acttcccatcacacagaacagaatg

SEQ ID NO: 134518 - DNA, 25 bp, Mus musculus
acttcccatcactcagaacagaatg

SEQ ID NO: 134519 - DNA, 25 bp, Mus musculus
acttcccatcttcacaagggcctag

SEQ ID NO: 134520 - DNA, 25 bp, Mus musculus
acttcccatcttgacaagggcctag

SEQ ID NO: 134521 - DNA, 25 bp, Mus musculus
acttcccatggaaaatattcacttt

SEQ ID NO: 134522 - DNA, 25 bp, Mus musculus
acttcccatggataatattcacttt

SEQ ID NO: 134523 - DNA, 25 bp, Mus musculus
acttccccaaacaggcaactgtggt

SEQ ID NO: 134524 - DNA, 25 bp, Mus musculus
acttccccaaactggcaactgtggt

SEQ ID NO: 134525 - DNA, 25 bp, Mus musculus
acttccccaaagatcatgactgaaa

SEQ ID NO: 134526 - DNA, 25 bp, Mus musculus
acttccccaaagattacacgtgctg

SEQ ID NO: 134527 - DNA, 25 bp, Mus musculus
acttccccaaagttcatgactgaaa

SEQ ID NO: 134528 - DNA, 25 bp, Mus musculus
acttccccaaagtttacacgtgctg

SEQ ID NO: 134529 - DNA, 25 bp, Mus musculus
acttccccacttacatgatggccat

SEQ ID NO: 134530 - DNA, 25 bp, Mus musculus
acttccccactttcatgatggccat

SEQ ID NO: 134531 - DNA, 25 bp, Mus musculus
acttccccagagatgggactgtcta

SEQ ID NO: 134532 - DNA, 25 bp, Mus musculus
acttccccagagttgggactgtcta

SEQ ID NO: 134533 - DNA, 25 bp, Mus musculus
acttccccagatctgggattgcaga

SEQ ID NO: 134534 - DNA, 25 bp, Mus musculus
acttccccagatgtgggattgcaga

SEQ ID NO: 134535 - DNA, 25 bp, Mus musculus
acttccccagtaaggtatctgttct

SEQ ID NO: 134536 - DNA, 25 bp, Mus musculus
acttccccagtatggtatctgttct

SEQ ID NO: 134537 - DNA, 25 bp, Mus musculus
acttccccatccattgtaactgtat

SEQ ID NO: 134538 - DNA, 25 bp, Mus musculus
acttccccatcctttgtaactgtat

SEQ ID NO: 134539 - DNA, 25 bp, Mus musculus
acttcccctcggaggtagatatgct

SEQ ID NO: 134540 - DNA, 25 bp, Mus musculus
acttcccctcggtggtagatatgct

SEQ ID NO: 134541 - DNA, 25 bp, Mus musculus
acttcccctttgcatcctgtgtaat

SEQ ID NO: 134542 - DNA, 25 bp, Mus musculus
acttcccctttggatcctgtgtaat

SEQ ID NO: 134543 - DNA, 25 bp, Mus musculus
acttcccgcagccaatttgagtggg

SEQ ID NO: 134544 - DNA, 25 bp, Mus musculus
acttcccgcagcgaatttgagtggg

SEQ ID NO: 134545 - DNA, 25 bp, Mus musculus
acttccctaggccagaggatctgac

SEQ ID NO: 134546 - DNA, 25 bp, Mus musculus
acttccctaggcgagaggatctgac

SEQ ID NO: 134547 - DNA, 25 bp, Mus musculus
acttccctcactatgatgtaagcca

SEQ ID NO: 134548 - DNA, 25 bp, Mus musculus
acttccctcactttgatgtaagcca

SEQ ID NO: 134549 - DNA, 25 bp, Mus musculus
acttccctcattatgaagagttcca

SEQ ID NO: 134550 - DNA, 25 bp, Mus musculus
acttccctcattttgaagagttcca

SEQ ID NO: 134551 - DNA, 25 bp, Mus musculus
acttccctccttctggagaacataa

SEQ ID NO: 134552 - DNA, 25 bp, Mus musculus
acttccctccttgtggagaacataa

SEQ ID NO: 134553 - DNA, 25 bp, Mus musculus
acttccctgagtatgatgggccaca

SEQ ID NO: 134554 - DNA, 25 bp, Mus musculus
acttccctgagtttgatgggccaca

SEQ ID NO: 134555 - DNA, 25 bp, Mus musculus
acttccctgcctctaatggttgaaa

SEQ ID NO: 134556 - DNA, 25 bp, Mus musculus
acttccctgcctgtaatggttgaaa

SEQ ID NO: 134557 - DNA, 25 bp, Mus musculus
acttccctgctccagacaggaagaa

SEQ ID NO: 134558 - DNA, 25 bp, Mus musculus
acttccctgctcgagacaggaagaa

SEQ ID NO: 134559 - DNA, 25 bp, Mus musculus
acttccctgctgattatttgctaag

SEQ ID NO: 134560 - DNA, 25 bp, Mus musculus
acttccctgctgtttatttgctaag

SEQ ID NO: 134561 - DNA, 25 bp, Mus musculus
acttccctggatcctttcttttcat

SEQ ID NO: 134562 - DNA, 25 bp, Mus musculus
acttccctggatgctttcttttcat

SEQ ID NO: 134563 - DNA, 25 bp, Mus musculus
acttccctgggtcagtgtgactccc

SEQ ID NO: 134564 - DNA, 25 bp, Mus musculus
acttccctgggtgagtgtgactccc

SEQ ID NO: 134565 - DNA, 25 bp, Mus musculus
acttccctgtacagtcgatctctca

SEQ ID NO: 134566 - DNA, 25 bp, Mus musculus
acttccctgtactgtcgatctctca

SEQ ID NO: 134567 - DNA, 25 bp, Mus musculus
acttcccttcacacagtataggtta

SEQ ID NO: 134568 - DNA, 25 bp, Mus musculus
acttcccttcactcagtataggtta

SEQ ID NO: 134569 - DNA, 25 bp, Mus musculus
acttcccttctactgatatttgtcc

SEQ ID NO: 134570 - DNA, 25 bp, Mus musculus
acttcccttctagtgatatttgtcc

SEQ ID NO: 134571 - DNA, 25 bp, Mus musculus
acttcccttggacgctggtaggttg

SEQ ID NO: 134572 - DNA, 25 bp, Mus musculus
acttcccttggaggctggtaggttg

SEQ ID NO: 134573 - DNA, 25 bp, Mus musculus
acttccgaagagagtacggttgcat

SEQ ID NO: 134574 - DNA, 25 bp, Mus musculus
acttccgaagagtgtacggttgcat

SEQ ID NO: 134575 - DNA, 25 bp, Mus musculus
acttccgacctacagaggagctcat

SEQ ID NO: 134576 - DNA, 25 bp, Mus musculus
acttccgacctagagaggagctcat

SEQ ID NO: 134577 - DNA, 25 bp, Mus musculus
acttccgcaattattgaaatgcctg

SEQ ID NO: 134578 - DNA, 25 bp, Mus musculus
acttccgcaatttttgaaatgcctg

SEQ ID NO: 134579 - DNA, 25 bp, Mus musculus
acttccgcagcgcaagcatgatcag

SEQ ID NO: 134580 - DNA, 25 bp, Mus musculus
acttccgcagcggaagcatgatcag

SEQ ID NO: 134581 - DNA, 25 bp, Mus musculus
acttccgcattgagtctgtggtgtg

SEQ ID NO: 134582 - DNA, 25 bp, Mus musculus
acttccgcattgtgtctgtggtgtg

SEQ ID NO: 134583 - DNA, 25 bp, Mus musculus
acttccgccaagctgagaacggcat

SEQ ID NO: 134584 - DNA, 25 bp, Mus musculus
acttccgccaaggtgagaacggcat

SEQ ID NO: 134585 - DNA, 25 bp, Mus musculus
acttccgctgtgaatcagtctatca

SEQ ID NO: 134586 - DNA, 25 bp, Mus musculus
acttccgctgtgtatcagtctatca

SEQ ID NO: 134587 - DNA, 25 bp, Mus musculus
acttccgctgttactgagtgggacc

SEQ ID NO: 134588 - DNA, 25 bp, Mus musculus
acttccgctgtttctgagtgggacc

SEQ ID NO: 134589 - DNA, 25 bp, Mus musculus
acttccggaagtacaattcatgagt

SEQ ID NO: 134590 - DNA, 25 bp, Mus musculus
acttccggaagttcaattcatgagt

SEQ ID NO: 134591 - DNA, 25 bp, Mus musculus
acttccggaccaagtcagatatctt

SEQ ID NO: 134592 - DNA, 25 bp, Mus musculus
acttccggaccatgtcagatatctt

SEQ ID NO: 134593 - DNA, 25 bp, Mus musculus
acttccggcttcatgctcaggcttg

SEQ ID NO: 134594 - DNA, 25 bp, Mus musculus
acttccggcttcttgctcaggcttg

SEQ ID NO: 134595 - DNA, 25 bp, Mus musculus
acttccgggctaatcttagatatgc

SEQ ID NO: 134596 - DNA, 25 bp, Mus musculus
acttccgggctattcttagatatgc

SEQ ID NO: 134597 - DNA, 25 bp, Mus musculus
acttccgggtgtctgctcgcctgga

SEQ ID NO: 134598 - DNA, 25 bp, Mus musculus
acttccgggtgtgtgctcgcctgga

SEQ ID NO: 134599 - DNA, 25 bp, Mus musculus
acttccgtcatccattgtcttggat

SEQ ID NO: 134600 - DNA, 25 bp, Mus musculus
acttccgtcatcgattgtcttggat

SEQ ID NO: 134601 - DNA, 25 bp, Mus musculus
acttccgtccagcagagagccgaaa

SEQ ID NO: 134602 - DNA, 25 bp, Mus musculus
acttccgtccaggagagagccgaaa

SEQ ID NO: 134603 - DNA, 25 bp, Mus musculus
acttccgtcggaccctgggcaagaa

SEQ ID NO: 134604 - DNA, 25 bp, Mus musculus
acttccgtcggagcctgggcaagaa

SEQ ID NO: 134605 - DNA, 25 bp, Mus musculus
acttccgtgatgaggctgttcagaa

SEQ ID NO: 134606 - DNA, 25 bp, Mus musculus
acttccgtgatgtggctgttcagaa

SEQ ID NO: 134607 - DNA, 25 bp, Mus musculus
acttccgttcggctgggctggacac

SEQ ID NO: 134608 - DNA, 25 bp, Mus musculus
acttccgttcgggtgggctggacac

SEQ ID NO: 134609 - DNA, 25 bp, Mus musculus
acttccgttttcatatagtcatgaa

SEQ ID NO: 134610 - DNA, 25 bp, Mus musculus
acttccgttttcttatagtcatgaa

SEQ ID NO: 134611 - DNA, 25 bp, Mus musculus
acttcctaattgagtcacattttta

SEQ ID NO: 134612 - DNA, 25 bp, Mus musculus
acttcctaattgattcacaactcca

SEQ ID NO: 134613 - DNA, 25 bp, Mus musculus
acttcctaattgtgtcacattttta

SEQ ID NO: 134614 - DNA, 25 bp, Mus musculus
acttcctaattgtttcacaactcca

SEQ ID NO: 134615 - DNA, 25 bp, Mus musculus
acttcctacagcctgtctaacagtg

SEQ ID NO: 134616 - DNA, 25 bp, Mus musculus
acttcctacagcgtgtctaacagtg

SEQ ID NO: 134617 - DNA, 25 bp, Mus musculus
acttcctactgccatggtcttaagt

SEQ ID NO: 134618 - DNA, 25 bp, Mus musculus
acttcctactgcgatggtcttaagt

SEQ ID NO: 134619 - DNA, 25 bp, Mus musculus
acttcctactgtacagtctcaactg

SEQ ID NO: 134620 - DNA, 25 bp, Mus musculus
acttcctactgttcagtctcaactg

SEQ ID NO: 134621 - DNA, 25 bp, Mus musculus
acttcctagaggattttgctgcaga

SEQ ID NO: 134622 - DNA, 25 bp, Mus musculus
acttcctagaggtttttgctgcaga

SEQ ID NO: 134623 - DNA, 25 bp, Mus musculus
acttcctagatgcaactctttcaat

SEQ ID NO: 134624 - DNA, 25 bp, Mus musculus
acttcctagatggaactctttcaat

SEQ ID NO: 134625 - DNA, 25 bp, Mus musculus
acttcctaggaacggatgcactgta

SEQ ID NO: 134626 - DNA, 25 bp, Mus musculus
acttcctaggaagggatgcactgta

SEQ ID NO: 134627 - DNA, 25 bp, Mus musculus
acttcctagtttctgacagtgatca

SEQ ID NO: 134628 - DNA, 25 bp, Mus musculus
acttcctagtttgtgacagtgatca

SEQ ID NO: 134629 - DNA, 25 bp, Mus musculus
acttcctatcctaccagaggacttg

SEQ ID NO: 134630 - DNA, 25 bp, Mus musculus
acttcctatccttccagaggacttg

SEQ ID NO: 134631 - DNA, 25 bp, Mus musculus
acttcctatgttctcaggtcacact

SEQ ID NO: 134632 - DNA, 25 bp, Mus musculus
acttcctatgttgtcaggtcacact

SEQ ID NO: 134633 - DNA, 25 bp, Mus musculus
acttcctcacagagaagcggcggga

SEQ ID NO: 134634 - DNA, 25 bp, Mus musculus
acttcctcacagtgaagcggcggga

SEQ ID NO: 134635 - DNA, 25 bp, Mus musculus
acttcctcagaacctgtcaactgtc

SEQ ID NO: 134636 - DNA, 25 bp, Mus musculus
acttcctcagaagctgtcaactgtc

SEQ ID NO: 134637 - DNA, 25 bp, Mus musculus
acttcctcagtaaattgccatcctt

SEQ ID NO: 134638 - DNA, 25 bp, Mus musculus
acttcctcagtatattgccatcctt

SEQ ID NO: 134639 - DNA, 25 bp, Mus musculus
acttcctcagtgctggtgttgcaaa

SEQ ID NO: 134640 - DNA, 25 bp, Mus musculus
acttcctcagtggtggtgttgcaaa

SEQ ID NO: 134641 - DNA, 25 bp, Mus musculus
acttcctccagaattggctgatgtt

SEQ ID NO: 134642 - DNA, 25 bp, Mus musculus
acttcctccagatttggctgatgtt

SEQ ID NO: 134643 - DNA, 25 bp, Mus musculus
acttcctccgtgaagacagctaatt

SEQ ID NO: 134644 - DNA, 25 bp, Mus musculus
acttcctccgtgtagacagctaatt

SEQ ID NO: 134645 - DNA, 25 bp, Mus musculus
acttcctcctaaaagttacatacag

SEQ ID NO: 134646 - DNA, 25 bp, Mus musculus
acttcctcctaatagttacatacag

SEQ ID NO: 134647 - DNA, 25 bp, Mus musculus
acttcctcctgacttagatctcttt

SEQ ID NO: 134648 - DNA, 25 bp, Mus musculus
acttcctcctgagttagatctcttt

SEQ ID NO: 134649 - DNA, 25 bp, Mus musculus
acttcctcgagcagttactgcctgt

SEQ ID NO: 134650 - DNA, 25 bp, Mus musculus
acttcctcgagctgttactgcctgt

SEQ ID NO: 134651 - DNA, 25 bp, Mus musculus
acttcctcggaactgagccgatctg

SEQ ID NO: 134652 - DNA, 25 bp, Mus musculus
acttcctcggaagtgagccgatctg

SEQ ID NO: 134653 - DNA, 25 bp, Mus musculus
acttcctcgtgaccccgtgtgtaat

SEQ ID NO: 134654 - DNA, 25 bp, Mus musculus
acttcctcgtgagcccgtgtgtaat

SEQ ID NO: 134655 - DNA, 25 bp, Mus musculus
acttcctcgttccacagtatgattt

SEQ ID NO: 134656 - DNA, 25 bp, Mus musculus
acttcctcgttcgacagtatgattt

SEQ ID NO: 134657 - DNA, 25 bp, Mus musculus
acttcctctagtcgtgttctcttga

SEQ ID NO: 134658 - DNA, 25 bp, Mus musculus
acttcctctagtggtgttctcttga

SEQ ID NO: 134659 - DNA, 25 bp, Mus musculus
acttcctctccactatgtgaatcaa

SEQ ID NO: 134660 - DNA, 25 bp, Mus musculus
acttcctctccagtatgtgaatcaa

SEQ ID NO: 134661 - DNA, 25 bp, Mus musculus
acttcctgaagtccccatggagatg

SEQ ID NO: 134662 - DNA, 25 bp, Mus musculus
acttcctgaagtgcccatggagatg

SEQ ID NO: 134663 - DNA, 25 bp, Mus musculus
acttcctgacatctccgttggaaaa

SEQ ID NO: 134664 - DNA, 25 bp, Mus musculus
acttcctgacatgtccgttggaaaa

SEQ ID NO: 134665 - DNA, 25 bp, Mus musculus
acttcctgacttccatattcttatc

SEQ ID NO: 134666 - DNA, 25 bp, Mus musculus
acttcctgacttgcatattcttatc

SEQ ID NO: 134667 - DNA, 25 bp, Mus musculus
acttcctgagaacactccaactttg

SEQ ID NO: 134668 - DNA, 25 bp, Mus musculus
acttcctgagaagactccaactttg

SEQ ID NO: 134669 - DNA, 25 bp, Mus musculus
acttcctgcacaattttcttacaca

SEQ ID NO: 134670 - DNA, 25 bp, Mus musculus
acttcctgcacatttttcttacaca

SEQ ID NO: 134671 - DNA, 25 bp, Mus musculus
acttcctgcagaaggaactactgct

SEQ ID NO: 134672 - DNA, 25 bp, Mus musculus
acttcctgcagatggaactactgct

SEQ ID NO: 134673 - DNA, 25 bp, Mus musculus
acttcctgcagcattacttgtggcg

SEQ ID NO: 134674 - DNA, 25 bp, Mus musculus
acttcctgcagctttacttgtggcg

SEQ ID NO: 134675 - DNA, 25 bp, Mus musculus
acttcctgcccgacgaaaagacaat

SEQ ID NO: 134676 - DNA, 25 bp, Mus musculus
acttcctgcccgtcgaaaagacaat

SEQ ID NO: 134677 - DNA, 25 bp, Mus musculus
acttcctgccctactgcatagggta

SEQ ID NO: 134678 - DNA, 25 bp, Mus musculus
acttcctgcccttctgcatagggta

SEQ ID NO: 134679 - DNA, 25 bp, Mus musculus
acttcctgcctcaagtggtgatgtt

SEQ ID NO: 134680 - DNA, 25 bp, Mus musculus
acttcctgcctctagtggtgatgtt

SEQ ID NO: 134681 - DNA, 25 bp, Mus musculus
acttcctgctccagtaaactatttt

SEQ ID NO: 134682 - DNA, 25 bp, Mus musculus
acttcctgctcctgtaaactatttt

SEQ ID NO: 134683 - DNA, 25 bp, Mus musculus
acttcctgctgacatttgttatcat

SEQ ID NO: 134684 - DNA, 25 bp, Mus musculus
acttcctgctgagatttgttatcat

SEQ ID NO: 134685 - DNA, 25 bp, Mus musculus
acttcctgctttatacctattttca

SEQ ID NO: 134686 - DNA, 25 bp, Mus musculus
acttcctgctttttacctattttca

SEQ ID NO: 134687 - DNA, 25 bp, Mus musculus
acttcctggagaactggagtacaag

SEQ ID NO: 134688 - DNA, 25 bp, Mus musculus
acttcctggagatctggagtacaag

SEQ ID NO: 134689 - DNA, 25 bp, Mus musculus
acttcctggagcaataataacgtgc

SEQ ID NO: 134690 - DNA, 25 bp, Mus musculus
acttcctggagctataataacgtgc

SEQ ID NO: 134691 - DNA, 25 bp, Mus musculus
acttcctgggcactagggtaggctt

SEQ ID NO: 134692 - DNA, 25 bp, Mus musculus
acttcctgggcagtagggtaggctt

SEQ ID NO: 134693 - DNA, 25 bp, Mus musculus
acttcctgggttactatgtgctgga

SEQ ID NO: 134694 - DNA, 25 bp, Mus musculus
acttcctgggtttctatgtgctgga

SEQ ID NO: 134695 - DNA, 25 bp, Mus musculus
acttcctggtaaactgtctaggtga

SEQ ID NO: 134696 - DNA, 25 bp, Mus musculus
acttcctggtaatctgtctaggtga

SEQ ID NO: 134697 - DNA, 25 bp, Mus musculus
acttcctgtggcaactttgtaattg

SEQ ID NO: 134698 - DNA, 25 bp, Mus musculus
acttcctgtggctactttgtaattg

SEQ ID NO: 134699 - DNA, 25 bp, Mus musculus
acttcctgtggtacagacgctatca

SEQ ID NO: 134700 - DNA, 25 bp, Mus musculus
acttcctgtggttcagacgctatca

SEQ ID NO: 134701 - DNA, 25 bp, Mus musculus
acttcctgttggagttcttcagcca

SEQ ID NO: 134702 - DNA, 25 bp, Mus musculus
acttcctgttggtgttcttcagcca

SEQ ID NO: 134703 - DNA, 25 bp, Mus musculus
acttcctgttttatgcagctcaaaa

SEQ ID NO: 134704 - DNA, 25 bp, Mus musculus
acttcctgttttttgcagctcaaaa

SEQ ID NO: 134705 - DNA, 25 bp, Mus musculus
acttccttaatgagccagaggtgtg

SEQ ID NO: 134706 - DNA, 25 bp, Mus musculus
acttccttaatgtgccagaggtgtg

SEQ ID NO: 134707 - DNA, 25 bp, Mus musculus
acttccttaattcaagagccctgcc

SEQ ID NO: 134708 - DNA, 25 bp, Mus musculus
acttccttaattgaagagccctgcc

SEQ ID NO: 134709 - DNA, 25 bp, Mus musculus
acttccttacacaaccacagtacaa

SEQ ID NO: 134710 - DNA, 25 bp, Mus musculus
acttccttacactaccacagtacaa

SEQ ID NO: 134711 - DNA, 25 bp, Mus musculus
acttccttagaacccaggtgagcaa

SEQ ID NO: 134712 - DNA, 25 bp, Mus musculus
acttccttagaagccaggtgagcaa

SEQ ID NO: 134713 - DNA, 25 bp, Mus musculus
acttccttagacatgcagtactgtg

SEQ ID NO: 134714 - DNA, 25 bp, Mus musculus
acttccttagacttgcagtactgtg

SEQ ID NO: 134715 - DNA, 25 bp, Mus musculus
acttccttaggcaacagttgctctg

SEQ ID NO: 134716 - DNA, 25 bp, Mus musculus
acttccttaggctacagttgctctg

SEQ ID NO: 134717 - DNA, 25 bp, Mus musculus
acttccttcaggacatgccggttac

SEQ ID NO: 134718 - DNA, 25 bp, Mus musculus
acttccttcaggtcatgccggttac

SEQ ID NO: 134719 - DNA, 25 bp, Mus musculus
acttccttcatgatcctggttcttc

SEQ ID NO: 134720 - DNA, 25 bp, Mus musculus
acttccttcatgttcctggttcttc

SEQ ID NO: 134721 - DNA, 25 bp, Mus musculus
acttccttccctctggtagtagtat

SEQ ID NO: 134722 - DNA, 25 bp, Mus musculus
acttccttccctgtggtagtagtat

SEQ ID NO: 134723 - DNA, 25 bp, Mus musculus
acttccttcggtaattagccagcgt

SEQ ID NO: 134724 - DNA, 25 bp, Mus musculus
acttccttcggttattagccagcgt

SEQ ID NO: 134725 - DNA, 25 bp, Mus musculus
acttccttgagtcactgctttgacc

SEQ ID NO: 134726 - DNA, 25 bp, Mus musculus
acttccttgagtgactgctttgacc

SEQ ID NO: 134727 - DNA, 25 bp, Mus musculus
acttccttgctacagttcccagctg

SEQ ID NO: 134728 - DNA, 25 bp, Mus musculus
acttccttgctagagttcccagctg

SEQ ID NO: 134729 - DNA, 25 bp, Mus musculus
acttccttggacacttagctacatt

SEQ ID NO: 134730 - DNA, 25 bp, Mus musculus
acttccttggactcttagctacatt

SEQ ID NO: 134731 - DNA, 25 bp, Mus musculus
acttccttggcacctgcagaatatg

SEQ ID NO: 134732 - DNA, 25 bp, Mus musculus
acttccttggcagctgcagaatatg

SEQ ID NO: 134733 - DNA, 25 bp, Mus musculus
acttccttgttcagccatatgcact

SEQ ID NO: 134734 - DNA, 25 bp, Mus musculus
acttccttgttctgccatatgcact

SEQ ID NO: 134735 - DNA, 25 bp, Mus musculus
acttcctttaacaattttgtgatgc

SEQ ID NO: 134736 - DNA, 25 bp, Mus musculus
acttcctttaactattttgtgatgc

SEQ ID NO: 134737 - DNA, 25 bp, Mus musculus
acttcctttacccaatgtagctgat

SEQ ID NO: 134738 - DNA, 25 bp, Mus musculus
acttcctttaccgaatgtagctgat

SEQ ID NO: 134739 - DNA, 25 bp, Mus musculus
acttcctttagcatgatgtgacctg

SEQ ID NO: 134740 - DNA, 25 bp, Mus musculus
acttcctttagcttgatgtgacctg

SEQ ID NO: 134741 - DNA, 25 bp, Mus musculus
acttcctttattcctatattccgac

SEQ ID NO: 134742 - DNA, 25 bp, Mus musculus
acttcctttattgctatattccgac

SEQ ID NO: 134743 - DNA, 25 bp, Mus musculus
acttcctttccccttataagtcatg

SEQ ID NO: 134744 - DNA, 25 bp, Mus musculus
acttcctttcccgttataagtcatg

SEQ ID NO: 134745 - DNA, 25 bp, Mus musculus
acttcctttctacgtgatgagaata

SEQ ID NO: 134746 - DNA, 25 bp, Mus musculus
acttcctttctaggtgatgagaata

SEQ ID NO: 134747 - DNA, 25 bp, Mus musculus
acttcctttctcactgcagtggaat

SEQ ID NO: 134748 - DNA, 25 bp, Mus musculus
acttcctttctctctgcagtggaat

SEQ ID NO: 134749 - DNA, 25 bp, Mus musculus
acttcctttctgactgcacactagg

SEQ ID NO: 134750 - DNA, 25 bp, Mus musculus
acttcctttctgtctgcacactagg

SEQ ID NO: 134751 - DNA, 25 bp, Mus musculus
acttcctttgtaactttaggctgca

SEQ ID NO: 134752 - DNA, 25 bp, Mus musculus
acttcctttgtatctttaggctgca

SEQ ID NO: 134753 - DNA, 25 bp, Mus musculus
acttccttttaacagcaggtgggat

SEQ ID NO: 134754 - DNA, 25 bp, Mus musculus
acttccttttaagagcaggtgggat

SEQ ID NO: 134755 - DNA, 25 bp, Mus musculus
acttcgacacttcccttagtggtgt

SEQ ID NO: 134756 - DNA, 25 bp, Mus musculus
acttcgacacttgccttagtggtgt

SEQ ID NO: 134757 - DNA, 25 bp, Mus musculus
acttcgacttatatccgtggcttta

SEQ ID NO: 134758 - DNA, 25 bp, Mus musculus
acttcgacttatttccgtggcttta

SEQ ID NO: 134759 - DNA, 25 bp, Mus musculus
acttcgagaggcagagtgggacccc

SEQ ID NO: 134760 - DNA, 25 bp, Mus musculus
acttcgagaggctgagtgggacccc

SEQ ID NO: 134761 - DNA, 25 bp, Mus musculus
acttcgatgagtcgtttttcagtct

SEQ ID NO: 134762 - DNA, 25 bp, Mus musculus
acttcgatgagtggtttttcagtct

SEQ ID NO: 134763 - DNA, 25 bp, Mus musculus
acttcgatgttgctggtcttagtgt

SEQ ID NO: 134764 - DNA, 25 bp, Mus musculus
acttcgatgttggtggtcttagtgt

SEQ ID NO: 134765 - DNA, 25 bp, Mus musculus
acttcgcaatgcataggctgattta

SEQ ID NO: 134766 - DNA, 25 bp, Mus musculus
acttcgcaatgcttaggctgattta

SEQ ID NO: 134767 - DNA, 25 bp, Mus musculus
acttcgcagctacagcacatctatt

SEQ ID NO: 134768 - DNA, 25 bp, Mus musculus
acttcgcagctagagcacatctatt

SEQ ID NO: 134769 - DNA, 25 bp, Mus musculus
acttcgcatttcatctgtgaggcat

SEQ ID NO: 134770 - DNA, 25 bp, Mus musculus
acttcgcatttcttctgtgaggcat

SEQ ID NO: 134771 - DNA, 25 bp, Mus musculus
acttcgcgaccaattggcagtggat

SEQ ID NO: 134772 - DNA, 25 bp, Mus musculus
acttcgcgaccatttggcagtggat

SEQ ID NO: 134773 - DNA, 25 bp, Mus musculus
acttcgctagatcaaaattgctata

SEQ ID NO: 134774 - DNA, 25 bp, Mus musculus
acttcgctagatgaaaattgctata

SEQ ID NO: 134775 - DNA, 25 bp, Mus musculus
acttcgctcagtctctaggttacaa

SEQ ID NO: 134776 - DNA, 25 bp, Mus musculus
acttcgctcagtgtctaggttacaa

SEQ ID NO: 134777 - DNA, 25 bp, Mus musculus
acttcgcttgtccaggaaagaaggc

SEQ ID NO: 134778 - DNA, 25 bp, Mus musculus
acttcgcttgtcgaggaaagaaggc

SEQ ID NO: 134779 - DNA, 25 bp, Mus musculus
acttcggagggtccgtatgtctgcc

SEQ ID NO: 134780 - DNA, 25 bp, Mus musculus
acttcggagggtgcgtatgtctgcc

SEQ ID NO: 134781 - DNA, 25 bp, Mus musculus
acttcggagtcgagaatgtctgccg

SEQ ID NO: 134782 - DNA, 25 bp, Mus musculus
acttcggagtcgtgaatgtctgccg

SEQ ID NO: 134783 - DNA, 25 bp, Mus musculus
acttcggagttaatatcatttggga

SEQ ID NO: 134784 - DNA, 25 bp, Mus musculus
acttcggagttattatcatttggga

SEQ ID NO: 134785 - DNA, 25 bp, Mus musculus
acttcggcctgtcgaaaggtcacca

SEQ ID NO: 134786 - DNA, 25 bp, Mus musculus
acttcggcctgtggaaaggtcacca

SEQ ID NO: 134787 - DNA, 25 bp, Mus musculus
acttcgggaactcttgacatgcaca

SEQ ID NO: 134788 - DNA, 25 bp, Mus musculus
acttcgggaactgttgacatgcaca

SEQ ID NO: 134789 - DNA, 25 bp, Mus musculus
acttcgggcaggagtccacatcaaa

SEQ ID NO: 134790 - DNA, 25 bp, Mus musculus
acttcgggcaggtgtccacatcaaa

SEQ ID NO: 134791 - DNA, 25 bp, Mus musculus
acttcgggcatcactgtggcaggag

SEQ ID NO: 134792 - DNA, 25 bp, Mus musculus
acttcgggcatctctgtggcaggag

SEQ ID NO: 134793 - DNA, 25 bp, Mus musculus
acttcggtgaccacctttacagtga

SEQ ID NO: 134794 - DNA, 25 bp, Mus musculus
acttcggtgacctcctttacagtga

SEQ ID NO: 134795 - DNA, 25 bp, Mus musculus
acttcggtgtgtcatgacgtaggcc

SEQ ID NO: 134796 - DNA, 25 bp, Mus musculus
acttcggtgtgtgatgacgtaggcc

SEQ ID NO: 134797 - DNA, 25 bp, Mus musculus
acttcgtagaggcttggtttaactg

SEQ ID NO: 134798 - DNA, 25 bp, Mus musculus
acttcgtagagggttggtttaactg

SEQ ID NO: 134799 - DNA, 25 bp, Mus musculus
acttcgtattaaaatgtcgcctgta

SEQ ID NO: 134800 - DNA, 25 bp, Mus musculus
acttcgtattaatatgtcgcctgta

SEQ ID NO: 134801 - DNA, 25 bp, Mus musculus
acttcgtccaggagctactggccaa

SEQ ID NO: 134802 - DNA, 25 bp, Mus musculus
acttcgtccaggtgctactggccaa

SEQ ID NO: 134803 - DNA, 25 bp, Mus musculus
acttcgtgccaacctggctgtcctg

SEQ ID NO: 134804 - DNA, 25 bp, Mus musculus
acttcgtgccaagctggctgtcctg

SEQ ID NO: 134805 - DNA, 25 bp, Mus musculus
acttcgtgccagagtatgaggaatt

SEQ ID NO: 134806 - DNA, 25 bp, Mus musculus
acttcgtgccagtgtatgaggaatt

SEQ ID NO: 134807 - DNA, 25 bp, Mus musculus
acttcgttaagcaccaggcatgcat

SEQ ID NO: 134808 - DNA, 25 bp, Mus musculus
acttcgttaagctccaggcatgcat

SEQ ID NO: 134809 - DNA, 25 bp, Mus musculus
acttcgttcatccttgattctctga

SEQ ID NO: 134810 - DNA, 25 bp, Mus musculus
acttcgttcatcgttgattctctga

SEQ ID NO: 134811 - DNA, 25 bp, Mus musculus
acttcgttccctcaaggagcattta

SEQ ID NO: 134812 - DNA, 25 bp, Mus musculus
acttcgttccctgaaggagcattta

SEQ ID NO: 134813 - DNA, 25 bp, Mus musculus
acttctaaacacaagcctcaactta

SEQ ID NO: 134814 - DNA, 25 bp, Mus musculus
acttctaaacactagcctcaactta

SEQ ID NO: 134815 - DNA, 25 bp, Mus musculus
acttctaactatatgcagtagccgc

SEQ ID NO: 134816 - DNA, 25 bp, Mus musculus
acttctaactatttgcagtagccgc

SEQ ID NO: 134817 - DNA, 25 bp, Mus musculus
acttctaagtttcaatgtcaccatg

SEQ ID NO: 134818 - DNA, 25 bp, Mus musculus
acttctaagtttgaatgtcaccatg

SEQ ID NO: 134819 - DNA, 25 bp, Mus musculus
acttctaatatcagggttagcatta

SEQ ID NO: 134820 - DNA, 25 bp, Mus musculus
acttctaatatctgggttagcatta

SEQ ID NO: 134821 - DNA, 25 bp, Mus musculus
acttctaatcaccatgacctgtcct

SEQ ID NO: 134822 - DNA, 25 bp, Mus musculus
acttctaatcacgatgacctgtcct

SEQ ID NO: 134823 - DNA, 25 bp, Mus musculus
acttctaatctgaacgtgctttctg

SEQ ID NO: 134824 - DNA, 25 bp, Mus musculus
acttctaatctgtacgtgctttctg

SEQ ID NO: 134825 - DNA, 25 bp, Mus musculus
acttctaattgtaaccatcctgggc

SEQ ID NO: 134826 - DNA, 25 bp, Mus musculus
acttctaattgttaccatcctgggc

SEQ ID NO: 134827 - DNA, 25 bp, Mus musculus
acttctaccagcagcctaggtgact

SEQ ID NO: 134828 - DNA, 25 bp, Mus musculus
acttctaccagctgcctaggtgact

SEQ ID NO: 134829 - DNA, 25 bp, Mus musculus
acttctacccggagcgctgtgaatg

SEQ ID NO: 134830 - DNA, 25 bp, Mus musculus
acttctacccggtgcgctgtgaatg

SEQ ID NO: 134831 - DNA, 25 bp, Mus musculus
acttctacctttcctgtacagtctg

SEQ ID NO: 134832 - DNA, 25 bp, Mus musculus
acttctacctttgctgtacagtctg

SEQ ID NO: 134833 - DNA, 25 bp, Mus musculus
acttctacgaaaccttgtgctacca

SEQ ID NO: 134834 - DNA, 25 bp, Mus musculus
acttctacgaaagcttgtgctacca

SEQ ID NO: 134835 - DNA, 25 bp, Mus musculus
acttctactgcaaacatggtcaacg

SEQ ID NO: 134836 - DNA, 25 bp, Mus musculus
acttctactgcatacatggtcaacg

SEQ ID NO: 134837 - DNA, 25 bp, Mus musculus
acttctactgtaatccgtggagcat

SEQ ID NO: 134838 - DNA, 25 bp, Mus musculus
acttctactgtattccgtggagcat

SEQ ID NO: 134839 - DNA, 25 bp, Mus musculus
acttctacttctccgcgacggttgg

SEQ ID NO: 134840 - DNA, 25 bp, Mus musculus
acttctacttctgcgcgacggttgg

SEQ ID NO: 134841 - DNA, 25 bp, Mus musculus
acttctagaacactatcccaccagg

SEQ ID NO: 134842 - DNA, 25 bp, Mus musculus
acttctagaacagtatcccaccagg

SEQ ID NO: 134843 - DNA, 25 bp, Mus musculus
acttctagactaacaactgattttc

SEQ ID NO: 134844 - DNA, 25 bp, Mus musculus
acttctagactatcaactgattttc

SEQ ID NO: 134845 - DNA, 25 bp, Mus musculus
acttctagcgaaccccaggatctgt

SEQ ID NO: 134846 - DNA, 25 bp, Mus musculus
acttctagcgaagcccaggatctgt

SEQ ID NO: 134847 - DNA, 25 bp, Mus musculus
acttctagcgagagggttttgtcca

SEQ ID NO: 134848 - DNA, 25 bp, Mus musculus
acttctagcgagtgggttttgtcca

SEQ ID NO: 134849 - DNA, 25 bp, Mus musculus
acttctagcttcagtttagtgggtt

SEQ ID NO: 134850 - DNA, 25 bp, Mus musculus
acttctagcttctgtttagtgggtt

SEQ ID NO: 134851 - DNA, 25 bp, Mus musculus
acttctagtgttctgagtctcatcc

SEQ ID NO: 134852 - DNA, 25 bp, Mus musculus
acttctagtgttgtgagtctcatcc

SEQ ID NO: 134853 - DNA, 25 bp, Mus musculus
acttctataagaccgtgacttgtaa

SEQ ID NO: 134854 - DNA, 25 bp, Mus musculus
acttctataagagcgtgacttgtaa

SEQ ID NO: 134855 - DNA, 25 bp, Mus musculus
acttctatacgtatgaacccagcct

SEQ ID NO: 134856 - DNA, 25 bp, Mus musculus
acttctatacgtttgaacccagcct

SEQ ID NO: 134857 - DNA, 25 bp, Mus musculus
acttctatagatcctctttctctag

SEQ ID NO: 134858 - DNA, 25 bp, Mus musculus
acttctatagatgctctttctctag

SEQ ID NO: 134859 - DNA, 25 bp, Mus musculus
acttctatcgggagtcccaagaaag

SEQ ID NO: 134860 - DNA, 25 bp, Mus musculus
acttctatcgggtgtcccaagaaag

SEQ ID NO: 134861 - DNA, 25 bp, Mus musculus
acttctatgagtccatgtttcccat

SEQ ID NO: 134862 - DNA, 25 bp, Mus musculus
acttctatgagtgcatgtttcccat

SEQ ID NO: 134863 - DNA, 25 bp, Mus musculus
acttctatggtgaataactttgtat

SEQ ID NO: 134864 - DNA, 25 bp, Mus musculus
acttctatggtgtataactttgtat

SEQ ID NO: 134865 - DNA, 25 bp, Mus musculus
acttctatggttcgagctatgtggc

SEQ ID NO: 134866 - DNA, 25 bp, Mus musculus
acttctatggttggagctatgtggc

SEQ ID NO: 134867 - DNA, 25 bp, Mus musculus
acttctatgtgcaagatgccagcta

SEQ ID NO: 134868 - DNA, 25 bp, Mus musculus
acttctatgtgcatgtcccaaagat

SEQ ID NO: 134869 - DNA, 25 bp, Mus musculus
acttctatgtgctagatgccagcta

SEQ ID NO: 134870 - DNA, 25 bp, Mus musculus
acttctatgtgcttgtcccaaagat

SEQ ID NO: 134871 - DNA, 25 bp, Mus musculus
acttctatttaacggccaggccact

SEQ ID NO: 134872 - DNA, 25 bp, Mus musculus
acttctatttaagggccaggccact

SEQ ID NO: 134873 - DNA, 25 bp, Mus musculus
acttctatttgcagtgggttgtatc

SEQ ID NO: 134874 - DNA, 25 bp, Mus musculus
acttctatttgctgtgggttgtatc

SEQ ID NO: 134875 - DNA, 25 bp, Mus musculus
acttctcaaaggacagctggtgcca

SEQ ID NO: 134876 - DNA, 25 bp, Mus musculus
acttctcaaaggtcagctggtgcca

SEQ ID NO: 134877 - DNA, 25 bp, Mus musculus
acttctcaaatcaacgaaatctgtg

SEQ ID NO: 134878 - DNA, 25 bp, Mus musculus
acttctcaaatctacgaaatctgtg

SEQ ID NO: 134879 - DNA, 25 bp, Mus musculus
acttctcaagagacatgcatgtgtg

SEQ ID NO: 134880 - DNA, 25 bp, Mus musculus
acttctcaagagtcatgcatgtgtg

SEQ ID NO: 134881 - DNA, 25 bp, Mus musculus
acttctcaagcgaactggtccatag

SEQ ID NO: 134882 - DNA, 25 bp, Mus musculus
acttctcaagcgtactggtccatag

SEQ ID NO: 134883 - DNA, 25 bp, Mus musculus
acttctcaagtgattcagataagac

SEQ ID NO: 134884 - DNA, 25 bp, Mus musculus
acttctcaagtgtttcagataagac

SEQ ID NO: 134885 - DNA, 25 bp, Mus musculus
acttctcactggcaactgacagaac

SEQ ID NO: 134886 - DNA, 25 bp, Mus musculus
acttctcactggcaccttacgagaa

SEQ ID NO: 134887 - DNA, 25 bp, Mus musculus
acttctcactgggaactgacagaac

SEQ ID NO: 134888 - DNA, 25 bp, Mus musculus
acttctcactgggaccttacgagaa

SEQ ID NO: 134889 - DNA, 25 bp, Mus musculus
acttctcagagtcgctttattatat

SEQ ID NO: 134890 - DNA, 25 bp, Mus musculus
acttctcagagtggctttattatat

SEQ ID NO: 134891 - DNA, 25 bp, Mus musculus
acttctcagatacagtgtgcaccct

SEQ ID NO: 134892 - DNA, 25 bp, Mus musculus
acttctcagatagagtgtgcaccct

SEQ ID NO: 134893 - DNA, 25 bp, Mus musculus
acttctcaggtcacgtgcacagccg

SEQ ID NO: 134894 - DNA, 25 bp, Mus musculus
acttctcaggtctcgtgcacagccg

SEQ ID NO: 134895 - DNA, 25 bp, Mus musculus
acttctcagtgaagtcttataacat

SEQ ID NO: 134896 - DNA, 25 bp, Mus musculus
acttctcagtgatgtcttataacat

SEQ ID NO: 134897 - DNA, 25 bp, Mus musculus
acttctcatccgctagaaactggtc

SEQ ID NO: 134898 - DNA, 25 bp, Mus musculus
acttctcatccggtagaaactggtc

SEQ ID NO: 134899 - DNA, 25 bp, Mus musculus
acttctcatcgtatttgcagtggtg

SEQ ID NO: 134900 - DNA, 25 bp, Mus musculus
acttctcatcgtttttgcagtggtg

SEQ ID NO: 134901 - DNA, 25 bp, Mus musculus
acttctccagaaacatgcaccaaac

SEQ ID NO: 134902 - DNA, 25 bp, Mus musculus
acttctccagaatcatgcaccaaac

SEQ ID NO: 134903 - DNA, 25 bp, Mus musculus
acttctccagtactttcacttgagc

SEQ ID NO: 134904 - DNA, 25 bp, Mus musculus
acttctccagtagtttcacttgagc

SEQ ID NO: 134905 - DNA, 25 bp, Mus musculus
acttctccatcgaggttggcgtgct

SEQ ID NO: 134906 - DNA, 25 bp, Mus musculus
acttctccatcgatactgttgttaa

SEQ ID NO: 134907 - DNA, 25 bp, Mus musculus
acttctccatcgtggttggcgtgct

SEQ ID NO: 134908 - DNA, 25 bp, Mus musculus
acttctccatcgttactgttgttaa

SEQ ID NO: 134909 - DNA, 25 bp, Mus musculus
acttctccatggactctgatttagt

SEQ ID NO: 134910 - DNA, 25 bp, Mus musculus
acttctccatggtctctgatttagt

SEQ ID NO: 134911 - DNA, 25 bp, Mus musculus
acttctcccgctactgagttcttat

SEQ ID NO: 134912 - DNA, 25 bp, Mus musculus
acttctcccgcttctgagttcttat

SEQ ID NO: 134913 - DNA, 25 bp, Mus musculus
acttctccctgaagtgatttttctg

SEQ ID NO: 134914 - DNA, 25 bp, Mus musculus
acttctccctgatgtgatttttctg

SEQ ID NO: 134915 - DNA, 25 bp, Mus musculus
acttctcctacaaggcatcgtgtga

SEQ ID NO: 134916 - DNA, 25 bp, Mus musculus
acttctcctacatggcatcgtgtga

SEQ ID NO: 134917 - DNA, 25 bp, Mus musculus
acttctcctgcccatcaagagggac

SEQ ID NO: 134918 - DNA, 25 bp, Mus musculus
acttctcctgccgatcaagagggac

SEQ ID NO: 134919 - DNA, 25 bp, Mus musculus
acttctcctgttagactgtccagtg

SEQ ID NO: 134920 - DNA, 25 bp, Mus musculus
acttctcctgtttgactgtccagtg

SEQ ID NO: 134921 - DNA, 25 bp, Mus musculus
acttctccttataccgctgtttgga

SEQ ID NO: 134922 - DNA, 25 bp, Mus musculus
acttctccttattccgctgtttgga

SEQ ID NO: 134923 - DNA, 25 bp, Mus musculus
acttctcgagaacactactaggtag

SEQ ID NO: 134924 - DNA, 25 bp, Mus musculus
acttctcgagaagactactaggtag

SEQ ID NO: 134925 - DNA, 25 bp, Mus musculus
acttctcgccaacgcacgattagct

SEQ ID NO: 134926 - DNA, 25 bp, Mus musculus
acttctcgccaaggcacgattagct

SEQ ID NO: 134927 - DNA, 25 bp, Mus musculus
acttctcgctttaaagtcctggaat

SEQ ID NO: 134928 - DNA, 25 bp, Mus musculus
acttctcgcttttaagtcctggaat

SEQ ID NO: 134929 - DNA, 25 bp, Mus musculus
acttctcggattcaggttgttgtta

SEQ ID NO: 134930 - DNA, 25 bp, Mus musculus
acttctcggattgaggttgttgtta

SEQ ID NO: 134931 - DNA, 25 bp, Mus musculus
acttctcgttcaataaattgtttat

SEQ ID NO: 134932 - DNA, 25 bp, Mus musculus
acttctcgttcattaaattgtttat

SEQ ID NO: 134933 - DNA, 25 bp, Mus musculus
acttctctacccaccctcttggttg

SEQ ID NO: 134934 - DNA, 25 bp, Mus musculus
acttctctaccctccctcttggttg

SEQ ID NO: 134935 - DNA, 25 bp, Mus musculus
acttctctagaacatagtatctctg

SEQ ID NO: 134936 - DNA, 25 bp, Mus musculus
acttctctagaagatagtatctctg

SEQ ID NO: 134937 - DNA, 25 bp, Mus musculus
acttctctcaccatgcagcttttat

SEQ ID NO: 134938 - DNA, 25 bp, Mus musculus
acttctctcaccttgcagcttttat

SEQ ID NO: 134939 - DNA, 25 bp, Mus musculus
acttctctccagagatcatcgtcag

SEQ ID NO: 134940 - DNA, 25 bp, Mus musculus
acttctctccagatttgtctaattg

SEQ ID NO: 134941 - DNA, 25 bp, Mus musculus
acttctctccagtgatcatcgtcag

SEQ ID NO: 134942 - DNA, 25 bp, Mus musculus
acttctctccagttttgtctaattg

SEQ ID NO: 134943 - DNA, 25 bp, Mus musculus
acttctctccggaggaactcaaagt

SEQ ID NO: 134944 - DNA, 25 bp, Mus musculus
acttctctccggtggaactcaaagt

SEQ ID NO: 134945 - DNA, 25 bp, Mus musculus
acttctctcctcctgaaatctatat

SEQ ID NO: 134946 - DNA, 25 bp, Mus musculus
acttctctcctcgtgaaatctatat

SEQ ID NO: 134947 - DNA, 25 bp, Mus musculus
acttctctccttcatctacctaggg

SEQ ID NO: 134948 - DNA, 25 bp, Mus musculus
acttctctccttgatctacctaggg

SEQ ID NO: 134949 - DNA, 25 bp, Mus musculus
acttctctcgtgaccaagtatgcag

SEQ ID NO: 134950 - DNA, 25 bp, Mus musculus
acttctctcgtgtccaagtatgcag

SEQ ID NO: 134951 - DNA, 25 bp, Mus musculus
acttctctctagaaatgtatctgtg

SEQ ID NO: 134952 - DNA, 25 bp, Mus musculus
acttctctctagtaatgtatctgtg

SEQ ID NO: 134953 - DNA, 25 bp, Mus musculus
acttctctgaccagagatcctctgg

SEQ ID NO: 134954 - DNA, 25 bp, Mus musculus
acttctctgacctgagatcctctgg

SEQ ID NO: 134955 - DNA, 25 bp, Mus musculus
acttctctgcccactatatattgtt

SEQ ID NO: 134956 - DNA, 25 bp, Mus musculus
acttctctgccctctatatattgtt

SEQ ID NO: 134957 - DNA, 25 bp, Mus musculus
acttctctgcgtagctggttaggga

SEQ ID NO: 134958 - DNA, 25 bp, Mus musculus
acttctctgcgttgctggttaggga

SEQ ID NO: 134959 - DNA, 25 bp, Mus musculus
acttctctggacatgtaggctctgg

SEQ ID NO: 134960 - DNA, 25 bp, Mus musculus
acttctctggacttgtaggctctgg

SEQ ID NO: 134961 - DNA, 25 bp, Mus musculus
acttctctggagacccccttaatag

SEQ ID NO: 134962 - DNA, 25 bp, Mus musculus
acttctctggagtcccccttaatag

SEQ ID NO: 134963 - DNA, 25 bp, Mus musculus
acttctctgtggcttatgccaacat

SEQ ID NO: 134964 - DNA, 25 bp, Mus musculus
acttctctgtgggttatgccaacat

SEQ ID NO: 134965 - DNA, 25 bp, Mus musculus
acttctctgttaccgactctcactc

SEQ ID NO: 134966 - DNA, 25 bp, Mus musculus
acttctctgttagcgactctcactc

SEQ ID NO: 134967 - DNA, 25 bp, Mus musculus
acttctcttataccttgtgtattct

SEQ ID NO: 134968 - DNA, 25 bp, Mus musculus
acttctcttatagcttgtgtattct

SEQ ID NO: 134969 - DNA, 25 bp, Mus musculus
acttctcttcctcaaggccttcagg

SEQ ID NO: 134970 - DNA, 25 bp, Mus musculus
acttctcttcctgaaggccttcagg

SEQ ID NO: 134971 - DNA, 25 bp, Mus musculus
acttctcttcttctaaatcatcctt

SEQ ID NO: 134972 - DNA, 25 bp, Mus musculus
acttctcttcttgtaaatcatcctt

SEQ ID NO: 134973 - DNA, 25 bp, Mus musculus
acttctgaacatattaccactcacc

SEQ ID NO: 134974 - DNA, 25 bp, Mus musculus
acttctgaacattttaccactcacc

SEQ ID NO: 134975 - DNA, 25 bp, Mus musculus
acttctgaatcacagtgcccagtat

SEQ ID NO: 134976 - DNA, 25 bp, Mus musculus
acttctgaatcagagtgcccagtat

SEQ ID NO: 134977 - DNA, 25 bp, Mus musculus
acttctgacacacaagccttctgtc

SEQ ID NO: 134978 - DNA, 25 bp, Mus musculus
acttctgacacacgcaaatgcttgc

SEQ ID NO: 134979 - DNA, 25 bp, Mus musculus
acttctgacacagaagccttctgtc

SEQ ID NO: 134980 - DNA, 25 bp, Mus musculus
acttctgacacaggcaaatgcttgc

SEQ ID NO: 134981 - DNA, 25 bp, Mus musculus
acttctgacattatgcttgaggctg

SEQ ID NO: 134982 - DNA, 25 bp, Mus musculus
acttctgacattttgcttgaggctg

SEQ ID NO: 134983 - DNA, 25 bp, Mus musculus
acttctgacccgcagggcgggcctg

SEQ ID NO: 134984 - DNA, 25 bp, Mus musculus
acttctgacccggagggcgggcctg

SEQ ID NO: 134985 - DNA, 25 bp, Mus musculus
acttctgaccgacctagggccatcg

SEQ ID NO: 134986 - DNA, 25 bp, Mus musculus
acttctgaccgagctagggccatcg

SEQ ID NO: 134987 - DNA, 25 bp, Mus musculus
acttctgaccttagggcgaaagccg

SEQ ID NO: 134988 - DNA, 25 bp, Mus musculus
acttctgacctttgggcgaaagccg

SEQ ID NO: 134989 - DNA, 25 bp, Mus musculus
acttctgactctaggccattccact

SEQ ID NO: 134990 - DNA, 25 bp, Mus musculus
acttctgactcttggccattccact

SEQ ID NO: 134991 - DNA, 25 bp, Mus musculus
acttctgactgtaggcataggttga

SEQ ID NO: 134992 - DNA, 25 bp, Mus musculus
acttctgactgttggcataggttga

SEQ ID NO: 134993 - DNA, 25 bp, Mus musculus
acttctgagccactctgctgtcata

SEQ ID NO: 134994 - DNA, 25 bp, Mus musculus
acttctgagccagtctgctgtcata

SEQ ID NO: 134995 - DNA, 25 bp, Mus musculus
acttctgaggagagcgtctgttctt

SEQ ID NO: 134996 - DNA, 25 bp, Mus musculus
acttctgaggagtgcgtctgttctt

SEQ ID NO: 134997 - DNA, 25 bp, Mus musculus
acttctgattgtatttgtgctctga

SEQ ID NO: 134998 - DNA, 25 bp, Mus musculus
acttctgattgtttttgtgctctga

SEQ ID NO: 134999 - DNA, 25 bp, Mus musculus
acttctgattttagtaataactatc

SEQ ID NO: 135000 - DNA, 25 bp, Mus musculus
acttctgattttatgctgcttagct

SEQ ID NO: 135001 - DNA, 25 bp, Mus musculus
acttctgatttttgtaataactatc

SEQ ID NO: 135002 - DNA, 25 bp, Mus musculus
acttctgattttttgctgcttagct

SEQ ID NO: 135003 - DNA, 25 bp, Mus musculus
acttctgcaagtaagtcgtcctatg

SEQ ID NO: 135004 - DNA, 25 bp, Mus musculus
acttctgcaagttagtcgtcctatg

SEQ ID NO: 135005 - DNA, 25 bp, Mus musculus
acttctgcagtcaggatcgtctgta

SEQ ID NO: 135006 - DNA, 25 bp, Mus musculus
acttctgcagtctggatcgtctgta

SEQ ID NO: 135007 - DNA, 25 bp, Mus musculus
acttctgcatgactgagtctcttaa

SEQ ID NO: 135008 - DNA, 25 bp, Mus musculus
acttctgcatgagtgagtctcttaa

SEQ ID NO: 135009 - DNA, 25 bp, Mus musculus
acttctgccatcatttagatctcag

SEQ ID NO: 135010 - DNA, 25 bp, Mus musculus
acttctgccatcttttagatctcag

SEQ ID NO: 135011 - DNA, 25 bp, Mus musculus
acttctgccatgacgactgtcaaga

SEQ ID NO: 135012 - DNA, 25 bp, Mus musculus
acttctgccatgtcgactgtcaaga

SEQ ID NO: 135013 - DNA, 25 bp, Mus musculus
acttctgccctcagactttaagtga

SEQ ID NO: 135014 - DNA, 25 bp, Mus musculus
acttctgccctctgactttaagtga

SEQ ID NO: 135015 - DNA, 25 bp, Mus musculus
acttctgcctacagggtcttgtttt

SEQ ID NO: 135016 - DNA, 25 bp, Mus musculus
acttctgcctactgggtcttgtttt

SEQ ID NO: 135017 - DNA, 25 bp, Mus musculus
acttctgcctctaaagaccttgcaa

SEQ ID NO: 135018 - DNA, 25 bp, Mus musculus
acttctgcctctagcaagattgctg

SEQ ID NO: 135019 - DNA, 25 bp, Mus musculus
acttctgcctcttaagaccttgcaa

SEQ ID NO: 135020 - DNA, 25 bp, Mus musculus
acttctgcctcttgcaagattgctg

SEQ ID NO: 135021 - DNA, 25 bp, Mus musculus
acttctgccttccagtatgttagag

SEQ ID NO: 135022 - DNA, 25 bp, Mus musculus
acttctgccttcgagtatgttagag

SEQ ID NO: 135023 - DNA, 25 bp, Mus musculus
acttctgcgaagatcctggtcacca

SEQ ID NO: 135024 - DNA, 25 bp, Mus musculus
acttctgcgaagttcctggtcacca

SEQ ID NO: 135025 - DNA, 25 bp, Mus musculus
acttctgcggctctgatgttcctag

SEQ ID NO: 135026 - DNA, 25 bp, Mus musculus
acttctgcggctgtgatgttcctag

SEQ ID NO: 135027 - DNA, 25 bp, Mus musculus
acttctgctgatagtctcttacttt

SEQ ID NO: 135028 - DNA, 25 bp, Mus musculus
acttctgctgattgtctcttacttt

SEQ ID NO: 135029 - DNA, 25 bp, Mus musculus
acttctgctgcaaagagtcggccca

SEQ ID NO: 135030 - DNA, 25 bp, Mus musculus
acttctgctgcatagagtcggccca

SEQ ID NO: 135031 - DNA, 25 bp, Mus musculus
acttctgctgggagtgtttcacatt

SEQ ID NO: 135032 - DNA, 25 bp, Mus musculus
acttctgctgggtgtgtttcacatt

SEQ ID NO: 135033 - DNA, 25 bp, Mus musculus
acttctgcttaaaggctatgagacc

SEQ ID NO: 135034 - DNA, 25 bp, Mus musculus
acttctgcttaatggctatgagacc

SEQ ID NO: 135035 - DNA, 25 bp, Mus musculus
acttctgctttaacaccacttatga

SEQ ID NO: 135036 - DNA, 25 bp, Mus musculus
acttctgctttatcaccacttatga

SEQ ID NO: 135037 - DNA, 25 bp, Mus musculus
acttctgcttttcatttcctcatat

SEQ ID NO: 135038 - DNA, 25 bp, Mus musculus
acttctgcttttgatttcctcatat

SEQ ID NO: 135039 - DNA, 25 bp, Mus musculus
acttctggaatcatgttgcctactg

SEQ ID NO: 135040 - DNA, 25 bp, Mus musculus
acttctggaatcttgttgcctactg

SEQ ID NO: 135041 - DNA, 25 bp, Mus musculus
acttctggatagaaagctggtgtta

SEQ ID NO: 135042 - DNA, 25 bp, Mus musculus
acttctggatagtaagctggtgtta

SEQ ID NO: 135043 - DNA, 25 bp, Mus musculus
acttctggatatctgacctctgacc

SEQ ID NO: 135044 - DNA, 25 bp, Mus musculus
acttctggatatgtgacctctgacc

SEQ ID NO: 135045 - DNA, 25 bp, Mus musculus
acttctggcagcagtgatcaaaccc

SEQ ID NO: 135046 - DNA, 25 bp, Mus musculus
acttctggcagctgtgatcaaaccc

SEQ ID NO: 135047 - DNA, 25 bp, Mus musculus
acttctggcaggctatctccttcag

SEQ ID NO: 135048 - DNA, 25 bp, Mus musculus
acttctggcagggtatctccttcag

SEQ ID NO: 135049 - DNA, 25 bp, Mus musculus
acttctggccatctgtcttctgtta

SEQ ID NO: 135050 - DNA, 25 bp, Mus musculus
acttctggccatgtgtcttctgtta

SEQ ID NO: 135051 - DNA, 25 bp, Mus musculus
acttctggccttcacagactttagc

SEQ ID NO: 135052 - DNA, 25 bp, Mus musculus
acttctggccttgacagactttagc

SEQ ID NO: 135053 - DNA, 25 bp, Mus musculus
acttctggctaaatctggacgtcta

SEQ ID NO: 135054 - DNA, 25 bp, Mus musculus
acttctggctaattctggacgtcta

SEQ ID NO: 135055 - DNA, 25 bp, Mus musculus
acttctggcttgactatttctgtta

SEQ ID NO: 135056 - DNA, 25 bp, Mus musculus
acttctggcttgtctatttctgtta

SEQ ID NO: 135057 - DNA, 25 bp, Mus musculus
acttctgggacaacctttgctacaa

SEQ ID NO: 135058 - DNA, 25 bp, Mus musculus
acttctgggacatcctttgctacaa

SEQ ID NO: 135059 - DNA, 25 bp, Mus musculus
acttctgggagtctaggcttctgtc

SEQ ID NO: 135060 - DNA, 25 bp, Mus musculus
acttctgggagtgtaggcttctgtc

SEQ ID NO: 135061 - DNA, 25 bp, Mus musculus
acttctgggcccaatacaatgcaac

SEQ ID NO: 135062 - DNA, 25 bp, Mus musculus
acttctgggccctatacaatgcaac

SEQ ID NO: 135063 - DNA, 25 bp, Mus musculus
acttctgggttccattgacattgac

SEQ ID NO: 135064 - DNA, 25 bp, Mus musculus
acttctgggttcgattgacattgac

SEQ ID NO: 135065 - DNA, 25 bp, Mus musculus
acttctggtagcaggtcatcatttc

SEQ ID NO: 135066 - DNA, 25 bp, Mus musculus
acttctggtagctggtcatcatttc

SEQ ID NO: 135067 - DNA, 25 bp, Mus musculus
acttctggtcagacggtcagcaggc

SEQ ID NO: 135068 - DNA, 25 bp, Mus musculus
acttctggtcagtcggtcagcaggc

SEQ ID NO: 135069 - DNA, 25 bp, Mus musculus
acttctggtgggactgcttatcttc

SEQ ID NO: 135070 - DNA, 25 bp, Mus musculus
acttctggtgggtctgcttatcttc

SEQ ID NO: 135071 - DNA, 25 bp, Mus musculus
acttctgtaaatactaccagttgga

SEQ ID NO: 135072 - DNA, 25 bp, Mus musculus
acttctgtaaattctaccagttgga

SEQ ID NO: 135073 - DNA, 25 bp, Mus musculus
acttctgtagacatcgcattgtttg

SEQ ID NO: 135074 - DNA, 25 bp, Mus musculus
acttctgtagacttcgcattgtttg

SEQ ID NO: 135075 - DNA, 25 bp, Mus musculus
acttctgtagctctgtattcacctt

SEQ ID NO: 135076 - DNA, 25 bp, Mus musculus
acttctgtagctgtgtattcacctt

SEQ ID NO: 135077 - DNA, 25 bp, Mus musculus
acttctgtatagattctagctctca

SEQ ID NO: 135078 - DNA, 25 bp, Mus musculus
acttctgtatagtttctagctctca

SEQ ID NO: 135079 - DNA, 25 bp, Mus musculus
acttctgtcagaatagtcctacttc

SEQ ID NO: 135080 - DNA, 25 bp, Mus musculus
acttctgtcagattagtcctacttc

SEQ ID NO: 135081 - DNA, 25 bp, Mus musculus
acttctgtcatgatcccagaggatt

SEQ ID NO: 135082 - DNA, 25 bp, Mus musculus
acttctgtcatgttcccagaggatt

SEQ ID NO: 135083 - DNA, 25 bp, Mus musculus
acttctgtcctcatcctgtaaataa

SEQ ID NO: 135084 - DNA, 25 bp, Mus musculus
acttctgtcctcttcctgtaaataa

SEQ ID NO: 135085 - DNA, 25 bp, Mus musculus
acttctgtgaagctgcctatgttga

SEQ ID NO: 135086 - DNA, 25 bp, Mus musculus
acttctgtgaaggtgcctatgttga

SEQ ID NO: 135087 - DNA, 25 bp, Mus musculus
acttctgtgcatataacttggtctt

SEQ ID NO: 135088 - DNA, 25 bp, Mus musculus
acttctgtgcatcttataaatcaaa

SEQ ID NO: 135089 - DNA, 25 bp, Mus musculus
acttctgtgcatgttataaatcaaa

SEQ ID NO: 135090 - DNA, 25 bp, Mus musculus
acttctgtgcatttaacttggtctt

SEQ ID NO: 135091 - DNA, 25 bp, Mus musculus
acttctgtgccaccggtgatgcaca

SEQ ID NO: 135092 - DNA, 25 bp, Mus musculus
acttctgtgccagcggtgatgcaca

SEQ ID NO: 135093 - DNA, 25 bp, Mus musculus
acttctgtgcctagcttctcttatt

SEQ ID NO: 135094 - DNA, 25 bp, Mus musculus
acttctgtgcctctgtgcattatta

SEQ ID NO: 135095 - DNA, 25 bp, Mus musculus
acttctgtgcctgtgtgcattatta

SEQ ID NO: 135096 - DNA, 25 bp, Mus musculus
acttctgtgccttgcttctcttatt

SEQ ID NO: 135097 - DNA, 25 bp, Mus musculus
acttctgtgcgcatgtgtatgacct

SEQ ID NO: 135098 - DNA, 25 bp, Mus musculus
acttctgtgcgcttgtgtatgacct

SEQ ID NO: 135099 - DNA, 25 bp, Mus musculus
acttctgtgctactgccatacaaat

SEQ ID NO: 135100 - DNA, 25 bp, Mus musculus
acttctgtgctagtgccatacaaat

SEQ ID NO: 135101 - DNA, 25 bp, Mus musculus
acttctgtgcttctgagtgcctgat

SEQ ID NO: 135102 - DNA, 25 bp, Mus musculus
acttctgtgcttgtgagtgcctgat

SEQ ID NO: 135103 - DNA, 25 bp, Mus musculus
acttctgtggccatagcggtgtgta

SEQ ID NO: 135104 - DNA, 25 bp, Mus musculus
acttctgtggccatctcaaagagtg

SEQ ID NO: 135105 - DNA, 25 bp, Mus musculus
acttctgtggccttagcggtgtgta

SEQ ID NO: 135106 - DNA, 25 bp, Mus musculus
acttctgtggccttctcaaagagtg

SEQ ID NO: 135107 - DNA, 25 bp, Mus musculus
acttctgtgggccttcttaacaagc

SEQ ID NO: 135108 - DNA, 25 bp, Mus musculus
acttctgtgggcgttcttaacaagc

SEQ ID NO: 135109 - DNA, 25 bp, Mus musculus
acttctgtggtaaataacgatcgtg

SEQ ID NO: 135110 - DNA, 25 bp, Mus musculus
acttctgtggtatataacgatcgtg

SEQ ID NO: 135111 - DNA, 25 bp, Mus musculus
acttctgtggtcacatctttgtctt

SEQ ID NO: 135112 - DNA, 25 bp, Mus musculus
acttctgtggtctcatctttgtctt

SEQ ID NO: 135113 - DNA, 25 bp, Mus musculus
acttctgtggttacctggaggatcc

SEQ ID NO: 135114 - DNA, 25 bp, Mus musculus
acttctgtggtttcctggaggatcc

SEQ ID NO: 135115 - DNA, 25 bp, Mus musculus
acttctgtgtagcagtcaccactgg

SEQ ID NO: 135116 - DNA, 25 bp, Mus musculus
acttctgtgtaggagtcaccactgg

SEQ ID NO: 135117 - DNA, 25 bp, Mus musculus
acttctgtgtccctaaagtgtgccg

SEQ ID NO: 135118 - DNA, 25 bp, Mus musculus
acttctgtgtccgtaaagtgtgccg

SEQ ID NO: 135119 - DNA, 25 bp, Mus musculus
acttctgtgtgaaactgagccccat

SEQ ID NO: 135120 - DNA, 25 bp, Mus musculus
acttctgtgtgatactgagccccat

SEQ ID NO: 135121 - DNA, 25 bp, Mus musculus
acttctgtgtgcacgagctgcccca

SEQ ID NO: 135122 - DNA, 25 bp, Mus musculus
acttctgtgtgctcgagctgcccca

SEQ ID NO: 135123 - DNA, 25 bp, Mus musculus
acttctgtgttcaccaacagtgagg

SEQ ID NO: 135124 - DNA, 25 bp, Mus musculus
acttctgtgttctccaacagtgagg

SEQ ID NO: 135125 - DNA, 25 bp, Mus musculus
acttctgttccactagcctagtggt

SEQ ID NO: 135126 - DNA, 25 bp, Mus musculus
acttctgttccagtagcctagtggt

SEQ ID NO: 135127 - DNA, 25 bp, Mus musculus
acttctgttcgcatcaccaggtgct

SEQ ID NO: 135128 - DNA, 25 bp, Mus musculus
acttctgttcgcttcaccaggtgct

SEQ ID NO: 135129 - DNA, 25 bp, Mus musculus
acttctgttgacaatttgaattttg

SEQ ID NO: 135130 - DNA, 25 bp, Mus musculus
acttctgttgactatttgaattttg

SEQ ID NO: 135131 - DNA, 25 bp, Mus musculus
acttctgttgatagcctttttgttc

SEQ ID NO: 135132 - DNA, 25 bp, Mus musculus
acttctgttgatcttaaactaaatg

SEQ ID NO: 135133 - DNA, 25 bp, Mus musculus
acttctgttgatgttaaactaaatg

SEQ ID NO: 135134 - DNA, 25 bp, Mus musculus
acttctgttgattgcctttttgttc

SEQ ID NO: 135135 - DNA, 25 bp, Mus musculus
acttctgttggtaatgtattagtct

SEQ ID NO: 135136 - DNA, 25 bp, Mus musculus
acttctgttggttatgtattagtct

SEQ ID NO: 135137 - DNA, 25 bp, Mus musculus
acttctgtttcccaagactttcagg

SEQ ID NO: 135138 - DNA, 25 bp, Mus musculus
acttctgtttccgaagactttcagg

SEQ ID NO: 135139 - DNA, 25 bp, Mus musculus
acttctgttttgacttctggaacct

SEQ ID NO: 135140 - DNA, 25 bp, Mus musculus
acttctgttttgtcttctggaacct

SEQ ID NO: 135141 - DNA, 25 bp, Mus musculus
acttcttaatccattcttgctgcac

SEQ ID NO: 135142 - DNA, 25 bp, Mus musculus
acttcttaatcctttcttgctgcac

SEQ ID NO: 135143 - DNA, 25 bp, Mus musculus
acttcttacaacaacatccttttca

SEQ ID NO: 135144 - DNA, 25 bp, Mus musculus
acttcttacaacattctccagagat

SEQ ID NO: 135145 - DNA, 25 bp, Mus musculus
acttcttacaactacatccttttca

SEQ ID NO: 135146 - DNA, 25 bp, Mus musculus
acttcttacaactttctccagagat

SEQ ID NO: 135147 - DNA, 25 bp, Mus musculus
acttcttacactaacgaggtcacat

SEQ ID NO: 135148 - DNA, 25 bp, Mus musculus
acttcttacacttacgaggtcacat

SEQ ID NO: 135149 - DNA, 25 bp, Mus musculus
acttcttagaagactcctgattttc

SEQ ID NO: 135150 - DNA, 25 bp, Mus musculus
acttcttagaagtctcctgattttc

SEQ ID NO: 135151 - DNA, 25 bp, Mus musculus
acttcttaggaacaaagatgcaaca

SEQ ID NO: 135152 - DNA, 25 bp, Mus musculus
acttcttaggaagaaagatgcaaca

SEQ ID NO: 135153 - DNA, 25 bp, Mus musculus
acttcttatcaaccttgtgtgacaa

SEQ ID NO: 135154 - DNA, 25 bp, Mus musculus
acttcttatcaagcttgtgtgacaa

SEQ ID NO: 135155 - DNA, 25 bp, Mus musculus
acttcttatctcaccccattaagag

SEQ ID NO: 135156 - DNA, 25 bp, Mus musculus
acttcttatctctccccattaagag

SEQ ID NO: 135157 - DNA, 25 bp, Mus musculus
acttcttatctgagtattggctttg

SEQ ID NO: 135158 - DNA, 25 bp, Mus musculus
acttcttatctgtgtattggctttg

SEQ ID NO: 135159 - DNA, 25 bp, Mus musculus
acttcttattcaatccctggacaga

SEQ ID NO: 135160 - DNA, 25 bp, Mus musculus
acttcttattcattccctggacaga

SEQ ID NO: 135161 - DNA, 25 bp, Mus musculus
acttcttatttgactatgtgtggca

SEQ ID NO: 135162 - DNA, 25 bp, Mus musculus
acttcttatttgtctatgtgtggca

SEQ ID NO: 135163 - DNA, 25 bp, Mus musculus
acttcttcaagcaaaaatgctgatt

SEQ ID NO: 135164 - DNA, 25 bp, Mus musculus
acttcttcaagctaaaatgctgatt

SEQ ID NO: 135165 - DNA, 25 bp, Mus musculus
acttcttcaaggagctgatcctgga

SEQ ID NO: 135166 - DNA, 25 bp, Mus musculus
acttcttcaaggtgctgatcctgga

SEQ ID NO: 135167 - DNA, 25 bp, Mus musculus
acttcttcaccaatttaatgcctta

SEQ ID NO: 135168 - DNA, 25 bp, Mus musculus
acttcttcaccattttaatgcctta

SEQ ID NO: 135169 - DNA, 25 bp, Mus musculus
acttcttcacccatatgcacaataa

SEQ ID NO: 135170 - DNA, 25 bp, Mus musculus
acttcttcacccttatgcacaataa

SEQ ID NO: 135171 - DNA, 25 bp, Mus musculus
acttcttcagttcctaatgccaggc

SEQ ID NO: 135172 - DNA, 25 bp, Mus musculus
acttcttcagttgctaatgccaggc

SEQ ID NO: 135173 - DNA, 25 bp, Mus musculus
acttcttcatgtcggctggttggca

SEQ ID NO: 135174 - DNA, 25 bp, Mus musculus
acttcttcatgtgggctggttggca

SEQ ID NO: 135175 - DNA, 25 bp, Mus musculus
acttcttccaggctaggacgtatcc

SEQ ID NO: 135176 - DNA, 25 bp, Mus musculus
acttcttccagggtaggacgtatcc

SEQ ID NO: 135177 - DNA, 25 bp, Mus musculus
acttcttccatcatttcacaagcag

SEQ ID NO: 135178 - DNA, 25 bp, Mus musculus
acttcttccatcttttcacaagcag

SEQ ID NO: 135179 - DNA, 25 bp, Mus musculus
acttcttccgcgaattggccgagga

SEQ ID NO: 135180 - DNA, 25 bp, Mus musculus
acttcttccgcgtattggccgagga

SEQ ID NO: 135181 - DNA, 25 bp, Mus musculus
acttcttccggcaggcggcctgggt

SEQ ID NO: 135182 - DNA, 25 bp, Mus musculus
acttcttccggctggcggcctgggt

SEQ ID NO: 135183 - DNA, 25 bp, Mus musculus
acttcttcctcaagtggagtgttta

SEQ ID NO: 135184 - DNA, 25 bp, Mus musculus
acttcttcctcatgtggagtgttta

SEQ ID NO: 135185 - DNA, 25 bp, Mus musculus
acttcttcctggaagcgtgtctgga

SEQ ID NO: 135186 - DNA, 25 bp, Mus musculus
acttcttcctggtagcgtgtctgga

SEQ ID NO: 135187 - DNA, 25 bp, Mus musculus
acttcttcttgaacagtgtgctgtt

SEQ ID NO: 135188 - DNA, 25 bp, Mus musculus
acttcttcttgatcagtgtgctgtt

SEQ ID NO: 135189 - DNA, 25 bp, Mus musculus
acttcttgaacccatcacttcaggg

SEQ ID NO: 135190 - DNA, 25 bp, Mus musculus
acttcttgaaccgatcacttcaggg

SEQ ID NO: 135191 - DNA, 25 bp, Mus musculus
acttcttgaactatactgtaaggca

SEQ ID NO: 135192 - DNA, 25 bp, Mus musculus
acttcttgaactttactgtaaggca

SEQ ID NO: 135193 - DNA, 25 bp, Mus musculus
acttcttgagaacgcggttccagtt

SEQ ID NO: 135194 - DNA, 25 bp, Mus musculus
acttcttgagaaggcggttccagtt

SEQ ID NO: 135195 - DNA, 25 bp, Mus musculus
acttcttgattgacgatctctgtca

SEQ ID NO: 135196 - DNA, 25 bp, Mus musculus
acttcttgattgtcgatctctgtca

SEQ ID NO: 135197 - DNA, 25 bp, Mus musculus
acttcttgcccaaggaatctccagg

SEQ ID NO: 135198 - DNA, 25 bp, Mus musculus
acttcttgcccatggaatctccagg

SEQ ID NO: 135199 - DNA, 25 bp, Mus musculus
acttcttgctctagggttcctggca

SEQ ID NO: 135200 - DNA, 25 bp, Mus musculus
acttcttgctcttgggttcctggca

SEQ ID NO: 135201 - DNA, 25 bp, Mus musculus
acttcttggaagacaaccgtcagga

SEQ ID NO: 135202 - DNA, 25 bp, Mus musculus
acttcttggaagctttatttctgga

SEQ ID NO: 135203 - DNA, 25 bp, Mus musculus
acttcttggaaggtttatttctgga

SEQ ID NO: 135204 - DNA, 25 bp, Mus musculus
acttcttggaagtcaaccgtcagga

SEQ ID NO: 135205 - DNA, 25 bp, Mus musculus
acttcttggatcctctgtggagaaa

SEQ ID NO: 135206 - DNA, 25 bp, Mus musculus
acttcttggatcgtctgtggagaaa

SEQ ID NO: 135207 - DNA, 25 bp, Mus musculus
acttcttggattcgttttactactg

SEQ ID NO: 135208 - DNA, 25 bp, Mus musculus
acttcttggattggttttactactg

SEQ ID NO: 135209 - DNA, 25 bp, Mus musculus
acttcttggcataacatttttgacg

SEQ ID NO: 135210 - DNA, 25 bp, Mus musculus
acttcttggcattacatttttgacg

SEQ ID NO: 135211 - DNA, 25 bp, Mus musculus
acttcttgtaagattgacaccagag

SEQ ID NO: 135212 - DNA, 25 bp, Mus musculus
acttcttgtaagtttgacaccagag

SEQ ID NO: 135213 - DNA, 25 bp, Mus musculus
acttcttgtaccagcttgaggacac

SEQ ID NO: 135214 - DNA, 25 bp, Mus musculus
acttcttgtacctgcttgaggacac

SEQ ID NO: 135215 - DNA, 25 bp, Mus musculus
acttcttgtattctgctatcccatc

SEQ ID NO: 135216 - DNA, 25 bp, Mus musculus
acttcttgtattgtgctatcccatc

SEQ ID NO: 135217 - DNA, 25 bp, Mus musculus
acttcttgtcaacggattgcttgct

SEQ ID NO: 135218 - DNA, 25 bp, Mus musculus
acttcttgtcaagggattgcttgct

SEQ ID NO: 135219 - DNA, 25 bp, Mus musculus
acttcttgtgcacacgacgaggacg

SEQ ID NO: 135220 - DNA, 25 bp, Mus musculus
acttcttgtgcagacgacgaggacg

SEQ ID NO: 135221 - DNA, 25 bp, Mus musculus
acttcttgtgtgcatgctgggtgtt

SEQ ID NO: 135222 - DNA, 25 bp, Mus musculus
acttcttgtgtggatgctgggtgtt

SEQ ID NO: 135223 - DNA, 25 bp, Mus musculus
acttctttaacaagcctgatccgta

SEQ ID NO: 135224 - DNA, 25 bp, Mus musculus
acttctttaacatgcctgatccgta

SEQ ID NO: 135225 - DNA, 25 bp, Mus musculus
acttctttaaggcacagcttagctg

SEQ ID NO: 135226 - DNA, 25 bp, Mus musculus
acttctttaagggacagcttagctg

SEQ ID NO: 135227 - DNA, 25 bp, Mus musculus
acttctttaattaccgctgtagccg

SEQ ID NO: 135228 - DNA, 25 bp, Mus musculus
acttctttaatttccgctgtagccg

SEQ ID NO: 135229 - DNA, 25 bp, Mus musculus
acttctttatccagagggtaccagt

SEQ ID NO: 135230 - DNA, 25 bp, Mus musculus
acttctttatcctgagggtaccagt

SEQ ID NO: 135231 - DNA, 25 bp, Mus musculus
acttctttcaagaatgaggtttcta

SEQ ID NO: 135232 - DNA, 25 bp, Mus musculus
acttctttcaagtatgaggtttcta

SEQ ID NO: 135233 - DNA, 25 bp, Mus musculus
acttctttccatatgttctgtttca

SEQ ID NO: 135234 - DNA, 25 bp, Mus musculus
acttctttccatttgttctgtttca

SEQ ID NO: 135235 - DNA, 25 bp, Mus musculus
acttctttctatacattgcctacag

SEQ ID NO: 135236 - DNA, 25 bp, Mus musculus
acttctttctattcattgcctacag

SEQ ID NO: 135237 - DNA, 25 bp, Mus musculus
acttctttctttccctgtatattaa

SEQ ID NO: 135238 - DNA, 25 bp, Mus musculus
acttctttctttgcctgtatattaa

SEQ ID NO: 135239 - DNA, 25 bp, Mus musculus
acttctttgactatctggatgccca

SEQ ID NO: 135240 - DNA, 25 bp, Mus musculus
acttctttgactttctggatgccca

SEQ ID NO: 135241 - DNA, 25 bp, Mus musculus
acttctttgagaatagcacctggct

SEQ ID NO: 135242 - DNA, 25 bp, Mus musculus
acttctttgagattagcacctggct

SEQ ID NO: 135243 - DNA, 25 bp, Mus musculus
acttctttgaggagaatctgtctgc

SEQ ID NO: 135244 - DNA, 25 bp, Mus musculus
acttctttgaggtgaatctgtctgc

SEQ ID NO: 135245 - DNA, 25 bp, Mus musculus
acttctttgggtcagtgcagtgtag

SEQ ID NO: 135246 - DNA, 25 bp, Mus musculus
acttctttgggtgagtgcagtgtag

SEQ ID NO: 135247 - DNA, 25 bp, Mus musculus
acttcttttattactatcgacgttg

SEQ ID NO: 135248 - DNA, 25 bp, Mus musculus
acttcttttatttctatcgacgttg

SEQ ID NO: 135249 - DNA, 25 bp, Mus musculus
acttcttttcccatcaataaatgtg

SEQ ID NO: 135250 - DNA, 25 bp, Mus musculus
acttcttttcccttcaataaatgtg

SEQ ID NO: 135251 - DNA, 25 bp, Mus musculus
acttcttttcctcggctatacatat

SEQ ID NO: 135252 - DNA, 25 bp, Mus musculus
acttcttttcctgggctatacatat

SEQ ID NO: 135253 - DNA, 25 bp, Mus musculus
acttctttttgtatctgttcagaga

SEQ ID NO: 135254 - DNA, 25 bp, Mus musculus
acttctttttgtttctgttcagaga

SEQ ID NO: 135255 - DNA, 25 bp, Mus musculus
acttcttttttaactctaggaggct

SEQ ID NO: 135256 - DNA, 25 bp, Mus musculus
acttcttttttatctctaggaggct

SEQ ID NO: 135257 - DNA, 25 bp, Mus musculus
acttgaaaacccctctgcatgtgga

SEQ ID NO: 135258 - DNA, 25 bp, Mus musculus
acttgaaaacccgtctgcatgtgga

SEQ ID NO: 135259 - DNA, 25 bp, Mus musculus
acttgaaaaggcactcttgactatt

SEQ ID NO: 135260 - DNA, 25 bp, Mus musculus
acttgaaaaggctctcttgactatt

SEQ ID NO: 135261 - DNA, 25 bp, Mus musculus
acttgaaaatacactacattccttg

SEQ ID NO: 135262 - DNA, 25 bp, Mus musculus
acttgaaaatactctacattccttg

SEQ ID NO: 135263 - DNA, 25 bp, Mus musculus
acttgaaactcaatcaggcctgatg

SEQ ID NO: 135264 - DNA, 25 bp, Mus musculus
acttgaaactcattcaggcctgatg

SEQ ID NO: 135265 - DNA, 25 bp, Mus musculus
acttgaaagcagagccagaggacat

SEQ ID NO: 135266 - DNA, 25 bp, Mus musculus
acttgaaagcagtgccagaggacat

SEQ ID NO: 135267 - DNA, 25 bp, Mus musculus
acttgaaatcaccacactcaatgtg

SEQ ID NO: 135268 - DNA, 25 bp, Mus musculus
acttgaaatcacgacactcaatgtg

SEQ ID NO: 135269 - DNA, 25 bp, Mus musculus
acttgaaatcctattacctccatca

SEQ ID NO: 135270 - DNA, 25 bp, Mus musculus
acttgaaatccttttacctccatca

SEQ ID NO: 135271 - DNA, 25 bp, Mus musculus
acttgaacaacacataatccatatt

SEQ ID NO: 135272 - DNA, 25 bp, Mus musculus
acttgaacaacagataatccatatt

SEQ ID NO: 135273 - DNA, 25 bp, Mus musculus
acttgaacaactaagcctccagatg

SEQ ID NO: 135274 - DNA, 25 bp, Mus musculus
acttgaacaacttagcctccagatg

SEQ ID NO: 135275 - DNA, 25 bp, Mus musculus
acttgaacactgatcaaacttgaga

SEQ ID NO: 135276 - DNA, 25 bp, Mus musculus
acttgaacactgttcaaacttgaga

SEQ ID NO: 135277 - DNA, 25 bp, Mus musculus
acttgaacagttcctttgcctatca

SEQ ID NO: 135278 - DNA, 25 bp, Mus musculus
acttgaacagttgctttgcctatca

SEQ ID NO: 135279 - DNA, 25 bp, Mus musculus
acttgaacatccaagatggtgtctt

SEQ ID NO: 135280 - DNA, 25 bp, Mus musculus
acttgaacatcctagatggtgtctt

SEQ ID NO: 135281 - DNA, 25 bp, Mus musculus
acttgaacatggctcaccttcttgc

SEQ ID NO: 135282 - DNA, 25 bp, Mus musculus
acttgaacatgggtcaccttcttgc

SEQ ID NO: 135283 - DNA, 25 bp, Mus musculus
acttgaacattaccgagagggtctg

SEQ ID NO: 135284 - DNA, 25 bp, Mus musculus
acttgaacattagcgagagggtctg

SEQ ID NO: 135285 - DNA, 25 bp, Mus musculus
acttgaacatttactaattgcttat

SEQ ID NO: 135286 - DNA, 25 bp, Mus musculus
acttgaacattttctaattgcttat

SEQ ID NO: 135287 - DNA, 25 bp, Mus musculus
acttgaaccaggagcaggtgacaca

SEQ ID NO: 135288 - DNA, 25 bp, Mus musculus
acttgaaccaggtgcaggtgacaca

SEQ ID NO: 135289 - DNA, 25 bp, Mus musculus
acttgaacccatcttgaataccctt

SEQ ID NO: 135290 - DNA, 25 bp, Mus musculus
acttgaacccatgttgaataccctt

SEQ ID NO: 135291 - DNA, 25 bp, Mus musculus
acttgaagacatcgaggatttagac

SEQ ID NO: 135292 - DNA, 25 bp, Mus musculus
acttgaagacatggaggatttagac

SEQ ID NO: 135293 - DNA, 25 bp, Mus musculus
acttgaagcaaccagtgtatagaaa

SEQ ID NO: 135294 - DNA, 25 bp, Mus musculus
acttgaagcaacgagtgtatagaaa

SEQ ID NO: 135295 - DNA, 25 bp, Mus musculus
acttgaagccccatagaggctctgt

SEQ ID NO: 135296 - DNA, 25 bp, Mus musculus
acttgaagccccttagaggctctgt

SEQ ID NO: 135297 - DNA, 25 bp, Mus musculus
acttgaagccttagtttgcactgaa

SEQ ID NO: 135298 - DNA, 25 bp, Mus musculus
acttgaagcctttgtttgcactgaa

SEQ ID NO: 135299 - DNA, 25 bp, Mus musculus
acttgaagctggaagcatttgtttt

SEQ ID NO: 135300 - DNA, 25 bp, Mus musculus
acttgaagctggctatggtatcaaa

SEQ ID NO: 135301 - DNA, 25 bp, Mus musculus
acttgaagctgggtatggtatcaaa

SEQ ID NO: 135302 - DNA, 25 bp, Mus musculus
acttgaagctggtagcatttgtttt

SEQ ID NO: 135303 - DNA, 25 bp, Mus musculus
acttgaaggagcacaaggttctcgt

SEQ ID NO: 135304 - DNA, 25 bp, Mus musculus
acttgaaggagctcaaggttctcgt

SEQ ID NO: 135305 - DNA, 25 bp, Mus musculus
acttgaaggatgaccccgactgaaa

SEQ ID NO: 135306 - DNA, 25 bp, Mus musculus
acttgaaggatgtccccgactgaaa

SEQ ID NO: 135307 - DNA, 25 bp, Mus musculus
acttgaaggctgcaccccgatggac

SEQ ID NO: 135308 - DNA, 25 bp, Mus musculus
acttgaaggctggaccccgatggac

SEQ ID NO: 135309 - DNA, 25 bp, Mus musculus
acttgaagtactccttcatgcttcc

SEQ ID NO: 135310 - DNA, 25 bp, Mus musculus
acttgaagtactgcttcatgcttcc

SEQ ID NO: 135311 - DNA, 25 bp, Mus musculus
acttgaagtagactgtatgaagcag

SEQ ID NO: 135312 - DNA, 25 bp, Mus musculus
acttgaagtagagtgtatgaagcag

SEQ ID NO: 135313 - DNA, 25 bp, Mus musculus
acttgaagtattacctgacctccag

SEQ ID NO: 135314 - DNA, 25 bp, Mus musculus
acttgaagtatttcctgacctccag

SEQ ID NO: 135315 - DNA, 25 bp, Mus musculus
acttgaagtgaccattcctccttgg

SEQ ID NO: 135316 - DNA, 25 bp, Mus musculus
acttgaagtgacgattcctccttgg

SEQ ID NO: 135317 - DNA, 25 bp, Mus musculus
acttgaagttcaaagcataacagct

SEQ ID NO: 135318 - DNA, 25 bp, Mus musculus
acttgaagttcatagcataacagct

SEQ ID NO: 135319 - DNA, 25 bp, Mus musculus
acttgaatatagatctggctggcac

SEQ ID NO: 135320 - DNA, 25 bp, Mus musculus
acttgaatatagttctggctggcac

SEQ ID NO: 135321 - DNA, 25 bp, Mus musculus
acttgaatcaggctcgcatatgaaa

SEQ ID NO: 135322 - DNA, 25 bp, Mus musculus
acttgaatcagggtcgcatatgaaa

SEQ ID NO: 135323 - DNA, 25 bp, Mus musculus
acttgaatcatgacttgttttttgg

SEQ ID NO: 135324 - DNA, 25 bp, Mus musculus
acttgaatcatgtcttgttttttgg

SEQ ID NO: 135325 - DNA, 25 bp, Mus musculus
acttgaatgaagaacctagagtgtc

SEQ ID NO: 135326 - DNA, 25 bp, Mus musculus
acttgaatgaagtacctagagtgtc

SEQ ID NO: 135327 - DNA, 25 bp, Mus musculus
acttgaattttaacctttgtatgca

SEQ ID NO: 135328 - DNA, 25 bp, Mus musculus
acttgaattttatcctttgtatgca

SEQ ID NO: 135329 - DNA, 25 bp, Mus musculus
acttgacaagataccgagcttcgtt

SEQ ID NO: 135330 - DNA, 25 bp, Mus musculus
acttgacaagattccgagcttcgtt

SEQ ID NO: 135331 - DNA, 25 bp, Mus musculus
acttgacactgccattttagcacca

SEQ ID NO: 135332 - DNA, 25 bp, Mus musculus
acttgacactgcgattttagcacca

SEQ ID NO: 135333 - DNA, 25 bp, Mus musculus
acttgacactgtcctcatagctgct

SEQ ID NO: 135334 - DNA, 25 bp, Mus musculus
acttgacactgtgctcatagctgct

SEQ ID NO: 135335 - DNA, 25 bp, Mus musculus
acttgacagggccattgactcacaa

SEQ ID NO: 135336 - DNA, 25 bp, Mus musculus
acttgacagggcgattgactcacaa

SEQ ID NO: 135337 - DNA, 25 bp, Mus musculus
acttgacatattaagctgggcgtgg

SEQ ID NO: 135338 - DNA, 25 bp, Mus musculus
acttgacatatttagctgggcgtgg

SEQ ID NO: 135339 - DNA, 25 bp, Mus musculus
acttgaccaagtcatctgagaaaat

SEQ ID NO: 135340 - DNA, 25 bp, Mus musculus
acttgaccaagtgatctgagaaaat

SEQ ID NO: 135341 - DNA, 25 bp, Mus musculus
acttgaccaatcagctgttggcagg

SEQ ID NO: 135342 - DNA, 25 bp, Mus musculus
acttgaccaatctgctgttggcagg

SEQ ID NO: 135343 - DNA, 25 bp, Mus musculus
acttgaccagaactgcatccactgg

SEQ ID NO: 135344 - DNA, 25 bp, Mus musculus
acttgaccagaagtgcatccactgg

SEQ ID NO: 135345 - DNA, 25 bp, Mus musculus
acttgaccaggcagctcatgacact

SEQ ID NO: 135346 - DNA, 25 bp, Mus musculus
acttgaccaggctgctcatgacact

SEQ ID NO: 135347 - DNA, 25 bp, Mus musculus
acttgacccatgagaattctggacc

SEQ ID NO: 135348 - DNA, 25 bp, Mus musculus
acttgacccatgtgaattctggacc

SEQ ID NO: 135349 - DNA, 25 bp, Mus musculus
acttgaccctgaactgcatgtattg

SEQ ID NO: 135350 - DNA, 25 bp, Mus musculus
acttgaccctgacttggactcgtga

SEQ ID NO: 135351 - DNA, 25 bp, Mus musculus
acttgaccctgactttcttgaggtt

SEQ ID NO: 135352 - DNA, 25 bp, Mus musculus
acttgaccctgagttggactcgtga

SEQ ID NO: 135353 - DNA, 25 bp, Mus musculus
acttgaccctgagtttcttgaggtt

SEQ ID NO: 135354 - DNA, 25 bp, Mus musculus
acttgaccctgatctgcatgtattg

SEQ ID NO: 135355 - DNA, 25 bp, Mus musculus
acttgaccggtgagggctctgacca

SEQ ID NO: 135356 - DNA, 25 bp, Mus musculus
acttgaccggtgtgggctctgacca

SEQ ID NO: 135357 - DNA, 25 bp, Mus musculus
acttgaccttatctttaatggccta

SEQ ID NO: 135358 - DNA, 25 bp, Mus musculus
acttgaccttatgtttaatggccta

SEQ ID NO: 135359 - DNA, 25 bp, Mus musculus
acttgaccttccatagagctactga

SEQ ID NO: 135360 - DNA, 25 bp, Mus musculus
acttgaccttccttagagctactga

SEQ ID NO: 135361 - DNA, 25 bp, Mus musculus
acttgacctttacttggatgcctaa

SEQ ID NO: 135362 - DNA, 25 bp, Mus musculus
acttgacctttagttggatgcctaa

SEQ ID NO: 135363 - DNA, 25 bp, Mus musculus
acttgacgaacaacaggctgccatt

SEQ ID NO: 135364 - DNA, 25 bp, Mus musculus
acttgacgaacatcaggctgccatt

SEQ ID NO: 135365 - DNA, 25 bp, Mus musculus
acttgacgaggtctagaatccctta

SEQ ID NO: 135366 - DNA, 25 bp, Mus musculus
acttgacgaggtgtagaatccctta

SEQ ID NO: 135367 - DNA, 25 bp, Mus musculus
acttgacggcctaaaacctgctgtt

SEQ ID NO: 135368 - DNA, 25 bp, Mus musculus
acttgacggccttaaacctgctgtt

SEQ ID NO: 135369 - DNA, 25 bp, Mus musculus
acttgactacatcggatacataaac

SEQ ID NO: 135370 - DNA, 25 bp, Mus musculus
acttgactacatgggatacataaac

SEQ ID NO: 135371 - DNA, 25 bp, Mus musculus
acttgactctacatgcaggtggttt

SEQ ID NO: 135372 - DNA, 25 bp, Mus musculus
acttgactctacttgcaggtggttt

SEQ ID NO: 135373 - DNA, 25 bp, Mus musculus
acttgactggtcactatgggcacta

SEQ ID NO: 135374 - DNA, 25 bp, Mus musculus
acttgactggtcataaagctgctat

SEQ ID NO: 135375 - DNA, 25 bp, Mus musculus
acttgactggtctctatgggcacta

SEQ ID NO: 135376 - DNA, 25 bp, Mus musculus
acttgactggtcttaaagctgctat

SEQ ID NO: 135377 - DNA, 25 bp, Mus musculus
acttgactgtctagtggaccacgag

SEQ ID NO: 135378 - DNA, 25 bp, Mus musculus
acttgactgtcttgtggaccacgag

SEQ ID NO: 135379 - DNA, 25 bp, Mus musculus
acttgacttaaaattgaccctatgg

SEQ ID NO: 135380 - DNA, 25 bp, Mus musculus
acttgacttaaatttgaccctatgg

SEQ ID NO: 135381 - DNA, 25 bp, Mus musculus
acttgacttaagatttcttgccaga

SEQ ID NO: 135382 - DNA, 25 bp, Mus musculus
acttgacttaagttttcttgccaga

SEQ ID NO: 135383 - DNA, 25 bp, Mus musculus
acttgacttaggctctgtattcaga

SEQ ID NO: 135384 - DNA, 25 bp, Mus musculus
acttgacttagggtctgtattcaga

SEQ ID NO: 135385 - DNA, 25 bp, Mus musculus
acttgacttcaaaggcaattataaa

SEQ ID NO: 135386 - DNA, 25 bp, Mus musculus
acttgacttcaatggcaattataaa

SEQ ID NO: 135387 - DNA, 25 bp, Mus musculus
acttgacttgatacttttctaataa

SEQ ID NO: 135388 - DNA, 25 bp, Mus musculus
acttgacttgattcttttctaataa

SEQ ID NO: 135389 - DNA, 25 bp, Mus musculus
acttgacttgcgatgatctttttac

SEQ ID NO: 135390 - DNA, 25 bp, Mus musculus
acttgacttgcgttgatctttttac

SEQ ID NO: 135391 - DNA, 25 bp, Mus musculus
acttgactttgaaacatccctgttg

SEQ ID NO: 135392 - DNA, 25 bp, Mus musculus
acttgactttgaaccctgctaaggc

SEQ ID NO: 135393 - DNA, 25 bp, Mus musculus
acttgactttgatacatccctgttg

SEQ ID NO: 135394 - DNA, 25 bp, Mus musculus
acttgactttgatccctgctaaggc

SEQ ID NO: 135395 - DNA, 25 bp, Mus musculus
acttgagaaatgcttccctgtctga

SEQ ID NO: 135396 - DNA, 25 bp, Mus musculus
acttgagaaatggttccctgtctga

SEQ ID NO: 135397 - DNA, 25 bp, Mus musculus
acttgagaacttcactggttgcgac

SEQ ID NO: 135398 - DNA, 25 bp, Mus musculus
acttgagaacttgactggttgcgac

SEQ ID NO: 135399 - DNA, 25 bp, Mus musculus
acttgagaagctccatcgagtgaag

SEQ ID NO: 135400 - DNA, 25 bp, Mus musculus
acttgagaagctgcatcgagtgaag

SEQ ID NO: 135401 - DNA, 25 bp, Mus musculus
acttgagaattcaggtatccttggg

SEQ ID NO: 135402 - DNA, 25 bp, Mus musculus
acttgagaattctggtatccttggg

SEQ ID NO: 135403 - DNA, 25 bp, Mus musculus
acttgagacattagtgatgttggct

SEQ ID NO: 135404 - DNA, 25 bp, Mus musculus
acttgagacatttgtgatgttggct

SEQ ID NO: 135405 - DNA, 25 bp, Mus musculus
acttgagagccccatgtcagagcat

SEQ ID NO: 135406 - DNA, 25 bp, Mus musculus
acttgagagcccgatgtcagagcat

SEQ ID NO: 135407 - DNA, 25 bp, Mus musculus
acttgagagctgacaggtatgtgtc

SEQ ID NO: 135408 - DNA, 25 bp, Mus musculus
acttgagagctgtcaggtatgtgtc

SEQ ID NO: 135409 - DNA, 25 bp, Mus musculus
acttgagaggaacaggtgacgacac

SEQ ID NO: 135410 - DNA, 25 bp, Mus musculus
acttgagaggaagaggtgacgacac

SEQ ID NO: 135411 - DNA, 25 bp, Mus musculus
acttgagagtctatgatcccaggaa

SEQ ID NO: 135412 - DNA, 25 bp, Mus musculus
acttgagagtctttgatcccaggaa

SEQ ID NO: 135413 - DNA, 25 bp, Mus musculus
acttgagatatcacattctcagatt

SEQ ID NO: 135414 - DNA, 25 bp, Mus musculus
acttgagatatctcattctcagatt

SEQ ID NO: 135415 - DNA, 25 bp, Mus musculus
acttgagcaatgagcttgctggccc

SEQ ID NO: 135416 - DNA, 25 bp, Mus musculus
acttgagcaatgtgcttgctggccc

SEQ ID NO: 135417 - DNA, 25 bp, Mus musculus
acttgagccagcatgttgtttatca

SEQ ID NO: 135418 - DNA, 25 bp, Mus musculus
acttgagccagcttgttgtttatca

SEQ ID NO: 135419 - DNA, 25 bp, Mus musculus
acttgagcccaccagatctagatag

SEQ ID NO: 135420 - DNA, 25 bp, Mus musculus
acttgagcccacgagatctagatag

SEQ ID NO: 135421 - DNA, 25 bp, Mus musculus
acttgagctagcacaggattcctgg

SEQ ID NO: 135422 - DNA, 25 bp, Mus musculus
acttgagctagctcaggattcctgg

SEQ ID NO: 135423 - DNA, 25 bp, Mus musculus
acttgagcttagacatgccaggcaa

SEQ ID NO: 135424 - DNA, 25 bp, Mus musculus
acttgagcttagtcatgccaggcaa

SEQ ID NO: 135425 - DNA, 25 bp, Mus musculus
acttgagcttgcatcttctcctgtt

SEQ ID NO: 135426 - DNA, 25 bp, Mus musculus
acttgagcttgcttcttctcctgtt

SEQ ID NO: 135427 - DNA, 25 bp, Mus musculus
acttgaggactcagcaggaaattgc

SEQ ID NO: 135428 - DNA, 25 bp, Mus musculus
acttgaggactctgcaggaaattgc

SEQ ID NO: 135429 - DNA, 25 bp, Mus musculus
acttgaggacttagggctcttctga

SEQ ID NO: 135430 - DNA, 25 bp, Mus musculus
acttgaggactttgggctcttctga

SEQ ID NO: 135431 - DNA, 25 bp, Mus musculus
acttgaggcattataccagccattt

SEQ ID NO: 135432 - DNA, 25 bp, Mus musculus
acttgaggcattttaccagccattt

SEQ ID NO: 135433 - DNA, 25 bp, Mus musculus
acttgaggctgcatgacagggctca

SEQ ID NO: 135434 - DNA, 25 bp, Mus musculus
acttgaggctgcttgacagggctca

SEQ ID NO: 135435 - DNA, 25 bp, Mus musculus
acttgaggcttgctgtgttagcttt

SEQ ID NO: 135436 - DNA, 25 bp, Mus musculus
acttgaggcttggtgtgttagcttt

SEQ ID NO: 135437 - DNA, 25 bp, Mus musculus
acttgaggctttctactgggacaca

SEQ ID NO: 135438 - DNA, 25 bp, Mus musculus
acttgaggctttgtactgggacaca

SEQ ID NO: 135439 - DNA, 25 bp, Mus musculus
acttgaggtatgagtttcctgcgca

SEQ ID NO: 135440 - DNA, 25 bp, Mus musculus
acttgaggtatgtgtttcctgcgca

SEQ ID NO: 135441 - DNA, 25 bp, Mus musculus
acttgaggtcgaagttcttcacctt

SEQ ID NO: 135442 - DNA, 25 bp, Mus musculus
acttgaggtcgatgttcttcacctt

SEQ ID NO: 135443 - DNA, 25 bp, Mus musculus
acttgaggtggtacttagtacacac

SEQ ID NO: 135444 - DNA, 25 bp, Mus musculus
acttgaggtggttcttagtacacac

SEQ ID NO: 135445 - DNA, 25 bp, Mus musculus
acttgagtaataagtcaggttccat

SEQ ID NO: 135446 - DNA, 25 bp, Mus musculus
acttgagtaatatgtcaggttccat

SEQ ID NO: 135447 - DNA, 25 bp, Mus musculus
acttgagtacatcgacaggcctata

SEQ ID NO: 135448 - DNA, 25 bp, Mus musculus
acttgagtacatggacaggcctata

SEQ ID NO: 135449 - DNA, 25 bp, Mus musculus
acttgagtagttctatggtctgcca

SEQ ID NO: 135450 - DNA, 25 bp, Mus musculus
acttgagtagttgtatggtctgcca

SEQ ID NO: 135451 - DNA, 25 bp, Mus musculus
acttgagtcatactctggctagtca

SEQ ID NO: 135452 - DNA, 25 bp, Mus musculus
acttgagtcatagtctggctagtca

SEQ ID NO: 135453 - DNA, 25 bp, Mus musculus
acttgagtgccacgcgctgtgccag

SEQ ID NO: 135454 - DNA, 25 bp, Mus musculus
acttgagtgccaggcgctgtgccag

SEQ ID NO: 135455 - DNA, 25 bp, Mus musculus
acttgagtgcttctgccttctaaat

SEQ ID NO: 135456 - DNA, 25 bp, Mus musculus
acttgagtgcttgtgccttctaaat

SEQ ID NO: 135457 - DNA, 25 bp, Mus musculus
acttgagtggctacggccagggctt

SEQ ID NO: 135458 - DNA, 25 bp, Mus musculus
acttgagtggcttcggccagggctt

SEQ ID NO: 135459 - DNA, 25 bp, Mus musculus
acttgagttatcacttaggcttgga

SEQ ID NO: 135460 - DNA, 25 bp, Mus musculus
acttgagttatctcttaggcttgga

SEQ ID NO: 135461 - DNA, 25 bp, Mus musculus
acttgagttctgcacttggatgtca

SEQ ID NO: 135462 - DNA, 25 bp, Mus musculus
acttgagttctggacttggatgtca

SEQ ID NO: 135463 - DNA, 25 bp, Mus musculus
acttgagtttccactaagcttgctg

SEQ ID NO: 135464 - DNA, 25 bp, Mus musculus
acttgagtttcctctaagcttgctg

SEQ ID NO: 135465 - DNA, 25 bp, Mus musculus
acttgataaggactcaggtgcagca

SEQ ID NO: 135466 - DNA, 25 bp, Mus musculus
acttgataaggagtcaggtgcagca

SEQ ID NO: 135467 - DNA, 25 bp, Mus musculus
acttgatacaaaccacttcctggat

SEQ ID NO: 135468 - DNA, 25 bp, Mus musculus
acttgatacaaagcacttcctggat

SEQ ID NO: 135469 - DNA, 25 bp, Mus musculus
acttgatactatatgctcataattt

SEQ ID NO: 135470 - DNA, 25 bp, Mus musculus
acttgatactatttgctcataattt

SEQ ID NO: 135471 - DNA, 25 bp, Mus musculus
acttgatagcgaaggagctgacctc

SEQ ID NO: 135472 - DNA, 25 bp, Mus musculus
acttgatagcgatggagctgacctc

SEQ ID NO: 135473 - DNA, 25 bp, Mus musculus
acttgatcactccttggctcaaaat

SEQ ID NO: 135474 - DNA, 25 bp, Mus musculus
acttgatcactcgttggctcaaaat

SEQ ID NO: 135475 - DNA, 25 bp, Mus musculus
acttgatcagcacaggcctgacaga

SEQ ID NO: 135476 - DNA, 25 bp, Mus musculus
acttgatcagcagaggcctgacaga

SEQ ID NO: 135477 - DNA, 25 bp, Mus musculus
acttgatcatctacacacttgagaa

SEQ ID NO: 135478 - DNA, 25 bp, Mus musculus
acttgatcatcttcacacttgagaa

SEQ ID NO: 135479 - DNA, 25 bp, Mus musculus
acttgatcatgtcactcatgtccaa

SEQ ID NO: 135480 - DNA, 25 bp, Mus musculus
acttgatcatgtgactcatgtccaa

SEQ ID NO: 135481 - DNA, 25 bp, Mus musculus
acttgatccgcactgggaaacccat

SEQ ID NO: 135482 - DNA, 25 bp, Mus musculus
acttgatccgcagtgggaaacccat

SEQ ID NO: 135483 - DNA, 25 bp, Mus musculus
acttgatcctgacggagtctccact

SEQ ID NO: 135484 - DNA, 25 bp, Mus musculus
acttgatcctgagggagtctccact

SEQ ID NO: 135485 - DNA, 25 bp, Mus musculus
acttgatcggtgacagaacctggga

SEQ ID NO: 135486 - DNA, 25 bp, Mus musculus
acttgatcggtgtcagaacctggga

SEQ ID NO: 135487 - DNA, 25 bp, Mus musculus
acttgatgaagcatttctggcatga

SEQ ID NO: 135488 - DNA, 25 bp, Mus musculus
acttgatgaagccttcttccttcct

SEQ ID NO: 135489 - DNA, 25 bp, Mus musculus
acttgatgaagcgttcttccttcct

SEQ ID NO: 135490 - DNA, 25 bp, Mus musculus
acttgatgaagcttttctggcatga

SEQ ID NO: 135491 - DNA, 25 bp, Mus musculus
acttgatgcatgaagttcctctctg

SEQ ID NO: 135492 - DNA, 25 bp, Mus musculus
acttgatgcatgtagttcctctctg

SEQ ID NO: 135493 - DNA, 25 bp, Mus musculus
acttgatgccccagagaaggaggaa

SEQ ID NO: 135494 - DNA, 25 bp, Mus musculus
acttgatgcccctgagaaggaggaa

SEQ ID NO: 135495 - DNA, 25 bp, Mus musculus
acttgatgcgtaatctgtggccgct

SEQ ID NO: 135496 - DNA, 25 bp, Mus musculus
acttgatgcgtattctgtggccgct

SEQ ID NO: 135497 - DNA, 25 bp, Mus musculus
acttgatggctaacaaagacggaca

SEQ ID NO: 135498 - DNA, 25 bp, Mus musculus
acttgatggctatcaaagacggaca

SEQ ID NO: 135499 - DNA, 25 bp, Mus musculus
acttgatgtattatggttgttatca

SEQ ID NO: 135500 - DNA, 25 bp, Mus musculus
acttgatgtattttggttgttatca

SEQ ID NO: 135501 - DNA, 25 bp, Mus musculus
acttgatgtcctcgcctagaagagt

SEQ ID NO: 135502 - DNA, 25 bp, Mus musculus
acttgatgtcctggcctagaagagt

SEQ ID NO: 135503 - DNA, 25 bp, Mus musculus
acttgatgtctcagatctagtccag

SEQ ID NO: 135504 - DNA, 25 bp, Mus musculus
acttgatgtctctgatctagtccag

SEQ ID NO: 135505 - DNA, 25 bp, Mus musculus
acttgatgtgttcttgttgccttac

SEQ ID NO: 135506 - DNA, 25 bp, Mus musculus
acttgatgtgttgttgttgccttac

SEQ ID NO: 135507 - DNA, 25 bp, Mus musculus
acttgatgttttaccacctgtccac

SEQ ID NO: 135508 - DNA, 25 bp, Mus musculus
acttgatgtttttccacctgtccac

SEQ ID NO: 135509 - DNA, 25 bp, Mus musculus
acttgattatgcagtggcctggttc

SEQ ID NO: 135510 - DNA, 25 bp, Mus musculus
acttgattatgctgtggcctggttc

SEQ ID NO: 135511 - DNA, 25 bp, Mus musculus
acttgattccatctgcaaccctttg

SEQ ID NO: 135512 - DNA, 25 bp, Mus musculus
acttgattccatgtgcaaccctttg

SEQ ID NO: 135513 - DNA, 25 bp, Mus musculus
acttgattccctctttttctgttga

SEQ ID NO: 135514 - DNA, 25 bp, Mus musculus
acttgattccctgtttttctgttga

SEQ ID NO: 135515 - DNA, 25 bp, Mus musculus
acttgattcctgagtaccctttgga

SEQ ID NO: 135516 - DNA, 25 bp, Mus musculus
acttgattcctgtgtaccctttgga

SEQ ID NO: 135517 - DNA, 25 bp, Mus musculus
acttgattctatattgtggtggatg

SEQ ID NO: 135518 - DNA, 25 bp, Mus musculus
acttgattctattttgtggtggatg

SEQ ID NO: 135519 - DNA, 25 bp, Mus musculus
acttgattgtcaaagagtctgcatg

SEQ ID NO: 135520 - DNA, 25 bp, Mus musculus
acttgattgtcatagagtctgcatg

SEQ ID NO: 135521 - DNA, 25 bp, Mus musculus
acttgattgtgacgcatgttctgat

SEQ ID NO: 135522 - DNA, 25 bp, Mus musculus
acttgattgtgaggcatgttctgat

SEQ ID NO: 135523 - DNA, 25 bp, Mus musculus
acttgatttcacaatggctctaaaa

SEQ ID NO: 135524 - DNA, 25 bp, Mus musculus
acttgatttcactatggctctaaaa

SEQ ID NO: 135525 - DNA, 25 bp, Mus musculus
acttgatttcccctagctattaatt

SEQ ID NO: 135526 - DNA, 25 bp, Mus musculus
acttgatttcccgtagctattaatt

SEQ ID NO: 135527 - DNA, 25 bp, Mus musculus
acttgatttctgacaatcattgtat

SEQ ID NO: 135528 - DNA, 25 bp, Mus musculus
acttgatttctgacaggctctctaa

SEQ ID NO: 135529 - DNA, 25 bp, Mus musculus
acttgatttctgtcaatcattgtat

SEQ ID NO: 135530 - DNA, 25 bp, Mus musculus
acttgatttctgtcaggctctctaa

SEQ ID NO: 135531 - DNA, 25 bp, Mus musculus
acttgatttgttctgacttttgtca

SEQ ID NO: 135532 - DNA, 25 bp, Mus musculus
acttgatttgttgtgacttttgtca

SEQ ID NO: 135533 - DNA, 25 bp, Mus musculus
acttgcaacgtcagatgtgctgtta

SEQ ID NO: 135534 - DNA, 25 bp, Mus musculus
acttgcaacgtctgatgtgctgtta

SEQ ID NO: 135535 - DNA, 25 bp, Mus musculus
acttgcaagagtcagttttaaagac

SEQ ID NO: 135536 - DNA, 25 bp, Mus musculus
acttgcaagagtgagttttaaagac

SEQ ID NO: 135537 - DNA, 25 bp, Mus musculus
acttgcaagatgctaccagctggat

SEQ ID NO: 135538 - DNA, 25 bp, Mus musculus
acttgcaagatggtaccagctggat

SEQ ID NO: 135539 - DNA, 25 bp, Mus musculus
acttgcaaggccatcaacgtgctag

SEQ ID NO: 135540 - DNA, 25 bp, Mus musculus
acttgcaaggccttcaacgtgctag

SEQ ID NO: 135541 - DNA, 25 bp, Mus musculus
acttgcaatgctcttcatggagaat

SEQ ID NO: 135542 - DNA, 25 bp, Mus musculus
acttgcaatgctgttcatggagaat

SEQ ID NO: 135543 - DNA, 25 bp, Mus musculus
acttgcaatggtaactgagtccaca

SEQ ID NO: 135544 - DNA, 25 bp, Mus musculus
acttgcaatggttactgagtccaca

SEQ ID NO: 135545 - DNA, 25 bp, Mus musculus
acttgcacaaggacgacactatttt

SEQ ID NO: 135546 - DNA, 25 bp, Mus musculus
acttgcacaaggtcgacactatttt

SEQ ID NO: 135547 - DNA, 25 bp, Mus musculus
acttgcacataaagttgctttccag

SEQ ID NO: 135548 - DNA, 25 bp, Mus musculus
acttgcacataatgttgctttccag

SEQ ID NO: 135549 - DNA, 25 bp, Mus musculus
acttgcactgtgattttagctcaga

SEQ ID NO: 135550 - DNA, 25 bp, Mus musculus
acttgcactgtgtttttagctcaga

SEQ ID NO: 135551 - DNA, 25 bp, Mus musculus
acttgcactttactttctgtcaggg

SEQ ID NO: 135552 - DNA, 25 bp, Mus musculus
acttgcactttagtttctgtcaggg

SEQ ID NO: 135553 - DNA, 25 bp, Mus musculus
acttgcagccttatcccaattaatc

SEQ ID NO: 135554 - DNA, 25 bp, Mus musculus
acttgcagccttttcccaattaatc

SEQ ID NO: 135555 - DNA, 25 bp, Mus musculus
acttgcagctttaacaattgtaata

SEQ ID NO: 135556 - DNA, 25 bp, Mus musculus
acttgcagctttagcctgaggtcca

SEQ ID NO: 135557 - DNA, 25 bp, Mus musculus
acttgcagcttttacaattgtaata

SEQ ID NO: 135558 - DNA, 25 bp, Mus musculus
acttgcagcttttgcctgaggtcca

SEQ ID NO: 135559 - DNA, 25 bp, Mus musculus
acttgcaggaacatgacctggccct

SEQ ID NO: 135560 - DNA, 25 bp, Mus musculus
acttgcaggaacttgacctggccct

SEQ ID NO: 135561 - DNA, 25 bp, Mus musculus
acttgcaggagcaccgaggccgcta

SEQ ID NO: 135562 - DNA, 25 bp, Mus musculus
acttgcaggagcctgttttctgctt

SEQ ID NO: 135563 - DNA, 25 bp, Mus musculus
acttgcaggagcgtgttttctgctt

SEQ ID NO: 135564 - DNA, 25 bp, Mus musculus
acttgcaggagctccgaggccgcta

SEQ ID NO: 135565 - DNA, 25 bp, Mus musculus
acttgcaggcgaaatcttgtttaac

SEQ ID NO: 135566 - DNA, 25 bp, Mus musculus
acttgcaggcgatatcttgtttaac

SEQ ID NO: 135567 - DNA, 25 bp, Mus musculus
acttgcagtggcaggatgttctcac

SEQ ID NO: 135568 - DNA, 25 bp, Mus musculus
acttgcagtggctggatgttctcac

SEQ ID NO: 135569 - DNA, 25 bp, Mus musculus
acttgcagttggatctgtctttgta

SEQ ID NO: 135570 - DNA, 25 bp, Mus musculus
acttgcagttggttctgtctttgta

SEQ ID NO: 135571 - DNA, 25 bp, Mus musculus
acttgcatcaagagaagcccttgtg

SEQ ID NO: 135572 - DNA, 25 bp, Mus musculus
acttgcatcaagtgaagcccttgtg

SEQ ID NO: 135573 - DNA, 25 bp, Mus musculus
acttgcatccagaagacccttcatc

SEQ ID NO: 135574 - DNA, 25 bp, Mus musculus
acttgcatccagtagacccttcatc

SEQ ID NO: 135575 - DNA, 25 bp, Mus musculus
acttgcatgcttcaactgttggaaa

SEQ ID NO: 135576 - DNA, 25 bp, Mus musculus
acttgcatgcttgaactgttggaaa

SEQ ID NO: 135577 - DNA, 25 bp, Mus musculus
acttgcattagaccttacatacggg

SEQ ID NO: 135578 - DNA, 25 bp, Mus musculus
acttgcattagagcttacatacggg

SEQ ID NO: 135579 - DNA, 25 bp, Mus musculus
acttgcattgtgatctcaggctgaa

SEQ ID NO: 135580 - DNA, 25 bp, Mus musculus
acttgcattgtgttctcaggctgaa

SEQ ID NO: 135581 - DNA, 25 bp, Mus musculus
acttgcatttgcagatggtgatttc

SEQ ID NO: 135582 - DNA, 25 bp, Mus musculus
acttgcatttgctgatggtgatttc

SEQ ID NO: 135583 - DNA, 25 bp, Mus musculus
acttgccaagagaaaactacttctt

SEQ ID NO: 135584 - DNA, 25 bp, Mus musculus
acttgccaagagtaaactacttctt

SEQ ID NO: 135585 - DNA, 25 bp, Mus musculus
acttgccaagggacccggatgtctg

SEQ ID NO: 135586 - DNA, 25 bp, Mus musculus
acttgccaagggtcccggatgtctg

SEQ ID NO: 135587 - DNA, 25 bp, Mus musculus
acttgccaatttcctatcatgactc

SEQ ID NO: 135588 - DNA, 25 bp, Mus musculus
acttgccaatttgctatcatgactc

SEQ ID NO: 135589 - DNA, 25 bp, Mus musculus
acttgccacaaaagcccagtgactg

SEQ ID NO: 135590 - DNA, 25 bp, Mus musculus
acttgccacaaatgcccagtgactg

SEQ ID NO: 135591 - DNA, 25 bp, Mus musculus
acttgccacagccaggacctgaaga

SEQ ID NO: 135592 - DNA, 25 bp, Mus musculus
acttgccacagcgaggacctgaaga

SEQ ID NO: 135593 - DNA, 25 bp, Mus musculus
acttgccacgtgactgttaacatct

SEQ ID NO: 135594 - DNA, 25 bp, Mus musculus
acttgccacgtgtctgttaacatct

SEQ ID NO: 135595 - DNA, 25 bp, Mus musculus
acttgccaggcaatcacagtgacgc

SEQ ID NO: 135596 - DNA, 25 bp, Mus musculus
acttgccaggcaattgtgttatatt

SEQ ID NO: 135597 - DNA, 25 bp, Mus musculus
acttgccaggcattcacagtgacgc

SEQ ID NO: 135598 - DNA, 25 bp, Mus musculus
acttgccaggcatttgtgttatatt

SEQ ID NO: 135599 - DNA, 25 bp, Mus musculus
acttgccagggtcatttcttttcca

SEQ ID NO: 135600 - DNA, 25 bp, Mus musculus
acttgccagggtgatttcttttcca

SEQ ID NO: 135601 - DNA, 25 bp, Mus musculus
acttgccagttgacaagaatgagcc

SEQ ID NO: 135602 - DNA, 25 bp, Mus musculus
acttgccagttgtcaagaatgagcc

SEQ ID NO: 135603 - DNA, 25 bp, Mus musculus
acttgccatcatcctgtttcatcaa

SEQ ID NO: 135604 - DNA, 25 bp, Mus musculus
acttgccatcatgctgtttcatcaa

SEQ ID NO: 135605 - DNA, 25 bp, Mus musculus
acttgccatgccagtcagaacatta

SEQ ID NO: 135606 - DNA, 25 bp, Mus musculus
acttgccatgcctgtcagaacatta

SEQ ID NO: 135607 - DNA, 25 bp, Mus musculus
acttgccatgggaccgaatattttc

SEQ ID NO: 135608 - DNA, 25 bp, Mus musculus
acttgccatgggtccgaatattttc

SEQ ID NO: 135609 - DNA, 25 bp, Mus musculus
acttgccatgtgattcctgtagact

SEQ ID NO: 135610 - DNA, 25 bp, Mus musculus
acttgccatgtgtttcctgtagact

SEQ ID NO: 135611 - DNA, 25 bp, Mus musculus
acttgcccacccaagtgaagatgga

SEQ ID NO: 135612 - DNA, 25 bp, Mus musculus
acttgcccaccctagtgaagatgga

SEQ ID NO: 135613 - DNA, 25 bp, Mus musculus
acttgcccactcagtattttattca

SEQ ID NO: 135614 - DNA, 25 bp, Mus musculus
acttgcccactctgtattttattca

SEQ ID NO: 135615 - DNA, 25 bp, Mus musculus
acttgccccgcgcagtagggcttag

SEQ ID NO: 135616 - DNA, 25 bp, Mus musculus
acttgccccgcggagtagggcttag

SEQ ID NO: 135617 - DNA, 25 bp, Mus musculus
acttgccccgtgactgatattaatc

SEQ ID NO: 135618 - DNA, 25 bp, Mus musculus
acttgccccgtgtctgatattaatc

SEQ ID NO: 135619 - DNA, 25 bp, Mus musculus
acttgcccgacccagggagagttag

SEQ ID NO: 135620 - DNA, 25 bp, Mus musculus
acttgcccgaccgagggagagttag

SEQ ID NO: 135621 - DNA, 25 bp, Mus musculus
acttgcccgttcagtggattttatc

SEQ ID NO: 135622 - DNA, 25 bp, Mus musculus
acttgcccgttctgtggattttatc

SEQ ID NO: 135623 - DNA, 25 bp, Mus musculus
acttgccctaaaagaacacctttct

SEQ ID NO: 135624 - DNA, 25 bp, Mus musculus
acttgccctaaatgaacacctttct

SEQ ID NO: 135625 - DNA, 25 bp, Mus musculus
acttgcccttgacttatggaagagc

SEQ ID NO: 135626 - DNA, 25 bp, Mus musculus
acttgcccttgagttatggaagagc

SEQ ID NO: 135627 - DNA, 25 bp, Mus musculus
acttgccgaaatagtttgcgcattt

SEQ ID NO: 135628 - DNA, 25 bp, Mus musculus
acttgccgaaattgtttgcgcattt

SEQ ID NO: 135629 - DNA, 25 bp, Mus musculus
acttgccgagtcactggaacaagtt

SEQ ID NO: 135630 - DNA, 25 bp, Mus musculus
acttgccgagtctctggaacaagtt

SEQ ID NO: 135631 - DNA, 25 bp, Mus musculus
acttgccggcggatcagtgagacat

SEQ ID NO: 135632 - DNA, 25 bp, Mus musculus
acttgccggcggttcagtgagacat

SEQ ID NO: 135633 - DNA, 25 bp, Mus musculus
acttgccgtggacggaatctttcta

SEQ ID NO: 135634 - DNA, 25 bp, Mus musculus
acttgccgtggagggaatctttcta

SEQ ID NO: 135635 - DNA, 25 bp, Mus musculus
acttgcctaaagctggaacctggtt

SEQ ID NO: 135636 - DNA, 25 bp, Mus musculus
acttgcctaaaggtggaacctggtt

SEQ ID NO: 135637 - DNA, 25 bp, Mus musculus
acttgcctagcaagggcctcgctgt

SEQ ID NO: 135638 - DNA, 25 bp, Mus musculus
acttgcctagcatgggcctcgctgt

SEQ ID NO: 135639 - DNA, 25 bp, Mus musculus
acttgcctcagcagtgggacctgga

SEQ ID NO: 135640 - DNA, 25 bp, Mus musculus
acttgcctcagctgtgggacctgga

SEQ ID NO: 135641 - DNA, 25 bp, Mus musculus
acttgcctcataaattgggttctag

SEQ ID NO: 135642 - DNA, 25 bp, Mus musculus
acttgcctcatatattgggttctag

SEQ ID NO: 135643 - DNA, 25 bp, Mus musculus
acttgcctgctactgtcctgggtta

SEQ ID NO: 135644 - DNA, 25 bp, Mus musculus
acttgcctgctagtgtcctgggtta

SEQ ID NO: 135645 - DNA, 25 bp, Mus musculus
acttgcctgggaccctgaaagcggc

SEQ ID NO: 135646 - DNA, 25 bp, Mus musculus
acttgcctgggagcctgaaagcggc

SEQ ID NO: 135647 - DNA, 25 bp, Mus musculus
acttgccttagcagtggtgctcccc

SEQ ID NO: 135648 - DNA, 25 bp, Mus musculus
acttgccttagctgtggtgctcccc

SEQ ID NO: 135649 - DNA, 25 bp, Mus musculus
acttgccttattctgattttatcct

SEQ ID NO: 135650 - DNA, 25 bp, Mus musculus
acttgccttattgtgattttatcct

SEQ ID NO: 135651 - DNA, 25 bp, Mus musculus
acttgccttccactggtcagtttat

SEQ ID NO: 135652 - DNA, 25 bp, Mus musculus
acttgccttccagtggtcagtttat

SEQ ID NO: 135653 - DNA, 25 bp, Mus musculus
acttgccttgccagtcagttaggat

SEQ ID NO: 135654 - DNA, 25 bp, Mus musculus
acttgccttgcctgtcagttaggat

SEQ ID NO: 135655 - DNA, 25 bp, Mus musculus
acttgccttgctctcccttggtggc

SEQ ID NO: 135656 - DNA, 25 bp, Mus musculus
acttgccttgctgtcccttggtggc

SEQ ID NO: 135657 - DNA, 25 bp, Mus musculus
acttgccttggacctggtgcattac

SEQ ID NO: 135658 - DNA, 25 bp, Mus musculus
acttgccttggagctggtgcattac

SEQ ID NO: 135659 - DNA, 25 bp, Mus musculus
acttgcctttgcaccagttagagac

SEQ ID NO: 135660 - DNA, 25 bp, Mus musculus
acttgcctttgctccagttagagac

SEQ ID NO: 135661 - DNA, 25 bp, Mus musculus
acttgcgagactacctgttggtcta

SEQ ID NO: 135662 - DNA, 25 bp, Mus musculus
acttgcgagacttcctgttggtcta

SEQ ID NO: 135663 - DNA, 25 bp, Mus musculus
acttgcgcatcgcaaggcccaaagg

SEQ ID NO: 135664 - DNA, 25 bp, Mus musculus
acttgcgcatcggaaggcccaaagg

SEQ ID NO: 135665 - DNA, 25 bp, Mus musculus
acttgcgccccgatgcggtggcttc

SEQ ID NO: 135666 - DNA, 25 bp, Mus musculus
acttgcgccccgttgcggtggcttc

SEQ ID NO: 135667 - DNA, 25 bp, Mus musculus
acttgcggttgtacagcttttggaa

SEQ ID NO: 135668 - DNA, 25 bp, Mus musculus
acttgcggttgttcagcttttggaa

SEQ ID NO: 135669 - DNA, 25 bp, Mus musculus
acttgcgttgatctttttacatatt

SEQ ID NO: 135670 - DNA, 25 bp, Mus musculus
acttgcgttgatgtttttacatatt

SEQ ID NO: 135671 - DNA, 25 bp, Mus musculus
acttgctaagttctgggcttggaca

SEQ ID NO: 135672 - DNA, 25 bp, Mus musculus
acttgctaagttgtgggcttggaca

SEQ ID NO: 135673 - DNA, 25 bp, Mus musculus
acttgctaatgaagccgagtcccca

SEQ ID NO: 135674 - DNA, 25 bp, Mus musculus
acttgctaatgatgccgagtcccca

SEQ ID NO: 135675 - DNA, 25 bp, Mus musculus
acttgctaccaaccctgaagattga

SEQ ID NO: 135676 - DNA, 25 bp, Mus musculus
acttgctaccaagcctgaagattga

SEQ ID NO: 135677 - DNA, 25 bp, Mus musculus
acttgctagagtaggttttctgctt

SEQ ID NO: 135678 - DNA, 25 bp, Mus musculus
acttgctagagttggttttctgctt

SEQ ID NO: 135679 - DNA, 25 bp, Mus musculus
acttgctagcgcactgaagcccaga

SEQ ID NO: 135680 - DNA, 25 bp, Mus musculus
acttgctagcgctctgaagcccaga

SEQ ID NO: 135681 - DNA, 25 bp, Mus musculus
acttgctatataatgtgaccctgtg

SEQ ID NO: 135682 - DNA, 25 bp, Mus musculus
acttgctatatattgtgaccctgtg

SEQ ID NO: 135683 - DNA, 25 bp, Mus musculus
acttgctatatcagtcctcagtagg

SEQ ID NO: 135684 - DNA, 25 bp, Mus musculus
acttgctatatctgtcctcagtagg

SEQ ID NO: 135685 - DNA, 25 bp, Mus musculus
acttgctatcccagtcattcaaaag

SEQ ID NO: 135686 - DNA, 25 bp, Mus musculus
acttgctatccctgtcattcaaaag

SEQ ID NO: 135687 - DNA, 25 bp, Mus musculus
acttgctatgcaatcaggctctgag

SEQ ID NO: 135688 - DNA, 25 bp, Mus musculus
acttgctatgcattcaggctctgag

SEQ ID NO: 135689 - DNA, 25 bp, Mus musculus
acttgctatgttccgttttgtggta

SEQ ID NO: 135690 - DNA, 25 bp, Mus musculus
acttgctatgttgcgttttgtggta

SEQ ID NO: 135691 - DNA, 25 bp, Mus musculus
acttgctcacagataaataaatgta

SEQ ID NO: 135692 - DNA, 25 bp, Mus musculus
acttgctcacagttaaataaatgta

SEQ ID NO: 135693 - DNA, 25 bp, Mus musculus
acttgctcactcaaatcgccaaaag

SEQ ID NO: 135694 - DNA, 25 bp, Mus musculus
acttgctcactctaatcgccaaaag

SEQ ID NO: 135695 - DNA, 25 bp, Mus musculus
acttgctcagacatactgttggtac

SEQ ID NO: 135696 - DNA, 25 bp, Mus musculus
acttgctcagacttactgttggtac

SEQ ID NO: 135697 - DNA, 25 bp, Mus musculus
acttgctcagcaatactaccttgtt

SEQ ID NO: 135698 - DNA, 25 bp, Mus musculus
acttgctcagcattactaccttgtt

SEQ ID NO: 135699 - DNA, 25 bp, Mus musculus
acttgctcagctaacgtaggtcttg

SEQ ID NO: 135700 - DNA, 25 bp, Mus musculus
acttgctcagcttacgtaggtcttg

SEQ ID NO: 135701 - DNA, 25 bp, Mus musculus
acttgctcaggtatagtagctattt

SEQ ID NO: 135702 - DNA, 25 bp, Mus musculus
acttgctcaggtttagtagctattt

SEQ ID NO: 135703 - DNA, 25 bp, Mus musculus
acttgctcatgcacgacaaatccca

SEQ ID NO: 135704 - DNA, 25 bp, Mus musculus
acttgctcatgctcgacaaatccca

SEQ ID NO: 135705 - DNA, 25 bp, Mus musculus
acttgctccacaatttttgaagaat

SEQ ID NO: 135706 - DNA, 25 bp, Mus musculus
acttgctccacattttttgaagaat

SEQ ID NO: 135707 - DNA, 25 bp, Mus musculus
acttgctcctgcaggataccccaca

SEQ ID NO: 135708 - DNA, 25 bp, Mus musculus
acttgctcctgctggataccccaca

SEQ ID NO: 135709 - DNA, 25 bp, Mus musculus
acttgctctcacagagtatgccaga

SEQ ID NO: 135710 - DNA, 25 bp, Mus musculus
acttgctctcactgagtatgccaga

SEQ ID NO: 135711 - DNA, 25 bp, Mus musculus
acttgctctgatatttgtcttgtta

SEQ ID NO: 135712 - DNA, 25 bp, Mus musculus
acttgctctgatttttgtcttgtta

SEQ ID NO: 135713 - DNA, 25 bp, Mus musculus
acttgctctgcaatttatgtgccac

SEQ ID NO: 135714 - DNA, 25 bp, Mus musculus
acttgctctgcacattattacttga

SEQ ID NO: 135715 - DNA, 25 bp, Mus musculus
acttgctctgcagattattacttga

SEQ ID NO: 135716 - DNA, 25 bp, Mus musculus
acttgctctgcattttatgtgccac

SEQ ID NO: 135717 - DNA, 25 bp, Mus musculus
acttgctctggtctccattcaaatc

SEQ ID NO: 135718 - DNA, 25 bp, Mus musculus
acttgctctggtgtccattcaaatc

SEQ ID NO: 135719 - DNA, 25 bp, Mus musculus
acttgctctgtgagatgttgtagac

SEQ ID NO: 135720 - DNA, 25 bp, Mus musculus
acttgctctgtgtgatgttgtagac

SEQ ID NO: 135721 - DNA, 25 bp, Mus musculus
acttgctcttgtactcatgtccaaa

SEQ ID NO: 135722 - DNA, 25 bp, Mus musculus
acttgctcttgttctcatgtccaaa

SEQ ID NO: 135723 - DNA, 25 bp, Mus musculus
acttgctgacttccttcttattgga

SEQ ID NO: 135724 - DNA, 25 bp, Mus musculus
acttgctgacttgcttcttattgga

SEQ ID NO: 135725 - DNA, 25 bp, Mus musculus
acttgctgagcaaagcaactcctat

SEQ ID NO: 135726 - DNA, 25 bp, Mus musculus
acttgctgagcatagcaactcctat

SEQ ID NO: 135727 - DNA, 25 bp, Mus musculus
acttgctgagtactcatggctcacc

SEQ ID NO: 135728 - DNA, 25 bp, Mus musculus
acttgctgagtagtcatggctcacc

SEQ ID NO: 135729 - DNA, 25 bp, Mus musculus
acttgctgagtcagtcacctggatt

SEQ ID NO: 135730 - DNA, 25 bp, Mus musculus
acttgctgagtctgtcacctggatt

SEQ ID NO: 135731 - DNA, 25 bp, Mus musculus
acttgctgcattaacgggctattca

SEQ ID NO: 135732 - DNA, 25 bp, Mus musculus
acttgctgcatttacgggctattca

SEQ ID NO: 135733 - DNA, 25 bp, Mus musculus
acttgctgccgtacaacttgctgtg

SEQ ID NO: 135734 - DNA, 25 bp, Mus musculus
acttgctgccgttcaacttgctgtg

SEQ ID NO: 135735 - DNA, 25 bp, Mus musculus
acttgctgctccaatagaggctctg

SEQ ID NO: 135736 - DNA, 25 bp, Mus musculus
acttgctgctcctatagaggctctg

SEQ ID NO: 135737 - DNA, 25 bp, Mus musculus
acttgctgctctcgcagaggccaga

SEQ ID NO: 135738 - DNA, 25 bp, Mus musculus
acttgctgctctggcagaggccaga

SEQ ID NO: 135739 - DNA, 25 bp, Mus musculus
acttgctgctgcatgacccttctga

SEQ ID NO: 135740 - DNA, 25 bp, Mus musculus
acttgctgctgcttgacccttctga

SEQ ID NO: 135741 - DNA, 25 bp, Mus musculus
acttgctgcttgagcaaagggcctg

SEQ ID NO: 135742 - DNA, 25 bp, Mus musculus
acttgctgcttgtgcaaagggcctg

SEQ ID NO: 135743 - DNA, 25 bp, Mus musculus
acttgctggaataagctctctccta

SEQ ID NO: 135744 - DNA, 25 bp, Mus musculus
acttgctggaattagctctctccta

SEQ ID NO: 135745 - DNA, 25 bp, Mus musculus
acttgctggagcacattgctgatct

SEQ ID NO: 135746 - DNA, 25 bp, Mus musculus
acttgctggagctcattgctgatct

SEQ ID NO: 135747 - DNA, 25 bp, Mus musculus
acttgctggagtccctcgaggaaga

SEQ ID NO: 135748 - DNA, 25 bp, Mus musculus
acttgctggagtccgtgatcccctt

SEQ ID NO: 135749 - DNA, 25 bp, Mus musculus
acttgctggagtgcctcgaggaaga

SEQ ID NO: 135750 - DNA, 25 bp, Mus musculus
acttgctggagtgcgtgatcccctt

SEQ ID NO: 135751 - DNA, 25 bp, Mus musculus
acttgctggtctagctgtgcataga

SEQ ID NO: 135752 - DNA, 25 bp, Mus musculus
acttgctggtcttgctgtgcataga

SEQ ID NO: 135753 - DNA, 25 bp, Mus musculus
acttgctggtgactcgggcatctac

SEQ ID NO: 135754 - DNA, 25 bp, Mus musculus
acttgctggtgagtcgggcatctac

SEQ ID NO: 135755 - DNA, 25 bp, Mus musculus
acttgctgtagaaggcttattttgc

SEQ ID NO: 135756 - DNA, 25 bp, Mus musculus
acttgctgtagatggcttattttgc

SEQ ID NO: 135757 - DNA, 25 bp, Mus musculus
acttgctgtagccagtggtccagga

SEQ ID NO: 135758 - DNA, 25 bp, Mus musculus
acttgctgtagcgagtggtccagga

SEQ ID NO: 135759 - DNA, 25 bp, Mus musculus
acttgctgtcttaatgctttgaaac

SEQ ID NO: 135760 - DNA, 25 bp, Mus musculus
acttgctgtctttatgctttgaaac

SEQ ID NO: 135761 - DNA, 25 bp, Mus musculus
acttgctgtggcatcagtggtgtta

SEQ ID NO: 135762 - DNA, 25 bp, Mus musculus
acttgctgtggccagaagccatcag

SEQ ID NO: 135763 - DNA, 25 bp, Mus musculus
acttgctgtggcgagaagccatcag

SEQ ID NO: 135764 - DNA, 25 bp, Mus musculus
acttgctgtggcttcagtggtgtta

SEQ ID NO: 135765 - DNA, 25 bp, Mus musculus
acttgctgttatcctcctgtgagct

SEQ ID NO: 135766 - DNA, 25 bp, Mus musculus
acttgctgttatgctcctgtgagct

SEQ ID NO: 135767 - DNA, 25 bp, Mus musculus
acttgctgttctagccgagggtcac

SEQ ID NO: 135768 - DNA, 25 bp, Mus musculus
acttgctgttctcaccaaaggacct

SEQ ID NO: 135769 - DNA, 25 bp, Mus musculus
acttgctgttctgaccaaaggacct

SEQ ID NO: 135770 - DNA, 25 bp, Mus musculus
acttgctgttcttgccgagggtcac

SEQ ID NO: 135771 - DNA, 25 bp, Mus musculus
acttgcttaaagagactttcctgga

SEQ ID NO: 135772 - DNA, 25 bp, Mus musculus
acttgcttaaagtgactttcctgga

SEQ ID NO: 135773 - DNA, 25 bp, Mus musculus
acttgcttaaataggagatgtctat

SEQ ID NO: 135774 - DNA, 25 bp, Mus musculus
acttgcttaaattggagatgtctat

SEQ ID NO: 135775 - DNA, 25 bp, Mus musculus
acttgcttcaaaatagggaggctca

SEQ ID NO: 135776 - DNA, 25 bp, Mus musculus
acttgcttcaaattagggaggctca

SEQ ID NO: 135777 - DNA, 25 bp, Mus musculus
acttgcttcagtctgttcgtactta

SEQ ID NO: 135778 - DNA, 25 bp, Mus musculus
acttgcttcagtgtgttcgtactta

SEQ ID NO: 135779 - DNA, 25 bp, Mus musculus
acttgcttcctactgagggctcctg

SEQ ID NO: 135780 - DNA, 25 bp, Mus musculus
acttgcttcctactgctgcgataaa

SEQ ID NO: 135781 - DNA, 25 bp, Mus musculus
acttgcttcctagtgagggctcctg

SEQ ID NO: 135782 - DNA, 25 bp, Mus musculus
acttgcttcctagtgctgcgataaa

SEQ ID NO: 135783 - DNA, 25 bp, Mus musculus
acttgcttctgaatgcaggtgtcct

SEQ ID NO: 135784 - DNA, 25 bp, Mus musculus
acttgcttctgattgcaggtgtcct

SEQ ID NO: 135785 - DNA, 25 bp, Mus musculus
acttgcttcttgacataggtcatta

SEQ ID NO: 135786 - DNA, 25 bp, Mus musculus
acttgcttcttgtcataggtcatta

SEQ ID NO: 135787 - DNA, 25 bp, Mus musculus
acttgcttgcctcttgccctaaggg

SEQ ID NO: 135788 - DNA, 25 bp, Mus musculus
acttgcttgcctgttgccctaaggg

SEQ ID NO: 135789 - DNA, 25 bp, Mus musculus
acttgcttgctcagttctcagctga

SEQ ID NO: 135790 - DNA, 25 bp, Mus musculus
acttgcttgctctgttctcagctga

SEQ ID NO: 135791 - DNA, 25 bp, Mus musculus
acttgcttggaaccaccatgccttc

SEQ ID NO: 135792 - DNA, 25 bp, Mus musculus
acttgcttggaagcaccatgccttc

SEQ ID NO: 135793 - DNA, 25 bp, Mus musculus
acttgcttgggcacagaacgatgtc

SEQ ID NO: 135794 - DNA, 25 bp, Mus musculus
acttgcttgggctcagaacgatgtc

SEQ ID NO: 135795 - DNA, 25 bp, Mus musculus
acttgcttggtgaggcactgtgcta

SEQ ID NO: 135796 - DNA, 25 bp, Mus musculus
acttgcttggtgtggcactgtgcta

SEQ ID NO: 135797 - DNA, 25 bp, Mus musculus
acttgctttgtaacgtgtggtggta

SEQ ID NO: 135798 - DNA, 25 bp, Mus musculus
acttgctttgtatcgtgtggtggta

SEQ ID NO: 135799 - DNA, 25 bp, Mus musculus
acttggaactccaagatagcccagg

SEQ ID NO: 135800 - DNA, 25 bp, Mus musculus
acttggaactcctagatagcccagg

SEQ ID NO: 135801 - DNA, 25 bp, Mus musculus
acttggaactgtccttgcagcttcc

SEQ ID NO: 135802 - DNA, 25 bp, Mus musculus
acttggaactgtgcttgcagcttcc

SEQ ID NO: 135803 - DNA, 25 bp, Mus musculus
acttggaatattatgctggttcatt

SEQ ID NO: 135804 - DNA, 25 bp, Mus musculus
acttggaatattttgctggttcatt

SEQ ID NO: 135805 - DNA, 25 bp, Mus musculus
acttggaatctcatgcactgtcgct

SEQ ID NO: 135806 - DNA, 25 bp, Mus musculus
acttggaatctcttgcactgtcgct

SEQ ID NO: 135807 - DNA, 25 bp, Mus musculus
acttggaatgaaaggcgctctctgt

SEQ ID NO: 135808 - DNA, 25 bp, Mus musculus
acttggaatgaatggcgctctctgt

SEQ ID NO: 135809 - DNA, 25 bp, Mus musculus
acttggacagttatgggcctggtca

SEQ ID NO: 135810 - DNA, 25 bp, Mus musculus
acttggacagttttgggcctggtca

SEQ ID NO: 135811 - DNA, 25 bp, Mus musculus
acttggacatccctgcatcatggac

SEQ ID NO: 135812 - DNA, 25 bp, Mus musculus
acttggacatccgtgcatcatggac

SEQ ID NO: 135813 - DNA, 25 bp, Mus musculus
acttggacattgcattccattgctt

SEQ ID NO: 135814 - DNA, 25 bp, Mus musculus
acttggacattggattccattgctt

SEQ ID NO: 135815 - DNA, 25 bp, Mus musculus
acttggacccagacatggtggaacc

SEQ ID NO: 135816 - DNA, 25 bp, Mus musculus
acttggacccagtcatggtggaacc

SEQ ID NO: 135817 - DNA, 25 bp, Mus musculus
acttggacccttacagtcagtattc

SEQ ID NO: 135818 - DNA, 25 bp, Mus musculus
acttggaccctttcagtcagtattc

SEQ ID NO: 135819 - DNA, 25 bp, Mus musculus
acttggacgagtaggtcaggaccct

SEQ ID NO: 135820 - DNA, 25 bp, Mus musculus
acttggacgagttggtcaggaccct

SEQ ID NO: 135821 - DNA, 25 bp, Mus musculus
acttggacggcacccgcgagacctt

SEQ ID NO: 135822 - DNA, 25 bp, Mus musculus
acttggacggcagccgcgagacctt

SEQ ID NO: 135823 - DNA, 25 bp, Mus musculus
acttggacgtggaggtgactgcttt

SEQ ID NO: 135824 - DNA, 25 bp, Mus musculus
acttggacgtggtggtgactgcttt

SEQ ID NO: 135825 - DNA, 25 bp, Mus musculus
acttggagcactccggtgacactgc

SEQ ID NO: 135826 - DNA, 25 bp, Mus musculus
acttggagcactgcggtgacactgc

SEQ ID NO: 135827 - DNA, 25 bp, Mus musculus
acttggagcctgatcactgtgttta

SEQ ID NO: 135828 - DNA, 25 bp, Mus musculus
acttggagcctgttcactgtgttta

SEQ ID NO: 135829 - DNA, 25 bp, Mus musculus
acttggagctagaaagtgttgggat

SEQ ID NO: 135830 - DNA, 25 bp, Mus musculus
acttggagctagtaagtgttgggat

SEQ ID NO: 135831 - DNA, 25 bp, Mus musculus
acttggagctgtcgcttctttagac

SEQ ID NO: 135832 - DNA, 25 bp, Mus musculus
acttggagctgtggcttctttagac

SEQ ID NO: 135833 - DNA, 25 bp, Mus musculus
acttggaggctgacacggaaatgta

SEQ ID NO: 135834 - DNA, 25 bp, Mus musculus
acttggaggctgaccctatgcaaaa

SEQ ID NO: 135835 - DNA, 25 bp, Mus musculus
acttggaggctgtcacggaaatgta

SEQ ID NO: 135836 - DNA, 25 bp, Mus musculus
acttggaggctgtccctatgcaaaa

SEQ ID NO: 135837 - DNA, 25 bp, Mus musculus
acttggagggctcctcaaagctggt

SEQ ID NO: 135838 - DNA, 25 bp, Mus musculus
acttggagggctgctcaaagctggt

SEQ ID NO: 135839 - DNA, 25 bp, Mus musculus
acttggaggtctatgggccacaggc

SEQ ID NO: 135840 - DNA, 25 bp, Mus musculus
acttggaggtctttgggccacaggc

SEQ ID NO: 135841 - DNA, 25 bp, Mus musculus
acttggaggttgactatttaaccag

SEQ ID NO: 135842 - DNA, 25 bp, Mus musculus
acttggaggttgtctatttaaccag

SEQ ID NO: 135843 - DNA, 25 bp, Mus musculus
acttggaggtttctcttagtctgca

SEQ ID NO: 135844 - DNA, 25 bp, Mus musculus
acttggaggtttgtcttagtctgca

SEQ ID NO: 135845 - DNA, 25 bp, Mus musculus
acttggagtacgctcctgtttgggt

SEQ ID NO: 135846 - DNA, 25 bp, Mus musculus
acttggagtacggtcctgtttgggt

SEQ ID NO: 135847 - DNA, 25 bp, Mus musculus
acttggagttggagacttttgctgg

SEQ ID NO: 135848 - DNA, 25 bp, Mus musculus
acttggagttggtgacttttgctgg

SEQ ID NO: 135849 - DNA, 25 bp, Mus musculus
acttggatacgtaagctcagcactt

SEQ ID NO: 135850 - DNA, 25 bp, Mus musculus
acttggatacgttagctcagcactt

SEQ ID NO: 135851 - DNA, 25 bp, Mus musculus
acttggatactaattgcatgctgtt

SEQ ID NO: 135852 - DNA, 25 bp, Mus musculus
acttggatactatttgcatgctgtt

SEQ ID NO: 135853 - DNA, 25 bp, Mus musculus
acttggatcctgaaatctacccaga

SEQ ID NO: 135854 - DNA, 25 bp, Mus musculus
acttggatcctgtaatctacccaga

SEQ ID NO: 135855 - DNA, 25 bp, Mus musculus
acttggatctttctgggtgtcatta

SEQ ID NO: 135856 - DNA, 25 bp, Mus musculus
acttggatctttgtgggtgtcatta

SEQ ID NO: 135857 - DNA, 25 bp, Mus musculus
acttggatgactatcacgtggaatc

SEQ ID NO: 135858 - DNA, 25 bp, Mus musculus
acttggatgactttcacgtggaatc

SEQ ID NO: 135859 - DNA, 25 bp, Mus musculus
acttggatgcttagaatgacttcat

SEQ ID NO: 135860 - DNA, 25 bp, Mus musculus
acttggatgctttgaatgacttcat

SEQ ID NO: 135861 - DNA, 25 bp, Mus musculus
acttggatggttactgtccctggac

SEQ ID NO: 135862 - DNA, 25 bp, Mus musculus
acttggatggtttctgtccctggac

SEQ ID NO: 135863 - DNA, 25 bp, Mus musculus
acttggattgtgcttcgggagccca

SEQ ID NO: 135864 - DNA, 25 bp, Mus musculus
acttggattgtggttcgggagccca

SEQ ID NO: 135865 - DNA, 25 bp, Mus musculus
acttggatttccagtttgtttacag

SEQ ID NO: 135866 - DNA, 25 bp, Mus musculus
acttggatttcctgtttgtttacag

SEQ ID NO: 135867 - DNA, 25 bp, Mus musculus
acttggatttggagtctgtcaggca

SEQ ID NO: 135868 - DNA, 25 bp, Mus musculus
acttggatttggtgtctgtcaggca

SEQ ID NO: 135869 - DNA, 25 bp, Mus musculus
acttggcaaattatactctagctta

SEQ ID NO: 135870 - DNA, 25 bp, Mus musculus
acttggcaaattttactctagctta

SEQ ID NO: 135871 - DNA, 25 bp, Mus musculus
acttggcaactaagagatcctgtat

SEQ ID NO: 135872 - DNA, 25 bp, Mus musculus
acttggcaactatgagatcctgtat

SEQ ID NO: 135873 - DNA, 25 bp, Mus musculus
acttggcaactcatttcgtgtttca

SEQ ID NO: 135874 - DNA, 25 bp, Mus musculus
acttggcaactcttttcgtgtttca

SEQ ID NO: 135875 - DNA, 25 bp, Mus musculus
acttggcaagcccaatggacagcac

SEQ ID NO: 135876 - DNA, 25 bp, Mus musculus
acttggcaagccgaatggacagcac

SEQ ID NO: 135877 - DNA, 25 bp, Mus musculus
acttggcaagtgatctatcctagac

SEQ ID NO: 135878 - DNA, 25 bp, Mus musculus
acttggcaagtgttctatcctagac

SEQ ID NO: 135879 - DNA, 25 bp, Mus musculus
acttggcacctgctagttctaatgc

SEQ ID NO: 135880 - DNA, 25 bp, Mus musculus
acttggcacctggtagttctaatgc

SEQ ID NO: 135881 - DNA, 25 bp, Mus musculus
acttggcatccaatccctttttata

SEQ ID NO: 135882 - DNA, 25 bp, Mus musculus
acttggcatccattccctttttata

SEQ ID NO: 135883 - DNA, 25 bp, Mus musculus
acttggcatctgaattgatagttca

SEQ ID NO: 135884 - DNA, 25 bp, Mus musculus
acttggcatctgtattgatagttca

SEQ ID NO: 135885 - DNA, 25 bp, Mus musculus
acttggcatgatacttgctttgtgt

SEQ ID NO: 135886 - DNA, 25 bp, Mus musculus
acttggcatgattcttgctttgtgt

SEQ ID NO: 135887 - DNA, 25 bp, Mus musculus
acttggcatgtcccgagcacacagt

SEQ ID NO: 135888 - DNA, 25 bp, Mus musculus
acttggcatgtcgcgagcacacagt

SEQ ID NO: 135889 - DNA, 25 bp, Mus musculus
acttggcattgtagtcacacttaca

SEQ ID NO: 135890 - DNA, 25 bp, Mus musculus
acttggcattgttgtcacacttaca

SEQ ID NO: 135891 - DNA, 25 bp, Mus musculus
acttggccaaagcaaatgacttctg

SEQ ID NO: 135892 - DNA, 25 bp, Mus musculus
acttggccaaaggaaatgacttctg

SEQ ID NO: 135893 - DNA, 25 bp, Mus musculus
acttggccagtgctgatgtgctgca

SEQ ID NO: 135894 - DNA, 25 bp, Mus musculus
acttggccagtggtgatgtgctgca

SEQ ID NO: 135895 - DNA, 25 bp, Mus musculus
acttggcccattaacagattgtctt

SEQ ID NO: 135896 - DNA, 25 bp, Mus musculus
acttggcccatttacagattgtctt

SEQ ID NO: 135897 - DNA, 25 bp, Mus musculus
acttggcccttcagttaggagtgat

SEQ ID NO: 135898 - DNA, 25 bp, Mus musculus
acttggcccttctgttaggagtgat

SEQ ID NO: 135899 - DNA, 25 bp, Mus musculus
acttggccgcaaacatctttacctg

SEQ ID NO: 135900 - DNA, 25 bp, Mus musculus
acttggccgcaatcatctttacctg

SEQ ID NO: 135901 - DNA, 25 bp, Mus musculus
acttggccgttgagtgtctgagcag

SEQ ID NO: 135902 - DNA, 25 bp, Mus musculus
acttggccgttgtgtgtctgagcag

SEQ ID NO: 135903 - DNA, 25 bp, Mus musculus
acttggcctctcattacgtgagata

SEQ ID NO: 135904 - DNA, 25 bp, Mus musculus
acttggcctctctttacgtgagata

SEQ ID NO: 135905 - DNA, 25 bp, Mus musculus
acttggcgcctacaactgcttagat

SEQ ID NO: 135906 - DNA, 25 bp, Mus musculus
acttggcgcctagaactgcttagat

SEQ ID NO: 135907 - DNA, 25 bp, Mus musculus
acttggcggacgagtattttgcata

SEQ ID NO: 135908 - DNA, 25 bp, Mus musculus
acttggcggacgtgtattttgcata

SEQ ID NO: 135909 - DNA, 25 bp, Mus musculus
acttggcgtttcaaaagacaatctg

SEQ ID NO: 135910 - DNA, 25 bp, Mus musculus
acttggcgtttctaaagacaatctg

SEQ ID NO: 135911 - DNA, 25 bp, Mus musculus
acttggctaaaactttacacttgag

SEQ ID NO: 135912 - DNA, 25 bp, Mus musculus
acttggctaaaagtttacacttgag

SEQ ID NO: 135913 - DNA, 25 bp, Mus musculus
acttggctactcagggcgagtcagc

SEQ ID NO: 135914 - DNA, 25 bp, Mus musculus
acttggctactctgggcgagtcagc

SEQ ID NO: 135915 - DNA, 25 bp, Mus musculus
acttggctagatatcttatcttctt

SEQ ID NO: 135916 - DNA, 25 bp, Mus musculus
acttggctagatttcttatcttctt

SEQ ID NO: 135917 - DNA, 25 bp, Mus musculus
acttggctatggcacagacgctgat

SEQ ID NO: 135918 - DNA, 25 bp, Mus musculus
acttggctatgggacagacgctgat

SEQ ID NO: 135919 - DNA, 25 bp, Mus musculus
acttggctatttactatccgtggga

SEQ ID NO: 135920 - DNA, 25 bp, Mus musculus
acttggctattttctatccgtggga

SEQ ID NO: 135921 - DNA, 25 bp, Mus musculus
acttggctccaactcttctgggacc

SEQ ID NO: 135922 - DNA, 25 bp, Mus musculus
acttggctccaagtcttctgggacc

SEQ ID NO: 135923 - DNA, 25 bp, Mus musculus
acttggctctgcctttgtttagctt

SEQ ID NO: 135924 - DNA, 25 bp, Mus musculus
acttggctctgcgtttgtttagctt

SEQ ID NO: 135925 - DNA, 25 bp, Mus musculus
acttggctctggatttgcactgatg

SEQ ID NO: 135926 - DNA, 25 bp, Mus musculus
acttggctctggttttgcactgatg

SEQ ID NO: 135927 - DNA, 25 bp, Mus musculus
acttggctgaacaggaggattgtct

SEQ ID NO: 135928 - DNA, 25 bp, Mus musculus
acttggctgaactggaggattgtct

SEQ ID NO: 135929 - DNA, 25 bp, Mus musculus
acttggctgagtccagtttgagctc

SEQ ID NO: 135930 - DNA, 25 bp, Mus musculus
acttggctgagtgcagtttgagctc

SEQ ID NO: 135931 - DNA, 25 bp, Mus musculus
acttggctgcagcaggtactgacta

SEQ ID NO: 135932 - DNA, 25 bp, Mus musculus
acttggctgcaggaggtactgacta

SEQ ID NO: 135933 - DNA, 25 bp, Mus musculus
acttggctgctcaggattccaaaca

SEQ ID NO: 135934 - DNA, 25 bp, Mus musculus
acttggctgctctggattccaaaca

SEQ ID NO: 135935 - DNA, 25 bp, Mus musculus
acttggctggagaaccctgaatgtt

SEQ ID NO: 135936 - DNA, 25 bp, Mus musculus
acttggctggagtaccctgaatgtt

SEQ ID NO: 135937 - DNA, 25 bp, Mus musculus
acttggctgtacataaagcgttctt

SEQ ID NO: 135938 - DNA, 25 bp, Mus musculus
acttggctgtacttaaagcgttctt

SEQ ID NO: 135939 - DNA, 25 bp, Mus musculus
acttggctgttaagacggacacgtc

SEQ ID NO: 135940 - DNA, 25 bp, Mus musculus
acttggctgttatgacggacacgtc

SEQ ID NO: 135941 - DNA, 25 bp, Mus musculus
acttggcttaatcatctacctcgtg

SEQ ID NO: 135942 - DNA, 25 bp, Mus musculus
acttggcttaatgatctacctcgtg

SEQ ID NO: 135943 - DNA, 25 bp, Mus musculus
acttggcttcatatctcagcacaaa

SEQ ID NO: 135944 - DNA, 25 bp, Mus musculus
acttggcttcatttctcagcacaaa

SEQ ID NO: 135945 - DNA, 25 bp, Mus musculus
acttgggaagttagtcttgcttttg

SEQ ID NO: 135946 - DNA, 25 bp, Mus musculus
acttgggaagtttgtcttgcttttg

SEQ ID NO: 135947 - DNA, 25 bp, Mus musculus
acttgggactggcacctgaattgtt

SEQ ID NO: 135948 - DNA, 25 bp, Mus musculus
acttgggactgggacctgaattgtt

SEQ ID NO: 135949 - DNA, 25 bp, Mus musculus
acttgggagagtcttgtccagtgac

SEQ ID NO: 135950 - DNA, 25 bp, Mus musculus
acttgggagagtgttgtccagtgac

SEQ ID NO: 135951 - DNA, 25 bp, Mus musculus
acttgggaggcacttctgttttgca

SEQ ID NO: 135952 - DNA, 25 bp, Mus musculus
acttgggaggcagttctgttttgca

SEQ ID NO: 135953 - DNA, 25 bp, Mus musculus
acttgggagtgccagatgcctgaca

SEQ ID NO: 135954 - DNA, 25 bp, Mus musculus
acttgggagtgcgagatgcctgaca

SEQ ID NO: 135955 - DNA, 25 bp, Mus musculus
acttgggatgctctactctgggaac

SEQ ID NO: 135956 - DNA, 25 bp, Mus musculus
acttgggatgctgtactctgggaac

SEQ ID NO: 135957 - DNA, 25 bp, Mus musculus
acttgggcaccaaaactttgagata

SEQ ID NO: 135958 - DNA, 25 bp, Mus musculus
acttgggcaccaaagttgctgatct

SEQ ID NO: 135959 - DNA, 25 bp, Mus musculus
acttgggcaccataactttgagata

SEQ ID NO: 135960 - DNA, 25 bp, Mus musculus
acttgggcaccatagttgctgatct

SEQ ID NO: 135961 - DNA, 25 bp, Mus musculus
acttgggcaggcaagagtcccagac

SEQ ID NO: 135962 - DNA, 25 bp, Mus musculus
acttgggcaggctagagtcccagac

SEQ ID NO: 135963 - DNA, 25 bp, Mus musculus
acttgggcaggtcactctaatattt

SEQ ID NO: 135964 - DNA, 25 bp, Mus musculus
acttgggcaggtgactctaatattt

SEQ ID NO: 135965 - DNA, 25 bp, Mus musculus
acttgggcatttcccttaatccttg

SEQ ID NO: 135966 - DNA, 25 bp, Mus musculus
acttgggcatttgccttaatccttg

SEQ ID NO: 135967 - DNA, 25 bp, Mus musculus
acttgggcccgaattgggatctgga

SEQ ID NO: 135968 - DNA, 25 bp, Mus musculus
acttgggcccgatttgggatctgga

SEQ ID NO: 135969 - DNA, 25 bp, Mus musculus
acttgggctagtattctctctgaat

SEQ ID NO: 135970 - DNA, 25 bp, Mus musculus
acttgggctagttttctctctgaat

SEQ ID NO: 135971 - DNA, 25 bp, Mus musculus
acttgggctcaaccagtaggccagc

SEQ ID NO: 135972 - DNA, 25 bp, Mus musculus
acttgggctcaagcagtaggccagc

SEQ ID NO: 135973 - DNA, 25 bp, Mus musculus
acttgggctcatcgcagggtcaggg

SEQ ID NO: 135974 - DNA, 25 bp, Mus musculus
acttgggctcatggcagggtcaggg

SEQ ID NO: 135975 - DNA, 25 bp, Mus musculus
acttgggctggtagattattttaca

SEQ ID NO: 135976 - DNA, 25 bp, Mus musculus
acttgggctggttgattattttaca

SEQ ID NO: 135977 - DNA, 25 bp, Mus musculus
acttgggcttcacggaagcaggctc

SEQ ID NO: 135978 - DNA, 25 bp, Mus musculus
acttgggcttcagggaagcaggctc

SEQ ID NO: 135979 - DNA, 25 bp, Mus musculus
acttggggacccattaatgtcttgg

SEQ ID NO: 135980 - DNA, 25 bp, Mus musculus
acttggggaccctttaatgtcttgg

SEQ ID NO: 135981 - DNA, 25 bp, Mus musculus
acttggggctgtcccaagaacccag

SEQ ID NO: 135982 - DNA, 25 bp, Mus musculus
acttggggctgtgccaagaacccag

SEQ ID NO: 135983 - DNA, 25 bp, Mus musculus
acttgggggtgaactgtctgcagaa

SEQ ID NO: 135984 - DNA, 25 bp, Mus musculus
acttgggggtgatctgtctgcagaa

SEQ ID NO: 135985 - DNA, 25 bp, Mus musculus
acttgggtaacaacccagcaccaca

SEQ ID NO: 135986 - DNA, 25 bp, Mus musculus
acttgggtaacatcccagcaccaca

SEQ ID NO: 135987 - DNA, 25 bp, Mus musculus
acttgggtagcaagtgacaggcttt

SEQ ID NO: 135988 - DNA, 25 bp, Mus musculus
acttgggtagcatgtgacaggcttt

SEQ ID NO: 135989 - DNA, 25 bp, Mus musculus
acttgggtatatacttttgtgctaa

SEQ ID NO: 135990 - DNA, 25 bp, Mus musculus
acttgggtatattcttttgtgctaa

SEQ ID NO: 135991 - DNA, 25 bp, Mus musculus
acttgggtcagcaggctcagactgc

SEQ ID NO: 135992 - DNA, 25 bp, Mus musculus
acttgggtcagctggctcagactgc

SEQ ID NO: 135993 - DNA, 25 bp, Mus musculus
acttgggtccaaagtcatagactac

SEQ ID NO: 135994 - DNA, 25 bp, Mus musculus
acttgggtccaatgtcatagactac

SEQ ID NO: 135995 - DNA, 25 bp, Mus musculus
acttgggtccttctgcccgagggct

SEQ ID NO: 135996 - DNA, 25 bp, Mus musculus
acttgggtccttgtgcccgagggct

SEQ ID NO: 135997 - DNA, 25 bp, Mus musculus
acttgggtgaccctatcatctttca

SEQ ID NO: 135998 - DNA, 25 bp, Mus musculus
acttgggtgaccgtatcatctttca

SEQ ID NO: 135999 - DNA, 25 bp, Mus musculus
acttgggtgcccagtgcccatggag

SEQ ID NO: 136000 - DNA, 25 bp, Mus musculus
acttgggtgccctgtgcccatggag

SEQ ID NO: 136001 - DNA, 25 bp, Mus musculus
acttgggtggccagaagagctagca

SEQ ID NO: 136002 - DNA, 25 bp, Mus musculus
acttgggtggcctgaagagctagca

SEQ ID NO: 136003 - DNA, 25 bp, Mus musculus
acttgggtgtgtctacaacggtcgt

SEQ ID NO: 136004 - DNA, 25 bp, Mus musculus
acttgggtgtgtgtacaacggtcgt

SEQ ID NO: 136005 - DNA, 25 bp, Mus musculus
acttgggttggaagaccagaggatc

SEQ ID NO: 136006 - DNA, 25 bp, Mus musculus
acttgggttggatgaccagaggatc

SEQ ID NO: 136007 - DNA, 25 bp, Mus musculus
acttgggtttgcagccttcggaaga

SEQ ID NO: 136008 - DNA, 25 bp, Mus musculus
acttgggtttgctgccttcggaaga

SEQ ID NO: 136009 - DNA, 25 bp, Mus musculus
acttgggtttgtcacagtttgtgat

SEQ ID NO: 136010 - DNA, 25 bp, Mus musculus
acttgggtttgtgacagtttgtgat

SEQ ID NO: 136011 - DNA, 25 bp, Mus musculus
acttggtaaatcagtcggtctgtct

SEQ ID NO: 136012 - DNA, 25 bp, Mus musculus
acttggtaaatctgtcggtctgtct

SEQ ID NO: 136013 - DNA, 25 bp, Mus musculus
acttggtacctgacttgttcttgac

SEQ ID NO: 136014 - DNA, 25 bp, Mus musculus
acttggtacctgtcttgttcttgac

SEQ ID NO: 136015 - DNA, 25 bp, Mus musculus
acttggtagaagaatcctatgctta

SEQ ID NO: 136016 - DNA, 25 bp, Mus musculus
acttggtagaagtatcctatgctta

SEQ ID NO: 136017 - DNA, 25 bp, Mus musculus
acttggtagttaagtgtctctgagc

SEQ ID NO: 136018 - DNA, 25 bp, Mus musculus
acttggtagttatgtgtctctgagc

SEQ ID NO: 136019 - DNA, 25 bp, Mus musculus
acttggtatccaacgcttgaactga

SEQ ID NO: 136020 - DNA, 25 bp, Mus musculus
acttggtatccatcgcttgaactga

SEQ ID NO: 136021 - DNA, 25 bp, Mus musculus
acttggtatgcacgtctgtgactac

SEQ ID NO: 136022 - DNA, 25 bp, Mus musculus
acttggtatgcaggtctgtgactac

SEQ ID NO: 136023 - DNA, 25 bp, Mus musculus
acttggtattcccatgtatgtcaac

SEQ ID NO: 136024 - DNA, 25 bp, Mus musculus
acttggtattccgatgtatgtcaac

SEQ ID NO: 136025 - DNA, 25 bp, Mus musculus
acttggtattttcgcctgacaaagc

SEQ ID NO: 136026 - DNA, 25 bp, Mus musculus
acttggtattttggcctgacaaagc

SEQ ID NO: 136027 - DNA, 25 bp, Mus musculus
acttggtcatctactgtttctgttt

SEQ ID NO: 136028 - DNA, 25 bp, Mus musculus
acttggtcatcttctgtttctgttt

SEQ ID NO: 136029 - DNA, 25 bp, Mus musculus
acttggtccaaactgtctaagccca

SEQ ID NO: 136030 - DNA, 25 bp, Mus musculus
acttggtccaaagtgtctaagccca

SEQ ID NO: 136031 - DNA, 25 bp, Mus musculus
acttggtccgtgatgcatgagctcg

SEQ ID NO: 136032 - DNA, 25 bp, Mus musculus
acttggtccgtgttgcatgagctcg

SEQ ID NO: 136033 - DNA, 25 bp, Mus musculus
acttggtctacacctcctggtgggc

SEQ ID NO: 136034 - DNA, 25 bp, Mus musculus
acttggtctacagctcctggtgggc

SEQ ID NO: 136035 - DNA, 25 bp, Mus musculus
acttggtctatgaaagagccattgc

SEQ ID NO: 136036 - DNA, 25 bp, Mus musculus
acttggtctatgtaagagccattgc

SEQ ID NO: 136037 - DNA, 25 bp, Mus musculus
acttggtctctgataatgatgtctc

SEQ ID NO: 136038 - DNA, 25 bp, Mus musculus
acttggtctctgttaatgatgtctc

SEQ ID NO: 136039 - DNA, 25 bp, Mus musculus
acttggtggaagctttgtgtatgac

SEQ ID NO: 136040 - DNA, 25 bp, Mus musculus
acttggtggaaggtttgtgtatgac

SEQ ID NO: 136041 - DNA, 25 bp, Mus musculus
acttggtggccaaggtcagtgactt

SEQ ID NO: 136042 - DNA, 25 bp, Mus musculus
acttggtggccatggtcagtgactt

SEQ ID NO: 136043 - DNA, 25 bp, Mus musculus
acttggtggcctatgcggtgtctgc

SEQ ID NO: 136044 - DNA, 25 bp, Mus musculus
acttggtggcctttgcggtgtctgc

SEQ ID NO: 136045 - DNA, 25 bp, Mus musculus
acttggtggcgcaggtagaaatgat

SEQ ID NO: 136046 - DNA, 25 bp, Mus musculus
acttggtggcgctggtagaaatgat

SEQ ID NO: 136047 - DNA, 25 bp, Mus musculus
acttggtggctcagccaggcggtac

SEQ ID NO: 136048 - DNA, 25 bp, Mus musculus
acttggtggctctgccaggcggtac

SEQ ID NO: 136049 - DNA, 25 bp, Mus musculus
acttggtgggatatgcagggacttc

SEQ ID NO: 136050 - DNA, 25 bp, Mus musculus
acttggtgggatttgcagggacttc

SEQ ID NO: 136051 - DNA, 25 bp, Mus musculus
acttggtgggtcaattggaggcctt

SEQ ID NO: 136052 - DNA, 25 bp, Mus musculus
acttggtgggtctattggaggcctt

SEQ ID NO: 136053 - DNA, 25 bp, Mus musculus
acttggtgggtgaactcctgggata

SEQ ID NO: 136054 - DNA, 25 bp, Mus musculus
acttggtgggtgtactcctgggata

SEQ ID NO: 136055 - DNA, 25 bp, Mus musculus
acttggtggtagagtttctcttcta

SEQ ID NO: 136056 - DNA, 25 bp, Mus musculus
acttggtggtagtgtttctcttcta

SEQ ID NO: 136057 - DNA, 25 bp, Mus musculus
acttggtggtgccaactggagcttc

SEQ ID NO: 136058 - DNA, 25 bp, Mus musculus
acttggtggtgcgaactggagcttc

SEQ ID NO: 136059 - DNA, 25 bp, Mus musculus
acttggtggtgtatgctaagcatgc

SEQ ID NO: 136060 - DNA, 25 bp, Mus musculus
acttggtggtgtttgctaagcatgc

SEQ ID NO: 136061 - DNA, 25 bp, Mus musculus
acttggtgtcagataggtcccttta

SEQ ID NO: 136062 - DNA, 25 bp, Mus musculus
acttggtgtcagttaggtcccttta

SEQ ID NO: 136063 - DNA, 25 bp, Mus musculus
acttggtgtgtgacccatcagccgc

SEQ ID NO: 136064 - DNA, 25 bp, Mus musculus
acttggtgtgtgtcccatcagccgc

SEQ ID NO: 136065 - DNA, 25 bp, Mus musculus
acttggtgttaaactttggttccag

SEQ ID NO: 136066 - DNA, 25 bp, Mus musculus
acttggtgttaatctttggttccag

SEQ ID NO: 136067 - DNA, 25 bp, Mus musculus
acttggtgttgactctgctgattgc

SEQ ID NO: 136068 - DNA, 25 bp, Mus musculus
acttggtgttgagtctgctgattgc

SEQ ID NO: 136069 - DNA, 25 bp, Mus musculus
acttggtgttggaaatcgtgtctta

SEQ ID NO: 136070 - DNA, 25 bp, Mus musculus
acttggtgttggtaatcgtgtctta

SEQ ID NO: 136071 - DNA, 25 bp, Mus musculus
acttggttacagatacttgcgttgt

SEQ ID NO: 136072 - DNA, 25 bp, Mus musculus
acttggttacagttacttgcgttgt

SEQ ID NO: 136073 - DNA, 25 bp, Mus musculus
acttggttaggcagctgtcagatga

SEQ ID NO: 136074 - DNA, 25 bp, Mus musculus
acttggttaggctgctgtcagatga

SEQ ID NO: 136075 - DNA, 25 bp, Mus musculus
acttggttcagtaccttggatagca

SEQ ID NO: 136076 - DNA, 25 bp, Mus musculus
acttggttcagttccttggatagca

SEQ ID NO: 136077 - DNA, 25 bp, Mus musculus
acttggttccagcagccagtgctca

SEQ ID NO: 136078 - DNA, 25 bp, Mus musculus
acttggttccaggagccagtgctca

SEQ ID NO: 136079 - DNA, 25 bp, Mus musculus
acttggttgatgatgccaccagcct

SEQ ID NO: 136080 - DNA, 25 bp, Mus musculus
acttggttgatgttgccaccagcct

SEQ ID NO: 136081 - DNA, 25 bp, Mus musculus
acttggttgtatatcctacatatag

SEQ ID NO: 136082 - DNA, 25 bp, Mus musculus
acttggttgtatttcctacatatag

SEQ ID NO: 136083 - DNA, 25 bp, Mus musculus
acttggttgtcacatcatttgcaca

SEQ ID NO: 136084 - DNA, 25 bp, Mus musculus
acttggttgtcagatcatttgcaca

SEQ ID NO: 136085 - DNA, 25 bp, Mus musculus
acttggtttacccaggatcattcct

SEQ ID NO: 136086 - DNA, 25 bp, Mus musculus
acttggtttaccgaggatcattcct

SEQ ID NO: 136087 - DNA, 25 bp, Mus musculus
acttggtttctcactttctggctgc

SEQ ID NO: 136088 - DNA, 25 bp, Mus musculus
acttggtttctctctttctggctgc

SEQ ID NO: 136089 - DNA, 25 bp, Mus musculus
acttggtttgtcagctataccttag

SEQ ID NO: 136090 - DNA, 25 bp, Mus musculus
acttggtttgtctgctataccttag

SEQ ID NO: 136091 - DNA, 25 bp, Mus musculus
acttggtttgtgcactcagacgcgc

SEQ ID NO: 136092 - DNA, 25 bp, Mus musculus
acttggtttgtggactcagacgcgc

SEQ ID NO: 136093 - DNA, 25 bp, Mus musculus
acttggttttaaaccctgagatcta

SEQ ID NO: 136094 - DNA, 25 bp, Mus musculus
acttggttttaatccctgagatcta

SEQ ID NO: 136095 - DNA, 25 bp, Mus musculus
acttggttttgcatatcattgcctc

SEQ ID NO: 136096 - DNA, 25 bp, Mus musculus
acttggttttgcttatcattgcctc

SEQ ID NO: 136097 - DNA, 25 bp, Mus musculus
acttgtaaaaagactggcccgcaga

SEQ ID NO: 136098 - DNA, 25 bp, Mus musculus
acttgtaaaaagtctggcccgcaga

SEQ ID NO: 136099 - DNA, 25 bp, Mus musculus
acttgtaaatcacatccgcgtgcac

SEQ ID NO: 136100 - DNA, 25 bp, Mus musculus
acttgtaaatcagatccgcgtgcac

SEQ ID NO: 136101 - DNA, 25 bp, Mus musculus
acttgtaaatttctgatgcgcttga

SEQ ID NO: 136102 - DNA, 25 bp, Mus musculus
acttgtaaatttgtgatgcgcttga

SEQ ID NO: 136103 - DNA, 25 bp, Mus musculus
acttgtaaccagcttgtggcctgta

SEQ ID NO: 136104 - DNA, 25 bp, Mus musculus
acttgtaaccaggttgtggcctgta

SEQ ID NO: 136105 - DNA, 25 bp, Mus musculus
acttgtaactacaaatgcatctttt

SEQ ID NO: 136106 - DNA, 25 bp, Mus musculus
acttgtaactactaatgcatctttt

SEQ ID NO: 136107 - DNA, 25 bp, Mus musculus
acttgtaagcagagttgacctgtgc

SEQ ID NO: 136108 - DNA, 25 bp, Mus musculus
acttgtaagcagtgttgacctgtgc

SEQ ID NO: 136109 - DNA, 25 bp, Mus musculus
acttgtaatgtacttcctggccaaa

SEQ ID NO: 136110 - DNA, 25 bp, Mus musculus
acttgtaatgtagttcctggccaaa

SEQ ID NO: 136111 - DNA, 25 bp, Mus musculus
acttgtacacagatttgcagcctta

SEQ ID NO: 136112 - DNA, 25 bp, Mus musculus
acttgtacacagttttgcagcctta

SEQ ID NO: 136113 - DNA, 25 bp, Mus musculus
acttgtacacgtagtcccttgactt

SEQ ID NO: 136114 - DNA, 25 bp, Mus musculus
acttgtacacgttgtcccttgactt

SEQ ID NO: 136115 - DNA, 25 bp, Mus musculus
acttgtacagccacaggagcaccat

SEQ ID NO: 136116 - DNA, 25 bp, Mus musculus
acttgtacagcctcaggagcaccat

SEQ ID NO: 136117 - DNA, 25 bp, Mus musculus
acttgtacatatcctatggctgtgc

SEQ ID NO: 136118 - DNA, 25 bp, Mus musculus
acttgtacatatgctatggctgtgc

SEQ ID NO: 136119 - DNA, 25 bp, Mus musculus
acttgtacatttaagctgagaagga

SEQ ID NO: 136120 - DNA, 25 bp, Mus musculus
acttgtacattttagctgagaagga

SEQ ID NO: 136121 - DNA, 25 bp, Mus musculus
acttgtacctcactgagtcctgcga

SEQ ID NO: 136122 - DNA, 25 bp, Mus musculus
acttgtacctcagtgagtcctgcga

SEQ ID NO: 136123 - DNA, 25 bp, Mus musculus
acttgtacgatgaaggatgccttta

SEQ ID NO: 136124 - DNA, 25 bp, Mus musculus
acttgtacgatgtaggatgccttta

SEQ ID NO: 136125 - DNA, 25 bp, Mus musculus
acttgtacgctcagacccaagcatg

SEQ ID NO: 136126 - DNA, 25 bp, Mus musculus
acttgtacgctctgacccaagcatg

SEQ ID NO: 136127 - DNA, 25 bp, Mus musculus
acttgtacgtgaagtctttgagctc

SEQ ID NO: 136128 - DNA, 25 bp, Mus musculus
acttgtacgtgatgtctttgagctc

SEQ ID NO: 136129 - DNA, 25 bp, Mus musculus
acttgtactcacatctgagcagcgc

SEQ ID NO: 136130 - DNA, 25 bp, Mus musculus
acttgtactcacttctgagcagcgc

SEQ ID NO: 136131 - DNA, 25 bp, Mus musculus
acttgtacttccagtggtgcctggg

SEQ ID NO: 136132 - DNA, 25 bp, Mus musculus
acttgtacttcctgtggtgcctggg

SEQ ID NO: 136133 - DNA, 25 bp, Mus musculus
acttgtacttttccagactctcatg

SEQ ID NO: 136134 - DNA, 25 bp, Mus musculus
acttgtacttttgcagactctcatg

SEQ ID NO: 136135 - DNA, 25 bp, Mus musculus
acttgtagaatcagatttccgtgga

SEQ ID NO: 136136 - DNA, 25 bp, Mus musculus
acttgtagaatctgatttccgtgga

SEQ ID NO: 136137 - DNA, 25 bp, Mus musculus
acttgtagatgtcagaaagcctatc

SEQ ID NO: 136138 - DNA, 25 bp, Mus musculus
acttgtagatgtgagaaagcctatc

SEQ ID NO: 136139 - DNA, 25 bp, Mus musculus
acttgtagcattcaatgcttcctgt

SEQ ID NO: 136140 - DNA, 25 bp, Mus musculus
acttgtagcattgaatgcttcctgt

SEQ ID NO: 136141 - DNA, 25 bp, Mus musculus
acttgtagcgtaatcttcctgcaaa

SEQ ID NO: 136142 - DNA, 25 bp, Mus musculus
acttgtagcgtattcttcctgcaaa

SEQ ID NO: 136143 - DNA, 25 bp, Mus musculus
acttgtataattactccacgtgtaa

SEQ ID NO: 136144 - DNA, 25 bp, Mus musculus
acttgtataatttctccacgtgtaa

SEQ ID NO: 136145 - DNA, 25 bp, Mus musculus
acttgtatacttaccatcagtgtta

SEQ ID NO: 136146 - DNA, 25 bp, Mus musculus
acttgtatactttccatcagtgtta

SEQ ID NO: 136147 - DNA, 25 bp, Mus musculus
acttgtatatcaactctgtgaaggg

SEQ ID NO: 136148 - DNA, 25 bp, Mus musculus
acttgtatatcatctctgtgaaggg

SEQ ID NO: 136149 - DNA, 25 bp, Mus musculus
acttgtatatgtactgttctcagtc

SEQ ID NO: 136150 - DNA, 25 bp, Mus musculus
acttgtatatgttctgttctcagtc

SEQ ID NO: 136151 - DNA, 25 bp, Mus musculus
acttgtatctttagcttggtgactt

SEQ ID NO: 136152 - DNA, 25 bp, Mus musculus
acttgtatcttttgcttggtgactt

SEQ ID NO: 136153 - DNA, 25 bp, Mus musculus
acttgtatgactatcatgtccctcc

SEQ ID NO: 136154 - DNA, 25 bp, Mus musculus
acttgtatgactttcatgtccctcc

SEQ ID NO: 136155 - DNA, 25 bp, Mus musculus
acttgtatgatgctgtcaccatgtg

SEQ ID NO: 136156 - DNA, 25 bp, Mus musculus
acttgtatgatggtgtcaccatgtg

SEQ ID NO: 136157 - DNA, 25 bp, Mus musculus
acttgtatgggcagcttgattgaca

SEQ ID NO: 136158 - DNA, 25 bp, Mus musculus
acttgtatgggctgcttgattgaca

SEQ ID NO: 136159 - DNA, 25 bp, Mus musculus
acttgtattcatattctttcagtga

SEQ ID NO: 136160 - DNA, 25 bp, Mus musculus
acttgtattcattttctttcagtga

SEQ ID NO: 136161 - DNA, 25 bp, Mus musculus
acttgtattcttaatgctgttgtta

SEQ ID NO: 136162 - DNA, 25 bp, Mus musculus
acttgtattctttatgctgttgtta

SEQ ID NO: 136163 - DNA, 25 bp, Mus musculus
acttgtattgtgagctgcctcctga

SEQ ID NO: 136164 - DNA, 25 bp, Mus musculus
acttgtattgtgtgctgcctcctga

SEQ ID NO: 136165 - DNA, 25 bp, Mus musculus
acttgtattttcattcgccgatgca

SEQ ID NO: 136166 - DNA, 25 bp, Mus musculus
acttgtattttctttcgccgatgca

SEQ ID NO: 136167 - DNA, 25 bp, Mus musculus
acttgtcaaaccactaacttctgct

SEQ ID NO: 136168 - DNA, 25 bp, Mus musculus
acttgtcaaacctctaacttctgct

SEQ ID NO: 136169 - DNA, 25 bp, Mus musculus
acttgtcaaatcagcatgtgtggga

SEQ ID NO: 136170 - DNA, 25 bp, Mus musculus
acttgtcaaatctgcatgtgtggga

SEQ ID NO: 136171 - DNA, 25 bp, Mus musculus
acttgtcacaggcatggagcagata

SEQ ID NO: 136172 - DNA, 25 bp, Mus musculus
acttgtcacagggatggagcagata

SEQ ID NO: 136173 - DNA, 25 bp, Mus musculus
acttgtcatagtacctgtctttagg

SEQ ID NO: 136174 - DNA, 25 bp, Mus musculus
acttgtcatagttcctgtctttagg

SEQ ID NO: 136175 - DNA, 25 bp, Mus musculus
acttgtccatttagttgcatattct

SEQ ID NO: 136176 - DNA, 25 bp, Mus musculus
acttgtccattttgttgcatattct

SEQ ID NO: 136177 - DNA, 25 bp, Mus musculus
acttgtcccggcacattatgtacgt

SEQ ID NO: 136178 - DNA, 25 bp, Mus musculus
acttgtcccggcatgcaggaatgta

SEQ ID NO: 136179 - DNA, 25 bp, Mus musculus
acttgtcccggctcattatgtacgt

SEQ ID NO: 136180 - DNA, 25 bp, Mus musculus
acttgtcccggcttgcaggaatgta

SEQ ID NO: 136181 - DNA, 25 bp, Mus musculus
acttgtccctttcctctgcagttgg

SEQ ID NO: 136182 - DNA, 25 bp, Mus musculus
acttgtccctttgctctgcagttgg

SEQ ID NO: 136183 - DNA, 25 bp, Mus musculus
acttgtccgtatcggtgaaggctac

SEQ ID NO: 136184 - DNA, 25 bp, Mus musculus
acttgtccgtatgggtgaaggctac

SEQ ID NO: 136185 - DNA, 25 bp, Mus musculus
acttgtccgtctctccagtaagcag

SEQ ID NO: 136186 - DNA, 25 bp, Mus musculus
acttgtccgtctgtccagtaagcag

SEQ ID NO: 136187 - DNA, 25 bp, Mus musculus
acttgtcctgaaacatgtcgcattt

SEQ ID NO: 136188 - DNA, 25 bp, Mus musculus
acttgtcctgaatcatgtcgcattt

SEQ ID NO: 136189 - DNA, 25 bp, Mus musculus
acttgtcctggaattgagctttcac

SEQ ID NO: 136190 - DNA, 25 bp, Mus musculus
acttgtcctggatttgagctttcac

SEQ ID NO: 136191 - DNA, 25 bp, Mus musculus
acttgtccttgcagtcttagctgag

SEQ ID NO: 136192 - DNA, 25 bp, Mus musculus
acttgtccttgctgtcttagctgag

SEQ ID NO: 136193 - DNA, 25 bp, Mus musculus
acttgtcgtatgcgactttcaagta

SEQ ID NO: 136194 - DNA, 25 bp, Mus musculus
acttgtcgtatgggactttcaagta

SEQ ID NO: 136195 - DNA, 25 bp, Mus musculus
acttgtctagagaacacacttggca

SEQ ID NO: 136196 - DNA, 25 bp, Mus musculus
acttgtctagagtacacacttggca

SEQ ID NO: 136197 - DNA, 25 bp, Mus musculus
acttgtctaggccactccccaggaa

SEQ ID NO: 136198 - DNA, 25 bp, Mus musculus
acttgtctaggcgactccccaggaa

SEQ ID NO: 136199 - DNA, 25 bp, Mus musculus
acttgtctagtgagacttgtccctt

SEQ ID NO: 136200 - DNA, 25 bp, Mus musculus
acttgtctagtgtgacttgtccctt

SEQ ID NO: 136201 - DNA, 25 bp, Mus musculus
acttgtctatgaatcttgggtggca

SEQ ID NO: 136202 - DNA, 25 bp, Mus musculus
acttgtctatgattcttgggtggca

SEQ ID NO: 136203 - DNA, 25 bp, Mus musculus
acttgtctcacacactgactgcagt

SEQ ID NO: 136204 - DNA, 25 bp, Mus musculus
acttgtctcacagactgactgcagt

SEQ ID NO: 136205 - DNA, 25 bp, Mus musculus
acttgtctcagaatttttattattg

SEQ ID NO: 136206 - DNA, 25 bp, Mus musculus
acttgtctcagattttttattattg

SEQ ID NO: 136207 - DNA, 25 bp, Mus musculus
acttgtctcagcctgggtcttagac

SEQ ID NO: 136208 - DNA, 25 bp, Mus musculus
acttgtctcagcgtgggtcttagac

SEQ ID NO: 136209 - DNA, 25 bp, Mus musculus
acttgtctcctaacgatgatccatt

SEQ ID NO: 136210 - DNA, 25 bp, Mus musculus
acttgtctcctatcgatgatccatt

SEQ ID NO: 136211 - DNA, 25 bp, Mus musculus
acttgtctctctctgtggtggagtg

SEQ ID NO: 136212 - DNA, 25 bp, Mus musculus
acttgtctctctgtgtggtggagtg

SEQ ID NO: 136213 - DNA, 25 bp, Mus musculus
acttgtctctttagacactgccttc

SEQ ID NO: 136214 - DNA, 25 bp, Mus musculus
acttgtctctttctgtagcttgaac

SEQ ID NO: 136215 - DNA, 25 bp, Mus musculus
acttgtctctttgtgtagcttgaac

SEQ ID NO: 136216 - DNA, 25 bp, Mus musculus
acttgtctcttttgacactgccttc

SEQ ID NO: 136217 - DNA, 25 bp, Mus musculus
acttgtctgcttcggatctccaaag

SEQ ID NO: 136218 - DNA, 25 bp, Mus musculus
acttgtctgcttgggatctccaaag

SEQ ID NO: 136219 - DNA, 25 bp, Mus musculus
acttgtctgtatatgcattggtagg

SEQ ID NO: 136220 - DNA, 25 bp, Mus musculus
acttgtctgtatttgcattggtagg

SEQ ID NO: 136221 - DNA, 25 bp, Mus musculus
acttgtcttgacctgtttcattttt

SEQ ID NO: 136222 - DNA, 25 bp, Mus musculus
acttgtcttgacgtgtttcattttt

SEQ ID NO: 136223 - DNA, 25 bp, Mus musculus
acttgtcttgtgaacgtgcatatta

SEQ ID NO: 136224 - DNA, 25 bp, Mus musculus
acttgtcttgtgtacgtgcatatta

SEQ ID NO: 136225 - DNA, 25 bp, Mus musculus
acttgtctttgtatgtccagcactc

SEQ ID NO: 136226 - DNA, 25 bp, Mus musculus
acttgtctttgtttgtccagcactc

SEQ ID NO: 136227 - DNA, 25 bp, Mus musculus
acttgtgaaaagacttagccaggca

SEQ ID NO: 136228 - DNA, 25 bp, Mus musculus
acttgtgaaaagtcttagccaggca

SEQ ID NO: 136229 - DNA, 25 bp, Mus musculus
acttgtgaacatcctatctgattta

SEQ ID NO: 136230 - DNA, 25 bp, Mus musculus
acttgtgaacatgctatctgattta

SEQ ID NO: 136231 - DNA, 25 bp, Mus musculus
acttgtgaagtcaccacgttttcag

SEQ ID NO: 136232 - DNA, 25 bp, Mus musculus
acttgtgaagtctccacgttttcag

SEQ ID NO: 136233 - DNA, 25 bp, Mus musculus
acttgtgaatgtccttgctactccc

SEQ ID NO: 136234 - DNA, 25 bp, Mus musculus
acttgtgaatgtgcttgctactccc

SEQ ID NO: 136235 - DNA, 25 bp, Mus musculus
acttgtgacaccagggctgtgatcc

SEQ ID NO: 136236 - DNA, 25 bp, Mus musculus
acttgtgacacctgggctgtgatcc

SEQ ID NO: 136237 - DNA, 25 bp, Mus musculus
acttgtgactaaaaactccgtcatt

SEQ ID NO: 136238 - DNA, 25 bp, Mus musculus
acttgtgactaataactccgtcatt

SEQ ID NO: 136239 - DNA, 25 bp, Mus musculus
acttgtgactcaagcttggtgacct

SEQ ID NO: 136240 - DNA, 25 bp, Mus musculus
acttgtgactcatgcttggtgacct

SEQ ID NO: 136241 - DNA, 25 bp, Mus musculus
acttgtgagaatccattgtagcgtt

SEQ ID NO: 136242 - DNA, 25 bp, Mus musculus
acttgtgagaatgcattgtagcgtt

SEQ ID NO: 136243 - DNA, 25 bp, Mus musculus
acttgtgatcccagtgcgggagaga

SEQ ID NO: 136244 - DNA, 25 bp, Mus musculus
acttgtgatccctgtgcgggagaga

SEQ ID NO: 136245 - DNA, 25 bp, Mus musculus
acttgtgattccagtatatctctga

SEQ ID NO: 136246 - DNA, 25 bp, Mus musculus
acttgtgattcctgtatatctctga

SEQ ID NO: 136247 - DNA, 25 bp, Mus musculus
acttgtgcaagaactacagagctca

SEQ ID NO: 136248 - DNA, 25 bp, Mus musculus
acttgtgcaagatctacagagctca

SEQ ID NO: 136249 - DNA, 25 bp, Mus musculus
acttgtgcagaacctttggccgcca

SEQ ID NO: 136250 - DNA, 25 bp, Mus musculus
acttgtgcagaagctttggccgcca

SEQ ID NO: 136251 - DNA, 25 bp, Mus musculus
acttgtgcagtcagggctttttgtt

SEQ ID NO: 136252 - DNA, 25 bp, Mus musculus
acttgtgcagtctgggctttttgtt

SEQ ID NO: 136253 - DNA, 25 bp, Mus musculus
acttgtgcatttcggagttcattaa

SEQ ID NO: 136254 - DNA, 25 bp, Mus musculus
acttgtgcatttgggagttcattaa

SEQ ID NO: 136255 - DNA, 25 bp, Mus musculus
acttgtgccaaaagcacctggatgg

SEQ ID NO: 136256 - DNA, 25 bp, Mus musculus
acttgtgccaaatgcacctggatgg

SEQ ID NO: 136257 - DNA, 25 bp, Mus musculus
acttgtgccccacatgggccagtca

SEQ ID NO: 136258 - DNA, 25 bp, Mus musculus
acttgtgccccagatgggccagtca

SEQ ID NO: 136259 - DNA, 25 bp, Mus musculus
acttgtgccccgcagtttagatctg

SEQ ID NO: 136260 - DNA, 25 bp, Mus musculus
acttgtgccccggagtttagatctg

SEQ ID NO: 136261 - DNA, 25 bp, Mus musculus
acttgtgcctaaacatggtgatcga

SEQ ID NO: 136262 - DNA, 25 bp, Mus musculus
acttgtgcctaatcatggtgatcga

SEQ ID NO: 136263 - DNA, 25 bp, Mus musculus
acttgtgcctacctgatccatctgg

SEQ ID NO: 136264 - DNA, 25 bp, Mus musculus
acttgtgcctacgtgatccatctgg

SEQ ID NO: 136265 - DNA, 25 bp, Mus musculus
acttgtgccttcaatatgtactgtg

SEQ ID NO: 136266 - DNA, 25 bp, Mus musculus
acttgtgccttctatatgtactgtg

SEQ ID NO: 136267 - DNA, 25 bp, Mus musculus
acttgtgcgcttagcagagcggcag

SEQ ID NO: 136268 - DNA, 25 bp, Mus musculus
acttgtgcgctttgcagagcggcag

SEQ ID NO: 136269 - DNA, 25 bp, Mus musculus
acttgtgctacccttaggtcctgaa

SEQ ID NO: 136270 - DNA, 25 bp, Mus musculus
acttgtgctaccgttaggtcctgaa

SEQ ID NO: 136271 - DNA, 25 bp, Mus musculus
acttgtgctagtcaggcgaccctgc

SEQ ID NO: 136272 - DNA, 25 bp, Mus musculus
acttgtgctagtgaggcgaccctgc

SEQ ID NO: 136273 - DNA, 25 bp, Mus musculus
acttgtgctcccagcaagaggttca

SEQ ID NO: 136274 - DNA, 25 bp, Mus musculus
acttgtgctccctgcaagaggttca

SEQ ID NO: 136275 - DNA, 25 bp, Mus musculus
acttgtgctgcaagggtatatccat

SEQ ID NO: 136276 - DNA, 25 bp, Mus musculus
acttgtgctgcatgggtatatccat

SEQ ID NO: 136277 - DNA, 25 bp, Mus musculus
acttgtgctgccagcatgggcctaa

SEQ ID NO: 136278 - DNA, 25 bp, Mus musculus
acttgtgctgcctgcatgggcctaa

SEQ ID NO: 136279 - DNA, 25 bp, Mus musculus
acttgtggaagtctgtcattctaaa

SEQ ID NO: 136280 - DNA, 25 bp, Mus musculus
acttgtggaagtgtgtcattctaaa

SEQ ID NO: 136281 - DNA, 25 bp, Mus musculus
acttgtggatcaagggactcccttg

SEQ ID NO: 136282 - DNA, 25 bp, Mus musculus
acttgtggatcatgggactcccttg

SEQ ID NO: 136283 - DNA, 25 bp, Mus musculus
acttgtggccccagaaagtgacagt

SEQ ID NO: 136284 - DNA, 25 bp, Mus musculus
acttgtggcccctgaaagtgacagt

SEQ ID NO: 136285 - DNA, 25 bp, Mus musculus
acttgtggcctcctaaggaagctgt

SEQ ID NO: 136286 - DNA, 25 bp, Mus musculus
acttgtggcctcgtaaggaagctgt

SEQ ID NO: 136287 - DNA, 25 bp, Mus musculus
acttgtggctcaaactcggcttgat

SEQ ID NO: 136288 - DNA, 25 bp, Mus musculus
acttgtggctcatactcggcttgat

SEQ ID NO: 136289 - DNA, 25 bp, Mus musculus
acttgtggcttcagactatcttcca

SEQ ID NO: 136290 - DNA, 25 bp, Mus musculus
acttgtggcttctgactatcttcca

SEQ ID NO: 136291 - DNA, 25 bp, Mus musculus
acttgtggcttgacactctaggtaa

SEQ ID NO: 136292 - DNA, 25 bp, Mus musculus
acttgtggcttgtcactctaggtaa

SEQ ID NO: 136293 - DNA, 25 bp, Mus musculus
acttgtgggtagatcactatcccta

SEQ ID NO: 136294 - DNA, 25 bp, Mus musculus
acttgtgggtagttcactatcccta

SEQ ID NO: 136295 - DNA, 25 bp, Mus musculus
acttgtgggtctagtgtatgtctgt

SEQ ID NO: 136296 - DNA, 25 bp, Mus musculus
acttgtgggtcttgtgtatgtctgt

SEQ ID NO: 136297 - DNA, 25 bp, Mus musculus
acttgtgggtttacagagatggtgt

SEQ ID NO: 136298 - DNA, 25 bp, Mus musculus
acttgtgggttttcagagatggtgt

SEQ ID NO: 136299 - DNA, 25 bp, Mus musculus
acttgtgtaaaaaggtagcaatact

SEQ ID NO: 136300 - DNA, 25 bp, Mus musculus
acttgtgtaaaatggtagcaatact

SEQ ID NO: 136301 - DNA, 25 bp, Mus musculus
acttgtgtactaaactgcttcctat

SEQ ID NO: 136302 - DNA, 25 bp, Mus musculus
acttgtgtactatactgcttcctat

SEQ ID NO: 136303 - DNA, 25 bp, Mus musculus
acttgtgtagcaagtctctatacga

SEQ ID NO: 136304 - DNA, 25 bp, Mus musculus
acttgtgtagcatgtctctatacga

SEQ ID NO: 136305 - DNA, 25 bp, Mus musculus
acttgtgtagtactgtgtgagccct

SEQ ID NO: 136306 - DNA, 25 bp, Mus musculus
acttgtgtagtagtgtgtgagccct

SEQ ID NO: 136307 - DNA, 25 bp, Mus musculus
acttgtgtatgtacctcacgcatgc

SEQ ID NO: 136308 - DNA, 25 bp, Mus musculus
acttgtgtatgttcctcacgcatgc

SEQ ID NO: 136309 - DNA, 25 bp, Mus musculus
acttgtgtcagcacttgtaccctgg

SEQ ID NO: 136310 - DNA, 25 bp, Mus musculus
acttgtgtcagctcttgtaccctgg

SEQ ID NO: 136311 - DNA, 25 bp, Mus musculus
acttgtgtctagattccacccatac

SEQ ID NO: 136312 - DNA, 25 bp, Mus musculus
acttgtgtctagtttccacccatac

SEQ ID NO: 136313 - DNA, 25 bp, Mus musculus
acttgtgtcttccaagaaattctct

SEQ ID NO: 136314 - DNA, 25 bp, Mus musculus
acttgtgtcttcgaagaaattctct

SEQ ID NO: 136315 - DNA, 25 bp, Mus musculus
acttgtgtgactccaatgcttacca

SEQ ID NO: 136316 - DNA, 25 bp, Mus musculus
acttgtgtgactgcaatgcttacca

SEQ ID NO: 136317 - DNA, 25 bp, Mus musculus
acttgtgtgaggacagtgcagcttc

SEQ ID NO: 136318 - DNA, 25 bp, Mus musculus
acttgtgtgaggtcagtgcagcttc

SEQ ID NO: 136319 - DNA, 25 bp, Mus musculus
acttgtgtgagtcggctcaggctca

SEQ ID NO: 136320 - DNA, 25 bp, Mus musculus
acttgtgtgagtgggctcaggctca

SEQ ID NO: 136321 - DNA, 25 bp, Mus musculus
acttgtgtggccacctgaagcaaca

SEQ ID NO: 136322 - DNA, 25 bp, Mus musculus
acttgtgtggcctcctgaagcaaca

SEQ ID NO: 136323 - DNA, 25 bp, Mus musculus
acttgtgtgtgcctgatttggttac

SEQ ID NO: 136324 - DNA, 25 bp, Mus musculus
acttgtgtgtgcgtgatttggttac

SEQ ID NO: 136325 - DNA, 25 bp, Mus musculus
acttgtgtgtgtacaatcctgtgca

SEQ ID NO: 136326 - DNA, 25 bp, Mus musculus
acttgtgtgtgtacagcgcctccga

SEQ ID NO: 136327 - DNA, 25 bp, Mus musculus
acttgtgtgtgttcaatcctgtgca

SEQ ID NO: 136328 - DNA, 25 bp, Mus musculus
acttgtgtgtgttcagcgcctccga

SEQ ID NO: 136329 - DNA, 25 bp, Mus musculus
acttgtgttccaatgatcagcttaa

SEQ ID NO: 136330 - DNA, 25 bp, Mus musculus
acttgtgttccattgatcagcttaa

SEQ ID NO: 136331 - DNA, 25 bp, Mus musculus
acttgtgtttacattgcagtcctgg

SEQ ID NO: 136332 - DNA, 25 bp, Mus musculus
acttgtgtttactttgcagtcctgg

SEQ ID NO: 136333 - DNA, 25 bp, Mus musculus
acttgtgttttcagagactcccttc

SEQ ID NO: 136334 - DNA, 25 bp, Mus musculus
acttgtgttttctgagactcccttc

SEQ ID NO: 136335 - DNA, 25 bp, Mus musculus
acttgttaatccaaaaccctctgtg

SEQ ID NO: 136336 - DNA, 25 bp, Mus musculus
acttgttaatcctaaaccctctgtg

SEQ ID NO: 136337 - DNA, 25 bp, Mus musculus
acttgttacattcagagcccttcca

SEQ ID NO: 136338 - DNA, 25 bp, Mus musculus
acttgttacattgagagcccttcca

SEQ ID NO: 136339 - DNA, 25 bp, Mus musculus
acttgttaccttcttgtctgtgaca

SEQ ID NO: 136340 - DNA, 25 bp, Mus musculus
acttgttaccttgttgtctgtgaca

SEQ ID NO: 136341 - DNA, 25 bp, Mus musculus
acttgttactccacgtgtcctgcaa

SEQ ID NO: 136342 - DNA, 25 bp, Mus musculus
acttgttactcctcgtgtcctgcaa

SEQ ID NO: 136343 - DNA, 25 bp, Mus musculus
acttgttagatacccagctcctgaa

SEQ ID NO: 136344 - DNA, 25 bp, Mus musculus
acttgttagatagccagctcctgaa

SEQ ID NO: 136345 - DNA, 25 bp, Mus musculus
acttgttcaacacaatgtccgacag

SEQ ID NO: 136346 - DNA, 25 bp, Mus musculus
acttgttcaacagaatgtccgacag

SEQ ID NO: 136347 - DNA, 25 bp, Mus musculus
acttgttcacctcattaactgaaga

SEQ ID NO: 136348 - DNA, 25 bp, Mus musculus
acttgttcacctgattaactgaaga

SEQ ID NO: 136349 - DNA, 25 bp, Mus musculus
acttgttcaggcacagctggagtac

SEQ ID NO: 136350 - DNA, 25 bp, Mus musculus
acttgttcaggctcagctggagtac

SEQ ID NO: 136351 - DNA, 25 bp, Mus musculus
acttgttcagttcttatttcagcga

SEQ ID NO: 136352 - DNA, 25 bp, Mus musculus
acttgttcagttgttatttcagcga

SEQ ID NO: 136353 - DNA, 25 bp, Mus musculus
acttgttcccggatggtttctgcag

SEQ ID NO: 136354 - DNA, 25 bp, Mus musculus
acttgttcccggttggtttctgcag

SEQ ID NO: 136355 - DNA, 25 bp, Mus musculus
acttgttccgcaagtttttgttgta

SEQ ID NO: 136356 - DNA, 25 bp, Mus musculus
acttgttccgcatgtttttgttgta

SEQ ID NO: 136357 - DNA, 25 bp, Mus musculus
acttgttcctctccttagaaacaca

SEQ ID NO: 136358 - DNA, 25 bp, Mus musculus
acttgttcctctgcttagaaacaca

SEQ ID NO: 136359 - DNA, 25 bp, Mus musculus
acttgttcctggctggtcagtgact

SEQ ID NO: 136360 - DNA, 25 bp, Mus musculus
acttgttcctgggtggtcagtgact

SEQ ID NO: 136361 - DNA, 25 bp, Mus musculus
acttgttcgtctacccaaagagctg

SEQ ID NO: 136362 - DNA, 25 bp, Mus musculus
acttgttcgtcttcccaaagagctg

SEQ ID NO: 136363 - DNA, 25 bp, Mus musculus
acttgttctgggacaacttggagga

SEQ ID NO: 136364 - DNA, 25 bp, Mus musculus
acttgttctgggtcaacttggagga

SEQ ID NO: 136365 - DNA, 25 bp, Mus musculus
acttgttctggtacctattcatcgg

SEQ ID NO: 136366 - DNA, 25 bp, Mus musculus
acttgttctggttcctattcatcgg

SEQ ID NO: 136367 - DNA, 25 bp, Mus musculus
acttgttctgtacgtgtttaatatt

SEQ ID NO: 136368 - DNA, 25 bp, Mus musculus
acttgttctgtaggtgtttaatatt

SEQ ID NO: 136369 - DNA, 25 bp, Mus musculus
acttgttcttcaacttatgttttat

SEQ ID NO: 136370 - DNA, 25 bp, Mus musculus
acttgttcttcatcttatgttttat

SEQ ID NO: 136371 - DNA, 25 bp, Mus musculus
acttgttcttctctctgccttcgtt

SEQ ID NO: 136372 - DNA, 25 bp, Mus musculus
acttgttcttctgtctgccttcgtt

SEQ ID NO: 136373 - DNA, 25 bp, Mus musculus
acttgttctttcatttgcggtgctg

SEQ ID NO: 136374 - DNA, 25 bp, Mus musculus
acttgttctttcttttgcggtgctg

SEQ ID NO: 136375 - DNA, 25 bp, Mus musculus
acttgttgactgatgttgtgactca

SEQ ID NO: 136376 - DNA, 25 bp, Mus musculus
acttgttgactgttgttgtgactca

SEQ ID NO: 136377 - DNA, 25 bp, Mus musculus
acttgttgcataatcctgtgtgtcc

SEQ ID NO: 136378 - DNA, 25 bp, Mus musculus
acttgttgcatattcctgtgtgtcc

SEQ ID NO: 136379 - DNA, 25 bp, Mus musculus
acttgttgcatccttcacaagacct

SEQ ID NO: 136380 - DNA, 25 bp, Mus musculus
acttgttgcatcgttcacaagacct

SEQ ID NO: 136381 - DNA, 25 bp, Mus musculus
acttgttgccatacccaagtatgcc

SEQ ID NO: 136382 - DNA, 25 bp, Mus musculus
acttgttgccattcccaagtatgcc

SEQ ID NO: 136383 - DNA, 25 bp, Mus musculus
acttgttgccgccttgtcagagcct

SEQ ID NO: 136384 - DNA, 25 bp, Mus musculus
acttgttgccgcgttgtcagagcct

SEQ ID NO: 136385 - DNA, 25 bp, Mus musculus
acttgttgccgtcctagctgctgca

SEQ ID NO: 136386 - DNA, 25 bp, Mus musculus
acttgttgccgtgctagctgctgca

SEQ ID NO: 136387 - DNA, 25 bp, Mus musculus
acttgttggctaatcagtctgggta

SEQ ID NO: 136388 - DNA, 25 bp, Mus musculus
acttgttggctattcagtctgggta

SEQ ID NO: 136389 - DNA, 25 bp, Mus musculus
acttgttgtcaccaggcaggccagg

SEQ ID NO: 136390 - DNA, 25 bp, Mus musculus
acttgttgtcacgaggcaggccagg

SEQ ID NO: 136391 - DNA, 25 bp, Mus musculus
acttgtttaaatatagcgttcttgg

SEQ ID NO: 136392 - DNA, 25 bp, Mus musculus
acttgtttaaatttagcgttcttgg

SEQ ID NO: 136393 - DNA, 25 bp, Mus musculus
acttgtttaggaatgacgtgctgga

SEQ ID NO: 136394 - DNA, 25 bp, Mus musculus
acttgtttaggattgacgtgctgga

SEQ ID NO: 136395 - DNA, 25 bp, Mus musculus
acttgtttctatatagtgcatgcac

SEQ ID NO: 136396 - DNA, 25 bp, Mus musculus
acttgtttctatttagtgcatgcac

SEQ ID NO: 136397 - DNA, 25 bp, Mus musculus
acttgtttgacaatgaggacggcat

SEQ ID NO: 136398 - DNA, 25 bp, Mus musculus
acttgtttgacattgaggacggcat

SEQ ID NO: 136399 - DNA, 25 bp, Mus musculus
acttgtttgattacagctctctgtt

SEQ ID NO: 136400 - DNA, 25 bp, Mus musculus
acttgtttgatttcagctctctgtt

SEQ ID NO: 136401 - DNA, 25 bp, Mus musculus
acttgtttgctcaccatccaggtga

SEQ ID NO: 136402 - DNA, 25 bp, Mus musculus
acttgtttgctctccatccaggtga

SEQ ID NO: 136403 - DNA, 25 bp, Mus musculus
acttgtttgtgtaggttgatgctgt

SEQ ID NO: 136404 - DNA, 25 bp, Mus musculus
acttgtttgtgttggttgatgctgt

SEQ ID NO: 136405 - DNA, 25 bp, Mus musculus
acttgttttcaaagtcttaggatgt

SEQ ID NO: 136406 - DNA, 25 bp, Mus musculus
acttgttttcaatgtcttaggatgt

SEQ ID NO: 136407 - DNA, 25 bp, Mus musculus
acttgttttcgcactcctaatgctc

SEQ ID NO: 136408 - DNA, 25 bp, Mus musculus
acttgttttcgctctcctaatgctc

SEQ ID NO: 136409 - DNA, 25 bp, Mus musculus
acttgttttgaaatgcttgcacatg

SEQ ID NO: 136410 - DNA, 25 bp, Mus musculus
acttgttttgaattgcttgcacatg

SEQ ID NO: 136411 - DNA, 25 bp, Mus musculus
acttgttttgcacagacgtgggcct

SEQ ID NO: 136412 - DNA, 25 bp, Mus musculus
acttgttttgcagagacgtgggcct

SEQ ID NO: 136413 - DNA, 25 bp, Mus musculus
actttaaaagctcatgtttggttct

SEQ ID NO: 136414 - DNA, 25 bp, Mus musculus
actttaaaagctgatgtttggttct

SEQ ID NO: 136415 - DNA, 25 bp, Mus musculus
actttaaactcgagtcagcccagaa

SEQ ID NO: 136416 - DNA, 25 bp, Mus musculus
actttaaactcgtgtcagcccagaa

SEQ ID NO: 136417 - DNA, 25 bp, Mus musculus
actttaaactggagaatgtgcaatg

SEQ ID NO: 136418 - DNA, 25 bp, Mus musculus
actttaaactggtgaatgtgcaatg

SEQ ID NO: 136419 - DNA, 25 bp, Mus musculus
actttaaagggcctgatccagcttg

SEQ ID NO: 136420 - DNA, 25 bp, Mus musculus
actttaaagggcgtgatccagcttg

SEQ ID NO: 136421 - DNA, 25 bp, Mus musculus
actttaactatgattctgcatttga

SEQ ID NO: 136422 - DNA, 25 bp, Mus musculus
actttaactatgtttctgcatttga

SEQ ID NO: 136423 - DNA, 25 bp, Mus musculus
actttaagacatcagctcctaggcc

SEQ ID NO: 136424 - DNA, 25 bp, Mus musculus
actttaagacatgagctcctaggcc

SEQ ID NO: 136425 - DNA, 25 bp, Mus musculus
actttaagatggctgcatgcaggtt

SEQ ID NO: 136426 - DNA, 25 bp, Mus musculus
actttaagatgggtgcatgcaggtt

SEQ ID NO: 136427 - DNA, 25 bp, Mus musculus
actttaagccacatcctctagggag

SEQ ID NO: 136428 - DNA, 25 bp, Mus musculus
actttaagccacttcctctagggag

SEQ ID NO: 136429 - DNA, 25 bp, Mus musculus
actttaaggacgctcttgtctgtct

SEQ ID NO: 136430 - DNA, 25 bp, Mus musculus
actttaaggacggtcttgtctgtct

SEQ ID NO: 136431 - DNA, 25 bp, Mus musculus
actttaaggcttatgccagtctccg

SEQ ID NO: 136432 - DNA, 25 bp, Mus musculus
actttaaggcttttgccagtctccg

SEQ ID NO: 136433 - DNA, 25 bp, Mus musculus
actttaagggctatggtcagcatga

SEQ ID NO: 136434 - DNA, 25 bp, Mus musculus
actttaagggctttggtcagcatga

SEQ ID NO: 136435 - DNA, 25 bp, Mus musculus
actttaagtctccagtatacagaat

SEQ ID NO: 136436 - DNA, 25 bp, Mus musculus
actttaagtctcgagtatacagaat

SEQ ID NO: 136437 - DNA, 25 bp, Mus musculus
actttaatcgttatctttgatcgca

SEQ ID NO: 136438 - DNA, 25 bp, Mus musculus
actttaatcgttttctttgatcgca

SEQ ID NO: 136439 - DNA, 25 bp, Mus musculus
actttaatttgcagttcatctggaa

SEQ ID NO: 136440 - DNA, 25 bp, Mus musculus
actttaatttgctgttcatctggaa

SEQ ID NO: 136441 - DNA, 25 bp, Mus musculus
actttacaattcatccttactgctg

SEQ ID NO: 136442 - DNA, 25 bp, Mus musculus
actttacaattcttccttactgctg

SEQ ID NO: 136443 - DNA, 25 bp, Mus musculus
actttacacattaaaacgtggcaat

SEQ ID NO: 136444 - DNA, 25 bp, Mus musculus
actttacacatttaaacgtggcaat

SEQ ID NO: 136445 - DNA, 25 bp, Mus musculus
actttacaccatcaaatttccaaga

SEQ ID NO: 136446 - DNA, 25 bp, Mus musculus
actttacaccatgaaatttccaaga

SEQ ID NO: 136447 - DNA, 25 bp, Mus musculus
actttacacttgatggatgaaccaa

SEQ ID NO: 136448 - DNA, 25 bp, Mus musculus
actttacacttgttggatgaaccaa

SEQ ID NO: 136449 - DNA, 25 bp, Mus musculus
actttacagaacctgagggctgctt

SEQ ID NO: 136450 - DNA, 25 bp, Mus musculus
actttacagaacgtgagggctgctt

SEQ ID NO: 136451 - DNA, 25 bp, Mus musculus
actttacagctcaggaactgcccta

SEQ ID NO: 136452 - DNA, 25 bp, Mus musculus
actttacagctctggaactgcccta

SEQ ID NO: 136453 - DNA, 25 bp, Mus musculus
actttacagggtcagttccgcttct

SEQ ID NO: 136454 - DNA, 25 bp, Mus musculus
actttacagggtgagttccgcttct

SEQ ID NO: 136455 - DNA, 25 bp, Mus musculus
actttacatgtgatatagcctcata

SEQ ID NO: 136456 - DNA, 25 bp, Mus musculus
actttacatgtgttatagcctcata

SEQ ID NO: 136457 - DNA, 25 bp, Mus musculus
actttaccagtgagcctcttttcaa

SEQ ID NO: 136458 - DNA, 25 bp, Mus musculus
actttaccagtgtgcctcttttcaa

SEQ ID NO: 136459 - DNA, 25 bp, Mus musculus
actttacctacaatttcatccagca

SEQ ID NO: 136460 - DNA, 25 bp, Mus musculus
actttacctacattttcatccagca

SEQ ID NO: 136461 - DNA, 25 bp, Mus musculus
actttacctcaccatgtcatattac

SEQ ID NO: 136462 - DNA, 25 bp, Mus musculus
actttacctcacgatgtcatattac

SEQ ID NO: 136463 - DNA, 25 bp, Mus musculus
actttacctcagatgacagtttgtt

SEQ ID NO: 136464 - DNA, 25 bp, Mus musculus
actttacctcagttgacagtttgtt

SEQ ID NO: 136465 - DNA, 25 bp, Mus musculus
actttacctggcaggcagggcagga

SEQ ID NO: 136466 - DNA, 25 bp, Mus musculus
actttacctggctggcagggcagga

SEQ ID NO: 136467 - DNA, 25 bp, Mus musculus
actttaccttgacctgagatggcaa

SEQ ID NO: 136468 - DNA, 25 bp, Mus musculus
actttaccttgagctgagatggcaa

SEQ ID NO: 136469 - DNA, 25 bp, Mus musculus
actttacgtatgaactctgcatcac

SEQ ID NO: 136470 - DNA, 25 bp, Mus musculus
actttacgtatgtactctgcatcac

SEQ ID NO: 136471 - DNA, 25 bp, Mus musculus
actttactcctcatggtatttctca

SEQ ID NO: 136472 - DNA, 25 bp, Mus musculus
actttactcctcttggtatttctca

SEQ ID NO: 136473 - DNA, 25 bp, Mus musculus
actttactcgggagtttgatcataa

SEQ ID NO: 136474 - DNA, 25 bp, Mus musculus
actttactcgggtgtttgatcataa

SEQ ID NO: 136475 - DNA, 25 bp, Mus musculus
actttactctttagccggcatggtg

SEQ ID NO: 136476 - DNA, 25 bp, Mus musculus
actttactctttctccaactcataa

SEQ ID NO: 136477 - DNA, 25 bp, Mus musculus
actttactctttcttactgtgaata

SEQ ID NO: 136478 - DNA, 25 bp, Mus musculus
actttactctttgtccaactcataa

SEQ ID NO: 136479 - DNA, 25 bp, Mus musculus
actttactctttgttactgtgaata

SEQ ID NO: 136480 - DNA, 25 bp, Mus musculus
actttactcttttgccggcatggtg

SEQ ID NO: 136481 - DNA, 25 bp, Mus musculus
actttactgagaagcccacttccga

SEQ ID NO: 136482 - DNA, 25 bp, Mus musculus
actttactgagatgcccacttccga

SEQ ID NO: 136483 - DNA, 25 bp, Mus musculus
actttactgatgacgtggcgctctg

SEQ ID NO: 136484 - DNA, 25 bp, Mus musculus
actttactgatgtcgtggcgctctg

SEQ ID NO: 136485 - DNA, 25 bp, Mus musculus
actttactgcgactggattgttccc

SEQ ID NO: 136486 - DNA, 25 bp, Mus musculus
actttactgcgagtggattgttccc

SEQ ID NO: 136487 - DNA, 25 bp, Mus musculus
actttagagtagagatcccctgcta

SEQ ID NO: 136488 - DNA, 25 bp, Mus musculus
actttagagtagtgatcccctgcta

SEQ ID NO: 136489 - DNA, 25 bp, Mus musculus
actttagatcagcagtgtcggccat

SEQ ID NO: 136490 - DNA, 25 bp, Mus musculus
actttagatcaggagtgtcggccat

SEQ ID NO: 136491 - DNA, 25 bp, Mus musculus
actttagatggtctgcgctcctcca

SEQ ID NO: 136492 - DNA, 25 bp, Mus musculus
actttagatggtgtgcgctcctcca

SEQ ID NO: 136493 - DNA, 25 bp, Mus musculus
actttagcactccagctagcttggg

SEQ ID NO: 136494 - DNA, 25 bp, Mus musculus
actttagcactcgagctagcttggg

SEQ ID NO: 136495 - DNA, 25 bp, Mus musculus
actttagctcctctgagtccactgt

SEQ ID NO: 136496 - DNA, 25 bp, Mus musculus
actttagctcctgtgagtccactgt

SEQ ID NO: 136497 - DNA, 25 bp, Mus musculus
actttaggaccaaatgtgagctctg

SEQ ID NO: 136498 - DNA, 25 bp, Mus musculus
actttaggaccatatgtgagctctg

SEQ ID NO: 136499 - DNA, 25 bp, Mus musculus
actttaggagaaactaccttgtgca

SEQ ID NO: 136500 - DNA, 25 bp, Mus musculus
actttaggagaatctaccttgtgca

SEQ ID NO: 136501 - DNA, 25 bp, Mus musculus
actttaggcctgaccctgaaggtgc

SEQ ID NO: 136502 - DNA, 25 bp, Mus musculus
actttaggcctgtccctgaaggtgc

SEQ ID NO: 136503 - DNA, 25 bp, Mus musculus
actttaggcgcactcgggaggatct

SEQ ID NO: 136504 - DNA, 25 bp, Mus musculus
actttaggcgcagtcgggaggatct

SEQ ID NO: 136505 - DNA, 25 bp, Mus musculus
actttaggtctactgtgcacacaca

SEQ ID NO: 136506 - DNA, 25 bp, Mus musculus
actttaggtctagtgtgcacacaca

SEQ ID NO: 136507 - DNA, 25 bp, Mus musculus
actttagtcccgagcctaaggatag

SEQ ID NO: 136508 - DNA, 25 bp, Mus musculus
actttagtcccgtgcctaaggatag

SEQ ID NO: 136509 - DNA, 25 bp, Mus musculus
actttagtccctcagtcctcagagt

SEQ ID NO: 136510 - DNA, 25 bp, Mus musculus
actttagtccctgagtcctcagagt

SEQ ID NO: 136511 - DNA, 25 bp, Mus musculus
actttagttaccacctatacagcca

SEQ ID NO: 136512 - DNA, 25 bp, Mus musculus
actttagttacctcctatacagcca

SEQ ID NO: 136513 - DNA, 25 bp, Mus musculus
actttataactgatggtcttggtat

SEQ ID NO: 136514 - DNA, 25 bp, Mus musculus
actttataactgcatggtaccctag

SEQ ID NO: 136515 - DNA, 25 bp, Mus musculus
actttataactggatggtaccctag

SEQ ID NO: 136516 - DNA, 25 bp, Mus musculus
actttataactgttggtcttggtat

SEQ ID NO: 136517 - DNA, 25 bp, Mus musculus
actttatacccaaatgacagctcat

SEQ ID NO: 136518 - DNA, 25 bp, Mus musculus
actttatacccaatgctcattcttg

SEQ ID NO: 136519 - DNA, 25 bp, Mus musculus
actttatacccatatgacagctcat

SEQ ID NO: 136520 - DNA, 25 bp, Mus musculus
actttatacccattgctcattcttg

SEQ ID NO: 136521 - DNA, 25 bp, Mus musculus
actttatactgtaggtagccttgat

SEQ ID NO: 136522 - DNA, 25 bp, Mus musculus
actttatactgttggtagccttgat

SEQ ID NO: 136523 - DNA, 25 bp, Mus musculus
actttatagcgcatgtaggtaggac

SEQ ID NO: 136524 - DNA, 25 bp, Mus musculus
actttatagcgcttgtaggtaggac

SEQ ID NO: 136525 - DNA, 25 bp, Mus musculus
actttatatgacatggcctggccca

SEQ ID NO: 136526 - DNA, 25 bp, Mus musculus
actttatatgacttggcctggccca

SEQ ID NO: 136527 - DNA, 25 bp, Mus musculus
actttatatgtcaggctctgggctg

SEQ ID NO: 136528 - DNA, 25 bp, Mus musculus
actttatatgtctggctctgggctg

SEQ ID NO: 136529 - DNA, 25 bp, Mus musculus
actttatcacagcaactctatcatg

SEQ ID NO: 136530 - DNA, 25 bp, Mus musculus
actttatcacaggaactctatcatg

SEQ ID NO: 136531 - DNA, 25 bp, Mus musculus
actttatcacatctacagatcacga

SEQ ID NO: 136532 - DNA, 25 bp, Mus musculus
actttatcacatgtacagatcacga

SEQ ID NO: 136533 - DNA, 25 bp, Mus musculus
actttatcagtcattggcaggtcat

SEQ ID NO: 136534 - DNA, 25 bp, Mus musculus
actttatcagtctttggcaggtcat

SEQ ID NO: 136535 - DNA, 25 bp, Mus musculus
actttatcattaactcgtcgtgcca

SEQ ID NO: 136536 - DNA, 25 bp, Mus musculus
actttatcattatctcgtcgtgcca

SEQ ID NO: 136537 - DNA, 25 bp, Mus musculus
actttatccagtatctgcctctatt

SEQ ID NO: 136538 - DNA, 25 bp, Mus musculus
actttatccagtttctgcctctatt

SEQ ID NO: 136539 - DNA, 25 bp, Mus musculus
actttatctccaaatttattcctgt

SEQ ID NO: 136540 - DNA, 25 bp, Mus musculus
actttatctccatatttattcctgt

SEQ ID NO: 136541 - DNA, 25 bp, Mus musculus
actttatctgatcagccctgggttt

SEQ ID NO: 136542 - DNA, 25 bp, Mus musculus
actttatctgatgagccctgggttt

SEQ ID NO: 136543 - DNA, 25 bp, Mus musculus
actttatcttccctgccagaatgga

SEQ ID NO: 136544 - DNA, 25 bp, Mus musculus
actttatcttccgtgccagaatgga

SEQ ID NO: 136545 - DNA, 25 bp, Mus musculus
actttatcttctctgagcgtgcgtt

SEQ ID NO: 136546 - DNA, 25 bp, Mus musculus
actttatcttctgtgagcgtgcgtt

SEQ ID NO: 136547 - DNA, 25 bp, Mus musculus
actttatgaaatcgccatcagctta

SEQ ID NO: 136548 - DNA, 25 bp, Mus musculus
actttatgaaatggccatcagctta

SEQ ID NO: 136549 - DNA, 25 bp, Mus musculus
actttatgatgaagcggtatagcca

SEQ ID NO: 136550 - DNA, 25 bp, Mus musculus
actttatgatgatgcggtatagcca

SEQ ID NO: 136551 - DNA, 25 bp, Mus musculus
actttatgggccacgaagagttgaa

SEQ ID NO: 136552 - DNA, 25 bp, Mus musculus
actttatgggcctcgaagagttgaa

SEQ ID NO: 136553 - DNA, 25 bp, Mus musculus
actttattatggcacacggaactgt

SEQ ID NO: 136554 - DNA, 25 bp, Mus musculus
actttattatggctgtgaattactg

SEQ ID NO: 136555 - DNA, 25 bp, Mus musculus
actttattatgggacacggaactgt

SEQ ID NO: 136556 - DNA, 25 bp, Mus musculus
actttattatgggtgtgaattactg

SEQ ID NO: 136557 - DNA, 25 bp, Mus musculus
actttattcaatcattccactgagg

SEQ ID NO: 136558 - DNA, 25 bp, Mus musculus
actttattcaatgattccactgagg

SEQ ID NO: 136559 - DNA, 25 bp, Mus musculus
actttattcagcactcctttacaga

SEQ ID NO: 136560 - DNA, 25 bp, Mus musculus
actttattcagctctcctttacaga

SEQ ID NO: 136561 - DNA, 25 bp, Mus musculus
actttattcccaagctggagttctc

SEQ ID NO: 136562 - DNA, 25 bp, Mus musculus
actttattcccatgctggagttctc

SEQ ID NO: 136563 - DNA, 25 bp, Mus musculus
actttattctaaactgttggcagca

SEQ ID NO: 136564 - DNA, 25 bp, Mus musculus
actttattctaatctgttggcagca

SEQ ID NO: 136565 - DNA, 25 bp, Mus musculus
actttattgtcaaggttttggcttt

SEQ ID NO: 136566 - DNA, 25 bp, Mus musculus
actttattgtcatggttttggcttt

SEQ ID NO: 136567 - DNA, 25 bp, Mus musculus
actttatttagaacaggttcctgag

SEQ ID NO: 136568 - DNA, 25 bp, Mus musculus
actttatttagatcaggttcctgag

SEQ ID NO: 136569 - DNA, 25 bp, Mus musculus
actttatttgttcactttgcacctg

SEQ ID NO: 136570 - DNA, 25 bp, Mus musculus
actttatttgttgactttgcacctg

SEQ ID NO: 136571 - DNA, 25 bp, Mus musculus
actttcaaatgaccctagctttctg

SEQ ID NO: 136572 - DNA, 25 bp, Mus musculus
actttcaaatgagcctagctttctg

SEQ ID NO: 136573 - DNA, 25 bp, Mus musculus
actttcaaccggcatgctgtagaat

SEQ ID NO: 136574 - DNA, 25 bp, Mus musculus
actttcaaccgggatgctgtagaat

SEQ ID NO: 136575 - DNA, 25 bp, Mus musculus
actttcaacttcaagctgatattag

SEQ ID NO: 136576 - DNA, 25 bp, Mus musculus
actttcaacttctagctgatattag

SEQ ID NO: 136577 - DNA, 25 bp, Mus musculus
actttcaatcctattggcttagcct

SEQ ID NO: 136578 - DNA, 25 bp, Mus musculus
actttcaatccttttggcttagcct

SEQ ID NO: 136579 - DNA, 25 bp, Mus musculus
actttcacagatcgtagtctcagct

SEQ ID NO: 136580 - DNA, 25 bp, Mus musculus
actttcacagatggtagtctcagct

SEQ ID NO: 136581 - DNA, 25 bp, Mus musculus
actttcacagggagcagcagccagg

SEQ ID NO: 136582 - DNA, 25 bp, Mus musculus
actttcacagggtgcagcagccagg

SEQ ID NO: 136583 - DNA, 25 bp, Mus musculus
actttcacatttaacgttaagcgag

SEQ ID NO: 136584 - DNA, 25 bp, Mus musculus
actttcacattttacgttaagcgag

SEQ ID NO: 136585 - DNA, 25 bp, Mus musculus
actttcaccactcttagatttagtt

SEQ ID NO: 136586 - DNA, 25 bp, Mus musculus
actttcaccactgttagatttagtt

SEQ ID NO: 136587 - DNA, 25 bp, Mus musculus
actttcaccccacttacaatgtcaa

SEQ ID NO: 136588 - DNA, 25 bp, Mus musculus
actttcaccccagttacaatgtcaa

SEQ ID NO: 136589 - DNA, 25 bp, Mus musculus
actttcactacacggtgtggccaga

SEQ ID NO: 136590 - DNA, 25 bp, Mus musculus
actttcactacagggtgtggccaga

SEQ ID NO: 136591 - DNA, 25 bp, Mus musculus
actttcactcaacctcggcttggtg

SEQ ID NO: 136592 - DNA, 25 bp, Mus musculus
actttcactcaagctcggcttggtg

SEQ ID NO: 136593 - DNA, 25 bp, Mus musculus
actttcactctgagggccctggagg

SEQ ID NO: 136594 - DNA, 25 bp, Mus musculus
actttcactctgtgggccctggagg

SEQ ID NO: 136595 - DNA, 25 bp, Mus musculus
actttcagaagacgtccgtccgcag

SEQ ID NO: 136596 - DNA, 25 bp, Mus musculus
actttcagaagaggtccgtccgcag

SEQ ID NO: 136597 - DNA, 25 bp, Mus musculus
actttcagcaatccttttggctctg

SEQ ID NO: 136598 - DNA, 25 bp, Mus musculus
actttcagcaatgcttttggctctg

SEQ ID NO: 136599 - DNA, 25 bp, Mus musculus
actttcagccacctgtcttgggaga

SEQ ID NO: 136600 - DNA, 25 bp, Mus musculus
actttcagccacgtgtcttgggaga

SEQ ID NO: 136601 - DNA, 25 bp, Mus musculus
actttcagcccactcagacagggtt

SEQ ID NO: 136602 - DNA, 25 bp, Mus musculus
actttcagcccagtcagacagggtt

SEQ ID NO: 136603 - DNA, 25 bp, Mus musculus
actttcaggagtacaaccctgctct

SEQ ID NO: 136604 - DNA, 25 bp, Mus musculus
actttcaggagttcaaccctgctct

SEQ ID NO: 136605 - DNA, 25 bp, Mus musculus
actttcaggcccaccggtgtgttgc

SEQ ID NO: 136606 - DNA, 25 bp, Mus musculus
actttcaggccctccggtgtgttgc

SEQ ID NO: 136607 - DNA, 25 bp, Mus musculus
actttcaggctacttagtgcaggac

SEQ ID NO: 136608 - DNA, 25 bp, Mus musculus
actttcaggctagttagtgcaggac

SEQ ID NO: 136609 - DNA, 25 bp, Mus musculus
actttcagtgatctgtgtgcatctg

SEQ ID NO: 136610 - DNA, 25 bp, Mus musculus
actttcagtgatgtgtgtgcatctg

SEQ ID NO: 136611 - DNA, 25 bp, Mus musculus
actttcagtggaaaagctgcctgct

SEQ ID NO: 136612 - DNA, 25 bp, Mus musculus
actttcagtggataagctgcctgct

SEQ ID NO: 136613 - DNA, 25 bp, Mus musculus
actttcagtgttcgagcagagctct

SEQ ID NO: 136614 - DNA, 25 bp, Mus musculus
actttcagtgttggagcagagctct

SEQ ID NO: 136615 - DNA, 25 bp, Mus musculus
actttcatactcagctcttagtcta

SEQ ID NO: 136616 - DNA, 25 bp, Mus musculus
actttcatactctgctcttagtcta

SEQ ID NO: 136617 - DNA, 25 bp, Mus musculus
actttcatccctatcagcattcagg

SEQ ID NO: 136618 - DNA, 25 bp, Mus musculus
actttcatccctttcagcattcagg

SEQ ID NO: 136619 - DNA, 25 bp, Mus musculus
actttcatccgtcacgctgagtatt

SEQ ID NO: 136620 - DNA, 25 bp, Mus musculus
actttcatccgtgacgctgagtatt

SEQ ID NO: 136621 - DNA, 25 bp, Mus musculus
actttcatcttaacactaggtctag

SEQ ID NO: 136622 - DNA, 25 bp, Mus musculus
actttcatcttatcactaggtctag

SEQ ID NO: 136623 - DNA, 25 bp, Mus musculus
actttcatgaagcttggcgactcct

SEQ ID NO: 136624 - DNA, 25 bp, Mus musculus
actttcatgaaggttggcgactcct

SEQ ID NO: 136625 - DNA, 25 bp, Mus musculus
actttcatgtcacctgtatgggcat

SEQ ID NO: 136626 - DNA, 25 bp, Mus musculus
actttcatgtcagctgtatgggcat

SEQ ID NO: 136627 - DNA, 25 bp, Mus musculus
actttcattctgaccaaggagggat

SEQ ID NO: 136628 - DNA, 25 bp, Mus musculus
actttcattctgataagccgggaca

SEQ ID NO: 136629 - DNA, 25 bp, Mus musculus
actttcattctgtccaaggagggat

SEQ ID NO: 136630 - DNA, 25 bp, Mus musculus
actttcattctgttaagccgggaca

SEQ ID NO: 136631 - DNA, 25 bp, Mus musculus
actttcattgacaaaggatgcccaa

SEQ ID NO: 136632 - DNA, 25 bp, Mus musculus
actttcattgactaaggatgcccaa

SEQ ID NO: 136633 - DNA, 25 bp, Mus musculus
actttcatttctccgggtcagtaag

SEQ ID NO: 136634 - DNA, 25 bp, Mus musculus
actttcatttctgcgggtcagtaag

SEQ ID NO: 136635 - DNA, 25 bp, Mus musculus
actttccaaaatcgtttctcatatg

SEQ ID NO: 136636 - DNA, 25 bp, Mus musculus
actttccaaaatggtttctcatatg

SEQ ID NO: 136637 - DNA, 25 bp, Mus musculus
actttccaccttactcagaaacaca

SEQ ID NO: 136638 - DNA, 25 bp, Mus musculus
actttccacctttctcagaaacaca

SEQ ID NO: 136639 - DNA, 25 bp, Mus musculus
actttccactgcactggctcgactt

SEQ ID NO: 136640 - DNA, 25 bp, Mus musculus
actttccactgctctggctcgactt

SEQ ID NO: 136641 - DNA, 25 bp, Mus musculus
actttccagagcctaggatatgtat

SEQ ID NO: 136642 - DNA, 25 bp, Mus musculus
actttccagagcgtaggatatgtat

SEQ ID NO: 136643 - DNA, 25 bp, Mus musculus
actttccagatgctaagattctaaa

SEQ ID NO: 136644 - DNA, 25 bp, Mus musculus
actttccagatggtaagattctaaa

SEQ ID NO: 136645 - DNA, 25 bp, Mus musculus
actttccagcacacataactatcga

SEQ ID NO: 136646 - DNA, 25 bp, Mus musculus
actttccagcactcataactatcga

SEQ ID NO: 136647 - DNA, 25 bp, Mus musculus
actttccagggaccaggcaggacat

SEQ ID NO: 136648 - DNA, 25 bp, Mus musculus
actttccagggagcaggcaggacat

SEQ ID NO: 136649 - DNA, 25 bp, Mus musculus
actttccagtctaacaaagcgttgg

SEQ ID NO: 136650 - DNA, 25 bp, Mus musculus
actttccagtcttacaaagcgttgg

SEQ ID NO: 136651 - DNA, 25 bp, Mus musculus
actttccataaaccttgccacatcg

SEQ ID NO: 136652 - DNA, 25 bp, Mus musculus
actttccataaagcttgccacatcg

SEQ ID NO: 136653 - DNA, 25 bp, Mus musculus
actttccatactcaatcgccgttta

SEQ ID NO: 136654 - DNA, 25 bp, Mus musculus
actttccatactgaatcgccgttta

SEQ ID NO: 136655 - DNA, 25 bp, Mus musculus
actttccatagacaattcacagaca

SEQ ID NO: 136656 - DNA, 25 bp, Mus musculus
actttccatagagaattcacagaca

SEQ ID NO: 136657 - DNA, 25 bp, Mus musculus
actttccatataatctgtgcctgtg

SEQ ID NO: 136658 - DNA, 25 bp, Mus musculus
actttccatatattctgtgcctgtg

SEQ ID NO: 136659 - DNA, 25 bp, Mus musculus
actttccatatgctcttgtgctgac

SEQ ID NO: 136660 - DNA, 25 bp, Mus musculus
actttccatatggtcttgtgctgac

SEQ ID NO: 136661 - DNA, 25 bp, Mus musculus
actttccatctcattgtagcatgta

SEQ ID NO: 136662 - DNA, 25 bp, Mus musculus
actttccatctctttgtagcatgta

SEQ ID NO: 136663 - DNA, 25 bp, Mus musculus
actttccatgacagtagcatactga

SEQ ID NO: 136664 - DNA, 25 bp, Mus musculus
actttccatgactgtagcatactga

SEQ ID NO: 136665 - DNA, 25 bp, Mus musculus
actttccatgagatttttgtccccg

SEQ ID NO: 136666 - DNA, 25 bp, Mus musculus
actttccatgagttttttgtccccg

SEQ ID NO: 136667 - DNA, 25 bp, Mus musculus
actttcccactgagaaccacaataa

SEQ ID NO: 136668 - DNA, 25 bp, Mus musculus
actttcccactgtgaaccacaataa

SEQ ID NO: 136669 - DNA, 25 bp, Mus musculus
actttcccagatattattcgcaact

SEQ ID NO: 136670 - DNA, 25 bp, Mus musculus
actttcccagattttattcgcaact

SEQ ID NO: 136671 - DNA, 25 bp, Mus musculus
actttcccagctagcattggtggta

SEQ ID NO: 136672 - DNA, 25 bp, Mus musculus
actttcccagcttgcattggtggta

SEQ ID NO: 136673 - DNA, 25 bp, Mus musculus
actttcccaggaacactattgtgtt

SEQ ID NO: 136674 - DNA, 25 bp, Mus musculus
actttcccaggatcactattgtgtt

SEQ ID NO: 136675 - DNA, 25 bp, Mus musculus
actttcccaggcctggtcctcttgg

SEQ ID NO: 136676 - DNA, 25 bp, Mus musculus
actttcccaggcgtggtcctcttgg

SEQ ID NO: 136677 - DNA, 25 bp, Mus musculus
actttcccagggagcacaggcttga

SEQ ID NO: 136678 - DNA, 25 bp, Mus musculus
actttcccagggtgcacaggcttga

SEQ ID NO: 136679 - DNA, 25 bp, Mus musculus
actttcccatggacactgtgcatca

SEQ ID NO: 136680 - DNA, 25 bp, Mus musculus
actttcccatggtcactgtgcatca

SEQ ID NO: 136681 - DNA, 25 bp, Mus musculus
actttccccaggactggctaatgaa

SEQ ID NO: 136682 - DNA, 25 bp, Mus musculus
actttccccaggtctggctaatgaa

SEQ ID NO: 136683 - DNA, 25 bp, Mus musculus
actttccccttgacatttctcagaa

SEQ ID NO: 136684 - DNA, 25 bp, Mus musculus
actttccccttgtcatttctcagaa

SEQ ID NO: 136685 - DNA, 25 bp, Mus musculus
actttcccgggcatcatgattaatg

SEQ ID NO: 136686 - DNA, 25 bp, Mus musculus
actttcccgggcttcatgattaatg

SEQ ID NO: 136687 - DNA, 25 bp, Mus musculus
actttccctatacctttcacactgt

SEQ ID NO: 136688 - DNA, 25 bp, Mus musculus
actttccctatagctttcacactgt

SEQ ID NO: 136689 - DNA, 25 bp, Mus musculus
actttccctctgactgtgctggcaa

SEQ ID NO: 136690 - DNA, 25 bp, Mus musculus
actttccctctgtctgtgctggcaa

SEQ ID NO: 136691 - DNA, 25 bp, Mus musculus
actttccctgaaagtctggctcttt

SEQ ID NO: 136692 - DNA, 25 bp, Mus musculus
actttccctgaatgtctggctcttt

SEQ ID NO: 136693 - DNA, 25 bp, Mus musculus
actttccctggaaaccatttgtgag

SEQ ID NO: 136694 - DNA, 25 bp, Mus musculus
actttccctggataccatttgtgag

SEQ ID NO: 136695 - DNA, 25 bp, Mus musculus
actttcccttgaatgtctgagatga

SEQ ID NO: 136696 - DNA, 25 bp, Mus musculus
actttcccttgattgtctgagatga

SEQ ID NO: 136697 - DNA, 25 bp, Mus musculus
actttccgtcgtattgtagatcatt

SEQ ID NO: 136698 - DNA, 25 bp, Mus musculus
actttccgtcgttttgtagatcatt

SEQ ID NO: 136699 - DNA, 25 bp, Mus musculus
actttccgtgaaattaactgtagag

SEQ ID NO: 136700 - DNA, 25 bp, Mus musculus
actttccgtgaatttaactgtagag

SEQ ID NO: 136701 - DNA, 25 bp, Mus musculus
actttcctaaaaagggagtggcact

SEQ ID NO: 136702 - DNA, 25 bp, Mus musculus
actttcctaaaatgggagtggcact

SEQ ID NO: 136703 - DNA, 25 bp, Mus musculus
actttcctaactcaaatgtgtaatc

SEQ ID NO: 136704 - DNA, 25 bp, Mus musculus
actttcctaactgaaatgtgtaatc

SEQ ID NO: 136705 - DNA, 25 bp, Mus musculus
actttcctacccagaggcaccatga

SEQ ID NO: 136706 - DNA, 25 bp, Mus musculus
actttcctaccctgaggcaccatga

SEQ ID NO: 136707 - DNA, 25 bp, Mus musculus
actttcctcaagactaactgctgtg

SEQ ID NO: 136708 - DNA, 25 bp, Mus musculus
actttcctcaagtctaactgctgtg

SEQ ID NO: 136709 - DNA, 25 bp, Mus musculus
actttcctcaccacttagtatatgg

SEQ ID NO: 136710 - DNA, 25 bp, Mus musculus
actttcctcacctcttagtatatgg

SEQ ID NO: 136711 - DNA, 25 bp, Mus musculus
actttcctcgttccggtatttgtcg

SEQ ID NO: 136712 - DNA, 25 bp, Mus musculus
actttcctcgttgcggtatttgtcg

SEQ ID NO: 136713 - DNA, 25 bp, Mus musculus
actttcctgactaccgtatgcatgc

SEQ ID NO: 136714 - DNA, 25 bp, Mus musculus
actttcctgacttccgtatgcatgc

SEQ ID NO: 136715 - DNA, 25 bp, Mus musculus
actttcctgcacatggatcaatcac

SEQ ID NO: 136716 - DNA, 25 bp, Mus musculus
actttcctgcacttggatcaatcac

SEQ ID NO: 136717 - DNA, 25 bp, Mus musculus
actttcctgcctctattgtgtaatt

SEQ ID NO: 136718 - DNA, 25 bp, Mus musculus
actttcctgcctgtattgtgtaatt

SEQ ID NO: 136719 - DNA, 25 bp, Mus musculus
actttcctgcgcacagtaggcgttc

SEQ ID NO: 136720 - DNA, 25 bp, Mus musculus
actttcctgcgctcagtaggcgttc

SEQ ID NO: 136721 - DNA, 25 bp, Mus musculus
actttcctgggcattcctccgagat

SEQ ID NO: 136722 - DNA, 25 bp, Mus musculus
actttcctgggctttcctccgagat

SEQ ID NO: 136723 - DNA, 25 bp, Mus musculus
actttcctgtggaggtaccctgaga

SEQ ID NO: 136724 - DNA, 25 bp, Mus musculus
actttcctgtggtggtaccctgaga

SEQ ID NO: 136725 - DNA, 25 bp, Mus musculus
actttccttactacagcaccaaagg

SEQ ID NO: 136726 - DNA, 25 bp, Mus musculus
actttccttacttcagcaccaaagg

SEQ ID NO: 136727 - DNA, 25 bp, Mus musculus
actttccttaggaccagatgagcta

SEQ ID NO: 136728 - DNA, 25 bp, Mus musculus
actttccttaggtccagatgagcta

SEQ ID NO: 136729 - DNA, 25 bp, Mus musculus
actttccttgagagtgctcccaagt

SEQ ID NO: 136730 - DNA, 25 bp, Mus musculus
actttccttgagtgtgctcccaagt

SEQ ID NO: 136731 - DNA, 25 bp, Mus musculus
actttccttgtgatgaccctactgt

SEQ ID NO: 136732 - DNA, 25 bp, Mus musculus
actttccttgtgttgaccctactgt

SEQ ID NO: 136733 - DNA, 25 bp, Mus musculus
actttcctttgaacatccgtctgca

SEQ ID NO: 136734 - DNA, 25 bp, Mus musculus
actttcctttgatcatccgtctgca

SEQ ID NO: 136735 - DNA, 25 bp, Mus musculus
actttcgaacataccgcatcttggg

SEQ ID NO: 136736 - DNA, 25 bp, Mus musculus
actttcgaacattccgcatcttggg

SEQ ID NO: 136737 - DNA, 25 bp, Mus musculus
actttcgaacctctgggtcacttgg

SEQ ID NO: 136738 - DNA, 25 bp, Mus musculus
actttcgaacctgtgggtcacttgg

SEQ ID NO: 136739 - DNA, 25 bp, Mus musculus
actttcgaagaaacgttgctaggtg

SEQ ID NO: 136740 - DNA, 25 bp, Mus musculus
actttcgaagaatcgttgctaggtg

SEQ ID NO: 136741 - DNA, 25 bp, Mus musculus
actttcgggatgaggctgttataga

SEQ ID NO: 136742 - DNA, 25 bp, Mus musculus
actttcgggatgtggctgttataga

SEQ ID NO: 136743 - DNA, 25 bp, Mus musculus
actttcgttttcacttctgtaccat

SEQ ID NO: 136744 - DNA, 25 bp, Mus musculus
actttcgttttctcttctgtaccat

SEQ ID NO: 136745 - DNA, 25 bp, Mus musculus
actttctaagtcaggagtccagtca

SEQ ID NO: 136746 - DNA, 25 bp, Mus musculus
actttctaagtctggagtccagtca

SEQ ID NO: 136747 - DNA, 25 bp, Mus musculus
actttctaatacaggtctaatgtga

SEQ ID NO: 136748 - DNA, 25 bp, Mus musculus
actttctaatactggtctaatgtga

SEQ ID NO: 136749 - DNA, 25 bp, Mus musculus
actttctacaacacctccattgaag

SEQ ID NO: 136750 - DNA, 25 bp, Mus musculus
actttctacaactcctccattgaag

SEQ ID NO: 136751 - DNA, 25 bp, Mus musculus
actttctacaccagggcagggcagg

SEQ ID NO: 136752 - DNA, 25 bp, Mus musculus
actttctacacctgggcagggcagg

SEQ ID NO: 136753 - DNA, 25 bp, Mus musculus
actttctacttgagcatgggcttgg

SEQ ID NO: 136754 - DNA, 25 bp, Mus musculus
actttctacttgtgcatgggcttgg

SEQ ID NO: 136755 - DNA, 25 bp, Mus musculus
actttctagagtattgtcagcccta

SEQ ID NO: 136756 - DNA, 25 bp, Mus musculus
actttctagagttttgtcagcccta

SEQ ID NO: 136757 - DNA, 25 bp, Mus musculus
actttctagatgagatcggcttcct

SEQ ID NO: 136758 - DNA, 25 bp, Mus musculus
actttctagatgtgatcggcttcct

SEQ ID NO: 136759 - DNA, 25 bp, Mus musculus
actttctaggacaagcacggcttct

SEQ ID NO: 136760 - DNA, 25 bp, Mus musculus
actttctaggactagcacggcttct

SEQ ID NO: 136761 - DNA, 25 bp, Mus musculus
actttctaggtaatgtggctgtgca

SEQ ID NO: 136762 - DNA, 25 bp, Mus musculus
actttctaggtattgtggctgtgca

SEQ ID NO: 136763 - DNA, 25 bp, Mus musculus
actttctatagcattgaggtccttc

SEQ ID NO: 136764 - DNA, 25 bp, Mus musculus
actttctatagctttgaggtccttc

SEQ ID NO: 136765 - DNA, 25 bp, Mus musculus
actttctatctaattcacccatttc

SEQ ID NO: 136766 - DNA, 25 bp, Mus musculus
actttctatctatttcacccatttc

SEQ ID NO: 136767 - DNA, 25 bp, Mus musculus
actttctatctgaatccaagccttt

SEQ ID NO: 136768 - DNA, 25 bp, Mus musculus
actttctatctgtatccaagccttt

SEQ ID NO: 136769 - DNA, 25 bp, Mus musculus
actttctattctaaactcctaccag

SEQ ID NO: 136770 - DNA, 25 bp, Mus musculus
actttctattctcttcaggaagctg

SEQ ID NO: 136771 - DNA, 25 bp, Mus musculus
actttctattctgttcaggaagctg

SEQ ID NO: 136772 - DNA, 25 bp, Mus musculus
actttctattcttaactcctaccag

SEQ ID NO: 136773 - DNA, 25 bp, Mus musculus
actttctcacatcccaaggtgttgg

SEQ ID NO: 136774 - DNA, 25 bp, Mus musculus
actttctcacatgccaaggtgttgg

SEQ ID NO: 136775 - DNA, 25 bp, Mus musculus
actttctcacctagtgggctgtgaa

SEQ ID NO: 136776 - DNA, 25 bp, Mus musculus
actttctcaccttgtgggctgtgaa

SEQ ID NO: 136777 - DNA, 25 bp, Mus musculus
actttctcacttcaattggcagcgc

SEQ ID NO: 136778 - DNA, 25 bp, Mus musculus
actttctcacttgaattggcagcgc

SEQ ID NO: 136779 - DNA, 25 bp, Mus musculus
actttctcagctctgctcagagtta

SEQ ID NO: 136780 - DNA, 25 bp, Mus musculus
actttctcagctgtgctcagagtta

SEQ ID NO: 136781 - DNA, 25 bp, Mus musculus
actttctcatttctaactataactg

SEQ ID NO: 136782 - DNA, 25 bp, Mus musculus
actttctcatttgtaactataactg

SEQ ID NO: 136783 - DNA, 25 bp, Mus musculus
actttctccatcataggacaacttg

SEQ ID NO: 136784 - DNA, 25 bp, Mus musculus
actttctccatcttaggacaacttg

SEQ ID NO: 136785 - DNA, 25 bp, Mus musculus
actttctcctggcatagagacgaga

SEQ ID NO: 136786 - DNA, 25 bp, Mus musculus
actttctcctgggatagagacgaga

SEQ ID NO: 136787 - DNA, 25 bp, Mus musculus
actttctccttcaataatctgccaa

SEQ ID NO: 136788 - DNA, 25 bp, Mus musculus
actttctccttcctgacattagtta

SEQ ID NO: 136789 - DNA, 25 bp, Mus musculus
actttctccttcgtgacattagtta

SEQ ID NO: 136790 - DNA, 25 bp, Mus musculus
actttctccttctataatctgccaa

SEQ ID NO: 136791 - DNA, 25 bp, Mus musculus
actttctctactcttgtggtgctaa

SEQ ID NO: 136792 - DNA, 25 bp, Mus musculus
actttctctactgttgtggtgctaa

SEQ ID NO: 136793 - DNA, 25 bp, Mus musculus
actttctctcatcactgaggtaata

SEQ ID NO: 136794 - DNA, 25 bp, Mus musculus
actttctctcatgactgaggtaata

SEQ ID NO: 136795 - DNA, 25 bp, Mus musculus
actttctctcttccgatctccaaag

SEQ ID NO: 136796 - DNA, 25 bp, Mus musculus
actttctctcttgcgatctccaaag

SEQ ID NO: 136797 - DNA, 25 bp, Mus musculus
actttctctgagatgcacgccagtg

SEQ ID NO: 136798 - DNA, 25 bp, Mus musculus
actttctctgagttgcacgccagtg

SEQ ID NO: 136799 - DNA, 25 bp, Mus musculus
actttctctgtaataaggcttgctt

SEQ ID NO: 136800 - DNA, 25 bp, Mus musculus
actttctctgtattaaggcttgctt

SEQ ID NO: 136801 - DNA, 25 bp, Mus musculus
actttctctttaccaaggtaccaag

SEQ ID NO: 136802 - DNA, 25 bp, Mus musculus
actttctctttagcaaggtaccaag

SEQ ID NO: 136803 - DNA, 25 bp, Mus musculus
actttctgaaatctcttccctgtac

SEQ ID NO: 136804 - DNA, 25 bp, Mus musculus
actttctgaaatgtcttccctgtac

SEQ ID NO: 136805 - DNA, 25 bp, Mus musculus
actttctgaagtagggtctctctct

SEQ ID NO: 136806 - DNA, 25 bp, Mus musculus
actttctgaagttgggtctctctct

SEQ ID NO: 136807 - DNA, 25 bp, Mus musculus
actttctgacagaccaacaggatga

SEQ ID NO: 136808 - DNA, 25 bp, Mus musculus
actttctgacagctgtgtgcgcctt

SEQ ID NO: 136809 - DNA, 25 bp, Mus musculus
actttctgacaggtgtgtgcgcctt

SEQ ID NO: 136810 - DNA, 25 bp, Mus musculus
actttctgacagtccaacaggatga

SEQ ID NO: 136811 - DNA, 25 bp, Mus musculus
actttctgaggcatcccattgagga

SEQ ID NO: 136812 - DNA, 25 bp, Mus musculus
actttctgaggcttcccattgagga

SEQ ID NO: 136813 - DNA, 25 bp, Mus musculus
actttctgcagcagtcaatgggaga

SEQ ID NO: 136814 - DNA, 25 bp, Mus musculus
actttctgcagctgtcaatgggaga

SEQ ID NO: 136815 - DNA, 25 bp, Mus musculus
actttctgcctcatagatgcatcta

SEQ ID NO: 136816 - DNA, 25 bp, Mus musculus
actttctgcctcttagatgcatcta

SEQ ID NO: 136817 - DNA, 25 bp, Mus musculus
actttctgcgccataatttctttat

SEQ ID NO: 136818 - DNA, 25 bp, Mus musculus
actttctgcgccttaatttctttat

SEQ ID NO: 136819 - DNA, 25 bp, Mus musculus
actttctgctacaataaggtcactt

SEQ ID NO: 136820 - DNA, 25 bp, Mus musculus
actttctgctactataaggtcactt

SEQ ID NO: 136821 - DNA, 25 bp, Mus musculus
actttctgctccacagtttctaaat

SEQ ID NO: 136822 - DNA, 25 bp, Mus musculus
actttctgctcctcagtttctaaat

SEQ ID NO: 136823 - DNA, 25 bp, Mus musculus
actttctggagaacatgggttccga

SEQ ID NO: 136824 - DNA, 25 bp, Mus musculus
actttctggagatcatgggttccga

SEQ ID NO: 136825 - DNA, 25 bp, Mus musculus
actttctggcctcagcttagagtga

SEQ ID NO: 136826 - DNA, 25 bp, Mus musculus
actttctggcctgagcttagagtga

SEQ ID NO: 136827 - DNA, 25 bp, Mus musculus
actttctgtctcagttcaagaagca

SEQ ID NO: 136828 - DNA, 25 bp, Mus musculus
actttctgtctctgttcaagaagca

SEQ ID NO: 136829 - DNA, 25 bp, Mus musculus
actttctgtgctagagtgtcttctg

SEQ ID NO: 136830 - DNA, 25 bp, Mus musculus
actttctgtgcttgagtgtcttctg

SEQ ID NO: 136831 - DNA, 25 bp, Mus musculus
actttctgttaccaatgttacaaat

SEQ ID NO: 136832 - DNA, 25 bp, Mus musculus
actttctgttacgaatgttacaaat

SEQ ID NO: 136833 - DNA, 25 bp, Mus musculus
actttctgttggatttgctgactgc

SEQ ID NO: 136834 - DNA, 25 bp, Mus musculus
actttctgttggttttgctgactgc

SEQ ID NO: 136835 - DNA, 25 bp, Mus musculus
actttcttaatgattgtctgccatg

SEQ ID NO: 136836 - DNA, 25 bp, Mus musculus
actttcttaatgtttgtctgccatg

SEQ ID NO: 136837 - DNA, 25 bp, Mus musculus
actttcttacatatggcttgcggga

SEQ ID NO: 136838 - DNA, 25 bp, Mus musculus
actttcttacatttggcttgcggga

SEQ ID NO: 136839 - DNA, 25 bp, Mus musculus
actttcttatgtcgacccatcagcc

SEQ ID NO: 136840 - DNA, 25 bp, Mus musculus
actttcttatgtggacccatcagcc

SEQ ID NO: 136841 - DNA, 25 bp, Mus musculus
actttcttatttactgcgtggtgta

SEQ ID NO: 136842 - DNA, 25 bp, Mus musculus
actttcttattttctgcgtggtgta

SEQ ID NO: 136843 - DNA, 25 bp, Mus musculus
actttcttcaggagattggttttca

SEQ ID NO: 136844 - DNA, 25 bp, Mus musculus
actttcttcaggtgattggttttca

SEQ ID NO: 136845 - DNA, 25 bp, Mus musculus
actttcttctagaggtagtctcacg

SEQ ID NO: 136846 - DNA, 25 bp, Mus musculus
actttcttctagtggtagtctcacg

SEQ ID NO: 136847 - DNA, 25 bp, Mus musculus
actttcttgccaatcctttgataac

SEQ ID NO: 136848 - DNA, 25 bp, Mus musculus
actttcttgccattcctttgataac

SEQ ID NO: 136849 - DNA, 25 bp, Mus musculus
actttctttataagctctcgatgaa

SEQ ID NO: 136850 - DNA, 25 bp, Mus musculus
actttctttatatgctctcgatgaa

SEQ ID NO: 136851 - DNA, 25 bp, Mus musculus
actttctttcatcatggactgtaag

SEQ ID NO: 136852 - DNA, 25 bp, Mus musculus
actttctttcatgatggactgtaag

SEQ ID NO: 136853 - DNA, 25 bp, Mus musculus
actttctttgcaactttagctgctt

SEQ ID NO: 136854 - DNA, 25 bp, Mus musculus
actttctttgcatctttagctgctt

SEQ ID NO: 136855 - DNA, 25 bp, Mus musculus
actttctttgctcgtaccttgctac

SEQ ID NO: 136856 - DNA, 25 bp, Mus musculus
actttctttgctggtaccttgctac

SEQ ID NO: 136857 - DNA, 25 bp, Mus musculus
actttcttttcacttcgtatgcaga

SEQ ID NO: 136858 - DNA, 25 bp, Mus musculus
actttcttttcagttcgtatgcaga

SEQ ID NO: 136859 - DNA, 25 bp, Mus musculus
actttcttttgcacagctttttata

SEQ ID NO: 136860 - DNA, 25 bp, Mus musculus
actttcttttgctcagctttttata

SEQ ID NO: 136861 - DNA, 25 bp, Mus musculus
actttgaaaccaagagactcaaggg

SEQ ID NO: 136862 - DNA, 25 bp, Mus musculus
actttgaaaccatgagactcaaggg

SEQ ID NO: 136863 - DNA, 25 bp, Mus musculus
actttgaagtatctccttttgtggg

SEQ ID NO: 136864 - DNA, 25 bp, Mus musculus
actttgaagtatgtccttttgtggg

SEQ ID NO: 136865 - DNA, 25 bp, Mus musculus
actttgacaagtcaggccctagcca

SEQ ID NO: 136866 - DNA, 25 bp, Mus musculus
actttgacaagtgaggccctagcca

SEQ ID NO: 136867 - DNA, 25 bp, Mus musculus
actttgacagtaaccgtcttcactt

SEQ ID NO: 136868 - DNA, 25 bp, Mus musculus
actttgacagtatccgtcttcactt

SEQ ID NO: 136869 - DNA, 25 bp, Mus musculus
actttgaccagcagagcagcaatat

SEQ ID NO: 136870 - DNA, 25 bp, Mus musculus
actttgaccagctgagcagcaatat

SEQ ID NO: 136871 - DNA, 25 bp, Mus musculus
actttgaccgtgatgacgtggccca

SEQ ID NO: 136872 - DNA, 25 bp, Mus musculus
actttgaccgtgttgacgtggccca

SEQ ID NO: 136873 - DNA, 25 bp, Mus musculus
actttgacctttaccgcatacgtgt

SEQ ID NO: 136874 - DNA, 25 bp, Mus musculus
actttgaccttttccgcatacgtgt

SEQ ID NO: 136875 - DNA, 25 bp, Mus musculus
actttgagacagaacctgtatgctg

SEQ ID NO: 136876 - DNA, 25 bp, Mus musculus
actttgagacagtacctgtatgctg

SEQ ID NO: 136877 - DNA, 25 bp, Mus musculus
actttgagacatacttcctcttctt

SEQ ID NO: 136878 - DNA, 25 bp, Mus musculus
actttgagacattcttcctcttctt

SEQ ID NO: 136879 - DNA, 25 bp, Mus musculus
actttgagactcagcatgcttgaac

SEQ ID NO: 136880 - DNA, 25 bp, Mus musculus
actttgagactctgcatgcttgaac

SEQ ID NO: 136881 - DNA, 25 bp, Mus musculus
actttgagagagacccacctcctgt

SEQ ID NO: 136882 - DNA, 25 bp, Mus musculus
actttgagagagtcccacctcctgt

SEQ ID NO: 136883 - DNA, 25 bp, Mus musculus
actttgagccaaaccaatgagggaa

SEQ ID NO: 136884 - DNA, 25 bp, Mus musculus
actttgagccaatccaatgagggaa

SEQ ID NO: 136885 - DNA, 25 bp, Mus musculus
actttgagccggatctggcctgtga

SEQ ID NO: 136886 - DNA, 25 bp, Mus musculus
actttgagccggttctggcctgtga

SEQ ID NO: 136887 - DNA, 25 bp, Mus musculus
actttgaggaggaagcttgtcgaca

SEQ ID NO: 136888 - DNA, 25 bp, Mus musculus
actttgaggaggtagcttgtcgaca

SEQ ID NO: 136889 - DNA, 25 bp, Mus musculus
actttgaggctaagacccagggcat

SEQ ID NO: 136890 - DNA, 25 bp, Mus musculus
actttgaggctatgacccagggcat

SEQ ID NO: 136891 - DNA, 25 bp, Mus musculus
actttgagggtcaggcaaggcatgc

SEQ ID NO: 136892 - DNA, 25 bp, Mus musculus
actttgagggtcatggttcttttga

SEQ ID NO: 136893 - DNA, 25 bp, Mus musculus
actttgagggtctggcaaggcatgc

SEQ ID NO: 136894 - DNA, 25 bp, Mus musculus
actttgagggtcttggttcttttga

SEQ ID NO: 136895 - DNA, 25 bp, Mus musculus
actttgagtaagcacacgagtgtgc

SEQ ID NO: 136896 - DNA, 25 bp, Mus musculus
actttgagtaaggacacgagtgtgc

SEQ ID NO: 136897 - DNA, 25 bp, Mus musculus
actttgagtcagcatccagtgtaag

SEQ ID NO: 136898 - DNA, 25 bp, Mus musculus
actttgagtcaggatccagtgtaag

SEQ ID NO: 136899 - DNA, 25 bp, Mus musculus
actttgataagcctttgggctccct

SEQ ID NO: 136900 - DNA, 25 bp, Mus musculus
actttgataagcgtttgggctccct

SEQ ID NO: 136901 - DNA, 25 bp, Mus musculus
actttgatcctgaggcctgcagctt

SEQ ID NO: 136902 - DNA, 25 bp, Mus musculus
actttgatcctgtggcctgcagctt

SEQ ID NO: 136903 - DNA, 25 bp, Mus musculus
actttgatcgtcagcaacttgcccc

SEQ ID NO: 136904 - DNA, 25 bp, Mus musculus
actttgatcgtctgcaacttgcccc

SEQ ID NO: 136905 - DNA, 25 bp, Mus musculus
actttgatcttaaatgttccaagct

SEQ ID NO: 136906 - DNA, 25 bp, Mus musculus
actttgatcttatatgttccaagct

SEQ ID NO: 136907 - DNA, 25 bp, Mus musculus
actttgatgacaagtccccaactct

SEQ ID NO: 136908 - DNA, 25 bp, Mus musculus
actttgatgacatgtccccaactct

SEQ ID NO: 136909 - DNA, 25 bp, Mus musculus
actttgatgcgaatgcacacttggc

SEQ ID NO: 136910 - DNA, 25 bp, Mus musculus
actttgatgcgattgcacacttggc

SEQ ID NO: 136911 - DNA, 25 bp, Mus musculus
actttgatggttccagccttgaaca

SEQ ID NO: 136912 - DNA, 25 bp, Mus musculus
actttgatggttgcagccttgaaca

SEQ ID NO: 136913 - DNA, 25 bp, Mus musculus
actttgatgtaacccacggctctgc

SEQ ID NO: 136914 - DNA, 25 bp, Mus musculus
actttgatgtaagccacggctctgc

SEQ ID NO: 136915 - DNA, 25 bp, Mus musculus
actttgattactcccaccttatggg

SEQ ID NO: 136916 - DNA, 25 bp, Mus musculus
actttgattactgccaccttatggg

SEQ ID NO: 136917 - DNA, 25 bp, Mus musculus
actttgattctactagactagctgt

SEQ ID NO: 136918 - DNA, 25 bp, Mus musculus
actttgattctagtagactagctgt

SEQ ID NO: 136919 - DNA, 25 bp, Mus musculus
actttgatttcacttccagttgcag

SEQ ID NO: 136920 - DNA, 25 bp, Mus musculus
actttgatttcagttccagttgcag

SEQ ID NO: 136921 - DNA, 25 bp, Mus musculus
actttgatttgcattctcccattct

SEQ ID NO: 136922 - DNA, 25 bp, Mus musculus
actttgatttgctttctcccattct

SEQ ID NO: 136923 - DNA, 25 bp, Mus musculus
actttgcaactgatgggatcacaca

SEQ ID NO: 136924 - DNA, 25 bp, Mus musculus
actttgcaactgttgggatcacaca

SEQ ID NO: 136925 - DNA, 25 bp, Mus musculus
actttgcaccttagctcatctgcta

SEQ ID NO: 136926 - DNA, 25 bp, Mus musculus
actttgcacctttgctcatctgcta

SEQ ID NO: 136927 - DNA, 25 bp, Mus musculus
actttgcactgtattctcttgttga

SEQ ID NO: 136928 - DNA, 25 bp, Mus musculus
actttgcactgttttctcttgttga

SEQ ID NO: 136929 - DNA, 25 bp, Mus musculus
actttgcaggacatgttttgagaac

SEQ ID NO: 136930 - DNA, 25 bp, Mus musculus
actttgcaggacttgttttgagaac

SEQ ID NO: 136931 - DNA, 25 bp, Mus musculus
actttgcatgtacctttgacatcag

SEQ ID NO: 136932 - DNA, 25 bp, Mus musculus
actttgcatgtagctttgacatcag

SEQ ID NO: 136933 - DNA, 25 bp, Mus musculus
actttgccaagaacatacctctgag

SEQ ID NO: 136934 - DNA, 25 bp, Mus musculus
actttgccaagatcatacctctgag

SEQ ID NO: 136935 - DNA, 25 bp, Mus musculus
actttgccaccaaatgccatattac

SEQ ID NO: 136936 - DNA, 25 bp, Mus musculus
actttgccaccatatgccatattac

SEQ ID NO: 136937 - DNA, 25 bp, Mus musculus
actttgccagataaaacattcttca

SEQ ID NO: 136938 - DNA, 25 bp, Mus musculus
actttgccagattaaacattcttca

SEQ ID NO: 136939 - DNA, 25 bp, Mus musculus
actttgccagccaccaatggaaggt

SEQ ID NO: 136940 - DNA, 25 bp, Mus musculus
actttgccagcctccaatggaaggt

SEQ ID NO: 136941 - DNA, 25 bp, Mus musculus
actttgcccacaacctgtgtttgta

SEQ ID NO: 136942 - DNA, 25 bp, Mus musculus
actttgcccacatcctgtgtttgta

SEQ ID NO: 136943 - DNA, 25 bp, Mus musculus
actttgcccatcacttggataattt

SEQ ID NO: 136944 - DNA, 25 bp, Mus musculus
actttgcccatctcttggataattt

SEQ ID NO: 136945 - DNA, 25 bp, Mus musculus
actttgcccctaaatttgagactga

SEQ ID NO: 136946 - DNA, 25 bp, Mus musculus
actttgcccctatatttgagactga

SEQ ID NO: 136947 - DNA, 25 bp, Mus musculus
actttgcccctcatcagagtatttt

SEQ ID NO: 136948 - DNA, 25 bp, Mus musculus
actttgcccctcttcagagtatttt

SEQ ID NO: 136949 - DNA, 25 bp, Mus musculus
actttgcccggcaccggctgaaggg

SEQ ID NO: 136950 - DNA, 25 bp, Mus musculus
actttgcccggcagcgctatgaaga

SEQ ID NO: 136951 - DNA, 25 bp, Mus musculus
actttgcccggctccggctgaaggg

SEQ ID NO: 136952 - DNA, 25 bp, Mus musculus
actttgcccggctgcgctatgaaga

SEQ ID NO: 136953 - DNA, 25 bp, Mus musculus
actttgccctggagagctgagagta

SEQ ID NO: 136954 - DNA, 25 bp, Mus musculus
actttgccctggtgagctgagagta

SEQ ID NO: 136955 - DNA, 25 bp, Mus musculus
actttgccctgtctgggtggcagca

SEQ ID NO: 136956 - DNA, 25 bp, Mus musculus
actttgccctgtgtgggtggcagca

SEQ ID NO: 136957 - DNA, 25 bp, Mus musculus
actttgcctcaactagcctggaatt

SEQ ID NO: 136958 - DNA, 25 bp, Mus musculus
actttgcctcaagtagcctggaatt

SEQ ID NO: 136959 - DNA, 25 bp, Mus musculus
actttgcctgcgatttatagttaag

SEQ ID NO: 136960 - DNA, 25 bp, Mus musculus
actttgcctgcgttttatagttaag

SEQ ID NO: 136961 - DNA, 25 bp, Mus musculus
actttgcctgtcaagttagtactgg

SEQ ID NO: 136962 - DNA, 25 bp, Mus musculus
actttgcctgtctagttagtactgg

SEQ ID NO: 136963 - DNA, 25 bp, Mus musculus
actttgccttttcggcagtcttaag

SEQ ID NO: 136964 - DNA, 25 bp, Mus musculus
actttgccttttgggcagtcttaag

SEQ ID NO: 136965 - DNA, 25 bp, Mus musculus
actttgcggaacagccccttcttgc

SEQ ID NO: 136966 - DNA, 25 bp, Mus musculus
actttgcggaactgccccttcttgc

SEQ ID NO: 136967 - DNA, 25 bp, Mus musculus
actttgctatctaatgcagtgtagt

SEQ ID NO: 136968 - DNA, 25 bp, Mus musculus
actttgctatcttatgcagtgtagt

SEQ ID NO: 136969 - DNA, 25 bp, Mus musculus
actttgctatgaattagcctcttca

SEQ ID NO: 136970 - DNA, 25 bp, Mus musculus
actttgctatgatttagcctcttca

SEQ ID NO: 136971 - DNA, 25 bp, Mus musculus
actttgctcggcatactaaccagaa

SEQ ID NO: 136972 - DNA, 25 bp, Mus musculus
actttgctcggcttactaaccagaa

SEQ ID NO: 136973 - DNA, 25 bp, Mus musculus
actttgctctaaagacgagcctgca

SEQ ID NO: 136974 - DNA, 25 bp, Mus musculus
actttgctctaatgacgagcctgca

SEQ ID NO: 136975 - DNA, 25 bp, Mus musculus
actttgctgaatataattaccgtag

SEQ ID NO: 136976 - DNA, 25 bp, Mus musculus
actttgctgaatttaattaccgtag

SEQ ID NO: 136977 - DNA, 25 bp, Mus musculus
actttgctgcttacctgctgcctga

SEQ ID NO: 136978 - DNA, 25 bp, Mus musculus
actttgctgctttcctgctgcctga

SEQ ID NO: 136979 - DNA, 25 bp, Mus musculus
actttgctgtacacgtgttggttgc

SEQ ID NO: 136980 - DNA, 25 bp, Mus musculus
actttgctgtactcgtgttggttgc

SEQ ID NO: 136981 - DNA, 25 bp, Mus musculus
actttgcttcatatgcttcatggct

SEQ ID NO: 136982 - DNA, 25 bp, Mus musculus
actttgcttcatttgcttcatggct

SEQ ID NO: 136983 - DNA, 25 bp, Mus musculus
actttgcttctcagtgcttctgtca

SEQ ID NO: 136984 - DNA, 25 bp, Mus musculus
actttgcttctctgtgcttctgtca

SEQ ID NO: 136985 - DNA, 25 bp, Mus musculus
actttgctttctaccaggtaccagt

SEQ ID NO: 136986 - DNA, 25 bp, Mus musculus
actttgctttctactgctgcaataa

SEQ ID NO: 136987 - DNA, 25 bp, Mus musculus
actttgctttcttccaggtaccagt

SEQ ID NO: 136988 - DNA, 25 bp, Mus musculus
actttgctttcttctgctgcaataa

SEQ ID NO: 136989 - DNA, 25 bp, Mus musculus
actttgcttttgacttactgtggga

SEQ ID NO: 136990 - DNA, 25 bp, Mus musculus
actttgcttttgtcttactgtggga

SEQ ID NO: 136991 - DNA, 25 bp, Mus musculus
actttggaagtcaatatgcacacac

SEQ ID NO: 136992 - DNA, 25 bp, Mus musculus
actttggaagtctatatgcacacac

SEQ ID NO: 136993 - DNA, 25 bp, Mus musculus
actttggaccgaacaacagcgttgc

SEQ ID NO: 136994 - DNA, 25 bp, Mus musculus
actttggaccgatcaacagcgttgc

SEQ ID NO: 136995 - DNA, 25 bp, Mus musculus
actttggactagcaacgcagttgaa

SEQ ID NO: 136996 - DNA, 25 bp, Mus musculus
actttggactaggaacgcagttgaa

SEQ ID NO: 136997 - DNA, 25 bp, Mus musculus
actttggactggatgggaataacca

SEQ ID NO: 136998 - DNA, 25 bp, Mus musculus
actttggactggttgggaataacca

SEQ ID NO: 136999 - DNA, 25 bp, Mus musculus
actttggagcccaacttatttgatg

SEQ ID NO: 137000 - DNA, 25 bp, Mus musculus
actttggagccctacttatttgatg

SEQ ID NO: 137001 - DNA, 25 bp, Mus musculus
actttggagtacaagattgagattc

SEQ ID NO: 137002 - DNA, 25 bp, Mus musculus
actttggagtactagattgagattc

SEQ ID NO: 137003 - DNA, 25 bp, Mus musculus
actttggatctacagcatcagcccc

SEQ ID NO: 137004 - DNA, 25 bp, Mus musculus
actttggatctagagcatcagcccc

SEQ ID NO: 137005 - DNA, 25 bp, Mus musculus
actttggcaactacgtggtgcgcaa

SEQ ID NO: 137006 - DNA, 25 bp, Mus musculus
actttggcaacttcgtggtgcgcaa

SEQ ID NO: 137007 - DNA, 25 bp, Mus musculus
actttggcaggaaatcacttccctg

SEQ ID NO: 137008 - DNA, 25 bp, Mus musculus
actttggcaggatatcacttccctg

SEQ ID NO: 137009 - DNA, 25 bp, Mus musculus
actttggcagggagatttgctgaca

SEQ ID NO: 137010 - DNA, 25 bp, Mus musculus
actttggcagggtgatttgctgaca

SEQ ID NO: 137011 - DNA, 25 bp, Mus musculus
actttggcatgtcagggtcctctca

SEQ ID NO: 137012 - DNA, 25 bp, Mus musculus
actttggcatgtgagggtcctctca

SEQ ID NO: 137013 - DNA, 25 bp, Mus musculus
actttggcatttacatacctgcatt

SEQ ID NO: 137014 - DNA, 25 bp, Mus musculus
actttggcattttcatacctgcatt

SEQ ID NO: 137015 - DNA, 25 bp, Mus musculus
actttggccacactttgggccagga

SEQ ID NO: 137016 - DNA, 25 bp, Mus musculus
actttggccacagtttgggccagga

SEQ ID NO: 137017 - DNA, 25 bp, Mus musculus
actttggctcagaaatgtactatat

SEQ ID NO: 137018 - DNA, 25 bp, Mus musculus
actttggctcagtaatgtactatat

SEQ ID NO: 137019 - DNA, 25 bp, Mus musculus
actttggctcatattccatgcctga

SEQ ID NO: 137020 - DNA, 25 bp, Mus musculus
actttggctcattttccatgcctga

SEQ ID NO: 137021 - DNA, 25 bp, Mus musculus
actttggctccaatcctatgaaaaa

SEQ ID NO: 137022 - DNA, 25 bp, Mus musculus
actttggctccattcctatgaaaaa

SEQ ID NO: 137023 - DNA, 25 bp, Mus musculus
actttggctcctaaatctgtggtag

SEQ ID NO: 137024 - DNA, 25 bp, Mus musculus
actttggctccttaatctgtggtag

SEQ ID NO: 137025 - DNA, 25 bp, Mus musculus
actttgggacgtcttgcttctgttc

SEQ ID NO: 137026 - DNA, 25 bp, Mus musculus
actttgggacgtgttgcttctgttc

SEQ ID NO: 137027 - DNA, 25 bp, Mus musculus
actttgggagccagcacatgatcaa

SEQ ID NO: 137028 - DNA, 25 bp, Mus musculus
actttgggagcctgcacatgatcaa

SEQ ID NO: 137029 - DNA, 25 bp, Mus musculus
actttgggctagatgggtgcatctt

SEQ ID NO: 137030 - DNA, 25 bp, Mus musculus
actttgggctagttgggtgcatctt

SEQ ID NO: 137031 - DNA, 25 bp, Mus musculus
actttgggtctcactgtgccaggtc

SEQ ID NO: 137032 - DNA, 25 bp, Mus musculus
actttgggtctctctgtgccaggtc

SEQ ID NO: 137033 - DNA, 25 bp, Mus musculus
actttgggtgcaccgtgggcctcaa

SEQ ID NO: 137034 - DNA, 25 bp, Mus musculus
actttgggtgcagcgtgggcctcaa

SEQ ID NO: 137035 - DNA, 25 bp, Mus musculus
actttgggtttaagccaggcaagga

SEQ ID NO: 137036 - DNA, 25 bp, Mus musculus
actttgggtttatgccaggcaagga

SEQ ID NO: 137037 - DNA, 25 bp, Mus musculus
actttggtacttactgttctaatat

SEQ ID NO: 137038 - DNA, 25 bp, Mus musculus
actttggtactttctgttctaatat

SEQ ID NO: 137039 - DNA, 25 bp, Mus musculus
actttggtagatccattgtctgttc

SEQ ID NO: 137040 - DNA, 25 bp, Mus musculus
actttggtagatgcattgtctgttc

SEQ ID NO: 137041 - DNA, 25 bp, Mus musculus
actttggtattgctatcctctctca

SEQ ID NO: 137042 - DNA, 25 bp, Mus musculus
actttggtattggtatcctctctca

SEQ ID NO: 137043 - DNA, 25 bp, Mus musculus
actttggtcactctactgggtgact

SEQ ID NO: 137044 - DNA, 25 bp, Mus musculus
actttggtcactgtactgggtgact

SEQ ID NO: 137045 - DNA, 25 bp, Mus musculus
actttggtcagaagctctacttcac

SEQ ID NO: 137046 - DNA, 25 bp, Mus musculus
actttggtcagatgctctacttcac

SEQ ID NO: 137047 - DNA, 25 bp, Mus musculus
actttggtctgaaacacatttgcac

SEQ ID NO: 137048 - DNA, 25 bp, Mus musculus
actttggtctgatacacatttgcac

SEQ ID NO: 137049 - DNA, 25 bp, Mus musculus
actttggtcttcctctttgggctgt

SEQ ID NO: 137050 - DNA, 25 bp, Mus musculus
actttggtcttcgtctttgggctgt

SEQ ID NO: 137051 - DNA, 25 bp, Mus musculus
actttggtgaccatttatgtacatt

SEQ ID NO: 137052 - DNA, 25 bp, Mus musculus
actttggtgaccttttatgtacatt

SEQ ID NO: 137053 - DNA, 25 bp, Mus musculus
actttggtgccactgataggaacat

SEQ ID NO: 137054 - DNA, 25 bp, Mus musculus
actttggtgccagtgataggaacat

SEQ ID NO: 137055 - DNA, 25 bp, Mus musculus
actttggtgcgaacctggcgactgg

SEQ ID NO: 137056 - DNA, 25 bp, Mus musculus
actttggtgcgatcctggcgactgg

SEQ ID NO: 137057 - DNA, 25 bp, Mus musculus
actttggtggcccagtgtatcagga

SEQ ID NO: 137058 - DNA, 25 bp, Mus musculus
actttggtggccgagtgtatcagga

SEQ ID NO: 137059 - DNA, 25 bp, Mus musculus
actttggttgataacacctgcccgt

SEQ ID NO: 137060 - DNA, 25 bp, Mus musculus
actttggttgattacacctgcccgt

SEQ ID NO: 137061 - DNA, 25 bp, Mus musculus
actttggttttcaagaggtgcttct

SEQ ID NO: 137062 - DNA, 25 bp, Mus musculus
actttggttttctagaggtgcttct

SEQ ID NO: 137063 - DNA, 25 bp, Mus musculus
actttgtaaaccagctttctgctct

SEQ ID NO: 137064 - DNA, 25 bp, Mus musculus
actttgtaaacctgctttctgctct

SEQ ID NO: 137065 - DNA, 25 bp, Mus musculus
actttgtaccttaatgagatgtttt

SEQ ID NO: 137066 - DNA, 25 bp, Mus musculus
actttgtacctttatgagatgtttt

SEQ ID NO: 137067 - DNA, 25 bp, Mus musculus
actttgtactctcactgtgctcatt

SEQ ID NO: 137068 - DNA, 25 bp, Mus musculus
actttgtactctgactgtgctcatt

SEQ ID NO: 137069 - DNA, 25 bp, Mus musculus
actttgtagcatcggaacaaccctc

SEQ ID NO: 137070 - DNA, 25 bp, Mus musculus
actttgtagcatgggaacaaccctc

SEQ ID NO: 137071 - DNA, 25 bp, Mus musculus
actttgtagctcatggatctagaga

SEQ ID NO: 137072 - DNA, 25 bp, Mus musculus
actttgtagctcttggatctagaga

SEQ ID NO: 137073 - DNA, 25 bp, Mus musculus
actttgtaggttagtattgcttata

SEQ ID NO: 137074 - DNA, 25 bp, Mus musculus
actttgtaggtttgtattgcttata

SEQ ID NO: 137075 - DNA, 25 bp, Mus musculus
actttgtatattaaatcgtggtctg

SEQ ID NO: 137076 - DNA, 25 bp, Mus musculus
actttgtatatttaatcgtggtctg

SEQ ID NO: 137077 - DNA, 25 bp, Mus musculus
actttgtatctaatactttcacctg

SEQ ID NO: 137078 - DNA, 25 bp, Mus musculus
actttgtatctattactttcacctg

SEQ ID NO: 137079 - DNA, 25 bp, Mus musculus
actttgtcaatgctcagtttccacg

SEQ ID NO: 137080 - DNA, 25 bp, Mus musculus
actttgtcaatggtcagtttccacg

SEQ ID NO: 137081 - DNA, 25 bp, Mus musculus
actttgtcacaaagcttcagctctt

SEQ ID NO: 137082 - DNA, 25 bp, Mus musculus
actttgtcacaatgcttcagctctt

SEQ ID NO: 137083 - DNA, 25 bp, Mus musculus
actttgtcatcaagcctattttagg

SEQ ID NO: 137084 - DNA, 25 bp, Mus musculus
actttgtcatcatgcctattttagg

SEQ ID NO: 137085 - DNA, 25 bp, Mus musculus
actttgtccagtctattcacattga

SEQ ID NO: 137086 - DNA, 25 bp, Mus musculus
actttgtccagtgtattcacattga

SEQ ID NO: 137087 - DNA, 25 bp, Mus musculus
actttgtccctcaattcaacttcgt

SEQ ID NO: 137088 - DNA, 25 bp, Mus musculus
actttgtccctctattcaacttcgt

SEQ ID NO: 137089 - DNA, 25 bp, Mus musculus
actttgtcgcccacttgagctggtg

SEQ ID NO: 137090 - DNA, 25 bp, Mus musculus
actttgtcgccctcttgagctggtg

SEQ ID NO: 137091 - DNA, 25 bp, Mus musculus
actttgtctcacaggctctcaagga

SEQ ID NO: 137092 - DNA, 25 bp, Mus musculus
actttgtctcactggctctcaagga

SEQ ID NO: 137093 - DNA, 25 bp, Mus musculus
actttgtctccaaatttgctcctgt

SEQ ID NO: 137094 - DNA, 25 bp, Mus musculus
actttgtctccatatttgctcctgt

SEQ ID NO: 137095 - DNA, 25 bp, Mus musculus
actttgtctctaactactattaggg

SEQ ID NO: 137096 - DNA, 25 bp, Mus musculus
actttgtctctatctactattaggg

SEQ ID NO: 137097 - DNA, 25 bp, Mus musculus
actttgtcttccctgctagtgacag

SEQ ID NO: 137098 - DNA, 25 bp, Mus musculus
actttgtcttccgtgctagtgacag

SEQ ID NO: 137099 - DNA, 25 bp, Mus musculus
actttgtgaactattgcagcctctt

SEQ ID NO: 137100 - DNA, 25 bp, Mus musculus
actttgtgaacttttgcagcctctt

SEQ ID NO: 137101 - DNA, 25 bp, Mus musculus
actttgtgaggcagggcttcaccta

SEQ ID NO: 137102 - DNA, 25 bp, Mus musculus
actttgtgaggctgggcttcaccta

SEQ ID NO: 137103 - DNA, 25 bp, Mus musculus
actttgtgctccatgatgccatgat

SEQ ID NO: 137104 - DNA, 25 bp, Mus musculus
actttgtgctccttgatgccatgat

SEQ ID NO: 137105 - DNA, 25 bp, Mus musculus
actttgtggcatcttctccaacctt

SEQ ID NO: 137106 - DNA, 25 bp, Mus musculus
actttgtggcatgttctccaacctt

SEQ ID NO: 137107 - DNA, 25 bp, Mus musculus
actttgtggctaacctagatgaggc

SEQ ID NO: 137108 - DNA, 25 bp, Mus musculus
actttgtggctatcctagatgaggc

SEQ ID NO: 137109 - DNA, 25 bp, Mus musculus
actttgtgggtgctctatagtatca

SEQ ID NO: 137110 - DNA, 25 bp, Mus musculus
actttgtgggtggtctatagtatca

SEQ ID NO: 137111 - DNA, 25 bp, Mus musculus
actttgtgtgctacccagatactga

SEQ ID NO: 137112 - DNA, 25 bp, Mus musculus
actttgtgtgcttcccagatactga

SEQ ID NO: 137113 - DNA, 25 bp, Mus musculus
actttgtgtttaatccagatttcat

SEQ ID NO: 137114 - DNA, 25 bp, Mus musculus
actttgtgtttattccagatttcat

SEQ ID NO: 137115 - DNA, 25 bp, Mus musculus
actttgttaatcagaccatgccatg

SEQ ID NO: 137116 - DNA, 25 bp, Mus musculus
actttgttaatctgaccatgccatg

SEQ ID NO: 137117 - DNA, 25 bp, Mus musculus
actttgttacagaagctagcagcag

SEQ ID NO: 137118 - DNA, 25 bp, Mus musculus
actttgttacagtagctagcagcag

SEQ ID NO: 137119 - DNA, 25 bp, Mus musculus
actttgttactcacagctctgttga

SEQ ID NO: 137120 - DNA, 25 bp, Mus musculus
actttgttactctcagctctgttga

SEQ ID NO: 137121 - DNA, 25 bp, Mus musculus
actttgttcagtcgtgtgcgctcag

SEQ ID NO: 137122 - DNA, 25 bp, Mus musculus
actttgttcagtggtgtgcgctcag

SEQ ID NO: 137123 - DNA, 25 bp, Mus musculus
actttgttccagaaggaactgtctg

SEQ ID NO: 137124 - DNA, 25 bp, Mus musculus
actttgttccagtaggaactgtctg

SEQ ID NO: 137125 - DNA, 25 bp, Mus musculus
actttgttcgggagtcttgtattag

SEQ ID NO: 137126 - DNA, 25 bp, Mus musculus
actttgttcgggtgtcttgtattag

SEQ ID NO: 137127 - DNA, 25 bp, Mus musculus
actttgttgcaaataaatctaagtg

SEQ ID NO: 137128 - DNA, 25 bp, Mus musculus
actttgttgcaattaaatctaagtg

SEQ ID NO: 137129 - DNA, 25 bp, Mus musculus
actttgttgttgagctctggctggc

SEQ ID NO: 137130 - DNA, 25 bp, Mus musculus
actttgttgttgtgctctggctggc

SEQ ID NO: 137131 - DNA, 25 bp, Mus musculus
actttgtttcagattgggtgtacta

SEQ ID NO: 137132 - DNA, 25 bp, Mus musculus
actttgtttcagtttgggtgtacta

SEQ ID NO: 137133 - DNA, 25 bp, Mus musculus
actttgtttccacctgttttatatg

SEQ ID NO: 137134 - DNA, 25 bp, Mus musculus
actttgtttccaccttacgctgaaa

SEQ ID NO: 137135 - DNA, 25 bp, Mus musculus
actttgtttccagctgttttatatg

SEQ ID NO: 137136 - DNA, 25 bp, Mus musculus
actttgtttccagcttacgctgaaa

SEQ ID NO: 137137 - DNA, 25 bp, Mus musculus
actttgtttgctatcttcacatatt

SEQ ID NO: 137138 - DNA, 25 bp, Mus musculus
actttgtttgctctccctttgtgga

SEQ ID NO: 137139 - DNA, 25 bp, Mus musculus
actttgtttgctgtccctttgtgga

SEQ ID NO: 137140 - DNA, 25 bp, Mus musculus
actttgtttgctttcttcacatatt

SEQ ID NO: 137141 - DNA, 25 bp, Mus musculus
acttttaagtcacgcactctcacaa

SEQ ID NO: 137142 - DNA, 25 bp, Mus musculus
acttttaagtcaggcactctcacaa

SEQ ID NO: 137143 - DNA, 25 bp, Mus musculus
acttttaatataaaccatctggcct

SEQ ID NO: 137144 - DNA, 25 bp, Mus musculus
acttttaatatataccatctggcct

SEQ ID NO: 137145 - DNA, 25 bp, Mus musculus
acttttaatccacctctcagcactt

SEQ ID NO: 137146 - DNA, 25 bp, Mus musculus
acttttaatccagctctcagcactt

SEQ ID NO: 137147 - DNA, 25 bp, Mus musculus
acttttacaaacactgtgcagctgt

SEQ ID NO: 137148 - DNA, 25 bp, Mus musculus
acttttacaaactctgtgcagctgt

SEQ ID NO: 137149 - DNA, 25 bp, Mus musculus
acttttacatgtctttcctccaggg

SEQ ID NO: 137150 - DNA, 25 bp, Mus musculus
acttttacatgtgtttcctccaggg

SEQ ID NO: 137151 - DNA, 25 bp, Mus musculus
acttttacttcacataggaggtcac

SEQ ID NO: 137152 - DNA, 25 bp, Mus musculus
acttttacttcagataggaggtcac

SEQ ID NO: 137153 - DNA, 25 bp, Mus musculus
acttttagatagacacagtggtact

SEQ ID NO: 137154 - DNA, 25 bp, Mus musculus
acttttagatagtcacagtggtact

SEQ ID NO: 137155 - DNA, 25 bp, Mus musculus
acttttagcctaagcaaaaaacagg

SEQ ID NO: 137156 - DNA, 25 bp, Mus musculus
acttttagcctatgcaaaaaacagg

SEQ ID NO: 137157 - DNA, 25 bp, Mus musculus
acttttagctgtcttgatcttgaga

SEQ ID NO: 137158 - DNA, 25 bp, Mus musculus
acttttagctgtgttgatcttgaga

SEQ ID NO: 137159 - DNA, 25 bp, Mus musculus
acttttaggtacctcgtggttgctg

SEQ ID NO: 137160 - DNA, 25 bp, Mus musculus
acttttaggtacgtcgtggttgctg

SEQ ID NO: 137161 - DNA, 25 bp, Mus musculus
acttttagtccgattgttccatgta

SEQ ID NO: 137162 - DNA, 25 bp, Mus musculus
acttttagtccgtttgttccatgta

SEQ ID NO: 137163 - DNA, 25 bp, Mus musculus
acttttatctccatatttgctcatg

SEQ ID NO: 137164 - DNA, 25 bp, Mus musculus
acttttatctccttatttgctcatg

SEQ ID NO: 137165 - DNA, 25 bp, Mus musculus
acttttatgaggacccagtgtccac

SEQ ID NO: 137166 - DNA, 25 bp, Mus musculus
acttttatgaggagactggtgccac

SEQ ID NO: 137167 - DNA, 25 bp, Mus musculus
acttttatgaggtcccagtgtccac

SEQ ID NO: 137168 - DNA, 25 bp, Mus musculus
acttttatgaggtgactggtgccac

SEQ ID NO: 137169 - DNA, 25 bp, Mus musculus
acttttatgattccccacaccatac

SEQ ID NO: 137170 - DNA, 25 bp, Mus musculus
acttttatgattgcccacaccatac

SEQ ID NO: 137171 - DNA, 25 bp, Mus musculus
acttttattccacgcgtgctctggg

SEQ ID NO: 137172 - DNA, 25 bp, Mus musculus
acttttattccaggcgtgctctggg

SEQ ID NO: 137173 - DNA, 25 bp, Mus musculus
acttttatttctctctccctgatta

SEQ ID NO: 137174 - DNA, 25 bp, Mus musculus
acttttatttctgtctccctgatta

SEQ ID NO: 137175 - DNA, 25 bp, Mus musculus
acttttattttaactgtactccacg

SEQ ID NO: 137176 - DNA, 25 bp, Mus musculus
acttttattttatctgtactccacg

SEQ ID NO: 137177 - DNA, 25 bp, Mus musculus
acttttcaaatactcgagcccaaga

SEQ ID NO: 137178 - DNA, 25 bp, Mus musculus
acttttcaaatagtcgagcccaaga

SEQ ID NO: 137179 - DNA, 25 bp, Mus musculus
acttttcaaggccagggtctcacac

SEQ ID NO: 137180 - DNA, 25 bp, Mus musculus
acttttcaaggcgagggtctcacac

SEQ ID NO: 137181 - DNA, 25 bp, Mus musculus
acttttcaagtaagggagactctgg

SEQ ID NO: 137182 - DNA, 25 bp, Mus musculus
acttttcaagtatgggagactctgg

SEQ ID NO: 137183 - DNA, 25 bp, Mus musculus
acttttcacagtaggcatatggcag

SEQ ID NO: 137184 - DNA, 25 bp, Mus musculus
acttttcacagttggcatatggcag

SEQ ID NO: 137185 - DNA, 25 bp, Mus musculus
acttttcacgcgatggaaatttctg

SEQ ID NO: 137186 - DNA, 25 bp, Mus musculus
acttttcacgcgttggaaatttctg

SEQ ID NO: 137187 - DNA, 25 bp, Mus musculus
acttttcacgttatggcagatgcta

SEQ ID NO: 137188 - DNA, 25 bp, Mus musculus
acttttcacgttttggcagatgcta

SEQ ID NO: 137189 - DNA, 25 bp, Mus musculus
acttttcagagtagagcgttcattc

SEQ ID NO: 137190 - DNA, 25 bp, Mus musculus
acttttcagagttgagcgttcattc

SEQ ID NO: 137191 - DNA, 25 bp, Mus musculus
acttttcaggtaccaaggccagaga

SEQ ID NO: 137192 - DNA, 25 bp, Mus musculus
acttttcaggtagcaaggccagaga

SEQ ID NO: 137193 - DNA, 25 bp, Mus musculus
acttttcagtgtcaacggcagtgga

SEQ ID NO: 137194 - DNA, 25 bp, Mus musculus
acttttcagtgtgaacggcagtgga

SEQ ID NO: 137195 - DNA, 25 bp, Mus musculus
acttttcagttaagagggtcctcat

SEQ ID NO: 137196 - DNA, 25 bp, Mus musculus
acttttcagttatgagggtcctcat

SEQ ID NO: 137197 - DNA, 25 bp, Mus musculus
acttttcagtttacagaggcattca

SEQ ID NO: 137198 - DNA, 25 bp, Mus musculus
acttttcagttttcagaggcattca

SEQ ID NO: 137199 - DNA, 25 bp, Mus musculus
acttttcattgcatctagactccag

SEQ ID NO: 137200 - DNA, 25 bp, Mus musculus
acttttcattgcttctagactccag

SEQ ID NO: 137201 - DNA, 25 bp, Mus musculus
acttttccagaacaatccggcgtga

SEQ ID NO: 137202 - DNA, 25 bp, Mus musculus
acttttccagaagaatccggcgtga

SEQ ID NO: 137203 - DNA, 25 bp, Mus musculus
acttttccatggctgctgccgagca

SEQ ID NO: 137204 - DNA, 25 bp, Mus musculus
acttttccatgggtgctgccgagca

SEQ ID NO: 137205 - DNA, 25 bp, Mus musculus
acttttccggagcagctgcgaacca

SEQ ID NO: 137206 - DNA, 25 bp, Mus musculus
acttttccggaggagctgcgaacca

SEQ ID NO: 137207 - DNA, 25 bp, Mus musculus
acttttcctcatattcacaccagtg

SEQ ID NO: 137208 - DNA, 25 bp, Mus musculus
acttttcctcattttcacaccagtg

SEQ ID NO: 137209 - DNA, 25 bp, Mus musculus
acttttcctcttaccttgaattgtg

SEQ ID NO: 137210 - DNA, 25 bp, Mus musculus
acttttcctctttccttgaattgtg

SEQ ID NO: 137211 - DNA, 25 bp, Mus musculus
acttttcctgaaaatccctgtgggt

SEQ ID NO: 137212 - DNA, 25 bp, Mus musculus
acttttcctgaatatccctgtgggt

SEQ ID NO: 137213 - DNA, 25 bp, Mus musculus
acttttcgtagtcagcttgttctta

SEQ ID NO: 137214 - DNA, 25 bp, Mus musculus
acttttcgtagtgagcttgttctta

SEQ ID NO: 137215 - DNA, 25 bp, Mus musculus
acttttctatgcctgtttactgtta

SEQ ID NO: 137216 - DNA, 25 bp, Mus musculus
acttttctatgcgtgtttactgtta

SEQ ID NO: 137217 - DNA, 25 bp, Mus musculus
acttttctcatgagactcaacacta

SEQ ID NO: 137218 - DNA, 25 bp, Mus musculus
acttttctcatgtgactcaacacta

SEQ ID NO: 137219 - DNA, 25 bp, Mus musculus
acttttctcgggaggatcattgcct

SEQ ID NO: 137220 - DNA, 25 bp, Mus musculus
acttttctcgggtggatcattgcct

SEQ ID NO: 137221 - DNA, 25 bp, Mus musculus
acttttctctagatgctgtctgcca

SEQ ID NO: 137222 - DNA, 25 bp, Mus musculus
acttttctctagttgctgtctgcca

SEQ ID NO: 137223 - DNA, 25 bp, Mus musculus
acttttctctggagctcatcgaacg

SEQ ID NO: 137224 - DNA, 25 bp, Mus musculus
acttttctctggtgctcatcgaacg

SEQ ID NO: 137225 - DNA, 25 bp, Mus musculus
acttttctggccatgtgtgctcttc

SEQ ID NO: 137226 - DNA, 25 bp, Mus musculus
acttttctggccttgtgtgctcttc

SEQ ID NO: 137227 - DNA, 25 bp, Mus musculus
acttttctgttaacaagatggtgcc

SEQ ID NO: 137228 - DNA, 25 bp, Mus musculus
acttttctgttatcaagatggtgcc

SEQ ID NO: 137229 - DNA, 25 bp, Mus musculus
acttttcttacaagcttcttctgat

SEQ ID NO: 137230 - DNA, 25 bp, Mus musculus
acttttcttacatgcttcttctgat

SEQ ID NO: 137231 - DNA, 25 bp, Mus musculus
acttttcttaggagagcgttgggct

SEQ ID NO: 137232 - DNA, 25 bp, Mus musculus
acttttcttaggtgagcgttgggct

SEQ ID NO: 137233 - DNA, 25 bp, Mus musculus
acttttcttcccagcaggcataatt

SEQ ID NO: 137234 - DNA, 25 bp, Mus musculus
acttttcttccctgcaggcataatt

SEQ ID NO: 137235 - DNA, 25 bp, Mus musculus
acttttcttggtcttggctacagcc

SEQ ID NO: 137236 - DNA, 25 bp, Mus musculus
acttttcttggtgttggctacagcc

SEQ ID NO: 137237 - DNA, 25 bp, Mus musculus
acttttctttccaatcacctactct

SEQ ID NO: 137238 - DNA, 25 bp, Mus musculus
acttttctttcctatcacctactct

SEQ ID NO: 137239 - DNA, 25 bp, Mus musculus
acttttgaaagaatagcctggaggc

SEQ ID NO: 137240 - DNA, 25 bp, Mus musculus
acttttgaaagattagcctggaggc

SEQ ID NO: 137241 - DNA, 25 bp, Mus musculus
acttttgacattccactatgtgcta

SEQ ID NO: 137242 - DNA, 25 bp, Mus musculus
acttttgacattgcactatgtgcta

SEQ ID NO: 137243 - DNA, 25 bp, Mus musculus
acttttgacttcactgaacagacag

SEQ ID NO: 137244 - DNA, 25 bp, Mus musculus
acttttgacttctctgaacagacag

SEQ ID NO: 137245 - DNA, 25 bp, Mus musculus
acttttgagaaaacgcctatccagc

SEQ ID NO: 137246 - DNA, 25 bp, Mus musculus
acttttgagaaaatgtacgtgaatg

SEQ ID NO: 137247 - DNA, 25 bp, Mus musculus
acttttgagaaatcgcctatccagc

SEQ ID NO: 137248 - DNA, 25 bp, Mus musculus
acttttgagaaattgtacgtgaatg

SEQ ID NO: 137249 - DNA, 25 bp, Mus musculus
acttttgagcagaagaaatcgggaa

SEQ ID NO: 137250 - DNA, 25 bp, Mus musculus
acttttgagcagtagaaatcgggaa

SEQ ID NO: 137251 - DNA, 25 bp, Mus musculus
acttttgatccaacatctgggaaaa

SEQ ID NO: 137252 - DNA, 25 bp, Mus musculus
acttttgatccatcatctgggaaaa

SEQ ID NO: 137253 - DNA, 25 bp, Mus musculus
acttttgatgcgaatgagacccact

SEQ ID NO: 137254 - DNA, 25 bp, Mus musculus
acttttgatgcgtatgagacccact

SEQ ID NO: 137255 - DNA, 25 bp, Mus musculus
acttttgatggaatggcggcgttaa

SEQ ID NO: 137256 - DNA, 25 bp, Mus musculus
acttttgatggattggcggcgttaa

SEQ ID NO: 137257 - DNA, 25 bp, Mus musculus
acttttgcacaaatgctcgggacac

SEQ ID NO: 137258 - DNA, 25 bp, Mus musculus
acttttgcacaattgctcgggacac

SEQ ID NO: 137259 - DNA, 25 bp, Mus musculus
acttttgcagacactcatgtggtgc

SEQ ID NO: 137260 - DNA, 25 bp, Mus musculus
acttttgcagactctcatgtggtgc

SEQ ID NO: 137261 - DNA, 25 bp, Mus musculus
acttttgcagatagggtaacacagg

SEQ ID NO: 137262 - DNA, 25 bp, Mus musculus
acttttgcagattgggtaacacagg

SEQ ID NO: 137263 - DNA, 25 bp, Mus musculus
acttttgcatgaccaccggagcgct

SEQ ID NO: 137264 - DNA, 25 bp, Mus musculus
acttttgcatgagcaccggagcgct

SEQ ID NO: 137265 - DNA, 25 bp, Mus musculus
acttttgccaagcagtgttgccaac

SEQ ID NO: 137266 - DNA, 25 bp, Mus musculus
acttttgccaaggagtgttgccaac

SEQ ID NO: 137267 - DNA, 25 bp, Mus musculus
acttttgcccttctaaactgtgtat

SEQ ID NO: 137268 - DNA, 25 bp, Mus musculus
acttttgcccttgtaaactgtgtat

SEQ ID NO: 137269 - DNA, 25 bp, Mus musculus
acttttgcgcacctcctagcaggtg

SEQ ID NO: 137270 - DNA, 25 bp, Mus musculus
acttttgcgcacgtcctagcaggtg

SEQ ID NO: 137271 - DNA, 25 bp, Mus musculus
acttttgcgcatatgtttacttgtg

SEQ ID NO: 137272 - DNA, 25 bp, Mus musculus
acttttgcgcatttgtttacttgtg

SEQ ID NO: 137273 - DNA, 25 bp, Mus musculus
acttttgctaagcatctgttcgctt

SEQ ID NO: 137274 - DNA, 25 bp, Mus musculus
acttttgctaaggatctgttcgctt

SEQ ID NO: 137275 - DNA, 25 bp, Mus musculus
acttttgctcagcttattgagtttc

SEQ ID NO: 137276 - DNA, 25 bp, Mus musculus
acttttgctcaggttattgagtttc

SEQ ID NO: 137277 - DNA, 25 bp, Mus musculus
acttttgctgctataactgttgtaa

SEQ ID NO: 137278 - DNA, 25 bp, Mus musculus
acttttgctgctttaactgttgtaa

SEQ ID NO: 137279 - DNA, 25 bp, Mus musculus
acttttgctgggaaattgggctcaa

SEQ ID NO: 137280 - DNA, 25 bp, Mus musculus
acttttgctgggtaattgggctcaa

SEQ ID NO: 137281 - DNA, 25 bp, Mus musculus
acttttgcttatctgcagcacggag

SEQ ID NO: 137282 - DNA, 25 bp, Mus musculus
acttttgcttatgtgcagcacggag

SEQ ID NO: 137283 - DNA, 25 bp, Mus musculus
acttttggacccagctataagctta

SEQ ID NO: 137284 - DNA, 25 bp, Mus musculus
acttttggaccctgctataagctta

SEQ ID NO: 137285 - DNA, 25 bp, Mus musculus
acttttggagctagactgtccacaa

SEQ ID NO: 137286 - DNA, 25 bp, Mus musculus
acttttggagcttgactgtccacaa

SEQ ID NO: 137287 - DNA, 25 bp, Mus musculus
acttttggcaaacagcaagtccagg

SEQ ID NO: 137288 - DNA, 25 bp, Mus musculus
acttttggcaaagagcaagtccagg

SEQ ID NO: 137289 - DNA, 25 bp, Mus musculus
acttttggcacaaaacttccctgaa

SEQ ID NO: 137290 - DNA, 25 bp, Mus musculus
acttttggcacataacttccctgaa

SEQ ID NO: 137291 - DNA, 25 bp, Mus musculus
acttttggcttaatgtacatggtct

SEQ ID NO: 137292 - DNA, 25 bp, Mus musculus
acttttggcttattgtacatggtct

SEQ ID NO: 137293 - DNA, 25 bp, Mus musculus
acttttggctttctgggagctgcac

SEQ ID NO: 137294 - DNA, 25 bp, Mus musculus
acttttggctttgtgggagctgcac

SEQ ID NO: 137295 - DNA, 25 bp, Mus musculus
acttttgggagcaggttctcctcca

SEQ ID NO: 137296 - DNA, 25 bp, Mus musculus
acttttgggagctggttctcctcca

SEQ ID NO: 137297 - DNA, 25 bp, Mus musculus
acttttggtcagctgttcagagcac

SEQ ID NO: 137298 - DNA, 25 bp, Mus musculus
acttttggtcaggtgttcagagcac

SEQ ID NO: 137299 - DNA, 25 bp, Mus musculus
acttttgtaatgaagcattgtgcac

SEQ ID NO: 137300 - DNA, 25 bp, Mus musculus
acttttgtaatgcagcacagctttc

SEQ ID NO: 137301 - DNA, 25 bp, Mus musculus
acttttgtaatggagcacagctttc

SEQ ID NO: 137302 - DNA, 25 bp, Mus musculus
acttttgtaatgtagcattgtgcac

SEQ ID NO: 137303 - DNA, 25 bp, Mus musculus
acttttgtactaattccatttcttg

SEQ ID NO: 137304 - DNA, 25 bp, Mus musculus
acttttgtactatttccatttcttg

SEQ ID NO: 137305 - DNA, 25 bp, Mus musculus
acttttgtacttatggagccatgcc

SEQ ID NO: 137306 - DNA, 25 bp, Mus musculus
acttttgtacttttggagccatgcc

SEQ ID NO: 137307 - DNA, 25 bp, Mus musculus
acttttgtaggactgtgtgtttctt

SEQ ID NO: 137308 - DNA, 25 bp, Mus musculus
acttttgtaggagtgtgtgtttctt

SEQ ID NO: 137309 - DNA, 25 bp, Mus musculus
acttttgtcccactggccctagact

SEQ ID NO: 137310 - DNA, 25 bp, Mus musculus
acttttgtcccagtggccctagact

SEQ ID NO: 137311 - DNA, 25 bp, Mus musculus
acttttgtcctcaatggtgtccagt

SEQ ID NO: 137312 - DNA, 25 bp, Mus musculus
acttttgtcctctatggtgtccagt

SEQ ID NO: 137313 - DNA, 25 bp, Mus musculus
acttttgtctcgaattagattgtaa

SEQ ID NO: 137314 - DNA, 25 bp, Mus musculus
acttttgtctcgtattagattgtaa

SEQ ID NO: 137315 - DNA, 25 bp, Mus musculus
acttttgtcttcaattcgtgtaaat

SEQ ID NO: 137316 - DNA, 25 bp, Mus musculus
acttttgtcttctattcgtgtaaat

SEQ ID NO: 137317 - DNA, 25 bp, Mus musculus
acttttgtgattcagttcagcttaa

SEQ ID NO: 137318 - DNA, 25 bp, Mus musculus
acttttgtgattgagttcagcttaa

SEQ ID NO: 137319 - DNA, 25 bp, Mus musculus
acttttgtgctccagaaaattttct

SEQ ID NO: 137320 - DNA, 25 bp, Mus musculus
acttttgtgctcgagaaaattttct

SEQ ID NO: 137321 - DNA, 25 bp, Mus musculus
acttttgtggaccaaccccataatg

SEQ ID NO: 137322 - DNA, 25 bp, Mus musculus
acttttgtggacgaaccccataatg

SEQ ID NO: 137323 - DNA, 25 bp, Mus musculus
acttttgtgtgtctccaggacccat

SEQ ID NO: 137324 - DNA, 25 bp, Mus musculus
acttttgtgtgtgtccaggacccat

SEQ ID NO: 137325 - DNA, 25 bp, Mus musculus
acttttgttcccacccagctaactg

SEQ ID NO: 137326 - DNA, 25 bp, Mus musculus
acttttgttccctcccagctaactg

SEQ ID NO: 137327 - DNA, 25 bp, Mus musculus
acttttgtttcaaaggttgtcctct

SEQ ID NO: 137328 - DNA, 25 bp, Mus musculus
acttttgtttcataggttgtcctct

SEQ ID NO: 137329 - DNA, 25 bp, Mus musculus
acttttgtttctaatcactggcttt

SEQ ID NO: 137330 - DNA, 25 bp, Mus musculus
acttttgtttcttatcactggcttt

SEQ ID NO: 137331 - DNA, 25 bp, Mus musculus
actttttaacctcacttggtgcctg

SEQ ID NO: 137332 - DNA, 25 bp, Mus musculus
actttttaacctgacttggtgcctg

SEQ ID NO: 137333 - DNA, 25 bp, Mus musculus
actttttacatgagctgctctgtca

SEQ ID NO: 137334 - DNA, 25 bp, Mus musculus
actttttacatgtgctgctctgtca

SEQ ID NO: 137335 - DNA, 25 bp, Mus musculus
actttttatactctgtctcgtctcg

SEQ ID NO: 137336 - DNA, 25 bp, Mus musculus
actttttatactgtgtctcgtctcg

SEQ ID NO: 137337 - DNA, 25 bp, Mus musculus
actttttatagccacacacttctgc

SEQ ID NO: 137338 - DNA, 25 bp, Mus musculus
actttttatagcgacacacttctgc

SEQ ID NO: 137339 - DNA, 25 bp, Mus musculus
actttttatatcaccatttcctgga

SEQ ID NO: 137340 - DNA, 25 bp, Mus musculus
actttttatatcagatgcccttgga

SEQ ID NO: 137341 - DNA, 25 bp, Mus musculus
actttttatatctccatttcctgga

SEQ ID NO: 137342 - DNA, 25 bp, Mus musculus
actttttatatctgatgcccttgga

SEQ ID NO: 137343 - DNA, 25 bp, Mus musculus
actttttatcatcgtaattttgaag

SEQ ID NO: 137344 - DNA, 25 bp, Mus musculus
actttttatcatggtaattttgaag

SEQ ID NO: 137345 - DNA, 25 bp, Mus musculus
actttttatcttactcttgaccact

SEQ ID NO: 137346 - DNA, 25 bp, Mus musculus
actttttatctttctcttgaccact

SEQ ID NO: 137347 - DNA, 25 bp, Mus musculus
actttttattgtcgtcatatcatta

SEQ ID NO: 137348 - DNA, 25 bp, Mus musculus
actttttattgtggtcatatcatta

SEQ ID NO: 137349 - DNA, 25 bp, Mus musculus
actttttatttcaggcatgcttggg

SEQ ID NO: 137350 - DNA, 25 bp, Mus musculus
actttttatttctggcatgcttggg

SEQ ID NO: 137351 - DNA, 25 bp, Mus musculus
actttttcagagactcctaggcgct

SEQ ID NO: 137352 - DNA, 25 bp, Mus musculus
actttttcagagtctcctaggcgct

SEQ ID NO: 137353 - DNA, 25 bp, Mus musculus
actttttcagtaccagcttggaatg

SEQ ID NO: 137354 - DNA, 25 bp, Mus musculus
actttttcagtagcagcttggaatg

SEQ ID NO: 137355 - DNA, 25 bp, Mus musculus
actttttccactagcctgtaagtct

SEQ ID NO: 137356 - DNA, 25 bp, Mus musculus
actttttccacttgcctgtaagtct

SEQ ID NO: 137357 - DNA, 25 bp, Mus musculus
actttttcctgcctgtggaccttgg

SEQ ID NO: 137358 - DNA, 25 bp, Mus musculus
actttttcctgcgtgtggaccttgg

SEQ ID NO: 137359 - DNA, 25 bp, Mus musculus
actttttccttgagcaccgtattga

SEQ ID NO: 137360 - DNA, 25 bp, Mus musculus
actttttccttgtgcaccgtattga

SEQ ID NO: 137361 - DNA, 25 bp, Mus musculus
actttttctcctcctacacttagct

SEQ ID NO: 137362 - DNA, 25 bp, Mus musculus
actttttctcctgctacacttagct

SEQ ID NO: 137363 - DNA, 25 bp, Mus musculus
actttttctgcacctgttcattttg

SEQ ID NO: 137364 - DNA, 25 bp, Mus musculus
actttttctgcagctgttcattttg

SEQ ID NO: 137365 - DNA, 25 bp, Mus musculus
actttttctgctagcactcactttg

SEQ ID NO: 137366 - DNA, 25 bp, Mus musculus
actttttctgcttgcactcactttg

SEQ ID NO: 137367 - DNA, 25 bp, Mus musculus
actttttctgtcctactgacactga

SEQ ID NO: 137368 - DNA, 25 bp, Mus musculus
actttttctgtcgtactgacactga

SEQ ID NO: 137369 - DNA, 25 bp, Mus musculus
actttttctgtgcttggccctctgg

SEQ ID NO: 137370 - DNA, 25 bp, Mus musculus
actttttctgtggttggccctctgg

SEQ ID NO: 137371 - DNA, 25 bp, Mus musculus
actttttcttaacatggtgctccaa

SEQ ID NO: 137372 - DNA, 25 bp, Mus musculus
actttttcttaagatggtgctccaa

SEQ ID NO: 137373 - DNA, 25 bp, Mus musculus
actttttgactaatccttttgcaga

SEQ ID NO: 137374 - DNA, 25 bp, Mus musculus
actttttgactattccttttgcaga

SEQ ID NO: 137375 - DNA, 25 bp, Mus musculus
actttttgaggaagcctgccagcac

SEQ ID NO: 137376 - DNA, 25 bp, Mus musculus
actttttgaggatgcctgccagcac

SEQ ID NO: 137377 - DNA, 25 bp, Mus musculus
actttttgcaaaccagcattagcgc

SEQ ID NO: 137378 - DNA, 25 bp, Mus musculus
actttttgcaaagcagcattagcgc

SEQ ID NO: 137379 - DNA, 25 bp, Mus musculus
actttttgcacaagtatgcccatat

SEQ ID NO: 137380 - DNA, 25 bp, Mus musculus
actttttgcacatgtatgcccatat

SEQ ID NO: 137381 - DNA, 25 bp, Mus musculus
actttttgcccacgcatatcatgta

SEQ ID NO: 137382 - DNA, 25 bp, Mus musculus
actttttgcccaggcatatcatgta

SEQ ID NO: 137383 - DNA, 25 bp, Mus musculus
actttttggcatcgcttggttacct

SEQ ID NO: 137384 - DNA, 25 bp, Mus musculus
actttttggcatggcttggttacct

SEQ ID NO: 137385 - DNA, 25 bp, Mus musculus
actttttgtaacctcactatgccga

SEQ ID NO: 137386 - DNA, 25 bp, Mus musculus
actttttgtaacgtcactatgccga

SEQ ID NO: 137387 - DNA, 25 bp, Mus musculus
actttttgtattaggcatttgcatc

SEQ ID NO: 137388 - DNA, 25 bp, Mus musculus
actttttgtatttggcatttgcatc

SEQ ID NO: 137389 - DNA, 25 bp, Mus musculus
actttttgtcttatctgagcttcga

SEQ ID NO: 137390 - DNA, 25 bp, Mus musculus
actttttgtcttttctgagcttcga

SEQ ID NO: 137391 - DNA, 25 bp, Mus musculus
actttttgtggtcttgatggaactc

SEQ ID NO: 137392 - DNA, 25 bp, Mus musculus
actttttgtggtgttgatggaactc

SEQ ID NO: 137393 - DNA, 25 bp, Mus musculus
actttttgtttgatgccttattcag

SEQ ID NO: 137394 - DNA, 25 bp, Mus musculus
actttttgtttgttgccttattcag

SEQ ID NO: 137395 - DNA, 25 bp, Mus musculus
acttttttaaggcatggaagctgat

SEQ ID NO: 137396 - DNA, 25 bp, Mus musculus
acttttttaagggatggaagctgat

SEQ ID NO: 137397 - DNA, 25 bp, Mus musculus
acttttttactgatggacatcctgg

SEQ ID NO: 137398 - DNA, 25 bp, Mus musculus
acttttttactgttggacatcctgg

SEQ ID NO: 137399 - DNA, 25 bp, Mus musculus
acttttttagggacacatcacgata

SEQ ID NO: 137400 - DNA, 25 bp, Mus musculus
acttttttagggtcacatcacgata

SEQ ID NO: 137401 - DNA, 25 bp, Mus musculus
acttttttctgtagcttgatactta

SEQ ID NO: 137402 - DNA, 25 bp, Mus musculus
acttttttctgttgcttgatactta

SEQ ID NO: 137403 - DNA, 25 bp, Mus musculus
acttttttgactcctgtggttctgc

SEQ ID NO: 137404 - DNA, 25 bp, Mus musculus
acttttttgactgctgtggttctgc

SEQ ID NO: 137405 - DNA, 25 bp, Mus musculus
acttttttgtacctagctgttacat

SEQ ID NO: 137406 - DNA, 25 bp, Mus musculus
acttttttgtacgtagctgttacat

SEQ ID NO: 137407 - DNA, 25 bp, Mus musculus
acttttttgtttctgctggaggcct

SEQ ID NO: 137408 - DNA, 25 bp, Mus musculus
acttttttgtttgtgctggaggcct

SEQ ID NO: 137409 - DNA, 25 bp, Mus musculus
agaaaaaacaacaccctctccacag

SEQ ID NO: 137410 - DNA, 25 bp, Mus musculus
agaaaaaacaactccctctccacag

SEQ ID NO: 137411 - DNA, 25 bp, Mus musculus
agaaaaaacactatgccacctgctt

SEQ ID NO: 137412 - DNA, 25 bp, Mus musculus
agaaaaaacactttgccacctgctt

SEQ ID NO: 137413 - DNA, 25 bp, Mus musculus
agaaaaacacccagctcattcctgt

SEQ ID NO: 137414 - DNA, 25 bp, Mus musculus
agaaaaacaccctgctcattcctgt

SEQ ID NO: 137415 - DNA, 25 bp, Mus musculus
agaaaaacagttctcctgctccaga

SEQ ID NO: 137416 - DNA, 25 bp, Mus musculus
agaaaaacagttgtcctgctccaga

SEQ ID NO: 137417 - DNA, 25 bp, Mus musculus
agaaaaaccgcacgctcttgtcact

SEQ ID NO: 137418 - DNA, 25 bp, Mus musculus
agaaaaaccgcaggctcttgtcact

SEQ ID NO: 137419 - DNA, 25 bp, Mus musculus
agaaaaacgggcagctggccgccat

SEQ ID NO: 137420 - DNA, 25 bp, Mus musculus
agaaaaacgggctgctggccgccat

SEQ ID NO: 137421 - DNA, 25 bp, Mus musculus
agaaaaacgtgacgctgtctgtgga

SEQ ID NO: 137422 - DNA, 25 bp, Mus musculus
agaaaaacgtgaggctgtctgtgga

SEQ ID NO: 137423 - DNA, 25 bp, Mus musculus
agaaaaactgatactggccagctca

SEQ ID NO: 137424 - DNA, 25 bp, Mus musculus
agaaaaactgattctggccagctca

SEQ ID NO: 137425 - DNA, 25 bp, Mus musculus
agaaaaagaattcgtcggaagatgt

SEQ ID NO: 137426 - DNA, 25 bp, Mus musculus
agaaaaagaattggtcggaagatgt

SEQ ID NO: 137427 - DNA, 25 bp, Mus musculus
agaaaaagagctcggccgctgagat

SEQ ID NO: 137428 - DNA, 25 bp, Mus musculus
agaaaaagagctgggccgctgagat

SEQ ID NO: 137429 - DNA, 25 bp, Mus musculus
agaaaaagataaccccggtgctcag

SEQ ID NO: 137430 - DNA, 25 bp, Mus musculus
agaaaaagataagcccggtgctcag

SEQ ID NO: 137431 - DNA, 25 bp, Mus musculus
agaaaaagatagacactaccttaga

SEQ ID NO: 137432 - DNA, 25 bp, Mus musculus
agaaaaagatagtcactaccttaga

SEQ ID NO: 137433 - DNA, 25 bp, Mus musculus
agaaaaagcacaccctgtccaggtt

SEQ ID NO: 137434 - DNA, 25 bp, Mus musculus
agaaaaagcacagcctgtccaggtt

SEQ ID NO: 137435 - DNA, 25 bp, Mus musculus
agaaaaagccataatctccctctcc

SEQ ID NO: 137436 - DNA, 25 bp, Mus musculus
agaaaaagccattatctccctctcc

SEQ ID NO: 137437 - DNA, 25 bp, Mus musculus
agaaaaaggcttattgagggagctg

SEQ ID NO: 137438 - DNA, 25 bp, Mus musculus
agaaaaaggctttttgagggagctg

SEQ ID NO: 137439 - DNA, 25 bp, Mus musculus
agaaaaagttccaatcagactggcc

SEQ ID NO: 137440 - DNA, 25 bp, Mus musculus
agaaaaagttcctatcagactggcc

SEQ ID NO: 137441 - DNA, 25 bp, Mus musculus
agaaaaatacctcccattgttgtta

SEQ ID NO: 137442 - DNA, 25 bp, Mus musculus
agaaaaatacctgccattgttgtta

SEQ ID NO: 137443 - DNA, 25 bp, Mus musculus
agaaaaatcaacaccctcgatcaac

SEQ ID NO: 137444 - DNA, 25 bp, Mus musculus
agaaaaatcaactccctcgatcaac

SEQ ID NO: 137445 - DNA, 25 bp, Mus musculus
agaaaaatccatagcacacttaaag

SEQ ID NO: 137446 - DNA, 25 bp, Mus musculus
agaaaaatccattgcacacttaaag

SEQ ID NO: 137447 - DNA, 25 bp, Mus musculus
agaaaaatctcccacaggctacttg

SEQ ID NO: 137448 - DNA, 25 bp, Mus musculus
agaaaaatctccgacaggctacttg

SEQ ID NO: 137449 - DNA, 25 bp, Mus musculus
agaaaaatggctccctcatctgttg

SEQ ID NO: 137450 - DNA, 25 bp, Mus musculus
agaaaaatggctgcctcatctgttg

SEQ ID NO: 137451 - DNA, 25 bp, Mus musculus
agaaaaatgtcacccactctcctga

SEQ ID NO: 137452 - DNA, 25 bp, Mus musculus
agaaaaatgtcagccactctcctga

SEQ ID NO: 137453 - DNA, 25 bp, Mus musculus
agaaaaatgtctcctccagctcaac

SEQ ID NO: 137454 - DNA, 25 bp, Mus musculus
agaaaaatgtctgctccagctcaac

SEQ ID NO: 137455 - DNA, 25 bp, Mus musculus
agaaaaattactagcctgaggacag

SEQ ID NO: 137456 - DNA, 25 bp, Mus musculus
agaaaaattacttgcctgaggacag

SEQ ID NO: 137457 - DNA, 25 bp, Mus musculus
agaaaacaacttattaccttctgca

SEQ ID NO: 137458 - DNA, 25 bp, Mus musculus
agaaaacaactttttaccttctgca

SEQ ID NO: 137459 - DNA, 25 bp, Mus musculus
agaaaacacccacagctcatcgatg

SEQ ID NO: 137460 - DNA, 25 bp, Mus musculus
agaaaacacccagagctcatcgatg

SEQ ID NO: 137461 - DNA, 25 bp, Mus musculus
agaaaacaccttcatcctgtcatag

SEQ ID NO: 137462 - DNA, 25 bp, Mus musculus
agaaaacaccttgatcctgtcatag

SEQ ID NO: 137463 - DNA, 25 bp, Mus musculus
agaaaacacgagcttccttcctcct

SEQ ID NO: 137464 - DNA, 25 bp, Mus musculus
agaaaacacgaggttccttcctcct

SEQ ID NO: 137465 - DNA, 25 bp, Mus musculus
agaaaacactcaattctgggctgga

SEQ ID NO: 137466 - DNA, 25 bp, Mus musculus
agaaaacactcatttctgggctgga

SEQ ID NO: 137467 - DNA, 25 bp, Mus musculus
agaaaacactgccacagcggcggac

SEQ ID NO: 137468 - DNA, 25 bp, Mus musculus
agaaaacactgcgacagcggcggac

SEQ ID NO: 137469 - DNA, 25 bp, Mus musculus
agaaaacagaccactagctccttat

SEQ ID NO: 137470 - DNA, 25 bp, Mus musculus
agaaaacagacctctagctccttat

SEQ ID NO: 137471 - DNA, 25 bp, Mus musculus
agaaaacagactcctgctcgttcag

SEQ ID NO: 137472 - DNA, 25 bp, Mus musculus
agaaaacagactgctgctcgttcag

SEQ ID NO: 137473 - DNA, 25 bp, Mus musculus
agaaaacagagtactccccatgcca

SEQ ID NO: 137474 - DNA, 25 bp, Mus musculus
agaaaacagagttctccccatgcca

SEQ ID NO: 137475 - DNA, 25 bp, Mus musculus
agaaaacaggccacgacttgtcact

SEQ ID NO: 137476 - DNA, 25 bp, Mus musculus
agaaaacaggcctcgacttgtcact

SEQ ID NO: 137477 - DNA, 25 bp, Mus musculus
agaaaacatcccatgcattgcatta

SEQ ID NO: 137478 - DNA, 25 bp, Mus musculus
agaaaacatcccttgcattgcatta

SEQ ID NO: 137479 - DNA, 25 bp, Mus musculus
agaaaacatgtacgccatccaccca

SEQ ID NO: 137480 - DNA, 25 bp, Mus musculus
agaaaacatgtaggccatccaccca

SEQ ID NO: 137481 - DNA, 25 bp, Mus musculus
agaaaacatgtcaacttgtcttgca

SEQ ID NO: 137482 - DNA, 25 bp, Mus musculus
agaaaacatgtctacttgtcttgca

SEQ ID NO: 137483 - DNA, 25 bp, Mus musculus
agaaaaccaaaccagcagctcattt

SEQ ID NO: 137484 - DNA, 25 bp, Mus musculus
agaaaaccaaacgagcagctcattt

SEQ ID NO: 137485 - DNA, 25 bp, Mus musculus
agaaaaccagtgctcgcacctctta

SEQ ID NO: 137486 - DNA, 25 bp, Mus musculus
agaaaaccagtggtcgcacctctta

SEQ ID NO: 137487 - DNA, 25 bp, Mus musculus
agaaaaccatgcagttctccgggat

SEQ ID NO: 137488 - DNA, 25 bp, Mus musculus
agaaaaccatgctgttctccgggat

SEQ ID NO: 137489 - DNA, 25 bp, Mus musculus
agaaaacccgctatatcttcgacct

SEQ ID NO: 137490 - DNA, 25 bp, Mus musculus
agaaaacccgctttatcttcgacct

SEQ ID NO: 137491 - DNA, 25 bp, Mus musculus
agaaaacccttgagccttacctgtg

SEQ ID NO: 137492 - DNA, 25 bp, Mus musculus
agaaaacccttgtgccttacctgtg

SEQ ID NO: 137493 - DNA, 25 bp, Mus musculus
agaaaaccgatcattcagaggtctt

SEQ ID NO: 137494 - DNA, 25 bp, Mus musculus
agaaaaccgatctttcagaggtctt

SEQ ID NO: 137495 - DNA, 25 bp, Mus musculus
agaaaacctctacggaactgtgaat

SEQ ID NO: 137496 - DNA, 25 bp, Mus musculus
agaaaacctctagggaactgtgaat

SEQ ID NO: 137497 - DNA, 25 bp, Mus musculus
agaaaacctgtaattgattcgacat

SEQ ID NO: 137498 - DNA, 25 bp, Mus musculus
agaaaacctgtatttgattcgacat

SEQ ID NO: 137499 - DNA, 25 bp, Mus musculus
agaaaacgagaaccctccaggctgg

SEQ ID NO: 137500 - DNA, 25 bp, Mus musculus
agaaaacgagaagcctccaggctgg

SEQ ID NO: 137501 - DNA, 25 bp, Mus musculus
agaaaacgccagcagattgccctgt

SEQ ID NO: 137502 - DNA, 25 bp, Mus musculus
agaaaacgccaggagattgccctgt

SEQ ID NO: 137503 - DNA, 25 bp, Mus musculus
agaaaacggtgccattttactgatg

SEQ ID NO: 137504 - DNA, 25 bp, Mus musculus
agaaaacggtgcgattttactgatg

SEQ ID NO: 137505 - DNA, 25 bp, Mus musculus
agaaaacgtgtgcttgctgtctcct

SEQ ID NO: 137506 - DNA, 25 bp, Mus musculus
agaaaacgtgtggttgctgtctcct

SEQ ID NO: 137507 - DNA, 25 bp, Mus musculus
agaaaactactcactgtgcttccgt

SEQ ID NO: 137508 - DNA, 25 bp, Mus musculus
agaaaactactctctgtgcttccgt

SEQ ID NO: 137509 - DNA, 25 bp, Mus musculus
agaaaactatgtacagcatactgta

SEQ ID NO: 137510 - DNA, 25 bp, Mus musculus
agaaaactatgttcagcatactgta

SEQ ID NO: 137511 - DNA, 25 bp, Mus musculus
agaaaactatttcctcttcagccag

SEQ ID NO: 137512 - DNA, 25 bp, Mus musculus
agaaaactatttgctcttcagccag

SEQ ID NO: 137513 - DNA, 25 bp, Mus musculus
agaaaactcaagattccagcccaca

SEQ ID NO: 137514 - DNA, 25 bp, Mus musculus
agaaaactcaagtttccagcccaca

SEQ ID NO: 137515 - DNA, 25 bp, Mus musculus
agaaaactcaggagaagtgccgcaa

SEQ ID NO: 137516 - DNA, 25 bp, Mus musculus
agaaaactcaggtgaagtgccgcaa

SEQ ID NO: 137517 - DNA, 25 bp, Mus musculus
agaaaactcccaccagcactttaga

SEQ ID NO: 137518 - DNA, 25 bp, Mus musculus
agaaaactcccagcagcactttaga

SEQ ID NO: 137519 - DNA, 25 bp, Mus musculus
agaaaactcggacgacttctagcga

SEQ ID NO: 137520 - DNA, 25 bp, Mus musculus
agaaaactcggaggacttctagcga

SEQ ID NO: 137521 - DNA, 25 bp, Mus musculus
agaaaactctaccatggcttgaagt

SEQ ID NO: 137522 - DNA, 25 bp, Mus musculus
agaaaactctacgatggcttgaagt

SEQ ID NO: 137523 - DNA, 25 bp, Mus musculus
agaaaactctataacctactgcaag

SEQ ID NO: 137524 - DNA, 25 bp, Mus musculus
agaaaactctattacctactgcaag

SEQ ID NO: 137525 - DNA, 25 bp, Mus musculus
agaaaactgtctcccatatgccatt

SEQ ID NO: 137526 - DNA, 25 bp, Mus musculus
agaaaactgtctcttctagtcctct

SEQ ID NO: 137527 - DNA, 25 bp, Mus musculus
agaaaactgtctgccatatgccatt

SEQ ID NO: 137528 - DNA, 25 bp, Mus musculus
agaaaactgtctgttctagtcctct

SEQ ID NO: 137529 - DNA, 25 bp, Mus musculus
agaaaactgtttagccttaggctgg

SEQ ID NO: 137530 - DNA, 25 bp, Mus musculus
agaaaactgttttgccttaggctgg

SEQ ID NO: 137531 - DNA, 25 bp, Mus musculus
agaaaacttaccatagaatgcattt

SEQ ID NO: 137532 - DNA, 25 bp, Mus musculus
agaaaacttaccttagaatgcattt

SEQ ID NO: 137533 - DNA, 25 bp, Mus musculus
agaaaacttatcatccggagacggc

SEQ ID NO: 137534 - DNA, 25 bp, Mus musculus
agaaaacttatcttccggagacggc

SEQ ID NO: 137535 - DNA, 25 bp, Mus musculus
agaaaacttcacaagcaggcttcca

SEQ ID NO: 137536 - DNA, 25 bp, Mus musculus
agaaaacttcactagcaggcttcca

SEQ ID NO: 137537 - DNA, 25 bp, Mus musculus
agaaaacttctccacatcctagaaa

SEQ ID NO: 137538 - DNA, 25 bp, Mus musculus
agaaaacttctcgacatcctagaaa

SEQ ID NO: 137539 - DNA, 25 bp, Mus musculus
agaaaactttagacctgtgacattt

SEQ ID NO: 137540 - DNA, 25 bp, Mus musculus
agaaaactttagtcctgtgacattt

SEQ ID NO: 137541 - DNA, 25 bp, Mus musculus
agaaaactttgacccacagcctgtc

SEQ ID NO: 137542 - DNA, 25 bp, Mus musculus
agaaaactttgagccacagcctgtc

SEQ ID NO: 137543 - DNA, 25 bp, Mus musculus
agaaaactttgcatgccaaactcac

SEQ ID NO: 137544 - DNA, 25 bp, Mus musculus
agaaaactttgcttgccaaactcac

SEQ ID NO: 137545 - DNA, 25 bp, Mus musculus
agaaaacttttccagtttgtgctgc

SEQ ID NO: 137546 - DNA, 25 bp, Mus musculus
agaaaacttttcgagtttgtgctgc

SEQ ID NO: 137547 - DNA, 25 bp, Mus musculus
agaaaagaaagcagcccctatactg

SEQ ID NO: 137548 - DNA, 25 bp, Mus musculus
agaaaagaaagcatcctgggcttcc

SEQ ID NO: 137549 - DNA, 25 bp, Mus musculus
agaaaagaaagctgcccctatactg

SEQ ID NO: 137550 - DNA, 25 bp, Mus musculus
agaaaagaaagcttcctgggcttcc

SEQ ID NO: 137551 - DNA, 25 bp, Mus musculus
agaaaagaagtgcactgaagcccag

SEQ ID NO: 137552 - DNA, 25 bp, Mus musculus
agaaaagaagtggactgaagcccag

SEQ ID NO: 137553 - DNA, 25 bp, Mus musculus
agaaaagactccaactctctcggat

SEQ ID NO: 137554 - DNA, 25 bp, Mus musculus
agaaaagactcctactctctcggat

SEQ ID NO: 137555 - DNA, 25 bp, Mus musculus
agaaaagacttgactccaattgaat

SEQ ID NO: 137556 - DNA, 25 bp, Mus musculus
agaaaagacttgtctccaattgaat

SEQ ID NO: 137557 - DNA, 25 bp, Mus musculus
agaaaagaggctccatctcacactg

SEQ ID NO: 137558 - DNA, 25 bp, Mus musculus
agaaaagaggctgcatctcacactg

SEQ ID NO: 137559 - DNA, 25 bp, Mus musculus
agaaaagatcacacagagctccctg

SEQ ID NO: 137560 - DNA, 25 bp, Mus musculus
agaaaagatcaccaacagccggcct

SEQ ID NO: 137561 - DNA, 25 bp, Mus musculus
agaaaagatcacgaacagccggcct

SEQ ID NO: 137562 - DNA, 25 bp, Mus musculus
agaaaagatcactcagagctccctg

SEQ ID NO: 137563 - DNA, 25 bp, Mus musculus
agaaaagatcccctccgagccctgt

SEQ ID NO: 137564 - DNA, 25 bp, Mus musculus
agaaaagatcccgtccgagccctgt

SEQ ID NO: 137565 - DNA, 25 bp, Mus musculus
agaaaagatcctaccagaacctgac

SEQ ID NO: 137566 - DNA, 25 bp, Mus musculus
agaaaagatccttccagaacctgac

SEQ ID NO: 137567 - DNA, 25 bp, Mus musculus
agaaaagatgtcacccagggaccac

SEQ ID NO: 137568 - DNA, 25 bp, Mus musculus
agaaaagatgtctcccagggaccac

SEQ ID NO: 137569 - DNA, 25 bp, Mus musculus
agaaaagattggacgatccttggta

SEQ ID NO: 137570 - DNA, 25 bp, Mus musculus
agaaaagattggtcgatccttggta

SEQ ID NO: 137571 - DNA, 25 bp, Mus musculus
agaaaagcacctatggatcccactc

SEQ ID NO: 137572 - DNA, 25 bp, Mus musculus
agaaaagcacctttggatcccactc

SEQ ID NO: 137573 - DNA, 25 bp, Mus musculus
agaaaagcactgcttccctcatgtg

SEQ ID NO: 137574 - DNA, 25 bp, Mus musculus
agaaaagcactggttccctcatgtg

SEQ ID NO: 137575 - DNA, 25 bp, Mus musculus
agaaaagcagatccgttagtatgtt

SEQ ID NO: 137576 - DNA, 25 bp, Mus musculus
agaaaagcagatgcgttagtatgtt

SEQ ID NO: 137577 - DNA, 25 bp, Mus musculus
agaaaagcagttccccgtagatagg

SEQ ID NO: 137578 - DNA, 25 bp, Mus musculus
agaaaagcagttgcccgtagatagg

SEQ ID NO: 137579 - DNA, 25 bp, Mus musculus
agaaaagccaagctctagaatgtct

SEQ ID NO: 137580 - DNA, 25 bp, Mus musculus
agaaaagccaaggtctagaatgtct

SEQ ID NO: 137581 - DNA, 25 bp, Mus musculus
agaaaagccacactcattacatgaa

SEQ ID NO: 137582 - DNA, 25 bp, Mus musculus
agaaaagccacagtcattacatgaa

SEQ ID NO: 137583 - DNA, 25 bp, Mus musculus
agaaaagccagaccctgaacggtcc

SEQ ID NO: 137584 - DNA, 25 bp, Mus musculus
agaaaagccagagcctgaacggtcc

SEQ ID NO: 137585 - DNA, 25 bp, Mus musculus
agaaaagcccctaccatctatcatg

SEQ ID NO: 137586 - DNA, 25 bp, Mus musculus
agaaaagccccttccatctatcatg

SEQ ID NO: 137587 - DNA, 25 bp, Mus musculus
agaaaagccctcacctagaacacag

SEQ ID NO: 137588 - DNA, 25 bp, Mus musculus
agaaaagccctctcctagaacacag

SEQ ID NO: 137589 - DNA, 25 bp, Mus musculus
agaaaagccctgattccagcagcgc

SEQ ID NO: 137590 - DNA, 25 bp, Mus musculus
agaaaagccctgctcttagccgtgg

SEQ ID NO: 137591 - DNA, 25 bp, Mus musculus
agaaaagccctggtcttagccgtgg

SEQ ID NO: 137592 - DNA, 25 bp, Mus musculus
agaaaagccctgtttccagcagcgc

SEQ ID NO: 137593 - DNA, 25 bp, Mus musculus
agaaaagccgaccatgaagacagat

SEQ ID NO: 137594 - DNA, 25 bp, Mus musculus
agaaaagccgacgatgaagacagat

SEQ ID NO: 137595 - DNA, 25 bp, Mus musculus
agaaaagccgtacaagtatactgta

SEQ ID NO: 137596 - DNA, 25 bp, Mus musculus
agaaaagccgtagaagtatactgta

SEQ ID NO: 137597 - DNA, 25 bp, Mus musculus
agaaaagcctgcagattttgtacag

SEQ ID NO: 137598 - DNA, 25 bp, Mus musculus
agaaaagcctgctgattttgtacag

SEQ ID NO: 137599 - DNA, 25 bp, Mus musculus
agaaaagcctgtcccagtggatcag

SEQ ID NO: 137600 - DNA, 25 bp, Mus musculus
agaaaagcctgtgccagtggatcag

SEQ ID NO: 137601 - DNA, 25 bp, Mus musculus
agaaaagccttcatggcacctgtgc

SEQ ID NO: 137602 - DNA, 25 bp, Mus musculus
agaaaagccttcctacgacacggag

SEQ ID NO: 137603 - DNA, 25 bp, Mus musculus
agaaaagccttcgtacgacacggag

SEQ ID NO: 137604 - DNA, 25 bp, Mus musculus
agaaaagccttcttggcacctgtgc

SEQ ID NO: 137605 - DNA, 25 bp, Mus musculus
agaaaagcgataccaggccacctca

SEQ ID NO: 137606 - DNA, 25 bp, Mus musculus
agaaaagcgatagcaggccacctca

SEQ ID NO: 137607 - DNA, 25 bp, Mus musculus
agaaaagcgccccacatttcagcaa

SEQ ID NO: 137608 - DNA, 25 bp, Mus musculus
agaaaagcgcccgacatttcagcaa

SEQ ID NO: 137609 - DNA, 25 bp, Mus musculus
agaaaagctcagaacgatcctggag

SEQ ID NO: 137610 - DNA, 25 bp, Mus musculus
agaaaagctcagtacgatcctggag

SEQ ID NO: 137611 - DNA, 25 bp, Mus musculus
agaaaagctgcactacattcgtagt

SEQ ID NO: 137612 - DNA, 25 bp, Mus musculus
agaaaagctgcagtacattcgtagt

SEQ ID NO: 137613 - DNA, 25 bp, Mus musculus
agaaaagctgtgatcatgcccctag

SEQ ID NO: 137614 - DNA, 25 bp, Mus musculus
agaaaagctgtgttcatgcccctag

SEQ ID NO: 137615 - DNA, 25 bp, Mus musculus
agaaaagctgttaggctttccctgt

SEQ ID NO: 137616 - DNA, 25 bp, Mus musculus
agaaaagctgtttggctttccctgt

SEQ ID NO: 137617 - DNA, 25 bp, Mus musculus
agaaaaggaaccaggcttctggcct

SEQ ID NO: 137618 - DNA, 25 bp, Mus musculus
agaaaaggaacctggcttctggcct

SEQ ID NO: 137619 - DNA, 25 bp, Mus musculus
agaaaaggaggcatgcccttcaccc

SEQ ID NO: 137620 - DNA, 25 bp, Mus musculus
agaaaaggaggcttgcccttcaccc

SEQ ID NO: 137621 - DNA, 25 bp, Mus musculus
agaaaaggcagcaccggtgtcggca

SEQ ID NO: 137622 - DNA, 25 bp, Mus musculus
agaaaaggcagctccggtgtcggca

SEQ ID NO: 137623 - DNA, 25 bp, Mus musculus
agaaaaggcccccagacttgtatgg

SEQ ID NO: 137624 - DNA, 25 bp, Mus musculus
agaaaaggccccgagacttgtatgg

SEQ ID NO: 137625 - DNA, 25 bp, Mus musculus
agaaaaggccgaacgccagcgtaca

SEQ ID NO: 137626 - DNA, 25 bp, Mus musculus
agaaaaggccgatcgccagcgtaca

SEQ ID NO: 137627 - DNA, 25 bp, Mus musculus
agaaaaggcctaaagtcgggcttga

SEQ ID NO: 137628 - DNA, 25 bp, Mus musculus
agaaaaggcctatagtcgggcttga

SEQ ID NO: 137629 - DNA, 25 bp, Mus musculus
agaaaaggcctcaaaccagtgctag

SEQ ID NO: 137630 - DNA, 25 bp, Mus musculus
agaaaaggcctctaaccagtgctag

SEQ ID NO: 137631 - DNA, 25 bp, Mus musculus
agaaaaggctttcccgcacttattg

SEQ ID NO: 137632 - DNA, 25 bp, Mus musculus
agaaaaggctttgccgcacttattg

SEQ ID NO: 137633 - DNA, 25 bp, Mus musculus
agaaaagggcctacagtcctcacag

SEQ ID NO: 137634 - DNA, 25 bp, Mus musculus
agaaaagggccttcagtcctcacag

SEQ ID NO: 137635 - DNA, 25 bp, Mus musculus
agaaaagggcgtcatcttcgtcatc

SEQ ID NO: 137636 - DNA, 25 bp, Mus musculus
agaaaagggcgtgatcttcgtcatc

SEQ ID NO: 137637 - DNA, 25 bp, Mus musculus
agaaaagtatcacgtgccacctggg

SEQ ID NO: 137638 - DNA, 25 bp, Mus musculus
agaaaagtatcaggtgccacctggg

SEQ ID NO: 137639 - DNA, 25 bp, Mus musculus
agaaaagtattcagtctaccaaggg

SEQ ID NO: 137640 - DNA, 25 bp, Mus musculus
agaaaagtattctgtctaccaaggg

SEQ ID NO: 137641 - DNA, 25 bp, Mus musculus
agaaaagtccatagtcctttccact

SEQ ID NO: 137642 - DNA, 25 bp, Mus musculus
agaaaagtccatcataagcgagtat

SEQ ID NO: 137643 - DNA, 25 bp, Mus musculus
agaaaagtccatgataagcgagtat

SEQ ID NO: 137644 - DNA, 25 bp, Mus musculus
agaaaagtccattgtcctttccact

SEQ ID NO: 137645 - DNA, 25 bp, Mus musculus
agaaaagtcctcattatggtgcccc

SEQ ID NO: 137646 - DNA, 25 bp, Mus musculus
agaaaagtcctccagattcttacga

SEQ ID NO: 137647 - DNA, 25 bp, Mus musculus
agaaaagtcctcgagattcttacga

SEQ ID NO: 137648 - DNA, 25 bp, Mus musculus
agaaaagtcctctttatggtgcccc

SEQ ID NO: 137649 - DNA, 25 bp, Mus musculus
agaaaagtcgagctcccggagcaga

SEQ ID NO: 137650 - DNA, 25 bp, Mus musculus
agaaaagtcgaggtcccggagcaga

SEQ ID NO: 137651 - DNA, 25 bp, Mus musculus
agaaaagtgattctcttgctgtggg

SEQ ID NO: 137652 - DNA, 25 bp, Mus musculus
agaaaagtgattgtcttgctgtggg

SEQ ID NO: 137653 - DNA, 25 bp, Mus musculus
agaaaagtgcctacttgtcccctgg

SEQ ID NO: 137654 - DNA, 25 bp, Mus musculus
agaaaagtgccttcttgtcccctgg

SEQ ID NO: 137655 - DNA, 25 bp, Mus musculus
agaaaagttaacaaggttgctgcag

SEQ ID NO: 137656 - DNA, 25 bp, Mus musculus
agaaaagttaactaggttgctgcag

SEQ ID NO: 137657 - DNA, 25 bp, Mus musculus
agaaaagttaccagtcattcaacct

SEQ ID NO: 137658 - DNA, 25 bp, Mus musculus
agaaaagttaccctaatgttgcttg

SEQ ID NO: 137659 - DNA, 25 bp, Mus musculus
agaaaagttaccgtaatgttgcttg

SEQ ID NO: 137660 - DNA, 25 bp, Mus musculus
agaaaagttacctgtcattcaacct

SEQ ID NO: 137661 - DNA, 25 bp, Mus musculus
agaaaagttcatcttcctccgtgga

SEQ ID NO: 137662 - DNA, 25 bp, Mus musculus
agaaaagttcatgttcctccgtgga

SEQ ID NO: 137663 - DNA, 25 bp, Mus musculus
agaaaagttgctctttcctgcctgc

SEQ ID NO: 137664 - DNA, 25 bp, Mus musculus
agaaaagttgctgtttcctgcctgc

SEQ ID NO: 137665 - DNA, 25 bp, Mus musculus
agaaaagttggtctgtcccgcgctg

SEQ ID NO: 137666 - DNA, 25 bp, Mus musculus
agaaaagttggtgtgtcccgcgctg

SEQ ID NO: 137667 - DNA, 25 bp, Mus musculus
agaaaataatcacatccgggaggga

SEQ ID NO: 137668 - DNA, 25 bp, Mus musculus
agaaaataatcagatccgggaggga

SEQ ID NO: 137669 - DNA, 25 bp, Mus musculus
agaaaatagcatcgctaccgccttt

SEQ ID NO: 137670 - DNA, 25 bp, Mus musculus
agaaaatagcatggctaccgccttt

SEQ ID NO: 137671 - DNA, 25 bp, Mus musculus
agaaaatatcccatagtaagcctat

SEQ ID NO: 137672 - DNA, 25 bp, Mus musculus
agaaaatatcccttagtaagcctat

SEQ ID NO: 137673 - DNA, 25 bp, Mus musculus
agaaaatatctgcaccgtgtggctg

SEQ ID NO: 137674 - DNA, 25 bp, Mus musculus
agaaaatatctggaccgtgtggctg

SEQ ID NO: 137675 - DNA, 25 bp, Mus musculus
agaaaatcaaacacaccatcaccta

SEQ ID NO: 137676 - DNA, 25 bp, Mus musculus
agaaaatcaaactcaccatcaccta

SEQ ID NO: 137677 - DNA, 25 bp, Mus musculus
agaaaatcaagtctcagcaccggcc

SEQ ID NO: 137678 - DNA, 25 bp, Mus musculus
agaaaatcaagtgtcagcaccggcc

SEQ ID NO: 137679 - DNA, 25 bp, Mus musculus
agaaaatcagttcttgattgcttgc

SEQ ID NO: 137680 - DNA, 25 bp, Mus musculus
agaaaatcagttgttgattgcttgc

SEQ ID NO: 137681 - DNA, 25 bp, Mus musculus
agaaaatccactatgcctgttggtt

SEQ ID NO: 137682 - DNA, 25 bp, Mus musculus
agaaaatccactttgcctgttggtt

SEQ ID NO: 137683 - DNA, 25 bp, Mus musculus
agaaaatccatgatcttttgcaatt

SEQ ID NO: 137684 - DNA, 25 bp, Mus musculus
agaaaatccatgttcttttgcaatt

SEQ ID NO: 137685 - DNA, 25 bp, Mus musculus
agaaaatcctctcttgggcagtggt

SEQ ID NO: 137686 - DNA, 25 bp, Mus musculus
agaaaatcctctgttgggcagtggt

SEQ ID NO: 137687 - DNA, 25 bp, Mus musculus
agaaaatcctttcacgcgtgtctgc

SEQ ID NO: 137688 - DNA, 25 bp, Mus musculus
agaaaatcctttgacgcgtgtctgc

SEQ ID NO: 137689 - DNA, 25 bp, Mus musculus
agaaaatctaacaaggcagtggtgg

SEQ ID NO: 137690 - DNA, 25 bp, Mus musculus
agaaaatctaactaggcagtggtgg

SEQ ID NO: 137691 - DNA, 25 bp, Mus musculus
agaaaatctcccaatctaaccgcat

SEQ ID NO: 137692 - DNA, 25 bp, Mus musculus
agaaaatctccctatctaaccgcat

SEQ ID NO: 137693 - DNA, 25 bp, Mus musculus
agaaaatctggacagagctgtttga

SEQ ID NO: 137694 - DNA, 25 bp, Mus musculus
agaaaatctggagagagctgtttga

SEQ ID NO: 137695 - DNA, 25 bp, Mus musculus
agaaaatgatctagcctcctctgta

SEQ ID NO: 137696 - DNA, 25 bp, Mus musculus
agaaaatgatcttgcctcctctgta

SEQ ID NO: 137697 - DNA, 25 bp, Mus musculus
agaaaatgcagacttcaaagacaga

SEQ ID NO: 137698 - DNA, 25 bp, Mus musculus
agaaaatgcagagttcaaagacaga

SEQ ID NO: 137699 - DNA, 25 bp, Mus musculus
agaaaatgccccaaccagattggcc

SEQ ID NO: 137700 - DNA, 25 bp, Mus musculus
agaaaatgcccctaccagattggcc

SEQ ID NO: 137701 - DNA, 25 bp, Mus musculus
agaaaatgccctagagggctccacc

SEQ ID NO: 137702 - DNA, 25 bp, Mus musculus
agaaaatgcccttgagggctccacc

SEQ ID NO: 137703 - DNA, 25 bp, Mus musculus
agaaaatgcgccacagatttgccta

SEQ ID NO: 137704 - DNA, 25 bp, Mus musculus
agaaaatgcgcctcagatttgccta

SEQ ID NO: 137705 - DNA, 25 bp, Mus musculus
agaaaatgcggtatgctctgcctac

SEQ ID NO: 137706 - DNA, 25 bp, Mus musculus
agaaaatgcggtttgctctgcctac

SEQ ID NO: 137707 - DNA, 25 bp, Mus musculus
agaaaatgctgtaacctttaagctt

SEQ ID NO: 137708 - DNA, 25 bp, Mus musculus
agaaaatgctgttacctttaagctt

SEQ ID NO: 137709 - DNA, 25 bp, Mus musculus
agaaaattaatgctggcttccactg

SEQ ID NO: 137710 - DNA, 25 bp, Mus musculus
agaaaattaatggtggcttccactg

SEQ ID NO: 137711 - DNA, 25 bp, Mus musculus
agaaaattagccagaaagccaacag

SEQ ID NO: 137712 - DNA, 25 bp, Mus musculus
agaaaattagcctgaaagccaacag

SEQ ID NO: 137713 - DNA, 25 bp, Mus musculus
agaaaattatccattgagaagctga

SEQ ID NO: 137714 - DNA, 25 bp, Mus musculus
agaaaattatcctttgagaagctga

SEQ ID NO: 137715 - DNA, 25 bp, Mus musculus
agaaaattatctatccaagacaggt

SEQ ID NO: 137716 - DNA, 25 bp, Mus musculus
agaaaattatctttccaagacaggt

SEQ ID NO: 137717 - DNA, 25 bp, Mus musculus
agaaaattcagcaggcccttcagca

SEQ ID NO: 137718 - DNA, 25 bp, Mus musculus
agaaaattcagctggcccttcagca

SEQ ID NO: 137719 - DNA, 25 bp, Mus musculus
agaaaattcataatacatacttgta

SEQ ID NO: 137720 - DNA, 25 bp, Mus musculus
agaaaattcatattacatacttgta

SEQ ID NO: 137721 - DNA, 25 bp, Mus musculus
agaaaattctaaaaatgctcactgg

SEQ ID NO: 137722 - DNA, 25 bp, Mus musculus
agaaaattctaataatgctcactgg

SEQ ID NO: 137723 - DNA, 25 bp, Mus musculus
agaaaattctgcctgccgtgttgaa

SEQ ID NO: 137724 - DNA, 25 bp, Mus musculus
agaaaattctgcgtgccgtgttgaa

SEQ ID NO: 137725 - DNA, 25 bp, Mus musculus
agaaaattgccccaaagccctgact

SEQ ID NO: 137726 - DNA, 25 bp, Mus musculus
agaaaattgcccgaaagccctgact

SEQ ID NO: 137727 - DNA, 25 bp, Mus musculus
agaaaatttagtatcccttgaagag

SEQ ID NO: 137728 - DNA, 25 bp, Mus musculus
agaaaatttagtttcccttgaagag

SEQ ID NO: 137729 - DNA, 25 bp, Mus musculus
agaaaatttcgtagactgtagtgtc

SEQ ID NO: 137730 - DNA, 25 bp, Mus musculus
agaaaatttcgttgactgtagtgtc

SEQ ID NO: 137731 - DNA, 25 bp, Mus musculus
agaaaatttgcacctgccttcctgg

SEQ ID NO: 137732 - DNA, 25 bp, Mus musculus
agaaaatttgcagctgccttcctgg

SEQ ID NO: 137733 - DNA, 25 bp, Mus musculus
agaaaatttgcccatctgctgctcc

SEQ ID NO: 137734 - DNA, 25 bp, Mus musculus
agaaaatttgccgatctgctgctcc

SEQ ID NO: 137735 - DNA, 25 bp, Mus musculus
agaaaattttccatggaccatagaa

SEQ ID NO: 137736 - DNA, 25 bp, Mus musculus
agaaaattttccttggaccatagaa

SEQ ID NO: 137737 - DNA, 25 bp, Mus musculus
agaaacaaagccacttctgtctcta

SEQ ID NO: 137738 - DNA, 25 bp, Mus musculus
agaaacaaagcctcttctgtctcta

SEQ ID NO: 137739 - DNA, 25 bp, Mus musculus
agaaacaacctgctcttgtgctgct

SEQ ID NO: 137740 - DNA, 25 bp, Mus musculus
agaaacaacctggtcttgtgctgct

SEQ ID NO: 137741 - DNA, 25 bp, Mus musculus
agaaacaacttgagccgggcggcag

SEQ ID NO: 137742 - DNA, 25 bp, Mus musculus
agaaacaacttgtgccgggcggcag

SEQ ID NO: 137743 - DNA, 25 bp, Mus musculus
agaaacaactttagcaatttggagt

SEQ ID NO: 137744 - DNA, 25 bp, Mus musculus
agaaacaacttttgcaatttggagt

SEQ ID NO: 137745 - DNA, 25 bp, Mus musculus
agaaacaagctcctacatacaccag

SEQ ID NO: 137746 - DNA, 25 bp, Mus musculus
agaaacaagctcgtacatacaccag

SEQ ID NO: 137747 - DNA, 25 bp, Mus musculus
agaaacaagctgagcggacctggcc

SEQ ID NO: 137748 - DNA, 25 bp, Mus musculus
agaaacaagctgtgcggacctggcc

SEQ ID NO: 137749 - DNA, 25 bp, Mus musculus
agaaacaattctctgtgcctctgat

SEQ ID NO: 137750 - DNA, 25 bp, Mus musculus
agaaacaattctgtgtgcctctgat

SEQ ID NO: 137751 - DNA, 25 bp, Mus musculus
agaaacaatttcaccagcactgggt

SEQ ID NO: 137752 - DNA, 25 bp, Mus musculus
agaaacaatttctccagcactgggt

SEQ ID NO: 137753 - DNA, 25 bp, Mus musculus
agaaacacacatcttttacttcaaa

SEQ ID NO: 137754 - DNA, 25 bp, Mus musculus
agaaacacacatgttttacttcaaa

SEQ ID NO: 137755 - DNA, 25 bp, Mus musculus
agaaacacacctaggtcatgttcta

SEQ ID NO: 137756 - DNA, 25 bp, Mus musculus
agaaacacaccttggtcatgttcta

SEQ ID NO: 137757 - DNA, 25 bp, Mus musculus
agaaacacaggaaccagaccccaaa

SEQ ID NO: 137758 - DNA, 25 bp, Mus musculus
agaaacacaggatccagaccccaaa

SEQ ID NO: 137759 - DNA, 25 bp, Mus musculus
agaaacacatctataccctgcatca

SEQ ID NO: 137760 - DNA, 25 bp, Mus musculus
agaaacacatctattgcgggcctac

SEQ ID NO: 137761 - DNA, 25 bp, Mus musculus
agaaacacatctttaccctgcatca

SEQ ID NO: 137762 - DNA, 25 bp, Mus musculus
agaaacacatcttttgcgggcctac

SEQ ID NO: 137763 - DNA, 25 bp, Mus musculus
agaaacacattgacatctttgcctt

SEQ ID NO: 137764 - DNA, 25 bp, Mus musculus
agaaacacattgtcatctttgcctt

SEQ ID NO: 137765 - DNA, 25 bp, Mus musculus
agaaacaccacgaccatcaatctgg

SEQ ID NO: 137766 - DNA, 25 bp, Mus musculus
agaaacaccacgtccatcaatctgg

SEQ ID NO: 137767 - DNA, 25 bp, Mus musculus
agaaacacccagaatagccaaagaa

SEQ ID NO: 137768 - DNA, 25 bp, Mus musculus
agaaacacccagtatagccaaagaa

SEQ ID NO: 137769 - DNA, 25 bp, Mus musculus
agaaacacccggactgtgacttgtc

SEQ ID NO: 137770 - DNA, 25 bp, Mus musculus
agaaacacccggtctgtgacttgtc

SEQ ID NO: 137771 - DNA, 25 bp, Mus musculus
agaaacaccgccaccgtgagtgcac

SEQ ID NO: 137772 - DNA, 25 bp, Mus musculus
agaaacaccgcctccgtgagtgcac

SEQ ID NO: 137773 - DNA, 25 bp, Mus musculus
agaaacacctgcaatttcaactccc

SEQ ID NO: 137774 - DNA, 25 bp, Mus musculus
agaaacacctgctatttcaactccc

SEQ ID NO: 137775 - DNA, 25 bp, Mus musculus
agaaacacctttatatctcatccac

SEQ ID NO: 137776 - DNA, 25 bp, Mus musculus
agaaacacctttttatctcatccac

SEQ ID NO: 137777 - DNA, 25 bp, Mus musculus
agaaacacgcaacccaactaagtat

SEQ ID NO: 137778 - DNA, 25 bp, Mus musculus
agaaacacgcaagccaactaagtat

SEQ ID NO: 137779 - DNA, 25 bp, Mus musculus
agaaacacgcggatctcaacttcga

SEQ ID NO: 137780 - DNA, 25 bp, Mus musculus
agaaacacgcggttctcaacttcga

SEQ ID NO: 137781 - DNA, 25 bp, Mus musculus
agaaacacgtgcagaaccggctcgc

SEQ ID NO: 137782 - DNA, 25 bp, Mus musculus
agaaacacgtgctgaaccggctcgc

SEQ ID NO: 137783 - DNA, 25 bp, Mus musculus
agaaacactagcataccacatgtag

SEQ ID NO: 137784 - DNA, 25 bp, Mus musculus
agaaacactagcttaccacatgtag

SEQ ID NO: 137785 - DNA, 25 bp, Mus musculus
agaaacactcgtctatctcttactc

SEQ ID NO: 137786 - DNA, 25 bp, Mus musculus
agaaacactcgtgtatctcttactc

SEQ ID NO: 137787 - DNA, 25 bp, Mus musculus
agaaacactgcccttactattatcc

SEQ ID NO: 137788 - DNA, 25 bp, Mus musculus
agaaacactgccgttactattatcc

SEQ ID NO: 137789 - DNA, 25 bp, Mus musculus
agaaacactttcatatttactgcgt

SEQ ID NO: 137790 - DNA, 25 bp, Mus musculus
agaaacactttcttatttactgcgt

SEQ ID NO: 137791 - DNA, 25 bp, Mus musculus
agaaacacttttcgcagttccttgt

SEQ ID NO: 137792 - DNA, 25 bp, Mus musculus
agaaacacttttggcagttccttgt

SEQ ID NO: 137793 - DNA, 25 bp, Mus musculus
agaaacagactgatgtggccacagt

SEQ ID NO: 137794 - DNA, 25 bp, Mus musculus
agaaacagactgttgtggccacagt

SEQ ID NO: 137795 - DNA, 25 bp, Mus musculus
agaaacagaggccccggcaggagaa

SEQ ID NO: 137796 - DNA, 25 bp, Mus musculus
agaaacagaggcgccggcaggagaa

SEQ ID NO: 137797 - DNA, 25 bp, Mus musculus
agaaacagcctaccagggcaggtgt

SEQ ID NO: 137798 - DNA, 25 bp, Mus musculus
agaaacagcctagcagggcaggtgt

SEQ ID NO: 137799 - DNA, 25 bp, Mus musculus
agaaacagctggcaccgctgtctct

SEQ ID NO: 137800 - DNA, 25 bp, Mus musculus
agaaacagctgggaccgctgtctct

SEQ ID NO: 137801 - DNA, 25 bp, Mus musculus
agaaacagcttactcagccccaggt

SEQ ID NO: 137802 - DNA, 25 bp, Mus musculus
agaaacagcttagtcagccccaggt

SEQ ID NO: 137803 - DNA, 25 bp, Mus musculus
agaaacagcttgactgccagttctt

SEQ ID NO: 137804 - DNA, 25 bp, Mus musculus
agaaacagcttgtctgccagttctt

SEQ ID NO: 137805 - DNA, 25 bp, Mus musculus
agaaacaggacccagctctcaggtg

SEQ ID NO: 137806 - DNA, 25 bp, Mus musculus
agaaacaggaccgagctctcaggtg

SEQ ID NO: 137807 - DNA, 25 bp, Mus musculus
agaaacagggccaaacccatggcac

SEQ ID NO: 137808 - DNA, 25 bp, Mus musculus
agaaacagggcctaacccatggcac

SEQ ID NO: 137809 - DNA, 25 bp, Mus musculus
agaaacagggctagccaccctctgg

SEQ ID NO: 137810 - DNA, 25 bp, Mus musculus
agaaacagggcttgccaccctctgg

SEQ ID NO: 137811 - DNA, 25 bp, Mus musculus
agaaacagggttcgcctactggcct

SEQ ID NO: 137812 - DNA, 25 bp, Mus musculus
agaaacagggttggcctactggcct

SEQ ID NO: 137813 - DNA, 25 bp, Mus musculus
agaaacaggttgcatctctctgagt

SEQ ID NO: 137814 - DNA, 25 bp, Mus musculus
agaaacaggttggatctctctgagt

SEQ ID NO: 137815 - DNA, 25 bp, Mus musculus
agaaacagtcccagaagcagtgcgc

SEQ ID NO: 137816 - DNA, 25 bp, Mus musculus
agaaacagtccctgaagcagtgcgc

SEQ ID NO: 137817 - DNA, 25 bp, Mus musculus
agaaacagtgggagttctgagatgc

SEQ ID NO: 137818 - DNA, 25 bp, Mus musculus
agaaacagtgggtgttctgagatgc

SEQ ID NO: 137819 - DNA, 25 bp, Mus musculus
agaaacagtggtctgaagagcccag

SEQ ID NO: 137820 - DNA, 25 bp, Mus musculus
agaaacagtggtgtgaagagcccag

SEQ ID NO: 137821 - DNA, 25 bp, Mus musculus
agaaacagtttacgcactgtcaaaa

SEQ ID NO: 137822 - DNA, 25 bp, Mus musculus
agaaacagtttaggcactgtcaaaa

SEQ ID NO: 137823 - DNA, 25 bp, Mus musculus
agaaacatataaatttatcccattt

SEQ ID NO: 137824 - DNA, 25 bp, Mus musculus
agaaacatataattttatcccattt

SEQ ID NO: 137825 - DNA, 25 bp, Mus musculus
agaaacatatggctcgcctgctgtt

SEQ ID NO: 137826 - DNA, 25 bp, Mus musculus
agaaacatatgggtcgcctgctgtt

SEQ ID NO: 137827 - DNA, 25 bp, Mus musculus
agaaacatccctcgattcccttcta

SEQ ID NO: 137828 - DNA, 25 bp, Mus musculus
agaaacatccctggattcccttcta

SEQ ID NO: 137829 - DNA, 25 bp, Mus musculus
agaaacatccttcaattgttgtatt

SEQ ID NO: 137830 - DNA, 25 bp, Mus musculus
agaaacatccttgaattgttgtatt

SEQ ID NO: 137831 - DNA, 25 bp, Mus musculus
agaaacatcgtacctgcatccagta

SEQ ID NO: 137832 - DNA, 25 bp, Mus musculus
agaaacatcgtagctgcatccagta

SEQ ID NO: 137833 - DNA, 25 bp, Mus musculus
agaaacatctgtaccctttgggtgt

SEQ ID NO: 137834 - DNA, 25 bp, Mus musculus
agaaacatctgttccctttgggtgt

SEQ ID NO: 137835 - DNA, 25 bp, Mus musculus
agaaacatctttcgcagaccacata

SEQ ID NO: 137836 - DNA, 25 bp, Mus musculus
agaaacatctttggcagaccacata

SEQ ID NO: 137837 - DNA, 25 bp, Mus musculus
agaaacatgcagctcacgagctact

SEQ ID NO: 137838 - DNA, 25 bp, Mus musculus
agaaacatgcaggtcacgagctact

SEQ ID NO: 137839 - DNA, 25 bp, Mus musculus
agaaacatgctcaagcacaacccac

SEQ ID NO: 137840 - DNA, 25 bp, Mus musculus
agaaacatgctctagcacaacccac

SEQ ID NO: 137841 - DNA, 25 bp, Mus musculus
agaaacatgcttaatttccttaagc

SEQ ID NO: 137842 - DNA, 25 bp, Mus musculus
agaaacatgctttatttccttaagc

SEQ ID NO: 137843 - DNA, 25 bp, Mus musculus
agaaacatgtgtacatccttagcta

SEQ ID NO: 137844 - DNA, 25 bp, Mus musculus
agaaacatgtgttcatccttagcta

SEQ ID NO: 137845 - DNA, 25 bp, Mus musculus
agaaacattcacagaagccctcctg

SEQ ID NO: 137846 - DNA, 25 bp, Mus musculus
agaaacattcactgaagccctcctg

SEQ ID NO: 137847 - DNA, 25 bp, Mus musculus
agaaacattcatcactgttcccaca

SEQ ID NO: 137848 - DNA, 25 bp, Mus musculus
agaaacattcatgactgttcccaca

SEQ ID NO: 137849 - DNA, 25 bp, Mus musculus
agaaacattcgcacgtgcacacgag

SEQ ID NO: 137850 - DNA, 25 bp, Mus musculus
agaaacattcgctcgtgcacacgag

SEQ ID NO: 137851 - DNA, 25 bp, Mus musculus
agaaacattcttaacagcttaggtt

SEQ ID NO: 137852 - DNA, 25 bp, Mus musculus
agaaacattctttacagcttaggtt

SEQ ID NO: 137853 - DNA, 25 bp, Mus musculus
agaaacatttgcatcccatgtggag

SEQ ID NO: 137854 - DNA, 25 bp, Mus musculus
agaaacatttgcttcccatgtggag

SEQ ID NO: 137855 - DNA, 25 bp, Mus musculus
agaaacatttggacctgtggagaga

SEQ ID NO: 137856 - DNA, 25 bp, Mus musculus
agaaacatttggtcctgtggagaga

SEQ ID NO: 137857 - DNA, 25 bp, Mus musculus
agaaaccaacacatcctgcgcttca

SEQ ID NO: 137858 - DNA, 25 bp, Mus musculus
agaaaccaacacttcctgcgcttca

SEQ ID NO: 137859 - DNA, 25 bp, Mus musculus
agaaaccaatgaaaaggcagagctt

SEQ ID NO: 137860 - DNA, 25 bp, Mus musculus
agaaaccaatgataaggcagagctt

SEQ ID NO: 137861 - DNA, 25 bp, Mus musculus
agaaaccaattgaccacggctgcca

SEQ ID NO: 137862 - DNA, 25 bp, Mus musculus
agaaaccaattgtccacggctgcca

SEQ ID NO: 137863 - DNA, 25 bp, Mus musculus
agaaaccaccccaattatagcagat

SEQ ID NO: 137864 - DNA, 25 bp, Mus musculus
agaaaccacccctattatagcagat

SEQ ID NO: 137865 - DNA, 25 bp, Mus musculus
agaaaccacggccatcagaagcaga

SEQ ID NO: 137866 - DNA, 25 bp, Mus musculus
agaaaccacggcgatcagaagcaga

SEQ ID NO: 137867 - DNA, 25 bp, Mus musculus
agaaaccactgcactgatcttcact

SEQ ID NO: 137868 - DNA, 25 bp, Mus musculus
agaaaccactgctctgatcttcact

SEQ ID NO: 137869 - DNA, 25 bp, Mus musculus
agaaaccagacactccgtggacacc

SEQ ID NO: 137870 - DNA, 25 bp, Mus musculus
agaaaccagacagtccgtggacacc

SEQ ID NO: 137871 - DNA, 25 bp, Mus musculus
agaaaccagcctctgatggagcctc

SEQ ID NO: 137872 - DNA, 25 bp, Mus musculus
agaaaccagcctgtgatggagcctc

SEQ ID NO: 137873 - DNA, 25 bp, Mus musculus
agaaaccagcggcttgctgctcgat

SEQ ID NO: 137874 - DNA, 25 bp, Mus musculus
agaaaccagcgggttgctgctcgat

SEQ ID NO: 137875 - DNA, 25 bp, Mus musculus
agaaaccagctacaaacatttgcat

SEQ ID NO: 137876 - DNA, 25 bp, Mus musculus
agaaaccagctagaaacatttgcat

SEQ ID NO: 137877 - DNA, 25 bp, Mus musculus
agaaaccagtttaggcatttgctac

SEQ ID NO: 137878 - DNA, 25 bp, Mus musculus
agaaaccagttttggcatttgctac

SEQ ID NO: 137879 - DNA, 25 bp, Mus musculus
agaaaccatatgagacccttgtcct

SEQ ID NO: 137880 - DNA, 25 bp, Mus musculus
agaaaccatatgatgatagtattca

SEQ ID NO: 137881 - DNA, 25 bp, Mus musculus
agaaaccatatgtgacccttgtcct

SEQ ID NO: 137882 - DNA, 25 bp, Mus musculus
agaaaccatatgttgatagtattca

SEQ ID NO: 137883 - DNA, 25 bp, Mus musculus
agaaaccatcctaaagtgaaactga

SEQ ID NO: 137884 - DNA, 25 bp, Mus musculus
agaaaccatccttaagtgaaactga

SEQ ID NO: 137885 - DNA, 25 bp, Mus musculus
agaaaccatctgaaacagttgtgtt

SEQ ID NO: 137886 - DNA, 25 bp, Mus musculus
agaaaccatctgtaacagttgtgtt

SEQ ID NO: 137887 - DNA, 25 bp, Mus musculus
agaaaccatttcaagacgttggtgg

SEQ ID NO: 137888 - DNA, 25 bp, Mus musculus
agaaaccatttctagacgttggtgg

SEQ ID NO: 137889 - DNA, 25 bp, Mus musculus
agaaacccaaggacagcaccctgct

SEQ ID NO: 137890 - DNA, 25 bp, Mus musculus
agaaacccaaggtcagcaccctgct

SEQ ID NO: 137891 - DNA, 25 bp, Mus musculus
agaaacccacaaactgccaaagcaa

SEQ ID NO: 137892 - DNA, 25 bp, Mus musculus
agaaacccacaatctgccaaagcaa

SEQ ID NO: 137893 - DNA, 25 bp, Mus musculus
agaaacccaccaatactctcagtgc

SEQ ID NO: 137894 - DNA, 25 bp, Mus musculus
agaaacccaccattactctcagtgc

SEQ ID NO: 137895 - DNA, 25 bp, Mus musculus
agaaacccagccctcagagacaaaa

SEQ ID NO: 137896 - DNA, 25 bp, Mus musculus
agaaacccagccgtcagagacaaaa

SEQ ID NO: 137897 - DNA, 25 bp, Mus musculus
agaaacccaggcatgcaagtgcatg

SEQ ID NO: 137898 - DNA, 25 bp, Mus musculus
agaaacccaggcttgcaagtgcatg

SEQ ID NO: 137899 - DNA, 25 bp, Mus musculus
agaaacccaggtctagatcatgcct

SEQ ID NO: 137900 - DNA, 25 bp, Mus musculus
agaaacccaggtgtagatcatgcct

SEQ ID NO: 137901 - DNA, 25 bp, Mus musculus
agaaacccagtaacttccagacgtt

SEQ ID NO: 137902 - DNA, 25 bp, Mus musculus
agaaacccagtatcttccagacgtt

SEQ ID NO: 137903 - DNA, 25 bp, Mus musculus
agaaacccatggcacacatgctttg

SEQ ID NO: 137904 - DNA, 25 bp, Mus musculus
agaaacccatgggacacatgctttg

SEQ ID NO: 137905 - DNA, 25 bp, Mus musculus
agaaaccccacaagtgaggagccgc

SEQ ID NO: 137906 - DNA, 25 bp, Mus musculus
agaaaccccacaccctgcaggatga

SEQ ID NO: 137907 - DNA, 25 bp, Mus musculus
agaaaccccacagcctgcaggatga

SEQ ID NO: 137908 - DNA, 25 bp, Mus musculus
agaaaccccacatgtgaggagccgc

SEQ ID NO: 137909 - DNA, 25 bp, Mus musculus
agaaaccccgccctcatgtccagag

SEQ ID NO: 137910 - DNA, 25 bp, Mus musculus
agaaaccccgccgtcatgtccagag

SEQ ID NO: 137911 - DNA, 25 bp, Mus musculus
agaaacccgcagagtcactgtctac

SEQ ID NO: 137912 - DNA, 25 bp, Mus musculus
agaaacccgcagtgtcactgtctac

SEQ ID NO: 137913 - DNA, 25 bp, Mus musculus
agaaacccgttacagactgtgatgt

SEQ ID NO: 137914 - DNA, 25 bp, Mus musculus
agaaacccgttagagactgtgatgt

SEQ ID NO: 137915 - DNA, 25 bp, Mus musculus
agaaaccctataactagccctatat

SEQ ID NO: 137916 - DNA, 25 bp, Mus musculus
agaaaccctatatctagccctatat

SEQ ID NO: 137917 - DNA, 25 bp, Mus musculus
agaaaccctcatcaatttgccttag

SEQ ID NO: 137918 - DNA, 25 bp, Mus musculus
agaaaccctcatgaatttgccttag

SEQ ID NO: 137919 - DNA, 25 bp, Mus musculus
agaaaccctggacgatgggctcccg

SEQ ID NO: 137920 - DNA, 25 bp, Mus musculus
agaaaccctggaggatgggctcccg

SEQ ID NO: 137921 - DNA, 25 bp, Mus musculus
agaaaccctggtactggagcgtttg

SEQ ID NO: 137922 - DNA, 25 bp, Mus musculus
agaaaccctggtagcactgggctca

SEQ ID NO: 137923 - DNA, 25 bp, Mus musculus
agaaaccctggttctggagcgtttg

SEQ ID NO: 137924 - DNA, 25 bp, Mus musculus
agaaaccctggttgcactgggctca

SEQ ID NO: 137925 - DNA, 25 bp, Mus musculus
agaaaccgaatcactctaacaccct

SEQ ID NO: 137926 - DNA, 25 bp, Mus musculus
agaaaccgaatctctctaacaccct

SEQ ID NO: 137927 - DNA, 25 bp, Mus musculus
agaaaccggttcagtctggtccact

SEQ ID NO: 137928 - DNA, 25 bp, Mus musculus
agaaaccggttctgtctggtccact

SEQ ID NO: 137929 - DNA, 25 bp, Mus musculus
agaaaccgtggcactggaggttttg

SEQ ID NO: 137930 - DNA, 25 bp, Mus musculus
agaaaccgtggctctggaggttttg

SEQ ID NO: 137931 - DNA, 25 bp, Mus musculus
agaaaccgtgttatgtgcttgcttt

SEQ ID NO: 137932 - DNA, 25 bp, Mus musculus
agaaaccgtgttttgtgcttgcttt

SEQ ID NO: 137933 - DNA, 25 bp, Mus musculus
agaaacctacctactgccgctgtgg

SEQ ID NO: 137934 - DNA, 25 bp, Mus musculus
agaaacctaccttctgccgctgtgg

SEQ ID NO: 137935 - DNA, 25 bp, Mus musculus
agaaacctagctcacttaaggctga

SEQ ID NO: 137936 - DNA, 25 bp, Mus musculus
agaaacctagctgacttaaggctga

SEQ ID NO: 137937 - DNA, 25 bp, Mus musculus
agaaacctatgccatccctttttat

SEQ ID NO: 137938 - DNA, 25 bp, Mus musculus
agaaacctatgcgatccctttttat

SEQ ID NO: 137939 - DNA, 25 bp, Mus musculus
agaaacctatttatccctgacttag

SEQ ID NO: 137940 - DNA, 25 bp, Mus musculus
agaaacctatttttccctgacttag

SEQ ID NO: 137941 - DNA, 25 bp, Mus musculus
agaaacctcaggaaatgatgtacat

SEQ ID NO: 137942 - DNA, 25 bp, Mus musculus
agaaacctcaggaactagggagaat

SEQ ID NO: 137943 - DNA, 25 bp, Mus musculus
agaaacctcaggtaatgatgtacat

SEQ ID NO: 137944 - DNA, 25 bp, Mus musculus
agaaacctcaggtactagggagaat

SEQ ID NO: 137945 - DNA, 25 bp, Mus musculus
agaaacctcatgagtgctttgccac

SEQ ID NO: 137946 - DNA, 25 bp, Mus musculus
agaaacctcatgtgtgctttgccac

SEQ ID NO: 137947 - DNA, 25 bp, Mus musculus
agaaacctcctaagagaactccctt

SEQ ID NO: 137948 - DNA, 25 bp, Mus musculus
agaaacctcctatgagaactccctt

SEQ ID NO: 137949 - DNA, 25 bp, Mus musculus
agaaacctctggaagcgtctcacat

SEQ ID NO: 137950 - DNA, 25 bp, Mus musculus
agaaacctctggataccatgcgtca

SEQ ID NO: 137951 - DNA, 25 bp, Mus musculus
agaaacctctggtagcgtctcacat

SEQ ID NO: 137952 - DNA, 25 bp, Mus musculus
agaaacctctggttaccatgcgtca

SEQ ID NO: 137953 - DNA, 25 bp, Mus musculus
agaaacctgagcagcctcgtttgag

SEQ ID NO: 137954 - DNA, 25 bp, Mus musculus
agaaacctgagcatcttcttcagtg

SEQ ID NO: 137955 - DNA, 25 bp, Mus musculus
agaaacctgagctgcctcgtttgag

SEQ ID NO: 137956 - DNA, 25 bp, Mus musculus
agaaacctgagcttcttcttcagtg

SEQ ID NO: 137957 - DNA, 25 bp, Mus musculus
agaaacctgaggcaagcaccgcaag

SEQ ID NO: 137958 - DNA, 25 bp, Mus musculus
agaaacctgagggaagcaccgcaag

SEQ ID NO: 137959 - DNA, 25 bp, Mus musculus
agaaacctgcttctatgttgtctcc

SEQ ID NO: 137960 - DNA, 25 bp, Mus musculus
agaaacctgcttgtatgttgtctcc

SEQ ID NO: 137961 - DNA, 25 bp, Mus musculus
agaaacctggccattgagatctctg

SEQ ID NO: 137962 - DNA, 25 bp, Mus musculus
agaaacctggcctttgagatctctg

SEQ ID NO: 137963 - DNA, 25 bp, Mus musculus
agaaacctgtgtcctcgttgctgtc

SEQ ID NO: 137964 - DNA, 25 bp, Mus musculus
agaaacctgtgtgctcgttgctgtc

SEQ ID NO: 137965 - DNA, 25 bp, Mus musculus
agaaaccttaacattggctcctttg

SEQ ID NO: 137966 - DNA, 25 bp, Mus musculus
agaaaccttaactttggctcctttg

SEQ ID NO: 137967 - DNA, 25 bp, Mus musculus
agaaaccttccaactgcttgcaagc

SEQ ID NO: 137968 - DNA, 25 bp, Mus musculus
agaaaccttccatctgcttgcaagc

SEQ ID NO: 137969 - DNA, 25 bp, Mus musculus
agaaaccttcccagtttgaggacat

SEQ ID NO: 137970 - DNA, 25 bp, Mus musculus
agaaaccttccctgtttgaggacat

SEQ ID NO: 137971 - DNA, 25 bp, Mus musculus
agaaaccttgaccttggagatctct

SEQ ID NO: 137972 - DNA, 25 bp, Mus musculus
agaaaccttgacgttggagatctct

SEQ ID NO: 137973 - DNA, 25 bp, Mus musculus
agaaaccttgtcctcttagtcagag

SEQ ID NO: 137974 - DNA, 25 bp, Mus musculus
agaaaccttgtcgtcttagtcagag

SEQ ID NO: 137975 - DNA, 25 bp, Mus musculus
agaaacctttatcaacctgatctcc

SEQ ID NO: 137976 - DNA, 25 bp, Mus musculus
agaaacctttatgaacctgatctcc

SEQ ID NO: 137977 - DNA, 25 bp, Mus musculus
agaaacctttctcatgcaaagctgg

SEQ ID NO: 137978 - DNA, 25 bp, Mus musculus
agaaacctttctgatgcaaagctgg

SEQ ID NO: 137979 - DNA, 25 bp, Mus musculus
agaaacctttgcatttgctgcctct

SEQ ID NO: 137980 - DNA, 25 bp, Mus musculus
agaaacctttgcttttgctgcctct

SEQ ID NO: 137981 - DNA, 25 bp, Mus musculus
agaaacgaagcacctggcgcctcct

SEQ ID NO: 137982 - DNA, 25 bp, Mus musculus
agaaacgaagcagctggcgcctcct

SEQ ID NO: 137983 - DNA, 25 bp, Mus musculus
agaaacgagatcctgaccacatgaa

SEQ ID NO: 137984 - DNA, 25 bp, Mus musculus
agaaacgagatcgtgaccacatgaa

SEQ ID NO: 137985 - DNA, 25 bp, Mus musculus
agaaacgatactccagtgcttttgc

SEQ ID NO: 137986 - DNA, 25 bp, Mus musculus
agaaacgatactgcagtgcttttgc

SEQ ID NO: 137987 - DNA, 25 bp, Mus musculus
agaaacgccaccaaactgctaaatg

SEQ ID NO: 137988 - DNA, 25 bp, Mus musculus
agaaacgccacctaactgctaaatg

SEQ ID NO: 137989 - DNA, 25 bp, Mus musculus
agaaacgcgaacaggcgcaggccac

SEQ ID NO: 137990 - DNA, 25 bp, Mus musculus
agaaacgcgaactggcgcaggccac

SEQ ID NO: 137991 - DNA, 25 bp, Mus musculus
agaaacgctgctcagagctgaccca

SEQ ID NO: 137992 - DNA, 25 bp, Mus musculus
agaaacgctgctgagagctgaccca

SEQ ID NO: 137993 - DNA, 25 bp, Mus musculus
agaaacgctggtagctggagaacat

SEQ ID NO: 137994 - DNA, 25 bp, Mus musculus
agaaacgctggttgctggagaacat

SEQ ID NO: 137995 - DNA, 25 bp, Mus musculus
agaaacgcttttccatcaggtggaa

SEQ ID NO: 137996 - DNA, 25 bp, Mus musculus
agaaacgcttttgcatcaggtggaa

SEQ ID NO: 137997 - DNA, 25 bp, Mus musculus
agaaacggaaatcaagcctgcttga

SEQ ID NO: 137998 - DNA, 25 bp, Mus musculus
agaaacggaaatgaagcctgcttga

SEQ ID NO: 137999 - DNA, 25 bp, Mus musculus
agaaacggaactccatcacctgtct

SEQ ID NO: 138000 - DNA, 25 bp, Mus musculus
agaaacggaactgcatcacctgtct

SEQ ID NO: 138001 - DNA, 25 bp, Mus musculus
agaaacggcgagagttcatcatgct

SEQ ID NO: 138002 - DNA, 25 bp, Mus musculus
agaaacggcgagtgttcatcatgct

SEQ ID NO: 138003 - DNA, 25 bp, Mus musculus
agaaacggcttaacagtactggcag

SEQ ID NO: 138004 - DNA, 25 bp, Mus musculus
agaaacggcttatcagtactggcag

SEQ ID NO: 138005 - DNA, 25 bp, Mus musculus
agaaacgggacaattgacacctatt

SEQ ID NO: 138006 - DNA, 25 bp, Mus musculus
agaaacgggacatttgacacctatt

SEQ ID NO: 138007 - DNA, 25 bp, Mus musculus
agaaacggtcctctgagtcaaccca

SEQ ID NO: 138008 - DNA, 25 bp, Mus musculus
agaaacggtcctgtgagtcaaccca

SEQ ID NO: 138009 - DNA, 25 bp, Mus musculus
agaaacggtctgcactcactgggtc

SEQ ID NO: 138010 - DNA, 25 bp, Mus musculus
agaaacggtctggactcactgggtc

SEQ ID NO: 138011 - DNA, 25 bp, Mus musculus
agaaacgtatctcgccatattcctt

SEQ ID NO: 138012 - DNA, 25 bp, Mus musculus
agaaacgtatctggccatattcctt

SEQ ID NO: 138013 - DNA, 25 bp, Mus musculus
agaaacgtcgtaactcctgcttgat

SEQ ID NO: 138014 - DNA, 25 bp, Mus musculus
agaaacgtcgtatctcctgcttgat

SEQ ID NO: 138015 - DNA, 25 bp, Mus musculus
agaaacgtcgtcacgtcttgtcatt

SEQ ID NO: 138016 - DNA, 25 bp, Mus musculus
agaaacgtcgtctcgtcttgtcatt

SEQ ID NO: 138017 - DNA, 25 bp, Mus musculus
agaaacgtgcagagcttgtcttcct

SEQ ID NO: 138018 - DNA, 25 bp, Mus musculus
agaaacgtgcagtgcttgtcttcct

SEQ ID NO: 138019 - DNA, 25 bp, Mus musculus
agaaacgtgcttactgggcccgcgt

SEQ ID NO: 138020 - DNA, 25 bp, Mus musculus
agaaacgtgctttctgggcccgcgt

SEQ ID NO: 138021 - DNA, 25 bp, Mus musculus
agaaacgtggaaagggctaccgcca

SEQ ID NO: 138022 - DNA, 25 bp, Mus musculus
agaaacgtggaatgggctaccgcca

SEQ ID NO: 138023 - DNA, 25 bp, Mus musculus
agaaacgtgtgacccgtgaccagca

SEQ ID NO: 138024 - DNA, 25 bp, Mus musculus
agaaacgtgtgagccgtgaccagca

SEQ ID NO: 138025 - DNA, 25 bp, Mus musculus
agaaacgtgtggaccactgtcctat

SEQ ID NO: 138026 - DNA, 25 bp, Mus musculus
agaaacgtgtggtccactgtcctat

SEQ ID NO: 138027 - DNA, 25 bp, Mus musculus
agaaacgttcttaatttgctccagg

SEQ ID NO: 138028 - DNA, 25 bp, Mus musculus
agaaacgttctttatttgctccagg

SEQ ID NO: 138029 - DNA, 25 bp, Mus musculus
agaaacgttgctcctgtgagtcagg

SEQ ID NO: 138030 - DNA, 25 bp, Mus musculus
agaaacgttgctgctgtgagtcagg

SEQ ID NO: 138031 - DNA, 25 bp, Mus musculus
agaaactaaggcagctagacatggt

SEQ ID NO: 138032 - DNA, 25 bp, Mus musculus
agaaactaaggctgctagacatggt

SEQ ID NO: 138033 - DNA, 25 bp, Mus musculus
agaaactacatcctggcatcttggc

SEQ ID NO: 138034 - DNA, 25 bp, Mus musculus
agaaactacatcgtggcatcttggc

SEQ ID NO: 138035 - DNA, 25 bp, Mus musculus
agaaactaccataaccctgtgactc

SEQ ID NO: 138036 - DNA, 25 bp, Mus musculus
agaaactaccattaccctgtgactc

SEQ ID NO: 138037 - DNA, 25 bp, Mus musculus
agaaactacctcagaaggcttcgcc

SEQ ID NO: 138038 - DNA, 25 bp, Mus musculus
agaaactacctctgaaggcttcgcc

SEQ ID NO: 138039 - DNA, 25 bp, Mus musculus
agaaactactcacggtttatgctga

SEQ ID NO: 138040 - DNA, 25 bp, Mus musculus
agaaactactcagggtttatgctga

SEQ ID NO: 138041 - DNA, 25 bp, Mus musculus
agaaactatctcatggtggcaagcc

SEQ ID NO: 138042 - DNA, 25 bp, Mus musculus
agaaactatctcttggtggcaagcc

SEQ ID NO: 138043 - DNA, 25 bp, Mus musculus
agaaactatgtacccaggtggtggt

SEQ ID NO: 138044 - DNA, 25 bp, Mus musculus
agaaactatgtagccaggtggtggt

SEQ ID NO: 138045 - DNA, 25 bp, Mus musculus
agaaactatttcatggctcatttga

SEQ ID NO: 138046 - DNA, 25 bp, Mus musculus
agaaactatttcttggctcatttga

SEQ ID NO: 138047 - DNA, 25 bp, Mus musculus
agaaactcaatacgcttcctaccca

SEQ ID NO: 138048 - DNA, 25 bp, Mus musculus
agaaactcaataggcttcctaccca

SEQ ID NO: 138049 - DNA, 25 bp, Mus musculus
agaaactcaattctgctgaatgaaa

SEQ ID NO: 138050 - DNA, 25 bp, Mus musculus
agaaactcaattgtgctgaatgaaa

SEQ ID NO: 138051 - DNA, 25 bp, Mus musculus
agaaactcacagatggcctggcagt

SEQ ID NO: 138052 - DNA, 25 bp, Mus musculus
agaaactcacagttggcctggcagt

SEQ ID NO: 138053 - DNA, 25 bp, Mus musculus
agaaactcatcacctaggctctcgg

SEQ ID NO: 138054 - DNA, 25 bp, Mus musculus
agaaactcatcagctaggctctcgg

SEQ ID NO: 138055 - DNA, 25 bp, Mus musculus
agaaactcatgtcctgtcccataag

SEQ ID NO: 138056 - DNA, 25 bp, Mus musculus
agaaactcatgtgctgtcccataag

SEQ ID NO: 138057 - DNA, 25 bp, Mus musculus
agaaactccacgcttagctgctaac

SEQ ID NO: 138058 - DNA, 25 bp, Mus musculus
agaaactccacggttagctgctaac

SEQ ID NO: 138059 - DNA, 25 bp, Mus musculus
agaaactccatacgcaaccggtgtt

SEQ ID NO: 138060 - DNA, 25 bp, Mus musculus
agaaactccataggcaaccggtgtt

SEQ ID NO: 138061 - DNA, 25 bp, Mus musculus
agaaactccctaactcttgtgctgt

SEQ ID NO: 138062 - DNA, 25 bp, Mus musculus
agaaactccctatctcttgtgctgt

SEQ ID NO: 138063 - DNA, 25 bp, Mus musculus
agaaactcctgtctaagtgctctgc

SEQ ID NO: 138064 - DNA, 25 bp, Mus musculus
agaaactcctgtgtaagtgctctgc

SEQ ID NO: 138065 - DNA, 25 bp, Mus musculus
agaaactcgtggagattttaagatt

SEQ ID NO: 138066 - DNA, 25 bp, Mus musculus
agaaactcgtggtgattttaagatt

SEQ ID NO: 138067 - DNA, 25 bp, Mus musculus
agaaactctacaagtcctgcatcgc

SEQ ID NO: 138068 - DNA, 25 bp, Mus musculus
agaaactctacatgtcctgcatcgc

SEQ ID NO: 138069 - DNA, 25 bp, Mus musculus
agaaactctagaactgaccctctgt

SEQ ID NO: 138070 - DNA, 25 bp, Mus musculus
agaaactctagatctgaccctctgt

SEQ ID NO: 138071 - DNA, 25 bp, Mus musculus
agaaactctcaaacctgcatggaaa

SEQ ID NO: 138072 - DNA, 25 bp, Mus musculus
agaaactctcaatcctgcatggaaa

SEQ ID NO: 138073 - DNA, 25 bp, Mus musculus
agaaactctggtccattggccgatg

SEQ ID NO: 138074 - DNA, 25 bp, Mus musculus
agaaactctggtgcattggccgatg

SEQ ID NO: 138075 - DNA, 25 bp, Mus musculus
agaaactcttctccctagcgacggt

SEQ ID NO: 138076 - DNA, 25 bp, Mus musculus
agaaactcttctgcctagcgacggt

SEQ ID NO: 138077 - DNA, 25 bp, Mus musculus
agaaactgaacacggaccgtctgca

SEQ ID NO: 138078 - DNA, 25 bp, Mus musculus
agaaactgaacagggaccgtctgca

SEQ ID NO: 138079 - DNA, 25 bp, Mus musculus
agaaactgacatcctccagcaaatc

SEQ ID NO: 138080 - DNA, 25 bp, Mus musculus
agaaactgacatgctccagcaaatc

SEQ ID NO: 138081 - DNA, 25 bp, Mus musculus
agaaactgacgcatgtgcttgccac

SEQ ID NO: 138082 - DNA, 25 bp, Mus musculus
agaaactgacgcttgtgcttgccac

SEQ ID NO: 138083 - DNA, 25 bp, Mus musculus
agaaactgagccactgaccaggccc

SEQ ID NO: 138084 - DNA, 25 bp, Mus musculus
agaaactgagcctctgaccaggccc

SEQ ID NO: 138085 - DNA, 25 bp, Mus musculus
agaaactgaggcacaccaccttgtt

SEQ ID NO: 138086 - DNA, 25 bp, Mus musculus
agaaactgaggctcaccaccttgtt

SEQ ID NO: 138087 - DNA, 25 bp, Mus musculus
agaaactgcacaccgacagcggcat

SEQ ID NO: 138088 - DNA, 25 bp, Mus musculus
agaaactgcacagcgacagcggcat

SEQ ID NO: 138089 - DNA, 25 bp, Mus musculus
agaaactgcagtactccttaaagaa

SEQ ID NO: 138090 - DNA, 25 bp, Mus musculus
agaaactgcagtaggtgctggcccc

SEQ ID NO: 138091 - DNA, 25 bp, Mus musculus
agaaactgcagtatctggcctcaga

SEQ ID NO: 138092 - DNA, 25 bp, Mus musculus
agaaactgcagttctccttaaagaa

SEQ ID NO: 138093 - DNA, 25 bp, Mus musculus
agaaactgcagttggtgctggcccc

SEQ ID NO: 138094 - DNA, 25 bp, Mus musculus
agaaactgcagtttctggcctcaga

SEQ ID NO: 138095 - DNA, 25 bp, Mus musculus
agaaactgcctcacataagagccct

SEQ ID NO: 138096 - DNA, 25 bp, Mus musculus
agaaactgcctctcataagagccct

SEQ ID NO: 138097 - DNA, 25 bp, Mus musculus
agaaactgctaaagttcttcttgca

SEQ ID NO: 138098 - DNA, 25 bp, Mus musculus
agaaactgctaatgttcttcttgca

SEQ ID NO: 138099 - DNA, 25 bp, Mus musculus
agaaactgctctagtagactcccaa

SEQ ID NO: 138100 - DNA, 25 bp, Mus musculus
agaaactgctcttgtagactcccaa

SEQ ID NO: 138101 - DNA, 25 bp, Mus musculus
agaaactgcttgctggtgtccctct

SEQ ID NO: 138102 - DNA, 25 bp, Mus musculus
agaaactgcttggtggtgtccctct

SEQ ID NO: 138103 - DNA, 25 bp, Mus musculus
agaaactggagaacaacttggctat

SEQ ID NO: 138104 - DNA, 25 bp, Mus musculus
agaaactggagatcaacttggctat

SEQ ID NO: 138105 - DNA, 25 bp, Mus musculus
agaaactggatgaccttcaccagca

SEQ ID NO: 138106 - DNA, 25 bp, Mus musculus
agaaactggatgtccttcaccagca

SEQ ID NO: 138107 - DNA, 25 bp, Mus musculus
agaaactggattcccacagccggca

SEQ ID NO: 138108 - DNA, 25 bp, Mus musculus
agaaactggattgccacagccggca

SEQ ID NO: 138109 - DNA, 25 bp, Mus musculus
agaaactggcaactgtccacgcgct

SEQ ID NO: 138110 - DNA, 25 bp, Mus musculus
agaaactggcaagtgtccacgcgct

SEQ ID NO: 138111 - DNA, 25 bp, Mus musculus
agaaactggccacggacctgcctgg

SEQ ID NO: 138112 - DNA, 25 bp, Mus musculus
agaaactggccagggacctgcctgg

SEQ ID NO: 138113 - DNA, 25 bp, Mus musculus
agaaactggcctacatcgagaacct

SEQ ID NO: 138114 - DNA, 25 bp, Mus musculus
agaaactggccttcatcgagaacct

SEQ ID NO: 138115 - DNA, 25 bp, Mus musculus
agaaactggtagctgacatgcctct

SEQ ID NO: 138116 - DNA, 25 bp, Mus musculus
agaaactggtaggtgacatgcctct

SEQ ID NO: 138117 - DNA, 25 bp, Mus musculus
agaaactgtattaccatttgcacac

SEQ ID NO: 138118 - DNA, 25 bp, Mus musculus
agaaactgtatttccatttgcacac

SEQ ID NO: 138119 - DNA, 25 bp, Mus musculus
agaaactgtgggactctgaccccta

SEQ ID NO: 138120 - DNA, 25 bp, Mus musculus
agaaactgtgggtctctgaccccta

SEQ ID NO: 138121 - DNA, 25 bp, Mus musculus
agaaactgtttaatggacaacctgt

SEQ ID NO: 138122 - DNA, 25 bp, Mus musculus
agaaactgtttattggacaacctgt

SEQ ID NO: 138123 - DNA, 25 bp, Mus musculus
agaaacttaactcttgcctgcctac

SEQ ID NO: 138124 - DNA, 25 bp, Mus musculus
agaaacttaactgttgcctgcctac

SEQ ID NO: 138125 - DNA, 25 bp, Mus musculus
agaaacttagaccaccaatatagct

SEQ ID NO: 138126 - DNA, 25 bp, Mus musculus
agaaacttagacgaccaatatagct

SEQ ID NO: 138127 - DNA, 25 bp, Mus musculus
agaaacttagtgcacgtccatctat

SEQ ID NO: 138128 - DNA, 25 bp, Mus musculus
agaaacttagtggacgtccatctat

SEQ ID NO: 138129 - DNA, 25 bp, Mus musculus
agaaacttcaacacttatctcccca

SEQ ID NO: 138130 - DNA, 25 bp, Mus musculus
agaaacttcaactcttatctcccca

SEQ ID NO: 138131 - DNA, 25 bp, Mus musculus
agaaacttcagtaaccacctcacaa

SEQ ID NO: 138132 - DNA, 25 bp, Mus musculus
agaaacttcagttaccacctcacaa

SEQ ID NO: 138133 - DNA, 25 bp, Mus musculus
agaaacttccgacgacagcgaccag

SEQ ID NO: 138134 - DNA, 25 bp, Mus musculus
agaaacttccgaggacagcgaccag

SEQ ID NO: 138135 - DNA, 25 bp, Mus musculus
agaaacttcgtcaggtcatctctga

SEQ ID NO: 138136 - DNA, 25 bp, Mus musculus
agaaacttcgtctggtcatctctga

SEQ ID NO: 138137 - DNA, 25 bp, Mus musculus
agaaacttctctcagattctggtca

SEQ ID NO: 138138 - DNA, 25 bp, Mus musculus
agaaacttctctgagattctggtca

SEQ ID NO: 138139 - DNA, 25 bp, Mus musculus
agaaacttgaggaagcggcttgcca

SEQ ID NO: 138140 - DNA, 25 bp, Mus musculus
agaaacttgaggtagcggcttgcca

SEQ ID NO: 138141 - DNA, 25 bp, Mus musculus
agaaacttgctacccatgactacat

SEQ ID NO: 138142 - DNA, 25 bp, Mus musculus
agaaacttgctagccatgactacat

SEQ ID NO: 138143 - DNA, 25 bp, Mus musculus
agaaacttgctgagcccatcattga

SEQ ID NO: 138144 - DNA, 25 bp, Mus musculus
agaaacttgctgattatacccctca

SEQ ID NO: 138145 - DNA, 25 bp, Mus musculus
agaaacttgctgtgcccatcattga

SEQ ID NO: 138146 - DNA, 25 bp, Mus musculus
agaaacttgctgtttatacccctca

SEQ ID NO: 138147 - DNA, 25 bp, Mus musculus
agaaacttgcttattttcatattgt

SEQ ID NO: 138148 - DNA, 25 bp, Mus musculus
agaaacttgctttttttcatattgt

SEQ ID NO: 138149 - DNA, 25 bp, Mus musculus
agaaacttgttcatctctctgcctt

SEQ ID NO: 138150 - DNA, 25 bp, Mus musculus
agaaacttgttcttctctctgcctt

SEQ ID NO: 138151 - DNA, 25 bp, Mus musculus
agaaactttctcaaatctccccagg

SEQ ID NO: 138152 - DNA, 25 bp, Mus musculus
agaaactttctctaatctccccagg

SEQ ID NO: 138153 - DNA, 25 bp, Mus musculus
agaaactttgcactgaccctgggaa

SEQ ID NO: 138154 - DNA, 25 bp, Mus musculus
agaaactttgcagtgaccctgggaa

SEQ ID NO: 138155 - DNA, 25 bp, Mus musculus
agaaactttgcccagtgttgttcca

SEQ ID NO: 138156 - DNA, 25 bp, Mus musculus
agaaactttgccgagtgttgttcca

SEQ ID NO: 138157 - DNA, 25 bp, Mus musculus
agaaagaaaactcagagacttgctt

SEQ ID NO: 138158 - DNA, 25 bp, Mus musculus
agaaagaaaactgagagacttgctt

SEQ ID NO: 138159 - DNA, 25 bp, Mus musculus
agaaagaaaccaagaatttgaggat

SEQ ID NO: 138160 - DNA, 25 bp, Mus musculus
agaaagaaaccatgaatttgaggat

SEQ ID NO: 138161 - DNA, 25 bp, Mus musculus
agaaagaacgatatggctctgtcca

SEQ ID NO: 138162 - DNA, 25 bp, Mus musculus
agaaagaacgatttggctctgtcca

SEQ ID NO: 138163 - DNA, 25 bp, Mus musculus
agaaagaacgctccgcaccatcatt

SEQ ID NO: 138164 - DNA, 25 bp, Mus musculus
agaaagaacgctgcgcaccatcatt

SEQ ID NO: 138165 - DNA, 25 bp, Mus musculus
agaaagaactctcccacaaaggtgg

SEQ ID NO: 138166 - DNA, 25 bp, Mus musculus
agaaagaactctgccacaaaggtgg

SEQ ID NO: 138167 - DNA, 25 bp, Mus musculus
agaaagaactgtcgcttcccgggca

SEQ ID NO: 138168 - DNA, 25 bp, Mus musculus
agaaagaactgtggcttcccgggca

SEQ ID NO: 138169 - DNA, 25 bp, Mus musculus
agaaagaagactcagggtcgccctg

SEQ ID NO: 138170 - DNA, 25 bp, Mus musculus
agaaagaagactgagggtcgccctg

SEQ ID NO: 138171 - DNA, 25 bp, Mus musculus
agaaagaagctcatcgctcttctca

SEQ ID NO: 138172 - DNA, 25 bp, Mus musculus
agaaagaagctcttcgctcttctca

SEQ ID NO: 138173 - DNA, 25 bp, Mus musculus
agaaagaagtaccataccatgctca

SEQ ID NO: 138174 - DNA, 25 bp, Mus musculus
agaaagaagtacgataccatgctca

SEQ ID NO: 138175 - DNA, 25 bp, Mus musculus
agaaagaagttaccgaggaggcctt

SEQ ID NO: 138176 - DNA, 25 bp, Mus musculus
agaaagaagttagcgaggaggcctt

SEQ ID NO: 138177 - DNA, 25 bp, Mus musculus
agaaagaatacaacagcctccggct

SEQ ID NO: 138178 - DNA, 25 bp, Mus musculus
agaaagaatacatcagcctccggct

SEQ ID NO: 138179 - DNA, 25 bp, Mus musculus
agaaagaatttcaggcccatgcccc

SEQ ID NO: 138180 - DNA, 25 bp, Mus musculus
agaaagaatttctggcccatgcccc

SEQ ID NO: 138181 - DNA, 25 bp, Mus musculus
agaaagacagaacttcctcagcacc

SEQ ID NO: 138182 - DNA, 25 bp, Mus musculus
agaaagacagaagttcctcagcacc

SEQ ID NO: 138183 - DNA, 25 bp, Mus musculus
agaaagacagctctcaccctgatgc

SEQ ID NO: 138184 - DNA, 25 bp, Mus musculus
agaaagacagctgtcaccctgatgc

SEQ ID NO: 138185 - DNA, 25 bp, Mus musculus
agaaagacagtgatccaagcccgct

SEQ ID NO: 138186 - DNA, 25 bp, Mus musculus
agaaagacagtgttccaagcccgct

SEQ ID NO: 138187 - DNA, 25 bp, Mus musculus
agaaagacatccaatgcgcagcacc

SEQ ID NO: 138188 - DNA, 25 bp, Mus musculus
agaaagacatcctatgcgcagcacc

SEQ ID NO: 138189 - DNA, 25 bp, Mus musculus
agaaagacccatatatctccacagc

SEQ ID NO: 138190 - DNA, 25 bp, Mus musculus
agaaagacccatttatctccacagc

SEQ ID NO: 138191 - DNA, 25 bp, Mus musculus
agaaagaccctgaattcccttgcca

SEQ ID NO: 138192 - DNA, 25 bp, Mus musculus
agaaagaccctgtattcccttgcca

SEQ ID NO: 138193 - DNA, 25 bp, Mus musculus
agaaagacctgcagatcaccgagat

SEQ ID NO: 138194 - DNA, 25 bp, Mus musculus
agaaagacctgctgatcaccgagat

SEQ ID NO: 138195 - DNA, 25 bp, Mus musculus
agaaagacctggatatcccacctcc

SEQ ID NO: 138196 - DNA, 25 bp, Mus musculus
agaaagacctggttatcccacctcc

SEQ ID NO: 138197 - DNA, 25 bp, Mus musculus
agaaagacgagcagctccgaatcgt

SEQ ID NO: 138198 - DNA, 25 bp, Mus musculus
agaaagacgagctgctccgaatcgt

SEQ ID NO: 138199 - DNA, 25 bp, Mus musculus
agaaagactcacacctgcgctctgg

SEQ ID NO: 138200 - DNA, 25 bp, Mus musculus
agaaagactcactcctgcgctctgg

SEQ ID NO: 138201 - DNA, 25 bp, Mus musculus
agaaagactcctcttgctactccag

SEQ ID NO: 138202 - DNA, 25 bp, Mus musculus
agaaagactcctgttgctactccag

SEQ ID NO: 138203 - DNA, 25 bp, Mus musculus
agaaagactcggacacctgagtgaa

SEQ ID NO: 138204 - DNA, 25 bp, Mus musculus
agaaagactcggtcacctgagtgaa

SEQ ID NO: 138205 - DNA, 25 bp, Mus musculus
agaaagactgcccatatatgtgtgc

SEQ ID NO: 138206 - DNA, 25 bp, Mus musculus
agaaagactgccgatatatgtgtgc

SEQ ID NO: 138207 - DNA, 25 bp, Mus musculus
agaaagactggcctggctcccagca

SEQ ID NO: 138208 - DNA, 25 bp, Mus musculus
agaaagactggcgtggctcccagca

SEQ ID NO: 138209 - DNA, 25 bp, Mus musculus
agaaagagaagtccggctcagctcc

SEQ ID NO: 138210 - DNA, 25 bp, Mus musculus
agaaagagaagtgcggctcagctcc

SEQ ID NO: 138211 - DNA, 25 bp, Mus musculus
agaaagagaccaagtagccaccacc

SEQ ID NO: 138212 - DNA, 25 bp, Mus musculus
agaaagagaccatgtagccaccacc

SEQ ID NO: 138213 - DNA, 25 bp, Mus musculus
agaaagagactcctggccgccaagc

SEQ ID NO: 138214 - DNA, 25 bp, Mus musculus
agaaagagactcgtggccgccaagc

SEQ ID NO: 138215 - DNA, 25 bp, Mus musculus
agaaagagatccacggtcctttgcc

SEQ ID NO: 138216 - DNA, 25 bp, Mus musculus
agaaagagatcctcggtcctttgcc

SEQ ID NO: 138217 - DNA, 25 bp, Mus musculus
agaaagagcatccttcatccatgtc

SEQ ID NO: 138218 - DNA, 25 bp, Mus musculus
agaaagagcatcgttcatccatgtc

SEQ ID NO: 138219 - DNA, 25 bp, Mus musculus
agaaagagctctatacttcctccca

SEQ ID NO: 138220 - DNA, 25 bp, Mus musculus
agaaagagctctttacttcctccca

SEQ ID NO: 138221 - DNA, 25 bp, Mus musculus
agaaagagtctacgcccgcaagggc

SEQ ID NO: 138222 - DNA, 25 bp, Mus musculus
agaaagagtctaggcccgcaagggc

SEQ ID NO: 138223 - DNA, 25 bp, Mus musculus
agaaagagtctcagatcttccctcc

SEQ ID NO: 138224 - DNA, 25 bp, Mus musculus
agaaagagtctctgatcttccctcc

SEQ ID NO: 138225 - DNA, 25 bp, Mus musculus
agaaagagtgctcccactcttccag

SEQ ID NO: 138226 - DNA, 25 bp, Mus musculus
agaaagagtgctgccactcttccag

SEQ ID NO: 138227 - DNA, 25 bp, Mus musculus
agaaagatagaaccttgttctgtag

SEQ ID NO: 138228 - DNA, 25 bp, Mus musculus
agaaagatagaagcttgttctgtag

SEQ ID NO: 138229 - DNA, 25 bp, Mus musculus
agaaagatatcccaatacagtcttt

SEQ ID NO: 138230 - DNA, 25 bp, Mus musculus
agaaagatatccgaatacagtcttt

SEQ ID NO: 138231 - DNA, 25 bp, Mus musculus
agaaagatcaccaaggctcgggagt

SEQ ID NO: 138232 - DNA, 25 bp, Mus musculus
agaaagatcacctaggctcgggagt

SEQ ID NO: 138233 - DNA, 25 bp, Mus musculus
agaaagatcaggaatccaggccagg

SEQ ID NO: 138234 - DNA, 25 bp, Mus musculus
agaaagatcaggtatccaggccagg

SEQ ID NO: 138235 - DNA, 25 bp, Mus musculus
agaaagatcccacctgtttactcag

SEQ ID NO: 138236 - DNA, 25 bp, Mus musculus
agaaagatcccagctgtttactcag

SEQ ID NO: 138237 - DNA, 25 bp, Mus musculus
agaaagatccggagaccaccattta

SEQ ID NO: 138238 - DNA, 25 bp, Mus musculus
agaaagatccggtgaccaccattta

SEQ ID NO: 138239 - DNA, 25 bp, Mus musculus
agaaagatgaagatccagggctgtg

SEQ ID NO: 138240 - DNA, 25 bp, Mus musculus
agaaagatgaagttccagggctgtg

SEQ ID NO: 138241 - DNA, 25 bp, Mus musculus
agaaagatgactcccccttatcacc

SEQ ID NO: 138242 - DNA, 25 bp, Mus musculus
agaaagatgactgccccttatcacc

SEQ ID NO: 138243 - DNA, 25 bp, Mus musculus
agaaagatgtgcataccagagcccc

SEQ ID NO: 138244 - DNA, 25 bp, Mus musculus
agaaagatgtgcttaccagagcccc

SEQ ID NO: 138245 - DNA, 25 bp, Mus musculus
agaaagatgtggctctgaaggcaaa

SEQ ID NO: 138246 - DNA, 25 bp, Mus musculus
agaaagatgtgggtctgaaggcaaa

SEQ ID NO: 138247 - DNA, 25 bp, Mus musculus
agaaagattcagctggaggccatca

SEQ ID NO: 138248 - DNA, 25 bp, Mus musculus
agaaagattcaggtggaggccatca

SEQ ID NO: 138249 - DNA, 25 bp, Mus musculus
agaaagcaacaaagtattacagatt

SEQ ID NO: 138250 - DNA, 25 bp, Mus musculus
agaaagcaacaatgtattacagatt

SEQ ID NO: 138251 - DNA, 25 bp, Mus musculus
agaaagcaacggcacagtcatgggt

SEQ ID NO: 138252 - DNA, 25 bp, Mus musculus
agaaagcaacgggacagtcatgggt

SEQ ID NO: 138253 - DNA, 25 bp, Mus musculus
agaaagcaaggactggcctctgcct

SEQ ID NO: 138254 - DNA, 25 bp, Mus musculus
agaaagcaaggagtggcctctgcct

SEQ ID NO: 138255 - DNA, 25 bp, Mus musculus
agaaagcaattcatccactaaggtt

SEQ ID NO: 138256 - DNA, 25 bp, Mus musculus
agaaagcaattcttccactaaggtt

SEQ ID NO: 138257 - DNA, 25 bp, Mus musculus
agaaagcacagcaaaccctgttagg

SEQ ID NO: 138258 - DNA, 25 bp, Mus musculus
agaaagcacagctaaccctgttagg

SEQ ID NO: 138259 - DNA, 25 bp, Mus musculus
agaaagcacctgctccaaaggcggc

SEQ ID NO: 138260 - DNA, 25 bp, Mus musculus
agaaagcacctggtccaaaggcggc

SEQ ID NO: 138261 - DNA, 25 bp, Mus musculus
agaaagcactctctgggtcagccac

SEQ ID NO: 138262 - DNA, 25 bp, Mus musculus
agaaagcactctgtgggtcagccac

SEQ ID NO: 138263 - DNA, 25 bp, Mus musculus
agaaagcacttcagagcctcagcat

SEQ ID NO: 138264 - DNA, 25 bp, Mus musculus
agaaagcacttctgagcctcagcat

SEQ ID NO: 138265 - DNA, 25 bp, Mus musculus
agaaagcagaggactccgcaaggga

SEQ ID NO: 138266 - DNA, 25 bp, Mus musculus
agaaagcagaggtctccgcaaggga

SEQ ID NO: 138267 - DNA, 25 bp, Mus musculus
agaaagcagcccctatactgggccc

SEQ ID NO: 138268 - DNA, 25 bp, Mus musculus
agaaagcagcccgtatactgggccc

SEQ ID NO: 138269 - DNA, 25 bp, Mus musculus
agaaagcagcgaatctggacctcaa

SEQ ID NO: 138270 - DNA, 25 bp, Mus musculus
agaaagcagcgattctggacctcaa

SEQ ID NO: 138271 - DNA, 25 bp, Mus musculus
agaaagcaggctccctagcctttgc

SEQ ID NO: 138272 - DNA, 25 bp, Mus musculus
agaaagcaggctgcctagcctttgc

SEQ ID NO: 138273 - DNA, 25 bp, Mus musculus
agaaagcaggttacaccctcaacaa

SEQ ID NO: 138274 - DNA, 25 bp, Mus musculus
agaaagcaggtttcaccctcaacaa

SEQ ID NO: 138275 - DNA, 25 bp, Mus musculus
agaaagcagttgatgtcctctgcca

SEQ ID NO: 138276 - DNA, 25 bp, Mus musculus
agaaagcagttgttgtcctctgcca

SEQ ID NO: 138277 - DNA, 25 bp, Mus musculus
agaaagcatcgtagccgtgtggcct

SEQ ID NO: 138278 - DNA, 25 bp, Mus musculus
agaaagcatcgttgccgtgtggcct

SEQ ID NO: 138279 - DNA, 25 bp, Mus musculus
agaaagcatctaacctcttctcaga

SEQ ID NO: 138280 - DNA, 25 bp, Mus musculus
agaaagcatctatcctcttctcaga

SEQ ID NO: 138281 - DNA, 25 bp, Mus musculus
agaaagcatcttcccaaatagtacc

SEQ ID NO: 138282 - DNA, 25 bp, Mus musculus
agaaagcatcttgccaaatagtacc

SEQ ID NO: 138283 - DNA, 25 bp, Mus musculus
agaaagcattcaagtgctctgcccc

SEQ ID NO: 138284 - DNA, 25 bp, Mus musculus
agaaagcattcatgtgctctgcccc

SEQ ID NO: 138285 - DNA, 25 bp, Mus musculus
agaaagcattctacatttatggtgc

SEQ ID NO: 138286 - DNA, 25 bp, Mus musculus
agaaagcattcttcatttatggtgc

SEQ ID NO: 138287 - DNA, 25 bp, Mus musculus
agaaagcattgtaactccgtgccct

SEQ ID NO: 138288 - DNA, 25 bp, Mus musculus
agaaagcattgttactccgtgccct

SEQ ID NO: 138289 - DNA, 25 bp, Mus musculus
agaaagcatttcaccacccctgtag

SEQ ID NO: 138290 - DNA, 25 bp, Mus musculus
agaaagcatttctccacccctgtag

SEQ ID NO: 138291 - DNA, 25 bp, Mus musculus
agaaagcatttgagtttccctctcc

SEQ ID NO: 138292 - DNA, 25 bp, Mus musculus
agaaagcatttgtgtttccctctcc

SEQ ID NO: 138293 - DNA, 25 bp, Mus musculus
agaaagccacaaattggtcccacca

SEQ ID NO: 138294 - DNA, 25 bp, Mus musculus
agaaagccacaatttggtcccacca

SEQ ID NO: 138295 - DNA, 25 bp, Mus musculus
agaaagccacacacggatcctgact

SEQ ID NO: 138296 - DNA, 25 bp, Mus musculus
agaaagccacactcggatcctgact

SEQ ID NO: 138297 - DNA, 25 bp, Mus musculus
agaaagccactgatacaaaggtttg

SEQ ID NO: 138298 - DNA, 25 bp, Mus musculus
agaaagccactgttacaaaggtttg

SEQ ID NO: 138299 - DNA, 25 bp, Mus musculus
agaaagccaggcatggcccggcagt

SEQ ID NO: 138300 - DNA, 25 bp, Mus musculus
agaaagccaggcttggcccggcagt

SEQ ID NO: 138301 - DNA, 25 bp, Mus musculus
agaaagccatctctcttctttctaa

SEQ ID NO: 138302 - DNA, 25 bp, Mus musculus
agaaagccatctgtcttctttctaa

SEQ ID NO: 138303 - DNA, 25 bp, Mus musculus
agaaagccatgacccctggctgtaa

SEQ ID NO: 138304 - DNA, 25 bp, Mus musculus
agaaagccatgagccctggctgtaa

SEQ ID NO: 138305 - DNA, 25 bp, Mus musculus
agaaagccattacgcagactaaagt

SEQ ID NO: 138306 - DNA, 25 bp, Mus musculus
agaaagccattaggcagactaaagt

SEQ ID NO: 138307 - DNA, 25 bp, Mus musculus
agaaagccattcagtgcatccctga

SEQ ID NO: 138308 - DNA, 25 bp, Mus musculus
agaaagccattctgtgcatccctga

SEQ ID NO: 138309 - DNA, 25 bp, Mus musculus
agaaagcccagcaagcctttatcga

SEQ ID NO: 138310 - DNA, 25 bp, Mus musculus
agaaagcccagctagcctttatcga

SEQ ID NO: 138311 - DNA, 25 bp, Mus musculus
agaaagcccattccgaggtggccca

SEQ ID NO: 138312 - DNA, 25 bp, Mus musculus
agaaagcccattgcgaggtggccca

SEQ ID NO: 138313 - DNA, 25 bp, Mus musculus
agaaagcccgagctgtactgcagtc

SEQ ID NO: 138314 - DNA, 25 bp, Mus musculus
agaaagcccgaggtgtactgcagtc

SEQ ID NO: 138315 - DNA, 25 bp, Mus musculus
agaaagccctcccttaggctcagaa

SEQ ID NO: 138316 - DNA, 25 bp, Mus musculus
agaaagccctccgttaggctcagaa

SEQ ID NO: 138317 - DNA, 25 bp, Mus musculus
agaaagccctgacagactttgggaa

SEQ ID NO: 138318 - DNA, 25 bp, Mus musculus
agaaagccctgaccaggcacactca

SEQ ID NO: 138319 - DNA, 25 bp, Mus musculus
agaaagccctgagagactttgggaa

SEQ ID NO: 138320 - DNA, 25 bp, Mus musculus
agaaagccctgagcaggcacactca

SEQ ID NO: 138321 - DNA, 25 bp, Mus musculus
agaaagccctgtactgattcctctc

SEQ ID NO: 138322 - DNA, 25 bp, Mus musculus
agaaagccctgttctgattcctctc

SEQ ID NO: 138323 - DNA, 25 bp, Mus musculus
agaaagccgaccaactcattttgac

SEQ ID NO: 138324 - DNA, 25 bp, Mus musculus
agaaagccgacctactcattttgac

SEQ ID NO: 138325 - DNA, 25 bp, Mus musculus
agaaagccgtaccaggctcttcctt

SEQ ID NO: 138326 - DNA, 25 bp, Mus musculus
agaaagccgtacgaggctcttcctt

SEQ ID NO: 138327 - DNA, 25 bp, Mus musculus
agaaagcctcacagatgcctagcca

SEQ ID NO: 138328 - DNA, 25 bp, Mus musculus
agaaagcctcactgatgcctagcca

SEQ ID NO: 138329 - DNA, 25 bp, Mus musculus
agaaagcctcatacacaaaacccca

SEQ ID NO: 138330 - DNA, 25 bp, Mus musculus
agaaagcctcattcacaaaacccca

SEQ ID NO: 138331 - DNA, 25 bp, Mus musculus
agaaagcctccaagattctttccag

SEQ ID NO: 138332 - DNA, 25 bp, Mus musculus
agaaagcctccatgattctttccag

SEQ ID NO: 138333 - DNA, 25 bp, Mus musculus
agaaagcctgcaaggagtcccagca

SEQ ID NO: 138334 - DNA, 25 bp, Mus musculus
agaaagcctgcatggagtcccagca

SEQ ID NO: 138335 - DNA, 25 bp, Mus musculus
agaaagcctggtaggacttccgaag

SEQ ID NO: 138336 - DNA, 25 bp, Mus musculus
agaaagcctggttggacttccgaag

SEQ ID NO: 138337 - DNA, 25 bp, Mus musculus
agaaagcctgtacctggcagccgct

SEQ ID NO: 138338 - DNA, 25 bp, Mus musculus
agaaagcctgtagctggcagccgct

SEQ ID NO: 138339 - DNA, 25 bp, Mus musculus
agaaagcctttccatatttttgatg

SEQ ID NO: 138340 - DNA, 25 bp, Mus musculus
agaaagcctttcgatatttttgatg

SEQ ID NO: 138341 - DNA, 25 bp, Mus musculus
agaaagcgagaactaattcccacaa

SEQ ID NO: 138342 - DNA, 25 bp, Mus musculus
agaaagcgagaagtaattcccacaa

SEQ ID NO: 138343 - DNA, 25 bp, Mus musculus
agaaagcgatttcttccttgcaacc

SEQ ID NO: 138344 - DNA, 25 bp, Mus musculus
agaaagcgatttgttccttgcaacc

SEQ ID NO: 138345 - DNA, 25 bp, Mus musculus
agaaagcgccagcatgatccagagg

SEQ ID NO: 138346 - DNA, 25 bp, Mus musculus
agaaagcgccaggatgatccagagg

SEQ ID NO: 138347 - DNA, 25 bp, Mus musculus
agaaagcggttcagcatagactgca

SEQ ID NO: 138348 - DNA, 25 bp, Mus musculus
agaaagcggttctgcatagactgca

SEQ ID NO: 138349 - DNA, 25 bp, Mus musculus
agaaagctaagactctccatctacc

SEQ ID NO: 138350 - DNA, 25 bp, Mus musculus
agaaagctaagagtctccatctacc

SEQ ID NO: 138351 - DNA, 25 bp, Mus musculus
agaaagctacctacaatccattccg

SEQ ID NO: 138352 - DNA, 25 bp, Mus musculus
agaaagctaccttcaatccattccg

SEQ ID NO: 138353 - DNA, 25 bp, Mus musculus
agaaagctaggcagacaatcgcaga

SEQ ID NO: 138354 - DNA, 25 bp, Mus musculus
agaaagctaggctgacaatcgcaga

SEQ ID NO: 138355 - DNA, 25 bp, Mus musculus
agaaagctcaatatacctgcctctt

SEQ ID NO: 138356 - DNA, 25 bp, Mus musculus
agaaagctcaatttacctgcctctt

SEQ ID NO: 138357 - DNA, 25 bp, Mus musculus
agaaagctcaccagggctagcgaaa

SEQ ID NO: 138358 - DNA, 25 bp, Mus musculus
agaaagctcacctgggctagcgaaa

SEQ ID NO: 138359 - DNA, 25 bp, Mus musculus
agaaagctcagcagaacccaacctt

SEQ ID NO: 138360 - DNA, 25 bp, Mus musculus
agaaagctcagctgaacccaacctt

SEQ ID NO: 138361 - DNA, 25 bp, Mus musculus
agaaagctccagcaactctctgttt

SEQ ID NO: 138362 - DNA, 25 bp, Mus musculus
agaaagctccaggaactctctgttt

SEQ ID NO: 138363 - DNA, 25 bp, Mus musculus
agaaagctcctgcagggtctcacga

SEQ ID NO: 138364 - DNA, 25 bp, Mus musculus
agaaagctcctggagggtctcacga

SEQ ID NO: 138365 - DNA, 25 bp, Mus musculus
agaaagctcgccctgctgcttggga

SEQ ID NO: 138366 - DNA, 25 bp, Mus musculus
agaaagctcgccgtgctgcttggga

SEQ ID NO: 138367 - DNA, 25 bp, Mus musculus
agaaagctcttaactatctcagttg

SEQ ID NO: 138368 - DNA, 25 bp, Mus musculus
agaaagctcttatctatctcagttg

SEQ ID NO: 138369 - DNA, 25 bp, Mus musculus
agaaagctcttcagagttggcctta

SEQ ID NO: 138370 - DNA, 25 bp, Mus musculus
agaaagctcttctgagttggcctta

SEQ ID NO: 138371 - DNA, 25 bp, Mus musculus
agaaagctgaaaaccatcgccttcc

SEQ ID NO: 138372 - DNA, 25 bp, Mus musculus
agaaagctgaaatccatcgccttcc

SEQ ID NO: 138373 - DNA, 25 bp, Mus musculus
agaaagctgagccatcctaacccag

SEQ ID NO: 138374 - DNA, 25 bp, Mus musculus
agaaagctgagcgatcctaacccag

SEQ ID NO: 138375 - DNA, 25 bp, Mus musculus
agaaagctgatgctcacggcacact

SEQ ID NO: 138376 - DNA, 25 bp, Mus musculus
agaaagctgatggtcacggcacact

SEQ ID NO: 138377 - DNA, 25 bp, Mus musculus
agaaagctgcagactggcctatgct

SEQ ID NO: 138378 - DNA, 25 bp, Mus musculus
agaaagctgcagagaccctggcccg

SEQ ID NO: 138379 - DNA, 25 bp, Mus musculus
agaaagctgcagtctggcctatgct

SEQ ID NO: 138380 - DNA, 25 bp, Mus musculus
agaaagctgcagtgaccctggcccg

SEQ ID NO: 138381 - DNA, 25 bp, Mus musculus
agaaagctgcatagttccctgatgg

SEQ ID NO: 138382 - DNA, 25 bp, Mus musculus
agaaagctgcattgttccctgatgg

SEQ ID NO: 138383 - DNA, 25 bp, Mus musculus
agaaagctgccgaccagtgcactga

SEQ ID NO: 138384 - DNA, 25 bp, Mus musculus
agaaagctgccgtccagtgcactga

SEQ ID NO: 138385 - DNA, 25 bp, Mus musculus
agaaagctgcgacctgccacaacag

SEQ ID NO: 138386 - DNA, 25 bp, Mus musculus
agaaagctgcgagctgccacaacag

SEQ ID NO: 138387 - DNA, 25 bp, Mus musculus
agaaagctgtcaacgtgtgccattg

SEQ ID NO: 138388 - DNA, 25 bp, Mus musculus
agaaagctgtcatcgtgtgccattg

SEQ ID NO: 138389 - DNA, 25 bp, Mus musculus
agaaagctgtcgactgcttggcctt

SEQ ID NO: 138390 - DNA, 25 bp, Mus musculus
agaaagctgtcgtctgcttggcctt

SEQ ID NO: 138391 - DNA, 25 bp, Mus musculus
agaaagctgttcatcctaccagtaa

SEQ ID NO: 138392 - DNA, 25 bp, Mus musculus
agaaagctgttcttcctaccagtaa

SEQ ID NO: 138393 - DNA, 25 bp, Mus musculus
agaaagcttagcatggtggccccag

SEQ ID NO: 138394 - DNA, 25 bp, Mus musculus
agaaagcttagcttggtggccccag

SEQ ID NO: 138395 - DNA, 25 bp, Mus musculus
agaaagcttctgattgcatctgcct

SEQ ID NO: 138396 - DNA, 25 bp, Mus musculus
agaaagcttctgtttgcatctgcct

SEQ ID NO: 138397 - DNA, 25 bp, Mus musculus
agaaagcttcttccaacttctgttt

SEQ ID NO: 138398 - DNA, 25 bp, Mus musculus
agaaagcttcttgcaacttctgttt

SEQ ID NO: 138399 - DNA, 25 bp, Mus musculus
agaaagcttgttatcactcgcagcc

SEQ ID NO: 138400 - DNA, 25 bp, Mus musculus
agaaagcttgttttcactcgcagcc

SEQ ID NO: 138401 - DNA, 25 bp, Mus musculus
agaaagcttttgaatccatgtagac

SEQ ID NO: 138402 - DNA, 25 bp, Mus musculus
agaaagcttttgtatccatgtagac

SEQ ID NO: 138403 - DNA, 25 bp, Mus musculus
agaaaggaacctagaactaactgag

SEQ ID NO: 138404 - DNA, 25 bp, Mus musculus
agaaaggaaccttgaactaactgag

SEQ ID NO: 138405 - DNA, 25 bp, Mus musculus
agaaaggaacgcatcccgggcgact

SEQ ID NO: 138406 - DNA, 25 bp, Mus musculus
agaaaggaacgcttcccgggcgact

SEQ ID NO: 138407 - DNA, 25 bp, Mus musculus
agaaaggaacttaatgacatacgat

SEQ ID NO: 138408 - DNA, 25 bp, Mus musculus
agaaaggaactttatgacatacgat

SEQ ID NO: 138409 - DNA, 25 bp, Mus musculus
agaaaggaatgcagtactgactgga

SEQ ID NO: 138410 - DNA, 25 bp, Mus musculus
agaaaggaatgctgtactgactgga

SEQ ID NO: 138411 - DNA, 25 bp, Mus musculus
agaaaggacaccatggcctccatag

SEQ ID NO: 138412 - DNA, 25 bp, Mus musculus
agaaaggacaccttggcctccatag

SEQ ID NO: 138413 - DNA, 25 bp, Mus musculus
agaaaggacattccttctccctgct

SEQ ID NO: 138414 - DNA, 25 bp, Mus musculus
agaaaggacattgcttctccctgct

SEQ ID NO: 138415 - DNA, 25 bp, Mus musculus
agaaaggaccccatcccagctctgc

SEQ ID NO: 138416 - DNA, 25 bp, Mus musculus
agaaaggaccccttcccagctctgc

SEQ ID NO: 138417 - DNA, 25 bp, Mus musculus
agaaaggacctgagccatctggcac

SEQ ID NO: 138418 - DNA, 25 bp, Mus musculus
agaaaggacctgtgccatctggcac

SEQ ID NO: 138419 - DNA, 25 bp, Mus musculus
agaaaggactctatctccctgagtt

SEQ ID NO: 138420 - DNA, 25 bp, Mus musculus
agaaaggactctttctccctgagtt

SEQ ID NO: 138421 - DNA, 25 bp, Mus musculus
agaaaggagactccgactgccgtct

SEQ ID NO: 138422 - DNA, 25 bp, Mus musculus
agaaaggagactgcgactgccgtct

SEQ ID NO: 138423 - DNA, 25 bp, Mus musculus
agaaaggagcctccgaggcacttcc

SEQ ID NO: 138424 - DNA, 25 bp, Mus musculus
agaaaggagcctgcgaggcacttcc

SEQ ID NO: 138425 - DNA, 25 bp, Mus musculus
agaaaggagtccaccccagagtgtt

SEQ ID NO: 138426 - DNA, 25 bp, Mus musculus
agaaaggagtcctccccagagtgtt

SEQ ID NO: 138427 - DNA, 25 bp, Mus musculus
agaaaggattctccagtcccataaa

SEQ ID NO: 138428 - DNA, 25 bp, Mus musculus
agaaaggattctgcagtcccataaa

SEQ ID NO: 138429 - DNA, 25 bp, Mus musculus
agaaaggattgtcccagtagttttt

SEQ ID NO: 138430 - DNA, 25 bp, Mus musculus
agaaaggattgtgccagtagttttt

SEQ ID NO: 138431 - DNA, 25 bp, Mus musculus
agaaaggcacatccatgtgactaat

SEQ ID NO: 138432 - DNA, 25 bp, Mus musculus
agaaaggcacatgcatgtgactaat

SEQ ID NO: 138433 - DNA, 25 bp, Mus musculus
agaaaggcacctaacaggtcccatt

SEQ ID NO: 138434 - DNA, 25 bp, Mus musculus
agaaaggcaccttacaggtcccatt

SEQ ID NO: 138435 - DNA, 25 bp, Mus musculus
agaaaggcacttattcctaccagct

SEQ ID NO: 138436 - DNA, 25 bp, Mus musculus
agaaaggcactttttcctaccagct

SEQ ID NO: 138437 - DNA, 25 bp, Mus musculus
agaaaggcagcaccgcgtctcaggt

SEQ ID NO: 138438 - DNA, 25 bp, Mus musculus
agaaaggcagcagcgcgtctcaggt

SEQ ID NO: 138439 - DNA, 25 bp, Mus musculus
agaaaggcagccagcatggctcggt

SEQ ID NO: 138440 - DNA, 25 bp, Mus musculus
agaaaggcagcctgcatggctcggt

SEQ ID NO: 138441 - DNA, 25 bp, Mus musculus
agaaaggcagctcccctcgtttcac

SEQ ID NO: 138442 - DNA, 25 bp, Mus musculus
agaaaggcagctgccctcgtttcac

SEQ ID NO: 138443 - DNA, 25 bp, Mus musculus
agaaaggcagttcgcctgcatgtgt

SEQ ID NO: 138444 - DNA, 25 bp, Mus musculus
agaaaggcagttggcctgcatgtgt

SEQ ID NO: 138445 - DNA, 25 bp, Mus musculus
agaaaggccaggacaacatcccagc

SEQ ID NO: 138446 - DNA, 25 bp, Mus musculus
agaaaggccaggtcaacatcccagc

SEQ ID NO: 138447 - DNA, 25 bp, Mus musculus
agaaaggcccacagaaatgatgctt

SEQ ID NO: 138448 - DNA, 25 bp, Mus musculus
agaaaggcccactgaaatgatgctt

SEQ ID NO: 138449 - DNA, 25 bp, Mus musculus
agaaaggcccagagtgtctctgtct

SEQ ID NO: 138450 - DNA, 25 bp, Mus musculus
agaaaggcccagtgtgtctctgtct

SEQ ID NO: 138451 - DNA, 25 bp, Mus musculus
agaaaggcctgtatgtcactgacca

SEQ ID NO: 138452 - DNA, 25 bp, Mus musculus
agaaaggcctgtttgtcactgacca

SEQ ID NO: 138453 - DNA, 25 bp, Mus musculus
agaaaggcgtggctgcctgcattca

SEQ ID NO: 138454 - DNA, 25 bp, Mus musculus
agaaaggcgtgggtgcctgcattca

SEQ ID NO: 138455 - DNA, 25 bp, Mus musculus
agaaaggcgttcacatttctttggg

SEQ ID NO: 138456 - DNA, 25 bp, Mus musculus
agaaaggcgttctcatttctttggg

SEQ ID NO: 138457 - DNA, 25 bp, Mus musculus
agaaaggctaccacctacagatctt

SEQ ID NO: 138458 - DNA, 25 bp, Mus musculus
agaaaggctacctcctacagatctt

SEQ ID NO: 138459 - DNA, 25 bp, Mus musculus
agaaaggctctcctgcagcagtgca

SEQ ID NO: 138460 - DNA, 25 bp, Mus musculus
agaaaggctctcgtgcagcagtgca

SEQ ID NO: 138461 - DNA, 25 bp, Mus musculus
agaaaggctgccatcagtcccagtg

SEQ ID NO: 138462 - DNA, 25 bp, Mus musculus
agaaaggctgccttcagtcccagtg

SEQ ID NO: 138463 - DNA, 25 bp, Mus musculus
agaaaggcttctacacacctgagtt

SEQ ID NO: 138464 - DNA, 25 bp, Mus musculus
agaaaggcttcttcacacctgagtt

SEQ ID NO: 138465 - DNA, 25 bp, Mus musculus
agaaaggctttactctgctggctct

SEQ ID NO: 138466 - DNA, 25 bp, Mus musculus
agaaaggctttagtctgctggctct

SEQ ID NO: 138467 - DNA, 25 bp, Mus musculus
agaaaggctttgaatgtccaggact

SEQ ID NO: 138468 - DNA, 25 bp, Mus musculus
agaaaggctttgcaccttggatcac

SEQ ID NO: 138469 - DNA, 25 bp, Mus musculus
agaaaggctttggaccttggatcac

SEQ ID NO: 138470 - DNA, 25 bp, Mus musculus
agaaaggctttgtatgtccaggact

SEQ ID NO: 138471 - DNA, 25 bp, Mus musculus
agaaagggacttcctatggtgtctg

SEQ ID NO: 138472 - DNA, 25 bp, Mus musculus
agaaagggacttgctatggtgtctg

SEQ ID NO: 138473 - DNA, 25 bp, Mus musculus
agaaagggatgacagctaaccagga

SEQ ID NO: 138474 - DNA, 25 bp, Mus musculus
agaaagggatgagagctaaccagga

SEQ ID NO: 138475 - DNA, 25 bp, Mus musculus
agaaagggcagactcttgtggcaat

SEQ ID NO: 138476 - DNA, 25 bp, Mus musculus
agaaagggcagagtcttgtggcaat

SEQ ID NO: 138477 - DNA, 25 bp, Mus musculus
agaaagggcatcctatcctgttcct

SEQ ID NO: 138478 - DNA, 25 bp, Mus musculus
agaaagggcatcgtatcctgttcct

SEQ ID NO: 138479 - DNA, 25 bp, Mus musculus
agaaagggccatagcttgcattcct

SEQ ID NO: 138480 - DNA, 25 bp, Mus musculus
agaaagggccattgcttgcattcct

SEQ ID NO: 138481 - DNA, 25 bp, Mus musculus
agaaagggcccaccagattgcggct

SEQ ID NO: 138482 - DNA, 25 bp, Mus musculus
agaaagggcccagcagattgcggct

SEQ ID NO: 138483 - DNA, 25 bp, Mus musculus
agaaagggcctcactacatcacgct

SEQ ID NO: 138484 - DNA, 25 bp, Mus musculus
agaaagggcctctctacatcacgct

SEQ ID NO: 138485 - DNA, 25 bp, Mus musculus
agaaagggcctgcagtatcgccctg

SEQ ID NO: 138486 - DNA, 25 bp, Mus musculus
agaaagggcctggagtatcgccctg

SEQ ID NO: 138487 - DNA, 25 bp, Mus musculus
agaaagggctgaattcctgaggctg

SEQ ID NO: 138488 - DNA, 25 bp, Mus musculus
agaaagggctgatttcctgaggctg

SEQ ID NO: 138489 - DNA, 25 bp, Mus musculus
agaaagggcttcagtttttcacaca

SEQ ID NO: 138490 - DNA, 25 bp, Mus musculus
agaaagggcttctgtttttcacaca

SEQ ID NO: 138491 - DNA, 25 bp, Mus musculus
agaaagggtccaactgcgacctcac

SEQ ID NO: 138492 - DNA, 25 bp, Mus musculus
agaaagggtccatctgcgacctcac

SEQ ID NO: 138493 - DNA, 25 bp, Mus musculus
agaaagggtctcacgcagccctgca

SEQ ID NO: 138494 - DNA, 25 bp, Mus musculus
agaaagggtctctcgcagccctgca

SEQ ID NO: 138495 - DNA, 25 bp, Mus musculus
agaaaggtaccacgacccctgagct

SEQ ID NO: 138496 - DNA, 25 bp, Mus musculus
agaaaggtaccaggacccctgagct

SEQ ID NO: 138497 - DNA, 25 bp, Mus musculus
agaaaggtactcaggtgatgtcccc

SEQ ID NO: 138498 - DNA, 25 bp, Mus musculus
agaaaggtactctggtgatgtcccc

SEQ ID NO: 138499 - DNA, 25 bp, Mus musculus
agaaaggtagatcggcatttcaacc

SEQ ID NO: 138500 - DNA, 25 bp, Mus musculus
agaaaggtagatgggcatttcaacc

SEQ ID NO: 138501 - DNA, 25 bp, Mus musculus
agaaaggtaggcctccagctccagt

SEQ ID NO: 138502 - DNA, 25 bp, Mus musculus
agaaaggtaggcgtccagctccagt

SEQ ID NO: 138503 - DNA, 25 bp, Mus musculus
agaaaggtcaccatgttcttcctta

SEQ ID NO: 138504 - DNA, 25 bp, Mus musculus
agaaaggtcaccttgttcttcctta

SEQ ID NO: 138505 - DNA, 25 bp, Mus musculus
agaaaggtccggagcagctgatcca

SEQ ID NO: 138506 - DNA, 25 bp, Mus musculus
agaaaggtccggtgcagctgatcca

SEQ ID NO: 138507 - DNA, 25 bp, Mus musculus
agaaaggtgggacccctcctatatg

SEQ ID NO: 138508 - DNA, 25 bp, Mus musculus
agaaaggtgggagccctcctatatg

SEQ ID NO: 138509 - DNA, 25 bp, Mus musculus
agaaaggtgtttccatgacctgacc

SEQ ID NO: 138510 - DNA, 25 bp, Mus musculus
agaaaggtgtttgcatgacctgacc

SEQ ID NO: 138511 - DNA, 25 bp, Mus musculus
agaaaggttccaccctttttctcag

SEQ ID NO: 138512 - DNA, 25 bp, Mus musculus
agaaaggttccagcctttttctcag

SEQ ID NO: 138513 - DNA, 25 bp, Mus musculus
agaaagtaacccagttctgcaccac

SEQ ID NO: 138514 - DNA, 25 bp, Mus musculus
agaaagtaaccctgttctgcaccac

SEQ ID NO: 138515 - DNA, 25 bp, Mus musculus
agaaagtagcggactacacccacct

SEQ ID NO: 138516 - DNA, 25 bp, Mus musculus
agaaagtagcggtctacacccacct

SEQ ID NO: 138517 - DNA, 25 bp, Mus musculus
agaaagtcaaatcgcgtccagttta

SEQ ID NO: 138518 - DNA, 25 bp, Mus musculus
agaaagtcaaatggcgtccagttta

SEQ ID NO: 138519 - DNA, 25 bp, Mus musculus
agaaagtcacccaggccattaccag

SEQ ID NO: 138520 - DNA, 25 bp, Mus musculus
agaaagtcaccctggccattaccag

SEQ ID NO: 138521 - DNA, 25 bp, Mus musculus
agaaagtcagtcagcttagcccttc

SEQ ID NO: 138522 - DNA, 25 bp, Mus musculus
agaaagtcagtctgcttagcccttc

SEQ ID NO: 138523 - DNA, 25 bp, Mus musculus
agaaagtcatcccttaattgccacc

SEQ ID NO: 138524 - DNA, 25 bp, Mus musculus
agaaagtcatccgttaattgccacc

SEQ ID NO: 138525 - DNA, 25 bp, Mus musculus
agaaagtcctacagtccaacatcct

SEQ ID NO: 138526 - DNA, 25 bp, Mus musculus
agaaagtcctactgtccaacatcct

SEQ ID NO: 138527 - DNA, 25 bp, Mus musculus
agaaagtcctcacaccttagcacag

SEQ ID NO: 138528 - DNA, 25 bp, Mus musculus
agaaagtcctcagaccttagcacag

SEQ ID NO: 138529 - DNA, 25 bp, Mus musculus
agaaagtcctttctcactcggagat

SEQ ID NO: 138530 - DNA, 25 bp, Mus musculus
agaaagtcctttgtcactcggagat

SEQ ID NO: 138531 - DNA, 25 bp, Mus musculus
agaaagtctacaagggcagccctga

SEQ ID NO: 138532 - DNA, 25 bp, Mus musculus
agaaagtctacatgggcagccctga

SEQ ID NO: 138533 - DNA, 25 bp, Mus musculus
agaaagtctatgctctccactactg

SEQ ID NO: 138534 - DNA, 25 bp, Mus musculus
agaaagtctatggtctccactactg

SEQ ID NO: 138535 - DNA, 25 bp, Mus musculus
agaaagtctgacagcttgctcctgc

SEQ ID NO: 138536 - DNA, 25 bp, Mus musculus
agaaagtctgactgcttgctcctgc

SEQ ID NO: 138537 - DNA, 25 bp, Mus musculus
agaaagtctggcaagtgccttgaac

SEQ ID NO: 138538 - DNA, 25 bp, Mus musculus
agaaagtctggctagtgccttgaac

SEQ ID NO: 138539 - DNA, 25 bp, Mus musculus
agaaagtgacgcagtctgacctcta

SEQ ID NO: 138540 - DNA, 25 bp, Mus musculus
agaaagtgacgctgtctgacctcta

SEQ ID NO: 138541 - DNA, 25 bp, Mus musculus
agaaagtgactcaccttgcttagca

SEQ ID NO: 138542 - DNA, 25 bp, Mus musculus
agaaagtgactctccttgcttagca

SEQ ID NO: 138543 - DNA, 25 bp, Mus musculus
agaaagtgcactccccctcagtgaa

SEQ ID NO: 138544 - DNA, 25 bp, Mus musculus
agaaagtgcactgcccctcagtgaa

SEQ ID NO: 138545 - DNA, 25 bp, Mus musculus
agaaagtgcgctctggtcaatgcca

SEQ ID NO: 138546 - DNA, 25 bp, Mus musculus
agaaagtgcgctgtggtcaatgcca

SEQ ID NO: 138547 - DNA, 25 bp, Mus musculus
agaaagtgctatcctgggtcctcaa

SEQ ID NO: 138548 - DNA, 25 bp, Mus musculus
agaaagtgctatgctgggtcctcaa

SEQ ID NO: 138549 - DNA, 25 bp, Mus musculus
agaaagtgctgtaccagaacctcct

SEQ ID NO: 138550 - DNA, 25 bp, Mus musculus
agaaagtgctgttccagaacctcct

SEQ ID NO: 138551 - DNA, 25 bp, Mus musculus
agaaagtgggtcagcacctcaggga

SEQ ID NO: 138552 - DNA, 25 bp, Mus musculus
agaaagtgggtcatcgccaagccct

SEQ ID NO: 138553 - DNA, 25 bp, Mus musculus
agaaagtgggtctgcacctcaggga

SEQ ID NO: 138554 - DNA, 25 bp, Mus musculus
agaaagtgggtcttcgccaagccct

SEQ ID NO: 138555 - DNA, 25 bp, Mus musculus
agaaagtgtcttagctgcctggtta

SEQ ID NO: 138556 - DNA, 25 bp, Mus musculus
agaaagtgtctttgctgcctggtta

SEQ ID NO: 138557 - DNA, 25 bp, Mus musculus
agaaagtgtgtaaggtcctttgcat

SEQ ID NO: 138558 - DNA, 25 bp, Mus musculus
agaaagtgtgtatggtcctttgcat

SEQ ID NO: 138559 - DNA, 25 bp, Mus musculus
agaaagtgtgtgagacgttgctgaa

SEQ ID NO: 138560 - DNA, 25 bp, Mus musculus
agaaagtgtgtgtgacgttgctgaa

SEQ ID NO: 138561 - DNA, 25 bp, Mus musculus
agaaagtgtttgactctccgatttg

SEQ ID NO: 138562 - DNA, 25 bp, Mus musculus
agaaagtgtttgtctctccgatttg

SEQ ID NO: 138563 - DNA, 25 bp, Mus musculus
agaaagttacaccagcccaagcaag

SEQ ID NO: 138564 - DNA, 25 bp, Mus musculus
agaaagttacacgagcccaagcaag

SEQ ID NO: 138565 - DNA, 25 bp, Mus musculus
agaaagttacagcaggatgggctac

SEQ ID NO: 138566 - DNA, 25 bp, Mus musculus
agaaagttacaggaggatgggctac

SEQ ID NO: 138567 - DNA, 25 bp, Mus musculus
agaaagttaccaccagcttacacca

SEQ ID NO: 138568 - DNA, 25 bp, Mus musculus
agaaagttaccagcagcttacacca

SEQ ID NO: 138569 - DNA, 25 bp, Mus musculus
agaaagttagctctccactctctca

SEQ ID NO: 138570 - DNA, 25 bp, Mus musculus
agaaagttagctgtccactctctca

SEQ ID NO: 138571 - DNA, 25 bp, Mus musculus
agaaagttcacacgatccctgccca

SEQ ID NO: 138572 - DNA, 25 bp, Mus musculus
agaaagttcacaggatccctgccca

SEQ ID NO: 138573 - DNA, 25 bp, Mus musculus
agaaagttcgctcgacatgagtaca

SEQ ID NO: 138574 - DNA, 25 bp, Mus musculus
agaaagttcgctggacatgagtaca

SEQ ID NO: 138575 - DNA, 25 bp, Mus musculus
agaaagttctctcatggccacacag

SEQ ID NO: 138576 - DNA, 25 bp, Mus musculus
agaaagttctctgatggccacacag

SEQ ID NO: 138577 - DNA, 25 bp, Mus musculus
agaaagttcttaactccagcccaga

SEQ ID NO: 138578 - DNA, 25 bp, Mus musculus
agaaagttcttatctccagcccaga

SEQ ID NO: 138579 - DNA, 25 bp, Mus musculus
agaaagttggcaacgcctttgacca

SEQ ID NO: 138580 - DNA, 25 bp, Mus musculus
agaaagttggcatcgcctttgacca

SEQ ID NO: 138581 - DNA, 25 bp, Mus musculus
agaaagttgtggactgatcagttaa

SEQ ID NO: 138582 - DNA, 25 bp, Mus musculus
agaaagttgtggtctgatcagttaa

SEQ ID NO: 138583 - DNA, 25 bp, Mus musculus
agaaagttgtttctctaagcctttg

SEQ ID NO: 138584 - DNA, 25 bp, Mus musculus
agaaagttgtttgtctaagcctttg

SEQ ID NO: 138585 - DNA, 25 bp, Mus musculus
agaaagtttcagaccagctcagact

SEQ ID NO: 138586 - DNA, 25 bp, Mus musculus
agaaagtttcagtccagctcagact

SEQ ID NO: 138587 - DNA, 25 bp, Mus musculus
agaaataaaacgcaggcaggcggat

SEQ ID NO: 138588 - DNA, 25 bp, Mus musculus
agaaataaaacggaggcaggcggat

SEQ ID NO: 138589 - DNA, 25 bp, Mus musculus
agaaataaagcactccctcgggagt

SEQ ID NO: 138590 - DNA, 25 bp, Mus musculus
agaaataaagcagtccctcgggagt

SEQ ID NO: 138591 - DNA, 25 bp, Mus musculus
agaaataacaggcactcctcatgtg

SEQ ID NO: 138592 - DNA, 25 bp, Mus musculus
agaaataacagggactcctcatgtg

SEQ ID NO: 138593 - DNA, 25 bp, Mus musculus
agaaataactacactcctgctcttg

SEQ ID NO: 138594 - DNA, 25 bp, Mus musculus
agaaataactactctcctgctcttg

SEQ ID NO: 138595 - DNA, 25 bp, Mus musculus
agaaataactccaaagctgggcatg

SEQ ID NO: 138596 - DNA, 25 bp, Mus musculus
agaaataactcctaagctgggcatg

SEQ ID NO: 138597 - DNA, 25 bp, Mus musculus
agaaataactctacaatcatgcttt

SEQ ID NO: 138598 - DNA, 25 bp, Mus musculus
agaaataactcttcaatcatgcttt

SEQ ID NO: 138599 - DNA, 25 bp, Mus musculus
agaaataagagaccctccttcctgc

SEQ ID NO: 138600 - DNA, 25 bp, Mus musculus
agaaataagagagcctccttcctgc

SEQ ID NO: 138601 - DNA, 25 bp, Mus musculus
agaaataagcatccccactttgtgg

SEQ ID NO: 138602 - DNA, 25 bp, Mus musculus
agaaataagcatgcccactttgtgg

SEQ ID NO: 138603 - DNA, 25 bp, Mus musculus
agaaatacaccaataattcacagca

SEQ ID NO: 138604 - DNA, 25 bp, Mus musculus
agaaatacaccattaattcacagca

SEQ ID NO: 138605 - DNA, 25 bp, Mus musculus
agaaataccaccatctcctacatat

SEQ ID NO: 138606 - DNA, 25 bp, Mus musculus
agaaataccaccttctcctacatat

SEQ ID NO: 138607 - DNA, 25 bp, Mus musculus
agaaatacgtttcagctgctatgtt

SEQ ID NO: 138608 - DNA, 25 bp, Mus musculus
agaaatacgtttgagctgctatgtt

SEQ ID NO: 138609 - DNA, 25 bp, Mus musculus
agaaatactatcacgtgctgaccga

SEQ ID NO: 138610 - DNA, 25 bp, Mus musculus
agaaatactatctcgtgctgaccga

SEQ ID NO: 138611 - DNA, 25 bp, Mus musculus
agaaatactccaccgtccagtgttt

SEQ ID NO: 138612 - DNA, 25 bp, Mus musculus
agaaatactccagcgtccagtgttt

SEQ ID NO: 138613 - DNA, 25 bp, Mus musculus
agaaatactctcatcatttgtcact

SEQ ID NO: 138614 - DNA, 25 bp, Mus musculus
agaaatactctcttcatttgtcact

SEQ ID NO: 138615 - DNA, 25 bp, Mus musculus
agaaatactgctcctttcatagctt

SEQ ID NO: 138616 - DNA, 25 bp, Mus musculus
agaaatactgctgctttcatagctt

SEQ ID NO: 138617 - DNA, 25 bp, Mus musculus
agaaatacttcccagtggcgtccag

SEQ ID NO: 138618 - DNA, 25 bp, Mus musculus
agaaatacttccgagtggcgtccag

SEQ ID NO: 138619 - DNA, 25 bp, Mus musculus
agaaatacttttccatgacccatgg

SEQ ID NO: 138620 - DNA, 25 bp, Mus musculus
agaaatacttttgcatgacccatgg

SEQ ID NO: 138621 - DNA, 25 bp, Mus musculus
agaaatagacgaccgcatagcgcct

SEQ ID NO: 138622 - DNA, 25 bp, Mus musculus
agaaatagacgagcgcatagcgcct

SEQ ID NO: 138623 - DNA, 25 bp, Mus musculus
agaaatagagctccttcgcctagaa

SEQ ID NO: 138624 - DNA, 25 bp, Mus musculus
agaaatagagctctggcagtcccag

SEQ ID NO: 138625 - DNA, 25 bp, Mus musculus
agaaatagagctgcttcgcctagaa

SEQ ID NO: 138626 - DNA, 25 bp, Mus musculus
agaaatagagctgtggcagtcccag

SEQ ID NO: 138627 - DNA, 25 bp, Mus musculus
agaaatagcatgcaaccagggttga

SEQ ID NO: 138628 - DNA, 25 bp, Mus musculus
agaaatagcatggaaccagggttga

SEQ ID NO: 138629 - DNA, 25 bp, Mus musculus
agaaatagtcttctggtccttggac

SEQ ID NO: 138630 - DNA, 25 bp, Mus musculus
agaaatagtcttgtggtccttggac

SEQ ID NO: 138631 - DNA, 25 bp, Mus musculus
agaaatagttctcacagagcatccc

SEQ ID NO: 138632 - DNA, 25 bp, Mus musculus
agaaatagttctgacagagcatccc

SEQ ID NO: 138633 - DNA, 25 bp, Mus musculus
agaaatagtttcatctgaagactga

SEQ ID NO: 138634 - DNA, 25 bp, Mus musculus
agaaatagtttcttctgaagactga

SEQ ID NO: 138635 - DNA, 25 bp, Mus musculus
agaaatatataaatctctattcccc

SEQ ID NO: 138636 - DNA, 25 bp, Mus musculus
agaaatatataattctctattcccc

SEQ ID NO: 138637 - DNA, 25 bp, Mus musculus
agaaatatatttaggccacatgtat

SEQ ID NO: 138638 - DNA, 25 bp, Mus musculus
agaaatatattttggccacatgtat

SEQ ID NO: 138639 - DNA, 25 bp, Mus musculus
agaaatatcagactttgagtccaca

SEQ ID NO: 138640 - DNA, 25 bp, Mus musculus
agaaatatcagagtttgagtccaca

SEQ ID NO: 138641 - DNA, 25 bp, Mus musculus
agaaatatccagaccgagtgtctcg

SEQ ID NO: 138642 - DNA, 25 bp, Mus musculus
agaaatatccagtccgagtgtctcg

SEQ ID NO: 138643 - DNA, 25 bp, Mus musculus
agaaatatccataccactgccagtt

SEQ ID NO: 138644 - DNA, 25 bp, Mus musculus
agaaatatccattccactgccagtt

SEQ ID NO: 138645 - DNA, 25 bp, Mus musculus
agaaatatgattcagccccgagaac

SEQ ID NO: 138646 - DNA, 25 bp, Mus musculus
agaaatatgattgagccccgagaac

SEQ ID NO: 138647 - DNA, 25 bp, Mus musculus
agaaatatggcacccgttgttccag

SEQ ID NO: 138648 - DNA, 25 bp, Mus musculus
agaaatatggcagccgttgttccag

SEQ ID NO: 138649 - DNA, 25 bp, Mus musculus
agaaatattctacccatttgtgtgt

SEQ ID NO: 138650 - DNA, 25 bp, Mus musculus
agaaatattctagccatttgtgtgt

SEQ ID NO: 138651 - DNA, 25 bp, Mus musculus
agaaatattctgaggtcactctgct

SEQ ID NO: 138652 - DNA, 25 bp, Mus musculus
agaaatattctgtggtcactctgct

SEQ ID NO: 138653 - DNA, 25 bp, Mus musculus
agaaatatttagaaagcataccttt

SEQ ID NO: 138654 - DNA, 25 bp, Mus musculus
agaaatatttagtaagcataccttt

SEQ ID NO: 138655 - DNA, 25 bp, Mus musculus
agaaatatttccagttcttccatat

SEQ ID NO: 138656 - DNA, 25 bp, Mus musculus
agaaatatttcctgttcttccatat

SEQ ID NO: 138657 - DNA, 25 bp, Mus musculus
agaaatatttgtatactctggatac

SEQ ID NO: 138658 - DNA, 25 bp, Mus musculus
agaaatatttgtttactctggatac

SEQ ID NO: 138659 - DNA, 25 bp, Mus musculus
agaaatattttgaagcccggcatgg

SEQ ID NO: 138660 - DNA, 25 bp, Mus musculus
agaaatattttgtagcccggcatgg

SEQ ID NO: 138661 - DNA, 25 bp, Mus musculus
agaaatcaaagcagttcttagacca

SEQ ID NO: 138662 - DNA, 25 bp, Mus musculus
agaaatcaaagctgttcttagacca

SEQ ID NO: 138663 - DNA, 25 bp, Mus musculus
agaaatcaagttcccagcattcctg

SEQ ID NO: 138664 - DNA, 25 bp, Mus musculus
agaaatcaagttgccagcattcctg

SEQ ID NO: 138665 - DNA, 25 bp, Mus musculus
agaaatcaatttcagcataggtatt

SEQ ID NO: 138666 - DNA, 25 bp, Mus musculus
agaaatcaatttgagcataggtatt

SEQ ID NO: 138667 - DNA, 25 bp, Mus musculus
agaaatcacccactccaatgctgac

SEQ ID NO: 138668 - DNA, 25 bp, Mus musculus
agaaatcacccagtccaatgctgac

SEQ ID NO: 138669 - DNA, 25 bp, Mus musculus
agaaatcactacctgagggctggtg

SEQ ID NO: 138670 - DNA, 25 bp, Mus musculus
agaaatcactacgtgagggctggtg

SEQ ID NO: 138671 - DNA, 25 bp, Mus musculus
agaaatcagggtctcaggctctgct

SEQ ID NO: 138672 - DNA, 25 bp, Mus musculus
agaaatcagggtgtcaggctctgct

SEQ ID NO: 138673 - DNA, 25 bp, Mus musculus
agaaatcagtgtccggttttgagta

SEQ ID NO: 138674 - DNA, 25 bp, Mus musculus
agaaatcagtgtgcggttttgagta

SEQ ID NO: 138675 - DNA, 25 bp, Mus musculus
agaaatcatagactctgggcaggaa

SEQ ID NO: 138676 - DNA, 25 bp, Mus musculus
agaaatcatagagtctgggcaggaa

SEQ ID NO: 138677 - DNA, 25 bp, Mus musculus
agaaatcatgccagactcttaccca

SEQ ID NO: 138678 - DNA, 25 bp, Mus musculus
agaaatcatgccctcttagagcacg

SEQ ID NO: 138679 - DNA, 25 bp, Mus musculus
agaaatcatgccgtcttagagcacg

SEQ ID NO: 138680 - DNA, 25 bp, Mus musculus
agaaatcatgcctgactcttaccca

SEQ ID NO: 138681 - DNA, 25 bp, Mus musculus
agaaatcatgctcccatgggtcaca

SEQ ID NO: 138682 - DNA, 25 bp, Mus musculus
agaaatcatgctgccatgggtcaca

SEQ ID NO: 138683 - DNA, 25 bp, Mus musculus
agaaatcattaacggctagccacat

SEQ ID NO: 138684 - DNA, 25 bp, Mus musculus
agaaatcattaagggctagccacat

SEQ ID NO: 138685 - DNA, 25 bp, Mus musculus
agaaatccactcaatgcctagtcaa

SEQ ID NO: 138686 - DNA, 25 bp, Mus musculus
agaaatccactctatgcctagtcaa

SEQ ID NO: 138687 - DNA, 25 bp, Mus musculus
agaaatccagataacagacggcccc

SEQ ID NO: 138688 - DNA, 25 bp, Mus musculus
agaaatccagattacagacggcccc

SEQ ID NO: 138689 - DNA, 25 bp, Mus musculus
agaaatccagggaattccaattctg

SEQ ID NO: 138690 - DNA, 25 bp, Mus musculus
agaaatccagggacaccctaggcta

SEQ ID NO: 138691 - DNA, 25 bp, Mus musculus
agaaatccagggacttcccagacgg

SEQ ID NO: 138692 - DNA, 25 bp, Mus musculus
agaaatccagggtattccaattctg

SEQ ID NO: 138693 - DNA, 25 bp, Mus musculus
agaaatccagggtcaccctaggcta

SEQ ID NO: 138694 - DNA, 25 bp, Mus musculus
agaaatccagggtcttcccagacgg

SEQ ID NO: 138695 - DNA, 25 bp, Mus musculus
agaaatcccagacttgcccacaagg

SEQ ID NO: 138696 - DNA, 25 bp, Mus musculus
agaaatcccagagttgcccacaagg

SEQ ID NO: 138697 - DNA, 25 bp, Mus musculus
agaaatcccatgacttcctggaaac

SEQ ID NO: 138698 - DNA, 25 bp, Mus musculus
agaaatcccatgtcttcctggaaac

SEQ ID NO: 138699 - DNA, 25 bp, Mus musculus
agaaatccccagacatgaacacttg

SEQ ID NO: 138700 - DNA, 25 bp, Mus musculus
agaaatccccagtcatgaacacttg

SEQ ID NO: 138701 - DNA, 25 bp, Mus musculus
agaaatccctaaatatgtctgcatt

SEQ ID NO: 138702 - DNA, 25 bp, Mus musculus
agaaatccctaattatgtctgcatt

SEQ ID NO: 138703 - DNA, 25 bp, Mus musculus
agaaatccctaccaccagaagcaga

SEQ ID NO: 138704 - DNA, 25 bp, Mus musculus
agaaatccctacgaccagaagcaga

SEQ ID NO: 138705 - DNA, 25 bp, Mus musculus
agaaatccctccagatcactatgaa

SEQ ID NO: 138706 - DNA, 25 bp, Mus musculus
agaaatccctcctgatcactatgaa

SEQ ID NO: 138707 - DNA, 25 bp, Mus musculus
agaaatcctagcaccagcagggcaa

SEQ ID NO: 138708 - DNA, 25 bp, Mus musculus
agaaatcctagctccagcagggcaa

SEQ ID NO: 138709 - DNA, 25 bp, Mus musculus
agaaatcctatgcaaggcctgcctt

SEQ ID NO: 138710 - DNA, 25 bp, Mus musculus
agaaatcctatggaaggcctgcctt

SEQ ID NO: 138711 - DNA, 25 bp, Mus musculus
agaaatcctcctcccgaggagactc

SEQ ID NO: 138712 - DNA, 25 bp, Mus musculus
agaaatcctcctgccgaggagactc

SEQ ID NO: 138713 - DNA, 25 bp, Mus musculus
agaaatcctcgcagtcagagcaaca

SEQ ID NO: 138714 - DNA, 25 bp, Mus musculus
agaaatcctcgctgtcagagcaaca

SEQ ID NO: 138715 - DNA, 25 bp, Mus musculus
agaaatcctctgagagtctttccac

SEQ ID NO: 138716 - DNA, 25 bp, Mus musculus
agaaatcctctgtgagtctttccac

SEQ ID NO: 138717 - DNA, 25 bp, Mus musculus
agaaatcctgagatggaatcttggg

SEQ ID NO: 138718 - DNA, 25 bp, Mus musculus
agaaatcctgagttggaatcttggg

SEQ ID NO: 138719 - DNA, 25 bp, Mus musculus
agaaatcctgccacattaagtcctg

SEQ ID NO: 138720 - DNA, 25 bp, Mus musculus
agaaatcctgccaccagaagattaa

SEQ ID NO: 138721 - DNA, 25 bp, Mus musculus
agaaatcctgcctcattaagtcctg

SEQ ID NO: 138722 - DNA, 25 bp, Mus musculus
agaaatcctgcctccagaagattaa

SEQ ID NO: 138723 - DNA, 25 bp, Mus musculus
agaaatcctgctcccaaggatcagg

SEQ ID NO: 138724 - DNA, 25 bp, Mus musculus
agaaatcctgctgccaaggatcagg

SEQ ID NO: 138725 - DNA, 25 bp, Mus musculus
agaaatcctgggatcctttcccttg

SEQ ID NO: 138726 - DNA, 25 bp, Mus musculus
agaaatcctgggttcctttcccttg

SEQ ID NO: 138727 - DNA, 25 bp, Mus musculus
agaaatcgaaacccccatgactact

SEQ ID NO: 138728 - DNA, 25 bp, Mus musculus
agaaatcgaaacgcccatgactact

SEQ ID NO: 138729 - DNA, 25 bp, Mus musculus
agaaatcgacatcacctgctgggat

SEQ ID NO: 138730 - DNA, 25 bp, Mus musculus
agaaatcgacatgacctgctgggat

SEQ ID NO: 138731 - DNA, 25 bp, Mus musculus
agaaatcgattcacctcttccatca

SEQ ID NO: 138732 - DNA, 25 bp, Mus musculus
agaaatcgattctcctcttccatca

SEQ ID NO: 138733 - DNA, 25 bp, Mus musculus
agaaatcgctgaaccggtccttctg

SEQ ID NO: 138734 - DNA, 25 bp, Mus musculus
agaaatcgctgatccggtccttctg

SEQ ID NO: 138735 - DNA, 25 bp, Mus musculus
agaaatcgggctatgggatccagtt

SEQ ID NO: 138736 - DNA, 25 bp, Mus musculus
agaaatcgggctccactctgggagt

SEQ ID NO: 138737 - DNA, 25 bp, Mus musculus
agaaatcgggctgcactctgggagt

SEQ ID NO: 138738 - DNA, 25 bp, Mus musculus
agaaatcgggctttgggatccagtt

SEQ ID NO: 138739 - DNA, 25 bp, Mus musculus
agaaatcggtagactgctccaggcc

SEQ ID NO: 138740 - DNA, 25 bp, Mus musculus
agaaatcggtagtctgctccaggcc

SEQ ID NO: 138741 - DNA, 25 bp, Mus musculus
agaaatcgtcacatctatctggcct

SEQ ID NO: 138742 - DNA, 25 bp, Mus musculus
agaaatcgtcacttctatctggcct

SEQ ID NO: 138743 - DNA, 25 bp, Mus musculus
agaaatctaaaaaggtaccagtact

SEQ ID NO: 138744 - DNA, 25 bp, Mus musculus
agaaatctaaaatggtaccagtact

SEQ ID NO: 138745 - DNA, 25 bp, Mus musculus
agaaatctaatacccaggaccagga

SEQ ID NO: 138746 - DNA, 25 bp, Mus musculus
agaaatctaatagccaggaccagga

SEQ ID NO: 138747 - DNA, 25 bp, Mus musculus
agaaatctagctactgggcttcacc

SEQ ID NO: 138748 - DNA, 25 bp, Mus musculus
agaaatctagcttctgggcttcacc

SEQ ID NO: 138749 - DNA, 25 bp, Mus musculus
agaaatctatgtccaggcgcctcgg

SEQ ID NO: 138750 - DNA, 25 bp, Mus musculus
agaaatctatgtgcaggcgcctcgg

SEQ ID NO: 138751 - DNA, 25 bp, Mus musculus
agaaatctcaaactgtatcccagtg

SEQ ID NO: 138752 - DNA, 25 bp, Mus musculus
agaaatctcaaagtgtatcccagtg

SEQ ID NO: 138753 - DNA, 25 bp, Mus musculus
agaaatctcccaagttgtcattcat

SEQ ID NO: 138754 - DNA, 25 bp, Mus musculus
agaaatctcccatgttgtcattcat

SEQ ID NO: 138755 - DNA, 25 bp, Mus musculus
agaaatctgaccattgccgatgctg

SEQ ID NO: 138756 - DNA, 25 bp, Mus musculus
agaaatctgacctttgccgatgctg

SEQ ID NO: 138757 - DNA, 25 bp, Mus musculus
agaaatctgactcagggcctgtgag

SEQ ID NO: 138758 - DNA, 25 bp, Mus musculus
agaaatctgactgagggcctgtgag

SEQ ID NO: 138759 - DNA, 25 bp, Mus musculus
agaaatctggtcatgttaggaaaca

SEQ ID NO: 138760 - DNA, 25 bp, Mus musculus
agaaatctggtcttgttaggaaaca

SEQ ID NO: 138761 - DNA, 25 bp, Mus musculus
agaaatctggtgatcctcatattcc

SEQ ID NO: 138762 - DNA, 25 bp, Mus musculus
agaaatctggtgttcctcatattcc

SEQ ID NO: 138763 - DNA, 25 bp, Mus musculus
agaaatcttactcctttccttcctt

SEQ ID NO: 138764 - DNA, 25 bp, Mus musculus
agaaatcttactgctttccttcctt

SEQ ID NO: 138765 - DNA, 25 bp, Mus musculus
agaaatcttctaagagcaactccgt

SEQ ID NO: 138766 - DNA, 25 bp, Mus musculus
agaaatcttctatgagcaactccgt

SEQ ID NO: 138767 - DNA, 25 bp, Mus musculus
agaaatcttgggatccgcggaagag

SEQ ID NO: 138768 - DNA, 25 bp, Mus musculus
agaaatcttgggttccgcggaagag

SEQ ID NO: 138769 - DNA, 25 bp, Mus musculus
agaaatcttgtgacataacctgtga

SEQ ID NO: 138770 - DNA, 25 bp, Mus musculus
agaaatcttgtgtcataacctgtga

SEQ ID NO: 138771 - DNA, 25 bp, Mus musculus
agaaatcttttcacgccctatgcac

SEQ ID NO: 138772 - DNA, 25 bp, Mus musculus
agaaatcttttctcgccctatgcac

SEQ ID NO: 138773 - DNA, 25 bp, Mus musculus
agaaatgaagaactacccaggaggt

SEQ ID NO: 138774 - DNA, 25 bp, Mus musculus
agaaatgaagaagtacccaggaggt

SEQ ID NO: 138775 - DNA, 25 bp, Mus musculus
agaaatgaaggcaaactgattaatc

SEQ ID NO: 138776 - DNA, 25 bp, Mus musculus
agaaatgaaggctaactgattaatc

SEQ ID NO: 138777 - DNA, 25 bp, Mus musculus
agaaatgacagcacgtcctctgtgg

SEQ ID NO: 138778 - DNA, 25 bp, Mus musculus
agaaatgacagcatccagcggagaa

SEQ ID NO: 138779 - DNA, 25 bp, Mus musculus
agaaatgacagctcgtcctctgtgg

SEQ ID NO: 138780 - DNA, 25 bp, Mus musculus
agaaatgacagcttccagcggagaa

SEQ ID NO: 138781 - DNA, 25 bp, Mus musculus
agaaatgaccatcgcagtgaggaaa

SEQ ID NO: 138782 - DNA, 25 bp, Mus musculus
agaaatgaccatggcagtgaggaaa

SEQ ID NO: 138783 - DNA, 25 bp, Mus musculus
agaaatgacctgcagactactccag

SEQ ID NO: 138784 - DNA, 25 bp, Mus musculus
agaaatgacctggagactactccag

SEQ ID NO: 138785 - DNA, 25 bp, Mus musculus
agaaatgactctcgatcctctaggg

SEQ ID NO: 138786 - DNA, 25 bp, Mus musculus
agaaatgactctggatcctctaggg

SEQ ID NO: 138787 - DNA, 25 bp, Mus musculus
agaaatgagaccagaaccaccggct

SEQ ID NO: 138788 - DNA, 25 bp, Mus musculus
agaaatgagacctgaaccaccggct

SEQ ID NO: 138789 - DNA, 25 bp, Mus musculus
agaaatgaggtgactggttgcctgt

SEQ ID NO: 138790 - DNA, 25 bp, Mus musculus
agaaatgaggtgtctggttgcctgt

SEQ ID NO: 138791 - DNA, 25 bp, Mus musculus
agaaatgatccaccaaagacttggg

SEQ ID NO: 138792 - DNA, 25 bp, Mus musculus
agaaatgatccagcaaagacttggg

SEQ ID NO: 138793 - DNA, 25 bp, Mus musculus
agaaatgatccgacgtggctacagg

SEQ ID NO: 138794 - DNA, 25 bp, Mus musculus
agaaatgatccgtcgtggctacagg

SEQ ID NO: 138795 - DNA, 25 bp, Mus musculus
agaaatgatctcagcccatgtgggc

SEQ ID NO: 138796 - DNA, 25 bp, Mus musculus
agaaatgatctctgcccatgtgggc

SEQ ID NO: 138797 - DNA, 25 bp, Mus musculus
agaaatgatgtactaacctcccctc

SEQ ID NO: 138798 - DNA, 25 bp, Mus musculus
agaaatgatgtagtaacctcccctc

SEQ ID NO: 138799 - DNA, 25 bp, Mus musculus
agaaatgattgacagcagtccctaa

SEQ ID NO: 138800 - DNA, 25 bp, Mus musculus
agaaatgattgagagcagtccctaa

SEQ ID NO: 138801 - DNA, 25 bp, Mus musculus
agaaatgcacacaatctcatgaatt

SEQ ID NO: 138802 - DNA, 25 bp, Mus musculus
agaaatgcacactatctcatgaatt

SEQ ID NO: 138803 - DNA, 25 bp, Mus musculus
agaaatgcaccaagccattgaccgg

SEQ ID NO: 138804 - DNA, 25 bp, Mus musculus
agaaatgcaccatgccattgaccgg

SEQ ID NO: 138805 - DNA, 25 bp, Mus musculus
agaaatgcagtgacccctatgtcca

SEQ ID NO: 138806 - DNA, 25 bp, Mus musculus
agaaatgcagtgtcccctatgtcca

SEQ ID NO: 138807 - DNA, 25 bp, Mus musculus
agaaatgccaacacctttatgtccc

SEQ ID NO: 138808 - DNA, 25 bp, Mus musculus
agaaatgccaactcctttatgtccc

SEQ ID NO: 138809 - DNA, 25 bp, Mus musculus
agaaatgccagtatcagaccccgct

SEQ ID NO: 138810 - DNA, 25 bp, Mus musculus
agaaatgccagtttcagaccccgct

SEQ ID NO: 138811 - DNA, 25 bp, Mus musculus
agaaatgcccatatagcactccttt

SEQ ID NO: 138812 - DNA, 25 bp, Mus musculus
agaaatgcccatttagcactccttt

SEQ ID NO: 138813 - DNA, 25 bp, Mus musculus
agaaatgcctacctaatctatgctg

SEQ ID NO: 138814 - DNA, 25 bp, Mus musculus
agaaatgcctacgtaatctatgctg

SEQ ID NO: 138815 - DNA, 25 bp, Mus musculus
agaaatgcctctcggaccaagaatg

SEQ ID NO: 138816 - DNA, 25 bp, Mus musculus
agaaatgcctctgggaccaagaatg

SEQ ID NO: 138817 - DNA, 25 bp, Mus musculus
agaaatgccttgctgccttggcgtc

SEQ ID NO: 138818 - DNA, 25 bp, Mus musculus
agaaatgccttggtgccttggcgtc

SEQ ID NO: 138819 - DNA, 25 bp, Mus musculus
agaaatgcgaggatggatgccaaga

SEQ ID NO: 138820 - DNA, 25 bp, Mus musculus
agaaatgcgaggttggatgccaaga

SEQ ID NO: 138821 - DNA, 25 bp, Mus musculus
agaaatgcgctcacatgggtctaag

SEQ ID NO: 138822 - DNA, 25 bp, Mus musculus
agaaatgcgctctcatgggtctaag

SEQ ID NO: 138823 - DNA, 25 bp, Mus musculus
agaaatgcggtgctggctactttga

SEQ ID NO: 138824 - DNA, 25 bp, Mus musculus
agaaatgcggtggtggctactttga

SEQ ID NO: 138825 - DNA, 25 bp, Mus musculus
agaaatgcgtgacttttgggatagc

SEQ ID NO: 138826 - DNA, 25 bp, Mus musculus
agaaatgcgtgagttttgggatagc

SEQ ID NO: 138827 - DNA, 25 bp, Mus musculus
agaaatgctgcaaggcacccactat

SEQ ID NO: 138828 - DNA, 25 bp, Mus musculus
agaaatgctgcatggcacccactat

SEQ ID NO: 138829 - DNA, 25 bp, Mus musculus
agaaatgctgctatccttcatccat

SEQ ID NO: 138830 - DNA, 25 bp, Mus musculus
agaaatgctgctttccttcatccat

SEQ ID NO: 138831 - DNA, 25 bp, Mus musculus
agaaatgctgttagctactcccggg

SEQ ID NO: 138832 - DNA, 25 bp, Mus musculus
agaaatgctgtttgctactcccggg

SEQ ID NO: 138833 - DNA, 25 bp, Mus musculus
agaaatgcttctccggcctgagaac

SEQ ID NO: 138834 - DNA, 25 bp, Mus musculus
agaaatgcttctgcggcctgagaac

SEQ ID NO: 138835 - DNA, 25 bp, Mus musculus
agaaatgcttgcacattgacccaga

SEQ ID NO: 138836 - DNA, 25 bp, Mus musculus
agaaatgcttgctcattgacccaga

SEQ ID NO: 138837 - DNA, 25 bp, Mus musculus
agaaatggaacgctgccacaagaaa

SEQ ID NO: 138838 - DNA, 25 bp, Mus musculus
agaaatggaacggtgccacaagaaa

SEQ ID NO: 138839 - DNA, 25 bp, Mus musculus
agaaatggacgcacgggactcagac

SEQ ID NO: 138840 - DNA, 25 bp, Mus musculus
agaaatggacgctcgggactcagac

SEQ ID NO: 138841 - DNA, 25 bp, Mus musculus
agaaatggactgcatgagggctcta

SEQ ID NO: 138842 - DNA, 25 bp, Mus musculus
agaaatggactggatgagggctcta

SEQ ID NO: 138843 - DNA, 25 bp, Mus musculus
agaaatggagacctcatgcagcatc

SEQ ID NO: 138844 - DNA, 25 bp, Mus musculus
agaaatggagacgtcatgcagcatc

SEQ ID NO: 138845 - DNA, 25 bp, Mus musculus
agaaatggaggcagtgaaacacgaa

SEQ ID NO: 138846 - DNA, 25 bp, Mus musculus
agaaatggaggctgtgaaacacgaa

SEQ ID NO: 138847 - DNA, 25 bp, Mus musculus
agaaatggcacgcacactggccagc

SEQ ID NO: 138848 - DNA, 25 bp, Mus musculus
agaaatggcacggacactggccagc

SEQ ID NO: 138849 - DNA, 25 bp, Mus musculus
agaaatggccatctacctaccaacc

SEQ ID NO: 138850 - DNA, 25 bp, Mus musculus
agaaatggccatgtacctaccaacc

SEQ ID NO: 138851 - DNA, 25 bp, Mus musculus
agaaatggccccaccagaaactaga

SEQ ID NO: 138852 - DNA, 25 bp, Mus musculus
agaaatggcccctccagaaactaga

SEQ ID NO: 138853 - DNA, 25 bp, Mus musculus
agaaatggcctcacactttctccag

SEQ ID NO: 138854 - DNA, 25 bp, Mus musculus
agaaatggcctctcactttctccag

SEQ ID NO: 138855 - DNA, 25 bp, Mus musculus
agaaatggcgtgctcccaaatccag

SEQ ID NO: 138856 - DNA, 25 bp, Mus musculus
agaaatggcgtggtcccaaatccag

SEQ ID NO: 138857 - DNA, 25 bp, Mus musculus
agaaatggctacaggtgccttgctc

SEQ ID NO: 138858 - DNA, 25 bp, Mus musculus
agaaatggctactggtgccttgctc

SEQ ID NO: 138859 - DNA, 25 bp, Mus musculus
agaaatggctccagacccagtccat

SEQ ID NO: 138860 - DNA, 25 bp, Mus musculus
agaaatggctcctgacccagtccat

SEQ ID NO: 138861 - DNA, 25 bp, Mus musculus
agaaatggctctccactgagtaaag

SEQ ID NO: 138862 - DNA, 25 bp, Mus musculus
agaaatggctctgcactgagtaaag

SEQ ID NO: 138863 - DNA, 25 bp, Mus musculus
agaaatgggcaacctccggctgacg

SEQ ID NO: 138864 - DNA, 25 bp, Mus musculus
agaaatgggcaagctccggctgacg

SEQ ID NO: 138865 - DNA, 25 bp, Mus musculus
agaaatggtgtcatccggagccttt

SEQ ID NO: 138866 - DNA, 25 bp, Mus musculus
agaaatggtgtcttccggagccttt

SEQ ID NO: 138867 - DNA, 25 bp, Mus musculus
agaaatggtttaagcagcgcctggc

SEQ ID NO: 138868 - DNA, 25 bp, Mus musculus
agaaatggtttatgcagcgcctggc

SEQ ID NO: 138869 - DNA, 25 bp, Mus musculus
agaaatggttttactctgctcttaa

SEQ ID NO: 138870 - DNA, 25 bp, Mus musculus
agaaatggtttttctctgctcttaa

SEQ ID NO: 138871 - DNA, 25 bp, Mus musculus
agaaatgtacttacatgtcttctca

SEQ ID NO: 138872 - DNA, 25 bp, Mus musculus
agaaatgtactttcatgtcttctca

SEQ ID NO: 138873 - DNA, 25 bp, Mus musculus
agaaatgtagcccttgtgcaaccca

SEQ ID NO: 138874 - DNA, 25 bp, Mus musculus
agaaatgtagccgttgtgcaaccca

SEQ ID NO: 138875 - DNA, 25 bp, Mus musculus
agaaatgtcaatctttgccctgatt

SEQ ID NO: 138876 - DNA, 25 bp, Mus musculus
agaaatgtcaatgtttgccctgatt

SEQ ID NO: 138877 - DNA, 25 bp, Mus musculus
agaaatgtcaccactaaatgacagc

SEQ ID NO: 138878 - DNA, 25 bp, Mus musculus
agaaatgtcacctctaaatgacagc

SEQ ID NO: 138879 - DNA, 25 bp, Mus musculus
agaaatgtccacatcacctgtgatc

SEQ ID NO: 138880 - DNA, 25 bp, Mus musculus
agaaatgtccacttcacctgtgatc

SEQ ID NO: 138881 - DNA, 25 bp, Mus musculus
agaaatgtcccaccaaggccagtgt

SEQ ID NO: 138882 - DNA, 25 bp, Mus musculus
agaaatgtcccagcaaggccagtgt

SEQ ID NO: 138883 - DNA, 25 bp, Mus musculus
agaaatgtcctgagtgacgcgctcc

SEQ ID NO: 138884 - DNA, 25 bp, Mus musculus
agaaatgtcctgtgtgacgcgctcc

SEQ ID NO: 138885 - DNA, 25 bp, Mus musculus
agaaatgtctaaagtctttggcccc

SEQ ID NO: 138886 - DNA, 25 bp, Mus musculus
agaaatgtctaatgtctttggcccc

SEQ ID NO: 138887 - DNA, 25 bp, Mus musculus
agaaatgtctgcaccaagcgagcca

SEQ ID NO: 138888 - DNA, 25 bp, Mus musculus
agaaatgtctgctccaagcgagcca

SEQ ID NO: 138889 - DNA, 25 bp, Mus musculus
agaaatgtctttccttgcacttgct

SEQ ID NO: 138890 - DNA, 25 bp, Mus musculus
agaaatgtctttgcttgcacttgct

SEQ ID NO: 138891 - DNA, 25 bp, Mus musculus
agaaatgtgaaactcgtcatggccg

SEQ ID NO: 138892 - DNA, 25 bp, Mus musculus
agaaatgtgaaagtcgtcatggccg

SEQ ID NO: 138893 - DNA, 25 bp, Mus musculus
agaaatgtgacgaaccccagcgctc

SEQ ID NO: 138894 - DNA, 25 bp, Mus musculus
agaaatgtgacgtaccccagcgctc

SEQ ID NO: 138895 - DNA, 25 bp, Mus musculus
agaaatgtgcggctctcaactttcc

SEQ ID NO: 138896 - DNA, 25 bp, Mus musculus
agaaatgtgcgggtctcaactttcc

SEQ ID NO: 138897 - DNA, 25 bp, Mus musculus
agaaatgtgctgctcttgttttggg

SEQ ID NO: 138898 - DNA, 25 bp, Mus musculus
agaaatgtgctggtcttgttttggg

SEQ ID NO: 138899 - DNA, 25 bp, Mus musculus
agaaatgtgcttaccagccctagtg

SEQ ID NO: 138900 - DNA, 25 bp, Mus musculus
agaaatgtgctttccagccctagtg

SEQ ID NO: 138901 - DNA, 25 bp, Mus musculus
agaaatgtgggcagcctgtcccaac

SEQ ID NO: 138902 - DNA, 25 bp, Mus musculus
agaaatgtgggctgcctgtcccaac

SEQ ID NO: 138903 - DNA, 25 bp, Mus musculus
agaaatgtgtcccactgactgggct

SEQ ID NO: 138904 - DNA, 25 bp, Mus musculus
agaaatgtgtccgactgactgggct

SEQ ID NO: 138905 - DNA, 25 bp, Mus musculus
agaaatgtgtggcatgcccctgttc

SEQ ID NO: 138906 - DNA, 25 bp, Mus musculus
agaaatgtgtgggatgcccctgttc

SEQ ID NO: 138907 - DNA, 25 bp, Mus musculus
agaaatgtgtgtccccttcctttga

SEQ ID NO: 138908 - DNA, 25 bp, Mus musculus
agaaatgtgtgtgcccttcctttga

SEQ ID NO: 138909 - DNA, 25 bp, Mus musculus
agaaatgttagcatcctctccccat

SEQ ID NO: 138910 - DNA, 25 bp, Mus musculus
agaaatgttagcttcctctccccat

SEQ ID NO: 138911 - DNA, 25 bp, Mus musculus
agaaatgttctcatgaactttcatg

SEQ ID NO: 138912 - DNA, 25 bp, Mus musculus
agaaatgttctcttgaactttcatg

SEQ ID NO: 138913 - DNA, 25 bp, Mus musculus
agaaattaagtcaagggctggtgag

SEQ ID NO: 138914 - DNA, 25 bp, Mus musculus
agaaattaagtctagggctggtgag

SEQ ID NO: 138915 - DNA, 25 bp, Mus musculus
agaaattaatagactcgctgccgag

SEQ ID NO: 138916 - DNA, 25 bp, Mus musculus
agaaattaatagtctcgctgccgag

SEQ ID NO: 138917 - DNA, 25 bp, Mus musculus
agaaattacagcatctcatggccac

SEQ ID NO: 138918 - DNA, 25 bp, Mus musculus
agaaattacagcttctcatggccac

SEQ ID NO: 138919 - DNA, 25 bp, Mus musculus
agaaattaccttatcattctgtagt

SEQ ID NO: 138920 - DNA, 25 bp, Mus musculus
agaaattaccttttcattctgtagt

SEQ ID NO: 138921 - DNA, 25 bp, Mus musculus
agaaattactgtattgcacctcttg

SEQ ID NO: 138922 - DNA, 25 bp, Mus musculus
agaaattactgttttgcacctcttg

SEQ ID NO: 138923 - DNA, 25 bp, Mus musculus
agaaattagactcattttcactgaa

SEQ ID NO: 138924 - DNA, 25 bp, Mus musculus
agaaattagactgattttcactgaa

SEQ ID NO: 138925 - DNA, 25 bp, Mus musculus
agaaattagcttcaccactttggta

SEQ ID NO: 138926 - DNA, 25 bp, Mus musculus
agaaattagcttgaccactttggta

SEQ ID NO: 138927 - DNA, 25 bp, Mus musculus
agaaattaggagatgtaagcaggac

SEQ ID NO: 138928 - DNA, 25 bp, Mus musculus
agaaattaggagttgtaagcaggac

SEQ ID NO: 138929 - DNA, 25 bp, Mus musculus
agaaattatcatccaggccattccc

SEQ ID NO: 138930 - DNA, 25 bp, Mus musculus
agaaattatcatgcaggccattccc

SEQ ID NO: 138931 - DNA, 25 bp, Mus musculus
agaaattattgtcactgctgcctga

SEQ ID NO: 138932 - DNA, 25 bp, Mus musculus
agaaattattgtgactgctgcctga

SEQ ID NO: 138933 - DNA, 25 bp, Mus musculus
agaaattcaacaccctgacacttat

SEQ ID NO: 138934 - DNA, 25 bp, Mus musculus
agaaattcaacagcctgacacttat

SEQ ID NO: 138935 - DNA, 25 bp, Mus musculus
agaaattcaataccagtacagcatt

SEQ ID NO: 138936 - DNA, 25 bp, Mus musculus
agaaattcaatagcagtacagcatt

SEQ ID NO: 138937 - DNA, 25 bp, Mus musculus
agaaattccagacggcttcataacc

SEQ ID NO: 138938 - DNA, 25 bp, Mus musculus
agaaattccagagggcttcataacc

SEQ ID NO: 138939 - DNA, 25 bp, Mus musculus
agaaattccagcagttccgcggcct

SEQ ID NO: 138940 - DNA, 25 bp, Mus musculus
agaaattccagctgttccgcggcct

SEQ ID NO: 138941 - DNA, 25 bp, Mus musculus
agaaattcctaccactatgagcacc

SEQ ID NO: 138942 - DNA, 25 bp, Mus musculus
agaaattcctacgactatgagcacc

SEQ ID NO: 138943 - DNA, 25 bp, Mus musculus
agaaattccttgactctgaacctct

SEQ ID NO: 138944 - DNA, 25 bp, Mus musculus
agaaattccttgtctctgaacctct

SEQ ID NO: 138945 - DNA, 25 bp, Mus musculus
agaaattctaacacatcggcctgct

SEQ ID NO: 138946 - DNA, 25 bp, Mus musculus
agaaattctaactcatcggcctgct

SEQ ID NO: 138947 - DNA, 25 bp, Mus musculus
agaaattctaatacccctctaatct

SEQ ID NO: 138948 - DNA, 25 bp, Mus musculus
agaaattctaattcccctctaatct

SEQ ID NO: 138949 - DNA, 25 bp, Mus musculus
agaaattctgacattgagcttatga

SEQ ID NO: 138950 - DNA, 25 bp, Mus musculus
agaaattctgactttgagcttatga

SEQ ID NO: 138951 - DNA, 25 bp, Mus musculus
agaaattctgagagtgtctgtctca

SEQ ID NO: 138952 - DNA, 25 bp, Mus musculus
agaaattctgagtgtgtctgtctca

SEQ ID NO: 138953 - DNA, 25 bp, Mus musculus
agaaattctgtaccatctgaaagta

SEQ ID NO: 138954 - DNA, 25 bp, Mus musculus
agaaattctgtagcatctgaaagta

SEQ ID NO: 138955 - DNA, 25 bp, Mus musculus
agaaattcttcccaatttgccgtgc

SEQ ID NO: 138956 - DNA, 25 bp, Mus musculus
agaaattcttccgaatttgccgtgc

SEQ ID NO: 138957 - DNA, 25 bp, Mus musculus
agaaattgactacctcccgtgtgat

SEQ ID NO: 138958 - DNA, 25 bp, Mus musculus
agaaattgactagctcccgtgtgat

SEQ ID NO: 138959 - DNA, 25 bp, Mus musculus
agaaattgagccattctgctctcag

SEQ ID NO: 138960 - DNA, 25 bp, Mus musculus
agaaattgagcctttctgctctcag

SEQ ID NO: 138961 - DNA, 25 bp, Mus musculus
agaaattgctctctttgtcttaatt

SEQ ID NO: 138962 - DNA, 25 bp, Mus musculus
agaaattgctctgtttgtcttaatt

SEQ ID NO: 138963 - DNA, 25 bp, Mus musculus
agaaattgctttacttcccaagaca

SEQ ID NO: 138964 - DNA, 25 bp, Mus musculus
agaaattgcttttcttcccaagaca

SEQ ID NO: 138965 - DNA, 25 bp, Mus musculus
agaaattggctgagcggtcagctcc

SEQ ID NO: 138966 - DNA, 25 bp, Mus musculus
agaaattggctgtgcggtcagctcc

SEQ ID NO: 138967 - DNA, 25 bp, Mus musculus
agaaattgggcgagatggtacatac

SEQ ID NO: 138968 - DNA, 25 bp, Mus musculus
agaaattgggcgtgatggtacatac

SEQ ID NO: 138969 - DNA, 25 bp, Mus musculus
agaaattgtgctcctagttactatt

SEQ ID NO: 138970 - DNA, 25 bp, Mus musculus
agaaattgtgctgctagttactatt

SEQ ID NO: 138971 - DNA, 25 bp, Mus musculus
agaaatttacacaaagcagggcttt

SEQ ID NO: 138972 - DNA, 25 bp, Mus musculus
agaaatttacactaagcagggcttt

SEQ ID NO: 138973 - DNA, 25 bp, Mus musculus
agaaatttagctaatggtcacttca

SEQ ID NO: 138974 - DNA, 25 bp, Mus musculus
agaaatttagcttatggtcacttca

SEQ ID NO: 138975 - DNA, 25 bp, Mus musculus
agaaatttaggcatccacatcccaa

SEQ ID NO: 138976 - DNA, 25 bp, Mus musculus
agaaatttaggcatggaccctgcgc

SEQ ID NO: 138977 - DNA, 25 bp, Mus musculus
agaaatttaggcttccacatcccaa

SEQ ID NO: 138978 - DNA, 25 bp, Mus musculus
agaaatttaggcttggaccctgcgc

SEQ ID NO: 138979 - DNA, 25 bp, Mus musculus
agaaatttagtcacactgccccata

SEQ ID NO: 138980 - DNA, 25 bp, Mus musculus
agaaatttagtctcactgccccata

SEQ ID NO: 138981 - DNA, 25 bp, Mus musculus
agaaatttcactagccaactgcctt

SEQ ID NO: 138982 - DNA, 25 bp, Mus musculus
agaaatttcacttgccaactgcctt

SEQ ID NO: 138983 - DNA, 25 bp, Mus musculus
agaaatttcatgcactcaagaccca

SEQ ID NO: 138984 - DNA, 25 bp, Mus musculus
agaaatttcatggactcaagaccca

SEQ ID NO: 138985 - DNA, 25 bp, Mus musculus
agaaatttcccactgaaggcctctc

SEQ ID NO: 138986 - DNA, 25 bp, Mus musculus
agaaatttcccagtgaaggcctctc

SEQ ID NO: 138987 - DNA, 25 bp, Mus musculus
agaaatttccccatcagctcatctt

SEQ ID NO: 138988 - DNA, 25 bp, Mus musculus
agaaatttccccttcagctcatctt

SEQ ID NO: 138989 - DNA, 25 bp, Mus musculus
agaaatttcctccactttggtgtcg

SEQ ID NO: 138990 - DNA, 25 bp, Mus musculus
agaaatttcctcgactttggtgtcg

SEQ ID NO: 138991 - DNA, 25 bp, Mus musculus
agaaatttctcaagcagcatctcct

SEQ ID NO: 138992 - DNA, 25 bp, Mus musculus
agaaatttctcatgcagcatctcct

SEQ ID NO: 138993 - DNA, 25 bp, Mus musculus
agaaatttcttgcatcctgatagta

SEQ ID NO: 138994 - DNA, 25 bp, Mus musculus
agaaatttcttggatcctgatagta

SEQ ID NO: 138995 - DNA, 25 bp, Mus musculus
agaaatttgaccagggcttgtgcaa

SEQ ID NO: 138996 - DNA, 25 bp, Mus musculus
agaaatttgacctgggcttgtgcaa

SEQ ID NO: 138997 - DNA, 25 bp, Mus musculus
agaaatttgattcctctcgggacag

SEQ ID NO: 138998 - DNA, 25 bp, Mus musculus
agaaatttgattgctctcgggacag

SEQ ID NO: 138999 - DNA, 25 bp, Mus musculus
agaaatttggctaccctgcgttcag

SEQ ID NO: 139000 - DNA, 25 bp, Mus musculus
agaaatttggcttccctgcgttcag

SEQ ID NO: 139001 - DNA, 25 bp, Mus musculus
agaaatttggtgcacctggacgcat

SEQ ID NO: 139002 - DNA, 25 bp, Mus musculus
agaaatttggtggacctggacgcat

SEQ ID NO: 139003 - DNA, 25 bp, Mus musculus
agaaatttgtgtattggtgtaagca

SEQ ID NO: 139004 - DNA, 25 bp, Mus musculus
agaaatttgtgttttggtgtaagca

SEQ ID NO: 139005 - DNA, 25 bp, Mus musculus
agaaatttgttactgccacaggcac

SEQ ID NO: 139006 - DNA, 25 bp, Mus musculus
agaaatttgttagtgccacaggcac

SEQ ID NO: 139007 - DNA, 25 bp, Mus musculus
agaaattttgaccttactgccatcc

SEQ ID NO: 139008 - DNA, 25 bp, Mus musculus
agaaattttgacgttactgccatcc

SEQ ID NO: 139009 - DNA, 25 bp, Mus musculus
agaacaaaagcgctcggccgggcct

SEQ ID NO: 139010 - DNA, 25 bp, Mus musculus
agaacaaaagcggtcggccgggcct

SEQ ID NO: 139011 - DNA, 25 bp, Mus musculus
agaacaaaatcacagcttggccttt

SEQ ID NO: 139012 - DNA, 25 bp, Mus musculus
agaacaaaatcagagcttggccttt

SEQ ID NO: 139013 - DNA, 25 bp, Mus musculus
agaacaaactctcctttcctttctg

SEQ ID NO: 139014 - DNA, 25 bp, Mus musculus
agaacaaactctgctttcctttctg

SEQ ID NO: 139015 - DNA, 25 bp, Mus musculus
agaacaaactgtctgccttcctcat

SEQ ID NO: 139016 - DNA, 25 bp, Mus musculus
agaacaaactgtgtgccttcctcat

SEQ ID NO: 139017 - DNA, 25 bp, Mus musculus
agaacaaaggccctatctcccgata

SEQ ID NO: 139018 - DNA, 25 bp, Mus musculus
agaacaaaggccgtatctcccgata

SEQ ID NO: 139019 - DNA, 25 bp, Mus musculus
agaacaaagtgtcccatgagagaaa

SEQ ID NO: 139020 - DNA, 25 bp, Mus musculus
agaacaaagtgtgccatgagagaaa

SEQ ID NO: 139021 - DNA, 25 bp, Mus musculus
agaacaaatatgctgccctatcgcc

SEQ ID NO: 139022 - DNA, 25 bp, Mus musculus
agaacaaatatggtgccctatcgcc

SEQ ID NO: 139023 - DNA, 25 bp, Mus musculus
agaacaaattctagccgcagggcac

SEQ ID NO: 139024 - DNA, 25 bp, Mus musculus
agaacaaattcttgccgcagggcac

SEQ ID NO: 139025 - DNA, 25 bp, Mus musculus
agaacaacaattagcccaccacctt

SEQ ID NO: 139026 - DNA, 25 bp, Mus musculus
agaacaacaatttgcccaccacctt

SEQ ID NO: 139027 - DNA, 25 bp, Mus musculus
agaacaacacaactctgataccctc

SEQ ID NO: 139028 - DNA, 25 bp, Mus musculus
agaacaacacaagtctgataccctc

SEQ ID NO: 139029 - DNA, 25 bp, Mus musculus
agaacaacacccattaggcccacag

SEQ ID NO: 139030 - DNA, 25 bp, Mus musculus
agaacaacaccctttaggcccacag

SEQ ID NO: 139031 - DNA, 25 bp, Mus musculus
agaacaacagctctctgcactgaac

SEQ ID NO: 139032 - DNA, 25 bp, Mus musculus
agaacaacagctgtctgcactgaac

SEQ ID NO: 139033 - DNA, 25 bp, Mus musculus
agaacaacagttcttacagcctcct

SEQ ID NO: 139034 - DNA, 25 bp, Mus musculus
agaacaacagttgttacagcctcct

SEQ ID NO: 139035 - DNA, 25 bp, Mus musculus
agaacaacattcacttgtcctctca

SEQ ID NO: 139036 - DNA, 25 bp, Mus musculus
agaacaacattctcttgtcctctca

SEQ ID NO: 139037 - DNA, 25 bp, Mus musculus
agaacaaccagcaataccactgcag

SEQ ID NO: 139038 - DNA, 25 bp, Mus musculus
agaacaaccagctataccactgcag

SEQ ID NO: 139039 - DNA, 25 bp, Mus musculus
agaacaacccacacatcaaagcttt

SEQ ID NO: 139040 - DNA, 25 bp, Mus musculus
agaacaacccactcatcaaagcttt

SEQ ID NO: 139041 - DNA, 25 bp, Mus musculus
agaacaaccctgcttacaaagtaga

SEQ ID NO: 139042 - DNA, 25 bp, Mus musculus
agaacaaccctggttacaaagtaga

SEQ ID NO: 139043 - DNA, 25 bp, Mus musculus
agaacaacctagcagccttcccgtg

SEQ ID NO: 139044 - DNA, 25 bp, Mus musculus
agaacaacctaggagccttcccgtg

SEQ ID NO: 139045 - DNA, 25 bp, Mus musculus
agaacaacctgaacctccttagaga

SEQ ID NO: 139046 - DNA, 25 bp, Mus musculus
agaacaacctgatcctccttagaga

SEQ ID NO: 139047 - DNA, 25 bp, Mus musculus
agaacaacgactatctccagtgtgg

SEQ ID NO: 139048 - DNA, 25 bp, Mus musculus
agaacaacgactttctccagtgtgg

SEQ ID NO: 139049 - DNA, 25 bp, Mus musculus
agaacaacgtccatatcgtctgtgt

SEQ ID NO: 139050 - DNA, 25 bp, Mus musculus
agaacaacgtccttatcgtctgtgt

SEQ ID NO: 139051 - DNA, 25 bp, Mus musculus
agaacaactaatcggatggtgccag

SEQ ID NO: 139052 - DNA, 25 bp, Mus musculus
agaacaactaatgggatggtgccag

SEQ ID NO: 139053 - DNA, 25 bp, Mus musculus
agaacaactacaacagggtcgcctc

SEQ ID NO: 139054 - DNA, 25 bp, Mus musculus
agaacaactacatcagggtcgcctc

SEQ ID NO: 139055 - DNA, 25 bp, Mus musculus
agaacaactatgagccatcatggct

SEQ ID NO: 139056 - DNA, 25 bp, Mus musculus
agaacaactatgtgccatcatggct

SEQ ID NO: 139057 - DNA, 25 bp, Mus musculus
agaacaactccgaataggcccgtgt

SEQ ID NO: 139058 - DNA, 25 bp, Mus musculus
agaacaactccgtataggcccgtgt

SEQ ID NO: 139059 - DNA, 25 bp, Mus musculus
agaacaactcgcacatttgcttcat

SEQ ID NO: 139060 - DNA, 25 bp, Mus musculus
agaacaactcgctcatttgcttcat

SEQ ID NO: 139061 - DNA, 25 bp, Mus musculus
agaacaactgccactcatttttctc

SEQ ID NO: 139062 - DNA, 25 bp, Mus musculus
agaacaactgcctctcatttttctc

SEQ ID NO: 139063 - DNA, 25 bp, Mus musculus
agaacaactttgatactccatagtt

SEQ ID NO: 139064 - DNA, 25 bp, Mus musculus
agaacaactttgttactccatagtt

SEQ ID NO: 139065 - DNA, 25 bp, Mus musculus
agaacaagaatgcactcactgcctg

SEQ ID NO: 139066 - DNA, 25 bp, Mus musculus
agaacaagaatggactcactgcctg

SEQ ID NO: 139067 - DNA, 25 bp, Mus musculus
agaacaagacatagcccacatccgg

SEQ ID NO: 139068 - DNA, 25 bp, Mus musculus
agaacaagacattgcccacatccgg

SEQ ID NO: 139069 - DNA, 25 bp, Mus musculus
agaacaagattcaggccagctttcg

SEQ ID NO: 139070 - DNA, 25 bp, Mus musculus
agaacaagattctggccagctttcg

SEQ ID NO: 139071 - DNA, 25 bp, Mus musculus
agaacaagcaagcacagcctctggt

SEQ ID NO: 139072 - DNA, 25 bp, Mus musculus
agaacaagcaaggacagcctctggt

SEQ ID NO: 139073 - DNA, 25 bp, Mus musculus
agaacaagccccagtacttcgctga

SEQ ID NO: 139074 - DNA, 25 bp, Mus musculus
agaacaagcccctgtacttcgctga

SEQ ID NO: 139075 - DNA, 25 bp, Mus musculus
agaacaagcctcaagggccagcagg

SEQ ID NO: 139076 - DNA, 25 bp, Mus musculus
agaacaagcctctagggccagcagg

SEQ ID NO: 139077 - DNA, 25 bp, Mus musculus
agaacaagcggaaggctgacagcct

SEQ ID NO: 139078 - DNA, 25 bp, Mus musculus
agaacaagcggatggctgacagcct

SEQ ID NO: 139079 - DNA, 25 bp, Mus musculus
agaacaagctccagagactggtccc

SEQ ID NO: 139080 - DNA, 25 bp, Mus musculus
agaacaagctcctgagactggtccc

SEQ ID NO: 139081 - DNA, 25 bp, Mus musculus
agaacaagctgcatgctttccttct

SEQ ID NO: 139082 - DNA, 25 bp, Mus musculus
agaacaagctgcttgctttccttct

SEQ ID NO: 139083 - DNA, 25 bp, Mus musculus
agaacaaggcccagattggcccaga

SEQ ID NO: 139084 - DNA, 25 bp, Mus musculus
agaacaaggccctgattggcccaga

SEQ ID NO: 139085 - DNA, 25 bp, Mus musculus
agaacaaggctgacgggacctccga

SEQ ID NO: 139086 - DNA, 25 bp, Mus musculus
agaacaaggctgcttctgcatcccc

SEQ ID NO: 139087 - DNA, 25 bp, Mus musculus
agaacaaggctggttctgcatcccc

SEQ ID NO: 139088 - DNA, 25 bp, Mus musculus
agaacaaggctgtcgggacctccga

SEQ ID NO: 139089 - DNA, 25 bp, Mus musculus
agaacaaggcttcaagacccttcca

SEQ ID NO: 139090 - DNA, 25 bp, Mus musculus
agaacaaggcttgaagacccttcca

SEQ ID NO: 139091 - DNA, 25 bp, Mus musculus
agaacaagggctcccttgctacagg

SEQ ID NO: 139092 - DNA, 25 bp, Mus musculus
agaacaagggctgccttgctacagg

SEQ ID NO: 139093 - DNA, 25 bp, Mus musculus
agaacaaggtacataatttctcttc

SEQ ID NO: 139094 - DNA, 25 bp, Mus musculus
agaacaaggtacttaatttctcttc

SEQ ID NO: 139095 - DNA, 25 bp, Mus musculus
agaacaaggtccacgcgagatcgga

SEQ ID NO: 139096 - DNA, 25 bp, Mus musculus
agaacaaggtcctcgcgagatcgga

SEQ ID NO: 139097 - DNA, 25 bp, Mus musculus
agaacaaggtgaagcgctccgccat

SEQ ID NO: 139098 - DNA, 25 bp, Mus musculus
agaacaaggtgatgcgctccgccat

SEQ ID NO: 139099 - DNA, 25 bp, Mus musculus
agaacaagtcccctttgcagaagaa

SEQ ID NO: 139100 - DNA, 25 bp, Mus musculus
agaacaagtcccgtttgcagaagaa

SEQ ID NO: 139101 - DNA, 25 bp, Mus musculus
agaacaagtcttcagtttcagttga

SEQ ID NO: 139102 - DNA, 25 bp, Mus musculus
agaacaagtcttgagtttcagttga

SEQ ID NO: 139103 - DNA, 25 bp, Mus musculus
agaacaagtgctcttgcctgctgaa

SEQ ID NO: 139104 - DNA, 25 bp, Mus musculus
agaacaagtgctgttgcctgctgaa

SEQ ID NO: 139105 - DNA, 25 bp, Mus musculus
agaacaagtgtgctcccaacagcaa

SEQ ID NO: 139106 - DNA, 25 bp, Mus musculus
agaacaagtgtggtcccaacagcaa

SEQ ID NO: 139107 - DNA, 25 bp, Mus musculus
agaacaagtttccagccacgcgcta

SEQ ID NO: 139108 - DNA, 25 bp, Mus musculus
agaacaagtttcgagccacgcgcta

SEQ ID NO: 139109 - DNA, 25 bp, Mus musculus
agaacaatacatcgcttttagaatc

SEQ ID NO: 139110 - DNA, 25 bp, Mus musculus
agaacaatacatggcttttagaatc

SEQ ID NO: 139111 - DNA, 25 bp, Mus musculus
agaacaataggacgagtgcactcag

SEQ ID NO: 139112 - DNA, 25 bp, Mus musculus
agaacaataggaggagtgcactcag

SEQ ID NO: 139113 - DNA, 25 bp, Mus musculus
agaacaatatttactcccaccaggg

SEQ ID NO: 139114 - DNA, 25 bp, Mus musculus
agaacaatattttctcccaccaggg

SEQ ID NO: 139115 - DNA, 25 bp, Mus musculus
agaacaatcatgaagtcttgacaaa

SEQ ID NO: 139116 - DNA, 25 bp, Mus musculus
agaacaatcatgtagtcttgacaaa

SEQ ID NO: 139117 - DNA, 25 bp, Mus musculus
agaacaatccgcaggagatctgccc

SEQ ID NO: 139118 - DNA, 25 bp, Mus musculus
agaacaatccgctggagatctgccc

SEQ ID NO: 139119 - DNA, 25 bp, Mus musculus
agaacaatccttacatatttacaaa

SEQ ID NO: 139120 - DNA, 25 bp, Mus musculus
agaacaatcctttcatatttacaaa

SEQ ID NO: 139121 - DNA, 25 bp, Mus musculus
agaacaatctacatccctagctgac

SEQ ID NO: 139122 - DNA, 25 bp, Mus musculus
agaacaatctacttccctagctgac

SEQ ID NO: 139123 - DNA, 25 bp, Mus musculus
agaacaatctatacccaagacaccc

SEQ ID NO: 139124 - DNA, 25 bp, Mus musculus
agaacaatctattcccaagacaccc

SEQ ID NO: 139125 - DNA, 25 bp, Mus musculus
agaacaatctctcgacaggcccagt

SEQ ID NO: 139126 - DNA, 25 bp, Mus musculus
agaacaatctctggacaggcccagt

SEQ ID NO: 139127 - DNA, 25 bp, Mus musculus
agaacaatctttccttacccatctg

SEQ ID NO: 139128 - DNA, 25 bp, Mus musculus
agaacaatctttgcttacccatctg

SEQ ID NO: 139129 - DNA, 25 bp, Mus musculus
agaacaatgccgacagagctcccat

SEQ ID NO: 139130 - DNA, 25 bp, Mus musculus
agaacaatgccgtcagagctcccat

SEQ ID NO: 139131 - DNA, 25 bp, Mus musculus
agaacaatgctcatttctctgcatc

SEQ ID NO: 139132 - DNA, 25 bp, Mus musculus
agaacaatgctccagctctatctat

SEQ ID NO: 139133 - DNA, 25 bp, Mus musculus
agaacaatgctcgagctctatctat

SEQ ID NO: 139134 - DNA, 25 bp, Mus musculus
agaacaatgctcttttctctgcatc

SEQ ID NO: 139135 - DNA, 25 bp, Mus musculus
agaacaatggcgaagcagctgaggt

SEQ ID NO: 139136 - DNA, 25 bp, Mus musculus
agaacaatggcgtagcagctgaggt

SEQ ID NO: 139137 - DNA, 25 bp, Mus musculus
agaacaattccaattccactcatcc

SEQ ID NO: 139138 - DNA, 25 bp, Mus musculus
agaacaattccatttccactcatcc

SEQ ID NO: 139139 - DNA, 25 bp, Mus musculus
agaacaattttgacccgaactcctg

SEQ ID NO: 139140 - DNA, 25 bp, Mus musculus
agaacaattttgtcccgaactcctg

SEQ ID NO: 139141 - DNA, 25 bp, Mus musculus
agaacacaactaagccgtactccgc

SEQ ID NO: 139142 - DNA, 25 bp, Mus musculus
agaacacaactatgccgtactccgc

SEQ ID NO: 139143 - DNA, 25 bp, Mus musculus
agaacacaagtactggccgcagaca

SEQ ID NO: 139144 - DNA, 25 bp, Mus musculus
agaacacaagtagtggccgcagaca

SEQ ID NO: 139145 - DNA, 25 bp, Mus musculus
agaacacaagtgaccagcctatgcc

SEQ ID NO: 139146 - DNA, 25 bp, Mus musculus
agaacacaagtgtccagcctatgcc

SEQ ID NO: 139147 - DNA, 25 bp, Mus musculus
agaacacacaatccggaactaccca

SEQ ID NO: 139148 - DNA, 25 bp, Mus musculus
agaacacacaatgcggaactaccca

SEQ ID NO: 139149 - DNA, 25 bp, Mus musculus
agaacacacagcaggctcctactct

SEQ ID NO: 139150 - DNA, 25 bp, Mus musculus
agaacacacagctggctcctactct

SEQ ID NO: 139151 - DNA, 25 bp, Mus musculus
agaacacacgctaggtgtccatctg

SEQ ID NO: 139152 - DNA, 25 bp, Mus musculus
agaacacacgcttggtgtccatctg

SEQ ID NO: 139153 - DNA, 25 bp, Mus musculus
agaacacactagcaatttctttcca

SEQ ID NO: 139154 - DNA, 25 bp, Mus musculus
agaacacactaggaatttctttcca

SEQ ID NO: 139155 - DNA, 25 bp, Mus musculus
agaacacactcacatgcaagcgatg

SEQ ID NO: 139156 - DNA, 25 bp, Mus musculus
agaacacactcagatgcaagcgatg

SEQ ID NO: 139157 - DNA, 25 bp, Mus musculus
agaacacagaatctggcccgcttgc

SEQ ID NO: 139158 - DNA, 25 bp, Mus musculus
agaacacagaatgtggcccgcttgc

SEQ ID NO: 139159 - DNA, 25 bp, Mus musculus
agaacacagacaaaggcaacaaccc

SEQ ID NO: 139160 - DNA, 25 bp, Mus musculus
agaacacagacataggcaacaaccc

SEQ ID NO: 139161 - DNA, 25 bp, Mus musculus
agaacacagccccactagagtgcgg

SEQ ID NO: 139162 - DNA, 25 bp, Mus musculus
agaacacagcccgactagagtgcgg

SEQ ID NO: 139163 - DNA, 25 bp, Mus musculus
agaacacatctgatcatcagctgct

SEQ ID NO: 139164 - DNA, 25 bp, Mus musculus
agaacacatctgttcatcagctgct

SEQ ID NO: 139165 - DNA, 25 bp, Mus musculus
agaacaccactcagttctgtgccag

SEQ ID NO: 139166 - DNA, 25 bp, Mus musculus
agaacaccactctgttctgtgccag

SEQ ID NO: 139167 - DNA, 25 bp, Mus musculus
agaacaccactgagtgctccagaag

SEQ ID NO: 139168 - DNA, 25 bp, Mus musculus
agaacaccactgtgtgctccagaag

SEQ ID NO: 139169 - DNA, 25 bp, Mus musculus
agaacaccaggaagtctgccatgaa

SEQ ID NO: 139170 - DNA, 25 bp, Mus musculus
agaacaccaggatgtctgccatgaa

SEQ ID NO: 139171 - DNA, 25 bp, Mus musculus
agaacaccatcacgtttccagtcac

SEQ ID NO: 139172 - DNA, 25 bp, Mus musculus
agaacaccatcaggtttccagtcac

SEQ ID NO: 139173 - DNA, 25 bp, Mus musculus
agaacacccactctttgagcgtgtg

SEQ ID NO: 139174 - DNA, 25 bp, Mus musculus
agaacacccactgtttgagcgtgtg

SEQ ID NO: 139175 - DNA, 25 bp, Mus musculus
agaacaccgacgaggccttgcagaa

SEQ ID NO: 139176 - DNA, 25 bp, Mus musculus
agaacaccgacgtggccttgcagaa

SEQ ID NO: 139177 - DNA, 25 bp, Mus musculus
agaacaccgcagatcttaaccaagg

SEQ ID NO: 139178 - DNA, 25 bp, Mus musculus
agaacaccgcagttcttaaccaagg

SEQ ID NO: 139179 - DNA, 25 bp, Mus musculus
agaacaccgtggcagtgtccgcagc

SEQ ID NO: 139180 - DNA, 25 bp, Mus musculus
agaacaccgtgggagtgtccgcagc

SEQ ID NO: 139181 - DNA, 25 bp, Mus musculus
agaacacctacaatctgaggcccat

SEQ ID NO: 139182 - DNA, 25 bp, Mus musculus
agaacacctacattctgaggcccat

SEQ ID NO: 139183 - DNA, 25 bp, Mus musculus
agaacacctataatcgttacgaact

SEQ ID NO: 139184 - DNA, 25 bp, Mus musculus
agaacacctatattcgttacgaact

SEQ ID NO: 139185 - DNA, 25 bp, Mus musculus
agaacacctatgagccgggcgagaa

SEQ ID NO: 139186 - DNA, 25 bp, Mus musculus
agaacacctatgtgccgggcgagaa

SEQ ID NO: 139187 - DNA, 25 bp, Mus musculus
agaacacctcaacgcatcgaacagt

SEQ ID NO: 139188 - DNA, 25 bp, Mus musculus
agaacacctcaaggcatcgaacagt

SEQ ID NO: 139189 - DNA, 25 bp, Mus musculus
agaacacctcagctctttagctcac

SEQ ID NO: 139190 - DNA, 25 bp, Mus musculus
agaacacctcaggtctttagctcac

SEQ ID NO: 139191 - DNA, 25 bp, Mus musculus
agaacacctcttatagtcaaactgt

SEQ ID NO: 139192 - DNA, 25 bp, Mus musculus
agaacacctcttttagtcaaactgt

SEQ ID NO: 139193 - DNA, 25 bp, Mus musculus
agaacacctgccctgaggcgccagg

SEQ ID NO: 139194 - DNA, 25 bp, Mus musculus
agaacacctgccgtgaggcgccagg

SEQ ID NO: 139195 - DNA, 25 bp, Mus musculus
agaacaccttacagagccccttgtt

SEQ ID NO: 139196 - DNA, 25 bp, Mus musculus
agaacaccttactgagccccttgtt

SEQ ID NO: 139197 - DNA, 25 bp, Mus musculus
agaacacgaattcctcaatgcatga

SEQ ID NO: 139198 - DNA, 25 bp, Mus musculus
agaacacgaattgctcaatgcatga

SEQ ID NO: 139199 - DNA, 25 bp, Mus musculus
agaacacgatggctcaatgtgattt

SEQ ID NO: 139200 - DNA, 25 bp, Mus musculus
agaacacgatgggtcaatgtgattt

SEQ ID NO: 139201 - DNA, 25 bp, Mus musculus
agaacacgctttaccactcttttat

SEQ ID NO: 139202 - DNA, 25 bp, Mus musculus
agaacacgcttttccactcttttat

SEQ ID NO: 139203 - DNA, 25 bp, Mus musculus
agaacacggagtactctgagctgga

SEQ ID NO: 139204 - DNA, 25 bp, Mus musculus
agaacacggagttctctgagctgga

SEQ ID NO: 139205 - DNA, 25 bp, Mus musculus
agaacacggtgaactacggcgcgga

SEQ ID NO: 139206 - DNA, 25 bp, Mus musculus
agaacacggtgatctacggcgcgga

SEQ ID NO: 139207 - DNA, 25 bp, Mus musculus
agaacacggttcacaacagtagccc

SEQ ID NO: 139208 - DNA, 25 bp, Mus musculus
agaacacggttctcaacagtagccc

SEQ ID NO: 139209 - DNA, 25 bp, Mus musculus
agaacacgtagaactcccaaatcct

SEQ ID NO: 139210 - DNA, 25 bp, Mus musculus
agaacacgtagatctcccaaatcct

SEQ ID NO: 139211 - DNA, 25 bp, Mus musculus
agaacactatttctgagtcctccag

SEQ ID NO: 139212 - DNA, 25 bp, Mus musculus
agaacactatttgtgagtcctccag

SEQ ID NO: 139213 - DNA, 25 bp, Mus musculus
agaacactcgttcaacattcaggga

SEQ ID NO: 139214 - DNA, 25 bp, Mus musculus
agaacactcgttgaacattcaggga

SEQ ID NO: 139215 - DNA, 25 bp, Mus musculus
agaacactctgtaagcacaagccct

SEQ ID NO: 139216 - DNA, 25 bp, Mus musculus
agaacactctgttagcacaagccct

SEQ ID NO: 139217 - DNA, 25 bp, Mus musculus
agaacactgaaccagtcctggactc

SEQ ID NO: 139218 - DNA, 25 bp, Mus musculus
agaacactgaacgagtcctggactc

SEQ ID NO: 139219 - DNA, 25 bp, Mus musculus
agaacactgagtcggatactcggaa

SEQ ID NO: 139220 - DNA, 25 bp, Mus musculus
agaacactgagtgggatactcggaa

SEQ ID NO: 139221 - DNA, 25 bp, Mus musculus
agaacactgatcatcatcctcaggc

SEQ ID NO: 139222 - DNA, 25 bp, Mus musculus
agaacactgatcttcatcctcaggc

SEQ ID NO: 139223 - DNA, 25 bp, Mus musculus
agaacactgcacactgtttttcctt

SEQ ID NO: 139224 - DNA, 25 bp, Mus musculus
agaacactgcactctgtttttcctt

SEQ ID NO: 139225 - DNA, 25 bp, Mus musculus
agaacactgctacatacactgcacc

SEQ ID NO: 139226 - DNA, 25 bp, Mus musculus
agaacactgctagatacactgcacc

SEQ ID NO: 139227 - DNA, 25 bp, Mus musculus
agaacactgctgctgcataagccac

SEQ ID NO: 139228 - DNA, 25 bp, Mus musculus
agaacactgctggtgcataagccac

SEQ ID NO: 139229 - DNA, 25 bp, Mus musculus
agaacactggctcctggtcttggtt

SEQ ID NO: 139230 - DNA, 25 bp, Mus musculus
agaacactggctgctggtcttggtt

SEQ ID NO: 139231 - DNA, 25 bp, Mus musculus
agaacactgggcactggaagtcatc

SEQ ID NO: 139232 - DNA, 25 bp, Mus musculus
agaacactgggctctggaagtcatc

SEQ ID NO: 139233 - DNA, 25 bp, Mus musculus
agaacactggttaggcctggaacac

SEQ ID NO: 139234 - DNA, 25 bp, Mus musculus
agaacactggttccatcgttcattg

SEQ ID NO: 139235 - DNA, 25 bp, Mus musculus
agaacactggttgcatcgttcattg

SEQ ID NO: 139236 - DNA, 25 bp, Mus musculus
agaacactggtttggcctggaacac

SEQ ID NO: 139237 - DNA, 25 bp, Mus musculus
agaacactgtaaagtcccttgcagc

SEQ ID NO: 139238 - DNA, 25 bp, Mus musculus
agaacactgtaatgtcccttgcagc

SEQ ID NO: 139239 - DNA, 25 bp, Mus musculus
agaacactgtccatggaactttgcc

SEQ ID NO: 139240 - DNA, 25 bp, Mus musculus
agaacactgtccttggaactttgcc

SEQ ID NO: 139241 - DNA, 25 bp, Mus musculus
agaacactgtgactgacggcactca

SEQ ID NO: 139242 - DNA, 25 bp, Mus musculus
agaacactgtgagtgacggcactca

SEQ ID NO: 139243 - DNA, 25 bp, Mus musculus
agaacactgtgcaccacaatgcctg

SEQ ID NO: 139244 - DNA, 25 bp, Mus musculus
agaacactgtgctccacaatgcctg

SEQ ID NO: 139245 - DNA, 25 bp, Mus musculus
agaacactgtttcatttcccaccat

SEQ ID NO: 139246 - DNA, 25 bp, Mus musculus
agaacactgtttgatttcccaccat

SEQ ID NO: 139247 - DNA, 25 bp, Mus musculus
agaacacttaacagcgacgaggaga

SEQ ID NO: 139248 - DNA, 25 bp, Mus musculus
agaacacttaactgcgacgaggaga

SEQ ID NO: 139249 - DNA, 25 bp, Mus musculus
agaacacttacgattccacttcatg

SEQ ID NO: 139250 - DNA, 25 bp, Mus musculus
agaacacttacgtttccacttcatg

SEQ ID NO: 139251 - DNA, 25 bp, Mus musculus
agaacacttccaagtctgtgggaat

SEQ ID NO: 139252 - DNA, 25 bp, Mus musculus
agaacacttccatgtctgtgggaat

SEQ ID NO: 139253 - DNA, 25 bp, Mus musculus
agaacacttcccctgtgtcatactg

SEQ ID NO: 139254 - DNA, 25 bp, Mus musculus
agaacacttcccgtgtgtcatactg

SEQ ID NO: 139255 - DNA, 25 bp, Mus musculus
agaacacttctactcaattgtcaga

SEQ ID NO: 139256 - DNA, 25 bp, Mus musculus
agaacacttctagtcaattgtcaga

SEQ ID NO: 139257 - DNA, 25 bp, Mus musculus
agaacacttgcacagttctctcctt

SEQ ID NO: 139258 - DNA, 25 bp, Mus musculus
agaacacttgcagagttctctcctt

SEQ ID NO: 139259 - DNA, 25 bp, Mus musculus
agaacacttgctaggtatgcacaaa

SEQ ID NO: 139260 - DNA, 25 bp, Mus musculus
agaacacttgctcaaccgctgactt

SEQ ID NO: 139261 - DNA, 25 bp, Mus musculus
agaacacttgctccggttttaacca

SEQ ID NO: 139262 - DNA, 25 bp, Mus musculus
agaacacttgctgaaccgctgactt

SEQ ID NO: 139263 - DNA, 25 bp, Mus musculus
agaacacttgctgcggttttaacca

SEQ ID NO: 139264 - DNA, 25 bp, Mus musculus
agaacacttgcttggtatgcacaaa

SEQ ID NO: 139265 - DNA, 25 bp, Mus musculus
agaacacttggtacttggcgcagca

SEQ ID NO: 139266 - DNA, 25 bp, Mus musculus
agaacacttggttcttggcgcagca

SEQ ID NO: 139267 - DNA, 25 bp, Mus musculus
agaacagaaagtaggagaatgcatt

SEQ ID NO: 139268 - DNA, 25 bp, Mus musculus
agaacagaaagttggagaatgcatt

SEQ ID NO: 139269 - DNA, 25 bp, Mus musculus
agaacagaaatactttccaggccag

SEQ ID NO: 139270 - DNA, 25 bp, Mus musculus
agaacagaaatagtttccaggccag

SEQ ID NO: 139271 - DNA, 25 bp, Mus musculus
agaacagaaccaagaccatccacaa

SEQ ID NO: 139272 - DNA, 25 bp, Mus musculus
agaacagaaccatgaccatccacaa

SEQ ID NO: 139273 - DNA, 25 bp, Mus musculus
agaacagaacccaacaactccctgg

SEQ ID NO: 139274 - DNA, 25 bp, Mus musculus
agaacagaaccctacaactccctgg

SEQ ID NO: 139275 - DNA, 25 bp, Mus musculus
agaacagaactccacaagacactcc

SEQ ID NO: 139276 - DNA, 25 bp, Mus musculus
agaacagaactccagtggctcccga

SEQ ID NO: 139277 - DNA, 25 bp, Mus musculus
agaacagaactcgacaagacactcc

SEQ ID NO: 139278 - DNA, 25 bp, Mus musculus
agaacagaactcgagtggctcccga

SEQ ID NO: 139279 - DNA, 25 bp, Mus musculus
agaacagaagtcaggacctcgatga

SEQ ID NO: 139280 - DNA, 25 bp, Mus musculus
agaacagaagtctggacctcgatga

SEQ ID NO: 139281 - DNA, 25 bp, Mus musculus
agaacagaatacctttatatgctat

SEQ ID NO: 139282 - DNA, 25 bp, Mus musculus
agaacagaatacgtttatatgctat

SEQ ID NO: 139283 - DNA, 25 bp, Mus musculus
agaacagaatctcccgttgtatgcc

SEQ ID NO: 139284 - DNA, 25 bp, Mus musculus
agaacagaatctgccgttgtatgcc

SEQ ID NO: 139285 - DNA, 25 bp, Mus musculus
agaacagaatttcgactgggcttgg

SEQ ID NO: 139286 - DNA, 25 bp, Mus musculus
agaacagaatttggactgggcttgg

SEQ ID NO: 139287 - DNA, 25 bp, Mus musculus
agaacagacaatagtctctgtcttt

SEQ ID NO: 139288 - DNA, 25 bp, Mus musculus
agaacagacaattgtctctgtcttt

SEQ ID NO: 139289 - DNA, 25 bp, Mus musculus
agaacagacatgacggccggcatac

SEQ ID NO: 139290 - DNA, 25 bp, Mus musculus
agaacagacatgtcggccggcatac

SEQ ID NO: 139291 - DNA, 25 bp, Mus musculus
agaacagaccagaggcctcggaggc

SEQ ID NO: 139292 - DNA, 25 bp, Mus musculus
agaacagaccagtggcctcggaggc

SEQ ID NO: 139293 - DNA, 25 bp, Mus musculus
agaacagaccccatctggagacata

SEQ ID NO: 139294 - DNA, 25 bp, Mus musculus
agaacagaccccttctggagacata

SEQ ID NO: 139295 - DNA, 25 bp, Mus musculus
agaacagacctcctagggacatcaa

SEQ ID NO: 139296 - DNA, 25 bp, Mus musculus
agaacagacctcgtagggacatcaa

SEQ ID NO: 139297 - DNA, 25 bp, Mus musculus
agaacagactacctggccgtgacct

SEQ ID NO: 139298 - DNA, 25 bp, Mus musculus
agaacagactacgtggccgtgacct

SEQ ID NO: 139299 - DNA, 25 bp, Mus musculus
agaacagactctatgctaactccca

SEQ ID NO: 139300 - DNA, 25 bp, Mus musculus
agaacagactctttgctaactccca

SEQ ID NO: 139301 - DNA, 25 bp, Mus musculus
agaacagagaaaaggaagcttcctt

SEQ ID NO: 139302 - DNA, 25 bp, Mus musculus
agaacagagaaatggaagcttcctt

SEQ ID NO: 139303 - DNA, 25 bp, Mus musculus
agaacagagcacagggaactgtgcc

SEQ ID NO: 139304 - DNA, 25 bp, Mus musculus
agaacagagcactgggaactgtgcc

SEQ ID NO: 139305 - DNA, 25 bp, Mus musculus
agaacagagcagacccatccataat

SEQ ID NO: 139306 - DNA, 25 bp, Mus musculus
agaacagagcagtcccatccataat

SEQ ID NO: 139307 - DNA, 25 bp, Mus musculus
agaacagaggtcacctgtttaccac

SEQ ID NO: 139308 - DNA, 25 bp, Mus musculus
agaacagaggtctcctgtttaccac

SEQ ID NO: 139309 - DNA, 25 bp, Mus musculus
agaacagatatactatgccggccct

SEQ ID NO: 139310 - DNA, 25 bp, Mus musculus
agaacagatatagtatgccggccct

SEQ ID NO: 139311 - DNA, 25 bp, Mus musculus
agaacagatccgacgtatcctgaag

SEQ ID NO: 139312 - DNA, 25 bp, Mus musculus
agaacagatccgtcgtatcctgaag

SEQ ID NO: 139313 - DNA, 25 bp, Mus musculus
agaacagatgcaaggatgtgagaca

SEQ ID NO: 139314 - DNA, 25 bp, Mus musculus
agaacagatgcatggatgtgagaca

SEQ ID NO: 139315 - DNA, 25 bp, Mus musculus
agaacagattgtcggcctgcatgcg

SEQ ID NO: 139316 - DNA, 25 bp, Mus musculus
agaacagattgtgggcctgcatgcg

SEQ ID NO: 139317 - DNA, 25 bp, Mus musculus
agaacagatttcacgaagctcttaa

SEQ ID NO: 139318 - DNA, 25 bp, Mus musculus
agaacagatttcctggttcctctgc

SEQ ID NO: 139319 - DNA, 25 bp, Mus musculus
agaacagatttcgtggttcctctgc

SEQ ID NO: 139320 - DNA, 25 bp, Mus musculus
agaacagatttctcgaagctcttaa

SEQ ID NO: 139321 - DNA, 25 bp, Mus musculus
agaacagcaactccctttgataatc

SEQ ID NO: 139322 - DNA, 25 bp, Mus musculus
agaacagcaactgcctttgataatc

SEQ ID NO: 139323 - DNA, 25 bp, Mus musculus
agaacagcacacagtattacctcgt

SEQ ID NO: 139324 - DNA, 25 bp, Mus musculus
agaacagcacactgtattacctcgt

SEQ ID NO: 139325 - DNA, 25 bp, Mus musculus
agaacagcacatcaaacgctcctct

SEQ ID NO: 139326 - DNA, 25 bp, Mus musculus
agaacagcacatgaaacgctcctct

SEQ ID NO: 139327 - DNA, 25 bp, Mus musculus
agaacagcacccagaccagatgatg

SEQ ID NO: 139328 - DNA, 25 bp, Mus musculus
agaacagcaccctgaccagatgatg

SEQ ID NO: 139329 - DNA, 25 bp, Mus musculus
agaacagcacttaccctttgtggta

SEQ ID NO: 139330 - DNA, 25 bp, Mus musculus
agaacagcactttccctttgtggta

SEQ ID NO: 139331 - DNA, 25 bp, Mus musculus
agaacagcagggactccagcacgtg

SEQ ID NO: 139332 - DNA, 25 bp, Mus musculus
agaacagcagggtctccagcacgtg

SEQ ID NO: 139333 - DNA, 25 bp, Mus musculus
agaacagcagtacagcaggctctcc

SEQ ID NO: 139334 - DNA, 25 bp, Mus musculus
agaacagcagtagagcaggctctcc

SEQ ID NO: 139335 - DNA, 25 bp, Mus musculus
agaacagcatcaccacaaagccctt

SEQ ID NO: 139336 - DNA, 25 bp, Mus musculus
agaacagcatcagcacaaagccctt

SEQ ID NO: 139337 - DNA, 25 bp, Mus musculus
agaacagccaccatgtgataccatc

SEQ ID NO: 139338 - DNA, 25 bp, Mus musculus
agaacagccaccttgtgataccatc

SEQ ID NO: 139339 - DNA, 25 bp, Mus musculus
agaacagccactacatccagaaatg

SEQ ID NO: 139340 - DNA, 25 bp, Mus musculus
agaacagccacttcatccagaaatg

SEQ ID NO: 139341 - DNA, 25 bp, Mus musculus
agaacagccctaaaagaacgccgct

SEQ ID NO: 139342 - DNA, 25 bp, Mus musculus
agaacagccctataagaacgccgct

SEQ ID NO: 139343 - DNA, 25 bp, Mus musculus
agaacagccgtgaggctctctctgc

SEQ ID NO: 139344 - DNA, 25 bp, Mus musculus
agaacagccgtgtggctctctctgc

SEQ ID NO: 139345 - DNA, 25 bp, Mus musculus
agaacagcctatatgccgcatgagc

SEQ ID NO: 139346 - DNA, 25 bp, Mus musculus
agaacagcctatttgccgcatgagc

SEQ ID NO: 139347 - DNA, 25 bp, Mus musculus
agaacagcgcttcaacagcttcctg

SEQ ID NO: 139348 - DNA, 25 bp, Mus musculus
agaacagcgcttgaacagcttcctg

SEQ ID NO: 139349 - DNA, 25 bp, Mus musculus
agaacagcgttccttattcaagatg

SEQ ID NO: 139350 - DNA, 25 bp, Mus musculus
agaacagcgttcgttattcaagatg

SEQ ID NO: 139351 - DNA, 25 bp, Mus musculus
agaacagctcctcacacggacatgg

SEQ ID NO: 139352 - DNA, 25 bp, Mus musculus
agaacagctcctgacacggacatgg

SEQ ID NO: 139353 - DNA, 25 bp, Mus musculus
agaacagctcgacgacaatatcaac

SEQ ID NO: 139354 - DNA, 25 bp, Mus musculus
agaacagctcgaggacaatatcaac

SEQ ID NO: 139355 - DNA, 25 bp, Mus musculus
agaacagctctgcaaccgctcacag

SEQ ID NO: 139356 - DNA, 25 bp, Mus musculus
agaacagctctggaaccgctcacag

SEQ ID NO: 139357 - DNA, 25 bp, Mus musculus
agaacagctggaagcaatgagtttg

SEQ ID NO: 139358 - DNA, 25 bp, Mus musculus
agaacagctggacccctgatgagga

SEQ ID NO: 139359 - DNA, 25 bp, Mus musculus
agaacagctggagccctgatgagga

SEQ ID NO: 139360 - DNA, 25 bp, Mus musculus
agaacagctggatgcaatgagtttg

SEQ ID NO: 139361 - DNA, 25 bp, Mus musculus
agaacagctgttcgactccttcagt

SEQ ID NO: 139362 - DNA, 25 bp, Mus musculus
agaacagctgttggactccttcagt

SEQ ID NO: 139363 - DNA, 25 bp, Mus musculus
agaacaggagctccctcttggaact

SEQ ID NO: 139364 - DNA, 25 bp, Mus musculus
agaacaggagctgcctcttggaact

SEQ ID NO: 139365 - DNA, 25 bp, Mus musculus
agaacaggaggtaggctctgcttag

SEQ ID NO: 139366 - DNA, 25 bp, Mus musculus
agaacaggaggttggctctgcttag

SEQ ID NO: 139367 - DNA, 25 bp, Mus musculus
agaacaggcacaccgctcttcttgg

SEQ ID NO: 139368 - DNA, 25 bp, Mus musculus
agaacaggcacagcgctcttcttgg

SEQ ID NO: 139369 - DNA, 25 bp, Mus musculus
agaacaggcctcatgggccttcaag

SEQ ID NO: 139370 - DNA, 25 bp, Mus musculus
agaacaggcctcctgatgaagctcc

SEQ ID NO: 139371 - DNA, 25 bp, Mus musculus
agaacaggcctcgtgatgaagctcc

SEQ ID NO: 139372 - DNA, 25 bp, Mus musculus
agaacaggcctcttgggccttcaag

SEQ ID NO: 139373 - DNA, 25 bp, Mus musculus
agaacaggcttgcatggcttcccct

SEQ ID NO: 139374 - DNA, 25 bp, Mus musculus
agaacaggcttggatggcttcccct

SEQ ID NO: 139375 - DNA, 25 bp, Mus musculus
agaacagggcataagatctctagag

SEQ ID NO: 139376 - DNA, 25 bp, Mus musculus
agaacagggcattagatctctagag

SEQ ID NO: 139377 - DNA, 25 bp, Mus musculus
agaacagggcttcgctgcatcactt

SEQ ID NO: 139378 - DNA, 25 bp, Mus musculus
agaacagggcttggctgcatcactt

SEQ ID NO: 139379 - DNA, 25 bp, Mus musculus
agaacaggtagacggtccagacgcc

SEQ ID NO: 139380 - DNA, 25 bp, Mus musculus
agaacaggtagagggtccagacgcc

SEQ ID NO: 139381 - DNA, 25 bp, Mus musculus
agaacaggtcttagtccatgtgctc

SEQ ID NO: 139382 - DNA, 25 bp, Mus musculus
agaacaggtctttgtccatgtgctc

SEQ ID NO: 139383 - DNA, 25 bp, Mus musculus
agaacagtaacgcttcggttagaag

SEQ ID NO: 139384 - DNA, 25 bp, Mus musculus
agaacagtaacggttcggttagaag

SEQ ID NO: 139385 - DNA, 25 bp, Mus musculus
agaacagtcaccactttgagaacgt

SEQ ID NO: 139386 - DNA, 25 bp, Mus musculus
agaacagtcaccagtgttggcccag

SEQ ID NO: 139387 - DNA, 25 bp, Mus musculus
agaacagtcacctctttgagaacgt

SEQ ID NO: 139388 - DNA, 25 bp, Mus musculus
agaacagtcacctgtgttggcccag

SEQ ID NO: 139389 - DNA, 25 bp, Mus musculus
agaacagtcagtaactcttccaaaa

SEQ ID NO: 139390 - DNA, 25 bp, Mus musculus
agaacagtcagttactcttccaaaa

SEQ ID NO: 139391 - DNA, 25 bp, Mus musculus
agaacagtccctactggtgaacata

SEQ ID NO: 139392 - DNA, 25 bp, Mus musculus
agaacagtcccttctggtgaacata

SEQ ID NO: 139393 - DNA, 25 bp, Mus musculus
agaacagtcggacaagctgcggaca

SEQ ID NO: 139394 - DNA, 25 bp, Mus musculus
agaacagtcggagaagctgcggaca

SEQ ID NO: 139395 - DNA, 25 bp, Mus musculus
agaacagtctggcttgccctggcta

SEQ ID NO: 139396 - DNA, 25 bp, Mus musculus
agaacagtctgggttgccctggcta

SEQ ID NO: 139397 - DNA, 25 bp, Mus musculus
agaacagtgaagacactcctcccag

SEQ ID NO: 139398 - DNA, 25 bp, Mus musculus
agaacagtgaagtcactcctcccag

SEQ ID NO: 139399 - DNA, 25 bp, Mus musculus
agaacagtgactaggagggcccatt

SEQ ID NO: 139400 - DNA, 25 bp, Mus musculus
agaacagtgacttggagggcccatt

SEQ ID NO: 139401 - DNA, 25 bp, Mus musculus
agaacagtgatcagcctacttttgc

SEQ ID NO: 139402 - DNA, 25 bp, Mus musculus
agaacagtgatctgcctacttttgc

SEQ ID NO: 139403 - DNA, 25 bp, Mus musculus
agaacagtgccaccctgcgattgtg

SEQ ID NO: 139404 - DNA, 25 bp, Mus musculus
agaacagtgccagcctgcgattgtg

SEQ ID NO: 139405 - DNA, 25 bp, Mus musculus
agaacagtgctgctgtggagagaga

SEQ ID NO: 139406 - DNA, 25 bp, Mus musculus
agaacagtgctggtgtggagagaga

SEQ ID NO: 139407 - DNA, 25 bp, Mus musculus
agaacagtggctactacgcaatcct

SEQ ID NO: 139408 - DNA, 25 bp, Mus musculus
agaacagtggcttctacgcaatcct

SEQ ID NO: 139409 - DNA, 25 bp, Mus musculus
agaacagtggttcgcaaccatcttc

SEQ ID NO: 139410 - DNA, 25 bp, Mus musculus
agaacagtggttggcaaccatcttc

SEQ ID NO: 139411 - DNA, 25 bp, Mus musculus
agaacagtgtgtctacacccctgca

SEQ ID NO: 139412 - DNA, 25 bp, Mus musculus
agaacagtgtgtgtacacccctgca

SEQ ID NO: 139413 - DNA, 25 bp, Mus musculus
agaacagtgtttcatatgacccatt

SEQ ID NO: 139414 - DNA, 25 bp, Mus musculus
agaacagtgtttgatatgacccatt

SEQ ID NO: 139415 - DNA, 25 bp, Mus musculus
agaacagttactctctttcacaggc

SEQ ID NO: 139416 - DNA, 25 bp, Mus musculus
agaacagttactgtctttcacaggc

SEQ ID NO: 139417 - DNA, 25 bp, Mus musculus
agaacagttagacgtagccctctgc

SEQ ID NO: 139418 - DNA, 25 bp, Mus musculus
agaacagttagaggtagccctctgc

SEQ ID NO: 139419 - DNA, 25 bp, Mus musculus
agaacagttattatgcaagtcgcta

SEQ ID NO: 139420 - DNA, 25 bp, Mus musculus
agaacagttattttgcaagtcgcta

SEQ ID NO: 139421 - DNA, 25 bp, Mus musculus
agaacagttgaaacataccccatat

SEQ ID NO: 139422 - DNA, 25 bp, Mus musculus
agaacagttgaatcataccccatat

SEQ ID NO: 139423 - DNA, 25 bp, Mus musculus
agaacagttgttcaaatcattgtaa

SEQ ID NO: 139424 - DNA, 25 bp, Mus musculus
agaacagttgttgaaatcattgtaa

SEQ ID NO: 139425 - DNA, 25 bp, Mus musculus
agaacagtttgaaacaccgcaaatt

SEQ ID NO: 139426 - DNA, 25 bp, Mus musculus
agaacagtttgatacaccgcaaatt

SEQ ID NO: 139427 - DNA, 25 bp, Mus musculus
agaacataactcagcgcggcaacgt

SEQ ID NO: 139428 - DNA, 25 bp, Mus musculus
agaacataactctgcgcggcaacgt

SEQ ID NO: 139429 - DNA, 25 bp, Mus musculus
agaacatacggccattacacctgtc

SEQ ID NO: 139430 - DNA, 25 bp, Mus musculus
agaacatacggcgattacacctgtc

SEQ ID NO: 139431 - DNA, 25 bp, Mus musculus
agaacatatcccctgccatttgaga

SEQ ID NO: 139432 - DNA, 25 bp, Mus musculus
agaacatatcccgtgccatttgaga

SEQ ID NO: 139433 - DNA, 25 bp, Mus musculus
agaacatcaagtcgctcactcacgg

SEQ ID NO: 139434 - DNA, 25 bp, Mus musculus
agaacatcaagtggctcactcacgg

SEQ ID NO: 139435 - DNA, 25 bp, Mus musculus
agaacatcacagctttcaggacctc

SEQ ID NO: 139436 - DNA, 25 bp, Mus musculus
agaacatcacaggtttcaggacctc

SEQ ID NO: 139437 - DNA, 25 bp, Mus musculus
agaacatcagtccagcaccactggt

SEQ ID NO: 139438 - DNA, 25 bp, Mus musculus
agaacatcagtcgagcaccactggt

SEQ ID NO: 139439 - DNA, 25 bp, Mus musculus
agaacatccagtcctattaacaact

SEQ ID NO: 139440 - DNA, 25 bp, Mus musculus
agaacatccagtgctattaacaact

SEQ ID NO: 139441 - DNA, 25 bp, Mus musculus
agaacatcccctatgatgactgagt

SEQ ID NO: 139442 - DNA, 25 bp, Mus musculus
agaacatcccctttgatgactgagt

SEQ ID NO: 139443 - DNA, 25 bp, Mus musculus
agaacatccctgctctgtgaaggtt

SEQ ID NO: 139444 - DNA, 25 bp, Mus musculus
agaacatccctggtctgtgaaggtt

SEQ ID NO: 139445 - DNA, 25 bp, Mus musculus
agaacatccgcaccgtgaatctggg

SEQ ID NO: 139446 - DNA, 25 bp, Mus musculus
agaacatccgcagcgtgaatctggg

SEQ ID NO: 139447 - DNA, 25 bp, Mus musculus
agaacatcctctcctctgtaatgaa

SEQ ID NO: 139448 - DNA, 25 bp, Mus musculus
agaacatcctctgctctgtaatgaa

SEQ ID NO: 139449 - DNA, 25 bp, Mus musculus
agaacatcctggagcaaacgctgtc

SEQ ID NO: 139450 - DNA, 25 bp, Mus musculus
agaacatcctggtgcaaacgctgtc

SEQ ID NO: 139451 - DNA, 25 bp, Mus musculus
agaacatcctttcggatcctgtgga

SEQ ID NO: 139452 - DNA, 25 bp, Mus musculus
agaacatcctttgggatcctgtgga

SEQ ID NO: 139453 - DNA, 25 bp, Mus musculus
agaacatcgacacctactgaatagc

SEQ ID NO: 139454 - DNA, 25 bp, Mus musculus
agaacatcgacagctactgaatagc

SEQ ID NO: 139455 - DNA, 25 bp, Mus musculus
agaacatcgccgcatccacacgggt

SEQ ID NO: 139456 - DNA, 25 bp, Mus musculus
agaacatcgccggatccacacgggt

SEQ ID NO: 139457 - DNA, 25 bp, Mus musculus
agaacatctaatatgacccacctca

SEQ ID NO: 139458 - DNA, 25 bp, Mus musculus
agaacatctaatttgacccacctca

SEQ ID NO: 139459 - DNA, 25 bp, Mus musculus
agaacatctataactttgggctgta

SEQ ID NO: 139460 - DNA, 25 bp, Mus musculus
agaacatctatatctttgggctgta

SEQ ID NO: 139461 - DNA, 25 bp, Mus musculus
agaacatctgaacgtgcctgcattt

SEQ ID NO: 139462 - DNA, 25 bp, Mus musculus
agaacatctgaaggtgcctgcattt

SEQ ID NO: 139463 - DNA, 25 bp, Mus musculus
agaacatctgcacatggaagcctgc

SEQ ID NO: 139464 - DNA, 25 bp, Mus musculus
agaacatctgcagatggaagcctgc

SEQ ID NO: 139465 - DNA, 25 bp, Mus musculus
agaacatctgcgctctcagtgactc

SEQ ID NO: 139466 - DNA, 25 bp, Mus musculus
agaacatctgcggtctcagtgactc

SEQ ID NO: 139467 - DNA, 25 bp, Mus musculus
agaacatctgtcagtggcaatgaga

SEQ ID NO: 139468 - DNA, 25 bp, Mus musculus
agaacatctgtctgtggcaatgaga

SEQ ID NO: 139469 - DNA, 25 bp, Mus musculus
agaacatcttcgaggacgttagggt

SEQ ID NO: 139470 - DNA, 25 bp, Mus musculus
agaacatcttcgtggacgttagggt

SEQ ID NO: 139471 - DNA, 25 bp, Mus musculus
agaacatctttcctactttttgatt

SEQ ID NO: 139472 - DNA, 25 bp, Mus musculus
agaacatctttcgtactttttgatt

SEQ ID NO: 139473 - DNA, 25 bp, Mus musculus
agaacatgaactagttagagcgaga

SEQ ID NO: 139474 - DNA, 25 bp, Mus musculus
agaacatgaacttgttagagcgaga

SEQ ID NO: 139475 - DNA, 25 bp, Mus musculus
agaacatgagttccccggatgcctg

SEQ ID NO: 139476 - DNA, 25 bp, Mus musculus
agaacatgagttgcccggatgcctg

SEQ ID NO: 139477 - DNA, 25 bp, Mus musculus
agaacatgcatgaccccttagcgtg

SEQ ID NO: 139478 - DNA, 25 bp, Mus musculus
agaacatgcatgtccccttagcgtg

SEQ ID NO: 139479 - DNA, 25 bp, Mus musculus
agaacatgcattaccatcctaaata

SEQ ID NO: 139480 - DNA, 25 bp, Mus musculus
agaacatgcatttccatcctaaata

SEQ ID NO: 139481 - DNA, 25 bp, Mus musculus
agaacatgcctcacgcaaaggatct

SEQ ID NO: 139482 - DNA, 25 bp, Mus musculus
agaacatgcctctcgcaaaggatct

SEQ ID NO: 139483 - DNA, 25 bp, Mus musculus
agaacatgctttaggagtggtgccg

SEQ ID NO: 139484 - DNA, 25 bp, Mus musculus
agaacatgcttttggagtggtgccg

SEQ ID NO: 139485 - DNA, 25 bp, Mus musculus
agaacatggaaaccagcattgactg

SEQ ID NO: 139486 - DNA, 25 bp, Mus musculus
agaacatggaaagcagcattgactg

SEQ ID NO: 139487 - DNA, 25 bp, Mus musculus
agaacatggagaccgtcccactgga

SEQ ID NO: 139488 - DNA, 25 bp, Mus musculus
agaacatggagactgccgcccgatg

SEQ ID NO: 139489 - DNA, 25 bp, Mus musculus
agaacatggagagcgtcccactgga

SEQ ID NO: 139490 - DNA, 25 bp, Mus musculus
agaacatggagagtgccgcccgatg

SEQ ID NO: 139491 - DNA, 25 bp, Mus musculus
agaacatggagtcgcctctcaggct

SEQ ID NO: 139492 - DNA, 25 bp, Mus musculus
agaacatggagtggcctctcaggct

SEQ ID NO: 139493 - DNA, 25 bp, Mus musculus
agaacatggattatgtccgtctcca

SEQ ID NO: 139494 - DNA, 25 bp, Mus musculus
agaacatggattttgtccgtctcca

SEQ ID NO: 139495 - DNA, 25 bp, Mus musculus
agaacatggcccaacgatccaaggc

SEQ ID NO: 139496 - DNA, 25 bp, Mus musculus
agaacatggccctacgatccaaggc

SEQ ID NO: 139497 - DNA, 25 bp, Mus musculus
agaacatggcttaaaacctctcctc

SEQ ID NO: 139498 - DNA, 25 bp, Mus musculus
agaacatggctttaaacctctcctc

SEQ ID NO: 139499 - DNA, 25 bp, Mus musculus
agaacatgggccaggttcgagcctc

SEQ ID NO: 139500 - DNA, 25 bp, Mus musculus
agaacatgggcctggttcgagcctc

SEQ ID NO: 139501 - DNA, 25 bp, Mus musculus
agaacatggtgacctttgccaacct

SEQ ID NO: 139502 - DNA, 25 bp, Mus musculus
agaacatggtgagctttgccaacct

SEQ ID NO: 139503 - DNA, 25 bp, Mus musculus
agaacatgtaggactggtcttccag

SEQ ID NO: 139504 - DNA, 25 bp, Mus musculus
agaacatgtaggtctggtcttccag

SEQ ID NO: 139505 - DNA, 25 bp, Mus musculus
agaacatgtcccatcaaccttagac

SEQ ID NO: 139506 - DNA, 25 bp, Mus musculus
agaacatgtcccttcaaccttagac

SEQ ID NO: 139507 - DNA, 25 bp, Mus musculus
agaacatgtgtcctacagctcctgt

SEQ ID NO: 139508 - DNA, 25 bp, Mus musculus
agaacatgtgtcgtacagctcctgt

SEQ ID NO: 139509 - DNA, 25 bp, Mus musculus
agaacattacagcaagagactgaat

SEQ ID NO: 139510 - DNA, 25 bp, Mus musculus
agaacattacaggaagagactgaat

SEQ ID NO: 139511 - DNA, 25 bp, Mus musculus
agaacattagaaccctgtaatcagt

SEQ ID NO: 139512 - DNA, 25 bp, Mus musculus
agaacattagaagcctgtaatcagt

SEQ ID NO: 139513 - DNA, 25 bp, Mus musculus
agaacattagatccccaaagtcacc

SEQ ID NO: 139514 - DNA, 25 bp, Mus musculus
agaacattagatccctccgagagac

SEQ ID NO: 139515 - DNA, 25 bp, Mus musculus
agaacattagatgcccaaagtcacc

SEQ ID NO: 139516 - DNA, 25 bp, Mus musculus
agaacattagatgcctccgagagac

SEQ ID NO: 139517 - DNA, 25 bp, Mus musculus
agaacattccttctagtcactgcgg

SEQ ID NO: 139518 - DNA, 25 bp, Mus musculus
agaacattccttgtagtcactgcgg

SEQ ID NO: 139519 - DNA, 25 bp, Mus musculus
agaacattcgacaggcactgatttg

SEQ ID NO: 139520 - DNA, 25 bp, Mus musculus
agaacattcgactggcactgatttg

SEQ ID NO: 139521 - DNA, 25 bp, Mus musculus
agaacattcgctcgcaaggttactc

SEQ ID NO: 139522 - DNA, 25 bp, Mus musculus
agaacattcgctggcaaggttactc

SEQ ID NO: 139523 - DNA, 25 bp, Mus musculus
agaacattctagaaggccagctctt

SEQ ID NO: 139524 - DNA, 25 bp, Mus musculus
agaacattctagtaggccagctctt

SEQ ID NO: 139525 - DNA, 25 bp, Mus musculus
agaacattctccctcttaaggaaat

SEQ ID NO: 139526 - DNA, 25 bp, Mus musculus
agaacattctccgtcttaaggaaat

SEQ ID NO: 139527 - DNA, 25 bp, Mus musculus
agaacattctgcagtccccaaggaa

SEQ ID NO: 139528 - DNA, 25 bp, Mus musculus
agaacattctgctgtccccaaggaa

SEQ ID NO: 139529 - DNA, 25 bp, Mus musculus
agaacattcttcaacccaggcaaga

SEQ ID NO: 139530 - DNA, 25 bp, Mus musculus
agaacattcttctacccaggcaaga

SEQ ID NO: 139531 - DNA, 25 bp, Mus musculus
agaacattctttccctcggaagtgt

SEQ ID NO: 139532 - DNA, 25 bp, Mus musculus
agaacattctttgcctcggaagtgt

SEQ ID NO: 139533 - DNA, 25 bp, Mus musculus
agaacattgagtagacattgtccgg

SEQ ID NO: 139534 - DNA, 25 bp, Mus musculus
agaacattgagttgacattgtccgg

SEQ ID NO: 139535 - DNA, 25 bp, Mus musculus
agaacattgcttcgcctgtttgagg

SEQ ID NO: 139536 - DNA, 25 bp, Mus musculus
agaacattgcttggcctgtttgagg

SEQ ID NO: 139537 - DNA, 25 bp, Mus musculus
agaacattggcaaggtagctgaagc

SEQ ID NO: 139538 - DNA, 25 bp, Mus musculus
agaacattggcatggtagctgaagc

SEQ ID NO: 139539 - DNA, 25 bp, Mus musculus
agaacattggcccatgtcactgctg

SEQ ID NO: 139540 - DNA, 25 bp, Mus musculus
agaacattggccgatgtcactgctg

SEQ ID NO: 139541 - DNA, 25 bp, Mus musculus
agaacattggcgacctgatccagga

SEQ ID NO: 139542 - DNA, 25 bp, Mus musculus
agaacattggcgtcctgatccagga

SEQ ID NO: 139543 - DNA, 25 bp, Mus musculus
agaacattgggcagcaggactcact

SEQ ID NO: 139544 - DNA, 25 bp, Mus musculus
agaacattgggctgcaggactcact

SEQ ID NO: 139545 - DNA, 25 bp, Mus musculus
agaacattgggtatgcgtgtgccta

SEQ ID NO: 139546 - DNA, 25 bp, Mus musculus
agaacattgggtttgcgtgtgccta

SEQ ID NO: 139547 - DNA, 25 bp, Mus musculus
agaacatttcccatgactatagaag

SEQ ID NO: 139548 - DNA, 25 bp, Mus musculus
agaacatttcccttgactatagaag

SEQ ID NO: 139549 - DNA, 25 bp, Mus musculus
agaacatttcttcgcaaactgggaa

SEQ ID NO: 139550 - DNA, 25 bp, Mus musculus
agaacatttcttggcaaactgggaa

SEQ ID NO: 139551 - DNA, 25 bp, Mus musculus
agaacatttgcacctcgtccattta

SEQ ID NO: 139552 - DNA, 25 bp, Mus musculus
agaacatttgcagctcgtccattta

SEQ ID NO: 139553 - DNA, 25 bp, Mus musculus
agaacatttggaaccccacctatgg

SEQ ID NO: 139554 - DNA, 25 bp, Mus musculus
agaacatttggatccccacctatgg

SEQ ID NO: 139555 - DNA, 25 bp, Mus musculus
agaacattttcgaactcctcttctg

SEQ ID NO: 139556 - DNA, 25 bp, Mus musculus
agaacattttcgtactcctcttctg

SEQ ID NO: 139557 - DNA, 25 bp, Mus musculus
agaacattttctagcttacagtgaa

SEQ ID NO: 139558 - DNA, 25 bp, Mus musculus
agaacattttcttgcttacagtgaa

SEQ ID NO: 139559 - DNA, 25 bp, Mus musculus
agaacattttgcctacttagcccag

SEQ ID NO: 139560 - DNA, 25 bp, Mus musculus
agaacattttgcgtacttagcccag

SEQ ID NO: 139561 - DNA, 25 bp, Mus musculus
agaacatttttgctaggactgggaa

SEQ ID NO: 139562 - DNA, 25 bp, Mus musculus
agaacatttttggtaggactgggaa

SEQ ID NO: 139563 - DNA, 25 bp, Mus musculus
agaaccaaacctagatgctgaacag

SEQ ID NO: 139564 - DNA, 25 bp, Mus musculus
agaaccaaaccttgatgctgaacag

SEQ ID NO: 139565 - DNA, 25 bp, Mus musculus
agaaccaaactgattcgctgttgtt

SEQ ID NO: 139566 - DNA, 25 bp, Mus musculus
agaaccaaactgtttcgctgttgtt

SEQ ID NO: 139567 - DNA, 25 bp, Mus musculus
agaaccaaaggcctgtactagcaaa

SEQ ID NO: 139568 - DNA, 25 bp, Mus musculus
agaaccaaaggcgtgtactagcaaa

SEQ ID NO: 139569 - DNA, 25 bp, Mus musculus
agaaccaaatccactgttggccaag

SEQ ID NO: 139570 - DNA, 25 bp, Mus musculus
agaaccaaatcctctgttggccaag

SEQ ID NO: 139571 - DNA, 25 bp, Mus musculus
agaaccaacaggactctatctggaa

SEQ ID NO: 139572 - DNA, 25 bp, Mus musculus
agaaccaacaggtctctatctggaa

SEQ ID NO: 139573 - DNA, 25 bp, Mus musculus
agaaccaaccgtctcatcagcacag

SEQ ID NO: 139574 - DNA, 25 bp, Mus musculus
agaaccaaccgtgtcatcagcacag

SEQ ID NO: 139575 - DNA, 25 bp, Mus musculus
agaaccaacttcattaagagacttg

SEQ ID NO: 139576 - DNA, 25 bp, Mus musculus
agaaccaacttctttaagagacttg

SEQ ID NO: 139577 - DNA, 25 bp, Mus musculus
agaaccaagaaaacgacccttccag

SEQ ID NO: 139578 - DNA, 25 bp, Mus musculus
agaaccaagaaatcgacccttccag

SEQ ID NO: 139579 - DNA, 25 bp, Mus musculus
agaaccaagcccagtggagccttcg

SEQ ID NO: 139580 - DNA, 25 bp, Mus musculus
agaaccaagccctgtggagccttcg

SEQ ID NO: 139581 - DNA, 25 bp, Mus musculus
agaaccaagcctcacaccatcacac

SEQ ID NO: 139582 - DNA, 25 bp, Mus musculus
agaaccaagcctgacaccatcacac

SEQ ID NO: 139583 - DNA, 25 bp, Mus musculus
agaaccaaggacctttgcgtacaga

SEQ ID NO: 139584 - DNA, 25 bp, Mus musculus
agaaccaaggacgtttgcgtacaga

SEQ ID NO: 139585 - DNA, 25 bp, Mus musculus
agaaccaaggcaaccagcgagccga

SEQ ID NO: 139586 - DNA, 25 bp, Mus musculus
agaaccaaggcatccagcgagccga

SEQ ID NO: 139587 - DNA, 25 bp, Mus musculus
agaaccaaggctcccagtgaacttt

SEQ ID NO: 139588 - DNA, 25 bp, Mus musculus
agaaccaaggctgccagtgaacttt

SEQ ID NO: 139589 - DNA, 25 bp, Mus musculus
agaaccaaggtacatgccatccaca

SEQ ID NO: 139590 - DNA, 25 bp, Mus musculus
agaaccaaggtagatgccatccaca

SEQ ID NO: 139591 - DNA, 25 bp, Mus musculus
agaaccaaggtcaaggtctcagccc

SEQ ID NO: 139592 - DNA, 25 bp, Mus musculus
agaaccaaggtctaggtctcagccc

SEQ ID NO: 139593 - DNA, 25 bp, Mus musculus
agaaccaaggttctgtgctgaccac

SEQ ID NO: 139594 - DNA, 25 bp, Mus musculus
agaaccaaggttgtgtgctgaccac

SEQ ID NO: 139595 - DNA, 25 bp, Mus musculus
agaaccaagtccagcaagttgtgcc

SEQ ID NO: 139596 - DNA, 25 bp, Mus musculus
agaaccaagtcctgcaagttgtgcc

SEQ ID NO: 139597 - DNA, 25 bp, Mus musculus
agaaccaagtctagctagcctctgg

SEQ ID NO: 139598 - DNA, 25 bp, Mus musculus
agaaccaagtcttgctagcctctgg

SEQ ID NO: 139599 - DNA, 25 bp, Mus musculus
agaaccaatacaactcacctgcagc

SEQ ID NO: 139600 - DNA, 25 bp, Mus musculus
agaaccaatacatctcacctgcagc

SEQ ID NO: 139601 - DNA, 25 bp, Mus musculus
agaaccacaataatctcccaggctg

SEQ ID NO: 139602 - DNA, 25 bp, Mus musculus
agaaccacaatattctcccaggctg

SEQ ID NO: 139603 - DNA, 25 bp, Mus musculus
agaaccacacataccttcttatgtg

SEQ ID NO: 139604 - DNA, 25 bp, Mus musculus
agaaccacacattccttcttatgtg

SEQ ID NO: 139605 - DNA, 25 bp, Mus musculus
agaaccacacccattcctgaataag

SEQ ID NO: 139606 - DNA, 25 bp, Mus musculus
agaaccacaccctttcctgaataag

SEQ ID NO: 139607 - DNA, 25 bp, Mus musculus
agaaccacacggctcgcttcatctg

SEQ ID NO: 139608 - DNA, 25 bp, Mus musculus
agaaccacacgggtcgcttcatctg

SEQ ID NO: 139609 - DNA, 25 bp, Mus musculus
agaaccacactcctgcgtatatcca

SEQ ID NO: 139610 - DNA, 25 bp, Mus musculus
agaaccacactcgtgcgtatatcca

SEQ ID NO: 139611 - DNA, 25 bp, Mus musculus
agaaccacactgctctcatggtcaa

SEQ ID NO: 139612 - DNA, 25 bp, Mus musculus
agaaccacactggtctcatggtcaa

SEQ ID NO: 139613 - DNA, 25 bp, Mus musculus
agaaccacagcaactatcacaaatg

SEQ ID NO: 139614 - DNA, 25 bp, Mus musculus
agaaccacagcatctatcacaaatg

SEQ ID NO: 139615 - DNA, 25 bp, Mus musculus
agaaccacaggaaggcaggcctaca

SEQ ID NO: 139616 - DNA, 25 bp, Mus musculus
agaaccacaggatggcaggcctaca

SEQ ID NO: 139617 - DNA, 25 bp, Mus musculus
agaaccacatacaactgactaccgt

SEQ ID NO: 139618 - DNA, 25 bp, Mus musculus
agaaccacatactactgactaccgt

SEQ ID NO: 139619 - DNA, 25 bp, Mus musculus
agaaccacatcgactccctgagagg

SEQ ID NO: 139620 - DNA, 25 bp, Mus musculus
agaaccacatcgtctccctgagagg

SEQ ID NO: 139621 - DNA, 25 bp, Mus musculus
agaaccaccaagatctctctgacct

SEQ ID NO: 139622 - DNA, 25 bp, Mus musculus
agaaccaccaagttctctctgacct

SEQ ID NO: 139623 - DNA, 25 bp, Mus musculus
agaaccacccagagtatctctatct

SEQ ID NO: 139624 - DNA, 25 bp, Mus musculus
agaaccacccagtgtatctctatct

SEQ ID NO: 139625 - DNA, 25 bp, Mus musculus
agaaccacccggaacacatgtgaat

SEQ ID NO: 139626 - DNA, 25 bp, Mus musculus
agaaccacccggtacacatgtgaat

SEQ ID NO: 139627 - DNA, 25 bp, Mus musculus
agaaccaccgatcgaaatgaaaaga

SEQ ID NO: 139628 - DNA, 25 bp, Mus musculus
agaaccaccgatggaaatgaaaaga

SEQ ID NO: 139629 - DNA, 25 bp, Mus musculus
agaaccacctccatgcttagagaat

SEQ ID NO: 139630 - DNA, 25 bp, Mus musculus
agaaccacctccttgcttagagaat

SEQ ID NO: 139631 - DNA, 25 bp, Mus musculus
agaaccacggacaagtacctcggtg

SEQ ID NO: 139632 - DNA, 25 bp, Mus musculus
agaaccacggacatggtgtgtgtgt

SEQ ID NO: 139633 - DNA, 25 bp, Mus musculus
agaaccacggactagtacctcggtg

SEQ ID NO: 139634 - DNA, 25 bp, Mus musculus
agaaccacggacttggtgtgtgtgt

SEQ ID NO: 139635 - DNA, 25 bp, Mus musculus
agaaccactaacacgtgactgctgg

SEQ ID NO: 139636 - DNA, 25 bp, Mus musculus
agaaccactaactcgtgactgctgg

SEQ ID NO: 139637 - DNA, 25 bp, Mus musculus
agaaccactgcaataggtaggaagt

SEQ ID NO: 139638 - DNA, 25 bp, Mus musculus
agaaccactgcacccggcttagagt

SEQ ID NO: 139639 - DNA, 25 bp, Mus musculus
agaaccactgcagccggcttagagt

SEQ ID NO: 139640 - DNA, 25 bp, Mus musculus
agaaccactgcattaggtaggaagt

SEQ ID NO: 139641 - DNA, 25 bp, Mus musculus
agaaccacttataagccgtagagaa

SEQ ID NO: 139642 - DNA, 25 bp, Mus musculus
agaaccacttattagccgtagagaa

SEQ ID NO: 139643 - DNA, 25 bp, Mus musculus
agaaccacttcaaaggctccgatgt

SEQ ID NO: 139644 - DNA, 25 bp, Mus musculus
agaaccacttcataggctccgatgt

SEQ ID NO: 139645 - DNA, 25 bp, Mus musculus
agaaccacttgcagaactgcttggc

SEQ ID NO: 139646 - DNA, 25 bp, Mus musculus
agaaccacttgctgaactgcttggc

SEQ ID NO: 139647 - DNA, 25 bp, Mus musculus
agaaccagaaccatccacgggaaga

SEQ ID NO: 139648 - DNA, 25 bp, Mus musculus
agaaccagaaccttccacgggaaga

SEQ ID NO: 139649 - DNA, 25 bp, Mus musculus
agaaccagacaacaggatgccttag

SEQ ID NO: 139650 - DNA, 25 bp, Mus musculus
agaaccagacaagaggatgccttag

SEQ ID NO: 139651 - DNA, 25 bp, Mus musculus
agaaccagagaaccccaccagtgct

SEQ ID NO: 139652 - DNA, 25 bp, Mus musculus
agaaccagagaagcccaccagtgct

SEQ ID NO: 139653 - DNA, 25 bp, Mus musculus
agaaccagcatgcatccattcttgg

SEQ ID NO: 139654 - DNA, 25 bp, Mus musculus
agaaccagcatggatccattcttgg

SEQ ID NO: 139655 - DNA, 25 bp, Mus musculus
agaaccagccctctgagttcaggag

SEQ ID NO: 139656 - DNA, 25 bp, Mus musculus
agaaccagccctgtgagttcaggag

SEQ ID NO: 139657 - DNA, 25 bp, Mus musculus
agaaccagcgtgatggtaccccagt

SEQ ID NO: 139658 - DNA, 25 bp, Mus musculus
agaaccagcgtgttggtaccccagt

SEQ ID NO: 139659 - DNA, 25 bp, Mus musculus
agaaccagcttcaggcaccaaccag

SEQ ID NO: 139660 - DNA, 25 bp, Mus musculus
agaaccagcttctggcaccaaccag

SEQ ID NO: 139661 - DNA, 25 bp, Mus musculus
agaaccagcttgaatattctccctg

SEQ ID NO: 139662 - DNA, 25 bp, Mus musculus
agaaccagcttgtatattctccctg

SEQ ID NO: 139663 - DNA, 25 bp, Mus musculus
agaaccagctttacttccatgttgc

SEQ ID NO: 139664 - DNA, 25 bp, Mus musculus
agaaccagcttttcttccatgttgc

SEQ ID NO: 139665 - DNA, 25 bp, Mus musculus
agaaccaggcaactgattccaggga

SEQ ID NO: 139666 - DNA, 25 bp, Mus musculus
agaaccaggcaagtgattccaggga

SEQ ID NO: 139667 - DNA, 25 bp, Mus musculus
agaaccagggcaactgcctgaacta

SEQ ID NO: 139668 - DNA, 25 bp, Mus musculus
agaaccagggcatctgcctgaacta

SEQ ID NO: 139669 - DNA, 25 bp, Mus musculus
agaaccagggtcatcagtgggtgcc

SEQ ID NO: 139670 - DNA, 25 bp, Mus musculus
agaaccagggtcttcagtgggtgcc

SEQ ID NO: 139671 - DNA, 25 bp, Mus musculus
agaaccaggtagagaggccctaggc

SEQ ID NO: 139672 - DNA, 25 bp, Mus musculus
agaaccaggtagtgaggccctaggc

SEQ ID NO: 139673 - DNA, 25 bp, Mus musculus
agaaccagtcaaagcctgcccaggt

SEQ ID NO: 139674 - DNA, 25 bp, Mus musculus
agaaccagtcaatgcctgcccaggt

SEQ ID NO: 139675 - DNA, 25 bp, Mus musculus
agaaccagtgacactgaccagcaga

SEQ ID NO: 139676 - DNA, 25 bp, Mus musculus
agaaccagtgactctgaccagcaga

SEQ ID NO: 139677 - DNA, 25 bp, Mus musculus
agaaccagtggccttgcacaagctg

SEQ ID NO: 139678 - DNA, 25 bp, Mus musculus
agaaccagtggcgttgcacaagctg

SEQ ID NO: 139679 - DNA, 25 bp, Mus musculus
agaaccagttcgagttcagacaccc

SEQ ID NO: 139680 - DNA, 25 bp, Mus musculus
agaaccagttcgtgttcagacaccc

SEQ ID NO: 139681 - DNA, 25 bp, Mus musculus
agaaccatattgatttccaaggaga

SEQ ID NO: 139682 - DNA, 25 bp, Mus musculus
agaaccatattgttttccaaggaga

SEQ ID NO: 139683 - DNA, 25 bp, Mus musculus
agaaccatcactatcacattcctga

SEQ ID NO: 139684 - DNA, 25 bp, Mus musculus
agaaccatcactttcacattcctga

SEQ ID NO: 139685 - DNA, 25 bp, Mus musculus
agaaccatcattcgctacaggcaga

SEQ ID NO: 139686 - DNA, 25 bp, Mus musculus
agaaccatcattggctacaggcaga

SEQ ID NO: 139687 - DNA, 25 bp, Mus musculus
agaaccatcctacctgtatcttgca

SEQ ID NO: 139688 - DNA, 25 bp, Mus musculus
agaaccatcctagctgtatcttgca

SEQ ID NO: 139689 - DNA, 25 bp, Mus musculus
agaaccatgagacggacagaagaaa

SEQ ID NO: 139690 - DNA, 25 bp, Mus musculus
agaaccatgagagggacagaagaaa

SEQ ID NO: 139691 - DNA, 25 bp, Mus musculus
agaaccatgcttctttgggcacatt

SEQ ID NO: 139692 - DNA, 25 bp, Mus musculus
agaaccatgcttgtttgggcacatt

SEQ ID NO: 139693 - DNA, 25 bp, Mus musculus
agaaccatggctctaacgtggcggt

SEQ ID NO: 139694 - DNA, 25 bp, Mus musculus
agaaccatggctgtaacgtggcggt

SEQ ID NO: 139695 - DNA, 25 bp, Mus musculus
agaaccatggtgcaccgttcactgg

SEQ ID NO: 139696 - DNA, 25 bp, Mus musculus
agaaccatggtggaccgttcactgg

SEQ ID NO: 139697 - DNA, 25 bp, Mus musculus
agaaccatggttaagtgagcagtca

SEQ ID NO: 139698 - DNA, 25 bp, Mus musculus
agaaccatggttacataatccaaag

SEQ ID NO: 139699 - DNA, 25 bp, Mus musculus
agaaccatggttctcactgttcgtt

SEQ ID NO: 139700 - DNA, 25 bp, Mus musculus
agaaccatggttgtcactgttcgtt

SEQ ID NO: 139701 - DNA, 25 bp, Mus musculus
agaaccatggtttagtgagcagtca

SEQ ID NO: 139702 - DNA, 25 bp, Mus musculus
agaaccatggtttcataatccaaag

SEQ ID NO: 139703 - DNA, 25 bp, Mus musculus
agaaccatgtctcggtcctgtcagt

SEQ ID NO: 139704 - DNA, 25 bp, Mus musculus
agaaccatgtctgggtcctgtcagt

SEQ ID NO: 139705 - DNA, 25 bp, Mus musculus
agaaccatgtgactgggacctcacc

SEQ ID NO: 139706 - DNA, 25 bp, Mus musculus
agaaccatgtgagtgggacctcacc

SEQ ID NO: 139707 - DNA, 25 bp, Mus musculus
agaaccatgttcagtttcactgctt

SEQ ID NO: 139708 - DNA, 25 bp, Mus musculus
agaaccatgttctgtttcactgctt

SEQ ID NO: 139709 - DNA, 25 bp, Mus musculus
agaaccattggaccaggcaggcctg

SEQ ID NO: 139710 - DNA, 25 bp, Mus musculus
agaaccattggagcaggcaggcctg

SEQ ID NO: 139711 - DNA, 25 bp, Mus musculus
agaaccattgttacgctttgtaaag

SEQ ID NO: 139712 - DNA, 25 bp, Mus musculus
agaaccattgtttcgctttgtaaag

SEQ ID NO: 139713 - DNA, 25 bp, Mus musculus
agaaccatttgaaatcgtcctccca

SEQ ID NO: 139714 - DNA, 25 bp, Mus musculus
agaaccatttgatatcgtcctccca

SEQ ID NO: 139715 - DNA, 25 bp, Mus musculus
agaacccaacaacaccaaatccttg

SEQ ID NO: 139716 - DNA, 25 bp, Mus musculus
agaacccaacaagaccaaatccttg

SEQ ID NO: 139717 - DNA, 25 bp, Mus musculus
agaacccaacatatgcacatgcaca

SEQ ID NO: 139718 - DNA, 25 bp, Mus musculus
agaacccaacatttgcacatgcaca

SEQ ID NO: 139719 - DNA, 25 bp, Mus musculus
agaacccaacctagctggcagaact

SEQ ID NO: 139720 - DNA, 25 bp, Mus musculus
agaacccaaccttgctggcagaact

SEQ ID NO: 139721 - DNA, 25 bp, Mus musculus
agaacccaagaaccaactcctagat

SEQ ID NO: 139722 - DNA, 25 bp, Mus musculus
agaacccaagaagcaactcctagat

SEQ ID NO: 139723 - DNA, 25 bp, Mus musculus
agaacccaagcgatcttcagccttt

SEQ ID NO: 139724 - DNA, 25 bp, Mus musculus
agaacccaagcgttcttcagccttt

SEQ ID NO: 139725 - DNA, 25 bp, Mus musculus
agaacccaagctagaggaaccctca

SEQ ID NO: 139726 - DNA, 25 bp, Mus musculus
agaacccaagctcccatctggtgga

SEQ ID NO: 139727 - DNA, 25 bp, Mus musculus
agaacccaagctgccatctggtgga

SEQ ID NO: 139728 - DNA, 25 bp, Mus musculus
agaacccaagcttgaggaaccctca

SEQ ID NO: 139729 - DNA, 25 bp, Mus musculus
agaacccaaggtcccagatagacag

SEQ ID NO: 139730 - DNA, 25 bp, Mus musculus
agaacccaaggtgccagatagacag

SEQ ID NO: 139731 - DNA, 25 bp, Mus musculus
agaacccaagtcaccggctgtgcgg

SEQ ID NO: 139732 - DNA, 25 bp, Mus musculus
agaacccaagtctccggctgtgcgg

SEQ ID NO: 139733 - DNA, 25 bp, Mus musculus
agaacccaatagatgcaggtcccct

SEQ ID NO: 139734 - DNA, 25 bp, Mus musculus
agaacccaatagttgcaggtcccct

SEQ ID NO: 139735 - DNA, 25 bp, Mus musculus
agaacccaattcctgagtcaattcc

SEQ ID NO: 139736 - DNA, 25 bp, Mus musculus
agaacccaattcgtgagtcaattcc

SEQ ID NO: 139737 - DNA, 25 bp, Mus musculus
agaacccacatcagagaccagcatg

SEQ ID NO: 139738 - DNA, 25 bp, Mus musculus
agaacccacatctgagaccagcatg

SEQ ID NO: 139739 - DNA, 25 bp, Mus musculus
agaacccacatgatcagagggcaaa

SEQ ID NO: 139740 - DNA, 25 bp, Mus musculus
agaacccacatgttcagagggcaaa

SEQ ID NO: 139741 - DNA, 25 bp, Mus musculus
agaacccacctaaagctggagagga

SEQ ID NO: 139742 - DNA, 25 bp, Mus musculus
agaacccacctatagctggagagga

SEQ ID NO: 139743 - DNA, 25 bp, Mus musculus
agaacccactagcttcccaaatgat

SEQ ID NO: 139744 - DNA, 25 bp, Mus musculus
agaacccactaggttcccaaatgat

SEQ ID NO: 139745 - DNA, 25 bp, Mus musculus
agaacccagaggctcctatcttggg

SEQ ID NO: 139746 - DNA, 25 bp, Mus musculus
agaacccagagggtcctatcttggg

SEQ ID NO: 139747 - DNA, 25 bp, Mus musculus
agaacccaggacaacgaagtgcaaa

SEQ ID NO: 139748 - DNA, 25 bp, Mus musculus
agaacccaggactacgaagtgcaaa

SEQ ID NO: 139749 - DNA, 25 bp, Mus musculus
agaacccaggtccaccagctcaggc

SEQ ID NO: 139750 - DNA, 25 bp, Mus musculus
agaacccaggtcgaccagctcaggc

SEQ ID NO: 139751 - DNA, 25 bp, Mus musculus
agaacccagtagctactggcatctt

SEQ ID NO: 139752 - DNA, 25 bp, Mus musculus
agaacccagtaggtactggcatctt

SEQ ID NO: 139753 - DNA, 25 bp, Mus musculus
agaacccatcctcccaacatttatg

SEQ ID NO: 139754 - DNA, 25 bp, Mus musculus
agaacccatcctgccaacatttatg

SEQ ID NO: 139755 - DNA, 25 bp, Mus musculus
agaacccatgtaacaactcacaacc

SEQ ID NO: 139756 - DNA, 25 bp, Mus musculus
agaacccatgtatcaactcacaacc

SEQ ID NO: 139757 - DNA, 25 bp, Mus musculus
agaacccattctagcttccctggag

SEQ ID NO: 139758 - DNA, 25 bp, Mus musculus
agaacccattcttgcttccctggag

SEQ ID NO: 139759 - DNA, 25 bp, Mus musculus
agaacccattgcaggtgcctgtcaa

SEQ ID NO: 139760 - DNA, 25 bp, Mus musculus
agaacccattgctggtgcctgtcaa

SEQ ID NO: 139761 - DNA, 25 bp, Mus musculus
agaaccccaagaagcccatccagga

SEQ ID NO: 139762 - DNA, 25 bp, Mus musculus
agaaccccaagatgcccatccagga

SEQ ID NO: 139763 - DNA, 25 bp, Mus musculus
agaaccccaggacattgactatgtt

SEQ ID NO: 139764 - DNA, 25 bp, Mus musculus
agaaccccaggagattgactatgtt

SEQ ID NO: 139765 - DNA, 25 bp, Mus musculus
agaaccccatggctaactacacaac

SEQ ID NO: 139766 - DNA, 25 bp, Mus musculus
agaaccccatgggtaactacacaac

SEQ ID NO: 139767 - DNA, 25 bp, Mus musculus
agaaccccgaagctgtgatcctgtc

SEQ ID NO: 139768 - DNA, 25 bp, Mus musculus
agaaccccgaaggtgtgatcctgtc

SEQ ID NO: 139769 - DNA, 25 bp, Mus musculus
agaaccccgacacattgtcagccat

SEQ ID NO: 139770 - DNA, 25 bp, Mus musculus
agaaccccgacagattgtcagccat

SEQ ID NO: 139771 - DNA, 25 bp, Mus musculus
agaaccccgactagcagttgtagac

SEQ ID NO: 139772 - DNA, 25 bp, Mus musculus
agaaccccgacttgcagttgtagac

SEQ ID NO: 139773 - DNA, 25 bp, Mus musculus
agaacccctgacaggtggctttggc

SEQ ID NO: 139774 - DNA, 25 bp, Mus musculus
agaacccctgactggtggctttggc

SEQ ID NO: 139775 - DNA, 25 bp, Mus musculus
agaacccctgctacaggcattctat

SEQ ID NO: 139776 - DNA, 25 bp, Mus musculus
agaacccctgcttcaggcattctat

SEQ ID NO: 139777 - DNA, 25 bp, Mus musculus
agaacccctgtcacaatgatggccg

SEQ ID NO: 139778 - DNA, 25 bp, Mus musculus
agaacccctgtctcaatgatggccg

SEQ ID NO: 139779 - DNA, 25 bp, Mus musculus
agaacccctttgagatggtggctgt

SEQ ID NO: 139780 - DNA, 25 bp, Mus musculus
agaacccctttgtgatggtggctgt

SEQ ID NO: 139781 - DNA, 25 bp, Mus musculus
agaacccgcttacacagctctgttt

SEQ ID NO: 139782 - DNA, 25 bp, Mus musculus
agaacccgcttagacagctctgttt

SEQ ID NO: 139783 - DNA, 25 bp, Mus musculus
agaacccgcttcagtgccacagagc

SEQ ID NO: 139784 - DNA, 25 bp, Mus musculus
agaacccgcttctgtgccacagagc

SEQ ID NO: 139785 - DNA, 25 bp, Mus musculus
agaacccggctgacctgctgatgaa

SEQ ID NO: 139786 - DNA, 25 bp, Mus musculus
agaacccggctgtcctgctgatgaa

SEQ ID NO: 139787 - DNA, 25 bp, Mus musculus
agaacccgttcaagatgagcccgat

SEQ ID NO: 139788 - DNA, 25 bp, Mus musculus
agaacccgttcatgatgagcccgat

SEQ ID NO: 139789 - DNA, 25 bp, Mus musculus
agaacccgttgcagctgaatgtaat

SEQ ID NO: 139790 - DNA, 25 bp, Mus musculus
agaacccgttgctgctgaatgtaat

SEQ ID NO: 139791 - DNA, 25 bp, Mus musculus
agaaccctataaccctgacctaatg

SEQ ID NO: 139792 - DNA, 25 bp, Mus musculus
agaaccctataagcctgacctaatg

SEQ ID NO: 139793 - DNA, 25 bp, Mus musculus
agaaccctatctctattcctgtagt

SEQ ID NO: 139794 - DNA, 25 bp, Mus musculus
agaaccctatctgtattcctgtagt

SEQ ID NO: 139795 - DNA, 25 bp, Mus musculus
agaaccctatgtatgacgtcagcat

SEQ ID NO: 139796 - DNA, 25 bp, Mus musculus
agaaccctatgtttgacgtcagcat

SEQ ID NO: 139797 - DNA, 25 bp, Mus musculus
agaaccctcacaaactgcacattgt

SEQ ID NO: 139798 - DNA, 25 bp, Mus musculus
agaaccctcacatactgcacattgt

SEQ ID NO: 139799 - DNA, 25 bp, Mus musculus
agaaccctccttcgtgagaggctca

SEQ ID NO: 139800 - DNA, 25 bp, Mus musculus
agaaccctccttggtgagaggctca

SEQ ID NO: 139801 - DNA, 25 bp, Mus musculus
agaaccctctatccactttggctgt

SEQ ID NO: 139802 - DNA, 25 bp, Mus musculus
agaaccctctatgcactttggctgt

SEQ ID NO: 139803 - DNA, 25 bp, Mus musculus
agaaccctctccagtgtacttaact

SEQ ID NO: 139804 - DNA, 25 bp, Mus musculus
agaaccctctcctgtgtacttaact

SEQ ID NO: 139805 - DNA, 25 bp, Mus musculus
agaaccctcttcactcaagacccag

SEQ ID NO: 139806 - DNA, 25 bp, Mus musculus
agaaccctcttctctcaagacccag

SEQ ID NO: 139807 - DNA, 25 bp, Mus musculus
agaaccctcttgctatcattccctg

SEQ ID NO: 139808 - DNA, 25 bp, Mus musculus
agaaccctcttggtatcattccctg

SEQ ID NO: 139809 - DNA, 25 bp, Mus musculus
agaaccctgatcctatgcactgtag

SEQ ID NO: 139810 - DNA, 25 bp, Mus musculus
agaaccctgatcgtatgcactgtag

SEQ ID NO: 139811 - DNA, 25 bp, Mus musculus
agaaccctgcccagtgggcgagaaa

SEQ ID NO: 139812 - DNA, 25 bp, Mus musculus
agaaccctgccctgtgggcgagaaa

SEQ ID NO: 139813 - DNA, 25 bp, Mus musculus
agaaccctggtaatgttgttgatgg

SEQ ID NO: 139814 - DNA, 25 bp, Mus musculus
agaaccctggtattgttgttgatgg

SEQ ID NO: 139815 - DNA, 25 bp, Mus musculus
agaaccctggttcactgcacaaagc

SEQ ID NO: 139816 - DNA, 25 bp, Mus musculus
agaaccctggttgactgcacaaagc

SEQ ID NO: 139817 - DNA, 25 bp, Mus musculus
agaaccctgtgcagcgcgtttgtct

SEQ ID NO: 139818 - DNA, 25 bp, Mus musculus
agaaccctgtgctgcgcgtttgtct

SEQ ID NO: 139819 - DNA, 25 bp, Mus musculus
agaacccttaggagcgctgtgcgtg

SEQ ID NO: 139820 - DNA, 25 bp, Mus musculus
agaacccttaggtgcgctgtgcgtg

SEQ ID NO: 139821 - DNA, 25 bp, Mus musculus
agaacccttcatcgacgccaagtat

SEQ ID NO: 139822 - DNA, 25 bp, Mus musculus
agaacccttcatggacgccaagtat

SEQ ID NO: 139823 - DNA, 25 bp, Mus musculus
agaacccttctacttcagccatatc

SEQ ID NO: 139824 - DNA, 25 bp, Mus musculus
agaacccttctagttcagccatatc

SEQ ID NO: 139825 - DNA, 25 bp, Mus musculus
agaaccgagcagaagatgggcacct

SEQ ID NO: 139826 - DNA, 25 bp, Mus musculus
agaaccgagcagtagatgggcacct

SEQ ID NO: 139827 - DNA, 25 bp, Mus musculus
agaaccgagctcctcacaagggcgt

SEQ ID NO: 139828 - DNA, 25 bp, Mus musculus
agaaccgagctcgtcacaagggcgt

SEQ ID NO: 139829 - DNA, 25 bp, Mus musculus
agaaccgagctgagggaacccaggt

SEQ ID NO: 139830 - DNA, 25 bp, Mus musculus
agaaccgagctgtgggaacccaggt

SEQ ID NO: 139831 - DNA, 25 bp, Mus musculus
agaaccgagtgacgagagcccagca

SEQ ID NO: 139832 - DNA, 25 bp, Mus musculus
agaaccgagtgaggagagcccagca

SEQ ID NO: 139833 - DNA, 25 bp, Mus musculus
agaaccgatggcacagcaggacagt

SEQ ID NO: 139834 - DNA, 25 bp, Mus musculus
agaaccgatggctcagcaggacagt

SEQ ID NO: 139835 - DNA, 25 bp, Mus musculus
agaaccgatttcctagttgaccagg

SEQ ID NO: 139836 - DNA, 25 bp, Mus musculus
agaaccgatttcgtagttgaccagg

SEQ ID NO: 139837 - DNA, 25 bp, Mus musculus
agaaccgcaggtaggagcaccagaa

SEQ ID NO: 139838 - DNA, 25 bp, Mus musculus
agaaccgcaggttggagcaccagaa

SEQ ID NO: 139839 - DNA, 25 bp, Mus musculus
agaaccgcagtgacgggttttgccg

SEQ ID NO: 139840 - DNA, 25 bp, Mus musculus
agaaccgcagtgtcgggttttgccg

SEQ ID NO: 139841 - DNA, 25 bp, Mus musculus
agaaccgccagacttgagtcctctc

SEQ ID NO: 139842 - DNA, 25 bp, Mus musculus
agaaccgccagagttgagtcctctc

SEQ ID NO: 139843 - DNA, 25 bp, Mus musculus
agaaccgcccatcagttgttcttgg

SEQ ID NO: 139844 - DNA, 25 bp, Mus musculus
agaaccgcccatgagttgttcttgg

SEQ ID NO: 139845 - DNA, 25 bp, Mus musculus
agaaccgccgttcactgaagcatca

SEQ ID NO: 139846 - DNA, 25 bp, Mus musculus
agaaccgccgttgactgaagcatca

SEQ ID NO: 139847 - DNA, 25 bp, Mus musculus
agaaccgcgacgaggtgcaggccat

SEQ ID NO: 139848 - DNA, 25 bp, Mus musculus
agaaccgcgacgtggtgcaggccat

SEQ ID NO: 139849 - DNA, 25 bp, Mus musculus
agaaccgcgtgtctgctatcatctt

SEQ ID NO: 139850 - DNA, 25 bp, Mus musculus
agaaccgcgtgtgtgctatcatctt

SEQ ID NO: 139851 - DNA, 25 bp, Mus musculus
agaaccgctcttaaggtggtgcttt

SEQ ID NO: 139852 - DNA, 25 bp, Mus musculus
agaaccgctctttaggtggtgcttt

SEQ ID NO: 139853 - DNA, 25 bp, Mus musculus
agaaccgctgatatggtccggccaa

SEQ ID NO: 139854 - DNA, 25 bp, Mus musculus
agaaccgctgatttggtccggccaa

SEQ ID NO: 139855 - DNA, 25 bp, Mus musculus
agaaccggaatgatagtgcacctag

SEQ ID NO: 139856 - DNA, 25 bp, Mus musculus
agaaccggaatgttagtgcacctag

SEQ ID NO: 139857 - DNA, 25 bp, Mus musculus
agaaccggacttaatatgacaacac

SEQ ID NO: 139858 - DNA, 25 bp, Mus musculus
agaaccggactttatatgacaacac

SEQ ID NO: 139859 - DNA, 25 bp, Mus musculus
agaaccgggtagaagcagatgccaa

SEQ ID NO: 139860 - DNA, 25 bp, Mus musculus
agaaccgggtagtagcagatgccaa

SEQ ID NO: 139861 - DNA, 25 bp, Mus musculus
agaaccggttacagggcaagcacaa

SEQ ID NO: 139862 - DNA, 25 bp, Mus musculus
agaaccggttactgggcaagcacaa

SEQ ID NO: 139863 - DNA, 25 bp, Mus musculus
agaaccggttggatgctgggacact

SEQ ID NO: 139864 - DNA, 25 bp, Mus musculus
agaaccggttggttgctgggacact

SEQ ID NO: 139865 - DNA, 25 bp, Mus musculus
agaaccgtagatctctgtagagctt

SEQ ID NO: 139866 - DNA, 25 bp, Mus musculus
agaaccgtagatgtctgtagagctt

SEQ ID NO: 139867 - DNA, 25 bp, Mus musculus
agaaccgtagtcagctttggcggct

SEQ ID NO: 139868 - DNA, 25 bp, Mus musculus
agaaccgtagtctgctttggcggct

SEQ ID NO: 139869 - DNA, 25 bp, Mus musculus
agaaccgtatctccctataaaatct

SEQ ID NO: 139870 - DNA, 25 bp, Mus musculus
agaaccgtatctgcctataaaatct

SEQ ID NO: 139871 - DNA, 25 bp, Mus musculus
agaaccgtcactcgtagccagcagt

SEQ ID NO: 139872 - DNA, 25 bp, Mus musculus
agaaccgtcactggtagccagcagt

SEQ ID NO: 139873 - DNA, 25 bp, Mus musculus
agaaccgtgtgcagaagcaccctgt

SEQ ID NO: 139874 - DNA, 25 bp, Mus musculus
agaaccgtgtgctgaagcaccctgt

SEQ ID NO: 139875 - DNA, 25 bp, Mus musculus
agaacctaaaatcgctccacaggag

SEQ ID NO: 139876 - DNA, 25 bp, Mus musculus
agaacctaaaatggctccacaggag

SEQ ID NO: 139877 - DNA, 25 bp, Mus musculus
agaacctaaatgcactggaagcagt

SEQ ID NO: 139878 - DNA, 25 bp, Mus musculus
agaacctaaatggactggaagcagt

SEQ ID NO: 139879 - DNA, 25 bp, Mus musculus
agaacctaagacaccagctgctgtt

SEQ ID NO: 139880 - DNA, 25 bp, Mus musculus
agaacctaagactccagctgctgtt

SEQ ID NO: 139881 - DNA, 25 bp, Mus musculus
agaacctaagcaactcatctcggtg

SEQ ID NO: 139882 - DNA, 25 bp, Mus musculus
agaacctaagcatctcatctcggtg

SEQ ID NO: 139883 - DNA, 25 bp, Mus musculus
agaacctacactacagacgcattgg

SEQ ID NO: 139884 - DNA, 25 bp, Mus musculus
agaacctacacttcagacgcattgg

SEQ ID NO: 139885 - DNA, 25 bp, Mus musculus
agaacctacatgattggctctgagg

SEQ ID NO: 139886 - DNA, 25 bp, Mus musculus
agaacctacatgtttggctctgagg

SEQ ID NO: 139887 - DNA, 25 bp, Mus musculus
agaacctaccggaccaatgtggagc

SEQ ID NO: 139888 - DNA, 25 bp, Mus musculus
agaacctaccggtccaatgtggagc

SEQ ID NO: 139889 - DNA, 25 bp, Mus musculus
agaacctaccgtctatgttggtaca

SEQ ID NO: 139890 - DNA, 25 bp, Mus musculus
agaacctaccgtgtatgttggtaca

SEQ ID NO: 139891 - DNA, 25 bp, Mus musculus
agaacctactccctgagttgtcttc

SEQ ID NO: 139892 - DNA, 25 bp, Mus musculus
agaacctactccgtgagttgtcttc

SEQ ID NO: 139893 - DNA, 25 bp, Mus musculus
agaacctactcgcacacagactctt

SEQ ID NO: 139894 - DNA, 25 bp, Mus musculus
agaacctactcggacacagactctt

SEQ ID NO: 139895 - DNA, 25 bp, Mus musculus
agaacctagtgaccccagagctggc

SEQ ID NO: 139896 - DNA, 25 bp, Mus musculus
agaacctagtgagcccagagctggc

SEQ ID NO: 139897 - DNA, 25 bp, Mus musculus
agaacctatctgacatgctgctatg

SEQ ID NO: 139898 - DNA, 25 bp, Mus musculus
agaacctatctgatttagtggaaca

SEQ ID NO: 139899 - DNA, 25 bp, Mus musculus
agaacctatctgtcatgctgctatg

SEQ ID NO: 139900 - DNA, 25 bp, Mus musculus
agaacctatctgttttagtggaaca

SEQ ID NO: 139901 - DNA, 25 bp, Mus musculus
agaacctatgccatagaaccctgct

SEQ ID NO: 139902 - DNA, 25 bp, Mus musculus
agaacctatgccttagaaccctgct

SEQ ID NO: 139903 - DNA, 25 bp, Mus musculus
agaacctattctatgatgcaccctt

SEQ ID NO: 139904 - DNA, 25 bp, Mus musculus
agaacctattctttgatgcaccctt

SEQ ID NO: 139905 - DNA, 25 bp, Mus musculus
agaacctatttaaaaaagctcctat

SEQ ID NO: 139906 - DNA, 25 bp, Mus musculus
agaacctatttataaaagctcctat

SEQ ID NO: 139907 - DNA, 25 bp, Mus musculus
agaacctcacatcttactgttccga

SEQ ID NO: 139908 - DNA, 25 bp, Mus musculus
agaacctcacatgttactgttccga

SEQ ID NO: 139909 - DNA, 25 bp, Mus musculus
agaacctcacctaacgttcagtttg

SEQ ID NO: 139910 - DNA, 25 bp, Mus musculus
agaacctcacctactgccacaaata

SEQ ID NO: 139911 - DNA, 25 bp, Mus musculus
agaacctcaccttacgttcagtttg

SEQ ID NO: 139912 - DNA, 25 bp, Mus musculus
agaacctcaccttctgccacaaata

SEQ ID NO: 139913 - DNA, 25 bp, Mus musculus
agaacctcagagattcaccacacag

SEQ ID NO: 139914 - DNA, 25 bp, Mus musculus
agaacctcagagtttcaccacacag

SEQ ID NO: 139915 - DNA, 25 bp, Mus musculus
agaacctcatgacagtccctggtag

SEQ ID NO: 139916 - DNA, 25 bp, Mus musculus
agaacctcatgagagtccctggtag

SEQ ID NO: 139917 - DNA, 25 bp, Mus musculus
agaacctcatttcaccctgcagaag

SEQ ID NO: 139918 - DNA, 25 bp, Mus musculus
agaacctcatttgaccctgcagaag

SEQ ID NO: 139919 - DNA, 25 bp, Mus musculus
agaacctccaccatgtcatgaacag

SEQ ID NO: 139920 - DNA, 25 bp, Mus musculus
agaacctccaccttgtcatgaacag

SEQ ID NO: 139921 - DNA, 25 bp, Mus musculus
agaacctcccgactcaaatgttaga

SEQ ID NO: 139922 - DNA, 25 bp, Mus musculus
agaacctcccgagtcaaatgttaga

SEQ ID NO: 139923 - DNA, 25 bp, Mus musculus
agaacctccttcattctagccaaaa

SEQ ID NO: 139924 - DNA, 25 bp, Mus musculus
agaacctccttctttctagccaaaa

SEQ ID NO: 139925 - DNA, 25 bp, Mus musculus
agaacctccttgacactctttgcag

SEQ ID NO: 139926 - DNA, 25 bp, Mus musculus
agaacctccttgtcactctttgcag

SEQ ID NO: 139927 - DNA, 25 bp, Mus musculus
agaacctcgtggcactgctggagcc

SEQ ID NO: 139928 - DNA, 25 bp, Mus musculus
agaacctcgtgggactgctggagcc

SEQ ID NO: 139929 - DNA, 25 bp, Mus musculus
agaacctctaacacacttgcttagg

SEQ ID NO: 139930 - DNA, 25 bp, Mus musculus
agaacctctaactcacttgcttagg

SEQ ID NO: 139931 - DNA, 25 bp, Mus musculus
agaacctctaccaggctctgatcag

SEQ ID NO: 139932 - DNA, 25 bp, Mus musculus
agaacctctacctggctctgatcag

SEQ ID NO: 139933 - DNA, 25 bp, Mus musculus
agaacctctccgacttcagaagaga

SEQ ID NO: 139934 - DNA, 25 bp, Mus musculus
agaacctctccgtcttcagaagaga

SEQ ID NO: 139935 - DNA, 25 bp, Mus musculus
agaacctctctgaaaacctgactaa

SEQ ID NO: 139936 - DNA, 25 bp, Mus musculus
agaacctctctgtaaacctgactaa

SEQ ID NO: 139937 - DNA, 25 bp, Mus musculus
agaacctctgaaacacctggtgtct

SEQ ID NO: 139938 - DNA, 25 bp, Mus musculus
agaacctctgaatcacctggtgtct

SEQ ID NO: 139939 - DNA, 25 bp, Mus musculus
agaacctctggaccctggactgtca

SEQ ID NO: 139940 - DNA, 25 bp, Mus musculus
agaacctctggagcctggactgtca

SEQ ID NO: 139941 - DNA, 25 bp, Mus musculus
agaacctctggccaatatacttcct

SEQ ID NO: 139942 - DNA, 25 bp, Mus musculus
agaacctctggcgaatatacttcct

SEQ ID NO: 139943 - DNA, 25 bp, Mus musculus
agaacctctgggatgcgctgtacaa

SEQ ID NO: 139944 - DNA, 25 bp, Mus musculus
agaacctctgggttgcgctgtacaa

SEQ ID NO: 139945 - DNA, 25 bp, Mus musculus
agaacctcttcacagattcccagat

SEQ ID NO: 139946 - DNA, 25 bp, Mus musculus
agaacctcttcagagattcccagat

SEQ ID NO: 139947 - DNA, 25 bp, Mus musculus
agaacctcttggagtcgttggtgct

SEQ ID NO: 139948 - DNA, 25 bp, Mus musculus
agaacctcttggtgtcgttggtgct

SEQ ID NO: 139949 - DNA, 25 bp, Mus musculus
agaacctgactcaagtgggcagcat

SEQ ID NO: 139950 - DNA, 25 bp, Mus musculus
agaacctgactctagtgggcagcat

SEQ ID NO: 139951 - DNA, 25 bp, Mus musculus
agaacctgagacaatgtacctgcct

SEQ ID NO: 139952 - DNA, 25 bp, Mus musculus
agaacctgagactatgtacctgcct

SEQ ID NO: 139953 - DNA, 25 bp, Mus musculus
agaacctgagccagtcaccataaag

SEQ ID NO: 139954 - DNA, 25 bp, Mus musculus
agaacctgagcccagctaaggcagc

SEQ ID NO: 139955 - DNA, 25 bp, Mus musculus
agaacctgagccgagctaaggcagc

SEQ ID NO: 139956 - DNA, 25 bp, Mus musculus
agaacctgagcctgtcaccataaag

SEQ ID NO: 139957 - DNA, 25 bp, Mus musculus
agaacctgagggagccactgagagc

SEQ ID NO: 139958 - DNA, 25 bp, Mus musculus
agaacctgagggtgccactgagagc

SEQ ID NO: 139959 - DNA, 25 bp, Mus musculus
agaacctgagtacaccactacacgt

SEQ ID NO: 139960 - DNA, 25 bp, Mus musculus
agaacctgagtagaccactacacgt

SEQ ID NO: 139961 - DNA, 25 bp, Mus musculus
agaacctgatccagagctatgccga

SEQ ID NO: 139962 - DNA, 25 bp, Mus musculus
agaacctgatcctgagctatgccga

SEQ ID NO: 139963 - DNA, 25 bp, Mus musculus
agaacctgcaacaagactttgtggc

SEQ ID NO: 139964 - DNA, 25 bp, Mus musculus
agaacctgcaactagactttgtggc

SEQ ID NO: 139965 - DNA, 25 bp, Mus musculus
agaacctgcaggagttcgcttccct

SEQ ID NO: 139966 - DNA, 25 bp, Mus musculus
agaacctgcaggtgttcgcttccct

SEQ ID NO: 139967 - DNA, 25 bp, Mus musculus
agaacctgcagtccttatctgggta

SEQ ID NO: 139968 - DNA, 25 bp, Mus musculus
agaacctgcagtgcttatctgggta

SEQ ID NO: 139969 - DNA, 25 bp, Mus musculus
agaacctgcatcatttttagagctt

SEQ ID NO: 139970 - DNA, 25 bp, Mus musculus
agaacctgcatcttttttagagctt

SEQ ID NO: 139971 - DNA, 25 bp, Mus musculus
agaacctgccagcacttcaattctg

SEQ ID NO: 139972 - DNA, 25 bp, Mus musculus
agaacctgccaggacttcaattctg

SEQ ID NO: 139973 - DNA, 25 bp, Mus musculus
agaacctgcctcactcattataata

SEQ ID NO: 139974 - DNA, 25 bp, Mus musculus
agaacctgcctctctcattataata

SEQ ID NO: 139975 - DNA, 25 bp, Mus musculus
agaacctgcgccacaagggagctgg

SEQ ID NO: 139976 - DNA, 25 bp, Mus musculus
agaacctgcgcctcaagggagctgg

SEQ ID NO: 139977 - DNA, 25 bp, Mus musculus
agaacctgcgctattactggaagga

SEQ ID NO: 139978 - DNA, 25 bp, Mus musculus
agaacctgcgcttttactggaagga

SEQ ID NO: 139979 - DNA, 25 bp, Mus musculus
agaacctgcgttctttcacaaaaga

SEQ ID NO: 139980 - DNA, 25 bp, Mus musculus
agaacctgcgttgtttcacaaaaga

SEQ ID NO: 139981 - DNA, 25 bp, Mus musculus
agaacctgctcaagcgtatgctcaa

SEQ ID NO: 139982 - DNA, 25 bp, Mus musculus
agaacctgctcatgcgtatgctcaa

SEQ ID NO: 139983 - DNA, 25 bp, Mus musculus
agaacctgctccatggttagctttt

SEQ ID NO: 139984 - DNA, 25 bp, Mus musculus
agaacctgctccttggttagctttt

SEQ ID NO: 139985 - DNA, 25 bp, Mus musculus
agaacctgctgtccgctcctgggag

SEQ ID NO: 139986 - DNA, 25 bp, Mus musculus
agaacctgctgtgcgctcctgggag

SEQ ID NO: 139987 - DNA, 25 bp, Mus musculus
agaacctgcttcaactaggggaggc

SEQ ID NO: 139988 - DNA, 25 bp, Mus musculus
agaacctgcttcagttttacatcct

SEQ ID NO: 139989 - DNA, 25 bp, Mus musculus
agaacctgcttctactaggggaggc

SEQ ID NO: 139990 - DNA, 25 bp, Mus musculus
agaacctgcttctgttttacatcct

SEQ ID NO: 139991 - DNA, 25 bp, Mus musculus
agaacctggaaccttggctactcaa

SEQ ID NO: 139992 - DNA, 25 bp, Mus musculus
agaacctggaacgttggctactcaa

SEQ ID NO: 139993 - DNA, 25 bp, Mus musculus
agaacctggagtaggcacggaagct

SEQ ID NO: 139994 - DNA, 25 bp, Mus musculus
agaacctggagttggcacggaagct

SEQ ID NO: 139995 - DNA, 25 bp, Mus musculus
agaacctggatgacttaacgttatt

SEQ ID NO: 139996 - DNA, 25 bp, Mus musculus
agaacctggatgtcttaacgttatt

SEQ ID NO: 139997 - DNA, 25 bp, Mus musculus
agaacctggcacctgtgctttggtg

SEQ ID NO: 139998 - DNA, 25 bp, Mus musculus
agaacctggcacgtgtgctttggtg

SEQ ID NO: 139999 - DNA, 25 bp, Mus musculus
agaacctggcgcacggcatctaggt

SEQ ID NO: 140000 - DNA, 25 bp, Mus musculus
agaacctggcgctcggcatctaggt

SEQ ID NO: 140001 - DNA, 25 bp, Mus musculus
agaacctggctgcaagcaagtccct

SEQ ID NO: 140002 - DNA, 25 bp, Mus musculus
agaacctggctggaagcaagtccct

SEQ ID NO: 140003 - DNA, 25 bp, Mus musculus
agaacctgggacagaggcccctcga

SEQ ID NO: 140004 - DNA, 25 bp, Mus musculus
agaacctgggactgaggcccctcga

SEQ ID NO: 140005 - DNA, 25 bp, Mus musculus
agaacctgtactaggacgctttgtc

SEQ ID NO: 140006 - DNA, 25 bp, Mus musculus
agaacctgtacttggacgctttgtc

SEQ ID NO: 140007 - DNA, 25 bp, Mus musculus
agaacctgtcttacagtcctgatgg

SEQ ID NO: 140008 - DNA, 25 bp, Mus musculus
agaacctgtctttcagtcctgatgg

SEQ ID NO: 140009 - DNA, 25 bp, Mus musculus
agaacctgtgcactcatttgcccag

SEQ ID NO: 140010 - DNA, 25 bp, Mus musculus
agaacctgtgcagtcatttgcccag

SEQ ID NO: 140011 - DNA, 25 bp, Mus musculus
agaacctgttatctctggcctctgt

SEQ ID NO: 140012 - DNA, 25 bp, Mus musculus
agaacctgttatgtctggcctctgt

SEQ ID NO: 140013 - DNA, 25 bp, Mus musculus
agaaccttaactctggctccagcca

SEQ ID NO: 140014 - DNA, 25 bp, Mus musculus
agaaccttaactgtggctccagcca

SEQ ID NO: 140015 - DNA, 25 bp, Mus musculus
agaaccttaccaacgaggaccttgg

SEQ ID NO: 140016 - DNA, 25 bp, Mus musculus
agaaccttaccatcgaggaccttgg

SEQ ID NO: 140017 - DNA, 25 bp, Mus musculus
agaaccttacctacaggtgctgttg

SEQ ID NO: 140018 - DNA, 25 bp, Mus musculus
agaaccttacctcctgaacattgtt

SEQ ID NO: 140019 - DNA, 25 bp, Mus musculus
agaaccttacctgctgaacattgtt

SEQ ID NO: 140020 - DNA, 25 bp, Mus musculus
agaaccttaccttcaggtgctgttg

SEQ ID NO: 140021 - DNA, 25 bp, Mus musculus
agaaccttactgcagctgaagtggc

SEQ ID NO: 140022 - DNA, 25 bp, Mus musculus
agaaccttactggagctgaagtggc

SEQ ID NO: 140023 - DNA, 25 bp, Mus musculus
agaaccttagtaactgcccatagac

SEQ ID NO: 140024 - DNA, 25 bp, Mus musculus
agaaccttagtatctgcccatagac

SEQ ID NO: 140025 - DNA, 25 bp, Mus musculus
agaaccttcagcatcagccgggcaa

SEQ ID NO: 140026 - DNA, 25 bp, Mus musculus
agaaccttcagcttcagccgggcaa

SEQ ID NO: 140027 - DNA, 25 bp, Mus musculus
agaaccttcatcctcacatgactta

SEQ ID NO: 140028 - DNA, 25 bp, Mus musculus
agaaccttcatcgtcacatgactta

SEQ ID NO: 140029 - DNA, 25 bp, Mus musculus
agaaccttcctcagtccaacaaggt

SEQ ID NO: 140030 - DNA, 25 bp, Mus musculus
agaaccttcctctgtccaacaaggt

SEQ ID NO: 140031 - DNA, 25 bp, Mus musculus
agaaccttctagaacctgggctgtg

SEQ ID NO: 140032 - DNA, 25 bp, Mus musculus
agaaccttctagtacctgggctgtg

SEQ ID NO: 140033 - DNA, 25 bp, Mus musculus
agaaccttctcaactgtcgtagtaa

SEQ ID NO: 140034 - DNA, 25 bp, Mus musculus
agaaccttctcatctgtcgtagtaa

SEQ ID NO: 140035 - DNA, 25 bp, Mus musculus
agaaccttctgtccctctgcaagga

SEQ ID NO: 140036 - DNA, 25 bp, Mus musculus
agaaccttctgtgcctctgcaagga

SEQ ID NO: 140037 - DNA, 25 bp, Mus musculus
agaaccttgatccaccatttagcat

SEQ ID NO: 140038 - DNA, 25 bp, Mus musculus
agaaccttgatcgaccatttagcat

SEQ ID NO: 140039 - DNA, 25 bp, Mus musculus
agaaccttgcaaattcctacataga

SEQ ID NO: 140040 - DNA, 25 bp, Mus musculus
agaaccttgcaatttcctacataga

SEQ ID NO: 140041 - DNA, 25 bp, Mus musculus
agaaccttgcagaagtgctcccctg

SEQ ID NO: 140042 - DNA, 25 bp, Mus musculus
agaaccttgcagtagtgctcccctg

SEQ ID NO: 140043 - DNA, 25 bp, Mus musculus
agaaccttggctatctgctcataat

SEQ ID NO: 140044 - DNA, 25 bp, Mus musculus
agaaccttggctctattctgcagct

SEQ ID NO: 140045 - DNA, 25 bp, Mus musculus
agaaccttggctgtattctgcagct

SEQ ID NO: 140046 - DNA, 25 bp, Mus musculus
agaaccttggctttctgctcataat

SEQ ID NO: 140047 - DNA, 25 bp, Mus musculus
agaaccttgtgcagaacgggcccag

SEQ ID NO: 140048 - DNA, 25 bp, Mus musculus
agaaccttgtgctgaacgggcccag

SEQ ID NO: 140049 - DNA, 25 bp, Mus musculus
agaacctttcctagcacatagctgc

SEQ ID NO: 140050 - DNA, 25 bp, Mus musculus
agaacctttccttgcacatagctgc

SEQ ID NO: 140051 - DNA, 25 bp, Mus musculus
agaacctttgatcaacctcctgagt

SEQ ID NO: 140052 - DNA, 25 bp, Mus musculus
agaacctttgatgaacctcctgagt

SEQ ID NO: 140053 - DNA, 25 bp, Mus musculus
agaacctttgcaatctgcttattgg

SEQ ID NO: 140054 - DNA, 25 bp, Mus musculus
agaacctttgcattctgcttattgg

SEQ ID NO: 140055 - DNA, 25 bp, Mus musculus
agaaccttttagactgggaacacag

SEQ ID NO: 140056 - DNA, 25 bp, Mus musculus
agaaccttttagtctgggaacacag

SEQ ID NO: 140057 - DNA, 25 bp, Mus musculus
agaacgaaactcagtctcgatgact

SEQ ID NO: 140058 - DNA, 25 bp, Mus musculus
agaacgaaactctgtctcgatgact

SEQ ID NO: 140059 - DNA, 25 bp, Mus musculus
agaacgaaccctcttcagacagaaa

SEQ ID NO: 140060 - DNA, 25 bp, Mus musculus
agaacgaaccctgttcagacagaaa

SEQ ID NO: 140061 - DNA, 25 bp, Mus musculus
agaacgaagacacctgcatcatccg

SEQ ID NO: 140062 - DNA, 25 bp, Mus musculus
agaacgaagacagctgcatcatccg

SEQ ID NO: 140063 - DNA, 25 bp, Mus musculus
agaacgaagtccaggtatcactcaa

SEQ ID NO: 140064 - DNA, 25 bp, Mus musculus
agaacgaagtcctggtatcactcaa

SEQ ID NO: 140065 - DNA, 25 bp, Mus musculus
agaacgaattggacttcttcccagg

SEQ ID NO: 140066 - DNA, 25 bp, Mus musculus
agaacgaattggtcttcttcccagg

SEQ ID NO: 140067 - DNA, 25 bp, Mus musculus
agaacgacctggaggaggccttgaa

SEQ ID NO: 140068 - DNA, 25 bp, Mus musculus
agaacgacctggtggaggccttgaa

SEQ ID NO: 140069 - DNA, 25 bp, Mus musculus
agaacgactggcagccctttgagct

SEQ ID NO: 140070 - DNA, 25 bp, Mus musculus
agaacgactggctgccctttgagct

SEQ ID NO: 140071 - DNA, 25 bp, Mus musculus
agaacgacttcacagcttactcctc

SEQ ID NO: 140072 - DNA, 25 bp, Mus musculus
agaacgacttcagagcttactcctc

SEQ ID NO: 140073 - DNA, 25 bp, Mus musculus
agaacgagaccgatcatccagcggc

SEQ ID NO: 140074 - DNA, 25 bp, Mus musculus
agaacgagaccgttcatccagcggc

SEQ ID NO: 140075 - DNA, 25 bp, Mus musculus
agaacgagagcaaagcccgcgtgcg

SEQ ID NO: 140076 - DNA, 25 bp, Mus musculus
agaacgagagcatagcccgcgtgcg

SEQ ID NO: 140077 - DNA, 25 bp, Mus musculus
agaacgagcagtcacagcacaggca

SEQ ID NO: 140078 - DNA, 25 bp, Mus musculus
agaacgagcagtgacagcacaggca

SEQ ID NO: 140079 - DNA, 25 bp, Mus musculus
agaacgaggcagaccacttggaccg

SEQ ID NO: 140080 - DNA, 25 bp, Mus musculus
agaacgaggcagtccacttggaccg

SEQ ID NO: 140081 - DNA, 25 bp, Mus musculus
agaacgaggcgcagttcgagtacgc

SEQ ID NO: 140082 - DNA, 25 bp, Mus musculus
agaacgaggcgctgttcgagtacgc

SEQ ID NO: 140083 - DNA, 25 bp, Mus musculus
agaacgagggttccctgaaggctct

SEQ ID NO: 140084 - DNA, 25 bp, Mus musculus
agaacgagggttgcctgaaggctct

SEQ ID NO: 140085 - DNA, 25 bp, Mus musculus
agaacgagtctgaaggccctgtgat

SEQ ID NO: 140086 - DNA, 25 bp, Mus musculus
agaacgagtctgtaggccctgtgat

SEQ ID NO: 140087 - DNA, 25 bp, Mus musculus
agaacgatcagcacttactcataag

SEQ ID NO: 140088 - DNA, 25 bp, Mus musculus
agaacgatcagctcttactcataag

SEQ ID NO: 140089 - DNA, 25 bp, Mus musculus
agaacgatgttcagtctactcccat

SEQ ID NO: 140090 - DNA, 25 bp, Mus musculus
agaacgatgttctgtctactcccat

SEQ ID NO: 140091 - DNA, 25 bp, Mus musculus
agaacgattctcagtagcccaggcc

SEQ ID NO: 140092 - DNA, 25 bp, Mus musculus
agaacgattctctgtagcccaggcc

SEQ ID NO: 140093 - DNA, 25 bp, Mus musculus
agaacgatttcgatcgcctggcaat

SEQ ID NO: 140094 - DNA, 25 bp, Mus musculus
agaacgatttcgttcgcctggcaat

SEQ ID NO: 140095 - DNA, 25 bp, Mus musculus
agaacgatttggctctgtccaggaa

SEQ ID NO: 140096 - DNA, 25 bp, Mus musculus
agaacgatttgggtctgtccaggaa

SEQ ID NO: 140097 - DNA, 25 bp, Mus musculus
agaacgcaagcccacctgatgagcc

SEQ ID NO: 140098 - DNA, 25 bp, Mus musculus
agaacgcaagccgacctgatgagcc

SEQ ID NO: 140099 - DNA, 25 bp, Mus musculus
agaacgcaaggcagtgttggcagtt

SEQ ID NO: 140100 - DNA, 25 bp, Mus musculus
agaacgcaaggctgtgttggcagtt

SEQ ID NO: 140101 - DNA, 25 bp, Mus musculus
agaacgcaagtactctgtctggatc

SEQ ID NO: 140102 - DNA, 25 bp, Mus musculus
agaacgcaagtagtctgtctggatc

SEQ ID NO: 140103 - DNA, 25 bp, Mus musculus
agaacgcagctcaccgcaaagagat

SEQ ID NO: 140104 - DNA, 25 bp, Mus musculus
agaacgcagctctccgcaaagagat

SEQ ID NO: 140105 - DNA, 25 bp, Mus musculus
agaacgcagtgaacaccagagacac

SEQ ID NO: 140106 - DNA, 25 bp, Mus musculus
agaacgcagtgatcaccagagacac

SEQ ID NO: 140107 - DNA, 25 bp, Mus musculus
agaacgccaagcactcgactttgtc

SEQ ID NO: 140108 - DNA, 25 bp, Mus musculus
agaacgccaagctctcgactttgtc

SEQ ID NO: 140109 - DNA, 25 bp, Mus musculus
agaacgccatggagtgtcaactgca

SEQ ID NO: 140110 - DNA, 25 bp, Mus musculus
agaacgccatggtgtgtcaactgca

SEQ ID NO: 140111 - DNA, 25 bp, Mus musculus
agaacgccctgactacgggtaccat

SEQ ID NO: 140112 - DNA, 25 bp, Mus musculus
agaacgccctgagtacgggtaccat

SEQ ID NO: 140113 - DNA, 25 bp, Mus musculus
agaacgccgccgatgcgaccaagtg

SEQ ID NO: 140114 - DNA, 25 bp, Mus musculus
agaacgccgccgttgcgaccaagtg

SEQ ID NO: 140115 - DNA, 25 bp, Mus musculus
agaacgcctgccaccctgtgtggtg

SEQ ID NO: 140116 - DNA, 25 bp, Mus musculus
agaacgcctgcctccctgtgtggtg

SEQ ID NO: 140117 - DNA, 25 bp, Mus musculus
agaacgccttgtagcagggcttcaa

SEQ ID NO: 140118 - DNA, 25 bp, Mus musculus
agaacgccttgttgcagggcttcaa

SEQ ID NO: 140119 - DNA, 25 bp, Mus musculus
agaacgcgtgtaagagtcggtgctg

SEQ ID NO: 140120 - DNA, 25 bp, Mus musculus
agaacgcgtgtatgagtcggtgctg

SEQ ID NO: 140121 - DNA, 25 bp, Mus musculus
agaacgcgttttagggacctgcaga

SEQ ID NO: 140122 - DNA, 25 bp, Mus musculus
agaacgcgtttttgggacctgcaga

SEQ ID NO: 140123 - DNA, 25 bp, Mus musculus
agaacgctctttcgccatacatttc

SEQ ID NO: 140124 - DNA, 25 bp, Mus musculus
agaacgctctttggccatacatttc

SEQ ID NO: 140125 - DNA, 25 bp, Mus musculus
agaacgctgaaaagaggccactcgg

SEQ ID NO: 140126 - DNA, 25 bp, Mus musculus
agaacgctgaaatgaggccactcgg

SEQ ID NO: 140127 - DNA, 25 bp, Mus musculus
agaacgctgttccatctgcagagta

SEQ ID NO: 140128 - DNA, 25 bp, Mus musculus
agaacgctgttcgatctgcagagta

SEQ ID NO: 140129 - DNA, 25 bp, Mus musculus
agaacggaaccaaagggaatcagga

SEQ ID NO: 140130 - DNA, 25 bp, Mus musculus
agaacggaaccatagggaatcagga

SEQ ID NO: 140131 - DNA, 25 bp, Mus musculus
agaacggaccggacgcctgtgcacc

SEQ ID NO: 140132 - DNA, 25 bp, Mus musculus
agaacggaccggtcgcctgtgcacc

SEQ ID NO: 140133 - DNA, 25 bp, Mus musculus
agaacggactgaccactcaagtgat

SEQ ID NO: 140134 - DNA, 25 bp, Mus musculus
agaacggactgagcactcaagtgat

SEQ ID NO: 140135 - DNA, 25 bp, Mus musculus
agaacggagctgacatcaccaacaa

SEQ ID NO: 140136 - DNA, 25 bp, Mus musculus
agaacggagctgtcatcaccaacaa

SEQ ID NO: 140137 - DNA, 25 bp, Mus musculus
agaacggatacaacaatttacaagt

SEQ ID NO: 140138 - DNA, 25 bp, Mus musculus
agaacggatacatcaatttacaagt

SEQ ID NO: 140139 - DNA, 25 bp, Mus musculus
agaacggatgatacgtctttgatca

SEQ ID NO: 140140 - DNA, 25 bp, Mus musculus
agaacggatgattcgtctttgatca

SEQ ID NO: 140141 - DNA, 25 bp, Mus musculus
agaacggattctctcttacaggaca

SEQ ID NO: 140142 - DNA, 25 bp, Mus musculus
agaacggattctgtcttacaggaca

SEQ ID NO: 140143 - DNA, 25 bp, Mus musculus
agaacggcaaggacagcgggaccaa

SEQ ID NO: 140144 - DNA, 25 bp, Mus musculus
agaacggcaaggtcagcgggaccaa

SEQ ID NO: 140145 - DNA, 25 bp, Mus musculus
agaacggcaggcagtgcaagccaga

SEQ ID NO: 140146 - DNA, 25 bp, Mus musculus
agaacggcaggctgtgcaagccaga

SEQ ID NO: 140147 - DNA, 25 bp, Mus musculus
agaacggcagtgacactcgggttga

SEQ ID NO: 140148 - DNA, 25 bp, Mus musculus
agaacggcagtgtcactcgggttga

SEQ ID NO: 140149 - DNA, 25 bp, Mus musculus
agaacggcatgtacatccgcatggc

SEQ ID NO: 140150 - DNA, 25 bp, Mus musculus
agaacggcatgttcatccgcatggc

SEQ ID NO: 140151 - DNA, 25 bp, Mus musculus
agaacggcctacatgctacgcgtgg

SEQ ID NO: 140152 - DNA, 25 bp, Mus musculus
agaacggcctacttgctacgcgtgg

SEQ ID NO: 140153 - DNA, 25 bp, Mus musculus
agaacggcctctaatgtgccttcaa

SEQ ID NO: 140154 - DNA, 25 bp, Mus musculus
agaacggcctcttatgtgccttcaa

SEQ ID NO: 140155 - DNA, 25 bp, Mus musculus
agaacggcgccaacttctgtactta

SEQ ID NO: 140156 - DNA, 25 bp, Mus musculus
agaacggcgccatcttctgtactta

SEQ ID NO: 140157 - DNA, 25 bp, Mus musculus
agaacggcggatcttggacctctat

SEQ ID NO: 140158 - DNA, 25 bp, Mus musculus
agaacggcggatgttggacctctat

SEQ ID NO: 140159 - DNA, 25 bp, Mus musculus
agaacggcgtgtactcacacagcaa

SEQ ID NO: 140160 - DNA, 25 bp, Mus musculus
agaacggcgtgttctcacacagcaa

SEQ ID NO: 140161 - DNA, 25 bp, Mus musculus
agaacggctgggaagaggactattg

SEQ ID NO: 140162 - DNA, 25 bp, Mus musculus
agaacggctgggtagaggactattg

SEQ ID NO: 140163 - DNA, 25 bp, Mus musculus
agaacgggcacactttcttggatgc

SEQ ID NO: 140164 - DNA, 25 bp, Mus musculus
agaacgggcacagtttcttggatgc

SEQ ID NO: 140165 - DNA, 25 bp, Mus musculus
agaacgggtgttacgtatctcccat

SEQ ID NO: 140166 - DNA, 25 bp, Mus musculus
agaacgggtgtttcgtatctcccat

SEQ ID NO: 140167 - DNA, 25 bp, Mus musculus
agaacggtgagtccagccagctgtc

SEQ ID NO: 140168 - DNA, 25 bp, Mus musculus
agaacggtgagtgcagccagctgtc

SEQ ID NO: 140169 - DNA, 25 bp, Mus musculus
agaacggtgcaaatgggctccagct

SEQ ID NO: 140170 - DNA, 25 bp, Mus musculus
agaacggtgcaattgggctccagct

SEQ ID NO: 140171 - DNA, 25 bp, Mus musculus
agaacggtgctaactggaactgggt

SEQ ID NO: 140172 - DNA, 25 bp, Mus musculus
agaacggtgctatctggaactgggt

SEQ ID NO: 140173 - DNA, 25 bp, Mus musculus
agaacggttgccagcaaagcacggg

SEQ ID NO: 140174 - DNA, 25 bp, Mus musculus
agaacggttgcctgcaaagcacggg

SEQ ID NO: 140175 - DNA, 25 bp, Mus musculus
agaacggttgttctgttcaaaatat

SEQ ID NO: 140176 - DNA, 25 bp, Mus musculus
agaacggttgttgtgttcaaaatat

SEQ ID NO: 140177 - DNA, 25 bp, Mus musculus
agaacgtagcaccatgccactattg

SEQ ID NO: 140178 - DNA, 25 bp, Mus musculus
agaacgtagcacgatgccactattg

SEQ ID NO: 140179 - DNA, 25 bp, Mus musculus
agaacgtagcttaatggcccacaaa

SEQ ID NO: 140180 - DNA, 25 bp, Mus musculus
agaacgtagctttatggcccacaaa

SEQ ID NO: 140181 - DNA, 25 bp, Mus musculus
agaacgtcaagtcaactcggctgct

SEQ ID NO: 140182 - DNA, 25 bp, Mus musculus
agaacgtcaagtgaactcggctgct

SEQ ID NO: 140183 - DNA, 25 bp, Mus musculus
agaacgtcatggaccctgtgaactt

SEQ ID NO: 140184 - DNA, 25 bp, Mus musculus
agaacgtcatggtccctgtgaactt

SEQ ID NO: 140185 - DNA, 25 bp, Mus musculus
agaacgtcctgtaaggtgctccgtc

SEQ ID NO: 140186 - DNA, 25 bp, Mus musculus
agaacgtcctgttaggtgctccgtc

SEQ ID NO: 140187 - DNA, 25 bp, Mus musculus
agaacgtcgtggacaccattctctt

SEQ ID NO: 140188 - DNA, 25 bp, Mus musculus
agaacgtcgtggtcaccattctctt

SEQ ID NO: 140189 - DNA, 25 bp, Mus musculus
agaacgtctattaccaattgcctcc

SEQ ID NO: 140190 - DNA, 25 bp, Mus musculus
agaacgtctatttccaattgcctcc

SEQ ID NO: 140191 - DNA, 25 bp, Mus musculus
agaacgtgaggtattgcagagccta

SEQ ID NO: 140192 - DNA, 25 bp, Mus musculus
agaacgtgaggttttgcagagccta

SEQ ID NO: 140193 - DNA, 25 bp, Mus musculus
agaacgtggaggctccatctcggaa

SEQ ID NO: 140194 - DNA, 25 bp, Mus musculus
agaacgtggagggtccatctcggaa

SEQ ID NO: 140195 - DNA, 25 bp, Mus musculus
agaacgtggccaagctggatctgaa

SEQ ID NO: 140196 - DNA, 25 bp, Mus musculus
agaacgtggccatgctggatctgaa

SEQ ID NO: 140197 - DNA, 25 bp, Mus musculus
agaacgtggttcagccttggccaaa

SEQ ID NO: 140198 - DNA, 25 bp, Mus musculus
agaacgtggttcctgactcgactgg

SEQ ID NO: 140199 - DNA, 25 bp, Mus musculus
agaacgtggttcgtgactcgactgg

SEQ ID NO: 140200 - DNA, 25 bp, Mus musculus
agaacgtggttctgccttggccaaa

SEQ ID NO: 140201 - DNA, 25 bp, Mus musculus
agaacgttaaacagagaccacctca

SEQ ID NO: 140202 - DNA, 25 bp, Mus musculus
agaacgttaaactgagaccacctca

SEQ ID NO: 140203 - DNA, 25 bp, Mus musculus
agaacgttgggcactggcttcctgt

SEQ ID NO: 140204 - DNA, 25 bp, Mus musculus
agaacgttgggctctggcttcctgt

SEQ ID NO: 140205 - DNA, 25 bp, Mus musculus
agaacgttggtgcaatccctgcctt

SEQ ID NO: 140206 - DNA, 25 bp, Mus musculus
agaacgttggtggaatccctgcctt

SEQ ID NO: 140207 - DNA, 25 bp, Mus musculus
agaacgtttcgtctgtagtccagat

SEQ ID NO: 140208 - DNA, 25 bp, Mus musculus
agaacgtttcgtgtgtagtccagat

SEQ ID NO: 140209 - DNA, 25 bp, Mus musculus
agaacgttttagagaatctgagcct

SEQ ID NO: 140210 - DNA, 25 bp, Mus musculus
agaacgttttagtgaatctgagcct

SEQ ID NO: 140211 - DNA, 25 bp, Mus musculus
agaactaaacacactcaaactgaga

SEQ ID NO: 140212 - DNA, 25 bp, Mus musculus
agaactaaacactctcaaactgaga

SEQ ID NO: 140213 - DNA, 25 bp, Mus musculus
agaactaacaccagttggccttctg

SEQ ID NO: 140214 - DNA, 25 bp, Mus musculus
agaactaacacctgttggccttctg

SEQ ID NO: 140215 - DNA, 25 bp, Mus musculus
agaactaactggcagctaccctact

SEQ ID NO: 140216 - DNA, 25 bp, Mus musculus
agaactaactgggagctaccctact

SEQ ID NO: 140217 - DNA, 25 bp, Mus musculus
agaactaagtcgagcatccctgtgt

SEQ ID NO: 140218 - DNA, 25 bp, Mus musculus
agaactaagtcgtgcatccctgtgt

SEQ ID NO: 140219 - DNA, 25 bp, Mus musculus
agaactacaatgctaaggctggtaa

SEQ ID NO: 140220 - DNA, 25 bp, Mus musculus
agaactacaatggtaaggctggtaa

SEQ ID NO: 140221 - DNA, 25 bp, Mus musculus
agaactacagcaacaagcgcacagt

SEQ ID NO: 140222 - DNA, 25 bp, Mus musculus
agaactacagcatcaagcgcacagt

SEQ ID NO: 140223 - DNA, 25 bp, Mus musculus
agaactacagttcccagaaggcagc

SEQ ID NO: 140224 - DNA, 25 bp, Mus musculus
agaactacagttgccagaaggcagc

SEQ ID NO: 140225 - DNA, 25 bp, Mus musculus
agaactacatacagtccatttgctt

SEQ ID NO: 140226 - DNA, 25 bp, Mus musculus
agaactacatactgtccatttgctt

SEQ ID NO: 140227 - DNA, 25 bp, Mus musculus
agaactacctctaggactagcatcc

SEQ ID NO: 140228 - DNA, 25 bp, Mus musculus
agaactacctctcggaacaagactt

SEQ ID NO: 140229 - DNA, 25 bp, Mus musculus
agaactacctctcggatctgtgaga

SEQ ID NO: 140230 - DNA, 25 bp, Mus musculus
agaactacctctgggaacaagactt

SEQ ID NO: 140231 - DNA, 25 bp, Mus musculus
agaactacctctgggatctgtgaga

SEQ ID NO: 140232 - DNA, 25 bp, Mus musculus
agaactacctcttggactagcatcc

SEQ ID NO: 140233 - DNA, 25 bp, Mus musculus
agaactacggacagcgagccaagag

SEQ ID NO: 140234 - DNA, 25 bp, Mus musculus
agaactacggactgcgagccaagag

SEQ ID NO: 140235 - DNA, 25 bp, Mus musculus
agaactactgcgcagtggcttgctc

SEQ ID NO: 140236 - DNA, 25 bp, Mus musculus
agaactactgcggagtggcttgctc

SEQ ID NO: 140237 - DNA, 25 bp, Mus musculus
agaactactgtgctcccatcattcc

SEQ ID NO: 140238 - DNA, 25 bp, Mus musculus
agaactactgtggtcccatcattcc

SEQ ID NO: 140239 - DNA, 25 bp, Mus musculus
agaactactgttagcacatatttgc

SEQ ID NO: 140240 - DNA, 25 bp, Mus musculus
agaactactgtttgcacatatttgc

SEQ ID NO: 140241 - DNA, 25 bp, Mus musculus
agaactagacatatggtaacacagc

SEQ ID NO: 140242 - DNA, 25 bp, Mus musculus
agaactagacatttggtaacacagc

SEQ ID NO: 140243 - DNA, 25 bp, Mus musculus
agaactagacgtcctgttcctgaca

SEQ ID NO: 140244 - DNA, 25 bp, Mus musculus
agaactagacgtgctgttcctgaca

SEQ ID NO: 140245 - DNA, 25 bp, Mus musculus
agaactagagaactcacccttggga

SEQ ID NO: 140246 - DNA, 25 bp, Mus musculus
agaactagagaagtcacccttggga

SEQ ID NO: 140247 - DNA, 25 bp, Mus musculus
agaactagccagcaggtagccagtc

SEQ ID NO: 140248 - DNA, 25 bp, Mus musculus
agaactagccaggaggtagccagtc

SEQ ID NO: 140249 - DNA, 25 bp, Mus musculus
agaactagtgaacctccaggctcct

SEQ ID NO: 140250 - DNA, 25 bp, Mus musculus
agaactagtgaagctccaggctcct

SEQ ID NO: 140251 - DNA, 25 bp, Mus musculus
agaactagtgagacagtggtctgtt

SEQ ID NO: 140252 - DNA, 25 bp, Mus musculus
agaactagtgagtcagtggtctgtt

SEQ ID NO: 140253 - DNA, 25 bp, Mus musculus
agaactagttctacactgtgtcact

SEQ ID NO: 140254 - DNA, 25 bp, Mus musculus
agaactagttcttcactgtgtcact

SEQ ID NO: 140255 - DNA, 25 bp, Mus musculus
agaactagttgaatctgttgactgt

SEQ ID NO: 140256 - DNA, 25 bp, Mus musculus
agaactagttgattctgttgactgt

SEQ ID NO: 140257 - DNA, 25 bp, Mus musculus
agaactatagttaaccctccataca

SEQ ID NO: 140258 - DNA, 25 bp, Mus musculus
agaactatagtttaccctccataca

SEQ ID NO: 140259 - DNA, 25 bp, Mus musculus
agaactatccttcttgtgactccta

SEQ ID NO: 140260 - DNA, 25 bp, Mus musculus
agaactatccttgttgtgactccta

SEQ ID NO: 140261 - DNA, 25 bp, Mus musculus
agaactatgagaatgggtccagccc

SEQ ID NO: 140262 - DNA, 25 bp, Mus musculus
agaactatgagattgggtccagccc

SEQ ID NO: 140263 - DNA, 25 bp, Mus musculus
agaactatgagccacgcaacggcaa

SEQ ID NO: 140264 - DNA, 25 bp, Mus musculus
agaactatgagcgacgcaacggcaa

SEQ ID NO: 140265 - DNA, 25 bp, Mus musculus
agaactatgatgagtgccccttcaa

SEQ ID NO: 140266 - DNA, 25 bp, Mus musculus
agaactatgatgtgtgccccttcaa

SEQ ID NO: 140267 - DNA, 25 bp, Mus musculus
agaactatggtgacttggcgtacaa

SEQ ID NO: 140268 - DNA, 25 bp, Mus musculus
agaactatggtgtcttggcgtacaa

SEQ ID NO: 140269 - DNA, 25 bp, Mus musculus
agaactatgtataatatgtggctat

SEQ ID NO: 140270 - DNA, 25 bp, Mus musculus
agaactatgtattatatgtggctat

SEQ ID NO: 140271 - DNA, 25 bp, Mus musculus
agaactatgtccctacccatcgaag

SEQ ID NO: 140272 - DNA, 25 bp, Mus musculus
agaactatgtccctatgcaaaaccc

SEQ ID NO: 140273 - DNA, 25 bp, Mus musculus
agaactatgtccgtacccatcgaag

SEQ ID NO: 140274 - DNA, 25 bp, Mus musculus
agaactatgtccgtatgcaaaaccc

SEQ ID NO: 140275 - DNA, 25 bp, Mus musculus
agaactatgtgtcgctctctgtagg

SEQ ID NO: 140276 - DNA, 25 bp, Mus musculus
agaactatgtgtggctctctgtagg

SEQ ID NO: 140277 - DNA, 25 bp, Mus musculus
agaactattcttcacgcctctgaaa

SEQ ID NO: 140278 - DNA, 25 bp, Mus musculus
agaactattcttgacgcctctgaaa

SEQ ID NO: 140279 - DNA, 25 bp, Mus musculus
agaactatttacagcagacttaggg

SEQ ID NO: 140280 - DNA, 25 bp, Mus musculus
agaactatttactgcagacttaggg

SEQ ID NO: 140281 - DNA, 25 bp, Mus musculus
agaactatttcaagcgctccatttt

SEQ ID NO: 140282 - DNA, 25 bp, Mus musculus
agaactatttcatgcgctccatttt

SEQ ID NO: 140283 - DNA, 25 bp, Mus musculus
agaactatttttacattgcccatag

SEQ ID NO: 140284 - DNA, 25 bp, Mus musculus
agaactattttttcattgcccatag

SEQ ID NO: 140285 - DNA, 25 bp, Mus musculus
agaactcaaagaaccagctgccttc

SEQ ID NO: 140286 - DNA, 25 bp, Mus musculus
agaactcaaagatccagctgccttc

SEQ ID NO: 140287 - DNA, 25 bp, Mus musculus
agaactcaaatccatgggcccatct

SEQ ID NO: 140288 - DNA, 25 bp, Mus musculus
agaactcaaatcgatgggcccatct

SEQ ID NO: 140289 - DNA, 25 bp, Mus musculus
agaactcaacatcgcaccttcaagg

SEQ ID NO: 140290 - DNA, 25 bp, Mus musculus
agaactcaacatggcaccttcaagg

SEQ ID NO: 140291 - DNA, 25 bp, Mus musculus
agaactcaacttatacactgataaa

SEQ ID NO: 140292 - DNA, 25 bp, Mus musculus
agaactcaacttttacactgataaa

SEQ ID NO: 140293 - DNA, 25 bp, Mus musculus
agaactcaagtcatgagacctgaca

SEQ ID NO: 140294 - DNA, 25 bp, Mus musculus
agaactcaagtcttgagacctgaca

SEQ ID NO: 140295 - DNA, 25 bp, Mus musculus
agaactcaagtgaggtcctctgtgc

SEQ ID NO: 140296 - DNA, 25 bp, Mus musculus
agaactcaagtgtggtcctctgtgc

SEQ ID NO: 140297 - DNA, 25 bp, Mus musculus
agaactcaatgacaactgggccact

SEQ ID NO: 140298 - DNA, 25 bp, Mus musculus
agaactcaatgagaactgggccact

SEQ ID NO: 140299 - DNA, 25 bp, Mus musculus
agaactcaattcaagcactacatgg

SEQ ID NO: 140300 - DNA, 25 bp, Mus musculus
agaactcaattctagcactacatgg

SEQ ID NO: 140301 - DNA, 25 bp, Mus musculus
agaactcacacacaaaagcctgatg

SEQ ID NO: 140302 - DNA, 25 bp, Mus musculus
agaactcacacagaaaagcctgatg

SEQ ID NO: 140303 - DNA, 25 bp, Mus musculus
agaactcacaccaagttgggtgaat

SEQ ID NO: 140304 - DNA, 25 bp, Mus musculus
agaactcacacctagttgggtgaat

SEQ ID NO: 140305 - DNA, 25 bp, Mus musculus
agaactcacattcaaaccctgtcag

SEQ ID NO: 140306 - DNA, 25 bp, Mus musculus
agaactcacattgaaaccctgtcag

SEQ ID NO: 140307 - DNA, 25 bp, Mus musculus
agaactcaccagatctcagactgaa

SEQ ID NO: 140308 - DNA, 25 bp, Mus musculus
agaactcaccagttctcagactgaa

SEQ ID NO: 140309 - DNA, 25 bp, Mus musculus
agaactcactggagtcctatgcctt

SEQ ID NO: 140310 - DNA, 25 bp, Mus musculus
agaactcactggcacctactagcct

SEQ ID NO: 140311 - DNA, 25 bp, Mus musculus
agaactcactgggacctactagcct

SEQ ID NO: 140312 - DNA, 25 bp, Mus musculus
agaactcactggtgtcctatgcctt

SEQ ID NO: 140313 - DNA, 25 bp, Mus musculus
agaactcactttatcctcaatgcgg

SEQ ID NO: 140314 - DNA, 25 bp, Mus musculus
agaactcactttttcctcaatgcgg

SEQ ID NO: 140315 - DNA, 25 bp, Mus musculus
agaactcaggctcggcttgcatcag

SEQ ID NO: 140316 - DNA, 25 bp, Mus musculus
agaactcaggctgggcttgcatcag

SEQ ID NO: 140317 - DNA, 25 bp, Mus musculus
agaactcaggttagtagcatacttg

SEQ ID NO: 140318 - DNA, 25 bp, Mus musculus
agaactcaggtttgtagcatacttg

SEQ ID NO: 140319 - DNA, 25 bp, Mus musculus
agaactcagtgacgtgttcttctcc

SEQ ID NO: 140320 - DNA, 25 bp, Mus musculus
agaactcagtgaggtgttcttctcc

SEQ ID NO: 140321 - DNA, 25 bp, Mus musculus
agaactcatccccagcagggcttag

SEQ ID NO: 140322 - DNA, 25 bp, Mus musculus
agaactcatcccgagcagggcttag

SEQ ID NO: 140323 - DNA, 25 bp, Mus musculus
agaactcatcgcctcctggtgtcaa

SEQ ID NO: 140324 - DNA, 25 bp, Mus musculus
agaactcatcgcgtcctggtgtcaa

SEQ ID NO: 140325 - DNA, 25 bp, Mus musculus
agaactcatctgagattgtcaggag

SEQ ID NO: 140326 - DNA, 25 bp, Mus musculus
agaactcatctgtgattgtcaggag

SEQ ID NO: 140327 - DNA, 25 bp, Mus musculus
agaactcattctaatggcttccggc

SEQ ID NO: 140328 - DNA, 25 bp, Mus musculus
agaactcattcttatggcttccggc

SEQ ID NO: 140329 - DNA, 25 bp, Mus musculus
agaactccaagcaatcagacctcga

SEQ ID NO: 140330 - DNA, 25 bp, Mus musculus
agaactccaagctatcagacctcga

SEQ ID NO: 140331 - DNA, 25 bp, Mus musculus
agaactccacatctctccaggcgag

SEQ ID NO: 140332 - DNA, 25 bp, Mus musculus
agaactccacatgtctccaggcgag

SEQ ID NO: 140333 - DNA, 25 bp, Mus musculus
agaactccacgtaaagtcaccagaa

SEQ ID NO: 140334 - DNA, 25 bp, Mus musculus
agaactccacgttaagtcaccagaa

SEQ ID NO: 140335 - DNA, 25 bp, Mus musculus
agaactccaggcacaatcctatagt

SEQ ID NO: 140336 - DNA, 25 bp, Mus musculus
agaactccaggcatgttcagccatg

SEQ ID NO: 140337 - DNA, 25 bp, Mus musculus
agaactccaggctcaatcctatagt

SEQ ID NO: 140338 - DNA, 25 bp, Mus musculus
agaactccaggcttgttcagccatg

SEQ ID NO: 140339 - DNA, 25 bp, Mus musculus
agaactccagtgatgctatgcacaa

SEQ ID NO: 140340 - DNA, 25 bp, Mus musculus
agaactccagtgttgctatgcacaa

SEQ ID NO: 140341 - DNA, 25 bp, Mus musculus
agaactccatagctgggtctcacca

SEQ ID NO: 140342 - DNA, 25 bp, Mus musculus
agaactccataggtgggtctcacca

SEQ ID NO: 140343 - DNA, 25 bp, Mus musculus
agaactccatgtcacccaaacttga

SEQ ID NO: 140344 - DNA, 25 bp, Mus musculus
agaactccatgtgacccaaacttga

SEQ ID NO: 140345 - DNA, 25 bp, Mus musculus
agaactccattcaaaaaccatgcaa

SEQ ID NO: 140346 - DNA, 25 bp, Mus musculus
agaactccattctaaaaccatgcaa

SEQ ID NO: 140347 - DNA, 25 bp, Mus musculus
agaactcccaaaccttgagaccagg

SEQ ID NO: 140348 - DNA, 25 bp, Mus musculus
agaactcccaaagcttgagaccagg

SEQ ID NO: 140349 - DNA, 25 bp, Mus musculus
agaactcccattcctgagggacttg

SEQ ID NO: 140350 - DNA, 25 bp, Mus musculus
agaactcccattgctgagggacttg

SEQ ID NO: 140351 - DNA, 25 bp, Mus musculus
agaactccccagagaagtttgccct

SEQ ID NO: 140352 - DNA, 25 bp, Mus musculus
agaactccccagtgaagtttgccct

SEQ ID NO: 140353 - DNA, 25 bp, Mus musculus
agaactcccctaattctggccagag

SEQ ID NO: 140354 - DNA, 25 bp, Mus musculus
agaactcccctatttctggccagag

SEQ ID NO: 140355 - DNA, 25 bp, Mus musculus
agaactcccttcagcggtgcacctg

SEQ ID NO: 140356 - DNA, 25 bp, Mus musculus
agaactcccttctgcggtgcacctg

SEQ ID NO: 140357 - DNA, 25 bp, Mus musculus
agaactccctttagcggtgcacctg

SEQ ID NO: 140358 - DNA, 25 bp, Mus musculus
agaactcccttttgcggtgcacctg

SEQ ID NO: 140359 - DNA, 25 bp, Mus musculus
agaactccgtagaaaagcacacgag

SEQ ID NO: 140360 - DNA, 25 bp, Mus musculus
agaactccgtagtaaagcacacgag

SEQ ID NO: 140361 - DNA, 25 bp, Mus musculus
agaactccgtttactgctcggcaga

SEQ ID NO: 140362 - DNA, 25 bp, Mus musculus
agaactccgttttctgctcggcaga

SEQ ID NO: 140363 - DNA, 25 bp, Mus musculus
agaactcctaccatggtttgaaaag

SEQ ID NO: 140364 - DNA, 25 bp, Mus musculus
agaactcctaccttggtttgaaaag

SEQ ID NO: 140365 - DNA, 25 bp, Mus musculus
agaactcctgaaccgctgaagacac

SEQ ID NO: 140366 - DNA, 25 bp, Mus musculus
agaactcctgaagcgctgaagacac

SEQ ID NO: 140367 - DNA, 25 bp, Mus musculus
agaactcctgacaaccattctatga

SEQ ID NO: 140368 - DNA, 25 bp, Mus musculus
agaactcctgactaccattctatga

SEQ ID NO: 140369 - DNA, 25 bp, Mus musculus
agaactcctgcgcatctgcagcctg

SEQ ID NO: 140370 - DNA, 25 bp, Mus musculus
agaactcctgcggatctgcagcctg

SEQ ID NO: 140371 - DNA, 25 bp, Mus musculus
agaactcctggaagtttatagcaga

SEQ ID NO: 140372 - DNA, 25 bp, Mus musculus
agaactcctggatgtttatagcaga

SEQ ID NO: 140373 - DNA, 25 bp, Mus musculus
agaactcctggcactgtgtcaagca

SEQ ID NO: 140374 - DNA, 25 bp, Mus musculus
agaactcctggctctgtgtcaagca

SEQ ID NO: 140375 - DNA, 25 bp, Mus musculus
agaactcctgggaccggtgctggat

SEQ ID NO: 140376 - DNA, 25 bp, Mus musculus
agaactcctgggtccggtgctggat

SEQ ID NO: 140377 - DNA, 25 bp, Mus musculus
agaactcctgtgaagaagacgcaat

SEQ ID NO: 140378 - DNA, 25 bp, Mus musculus
agaactcctgtgtagaagacgcaat

SEQ ID NO: 140379 - DNA, 25 bp, Mus musculus
agaactcctttgaaagcttctgtct

SEQ ID NO: 140380 - DNA, 25 bp, Mus musculus
agaactcctttgtaagcttctgtct

SEQ ID NO: 140381 - DNA, 25 bp, Mus musculus
agaactcgacccatcgaacttatca

SEQ ID NO: 140382 - DNA, 25 bp, Mus musculus
agaactcgacccttcgaacttatca

SEQ ID NO: 140383 - DNA, 25 bp, Mus musculus
agaactcgacggagtaaacacagag

SEQ ID NO: 140384 - DNA, 25 bp, Mus musculus
agaactcgacggtgtaaacacagag

SEQ ID NO: 140385 - DNA, 25 bp, Mus musculus
agaactcgctttcccgtcatataca

SEQ ID NO: 140386 - DNA, 25 bp, Mus musculus
agaactcgctttgccgtcatataca

SEQ ID NO: 140387 - DNA, 25 bp, Mus musculus
agaactcggaggctgtttatgctga

SEQ ID NO: 140388 - DNA, 25 bp, Mus musculus
agaactcggagggtgtttatgctga

SEQ ID NO: 140389 - DNA, 25 bp, Mus musculus
agaactcggcatacgtgtgtgtgat

SEQ ID NO: 140390 - DNA, 25 bp, Mus musculus
agaactcggcattcgtgtgtgtgat

SEQ ID NO: 140391 - DNA, 25 bp, Mus musculus
agaactcgtaaaccggcatgcctgc

SEQ ID NO: 140392 - DNA, 25 bp, Mus musculus
agaactcgtaaagcggcatgcctgc

SEQ ID NO: 140393 - DNA, 25 bp, Mus musculus
agaactcgtctgacatgctcctgac

SEQ ID NO: 140394 - DNA, 25 bp, Mus musculus
agaactcgtctgtcatgctcctgac

SEQ ID NO: 140395 - DNA, 25 bp, Mus musculus
agaactcgtttgagacgcacctcag

SEQ ID NO: 140396 - DNA, 25 bp, Mus musculus
agaactcgtttgtgacgcacctcag

SEQ ID NO: 140397 - DNA, 25 bp, Mus musculus
agaactctaattccttccataatgg

SEQ ID NO: 140398 - DNA, 25 bp, Mus musculus
agaactctaattgcttccataatgg

SEQ ID NO: 140399 - DNA, 25 bp, Mus musculus
agaactctagcgactgggtgaccac

SEQ ID NO: 140400 - DNA, 25 bp, Mus musculus
agaactctagcgtctgggtgaccac

SEQ ID NO: 140401 - DNA, 25 bp, Mus musculus
agaactctatagagagcgtggaaca

SEQ ID NO: 140402 - DNA, 25 bp, Mus musculus
agaactctatagtgagcgtggaaca

SEQ ID NO: 140403 - DNA, 25 bp, Mus musculus
agaactctatcactttgtgcctcag

SEQ ID NO: 140404 - DNA, 25 bp, Mus musculus
agaactctatcagtttgtgcctcag

SEQ ID NO: 140405 - DNA, 25 bp, Mus musculus
agaactctatctccaggttactctt

SEQ ID NO: 140406 - DNA, 25 bp, Mus musculus
agaactctatctgcaggttactctt

SEQ ID NO: 140407 - DNA, 25 bp, Mus musculus
agaactctcaggaatctctccagaa

SEQ ID NO: 140408 - DNA, 25 bp, Mus musculus
agaactctcaggtatctctccagaa

SEQ ID NO: 140409 - DNA, 25 bp, Mus musculus
agaactctcctacgtgtgatctgca

SEQ ID NO: 140410 - DNA, 25 bp, Mus musculus
agaactctcctaggtgtgatctgca

SEQ ID NO: 140411 - DNA, 25 bp, Mus musculus
agaactctcgatagccatcccaggt

SEQ ID NO: 140412 - DNA, 25 bp, Mus musculus
agaactctcgattgccatcccaggt

SEQ ID NO: 140413 - DNA, 25 bp, Mus musculus
agaactctcgccagaggctgtctga

SEQ ID NO: 140414 - DNA, 25 bp, Mus musculus
agaactctcgcctgaggctgtctga

SEQ ID NO: 140415 - DNA, 25 bp, Mus musculus
agaactctctccatgttggtacaag

SEQ ID NO: 140416 - DNA, 25 bp, Mus musculus
agaactctctccttgttggtacaag

SEQ ID NO: 140417 - DNA, 25 bp, Mus musculus
agaactctctcgctgaactggaaca

SEQ ID NO: 140418 - DNA, 25 bp, Mus musculus
agaactctctcggtgaactggaaca

SEQ ID NO: 140419 - DNA, 25 bp, Mus musculus
agaactctcttaaccacactacgtt

SEQ ID NO: 140420 - DNA, 25 bp, Mus musculus
agaactctcttatccacactacgtt

SEQ ID NO: 140421 - DNA, 25 bp, Mus musculus
agaactctcttcacggtaatcaagt

SEQ ID NO: 140422 - DNA, 25 bp, Mus musculus
agaactctcttcatcatgtgaaagc

SEQ ID NO: 140423 - DNA, 25 bp, Mus musculus
agaactctcttctcggtaatcaagt

SEQ ID NO: 140424 - DNA, 25 bp, Mus musculus
agaactctcttcttcatgtgaaagc

SEQ ID NO: 140425 - DNA, 25 bp, Mus musculus
agaactctgactcatccttcagaat

SEQ ID NO: 140426 - DNA, 25 bp, Mus musculus
agaactctgactgatccttcagaat

SEQ ID NO: 140427 - DNA, 25 bp, Mus musculus
agaactctgagtcctccaatcatag

SEQ ID NO: 140428 - DNA, 25 bp, Mus musculus
agaactctgagtgctccaatcatag

SEQ ID NO: 140429 - DNA, 25 bp, Mus musculus
agaactctgccaagcacttgcgctt

SEQ ID NO: 140430 - DNA, 25 bp, Mus musculus
agaactctgccatgcacttgcgctt

SEQ ID NO: 140431 - DNA, 25 bp, Mus musculus
agaactctgcccatattggaaggga

SEQ ID NO: 140432 - DNA, 25 bp, Mus musculus
agaactctgcccttattggaaggga

SEQ ID NO: 140433 - DNA, 25 bp, Mus musculus
agaactctgctgacatcttttctca

SEQ ID NO: 140434 - DNA, 25 bp, Mus musculus
agaactctgctgtcatcttttctca

SEQ ID NO: 140435 - DNA, 25 bp, Mus musculus
agaactctgggcatcggctgggacc

SEQ ID NO: 140436 - DNA, 25 bp, Mus musculus
agaactctgggcttcggctgggacc

SEQ ID NO: 140437 - DNA, 25 bp, Mus musculus
agaactctgtgaatcctgtggaaat

SEQ ID NO: 140438 - DNA, 25 bp, Mus musculus
agaactctgtgattcctgtggaaat

SEQ ID NO: 140439 - DNA, 25 bp, Mus musculus
agaactctgtgcagcgcagggagat

SEQ ID NO: 140440 - DNA, 25 bp, Mus musculus
agaactctgtgctgcgcagggagat

SEQ ID NO: 140441 - DNA, 25 bp, Mus musculus
agaactcttaggacttccagctcca

SEQ ID NO: 140442 - DNA, 25 bp, Mus musculus
agaactcttaggtcttccagctcca

SEQ ID NO: 140443 - DNA, 25 bp, Mus musculus
agaactcttccaacgtgggaatcct

SEQ ID NO: 140444 - DNA, 25 bp, Mus musculus
agaactcttccatcgtgggaatcct

SEQ ID NO: 140445 - DNA, 25 bp, Mus musculus
agaactcttcctcaattcaacaaca

SEQ ID NO: 140446 - DNA, 25 bp, Mus musculus
agaactcttcctgaattcaacaaca

SEQ ID NO: 140447 - DNA, 25 bp, Mus musculus
agaactcttctgatgctgcgccaat

SEQ ID NO: 140448 - DNA, 25 bp, Mus musculus
agaactcttctgttgctgcgccaat

SEQ ID NO: 140449 - DNA, 25 bp, Mus musculus
agaactcttgccaggtgaccgggaa

SEQ ID NO: 140450 - DNA, 25 bp, Mus musculus
agaactcttgcctggtgaccgggaa

SEQ ID NO: 140451 - DNA, 25 bp, Mus musculus
agaactgaaataagcacctggtagc

SEQ ID NO: 140452 - DNA, 25 bp, Mus musculus
agaactgaaatatgcacctggtagc

SEQ ID NO: 140453 - DNA, 25 bp, Mus musculus
agaactgaatgtcccaagttgtcct

SEQ ID NO: 140454 - DNA, 25 bp, Mus musculus
agaactgaatgtgccaagttgtcct

SEQ ID NO: 140455 - DNA, 25 bp, Mus musculus
agaactgaattcacctcaaagggag

SEQ ID NO: 140456 - DNA, 25 bp, Mus musculus
agaactgaattctcctcaaagggag

SEQ ID NO: 140457 - DNA, 25 bp, Mus musculus
agaactgaccacctgacagcacttc

SEQ ID NO: 140458 - DNA, 25 bp, Mus musculus
agaactgaccacgtgacagcacttc

SEQ ID NO: 140459 - DNA, 25 bp, Mus musculus
agaactgactcaatgctcggaatgt

SEQ ID NO: 140460 - DNA, 25 bp, Mus musculus
agaactgactcattgctcggaatgt

SEQ ID NO: 140461 - DNA, 25 bp, Mus musculus
agaactgactctcatgctccgattc

SEQ ID NO: 140462 - DNA, 25 bp, Mus musculus
agaactgactctgatgctccgattc

SEQ ID NO: 140463 - DNA, 25 bp, Mus musculus
agaactgactgtccaagctgtcctc

SEQ ID NO: 140464 - DNA, 25 bp, Mus musculus
agaactgactgtgcaagctgtcctc

SEQ ID NO: 140465 - DNA, 25 bp, Mus musculus
agaactgagatactgcactgggaag

SEQ ID NO: 140466 - DNA, 25 bp, Mus musculus
agaactgagatagtgcactgggaag

SEQ ID NO: 140467 - DNA, 25 bp, Mus musculus
agaactgagattcttgaccacccgc

SEQ ID NO: 140468 - DNA, 25 bp, Mus musculus
agaactgagattgttgaccacccgc

SEQ ID NO: 140469 - DNA, 25 bp, Mus musculus
agaactgagctgattctctgaagtt

SEQ ID NO: 140470 - DNA, 25 bp, Mus musculus
agaactgagctgtttctctgaagtt

SEQ ID NO: 140471 - DNA, 25 bp, Mus musculus
agaactgagcttcggcttttggaac

SEQ ID NO: 140472 - DNA, 25 bp, Mus musculus
agaactgagcttgggcttttggaac

SEQ ID NO: 140473 - DNA, 25 bp, Mus musculus
agaactgagggcacctctggaggtt

SEQ ID NO: 140474 - DNA, 25 bp, Mus musculus
agaactgagggctcctctggaggtt

SEQ ID NO: 140475 - DNA, 25 bp, Mus musculus
agaactgagtcgcaggcccttgaac

SEQ ID NO: 140476 - DNA, 25 bp, Mus musculus
agaactgagtcggaggcccttgaac

SEQ ID NO: 140477 - DNA, 25 bp, Mus musculus
agaactgagtgacgttgcccgcccc

SEQ ID NO: 140478 - DNA, 25 bp, Mus musculus
agaactgagtgaggttgcccgcccc

SEQ ID NO: 140479 - DNA, 25 bp, Mus musculus
agaactgatcgtccatggatttttg

SEQ ID NO: 140480 - DNA, 25 bp, Mus musculus
agaactgatcgtgcatggatttttg

SEQ ID NO: 140481 - DNA, 25 bp, Mus musculus
agaactgatctccatacgtgcctga

SEQ ID NO: 140482 - DNA, 25 bp, Mus musculus
agaactgatctcgatacgtgcctga

SEQ ID NO: 140483 - DNA, 25 bp, Mus musculus
agaactgatctgacttccgtgtctc

SEQ ID NO: 140484 - DNA, 25 bp, Mus musculus
agaactgatctgtcttccgtgtctc

SEQ ID NO: 140485 - DNA, 25 bp, Mus musculus
agaactgatgcgctggaattaaaat

SEQ ID NO: 140486 - DNA, 25 bp, Mus musculus
agaactgatgcggtggaattaaaat

SEQ ID NO: 140487 - DNA, 25 bp, Mus musculus
agaactgattgccatggtgaaacca

SEQ ID NO: 140488 - DNA, 25 bp, Mus musculus
agaactgattgcgatggtgaaacca

SEQ ID NO: 140489 - DNA, 25 bp, Mus musculus
agaactgattggctttggctctggt

SEQ ID NO: 140490 - DNA, 25 bp, Mus musculus
agaactgattgggtttggctctggt

SEQ ID NO: 140491 - DNA, 25 bp, Mus musculus
agaactgcaaggcatccctcggtat

SEQ ID NO: 140492 - DNA, 25 bp, Mus musculus
agaactgcaagggatccctcggtat

SEQ ID NO: 140493 - DNA, 25 bp, Mus musculus
agaactgcaattcccaacattccag

SEQ ID NO: 140494 - DNA, 25 bp, Mus musculus
agaactgcaattgccaacattccag

SEQ ID NO: 140495 - DNA, 25 bp, Mus musculus
agaactgcacctacagtgtggtgga

SEQ ID NO: 140496 - DNA, 25 bp, Mus musculus
agaactgcaccttcagtgtggtgga

SEQ ID NO: 140497 - DNA, 25 bp, Mus musculus
agaactgcacgccatgtcagagaaa

SEQ ID NO: 140498 - DNA, 25 bp, Mus musculus
agaactgcacgcgatgtcagagaaa

SEQ ID NO: 140499 - DNA, 25 bp, Mus musculus
agaactgcactgatgcccttggaaa

SEQ ID NO: 140500 - DNA, 25 bp, Mus musculus
agaactgcactgcactatgcttgtg

SEQ ID NO: 140501 - DNA, 25 bp, Mus musculus
agaactgcactggactatgcttgtg

SEQ ID NO: 140502 - DNA, 25 bp, Mus musculus
agaactgcactgttgcccttggaaa

SEQ ID NO: 140503 - DNA, 25 bp, Mus musculus
agaactgcagaacatgccgtcttca

SEQ ID NO: 140504 - DNA, 25 bp, Mus musculus
agaactgcagaagatgccgtcttca

SEQ ID NO: 140505 - DNA, 25 bp, Mus musculus
agaactgcagcaatggccccaatgt

SEQ ID NO: 140506 - DNA, 25 bp, Mus musculus
agaactgcagcattggccccaatgt

SEQ ID NO: 140507 - DNA, 25 bp, Mus musculus
agaactgcagtcagcctgaagcctg

SEQ ID NO: 140508 - DNA, 25 bp, Mus musculus
agaactgcagtctgcctgaagcctg

SEQ ID NO: 140509 - DNA, 25 bp, Mus musculus
agaactgcatccactgggctggcca

SEQ ID NO: 140510 - DNA, 25 bp, Mus musculus
agaactgcatcctctgggctggcca

SEQ ID NO: 140511 - DNA, 25 bp, Mus musculus
agaactgcattcattggacgtgtga

SEQ ID NO: 140512 - DNA, 25 bp, Mus musculus
agaactgcattctttggacgtgtga

SEQ ID NO: 140513 - DNA, 25 bp, Mus musculus
agaactgccaatacctcgttcctgg

SEQ ID NO: 140514 - DNA, 25 bp, Mus musculus
agaactgccaattcctcgttcctgg

SEQ ID NO: 140515 - DNA, 25 bp, Mus musculus
agaactgccagcagcactgtagctg

SEQ ID NO: 140516 - DNA, 25 bp, Mus musculus
agaactgccagctgcactgtagctg

SEQ ID NO: 140517 - DNA, 25 bp, Mus musculus
agaactgccttcaattccaggccag

SEQ ID NO: 140518 - DNA, 25 bp, Mus musculus
agaactgccttctattccaggccag

SEQ ID NO: 140519 - DNA, 25 bp, Mus musculus
agaactgcgcagcaactcactggat

SEQ ID NO: 140520 - DNA, 25 bp, Mus musculus
agaactgcgcaggaactcactggat

SEQ ID NO: 140521 - DNA, 25 bp, Mus musculus
agaactgcggttctgcaggctccta

SEQ ID NO: 140522 - DNA, 25 bp, Mus musculus
agaactgcggttgtgcaggctccta

SEQ ID NO: 140523 - DNA, 25 bp, Mus musculus
agaactgcgttcattcatgcatgac

SEQ ID NO: 140524 - DNA, 25 bp, Mus musculus
agaactgcgttctttcatgcatgac

SEQ ID NO: 140525 - DNA, 25 bp, Mus musculus
agaactgctataagatccctccgtt

SEQ ID NO: 140526 - DNA, 25 bp, Mus musculus
agaactgctatatgatccctccgtt

SEQ ID NO: 140527 - DNA, 25 bp, Mus musculus
agaactgctatgactgatcctcagc

SEQ ID NO: 140528 - DNA, 25 bp, Mus musculus
agaactgctatgtctgatcctcagc

SEQ ID NO: 140529 - DNA, 25 bp, Mus musculus
agaactgctcaacctatatctggaa

SEQ ID NO: 140530 - DNA, 25 bp, Mus musculus
agaactgctcaagctatatctggaa

SEQ ID NO: 140531 - DNA, 25 bp, Mus musculus
agaactgctcagagtttccattttc

SEQ ID NO: 140532 - DNA, 25 bp, Mus musculus
agaactgctcagtgtttccattttc

SEQ ID NO: 140533 - DNA, 25 bp, Mus musculus
agaactgctgagctctgctgtagtc

SEQ ID NO: 140534 - DNA, 25 bp, Mus musculus
agaactgctgaggtctgctgtagtc

SEQ ID NO: 140535 - DNA, 25 bp, Mus musculus
agaactgctgtcctggctgctgagt

SEQ ID NO: 140536 - DNA, 25 bp, Mus musculus
agaactgctgtcgtggctgctgagt

SEQ ID NO: 140537 - DNA, 25 bp, Mus musculus
agaactgctgttcgctctgttgtga

SEQ ID NO: 140538 - DNA, 25 bp, Mus musculus
agaactgctgttggctctgttgtga

SEQ ID NO: 140539 - DNA, 25 bp, Mus musculus
agaactgcttacacgtggtgctggg

SEQ ID NO: 140540 - DNA, 25 bp, Mus musculus
agaactgcttactcgtggtgctggg

SEQ ID NO: 140541 - DNA, 25 bp, Mus musculus
agaactgcttgcatatccatggtct

SEQ ID NO: 140542 - DNA, 25 bp, Mus musculus
agaactgcttgcttatccatggtct

SEQ ID NO: 140543 - DNA, 25 bp, Mus musculus
agaactggaaccctggcactttctt

SEQ ID NO: 140544 - DNA, 25 bp, Mus musculus
agaactggaaccgtggcactttctt

SEQ ID NO: 140545 - DNA, 25 bp, Mus musculus
agaactggaccacccagtccaggag

SEQ ID NO: 140546 - DNA, 25 bp, Mus musculus
agaactggaccagccagtccaggag

SEQ ID NO: 140547 - DNA, 25 bp, Mus musculus
agaactggacttcttttgatctcca

SEQ ID NO: 140548 - DNA, 25 bp, Mus musculus
agaactggacttgttttgatctcca

SEQ ID NO: 140549 - DNA, 25 bp, Mus musculus
agaactggagtcatgctgctgtaaa

SEQ ID NO: 140550 - DNA, 25 bp, Mus musculus
agaactggagtcttgctgctgtaaa

SEQ ID NO: 140551 - DNA, 25 bp, Mus musculus
agaactggagttcgccacttggttg

SEQ ID NO: 140552 - DNA, 25 bp, Mus musculus
agaactggagttggccacttggttg

SEQ ID NO: 140553 - DNA, 25 bp, Mus musculus
agaactggcaggacacattagagaa

SEQ ID NO: 140554 - DNA, 25 bp, Mus musculus
agaactggcaggtcacattagagaa

SEQ ID NO: 140555 - DNA, 25 bp, Mus musculus
agaactggccagatagcacaacctg

SEQ ID NO: 140556 - DNA, 25 bp, Mus musculus
agaactggccagttagcacaacctg

SEQ ID NO: 140557 - DNA, 25 bp, Mus musculus
agaactggccccagtgcagattaag

SEQ ID NO: 140558 - DNA, 25 bp, Mus musculus
agaactggcccctgtgcagattaag

SEQ ID NO: 140559 - DNA, 25 bp, Mus musculus
agaactggcggtactgcctcaacca

SEQ ID NO: 140560 - DNA, 25 bp, Mus musculus
agaactggcggttctgcctcaacca

SEQ ID NO: 140561 - DNA, 25 bp, Mus musculus
agaactggctaaccggctccaaggg

SEQ ID NO: 140562 - DNA, 25 bp, Mus musculus
agaactggctaagcggctccaaggg

SEQ ID NO: 140563 - DNA, 25 bp, Mus musculus
agaactggctgcagtaacacaggca

SEQ ID NO: 140564 - DNA, 25 bp, Mus musculus
agaactggctgctgtaacacaggca

SEQ ID NO: 140565 - DNA, 25 bp, Mus musculus
agaactgggactattgattgcaatt

SEQ ID NO: 140566 - DNA, 25 bp, Mus musculus
agaactgggacttttgattgcaatt

SEQ ID NO: 140567 - DNA, 25 bp, Mus musculus
agaactgggctacgagcatcgagct

SEQ ID NO: 140568 - DNA, 25 bp, Mus musculus
agaactgggctaggagcatcgagct

SEQ ID NO: 140569 - DNA, 25 bp, Mus musculus
agaactgggtcaatgtagctgtcca

SEQ ID NO: 140570 - DNA, 25 bp, Mus musculus
agaactgggtcattgtagctgtcca

SEQ ID NO: 140571 - DNA, 25 bp, Mus musculus
agaactgggttgagtgccacttacc

SEQ ID NO: 140572 - DNA, 25 bp, Mus musculus
agaactgggttgtgtgccacttacc

SEQ ID NO: 140573 - DNA, 25 bp, Mus musculus
agaactggtctgataaggcatggca

SEQ ID NO: 140574 - DNA, 25 bp, Mus musculus
agaactggtctgttaaggcatggca

SEQ ID NO: 140575 - DNA, 25 bp, Mus musculus
agaactggtgacatctcaggctgtt

SEQ ID NO: 140576 - DNA, 25 bp, Mus musculus
agaactggtgacttctcaggctgtt

SEQ ID NO: 140577 - DNA, 25 bp, Mus musculus
agaactggtgcgagctggcactcac

SEQ ID NO: 140578 - DNA, 25 bp, Mus musculus
agaactggtgcgtgctggcactcac

SEQ ID NO: 140579 - DNA, 25 bp, Mus musculus
agaactggttgcctcccaggagaaa

SEQ ID NO: 140580 - DNA, 25 bp, Mus musculus
agaactggttgcgtcccaggagaaa

SEQ ID NO: 140581 - DNA, 25 bp, Mus musculus
agaactgtactgctctccaatgtgc

SEQ ID NO: 140582 - DNA, 25 bp, Mus musculus
agaactgtactggtctccaatgtgc

SEQ ID NO: 140583 - DNA, 25 bp, Mus musculus
agaactgtataacccacactttttg

SEQ ID NO: 140584 - DNA, 25 bp, Mus musculus
agaactgtataagccacactttttg

SEQ ID NO: 140585 - DNA, 25 bp, Mus musculus
agaactgtcactcggcagactcaac

SEQ ID NO: 140586 - DNA, 25 bp, Mus musculus
agaactgtcactgggcagactcaac

SEQ ID NO: 140587 - DNA, 25 bp, Mus musculus
agaactgtcagtcatcgccaacttc

SEQ ID NO: 140588 - DNA, 25 bp, Mus musculus
agaactgtcagtgatcgccaacttc

SEQ ID NO: 140589 - DNA, 25 bp, Mus musculus
agaactgtccaacccagactgtcat

SEQ ID NO: 140590 - DNA, 25 bp, Mus musculus
agaactgtccaagccagactgtcat

SEQ ID NO: 140591 - DNA, 25 bp, Mus musculus
agaactgtcgaaactccttagcaag

SEQ ID NO: 140592 - DNA, 25 bp, Mus musculus
agaactgtcgaatctccttagcaag

SEQ ID NO: 140593 - DNA, 25 bp, Mus musculus
agaactgtctagcatgggcttctcc

SEQ ID NO: 140594 - DNA, 25 bp, Mus musculus
agaactgtctaggatgggcttctcc

SEQ ID NO: 140595 - DNA, 25 bp, Mus musculus
agaactgtctttccattccgcagga

SEQ ID NO: 140596 - DNA, 25 bp, Mus musculus
agaactgtctttgcattccgcagga

SEQ ID NO: 140597 - DNA, 25 bp, Mus musculus
agaactgtgcttcggacctgactca

SEQ ID NO: 140598 - DNA, 25 bp, Mus musculus
agaactgtgcttgggacctgactca

SEQ ID NO: 140599 - DNA, 25 bp, Mus musculus
agaactgtggatcattgccctcaac

SEQ ID NO: 140600 - DNA, 25 bp, Mus musculus
agaactgtggatgattgccctcaac

SEQ ID NO: 140601 - DNA, 25 bp, Mus musculus
agaactgtggctacccgggcatcac

SEQ ID NO: 140602 - DNA, 25 bp, Mus musculus
agaactgtggctcccaaatcaccac

SEQ ID NO: 140603 - DNA, 25 bp, Mus musculus
agaactgtggctctgactctgtatg

SEQ ID NO: 140604 - DNA, 25 bp, Mus musculus
agaactgtggctgccaaatcaccac

SEQ ID NO: 140605 - DNA, 25 bp, Mus musculus
agaactgtggctgtgactctgtatg

SEQ ID NO: 140606 - DNA, 25 bp, Mus musculus
agaactgtggcttcccgggcatcac

SEQ ID NO: 140607 - DNA, 25 bp, Mus musculus
agaactgtgggacgccttctggact

SEQ ID NO: 140608 - DNA, 25 bp, Mus musculus
agaactgtgggaggccttctggact

SEQ ID NO: 140609 - DNA, 25 bp, Mus musculus
agaactgtgtctatcttctcagtgt

SEQ ID NO: 140610 - DNA, 25 bp, Mus musculus
agaactgtgtctttcttctcagtgt

SEQ ID NO: 140611 - DNA, 25 bp, Mus musculus
agaactgtgtttccagcgctgtgtg

SEQ ID NO: 140612 - DNA, 25 bp, Mus musculus
agaactgtgtttgcagcgctgtgtg

SEQ ID NO: 140613 - DNA, 25 bp, Mus musculus
agaactgttccaagtcagctgatat

SEQ ID NO: 140614 - DNA, 25 bp, Mus musculus
agaactgttccatgtcagctgatat

SEQ ID NO: 140615 - DNA, 25 bp, Mus musculus
agaactgttctcacatccaaagggc

SEQ ID NO: 140616 - DNA, 25 bp, Mus musculus
agaactgttctctcatccaaagggc

SEQ ID NO: 140617 - DNA, 25 bp, Mus musculus
agaactgttctgactagttagccaa

SEQ ID NO: 140618 - DNA, 25 bp, Mus musculus
agaactgttctgtctagttagccaa

SEQ ID NO: 140619 - DNA, 25 bp, Mus musculus
agaactgttgccacattagcactgt

SEQ ID NO: 140620 - DNA, 25 bp, Mus musculus
agaactgttgcctcattagcactgt

SEQ ID NO: 140621 - DNA, 25 bp, Mus musculus
agaactgttggtatctgacctgtga

SEQ ID NO: 140622 - DNA, 25 bp, Mus musculus
agaactgttggtttctgacctgtga

SEQ ID NO: 140623 - DNA, 25 bp, Mus musculus
agaactgttgtgcaccaaccctcaa

SEQ ID NO: 140624 - DNA, 25 bp, Mus musculus
agaactgttgtggaccaaccctcaa

SEQ ID NO: 140625 - DNA, 25 bp, Mus musculus
agaactgtttcaacttgcaaccaga

SEQ ID NO: 140626 - DNA, 25 bp, Mus musculus
agaactgtttcatcttgcaaccaga

SEQ ID NO: 140627 - DNA, 25 bp, Mus musculus
agaactgtttcgactacgcttcaga

SEQ ID NO: 140628 - DNA, 25 bp, Mus musculus
agaactgtttcgagctgggaaccct

SEQ ID NO: 140629 - DNA, 25 bp, Mus musculus
agaactgtttcgtctacgcttcaga

SEQ ID NO: 140630 - DNA, 25 bp, Mus musculus
agaactgtttcgtgctgggaaccct

SEQ ID NO: 140631 - DNA, 25 bp, Mus musculus
agaactgtttctcatggcataaaag

SEQ ID NO: 140632 - DNA, 25 bp, Mus musculus
agaactgtttctgatggcataaaag

SEQ ID NO: 140633 - DNA, 25 bp, Mus musculus
agaacttacaccagcagttgctggc

SEQ ID NO: 140634 - DNA, 25 bp, Mus musculus
agaacttacacctgcagttgctggc

SEQ ID NO: 140635 - DNA, 25 bp, Mus musculus
agaacttacactagagctggcactg

SEQ ID NO: 140636 - DNA, 25 bp, Mus musculus
agaacttacacttgagctggcactg

SEQ ID NO: 140637 - DNA, 25 bp, Mus musculus
agaacttacaggacagggtctccac

SEQ ID NO: 140638 - DNA, 25 bp, Mus musculus
agaacttacaggtcagggtctccac

SEQ ID NO: 140639 - DNA, 25 bp, Mus musculus
agaacttaccacagcctgacaccat

SEQ ID NO: 140640 - DNA, 25 bp, Mus musculus
agaacttaccactgcctgacaccat

SEQ ID NO: 140641 - DNA, 25 bp, Mus musculus
agaacttactcacctgcactcttaa

SEQ ID NO: 140642 - DNA, 25 bp, Mus musculus
agaacttactcagctgcactcttaa

SEQ ID NO: 140643 - DNA, 25 bp, Mus musculus
agaacttactgccactctactatca

SEQ ID NO: 140644 - DNA, 25 bp, Mus musculus
agaacttactgcgactctactatca

SEQ ID NO: 140645 - DNA, 25 bp, Mus musculus
agaacttagaaaactttacaccatg

SEQ ID NO: 140646 - DNA, 25 bp, Mus musculus
agaacttagaaatctttacaccatg

SEQ ID NO: 140647 - DNA, 25 bp, Mus musculus
agaacttagattctggtccccagtg

SEQ ID NO: 140648 - DNA, 25 bp, Mus musculus
agaacttagattgtggtccccagtg

SEQ ID NO: 140649 - DNA, 25 bp, Mus musculus
agaacttagcatactgggcccatgt

SEQ ID NO: 140650 - DNA, 25 bp, Mus musculus
agaacttagcattctgggcccatgt

SEQ ID NO: 140651 - DNA, 25 bp, Mus musculus
agaacttatcccagagaggctgctg

SEQ ID NO: 140652 - DNA, 25 bp, Mus musculus
agaacttatccctgagaggctgctg

SEQ ID NO: 140653 - DNA, 25 bp, Mus musculus
agaacttattctacggttcatcagt

SEQ ID NO: 140654 - DNA, 25 bp, Mus musculus
agaacttattcttcggttcatcagt

SEQ ID NO: 140655 - DNA, 25 bp, Mus musculus
agaacttcaaatcccaaccgtcagc

SEQ ID NO: 140656 - DNA, 25 bp, Mus musculus
agaacttcaaatgccaaccgtcagc

SEQ ID NO: 140657 - DNA, 25 bp, Mus musculus
agaacttcaacccaatgctgccagc

SEQ ID NO: 140658 - DNA, 25 bp, Mus musculus
agaacttcaaccgaatgctgccagc

SEQ ID NO: 140659 - DNA, 25 bp, Mus musculus
agaacttcaaggaaatcccagaaat

SEQ ID NO: 140660 - DNA, 25 bp, Mus musculus
agaacttcaaggtaatcccagaaat

SEQ ID NO: 140661 - DNA, 25 bp, Mus musculus
agaacttcaagtacatggtccccac

SEQ ID NO: 140662 - DNA, 25 bp, Mus musculus
agaacttcaagttcatggtccccac

SEQ ID NO: 140663 - DNA, 25 bp, Mus musculus
agaacttcaatcactgtagtctaag

SEQ ID NO: 140664 - DNA, 25 bp, Mus musculus
agaacttcaatctctgtagtctaag

SEQ ID NO: 140665 - DNA, 25 bp, Mus musculus
agaacttcacctatgcgggcatcga

SEQ ID NO: 140666 - DNA, 25 bp, Mus musculus
agaacttcacctttgcgggcatcga

SEQ ID NO: 140667 - DNA, 25 bp, Mus musculus
agaacttcactgcacactcatgctt

SEQ ID NO: 140668 - DNA, 25 bp, Mus musculus
agaacttcactggacactcatgctt

SEQ ID NO: 140669 - DNA, 25 bp, Mus musculus
agaacttcagacaaccatttcctct

SEQ ID NO: 140670 - DNA, 25 bp, Mus musculus
agaacttcagactaccatttcctct

SEQ ID NO: 140671 - DNA, 25 bp, Mus musculus
agaacttcagcaatgttgtaggagc

SEQ ID NO: 140672 - DNA, 25 bp, Mus musculus
agaacttcagcattgttgtaggagc

SEQ ID NO: 140673 - DNA, 25 bp, Mus musculus
agaacttcagctactggcggtccaa

SEQ ID NO: 140674 - DNA, 25 bp, Mus musculus
agaacttcagcttctggcggtccaa

SEQ ID NO: 140675 - DNA, 25 bp, Mus musculus
agaacttcaggtctctctttttcaa

SEQ ID NO: 140676 - DNA, 25 bp, Mus musculus
agaacttcaggtgtctctttttcaa

SEQ ID NO: 140677 - DNA, 25 bp, Mus musculus
agaacttcatccagaactatcccgt

SEQ ID NO: 140678 - DNA, 25 bp, Mus musculus
agaacttcatcctgaactatcccgt

SEQ ID NO: 140679 - DNA, 25 bp, Mus musculus
agaacttcatctagactgctcaggc

SEQ ID NO: 140680 - DNA, 25 bp, Mus musculus
agaacttcatcttgactgctcaggc

SEQ ID NO: 140681 - DNA, 25 bp, Mus musculus
agaacttccgaaatcatactccacc

SEQ ID NO: 140682 - DNA, 25 bp, Mus musculus
agaacttccgaattcatactccacc

SEQ ID NO: 140683 - DNA, 25 bp, Mus musculus
agaacttcctatcacgggccactga

SEQ ID NO: 140684 - DNA, 25 bp, Mus musculus
agaacttcctatgacgggccactga

SEQ ID NO: 140685 - DNA, 25 bp, Mus musculus
agaacttcctccagtttgacatgac

SEQ ID NO: 140686 - DNA, 25 bp, Mus musculus
agaacttcctcctgtttgacatgac

SEQ ID NO: 140687 - DNA, 25 bp, Mus musculus
agaacttcgttcaaccatggtgatc

SEQ ID NO: 140688 - DNA, 25 bp, Mus musculus
agaacttcgttctaccatggtgatc

SEQ ID NO: 140689 - DNA, 25 bp, Mus musculus
agaacttctccacccaactacagga

SEQ ID NO: 140690 - DNA, 25 bp, Mus musculus
agaacttctccagccaactacagga

SEQ ID NO: 140691 - DNA, 25 bp, Mus musculus
agaacttctgatacctggtgataac

SEQ ID NO: 140692 - DNA, 25 bp, Mus musculus
agaacttctgattcctggtgataac

SEQ ID NO: 140693 - DNA, 25 bp, Mus musculus
agaacttctgcacatgtacccagcc

SEQ ID NO: 140694 - DNA, 25 bp, Mus musculus
agaacttctgcacccaggttaacaa

SEQ ID NO: 140695 - DNA, 25 bp, Mus musculus
agaacttctgcagatgtacccagcc

SEQ ID NO: 140696 - DNA, 25 bp, Mus musculus
agaacttctgcagccaggttaacaa

SEQ ID NO: 140697 - DNA, 25 bp, Mus musculus
agaacttcttccagactttagcaac

SEQ ID NO: 140698 - DNA, 25 bp, Mus musculus
agaacttcttcctgactttagcaac

SEQ ID NO: 140699 - DNA, 25 bp, Mus musculus
agaacttcttggagctctggtctga

SEQ ID NO: 140700 - DNA, 25 bp, Mus musculus
agaacttcttggtgctctggtctga

SEQ ID NO: 140701 - DNA, 25 bp, Mus musculus
agaacttgacgacatcagctgtgaa

SEQ ID NO: 140702 - DNA, 25 bp, Mus musculus
agaacttgacgagatcagctgtgaa

SEQ ID NO: 140703 - DNA, 25 bp, Mus musculus
agaacttgactcagacgcactgcag

SEQ ID NO: 140704 - DNA, 25 bp, Mus musculus
agaacttgactctgacgcactgcag

SEQ ID NO: 140705 - DNA, 25 bp, Mus musculus
agaacttgatccctggtacctgcct

SEQ ID NO: 140706 - DNA, 25 bp, Mus musculus
agaacttgatccgtggtacctgcct

SEQ ID NO: 140707 - DNA, 25 bp, Mus musculus
agaacttgcacaaggagaggtgaga

SEQ ID NO: 140708 - DNA, 25 bp, Mus musculus
agaacttgcacaatcccaatgcttt

SEQ ID NO: 140709 - DNA, 25 bp, Mus musculus
agaacttgcacatggagaggtgaga

SEQ ID NO: 140710 - DNA, 25 bp, Mus musculus
agaacttgcacattcccaatgcttt

SEQ ID NO: 140711 - DNA, 25 bp, Mus musculus
agaacttgccacaccagactcagat

SEQ ID NO: 140712 - DNA, 25 bp, Mus musculus
agaacttgccactccagactcagat

SEQ ID NO: 140713 - DNA, 25 bp, Mus musculus
agaacttgccagcaactcctttgag

SEQ ID NO: 140714 - DNA, 25 bp, Mus musculus
agaacttgccaggaactcctttgag

SEQ ID NO: 140715 - DNA, 25 bp, Mus musculus
agaacttgccctccatccagattgt

SEQ ID NO: 140716 - DNA, 25 bp, Mus musculus
agaacttgccctgcatccagattgt

SEQ ID NO: 140717 - DNA, 25 bp, Mus musculus
agaacttgccgtctaagcatgagga

SEQ ID NO: 140718 - DNA, 25 bp, Mus musculus
agaacttgccgtgtaagcatgagga

SEQ ID NO: 140719 - DNA, 25 bp, Mus musculus
agaacttgcctaacaaccacggaat

SEQ ID NO: 140720 - DNA, 25 bp, Mus musculus
agaacttgcctatcaaccacggaat

SEQ ID NO: 140721 - DNA, 25 bp, Mus musculus
agaacttgctagctatctactccag

SEQ ID NO: 140722 - DNA, 25 bp, Mus musculus
agaacttgctaggtatctactccag

SEQ ID NO: 140723 - DNA, 25 bp, Mus musculus
agaacttgctcaatacccaggctat

SEQ ID NO: 140724 - DNA, 25 bp, Mus musculus
agaacttgctcacgctgcagagtct

SEQ ID NO: 140725 - DNA, 25 bp, Mus musculus
agaacttgctcaggctgcagagtct

SEQ ID NO: 140726 - DNA, 25 bp, Mus musculus
agaacttgctcattacccaggctat

SEQ ID NO: 140727 - DNA, 25 bp, Mus musculus
agaacttgctgcctagccagtaagg

SEQ ID NO: 140728 - DNA, 25 bp, Mus musculus
agaacttgctgcgtagccagtaagg

SEQ ID NO: 140729 - DNA, 25 bp, Mus musculus
agaacttgctttaattcccgtgaca

SEQ ID NO: 140730 - DNA, 25 bp, Mus musculus
agaacttgcttttattcccgtgaca

SEQ ID NO: 140731 - DNA, 25 bp, Mus musculus
agaacttggccaccacaaagaactt

SEQ ID NO: 140732 - DNA, 25 bp, Mus musculus
agaacttggccagcacaaagaactt

SEQ ID NO: 140733 - DNA, 25 bp, Mus musculus
agaacttggcgaacctggcgctgca

SEQ ID NO: 140734 - DNA, 25 bp, Mus musculus
agaacttggcgatcctggcgctgca

SEQ ID NO: 140735 - DNA, 25 bp, Mus musculus
agaacttggctgattatctttaaga

SEQ ID NO: 140736 - DNA, 25 bp, Mus musculus
agaacttggctgtttatctttaaga

SEQ ID NO: 140737 - DNA, 25 bp, Mus musculus
agaacttggtgtacactgtctaacc

SEQ ID NO: 140738 - DNA, 25 bp, Mus musculus
agaacttggtgttcactgtctaacc

SEQ ID NO: 140739 - DNA, 25 bp, Mus musculus
agaacttgtaagaaccatttgatta

SEQ ID NO: 140740 - DNA, 25 bp, Mus musculus
agaacttgtaagtaccatttgatta

SEQ ID NO: 140741 - DNA, 25 bp, Mus musculus
agaacttgtatcactcttccccacg

SEQ ID NO: 140742 - DNA, 25 bp, Mus musculus
agaacttgtatctctcttccccacg

SEQ ID NO: 140743 - DNA, 25 bp, Mus musculus
agaacttgtattctgtcatttcaga

SEQ ID NO: 140744 - DNA, 25 bp, Mus musculus
agaacttgtattgtgtcatttcaga

SEQ ID NO: 140745 - DNA, 25 bp, Mus musculus
agaacttgtcgacctatttccaatt

SEQ ID NO: 140746 - DNA, 25 bp, Mus musculus
agaacttgtcgagctatttccaatt

SEQ ID NO: 140747 - DNA, 25 bp, Mus musculus
agaacttgttgaagtggccgcacct

SEQ ID NO: 140748 - DNA, 25 bp, Mus musculus
agaacttgttgatgtggccgcacct

SEQ ID NO: 140749 - DNA, 25 bp, Mus musculus
agaactttcaaacacccatgtatgt

SEQ ID NO: 140750 - DNA, 25 bp, Mus musculus
agaactttcaaagacccatgtatgt

SEQ ID NO: 140751 - DNA, 25 bp, Mus musculus
agaactttcataaaccttttgtagt

SEQ ID NO: 140752 - DNA, 25 bp, Mus musculus
agaactttcatataccttttgtagt

SEQ ID NO: 140753 - DNA, 25 bp, Mus musculus
agaactttccaaactgtactagcag

SEQ ID NO: 140754 - DNA, 25 bp, Mus musculus
agaactttccaatctgtactagcag

SEQ ID NO: 140755 - DNA, 25 bp, Mus musculus
agaactttccacacttacgctgaag

SEQ ID NO: 140756 - DNA, 25 bp, Mus musculus
agaactttccacatagtttaagtag

SEQ ID NO: 140757 - DNA, 25 bp, Mus musculus
agaactttccactcttacgctgaag

SEQ ID NO: 140758 - DNA, 25 bp, Mus musculus
agaactttccacttagtttaagtag

SEQ ID NO: 140759 - DNA, 25 bp, Mus musculus
agaactttccatagttggatctaga

SEQ ID NO: 140760 - DNA, 25 bp, Mus musculus
agaactttccattgttggatctaga

SEQ ID NO: 140761 - DNA, 25 bp, Mus musculus
agaactttcccgaatttgctgctgt

SEQ ID NO: 140762 - DNA, 25 bp, Mus musculus
agaactttcccgtatttgctgctgt

SEQ ID NO: 140763 - DNA, 25 bp, Mus musculus
agaactttctccaattactgggtga

SEQ ID NO: 140764 - DNA, 25 bp, Mus musculus
agaactttctccacgggatccaaga

SEQ ID NO: 140765 - DNA, 25 bp, Mus musculus
agaactttctcctattactgggtga

SEQ ID NO: 140766 - DNA, 25 bp, Mus musculus
agaactttctcctcgggatccaaga

SEQ ID NO: 140767 - DNA, 25 bp, Mus musculus
agaactttctgcaggcccacaacgg

SEQ ID NO: 140768 - DNA, 25 bp, Mus musculus
agaactttctgctggcccacaacgg

SEQ ID NO: 140769 - DNA, 25 bp, Mus musculus
agaactttgaatcctatgcctccac

SEQ ID NO: 140770 - DNA, 25 bp, Mus musculus
agaactttgaatgctatgcctccac

SEQ ID NO: 140771 - DNA, 25 bp, Mus musculus
agaactttgccaaatactttctcca

SEQ ID NO: 140772 - DNA, 25 bp, Mus musculus
agaactttgccatatactttctcca

SEQ ID NO: 140773 - DNA, 25 bp, Mus musculus
agaactttgctgaacatgtccttaa

SEQ ID NO: 140774 - DNA, 25 bp, Mus musculus
agaactttgctgaaccaactctgcc

SEQ ID NO: 140775 - DNA, 25 bp, Mus musculus
agaactttgctgacgatctcactac

SEQ ID NO: 140776 - DNA, 25 bp, Mus musculus
agaactttgctgtacatgtccttaa

SEQ ID NO: 140777 - DNA, 25 bp, Mus musculus
agaactttgctgtaccaactctgcc

SEQ ID NO: 140778 - DNA, 25 bp, Mus musculus
agaactttgctgtcgatctcactac

SEQ ID NO: 140779 - DNA, 25 bp, Mus musculus
agaactttgcttcgcatcccagccg

SEQ ID NO: 140780 - DNA, 25 bp, Mus musculus
agaactttgcttggcatcccagccg

SEQ ID NO: 140781 - DNA, 25 bp, Mus musculus
agaactttggcacgtctgagcagca

SEQ ID NO: 140782 - DNA, 25 bp, Mus musculus
agaactttggcaggtctgagcagca

SEQ ID NO: 140783 - DNA, 25 bp, Mus musculus
agaactttgtatcgtcccaactcct

SEQ ID NO: 140784 - DNA, 25 bp, Mus musculus
agaactttgtatggtcccaactcct

SEQ ID NO: 140785 - DNA, 25 bp, Mus musculus
agaactttgtgtcagacctgcccag

SEQ ID NO: 140786 - DNA, 25 bp, Mus musculus
agaactttgtgtgagacctgcccag

SEQ ID NO: 140787 - DNA, 25 bp, Mus musculus
agaactttgtttcacacaattaagg

SEQ ID NO: 140788 - DNA, 25 bp, Mus musculus
agaactttgtttgacacaattaagg

SEQ ID NO: 140789 - DNA, 25 bp, Mus musculus
agaacttttcagacatctgcttatt

SEQ ID NO: 140790 - DNA, 25 bp, Mus musculus
agaacttttcagtcatctgcttatt

SEQ ID NO: 140791 - DNA, 25 bp, Mus musculus
agaacttttgagcagaagaaatcgg

SEQ ID NO: 140792 - DNA, 25 bp, Mus musculus
agaacttttgaggagaagaaatcgg

SEQ ID NO: 140793 - DNA, 25 bp, Mus musculus
agaacttttggacggccatttgcca

SEQ ID NO: 140794 - DNA, 25 bp, Mus musculus
agaacttttggagggccatttgcca

SEQ ID NO: 140795 - DNA, 25 bp, Mus musculus
agaactttttccattgattgcaatt

SEQ ID NO: 140796 - DNA, 25 bp, Mus musculus
agaactttttcctttgattgcaatt

SEQ ID NO: 140797 - DNA, 25 bp, Mus musculus
agaagaaaaaggctctgtcctccat

SEQ ID NO: 140798 - DNA, 25 bp, Mus musculus
agaagaaaaagggtctgtcctccat

SEQ ID NO: 140799 - DNA, 25 bp, Mus musculus
agaagaaaaccaacctgcaccacag

SEQ ID NO: 140800 - DNA, 25 bp, Mus musculus
agaagaaaaccatcctgcaccacag

SEQ ID NO: 140801 - DNA, 25 bp, Mus musculus
agaagaaaatatccagccgggtggt

SEQ ID NO: 140802 - DNA, 25 bp, Mus musculus
agaagaaaatatgcagccgggtggt

SEQ ID NO: 140803 - DNA, 25 bp, Mus musculus
agaagaaacgctccatgccaaggct

SEQ ID NO: 140804 - DNA, 25 bp, Mus musculus
agaagaaacgctgcatgccaaggct

SEQ ID NO: 140805 - DNA, 25 bp, Mus musculus
agaagaaacggcaatcgctcaagca

SEQ ID NO: 140806 - DNA, 25 bp, Mus musculus
agaagaaacggctatcgctcaagca

SEQ ID NO: 140807 - DNA, 25 bp, Mus musculus
agaagaaactcaaggccgctaggga

SEQ ID NO: 140808 - DNA, 25 bp, Mus musculus
agaagaaactcatggccgctaggga

SEQ ID NO: 140809 - DNA, 25 bp, Mus musculus
agaagaaactgtcacgccgtctgct

SEQ ID NO: 140810 - DNA, 25 bp, Mus musculus
agaagaaactgtgacgccgtctgct

SEQ ID NO: 140811 - DNA, 25 bp, Mus musculus
agaagaaagcctatgccacctgtgc

SEQ ID NO: 140812 - DNA, 25 bp, Mus musculus
agaagaaagcctttgccacctgtgc

SEQ ID NO: 140813 - DNA, 25 bp, Mus musculus
agaagaaagctgagtttaggtgtca

SEQ ID NO: 140814 - DNA, 25 bp, Mus musculus
agaagaaagctgtgtttaggtgtca

SEQ ID NO: 140815 - DNA, 25 bp, Mus musculus
agaagaaataccaggccgcagcctt

SEQ ID NO: 140816 - DNA, 25 bp, Mus musculus
agaagaaatacctggccgcagcctt

SEQ ID NO: 140817 - DNA, 25 bp, Mus musculus
agaagaaatcccatctatgcctcct

SEQ ID NO: 140818 - DNA, 25 bp, Mus musculus
agaagaaatcccttctatgcctcct

SEQ ID NO: 140819 - DNA, 25 bp, Mus musculus
agaagaaatgatcgtcactgtggtt

SEQ ID NO: 140820 - DNA, 25 bp, Mus musculus
agaagaaatgatggtcactgtggtt

SEQ ID NO: 140821 - DNA, 25 bp, Mus musculus
agaagaaatggaaggctttctacaa

SEQ ID NO: 140822 - DNA, 25 bp, Mus musculus
agaagaaatggatggctttctacaa

SEQ ID NO: 140823 - DNA, 25 bp, Mus musculus
agaagaaatggtactcacaagagag

SEQ ID NO: 140824 - DNA, 25 bp, Mus musculus
agaagaaatggttctcacaagagag

SEQ ID NO: 140825 - DNA, 25 bp, Mus musculus
agaagaacaaagaaggccaccagga

SEQ ID NO: 140826 - DNA, 25 bp, Mus musculus
agaagaacaaagtaggccaccagga

SEQ ID NO: 140827 - DNA, 25 bp, Mus musculus
agaagaacactgcagtcactagcct

SEQ ID NO: 140828 - DNA, 25 bp, Mus musculus
agaagaacactggagtcactagcct

SEQ ID NO: 140829 - DNA, 25 bp, Mus musculus
agaagaacacttcttgtcccagctc

SEQ ID NO: 140830 - DNA, 25 bp, Mus musculus
agaagaacacttgttgtcccagctc

SEQ ID NO: 140831 - DNA, 25 bp, Mus musculus
agaagaacagccacaggactgcgct

SEQ ID NO: 140832 - DNA, 25 bp, Mus musculus
agaagaacagcctcaggactgcgct

SEQ ID NO: 140833 - DNA, 25 bp, Mus musculus
agaagaacatccagagctcggccga

SEQ ID NO: 140834 - DNA, 25 bp, Mus musculus
agaagaacatcctgagctcggccga

SEQ ID NO: 140835 - DNA, 25 bp, Mus musculus
agaagaacatgtagaatccagattc

SEQ ID NO: 140836 - DNA, 25 bp, Mus musculus
agaagaacatgttgaatccagattc

SEQ ID NO: 140837 - DNA, 25 bp, Mus musculus
agaagaacattcagcatgacccctg

SEQ ID NO: 140838 - DNA, 25 bp, Mus musculus
agaagaacattctgcatgacccctg

SEQ ID NO: 140839 - DNA, 25 bp, Mus musculus
agaagaacattgaccacacgctgtg

SEQ ID NO: 140840 - DNA, 25 bp, Mus musculus
agaagaacattgtccacacgctgtg

SEQ ID NO: 140841 - DNA, 25 bp, Mus musculus
agaagaacatttcaacacactgcta

SEQ ID NO: 140842 - DNA, 25 bp, Mus musculus
agaagaacatttgaacacactgcta

SEQ ID NO: 140843 - DNA, 25 bp, Mus musculus
agaagaaccaagctctatttttcaa

SEQ ID NO: 140844 - DNA, 25 bp, Mus musculus
agaagaaccaaggtctatttttcaa

SEQ ID NO: 140845 - DNA, 25 bp, Mus musculus
agaagaaccagacccattaactctt

SEQ ID NO: 140846 - DNA, 25 bp, Mus musculus
agaagaaccagagccattaactctt

SEQ ID NO: 140847 - DNA, 25 bp, Mus musculus
agaagaaccatgatgcttccttctc

SEQ ID NO: 140848 - DNA, 25 bp, Mus musculus
agaagaaccatgttgcttccttctc

SEQ ID NO: 140849 - DNA, 25 bp, Mus musculus
agaagaacccataaaatagcacaag

SEQ ID NO: 140850 - DNA, 25 bp, Mus musculus
agaagaacccattaaatagcacaag

SEQ ID NO: 140851 - DNA, 25 bp, Mus musculus
agaagaacccctagaagccatcaga

SEQ ID NO: 140852 - DNA, 25 bp, Mus musculus
agaagaaccccttgaagccatcaga

SEQ ID NO: 140853 - DNA, 25 bp, Mus musculus
agaagaaccctcacaccacacacat

SEQ ID NO: 140854 - DNA, 25 bp, Mus musculus
agaagaaccctccaacagccagctg

SEQ ID NO: 140855 - DNA, 25 bp, Mus musculus
agaagaaccctcgaacagccagctg

SEQ ID NO: 140856 - DNA, 25 bp, Mus musculus
agaagaaccctctcaccacacacat

SEQ ID NO: 140857 - DNA, 25 bp, Mus musculus
agaagaaccgacagacttacgccac

SEQ ID NO: 140858 - DNA, 25 bp, Mus musculus
agaagaaccgactgacttacgccac

SEQ ID NO: 140859 - DNA, 25 bp, Mus musculus
agaagaacctgccagggctggccac

SEQ ID NO: 140860 - DNA, 25 bp, Mus musculus
agaagaacctgcgagggctggccac

SEQ ID NO: 140861 - DNA, 25 bp, Mus musculus
agaagaaccttcacatgtccttggc

SEQ ID NO: 140862 - DNA, 25 bp, Mus musculus
agaagaaccttctcatgtccttggc

SEQ ID NO: 140863 - DNA, 25 bp, Mus musculus
agaagaacgccaactatcggcacta

SEQ ID NO: 140864 - DNA, 25 bp, Mus musculus
agaagaacgccaatcactcagctgt

SEQ ID NO: 140865 - DNA, 25 bp, Mus musculus
agaagaacgccatctatcggcacta

SEQ ID NO: 140866 - DNA, 25 bp, Mus musculus
agaagaacgccattcactcagctgt

SEQ ID NO: 140867 - DNA, 25 bp, Mus musculus
agaagaacgctccatattcacactc

SEQ ID NO: 140868 - DNA, 25 bp, Mus musculus
agaagaacgctcgatattcacactc

SEQ ID NO: 140869 - DNA, 25 bp, Mus musculus
agaagaactcacacttatggcaaga

SEQ ID NO: 140870 - DNA, 25 bp, Mus musculus
agaagaactcactcttatggcaaga

SEQ ID NO: 140871 - DNA, 25 bp, Mus musculus
agaagaactgctcgcgacgttccca

SEQ ID NO: 140872 - DNA, 25 bp, Mus musculus
agaagaactgctggcgacgttccca

SEQ ID NO: 140873 - DNA, 25 bp, Mus musculus
agaagaacttaaagcggctgcagga

SEQ ID NO: 140874 - DNA, 25 bp, Mus musculus
agaagaacttaatgcggctgcagga

SEQ ID NO: 140875 - DNA, 25 bp, Mus musculus
agaagaacttgtagtcccctgtcac

SEQ ID NO: 140876 - DNA, 25 bp, Mus musculus
agaagaacttgttgtcccctgtcac

SEQ ID NO: 140877 - DNA, 25 bp, Mus musculus
agaagaactttaaggcttttgccag

SEQ ID NO: 140878 - DNA, 25 bp, Mus musculus
agaagaactttatggcttttgccag

SEQ ID NO: 140879 - DNA, 25 bp, Mus musculus
agaagaagacaacctgagtgttcag

SEQ ID NO: 140880 - DNA, 25 bp, Mus musculus
agaagaagacaagctgagtgttcag

SEQ ID NO: 140881 - DNA, 25 bp, Mus musculus
agaagaagacctaagagcccagtgt

SEQ ID NO: 140882 - DNA, 25 bp, Mus musculus
agaagaagaccttagagcccagtgt

SEQ ID NO: 140883 - DNA, 25 bp, Mus musculus
agaagaagatcccagcgcttagcca

SEQ ID NO: 140884 - DNA, 25 bp, Mus musculus
agaagaagatccgagcgcttagcca

SEQ ID NO: 140885 - DNA, 25 bp, Mus musculus
agaagaagatcgacgctgcctttga

SEQ ID NO: 140886 - DNA, 25 bp, Mus musculus
agaagaagatcgtcgctgcctttga

SEQ ID NO: 140887 - DNA, 25 bp, Mus musculus
agaagaagcaatcgcctcctgacaa

SEQ ID NO: 140888 - DNA, 25 bp, Mus musculus
agaagaagcaatggcctcctgacaa

SEQ ID NO: 140889 - DNA, 25 bp, Mus musculus
agaagaagcagcagaagcagcccgc

SEQ ID NO: 140890 - DNA, 25 bp, Mus musculus
agaagaagcagctgaagcagcccgc

SEQ ID NO: 140891 - DNA, 25 bp, Mus musculus
agaagaagccaactgactgagcatg

SEQ ID NO: 140892 - DNA, 25 bp, Mus musculus
agaagaagccaagtgactgagcatg

SEQ ID NO: 140893 - DNA, 25 bp, Mus musculus
agaagaagcctcacctaggtctggg

SEQ ID NO: 140894 - DNA, 25 bp, Mus musculus
agaagaagcctcaggaactatggaa

SEQ ID NO: 140895 - DNA, 25 bp, Mus musculus
agaagaagcctctcctaggtctggg

SEQ ID NO: 140896 - DNA, 25 bp, Mus musculus
agaagaagcctctggaactatggaa

SEQ ID NO: 140897 - DNA, 25 bp, Mus musculus
agaagaagcctgatcctgtgctaga

SEQ ID NO: 140898 - DNA, 25 bp, Mus musculus
agaagaagcctgttcctgtgctaga

SEQ ID NO: 140899 - DNA, 25 bp, Mus musculus
agaagaagcgcacccctacaaagaa

SEQ ID NO: 140900 - DNA, 25 bp, Mus musculus
agaagaagcgcagccctacaaagaa

SEQ ID NO: 140901 - DNA, 25 bp, Mus musculus
agaagaagcgctactaccctgtgat

SEQ ID NO: 140902 - DNA, 25 bp, Mus musculus
agaagaagcgctactgcaggatggt

SEQ ID NO: 140903 - DNA, 25 bp, Mus musculus
agaagaagcgcttctaccctgtgat

SEQ ID NO: 140904 - DNA, 25 bp, Mus musculus
agaagaagcgcttctgcaggatggt

SEQ ID NO: 140905 - DNA, 25 bp, Mus musculus
agaagaagcggcagaccccagggca

SEQ ID NO: 140906 - DNA, 25 bp, Mus musculus
agaagaagcggctgaccccagggca

SEQ ID NO: 140907 - DNA, 25 bp, Mus musculus
agaagaagctcacctaccagttcag

SEQ ID NO: 140908 - DNA, 25 bp, Mus musculus
agaagaagctcagctaccagttcag

SEQ ID NO: 140909 - DNA, 25 bp, Mus musculus
agaagaagctgccagactcccagtg

SEQ ID NO: 140910 - DNA, 25 bp, Mus musculus
agaagaagctgcgagactcccagtg

SEQ ID NO: 140911 - DNA, 25 bp, Mus musculus
agaagaagctttctgctggtctctc

SEQ ID NO: 140912 - DNA, 25 bp, Mus musculus
agaagaagctttgtgctggtctctc

SEQ ID NO: 140913 - DNA, 25 bp, Mus musculus
agaagaaggatccagcaagatggct

SEQ ID NO: 140914 - DNA, 25 bp, Mus musculus
agaagaaggatcgagcaagatggct

SEQ ID NO: 140915 - DNA, 25 bp, Mus musculus
agaagaagtctcaaaggataaccct

SEQ ID NO: 140916 - DNA, 25 bp, Mus musculus
agaagaagtctctaaggataaccct

SEQ ID NO: 140917 - DNA, 25 bp, Mus musculus
agaagaagttatcacaatttcacac

SEQ ID NO: 140918 - DNA, 25 bp, Mus musculus
agaagaagttatgacaatttcacac

SEQ ID NO: 140919 - DNA, 25 bp, Mus musculus
agaagaagttcccagcagtttttgt

SEQ ID NO: 140920 - DNA, 25 bp, Mus musculus
agaagaagttccgagcagtttttgt

SEQ ID NO: 140921 - DNA, 25 bp, Mus musculus
agaagaagttgtagccctcttggtt

SEQ ID NO: 140922 - DNA, 25 bp, Mus musculus
agaagaagttgttgccctcttggtt

SEQ ID NO: 140923 - DNA, 25 bp, Mus musculus
agaagaataaagacgcagggttgct

SEQ ID NO: 140924 - DNA, 25 bp, Mus musculus
agaagaataaagtcgcagggttgct

SEQ ID NO: 140925 - DNA, 25 bp, Mus musculus
agaagaataacccatggctgtgtat

SEQ ID NO: 140926 - DNA, 25 bp, Mus musculus
agaagaataaccgatggctgtgtat

SEQ ID NO: 140927 - DNA, 25 bp, Mus musculus
agaagaatcaccaggaatcttacag

SEQ ID NO: 140928 - DNA, 25 bp, Mus musculus
agaagaatcacctggaatcttacag

SEQ ID NO: 140929 - DNA, 25 bp, Mus musculus
agaagaatcactcccatgttgcctg

SEQ ID NO: 140930 - DNA, 25 bp, Mus musculus
agaagaatcactgccatgttgcctg

SEQ ID NO: 140931 - DNA, 25 bp, Mus musculus
agaagaatcaggactcatgctaggg

SEQ ID NO: 140932 - DNA, 25 bp, Mus musculus
agaagaatcaggtctcatgctaggg

SEQ ID NO: 140933 - DNA, 25 bp, Mus musculus
agaagaatccacctgcttgcaaggc

SEQ ID NO: 140934 - DNA, 25 bp, Mus musculus
agaagaatccacgtgcttgcaaggc

SEQ ID NO: 140935 - DNA, 25 bp, Mus musculus
agaagaatccctcaggcttgccagc

SEQ ID NO: 140936 - DNA, 25 bp, Mus musculus
agaagaatccctcctgagatggcat

SEQ ID NO: 140937 - DNA, 25 bp, Mus musculus
agaagaatccctgaggcttgccagc

SEQ ID NO: 140938 - DNA, 25 bp, Mus musculus
agaagaatccctgctgagatggcat

SEQ ID NO: 140939 - DNA, 25 bp, Mus musculus
agaagaatcttgctgcctttcaaag

SEQ ID NO: 140940 - DNA, 25 bp, Mus musculus
agaagaatcttggtgcctttcaaag

SEQ ID NO: 140941 - DNA, 25 bp, Mus musculus
agaagaatgggccacaactcgctcc

SEQ ID NO: 140942 - DNA, 25 bp, Mus musculus
agaagaatgggcgacaactcgctcc

SEQ ID NO: 140943 - DNA, 25 bp, Mus musculus
agaagaatgttgacttctaactctg

SEQ ID NO: 140944 - DNA, 25 bp, Mus musculus
agaagaatgttgtcttctaactctg

SEQ ID NO: 140945 - DNA, 25 bp, Mus musculus
agaagaattactctctctccctctg

SEQ ID NO: 140946 - DNA, 25 bp, Mus musculus
agaagaattactgtctctccctctg

SEQ ID NO: 140947 - DNA, 25 bp, Mus musculus
agaagacaagatccccatggtcact

SEQ ID NO: 140948 - DNA, 25 bp, Mus musculus
agaagacaagatgcccatggtcact

SEQ ID NO: 140949 - DNA, 25 bp, Mus musculus
agaagacacaagacggccctgaccc

SEQ ID NO: 140950 - DNA, 25 bp, Mus musculus
agaagacacaagtcggccctgaccc

SEQ ID NO: 140951 - DNA, 25 bp, Mus musculus
agaagacacaccatcgaatctccag

SEQ ID NO: 140952 - DNA, 25 bp, Mus musculus
agaagacacaccttcgaatctccag

SEQ ID NO: 140953 - DNA, 25 bp, Mus musculus
agaagacacactcccgctttaaggg

SEQ ID NO: 140954 - DNA, 25 bp, Mus musculus
agaagacacactgccgctttaaggg

SEQ ID NO: 140955 - DNA, 25 bp, Mus musculus
agaagacaccttagacgtcttccgc

SEQ ID NO: 140956 - DNA, 25 bp, Mus musculus
agaagacaccttcagactgtcccac

SEQ ID NO: 140957 - DNA, 25 bp, Mus musculus
agaagacaccttgagactgtcccac

SEQ ID NO: 140958 - DNA, 25 bp, Mus musculus
agaagacacctttgacgtcttccgc

SEQ ID NO: 140959 - DNA, 25 bp, Mus musculus
agaagacacggcacacgctggagaa

SEQ ID NO: 140960 - DNA, 25 bp, Mus musculus
agaagacacggctcacgctggagaa

SEQ ID NO: 140961 - DNA, 25 bp, Mus musculus
agaagacactgaccctctggcagta

SEQ ID NO: 140962 - DNA, 25 bp, Mus musculus
agaagacactgagcctctggcagta

SEQ ID NO: 140963 - DNA, 25 bp, Mus musculus
agaagacactgcagagccctgaagc

SEQ ID NO: 140964 - DNA, 25 bp, Mus musculus
agaagacactgccttgtaacccact

SEQ ID NO: 140965 - DNA, 25 bp, Mus musculus
agaagacactgcgttgtaacccact

SEQ ID NO: 140966 - DNA, 25 bp, Mus musculus
agaagacactgctgagccctgaagc

SEQ ID NO: 140967 - DNA, 25 bp, Mus musculus
agaagacactgtcggttctttccct

SEQ ID NO: 140968 - DNA, 25 bp, Mus musculus
agaagacactgtgggttctttccct

SEQ ID NO: 140969 - DNA, 25 bp, Mus musculus
agaagacagactatggccaggaaag

SEQ ID NO: 140970 - DNA, 25 bp, Mus musculus
agaagacagactttggccaggaaag

SEQ ID NO: 140971 - DNA, 25 bp, Mus musculus
agaagacagatcactgggcctctcg

SEQ ID NO: 140972 - DNA, 25 bp, Mus musculus
agaagacagatctctgggcctctcg

SEQ ID NO: 140973 - DNA, 25 bp, Mus musculus
agaagacagcgccactgctgacaga

SEQ ID NO: 140974 - DNA, 25 bp, Mus musculus
agaagacagcgcgactgctgacaga

SEQ ID NO: 140975 - DNA, 25 bp, Mus musculus
agaagacaggcacccatgtttccag

SEQ ID NO: 140976 - DNA, 25 bp, Mus musculus
agaagacaggcagccatgtttccag

SEQ ID NO: 140977 - DNA, 25 bp, Mus musculus
agaagacaggcgacctagctgctgt

SEQ ID NO: 140978 - DNA, 25 bp, Mus musculus
agaagacaggcgtcctagctgctgt

SEQ ID NO: 140979 - DNA, 25 bp, Mus musculus
agaagacagtagacgctatccctcc

SEQ ID NO: 140980 - DNA, 25 bp, Mus musculus
agaagacagtagtcgctatccctcc

SEQ ID NO: 140981 - DNA, 25 bp, Mus musculus
agaagacagtttaccctcagtatcc

SEQ ID NO: 140982 - DNA, 25 bp, Mus musculus
agaagacagttttccctcagtatcc

SEQ ID NO: 140983 - DNA, 25 bp, Mus musculus
agaagacatcctccccattgcaaaa

SEQ ID NO: 140984 - DNA, 25 bp, Mus musculus
agaagacatcctgcccattgcaaaa

SEQ ID NO: 140985 - DNA, 25 bp, Mus musculus
agaagacatctgaaacctctgtccc

SEQ ID NO: 140986 - DNA, 25 bp, Mus musculus
agaagacatctgtaacctctgtccc

SEQ ID NO: 140987 - DNA, 25 bp, Mus musculus
agaagacatgcaatatttttccttt

SEQ ID NO: 140988 - DNA, 25 bp, Mus musculus
agaagacatgcattatttttccttt

SEQ ID NO: 140989 - DNA, 25 bp, Mus musculus
agaagacattggagctgaaccctgt

SEQ ID NO: 140990 - DNA, 25 bp, Mus musculus
agaagacattggtgctgaaccctgt

SEQ ID NO: 140991 - DNA, 25 bp, Mus musculus
agaagaccacccagatgttgtcacc

SEQ ID NO: 140992 - DNA, 25 bp, Mus musculus
agaagaccaccctgatgttgtcacc

SEQ ID NO: 140993 - DNA, 25 bp, Mus musculus
agaagaccacctctgaaggctgaag

SEQ ID NO: 140994 - DNA, 25 bp, Mus musculus
agaagaccacctgtgaaggctgaag

SEQ ID NO: 140995 - DNA, 25 bp, Mus musculus
agaagaccactacagcagactcatt

SEQ ID NO: 140996 - DNA, 25 bp, Mus musculus
agaagaccactagagcagactcatt

SEQ ID NO: 140997 - DNA, 25 bp, Mus musculus
agaagaccagcaaactctgtctctc

SEQ ID NO: 140998 - DNA, 25 bp, Mus musculus
agaagaccagcatactctgtctctc

SEQ ID NO: 140999 - DNA, 25 bp, Mus musculus
agaagaccaggcagactgttcttgt

SEQ ID NO: 141000 - DNA, 25 bp, Mus musculus
agaagaccaggctgactgttcttgt

SEQ ID NO: 141001 - DNA, 25 bp, Mus musculus
agaagaccagggatgctgcatctgc

SEQ ID NO: 141002 - DNA, 25 bp, Mus musculus
agaagaccagggttgctgcatctgc

SEQ ID NO: 141003 - DNA, 25 bp, Mus musculus
agaagaccatctcccagctgtgtgt

SEQ ID NO: 141004 - DNA, 25 bp, Mus musculus
agaagaccatctgccagctgtgtgt

SEQ ID NO: 141005 - DNA, 25 bp, Mus musculus
agaagacccaaacactatctgattt

SEQ ID NO: 141006 - DNA, 25 bp, Mus musculus
agaagacccaaagactatctgattt

SEQ ID NO: 141007 - DNA, 25 bp, Mus musculus
agaagacccaagatatccaagatat

SEQ ID NO: 141008 - DNA, 25 bp, Mus musculus
agaagacccaagttatccaagatat

SEQ ID NO: 141009 - DNA, 25 bp, Mus musculus
agaagacccagcacttggtgcgggc

SEQ ID NO: 141010 - DNA, 25 bp, Mus musculus
agaagacccagctcttggtgcgggc

SEQ ID NO: 141011 - DNA, 25 bp, Mus musculus
agaagaccccgacgctgaccaagaa

SEQ ID NO: 141012 - DNA, 25 bp, Mus musculus
agaagaccccgaggctgaccaagaa

SEQ ID NO: 141013 - DNA, 25 bp, Mus musculus
agaagacccgtgacccattcagggt

SEQ ID NO: 141014 - DNA, 25 bp, Mus musculus
agaagacccgtgtcccattcagggt

SEQ ID NO: 141015 - DNA, 25 bp, Mus musculus
agaagaccctaacatttcttggctg

SEQ ID NO: 141016 - DNA, 25 bp, Mus musculus
agaagaccctaagatttcttggctg

SEQ ID NO: 141017 - DNA, 25 bp, Mus musculus
agaagaccctacatgactgccctag

SEQ ID NO: 141018 - DNA, 25 bp, Mus musculus
agaagaccctacttgactgccctag

SEQ ID NO: 141019 - DNA, 25 bp, Mus musculus
agaagaccctcaacacgttcgtgaa

SEQ ID NO: 141020 - DNA, 25 bp, Mus musculus
agaagaccctcatcacgttcgtgaa

SEQ ID NO: 141021 - DNA, 25 bp, Mus musculus
agaagaccctgtattagatccctag

SEQ ID NO: 141022 - DNA, 25 bp, Mus musculus
agaagaccctgttttagatccctag

SEQ ID NO: 141023 - DNA, 25 bp, Mus musculus
agaagacccttcatagactgtgctg

SEQ ID NO: 141024 - DNA, 25 bp, Mus musculus
agaagacccttcttagactgtgctg

SEQ ID NO: 141025 - DNA, 25 bp, Mus musculus
agaagacccttgaacccacgattag

SEQ ID NO: 141026 - DNA, 25 bp, Mus musculus
agaagacccttgtacccacgattag

SEQ ID NO: 141027 - DNA, 25 bp, Mus musculus
agaagaccgcagaaaccaaggttgt

SEQ ID NO: 141028 - DNA, 25 bp, Mus musculus
agaagaccgcagacagcaatcctgt

SEQ ID NO: 141029 - DNA, 25 bp, Mus musculus
agaagaccgcagtaaccaaggttgt

SEQ ID NO: 141030 - DNA, 25 bp, Mus musculus
agaagaccgcagtcagcaatcctgt

SEQ ID NO: 141031 - DNA, 25 bp, Mus musculus
agaagaccgcgaaaaggagcagctt

SEQ ID NO: 141032 - DNA, 25 bp, Mus musculus
agaagaccgcgataaggagcagctt

SEQ ID NO: 141033 - DNA, 25 bp, Mus musculus
agaagaccgtgtccgaatcgactga

SEQ ID NO: 141034 - DNA, 25 bp, Mus musculus
agaagaccgtgtgcgaatcgactga

SEQ ID NO: 141035 - DNA, 25 bp, Mus musculus
agaagacctacaagcccagtgcaaa

SEQ ID NO: 141036 - DNA, 25 bp, Mus musculus
agaagacctacatgcccagtgcaaa

SEQ ID NO: 141037 - DNA, 25 bp, Mus musculus
agaagacctatcagatctcccggaa

SEQ ID NO: 141038 - DNA, 25 bp, Mus musculus
agaagacctatctgatctcccggaa

SEQ ID NO: 141039 - DNA, 25 bp, Mus musculus
agaagacctcacactggtggcagaa

SEQ ID NO: 141040 - DNA, 25 bp, Mus musculus
agaagacctcactctggtggcagaa

SEQ ID NO: 141041 - DNA, 25 bp, Mus musculus
agaagacctccaagttgtactttcc

SEQ ID NO: 141042 - DNA, 25 bp, Mus musculus
agaagacctccatgttgtactttcc

SEQ ID NO: 141043 - DNA, 25 bp, Mus musculus
agaagacctggacgattctctatcc

SEQ ID NO: 141044 - DNA, 25 bp, Mus musculus
agaagacctggaggattctctatcc

SEQ ID NO: 141045 - DNA, 25 bp, Mus musculus
agaagacctgggatccctactcagc

SEQ ID NO: 141046 - DNA, 25 bp, Mus musculus
agaagacctgggttccctactcagc

SEQ ID NO: 141047 - DNA, 25 bp, Mus musculus
agaagacctgtacgactctgcccca

SEQ ID NO: 141048 - DNA, 25 bp, Mus musculus
agaagacctgtaggactctgcccca

SEQ ID NO: 141049 - DNA, 25 bp, Mus musculus
agaagaccttacactctggattagt

SEQ ID NO: 141050 - DNA, 25 bp, Mus musculus
agaagaccttactctctggattagt

SEQ ID NO: 141051 - DNA, 25 bp, Mus musculus
agaagacctttcagtgccaagcagt

SEQ ID NO: 141052 - DNA, 25 bp, Mus musculus
agaagacctttctgtgccaagcagt

SEQ ID NO: 141053 - DNA, 25 bp, Mus musculus
agaagacgacagattggcaatcaca

SEQ ID NO: 141054 - DNA, 25 bp, Mus musculus
agaagacgacagtttggcaatcaca

SEQ ID NO: 141055 - DNA, 25 bp, Mus musculus
agaagacgccttcttgcagcggtac

SEQ ID NO: 141056 - DNA, 25 bp, Mus musculus
agaagacgccttgttgcagcggtac

SEQ ID NO: 141057 - DNA, 25 bp, Mus musculus
agaagacgcgaccttcctaaacgag

SEQ ID NO: 141058 - DNA, 25 bp, Mus musculus
agaagacgcgacgttcctaaacgag

SEQ ID NO: 141059 - DNA, 25 bp, Mus musculus
agaagacgcgcgctcagtcacatcc

SEQ ID NO: 141060 - DNA, 25 bp, Mus musculus
agaagacgcgcggtcagtcacatcc

SEQ ID NO: 141061 - DNA, 25 bp, Mus musculus
agaagacgctgtactctgtgttacc

SEQ ID NO: 141062 - DNA, 25 bp, Mus musculus
agaagacgctgttctctgtgttacc

SEQ ID NO: 141063 - DNA, 25 bp, Mus musculus
agaagacggccacatctgcatctgg

SEQ ID NO: 141064 - DNA, 25 bp, Mus musculus
agaagacggccagatctgcatctgg

SEQ ID NO: 141065 - DNA, 25 bp, Mus musculus
agaagacggtatcgtcacctcccat

SEQ ID NO: 141066 - DNA, 25 bp, Mus musculus
agaagacggtatggtcacctcccat

SEQ ID NO: 141067 - DNA, 25 bp, Mus musculus
agaagacggttcaggtcaaccgcag

SEQ ID NO: 141068 - DNA, 25 bp, Mus musculus
agaagacggttctggtcaaccgcag

SEQ ID NO: 141069 - DNA, 25 bp, Mus musculus
agaagacgtactcctgtaagttgtc

SEQ ID NO: 141070 - DNA, 25 bp, Mus musculus
agaagacgtactgctgtaagttgtc

SEQ ID NO: 141071 - DNA, 25 bp, Mus musculus
agaagacgtccactgactacgagga

SEQ ID NO: 141072 - DNA, 25 bp, Mus musculus
agaagacgtccagtgactacgagga

SEQ ID NO: 141073 - DNA, 25 bp, Mus musculus
agaagacgtgttcctgccgtctcta

SEQ ID NO: 141074 - DNA, 25 bp, Mus musculus
agaagacgtgttgctgccgtctcta

SEQ ID NO: 141075 - DNA, 25 bp, Mus musculus
agaagacgttgcagtttttgacaaa

SEQ ID NO: 141076 - DNA, 25 bp, Mus musculus
agaagacgttgctgtttttgacaaa

SEQ ID NO: 141077 - DNA, 25 bp, Mus musculus
agaagactacctagtgcccgagacc

SEQ ID NO: 141078 - DNA, 25 bp, Mus musculus
agaagactaccttgtgcccgagacc

SEQ ID NO: 141079 - DNA, 25 bp, Mus musculus
agaagactacttcatcagctgatgc

SEQ ID NO: 141080 - DNA, 25 bp, Mus musculus
agaagactacttgatcagctgatgc

SEQ ID NO: 141081 - DNA, 25 bp, Mus musculus
agaagactagaaacgccaacaacat

SEQ ID NO: 141082 - DNA, 25 bp, Mus musculus
agaagactagaatcgccaacaacat

SEQ ID NO: 141083 - DNA, 25 bp, Mus musculus
agaagactatggatgcatgcacagt

SEQ ID NO: 141084 - DNA, 25 bp, Mus musculus
agaagactatggttgcatgcacagt

SEQ ID NO: 141085 - DNA, 25 bp, Mus musculus
agaagactcaacacgcattgggcgg

SEQ ID NO: 141086 - DNA, 25 bp, Mus musculus
agaagactcaactcgcattgggcgg

SEQ ID NO: 141087 - DNA, 25 bp, Mus musculus
agaagactccaaagaaagcgaagaa

SEQ ID NO: 141088 - DNA, 25 bp, Mus musculus
agaagactccaatgaaagcgaagaa

SEQ ID NO: 141089 - DNA, 25 bp, Mus musculus
agaagactccacaatgagcggctac

SEQ ID NO: 141090 - DNA, 25 bp, Mus musculus
agaagactccactatgagcggctac

SEQ ID NO: 141091 - DNA, 25 bp, Mus musculus
agaagactccgaacttcgaagatcc

SEQ ID NO: 141092 - DNA, 25 bp, Mus musculus
agaagactccgatcttcgaagatcc

SEQ ID NO: 141093 - DNA, 25 bp, Mus musculus
agaagactcctgattttctctcttc

SEQ ID NO: 141094 - DNA, 25 bp, Mus musculus
agaagactcctgtttttctctcttc

SEQ ID NO: 141095 - DNA, 25 bp, Mus musculus
agaagactcggcactgttggcccat

SEQ ID NO: 141096 - DNA, 25 bp, Mus musculus
agaagactcggctctgttggcccat

SEQ ID NO: 141097 - DNA, 25 bp, Mus musculus
agaagactctctccagggctcctta

SEQ ID NO: 141098 - DNA, 25 bp, Mus musculus
agaagactctctgcagggctcctta

SEQ ID NO: 141099 - DNA, 25 bp, Mus musculus
agaagactctgacatggaggtccca

SEQ ID NO: 141100 - DNA, 25 bp, Mus musculus
agaagactctgagatggaggtccca

SEQ ID NO: 141101 - DNA, 25 bp, Mus musculus
agaagactctgcctctgtgaacttg

SEQ ID NO: 141102 - DNA, 25 bp, Mus musculus
agaagactctgcgtctgtgaacttg

SEQ ID NO: 141103 - DNA, 25 bp, Mus musculus
agaagactctgtatggacggcccaa

SEQ ID NO: 141104 - DNA, 25 bp, Mus musculus
agaagactctgtttggacggcccaa

SEQ ID NO: 141105 - DNA, 25 bp, Mus musculus
agaagactgaccagcgcggatggaa

SEQ ID NO: 141106 - DNA, 25 bp, Mus musculus
agaagactgacctgcgcggatggaa

SEQ ID NO: 141107 - DNA, 25 bp, Mus musculus
agaagactgactatccctctcttag

SEQ ID NO: 141108 - DNA, 25 bp, Mus musculus
agaagactgactttccctctcttag

SEQ ID NO: 141109 - DNA, 25 bp, Mus musculus
agaagactgagcctttctggtgctc

SEQ ID NO: 141110 - DNA, 25 bp, Mus musculus
agaagactgagcgtttctggtgctc

SEQ ID NO: 141111 - DNA, 25 bp, Mus musculus
agaagactgcttatctcagagtgaa

SEQ ID NO: 141112 - DNA, 25 bp, Mus musculus
agaagactgcttttctcagagtgaa

SEQ ID NO: 141113 - DNA, 25 bp, Mus musculus
agaagactggagaccctgataagga

SEQ ID NO: 141114 - DNA, 25 bp, Mus musculus
agaagactggagtccctgataagga

SEQ ID NO: 141115 - DNA, 25 bp, Mus musculus
agaagactggttcaatccccacctg

SEQ ID NO: 141116 - DNA, 25 bp, Mus musculus
agaagactggttgaatccccacctg

SEQ ID NO: 141117 - DNA, 25 bp, Mus musculus
agaagactgtggatcagttcctagc

SEQ ID NO: 141118 - DNA, 25 bp, Mus musculus
agaagactgtggttcagttcctagc

SEQ ID NO: 141119 - DNA, 25 bp, Mus musculus
agaagactgtgtccgacaacagcga

SEQ ID NO: 141120 - DNA, 25 bp, Mus musculus
agaagactgtgtgcgacaacagcga

SEQ ID NO: 141121 - DNA, 25 bp, Mus musculus
agaagacttccccagagtatgaaga

SEQ ID NO: 141122 - DNA, 25 bp, Mus musculus
agaagacttcccgagagtatgaaga

SEQ ID NO: 141123 - DNA, 25 bp, Mus musculus
agaagacttcgaactggccagcatg

SEQ ID NO: 141124 - DNA, 25 bp, Mus musculus
agaagacttcgatctggccagcatg

SEQ ID NO: 141125 - DNA, 25 bp, Mus musculus
agaagacttgaaccgcgactggctg

SEQ ID NO: 141126 - DNA, 25 bp, Mus musculus
agaagacttgaagcgcgactggctg

SEQ ID NO: 141127 - DNA, 25 bp, Mus musculus
agaagacttgatctggtactgcaga

SEQ ID NO: 141128 - DNA, 25 bp, Mus musculus
agaagacttgatgtggtactgcaga

SEQ ID NO: 141129 - DNA, 25 bp, Mus musculus
agaagagaaaatcgccccggctttg

SEQ ID NO: 141130 - DNA, 25 bp, Mus musculus
agaagagaaaatggccccggctttg

SEQ ID NO: 141131 - DNA, 25 bp, Mus musculus
agaagagaagccacgcctcctggtt

SEQ ID NO: 141132 - DNA, 25 bp, Mus musculus
agaagagaagcctcgcctcctggtt

SEQ ID NO: 141133 - DNA, 25 bp, Mus musculus
agaagagaagtccacactccggcaa

SEQ ID NO: 141134 - DNA, 25 bp, Mus musculus
agaagagaagtcgacactccggcaa

SEQ ID NO: 141135 - DNA, 25 bp, Mus musculus
agaagagaatcaactgccccgtggc

SEQ ID NO: 141136 - DNA, 25 bp, Mus musculus
agaagagaatcatctgccccgtggc

SEQ ID NO: 141137 - DNA, 25 bp, Mus musculus
agaagagacacacctcgcagagcag

SEQ ID NO: 141138 - DNA, 25 bp, Mus musculus
agaagagacacagctcgcagagcag

SEQ ID NO: 141139 - DNA, 25 bp, Mus musculus
agaagagacaccaaagcctccagct

SEQ ID NO: 141140 - DNA, 25 bp, Mus musculus
agaagagacacctaagcctccagct

SEQ ID NO: 141141 - DNA, 25 bp, Mus musculus
agaagagacagcattctactcccaa

SEQ ID NO: 141142 - DNA, 25 bp, Mus musculus
agaagagacagctttctactcccaa

SEQ ID NO: 141143 - DNA, 25 bp, Mus musculus
agaagagacatgacagccacactgc

SEQ ID NO: 141144 - DNA, 25 bp, Mus musculus
agaagagacatgtcagccacactgc

SEQ ID NO: 141145 - DNA, 25 bp, Mus musculus
agaagagaccagctcgcaggaccac

SEQ ID NO: 141146 - DNA, 25 bp, Mus musculus
agaagagaccaggtcgcaggaccac

SEQ ID NO: 141147 - DNA, 25 bp, Mus musculus
agaagagaccatccggctaccacag

SEQ ID NO: 141148 - DNA, 25 bp, Mus musculus
agaagagaccatgcggctaccacag

SEQ ID NO: 141149 - DNA, 25 bp, Mus musculus
agaagagaccctagcacaatgcctg

SEQ ID NO: 141150 - DNA, 25 bp, Mus musculus
agaagagacccttgcacaatgcctg

SEQ ID NO: 141151 - DNA, 25 bp, Mus musculus
agaagagacctaccctggtgccatg

SEQ ID NO: 141152 - DNA, 25 bp, Mus musculus
agaagagacctagcctggtgccatg

SEQ ID NO: 141153 - DNA, 25 bp, Mus musculus
agaagagacctcagtggatgccgga

SEQ ID NO: 141154 - DNA, 25 bp, Mus musculus
agaagagacctcatttgtaccccag

SEQ ID NO: 141155 - DNA, 25 bp, Mus musculus
agaagagacctctgtggatgccgga

SEQ ID NO: 141156 - DNA, 25 bp, Mus musculus
agaagagacctcttttgtaccccag

SEQ ID NO: 141157 - DNA, 25 bp, Mus musculus
agaagagacctgactattgcaatag

SEQ ID NO: 141158 - DNA, 25 bp, Mus musculus
agaagagacctgtctattgcaatag

SEQ ID NO: 141159 - DNA, 25 bp, Mus musculus
agaagagacgccatgtttcctgaca

SEQ ID NO: 141160 - DNA, 25 bp, Mus musculus
agaagagacgccttgtttcctgaca

SEQ ID NO: 141161 - DNA, 25 bp, Mus musculus
agaagagacgttccctgtcatccga

SEQ ID NO: 141162 - DNA, 25 bp, Mus musculus
agaagagacgttgcctgtcatccga

SEQ ID NO: 141163 - DNA, 25 bp, Mus musculus
agaagagactctacctctcaggtcc

SEQ ID NO: 141164 - DNA, 25 bp, Mus musculus
agaagagactctccggacaatccag

SEQ ID NO: 141165 - DNA, 25 bp, Mus musculus
agaagagactctgcggacaatccag

SEQ ID NO: 141166 - DNA, 25 bp, Mus musculus
agaagagactcttcctctcaggtcc

SEQ ID NO: 141167 - DNA, 25 bp, Mus musculus
agaagagacttcaaggttactgcta

SEQ ID NO: 141168 - DNA, 25 bp, Mus musculus
agaagagacttctaggttactgcta

SEQ ID NO: 141169 - DNA, 25 bp, Mus musculus
agaagagagaacaccgccgaagcat

SEQ ID NO: 141170 - DNA, 25 bp, Mus musculus
agaagagagaactccgccgaagcat

SEQ ID NO: 141171 - DNA, 25 bp, Mus musculus
agaagagagcccaagttcagtttcc

SEQ ID NO: 141172 - DNA, 25 bp, Mus musculus
agaagagagcccatgcatcctttaa

SEQ ID NO: 141173 - DNA, 25 bp, Mus musculus
agaagagagccccttggcatccagc

SEQ ID NO: 141174 - DNA, 25 bp, Mus musculus
agaagagagcccgttggcatccagc

SEQ ID NO: 141175 - DNA, 25 bp, Mus musculus
agaagagagccctagttcagtttcc

SEQ ID NO: 141176 - DNA, 25 bp, Mus musculus
agaagagagcccttgcatcctttaa

SEQ ID NO: 141177 - DNA, 25 bp, Mus musculus
agaagagaggccaaagctgttgtga

SEQ ID NO: 141178 - DNA, 25 bp, Mus musculus
agaagagaggcctaagctgttgtga

SEQ ID NO: 141179 - DNA, 25 bp, Mus musculus
agaagagaggtacacactgcacact

SEQ ID NO: 141180 - DNA, 25 bp, Mus musculus
agaagagaggtagacactgcacact

SEQ ID NO: 141181 - DNA, 25 bp, Mus musculus
agaagagagtctattgctgccaata

SEQ ID NO: 141182 - DNA, 25 bp, Mus musculus
agaagagagtcttttgctgccaata

SEQ ID NO: 141183 - DNA, 25 bp, Mus musculus
agaagagagtgtcagtatccctggg

SEQ ID NO: 141184 - DNA, 25 bp, Mus musculus
agaagagagtgtgagtatccctggg

SEQ ID NO: 141185 - DNA, 25 bp, Mus musculus
agaagagatccgaatctgtgcccag

SEQ ID NO: 141186 - DNA, 25 bp, Mus musculus
agaagagatccgtatctgtgcccag

SEQ ID NO: 141187 - DNA, 25 bp, Mus musculus
agaagagatctcagcctggctggta

SEQ ID NO: 141188 - DNA, 25 bp, Mus musculus
agaagagatctctgcctggctggta

SEQ ID NO: 141189 - DNA, 25 bp, Mus musculus
agaagagatcttaaagggctagcga

SEQ ID NO: 141190 - DNA, 25 bp, Mus musculus
agaagagatctttaagggctagcga

SEQ ID NO: 141191 - DNA, 25 bp, Mus musculus
agaagagatgatcgcctcccacgag

SEQ ID NO: 141192 - DNA, 25 bp, Mus musculus
agaagagatgatggcctcccacgag

SEQ ID NO: 141193 - DNA, 25 bp, Mus musculus
agaagagattatcccttgtgtgtgt

SEQ ID NO: 141194 - DNA, 25 bp, Mus musculus
agaagagattatgccttgtgtgtgt

SEQ ID NO: 141195 - DNA, 25 bp, Mus musculus
agaagagcacatcattccgaccagg

SEQ ID NO: 141196 - DNA, 25 bp, Mus musculus
agaagagcacatgattccgaccagg

SEQ ID NO: 141197 - DNA, 25 bp, Mus musculus
agaagagcagaaaccctcctaggcc

SEQ ID NO: 141198 - DNA, 25 bp, Mus musculus
agaagagcagaatccctcctaggcc

SEQ ID NO: 141199 - DNA, 25 bp, Mus musculus
agaagagcagggacttccagccagc

SEQ ID NO: 141200 - DNA, 25 bp, Mus musculus
agaagagcagggtcttccagccagc

SEQ ID NO: 141201 - DNA, 25 bp, Mus musculus
agaagagcatctaccttgtggccca

SEQ ID NO: 141202 - DNA, 25 bp, Mus musculus
agaagagcatcttccttgtggccca

SEQ ID NO: 141203 - DNA, 25 bp, Mus musculus
agaagagccaggattccatccttgc

SEQ ID NO: 141204 - DNA, 25 bp, Mus musculus
agaagagccaggtttccatccttgc

SEQ ID NO: 141205 - DNA, 25 bp, Mus musculus
agaagagcccgaccgtccttagatc

SEQ ID NO: 141206 - DNA, 25 bp, Mus musculus
agaagagcccgagcgtccttagatc

SEQ ID NO: 141207 - DNA, 25 bp, Mus musculus
agaagagccctcatatgagtgaatt

SEQ ID NO: 141208 - DNA, 25 bp, Mus musculus
agaagagccctcttatgagtgaatt

SEQ ID NO: 141209 - DNA, 25 bp, Mus musculus
agaagagccctgcacgtggcatcca

SEQ ID NO: 141210 - DNA, 25 bp, Mus musculus
agaagagccctggacgtggcatcca

SEQ ID NO: 141211 - DNA, 25 bp, Mus musculus
agaagagcctagaagcccatctcct

SEQ ID NO: 141212 - DNA, 25 bp, Mus musculus
agaagagcctagtagcccatctcct

SEQ ID NO: 141213 - DNA, 25 bp, Mus musculus
agaagagcgagcacagctgtgcccc

SEQ ID NO: 141214 - DNA, 25 bp, Mus musculus
agaagagcgagctcagctgtgcccc

SEQ ID NO: 141215 - DNA, 25 bp, Mus musculus
agaagagcgcctactctgtgttcaa

SEQ ID NO: 141216 - DNA, 25 bp, Mus musculus
agaagagcgccttctctgtgttcaa

SEQ ID NO: 141217 - DNA, 25 bp, Mus musculus
agaagagcggatcgcctaccgtgct

SEQ ID NO: 141218 - DNA, 25 bp, Mus musculus
agaagagcggatggcctaccgtgct

SEQ ID NO: 141219 - DNA, 25 bp, Mus musculus
agaagagcggccactcagggtatga

SEQ ID NO: 141220 - DNA, 25 bp, Mus musculus
agaagagcggcctctcagggtatga

SEQ ID NO: 141221 - DNA, 25 bp, Mus musculus
agaagagcggcgcacacctgcagat

SEQ ID NO: 141222 - DNA, 25 bp, Mus musculus
agaagagcggcggacacctgcagat

SEQ ID NO: 141223 - DNA, 25 bp, Mus musculus
agaagagcgtggaggcagcggccga

SEQ ID NO: 141224 - DNA, 25 bp, Mus musculus
agaagagcgtggtggcagcggccga

SEQ ID NO: 141225 - DNA, 25 bp, Mus musculus
agaagagctatgaccgcaccaaacg

SEQ ID NO: 141226 - DNA, 25 bp, Mus musculus
agaagagctatgagctgcctgacgg

SEQ ID NO: 141227 - DNA, 25 bp, Mus musculus
agaagagctatgtccgcaccaaacg

SEQ ID NO: 141228 - DNA, 25 bp, Mus musculus
agaagagctatgtgctgcctgacgg

SEQ ID NO: 141229 - DNA, 25 bp, Mus musculus
agaagagctcacacctgaattccca

SEQ ID NO: 141230 - DNA, 25 bp, Mus musculus
agaagagctcactcctgaattccca

SEQ ID NO: 141231 - DNA, 25 bp, Mus musculus
agaagagctcatccatatctgccat

SEQ ID NO: 141232 - DNA, 25 bp, Mus musculus
agaagagctcatgcatatctgccat

SEQ ID NO: 141233 - DNA, 25 bp, Mus musculus
agaagagctcgacccacagaagtgt

SEQ ID NO: 141234 - DNA, 25 bp, Mus musculus
agaagagctcgagccacagaagtgt

SEQ ID NO: 141235 - DNA, 25 bp, Mus musculus
agaagagctcggaaccctacagcag

SEQ ID NO: 141236 - DNA, 25 bp, Mus musculus
agaagagctcggtaccctacagcag

SEQ ID NO: 141237 - DNA, 25 bp, Mus musculus
agaagagctctcaggtttgctaact

SEQ ID NO: 141238 - DNA, 25 bp, Mus musculus
agaagagctctccatcaccagggat

SEQ ID NO: 141239 - DNA, 25 bp, Mus musculus
agaagagctctcgatcaccagggat

SEQ ID NO: 141240 - DNA, 25 bp, Mus musculus
agaagagctctctggtttgctaact

SEQ ID NO: 141241 - DNA, 25 bp, Mus musculus
agaagagctctgcaaaggcgcatta

SEQ ID NO: 141242 - DNA, 25 bp, Mus musculus
agaagagctctggaaaggcgcatta

SEQ ID NO: 141243 - DNA, 25 bp, Mus musculus
agaagagctgaaagaagttgggcca

SEQ ID NO: 141244 - DNA, 25 bp, Mus musculus
agaagagctgaatgaagttgggcca

SEQ ID NO: 141245 - DNA, 25 bp, Mus musculus
agaagagcttacactctcaggctcc

SEQ ID NO: 141246 - DNA, 25 bp, Mus musculus
agaagagcttactctctcaggctcc

SEQ ID NO: 141247 - DNA, 25 bp, Mus musculus
agaagagcttcaagctgctgagcat

SEQ ID NO: 141248 - DNA, 25 bp, Mus musculus
agaagagcttcatgctgctgagcat

SEQ ID NO: 141249 - DNA, 25 bp, Mus musculus
agaagaggacacaggctatcccgcc

SEQ ID NO: 141250 - DNA, 25 bp, Mus musculus
agaagaggacactggctatcccgcc

SEQ ID NO: 141251 - DNA, 25 bp, Mus musculus
agaagaggagagatgttcacccatt

SEQ ID NO: 141252 - DNA, 25 bp, Mus musculus
agaagaggagagttgttcacccatt

SEQ ID NO: 141253 - DNA, 25 bp, Mus musculus
agaagaggataaccactgcccacca

SEQ ID NO: 141254 - DNA, 25 bp, Mus musculus
agaagaggataagcactgcccacca

SEQ ID NO: 141255 - DNA, 25 bp, Mus musculus
agaagaggcagtctttgcaaacagt

SEQ ID NO: 141256 - DNA, 25 bp, Mus musculus
agaagaggcagtgtttgcaaacagt

SEQ ID NO: 141257 - DNA, 25 bp, Mus musculus
agaagaggcctcctatgactctgac

SEQ ID NO: 141258 - DNA, 25 bp, Mus musculus
agaagaggcctcgtatgactctgac

SEQ ID NO: 141259 - DNA, 25 bp, Mus musculus
agaagaggcctgcacaggaacttga

SEQ ID NO: 141260 - DNA, 25 bp, Mus musculus
agaagaggcctggacaggaacttga

SEQ ID NO: 141261 - DNA, 25 bp, Mus musculus
agaagaggctcactctgtccggcat

SEQ ID NO: 141262 - DNA, 25 bp, Mus musculus
agaagaggctcagtctgtccggcat

SEQ ID NO: 141263 - DNA, 25 bp, Mus musculus
agaagaggcttcctgctaccgcaga

SEQ ID NO: 141264 - DNA, 25 bp, Mus musculus
agaagaggcttcgtgctaccgcaga

SEQ ID NO: 141265 - DNA, 25 bp, Mus musculus
agaagaggcttgcacacttcctgct

SEQ ID NO: 141266 - DNA, 25 bp, Mus musculus
agaagaggcttggacacttcctgct

SEQ ID NO: 141267 - DNA, 25 bp, Mus musculus
agaagagggcagacagccaccggac

SEQ ID NO: 141268 - DNA, 25 bp, Mus musculus
agaagagggcagtcagccaccggac

SEQ ID NO: 141269 - DNA, 25 bp, Mus musculus
agaagagggcggacacagaaagcca

SEQ ID NO: 141270 - DNA, 25 bp, Mus musculus
agaagagggcggtcacagaaagcca

SEQ ID NO: 141271 - DNA, 25 bp, Mus musculus
agaagagggtatccatagcccttgg

SEQ ID NO: 141272 - DNA, 25 bp, Mus musculus
agaagagggtatgcatagcccttgg

SEQ ID NO: 141273 - DNA, 25 bp, Mus musculus
agaagagggtccatcgctgtcagtt

SEQ ID NO: 141274 - DNA, 25 bp, Mus musculus
agaagagggtccttcgctgtcagtt

SEQ ID NO: 141275 - DNA, 25 bp, Mus musculus
agaagaggtagtacttcctcctgct

SEQ ID NO: 141276 - DNA, 25 bp, Mus musculus
agaagaggtagttcttcctcctgct

SEQ ID NO: 141277 - DNA, 25 bp, Mus musculus
agaagaggtcagctgatcaactgct

SEQ ID NO: 141278 - DNA, 25 bp, Mus musculus
agaagaggtcaggtgatcaactgct

SEQ ID NO: 141279 - DNA, 25 bp, Mus musculus
agaagaggtcatacagttccttaga

SEQ ID NO: 141280 - DNA, 25 bp, Mus musculus
agaagaggtcattcagttccttaga

SEQ ID NO: 141281 - DNA, 25 bp, Mus musculus
agaagaggtcgccttccacgaagag

SEQ ID NO: 141282 - DNA, 25 bp, Mus musculus
agaagaggtcgcgttccacgaagag

SEQ ID NO: 141283 - DNA, 25 bp, Mus musculus
agaagaggtcttcttagtctgtaca

SEQ ID NO: 141284 - DNA, 25 bp, Mus musculus
agaagaggtcttgttagtctgtaca

SEQ ID NO: 141285 - DNA, 25 bp, Mus musculus
agaagaggtgcaacttctccatcgg

SEQ ID NO: 141286 - DNA, 25 bp, Mus musculus
agaagaggtgcatcttctccatcgg

SEQ ID NO: 141287 - DNA, 25 bp, Mus musculus
agaagaggtgctacggatctgtcca

SEQ ID NO: 141288 - DNA, 25 bp, Mus musculus
agaagaggtgcttcggatctgtcca

SEQ ID NO: 141289 - DNA, 25 bp, Mus musculus
agaagaggttctacactgaagtgtt

SEQ ID NO: 141290 - DNA, 25 bp, Mus musculus
agaagaggttcttcactgaagtgtt

SEQ ID NO: 141291 - DNA, 25 bp, Mus musculus
agaagagtaccacctgtgcctatga

SEQ ID NO: 141292 - DNA, 25 bp, Mus musculus
agaagagtaccagctgtgcctatga

SEQ ID NO: 141293 - DNA, 25 bp, Mus musculus
agaagagtacctccgagtccttggc

SEQ ID NO: 141294 - DNA, 25 bp, Mus musculus
agaagagtacctgcgagtccttggc

SEQ ID NO: 141295 - DNA, 25 bp, Mus musculus
agaagagtagccagttttagaaagt

SEQ ID NO: 141296 - DNA, 25 bp, Mus musculus
agaagagtagcctgttttagaaagt

SEQ ID NO: 141297 - DNA, 25 bp, Mus musculus
agaagagtcattatcactgtcctgt

SEQ ID NO: 141298 - DNA, 25 bp, Mus musculus
agaagagtcattcctggttcccagg

SEQ ID NO: 141299 - DNA, 25 bp, Mus musculus
agaagagtcattgctggttcccagg

SEQ ID NO: 141300 - DNA, 25 bp, Mus musculus
agaagagtcattttcactgtcctgt

SEQ ID NO: 141301 - DNA, 25 bp, Mus musculus
agaagagtcctaacaccagcgtggg

SEQ ID NO: 141302 - DNA, 25 bp, Mus musculus
agaagagtcctatcaccagcgtggg

SEQ ID NO: 141303 - DNA, 25 bp, Mus musculus
agaagagtccttaggctctgctagc

SEQ ID NO: 141304 - DNA, 25 bp, Mus musculus
agaagagtccttctctgacctgacc

SEQ ID NO: 141305 - DNA, 25 bp, Mus musculus
agaagagtccttgtctgacctgacc

SEQ ID NO: 141306 - DNA, 25 bp, Mus musculus
agaagagtcctttggctctgctagc

SEQ ID NO: 141307 - DNA, 25 bp, Mus musculus
agaagagtcttcctccatgtttgat

SEQ ID NO: 141308 - DNA, 25 bp, Mus musculus
agaagagtcttcgtccatgtttgat

SEQ ID NO: 141309 - DNA, 25 bp, Mus musculus
agaagagtgaccatctgagggaaca

SEQ ID NO: 141310 - DNA, 25 bp, Mus musculus
agaagagtgaccttctgagggaaca

SEQ ID NO: 141311 - DNA, 25 bp, Mus musculus
agaagagtgataaccaaggctggcc

SEQ ID NO: 141312 - DNA, 25 bp, Mus musculus
agaagagtgatatccaaggctggcc

SEQ ID NO: 141313 - DNA, 25 bp, Mus musculus
agaagagtgcacagatccatctccg

SEQ ID NO: 141314 - DNA, 25 bp, Mus musculus
agaagagtgcactgatccatctccg

SEQ ID NO: 141315 - DNA, 25 bp, Mus musculus
agaagagtgcatcggcattccccta

SEQ ID NO: 141316 - DNA, 25 bp, Mus musculus
agaagagtgcatgggcattccccta

SEQ ID NO: 141317 - DNA, 25 bp, Mus musculus
agaagagtggtcaggtcctgtttct

SEQ ID NO: 141318 - DNA, 25 bp, Mus musculus
agaagagtggtctggtcctgtttct

SEQ ID NO: 141319 - DNA, 25 bp, Mus musculus
agaagagttacactgcctttgccat

SEQ ID NO: 141320 - DNA, 25 bp, Mus musculus
agaagagttacagtgcctttgccat

SEQ ID NO: 141321 - DNA, 25 bp, Mus musculus
agaagagttcttagcccacatagtt

SEQ ID NO: 141322 - DNA, 25 bp, Mus musculus
agaagagttctttgcccacatagtt

SEQ ID NO: 141323 - DNA, 25 bp, Mus musculus
agaagagttggaactgcccactccc

SEQ ID NO: 141324 - DNA, 25 bp, Mus musculus
agaagagttggatctgcccactccc

SEQ ID NO: 141325 - DNA, 25 bp, Mus musculus
agaagagtttcgatcccaggagatt

SEQ ID NO: 141326 - DNA, 25 bp, Mus musculus
agaagagtttcgttcccaggagatt

SEQ ID NO: 141327 - DNA, 25 bp, Mus musculus
agaagagtttctagccatcagccct

SEQ ID NO: 141328 - DNA, 25 bp, Mus musculus
agaagagtttcttgccatcagccct

SEQ ID NO: 141329 - DNA, 25 bp, Mus musculus
agaagagtttgtagctttttcaggg

SEQ ID NO: 141330 - DNA, 25 bp, Mus musculus
agaagagtttgttgctttttcaggg

SEQ ID NO: 141331 - DNA, 25 bp, Mus musculus
agaagataaaagctccccaggacgt

SEQ ID NO: 141332 - DNA, 25 bp, Mus musculus
agaagataaaaggtccccaggacgt

SEQ ID NO: 141333 - DNA, 25 bp, Mus musculus
agaagataactgatccccgggatgt

SEQ ID NO: 141334 - DNA, 25 bp, Mus musculus
agaagataactgttccccgggatgt

SEQ ID NO: 141335 - DNA, 25 bp, Mus musculus
agaagataagaacgcccacggtgca

SEQ ID NO: 141336 - DNA, 25 bp, Mus musculus
agaagataagaaggcccacggtgca

SEQ ID NO: 141337 - DNA, 25 bp, Mus musculus
agaagatagagcctcatcgccttga

SEQ ID NO: 141338 - DNA, 25 bp, Mus musculus
agaagatagagcgtcatcgccttga

SEQ ID NO: 141339 - DNA, 25 bp, Mus musculus
agaagatagcacaggcccagggtct

SEQ ID NO: 141340 - DNA, 25 bp, Mus musculus
agaagatagcactggcccagggtct

SEQ ID NO: 141341 - DNA, 25 bp, Mus musculus
agaagatagcttcatctctatcctt

SEQ ID NO: 141342 - DNA, 25 bp, Mus musculus
agaagatagcttgatctctatcctt

SEQ ID NO: 141343 - DNA, 25 bp, Mus musculus
agaagatatccaccaggcactgtga

SEQ ID NO: 141344 - DNA, 25 bp, Mus musculus
agaagatatccagcaggcactgtga

SEQ ID NO: 141345 - DNA, 25 bp, Mus musculus
agaagatcaaacagcattgccgctt

SEQ ID NO: 141346 - DNA, 25 bp, Mus musculus
agaagatcaaactgcattgccgctt

SEQ ID NO: 141347 - DNA, 25 bp, Mus musculus
agaagatcaacacaaactcccggaa

SEQ ID NO: 141348 - DNA, 25 bp, Mus musculus
agaagatcaacagaaactcccggaa

SEQ ID NO: 141349 - DNA, 25 bp, Mus musculus
agaagatcaattaccacacctccag

SEQ ID NO: 141350 - DNA, 25 bp, Mus musculus
agaagatcaatttccacacctccag

SEQ ID NO: 141351 - DNA, 25 bp, Mus musculus
agaagatcacagaagatttcaggcc

SEQ ID NO: 141352 - DNA, 25 bp, Mus musculus
agaagatcacagtagatttcaggcc

SEQ ID NO: 141353 - DNA, 25 bp, Mus musculus
agaagatcaccacttccaggccaga

SEQ ID NO: 141354 - DNA, 25 bp, Mus musculus
agaagatcaccagttccaggccaga

SEQ ID NO: 141355 - DNA, 25 bp, Mus musculus
agaagatcacctacccgtatgagtc

SEQ ID NO: 141356 - DNA, 25 bp, Mus musculus
agaagatcaccttcccgtatgagtc

SEQ ID NO: 141357 - DNA, 25 bp, Mus musculus
agaagatcacggactgcggtaagaa

SEQ ID NO: 141358 - DNA, 25 bp, Mus musculus
agaagatcacggtctgcggtaagaa

SEQ ID NO: 141359 - DNA, 25 bp, Mus musculus
agaagatcactcctgcgttcaacca

SEQ ID NO: 141360 - DNA, 25 bp, Mus musculus
agaagatcactcgtgcgttcaacca

SEQ ID NO: 141361 - DNA, 25 bp, Mus musculus
agaagatcactgctatccctaagct

SEQ ID NO: 141362 - DNA, 25 bp, Mus musculus
agaagatcactggtatccctaagct

SEQ ID NO: 141363 - DNA, 25 bp, Mus musculus
agaagatcatccacagatggccagc

SEQ ID NO: 141364 - DNA, 25 bp, Mus musculus
agaagatcatcctcagatggccagc

SEQ ID NO: 141365 - DNA, 25 bp, Mus musculus
agaagatccactctcactcttactg

SEQ ID NO: 141366 - DNA, 25 bp, Mus musculus
agaagatccactgtcactcttactg

SEQ ID NO: 141367 - DNA, 25 bp, Mus musculus
agaagatccagaccgcctacagcaa

SEQ ID NO: 141368 - DNA, 25 bp, Mus musculus
agaagatccagagcgcctacagcaa

SEQ ID NO: 141369 - DNA, 25 bp, Mus musculus
agaagatccaggacggtcaccaggg

SEQ ID NO: 141370 - DNA, 25 bp, Mus musculus
agaagatccaggatacccactctct

SEQ ID NO: 141371 - DNA, 25 bp, Mus musculus
agaagatccaggtcggtcaccaggg

SEQ ID NO: 141372 - DNA, 25 bp, Mus musculus
agaagatccaggttacccactctct

SEQ ID NO: 141373 - DNA, 25 bp, Mus musculus
agaagatccgacagcgctttggcaa

SEQ ID NO: 141374 - DNA, 25 bp, Mus musculus
agaagatccgactgcgctttggcaa

SEQ ID NO: 141375 - DNA, 25 bp, Mus musculus
agaagatccgatcagccaccaaact

SEQ ID NO: 141376 - DNA, 25 bp, Mus musculus
agaagatccgatgagccaccaaact

SEQ ID NO: 141377 - DNA, 25 bp, Mus musculus
agaagatcctccacacagcctggca

SEQ ID NO: 141378 - DNA, 25 bp, Mus musculus
agaagatcctcctcacagcctggca

SEQ ID NO: 141379 - DNA, 25 bp, Mus musculus
agaagatcctgaagtcactccatca

SEQ ID NO: 141380 - DNA, 25 bp, Mus musculus
agaagatcctgacgcaatgtgagca

SEQ ID NO: 141381 - DNA, 25 bp, Mus musculus
agaagatcctgaggcaatgtgagca

SEQ ID NO: 141382 - DNA, 25 bp, Mus musculus
agaagatcctgatgtcactccatca

SEQ ID NO: 141383 - DNA, 25 bp, Mus musculus
agaagatccttcagcagacaccgag

SEQ ID NO: 141384 - DNA, 25 bp, Mus musculus
agaagatccttctgcagacaccgag

SEQ ID NO: 141385 - DNA, 25 bp, Mus musculus
agaagatcgagaaatcccactgatg

SEQ ID NO: 141386 - DNA, 25 bp, Mus musculus
agaagatcgagatatcccactgatg

SEQ ID NO: 141387 - DNA, 25 bp, Mus musculus
agaagatcgagtcatccacacacca

SEQ ID NO: 141388 - DNA, 25 bp, Mus musculus
agaagatcgagtgatccacacacca

SEQ ID NO: 141389 - DNA, 25 bp, Mus musculus
agaagatcgatgacactgtcagtgt

SEQ ID NO: 141390 - DNA, 25 bp, Mus musculus
agaagatcgatgtcactgtcagtgt

SEQ ID NO: 141391 - DNA, 25 bp, Mus musculus
agaagatcgcatccggactcggcaa

SEQ ID NO: 141392 - DNA, 25 bp, Mus musculus
agaagatcgcatgcggactcggcaa

SEQ ID NO: 141393 - DNA, 25 bp, Mus musculus
agaagatcgcttaccaaggccgtgt

SEQ ID NO: 141394 - DNA, 25 bp, Mus musculus
agaagatcgctttccaaggccgtgt

SEQ ID NO: 141395 - DNA, 25 bp, Mus musculus
agaagatcggaaccctgcgccatca

SEQ ID NO: 141396 - DNA, 25 bp, Mus musculus
agaagatcggaagcctgcgccatca

SEQ ID NO: 141397 - DNA, 25 bp, Mus musculus
agaagatcgtggctcccatcagtga

SEQ ID NO: 141398 - DNA, 25 bp, Mus musculus
agaagatcgtgggtcccatcagtga

SEQ ID NO: 141399 - DNA, 25 bp, Mus musculus
agaagatctatgagctgcgggtgat

SEQ ID NO: 141400 - DNA, 25 bp, Mus musculus
agaagatctatgtgctgcgggtgat

SEQ ID NO: 141401 - DNA, 25 bp, Mus musculus
agaagatctcctcccatctagacca

SEQ ID NO: 141402 - DNA, 25 bp, Mus musculus
agaagatctcctgccatctagacca

SEQ ID NO: 141403 - DNA, 25 bp, Mus musculus
agaagatctcgcacgtcgggtgaac

SEQ ID NO: 141404 - DNA, 25 bp, Mus musculus
agaagatctcgctcgtcgggtgaac

SEQ ID NO: 141405 - DNA, 25 bp, Mus musculus
agaagatctgatcgtccatccacca

SEQ ID NO: 141406 - DNA, 25 bp, Mus musculus
agaagatctgatggtccatccacca

SEQ ID NO: 141407 - DNA, 25 bp, Mus musculus
agaagatctgctatatctaccgact

SEQ ID NO: 141408 - DNA, 25 bp, Mus musculus
agaagatctgctcacatctgaccca

SEQ ID NO: 141409 - DNA, 25 bp, Mus musculus
agaagatctgctgacatctgaccca

SEQ ID NO: 141410 - DNA, 25 bp, Mus musculus
agaagatctgctttatctaccgact

SEQ ID NO: 141411 - DNA, 25 bp, Mus musculus
agaagatctgtcaccacatgaggct

SEQ ID NO: 141412 - DNA, 25 bp, Mus musculus
agaagatctgtctccacatgaggct

SEQ ID NO: 141413 - DNA, 25 bp, Mus musculus
agaagatctgtgctgtccttggcat

SEQ ID NO: 141414 - DNA, 25 bp, Mus musculus
agaagatctgtggtgtccttggcat

SEQ ID NO: 141415 - DNA, 25 bp, Mus musculus
agaagatcttacacttgccctttga

SEQ ID NO: 141416 - DNA, 25 bp, Mus musculus
agaagatcttactcttgccctttga

SEQ ID NO: 141417 - DNA, 25 bp, Mus musculus
agaagatcttcacacttccaggcaa

SEQ ID NO: 141418 - DNA, 25 bp, Mus musculus
agaagatcttcagacttccaggcaa

SEQ ID NO: 141419 - DNA, 25 bp, Mus musculus
agaagatgaagtactccctctcacc

SEQ ID NO: 141420 - DNA, 25 bp, Mus musculus
agaagatgaagttctccctctcacc

SEQ ID NO: 141421 - DNA, 25 bp, Mus musculus
agaagatgacaaccctgcgttctgt

SEQ ID NO: 141422 - DNA, 25 bp, Mus musculus
agaagatgacaagcctgcgttctgt

SEQ ID NO: 141423 - DNA, 25 bp, Mus musculus
agaagatgacatagggttccctgag

SEQ ID NO: 141424 - DNA, 25 bp, Mus musculus
agaagatgacattgggttccctgag

SEQ ID NO: 141425 - DNA, 25 bp, Mus musculus
agaagatgactcacccagtttcctt

SEQ ID NO: 141426 - DNA, 25 bp, Mus musculus
agaagatgactctcccagtttcctt

SEQ ID NO: 141427 - DNA, 25 bp, Mus musculus
agaagatgacttccgtttgtttata

SEQ ID NO: 141428 - DNA, 25 bp, Mus musculus
agaagatgacttgcgtttgtttata

SEQ ID NO: 141429 - DNA, 25 bp, Mus musculus
agaagatgagctccgcatggagcca

SEQ ID NO: 141430 - DNA, 25 bp, Mus musculus
agaagatgagctgcgcatggagcca

SEQ ID NO: 141431 - DNA, 25 bp, Mus musculus
agaagatgatgcagacccctagcca

SEQ ID NO: 141432 - DNA, 25 bp, Mus musculus
agaagatgatgctgacccctagcca

SEQ ID NO: 141433 - DNA, 25 bp, Mus musculus
agaagatgatgtccgccagtatgtt

SEQ ID NO: 141434 - DNA, 25 bp, Mus musculus
agaagatgatgtgcgccagtatgtt

SEQ ID NO: 141435 - DNA, 25 bp, Mus musculus
agaagatgcaacagggctcccgtga

SEQ ID NO: 141436 - DNA, 25 bp, Mus musculus
agaagatgcaactgggctcccgtga

SEQ ID NO: 141437 - DNA, 25 bp, Mus musculus
agaagatgcagtctctgccactcct

SEQ ID NO: 141438 - DNA, 25 bp, Mus musculus
agaagatgcagtgtctgccactcct

SEQ ID NO: 141439 - DNA, 25 bp, Mus musculus
agaagatgcccgagtgggtcctctt

SEQ ID NO: 141440 - DNA, 25 bp, Mus musculus
agaagatgcccgtgtgggtcctctt

SEQ ID NO: 141441 - DNA, 25 bp, Mus musculus
agaagatgccttactctgtcgcttt

SEQ ID NO: 141442 - DNA, 25 bp, Mus musculus
agaagatgcctttctctgtcgcttt

SEQ ID NO: 141443 - DNA, 25 bp, Mus musculus
agaagatgctacaccagcagctctg

SEQ ID NO: 141444 - DNA, 25 bp, Mus musculus
agaagatgctactccagcagctctg

SEQ ID NO: 141445 - DNA, 25 bp, Mus musculus
agaagatgctatacatcagctgtca

SEQ ID NO: 141446 - DNA, 25 bp, Mus musculus
agaagatgctattcatcagctgtca

SEQ ID NO: 141447 - DNA, 25 bp, Mus musculus
agaagatgcttgagccaggtggcac

SEQ ID NO: 141448 - DNA, 25 bp, Mus musculus
agaagatgcttgtgccaggtggcac

SEQ ID NO: 141449 - DNA, 25 bp, Mus musculus
agaagatggcaacccgataagaaga

SEQ ID NO: 141450 - DNA, 25 bp, Mus musculus
agaagatggcaagccgataagaaga

SEQ ID NO: 141451 - DNA, 25 bp, Mus musculus
agaagatggcccagtgcctctttac

SEQ ID NO: 141452 - DNA, 25 bp, Mus musculus
agaagatggccctgtgcctctttac

SEQ ID NO: 141453 - DNA, 25 bp, Mus musculus
agaagatgggccacctttgccgaga

SEQ ID NO: 141454 - DNA, 25 bp, Mus musculus
agaagatgggcctcctttgccgaga

SEQ ID NO: 141455 - DNA, 25 bp, Mus musculus
agaagatggtgcactgccgtctgat

SEQ ID NO: 141456 - DNA, 25 bp, Mus musculus
agaagatggtgctctgccgtctgat

SEQ ID NO: 141457 - DNA, 25 bp, Mus musculus
agaagatggtggacgtggctctcca

SEQ ID NO: 141458 - DNA, 25 bp, Mus musculus
agaagatggtggtcgtggctctcca

SEQ ID NO: 141459 - DNA, 25 bp, Mus musculus
agaagatggttcagatcaggacaat

SEQ ID NO: 141460 - DNA, 25 bp, Mus musculus
agaagatggttctgatcaggacaat

SEQ ID NO: 141461 - DNA, 25 bp, Mus musculus
agaagatgtaccatggagcacctcc

SEQ ID NO: 141462 - DNA, 25 bp, Mus musculus
agaagatgtaccttggagcacctcc

SEQ ID NO: 141463 - DNA, 25 bp, Mus musculus
agaagatgtagtctcgtgtccgcct

SEQ ID NO: 141464 - DNA, 25 bp, Mus musculus
agaagatgtagtgtcgtgtccgcct

SEQ ID NO: 141465 - DNA, 25 bp, Mus musculus
agaagatgtcaccagatcccctgct

SEQ ID NO: 141466 - DNA, 25 bp, Mus musculus
agaagatgtcacgagatcccctgct

SEQ ID NO: 141467 - DNA, 25 bp, Mus musculus
agaagatgtggccacgtgtcctagc

SEQ ID NO: 141468 - DNA, 25 bp, Mus musculus
agaagatgtggcgacgtgtcctagc

SEQ ID NO: 141469 - DNA, 25 bp, Mus musculus
agaagatgtttcactatgcaggaac

SEQ ID NO: 141470 - DNA, 25 bp, Mus musculus
agaagatgtttctctatgcaggaac

SEQ ID NO: 141471 - DNA, 25 bp, Mus musculus
agaagattaccaccagttcgtgagg

SEQ ID NO: 141472 - DNA, 25 bp, Mus musculus
agaagattaccacctccaagaagcc

SEQ ID NO: 141473 - DNA, 25 bp, Mus musculus
agaagattaccagcagttcgtgagg

SEQ ID NO: 141474 - DNA, 25 bp, Mus musculus
agaagattaccagctccaagaagcc

SEQ ID NO: 141475 - DNA, 25 bp, Mus musculus
agaagattatttaggctggcttaat

SEQ ID NO: 141476 - DNA, 25 bp, Mus musculus
agaagattattttggctggcttaat

SEQ ID NO: 141477 - DNA, 25 bp, Mus musculus
agaagattcaacacctcccaagatg

SEQ ID NO: 141478 - DNA, 25 bp, Mus musculus
agaagattcaactcctcccaagatg

SEQ ID NO: 141479 - DNA, 25 bp, Mus musculus
agaagattcacaacctaacccacgc

SEQ ID NO: 141480 - DNA, 25 bp, Mus musculus
agaagattcacatcctaacccacgc

SEQ ID NO: 141481 - DNA, 25 bp, Mus musculus
agaagattcacgaccggaagctgaa

SEQ ID NO: 141482 - DNA, 25 bp, Mus musculus
agaagattcacgtccggaagctgaa

SEQ ID NO: 141483 - DNA, 25 bp, Mus musculus
agaagattccccatggaggctggag

SEQ ID NO: 141484 - DNA, 25 bp, Mus musculus
agaagattccccttggaggctggag

SEQ ID NO: 141485 - DNA, 25 bp, Mus musculus
agaagattccgacgccgctacagaa

SEQ ID NO: 141486 - DNA, 25 bp, Mus musculus
agaagattccgaggccgctacagaa

SEQ ID NO: 141487 - DNA, 25 bp, Mus musculus
agaagattctccattgcccaatgtc

SEQ ID NO: 141488 - DNA, 25 bp, Mus musculus
agaagattctcctttgcccaatgtc

SEQ ID NO: 141489 - DNA, 25 bp, Mus musculus
agaagattctgcaccacacattgtt

SEQ ID NO: 141490 - DNA, 25 bp, Mus musculus
agaagattctgctccacacattgtt

SEQ ID NO: 141491 - DNA, 25 bp, Mus musculus
agaagattggtgagccggctttcca

SEQ ID NO: 141492 - DNA, 25 bp, Mus musculus
agaagattggtgtgccggctttcca

SEQ ID NO: 141493 - DNA, 25 bp, Mus musculus
agaagattgtgtcctgccgcatttg

SEQ ID NO: 141494 - DNA, 25 bp, Mus musculus
agaagattgtgtgctgccgcatttg

SEQ ID NO: 141495 - DNA, 25 bp, Mus musculus
agaagattgttcagcatgggaagtg

SEQ ID NO: 141496 - DNA, 25 bp, Mus musculus
agaagattgttctgcatgggaagtg

SEQ ID NO: 141497 - DNA, 25 bp, Mus musculus
agaagatttcatccctaacttaaaa

SEQ ID NO: 141498 - DNA, 25 bp, Mus musculus
agaagatttcatgcctaacttaaaa

SEQ ID NO: 141499 - DNA, 25 bp, Mus musculus
agaagatttgtcaggaactcaggca

SEQ ID NO: 141500 - DNA, 25 bp, Mus musculus
agaagatttgtctggaactcaggca

SEQ ID NO: 141501 - DNA, 25 bp, Mus musculus
agaagattttatcgcgtttcacaaa

SEQ ID NO: 141502 - DNA, 25 bp, Mus musculus
agaagattttatggcgtttcacaaa

SEQ ID NO: 141503 - DNA, 25 bp, Mus musculus
agaagcaaaccacagctctcttaaa

SEQ ID NO: 141504 - DNA, 25 bp, Mus musculus
agaagcaaaccagagctctcttaaa

SEQ ID NO: 141505 - DNA, 25 bp, Mus musculus
agaagcaaagctcgcatttccccga

SEQ ID NO: 141506 - DNA, 25 bp, Mus musculus
agaagcaaagctggcatttccccga

SEQ ID NO: 141507 - DNA, 25 bp, Mus musculus
agaagcaaatctctgacctctttgc

SEQ ID NO: 141508 - DNA, 25 bp, Mus musculus
agaagcaaatctgtgacctctttgc

SEQ ID NO: 141509 - DNA, 25 bp, Mus musculus
agaagcaaattcactgaaccccaga

SEQ ID NO: 141510 - DNA, 25 bp, Mus musculus
agaagcaaattctctgaaccccaga

SEQ ID NO: 141511 - DNA, 25 bp, Mus musculus
agaagcaacctcataatatccagtt

SEQ ID NO: 141512 - DNA, 25 bp, Mus musculus
agaagcaacctcttaatatccagtt

SEQ ID NO: 141513 - DNA, 25 bp, Mus musculus
agaagcaacgccacgtgttcacaga

SEQ ID NO: 141514 - DNA, 25 bp, Mus musculus
agaagcaacgcctcgtgttcacaga

SEQ ID NO: 141515 - DNA, 25 bp, Mus musculus
agaagcaactgcagctacttcacct

SEQ ID NO: 141516 - DNA, 25 bp, Mus musculus
agaagcaactgctgctacttcacct

SEQ ID NO: 141517 - DNA, 25 bp, Mus musculus
agaagcaagctcactgcgtttcaga

SEQ ID NO: 141518 - DNA, 25 bp, Mus musculus
agaagcaagctctctgcgtttcaga

SEQ ID NO: 141519 - DNA, 25 bp, Mus musculus
agaagcaagtaaccagcccctgggc

SEQ ID NO: 141520 - DNA, 25 bp, Mus musculus
agaagcaagtaagcagcccctgggc

SEQ ID NO: 141521 - DNA, 25 bp, Mus musculus
agaagcaagtctattcatccaccgt

SEQ ID NO: 141522 - DNA, 25 bp, Mus musculus
agaagcaagtcttttcatccaccgt

SEQ ID NO: 141523 - DNA, 25 bp, Mus musculus
agaagcaatagtctgccggtgtgca

SEQ ID NO: 141524 - DNA, 25 bp, Mus musculus
agaagcaatagtgtgccggtgtgca

SEQ ID NO: 141525 - DNA, 25 bp, Mus musculus
agaagcaatatgcatataacaccca

SEQ ID NO: 141526 - DNA, 25 bp, Mus musculus
agaagcaatatggatataacaccca

SEQ ID NO: 141527 - DNA, 25 bp, Mus musculus
agaagcaattcaagcggctgcaaca

SEQ ID NO: 141528 - DNA, 25 bp, Mus musculus
agaagcaattcatgcggctgcaaca

SEQ ID NO: 141529 - DNA, 25 bp, Mus musculus
agaagcaatttcctcagtcctttgg

SEQ ID NO: 141530 - DNA, 25 bp, Mus musculus
agaagcaatttcgtcagtcctttgg

SEQ ID NO: 141531 - DNA, 25 bp, Mus musculus
agaagcacaaatacctgtactgtag

SEQ ID NO: 141532 - DNA, 25 bp, Mus musculus
agaagcacaaattcctgtactgtag

SEQ ID NO: 141533 - DNA, 25 bp, Mus musculus
agaagcacaaccagtctgctacgta

SEQ ID NO: 141534 - DNA, 25 bp, Mus musculus
agaagcacaacctgtctgctacgta

SEQ ID NO: 141535 - DNA, 25 bp, Mus musculus
agaagcacacttccttcttgggcag

SEQ ID NO: 141536 - DNA, 25 bp, Mus musculus
agaagcacacttgcttcttgggcag

SEQ ID NO: 141537 - DNA, 25 bp, Mus musculus
agaagcacagctcttttcctgcagt

SEQ ID NO: 141538 - DNA, 25 bp, Mus musculus
agaagcacagctgttttcctgcagt

SEQ ID NO: 141539 - DNA, 25 bp, Mus musculus
agaagcacaggccacgaacaataat

SEQ ID NO: 141540 - DNA, 25 bp, Mus musculus
agaagcacaggcgacgaacaataat

SEQ ID NO: 141541 - DNA, 25 bp, Mus musculus
agaagcacataaaaccctgggccga

SEQ ID NO: 141542 - DNA, 25 bp, Mus musculus
agaagcacataataccctgggccga

SEQ ID NO: 141543 - DNA, 25 bp, Mus musculus
agaagcacatataggtgaccatcat

SEQ ID NO: 141544 - DNA, 25 bp, Mus musculus
agaagcacatattggtgaccatcat

SEQ ID NO: 141545 - DNA, 25 bp, Mus musculus
agaagcacatggacggactccgcac

SEQ ID NO: 141546 - DNA, 25 bp, Mus musculus
agaagcacatggtcggactccgcac

SEQ ID NO: 141547 - DNA, 25 bp, Mus musculus
agaagcaccagcacagactgattcc

SEQ ID NO: 141548 - DNA, 25 bp, Mus musculus
agaagcaccagctcagactgattcc

SEQ ID NO: 141549 - DNA, 25 bp, Mus musculus
agaagcaccatgattccacgcgtgt

SEQ ID NO: 141550 - DNA, 25 bp, Mus musculus
agaagcaccatgtttccacgcgtgt

SEQ ID NO: 141551 - DNA, 25 bp, Mus musculus
agaagcacccatcgtatctgagaga

SEQ ID NO: 141552 - DNA, 25 bp, Mus musculus
agaagcacccatggtatctgagaga

SEQ ID NO: 141553 - DNA, 25 bp, Mus musculus
agaagcaccctgacatctatgcggt

SEQ ID NO: 141554 - DNA, 25 bp, Mus musculus
agaagcaccctgtcatctatgcggt

SEQ ID NO: 141555 - DNA, 25 bp, Mus musculus
agaagcaccggcaatggcacgctgt

SEQ ID NO: 141556 - DNA, 25 bp, Mus musculus
agaagcaccggctatggcacgctgt

SEQ ID NO: 141557 - DNA, 25 bp, Mus musculus
agaagcaccgtcctcatcagtaggt

SEQ ID NO: 141558 - DNA, 25 bp, Mus musculus
agaagcaccgtcgtcatcagtaggt

SEQ ID NO: 141559 - DNA, 25 bp, Mus musculus
agaagcaccgtgactgaaccgttgc

SEQ ID NO: 141560 - DNA, 25 bp, Mus musculus
agaagcaccgtgtctgaaccgttgc

SEQ ID NO: 141561 - DNA, 25 bp, Mus musculus
agaagcacctagaaagcctggtata

SEQ ID NO: 141562 - DNA, 25 bp, Mus musculus
agaagcacctagtaagcctggtata

SEQ ID NO: 141563 - DNA, 25 bp, Mus musculus
agaagcacctgaaactctcaggcct

SEQ ID NO: 141564 - DNA, 25 bp, Mus musculus
agaagcacctgatactctcaggcct

SEQ ID NO: 141565 - DNA, 25 bp, Mus musculus
agaagcacgtcaacatccacatggg

SEQ ID NO: 141566 - DNA, 25 bp, Mus musculus
agaagcacgtcaccagggcctatgg

SEQ ID NO: 141567 - DNA, 25 bp, Mus musculus
agaagcacgtcagcagggcctatgg

SEQ ID NO: 141568 - DNA, 25 bp, Mus musculus
agaagcacgtcatcatccacatggg

SEQ ID NO: 141569 - DNA, 25 bp, Mus musculus
agaagcactaggatttttacttgcc

SEQ ID NO: 141570 - DNA, 25 bp, Mus musculus
agaagcactaggttttttacttgcc

SEQ ID NO: 141571 - DNA, 25 bp, Mus musculus
agaagcactcccatgtgggtgtctc

SEQ ID NO: 141572 - DNA, 25 bp, Mus musculus
agaagcactcccttgtgggtgtctc

SEQ ID NO: 141573 - DNA, 25 bp, Mus musculus
agaagcactctgcacggtgcagaat

SEQ ID NO: 141574 - DNA, 25 bp, Mus musculus
agaagcactctggacggtgcagaat

SEQ ID NO: 141575 - DNA, 25 bp, Mus musculus
agaagcactgtccacttaggagtcc

SEQ ID NO: 141576 - DNA, 25 bp, Mus musculus
agaagcactgtcgacttaggagtcc

SEQ ID NO: 141577 - DNA, 25 bp, Mus musculus
agaagcacttagaaagccgggcggt

SEQ ID NO: 141578 - DNA, 25 bp, Mus musculus
agaagcacttagtaagccgggcggt

SEQ ID NO: 141579 - DNA, 25 bp, Mus musculus
agaagcacttccacagcgttgaggt

SEQ ID NO: 141580 - DNA, 25 bp, Mus musculus
agaagcacttcctcagcgttgaggt

SEQ ID NO: 141581 - DNA, 25 bp, Mus musculus
agaagcacttgccttcccagcagtg

SEQ ID NO: 141582 - DNA, 25 bp, Mus musculus
agaagcacttgcgttcccagcagtg

SEQ ID NO: 141583 - DNA, 25 bp, Mus musculus
agaagcactttcattccgttgctag

SEQ ID NO: 141584 - DNA, 25 bp, Mus musculus
agaagcactttctttccgttgctag

SEQ ID NO: 141585 - DNA, 25 bp, Mus musculus
agaagcagaagacaacccaagtttt

SEQ ID NO: 141586 - DNA, 25 bp, Mus musculus
agaagcagaagagaacccaagtttt

SEQ ID NO: 141587 - DNA, 25 bp, Mus musculus
agaagcagacccctgtgctcttatt

SEQ ID NO: 141588 - DNA, 25 bp, Mus musculus
agaagcagacccgtgtgctcttatt

SEQ ID NO: 141589 - DNA, 25 bp, Mus musculus
agaagcagactcctaccagtgatgg

SEQ ID NO: 141590 - DNA, 25 bp, Mus musculus
agaagcagactcgtaccagtgatgg

SEQ ID NO: 141591 - DNA, 25 bp, Mus musculus
agaagcagagacacagcgcggctgt

SEQ ID NO: 141592 - DNA, 25 bp, Mus musculus
agaagcagagactcagcgcggctgt

SEQ ID NO: 141593 - DNA, 25 bp, Mus musculus
agaagcagagctccctatctgggtg

SEQ ID NO: 141594 - DNA, 25 bp, Mus musculus
agaagcagagctgcctatctgggtg

SEQ ID NO: 141595 - DNA, 25 bp, Mus musculus
agaagcagatgaaaccactccaggt

SEQ ID NO: 141596 - DNA, 25 bp, Mus musculus
agaagcagatgataccactccaggt

SEQ ID NO: 141597 - DNA, 25 bp, Mus musculus
agaagcagatgcaggtctccctcgc

SEQ ID NO: 141598 - DNA, 25 bp, Mus musculus
agaagcagatgctggtctccctcgc

SEQ ID NO: 141599 - DNA, 25 bp, Mus musculus
agaagcagattcaggcctcttctgt

SEQ ID NO: 141600 - DNA, 25 bp, Mus musculus
agaagcagattctggcctcttctgt

SEQ ID NO: 141601 - DNA, 25 bp, Mus musculus
agaagcagcaacacctgagcacggg

SEQ ID NO: 141602 - DNA, 25 bp, Mus musculus
agaagcagcaactcctgagcacggg

SEQ ID NO: 141603 - DNA, 25 bp, Mus musculus
agaagcagcactcagtgtggagccc

SEQ ID NO: 141604 - DNA, 25 bp, Mus musculus
agaagcagcactccaatccatccga

SEQ ID NO: 141605 - DNA, 25 bp, Mus musculus
agaagcagcactgagtgtggagccc

SEQ ID NO: 141606 - DNA, 25 bp, Mus musculus
agaagcagcactgcaatccatccga

SEQ ID NO: 141607 - DNA, 25 bp, Mus musculus
agaagcagcagtaccatgaccaccc

SEQ ID NO: 141608 - DNA, 25 bp, Mus musculus
agaagcagcagtatccacagcagga

SEQ ID NO: 141609 - DNA, 25 bp, Mus musculus
agaagcagcagttccatgaccaccc

SEQ ID NO: 141610 - DNA, 25 bp, Mus musculus
agaagcagcagtttccacagcagga

SEQ ID NO: 141611 - DNA, 25 bp, Mus musculus
agaagcagcccaccatggagcagac

SEQ ID NO: 141612 - DNA, 25 bp, Mus musculus
agaagcagcccagcatggagcagac

SEQ ID NO: 141613 - DNA, 25 bp, Mus musculus
agaagcagccccattgccgtatgca

SEQ ID NO: 141614 - DNA, 25 bp, Mus musculus
agaagcagcccctttgccgtatgca

SEQ ID NO: 141615 - DNA, 25 bp, Mus musculus
agaagcagccgaacaaaatccagat

SEQ ID NO: 141616 - DNA, 25 bp, Mus musculus
agaagcagccgatcaaaatccagat

SEQ ID NO: 141617 - DNA, 25 bp, Mus musculus
agaagcagccgtcgtttcacggccc

SEQ ID NO: 141618 - DNA, 25 bp, Mus musculus
agaagcagccgtggtttcacggccc

SEQ ID NO: 141619 - DNA, 25 bp, Mus musculus
agaagcagccttctatcttgccttt

SEQ ID NO: 141620 - DNA, 25 bp, Mus musculus
agaagcagccttgtatcttgccttt

SEQ ID NO: 141621 - DNA, 25 bp, Mus musculus
agaagcagcgctaccagcagctggt

SEQ ID NO: 141622 - DNA, 25 bp, Mus musculus
agaagcagcgcttccagcagctggt

SEQ ID NO: 141623 - DNA, 25 bp, Mus musculus
agaagcagctgactagaacatgaac

SEQ ID NO: 141624 - DNA, 25 bp, Mus musculus
agaagcagctgagtagaacatgaac

SEQ ID NO: 141625 - DNA, 25 bp, Mus musculus
agaagcagctgtcccactttatact

SEQ ID NO: 141626 - DNA, 25 bp, Mus musculus
agaagcagctgtgccactttatact

SEQ ID NO: 141627 - DNA, 25 bp, Mus musculus
agaagcagcttacctgcccgagtgg

SEQ ID NO: 141628 - DNA, 25 bp, Mus musculus
agaagcagcttagctgcccgagtgg

SEQ ID NO: 141629 - DNA, 25 bp, Mus musculus
agaagcagcttcctgaacactgcca

SEQ ID NO: 141630 - DNA, 25 bp, Mus musculus
agaagcagcttcgtgaacactgcca

SEQ ID NO: 141631 - DNA, 25 bp, Mus musculus
agaagcagctttacatcctcttgac

SEQ ID NO: 141632 - DNA, 25 bp, Mus musculus
agaagcagcttttcatcctcttgac

SEQ ID NO: 141633 - DNA, 25 bp, Mus musculus
agaagcaggaaaaggccagtcccat

SEQ ID NO: 141634 - DNA, 25 bp, Mus musculus
agaagcaggaaatggccagtcccat

SEQ ID NO: 141635 - DNA, 25 bp, Mus musculus
agaagcaggacgaatacgaggacct

SEQ ID NO: 141636 - DNA, 25 bp, Mus musculus
agaagcaggacgtatacgaggacct

SEQ ID NO: 141637 - DNA, 25 bp, Mus musculus
agaagcaggcaccttgtgggacccc

SEQ ID NO: 141638 - DNA, 25 bp, Mus musculus
agaagcaggcacgttgtgggacccc

SEQ ID NO: 141639 - DNA, 25 bp, Mus musculus
agaagcaggcagaccccaagggtcc

SEQ ID NO: 141640 - DNA, 25 bp, Mus musculus
agaagcaggcagctacccgagtcta

SEQ ID NO: 141641 - DNA, 25 bp, Mus musculus
agaagcaggcaggtacccgagtcta

SEQ ID NO: 141642 - DNA, 25 bp, Mus musculus
agaagcaggcagtccccaagggtcc

SEQ ID NO: 141643 - DNA, 25 bp, Mus musculus
agaagcaggccacggccctttaatt

SEQ ID NO: 141644 - DNA, 25 bp, Mus musculus
agaagcaggccagggccctttaatt

SEQ ID NO: 141645 - DNA, 25 bp, Mus musculus
agaagcaggcctcggatcttcacag

SEQ ID NO: 141646 - DNA, 25 bp, Mus musculus
agaagcaggcctgggatcttcacag

SEQ ID NO: 141647 - DNA, 25 bp, Mus musculus
agaagcaggtcccagcactgagact

SEQ ID NO: 141648 - DNA, 25 bp, Mus musculus
agaagcaggtccgagcactgagact

SEQ ID NO: 141649 - DNA, 25 bp, Mus musculus
agaagcagtaacctctttccagctg

SEQ ID NO: 141650 - DNA, 25 bp, Mus musculus
agaagcagtaacgtctttccagctg

SEQ ID NO: 141651 - DNA, 25 bp, Mus musculus
agaagcagtcacaacggagggcaga

SEQ ID NO: 141652 - DNA, 25 bp, Mus musculus
agaagcagtcactacggagggcaga

SEQ ID NO: 141653 - DNA, 25 bp, Mus musculus
agaagcagtcagaacatttagcaac

SEQ ID NO: 141654 - DNA, 25 bp, Mus musculus
agaagcagtcagtacatttagcaac

SEQ ID NO: 141655 - DNA, 25 bp, Mus musculus
agaagcagtcctagagctgtcctat

SEQ ID NO: 141656 - DNA, 25 bp, Mus musculus
agaagcagtccttgagctgtcctat

SEQ ID NO: 141657 - DNA, 25 bp, Mus musculus
agaagcataactcggctgctgttct

SEQ ID NO: 141658 - DNA, 25 bp, Mus musculus
agaagcataactgggctgctgttct

SEQ ID NO: 141659 - DNA, 25 bp, Mus musculus
agaagcataagcattagcagcagtg

SEQ ID NO: 141660 - DNA, 25 bp, Mus musculus
agaagcataagctttagcagcagtg

SEQ ID NO: 141661 - DNA, 25 bp, Mus musculus
agaagcataatgctgtcaccctcac

SEQ ID NO: 141662 - DNA, 25 bp, Mus musculus
agaagcataatggtgtcaccctcac

SEQ ID NO: 141663 - DNA, 25 bp, Mus musculus
agaagcatagctagtttgccaccaa

SEQ ID NO: 141664 - DNA, 25 bp, Mus musculus
agaagcatagcttgtttgccaccaa

SEQ ID NO: 141665 - DNA, 25 bp, Mus musculus
agaagcatatctatctcctgccgag

SEQ ID NO: 141666 - DNA, 25 bp, Mus musculus
agaagcatatctttctcctgccgag

SEQ ID NO: 141667 - DNA, 25 bp, Mus musculus
agaagcatcataccactgtgtttta

SEQ ID NO: 141668 - DNA, 25 bp, Mus musculus
agaagcatcatagcactgtgtttta

SEQ ID NO: 141669 - DNA, 25 bp, Mus musculus
agaagcatccaactgcctgcttgtc

SEQ ID NO: 141670 - DNA, 25 bp, Mus musculus
agaagcatccaagtgcctgcttgtc

SEQ ID NO: 141671 - DNA, 25 bp, Mus musculus
agaagcatccagcttagtggccatc

SEQ ID NO: 141672 - DNA, 25 bp, Mus musculus
agaagcatccaggttagtggccatc

SEQ ID NO: 141673 - DNA, 25 bp, Mus musculus
agaagcatcctgattgtccatcaag

SEQ ID NO: 141674 - DNA, 25 bp, Mus musculus
agaagcatcctgtttgtccatcaag

SEQ ID NO: 141675 - DNA, 25 bp, Mus musculus
agaagcatccttcacatgagccctt

SEQ ID NO: 141676 - DNA, 25 bp, Mus musculus
agaagcatccttgacatgagccctt

SEQ ID NO: 141677 - DNA, 25 bp, Mus musculus
agaagcatcgccaggagccgagagt

SEQ ID NO: 141678 - DNA, 25 bp, Mus musculus
agaagcatcgcctggagccgagagt

SEQ ID NO: 141679 - DNA, 25 bp, Mus musculus
agaagcatctgtcggcatcttgcct

SEQ ID NO: 141680 - DNA, 25 bp, Mus musculus
agaagcatctgtgggcatcttgcct

SEQ ID NO: 141681 - DNA, 25 bp, Mus musculus
agaagcatgactctggcctgttgtc

SEQ ID NO: 141682 - DNA, 25 bp, Mus musculus
agaagcatgactgtggcctgttgtc

SEQ ID NO: 141683 - DNA, 25 bp, Mus musculus
agaagcatgcgcaggaacgctttga

SEQ ID NO: 141684 - DNA, 25 bp, Mus musculus
agaagcatgcgctggaacgctttga

SEQ ID NO: 141685 - DNA, 25 bp, Mus musculus
agaagcatgcttcgacgccaggcac

SEQ ID NO: 141686 - DNA, 25 bp, Mus musculus
agaagcatgcttggacgccaggcac

SEQ ID NO: 141687 - DNA, 25 bp, Mus musculus
agaagcatggttaatagtcagggta

SEQ ID NO: 141688 - DNA, 25 bp, Mus musculus
agaagcatggttccttcccactctg

SEQ ID NO: 141689 - DNA, 25 bp, Mus musculus
agaagcatggttgcttcccactctg

SEQ ID NO: 141690 - DNA, 25 bp, Mus musculus
agaagcatggtttatagtcagggta

SEQ ID NO: 141691 - DNA, 25 bp, Mus musculus
agaagcattgctatcagtgggctgc

SEQ ID NO: 141692 - DNA, 25 bp, Mus musculus
agaagcattgctttcagtgggctgc

SEQ ID NO: 141693 - DNA, 25 bp, Mus musculus
agaagccaaaacaatccagtggaaa

SEQ ID NO: 141694 - DNA, 25 bp, Mus musculus
agaagccaaaactatccagtggaaa

SEQ ID NO: 141695 - DNA, 25 bp, Mus musculus
agaagccaactgctgccagctgacg

SEQ ID NO: 141696 - DNA, 25 bp, Mus musculus
agaagccaactggtgccagctgacg

SEQ ID NO: 141697 - DNA, 25 bp, Mus musculus
agaagccaagatatagagcaccatg

SEQ ID NO: 141698 - DNA, 25 bp, Mus musculus
agaagccaagatttagagcaccatg

SEQ ID NO: 141699 - DNA, 25 bp, Mus musculus
agaagccaaggcagcttgcgttcac

SEQ ID NO: 141700 - DNA, 25 bp, Mus musculus
agaagccaaggctgcttgcgttcac

SEQ ID NO: 141701 - DNA, 25 bp, Mus musculus
agaagccaatccatggcgtcggaca

SEQ ID NO: 141702 - DNA, 25 bp, Mus musculus
agaagccaatccttggcgtcggaca

SEQ ID NO: 141703 - DNA, 25 bp, Mus musculus
agaagccacatacctttcacttttc

SEQ ID NO: 141704 - DNA, 25 bp, Mus musculus
agaagccacatagctttcacttttc

SEQ ID NO: 141705 - DNA, 25 bp, Mus musculus
agaagccacctcacccggaaagaca

SEQ ID NO: 141706 - DNA, 25 bp, Mus musculus
agaagccacctctcccggaaagaca

SEQ ID NO: 141707 - DNA, 25 bp, Mus musculus
agaagccacctgattgttactatac

SEQ ID NO: 141708 - DNA, 25 bp, Mus musculus
agaagccacctgcagtctctgttct

SEQ ID NO: 141709 - DNA, 25 bp, Mus musculus
agaagccacctggagtctctgttct

SEQ ID NO: 141710 - DNA, 25 bp, Mus musculus
agaagccacctgtttgttactatac

SEQ ID NO: 141711 - DNA, 25 bp, Mus musculus
agaagccaccttaagtctttctcga

SEQ ID NO: 141712 - DNA, 25 bp, Mus musculus
agaagccacctttagtctttctcga

SEQ ID NO: 141713 - DNA, 25 bp, Mus musculus
agaagccacggtatctgagggcagt

SEQ ID NO: 141714 - DNA, 25 bp, Mus musculus
agaagccacggtttctgagggcagt

SEQ ID NO: 141715 - DNA, 25 bp, Mus musculus
agaagccagaatacctgtgagcccc

SEQ ID NO: 141716 - DNA, 25 bp, Mus musculus
agaagccagaattcctgtgagcccc

SEQ ID NO: 141717 - DNA, 25 bp, Mus musculus
agaagccagaccatacactcagctt

SEQ ID NO: 141718 - DNA, 25 bp, Mus musculus
agaagccagaccttacactcagctt

SEQ ID NO: 141719 - DNA, 25 bp, Mus musculus
agaagccagagacaggcgatttttg

SEQ ID NO: 141720 - DNA, 25 bp, Mus musculus
agaagccagagaccgccatgtgaag

SEQ ID NO: 141721 - DNA, 25 bp, Mus musculus
agaagccagagagaggcgatttttg

SEQ ID NO: 141722 - DNA, 25 bp, Mus musculus
agaagccagagagcgccatgtgaag

SEQ ID NO: 141723 - DNA, 25 bp, Mus musculus
agaagccagagtatagtccaacact

SEQ ID NO: 141724 - DNA, 25 bp, Mus musculus
agaagccagagtttagtccaacact

SEQ ID NO: 141725 - DNA, 25 bp, Mus musculus
agaagccagcagaccgcaggcagtt

SEQ ID NO: 141726 - DNA, 25 bp, Mus musculus
agaagccagcagtccgcaggcagtt

SEQ ID NO: 141727 - DNA, 25 bp, Mus musculus
agaagccaggacctgcatcctacag

SEQ ID NO: 141728 - DNA, 25 bp, Mus musculus
agaagccaggacgtgcatcctacag

SEQ ID NO: 141729 - DNA, 25 bp, Mus musculus
agaagccaggcacaagcccttggac

SEQ ID NO: 141730 - DNA, 25 bp, Mus musculus
agaagccaggcacttctcccaaact

SEQ ID NO: 141731 - DNA, 25 bp, Mus musculus
agaagccaggcagaagcccttggac

SEQ ID NO: 141732 - DNA, 25 bp, Mus musculus
agaagccaggcagttctcccaaact

SEQ ID NO: 141733 - DNA, 25 bp, Mus musculus
agaagccagtataagcctagatctc

SEQ ID NO: 141734 - DNA, 25 bp, Mus musculus
agaagccagtatcatcaccagccaa

SEQ ID NO: 141735 - DNA, 25 bp, Mus musculus
agaagccagtatgatcaccagccaa

SEQ ID NO: 141736 - DNA, 25 bp, Mus musculus
agaagccagtattagcctagatctc

SEQ ID NO: 141737 - DNA, 25 bp, Mus musculus
agaagccagtgactcactccttgat

SEQ ID NO: 141738 - DNA, 25 bp, Mus musculus
agaagccagtgagtcactccttgat

SEQ ID NO: 141739 - DNA, 25 bp, Mus musculus
agaagccagtgtactcagagggaca

SEQ ID NO: 141740 - DNA, 25 bp, Mus musculus
agaagccagtgttctcagagggaca

SEQ ID NO: 141741 - DNA, 25 bp, Mus musculus
agaagccagttaccgtgtctgctca

SEQ ID NO: 141742 - DNA, 25 bp, Mus musculus
agaagccagttagcgtgtctgctca

SEQ ID NO: 141743 - DNA, 25 bp, Mus musculus
agaagccagttgactgctttagcct

SEQ ID NO: 141744 - DNA, 25 bp, Mus musculus
agaagccagttgtctgctttagcct

SEQ ID NO: 141745 - DNA, 25 bp, Mus musculus
agaagccatccacttgcaattgggc

SEQ ID NO: 141746 - DNA, 25 bp, Mus musculus
agaagccatccagttgcaattgggc

SEQ ID NO: 141747 - DNA, 25 bp, Mus musculus
agaagccatgaactgtcctagaagc

SEQ ID NO: 141748 - DNA, 25 bp, Mus musculus
agaagccatgaagtgtcctagaagc

SEQ ID NO: 141749 - DNA, 25 bp, Mus musculus
agaagccatgagactgctgctgcct

SEQ ID NO: 141750 - DNA, 25 bp, Mus musculus
agaagccatgagtctgctgctgcct

SEQ ID NO: 141751 - DNA, 25 bp, Mus musculus
agaagccatgtacccattttgttca

SEQ ID NO: 141752 - DNA, 25 bp, Mus musculus
agaagccatgtagccattttgttca

SEQ ID NO: 141753 - DNA, 25 bp, Mus musculus
agaagccattatacctgagtctgat

SEQ ID NO: 141754 - DNA, 25 bp, Mus musculus
agaagccattattcctgagtctgat

SEQ ID NO: 141755 - DNA, 25 bp, Mus musculus
agaagccattccagacccagtctct

SEQ ID NO: 141756 - DNA, 25 bp, Mus musculus
agaagccattcccactctgaaggtc

SEQ ID NO: 141757 - DNA, 25 bp, Mus musculus
agaagccattccctttgtgtggttt

SEQ ID NO: 141758 - DNA, 25 bp, Mus musculus
agaagccattccgactctgaaggtc

SEQ ID NO: 141759 - DNA, 25 bp, Mus musculus
agaagccattccgtttgtgtggttt

SEQ ID NO: 141760 - DNA, 25 bp, Mus musculus
agaagccattcctgacccagtctct

SEQ ID NO: 141761 - DNA, 25 bp, Mus musculus
agaagccatttaacactgggcttgg

SEQ ID NO: 141762 - DNA, 25 bp, Mus musculus
agaagccatttatcactgggcttgg

SEQ ID NO: 141763 - DNA, 25 bp, Mus musculus
agaagcccaactaacagaactccaa

SEQ ID NO: 141764 - DNA, 25 bp, Mus musculus
agaagcccaacttacagaactccaa

SEQ ID NO: 141765 - DNA, 25 bp, Mus musculus
agaagcccactgatggcgacaagtc

SEQ ID NO: 141766 - DNA, 25 bp, Mus musculus
agaagcccactgttggcgacaagtc

SEQ ID NO: 141767 - DNA, 25 bp, Mus musculus
agaagcccacttccgaatcaataaa

SEQ ID NO: 141768 - DNA, 25 bp, Mus musculus
agaagcccacttgcgaatcaataaa

SEQ ID NO: 141769 - DNA, 25 bp, Mus musculus
agaagcccagaaagaacttgaactt

SEQ ID NO: 141770 - DNA, 25 bp, Mus musculus
agaagcccagaatgaacttgaactt

SEQ ID NO: 141771 - DNA, 25 bp, Mus musculus
agaagcccagacctgtagccatgtg

SEQ ID NO: 141772 - DNA, 25 bp, Mus musculus
agaagcccagacgtgtagccatgtg

SEQ ID NO: 141773 - DNA, 25 bp, Mus musculus
agaagcccatatagtgccgaaggat

SEQ ID NO: 141774 - DNA, 25 bp, Mus musculus
agaagcccatattgtgccgaaggat

SEQ ID NO: 141775 - DNA, 25 bp, Mus musculus
agaagcccatctccaaagcgaagaa

SEQ ID NO: 141776 - DNA, 25 bp, Mus musculus
agaagcccatctgcaaagcgaagaa

SEQ ID NO: 141777 - DNA, 25 bp, Mus musculus
agaagcccatgaatttgaggattaa

SEQ ID NO: 141778 - DNA, 25 bp, Mus musculus
agaagcccatgattttgaggattaa

SEQ ID NO: 141779 - DNA, 25 bp, Mus musculus
agaagcccatttacttcatctcggt

SEQ ID NO: 141780 - DNA, 25 bp, Mus musculus
agaagcccattttcttcatctcggt

SEQ ID NO: 141781 - DNA, 25 bp, Mus musculus
agaagccccgtgcaggaatctctct

SEQ ID NO: 141782 - DNA, 25 bp, Mus musculus
agaagccccgtggaggaatctctct

SEQ ID NO: 141783 - DNA, 25 bp, Mus musculus
agaagccccttgctatttcgcagat

SEQ ID NO: 141784 - DNA, 25 bp, Mus musculus
agaagccccttgctctgggaatggc

SEQ ID NO: 141785 - DNA, 25 bp, Mus musculus
agaagccccttggtatttcgcagat

SEQ ID NO: 141786 - DNA, 25 bp, Mus musculus
agaagccccttggtctgggaatggc

SEQ ID NO: 141787 - DNA, 25 bp, Mus musculus
agaagcccgatgacctgtggcctga

SEQ ID NO: 141788 - DNA, 25 bp, Mus musculus
agaagcccgatgtcctgtggcctga

SEQ ID NO: 141789 - DNA, 25 bp, Mus musculus
agaagcccgcttcaaccagctggtt

SEQ ID NO: 141790 - DNA, 25 bp, Mus musculus
agaagcccgcttgaaccagctggtt

SEQ ID NO: 141791 - DNA, 25 bp, Mus musculus
agaagcccgggaccattcagaagag

SEQ ID NO: 141792 - DNA, 25 bp, Mus musculus
agaagcccgggagcattcagaagag

SEQ ID NO: 141793 - DNA, 25 bp, Mus musculus
agaagcccgtacaatagccatatgg

SEQ ID NO: 141794 - DNA, 25 bp, Mus musculus
agaagcccgtactatagccatatgg

SEQ ID NO: 141795 - DNA, 25 bp, Mus musculus
agaagccctactagcgaagagctgg

SEQ ID NO: 141796 - DNA, 25 bp, Mus musculus
agaagccctacttgcgaagagctgg

SEQ ID NO: 141797 - DNA, 25 bp, Mus musculus
agaagccctgccctctgtatagtat

SEQ ID NO: 141798 - DNA, 25 bp, Mus musculus
agaagccctgccgtctgtatagtat

SEQ ID NO: 141799 - DNA, 25 bp, Mus musculus
agaagccctgctctttgagacttgc

SEQ ID NO: 141800 - DNA, 25 bp, Mus musculus
agaagccctgctgtttgagacttgc

SEQ ID NO: 141801 - DNA, 25 bp, Mus musculus
agaagccctggacagaatcaagaaa

SEQ ID NO: 141802 - DNA, 25 bp, Mus musculus
agaagccctggacatcatttacaca

SEQ ID NO: 141803 - DNA, 25 bp, Mus musculus
agaagccctggacggaatctgtgat

SEQ ID NO: 141804 - DNA, 25 bp, Mus musculus
agaagccctggagagaatcaagaaa

SEQ ID NO: 141805 - DNA, 25 bp, Mus musculus
agaagccctggagatcatttacaca

SEQ ID NO: 141806 - DNA, 25 bp, Mus musculus
agaagccctggagggaatctgtgat

SEQ ID NO: 141807 - DNA, 25 bp, Mus musculus
agaagccctggcctcaattcagaac

SEQ ID NO: 141808 - DNA, 25 bp, Mus musculus
agaagccctggccttcatcaattct

SEQ ID NO: 141809 - DNA, 25 bp, Mus musculus
agaagccctggcgtcaattcagaac

SEQ ID NO: 141810 - DNA, 25 bp, Mus musculus
agaagccctggcgttcatcaattct

SEQ ID NO: 141811 - DNA, 25 bp, Mus musculus
agaagccctgggagtcacgcaagcc

SEQ ID NO: 141812 - DNA, 25 bp, Mus musculus
agaagccctgggtgtcacgcaagcc

SEQ ID NO: 141813 - DNA, 25 bp, Mus musculus
agaagccctggtctgctctactggg

SEQ ID NO: 141814 - DNA, 25 bp, Mus musculus
agaagccctggtgtgctctactggg

SEQ ID NO: 141815 - DNA, 25 bp, Mus musculus
agaagccctgtgaagaacagcctgt

SEQ ID NO: 141816 - DNA, 25 bp, Mus musculus
agaagccctgtgatgtctgatgtca

SEQ ID NO: 141817 - DNA, 25 bp, Mus musculus
agaagccctgtgtagaacagcctgt

SEQ ID NO: 141818 - DNA, 25 bp, Mus musculus
agaagccctgtgttgtctgatgtca

SEQ ID NO: 141819 - DNA, 25 bp, Mus musculus
agaagcccttcaaatacaccacagt

SEQ ID NO: 141820 - DNA, 25 bp, Mus musculus
agaagcccttcatatacaccacagt

SEQ ID NO: 141821 - DNA, 25 bp, Mus musculus
agaagccctttcagaagcctgcttt

SEQ ID NO: 141822 - DNA, 25 bp, Mus musculus
agaagccctttctgaagcctgcttt

SEQ ID NO: 141823 - DNA, 25 bp, Mus musculus
agaagccgacacagtgacgacgctc

SEQ ID NO: 141824 - DNA, 25 bp, Mus musculus
agaagccgacactgtgacgacgctc

SEQ ID NO: 141825 - DNA, 25 bp, Mus musculus
agaagccgaggccatcgctgcagcc

SEQ ID NO: 141826 - DNA, 25 bp, Mus musculus
agaagccgaggcgatcgctgcagcc

SEQ ID NO: 141827 - DNA, 25 bp, Mus musculus
agaagccgaggtaccgagttgccat

SEQ ID NO: 141828 - DNA, 25 bp, Mus musculus
agaagccgaggttccgagttgccat

SEQ ID NO: 141829 - DNA, 25 bp, Mus musculus
agaagccgatcgaccgcgagaagac

SEQ ID NO: 141830 - DNA, 25 bp, Mus musculus
agaagccgatcgtccgcgagaagac

SEQ ID NO: 141831 - DNA, 25 bp, Mus musculus
agaagccgcagaccaaactgctcat

SEQ ID NO: 141832 - DNA, 25 bp, Mus musculus
agaagccgcagagcaaactgctcat

SEQ ID NO: 141833 - DNA, 25 bp, Mus musculus
agaagccgccagagctcatgtttct

SEQ ID NO: 141834 - DNA, 25 bp, Mus musculus
agaagccgccagtgctcatgtttct

SEQ ID NO: 141835 - DNA, 25 bp, Mus musculus
agaagccgcccgagagcgatgacga

SEQ ID NO: 141836 - DNA, 25 bp, Mus musculus
agaagccgcccgtgagcgatgacga

SEQ ID NO: 141837 - DNA, 25 bp, Mus musculus
agaagccggagcattcagaagagaa

SEQ ID NO: 141838 - DNA, 25 bp, Mus musculus
agaagccggagctttcagaagagaa

SEQ ID NO: 141839 - DNA, 25 bp, Mus musculus
agaagccggcaacgctcccagcaaa

SEQ ID NO: 141840 - DNA, 25 bp, Mus musculus
agaagccggcaaggctcccagcaaa

SEQ ID NO: 141841 - DNA, 25 bp, Mus musculus
agaagccggttcaggagagtaactt

SEQ ID NO: 141842 - DNA, 25 bp, Mus musculus
agaagccggttctggagagtaactt

SEQ ID NO: 141843 - DNA, 25 bp, Mus musculus
agaagccgtacaaggagacatcccc

SEQ ID NO: 141844 - DNA, 25 bp, Mus musculus
agaagccgtacatggagacatcccc

SEQ ID NO: 141845 - DNA, 25 bp, Mus musculus
agaagccgtatcagctgattgccca

SEQ ID NO: 141846 - DNA, 25 bp, Mus musculus
agaagccgtatctgctgattgccca

SEQ ID NO: 141847 - DNA, 25 bp, Mus musculus
agaagccgtggtacacatgagccag

SEQ ID NO: 141848 - DNA, 25 bp, Mus musculus
agaagccgtggttcacatgagccag

SEQ ID NO: 141849 - DNA, 25 bp, Mus musculus
agaagccgttgcagagggccctgat

SEQ ID NO: 141850 - DNA, 25 bp, Mus musculus
agaagccgttgctgagggccctgat

SEQ ID NO: 141851 - DNA, 25 bp, Mus musculus
agaagcctaaggacgctcagccagt

SEQ ID NO: 141852 - DNA, 25 bp, Mus musculus
agaagcctaaggtcgctcagccagt

SEQ ID NO: 141853 - DNA, 25 bp, Mus musculus
agaagcctacatctagtcttccctt

SEQ ID NO: 141854 - DNA, 25 bp, Mus musculus
agaagcctacatgtagtcttccctt

SEQ ID NO: 141855 - DNA, 25 bp, Mus musculus
agaagcctactgattgcagccacgg

SEQ ID NO: 141856 - DNA, 25 bp, Mus musculus
agaagcctactgtttgcagccacgg

SEQ ID NO: 141857 - DNA, 25 bp, Mus musculus
agaagcctacttacctgaggcagca

SEQ ID NO: 141858 - DNA, 25 bp, Mus musculus
agaagcctactttcctgaggcagca

SEQ ID NO: 141859 - DNA, 25 bp, Mus musculus
agaagcctaggccatccagtgacac

SEQ ID NO: 141860 - DNA, 25 bp, Mus musculus
agaagcctaggcgatccagtgacac

SEQ ID NO: 141861 - DNA, 25 bp, Mus musculus
agaagcctaggtcttgcccagccgt

SEQ ID NO: 141862 - DNA, 25 bp, Mus musculus
agaagcctaggtgttgcccagccgt

SEQ ID NO: 141863 - DNA, 25 bp, Mus musculus
agaagcctagttatgttcccaagca

SEQ ID NO: 141864 - DNA, 25 bp, Mus musculus
agaagcctagttttgttcccaagca

SEQ ID NO: 141865 - DNA, 25 bp, Mus musculus
agaagcctcagcaagcctgatggcg

SEQ ID NO: 141866 - DNA, 25 bp, Mus musculus
agaagcctcagctagcctgatggcg

SEQ ID NO: 141867 - DNA, 25 bp, Mus musculus
agaagcctccaaaccagagctgcgg

SEQ ID NO: 141868 - DNA, 25 bp, Mus musculus
agaagcctccaatccagagctgcgg

SEQ ID NO: 141869 - DNA, 25 bp, Mus musculus
agaagcctcctgaatacgccagtgg

SEQ ID NO: 141870 - DNA, 25 bp, Mus musculus
agaagcctcctgactccgagtggtt

SEQ ID NO: 141871 - DNA, 25 bp, Mus musculus
agaagcctcctgtatacgccagtgg

SEQ ID NO: 141872 - DNA, 25 bp, Mus musculus
agaagcctcctgtctccgagtggtt

SEQ ID NO: 141873 - DNA, 25 bp, Mus musculus
agaagcctcgtacctgatttcagca

SEQ ID NO: 141874 - DNA, 25 bp, Mus musculus
agaagcctcgtagctgatttcagca

SEQ ID NO: 141875 - DNA, 25 bp, Mus musculus
agaagcctctgaccttgtgttccct

SEQ ID NO: 141876 - DNA, 25 bp, Mus musculus
agaagcctctgagcttgtgttccct

SEQ ID NO: 141877 - DNA, 25 bp, Mus musculus
agaagcctctgcctgatcatgtgag

SEQ ID NO: 141878 - DNA, 25 bp, Mus musculus
agaagcctctgcgtgatcatgtgag

SEQ ID NO: 141879 - DNA, 25 bp, Mus musculus
agaagcctgcagctgccgaggaaaa

SEQ ID NO: 141880 - DNA, 25 bp, Mus musculus
agaagcctgcaggtgccgaggaaaa

SEQ ID NO: 141881 - DNA, 25 bp, Mus musculus
agaagcctgccaaggctgctgccag

SEQ ID NO: 141882 - DNA, 25 bp, Mus musculus
agaagcctgccatggctgctgccag

SEQ ID NO: 141883 - DNA, 25 bp, Mus musculus
agaagcctgcctagtgggagttccc

SEQ ID NO: 141884 - DNA, 25 bp, Mus musculus
agaagcctgccttgtgggagttccc

SEQ ID NO: 141885 - DNA, 25 bp, Mus musculus
agaagcctgcttcattttgtctgat

SEQ ID NO: 141886 - DNA, 25 bp, Mus musculus
agaagcctgcttgattttgtctgat

SEQ ID NO: 141887 - DNA, 25 bp, Mus musculus
agaagcctggacacccctggtgggt

SEQ ID NO: 141888 - DNA, 25 bp, Mus musculus
agaagcctggactcccctggtgggt

SEQ ID NO: 141889 - DNA, 25 bp, Mus musculus
agaagcctggagcaacttcagaaga

SEQ ID NO: 141890 - DNA, 25 bp, Mus musculus
agaagcctggaggaacttcagaaga

SEQ ID NO: 141891 - DNA, 25 bp, Mus musculus
agaagcctggatatctttcggcaag

SEQ ID NO: 141892 - DNA, 25 bp, Mus musculus
agaagcctggatttctttcggcaag

SEQ ID NO: 141893 - DNA, 25 bp, Mus musculus
agaagcctgggtcggtaactacaag

SEQ ID NO: 141894 - DNA, 25 bp, Mus musculus
agaagcctgggtgggtaactacaag

SEQ ID NO: 141895 - DNA, 25 bp, Mus musculus
agaagcctggtaccagtgtctcagt

SEQ ID NO: 141896 - DNA, 25 bp, Mus musculus
agaagcctggtagcagtgtctcagt

SEQ ID NO: 141897 - DNA, 25 bp, Mus musculus
agaagcctggttctgctctgacgtt

SEQ ID NO: 141898 - DNA, 25 bp, Mus musculus
agaagcctggttgtgctctgacgtt

SEQ ID NO: 141899 - DNA, 25 bp, Mus musculus
agaagcctgtccattctaaacgcag

SEQ ID NO: 141900 - DNA, 25 bp, Mus musculus
agaagcctgtcctttctaaacgcag

SEQ ID NO: 141901 - DNA, 25 bp, Mus musculus
agaagccttaccaaagtcagccgtc

SEQ ID NO: 141902 - DNA, 25 bp, Mus musculus
agaagccttacctaagtcagccgtc

SEQ ID NO: 141903 - DNA, 25 bp, Mus musculus
agaagccttcccaagtctgctgaag

SEQ ID NO: 141904 - DNA, 25 bp, Mus musculus
agaagccttccctagtctgctgaag

SEQ ID NO: 141905 - DNA, 25 bp, Mus musculus
agaagccttgctacagggtggtgaa

SEQ ID NO: 141906 - DNA, 25 bp, Mus musculus
agaagccttgcttcagggtggtgaa

SEQ ID NO: 141907 - DNA, 25 bp, Mus musculus
agaagcctttgacgtcatccattcc

SEQ ID NO: 141908 - DNA, 25 bp, Mus musculus
agaagcctttgaggtcatccattcc

SEQ ID NO: 141909 - DNA, 25 bp, Mus musculus
agaagccttttcacatgactctctg

SEQ ID NO: 141910 - DNA, 25 bp, Mus musculus
agaagccttttctcatgactctctg

SEQ ID NO: 141911 - DNA, 25 bp, Mus musculus
agaagcgaaactcagggacccctgt

SEQ ID NO: 141912 - DNA, 25 bp, Mus musculus
agaagcgaaactgagggacccctgt

SEQ ID NO: 141913 - DNA, 25 bp, Mus musculus
agaagcgaaagcctctcaatgcccg

SEQ ID NO: 141914 - DNA, 25 bp, Mus musculus
agaagcgaaagcgtctcaatgcccg

SEQ ID NO: 141915 - DNA, 25 bp, Mus musculus
agaagcgacgccacaaagttaccct

SEQ ID NO: 141916 - DNA, 25 bp, Mus musculus
agaagcgacgcctcaaagttaccct

SEQ ID NO: 141917 - DNA, 25 bp, Mus musculus
agaagcgactgcagccacttctgtg

SEQ ID NO: 141918 - DNA, 25 bp, Mus musculus
agaagcgactgctgccacttctgtg

SEQ ID NO: 141919 - DNA, 25 bp, Mus musculus
agaagcgactggaggtctatttaca

SEQ ID NO: 141920 - DNA, 25 bp, Mus musculus
agaagcgactggtggtctatttaca

SEQ ID NO: 141921 - DNA, 25 bp, Mus musculus
agaagcgactttactcttgcaacgc

SEQ ID NO: 141922 - DNA, 25 bp, Mus musculus
agaagcgacttttctcttgcaacgc

SEQ ID NO: 141923 - DNA, 25 bp, Mus musculus
agaagcgagaacactggtgctgccc

SEQ ID NO: 141924 - DNA, 25 bp, Mus musculus
agaagcgagaactctggtgctgccc

SEQ ID NO: 141925 - DNA, 25 bp, Mus musculus
agaagcgagggccttttcctggctc

SEQ ID NO: 141926 - DNA, 25 bp, Mus musculus
agaagcgagggcgttttcctggctc

SEQ ID NO: 141927 - DNA, 25 bp, Mus musculus
agaagcgagtccctaatgcctacga

SEQ ID NO: 141928 - DNA, 25 bp, Mus musculus
agaagcgagtccgtaatgcctacga

SEQ ID NO: 141929 - DNA, 25 bp, Mus musculus
agaagcgatcgccaaaatccggtca

SEQ ID NO: 141930 - DNA, 25 bp, Mus musculus
agaagcgatcgcgaaaatccggtca

SEQ ID NO: 141931 - DNA, 25 bp, Mus musculus
agaagcgatgggacagactctggcc

SEQ ID NO: 141932 - DNA, 25 bp, Mus musculus
agaagcgatgggtcagactctggcc

SEQ ID NO: 141933 - DNA, 25 bp, Mus musculus
agaagcgcaacaacgaagccgtcaa

SEQ ID NO: 141934 - DNA, 25 bp, Mus musculus
agaagcgcaacatcgaagccgtcaa

SEQ ID NO: 141935 - DNA, 25 bp, Mus musculus
agaagcgcagtccttggcaatgaag

SEQ ID NO: 141936 - DNA, 25 bp, Mus musculus
agaagcgcagtcgttggcaatgaag

SEQ ID NO: 141937 - DNA, 25 bp, Mus musculus
agaagcgcatggaacagactccctg

SEQ ID NO: 141938 - DNA, 25 bp, Mus musculus
agaagcgcatggtacagactccctg

SEQ ID NO: 141939 - DNA, 25 bp, Mus musculus
agaagcgcatttcagcgcagcgcag

SEQ ID NO: 141940 - DNA, 25 bp, Mus musculus
agaagcgcatttgagcgcagcgcag

SEQ ID NO: 141941 - DNA, 25 bp, Mus musculus
agaagcgccttcactgtcaggtaag

SEQ ID NO: 141942 - DNA, 25 bp, Mus musculus
agaagcgccttctctgtcaggtaag

SEQ ID NO: 141943 - DNA, 25 bp, Mus musculus
agaagcgctataaggccattcccag

SEQ ID NO: 141944 - DNA, 25 bp, Mus musculus
agaagcgctatatggccattcccag

SEQ ID NO: 141945 - DNA, 25 bp, Mus musculus
agaagcgctcacacgaagcctattt

SEQ ID NO: 141946 - DNA, 25 bp, Mus musculus
agaagcgctcactcgaagcctattt

SEQ ID NO: 141947 - DNA, 25 bp, Mus musculus
agaagcgctgctcgttgactccagg

SEQ ID NO: 141948 - DNA, 25 bp, Mus musculus
agaagcgctgctggttgactccagg

SEQ ID NO: 141949 - DNA, 25 bp, Mus musculus
agaagcgcttgtcgcattccgggca

SEQ ID NO: 141950 - DNA, 25 bp, Mus musculus
agaagcgcttgtggcattccgggca

SEQ ID NO: 141951 - DNA, 25 bp, Mus musculus
agaagcggaattacctccagtattt

SEQ ID NO: 141952 - DNA, 25 bp, Mus musculus
agaagcggaatttcctccagtattt

SEQ ID NO: 141953 - DNA, 25 bp, Mus musculus
agaagcggacgcacctttttccatt

SEQ ID NO: 141954 - DNA, 25 bp, Mus musculus
agaagcggacgctcctttttccatt

SEQ ID NO: 141955 - DNA, 25 bp, Mus musculus
agaagcggctatacttccaggaagc

SEQ ID NO: 141956 - DNA, 25 bp, Mus musculus
agaagcggctattcttccaggaagc

SEQ ID NO: 141957 - DNA, 25 bp, Mus musculus
agaagcggcttcagggacttcgcat

SEQ ID NO: 141958 - DNA, 25 bp, Mus musculus
agaagcggcttctgggacttcgcat

SEQ ID NO: 141959 - DNA, 25 bp, Mus musculus
agaagcgggaagacccctgagaaca

SEQ ID NO: 141960 - DNA, 25 bp, Mus musculus
agaagcgggaagtcccctgagaaca

SEQ ID NO: 141961 - DNA, 25 bp, Mus musculus
agaagcgggttcacttcgacacttc

SEQ ID NO: 141962 - DNA, 25 bp, Mus musculus
agaagcgggttctcttcgacacttc

SEQ ID NO: 141963 - DNA, 25 bp, Mus musculus
agaagcggtatcaccgggcactagg

SEQ ID NO: 141964 - DNA, 25 bp, Mus musculus
agaagcggtatctccgggcactagg

SEQ ID NO: 141965 - DNA, 25 bp, Mus musculus
agaagcgtagccaccaccgtgcacg

SEQ ID NO: 141966 - DNA, 25 bp, Mus musculus
agaagcgtagcctccaccgtgcacg

SEQ ID NO: 141967 - DNA, 25 bp, Mus musculus
agaagcgtcacaagaacatgtctgt

SEQ ID NO: 141968 - DNA, 25 bp, Mus musculus
agaagcgtcacatgaacatgtctgt

SEQ ID NO: 141969 - DNA, 25 bp, Mus musculus
agaagcgtccctccggaagcgtttc

SEQ ID NO: 141970 - DNA, 25 bp, Mus musculus
agaagcgtccctgcggaagcgtttc

SEQ ID NO: 141971 - DNA, 25 bp, Mus musculus
agaagcgtcgtcattgctaggtcca

SEQ ID NO: 141972 - DNA, 25 bp, Mus musculus
agaagcgtcgtctttgctaggtcca

SEQ ID NO: 141973 - DNA, 25 bp, Mus musculus
agaagcgtctctcgtgtactgaatg

SEQ ID NO: 141974 - DNA, 25 bp, Mus musculus
agaagcgtctctggtgtactgaatg

SEQ ID NO: 141975 - DNA, 25 bp, Mus musculus
agaagcgtgaagactgggctccagc

SEQ ID NO: 141976 - DNA, 25 bp, Mus musculus
agaagcgtgaagtctgggctccagc

SEQ ID NO: 141977 - DNA, 25 bp, Mus musculus
agaagcgtgatcatggagcctccgg

SEQ ID NO: 141978 - DNA, 25 bp, Mus musculus
agaagcgtgatcttggagcctccgg

SEQ ID NO: 141979 - DNA, 25 bp, Mus musculus
agaagcgtgtgaaacacctgggtgt

SEQ ID NO: 141980 - DNA, 25 bp, Mus musculus
agaagcgtgtgatacacctgggtgt

SEQ ID NO: 141981 - DNA, 25 bp, Mus musculus
agaagcgttcccaggcctcctagaa

SEQ ID NO: 141982 - DNA, 25 bp, Mus musculus
agaagcgttccctggcctcctagaa

SEQ ID NO: 141983 - DNA, 25 bp, Mus musculus
agaagcgttctgagtacgaccgggc

SEQ ID NO: 141984 - DNA, 25 bp, Mus musculus
agaagcgttctgtgtacgaccgggc

SEQ ID NO: 141985 - DNA, 25 bp, Mus musculus
agaagcgttgaaaccccagcccagg

SEQ ID NO: 141986 - DNA, 25 bp, Mus musculus
agaagcgttgaatccccagcccagg

SEQ ID NO: 141987 - DNA, 25 bp, Mus musculus
agaagcgttgctaggtttccttatt

SEQ ID NO: 141988 - DNA, 25 bp, Mus musculus
agaagcgttgcttggtttccttatt

SEQ ID NO: 141989 - DNA, 25 bp, Mus musculus
agaagctaaactcctgcggcagcac

SEQ ID NO: 141990 - DNA, 25 bp, Mus musculus
agaagctaaactgctgcggcagcac

SEQ ID NO: 141991 - DNA, 25 bp, Mus musculus
agaagctaaccacgcaccatgcgag

SEQ ID NO: 141992 - DNA, 25 bp, Mus musculus
agaagctaaccaggcaccatgcgag

SEQ ID NO: 141993 - DNA, 25 bp, Mus musculus
agaagctaacctcggcgtcagtcga

SEQ ID NO: 141994 - DNA, 25 bp, Mus musculus
agaagctaacctgggcgtcagtcga

SEQ ID NO: 141995 - DNA, 25 bp, Mus musculus
agaagctaagctcaacttggcctca

SEQ ID NO: 141996 - DNA, 25 bp, Mus musculus
agaagctaagctgaacttggcctca

SEQ ID NO: 141997 - DNA, 25 bp, Mus musculus
agaagctaatcaccacacatacaca

SEQ ID NO: 141998 - DNA, 25 bp, Mus musculus
agaagctaatcagcacacatacaca

SEQ ID NO: 141999 - DNA, 25 bp, Mus musculus
agaagctacactaggcagagaatgc

SEQ ID NO: 142000 - DNA, 25 bp, Mus musculus
agaagctacacttggcagagaatgc

SEQ ID NO: 142001 - DNA, 25 bp, Mus musculus
agaagctagagaagcacgtttacag

SEQ ID NO: 142002 - DNA, 25 bp, Mus musculus
agaagctagagatgcacgtttacag

SEQ ID NO: 142003 - DNA, 25 bp, Mus musculus
agaagctagagcagagggtgtccct

SEQ ID NO: 142004 - DNA, 25 bp, Mus musculus
agaagctagagccagtctgcagcct

SEQ ID NO: 142005 - DNA, 25 bp, Mus musculus
agaagctagagcgagtctgcagcct

SEQ ID NO: 142006 - DNA, 25 bp, Mus musculus
agaagctagagctgagggtgtccct

SEQ ID NO: 142007 - DNA, 25 bp, Mus musculus
agaagctagctcaccattaccttca

SEQ ID NO: 142008 - DNA, 25 bp, Mus musculus
agaagctagctctccattaccttca

SEQ ID NO: 142009 - DNA, 25 bp, Mus musculus
agaagctaggacacaccttgctggg

SEQ ID NO: 142010 - DNA, 25 bp, Mus musculus
agaagctaggactcaccttgctggg

SEQ ID NO: 142011 - DNA, 25 bp, Mus musculus
agaagctataccagcatgtccgctc

SEQ ID NO: 142012 - DNA, 25 bp, Mus musculus
agaagctatacctgcatgtccgctc

SEQ ID NO: 142013 - DNA, 25 bp, Mus musculus
agaagctatattccctcgggagctg

SEQ ID NO: 142014 - DNA, 25 bp, Mus musculus
agaagctatattgcctcgggagctg

SEQ ID NO: 142015 - DNA, 25 bp, Mus musculus
agaagctatcctcctgttttgtgta

SEQ ID NO: 142016 - DNA, 25 bp, Mus musculus
agaagctatcctgctgttttgtgta

SEQ ID NO: 142017 - DNA, 25 bp, Mus musculus
agaagctatgacctctgcttccaaa

SEQ ID NO: 142018 - DNA, 25 bp, Mus musculus
agaagctatgacgtctgcttccaaa

SEQ ID NO: 142019 - DNA, 25 bp, Mus musculus
agaagctatgcactggcaggctctt

SEQ ID NO: 142020 - DNA, 25 bp, Mus musculus
agaagctatgcagtggcaggctctt

SEQ ID NO: 142021 - DNA, 25 bp, Mus musculus
agaagctattacctacatcagatgt

SEQ ID NO: 142022 - DNA, 25 bp, Mus musculus
agaagctattacgtacatcagatgt

SEQ ID NO: 142023 - DNA, 25 bp, Mus musculus
agaagctattcccagatcgtcagca

SEQ ID NO: 142024 - DNA, 25 bp, Mus musculus
agaagctattccgagatcgtcagca

SEQ ID NO: 142025 - DNA, 25 bp, Mus musculus
agaagctattctacaagaccctcct

SEQ ID NO: 142026 - DNA, 25 bp, Mus musculus
agaagctattctcgagcaccacctt

SEQ ID NO: 142027 - DNA, 25 bp, Mus musculus
agaagctattctggagcaccacctt

SEQ ID NO: 142028 - DNA, 25 bp, Mus musculus
agaagctattcttcaagaccctcct

SEQ ID NO: 142029 - DNA, 25 bp, Mus musculus
agaagctattgtcttcctctcttac

SEQ ID NO: 142030 - DNA, 25 bp, Mus musculus
agaagctattgtgttcctctcttac

SEQ ID NO: 142031 - DNA, 25 bp, Mus musculus
agaagctcaaaccttgtctttattg

SEQ ID NO: 142032 - DNA, 25 bp, Mus musculus
agaagctcaaacgttgtctttattg

SEQ ID NO: 142033 - DNA, 25 bp, Mus musculus
agaagctcaactatcctttacttgg

SEQ ID NO: 142034 - DNA, 25 bp, Mus musculus
agaagctcaactttcctttacttgg

SEQ ID NO: 142035 - DNA, 25 bp, Mus musculus
agaagctcaataagaaagtgaccat

SEQ ID NO: 142036 - DNA, 25 bp, Mus musculus
agaagctcaatatgaaagtgaccat

SEQ ID NO: 142037 - DNA, 25 bp, Mus musculus
agaagctcacctctgacgattaact

SEQ ID NO: 142038 - DNA, 25 bp, Mus musculus
agaagctcacctctgttgcattgtc

SEQ ID NO: 142039 - DNA, 25 bp, Mus musculus
agaagctcacctgtgacgattaact

SEQ ID NO: 142040 - DNA, 25 bp, Mus musculus
agaagctcacctgtgttgcattgtc

SEQ ID NO: 142041 - DNA, 25 bp, Mus musculus
agaagctcagagctttctgttaaca

SEQ ID NO: 142042 - DNA, 25 bp, Mus musculus
agaagctcagaggtttctgttaaca

SEQ ID NO: 142043 - DNA, 25 bp, Mus musculus
agaagctcagctcaggaaaacgcca

SEQ ID NO: 142044 - DNA, 25 bp, Mus musculus
agaagctcagctgaggaaaacgcca

SEQ ID NO: 142045 - DNA, 25 bp, Mus musculus
agaagctcagtgagcactgctgtct

SEQ ID NO: 142046 - DNA, 25 bp, Mus musculus
agaagctcagtgatgctgttgatca

SEQ ID NO: 142047 - DNA, 25 bp, Mus musculus
agaagctcagtgtgcactgctgtct

SEQ ID NO: 142048 - DNA, 25 bp, Mus musculus
agaagctcagtgttgctgttgatca

SEQ ID NO: 142049 - DNA, 25 bp, Mus musculus
agaagctcagttagttctgcgagga

SEQ ID NO: 142050 - DNA, 25 bp, Mus musculus
agaagctcagtttgttctgcgagga

SEQ ID NO: 142051 - DNA, 25 bp, Mus musculus
agaagctcatctcattggcccaacg

SEQ ID NO: 142052 - DNA, 25 bp, Mus musculus
agaagctcatctgattggcccaacg

SEQ ID NO: 142053 - DNA, 25 bp, Mus musculus
agaagctcatggctcctttgggctc

SEQ ID NO: 142054 - DNA, 25 bp, Mus musculus
agaagctcatgggtcctttgggctc

SEQ ID NO: 142055 - DNA, 25 bp, Mus musculus
agaagctccatccttgtgcaacacc

SEQ ID NO: 142056 - DNA, 25 bp, Mus musculus
agaagctccatcgttgtgcaacacc

SEQ ID NO: 142057 - DNA, 25 bp, Mus musculus
agaagctcccagacaggttcaacaa

SEQ ID NO: 142058 - DNA, 25 bp, Mus musculus
agaagctcccagtcaggttcaacaa

SEQ ID NO: 142059 - DNA, 25 bp, Mus musculus
agaagctccgggagaaagagctgaa

SEQ ID NO: 142060 - DNA, 25 bp, Mus musculus
agaagctccgggtgaaagagctgaa

SEQ ID NO: 142061 - DNA, 25 bp, Mus musculus
agaagctcctacaagctctgggttc

SEQ ID NO: 142062 - DNA, 25 bp, Mus musculus
agaagctcctactagctctgggttc

SEQ ID NO: 142063 - DNA, 25 bp, Mus musculus
agaagctcctgcacatttacaagca

SEQ ID NO: 142064 - DNA, 25 bp, Mus musculus
agaagctcctgctcatttacaagca

SEQ ID NO: 142065 - DNA, 25 bp, Mus musculus
agaagctcctggaaccagcagctgc

SEQ ID NO: 142066 - DNA, 25 bp, Mus musculus
agaagctcctggagatcgccatcaa

SEQ ID NO: 142067 - DNA, 25 bp, Mus musculus
agaagctcctggtaccagcagctgc

SEQ ID NO: 142068 - DNA, 25 bp, Mus musculus
agaagctcctggtgatcgccatcaa

SEQ ID NO: 142069 - DNA, 25 bp, Mus musculus
agaagctccttgaaacctgtccttt

SEQ ID NO: 142070 - DNA, 25 bp, Mus musculus
agaagctccttgtaacctgtccttt

SEQ ID NO: 142071 - DNA, 25 bp, Mus musculus
agaagctcggccagcacttgacctg

SEQ ID NO: 142072 - DNA, 25 bp, Mus musculus
agaagctcggcctgcacttgacctg

SEQ ID NO: 142073 - DNA, 25 bp, Mus musculus
agaagctcggctatagagacctaat

SEQ ID NO: 142074 - DNA, 25 bp, Mus musculus
agaagctcggctttagagacctaat

SEQ ID NO: 142075 - DNA, 25 bp, Mus musculus
agaagctcgtggagcacagtgtctc

SEQ ID NO: 142076 - DNA, 25 bp, Mus musculus
agaagctcgtggtgcacagtgtctc

SEQ ID NO: 142077 - DNA, 25 bp, Mus musculus
agaagctcgtgtatttgtgactcct

SEQ ID NO: 142078 - DNA, 25 bp, Mus musculus
agaagctcgtgtttttgtgactcct

SEQ ID NO: 142079 - DNA, 25 bp, Mus musculus
agaagctctacaaccctcgaagtac

SEQ ID NO: 142080 - DNA, 25 bp, Mus musculus
agaagctctacatccctcgaagtac

SEQ ID NO: 142081 - DNA, 25 bp, Mus musculus
agaagctctagaagcgtacaggcgg

SEQ ID NO: 142082 - DNA, 25 bp, Mus musculus
agaagctctagatgcgtacaggcgg

SEQ ID NO: 142083 - DNA, 25 bp, Mus musculus
agaagctctcatcctccaggcgatg

SEQ ID NO: 142084 - DNA, 25 bp, Mus musculus
agaagctctcatgctccaggcgatg

SEQ ID NO: 142085 - DNA, 25 bp, Mus musculus
agaagctctctgcagcatggtcaca

SEQ ID NO: 142086 - DNA, 25 bp, Mus musculus
agaagctctctggagcatggtcaca

SEQ ID NO: 142087 - DNA, 25 bp, Mus musculus
agaagctctgatctctgtcctaggt

SEQ ID NO: 142088 - DNA, 25 bp, Mus musculus
agaagctctgatcttcaggctccat

SEQ ID NO: 142089 - DNA, 25 bp, Mus musculus
agaagctctgatgtctgtcctaggt

SEQ ID NO: 142090 - DNA, 25 bp, Mus musculus
agaagctctgatgttcaggctccat

SEQ ID NO: 142091 - DNA, 25 bp, Mus musculus
agaagctctggtatggacacacatt

SEQ ID NO: 142092 - DNA, 25 bp, Mus musculus
agaagctctggtttggacacacatt

SEQ ID NO: 142093 - DNA, 25 bp, Mus musculus
agaagctcttcaaccatcggttcag

SEQ ID NO: 142094 - DNA, 25 bp, Mus musculus
agaagctcttcaatctgaggaggat

SEQ ID NO: 142095 - DNA, 25 bp, Mus musculus
agaagctcttcatccatcggttcag

SEQ ID NO: 142096 - DNA, 25 bp, Mus musculus
agaagctcttcattctgaggaggat

SEQ ID NO: 142097 - DNA, 25 bp, Mus musculus
agaagctcttcccaggtctgtagct

SEQ ID NO: 142098 - DNA, 25 bp, Mus musculus
agaagctcttccgaggtctgtagct

SEQ ID NO: 142099 - DNA, 25 bp, Mus musculus
agaagctctttcagaagggtgcccc

SEQ ID NO: 142100 - DNA, 25 bp, Mus musculus
agaagctctttctgaagggtgcccc

SEQ ID NO: 142101 - DNA, 25 bp, Mus musculus
agaagctgaacgaactggcggacca

SEQ ID NO: 142102 - DNA, 25 bp, Mus musculus
agaagctgaacgtactggcggacca

SEQ ID NO: 142103 - DNA, 25 bp, Mus musculus
agaagctgaagaactggtaccgcag

SEQ ID NO: 142104 - DNA, 25 bp, Mus musculus
agaagctgaagatctggtaccgcag

SEQ ID NO: 142105 - DNA, 25 bp, Mus musculus
agaagctgacacattcaaagctcat

SEQ ID NO: 142106 - DNA, 25 bp, Mus musculus
agaagctgacactttcaaagctcat

SEQ ID NO: 142107 - DNA, 25 bp, Mus musculus
agaagctgaccacgccggcagcgtc

SEQ ID NO: 142108 - DNA, 25 bp, Mus musculus
agaagctgaccaggccggcagcgtc

SEQ ID NO: 142109 - DNA, 25 bp, Mus musculus
agaagctgacccacagatgtctggt

SEQ ID NO: 142110 - DNA, 25 bp, Mus musculus
agaagctgaccctcagatgtctggt

SEQ ID NO: 142111 - DNA, 25 bp, Mus musculus
agaagctgacgacggttatcagctc

SEQ ID NO: 142112 - DNA, 25 bp, Mus musculus
agaagctgacgagggttatcagctc

SEQ ID NO: 142113 - DNA, 25 bp, Mus musculus
agaagctgagctagtgcctcgggtc

SEQ ID NO: 142114 - DNA, 25 bp, Mus musculus
agaagctgagctcctaacttggtac

SEQ ID NO: 142115 - DNA, 25 bp, Mus musculus
agaagctgagctgctaacttggtac

SEQ ID NO: 142116 - DNA, 25 bp, Mus musculus
agaagctgagcttgtgcctcgggtc

SEQ ID NO: 142117 - DNA, 25 bp, Mus musculus
agaagctgaggaacacccttccaga

SEQ ID NO: 142118 - DNA, 25 bp, Mus musculus
agaagctgaggatcacccttccaga

SEQ ID NO: 142119 - DNA, 25 bp, Mus musculus
agaagctgaggcagacccctaggac

SEQ ID NO: 142120 - DNA, 25 bp, Mus musculus
agaagctgaggctgacccctaggac

SEQ ID NO: 142121 - DNA, 25 bp, Mus musculus
agaagctgagtgagtccctggcatt

SEQ ID NO: 142122 - DNA, 25 bp, Mus musculus
agaagctgagtgtgtccctggcatt

SEQ ID NO: 142123 - DNA, 25 bp, Mus musculus
agaagctgatgccaagtccaggctt

SEQ ID NO: 142124 - DNA, 25 bp, Mus musculus
agaagctgatgcgaagtccaggctt

SEQ ID NO: 142125 - DNA, 25 bp, Mus musculus
agaagctgatggaccaggcctctcg

SEQ ID NO: 142126 - DNA, 25 bp, Mus musculus
agaagctgatggtccaggcctctcg

SEQ ID NO: 142127 - DNA, 25 bp, Mus musculus
agaagctgcagtatcttcccctgtg

SEQ ID NO: 142128 - DNA, 25 bp, Mus musculus
agaagctgcagtttcttcccctgtg

SEQ ID NO: 142129 - DNA, 25 bp, Mus musculus
agaagctgcccaagatcggccgtac

SEQ ID NO: 142130 - DNA, 25 bp, Mus musculus
agaagctgcccatgatcggccgtac

SEQ ID NO: 142131 - DNA, 25 bp, Mus musculus
agaagctgcccgatgtgaaacttag

SEQ ID NO: 142132 - DNA, 25 bp, Mus musculus
agaagctgcccgttgtgaaacttag

SEQ ID NO: 142133 - DNA, 25 bp, Mus musculus
agaagctgccggcacatgtatgagt

SEQ ID NO: 142134 - DNA, 25 bp, Mus musculus
agaagctgccgggacatgtatgagt

SEQ ID NO: 142135 - DNA, 25 bp, Mus musculus
agaagctgcggaaggctctgaacgt

SEQ ID NO: 142136 - DNA, 25 bp, Mus musculus
agaagctgcggatggctctgaacgt

SEQ ID NO: 142137 - DNA, 25 bp, Mus musculus
agaagctgcgtcctgagcttgattc

SEQ ID NO: 142138 - DNA, 25 bp, Mus musculus
agaagctgcgtcgtgagcttgattc

SEQ ID NO: 142139 - DNA, 25 bp, Mus musculus
agaagctgctgacagaaacccagaa

SEQ ID NO: 142140 - DNA, 25 bp, Mus musculus
agaagctgctgagagaaacccagaa

SEQ ID NO: 142141 - DNA, 25 bp, Mus musculus
agaagctgctgccaaggccacaggt

SEQ ID NO: 142142 - DNA, 25 bp, Mus musculus
agaagctgctgcgaaggccacaggt

SEQ ID NO: 142143 - DNA, 25 bp, Mus musculus
agaagctgcttacactccagggtgc

SEQ ID NO: 142144 - DNA, 25 bp, Mus musculus
agaagctgcttagactccagggtgc

SEQ ID NO: 142145 - DNA, 25 bp, Mus musculus
agaagctgcttgaaggcctcccacg

SEQ ID NO: 142146 - DNA, 25 bp, Mus musculus
agaagctgcttgtaggcctcccacg

SEQ ID NO: 142147 - DNA, 25 bp, Mus musculus
agaagctgctttctgtgtacactgc

SEQ ID NO: 142148 - DNA, 25 bp, Mus musculus
agaagctgctttgtgtgtacactgc

SEQ ID NO: 142149 - DNA, 25 bp, Mus musculus
agaagctggaacataccatctccac

SEQ ID NO: 142150 - DNA, 25 bp, Mus musculus
agaagctggaacttaccatctccac

SEQ ID NO: 142151 - DNA, 25 bp, Mus musculus
agaagctggctccacggagggttct

SEQ ID NO: 142152 - DNA, 25 bp, Mus musculus
agaagctggctcgacggagggttct

SEQ ID NO: 142153 - DNA, 25 bp, Mus musculus
agaagctgggatcccctgttgttga

SEQ ID NO: 142154 - DNA, 25 bp, Mus musculus
agaagctgggatctacttaagtctc

SEQ ID NO: 142155 - DNA, 25 bp, Mus musculus
agaagctgggatgccctgttgttga

SEQ ID NO: 142156 - DNA, 25 bp, Mus musculus
agaagctgggatgtacttaagtctc

SEQ ID NO: 142157 - DNA, 25 bp, Mus musculus
agaagctgggcgagctcagcagcca

SEQ ID NO: 142158 - DNA, 25 bp, Mus musculus
agaagctgggcgtgctcagcagcca

SEQ ID NO: 142159 - DNA, 25 bp, Mus musculus
agaagctgggtaaagccacaccaac

SEQ ID NO: 142160 - DNA, 25 bp, Mus musculus
agaagctgggtatagccacaccaac

SEQ ID NO: 142161 - DNA, 25 bp, Mus musculus
agaagctggtaacagtgccctcctt

SEQ ID NO: 142162 - DNA, 25 bp, Mus musculus
agaagctggtaagagtgccctcctt

SEQ ID NO: 142163 - DNA, 25 bp, Mus musculus
agaagctggtacatgatctgccttg

SEQ ID NO: 142164 - DNA, 25 bp, Mus musculus
agaagctggtacttgatctgccttg

SEQ ID NO: 142165 - DNA, 25 bp, Mus musculus
agaagctggtcaaagctccccggga

SEQ ID NO: 142166 - DNA, 25 bp, Mus musculus
agaagctggtcatagctccccggga

SEQ ID NO: 142167 - DNA, 25 bp, Mus musculus
agaagctggtctcgaactgccatcc

SEQ ID NO: 142168 - DNA, 25 bp, Mus musculus
agaagctggtctggaactgccatcc

SEQ ID NO: 142169 - DNA, 25 bp, Mus musculus
agaagctggtgaatggagtggccaa

SEQ ID NO: 142170 - DNA, 25 bp, Mus musculus
agaagctggtgattggagtggccaa

SEQ ID NO: 142171 - DNA, 25 bp, Mus musculus
agaagctgtacaccgagagaagtca

SEQ ID NO: 142172 - DNA, 25 bp, Mus musculus
agaagctgtacacgcagtatcacgt

SEQ ID NO: 142173 - DNA, 25 bp, Mus musculus
agaagctgtacagcgagagaagtca

SEQ ID NO: 142174 - DNA, 25 bp, Mus musculus
agaagctgtacaggcagtatcacgt

SEQ ID NO: 142175 - DNA, 25 bp, Mus musculus
agaagctgtagccacttcagtcctc

SEQ ID NO: 142176 - DNA, 25 bp, Mus musculus
agaagctgtagcgacttcagtcctc

SEQ ID NO: 142177 - DNA, 25 bp, Mus musculus
agaagctgtcccagatccgcaagca

SEQ ID NO: 142178 - DNA, 25 bp, Mus musculus
agaagctgtccctgatccgcaagca

SEQ ID NO: 142179 - DNA, 25 bp, Mus musculus
agaagctgtgaaatacatgcctcaa

SEQ ID NO: 142180 - DNA, 25 bp, Mus musculus
agaagctgtgaattacatgcctcaa

SEQ ID NO: 142181 - DNA, 25 bp, Mus musculus
agaagctgtgacatgcccttggtca

SEQ ID NO: 142182 - DNA, 25 bp, Mus musculus
agaagctgtgacttgcccttggtca

SEQ ID NO: 142183 - DNA, 25 bp, Mus musculus
agaagctgtgagctgtcttctcact

SEQ ID NO: 142184 - DNA, 25 bp, Mus musculus
agaagctgtgaggtgtcttctcact

SEQ ID NO: 142185 - DNA, 25 bp, Mus musculus
agaagctgtgatccacctggaccac

SEQ ID NO: 142186 - DNA, 25 bp, Mus musculus
agaagctgtgatgcacctggaccac

SEQ ID NO: 142187 - DNA, 25 bp, Mus musculus
agaagctgtgtgaccaacttgttga

SEQ ID NO: 142188 - DNA, 25 bp, Mus musculus
agaagctgtgtgtccaacttgttga

SEQ ID NO: 142189 - DNA, 25 bp, Mus musculus
agaagctgttagagaattttgggtt

SEQ ID NO: 142190 - DNA, 25 bp, Mus musculus
agaagctgttagtgaattttgggtt

SEQ ID NO: 142191 - DNA, 25 bp, Mus musculus
agaagctgttcacatctagggctgg

SEQ ID NO: 142192 - DNA, 25 bp, Mus musculus
agaagctgttcagatctagggctgg

SEQ ID NO: 142193 - DNA, 25 bp, Mus musculus
agaagctgttctaggccctttaggc

SEQ ID NO: 142194 - DNA, 25 bp, Mus musculus
agaagctgttctatagaattttcag

SEQ ID NO: 142195 - DNA, 25 bp, Mus musculus
agaagctgttcttggccctttaggc

SEQ ID NO: 142196 - DNA, 25 bp, Mus musculus
agaagctgttctttagaattttcag

SEQ ID NO: 142197 - DNA, 25 bp, Mus musculus
agaagcttacatagccagacacctg

SEQ ID NO: 142198 - DNA, 25 bp, Mus musculus
agaagcttacattgccagacacctg

SEQ ID NO: 142199 - DNA, 25 bp, Mus musculus
agaagcttactaactgtggctaatt

SEQ ID NO: 142200 - DNA, 25 bp, Mus musculus
agaagcttactatctgtggctaatt

SEQ ID NO: 142201 - DNA, 25 bp, Mus musculus
agaagcttcaagcacctgagtccca

SEQ ID NO: 142202 - DNA, 25 bp, Mus musculus
agaagcttcaaggacctgagtccca

SEQ ID NO: 142203 - DNA, 25 bp, Mus musculus
agaagcttcaccacgcgggagcgat

SEQ ID NO: 142204 - DNA, 25 bp, Mus musculus
agaagcttcacctcgcgggagcgat

SEQ ID NO: 142205 - DNA, 25 bp, Mus musculus
agaagcttcactcacaaccttttaa

SEQ ID NO: 142206 - DNA, 25 bp, Mus musculus
agaagcttcactgacaaccttttaa

SEQ ID NO: 142207 - DNA, 25 bp, Mus musculus
agaagcttcctcagctggaggctct

SEQ ID NO: 142208 - DNA, 25 bp, Mus musculus
agaagcttcctctgctggaggctct

SEQ ID NO: 142209 - DNA, 25 bp, Mus musculus
agaagcttcgctattaggtatattt

SEQ ID NO: 142210 - DNA, 25 bp, Mus musculus
agaagcttcgcttttaggtatattt

SEQ ID NO: 142211 - DNA, 25 bp, Mus musculus
agaagcttctgcagaggatcctcaa

SEQ ID NO: 142212 - DNA, 25 bp, Mus musculus
agaagcttctgctgaggatcctcaa

SEQ ID NO: 142213 - DNA, 25 bp, Mus musculus
agaagcttgacgcatcccatcagga

SEQ ID NO: 142214 - DNA, 25 bp, Mus musculus
agaagcttgacggatcccatcagga

SEQ ID NO: 142215 - DNA, 25 bp, Mus musculus
agaagcttggcaacccatgtggcac

SEQ ID NO: 142216 - DNA, 25 bp, Mus musculus
agaagcttggcatcccatgtggcac

SEQ ID NO: 142217 - DNA, 25 bp, Mus musculus
agaagctttctcatctgttttccat

SEQ ID NO: 142218 - DNA, 25 bp, Mus musculus
agaagctttctcttctgttttccat

SEQ ID NO: 142219 - DNA, 25 bp, Mus musculus
agaagctttgttagactgtcttgct

SEQ ID NO: 142220 - DNA, 25 bp, Mus musculus
agaagctttgtttgactgtcttgct

SEQ ID NO: 142221 - DNA, 25 bp, Mus musculus
agaagcttttgacggctgactgcca

SEQ ID NO: 142222 - DNA, 25 bp, Mus musculus
agaagcttttgagggctgactgcca

SEQ ID NO: 142223 - DNA, 25 bp, Mus musculus
agaagcttttgtcgcggtactgtat

SEQ ID NO: 142224 - DNA, 25 bp, Mus musculus
agaagcttttgtggcggtactgtat

SEQ ID NO: 142225 - DNA, 25 bp, Mus musculus
agaaggaaaagtacccctgtcaatg

SEQ ID NO: 142226 - DNA, 25 bp, Mus musculus
agaaggaaaagttcccctgtcaatg

SEQ ID NO: 142227 - DNA, 25 bp, Mus musculus
agaaggaaccacctggcagtgtgtt

SEQ ID NO: 142228 - DNA, 25 bp, Mus musculus
agaaggaaccacgtggcagtgtgtt

SEQ ID NO: 142229 - DNA, 25 bp, Mus musculus
agaaggaacgtgaatccatgcagtt

SEQ ID NO: 142230 - DNA, 25 bp, Mus musculus
agaaggaacgtgtatccatgcagtt

SEQ ID NO: 142231 - DNA, 25 bp, Mus musculus
agaaggaactcacgctgcttttgaa

SEQ ID NO: 142232 - DNA, 25 bp, Mus musculus
agaaggaactcaggctgcttttgaa

SEQ ID NO: 142233 - DNA, 25 bp, Mus musculus
agaaggaactgcacctgcgcaggac

SEQ ID NO: 142234 - DNA, 25 bp, Mus musculus
agaaggaactgctcctgcgcaggac

SEQ ID NO: 142235 - DNA, 25 bp, Mus musculus
agaaggaagcatacctctgccctca

SEQ ID NO: 142236 - DNA, 25 bp, Mus musculus
agaaggaagcattcctctgccctca

SEQ ID NO: 142237 - DNA, 25 bp, Mus musculus
agaaggaagccaccgtggccaccaa

SEQ ID NO: 142238 - DNA, 25 bp, Mus musculus
agaaggaagccagcgtggccaccaa

SEQ ID NO: 142239 - DNA, 25 bp, Mus musculus
agaaggaagcctagcatctggagag

SEQ ID NO: 142240 - DNA, 25 bp, Mus musculus
agaaggaagccttgcatctggagag

SEQ ID NO: 142241 - DNA, 25 bp, Mus musculus
agaaggaagcgtcgccagcgcctaa

SEQ ID NO: 142242 - DNA, 25 bp, Mus musculus
agaaggaagcgtggccagcgcctaa

SEQ ID NO: 142243 - DNA, 25 bp, Mus musculus
agaaggaatcgacatcagccatcca

SEQ ID NO: 142244 - DNA, 25 bp, Mus musculus
agaaggaatcgagatcagccatcca

SEQ ID NO: 142245 - DNA, 25 bp, Mus musculus
agaaggaatggaccccgcatacgga

SEQ ID NO: 142246 - DNA, 25 bp, Mus musculus
agaaggaatggagcccgcatacgga

SEQ ID NO: 142247 - DNA, 25 bp, Mus musculus
agaaggaatttgcagccgactgcaa

SEQ ID NO: 142248 - DNA, 25 bp, Mus musculus
agaaggaatttggagccgactgcaa

SEQ ID NO: 142249 - DNA, 25 bp, Mus musculus
agaaggacaagcacgtggaagaggt

SEQ ID NO: 142250 - DNA, 25 bp, Mus musculus
agaaggacaagccactttgcaaaaa

SEQ ID NO: 142251 - DNA, 25 bp, Mus musculus
agaaggacaagcgactttgcaaaaa

SEQ ID NO: 142252 - DNA, 25 bp, Mus musculus
agaaggacaagctcgtggaagaggt

SEQ ID NO: 142253 - DNA, 25 bp, Mus musculus
agaaggacacatcgaaccctggcag

SEQ ID NO: 142254 - DNA, 25 bp, Mus musculus
agaaggacacatggaaccctggcag

SEQ ID NO: 142255 - DNA, 25 bp, Mus musculus
agaaggacaccccgacaatgctggc

SEQ ID NO: 142256 - DNA, 25 bp, Mus musculus
agaaggacacccggacaatgctggc

SEQ ID NO: 142257 - DNA, 25 bp, Mus musculus
agaaggacagatctgcagcctgtat

SEQ ID NO: 142258 - DNA, 25 bp, Mus musculus
agaaggacagatgtgcagcctgtat

SEQ ID NO: 142259 - DNA, 25 bp, Mus musculus
agaaggacagcactcgtggcaacaa

SEQ ID NO: 142260 - DNA, 25 bp, Mus musculus
agaaggacagcagtcgtggcaacaa

SEQ ID NO: 142261 - DNA, 25 bp, Mus musculus
agaaggacaggtaccatacctccca

SEQ ID NO: 142262 - DNA, 25 bp, Mus musculus
agaaggacaggttccatacctccca

SEQ ID NO: 142263 - DNA, 25 bp, Mus musculus
agaaggaccaaaaccagccttgagt

SEQ ID NO: 142264 - DNA, 25 bp, Mus musculus
agaaggaccaaatccagccttgagt

SEQ ID NO: 142265 - DNA, 25 bp, Mus musculus
agaaggaccagtacaaggtgcctcg

SEQ ID NO: 142266 - DNA, 25 bp, Mus musculus
agaaggaccagttcaaggtgcctcg

SEQ ID NO: 142267 - DNA, 25 bp, Mus musculus
agaaggaccgaaatctccgccgcat

SEQ ID NO: 142268 - DNA, 25 bp, Mus musculus
agaaggaccgaattctccgccgcat

SEQ ID NO: 142269 - DNA, 25 bp, Mus musculus
agaaggacctccatgccctgctgtg

SEQ ID NO: 142270 - DNA, 25 bp, Mus musculus
agaaggacctccctctttgagactg

SEQ ID NO: 142271 - DNA, 25 bp, Mus musculus
agaaggacctccgtctttgagactg

SEQ ID NO: 142272 - DNA, 25 bp, Mus musculus
agaaggacctccttgccctgctgtg

SEQ ID NO: 142273 - DNA, 25 bp, Mus musculus
agaaggacctgaaagcccgagtagt

SEQ ID NO: 142274 - DNA, 25 bp, Mus musculus
agaaggacctgatagcccgagtagt

SEQ ID NO: 142275 - DNA, 25 bp, Mus musculus
agaaggacctggcatctctggtctc

SEQ ID NO: 142276 - DNA, 25 bp, Mus musculus
agaaggacctgggatctctggtctc

SEQ ID NO: 142277 - DNA, 25 bp, Mus musculus
agaaggacgaagagctgcgccgcat

SEQ ID NO: 142278 - DNA, 25 bp, Mus musculus
agaaggacgaagtgctgcgccgcat

SEQ ID NO: 142279 - DNA, 25 bp, Mus musculus
agaaggacgattaggcagcccctcc

SEQ ID NO: 142280 - DNA, 25 bp, Mus musculus
agaaggacgatttggcagcccctcc

SEQ ID NO: 142281 - DNA, 25 bp, Mus musculus
agaaggacgcctctaagggtgactc

SEQ ID NO: 142282 - DNA, 25 bp, Mus musculus
agaaggacgcctgtaagggtgactc

SEQ ID NO: 142283 - DNA, 25 bp, Mus musculus
agaaggactctccttcttgcgacca

SEQ ID NO: 142284 - DNA, 25 bp, Mus musculus
agaaggactctcgttcttgcgacca

SEQ ID NO: 142285 - DNA, 25 bp, Mus musculus
agaaggactctgaggccatccgtag

SEQ ID NO: 142286 - DNA, 25 bp, Mus musculus
agaaggactctgtggccatccgtag

SEQ ID NO: 142287 - DNA, 25 bp, Mus musculus
agaaggactggcctgcccacaagaa

SEQ ID NO: 142288 - DNA, 25 bp, Mus musculus
agaaggactggcgtgcccacaagaa

SEQ ID NO: 142289 - DNA, 25 bp, Mus musculus
agaaggactgggaagttcactactc

SEQ ID NO: 142290 - DNA, 25 bp, Mus musculus
agaaggactgggtagttcactactc

SEQ ID NO: 142291 - DNA, 25 bp, Mus musculus
agaaggactgttcctatctctgcgg

SEQ ID NO: 142292 - DNA, 25 bp, Mus musculus
agaaggactgttgctatctctgcgg

SEQ ID NO: 142293 - DNA, 25 bp, Mus musculus
agaaggactttgctctcgagtaagc

SEQ ID NO: 142294 - DNA, 25 bp, Mus musculus
agaaggactttggtctcgagtaagc

SEQ ID NO: 142295 - DNA, 25 bp, Mus musculus
agaaggagaccactaccctctgaac

SEQ ID NO: 142296 - DNA, 25 bp, Mus musculus
agaaggagaccagtaccctctgaac

SEQ ID NO: 142297 - DNA, 25 bp, Mus musculus
agaaggagagctaaaccatgcctgg

SEQ ID NO: 142298 - DNA, 25 bp, Mus musculus
agaaggagagcttaaccatgcctgg

SEQ ID NO: 142299 - DNA, 25 bp, Mus musculus
agaaggagatgtccaatccccagcc

SEQ ID NO: 142300 - DNA, 25 bp, Mus musculus
agaaggagatgtgcaatccccagcc

SEQ ID NO: 142301 - DNA, 25 bp, Mus musculus
agaaggagcaccaatcggccaggta

SEQ ID NO: 142302 - DNA, 25 bp, Mus musculus
agaaggagcaccattgtccgcggaa

SEQ ID NO: 142303 - DNA, 25 bp, Mus musculus
agaaggagcacctatcggccaggta

SEQ ID NO: 142304 - DNA, 25 bp, Mus musculus
agaaggagcacctttgtccgcggaa

SEQ ID NO: 142305 - DNA, 25 bp, Mus musculus
agaaggagcagcagcgaaagctgaa

SEQ ID NO: 142306 - DNA, 25 bp, Mus musculus
agaaggagcagctgcgaaagctgaa

SEQ ID NO: 142307 - DNA, 25 bp, Mus musculus
agaaggagcatgagccgacctggct

SEQ ID NO: 142308 - DNA, 25 bp, Mus musculus
agaaggagcatgtgccgacctggct

SEQ ID NO: 142309 - DNA, 25 bp, Mus musculus
agaaggagcgcacaccctgaggtct

SEQ ID NO: 142310 - DNA, 25 bp, Mus musculus
agaaggagcgcagaccctgaggtct

SEQ ID NO: 142311 - DNA, 25 bp, Mus musculus
agaaggagctccctgtgcgcctgcc

SEQ ID NO: 142312 - DNA, 25 bp, Mus musculus
agaaggagctccgtgtgcgcctgcc

SEQ ID NO: 142313 - DNA, 25 bp, Mus musculus
agaaggaggcctcccccgtgtgcat

SEQ ID NO: 142314 - DNA, 25 bp, Mus musculus
agaaggaggcctgccccgtgtgcat

SEQ ID NO: 142315 - DNA, 25 bp, Mus musculus
agaaggaggcttctgtatgcttgtg

SEQ ID NO: 142316 - DNA, 25 bp, Mus musculus
agaaggaggcttgtgtatgcttgtg

SEQ ID NO: 142317 - DNA, 25 bp, Mus musculus
agaaggagtgatcccagcatcggca

SEQ ID NO: 142318 - DNA, 25 bp, Mus musculus
agaaggagtgatgccagcatcggca

SEQ ID NO: 142319 - DNA, 25 bp, Mus musculus
agaaggagtgcgacatgctgaagca

SEQ ID NO: 142320 - DNA, 25 bp, Mus musculus
agaaggagtgcgtcatgctgaagca

SEQ ID NO: 142321 - DNA, 25 bp, Mus musculus
agaaggagtggtagcgctcccctga

SEQ ID NO: 142322 - DNA, 25 bp, Mus musculus
agaaggagtggttgcgctcccctga

SEQ ID NO: 142323 - DNA, 25 bp, Mus musculus
agaaggagttgtcgaccccacctga

SEQ ID NO: 142324 - DNA, 25 bp, Mus musculus
agaaggagttgtggaccccacctga

SEQ ID NO: 142325 - DNA, 25 bp, Mus musculus
agaaggatcacgattctgctgtgcc

SEQ ID NO: 142326 - DNA, 25 bp, Mus musculus
agaaggatcacgtttctgctgtgcc

SEQ ID NO: 142327 - DNA, 25 bp, Mus musculus
agaaggatccagctctctatgctta

SEQ ID NO: 142328 - DNA, 25 bp, Mus musculus
agaaggatccaggtctctatgctta

SEQ ID NO: 142329 - DNA, 25 bp, Mus musculus
agaaggatccttaccttggctgttc

SEQ ID NO: 142330 - DNA, 25 bp, Mus musculus
agaaggatcctttccttggctgttc

SEQ ID NO: 142331 - DNA, 25 bp, Mus musculus
agaaggatcgcccatgcgctggcca

SEQ ID NO: 142332 - DNA, 25 bp, Mus musculus
agaaggatcgccgatgcgctggcca

SEQ ID NO: 142333 - DNA, 25 bp, Mus musculus
agaaggatcgtcaccagatccgcgt

SEQ ID NO: 142334 - DNA, 25 bp, Mus musculus
agaaggatcgtctccagatccgcgt

SEQ ID NO: 142335 - DNA, 25 bp, Mus musculus
agaaggatctagcttttaaggccag

SEQ ID NO: 142336 - DNA, 25 bp, Mus musculus
agaaggatctaggttttaaggccag

SEQ ID NO: 142337 - DNA, 25 bp, Mus musculus
agaaggatctctccgctttcaggga

SEQ ID NO: 142338 - DNA, 25 bp, Mus musculus
agaaggatctctgcgctttcaggga

SEQ ID NO: 142339 - DNA, 25 bp, Mus musculus
agaaggatctgaccggctgctgtac

SEQ ID NO: 142340 - DNA, 25 bp, Mus musculus
agaaggatctgagcggctgctgtac

SEQ ID NO: 142341 - DNA, 25 bp, Mus musculus
agaaggatgattactttcctgatcc

SEQ ID NO: 142342 - DNA, 25 bp, Mus musculus
agaaggatgatttctttcctgatcc

SEQ ID NO: 142343 - DNA, 25 bp, Mus musculus
agaaggatgcagatgggctacacga

SEQ ID NO: 142344 - DNA, 25 bp, Mus musculus
agaaggatgcagttgggctacacga

SEQ ID NO: 142345 - DNA, 25 bp, Mus musculus
agaaggatgccgcagaccattatct

SEQ ID NO: 142346 - DNA, 25 bp, Mus musculus
agaaggatgccggagaccattatct

SEQ ID NO: 142347 - DNA, 25 bp, Mus musculus
agaaggatgcgtcgcttcctgtctg

SEQ ID NO: 142348 - DNA, 25 bp, Mus musculus
agaaggatgcgtggcttcctgtctg

SEQ ID NO: 142349 - DNA, 25 bp, Mus musculus
agaaggatgctaactcctcctcttt

SEQ ID NO: 142350 - DNA, 25 bp, Mus musculus
agaaggatgctatctcctcctcttt

SEQ ID NO: 142351 - DNA, 25 bp, Mus musculus
agaaggatgtgtaccactccctttt

SEQ ID NO: 142352 - DNA, 25 bp, Mus musculus
agaaggatgtgttccactccctttt

SEQ ID NO: 142353 - DNA, 25 bp, Mus musculus
agaaggatttcacacagctcttccc

SEQ ID NO: 142354 - DNA, 25 bp, Mus musculus
agaaggatttcagacagctcttccc

SEQ ID NO: 142355 - DNA, 25 bp, Mus musculus
agaaggatttgcacactctggctgg

SEQ ID NO: 142356 - DNA, 25 bp, Mus musculus
agaaggatttgctcactctggctgg

SEQ ID NO: 142357 - DNA, 25 bp, Mus musculus
agaaggatttgtctcccttgttcca

SEQ ID NO: 142358 - DNA, 25 bp, Mus musculus
agaaggatttgtgtcccttgttcca

SEQ ID NO: 142359 - DNA, 25 bp, Mus musculus
agaaggcaaaccaagcacaagcatt

SEQ ID NO: 142360 - DNA, 25 bp, Mus musculus
agaaggcaaacctagcacaagcatt

SEQ ID NO: 142361 - DNA, 25 bp, Mus musculus
agaaggcaacatctcacccagtcat

SEQ ID NO: 142362 - DNA, 25 bp, Mus musculus
agaaggcaacatgtcacccagtcat

SEQ ID NO: 142363 - DNA, 25 bp, Mus musculus
agaaggcaacccagagtgttccaaa

SEQ ID NO: 142364 - DNA, 25 bp, Mus musculus
agaaggcaaccctgagtgttccaaa

SEQ ID NO: 142365 - DNA, 25 bp, Mus musculus
agaaggcaagccctacactgacgga

SEQ ID NO: 142366 - DNA, 25 bp, Mus musculus
agaaggcaagccgtacactgacgga

SEQ ID NO: 142367 - DNA, 25 bp, Mus musculus
agaaggcaagctacctcagagctca

SEQ ID NO: 142368 - DNA, 25 bp, Mus musculus
agaaggcaagcttcctcagagctca

SEQ ID NO: 142369 - DNA, 25 bp, Mus musculus
agaaggcaatgaagtcatgactcca

SEQ ID NO: 142370 - DNA, 25 bp, Mus musculus
agaaggcaatgatgtcatgactcca

SEQ ID NO: 142371 - DNA, 25 bp, Mus musculus
agaaggcaattcagttcagttcagc

SEQ ID NO: 142372 - DNA, 25 bp, Mus musculus
agaaggcaattctgttcagttcagc

SEQ ID NO: 142373 - DNA, 25 bp, Mus musculus
agaaggcacaccaagcttggaccca

SEQ ID NO: 142374 - DNA, 25 bp, Mus musculus
agaaggcacacccaggctgaatgat

SEQ ID NO: 142375 - DNA, 25 bp, Mus musculus
agaaggcacaccgaggctgaatgat

SEQ ID NO: 142376 - DNA, 25 bp, Mus musculus
agaaggcacacctagcttggaccca

SEQ ID NO: 142377 - DNA, 25 bp, Mus musculus
agaaggcacagcagtctccaaaaca

SEQ ID NO: 142378 - DNA, 25 bp, Mus musculus
agaaggcacagctgtctccaaaaca

SEQ ID NO: 142379 - DNA, 25 bp, Mus musculus
agaaggcacaggagcgcacgttcac

SEQ ID NO: 142380 - DNA, 25 bp, Mus musculus
agaaggcacaggtgcgcacgttcac

SEQ ID NO: 142381 - DNA, 25 bp, Mus musculus
agaaggcaccagcaatcacaccatg

SEQ ID NO: 142382 - DNA, 25 bp, Mus musculus
agaaggcaccaggaatcacaccatg

SEQ ID NO: 142383 - DNA, 25 bp, Mus musculus
agaaggcaccctcggaaggttctca

SEQ ID NO: 142384 - DNA, 25 bp, Mus musculus
agaaggcaccctgggaaggttctca

SEQ ID NO: 142385 - DNA, 25 bp, Mus musculus
agaaggcactgcaaggcccctgcga

SEQ ID NO: 142386 - DNA, 25 bp, Mus musculus
agaaggcactgctaggcccctgcga

SEQ ID NO: 142387 - DNA, 25 bp, Mus musculus
agaaggcactggactggctctagca

SEQ ID NO: 142388 - DNA, 25 bp, Mus musculus
agaaggcactggatgcccctacaag

SEQ ID NO: 142389 - DNA, 25 bp, Mus musculus
agaaggcactggtctggctctagca

SEQ ID NO: 142390 - DNA, 25 bp, Mus musculus
agaaggcactggttgcccctacaag

SEQ ID NO: 142391 - DNA, 25 bp, Mus musculus
agaaggcacttcctgttactctgct

SEQ ID NO: 142392 - DNA, 25 bp, Mus musculus
agaaggcacttcgtgttactctgct

SEQ ID NO: 142393 - DNA, 25 bp, Mus musculus
agaaggcagaaacctgttcctcctc

SEQ ID NO: 142394 - DNA, 25 bp, Mus musculus
agaaggcagaaagctgttcctcctc

SEQ ID NO: 142395 - DNA, 25 bp, Mus musculus
agaaggcagacaatctactcatcat

SEQ ID NO: 142396 - DNA, 25 bp, Mus musculus
agaaggcagacattctactcatcat

SEQ ID NO: 142397 - DNA, 25 bp, Mus musculus
agaaggcagccgatagacacctctt

SEQ ID NO: 142398 - DNA, 25 bp, Mus musculus
agaaggcagccgttagacacctctt

SEQ ID NO: 142399 - DNA, 25 bp, Mus musculus
agaaggcagcctatcatcaatggag

SEQ ID NO: 142400 - DNA, 25 bp, Mus musculus
agaaggcagcctttcatcaatggag

SEQ ID NO: 142401 - DNA, 25 bp, Mus musculus
agaaggcagcttccctaggatctgt

SEQ ID NO: 142402 - DNA, 25 bp, Mus musculus
agaaggcagcttgcctaggatctgt

SEQ ID NO: 142403 - DNA, 25 bp, Mus musculus
agaaggcagggacggctcctttgtc

SEQ ID NO: 142404 - DNA, 25 bp, Mus musculus
agaaggcagggagggctcctttgtc

SEQ ID NO: 142405 - DNA, 25 bp, Mus musculus
agaaggcagggcacagtttaacaaa

SEQ ID NO: 142406 - DNA, 25 bp, Mus musculus
agaaggcagggctcagtttaacaaa

SEQ ID NO: 142407 - DNA, 25 bp, Mus musculus
agaaggcagtgcactcagtaaagag

SEQ ID NO: 142408 - DNA, 25 bp, Mus musculus
agaaggcagtgctctcagtaaagag

SEQ ID NO: 142409 - DNA, 25 bp, Mus musculus
agaaggcatactaggactcaacaga

SEQ ID NO: 142410 - DNA, 25 bp, Mus musculus
agaaggcatacttggactcaacaga

SEQ ID NO: 142411 - DNA, 25 bp, Mus musculus
agaaggcatgaaactgtggcttcct

SEQ ID NO: 142412 - DNA, 25 bp, Mus musculus
agaaggcatgaatctgtggcttcct

SEQ ID NO: 142413 - DNA, 25 bp, Mus musculus
agaaggcatgcgacggacctgctta

SEQ ID NO: 142414 - DNA, 25 bp, Mus musculus
agaaggcatgcgtcggacctgctta

SEQ ID NO: 142415 - DNA, 25 bp, Mus musculus
agaaggcatgctagtcactctgcac

SEQ ID NO: 142416 - DNA, 25 bp, Mus musculus
agaaggcatgcttgtcactctgcac

SEQ ID NO: 142417 - DNA, 25 bp, Mus musculus
agaaggcatgtactaacccacagta

SEQ ID NO: 142418 - DNA, 25 bp, Mus musculus
agaaggcatgtagtaacccacagta

SEQ ID NO: 142419 - DNA, 25 bp, Mus musculus
agaaggcattaccacactcttgttc

SEQ ID NO: 142420 - DNA, 25 bp, Mus musculus
agaaggcattacgacactcttgttc

SEQ ID NO: 142421 - DNA, 25 bp, Mus musculus
agaaggcattggctcttgtggctgt

SEQ ID NO: 142422 - DNA, 25 bp, Mus musculus
agaaggcattgggtcttgtggctgt

SEQ ID NO: 142423 - DNA, 25 bp, Mus musculus
agaaggccaaggatgttcttttcta

SEQ ID NO: 142424 - DNA, 25 bp, Mus musculus
agaaggccaaggttgttcttttcta

SEQ ID NO: 142425 - DNA, 25 bp, Mus musculus
agaaggccaccaagacccagaggac

SEQ ID NO: 142426 - DNA, 25 bp, Mus musculus
agaaggccaccatgacccagaggac

SEQ ID NO: 142427 - DNA, 25 bp, Mus musculus
agaaggccaggcaagcattgttcct

SEQ ID NO: 142428 - DNA, 25 bp, Mus musculus
agaaggccaggctagcattgttcct

SEQ ID NO: 142429 - DNA, 25 bp, Mus musculus
agaaggccatcgctgttttctctct

SEQ ID NO: 142430 - DNA, 25 bp, Mus musculus
agaaggccatcggtgttttctctct

SEQ ID NO: 142431 - DNA, 25 bp, Mus musculus
agaaggccatctattgctcaaatat

SEQ ID NO: 142432 - DNA, 25 bp, Mus musculus
agaaggccatcttttgctcaaatat

SEQ ID NO: 142433 - DNA, 25 bp, Mus musculus
agaaggcccaggctcgcatgttctg

SEQ ID NO: 142434 - DNA, 25 bp, Mus musculus
agaaggcccagggtcgcatgttctg

SEQ ID NO: 142435 - DNA, 25 bp, Mus musculus
agaaggcccgagacatgtacgctga

SEQ ID NO: 142436 - DNA, 25 bp, Mus musculus
agaaggcccgagtcatgtacgctga

SEQ ID NO: 142437 - DNA, 25 bp, Mus musculus
agaaggcccgttactgtagcagatg

SEQ ID NO: 142438 - DNA, 25 bp, Mus musculus
agaaggcccgtttctgtagcagatg

SEQ ID NO: 142439 - DNA, 25 bp, Mus musculus
agaaggccctggactgctatctcca

SEQ ID NO: 142440 - DNA, 25 bp, Mus musculus
agaaggccctggatcttgaccccag

SEQ ID NO: 142441 - DNA, 25 bp, Mus musculus
agaaggccctggtctgctatctcca

SEQ ID NO: 142442 - DNA, 25 bp, Mus musculus
agaaggccctggttcttgaccccag

SEQ ID NO: 142443 - DNA, 25 bp, Mus musculus
agaaggccctgtcttcgccatgtgc

SEQ ID NO: 142444 - DNA, 25 bp, Mus musculus
agaaggccctgtgttcgccatgtgc

SEQ ID NO: 142445 - DNA, 25 bp, Mus musculus
agaaggccctttctggatactgtgg

SEQ ID NO: 142446 - DNA, 25 bp, Mus musculus
agaaggccctttgtggatactgtgg

SEQ ID NO: 142447 - DNA, 25 bp, Mus musculus
agaaggccgatgcttactctttgat

SEQ ID NO: 142448 - DNA, 25 bp, Mus musculus
agaaggccgatggttactctttgat

SEQ ID NO: 142449 - DNA, 25 bp, Mus musculus
agaaggccgcctatgatgtgtgcaa

SEQ ID NO: 142450 - DNA, 25 bp, Mus musculus
agaaggccgcctttgatgtgtgcaa

SEQ ID NO: 142451 - DNA, 25 bp, Mus musculus
agaaggccggccctgtggacttcat

SEQ ID NO: 142452 - DNA, 25 bp, Mus musculus
agaaggccggccgtgtggacttcat

SEQ ID NO: 142453 - DNA, 25 bp, Mus musculus
agaaggccgggacatcagcacaacc

SEQ ID NO: 142454 - DNA, 25 bp, Mus musculus
agaaggccgggagatcagcacaacc

SEQ ID NO: 142455 - DNA, 25 bp, Mus musculus
agaaggcctgtgacctttagtgtca

SEQ ID NO: 142456 - DNA, 25 bp, Mus musculus
agaaggcctgtgtcctttagtgtca

SEQ ID NO: 142457 - DNA, 25 bp, Mus musculus
agaaggccttcccttggctgcacaa

SEQ ID NO: 142458 - DNA, 25 bp, Mus musculus
agaaggccttccgttggctgcacaa

SEQ ID NO: 142459 - DNA, 25 bp, Mus musculus
agaaggccttgcacgccgtggatgc

SEQ ID NO: 142460 - DNA, 25 bp, Mus musculus
agaaggccttgctcgccgtggatgc

SEQ ID NO: 142461 - DNA, 25 bp, Mus musculus
agaaggccttgtctccttaggatcc

SEQ ID NO: 142462 - DNA, 25 bp, Mus musculus
agaaggccttgtgtccttaggatcc

SEQ ID NO: 142463 - DNA, 25 bp, Mus musculus
agaaggcgacttcgaatggctgatt

SEQ ID NO: 142464 - DNA, 25 bp, Mus musculus
agaaggcgacttcgagctatacagt

SEQ ID NO: 142465 - DNA, 25 bp, Mus musculus
agaaggcgacttggaatggctgatt

SEQ ID NO: 142466 - DNA, 25 bp, Mus musculus
agaaggcgacttggagctatacagt

SEQ ID NO: 142467 - DNA, 25 bp, Mus musculus
agaaggcgcgagagctccaagagct

SEQ ID NO: 142468 - DNA, 25 bp, Mus musculus
agaaggcgcgagtgctccaagagct

SEQ ID NO: 142469 - DNA, 25 bp, Mus musculus
agaaggcggtctccaagttgaccct

SEQ ID NO: 142470 - DNA, 25 bp, Mus musculus
agaaggcggtctgcaagttgaccct

SEQ ID NO: 142471 - DNA, 25 bp, Mus musculus
agaaggcgtgcaatacctgccaggc

SEQ ID NO: 142472 - DNA, 25 bp, Mus musculus
agaaggcgtgcattacctgccaggc

SEQ ID NO: 142473 - DNA, 25 bp, Mus musculus
agaaggcgtttgacccgaagctgac

SEQ ID NO: 142474 - DNA, 25 bp, Mus musculus
agaaggcgtttgtcccgaagctgac

SEQ ID NO: 142475 - DNA, 25 bp, Mus musculus
agaaggctacagatccatcctatcc

SEQ ID NO: 142476 - DNA, 25 bp, Mus musculus
agaaggctacagttccatcctatcc

SEQ ID NO: 142477 - DNA, 25 bp, Mus musculus
agaaggctagtcaccatagttgatg

SEQ ID NO: 142478 - DNA, 25 bp, Mus musculus
agaaggctagtctccatagttgatg

SEQ ID NO: 142479 - DNA, 25 bp, Mus musculus
agaaggctatctcaccaagcaggga

SEQ ID NO: 142480 - DNA, 25 bp, Mus musculus
agaaggctatctgaccaagcaggga

SEQ ID NO: 142481 - DNA, 25 bp, Mus musculus
agaaggctcagtcaaggtccagcag

SEQ ID NO: 142482 - DNA, 25 bp, Mus musculus
agaaggctcagtctcgccaatgctg

SEQ ID NO: 142483 - DNA, 25 bp, Mus musculus
agaaggctcagtctgtatcttgcag

SEQ ID NO: 142484 - DNA, 25 bp, Mus musculus
agaaggctcagtgaaggtccagcag

SEQ ID NO: 142485 - DNA, 25 bp, Mus musculus
agaaggctcagtgtcgccaatgctg

SEQ ID NO: 142486 - DNA, 25 bp, Mus musculus
agaaggctcagtgtgtatcttgcag

SEQ ID NO: 142487 - DNA, 25 bp, Mus musculus
agaaggctcatcacagctggaacaa

SEQ ID NO: 142488 - DNA, 25 bp, Mus musculus
agaaggctcatcatgcattagaaga

SEQ ID NO: 142489 - DNA, 25 bp, Mus musculus
agaaggctcatctcagctggaacaa

SEQ ID NO: 142490 - DNA, 25 bp, Mus musculus
agaaggctcatcttgcattagaaga

SEQ ID NO: 142491 - DNA, 25 bp, Mus musculus
agaaggctcccactgtgtaactgtg

SEQ ID NO: 142492 - DNA, 25 bp, Mus musculus
agaaggctcccagtgtgtaactgtg

SEQ ID NO: 142493 - DNA, 25 bp, Mus musculus
agaaggctccctagggatggccgtc

SEQ ID NO: 142494 - DNA, 25 bp, Mus musculus
agaaggctcccttgggatggccgtc

SEQ ID NO: 142495 - DNA, 25 bp, Mus musculus
agaaggctccgacgacctggcaaat

SEQ ID NO: 142496 - DNA, 25 bp, Mus musculus
agaaggctccgaggacctggcaaat

SEQ ID NO: 142497 - DNA, 25 bp, Mus musculus
agaaggctcctcagcagtgatcatc

SEQ ID NO: 142498 - DNA, 25 bp, Mus musculus
agaaggctcctctgcagtgatcatc

SEQ ID NO: 142499 - DNA, 25 bp, Mus musculus
agaaggctcctgatgtccacattga

SEQ ID NO: 142500 - DNA, 25 bp, Mus musculus
agaaggctcctgttgtccacattga

SEQ ID NO: 142501 - DNA, 25 bp, Mus musculus
agaaggctcgagctactcgggtcaa

SEQ ID NO: 142502 - DNA, 25 bp, Mus musculus
agaaggctcgaggtactcgggtcaa

SEQ ID NO: 142503 - DNA, 25 bp, Mus musculus
agaaggctctgaaccgccagttcaa

SEQ ID NO: 142504 - DNA, 25 bp, Mus musculus
agaaggctctgatccgccagttcaa

SEQ ID NO: 142505 - DNA, 25 bp, Mus musculus
agaaggctcttcagtattttgtaat

SEQ ID NO: 142506 - DNA, 25 bp, Mus musculus
agaaggctcttctgtattttgtaat

SEQ ID NO: 142507 - DNA, 25 bp, Mus musculus
agaaggctgcaacctcaagctgtca

SEQ ID NO: 142508 - DNA, 25 bp, Mus musculus
agaaggctgcaagctcaagctgtca

SEQ ID NO: 142509 - DNA, 25 bp, Mus musculus
agaaggctgcacatatgcgggcaaa

SEQ ID NO: 142510 - DNA, 25 bp, Mus musculus
agaaggctgcacttatgcgggcaaa

SEQ ID NO: 142511 - DNA, 25 bp, Mus musculus
agaaggctgccaagacgccgtgcgt

SEQ ID NO: 142512 - DNA, 25 bp, Mus musculus
agaaggctgccatgacgccgtgcgt

SEQ ID NO: 142513 - DNA, 25 bp, Mus musculus
agaaggctggccaatacatgaagat

SEQ ID NO: 142514 - DNA, 25 bp, Mus musculus
agaaggctggcccatgagcctcaag

SEQ ID NO: 142515 - DNA, 25 bp, Mus musculus
agaaggctggccgatgagcctcaag

SEQ ID NO: 142516 - DNA, 25 bp, Mus musculus
agaaggctggcctatacatgaagat

SEQ ID NO: 142517 - DNA, 25 bp, Mus musculus
agaaggctgggactcagtacctgat

SEQ ID NO: 142518 - DNA, 25 bp, Mus musculus
agaaggctgggagtcagtacctgat

SEQ ID NO: 142519 - DNA, 25 bp, Mus musculus
agaaggctggtcaactgtgcgcctt

SEQ ID NO: 142520 - DNA, 25 bp, Mus musculus
agaaggctggtctactgtgcgcctt

SEQ ID NO: 142521 - DNA, 25 bp, Mus musculus
agaaggctgtgaccatagccacccc

SEQ ID NO: 142522 - DNA, 25 bp, Mus musculus
agaaggctgtgagcatagccacccc

SEQ ID NO: 142523 - DNA, 25 bp, Mus musculus
agaaggctgtggctctgacgtctcc

SEQ ID NO: 142524 - DNA, 25 bp, Mus musculus
agaaggctgtggctttggttctctt

SEQ ID NO: 142525 - DNA, 25 bp, Mus musculus
agaaggctgtgggtctgacgtctcc

SEQ ID NO: 142526 - DNA, 25 bp, Mus musculus
agaaggctgtgggtttggttctctt

SEQ ID NO: 142527 - DNA, 25 bp, Mus musculus
agaaggctgttcaccttcaccaagt

SEQ ID NO: 142528 - DNA, 25 bp, Mus musculus
agaaggctgttctccttcaccaagt

SEQ ID NO: 142529 - DNA, 25 bp, Mus musculus
agaaggcttatgacatgcacagctc

SEQ ID NO: 142530 - DNA, 25 bp, Mus musculus
agaaggcttatgtcatgcacagctc

SEQ ID NO: 142531 - DNA, 25 bp, Mus musculus
agaaggcttcacatagcctcctcac

SEQ ID NO: 142532 - DNA, 25 bp, Mus musculus
agaaggcttcacttagcctcctcac

SEQ ID NO: 142533 - DNA, 25 bp, Mus musculus
agaaggcttcccacagctcggtgaa

SEQ ID NO: 142534 - DNA, 25 bp, Mus musculus
agaaggcttccctcagctcggtgaa

SEQ ID NO: 142535 - DNA, 25 bp, Mus musculus
agaaggcttgccaggtgacccagtc

SEQ ID NO: 142536 - DNA, 25 bp, Mus musculus
agaaggcttgcctggtgacccagtc

SEQ ID NO: 142537 - DNA, 25 bp, Mus musculus
agaaggcttggcacagggacctcac

SEQ ID NO: 142538 - DNA, 25 bp, Mus musculus
agaaggcttggctcagggacctcac

SEQ ID NO: 142539 - DNA, 25 bp, Mus musculus
agaaggcttggtcgactccttttct

SEQ ID NO: 142540 - DNA, 25 bp, Mus musculus
agaaggcttggtggactccttttct

SEQ ID NO: 142541 - DNA, 25 bp, Mus musculus
agaaggctttacatgttcgcggagt

SEQ ID NO: 142542 - DNA, 25 bp, Mus musculus
agaaggctttacttgttcgcggagt

SEQ ID NO: 142543 - DNA, 25 bp, Mus musculus
agaaggctttatcgctttatttctt

SEQ ID NO: 142544 - DNA, 25 bp, Mus musculus
agaaggctttatggctttatttctt

SEQ ID NO: 142545 - DNA, 25 bp, Mus musculus
agaaggctttggacagtttaatagt

SEQ ID NO: 142546 - DNA, 25 bp, Mus musculus
agaaggctttggtcagtttaatagt

SEQ ID NO: 142547 - DNA, 25 bp, Mus musculus
agaagggacacacagcatgcctacc

SEQ ID NO: 142548 - DNA, 25 bp, Mus musculus
agaagggacacagagcatgcctacc

SEQ ID NO: 142549 - DNA, 25 bp, Mus musculus
agaagggacccacgccacagcattt

SEQ ID NO: 142550 - DNA, 25 bp, Mus musculus
agaagggacccaggccacagcattt

SEQ ID NO: 142551 - DNA, 25 bp, Mus musculus
agaagggacctcatgtctctttggg

SEQ ID NO: 142552 - DNA, 25 bp, Mus musculus
agaagggacctcttgtctctttggg

SEQ ID NO: 142553 - DNA, 25 bp, Mus musculus
agaagggactgaagtacccctacat

SEQ ID NO: 142554 - DNA, 25 bp, Mus musculus
agaagggactgatgtacccctacat

SEQ ID NO: 142555 - DNA, 25 bp, Mus musculus
agaagggactgtacccactgtggac

SEQ ID NO: 142556 - DNA, 25 bp, Mus musculus
agaagggactgttcccactgtggac

SEQ ID NO: 142557 - DNA, 25 bp, Mus musculus
agaagggacttcaaagttgaccagg

SEQ ID NO: 142558 - DNA, 25 bp, Mus musculus
agaagggacttcattactgtctctt

SEQ ID NO: 142559 - DNA, 25 bp, Mus musculus
agaagggacttctaagttgaccagg

SEQ ID NO: 142560 - DNA, 25 bp, Mus musculus
agaagggacttctttactgtctctt

SEQ ID NO: 142561 - DNA, 25 bp, Mus musculus
agaagggagccaagtcctcggccgc

SEQ ID NO: 142562 - DNA, 25 bp, Mus musculus
agaagggagccatgtcctcggccgc

SEQ ID NO: 142563 - DNA, 25 bp, Mus musculus
agaagggagcttcacactgtgccca

SEQ ID NO: 142564 - DNA, 25 bp, Mus musculus
agaagggagcttgacactgtgccca

SEQ ID NO: 142565 - DNA, 25 bp, Mus musculus
agaagggaggctcgctgtagcttta

SEQ ID NO: 142566 - DNA, 25 bp, Mus musculus
agaagggaggctggctgtagcttta

SEQ ID NO: 142567 - DNA, 25 bp, Mus musculus
agaagggatgaacaccgctcagtag

SEQ ID NO: 142568 - DNA, 25 bp, Mus musculus
agaagggatgaagaccgctcagtag

SEQ ID NO: 142569 - DNA, 25 bp, Mus musculus
agaagggatgccagactcatttccg

SEQ ID NO: 142570 - DNA, 25 bp, Mus musculus
agaagggatgcctgactcatttccg

SEQ ID NO: 142571 - DNA, 25 bp, Mus musculus
agaagggcaaggatcctgtcaccta

SEQ ID NO: 142572 - DNA, 25 bp, Mus musculus
agaagggcaaggttcctgtcaccta

SEQ ID NO: 142573 - DNA, 25 bp, Mus musculus
agaagggcacgccatgccacttact

SEQ ID NO: 142574 - DNA, 25 bp, Mus musculus
agaagggcacgcgatgccacttact

SEQ ID NO: 142575 - DNA, 25 bp, Mus musculus
agaagggcagcaaaccaccctcgtt

SEQ ID NO: 142576 - DNA, 25 bp, Mus musculus
agaagggcagcataccaccctcgtt

SEQ ID NO: 142577 - DNA, 25 bp, Mus musculus
agaagggcatctatccaggaaccat

SEQ ID NO: 142578 - DNA, 25 bp, Mus musculus
agaagggcatctttccaggaaccat

SEQ ID NO: 142579 - DNA, 25 bp, Mus musculus
agaagggcatggatcccaagatgga

SEQ ID NO: 142580 - DNA, 25 bp, Mus musculus
agaagggcatggttcccaagatgga

SEQ ID NO: 142581 - DNA, 25 bp, Mus musculus
agaagggccaatatttccttgagca

SEQ ID NO: 142582 - DNA, 25 bp, Mus musculus
agaagggccaatttttccttgagca

SEQ ID NO: 142583 - DNA, 25 bp, Mus musculus
agaagggccccaatgccaattccta

SEQ ID NO: 142584 - DNA, 25 bp, Mus musculus
agaagggccccattgccaattccta

SEQ ID NO: 142585 - DNA, 25 bp, Mus musculus
agaagggccgctctgaccttcgtca

SEQ ID NO: 142586 - DNA, 25 bp, Mus musculus
agaagggccgctgtgaccttcgtca

SEQ ID NO: 142587 - DNA, 25 bp, Mus musculus
agaagggcctgacctgcctcattag

SEQ ID NO: 142588 - DNA, 25 bp, Mus musculus
agaagggcctgagctgcctcattag

SEQ ID NO: 142589 - DNA, 25 bp, Mus musculus
agaagggcctgtctcatctaacttg

SEQ ID NO: 142590 - DNA, 25 bp, Mus musculus
agaagggcctgtgtcatctaacttg

SEQ ID NO: 142591 - DNA, 25 bp, Mus musculus
agaagggcgtttagtcctgttcagc

SEQ ID NO: 142592 - DNA, 25 bp, Mus musculus
agaagggcgttttgtcctgttcagc

SEQ ID NO: 142593 - DNA, 25 bp, Mus musculus
agaagggctaacaccttgctcagtt

SEQ ID NO: 142594 - DNA, 25 bp, Mus musculus
agaagggctaactccttgctcagtt

SEQ ID NO: 142595 - DNA, 25 bp, Mus musculus
agaagggctaccatatgtccaaggg

SEQ ID NO: 142596 - DNA, 25 bp, Mus musculus
agaagggctaccttatgtccaaggg

SEQ ID NO: 142597 - DNA, 25 bp, Mus musculus
agaagggctatcaggtttttaccat

SEQ ID NO: 142598 - DNA, 25 bp, Mus musculus
agaagggctatctggtttttaccat

SEQ ID NO: 142599 - DNA, 25 bp, Mus musculus
agaagggctccacactgggacctct

SEQ ID NO: 142600 - DNA, 25 bp, Mus musculus
agaagggctccagactgggacctct

SEQ ID NO: 142601 - DNA, 25 bp, Mus musculus
agaagggctcccacaggtttgccgg

SEQ ID NO: 142602 - DNA, 25 bp, Mus musculus
agaagggctccctcaggtttgccgg

SEQ ID NO: 142603 - DNA, 25 bp, Mus musculus
agaagggcttacacgggagctcccg

SEQ ID NO: 142604 - DNA, 25 bp, Mus musculus
agaagggcttactcgggagctcccg

SEQ ID NO: 142605 - DNA, 25 bp, Mus musculus
agaagggcttcgaccagtcggccga

SEQ ID NO: 142606 - DNA, 25 bp, Mus musculus
agaagggcttcgtccagtcggccga

SEQ ID NO: 142607 - DNA, 25 bp, Mus musculus
agaagggctttcaatgctggaggca

SEQ ID NO: 142608 - DNA, 25 bp, Mus musculus
agaagggctttctatgctggaggca

SEQ ID NO: 142609 - DNA, 25 bp, Mus musculus
agaagggcttttccaacactaacaa

SEQ ID NO: 142610 - DNA, 25 bp, Mus musculus
agaagggcttttgcaacactaacaa

SEQ ID NO: 142611 - DNA, 25 bp, Mus musculus
agaagggtactcatgtcagcagcac

SEQ ID NO: 142612 - DNA, 25 bp, Mus musculus
agaagggtactcttgtcagcagcac

SEQ ID NO: 142613 - DNA, 25 bp, Mus musculus
agaagggtcaaaccagatcctgtaa

SEQ ID NO: 142614 - DNA, 25 bp, Mus musculus
agaagggtcaaagcagatcctgtaa

SEQ ID NO: 142615 - DNA, 25 bp, Mus musculus
agaagggtccagcttactgccagcg

SEQ ID NO: 142616 - DNA, 25 bp, Mus musculus
agaagggtccaggttactgccagcg

SEQ ID NO: 142617 - DNA, 25 bp, Mus musculus
agaagggtccgcactttgttgtcgg

SEQ ID NO: 142618 - DNA, 25 bp, Mus musculus
agaagggtccgctctttgttgtcgg

SEQ ID NO: 142619 - DNA, 25 bp, Mus musculus
agaagggtcgacagctatatgcccc

SEQ ID NO: 142620 - DNA, 25 bp, Mus musculus
agaagggtcgactgctatatgcccc

SEQ ID NO: 142621 - DNA, 25 bp, Mus musculus
agaagggtcgatctgctttaaaaca

SEQ ID NO: 142622 - DNA, 25 bp, Mus musculus
agaagggtcgatgtgctttaaaaca

SEQ ID NO: 142623 - DNA, 25 bp, Mus musculus
agaagggtctagaggttgagttcca

SEQ ID NO: 142624 - DNA, 25 bp, Mus musculus
agaagggtctagtggttgagttcca

SEQ ID NO: 142625 - DNA, 25 bp, Mus musculus
agaagggtctcaccagccggataat

SEQ ID NO: 142626 - DNA, 25 bp, Mus musculus
agaagggtctcagcagccggataat

SEQ ID NO: 142627 - DNA, 25 bp, Mus musculus
agaagggtgaccagtagacagatga

SEQ ID NO: 142628 - DNA, 25 bp, Mus musculus
agaagggtgacctgtagacagatga

SEQ ID NO: 142629 - DNA, 25 bp, Mus musculus
agaagggtgagaacctctccgaaga

SEQ ID NO: 142630 - DNA, 25 bp, Mus musculus
agaagggtgagatcctctccgaaga

SEQ ID NO: 142631 - DNA, 25 bp, Mus musculus
agaagggtgcacacaggtcaaccaa

SEQ ID NO: 142632 - DNA, 25 bp, Mus musculus
agaagggtgcactcaggtcaaccaa

SEQ ID NO: 142633 - DNA, 25 bp, Mus musculus
agaagggtgcttctcaagttcccag

SEQ ID NO: 142634 - DNA, 25 bp, Mus musculus
agaagggtgcttgtcaagttcccag

SEQ ID NO: 142635 - DNA, 25 bp, Mus musculus
agaagggtggctcctattccttgag

SEQ ID NO: 142636 - DNA, 25 bp, Mus musculus
agaagggtggctgctattccttgag

SEQ ID NO: 142637 - DNA, 25 bp, Mus musculus
agaagggttactacgcagtgactga

SEQ ID NO: 142638 - DNA, 25 bp, Mus musculus
agaagggttactctccagggagcct

SEQ ID NO: 142639 - DNA, 25 bp, Mus musculus
agaagggttactgtccagggagcct

SEQ ID NO: 142640 - DNA, 25 bp, Mus musculus
agaagggttacttcgcagtgactga

SEQ ID NO: 142641 - DNA, 25 bp, Mus musculus
agaaggtaaggccttgctccgccag

SEQ ID NO: 142642 - DNA, 25 bp, Mus musculus
agaaggtaaggcgttgctccgccag

SEQ ID NO: 142643 - DNA, 25 bp, Mus musculus
agaaggtaatctcagtcagtgcttg

SEQ ID NO: 142644 - DNA, 25 bp, Mus musculus
agaaggtaatctgagtcagtgcttg

SEQ ID NO: 142645 - DNA, 25 bp, Mus musculus
agaaggtacctgctgcagcacagct

SEQ ID NO: 142646 - DNA, 25 bp, Mus musculus
agaaggtacctggtgcagcacagct

SEQ ID NO: 142647 - DNA, 25 bp, Mus musculus
agaaggtagtttcccctcttcatgt

SEQ ID NO: 142648 - DNA, 25 bp, Mus musculus
agaaggtagtttgccctcttcatgt

SEQ ID NO: 142649 - DNA, 25 bp, Mus musculus
agaaggtatctcctgcgtgtatcct

SEQ ID NO: 142650 - DNA, 25 bp, Mus musculus
agaaggtatctcgtgcgtgtatcct

SEQ ID NO: 142651 - DNA, 25 bp, Mus musculus
agaaggtatcttaagggctggaaag

SEQ ID NO: 142652 - DNA, 25 bp, Mus musculus
agaaggtatctttagggctggaaag

SEQ ID NO: 142653 - DNA, 25 bp, Mus musculus
agaaggtatggaatcctgccctcca

SEQ ID NO: 142654 - DNA, 25 bp, Mus musculus
agaaggtatggattcctgccctcca

SEQ ID NO: 142655 - DNA, 25 bp, Mus musculus
agaaggtattgcctctgcaaccatg

SEQ ID NO: 142656 - DNA, 25 bp, Mus musculus
agaaggtattgcgtctgcaaccatg

SEQ ID NO: 142657 - DNA, 25 bp, Mus musculus
agaaggtcacgcaactggatctgga

SEQ ID NO: 142658 - DNA, 25 bp, Mus musculus
agaaggtcacgcacccgggatcgtc

SEQ ID NO: 142659 - DNA, 25 bp, Mus musculus
agaaggtcacgctactggatctgga

SEQ ID NO: 142660 - DNA, 25 bp, Mus musculus
agaaggtcacgctcccgggatcgtc

SEQ ID NO: 142661 - DNA, 25 bp, Mus musculus
agaaggtccccgacgtccagcaacg

SEQ ID NO: 142662 - DNA, 25 bp, Mus musculus
agaaggtccccgtcgtccagcaacg

SEQ ID NO: 142663 - DNA, 25 bp, Mus musculus
agaaggtccgcgagctgctcatgct

SEQ ID NO: 142664 - DNA, 25 bp, Mus musculus
agaaggtccgcgtgctgctcatgct

SEQ ID NO: 142665 - DNA, 25 bp, Mus musculus
agaaggtccggtctcagacttcagg

SEQ ID NO: 142666 - DNA, 25 bp, Mus musculus
agaaggtccggtgtcagacttcagg

SEQ ID NO: 142667 - DNA, 25 bp, Mus musculus
agaaggtcctagagcaggcatggca

SEQ ID NO: 142668 - DNA, 25 bp, Mus musculus
agaaggtcctagtgcaggcatggca

SEQ ID NO: 142669 - DNA, 25 bp, Mus musculus
agaaggtcctgaatgtctcctttgc

SEQ ID NO: 142670 - DNA, 25 bp, Mus musculus
agaaggtcctgattgtctcctttgc

SEQ ID NO: 142671 - DNA, 25 bp, Mus musculus
agaaggtccttgatcttctgcttgt

SEQ ID NO: 142672 - DNA, 25 bp, Mus musculus
agaaggtccttgttcttctgcttgt

SEQ ID NO: 142673 - DNA, 25 bp, Mus musculus
agaaggtcgccgatgctctggccaa

SEQ ID NO: 142674 - DNA, 25 bp, Mus musculus
agaaggtcgccgttgctctggccaa

SEQ ID NO: 142675 - DNA, 25 bp, Mus musculus
agaaggtctcaccagatactcagct

SEQ ID NO: 142676 - DNA, 25 bp, Mus musculus
agaaggtctcacgagatactcagct

SEQ ID NO: 142677 - DNA, 25 bp, Mus musculus
agaaggtctccaagtggcttttctt

SEQ ID NO: 142678 - DNA, 25 bp, Mus musculus
agaaggtctccatgtggcttttctt

SEQ ID NO: 142679 - DNA, 25 bp, Mus musculus
agaaggtctcccaggcttccggtgg

SEQ ID NO: 142680 - DNA, 25 bp, Mus musculus
agaaggtctccctggcttccggtgg

SEQ ID NO: 142681 - DNA, 25 bp, Mus musculus
agaaggtctgggacctgcaagctca

SEQ ID NO: 142682 - DNA, 25 bp, Mus musculus
agaaggtctgggtcctgcaagctca

SEQ ID NO: 142683 - DNA, 25 bp, Mus musculus
agaaggtgaactatgtcccgtctca

SEQ ID NO: 142684 - DNA, 25 bp, Mus musculus
agaaggtgaactttgtcccgtctca

SEQ ID NO: 142685 - DNA, 25 bp, Mus musculus
agaaggtgactcagcgacacgctca

SEQ ID NO: 142686 - DNA, 25 bp, Mus musculus
agaaggtgactctgcgacacgctca

SEQ ID NO: 142687 - DNA, 25 bp, Mus musculus
agaaggtgaggcagcattttctgca

SEQ ID NO: 142688 - DNA, 25 bp, Mus musculus
agaaggtgaggctgcattttctgca

SEQ ID NO: 142689 - DNA, 25 bp, Mus musculus
agaaggtgatgtcgtctctgctctc

SEQ ID NO: 142690 - DNA, 25 bp, Mus musculus
agaaggtgatgtggtctctgctctc

SEQ ID NO: 142691 - DNA, 25 bp, Mus musculus
agaaggtgccagcttactccatagc

SEQ ID NO: 142692 - DNA, 25 bp, Mus musculus
agaaggtgccaggttactccatagc

SEQ ID NO: 142693 - DNA, 25 bp, Mus musculus
agaaggtgcctcataggcttgccca

SEQ ID NO: 142694 - DNA, 25 bp, Mus musculus
agaaggtgcctcttaggcttgccca

SEQ ID NO: 142695 - DNA, 25 bp, Mus musculus
agaaggtgctctcaatctcctgcag

SEQ ID NO: 142696 - DNA, 25 bp, Mus musculus
agaaggtgctctgaatctcctgcag

SEQ ID NO: 142697 - DNA, 25 bp, Mus musculus
agaaggtgcttcaggcaagccgtgt

SEQ ID NO: 142698 - DNA, 25 bp, Mus musculus
agaaggtgcttctggcaagccgtgt

SEQ ID NO: 142699 - DNA, 25 bp, Mus musculus
agaaggtggaccagtctaagccctt

SEQ ID NO: 142700 - DNA, 25 bp, Mus musculus
agaaggtggacctgtctaagccctt

SEQ ID NO: 142701 - DNA, 25 bp, Mus musculus
agaaggtggaggaacgtccatcaca

SEQ ID NO: 142702 - DNA, 25 bp, Mus musculus
agaaggtggaggtacgtccatcaca

SEQ ID NO: 142703 - DNA, 25 bp, Mus musculus
agaaggtggcacactgccttagggc

SEQ ID NO: 142704 - DNA, 25 bp, Mus musculus
agaaggtggcactctgccttagggc

SEQ ID NO: 142705 - DNA, 25 bp, Mus musculus
agaaggtggcctcgcctaggctcac

SEQ ID NO: 142706 - DNA, 25 bp, Mus musculus
agaaggtggcctggcctaggctcac

SEQ ID NO: 142707 - DNA, 25 bp, Mus musculus
agaaggtggcgactattctgaccct

SEQ ID NO: 142708 - DNA, 25 bp, Mus musculus
agaaggtggcgagtattctgaccct

SEQ ID NO: 142709 - DNA, 25 bp, Mus musculus
agaaggtgtacgacctggtgcgctc

SEQ ID NO: 142710 - DNA, 25 bp, Mus musculus
agaaggtgtacgtcctggtgcgctc

SEQ ID NO: 142711 - DNA, 25 bp, Mus musculus
agaaggttagtcagacctgcctggt

SEQ ID NO: 142712 - DNA, 25 bp, Mus musculus
agaaggttagtctgacctgcctggt

SEQ ID NO: 142713 - DNA, 25 bp, Mus musculus
agaaggttcaacagctcaaagcaca

SEQ ID NO: 142714 - DNA, 25 bp, Mus musculus
agaaggttcaactgctcaaagcaca

SEQ ID NO: 142715 - DNA, 25 bp, Mus musculus
agaaggttcagcacagccgggcttg

SEQ ID NO: 142716 - DNA, 25 bp, Mus musculus
agaaggttcagctcagccgggcttg

SEQ ID NO: 142717 - DNA, 25 bp, Mus musculus
agaaggttccggatcctagccagca

SEQ ID NO: 142718 - DNA, 25 bp, Mus musculus
agaaggttccggttcctagccagca

SEQ ID NO: 142719 - DNA, 25 bp, Mus musculus
agaaggttctagacccaaccggctg

SEQ ID NO: 142720 - DNA, 25 bp, Mus musculus
agaaggttctagacctaccaccact

SEQ ID NO: 142721 - DNA, 25 bp, Mus musculus
agaaggttctagtcccaaccggctg

SEQ ID NO: 142722 - DNA, 25 bp, Mus musculus
agaaggttctagtcctaccaccact

SEQ ID NO: 142723 - DNA, 25 bp, Mus musculus
agaaggttctataagctttctggga

SEQ ID NO: 142724 - DNA, 25 bp, Mus musculus
agaaggttctattagctttctggga

SEQ ID NO: 142725 - DNA, 25 bp, Mus musculus
agaaggttctggctgtctttcctat

SEQ ID NO: 142726 - DNA, 25 bp, Mus musculus
agaaggttctgggtgtctttcctat

SEQ ID NO: 142727 - DNA, 25 bp, Mus musculus
agaaggttgtcaccctctctccggc

SEQ ID NO: 142728 - DNA, 25 bp, Mus musculus
agaaggttgtcagcctctctccggc

SEQ ID NO: 142729 - DNA, 25 bp, Mus musculus
agaaggttgttcatcgtctcacaca

SEQ ID NO: 142730 - DNA, 25 bp, Mus musculus
agaaggttgttcttcgtctcacaca

SEQ ID NO: 142731 - DNA, 25 bp, Mus musculus
agaaggtttccaacttggccagcag

SEQ ID NO: 142732 - DNA, 25 bp, Mus musculus
agaaggtttccatcttggccagcag

SEQ ID NO: 142733 - DNA, 25 bp, Mus musculus
agaagtaaaccaatgcatagctgca

SEQ ID NO: 142734 - DNA, 25 bp, Mus musculus
agaagtaaaccattgcatagctgca

SEQ ID NO: 142735 - DNA, 25 bp, Mus musculus
agaagtaacgggagctgctggctct

SEQ ID NO: 142736 - DNA, 25 bp, Mus musculus
agaagtaacgggtgctgctggctct

SEQ ID NO: 142737 - DNA, 25 bp, Mus musculus
agaagtaactcacacgcccctgaga

SEQ ID NO: 142738 - DNA, 25 bp, Mus musculus
agaagtaactcagacgcccctgaga

SEQ ID NO: 142739 - DNA, 25 bp, Mus musculus
agaagtaacttcacggccacagacc

SEQ ID NO: 142740 - DNA, 25 bp, Mus musculus
agaagtaacttctcggccacagacc

SEQ ID NO: 142741 - DNA, 25 bp, Mus musculus
agaagtaagcctcatgtgcacccgt

SEQ ID NO: 142742 - DNA, 25 bp, Mus musculus
agaagtaagcctgatgtgcacccgt

SEQ ID NO: 142743 - DNA, 25 bp, Mus musculus
agaagtaatataaaacacctgacat

SEQ ID NO: 142744 - DNA, 25 bp, Mus musculus
agaagtaatatataacacctgacat

SEQ ID NO: 142745 - DNA, 25 bp, Mus musculus
agaagtaatcggatcaattcccaga

SEQ ID NO: 142746 - DNA, 25 bp, Mus musculus
agaagtaatcggttcaattcccaga

SEQ ID NO: 142747 - DNA, 25 bp, Mus musculus
agaagtaattcacctacagggtgac

SEQ ID NO: 142748 - DNA, 25 bp, Mus musculus
agaagtaattcagctacagggtgac

SEQ ID NO: 142749 - DNA, 25 bp, Mus musculus
agaagtacaaccctacctggcactg

SEQ ID NO: 142750 - DNA, 25 bp, Mus musculus
agaagtacaaccgtacctggcactg

SEQ ID NO: 142751 - DNA, 25 bp, Mus musculus
agaagtacaattacctacagcagga

SEQ ID NO: 142752 - DNA, 25 bp, Mus musculus
agaagtacaatttcctacagcagga

SEQ ID NO: 142753 - DNA, 25 bp, Mus musculus
agaagtacactcagcctctgtacca

SEQ ID NO: 142754 - DNA, 25 bp, Mus musculus
agaagtacactctgcctctgtacca

SEQ ID NO: 142755 - DNA, 25 bp, Mus musculus
agaagtacatcactgcccacggact

SEQ ID NO: 142756 - DNA, 25 bp, Mus musculus
agaagtacatcagtgcccacggact

SEQ ID NO: 142757 - DNA, 25 bp, Mus musculus
agaagtacatggacgtgtcgggcct

SEQ ID NO: 142758 - DNA, 25 bp, Mus musculus
agaagtacatggtcgtgtcgggcct

SEQ ID NO: 142759 - DNA, 25 bp, Mus musculus
agaagtaccaagcacgtgcgccgtg

SEQ ID NO: 142760 - DNA, 25 bp, Mus musculus
agaagtaccaaggacgtgcgccgtg

SEQ ID NO: 142761 - DNA, 25 bp, Mus musculus
agaagtaccatgagggcatcgagaa

SEQ ID NO: 142762 - DNA, 25 bp, Mus musculus
agaagtaccatgtgggcatcgagaa

SEQ ID NO: 142763 - DNA, 25 bp, Mus musculus
agaagtaccattactaaccaaatga

SEQ ID NO: 142764 - DNA, 25 bp, Mus musculus
agaagtaccattatgtcctcgccta

SEQ ID NO: 142765 - DNA, 25 bp, Mus musculus
agaagtaccatttctaaccaaatga

SEQ ID NO: 142766 - DNA, 25 bp, Mus musculus
agaagtaccattttgtcctcgccta

SEQ ID NO: 142767 - DNA, 25 bp, Mus musculus
agaagtacctacagtagctcccaca

SEQ ID NO: 142768 - DNA, 25 bp, Mus musculus
agaagtacctactgtagctcccaca

SEQ ID NO: 142769 - DNA, 25 bp, Mus musculus
agaagtacgcctcccttggccttct

SEQ ID NO: 142770 - DNA, 25 bp, Mus musculus
agaagtacgcctgccttggccttct

SEQ ID NO: 142771 - DNA, 25 bp, Mus musculus
agaagtacggcaaatatcctcctcc

SEQ ID NO: 142772 - DNA, 25 bp, Mus musculus
agaagtacggcatatatcctcctcc

SEQ ID NO: 142773 - DNA, 25 bp, Mus musculus
agaagtactacgcatccaggactct

SEQ ID NO: 142774 - DNA, 25 bp, Mus musculus
agaagtactacggatccaggactct

SEQ ID NO: 142775 - DNA, 25 bp, Mus musculus
agaagtactagtcgctcctgctgtt

SEQ ID NO: 142776 - DNA, 25 bp, Mus musculus
agaagtactagtggctcctgctgtt

SEQ ID NO: 142777 - DNA, 25 bp, Mus musculus
agaagtactatgacaggaacgccct

SEQ ID NO: 142778 - DNA, 25 bp, Mus musculus
agaagtactatgtcaggaacgccct

SEQ ID NO: 142779 - DNA, 25 bp, Mus musculus
agaagtactgtacatccccaggttg

SEQ ID NO: 142780 - DNA, 25 bp, Mus musculus
agaagtactgtagatccccaggttg

SEQ ID NO: 142781 - DNA, 25 bp, Mus musculus
agaagtacttctccagatggcccag

SEQ ID NO: 142782 - DNA, 25 bp, Mus musculus
agaagtacttctgcagatggcccag

SEQ ID NO: 142783 - DNA, 25 bp, Mus musculus
agaagtagacccaagacacccagag

SEQ ID NO: 142784 - DNA, 25 bp, Mus musculus
agaagtagaccctagacacccagag

SEQ ID NO: 142785 - DNA, 25 bp, Mus musculus
agaagtagacgcactagtgggcatc

SEQ ID NO: 142786 - DNA, 25 bp, Mus musculus
agaagtagacgctctagtgggcatc

SEQ ID NO: 142787 - DNA, 25 bp, Mus musculus
agaagtagatagaagccccagcttg

SEQ ID NO: 142788 - DNA, 25 bp, Mus musculus
agaagtagatagtagccccagcttg

SEQ ID NO: 142789 - DNA, 25 bp, Mus musculus
agaagtagcctactactatcatggt

SEQ ID NO: 142790 - DNA, 25 bp, Mus musculus
agaagtagcctagtactatcatggt

SEQ ID NO: 142791 - DNA, 25 bp, Mus musculus
agaagtagccttccagactaaagtg

SEQ ID NO: 142792 - DNA, 25 bp, Mus musculus
agaagtagccttgcagactaaagtg

SEQ ID NO: 142793 - DNA, 25 bp, Mus musculus
agaagtagcgcgacgttttcttcgt

SEQ ID NO: 142794 - DNA, 25 bp, Mus musculus
agaagtagcgcgtcgttttcttcgt

SEQ ID NO: 142795 - DNA, 25 bp, Mus musculus
agaagtagctccaggccgagcataa

SEQ ID NO: 142796 - DNA, 25 bp, Mus musculus
agaagtagctcctggccgagcataa

SEQ ID NO: 142797 - DNA, 25 bp, Mus musculus
agaagtagctctaacctcggaggtt

SEQ ID NO: 142798 - DNA, 25 bp, Mus musculus
agaagtagctcttacctcggaggtt

SEQ ID NO: 142799 - DNA, 25 bp, Mus musculus
agaagtaggatcagtatctgctgat

SEQ ID NO: 142800 - DNA, 25 bp, Mus musculus
agaagtaggatctgtatctgctgat

SEQ ID NO: 142801 - DNA, 25 bp, Mus musculus
agaagtaggcaccaacctcttcgtt

SEQ ID NO: 142802 - DNA, 25 bp, Mus musculus
agaagtaggcacgaacctcttcgtt

SEQ ID NO: 142803 - DNA, 25 bp, Mus musculus
agaagtaggctcatatcagaccaga

SEQ ID NO: 142804 - DNA, 25 bp, Mus musculus
agaagtaggctcttatcagaccaga

SEQ ID NO: 142805 - DNA, 25 bp, Mus musculus
agaagtagtcaccacaccttcctgc

SEQ ID NO: 142806 - DNA, 25 bp, Mus musculus
agaagtagtcacgacaccttcctgc

SEQ ID NO: 142807 - DNA, 25 bp, Mus musculus
agaagtatagacctgcctccgcctc

SEQ ID NO: 142808 - DNA, 25 bp, Mus musculus
agaagtatagacgtgcctccgcctc

SEQ ID NO: 142809 - DNA, 25 bp, Mus musculus
agaagtatatccagtctcttccttt

SEQ ID NO: 142810 - DNA, 25 bp, Mus musculus
agaagtatatcctgtctcttccttt

SEQ ID NO: 142811 - DNA, 25 bp, Mus musculus
agaagtatcccgcaagctctttgat

SEQ ID NO: 142812 - DNA, 25 bp, Mus musculus
agaagtatcccggaagctctttgat

SEQ ID NO: 142813 - DNA, 25 bp, Mus musculus
agaagtatggtaaccctgagccacc

SEQ ID NO: 142814 - DNA, 25 bp, Mus musculus
agaagtatggtatccctgagccacc

SEQ ID NO: 142815 - DNA, 25 bp, Mus musculus
agaagtatgtacaccagtttacctg

SEQ ID NO: 142816 - DNA, 25 bp, Mus musculus
agaagtatgtactccagtttacctg

SEQ ID NO: 142817 - DNA, 25 bp, Mus musculus
agaagtattccacgtccagtcgctg

SEQ ID NO: 142818 - DNA, 25 bp, Mus musculus
agaagtattccaggtccagtcgctg

SEQ ID NO: 142819 - DNA, 25 bp, Mus musculus
agaagtattcccagtatgcgtttcc

SEQ ID NO: 142820 - DNA, 25 bp, Mus musculus
agaagtattccctgtatgcgtttcc

SEQ ID NO: 142821 - DNA, 25 bp, Mus musculus
agaagtattctaaaccagggcctgg

SEQ ID NO: 142822 - DNA, 25 bp, Mus musculus
agaagtattctataccagggcctgg

SEQ ID NO: 142823 - DNA, 25 bp, Mus musculus
agaagtattctcagtggacctcacc

SEQ ID NO: 142824 - DNA, 25 bp, Mus musculus
agaagtattctctgtggacctcacc

SEQ ID NO: 142825 - DNA, 25 bp, Mus musculus
agaagtattttccatccatttgcaa

SEQ ID NO: 142826 - DNA, 25 bp, Mus musculus
agaagtattttcgatccatttgcaa

SEQ ID NO: 142827 - DNA, 25 bp, Mus musculus
agaagtcaaaatcccaacacgcagc

SEQ ID NO: 142828 - DNA, 25 bp, Mus musculus
agaagtcaaaatgccaacacgcagc

SEQ ID NO: 142829 - DNA, 25 bp, Mus musculus
agaagtcaacctcaggtctcaggag

SEQ ID NO: 142830 - DNA, 25 bp, Mus musculus
agaagtcaacctgaggtctcaggag

SEQ ID NO: 142831 - DNA, 25 bp, Mus musculus
agaagtcaagctactactccacctg

SEQ ID NO: 142832 - DNA, 25 bp, Mus musculus
agaagtcaagcttctactccacctg

SEQ ID NO: 142833 - DNA, 25 bp, Mus musculus
agaagtcaagttagcctctgaggct

SEQ ID NO: 142834 - DNA, 25 bp, Mus musculus
agaagtcaagtttgcctctgaggct

SEQ ID NO: 142835 - DNA, 25 bp, Mus musculus
agaagtcaattgaccttgcactaag

SEQ ID NO: 142836 - DNA, 25 bp, Mus musculus
agaagtcaattgtccttgcactaag

SEQ ID NO: 142837 - DNA, 25 bp, Mus musculus
agaagtcacaccacatcgtacacca

SEQ ID NO: 142838 - DNA, 25 bp, Mus musculus
agaagtcacacctcatcgtacacca

SEQ ID NO: 142839 - DNA, 25 bp, Mus musculus
agaagtcacagacatccccgtaggc

SEQ ID NO: 142840 - DNA, 25 bp, Mus musculus
agaagtcacagagatccccgtaggc

SEQ ID NO: 142841 - DNA, 25 bp, Mus musculus
agaagtcacagcacctgcttctcag

SEQ ID NO: 142842 - DNA, 25 bp, Mus musculus
agaagtcacagctcctgcttctcag

SEQ ID NO: 142843 - DNA, 25 bp, Mus musculus
agaagtcacccaaggatttgctctt

SEQ ID NO: 142844 - DNA, 25 bp, Mus musculus
agaagtcacccatggatttgctctt

SEQ ID NO: 142845 - DNA, 25 bp, Mus musculus
agaagtcaccctctgcatggagctg

SEQ ID NO: 142846 - DNA, 25 bp, Mus musculus
agaagtcaccctgtgcatggagctg

SEQ ID NO: 142847 - DNA, 25 bp, Mus musculus
agaagtcacctgaagcctcatatgc

SEQ ID NO: 142848 - DNA, 25 bp, Mus musculus
agaagtcacctgtagcctcatatgc

SEQ ID NO: 142849 - DNA, 25 bp, Mus musculus
agaagtcaccttagggagcacccct

SEQ ID NO: 142850 - DNA, 25 bp, Mus musculus
agaagtcaccttcagtatccagctt

SEQ ID NO: 142851 - DNA, 25 bp, Mus musculus
agaagtcaccttgagtatccagctt

SEQ ID NO: 142852 - DNA, 25 bp, Mus musculus
agaagtcacctttgggagcacccct

SEQ ID NO: 142853 - DNA, 25 bp, Mus musculus
agaagtcactctcctcacagggttc

SEQ ID NO: 142854 - DNA, 25 bp, Mus musculus
agaagtcactctgctcacagggttc

SEQ ID NO: 142855 - DNA, 25 bp, Mus musculus
agaagtcagcctcagacgcgtccat

SEQ ID NO: 142856 - DNA, 25 bp, Mus musculus
agaagtcagcctgagacgcgtccat

SEQ ID NO: 142857 - DNA, 25 bp, Mus musculus
agaagtcaggatcacacactcagtc

SEQ ID NO: 142858 - DNA, 25 bp, Mus musculus
agaagtcaggatgacacactcagtc

SEQ ID NO: 142859 - DNA, 25 bp, Mus musculus
agaagtcaggcacgatcccaaccac

SEQ ID NO: 142860 - DNA, 25 bp, Mus musculus
agaagtcaggcaggatcccaaccac

SEQ ID NO: 142861 - DNA, 25 bp, Mus musculus
agaagtcagtcactgttggtgtgcc

SEQ ID NO: 142862 - DNA, 25 bp, Mus musculus
agaagtcagtcagtgttggtgtgcc

SEQ ID NO: 142863 - DNA, 25 bp, Mus musculus
agaagtcatatcactgtaggtacag

SEQ ID NO: 142864 - DNA, 25 bp, Mus musculus
agaagtcatatctctgtaggtacag

SEQ ID NO: 142865 - DNA, 25 bp, Mus musculus
agaagtcatccaaagttacatagta

SEQ ID NO: 142866 - DNA, 25 bp, Mus musculus
agaagtcatccatagttacatagta

SEQ ID NO: 142867 - DNA, 25 bp, Mus musculus
agaagtcatcccatcttccaggaag

SEQ ID NO: 142868 - DNA, 25 bp, Mus musculus
agaagtcatcccttcttccaggaag

SEQ ID NO: 142869 - DNA, 25 bp, Mus musculus
agaagtcatcttcctgtcaatgttt

SEQ ID NO: 142870 - DNA, 25 bp, Mus musculus
agaagtcatcttctatgcccgggta

SEQ ID NO: 142871 - DNA, 25 bp, Mus musculus
agaagtcatcttgctgtcaatgttt

SEQ ID NO: 142872 - DNA, 25 bp, Mus musculus
agaagtcatcttgtatgcccgggta

SEQ ID NO: 142873 - DNA, 25 bp, Mus musculus
agaagtcatgagacaccgcgtggat

SEQ ID NO: 142874 - DNA, 25 bp, Mus musculus
agaagtcatgagtcaccgcgtggat

SEQ ID NO: 142875 - DNA, 25 bp, Mus musculus
agaagtcatgcgcagctttttaagc

SEQ ID NO: 142876 - DNA, 25 bp, Mus musculus
agaagtcatgcggagctttttaagc

SEQ ID NO: 142877 - DNA, 25 bp, Mus musculus
agaagtcatttgatcccggctcgat

SEQ ID NO: 142878 - DNA, 25 bp, Mus musculus
agaagtcatttgttcccggctcgat

SEQ ID NO: 142879 - DNA, 25 bp, Mus musculus
agaagtccaatcaagctgcagccag

SEQ ID NO: 142880 - DNA, 25 bp, Mus musculus
agaagtccaatctagctgcagccag

SEQ ID NO: 142881 - DNA, 25 bp, Mus musculus
agaagtccaattccagtctatccac

SEQ ID NO: 142882 - DNA, 25 bp, Mus musculus
agaagtccaattgcagtctatccac

SEQ ID NO: 142883 - DNA, 25 bp, Mus musculus
agaagtccacccagaaggtgctgga

SEQ ID NO: 142884 - DNA, 25 bp, Mus musculus
agaagtccaccctgaaggtgctgga

SEQ ID NO: 142885 - DNA, 25 bp, Mus musculus
agaagtccacctcgaggtttcattt

SEQ ID NO: 142886 - DNA, 25 bp, Mus musculus
agaagtccacctggaggtttcattt

SEQ ID NO: 142887 - DNA, 25 bp, Mus musculus
agaagtccacgacagggcgcgcaac

SEQ ID NO: 142888 - DNA, 25 bp, Mus musculus
agaagtccacgagagggcgcgcaac

SEQ ID NO: 142889 - DNA, 25 bp, Mus musculus
agaagtccagccactgatgtccatg

SEQ ID NO: 142890 - DNA, 25 bp, Mus musculus
agaagtccagcctctgatgtccatg

SEQ ID NO: 142891 - DNA, 25 bp, Mus musculus
agaagtcccaggagagccctaacat

SEQ ID NO: 142892 - DNA, 25 bp, Mus musculus
agaagtcccaggcattcagactcct

SEQ ID NO: 142893 - DNA, 25 bp, Mus musculus
agaagtcccagggattcagactcct

SEQ ID NO: 142894 - DNA, 25 bp, Mus musculus
agaagtcccaggtgagccctaacat

SEQ ID NO: 142895 - DNA, 25 bp, Mus musculus
agaagtcccatgatctcatttgctt

SEQ ID NO: 142896 - DNA, 25 bp, Mus musculus
agaagtcccatgttctcatttgctt

SEQ ID NO: 142897 - DNA, 25 bp, Mus musculus
agaagtccccttaccagagatacct

SEQ ID NO: 142898 - DNA, 25 bp, Mus musculus
agaagtcccctttccagagatacct

SEQ ID NO: 142899 - DNA, 25 bp, Mus musculus
agaagtcccgcaaccgatttgagat

SEQ ID NO: 142900 - DNA, 25 bp, Mus musculus
agaagtcccgcatccgatttgagat

SEQ ID NO: 142901 - DNA, 25 bp, Mus musculus
agaagtccctcgatctgagacctgt

SEQ ID NO: 142902 - DNA, 25 bp, Mus musculus
agaagtccctcgttctgagacctgt

SEQ ID NO: 142903 - DNA, 25 bp, Mus musculus
agaagtccgccacaaggctctgaca

SEQ ID NO: 142904 - DNA, 25 bp, Mus musculus
agaagtccgccagaaggctctgaca

SEQ ID NO: 142905 - DNA, 25 bp, Mus musculus
agaagtccgcccatgtgctgtatgc

SEQ ID NO: 142906 - DNA, 25 bp, Mus musculus
agaagtccgcccttgtgctgtatgc

SEQ ID NO: 142907 - DNA, 25 bp, Mus musculus
agaagtccgccgaggttgtgccaaa

SEQ ID NO: 142908 - DNA, 25 bp, Mus musculus
agaagtccgccgtggttgtgccaaa

SEQ ID NO: 142909 - DNA, 25 bp, Mus musculus
agaagtccggctcccagctaagagg

SEQ ID NO: 142910 - DNA, 25 bp, Mus musculus
agaagtccggctgccagctaagagg

SEQ ID NO: 142911 - DNA, 25 bp, Mus musculus
agaagtccgtccctgtgggatctct

SEQ ID NO: 142912 - DNA, 25 bp, Mus musculus
agaagtccgtccgtgtgggatctct

SEQ ID NO: 142913 - DNA, 25 bp, Mus musculus
agaagtccgtgtcctgaggaccacg

SEQ ID NO: 142914 - DNA, 25 bp, Mus musculus
agaagtccgtgtgctgaggaccacg

SEQ ID NO: 142915 - DNA, 25 bp, Mus musculus
agaagtcctagcacttgccagatgg

SEQ ID NO: 142916 - DNA, 25 bp, Mus musculus
agaagtcctagctcttgccagatgg

SEQ ID NO: 142917 - DNA, 25 bp, Mus musculus
agaagtcctcatacctatgcagtca

SEQ ID NO: 142918 - DNA, 25 bp, Mus musculus
agaagtcctcattcctatgcagtca

SEQ ID NO: 142919 - DNA, 25 bp, Mus musculus
agaagtcctccaaaggctatttcct

SEQ ID NO: 142920 - DNA, 25 bp, Mus musculus
agaagtcctccataggctatttcct

SEQ ID NO: 142921 - DNA, 25 bp, Mus musculus
agaagtcctgctcactgccactatt

SEQ ID NO: 142922 - DNA, 25 bp, Mus musculus
agaagtcctgctgactgccactatt

SEQ ID NO: 142923 - DNA, 25 bp, Mus musculus
agaagtcctggtccctctcgtgcgg

SEQ ID NO: 142924 - DNA, 25 bp, Mus musculus
agaagtcctggtgcctctcgtgcgg

SEQ ID NO: 142925 - DNA, 25 bp, Mus musculus
agaagtcctgttcaactggtacaat

SEQ ID NO: 142926 - DNA, 25 bp, Mus musculus
agaagtcctgttgaactggtacaat

SEQ ID NO: 142927 - DNA, 25 bp, Mus musculus
agaagtcgaccgagctgctgatccg

SEQ ID NO: 142928 - DNA, 25 bp, Mus musculus
agaagtcgaccgtgctgctgatccg

SEQ ID NO: 142929 - DNA, 25 bp, Mus musculus
agaagtcgcaacaacttgagagtct

SEQ ID NO: 142930 - DNA, 25 bp, Mus musculus
agaagtcgcaactacttgagagtct

SEQ ID NO: 142931 - DNA, 25 bp, Mus musculus
agaagtcgcagcacggccggaccca

SEQ ID NO: 142932 - DNA, 25 bp, Mus musculus
agaagtcgcagctcggccggaccca

SEQ ID NO: 142933 - DNA, 25 bp, Mus musculus
agaagtcgccttaacagctaggtat

SEQ ID NO: 142934 - DNA, 25 bp, Mus musculus
agaagtcgcctttacagctaggtat

SEQ ID NO: 142935 - DNA, 25 bp, Mus musculus
agaagtcgcggaacatccaggaggt

SEQ ID NO: 142936 - DNA, 25 bp, Mus musculus
agaagtcgcggatcatccaggaggt

SEQ ID NO: 142937 - DNA, 25 bp, Mus musculus
agaagtcgctgcagtgcatccgctg

SEQ ID NO: 142938 - DNA, 25 bp, Mus musculus
agaagtcgctgctgtgcatccgctg

SEQ ID NO: 142939 - DNA, 25 bp, Mus musculus
agaagtcgcttcaggctgtgtgctt

SEQ ID NO: 142940 - DNA, 25 bp, Mus musculus
agaagtcgcttctggctgtgtgctt

SEQ ID NO: 142941 - DNA, 25 bp, Mus musculus
agaagtcggactaggagccctcgct

SEQ ID NO: 142942 - DNA, 25 bp, Mus musculus
agaagtcggacttggagccctcgct

SEQ ID NO: 142943 - DNA, 25 bp, Mus musculus
agaagtcggcccaggatgagatcat

SEQ ID NO: 142944 - DNA, 25 bp, Mus musculus
agaagtcggccctggatgagatcat

SEQ ID NO: 142945 - DNA, 25 bp, Mus musculus
agaagtcgtgcaccaacagccaggg

SEQ ID NO: 142946 - DNA, 25 bp, Mus musculus
agaagtcgtgcagcaacagccaggg

SEQ ID NO: 142947 - DNA, 25 bp, Mus musculus
agaagtcgtggccttccagaacagt

SEQ ID NO: 142948 - DNA, 25 bp, Mus musculus
agaagtcgtggcgttccagaacagt

SEQ ID NO: 142949 - DNA, 25 bp, Mus musculus
agaagtctaagtattgacacctggg

SEQ ID NO: 142950 - DNA, 25 bp, Mus musculus
agaagtctaagttttgacacctggg

SEQ ID NO: 142951 - DNA, 25 bp, Mus musculus
agaagtctacaacggcttctccctg

SEQ ID NO: 142952 - DNA, 25 bp, Mus musculus
agaagtctacaagggcttctccctg

SEQ ID NO: 142953 - DNA, 25 bp, Mus musculus
agaagtctacatctgaagaccctta

SEQ ID NO: 142954 - DNA, 25 bp, Mus musculus
agaagtctacatgtgaagaccctta

SEQ ID NO: 142955 - DNA, 25 bp, Mus musculus
agaagtctatgcagctaccggtagc

SEQ ID NO: 142956 - DNA, 25 bp, Mus musculus
agaagtctatgctgctaccggtagc

SEQ ID NO: 142957 - DNA, 25 bp, Mus musculus
agaagtctcagtatcctcggagtgc

SEQ ID NO: 142958 - DNA, 25 bp, Mus musculus
agaagtctcagtttcctcggagtgc

SEQ ID NO: 142959 - DNA, 25 bp, Mus musculus
agaagtctcattcctgtcaggcatg

SEQ ID NO: 142960 - DNA, 25 bp, Mus musculus
agaagtctcattgctgtcaggcatg

SEQ ID NO: 142961 - DNA, 25 bp, Mus musculus
agaagtctccgtagcaagccgagta

SEQ ID NO: 142962 - DNA, 25 bp, Mus musculus
agaagtctccgttgcaagccgagta

SEQ ID NO: 142963 - DNA, 25 bp, Mus musculus
agaagtctctcaagggcctattctt

SEQ ID NO: 142964 - DNA, 25 bp, Mus musculus
agaagtctctcatgggcctattctt

SEQ ID NO: 142965 - DNA, 25 bp, Mus musculus
agaagtctctctctgacatggttca

SEQ ID NO: 142966 - DNA, 25 bp, Mus musculus
agaagtctctctgtgacatggttca

SEQ ID NO: 142967 - DNA, 25 bp, Mus musculus
agaagtctctgaactctgccggtga

SEQ ID NO: 142968 - DNA, 25 bp, Mus musculus
agaagtctctgatctctgccggtga

SEQ ID NO: 142969 - DNA, 25 bp, Mus musculus
agaagtctgaacatgctataccaaa

SEQ ID NO: 142970 - DNA, 25 bp, Mus musculus
agaagtctgaacttgctataccaaa

SEQ ID NO: 142971 - DNA, 25 bp, Mus musculus
agaagtctgacacttgctttgtttt

SEQ ID NO: 142972 - DNA, 25 bp, Mus musculus
agaagtctgacagttgctttgtttt

SEQ ID NO: 142973 - DNA, 25 bp, Mus musculus
agaagtctgaccattcaggacccag

SEQ ID NO: 142974 - DNA, 25 bp, Mus musculus
agaagtctgacctttcaggacccag

SEQ ID NO: 142975 - DNA, 25 bp, Mus musculus
agaagtctgagcaggcactgtgtct

SEQ ID NO: 142976 - DNA, 25 bp, Mus musculus
agaagtctgagctggcactgtgtct

SEQ ID NO: 142977 - DNA, 25 bp, Mus musculus
agaagtctgaggctcgccgcaagga

SEQ ID NO: 142978 - DNA, 25 bp, Mus musculus
agaagtctgagggtcgccgcaagga

SEQ ID NO: 142979 - DNA, 25 bp, Mus musculus
agaagtctgagtctgttgctggccc

SEQ ID NO: 142980 - DNA, 25 bp, Mus musculus
agaagtctgagtgtgttgctggccc

SEQ ID NO: 142981 - DNA, 25 bp, Mus musculus
agaagtctgctcatcataccaagaa

SEQ ID NO: 142982 - DNA, 25 bp, Mus musculus
agaagtctgctcttcataccaagaa

SEQ ID NO: 142983 - DNA, 25 bp, Mus musculus
agaagtctgctgctgtcgtaagtaa

SEQ ID NO: 142984 - DNA, 25 bp, Mus musculus
agaagtctgctggtgtcgtaagtaa

SEQ ID NO: 142985 - DNA, 25 bp, Mus musculus
agaagtctggcaaggcaggctttcc

SEQ ID NO: 142986 - DNA, 25 bp, Mus musculus
agaagtctggcacctgcccagtgtg

SEQ ID NO: 142987 - DNA, 25 bp, Mus musculus
agaagtctggcagctgcccagtgtg

SEQ ID NO: 142988 - DNA, 25 bp, Mus musculus
agaagtctggcatggcaggctttcc

SEQ ID NO: 142989 - DNA, 25 bp, Mus musculus
agaagtctggcgacatctggctgga

SEQ ID NO: 142990 - DNA, 25 bp, Mus musculus
agaagtctggcgtcatctggctgga

SEQ ID NO: 142991 - DNA, 25 bp, Mus musculus
agaagtctggttacatctctggttt

SEQ ID NO: 142992 - DNA, 25 bp, Mus musculus
agaagtctggtttcatctctggttt

SEQ ID NO: 142993 - DNA, 25 bp, Mus musculus
agaagtctgtacacacttctggagg

SEQ ID NO: 142994 - DNA, 25 bp, Mus musculus
agaagtctgtactcacttctggagg

SEQ ID NO: 142995 - DNA, 25 bp, Mus musculus
agaagtctgtgccatcttcaggcag

SEQ ID NO: 142996 - DNA, 25 bp, Mus musculus
agaagtctgtgcgatcttcaggcag

SEQ ID NO: 142997 - DNA, 25 bp, Mus musculus
agaagtctgtgtagaaatgccatca

SEQ ID NO: 142998 - DNA, 25 bp, Mus musculus
agaagtctgtgttgaaatgccatca

SEQ ID NO: 142999 - DNA, 25 bp, Mus musculus
agaagtcttagcacactctcaggaa

SEQ ID NO: 143000 - DNA, 25 bp, Mus musculus
agaagtcttagctcactctcaggaa

SEQ ID NO: 143001 - DNA, 25 bp, Mus musculus
agaagtcttattaaccagcagcagc

SEQ ID NO: 143002 - DNA, 25 bp, Mus musculus
agaagtcttatttaccagcagcagc

SEQ ID NO: 143003 - DNA, 25 bp, Mus musculus
agaagtcttcacattttcaaacgga

SEQ ID NO: 143004 - DNA, 25 bp, Mus musculus
agaagtcttcactttttcaaacgga

SEQ ID NO: 143005 - DNA, 25 bp, Mus musculus
agaagtcttcggctcaggcactgct

SEQ ID NO: 143006 - DNA, 25 bp, Mus musculus
agaagtcttcgggtcaggcactgct

SEQ ID NO: 143007 - DNA, 25 bp, Mus musculus
agaagtcttcgtatcaccatggcag

SEQ ID NO: 143008 - DNA, 25 bp, Mus musculus
agaagtcttcgtttcaccatggcag

SEQ ID NO: 143009 - DNA, 25 bp, Mus musculus
agaagtcttgacaggttccatcttc

SEQ ID NO: 143010 - DNA, 25 bp, Mus musculus
agaagtcttgactggttccatcttc

SEQ ID NO: 143011 - DNA, 25 bp, Mus musculus
agaagtcttgcaagctttcagctca

SEQ ID NO: 143012 - DNA, 25 bp, Mus musculus
agaagtcttgcatgctttcagctca

SEQ ID NO: 143013 - DNA, 25 bp, Mus musculus
agaagtgaaaccacactcacggcca

SEQ ID NO: 143014 - DNA, 25 bp, Mus musculus
agaagtgaaacctcactcacggcca

SEQ ID NO: 143015 - DNA, 25 bp, Mus musculus
agaagtgaacatatcatgtttaggt

SEQ ID NO: 143016 - DNA, 25 bp, Mus musculus
agaagtgaacatttcatgtttaggt

SEQ ID NO: 143017 - DNA, 25 bp, Mus musculus
agaagtgaatcacagctggcccgcc

SEQ ID NO: 143018 - DNA, 25 bp, Mus musculus
agaagtgaatcagagctggcccgcc

SEQ ID NO: 143019 - DNA, 25 bp, Mus musculus
agaagtgaatgaagccctgccagcc

SEQ ID NO: 143020 - DNA, 25 bp, Mus musculus
agaagtgaatgatgccctgccagcc

SEQ ID NO: 143021 - DNA, 25 bp, Mus musculus
agaagtgaatgtcccttgatgtaca

SEQ ID NO: 143022 - DNA, 25 bp, Mus musculus
agaagtgaatgtgccttgatgtaca

SEQ ID NO: 143023 - DNA, 25 bp, Mus musculus
agaagtgacactcagcaaacccatt

SEQ ID NO: 143024 - DNA, 25 bp, Mus musculus
agaagtgacactgagcaaacccatt

SEQ ID NO: 143025 - DNA, 25 bp, Mus musculus
agaagtgactgtccacacctgtgac

SEQ ID NO: 143026 - DNA, 25 bp, Mus musculus
agaagtgactgtgcacacctgtgac

SEQ ID NO: 143027 - DNA, 25 bp, Mus musculus
agaagtgagcccctctaatgccaag

SEQ ID NO: 143028 - DNA, 25 bp, Mus musculus
agaagtgagcccgtctaatgccaag

SEQ ID NO: 143029 - DNA, 25 bp, Mus musculus
agaagtgatcctaccactggccatg

SEQ ID NO: 143030 - DNA, 25 bp, Mus musculus
agaagtgatccttccactggccatg

SEQ ID NO: 143031 - DNA, 25 bp, Mus musculus
agaagtgatcggctcgccttttcaa

SEQ ID NO: 143032 - DNA, 25 bp, Mus musculus
agaagtgatcgggtcgccttttcaa

SEQ ID NO: 143033 - DNA, 25 bp, Mus musculus
agaagtgatgaacccattgcacaac

SEQ ID NO: 143034 - DNA, 25 bp, Mus musculus
agaagtgatgaagccattgcacaac

SEQ ID NO: 143035 - DNA, 25 bp, Mus musculus
agaagtgatggcctctgtggatatt

SEQ ID NO: 143036 - DNA, 25 bp, Mus musculus
agaagtgatggcgtctgtggatatt

SEQ ID NO: 143037 - DNA, 25 bp, Mus musculus
agaagtgatgttccaaagcaaacca

SEQ ID NO: 143038 - DNA, 25 bp, Mus musculus
agaagtgatgttgcaaagcaaacca

SEQ ID NO: 143039 - DNA, 25 bp, Mus musculus
agaagtgattctctcctgcgtgtgc

SEQ ID NO: 143040 - DNA, 25 bp, Mus musculus
agaagtgattctgtcctgcgtgtgc

SEQ ID NO: 143041 - DNA, 25 bp, Mus musculus
agaagtgcaaacctaggactctaga

SEQ ID NO: 143042 - DNA, 25 bp, Mus musculus
agaagtgcaaacgtaggactctaga

SEQ ID NO: 143043 - DNA, 25 bp, Mus musculus
agaagtgcaaccaccgatgccagta

SEQ ID NO: 143044 - DNA, 25 bp, Mus musculus
agaagtgcaacctccgatgccagta

SEQ ID NO: 143045 - DNA, 25 bp, Mus musculus
agaagtgcaagacctcacagtgata

SEQ ID NO: 143046 - DNA, 25 bp, Mus musculus
agaagtgcaagagctcacagtgata

SEQ ID NO: 143047 - DNA, 25 bp, Mus musculus
agaagtgcacaaaagctaccaaagc

SEQ ID NO: 143048 - DNA, 25 bp, Mus musculus
agaagtgcacaatagctaccaaagc

SEQ ID NO: 143049 - DNA, 25 bp, Mus musculus
agaagtgcacgtctttcttcttttc

SEQ ID NO: 143050 - DNA, 25 bp, Mus musculus
agaagtgcacgtgtttcttcttttc

SEQ ID NO: 143051 - DNA, 25 bp, Mus musculus
agaagtgcactgaccctattcatgt

SEQ ID NO: 143052 - DNA, 25 bp, Mus musculus
agaagtgcactgtccctattcatgt

SEQ ID NO: 143053 - DNA, 25 bp, Mus musculus
agaagtgcacttattgatccaaatg

SEQ ID NO: 143054 - DNA, 25 bp, Mus musculus
agaagtgcactttttgatccaaatg

SEQ ID NO: 143055 - DNA, 25 bp, Mus musculus
agaagtgcagtgctgtcgcttgtct

SEQ ID NO: 143056 - DNA, 25 bp, Mus musculus
agaagtgcagtggtgtcgcttgtct

SEQ ID NO: 143057 - DNA, 25 bp, Mus musculus
agaagtgcataactctcagccgcct

SEQ ID NO: 143058 - DNA, 25 bp, Mus musculus
agaagtgcataagtctcagccgcct

SEQ ID NO: 143059 - DNA, 25 bp, Mus musculus
agaagtgcatcgcaagccccgggaa

SEQ ID NO: 143060 - DNA, 25 bp, Mus musculus
agaagtgcatcggaagccccgggaa

SEQ ID NO: 143061 - DNA, 25 bp, Mus musculus
agaagtgccaaaattcagtgagcca

SEQ ID NO: 143062 - DNA, 25 bp, Mus musculus
agaagtgccaaatttcagtgagcca

SEQ ID NO: 143063 - DNA, 25 bp, Mus musculus
agaagtgccaatccttcttcacaac

SEQ ID NO: 143064 - DNA, 25 bp, Mus musculus
agaagtgccaatgcttcttcacaac

SEQ ID NO: 143065 - DNA, 25 bp, Mus musculus
agaagtgccacaagagccaggcgtg

SEQ ID NO: 143066 - DNA, 25 bp, Mus musculus
agaagtgccacatgagccaggcgtg

SEQ ID NO: 143067 - DNA, 25 bp, Mus musculus
agaagtgccaggatgcgtccctgta

SEQ ID NO: 143068 - DNA, 25 bp, Mus musculus
agaagtgccaggttgcgtccctgta

SEQ ID NO: 143069 - DNA, 25 bp, Mus musculus
agaagtgccatcatggctagaaaac

SEQ ID NO: 143070 - DNA, 25 bp, Mus musculus
agaagtgccatcttggctagaaaac

SEQ ID NO: 143071 - DNA, 25 bp, Mus musculus
agaagtgccatgagcatgatgctga

SEQ ID NO: 143072 - DNA, 25 bp, Mus musculus
agaagtgccatgctcatcggcttcc

SEQ ID NO: 143073 - DNA, 25 bp, Mus musculus
agaagtgccatggtcatcggcttcc

SEQ ID NO: 143074 - DNA, 25 bp, Mus musculus
agaagtgccatgtgcatgatgctga

SEQ ID NO: 143075 - DNA, 25 bp, Mus musculus
agaagtgcccacactcgtgaagagg

SEQ ID NO: 143076 - DNA, 25 bp, Mus musculus
agaagtgcccactctcgtgaagagg

SEQ ID NO: 143077 - DNA, 25 bp, Mus musculus
agaagtgcccagaggctgaccccaa

SEQ ID NO: 143078 - DNA, 25 bp, Mus musculus
agaagtgcccagtggctgaccccaa

SEQ ID NO: 143079 - DNA, 25 bp, Mus musculus
agaagtgccccgagactgctaaatt

SEQ ID NO: 143080 - DNA, 25 bp, Mus musculus
agaagtgccccgtgactgctaaatt

SEQ ID NO: 143081 - DNA, 25 bp, Mus musculus
agaagtgcctctcccgcaaggagga

SEQ ID NO: 143082 - DNA, 25 bp, Mus musculus
agaagtgcctctgccgcaaggagga

SEQ ID NO: 143083 - DNA, 25 bp, Mus musculus
agaagtgccttgctggtttgtccac

SEQ ID NO: 143084 - DNA, 25 bp, Mus musculus
agaagtgccttggtggtttgtccac

SEQ ID NO: 143085 - DNA, 25 bp, Mus musculus
agaagtgcgccccagtggctgttct

SEQ ID NO: 143086 - DNA, 25 bp, Mus musculus
agaagtgcgcccgagtggctgttct

SEQ ID NO: 143087 - DNA, 25 bp, Mus musculus
agaagtgcgctcagagttatagact

SEQ ID NO: 143088 - DNA, 25 bp, Mus musculus
agaagtgcgctctgagttatagact

SEQ ID NO: 143089 - DNA, 25 bp, Mus musculus
agaagtgcgggactatccggatccc

SEQ ID NO: 143090 - DNA, 25 bp, Mus musculus
agaagtgcgggagtatccggatccc

SEQ ID NO: 143091 - DNA, 25 bp, Mus musculus
agaagtgcgtccagttttcgcctta

SEQ ID NO: 143092 - DNA, 25 bp, Mus musculus
agaagtgcgtcctgttttcgcctta

SEQ ID NO: 143093 - DNA, 25 bp, Mus musculus
agaagtgctcttatcacacagacta

SEQ ID NO: 143094 - DNA, 25 bp, Mus musculus
agaagtgctcttttcacacagacta

SEQ ID NO: 143095 - DNA, 25 bp, Mus musculus
agaagtgctgagatccaaggccctt

SEQ ID NO: 143096 - DNA, 25 bp, Mus musculus
agaagtgctgagttccaaggccctt

SEQ ID NO: 143097 - DNA, 25 bp, Mus musculus
agaagtggaccaaactgcgcccagg

SEQ ID NO: 143098 - DNA, 25 bp, Mus musculus
agaagtggaccatactgcgcccagg

SEQ ID NO: 143099 - DNA, 25 bp, Mus musculus
agaagtggagctacgttagccagaa

SEQ ID NO: 143100 - DNA, 25 bp, Mus musculus
agaagtggagcttcgttagccagaa

SEQ ID NO: 143101 - DNA, 25 bp, Mus musculus
agaagtggcaatacatccggctgat

SEQ ID NO: 143102 - DNA, 25 bp, Mus musculus
agaagtggcaatcgccttttgggtt

SEQ ID NO: 143103 - DNA, 25 bp, Mus musculus
agaagtggcaatggccttttgggtt

SEQ ID NO: 143104 - DNA, 25 bp, Mus musculus
agaagtggcaattcatccggctgat

SEQ ID NO: 143105 - DNA, 25 bp, Mus musculus
agaagtggccatatcgcccgtgaaa

SEQ ID NO: 143106 - DNA, 25 bp, Mus musculus
agaagtggccatttcgcccgtgaaa

SEQ ID NO: 143107 - DNA, 25 bp, Mus musculus
agaagtggcccaagagtggccccag

SEQ ID NO: 143108 - DNA, 25 bp, Mus musculus
agaagtggcccatgagtggccccag

SEQ ID NO: 143109 - DNA, 25 bp, Mus musculus
agaagtggcgatcgcatcactcttt

SEQ ID NO: 143110 - DNA, 25 bp, Mus musculus
agaagtggcgatggcatcactcttt

SEQ ID NO: 143111 - DNA, 25 bp, Mus musculus
agaagtgggcacattcttcctgggt

SEQ ID NO: 143112 - DNA, 25 bp, Mus musculus
agaagtgggcactttcttcctgggt

SEQ ID NO: 143113 - DNA, 25 bp, Mus musculus
agaagtgggcccagattcagagcct

SEQ ID NO: 143114 - DNA, 25 bp, Mus musculus
agaagtgggccctgattcagagcct

SEQ ID NO: 143115 - DNA, 25 bp, Mus musculus
agaagtgggctcagcacattgtcgc

SEQ ID NO: 143116 - DNA, 25 bp, Mus musculus
agaagtgggctctgcacattgtcgc

SEQ ID NO: 143117 - DNA, 25 bp, Mus musculus
agaagtggggccatcagtgccaccc

SEQ ID NO: 143118 - DNA, 25 bp, Mus musculus
agaagtggggccttcagtgccaccc

SEQ ID NO: 143119 - DNA, 25 bp, Mus musculus
agaagtgggtatccttgtctttaat

SEQ ID NO: 143120 - DNA, 25 bp, Mus musculus
agaagtgggtatgcttgtctttaat

SEQ ID NO: 143121 - DNA, 25 bp, Mus musculus
agaagtggtcacaccaggctacgga

SEQ ID NO: 143122 - DNA, 25 bp, Mus musculus
agaagtggtcactccaggctacgga

SEQ ID NO: 143123 - DNA, 25 bp, Mus musculus
agaagtggtcagatgctaaggaagt

SEQ ID NO: 143124 - DNA, 25 bp, Mus musculus
agaagtggtcagttgctaaggaagt

SEQ ID NO: 143125 - DNA, 25 bp, Mus musculus
agaagtggtgcactcctttctgatg

SEQ ID NO: 143126 - DNA, 25 bp, Mus musculus
agaagtggtgcagtcctttctgatg

SEQ ID NO: 143127 - DNA, 25 bp, Mus musculus
agaagtggtgcgaccagcctacctc

SEQ ID NO: 143128 - DNA, 25 bp, Mus musculus
agaagtggtgcgtccagcctacctc

SEQ ID NO: 143129 - DNA, 25 bp, Mus musculus
agaagtggtggcacccctataattc

SEQ ID NO: 143130 - DNA, 25 bp, Mus musculus
agaagtggtggctcccctataattc

SEQ ID NO: 143131 - DNA, 25 bp, Mus musculus
agaagtgtaaccctctctgagaaat

SEQ ID NO: 143132 - DNA, 25 bp, Mus musculus
agaagtgtaaccgtctctgagaaat

SEQ ID NO: 143133 - DNA, 25 bp, Mus musculus
agaagtgtaccaactcaccaaggcc

SEQ ID NO: 143134 - DNA, 25 bp, Mus musculus
agaagtgtaccatctcaccaaggcc

SEQ ID NO: 143135 - DNA, 25 bp, Mus musculus
agaagtgtacccaatgtccagatcc

SEQ ID NO: 143136 - DNA, 25 bp, Mus musculus
agaagtgtaccctatgtccagatcc

SEQ ID NO: 143137 - DNA, 25 bp, Mus musculus
agaagtgtacttactgtctctccat

SEQ ID NO: 143138 - DNA, 25 bp, Mus musculus
agaagtgtactttctgtctctccat

SEQ ID NO: 143139 - DNA, 25 bp, Mus musculus
agaagtgtcaccaatgtgttgagac

SEQ ID NO: 143140 - DNA, 25 bp, Mus musculus
agaagtgtcaccagcacagcccaaa

SEQ ID NO: 143141 - DNA, 25 bp, Mus musculus
agaagtgtcacctatgtgttgagac

SEQ ID NO: 143142 - DNA, 25 bp, Mus musculus
agaagtgtcacctgcacagcccaaa

SEQ ID NO: 143143 - DNA, 25 bp, Mus musculus
agaagtgtcactatgcactggcctt

SEQ ID NO: 143144 - DNA, 25 bp, Mus musculus
agaagtgtcactttgcactggcctt

SEQ ID NO: 143145 - DNA, 25 bp, Mus musculus
agaagtgtcattctagaatcctaga

SEQ ID NO: 143146 - DNA, 25 bp, Mus musculus
agaagtgtcattgtagaatcctaga

SEQ ID NO: 143147 - DNA, 25 bp, Mus musculus
agaagtgtcccaactgcgagaaggt

SEQ ID NO: 143148 - DNA, 25 bp, Mus musculus
agaagtgtcccatctgcgagaaggt

SEQ ID NO: 143149 - DNA, 25 bp, Mus musculus
agaagtgtcgcgctctgaagctgca

SEQ ID NO: 143150 - DNA, 25 bp, Mus musculus
agaagtgtcgcggtctgaagctgca

SEQ ID NO: 143151 - DNA, 25 bp, Mus musculus
agaagtgtctgacccctacagtctt

SEQ ID NO: 143152 - DNA, 25 bp, Mus musculus
agaagtgtctgacctgcgccacctc

SEQ ID NO: 143153 - DNA, 25 bp, Mus musculus
agaagtgtctgagccctacagtctt

SEQ ID NO: 143154 - DNA, 25 bp, Mus musculus
agaagtgtctgagctgcgccacctc

SEQ ID NO: 143155 - DNA, 25 bp, Mus musculus
agaagtgtcttcatgcagtagatag

SEQ ID NO: 143156 - DNA, 25 bp, Mus musculus
agaagtgtcttcttgcagtagatag

SEQ ID NO: 143157 - DNA, 25 bp, Mus musculus
agaagtgtctttaccctcagaatgt

SEQ ID NO: 143158 - DNA, 25 bp, Mus musculus
agaagtgtcttttccctcagaatgt

SEQ ID NO: 143159 - DNA, 25 bp, Mus musculus
agaagtgtgactatatctccctcct

SEQ ID NO: 143160 - DNA, 25 bp, Mus musculus
agaagtgtgactttatctccctcct

SEQ ID NO: 143161 - DNA, 25 bp, Mus musculus
agaagtgtgaggaaccggcagctct

SEQ ID NO: 143162 - DNA, 25 bp, Mus musculus
agaagtgtgaggtaccggcagctct

SEQ ID NO: 143163 - DNA, 25 bp, Mus musculus
agaagtgtgcaaaattggcccagat

SEQ ID NO: 143164 - DNA, 25 bp, Mus musculus
agaagtgtgcaatattggcccagat

SEQ ID NO: 143165 - DNA, 25 bp, Mus musculus
agaagtgtgcatctttcaagtgagc

SEQ ID NO: 143166 - DNA, 25 bp, Mus musculus
agaagtgtgcatgtttcaagtgagc

SEQ ID NO: 143167 - DNA, 25 bp, Mus musculus
agaagtgtgcccagtactggccatc

SEQ ID NO: 143168 - DNA, 25 bp, Mus musculus
agaagtgtgccctgtactggccatc

SEQ ID NO: 143169 - DNA, 25 bp, Mus musculus
agaagtgtgctcatgaggcctcaga

SEQ ID NO: 143170 - DNA, 25 bp, Mus musculus
agaagtgtgctcttgaggcctcaga

SEQ ID NO: 143171 - DNA, 25 bp, Mus musculus
agaagtgtggccaatttcagaagac

SEQ ID NO: 143172 - DNA, 25 bp, Mus musculus
agaagtgtggcctatttcagaagac

SEQ ID NO: 143173 - DNA, 25 bp, Mus musculus
agaagtgtggtcatgcagcagctat

SEQ ID NO: 143174 - DNA, 25 bp, Mus musculus
agaagtgtggtcttgcagcagctat

SEQ ID NO: 143175 - DNA, 25 bp, Mus musculus
agaagtgtgtatcatttcatcataa

SEQ ID NO: 143176 - DNA, 25 bp, Mus musculus
agaagtgtgtatgatttcatcataa

SEQ ID NO: 143177 - DNA, 25 bp, Mus musculus
agaagtgtgtccatggcttcctgtt

SEQ ID NO: 143178 - DNA, 25 bp, Mus musculus
agaagtgtgtccttggcttcctgtt

SEQ ID NO: 143179 - DNA, 25 bp, Mus musculus
agaagtgttaaacggtctgtccagg

SEQ ID NO: 143180 - DNA, 25 bp, Mus musculus
agaagtgttaaagggtctgtccagg

SEQ ID NO: 143181 - DNA, 25 bp, Mus musculus
agaagtgttataccccatggctgtt

SEQ ID NO: 143182 - DNA, 25 bp, Mus musculus
agaagtgttatagcccatggctgtt

SEQ ID NO: 143183 - DNA, 25 bp, Mus musculus
agaagtgttcggactcacccataag

SEQ ID NO: 143184 - DNA, 25 bp, Mus musculus
agaagtgttcggtctcacccataag

SEQ ID NO: 143185 - DNA, 25 bp, Mus musculus
agaagtgttctgacgcctgtagtgc

SEQ ID NO: 143186 - DNA, 25 bp, Mus musculus
agaagtgttctgtcgcctgtagtgc

SEQ ID NO: 143187 - DNA, 25 bp, Mus musculus
agaagtgttgagcttgtttccaaga

SEQ ID NO: 143188 - DNA, 25 bp, Mus musculus
agaagtgttgaggttgtttccaaga

SEQ ID NO: 143189 - DNA, 25 bp, Mus musculus
agaagtgttgttactgcatgtgtat

SEQ ID NO: 143190 - DNA, 25 bp, Mus musculus
agaagtgttgtttctgcatgtgtat

SEQ ID NO: 143191 - DNA, 25 bp, Mus musculus
agaagtgtttatctcccttcaggag

SEQ ID NO: 143192 - DNA, 25 bp, Mus musculus
agaagtgtttatgtcccttcaggag

SEQ ID NO: 143193 - DNA, 25 bp, Mus musculus
agaagttaccttatgatgattgatt

SEQ ID NO: 143194 - DNA, 25 bp, Mus musculus
agaagttaccttttgatgattgatt

SEQ ID NO: 143195 - DNA, 25 bp, Mus musculus
agaagttacgcgctcccactttcag

SEQ ID NO: 143196 - DNA, 25 bp, Mus musculus
agaagttacgcggtcccactttcag

SEQ ID NO: 143197 - DNA, 25 bp, Mus musculus
agaagttactagcttgggcatcagt

SEQ ID NO: 143198 - DNA, 25 bp, Mus musculus
agaagttactaggttgggcatcagt

SEQ ID NO: 143199 - DNA, 25 bp, Mus musculus
agaagttactctcttcctgttatga

SEQ ID NO: 143200 - DNA, 25 bp, Mus musculus
agaagttactctgttcctgttatga

SEQ ID NO: 143201 - DNA, 25 bp, Mus musculus
agaagttactgcagagataggacca

SEQ ID NO: 143202 - DNA, 25 bp, Mus musculus
agaagttactgctgagataggacca

SEQ ID NO: 143203 - DNA, 25 bp, Mus musculus
agaagttagttgactctgccagaag

SEQ ID NO: 143204 - DNA, 25 bp, Mus musculus
agaagttagttgtctctgccagaag

SEQ ID NO: 143205 - DNA, 25 bp, Mus musculus
agaagttatattccccatctctgga

SEQ ID NO: 143206 - DNA, 25 bp, Mus musculus
agaagttatattgcccatctctgga

SEQ ID NO: 143207 - DNA, 25 bp, Mus musculus
agaagttatcctctgatatcagata

SEQ ID NO: 143208 - DNA, 25 bp, Mus musculus
agaagttatcctgtgatatcagata

SEQ ID NO: 143209 - DNA, 25 bp, Mus musculus
agaagttatcgtcgcaaggcactgt

SEQ ID NO: 143210 - DNA, 25 bp, Mus musculus
agaagttatcgtggcaaggcactgt

SEQ ID NO: 143211 - DNA, 25 bp, Mus musculus
agaagttatgaacctggtgaaccaa

SEQ ID NO: 143212 - DNA, 25 bp, Mus musculus
agaagttatgaagctggtgaaccaa

SEQ ID NO: 143213 - DNA, 25 bp, Mus musculus
agaagttattatccctgcgcatact

SEQ ID NO: 143214 - DNA, 25 bp, Mus musculus
agaagttattatgcctgcgcatact

SEQ ID NO: 143215 - DNA, 25 bp, Mus musculus
agaagttcaaaacttgacagatagt

SEQ ID NO: 143216 - DNA, 25 bp, Mus musculus
agaagttcaaaagttgacagatagt

SEQ ID NO: 143217 - DNA, 25 bp, Mus musculus
agaagttcaacgctgtctaccagtc

SEQ ID NO: 143218 - DNA, 25 bp, Mus musculus
agaagttcaacggtgtctaccagtc

SEQ ID NO: 143219 - DNA, 25 bp, Mus musculus
agaagttcacaaatccctgtcagaa

SEQ ID NO: 143220 - DNA, 25 bp, Mus musculus
agaagttcacaattccctgtcagaa

SEQ ID NO: 143221 - DNA, 25 bp, Mus musculus
agaagttcaccgagtatccactact

SEQ ID NO: 143222 - DNA, 25 bp, Mus musculus
agaagttcaccgtgtatccactact

SEQ ID NO: 143223 - DNA, 25 bp, Mus musculus
agaagttcactcactcctgtcttgg

SEQ ID NO: 143224 - DNA, 25 bp, Mus musculus
agaagttcactctctcctgtcttgg

SEQ ID NO: 143225 - DNA, 25 bp, Mus musculus
agaagttcactgaggtatacaaacc

SEQ ID NO: 143226 - DNA, 25 bp, Mus musculus
agaagttcactgtggtatacaaacc

SEQ ID NO: 143227 - DNA, 25 bp, Mus musculus
agaagttcagagctgttgggccctc

SEQ ID NO: 143228 - DNA, 25 bp, Mus musculus
agaagttcagaggtgttgggccctc

SEQ ID NO: 143229 - DNA, 25 bp, Mus musculus
agaagttcagtgctctctagatctc

SEQ ID NO: 143230 - DNA, 25 bp, Mus musculus
agaagttcagtggtctctagatctc

SEQ ID NO: 143231 - DNA, 25 bp, Mus musculus
agaagttcatggaccagcacccaga

SEQ ID NO: 143232 - DNA, 25 bp, Mus musculus
agaagttcatggtccagcacccaga

SEQ ID NO: 143233 - DNA, 25 bp, Mus musculus
agaagttcatgtctggcctgagcta

SEQ ID NO: 143234 - DNA, 25 bp, Mus musculus
agaagttcatgtgtggcctgagcta

SEQ ID NO: 143235 - DNA, 25 bp, Mus musculus
agaagttcattgctcatgtgccggt

SEQ ID NO: 143236 - DNA, 25 bp, Mus musculus
agaagttcattggtcatgtgccggt

SEQ ID NO: 143237 - DNA, 25 bp, Mus musculus
agaagttcatttctgtgtctgtgga

SEQ ID NO: 143238 - DNA, 25 bp, Mus musculus
agaagttcatttgtgtgtctgtgga

SEQ ID NO: 143239 - DNA, 25 bp, Mus musculus
agaagttccaacatactgcaacctc

SEQ ID NO: 143240 - DNA, 25 bp, Mus musculus
agaagttccaacttactgcaacctc

SEQ ID NO: 143241 - DNA, 25 bp, Mus musculus
agaagttccacactttcgaccgcta

SEQ ID NO: 143242 - DNA, 25 bp, Mus musculus
agaagttccacagtttcgaccgcta

SEQ ID NO: 143243 - DNA, 25 bp, Mus musculus
agaagttccaggcacgacacgatat

SEQ ID NO: 143244 - DNA, 25 bp, Mus musculus
agaagttccagggacgacacgatat

SEQ ID NO: 143245 - DNA, 25 bp, Mus musculus
agaagttccctcatgagttcttcct

SEQ ID NO: 143246 - DNA, 25 bp, Mus musculus
agaagttccctcttgagttcttcct

SEQ ID NO: 143247 - DNA, 25 bp, Mus musculus
agaagttcctagaagccgggcctgg

SEQ ID NO: 143248 - DNA, 25 bp, Mus musculus
agaagttcctagtagccgggcctgg

SEQ ID NO: 143249 - DNA, 25 bp, Mus musculus
agaagttccttgacctttgctcaaa

SEQ ID NO: 143250 - DNA, 25 bp, Mus musculus
agaagttccttgtcctttgctcaaa

SEQ ID NO: 143251 - DNA, 25 bp, Mus musculus
agaagttcgtttaccagctgtggtc

SEQ ID NO: 143252 - DNA, 25 bp, Mus musculus
agaagttcgttttccagctgtggtc

SEQ ID NO: 143253 - DNA, 25 bp, Mus musculus
agaagttctaagctttccaagtctt

SEQ ID NO: 143254 - DNA, 25 bp, Mus musculus
agaagttctaaggtttccaagtctt

SEQ ID NO: 143255 - DNA, 25 bp, Mus musculus
agaagttctaccagtgacaggccct

SEQ ID NO: 143256 - DNA, 25 bp, Mus musculus
agaagttctacctgtgacaggccct

SEQ ID NO: 143257 - DNA, 25 bp, Mus musculus
agaagttctagtagtgctccgaggc

SEQ ID NO: 143258 - DNA, 25 bp, Mus musculus
agaagttctagttgtgctccgaggc

SEQ ID NO: 143259 - DNA, 25 bp, Mus musculus
agaagttctcaaccctcatcttcac

SEQ ID NO: 143260 - DNA, 25 bp, Mus musculus
agaagttctcaagcctcatcttcac

SEQ ID NO: 143261 - DNA, 25 bp, Mus musculus
agaagttctcacagttaagccacct

SEQ ID NO: 143262 - DNA, 25 bp, Mus musculus
agaagttctcactgttaagccacct

SEQ ID NO: 143263 - DNA, 25 bp, Mus musculus
agaagttctcccacgacattttttg

SEQ ID NO: 143264 - DNA, 25 bp, Mus musculus
agaagttctccctcgacattttttg

SEQ ID NO: 143265 - DNA, 25 bp, Mus musculus
agaagttctccgagcacttcagcat

SEQ ID NO: 143266 - DNA, 25 bp, Mus musculus
agaagttctccgtgcacttcagcat

SEQ ID NO: 143267 - DNA, 25 bp, Mus musculus
agaagttctggacccctactgtcaa

SEQ ID NO: 143268 - DNA, 25 bp, Mus musculus
agaagttctggagccctactgtcaa

SEQ ID NO: 143269 - DNA, 25 bp, Mus musculus
agaagttctggcctctcagctgcta

SEQ ID NO: 143270 - DNA, 25 bp, Mus musculus
agaagttctggcgtctcagctgcta

SEQ ID NO: 143271 - DNA, 25 bp, Mus musculus
agaagttctgtacgtcccagggagc

SEQ ID NO: 143272 - DNA, 25 bp, Mus musculus
agaagttctgtaggtcccagggagc

SEQ ID NO: 143273 - DNA, 25 bp, Mus musculus
agaagttcttgactatccctgtgtg

SEQ ID NO: 143274 - DNA, 25 bp, Mus musculus
agaagttcttgagtatccctgtgtg

SEQ ID NO: 143275 - DNA, 25 bp, Mus musculus
agaagttctttgacacggattagta

SEQ ID NO: 143276 - DNA, 25 bp, Mus musculus
agaagttctttgtcacggattagta

SEQ ID NO: 143277 - DNA, 25 bp, Mus musculus
agaagttgaaatcaccaccgtgcgg

SEQ ID NO: 143278 - DNA, 25 bp, Mus musculus
agaagttgaaatgaccaccgtgcgg

SEQ ID NO: 143279 - DNA, 25 bp, Mus musculus
agaagttgaacaactttgggtttgt

SEQ ID NO: 143280 - DNA, 25 bp, Mus musculus
agaagttgaacatctttgggtttgt

SEQ ID NO: 143281 - DNA, 25 bp, Mus musculus
agaagttgccataactctccaaatc

SEQ ID NO: 143282 - DNA, 25 bp, Mus musculus
agaagttgccatccaggcagctccc

SEQ ID NO: 143283 - DNA, 25 bp, Mus musculus
agaagttgccatgcaggcagctccc

SEQ ID NO: 143284 - DNA, 25 bp, Mus musculus
agaagttgccattactctccaaatc

SEQ ID NO: 143285 - DNA, 25 bp, Mus musculus
agaagttgccctcacaagctattgc

SEQ ID NO: 143286 - DNA, 25 bp, Mus musculus
agaagttgccctgacaagctattgc

SEQ ID NO: 143287 - DNA, 25 bp, Mus musculus
agaagttggcacacttgtccagctt

SEQ ID NO: 143288 - DNA, 25 bp, Mus musculus
agaagttggcactcttgtccagctt

SEQ ID NO: 143289 - DNA, 25 bp, Mus musculus
agaagttggcttcctgctcaagaca

SEQ ID NO: 143290 - DNA, 25 bp, Mus musculus
agaagttggcttgctgctcaagaca

SEQ ID NO: 143291 - DNA, 25 bp, Mus musculus
agaagttggtcaccttgcctatgga

SEQ ID NO: 143292 - DNA, 25 bp, Mus musculus
agaagttggtcagcttgcctatgga

SEQ ID NO: 143293 - DNA, 25 bp, Mus musculus
agaagttggtccagtgggcacttgt

SEQ ID NO: 143294 - DNA, 25 bp, Mus musculus
agaagttggtcctgtgggcacttgt

SEQ ID NO: 143295 - DNA, 25 bp, Mus musculus
agaagttgtagcctggaaccaccca

SEQ ID NO: 143296 - DNA, 25 bp, Mus musculus
agaagttgtagcgtggaaccaccca

SEQ ID NO: 143297 - DNA, 25 bp, Mus musculus
agaagttgtatacttgggtcctgag

SEQ ID NO: 143298 - DNA, 25 bp, Mus musculus
agaagttgtatagttgggtcctgag

SEQ ID NO: 143299 - DNA, 25 bp, Mus musculus
agaagttgtatccactttcctatcc

SEQ ID NO: 143300 - DNA, 25 bp, Mus musculus
agaagttgtatcgactttcctatcc

SEQ ID NO: 143301 - DNA, 25 bp, Mus musculus
agaagttgtcagatctccgtcatgc

SEQ ID NO: 143302 - DNA, 25 bp, Mus musculus
agaagttgtcagttctccgtcatgc

SEQ ID NO: 143303 - DNA, 25 bp, Mus musculus
agaagtttacatcgtgactgttcac

SEQ ID NO: 143304 - DNA, 25 bp, Mus musculus
agaagtttacatggtgactgttcac

SEQ ID NO: 143305 - DNA, 25 bp, Mus musculus
agaagtttaccactcgctacgatga

SEQ ID NO: 143306 - DNA, 25 bp, Mus musculus
agaagtttaccagtcgctacgatga

SEQ ID NO: 143307 - DNA, 25 bp, Mus musculus
agaagtttatcacggcaagtgtagt

SEQ ID NO: 143308 - DNA, 25 bp, Mus musculus
agaagtttatcagggcaagtgtagt

SEQ ID NO: 143309 - DNA, 25 bp, Mus musculus
agaagtttcaccaggactacctagt

SEQ ID NO: 143310 - DNA, 25 bp, Mus musculus
agaagtttcacctggactacctagt

SEQ ID NO: 143311 - DNA, 25 bp, Mus musculus
agaagtttcacgatgtgctctgcag

SEQ ID NO: 143312 - DNA, 25 bp, Mus musculus
agaagtttcacgttgtgctctgcag

SEQ ID NO: 143313 - DNA, 25 bp, Mus musculus
agaagtttcagcaccacctctgctt

SEQ ID NO: 143314 - DNA, 25 bp, Mus musculus
agaagtttcagctccacctctgctt

SEQ ID NO: 143315 - DNA, 25 bp, Mus musculus
agaagtttcagtacttgcccatcag

SEQ ID NO: 143316 - DNA, 25 bp, Mus musculus
agaagtttcagttcttgcccatcag

SEQ ID NO: 143317 - DNA, 25 bp, Mus musculus
agaagtttcattctcctatgcctac

SEQ ID NO: 143318 - DNA, 25 bp, Mus musculus
agaagtttcattgtcctatgcctac

SEQ ID NO: 143319 - DNA, 25 bp, Mus musculus
agaagtttccagcacactgtctaac

SEQ ID NO: 143320 - DNA, 25 bp, Mus musculus
agaagtttccaggacactgtctaac

SEQ ID NO: 143321 - DNA, 25 bp, Mus musculus
agaagtttccggaatgctgccgcca

SEQ ID NO: 143322 - DNA, 25 bp, Mus musculus
agaagtttccggtatgctgccgcca

SEQ ID NO: 143323 - DNA, 25 bp, Mus musculus
agaagtttcctgagcatcgcctgtg

SEQ ID NO: 143324 - DNA, 25 bp, Mus musculus
agaagtttcctgtgcatcgcctgtg

SEQ ID NO: 143325 - DNA, 25 bp, Mus musculus
agaagtttcggtatgctttagtagc

SEQ ID NO: 143326 - DNA, 25 bp, Mus musculus
agaagtttcggtttgctttagtagc

SEQ ID NO: 143327 - DNA, 25 bp, Mus musculus
agaagtttctaacctcatgcccggg

SEQ ID NO: 143328 - DNA, 25 bp, Mus musculus
agaagtttctaagctcatgcccggg

SEQ ID NO: 143329 - DNA, 25 bp, Mus musculus
agaagtttctgcaggtgggtttgcc

SEQ ID NO: 143330 - DNA, 25 bp, Mus musculus
agaagtttctgcctagcctcggcta

SEQ ID NO: 143331 - DNA, 25 bp, Mus musculus
agaagtttctgcgtagcctcggcta

SEQ ID NO: 143332 - DNA, 25 bp, Mus musculus
agaagtttctgctggtgggtttgcc

SEQ ID NO: 143333 - DNA, 25 bp, Mus musculus
agaagtttgaatcacaccgcccggc

SEQ ID NO: 143334 - DNA, 25 bp, Mus musculus
agaagtttgaatgacaccgcccggc

SEQ ID NO: 143335 - DNA, 25 bp, Mus musculus
agaagtttgcggacctctagaagag

SEQ ID NO: 143336 - DNA, 25 bp, Mus musculus
agaagtttgcggtcctctagaagag

SEQ ID NO: 143337 - DNA, 25 bp, Mus musculus
agaagtttgctgatccttggtttac

SEQ ID NO: 143338 - DNA, 25 bp, Mus musculus
agaagtttgctgttccttggtttac

SEQ ID NO: 143339 - DNA, 25 bp, Mus musculus
agaagtttgcttagatgttagtcca

SEQ ID NO: 143340 - DNA, 25 bp, Mus musculus
agaagtttgcttatgacgcttgtaa

SEQ ID NO: 143341 - DNA, 25 bp, Mus musculus
agaagtttgctttgatgttagtcca

SEQ ID NO: 143342 - DNA, 25 bp, Mus musculus
agaagtttgcttttgacgcttgtaa

SEQ ID NO: 143343 - DNA, 25 bp, Mus musculus
agaagtttggcaatagtcagctgct

SEQ ID NO: 143344 - DNA, 25 bp, Mus musculus
agaagtttggcattagtcagctgct

SEQ ID NO: 143345 - DNA, 25 bp, Mus musculus
agaagtttggctctcattgtgatgt

SEQ ID NO: 143346 - DNA, 25 bp, Mus musculus
agaagtttggctgtcattgtgatgt

SEQ ID NO: 143347 - DNA, 25 bp, Mus musculus
agaagtttgtcaccctgacccatca

SEQ ID NO: 143348 - DNA, 25 bp, Mus musculus
agaagtttgtcagcctgacccatca

SEQ ID NO: 143349 - DNA, 25 bp, Mus musculus
agaagtttgtgtagattgcataata

SEQ ID NO: 143350 - DNA, 25 bp, Mus musculus
agaagtttgtgttgattgcataata

SEQ ID NO: 143351 - DNA, 25 bp, Mus musculus
agaagttttcacactacctggcata

SEQ ID NO: 143352 - DNA, 25 bp, Mus musculus
agaagttttcactctacctggcata

SEQ ID NO: 143353 - DNA, 25 bp, Mus musculus
agaagttttctgaccactgataaga

SEQ ID NO: 143354 - DNA, 25 bp, Mus musculus
agaagttttctgtccactgataaga

SEQ ID NO: 143355 - DNA, 25 bp, Mus musculus
agaagttttgagagacaataccatt

SEQ ID NO: 143356 - DNA, 25 bp, Mus musculus
agaagttttgagtgacaataccatt

SEQ ID NO: 143357 - DNA, 25 bp, Mus musculus
agaagtttttgccacctgctctctg

SEQ ID NO: 143358 - DNA, 25 bp, Mus musculus
agaagtttttgccttgccaagtcta

SEQ ID NO: 143359 - DNA, 25 bp, Mus musculus
agaagtttttgcgacctgctctctg

SEQ ID NO: 143360 - DNA, 25 bp, Mus musculus
agaagtttttgcgttgccaagtcta

SEQ ID NO: 143361 - DNA, 25 bp, Mus musculus
agaagttttttcaccatccactctt

SEQ ID NO: 143362 - DNA, 25 bp, Mus musculus
agaagttttttctccatccactctt

SEQ ID NO: 143363 - DNA, 25 bp, Mus musculus
agaataaaccgccagccacgtggtg

SEQ ID NO: 143364 - DNA, 25 bp, Mus musculus
agaataaaccgcgagccacgtggtg

SEQ ID NO: 143365 - DNA, 25 bp, Mus musculus
agaataaactcaatttccctcctct

SEQ ID NO: 143366 - DNA, 25 bp, Mus musculus
agaataaactcattttccctcctct

SEQ ID NO: 143367 - DNA, 25 bp, Mus musculus
agaataaagattctgggccagggtt

SEQ ID NO: 143368 - DNA, 25 bp, Mus musculus
agaataaagattgtgggccagggtt

SEQ ID NO: 143369 - DNA, 25 bp, Mus musculus
agaataaagtctcgagcccttggcc

SEQ ID NO: 143370 - DNA, 25 bp, Mus musculus
agaataaagtctggagcccttggcc

SEQ ID NO: 143371 - DNA, 25 bp, Mus musculus
agaataacactgatagcagaatacc

SEQ ID NO: 143372 - DNA, 25 bp, Mus musculus
agaataacactgttagcagaatacc

SEQ ID NO: 143373 - DNA, 25 bp, Mus musculus
agaataacccacaaactctctactc

SEQ ID NO: 143374 - DNA, 25 bp, Mus musculus
agaataacccactaactctctactc

SEQ ID NO: 143375 - DNA, 25 bp, Mus musculus
agaataaccctcaatcagttaccct

SEQ ID NO: 143376 - DNA, 25 bp, Mus musculus
agaataaccctctatcagttaccct

SEQ ID NO: 143377 - DNA, 25 bp, Mus musculus
agaataactctcagcggtgacgtgc

SEQ ID NO: 143378 - DNA, 25 bp, Mus musculus
agaataactctctgcggtgacgtgc

SEQ ID NO: 143379 - DNA, 25 bp, Mus musculus
agaataagacgcacaaggccagcct

SEQ ID NO: 143380 - DNA, 25 bp, Mus musculus
agaataagacgctcaaggccagcct

SEQ ID NO: 143381 - DNA, 25 bp, Mus musculus
agaataagagccatcacccactggt

SEQ ID NO: 143382 - DNA, 25 bp, Mus musculus
agaataagagccttcacccactggt

SEQ ID NO: 143383 - DNA, 25 bp, Mus musculus
agaataagattgattacccacctca

SEQ ID NO: 143384 - DNA, 25 bp, Mus musculus
agaataagattgtttacccacctca

SEQ ID NO: 143385 - DNA, 25 bp, Mus musculus
agaataagctggacatctctgaggg

SEQ ID NO: 143386 - DNA, 25 bp, Mus musculus
agaataagctggtcatctctgaggg

SEQ ID NO: 143387 - DNA, 25 bp, Mus musculus
agaataaggatcaccactacaagct

SEQ ID NO: 143388 - DNA, 25 bp, Mus musculus
agaataaggatctccactacaagct

SEQ ID NO: 143389 - DNA, 25 bp, Mus musculus
agaataaggttgcttctggtaccaa

SEQ ID NO: 143390 - DNA, 25 bp, Mus musculus
agaataaggttggttctggtaccaa

SEQ ID NO: 143391 - DNA, 25 bp, Mus musculus
agaataagtaggattccaattggct

SEQ ID NO: 143392 - DNA, 25 bp, Mus musculus
agaataagtaggtttccaattggct

SEQ ID NO: 143393 - DNA, 25 bp, Mus musculus
agaataagtcagattatgtgggaaa

SEQ ID NO: 143394 - DNA, 25 bp, Mus musculus
agaataagtcagtttatgtgggaaa

SEQ ID NO: 143395 - DNA, 25 bp, Mus musculus
agaataagtgccaagccccacgcag

SEQ ID NO: 143396 - DNA, 25 bp, Mus musculus
agaataagtgcctagccccacgcag

SEQ ID NO: 143397 - DNA, 25 bp, Mus musculus
agaataagtgtgcagggcctccttt

SEQ ID NO: 143398 - DNA, 25 bp, Mus musculus
agaataagtgtggagggcctccttt

SEQ ID NO: 143399 - DNA, 25 bp, Mus musculus
agaataatagcgacaaggtctcatt

SEQ ID NO: 143400 - DNA, 25 bp, Mus musculus
agaataatagcgtcaaggtctcatt

SEQ ID NO: 143401 - DNA, 25 bp, Mus musculus
agaataatccagatggtcctctcaa

SEQ ID NO: 143402 - DNA, 25 bp, Mus musculus
agaataatccagttggtcctctcaa

SEQ ID NO: 143403 - DNA, 25 bp, Mus musculus
agaataatctccaaagacataaagg

SEQ ID NO: 143404 - DNA, 25 bp, Mus musculus
agaataatctcctaagacataaagg

SEQ ID NO: 143405 - DNA, 25 bp, Mus musculus
agaataatcttgacctttccgtcct

SEQ ID NO: 143406 - DNA, 25 bp, Mus musculus
agaataatcttgtcctttccgtcct

SEQ ID NO: 143407 - DNA, 25 bp, Mus musculus
agaataatgaagcagtgggcactga

SEQ ID NO: 143408 - DNA, 25 bp, Mus musculus
agaataatgaaggagtgggcactga

SEQ ID NO: 143409 - DNA, 25 bp, Mus musculus
agaataatggctcgcgttcctccct

SEQ ID NO: 143410 - DNA, 25 bp, Mus musculus
agaataatggctggcgttcctccct

SEQ ID NO: 143411 - DNA, 25 bp, Mus musculus
agaataatggtacagcttttggcta

SEQ ID NO: 143412 - DNA, 25 bp, Mus musculus
agaataatggtagagcttttggcta

SEQ ID NO: 143413 - DNA, 25 bp, Mus musculus
agaataatgtcacactcagccggcc

SEQ ID NO: 143414 - DNA, 25 bp, Mus musculus
agaataatgtcagactcagccggcc

SEQ ID NO: 143415 - DNA, 25 bp, Mus musculus
agaataattcttaggctgggcggtg

SEQ ID NO: 143416 - DNA, 25 bp, Mus musculus
agaataattctttggctgggcggtg

SEQ ID NO: 143417 - DNA, 25 bp, Mus musculus
agaatacacactaccagagccaact

SEQ ID NO: 143418 - DNA, 25 bp, Mus musculus
agaatacacacttccagagccaact

SEQ ID NO: 143419 - DNA, 25 bp, Mus musculus
agaatacacgcacttcatcactggc

SEQ ID NO: 143420 - DNA, 25 bp, Mus musculus
agaatacacgcagttcatcactggc

SEQ ID NO: 143421 - DNA, 25 bp, Mus musculus
agaatacactgaatccgcagctctg

SEQ ID NO: 143422 - DNA, 25 bp, Mus musculus
agaatacactgattccgcagctctg

SEQ ID NO: 143423 - DNA, 25 bp, Mus musculus
agaatacacttcagataccactcca

SEQ ID NO: 143424 - DNA, 25 bp, Mus musculus
agaatacacttctgataccactcca

SEQ ID NO: 143425 - DNA, 25 bp, Mus musculus
agaatacagcaacctgcacccgtag

SEQ ID NO: 143426 - DNA, 25 bp, Mus musculus
agaatacagcaagctgcacccgtag

SEQ ID NO: 143427 - DNA, 25 bp, Mus musculus
agaatacatccaacccaaggctgga

SEQ ID NO: 143428 - DNA, 25 bp, Mus musculus
agaatacatccatcccaaggctgga

SEQ ID NO: 143429 - DNA, 25 bp, Mus musculus
agaatacatcctcaaactgcagcgc

SEQ ID NO: 143430 - DNA, 25 bp, Mus musculus
agaatacatcctgaaactgcagcgc

SEQ ID NO: 143431 - DNA, 25 bp, Mus musculus
agaataccagagaccttccgtgggt

SEQ ID NO: 143432 - DNA, 25 bp, Mus musculus
agaataccagagtccttccgtgggt

SEQ ID NO: 143433 - DNA, 25 bp, Mus musculus
agaataccagccatgctgcctggaa

SEQ ID NO: 143434 - DNA, 25 bp, Mus musculus
agaataccagccttgctgcctggaa

SEQ ID NO: 143435 - DNA, 25 bp, Mus musculus
agaatacccagtcttaatctctctc

SEQ ID NO: 143436 - DNA, 25 bp, Mus musculus
agaatacccagtgttaatctctctc

SEQ ID NO: 143437 - DNA, 25 bp, Mus musculus
agaataccgtgcctagggactagta

SEQ ID NO: 143438 - DNA, 25 bp, Mus musculus
agaataccgtgcgtagggactagta

SEQ ID NO: 143439 - DNA, 25 bp, Mus musculus
agaatacgctaaacttttggccaag

SEQ ID NO: 143440 - DNA, 25 bp, Mus musculus
agaatacgctaatcttttggccaag

SEQ ID NO: 143441 - DNA, 25 bp, Mus musculus
agaatactacgccactccggagagc

SEQ ID NO: 143442 - DNA, 25 bp, Mus musculus
agaatactacgcgactccggagagc

SEQ ID NO: 143443 - DNA, 25 bp, Mus musculus
agaatactagcacctgccatctcct

SEQ ID NO: 143444 - DNA, 25 bp, Mus musculus
agaatactagcagctgccatctcct

SEQ ID NO: 143445 - DNA, 25 bp, Mus musculus
agaatactccagagagtcctctcat

SEQ ID NO: 143446 - DNA, 25 bp, Mus musculus
agaatactccagtgagtcctctcat

SEQ ID NO: 143447 - DNA, 25 bp, Mus musculus
agaatactcgctacataatctccgc

SEQ ID NO: 143448 - DNA, 25 bp, Mus musculus
agaatactcgcttcataatctccgc

SEQ ID NO: 143449 - DNA, 25 bp, Mus musculus
agaatactgagtcggctaccaggaa

SEQ ID NO: 143450 - DNA, 25 bp, Mus musculus
agaatactgagtgggctaccaggaa

SEQ ID NO: 143451 - DNA, 25 bp, Mus musculus
agaatactgcccatcccacaacttt

SEQ ID NO: 143452 - DNA, 25 bp, Mus musculus
agaatactgcccttcccacaacttt

SEQ ID NO: 143453 - DNA, 25 bp, Mus musculus
agaatactgcctccctaaggcttgt

SEQ ID NO: 143454 - DNA, 25 bp, Mus musculus
agaatactgcctgcctaaggcttgt

SEQ ID NO: 143455 - DNA, 25 bp, Mus musculus
agaatactgtgtaggtgagcccctc

SEQ ID NO: 143456 - DNA, 25 bp, Mus musculus
agaatactgtgttggtgagcccctc

SEQ ID NO: 143457 - DNA, 25 bp, Mus musculus
agaatactgtttctggtgaccacat

SEQ ID NO: 143458 - DNA, 25 bp, Mus musculus
agaatactgtttgtggtgaccacat

SEQ ID NO: 143459 - DNA, 25 bp, Mus musculus
agaatacttcctaccttggcctcat

SEQ ID NO: 143460 - DNA, 25 bp, Mus musculus
agaatacttccttccttggcctcat

SEQ ID NO: 143461 - DNA, 25 bp, Mus musculus
agaatacttgtcacactttataata

SEQ ID NO: 143462 - DNA, 25 bp, Mus musculus
agaatacttgtctcactttataata

SEQ ID NO: 143463 - DNA, 25 bp, Mus musculus
agaatactttctctgagcactgaaa

SEQ ID NO: 143464 - DNA, 25 bp, Mus musculus
agaatactttctgtgagcactgaaa

SEQ ID NO: 143465 - DNA, 25 bp, Mus musculus
agaatactttttaatacctcactat

SEQ ID NO: 143466 - DNA, 25 bp, Mus musculus
agaatacttttttatacctcactat

SEQ ID NO: 143467 - DNA, 25 bp, Mus musculus
agaatagaaccaactcaccatttta

SEQ ID NO: 143468 - DNA, 25 bp, Mus musculus
agaatagaaccatctcaccatttta

SEQ ID NO: 143469 - DNA, 25 bp, Mus musculus
agaatagaaggcactcctccagcct

SEQ ID NO: 143470 - DNA, 25 bp, Mus musculus
agaatagaaggctctcctccagcct

SEQ ID NO: 143471 - DNA, 25 bp, Mus musculus
agaatagaatccagggcctcacact

SEQ ID NO: 143472 - DNA, 25 bp, Mus musculus
agaatagaatcctgggcctcacact

SEQ ID NO: 143473 - DNA, 25 bp, Mus musculus
agaatagacagccttgctgtgcctc

SEQ ID NO: 143474 - DNA, 25 bp, Mus musculus
agaatagacagcgttgctgtgcctc

SEQ ID NO: 143475 - DNA, 25 bp, Mus musculus
agaatagaccttattcctaacacat

SEQ ID NO: 143476 - DNA, 25 bp, Mus musculus
agaatagacctttttcctaacacat

SEQ ID NO: 143477 - DNA, 25 bp, Mus musculus
agaatagagacaacacagtgatact

SEQ ID NO: 143478 - DNA, 25 bp, Mus musculus
agaatagagacatcacagtgatact

SEQ ID NO: 143479 - DNA, 25 bp, Mus musculus
agaatagcactgatgtagagcactt

SEQ ID NO: 143480 - DNA, 25 bp, Mus musculus
agaatagcactgttgtagagcactt

SEQ ID NO: 143481 - DNA, 25 bp, Mus musculus
agaatagccagaattgaatctcaat

SEQ ID NO: 143482 - DNA, 25 bp, Mus musculus
agaatagccagatttgaatctcaat

SEQ ID NO: 143483 - DNA, 25 bp, Mus musculus
agaatagcgggtacacgagtcctcc

SEQ ID NO: 143484 - DNA, 25 bp, Mus musculus
agaatagcgggttcacgagtcctcc

SEQ ID NO: 143485 - DNA, 25 bp, Mus musculus
agaatagctcagcagcctcccagca

SEQ ID NO: 143486 - DNA, 25 bp, Mus musculus
agaatagctcaggagcctcccagca

SEQ ID NO: 143487 - DNA, 25 bp, Mus musculus
agaatagctcggaagccgtctgtct

SEQ ID NO: 143488 - DNA, 25 bp, Mus musculus
agaatagctcggtagccgtctgtct

SEQ ID NO: 143489 - DNA, 25 bp, Mus musculus
agaatagctgcaaggcgctgaccct

SEQ ID NO: 143490 - DNA, 25 bp, Mus musculus
agaatagctgcatggcgctgaccct

SEQ ID NO: 143491 - DNA, 25 bp, Mus musculus
agaatagcttagagctcttacagct

SEQ ID NO: 143492 - DNA, 25 bp, Mus musculus
agaatagcttagtgctcttacagct

SEQ ID NO: 143493 - DNA, 25 bp, Mus musculus
agaataggagtcctttctccgacct

SEQ ID NO: 143494 - DNA, 25 bp, Mus musculus
agaataggagtcgtttctccgacct

SEQ ID NO: 143495 - DNA, 25 bp, Mus musculus
agaataggctgtacaggcctccagg

SEQ ID NO: 143496 - DNA, 25 bp, Mus musculus
agaataggctgttcaggcctccagg

SEQ ID NO: 143497 - DNA, 25 bp, Mus musculus
agaataggtccaattcatccagttg

SEQ ID NO: 143498 - DNA, 25 bp, Mus musculus
agaataggtccatttcatccagttg

SEQ ID NO: 143499 - DNA, 25 bp, Mus musculus
agaatagtagttctgtcctgcccag

SEQ ID NO: 143500 - DNA, 25 bp, Mus musculus
agaatagtagttgtgtcctgcccag

SEQ ID NO: 143501 - DNA, 25 bp, Mus musculus
agaatagtatagagtaagccgggca

SEQ ID NO: 143502 - DNA, 25 bp, Mus musculus
agaatagtatagtgtaagccgggca

SEQ ID NO: 143503 - DNA, 25 bp, Mus musculus
agaatagtctttatctcctactcct

SEQ ID NO: 143504 - DNA, 25 bp, Mus musculus
agaatagtctttttctcctactcct

SEQ ID NO: 143505 - DNA, 25 bp, Mus musculus
agaatagtgagcacttagtacctgc

SEQ ID NO: 143506 - DNA, 25 bp, Mus musculus
agaatagtgagctcttagtacctgc

SEQ ID NO: 143507 - DNA, 25 bp, Mus musculus
agaatagtggcgcacttctacttcc

SEQ ID NO: 143508 - DNA, 25 bp, Mus musculus
agaatagtggcggacttctacttcc

SEQ ID NO: 143509 - DNA, 25 bp, Mus musculus
agaatagttaccatcacacacactc

SEQ ID NO: 143510 - DNA, 25 bp, Mus musculus
agaatagttaccttcacacacactc

SEQ ID NO: 143511 - DNA, 25 bp, Mus musculus
agaatagttcagctttatcatcttg

SEQ ID NO: 143512 - DNA, 25 bp, Mus musculus
agaatagttcaggtttatcatcttg

SEQ ID NO: 143513 - DNA, 25 bp, Mus musculus
agaatatactcactgtctgtctcca

SEQ ID NO: 143514 - DNA, 25 bp, Mus musculus
agaatatactcagtgtctgtctcca

SEQ ID NO: 143515 - DNA, 25 bp, Mus musculus
agaatatagcaacgcctttacccgt

SEQ ID NO: 143516 - DNA, 25 bp, Mus musculus
agaatatagcaaggcctttacccgt

SEQ ID NO: 143517 - DNA, 25 bp, Mus musculus
agaatataggataagggctgggccc

SEQ ID NO: 143518 - DNA, 25 bp, Mus musculus
agaatataggattagggctgggccc

SEQ ID NO: 143519 - DNA, 25 bp, Mus musculus
agaatatatatcaccccttctcctc

SEQ ID NO: 143520 - DNA, 25 bp, Mus musculus
agaatatatatctccccttctcctc

SEQ ID NO: 143521 - DNA, 25 bp, Mus musculus
agaatatatcggatcccatcggctg

SEQ ID NO: 143522 - DNA, 25 bp, Mus musculus
agaatatatcggttcccatcggctg

SEQ ID NO: 143523 - DNA, 25 bp, Mus musculus
agaatatatgacagcccaagtgtga

SEQ ID NO: 143524 - DNA, 25 bp, Mus musculus
agaatatatgactgcccaagtgtga

SEQ ID NO: 143525 - DNA, 25 bp, Mus musculus
agaatatcagccattcatagcccag

SEQ ID NO: 143526 - DNA, 25 bp, Mus musculus
agaatatcagcctttcatagcccag

SEQ ID NO: 143527 - DNA, 25 bp, Mus musculus
agaatatcagtaccgaacggaccct

SEQ ID NO: 143528 - DNA, 25 bp, Mus musculus
agaatatcagtagcgaacggaccct

SEQ ID NO: 143529 - DNA, 25 bp, Mus musculus
agaatatcattaccgagttgcctgt

SEQ ID NO: 143530 - DNA, 25 bp, Mus musculus
agaatatcattagcgagttgcctgt

SEQ ID NO: 143531 - DNA, 25 bp, Mus musculus
agaatatcccagattccgtccatag

SEQ ID NO: 143532 - DNA, 25 bp, Mus musculus
agaatatcccagtttccgtccatag

SEQ ID NO: 143533 - DNA, 25 bp, Mus musculus
agaatatcctggattccctgggtgc

SEQ ID NO: 143534 - DNA, 25 bp, Mus musculus
agaatatcctggtttccctgggtgc

SEQ ID NO: 143535 - DNA, 25 bp, Mus musculus
agaatatccttccaacactgagcca

SEQ ID NO: 143536 - DNA, 25 bp, Mus musculus
agaatatccttcgaacactgagcca

SEQ ID NO: 143537 - DNA, 25 bp, Mus musculus
agaatatgactgatcccagctccaa

SEQ ID NO: 143538 - DNA, 25 bp, Mus musculus
agaatatgactgattttcactctga

SEQ ID NO: 143539 - DNA, 25 bp, Mus musculus
agaatatgactgttcccagctccaa

SEQ ID NO: 143540 - DNA, 25 bp, Mus musculus
agaatatgactgtttttcactctga

SEQ ID NO: 143541 - DNA, 25 bp, Mus musculus
agaatatgagacactccctaaccca

SEQ ID NO: 143542 - DNA, 25 bp, Mus musculus
agaatatgagactctccctaaccca

SEQ ID NO: 143543 - DNA, 25 bp, Mus musculus
agaatatgctcaaccactccttcat

SEQ ID NO: 143544 - DNA, 25 bp, Mus musculus
agaatatgctcatccactccttcat

SEQ ID NO: 143545 - DNA, 25 bp, Mus musculus
agaatatggattagctcaccacccc

SEQ ID NO: 143546 - DNA, 25 bp, Mus musculus
agaatatggatttgctcaccacccc

SEQ ID NO: 143547 - DNA, 25 bp, Mus musculus
agaatatgtactcgctcatagtagg

SEQ ID NO: 143548 - DNA, 25 bp, Mus musculus
agaatatgtactggctcatagtagg

SEQ ID NO: 143549 - DNA, 25 bp, Mus musculus
agaatatgtagcagacaaactgact

SEQ ID NO: 143550 - DNA, 25 bp, Mus musculus
agaatatgtagctgacaaactgact

SEQ ID NO: 143551 - DNA, 25 bp, Mus musculus
agaatatgtccacccacatctatgt

SEQ ID NO: 143552 - DNA, 25 bp, Mus musculus
agaatatgtccagccacatctatgt

SEQ ID NO: 143553 - DNA, 25 bp, Mus musculus
agaatattaatccacccgcagaagc

SEQ ID NO: 143554 - DNA, 25 bp, Mus musculus
agaatattaatcgacccgcagaagc

SEQ ID NO: 143555 - DNA, 25 bp, Mus musculus
agaatattcattaggctgccccaca

SEQ ID NO: 143556 - DNA, 25 bp, Mus musculus
agaatattcatttggctgccccaca

SEQ ID NO: 143557 - DNA, 25 bp, Mus musculus
agaatattcctgcacttcacagaga

SEQ ID NO: 143558 - DNA, 25 bp, Mus musculus
agaatattcctggacttcacagaga

SEQ ID NO: 143559 - DNA, 25 bp, Mus musculus
agaatattctctagagggctggcga

SEQ ID NO: 143560 - DNA, 25 bp, Mus musculus
agaatattctcttgagggctggcga

SEQ ID NO: 143561 - DNA, 25 bp, Mus musculus
agaatattcttaactgtcgccttcc

SEQ ID NO: 143562 - DNA, 25 bp, Mus musculus
agaatattcttatctgtcgccttcc

SEQ ID NO: 143563 - DNA, 25 bp, Mus musculus
agaatattgggcacttacatcccca

SEQ ID NO: 143564 - DNA, 25 bp, Mus musculus
agaatattgggctcttacatcccca

SEQ ID NO: 143565 - DNA, 25 bp, Mus musculus
agaatatttagcctgcctcccacag

SEQ ID NO: 143566 - DNA, 25 bp, Mus musculus
agaatatttagcgtgcctcccacag

SEQ ID NO: 143567 - DNA, 25 bp, Mus musculus
agaatatttattatcgccgggcgtg

SEQ ID NO: 143568 - DNA, 25 bp, Mus musculus
agaatatttattttcgccgggcgtg

SEQ ID NO: 143569 - DNA, 25 bp, Mus musculus
agaatatttcgaatgggactctgtt

SEQ ID NO: 143570 - DNA, 25 bp, Mus musculus
agaatatttcgattgggactctgtt

SEQ ID NO: 143571 - DNA, 25 bp, Mus musculus
agaatatttgagcaggagcccctcc

SEQ ID NO: 143572 - DNA, 25 bp, Mus musculus
agaatatttgaggaggagcccctcc

SEQ ID NO: 143573 - DNA, 25 bp, Mus musculus
agaatattttttccctgcaagccct

SEQ ID NO: 143574 - DNA, 25 bp, Mus musculus
agaatattttttgcctgcaagccct

SEQ ID NO: 143575 - DNA, 25 bp, Mus musculus
agaatcaaaagcagccctgtcttcc

SEQ ID NO: 143576 - DNA, 25 bp, Mus musculus
agaatcaaaagctgccctgtcttcc

SEQ ID NO: 143577 - DNA, 25 bp, Mus musculus
agaatcaaacgaccagcactggcaa

SEQ ID NO: 143578 - DNA, 25 bp, Mus musculus
agaatcaaacgagcagcactggcaa

SEQ ID NO: 143579 - DNA, 25 bp, Mus musculus
agaatcaaactcaggtctcactgcc

SEQ ID NO: 143580 - DNA, 25 bp, Mus musculus
agaatcaaactctggtctcactgcc

SEQ ID NO: 143581 - DNA, 25 bp, Mus musculus
agaatcaaaggtaccaccttccttg

SEQ ID NO: 143582 - DNA, 25 bp, Mus musculus
agaatcaaaggttccaccttccttg

SEQ ID NO: 143583 - DNA, 25 bp, Mus musculus
agaatcaaattgactcacctcctcg

SEQ ID NO: 143584 - DNA, 25 bp, Mus musculus
agaatcaaattgtctcacctcctcg

SEQ ID NO: 143585 - DNA, 25 bp, Mus musculus
agaatcaacctcactgggctcatag

SEQ ID NO: 143586 - DNA, 25 bp, Mus musculus
agaatcaacctctctgggctcatag

SEQ ID NO: 143587 - DNA, 25 bp, Mus musculus
agaatcaactaacctgggccagtgg

SEQ ID NO: 143588 - DNA, 25 bp, Mus musculus
agaatcaactaagctgggccagtgg

SEQ ID NO: 143589 - DNA, 25 bp, Mus musculus
agaatcaactgtcaccaaggtggct

SEQ ID NO: 143590 - DNA, 25 bp, Mus musculus
agaatcaactgtgaccaaggtggct

SEQ ID NO: 143591 - DNA, 25 bp, Mus musculus
agaatcaatccacagctttctccct

SEQ ID NO: 143592 - DNA, 25 bp, Mus musculus
agaatcaatccagagctttctccct

SEQ ID NO: 143593 - DNA, 25 bp, Mus musculus
agaatcaatgctagcttggactcac

SEQ ID NO: 143594 - DNA, 25 bp, Mus musculus
agaatcaatgcttgcttggactcac

SEQ ID NO: 143595 - DNA, 25 bp, Mus musculus
agaatcaattcgcacattccgcagc

SEQ ID NO: 143596 - DNA, 25 bp, Mus musculus
agaatcaattcggacattccgcagc

SEQ ID NO: 143597 - DNA, 25 bp, Mus musculus
agaatcacaactaggcatccattcc

SEQ ID NO: 143598 - DNA, 25 bp, Mus musculus
agaatcacaacttggcatccattcc

SEQ ID NO: 143599 - DNA, 25 bp, Mus musculus
agaatcacaggtaccagtctcaatt

SEQ ID NO: 143600 - DNA, 25 bp, Mus musculus
agaatcacaggttccagtctcaatt

SEQ ID NO: 143601 - DNA, 25 bp, Mus musculus
agaatcaccaacatgagggcacagc

SEQ ID NO: 143602 - DNA, 25 bp, Mus musculus
agaatcaccaacttgagggcacagc

SEQ ID NO: 143603 - DNA, 25 bp, Mus musculus
agaatcacctccatgagatgctacc

SEQ ID NO: 143604 - DNA, 25 bp, Mus musculus
agaatcacctccttgagatgctacc

SEQ ID NO: 143605 - DNA, 25 bp, Mus musculus
agaatcacctcgaagatacctctgg

SEQ ID NO: 143606 - DNA, 25 bp, Mus musculus
agaatcacctcgtagatacctctgg

SEQ ID NO: 143607 - DNA, 25 bp, Mus musculus
agaatcacctgtagtactcatctcc

SEQ ID NO: 143608 - DNA, 25 bp, Mus musculus
agaatcacctgttgtactcatctcc

SEQ ID NO: 143609 - DNA, 25 bp, Mus musculus
agaatcacgactaatctcattccct

SEQ ID NO: 143610 - DNA, 25 bp, Mus musculus
agaatcacgacttatctcattccct

SEQ ID NO: 143611 - DNA, 25 bp, Mus musculus
agaatcactcagagcaactcaaccc

SEQ ID NO: 143612 - DNA, 25 bp, Mus musculus
agaatcactcagtgcaactcaaccc

SEQ ID NO: 143613 - DNA, 25 bp, Mus musculus
agaatcactcccagagcctgaagaa

SEQ ID NO: 143614 - DNA, 25 bp, Mus musculus
agaatcactccctgagcctgaagaa

SEQ ID NO: 143615 - DNA, 25 bp, Mus musculus
agaatcacttttcctctcttaccag

SEQ ID NO: 143616 - DNA, 25 bp, Mus musculus
agaatcacttttgctctcttaccag

SEQ ID NO: 143617 - DNA, 25 bp, Mus musculus
agaatcagatcacagagtccattag

SEQ ID NO: 143618 - DNA, 25 bp, Mus musculus
agaatcagatcagagagtccattag

SEQ ID NO: 143619 - DNA, 25 bp, Mus musculus
agaatcagatctctcgctttcctgt

SEQ ID NO: 143620 - DNA, 25 bp, Mus musculus
agaatcagatctgtcgctttcctgt

SEQ ID NO: 143621 - DNA, 25 bp, Mus musculus
agaatcagatgtcaatgccctctcc

SEQ ID NO: 143622 - DNA, 25 bp, Mus musculus
agaatcagatgtgaatgccctctcc

SEQ ID NO: 143623 - DNA, 25 bp, Mus musculus
agaatcagattcagggccttgtgca

SEQ ID NO: 143624 - DNA, 25 bp, Mus musculus
agaatcagattctgggccttgtgca

SEQ ID NO: 143625 - DNA, 25 bp, Mus musculus
agaatcagcatcctcagccgtatat

SEQ ID NO: 143626 - DNA, 25 bp, Mus musculus
agaatcagcatcgtcagccgtatat

SEQ ID NO: 143627 - DNA, 25 bp, Mus musculus
agaatcagccgcattcttcatcttt

SEQ ID NO: 143628 - DNA, 25 bp, Mus musculus
agaatcagccgctttcttcatcttt

SEQ ID NO: 143629 - DNA, 25 bp, Mus musculus
agaatcagccttattcttcgagtag

SEQ ID NO: 143630 - DNA, 25 bp, Mus musculus
agaatcagcctttttcttcgagtag

SEQ ID NO: 143631 - DNA, 25 bp, Mus musculus
agaatcagcgctcgattgcagcttt

SEQ ID NO: 143632 - DNA, 25 bp, Mus musculus
agaatcagcgctggattgcagcttt

SEQ ID NO: 143633 - DNA, 25 bp, Mus musculus
agaatcagcttcacctggagcgaca

SEQ ID NO: 143634 - DNA, 25 bp, Mus musculus
agaatcagcttctcctggagcgaca

SEQ ID NO: 143635 - DNA, 25 bp, Mus musculus
agaatcaggctcctcagactgcaga

SEQ ID NO: 143636 - DNA, 25 bp, Mus musculus
agaatcaggctcgtcagactgcaga

SEQ ID NO: 143637 - DNA, 25 bp, Mus musculus
agaatcagggagcaacgtgttacat

SEQ ID NO: 143638 - DNA, 25 bp, Mus musculus
agaatcagggaggaacgtgttacat

SEQ ID NO: 143639 - DNA, 25 bp, Mus musculus
agaatcagtattcggagtcctgtgc

SEQ ID NO: 143640 - DNA, 25 bp, Mus musculus
agaatcagtattgggagtcctgtgc

SEQ ID NO: 143641 - DNA, 25 bp, Mus musculus
agaatcagtcaaagaatcttcacaa

SEQ ID NO: 143642 - DNA, 25 bp, Mus musculus
agaatcagtcaatgaatcttcacaa

SEQ ID NO: 143643 - DNA, 25 bp, Mus musculus
agaatcagtgagctcacagcctcaa

SEQ ID NO: 143644 - DNA, 25 bp, Mus musculus
agaatcagtgagctcttcggccctg

SEQ ID NO: 143645 - DNA, 25 bp, Mus musculus
agaatcagtgaggtcacagcctcaa

SEQ ID NO: 143646 - DNA, 25 bp, Mus musculus
agaatcagtgaggtcttcggccctg

SEQ ID NO: 143647 - DNA, 25 bp, Mus musculus
agaatcagttgcctttcaggtaact

SEQ ID NO: 143648 - DNA, 25 bp, Mus musculus
agaatcagttgcgtttcaggtaact

SEQ ID NO: 143649 - DNA, 25 bp, Mus musculus
agaatcataccaactcggttgccat

SEQ ID NO: 143650 - DNA, 25 bp, Mus musculus
agaatcataccatctcggttgccat

SEQ ID NO: 143651 - DNA, 25 bp, Mus musculus
agaatcatcggtagactgtcacaag

SEQ ID NO: 143652 - DNA, 25 bp, Mus musculus
agaatcatcggttgactgtcacaag

SEQ ID NO: 143653 - DNA, 25 bp, Mus musculus
agaatcatctatacctgtggagtat

SEQ ID NO: 143654 - DNA, 25 bp, Mus musculus
agaatcatctattcctgtggagtat

SEQ ID NO: 143655 - DNA, 25 bp, Mus musculus
agaatcatcttgcaggatgggtcca

SEQ ID NO: 143656 - DNA, 25 bp, Mus musculus
agaatcatcttggaggatgggtcca

SEQ ID NO: 143657 - DNA, 25 bp, Mus musculus
agaatcatggacatctaccccattg

SEQ ID NO: 143658 - DNA, 25 bp, Mus musculus
agaatcatggacttctaccccattg

SEQ ID NO: 143659 - DNA, 25 bp, Mus musculus
agaatcatggtcactcgcagtgaag

SEQ ID NO: 143660 - DNA, 25 bp, Mus musculus
agaatcatggtctctcgcagtgaag

SEQ ID NO: 143661 - DNA, 25 bp, Mus musculus
agaatcatgtgacacctcctgtggc

SEQ ID NO: 143662 - DNA, 25 bp, Mus musculus
agaatcatgtgagacctcctgtggc

SEQ ID NO: 143663 - DNA, 25 bp, Mus musculus
agaatcattcctagtgctcacaccg

SEQ ID NO: 143664 - DNA, 25 bp, Mus musculus
agaatcattccttgtgctcacaccg

SEQ ID NO: 143665 - DNA, 25 bp, Mus musculus
agaatcattggtaatgagcgccgga

SEQ ID NO: 143666 - DNA, 25 bp, Mus musculus
agaatcattggttatgagcgccgga

SEQ ID NO: 143667 - DNA, 25 bp, Mus musculus
agaatcatttgacggctctgttcgt

SEQ ID NO: 143668 - DNA, 25 bp, Mus musculus
agaatcatttgagggctctgttcgt

SEQ ID NO: 143669 - DNA, 25 bp, Mus musculus
agaatcattttgcatgtcttcccca

SEQ ID NO: 143670 - DNA, 25 bp, Mus musculus
agaatcattttggatgtcttcccca

SEQ ID NO: 143671 - DNA, 25 bp, Mus musculus
agaatccaaatcaaggtgcccatcc

SEQ ID NO: 143672 - DNA, 25 bp, Mus musculus
agaatccaaatctaggtgcccatcc

SEQ ID NO: 143673 - DNA, 25 bp, Mus musculus
agaatccaactgaataagccactgt

SEQ ID NO: 143674 - DNA, 25 bp, Mus musculus
agaatccaactgtataagccactgt

SEQ ID NO: 143675 - DNA, 25 bp, Mus musculus
agaatccaaggacaccatcaggttt

SEQ ID NO: 143676 - DNA, 25 bp, Mus musculus
agaatccaaggagaccatcaggttt

SEQ ID NO: 143677 - DNA, 25 bp, Mus musculus
agaatccacaggagcttccacaaaa

SEQ ID NO: 143678 - DNA, 25 bp, Mus musculus
agaatccacaggtgcttccacaaaa

SEQ ID NO: 143679 - DNA, 25 bp, Mus musculus
agaatccacctaagctttcagtcag

SEQ ID NO: 143680 - DNA, 25 bp, Mus musculus
agaatccacctatgctttcagtcag

SEQ ID NO: 143681 - DNA, 25 bp, Mus musculus
agaatccacttcacaatcacctttt

SEQ ID NO: 143682 - DNA, 25 bp, Mus musculus
agaatccacttctcaatcacctttt

SEQ ID NO: 143683 - DNA, 25 bp, Mus musculus
agaatccagaggacccagagggact

SEQ ID NO: 143684 - DNA, 25 bp, Mus musculus
agaatccagaggtcccagagggact

SEQ ID NO: 143685 - DNA, 25 bp, Mus musculus
agaatccagattatcttgggctatc

SEQ ID NO: 143686 - DNA, 25 bp, Mus musculus
agaatccagattccctgagtgtgag

SEQ ID NO: 143687 - DNA, 25 bp, Mus musculus
agaatccagattgcctgagtgtgag

SEQ ID NO: 143688 - DNA, 25 bp, Mus musculus
agaatccagattttcttgggctatc

SEQ ID NO: 143689 - DNA, 25 bp, Mus musculus
agaatccagcacctccaacacttgg

SEQ ID NO: 143690 - DNA, 25 bp, Mus musculus
agaatccagcacgtccaacacttgg

SEQ ID NO: 143691 - DNA, 25 bp, Mus musculus
agaatccagcatctattttcccaga

SEQ ID NO: 143692 - DNA, 25 bp, Mus musculus
agaatccagcatgtattttcccaga

SEQ ID NO: 143693 - DNA, 25 bp, Mus musculus
agaatccagctgaggtagcatgtgc

SEQ ID NO: 143694 - DNA, 25 bp, Mus musculus
agaatccagctgtggtagcatgtgc

SEQ ID NO: 143695 - DNA, 25 bp, Mus musculus
agaatccaggatacaaaccattagt

SEQ ID NO: 143696 - DNA, 25 bp, Mus musculus
agaatccaggattcaaaccattagt

SEQ ID NO: 143697 - DNA, 25 bp, Mus musculus
agaatccaggcaacagggcagtcct

SEQ ID NO: 143698 - DNA, 25 bp, Mus musculus
agaatccaggcatcagggcagtcct

SEQ ID NO: 143699 - DNA, 25 bp, Mus musculus
agaatccaggtgagtctgcaagccc

SEQ ID NO: 143700 - DNA, 25 bp, Mus musculus
agaatccaggtgtgtctgcaagccc

SEQ ID NO: 143701 - DNA, 25 bp, Mus musculus
agaatccagtctacagggttctgcc

SEQ ID NO: 143702 - DNA, 25 bp, Mus musculus
agaatccagtcttcagggttctgcc

SEQ ID NO: 143703 - DNA, 25 bp, Mus musculus
agaatccagtgaatttcccttgccc

SEQ ID NO: 143704 - DNA, 25 bp, Mus musculus
agaatccagtgacctggcctgtgtg

SEQ ID NO: 143705 - DNA, 25 bp, Mus musculus
agaatccagtgagctggcctgtgtg

SEQ ID NO: 143706 - DNA, 25 bp, Mus musculus
agaatccagtgattttcccttgccc

SEQ ID NO: 143707 - DNA, 25 bp, Mus musculus
agaatccagtggactttcccttttg

SEQ ID NO: 143708 - DNA, 25 bp, Mus musculus
agaatccagtggtctttcccttttg

SEQ ID NO: 143709 - DNA, 25 bp, Mus musculus
agaatccagtttaccctgtgctgtc

SEQ ID NO: 143710 - DNA, 25 bp, Mus musculus
agaatccagttttccctgtgctgtc

SEQ ID NO: 143711 - DNA, 25 bp, Mus musculus
agaatccatcaaccaataactcggg

SEQ ID NO: 143712 - DNA, 25 bp, Mus musculus
agaatccatcaagcaataactcggg

SEQ ID NO: 143713 - DNA, 25 bp, Mus musculus
agaatccatcctccatgatgtatag

SEQ ID NO: 143714 - DNA, 25 bp, Mus musculus
agaatccatcctgcatgatgtatag

SEQ ID NO: 143715 - DNA, 25 bp, Mus musculus
agaatccatgccaaagagctccttt

SEQ ID NO: 143716 - DNA, 25 bp, Mus musculus
agaatccatgcctaagagctccttt

SEQ ID NO: 143717 - DNA, 25 bp, Mus musculus
agaatccattctcgcctacagggtg

SEQ ID NO: 143718 - DNA, 25 bp, Mus musculus
agaatccattctggcctacagggtg

SEQ ID NO: 143719 - DNA, 25 bp, Mus musculus
agaatcccacatccgcatgattaag

SEQ ID NO: 143720 - DNA, 25 bp, Mus musculus
agaatcccacatgcgcatgattaag

SEQ ID NO: 143721 - DNA, 25 bp, Mus musculus
agaatcccactcactagtgctgctt

SEQ ID NO: 143722 - DNA, 25 bp, Mus musculus
agaatcccactctctagtgctgctt

SEQ ID NO: 143723 - DNA, 25 bp, Mus musculus
agaatcccagatattcccaagccca

SEQ ID NO: 143724 - DNA, 25 bp, Mus musculus
agaatcccagattttcccaagccca

SEQ ID NO: 143725 - DNA, 25 bp, Mus musculus
agaatcccagttacctctaggtggg

SEQ ID NO: 143726 - DNA, 25 bp, Mus musculus
agaatcccagtttcctctaggtggg

SEQ ID NO: 143727 - DNA, 25 bp, Mus musculus
agaatcccattcagtgcacatcgtt

SEQ ID NO: 143728 - DNA, 25 bp, Mus musculus
agaatcccattctgtgcacatcgtt

SEQ ID NO: 143729 - DNA, 25 bp, Mus musculus
agaatcccatttccaatctaagctc

SEQ ID NO: 143730 - DNA, 25 bp, Mus musculus
agaatcccatttgcaatctaagctc

SEQ ID NO: 143731 - DNA, 25 bp, Mus musculus
agaatcccctgtcgtcgtctgggaa

SEQ ID NO: 143732 - DNA, 25 bp, Mus musculus
agaatcccctgtggtcgtctgggaa

SEQ ID NO: 143733 - DNA, 25 bp, Mus musculus
agaatcccgtcgaggagtggtcgtc

SEQ ID NO: 143734 - DNA, 25 bp, Mus musculus
agaatcccgtcgtggagtggtcgtc

SEQ ID NO: 143735 - DNA, 25 bp, Mus musculus
agaatccctccgagccaaatatgga

SEQ ID NO: 143736 - DNA, 25 bp, Mus musculus
agaatccctccgtgccaaatatgga

SEQ ID NO: 143737 - DNA, 25 bp, Mus musculus
agaatccctggaaagcgtgcgccgc

SEQ ID NO: 143738 - DNA, 25 bp, Mus musculus
agaatccctggatagcgtgcgccgc

SEQ ID NO: 143739 - DNA, 25 bp, Mus musculus
agaatcccttctctatacttgtgtc

SEQ ID NO: 143740 - DNA, 25 bp, Mus musculus
agaatcccttctgtatacttgtgtc

SEQ ID NO: 143741 - DNA, 25 bp, Mus musculus
agaatccgacatctttgaggaggaa

SEQ ID NO: 143742 - DNA, 25 bp, Mus musculus
agaatccgacatgtttgaggaggaa

SEQ ID NO: 143743 - DNA, 25 bp, Mus musculus
agaatccgatatcggcagaccaaga

SEQ ID NO: 143744 - DNA, 25 bp, Mus musculus
agaatccgatatgggcagaccaaga

SEQ ID NO: 143745 - DNA, 25 bp, Mus musculus
agaatccgcagcactttaggtcttg

SEQ ID NO: 143746 - DNA, 25 bp, Mus musculus
agaatccgcagctctttaggtcttg

SEQ ID NO: 143747 - DNA, 25 bp, Mus musculus
agaatccgcgggacctatgagcgca

SEQ ID NO: 143748 - DNA, 25 bp, Mus musculus
agaatccgcgggtcctatgagcgca

SEQ ID NO: 143749 - DNA, 25 bp, Mus musculus
agaatccggcccagaagtgcctgag

SEQ ID NO: 143750 - DNA, 25 bp, Mus musculus
agaatccggccctgaagtgcctgag

SEQ ID NO: 143751 - DNA, 25 bp, Mus musculus
agaatccgggctcaatctggcacca

SEQ ID NO: 143752 - DNA, 25 bp, Mus musculus
agaatccgggctgaatctggcacca

SEQ ID NO: 143753 - DNA, 25 bp, Mus musculus
agaatccgtgtgatcttcctttggg

SEQ ID NO: 143754 - DNA, 25 bp, Mus musculus
agaatccgtgtgatgctgtacccat

SEQ ID NO: 143755 - DNA, 25 bp, Mus musculus
agaatccgtgtgttcttcctttggg

SEQ ID NO: 143756 - DNA, 25 bp, Mus musculus
agaatccgtgtgttgctgtacccat

SEQ ID NO: 143757 - DNA, 25 bp, Mus musculus
agaatcctacacagaaggcttccca

SEQ ID NO: 143758 - DNA, 25 bp, Mus musculus
agaatcctacactgaaggcttccca

SEQ ID NO: 143759 - DNA, 25 bp, Mus musculus
agaatcctaccgagttgtgttttat

SEQ ID NO: 143760 - DNA, 25 bp, Mus musculus
agaatcctaccgtgttgtgttttat

SEQ ID NO: 143761 - DNA, 25 bp, Mus musculus
agaatcctagccctcaacatcagca

SEQ ID NO: 143762 - DNA, 25 bp, Mus musculus
agaatcctagccgtcaacatcagca

SEQ ID NO: 143763 - DNA, 25 bp, Mus musculus
agaatcctattaatcctcctgtgtg

SEQ ID NO: 143764 - DNA, 25 bp, Mus musculus
agaatcctattattcctcctgtgtg

SEQ ID NO: 143765 - DNA, 25 bp, Mus musculus
agaatcctcaagagcagacccaggc

SEQ ID NO: 143766 - DNA, 25 bp, Mus musculus
agaatcctcaagtgcagacccaggc

SEQ ID NO: 143767 - DNA, 25 bp, Mus musculus
agaatcctcaatagcttctccactg

SEQ ID NO: 143768 - DNA, 25 bp, Mus musculus
agaatcctcaattgcttctccactg

SEQ ID NO: 143769 - DNA, 25 bp, Mus musculus
agaatcctcatcagtcttgagctgt

SEQ ID NO: 143770 - DNA, 25 bp, Mus musculus
agaatcctcatctgtcttgagctgt

SEQ ID NO: 143771 - DNA, 25 bp, Mus musculus
agaatcctccagctatagcctcatg

SEQ ID NO: 143772 - DNA, 25 bp, Mus musculus
agaatcctccaggtatagcctcatg

SEQ ID NO: 143773 - DNA, 25 bp, Mus musculus
agaatcctccatagagcagccaggc

SEQ ID NO: 143774 - DNA, 25 bp, Mus musculus
agaatcctccattgagcagccaggc

SEQ ID NO: 143775 - DNA, 25 bp, Mus musculus
agaatcctctttcaaatcacagcag

SEQ ID NO: 143776 - DNA, 25 bp, Mus musculus
agaatcctctttctccttaaccagg

SEQ ID NO: 143777 - DNA, 25 bp, Mus musculus
agaatcctctttgaaatcacagcag

SEQ ID NO: 143778 - DNA, 25 bp, Mus musculus
agaatcctctttgtccttaaccagg

SEQ ID NO: 143779 - DNA, 25 bp, Mus musculus
agaatcctgcatcggccctgtgaga

SEQ ID NO: 143780 - DNA, 25 bp, Mus musculus
agaatcctgcatgggccctgtgaga

SEQ ID NO: 143781 - DNA, 25 bp, Mus musculus
agaatcctggaaatgagacactcac

SEQ ID NO: 143782 - DNA, 25 bp, Mus musculus
agaatcctggaattgagacactcac

SEQ ID NO: 143783 - DNA, 25 bp, Mus musculus
agaatcctggacattgtgctccacg

SEQ ID NO: 143784 - DNA, 25 bp, Mus musculus
agaatcctggactttgtgctccacg

SEQ ID NO: 143785 - DNA, 25 bp, Mus musculus
agaatcctgttaattaagtcctgca

SEQ ID NO: 143786 - DNA, 25 bp, Mus musculus
agaatcctgttatttaagtcctgca

SEQ ID NO: 143787 - DNA, 25 bp, Mus musculus
agaatccttcagctgaaaccttagg

SEQ ID NO: 143788 - DNA, 25 bp, Mus musculus
agaatccttcaggtgaaaccttagg

SEQ ID NO: 143789 - DNA, 25 bp, Mus musculus
agaatccttccaaaactcaaatcag

SEQ ID NO: 143790 - DNA, 25 bp, Mus musculus
agaatccttccataactcaaatcag

SEQ ID NO: 143791 - DNA, 25 bp, Mus musculus
agaatccttcgtatttagctctcgt

SEQ ID NO: 143792 - DNA, 25 bp, Mus musculus
agaatccttcgtttttagctctcgt

SEQ ID NO: 143793 - DNA, 25 bp, Mus musculus
agaatccttgggagcagatcatgat

SEQ ID NO: 143794 - DNA, 25 bp, Mus musculus
agaatccttgggtgcagatcatgat

SEQ ID NO: 143795 - DNA, 25 bp, Mus musculus
agaatccttggtcttgagcccctgt

SEQ ID NO: 143796 - DNA, 25 bp, Mus musculus
agaatccttggtgttgagcccctgt

SEQ ID NO: 143797 - DNA, 25 bp, Mus musculus
agaatccttttacttggccatctga

SEQ ID NO: 143798 - DNA, 25 bp, Mus musculus
agaatccttttagttggccatctga

SEQ ID NO: 143799 - DNA, 25 bp, Mus musculus
agaatcgaggaccagaaggtgcctt

SEQ ID NO: 143800 - DNA, 25 bp, Mus musculus
agaatcgaggacgagaaggtgcctt

SEQ ID NO: 143801 - DNA, 25 bp, Mus musculus
agaatcgataggcagtccatccaca

SEQ ID NO: 143802 - DNA, 25 bp, Mus musculus
agaatcgatagggagtccatccaca

SEQ ID NO: 143803 - DNA, 25 bp, Mus musculus
agaatcgcagcgctcgcacagacag

SEQ ID NO: 143804 - DNA, 25 bp, Mus musculus
agaatcgcagcggtcgcacagacag

SEQ ID NO: 143805 - DNA, 25 bp, Mus musculus
agaatcgccggcctgcagggtcact

SEQ ID NO: 143806 - DNA, 25 bp, Mus musculus
agaatcgccggcgtgcagggtcact

SEQ ID NO: 143807 - DNA, 25 bp, Mus musculus
agaatcgcctgcctggacttactat

SEQ ID NO: 143808 - DNA, 25 bp, Mus musculus
agaatcgcctgcgtggacttactat

SEQ ID NO: 143809 - DNA, 25 bp, Mus musculus
agaatcgcgtgtctgagcgcgccaa

SEQ ID NO: 143810 - DNA, 25 bp, Mus musculus
agaatcgcgtgtgtgagcgcgccaa

SEQ ID NO: 143811 - DNA, 25 bp, Mus musculus
agaatcgctgcgcatagctttgacc

SEQ ID NO: 143812 - DNA, 25 bp, Mus musculus
agaatcgctgcggatagctttgacc

SEQ ID NO: 143813 - DNA, 25 bp, Mus musculus
agaatcgcttccatttcagcatggt

SEQ ID NO: 143814 - DNA, 25 bp, Mus musculus
agaatcgcttccttttcagcatggt

SEQ ID NO: 143815 - DNA, 25 bp, Mus musculus
agaatcggagaaactcatccaggaa

SEQ ID NO: 143816 - DNA, 25 bp, Mus musculus
agaatcggagaatctcatccaggaa

SEQ ID NO: 143817 - DNA, 25 bp, Mus musculus
agaatcggagtcaaacctgggcatt

SEQ ID NO: 143818 - DNA, 25 bp, Mus musculus
agaatcggagtctaacctgggcatt

SEQ ID NO: 143819 - DNA, 25 bp, Mus musculus
agaatcgtctgccatctaggatctg

SEQ ID NO: 143820 - DNA, 25 bp, Mus musculus
agaatcgtctgcgatctaggatctg

SEQ ID NO: 143821 - DNA, 25 bp, Mus musculus
agaatcgtggaaaggctctcgtccc

SEQ ID NO: 143822 - DNA, 25 bp, Mus musculus
agaatcgtggaatggctctcgtccc

SEQ ID NO: 143823 - DNA, 25 bp, Mus musculus
agaatcgtgttcatgtggctcaagt

SEQ ID NO: 143824 - DNA, 25 bp, Mus musculus
agaatcgtgttcttgtggctcaagt

SEQ ID NO: 143825 - DNA, 25 bp, Mus musculus
agaatctatcttagctctcattgct

SEQ ID NO: 143826 - DNA, 25 bp, Mus musculus
agaatctatcttccttcctgtggta

SEQ ID NO: 143827 - DNA, 25 bp, Mus musculus
agaatctatcttgcttcctgtggta

SEQ ID NO: 143828 - DNA, 25 bp, Mus musculus
agaatctatctttgctctcattgct

SEQ ID NO: 143829 - DNA, 25 bp, Mus musculus
agaatctatgctactcttccagctt

SEQ ID NO: 143830 - DNA, 25 bp, Mus musculus
agaatctatgcttctcttccagctt

SEQ ID NO: 143831 - DNA, 25 bp, Mus musculus
agaatctatttgactctcccaaaag

SEQ ID NO: 143832 - DNA, 25 bp, Mus musculus
agaatctatttgtctctcccaaaag

SEQ ID NO: 143833 - DNA, 25 bp, Mus musculus
agaatctcaagaacgggctggcaca

SEQ ID NO: 143834 - DNA, 25 bp, Mus musculus
agaatctcaagatcgggctggcaca

SEQ ID NO: 143835 - DNA, 25 bp, Mus musculus
agaatctcagccacaggatgacggt

SEQ ID NO: 143836 - DNA, 25 bp, Mus musculus
agaatctcagccatgcagaacatct

SEQ ID NO: 143837 - DNA, 25 bp, Mus musculus
agaatctcagcctcaggatgacggt

SEQ ID NO: 143838 - DNA, 25 bp, Mus musculus
agaatctcagccttgcagaacatct

SEQ ID NO: 143839 - DNA, 25 bp, Mus musculus
agaatctcatttccttccggaatcc

SEQ ID NO: 143840 - DNA, 25 bp, Mus musculus
agaatctcatttgcttccggaatcc

SEQ ID NO: 143841 - DNA, 25 bp, Mus musculus
agaatctcctctactaagacgctag

SEQ ID NO: 143842 - DNA, 25 bp, Mus musculus
agaatctcctcttctaagacgctag

SEQ ID NO: 143843 - DNA, 25 bp, Mus musculus
agaatctccttcactgtggcatggg

SEQ ID NO: 143844 - DNA, 25 bp, Mus musculus
agaatctccttctctgtggcatggg

SEQ ID NO: 143845 - DNA, 25 bp, Mus musculus
agaatctcgtgccttaaagcggccc

SEQ ID NO: 143846 - DNA, 25 bp, Mus musculus
agaatctcgtgcgttaaagcggccc

SEQ ID NO: 143847 - DNA, 25 bp, Mus musculus
agaatctctacgcttcttggcttgg

SEQ ID NO: 143848 - DNA, 25 bp, Mus musculus
agaatctctacggttcttggcttgg

SEQ ID NO: 143849 - DNA, 25 bp, Mus musculus
agaatctctcaaatccaactgcttt

SEQ ID NO: 143850 - DNA, 25 bp, Mus musculus
agaatctctcaattccaactgcttt

SEQ ID NO: 143851 - DNA, 25 bp, Mus musculus
agaatctctgagcttcgttgccttc

SEQ ID NO: 143852 - DNA, 25 bp, Mus musculus
agaatctctgaggttcgttgccttc

SEQ ID NO: 143853 - DNA, 25 bp, Mus musculus
agaatctctgcaaatgtgccctgga

SEQ ID NO: 143854 - DNA, 25 bp, Mus musculus
agaatctctgcaattcttgccaaag

SEQ ID NO: 143855 - DNA, 25 bp, Mus musculus
agaatctctgcatatgtgccctgga

SEQ ID NO: 143856 - DNA, 25 bp, Mus musculus
agaatctctgcatttcttgccaaag

SEQ ID NO: 143857 - DNA, 25 bp, Mus musculus
agaatctctgtgagtctctgttctc

SEQ ID NO: 143858 - DNA, 25 bp, Mus musculus
agaatctctgtgtgtctctgttctc

SEQ ID NO: 143859 - DNA, 25 bp, Mus musculus
agaatctcttaaatccgtgtaccaa

SEQ ID NO: 143860 - DNA, 25 bp, Mus musculus
agaatctcttaattccgtgtaccaa

SEQ ID NO: 143861 - DNA, 25 bp, Mus musculus
agaatctcttcacatttcctatcag

SEQ ID NO: 143862 - DNA, 25 bp, Mus musculus
agaatctcttcagatttcctatcag

SEQ ID NO: 143863 - DNA, 25 bp, Mus musculus
agaatctgacttagtttcccagcag

SEQ ID NO: 143864 - DNA, 25 bp, Mus musculus
agaatctgactttgtttcccagcag

SEQ ID NO: 143865 - DNA, 25 bp, Mus musculus
agaatctgaggaagccccggtttac

SEQ ID NO: 143866 - DNA, 25 bp, Mus musculus
agaatctgaggatgccccggtttac

SEQ ID NO: 143867 - DNA, 25 bp, Mus musculus
agaatctgagttctcttccagtcct

SEQ ID NO: 143868 - DNA, 25 bp, Mus musculus
agaatctgagttgtcttccagtcct

SEQ ID NO: 143869 - DNA, 25 bp, Mus musculus
agaatctgatgcagtgcgcactgca

SEQ ID NO: 143870 - DNA, 25 bp, Mus musculus
agaatctgatgctgtgcgcactgca

SEQ ID NO: 143871 - DNA, 25 bp, Mus musculus
agaatctgccacaggaagatttcta

SEQ ID NO: 143872 - DNA, 25 bp, Mus musculus
agaatctgccactggaagatttcta

SEQ ID NO: 143873 - DNA, 25 bp, Mus musculus
agaatctgcctcattcgtggtagaa

SEQ ID NO: 143874 - DNA, 25 bp, Mus musculus
agaatctgcctctttcgtggtagaa

SEQ ID NO: 143875 - DNA, 25 bp, Mus musculus
agaatctgctccacttactctaggg

SEQ ID NO: 143876 - DNA, 25 bp, Mus musculus
agaatctgctcctcttactctaggg

SEQ ID NO: 143877 - DNA, 25 bp, Mus musculus
agaatctggcctagaagagctgtca

SEQ ID NO: 143878 - DNA, 25 bp, Mus musculus
agaatctggccttgaagagctgtca

SEQ ID NO: 143879 - DNA, 25 bp, Mus musculus
agaatctggctacaatctctgggag

SEQ ID NO: 143880 - DNA, 25 bp, Mus musculus
agaatctggctagaatctctgggag

SEQ ID NO: 143881 - DNA, 25 bp, Mus musculus
agaatctgggatctatgctcctacc

SEQ ID NO: 143882 - DNA, 25 bp, Mus musculus
agaatctgggatgtatgctcctacc

SEQ ID NO: 143883 - DNA, 25 bp, Mus musculus
agaatctggtgccattgctatgcag

SEQ ID NO: 143884 - DNA, 25 bp, Mus musculus
agaatctggtgcgattgctatgcag

SEQ ID NO: 143885 - DNA, 25 bp, Mus musculus
agaatctgtaaacccactctgacac

SEQ ID NO: 143886 - DNA, 25 bp, Mus musculus
agaatctgtaaaccctcactgacca

SEQ ID NO: 143887 - DNA, 25 bp, Mus musculus
agaatctgtaaagccactctgacac

SEQ ID NO: 143888 - DNA, 25 bp, Mus musculus
agaatctgtaaagcctcactgacca

SEQ ID NO: 143889 - DNA, 25 bp, Mus musculus
agaatctgtgccaggcatacacagc

SEQ ID NO: 143890 - DNA, 25 bp, Mus musculus
agaatctgtgcctggcatacacagc

SEQ ID NO: 143891 - DNA, 25 bp, Mus musculus
agaatctgttaactgctcttccctg

SEQ ID NO: 143892 - DNA, 25 bp, Mus musculus
agaatctgttaagtgctcttccctg

SEQ ID NO: 143893 - DNA, 25 bp, Mus musculus
agaatctgttacaactttggaatgt

SEQ ID NO: 143894 - DNA, 25 bp, Mus musculus
agaatctgttactactttggaatgt

SEQ ID NO: 143895 - DNA, 25 bp, Mus musculus
agaatcttaatgagtaatccctagt

SEQ ID NO: 143896 - DNA, 25 bp, Mus musculus
agaatcttaatgtgtaatccctagt

SEQ ID NO: 143897 - DNA, 25 bp, Mus musculus
agaatcttacacatagctccacttc

SEQ ID NO: 143898 - DNA, 25 bp, Mus musculus
agaatcttacacttagctccacttc

SEQ ID NO: 143899 - DNA, 25 bp, Mus musculus
agaatcttagcacactttccttgtc

SEQ ID NO: 143900 - DNA, 25 bp, Mus musculus
agaatcttagcagactttccttgtc

SEQ ID NO: 143901 - DNA, 25 bp, Mus musculus
agaatcttcactccggtttatcttt

SEQ ID NO: 143902 - DNA, 25 bp, Mus musculus
agaatcttcactgcggtttatcttt

SEQ ID NO: 143903 - DNA, 25 bp, Mus musculus
agaatcttcaggataaatgtgcaca

SEQ ID NO: 143904 - DNA, 25 bp, Mus musculus
agaatcttcaggttaaatgtgcaca

SEQ ID NO: 143905 - DNA, 25 bp, Mus musculus
agaatcttccggatctgtaacatgg

SEQ ID NO: 143906 - DNA, 25 bp, Mus musculus
agaatcttccggttctgtaacatgg

SEQ ID NO: 143907 - DNA, 25 bp, Mus musculus
agaatcttccttagccagacgtggt

SEQ ID NO: 143908 - DNA, 25 bp, Mus musculus
agaatcttccttccgcagtggtgtg

SEQ ID NO: 143909 - DNA, 25 bp, Mus musculus
agaatcttccttgcgcagtggtgtg

SEQ ID NO: 143910 - DNA, 25 bp, Mus musculus
agaatcttcctttgccagacgtggt

SEQ ID NO: 143911 - DNA, 25 bp, Mus musculus
agaatcttgagccaagtatgatgtt

SEQ ID NO: 143912 - DNA, 25 bp, Mus musculus
agaatcttgagcgaagtatgatgtt

SEQ ID NO: 143913 - DNA, 25 bp, Mus musculus
agaatcttgccaagaagccacagtg

SEQ ID NO: 143914 - DNA, 25 bp, Mus musculus
agaatcttgccatgaagccacagtg

SEQ ID NO: 143915 - DNA, 25 bp, Mus musculus
agaatcttgtaactcacgggctgcc

SEQ ID NO: 143916 - DNA, 25 bp, Mus musculus
agaatcttgtaagtcacgggctgcc

SEQ ID NO: 143917 - DNA, 25 bp, Mus musculus
agaatctttgctacctagaacctgc

SEQ ID NO: 143918 - DNA, 25 bp, Mus musculus
agaatctttgcttcctagaacctgc

SEQ ID NO: 143919 - DNA, 25 bp, Mus musculus
agaatctttgtcacctctacatatt

SEQ ID NO: 143920 - DNA, 25 bp, Mus musculus
agaatctttgtctcctctacatatt

SEQ ID NO: 143921 - DNA, 25 bp, Mus musculus
agaatcttttgaccgaattatcctt

SEQ ID NO: 143922 - DNA, 25 bp, Mus musculus
agaatcttttgagcgaattatcctt

SEQ ID NO: 143923 - DNA, 25 bp, Mus musculus
agaatgaaattcactctagtttgct

SEQ ID NO: 143924 - DNA, 25 bp, Mus musculus
agaatgaaattctctctagtttgct

SEQ ID NO: 143925 - DNA, 25 bp, Mus musculus
agaatgaacatgagctggagcagtg

SEQ ID NO: 143926 - DNA, 25 bp, Mus musculus
agaatgaacatgtgctggagcagtg

SEQ ID NO: 143927 - DNA, 25 bp, Mus musculus
agaatgaacgcgcacaggccttccg

SEQ ID NO: 143928 - DNA, 25 bp, Mus musculus
agaatgaacgcggacaggccttccg

SEQ ID NO: 143929 - DNA, 25 bp, Mus musculus
agaatgaaggcccttcttctccctg

SEQ ID NO: 143930 - DNA, 25 bp, Mus musculus
agaatgaaggccgttcttctccctg

SEQ ID NO: 143931 - DNA, 25 bp, Mus musculus
agaatgaagttcacactagtggatc

SEQ ID NO: 143932 - DNA, 25 bp, Mus musculus
agaatgaagttctcactagtggatc

SEQ ID NO: 143933 - DNA, 25 bp, Mus musculus
agaatgaatcccagctgaagtccct

SEQ ID NO: 143934 - DNA, 25 bp, Mus musculus
agaatgaatccctgctgaagtccct

SEQ ID NO: 143935 - DNA, 25 bp, Mus musculus
agaatgaatgacaggaccggcaaga

SEQ ID NO: 143936 - DNA, 25 bp, Mus musculus
agaatgaatgactggaccggcaaga

SEQ ID NO: 143937 - DNA, 25 bp, Mus musculus
agaatgaatgatccttgcctctcac

SEQ ID NO: 143938 - DNA, 25 bp, Mus musculus
agaatgaatgatgcttgcctctcac

SEQ ID NO: 143939 - DNA, 25 bp, Mus musculus
agaatgacaacgagttctgcgccca

SEQ ID NO: 143940 - DNA, 25 bp, Mus musculus
agaatgacaacgtgttctgcgccca

SEQ ID NO: 143941 - DNA, 25 bp, Mus musculus
agaatgacactcagcatgctaccaa

SEQ ID NO: 143942 - DNA, 25 bp, Mus musculus
agaatgacactctgcatgctaccaa

SEQ ID NO: 143943 - DNA, 25 bp, Mus musculus
agaatgacagctcatctcctgggct

SEQ ID NO: 143944 - DNA, 25 bp, Mus musculus
agaatgacagctgatctcctgggct

SEQ ID NO: 143945 - DNA, 25 bp, Mus musculus
agaatgaccaaacctgccattgcct

SEQ ID NO: 143946 - DNA, 25 bp, Mus musculus
agaatgaccaaagctgccattgcct

SEQ ID NO: 143947 - DNA, 25 bp, Mus musculus
agaatgaccctgaaacaaaataatc

SEQ ID NO: 143948 - DNA, 25 bp, Mus musculus
agaatgaccctgtaacaaaataatc

SEQ ID NO: 143949 - DNA, 25 bp, Mus musculus
agaatgacctcaccttctctgtctg

SEQ ID NO: 143950 - DNA, 25 bp, Mus musculus
agaatgacctcagcttctctgtctg

SEQ ID NO: 143951 - DNA, 25 bp, Mus musculus
agaatgacgagccacccaaggtagt

SEQ ID NO: 143952 - DNA, 25 bp, Mus musculus
agaatgacgagcgacccaaggtagt

SEQ ID NO: 143953 - DNA, 25 bp, Mus musculus
agaatgacgcctatcacatcatgca

SEQ ID NO: 143954 - DNA, 25 bp, Mus musculus
agaatgacgcctttcacatcatgca

SEQ ID NO: 143955 - DNA, 25 bp, Mus musculus
agaatgacgtcgctttgctcgtccc

SEQ ID NO: 143956 - DNA, 25 bp, Mus musculus
agaatgacgtcggtttgctcgtccc

SEQ ID NO: 143957 - DNA, 25 bp, Mus musculus
agaatgactacgagaaggccctgcc

SEQ ID NO: 143958 - DNA, 25 bp, Mus musculus
agaatgactacgtgaaggccctgcc

SEQ ID NO: 143959 - DNA, 25 bp, Mus musculus
agaatgactagaatgacttgggagg

SEQ ID NO: 143960 - DNA, 25 bp, Mus musculus
agaatgactagattgacttgggagg

SEQ ID NO: 143961 - DNA, 25 bp, Mus musculus
agaatgactggaatggaccacccaa

SEQ ID NO: 143962 - DNA, 25 bp, Mus musculus
agaatgactggattggaccacccaa

SEQ ID NO: 143963 - DNA, 25 bp, Mus musculus
agaatgagacatctgctaggcagtg

SEQ ID NO: 143964 - DNA, 25 bp, Mus musculus
agaatgagacatgtgctaggcagtg

SEQ ID NO: 143965 - DNA, 25 bp, Mus musculus
agaatgagacgcactgcagaagaca

SEQ ID NO: 143966 - DNA, 25 bp, Mus musculus
agaatgagacgctctgcagaagaca

SEQ ID NO: 143967 - DNA, 25 bp, Mus musculus
agaatgagactcacttgtttcccca

SEQ ID NO: 143968 - DNA, 25 bp, Mus musculus
agaatgagactctcttgtttcccca

SEQ ID NO: 143969 - DNA, 25 bp, Mus musculus
agaatgagatcgagtcccaggctga

SEQ ID NO: 143970 - DNA, 25 bp, Mus musculus
agaatgagatcgtgtcccaggctga

SEQ ID NO: 143971 - DNA, 25 bp, Mus musculus
agaatgagcacacctaccaagtggg

SEQ ID NO: 143972 - DNA, 25 bp, Mus musculus
agaatgagcacagctaccaagtggg

SEQ ID NO: 143973 - DNA, 25 bp, Mus musculus
agaatgagcagccaatcccatcttc

SEQ ID NO: 143974 - DNA, 25 bp, Mus musculus
agaatgagcagcgaatcccatcttc

SEQ ID NO: 143975 - DNA, 25 bp, Mus musculus
agaatgaggtctacccagaacccat

SEQ ID NO: 143976 - DNA, 25 bp, Mus musculus
agaatgaggtcttcccagaacccat

SEQ ID NO: 143977 - DNA, 25 bp, Mus musculus
agaatgagtcgcacttgcacgagtt

SEQ ID NO: 143978 - DNA, 25 bp, Mus musculus
agaatgagtcgctcttgcacgagtt

SEQ ID NO: 143979 - DNA, 25 bp, Mus musculus
agaatgagtgcgactgtccgtccct

SEQ ID NO: 143980 - DNA, 25 bp, Mus musculus
agaatgagtgcgtctgtccgtccct

SEQ ID NO: 143981 - DNA, 25 bp, Mus musculus
agaatgagtgctcgctctgcctctg

SEQ ID NO: 143982 - DNA, 25 bp, Mus musculus
agaatgagtgctggctctgcctctg

SEQ ID NO: 143983 - DNA, 25 bp, Mus musculus
agaatgagttcacacgacccacctc

SEQ ID NO: 143984 - DNA, 25 bp, Mus musculus
agaatgagttcagacgacccacctc

SEQ ID NO: 143985 - DNA, 25 bp, Mus musculus
agaatgatacctcgcatgcatcccc

SEQ ID NO: 143986 - DNA, 25 bp, Mus musculus
agaatgatacctggcatgcatcccc

SEQ ID NO: 143987 - DNA, 25 bp, Mus musculus
agaatgatagcaccccatactcgag

SEQ ID NO: 143988 - DNA, 25 bp, Mus musculus
agaatgatagcagcccatactcgag

SEQ ID NO: 143989 - DNA, 25 bp, Mus musculus
agaatgatcggcacctattgtttag

SEQ ID NO: 143990 - DNA, 25 bp, Mus musculus
agaatgatcggctcctattgtttag

SEQ ID NO: 143991 - DNA, 25 bp, Mus musculus
agaatgatctcccatattatccgag

SEQ ID NO: 143992 - DNA, 25 bp, Mus musculus
agaatgatctccgatattatccgag

SEQ ID NO: 143993 - DNA, 25 bp, Mus musculus
agaatgatctgcagagttccaccca

SEQ ID NO: 143994 - DNA, 25 bp, Mus musculus
agaatgatctgctgagttccaccca

SEQ ID NO: 143995 - DNA, 25 bp, Mus musculus
agaatgatgacgctcctcctcaaca

SEQ ID NO: 143996 - DNA, 25 bp, Mus musculus
agaatgatgacggtcctcctcaaca

SEQ ID NO: 143997 - DNA, 25 bp, Mus musculus
agaatgatgataccctgcactggaa

SEQ ID NO: 143998 - DNA, 25 bp, Mus musculus
agaatgatgatagcctgcactggaa

SEQ ID NO: 143999 - DNA, 25 bp, Mus musculus
agaatgatggagcccagtctacccc

SEQ ID NO: 144000 - DNA, 25 bp, Mus musculus
agaatgatggaggccagtctacccc

SEQ ID NO: 144001 - DNA, 25 bp, Mus musculus
agaatgcaaaccatgtccatggaga

SEQ ID NO: 144002 - DNA, 25 bp, Mus musculus
agaatgcaaaccttgtccatggaga

SEQ ID NO: 144003 - DNA, 25 bp, Mus musculus
agaatgcaaaggaacacccctcctt

SEQ ID NO: 144004 - DNA, 25 bp, Mus musculus
agaatgcaaaggtacacccctcctt

SEQ ID NO: 144005 - DNA, 25 bp, Mus musculus
agaatgcactgacctgagccccgag

SEQ ID NO: 144006 - DNA, 25 bp, Mus musculus
agaatgcactgacgaccatgctacc

SEQ ID NO: 144007 - DNA, 25 bp, Mus musculus
agaatgcactgagctgagccccgag

SEQ ID NO: 144008 - DNA, 25 bp, Mus musculus
agaatgcactgaggaccatgctacc

SEQ ID NO: 144009 - DNA, 25 bp, Mus musculus
agaatgcagacacttatctccctat

SEQ ID NO: 144010 - DNA, 25 bp, Mus musculus
agaatgcagacagttatctccctat

SEQ ID NO: 144011 - DNA, 25 bp, Mus musculus
agaatgcagaccctagtgggctgta

SEQ ID NO: 144012 - DNA, 25 bp, Mus musculus
agaatgcagaccgtagtgggctgta

SEQ ID NO: 144013 - DNA, 25 bp, Mus musculus
agaatgcagacgatgttaagaagac

SEQ ID NO: 144014 - DNA, 25 bp, Mus musculus
agaatgcagacgttgttaagaagac

SEQ ID NO: 144015 - DNA, 25 bp, Mus musculus
agaatgcagactcacttcattccac

SEQ ID NO: 144016 - DNA, 25 bp, Mus musculus
agaatgcagactgacttcattccac

SEQ ID NO: 144017 - DNA, 25 bp, Mus musculus
agaatgcagccgacagctattcctg

SEQ ID NO: 144018 - DNA, 25 bp, Mus musculus
agaatgcagccgtcagctattcctg

SEQ ID NO: 144019 - DNA, 25 bp, Mus musculus
agaatgcagcctcatcccaggacgg

SEQ ID NO: 144020 - DNA, 25 bp, Mus musculus
agaatgcagcctgatcccaggacgg

SEQ ID NO: 144021 - DNA, 25 bp, Mus musculus
agaatgcagctacgtgggttgacac

SEQ ID NO: 144022 - DNA, 25 bp, Mus musculus
agaatgcagctaggtgggttgacac

SEQ ID NO: 144023 - DNA, 25 bp, Mus musculus
agaatgcaggcgcagctacacccac

SEQ ID NO: 144024 - DNA, 25 bp, Mus musculus
agaatgcaggcggagctacacccac

SEQ ID NO: 144025 - DNA, 25 bp, Mus musculus
agaatgcatgcgattgcttcctagc

SEQ ID NO: 144026 - DNA, 25 bp, Mus musculus
agaatgcatgcgtttgcttcctagc

SEQ ID NO: 144027 - DNA, 25 bp, Mus musculus
agaatgcattagatgggccaggata

SEQ ID NO: 144028 - DNA, 25 bp, Mus musculus
agaatgcattagttgggccaggata

SEQ ID NO: 144029 - DNA, 25 bp, Mus musculus
agaatgcattgccatttccacatag

SEQ ID NO: 144030 - DNA, 25 bp, Mus musculus
agaatgcattgcgatttccacatag

SEQ ID NO: 144031 - DNA, 25 bp, Mus musculus
agaatgccacagcaactgttgcatc

SEQ ID NO: 144032 - DNA, 25 bp, Mus musculus
agaatgccacaggaactgttgcatc

SEQ ID NO: 144033 - DNA, 25 bp, Mus musculus
agaatgccagaaatacttccctccc

SEQ ID NO: 144034 - DNA, 25 bp, Mus musculus
agaatgccagaattacttccctccc

SEQ ID NO: 144035 - DNA, 25 bp, Mus musculus
agaatgccagagaaacccgccgctt

SEQ ID NO: 144036 - DNA, 25 bp, Mus musculus
agaatgccagagtaacccgccgctt

SEQ ID NO: 144037 - DNA, 25 bp, Mus musculus
agaatgccagcgagtacttaaatca

SEQ ID NO: 144038 - DNA, 25 bp, Mus musculus
agaatgccagcgtgtacttaaatca

SEQ ID NO: 144039 - DNA, 25 bp, Mus musculus
agaatgccaggcattgctaaacaac

SEQ ID NO: 144040 - DNA, 25 bp, Mus musculus
agaatgccaggctttgctaaacaac

SEQ ID NO: 144041 - DNA, 25 bp, Mus musculus
agaatgccagttaagatgcccagag

SEQ ID NO: 144042 - DNA, 25 bp, Mus musculus
agaatgccagtttagatgcccagag

SEQ ID NO: 144043 - DNA, 25 bp, Mus musculus
agaatgcccaatcttaccactttta

SEQ ID NO: 144044 - DNA, 25 bp, Mus musculus
agaatgcccaatgttaccactttta

SEQ ID NO: 144045 - DNA, 25 bp, Mus musculus
agaatgcccagaccatcctagatgg

SEQ ID NO: 144046 - DNA, 25 bp, Mus musculus
agaatgcccagagcatcctagatgg

SEQ ID NO: 144047 - DNA, 25 bp, Mus musculus
agaatgccccatacaggttttattt

SEQ ID NO: 144048 - DNA, 25 bp, Mus musculus
agaatgccccattcaggttttattt

SEQ ID NO: 144049 - DNA, 25 bp, Mus musculus
agaatgccccgtcatgcctacctgg

SEQ ID NO: 144050 - DNA, 25 bp, Mus musculus
agaatgccccgtgatgcctacctgg

SEQ ID NO: 144051 - DNA, 25 bp, Mus musculus
agaatgccctcccagaagcaagcta

SEQ ID NO: 144052 - DNA, 25 bp, Mus musculus
agaatgccctccgagaagcaagcta

SEQ ID NO: 144053 - DNA, 25 bp, Mus musculus
agaatgcccttcagtgagcacatgg

SEQ ID NO: 144054 - DNA, 25 bp, Mus musculus
agaatgcccttctgtgagcacatgg

SEQ ID NO: 144055 - DNA, 25 bp, Mus musculus
agaatgccgcaaactctcaggactg

SEQ ID NO: 144056 - DNA, 25 bp, Mus musculus
agaatgccgcaatctctcaggactg

SEQ ID NO: 144057 - DNA, 25 bp, Mus musculus
agaatgccggcgagttcttcaggga

SEQ ID NO: 144058 - DNA, 25 bp, Mus musculus
agaatgccggcgtgttcttcaggga

SEQ ID NO: 144059 - DNA, 25 bp, Mus musculus
agaatgccggttccttcttctggaa

SEQ ID NO: 144060 - DNA, 25 bp, Mus musculus
agaatgccggttgcttcttctggaa

SEQ ID NO: 144061 - DNA, 25 bp, Mus musculus
agaatgcctctaatagtgctgctat

SEQ ID NO: 144062 - DNA, 25 bp, Mus musculus
agaatgcctctattagtgctgctat

SEQ ID NO: 144063 - DNA, 25 bp, Mus musculus
agaatgcctcttctcttgtgaacat

SEQ ID NO: 144064 - DNA, 25 bp, Mus musculus
agaatgcctcttgtcttgtgaacat

SEQ ID NO: 144065 - DNA, 25 bp, Mus musculus
agaatgcctgaaatctgtgactgta

SEQ ID NO: 144066 - DNA, 25 bp, Mus musculus
agaatgcctgaattctgtgactgta

SEQ ID NO: 144067 - DNA, 25 bp, Mus musculus
agaatgcctggaacaaccttgagag

SEQ ID NO: 144068 - DNA, 25 bp, Mus musculus
agaatgcctggatcaaccttgagag

SEQ ID NO: 144069 - DNA, 25 bp, Mus musculus
agaatgccttctcaacacagtaggg

SEQ ID NO: 144070 - DNA, 25 bp, Mus musculus
agaatgccttctgaacacagtaggg

SEQ ID NO: 144071 - DNA, 25 bp, Mus musculus
agaatgccttggatgctttaccttc

SEQ ID NO: 144072 - DNA, 25 bp, Mus musculus
agaatgccttggttgctttaccttc

SEQ ID NO: 144073 - DNA, 25 bp, Mus musculus
agaatgcgacacagttggccgaaga

SEQ ID NO: 144074 - DNA, 25 bp, Mus musculus
agaatgcgacactgttggccgaaga

SEQ ID NO: 144075 - DNA, 25 bp, Mus musculus
agaatgcggcttatcagcgtccgga

SEQ ID NO: 144076 - DNA, 25 bp, Mus musculus
agaatgcggcttttcagcgtccgga

SEQ ID NO: 144077 - DNA, 25 bp, Mus musculus
agaatgctaacacttgcccaacttg

SEQ ID NO: 144078 - DNA, 25 bp, Mus musculus
agaatgctaacagttgcccaacttg

SEQ ID NO: 144079 - DNA, 25 bp, Mus musculus
agaatgctacagatcccgaatcgga

SEQ ID NO: 144080 - DNA, 25 bp, Mus musculus
agaatgctacagttcccgaatcgga

SEQ ID NO: 144081 - DNA, 25 bp, Mus musculus
agaatgctaggtccactcccatctt

SEQ ID NO: 144082 - DNA, 25 bp, Mus musculus
agaatgctaggtgcactcccatctt

SEQ ID NO: 144083 - DNA, 25 bp, Mus musculus
agaatgctcatgaccttgtcgagtc

SEQ ID NO: 144084 - DNA, 25 bp, Mus musculus
agaatgctcatgtccttgtcgagtc

SEQ ID NO: 144085 - DNA, 25 bp, Mus musculus
agaatgctcgctatgcagcacaggc

SEQ ID NO: 144086 - DNA, 25 bp, Mus musculus
agaatgctcgctttgcagcacaggc

SEQ ID NO: 144087 - DNA, 25 bp, Mus musculus
agaatgctctctcatgtagattaga

SEQ ID NO: 144088 - DNA, 25 bp, Mus musculus
agaatgctctctgatgtagattaga

SEQ ID NO: 144089 - DNA, 25 bp, Mus musculus
agaatgctcttcagatctcatacga

SEQ ID NO: 144090 - DNA, 25 bp, Mus musculus
agaatgctcttctgatctcatacga

SEQ ID NO: 144091 - DNA, 25 bp, Mus musculus
agaatgctgcacctcgtaggttccg

SEQ ID NO: 144092 - DNA, 25 bp, Mus musculus
agaatgctgcacgtcgtaggttccg

SEQ ID NO: 144093 - DNA, 25 bp, Mus musculus
agaatgctgcttcgcccgtgatcct

SEQ ID NO: 144094 - DNA, 25 bp, Mus musculus
agaatgctgcttggcccgtgatcct

SEQ ID NO: 144095 - DNA, 25 bp, Mus musculus
agaatgctggctatgtctatctttc

SEQ ID NO: 144096 - DNA, 25 bp, Mus musculus
agaatgctggctttgtctatctttc

SEQ ID NO: 144097 - DNA, 25 bp, Mus musculus
agaatgctgtaaatccttgtcatac

SEQ ID NO: 144098 - DNA, 25 bp, Mus musculus
agaatgctgtaattccttgtcatac

SEQ ID NO: 144099 - DNA, 25 bp, Mus musculus
agaatgcttactctgtgtcgggcgc

SEQ ID NO: 144100 - DNA, 25 bp, Mus musculus
agaatgcttactgtgtgtcgggcgc

SEQ ID NO: 144101 - DNA, 25 bp, Mus musculus
agaatgcttctgcaccttgaacctg

SEQ ID NO: 144102 - DNA, 25 bp, Mus musculus
agaatgcttctgcacttggcctcat

SEQ ID NO: 144103 - DNA, 25 bp, Mus musculus
agaatgcttctggaccttgaacctg

SEQ ID NO: 144104 - DNA, 25 bp, Mus musculus
agaatgcttctggacttggcctcat

SEQ ID NO: 144105 - DNA, 25 bp, Mus musculus
agaatgcttgttatgtggcgatgaa

SEQ ID NO: 144106 - DNA, 25 bp, Mus musculus
agaatgcttgttttgtggcgatgaa

SEQ ID NO: 144107 - DNA, 25 bp, Mus musculus
agaatggaagagacactgggatgaa

SEQ ID NO: 144108 - DNA, 25 bp, Mus musculus
agaatggaagagtcactgggatgaa

SEQ ID NO: 144109 - DNA, 25 bp, Mus musculus
agaatggacattagccaccgtctct

SEQ ID NO: 144110 - DNA, 25 bp, Mus musculus
agaatggacatttgccaccgtctct

SEQ ID NO: 144111 - DNA, 25 bp, Mus musculus
agaatggaccctacaagcctaacta

SEQ ID NO: 144112 - DNA, 25 bp, Mus musculus
agaatggacccttcaagcctaacta

SEQ ID NO: 144113 - DNA, 25 bp, Mus musculus
agaatggaccgcctgttggataatg

SEQ ID NO: 144114 - DNA, 25 bp, Mus musculus
agaatggaccgcgtgttggataatg

SEQ ID NO: 144115 - DNA, 25 bp, Mus musculus
agaatggagccactgaagaaatttc

SEQ ID NO: 144116 - DNA, 25 bp, Mus musculus
agaatggagccagtgaagaaatttc

SEQ ID NO: 144117 - DNA, 25 bp, Mus musculus
agaatggaggcaagctccccttact

SEQ ID NO: 144118 - DNA, 25 bp, Mus musculus
agaatggaggcacccaccgagagaa

SEQ ID NO: 144119 - DNA, 25 bp, Mus musculus
agaatggaggcagccaccgagagaa

SEQ ID NO: 144120 - DNA, 25 bp, Mus musculus
agaatggaggcatgctccccttact

SEQ ID NO: 144121 - DNA, 25 bp, Mus musculus
agaatggatggcaacctatctccgc

SEQ ID NO: 144122 - DNA, 25 bp, Mus musculus
agaatggatggctacctatctccgc

SEQ ID NO: 144123 - DNA, 25 bp, Mus musculus
agaatggattctcggcagtgtcatt

SEQ ID NO: 144124 - DNA, 25 bp, Mus musculus
agaatggattctgggcagtgtcatt

SEQ ID NO: 144125 - DNA, 25 bp, Mus musculus
agaatggattgcagcgcgccctggc

SEQ ID NO: 144126 - DNA, 25 bp, Mus musculus
agaatggattgctgcgcgccctggc

SEQ ID NO: 144127 - DNA, 25 bp, Mus musculus
agaatggcacaaacctggcctgggc

SEQ ID NO: 144128 - DNA, 25 bp, Mus musculus
agaatggcacaatcctggcctgggc

SEQ ID NO: 144129 - DNA, 25 bp, Mus musculus
agaatggccaacatcccgaagaaaa

SEQ ID NO: 144130 - DNA, 25 bp, Mus musculus
agaatggccaacttcccgaagaaaa

SEQ ID NO: 144131 - DNA, 25 bp, Mus musculus
agaatggcccacactgtgccttcgt

SEQ ID NO: 144132 - DNA, 25 bp, Mus musculus
agaatggcccactctgtgccttcgt

SEQ ID NO: 144133 - DNA, 25 bp, Mus musculus
agaatggccgctactgtttgcccca

SEQ ID NO: 144134 - DNA, 25 bp, Mus musculus
agaatggccgcttctgtttgcccca

SEQ ID NO: 144135 - DNA, 25 bp, Mus musculus
agaatggccgtcctctaagacactc

SEQ ID NO: 144136 - DNA, 25 bp, Mus musculus
agaatggccgtcgtctaagacactc

SEQ ID NO: 144137 - DNA, 25 bp, Mus musculus
agaatggcctttctacaaagcaaga

SEQ ID NO: 144138 - DNA, 25 bp, Mus musculus
agaatggcctttgtacaaagcaaga

SEQ ID NO: 144139 - DNA, 25 bp, Mus musculus
agaatggcgactcctctaagggtga

SEQ ID NO: 144140 - DNA, 25 bp, Mus musculus
agaatggcgactgctctaagggtga

SEQ ID NO: 144141 - DNA, 25 bp, Mus musculus
agaatggcggagactgttcccgaca

SEQ ID NO: 144142 - DNA, 25 bp, Mus musculus
agaatggcggagtctgttcccgaca

SEQ ID NO: 144143 - DNA, 25 bp, Mus musculus
agaatggcggccacttaggcagaac

SEQ ID NO: 144144 - DNA, 25 bp, Mus musculus
agaatggcggcctcttaggcagaac

SEQ ID NO: 144145 - DNA, 25 bp, Mus musculus
agaatggcgttgcactccccgaagc

SEQ ID NO: 144146 - DNA, 25 bp, Mus musculus
agaatggcgttggactccccgaagc

SEQ ID NO: 144147 - DNA, 25 bp, Mus musculus
agaatggctacccaagactccctga

SEQ ID NO: 144148 - DNA, 25 bp, Mus musculus
agaatggctaccgaagactccctga

SEQ ID NO: 144149 - DNA, 25 bp, Mus musculus
agaatggctactccaaatgactttt

SEQ ID NO: 144150 - DNA, 25 bp, Mus musculus
agaatggctactgcaaatgactttt

SEQ ID NO: 144151 - DNA, 25 bp, Mus musculus
agaatggctcaacctccgattcttc

SEQ ID NO: 144152 - DNA, 25 bp, Mus musculus
agaatggctcaagctccgattcttc

SEQ ID NO: 144153 - DNA, 25 bp, Mus musculus
agaatggctcagacgttacgagcac

SEQ ID NO: 144154 - DNA, 25 bp, Mus musculus
agaatggctcagtcgttacgagcac

SEQ ID NO: 144155 - DNA, 25 bp, Mus musculus
agaatggctgcacctgaccatgtat

SEQ ID NO: 144156 - DNA, 25 bp, Mus musculus
agaatggctgcagctgaccatgtat

SEQ ID NO: 144157 - DNA, 25 bp, Mus musculus
agaatggctgttcgtcatcacatcc

SEQ ID NO: 144158 - DNA, 25 bp, Mus musculus
agaatggctgttggtcatcacatcc

SEQ ID NO: 144159 - DNA, 25 bp, Mus musculus
agaatgggacacagctgacaggatc

SEQ ID NO: 144160 - DNA, 25 bp, Mus musculus
agaatgggacactgctgacaggatc

SEQ ID NO: 144161 - DNA, 25 bp, Mus musculus
agaatgggacagagcagtataaaca

SEQ ID NO: 144162 - DNA, 25 bp, Mus musculus
agaatgggacagtgcagtataaaca

SEQ ID NO: 144163 - DNA, 25 bp, Mus musculus
agaatgggcattcttggtcattgtc

SEQ ID NO: 144164 - DNA, 25 bp, Mus musculus
agaatgggcattgttggtcattgtc

SEQ ID NO: 144165 - DNA, 25 bp, Mus musculus
agaatgggcccacctattagaatcc

SEQ ID NO: 144166 - DNA, 25 bp, Mus musculus
agaatgggcccagctattagaatcc

SEQ ID NO: 144167 - DNA, 25 bp, Mus musculus
agaatgggcctaacacttgccccag

SEQ ID NO: 144168 - DNA, 25 bp, Mus musculus
agaatgggcctatcacttgccccag

SEQ ID NO: 144169 - DNA, 25 bp, Mus musculus
agaatgggcctgctcgtcctacgtt

SEQ ID NO: 144170 - DNA, 25 bp, Mus musculus
agaatgggcctggtcgtcctacgtt

SEQ ID NO: 144171 - DNA, 25 bp, Mus musculus
agaatgggctgaaggcctcccgcat

SEQ ID NO: 144172 - DNA, 25 bp, Mus musculus
agaatgggctgatggcctcccgcat

SEQ ID NO: 144173 - DNA, 25 bp, Mus musculus
agaatgggctttaactctggtggca

SEQ ID NO: 144174 - DNA, 25 bp, Mus musculus
agaatgggcttttactctggtggca

SEQ ID NO: 144175 - DNA, 25 bp, Mus musculus
agaatgggtccccatgagaacctga

SEQ ID NO: 144176 - DNA, 25 bp, Mus musculus
agaatgggtcccgatgagaacctga

SEQ ID NO: 144177 - DNA, 25 bp, Mus musculus
agaatgggtctactattgcaggcac

SEQ ID NO: 144178 - DNA, 25 bp, Mus musculus
agaatgggtctagtattgcaggcac

SEQ ID NO: 144179 - DNA, 25 bp, Mus musculus
agaatgggtcttcttccattgttca

SEQ ID NO: 144180 - DNA, 25 bp, Mus musculus
agaatgggtcttgttccattgttca

SEQ ID NO: 144181 - DNA, 25 bp, Mus musculus
agaatgggtgatccagtgcctcatt

SEQ ID NO: 144182 - DNA, 25 bp, Mus musculus
agaatgggtgatgcagtgcctcatt

SEQ ID NO: 144183 - DNA, 25 bp, Mus musculus
agaatgggtgtcatgtgtccgcttc

SEQ ID NO: 144184 - DNA, 25 bp, Mus musculus
agaatgggtgtcttgtgtccgcttc

SEQ ID NO: 144185 - DNA, 25 bp, Mus musculus
agaatgggtgtgaggttgcgtgtgc

SEQ ID NO: 144186 - DNA, 25 bp, Mus musculus
agaatgggtgtgtggttgcgtgtgc

SEQ ID NO: 144187 - DNA, 25 bp, Mus musculus
agaatgggttcacctcagactggct

SEQ ID NO: 144188 - DNA, 25 bp, Mus musculus
agaatgggttcagctcagactggct

SEQ ID NO: 144189 - DNA, 25 bp, Mus musculus
agaatgggttctacgcagctcctta

SEQ ID NO: 144190 - DNA, 25 bp, Mus musculus
agaatgggttcttcgcagctcctta

SEQ ID NO: 144191 - DNA, 25 bp, Mus musculus
agaatgggtttccatgttcctccat

SEQ ID NO: 144192 - DNA, 25 bp, Mus musculus
agaatgggtttcgatgttcctccat

SEQ ID NO: 144193 - DNA, 25 bp, Mus musculus
agaatggtaagcactgacagcctat

SEQ ID NO: 144194 - DNA, 25 bp, Mus musculus
agaatggtaagctctgacagcctat

SEQ ID NO: 144195 - DNA, 25 bp, Mus musculus
agaatggtaggcctaggctgctcct

SEQ ID NO: 144196 - DNA, 25 bp, Mus musculus
agaatggtaggcgtaggctgctcct

SEQ ID NO: 144197 - DNA, 25 bp, Mus musculus
agaatggtatctcaaatccccagtg

SEQ ID NO: 144198 - DNA, 25 bp, Mus musculus
agaatggtatctgaaatccccagtg

SEQ ID NO: 144199 - DNA, 25 bp, Mus musculus
agaatggtccacctgggttctcatt

SEQ ID NO: 144200 - DNA, 25 bp, Mus musculus
agaatggtccacgtgggttctcatt

SEQ ID NO: 144201 - DNA, 25 bp, Mus musculus
agaatggtccatctcattttccttt

SEQ ID NO: 144202 - DNA, 25 bp, Mus musculus
agaatggtccatgtcattttccttt

SEQ ID NO: 144203 - DNA, 25 bp, Mus musculus
agaatggtcctgcttctgcaacagc

SEQ ID NO: 144204 - DNA, 25 bp, Mus musculus
agaatggtcctggttctgcaacagc

SEQ ID NO: 144205 - DNA, 25 bp, Mus musculus
agaatggtctgaccctactgatctt

SEQ ID NO: 144206 - DNA, 25 bp, Mus musculus
agaatggtctgagcctactgatctt

SEQ ID NO: 144207 - DNA, 25 bp, Mus musculus
agaatggtctgcctggagaattcca

SEQ ID NO: 144208 - DNA, 25 bp, Mus musculus
agaatggtctgcgtggagaattcca

SEQ ID NO: 144209 - DNA, 25 bp, Mus musculus
agaatggtcttcaccttgcagggtt

SEQ ID NO: 144210 - DNA, 25 bp, Mus musculus
agaatggtcttctccttgcagggtt

SEQ ID NO: 144211 - DNA, 25 bp, Mus musculus
agaatggtgcacactctgagccctc

SEQ ID NO: 144212 - DNA, 25 bp, Mus musculus
agaatggtgcactctctgagccctc

SEQ ID NO: 144213 - DNA, 25 bp, Mus musculus
agaatggtgcctctttactctggac

SEQ ID NO: 144214 - DNA, 25 bp, Mus musculus
agaatggtgcctgtttactctggac

SEQ ID NO: 144215 - DNA, 25 bp, Mus musculus
agaatggtggccaggtcaccggtaa

SEQ ID NO: 144216 - DNA, 25 bp, Mus musculus
agaatggtggcctggtcaccggtaa

SEQ ID NO: 144217 - DNA, 25 bp, Mus musculus
agaatggtgggcaccttgtaggtcc

SEQ ID NO: 144218 - DNA, 25 bp, Mus musculus
agaatggtgggctccttgtaggtcc

SEQ ID NO: 144219 - DNA, 25 bp, Mus musculus
agaatggtggttccctgggttccca

SEQ ID NO: 144220 - DNA, 25 bp, Mus musculus
agaatggtggttgcctgggttccca

SEQ ID NO: 144221 - DNA, 25 bp, Mus musculus
agaatggtgtccacatagcctccta

SEQ ID NO: 144222 - DNA, 25 bp, Mus musculus
agaatggtgtcctcatagcctccta

SEQ ID NO: 144223 - DNA, 25 bp, Mus musculus
agaatggtgtttacagtgctgcaaa

SEQ ID NO: 144224 - DNA, 25 bp, Mus musculus
agaatggtgttttcagtgctgcaaa

SEQ ID NO: 144225 - DNA, 25 bp, Mus musculus
agaatggttcccagtcacagtagta

SEQ ID NO: 144226 - DNA, 25 bp, Mus musculus
agaatggttccctgtcacagtagta

SEQ ID NO: 144227 - DNA, 25 bp, Mus musculus
agaatggttcctacttgggagcccg

SEQ ID NO: 144228 - DNA, 25 bp, Mus musculus
agaatggttccttcttgggagcccg

SEQ ID NO: 144229 - DNA, 25 bp, Mus musculus
agaatggttgggaaagtacttgcta

SEQ ID NO: 144230 - DNA, 25 bp, Mus musculus
agaatggttgggtaagtacttgcta

SEQ ID NO: 144231 - DNA, 25 bp, Mus musculus
agaatgtaactcattctgacctgcc

SEQ ID NO: 144232 - DNA, 25 bp, Mus musculus
agaatgtaactctttctgacctgcc

SEQ ID NO: 144233 - DNA, 25 bp, Mus musculus
agaatgtactacctgtggtgggaca

SEQ ID NO: 144234 - DNA, 25 bp, Mus musculus
agaatgtactacgtgtggtgggaca

SEQ ID NO: 144235 - DNA, 25 bp, Mus musculus
agaatgtagaatacctcaggataca

SEQ ID NO: 144236 - DNA, 25 bp, Mus musculus
agaatgtagaattcctcaggataca

SEQ ID NO: 144237 - DNA, 25 bp, Mus musculus
agaatgtagcgaacagcccctgcag

SEQ ID NO: 144238 - DNA, 25 bp, Mus musculus
agaatgtagcgatcagcccctgcag

SEQ ID NO: 144239 - DNA, 25 bp, Mus musculus
agaatgtaggtgacatccccaccag

SEQ ID NO: 144240 - DNA, 25 bp, Mus musculus
agaatgtaggtgtcatccccaccag

SEQ ID NO: 144241 - DNA, 25 bp, Mus musculus
agaatgtagtcaaacggcctcgagt

SEQ ID NO: 144242 - DNA, 25 bp, Mus musculus
agaatgtagtcatacggcctcgagt

SEQ ID NO: 144243 - DNA, 25 bp, Mus musculus
agaatgtatacacgtcagcaggact

SEQ ID NO: 144244 - DNA, 25 bp, Mus musculus
agaatgtatacaggtcagcaggact

SEQ ID NO: 144245 - DNA, 25 bp, Mus musculus
agaatgtatgacctggtcgccgttg

SEQ ID NO: 144246 - DNA, 25 bp, Mus musculus
agaatgtatgacgtggtcgccgttg

SEQ ID NO: 144247 - DNA, 25 bp, Mus musculus
agaatgtcacctacctgccagtggg

SEQ ID NO: 144248 - DNA, 25 bp, Mus musculus
agaatgtcaccttcctgccagtggg

SEQ ID NO: 144249 - DNA, 25 bp, Mus musculus
agaatgtcactcactcccttgggct

SEQ ID NO: 144250 - DNA, 25 bp, Mus musculus
agaatgtcactctctcccttgggct

SEQ ID NO: 144251 - DNA, 25 bp, Mus musculus
agaatgtcagaaccatcctcctgag

SEQ ID NO: 144252 - DNA, 25 bp, Mus musculus
agaatgtcagaagcatcctcctgag

SEQ ID NO: 144253 - DNA, 25 bp, Mus musculus
agaatgtcatgaacaaatctggatc

SEQ ID NO: 144254 - DNA, 25 bp, Mus musculus
agaatgtcatgatcaaatctggatc

SEQ ID NO: 144255 - DNA, 25 bp, Mus musculus
agaatgtcgaagaggccttttcccg

SEQ ID NO: 144256 - DNA, 25 bp, Mus musculus
agaatgtcgaagtggccttttcccg

SEQ ID NO: 144257 - DNA, 25 bp, Mus musculus
agaatgtcgtgtcccagcatctact

SEQ ID NO: 144258 - DNA, 25 bp, Mus musculus
agaatgtcgtgtctgctcttgggtt

SEQ ID NO: 144259 - DNA, 25 bp, Mus musculus
agaatgtcgtgtgccagcatctact

SEQ ID NO: 144260 - DNA, 25 bp, Mus musculus
agaatgtcgtgtgtgctcttgggtt

SEQ ID NO: 144261 - DNA, 25 bp, Mus musculus
agaatgtctcatcctccctgttaca

SEQ ID NO: 144262 - DNA, 25 bp, Mus musculus
agaatgtctcatgctccctgttaca

SEQ ID NO: 144263 - DNA, 25 bp, Mus musculus
agaatgtctcctccggtggtttgaa

SEQ ID NO: 144264 - DNA, 25 bp, Mus musculus
agaatgtctcctgcggtggtttgaa

SEQ ID NO: 144265 - DNA, 25 bp, Mus musculus
agaatgtctgtcaaccccacaagtg

SEQ ID NO: 144266 - DNA, 25 bp, Mus musculus
agaatgtctgtctaccccacaagtg

SEQ ID NO: 144267 - DNA, 25 bp, Mus musculus
agaatgtctttaagcctgccaacaa

SEQ ID NO: 144268 - DNA, 25 bp, Mus musculus
agaatgtctttatgcctgccaacaa

SEQ ID NO: 144269 - DNA, 25 bp, Mus musculus
agaatgtgacaacactcagcctcgt

SEQ ID NO: 144270 - DNA, 25 bp, Mus musculus
agaatgtgacaagactcagcctcgt

SEQ ID NO: 144271 - DNA, 25 bp, Mus musculus
agaatgtgacacaacccagactggg

SEQ ID NO: 144272 - DNA, 25 bp, Mus musculus
agaatgtgacactacccagactggg

SEQ ID NO: 144273 - DNA, 25 bp, Mus musculus
agaatgtgactcatctgtaacagaa

SEQ ID NO: 144274 - DNA, 25 bp, Mus musculus
agaatgtgactcttctgtaacagaa

SEQ ID NO: 144275 - DNA, 25 bp, Mus musculus
agaatgtgcacaatatcgtgagctg

SEQ ID NO: 144276 - DNA, 25 bp, Mus musculus
agaatgtgcacattatcgtgagctg

SEQ ID NO: 144277 - DNA, 25 bp, Mus musculus
agaatgtgccagaacttgcttgcta

SEQ ID NO: 144278 - DNA, 25 bp, Mus musculus
agaatgtgccagtacttgcttgcta

SEQ ID NO: 144279 - DNA, 25 bp, Mus musculus
agaatgtgcttcattggtatatgtt

SEQ ID NO: 144280 - DNA, 25 bp, Mus musculus
agaatgtgcttctttggtatatgtt

SEQ ID NO: 144281 - DNA, 25 bp, Mus musculus
agaatgtgcttgcatgtgtctcctg

SEQ ID NO: 144282 - DNA, 25 bp, Mus musculus
agaatgtgcttggatgtgtctcctg

SEQ ID NO: 144283 - DNA, 25 bp, Mus musculus
agaatgtggactagtatatttgtac

SEQ ID NO: 144284 - DNA, 25 bp, Mus musculus
agaatgtggacttgtatatttgtac

SEQ ID NO: 144285 - DNA, 25 bp, Mus musculus
agaatgtggccaatagcctttggtt

SEQ ID NO: 144286 - DNA, 25 bp, Mus musculus
agaatgtggccattagcctttggtt

SEQ ID NO: 144287 - DNA, 25 bp, Mus musculus
agaatgtggcttcctgagtgataat

SEQ ID NO: 144288 - DNA, 25 bp, Mus musculus
agaatgtggcttgctgagtgataat

SEQ ID NO: 144289 - DNA, 25 bp, Mus musculus
agaatgtggtataggccctggccta

SEQ ID NO: 144290 - DNA, 25 bp, Mus musculus
agaatgtggtattggccctggccta

SEQ ID NO: 144291 - DNA, 25 bp, Mus musculus
agaatgtgttggactgtggatttat

SEQ ID NO: 144292 - DNA, 25 bp, Mus musculus
agaatgtgttggtctgtggatttat

SEQ ID NO: 144293 - DNA, 25 bp, Mus musculus
agaatgttaaacactgccttcagat

SEQ ID NO: 144294 - DNA, 25 bp, Mus musculus
agaatgttaaactctgccttcagat

SEQ ID NO: 144295 - DNA, 25 bp, Mus musculus
agaatgttatccatccaagcctctt

SEQ ID NO: 144296 - DNA, 25 bp, Mus musculus
agaatgttatccttccaagcctctt

SEQ ID NO: 144297 - DNA, 25 bp, Mus musculus
agaatgttcactatcaccgttcggg

SEQ ID NO: 144298 - DNA, 25 bp, Mus musculus
agaatgttcactatgcacacaccag

SEQ ID NO: 144299 - DNA, 25 bp, Mus musculus
agaatgttcactttcaccgttcggg

SEQ ID NO: 144300 - DNA, 25 bp, Mus musculus
agaatgttcactttgcacacaccag

SEQ ID NO: 144301 - DNA, 25 bp, Mus musculus
agaatgttccggatgtcacaccagc

SEQ ID NO: 144302 - DNA, 25 bp, Mus musculus
agaatgttccggttgtcacaccagc

SEQ ID NO: 144303 - DNA, 25 bp, Mus musculus
agaatgttcctactcacacttcagc

SEQ ID NO: 144304 - DNA, 25 bp, Mus musculus
agaatgttcctagtcacacttcagc

SEQ ID NO: 144305 - DNA, 25 bp, Mus musculus
agaatgttcctcctaactactcgag

SEQ ID NO: 144306 - DNA, 25 bp, Mus musculus
agaatgttcctcgtaactactcgag

SEQ ID NO: 144307 - DNA, 25 bp, Mus musculus
agaatgttctgtacgcccttggctc

SEQ ID NO: 144308 - DNA, 25 bp, Mus musculus
agaatgttctgttcgcccttggctc

SEQ ID NO: 144309 - DNA, 25 bp, Mus musculus
agaatgttctttccttggtcaaggc

SEQ ID NO: 144310 - DNA, 25 bp, Mus musculus
agaatgttctttgcttggtcaaggc

SEQ ID NO: 144311 - DNA, 25 bp, Mus musculus
agaatgtttacaacatcagccccta

SEQ ID NO: 144312 - DNA, 25 bp, Mus musculus
agaatgtttacatcatcagccccta

SEQ ID NO: 144313 - DNA, 25 bp, Mus musculus
agaatgtttcgacgcgtttaacatg

SEQ ID NO: 144314 - DNA, 25 bp, Mus musculus
agaatgtttcgaggcgtttaacatg

SEQ ID NO: 144315 - DNA, 25 bp, Mus musculus
agaatgtttgaacctctaggagaaa

SEQ ID NO: 144316 - DNA, 25 bp, Mus musculus
agaatgtttgaagctctaggagaaa

SEQ ID NO: 144317 - DNA, 25 bp, Mus musculus
agaatgttttgtcctgttgcatccg

SEQ ID NO: 144318 - DNA, 25 bp, Mus musculus
agaatgttttgtgctgttgcatccg

SEQ ID NO: 144319 - DNA, 25 bp, Mus musculus
agaattaacattatcaagccgggcg

SEQ ID NO: 144320 - DNA, 25 bp, Mus musculus
agaattaacattttcaagccgggcg

SEQ ID NO: 144321 - DNA, 25 bp, Mus musculus
agaattaaccaacctgatcagtgat

SEQ ID NO: 144322 - DNA, 25 bp, Mus musculus
agaattaaccaagctgatcagtgat

SEQ ID NO: 144323 - DNA, 25 bp, Mus musculus
agaattaagcccaagccccaacaag

SEQ ID NO: 144324 - DNA, 25 bp, Mus musculus
agaattaagccctagccccaacaag

SEQ ID NO: 144325 - DNA, 25 bp, Mus musculus
agaattacaaatcaccatctcccag

SEQ ID NO: 144326 - DNA, 25 bp, Mus musculus
agaattacaaatgaccatctcccag

SEQ ID NO: 144327 - DNA, 25 bp, Mus musculus
agaattaccaggacattgttaatga

SEQ ID NO: 144328 - DNA, 25 bp, Mus musculus
agaattaccaggtcattgttaatga

SEQ ID NO: 144329 - DNA, 25 bp, Mus musculus
agaattaccccgattggtcacatat

SEQ ID NO: 144330 - DNA, 25 bp, Mus musculus
agaattaccccgtttggtcacatat

SEQ ID NO: 144331 - DNA, 25 bp, Mus musculus
agaattagaatcctgctcatttcct

SEQ ID NO: 144332 - DNA, 25 bp, Mus musculus
agaattagaatcgtgctcatttcct

SEQ ID NO: 144333 - DNA, 25 bp, Mus musculus
agaattaggaccagtgccactgggt

SEQ ID NO: 144334 - DNA, 25 bp, Mus musculus
agaattaggacctgtgccactgggt

SEQ ID NO: 144335 - DNA, 25 bp, Mus musculus
agaattaggcttagctgtctgtagt

SEQ ID NO: 144336 - DNA, 25 bp, Mus musculus
agaattaggctttgctgtctgtagt

SEQ ID NO: 144337 - DNA, 25 bp, Mus musculus
agaattagggataccagctgggcat

SEQ ID NO: 144338 - DNA, 25 bp, Mus musculus
agaattagggattccagctgggcat

SEQ ID NO: 144339 - DNA, 25 bp, Mus musculus
agaattagtaggacccacagcctgc

SEQ ID NO: 144340 - DNA, 25 bp, Mus musculus
agaattagtaggtcccacagcctgc

SEQ ID NO: 144341 - DNA, 25 bp, Mus musculus
agaattatacgcctctgccttgtct

SEQ ID NO: 144342 - DNA, 25 bp, Mus musculus
agaattatacgcgtctgccttgtct

SEQ ID NO: 144343 - DNA, 25 bp, Mus musculus
agaattatatccagtgtacctcact

SEQ ID NO: 144344 - DNA, 25 bp, Mus musculus
agaattatatcctgtgtacctcact

SEQ ID NO: 144345 - DNA, 25 bp, Mus musculus
agaattatccctcgtgagctcactc

SEQ ID NO: 144346 - DNA, 25 bp, Mus musculus
agaattatccctggtgagctcactc

SEQ ID NO: 144347 - DNA, 25 bp, Mus musculus
agaattatcttgcttgcttacactt

SEQ ID NO: 144348 - DNA, 25 bp, Mus musculus
agaattatcttggttgcttacactt

SEQ ID NO: 144349 - DNA, 25 bp, Mus musculus
agaattcaagtccatccagatgtgg

SEQ ID NO: 144350 - DNA, 25 bp, Mus musculus
agaattcaagtcgatccagatgtgg

SEQ ID NO: 144351 - DNA, 25 bp, Mus musculus
agaattcaccctattcgggtgcatt

SEQ ID NO: 144352 - DNA, 25 bp, Mus musculus
agaattcacccttttcgggtgcatt

SEQ ID NO: 144353 - DNA, 25 bp, Mus musculus
agaattcacctgaagatcccctgga

SEQ ID NO: 144354 - DNA, 25 bp, Mus musculus
agaattcacctgtagatcccctgga

SEQ ID NO: 144355 - DNA, 25 bp, Mus musculus
agaattcagatgatctactccaccc

SEQ ID NO: 144356 - DNA, 25 bp, Mus musculus
agaattcagatgttctactccaccc

SEQ ID NO: 144357 - DNA, 25 bp, Mus musculus
agaattcagctgaaaaggatgtaga

SEQ ID NO: 144358 - DNA, 25 bp, Mus musculus
agaattcagctgtaaaggatgtaga

SEQ ID NO: 144359 - DNA, 25 bp, Mus musculus
agaattcaggaaagtccctggctcc

SEQ ID NO: 144360 - DNA, 25 bp, Mus musculus
agaattcaggaatgtccctggctcc

SEQ ID NO: 144361 - DNA, 25 bp, Mus musculus
agaattcagggacgaactgtgctgt

SEQ ID NO: 144362 - DNA, 25 bp, Mus musculus
agaattcagggaggaactgtgctgt

SEQ ID NO: 144363 - DNA, 25 bp, Mus musculus
agaattcataccctgttttggctct

SEQ ID NO: 144364 - DNA, 25 bp, Mus musculus
agaattcataccgtgttttggctct

SEQ ID NO: 144365 - DNA, 25 bp, Mus musculus
agaattcatagtcggttctcttcat

SEQ ID NO: 144366 - DNA, 25 bp, Mus musculus
agaattcatagtgggttctcttcat

SEQ ID NO: 144367 - DNA, 25 bp, Mus musculus
agaattcatccacacagaggcccct

SEQ ID NO: 144368 - DNA, 25 bp, Mus musculus
agaattcatccagacagaggcccct

SEQ ID NO: 144369 - DNA, 25 bp, Mus musculus
agaattcatcccagctccagctgtc

SEQ ID NO: 144370 - DNA, 25 bp, Mus musculus
agaattcatccctgctccagctgtc

SEQ ID NO: 144371 - DNA, 25 bp, Mus musculus
agaattcatgctagcagctcccttg

SEQ ID NO: 144372 - DNA, 25 bp, Mus musculus
agaattcatgcttgcagctcccttg

SEQ ID NO: 144373 - DNA, 25 bp, Mus musculus
agaattcatgtaccttgtccttcag

SEQ ID NO: 144374 - DNA, 25 bp, Mus musculus
agaattcatgtagcttgtccttcag

SEQ ID NO: 144375 - DNA, 25 bp, Mus musculus
agaattccaaatcggccacctattt

SEQ ID NO: 144376 - DNA, 25 bp, Mus musculus
agaattccaaatgggccacctattt

SEQ ID NO: 144377 - DNA, 25 bp, Mus musculus
agaattccaactcatgttccctttc

SEQ ID NO: 144378 - DNA, 25 bp, Mus musculus
agaattccaactgatgttccctttc

SEQ ID NO: 144379 - DNA, 25 bp, Mus musculus
agaattccactcctcaacaaagcgg

SEQ ID NO: 144380 - DNA, 25 bp, Mus musculus
agaattccactcgtcaacaaagcgg

SEQ ID NO: 144381 - DNA, 25 bp, Mus musculus
agaattccatcacccggacagcaaa

SEQ ID NO: 144382 - DNA, 25 bp, Mus musculus
agaattccatcagccggacagcaaa

SEQ ID NO: 144383 - DNA, 25 bp, Mus musculus
agaattcccaacacaagtcctcagt

SEQ ID NO: 144384 - DNA, 25 bp, Mus musculus
agaattcccaactcaagtcctcagt

SEQ ID NO: 144385 - DNA, 25 bp, Mus musculus
agaattccccaaagagttgagtgta

SEQ ID NO: 144386 - DNA, 25 bp, Mus musculus
agaattccccaatgagttgagtgta

SEQ ID NO: 144387 - DNA, 25 bp, Mus musculus
agaattccctctcctagaaactatg

SEQ ID NO: 144388 - DNA, 25 bp, Mus musculus
agaattccctctgctagaaactatg

SEQ ID NO: 144389 - DNA, 25 bp, Mus musculus
agaattcctagaagtcaatgtgcac

SEQ ID NO: 144390 - DNA, 25 bp, Mus musculus
agaattcctagatgtcaatgtgcac

SEQ ID NO: 144391 - DNA, 25 bp, Mus musculus
agaattcctcaccatgactcacaaa

SEQ ID NO: 144392 - DNA, 25 bp, Mus musculus
agaattcctcacgatgactcacaaa

SEQ ID NO: 144393 - DNA, 25 bp, Mus musculus
agaattcctctgcaaatcctccaac

SEQ ID NO: 144394 - DNA, 25 bp, Mus musculus
agaattcctctggaaatcctccaac

SEQ ID NO: 144395 - DNA, 25 bp, Mus musculus
agaattcctgccaaagaggctccca

SEQ ID NO: 144396 - DNA, 25 bp, Mus musculus
agaattcctgccagggacagatgga

SEQ ID NO: 144397 - DNA, 25 bp, Mus musculus
agaattcctgcctaagaggctccca

SEQ ID NO: 144398 - DNA, 25 bp, Mus musculus
agaattcctgcctgggacagatgga

SEQ ID NO: 144399 - DNA, 25 bp, Mus musculus
agaattcgcgccatgagacagacct

SEQ ID NO: 144400 - DNA, 25 bp, Mus musculus
agaattcgcgccttgagacagacct

SEQ ID NO: 144401 - DNA, 25 bp, Mus musculus
agaattcgtggtaggcaggatttcc

SEQ ID NO: 144402 - DNA, 25 bp, Mus musculus
agaattcgtggttggcaggatttcc

SEQ ID NO: 144403 - DNA, 25 bp, Mus musculus
agaattctagccctttctctgagat

SEQ ID NO: 144404 - DNA, 25 bp, Mus musculus
agaattctagccgtttctctgagat

SEQ ID NO: 144405 - DNA, 25 bp, Mus musculus
agaattctaggccagcgtaagttac

SEQ ID NO: 144406 - DNA, 25 bp, Mus musculus
agaattctaggcgagcgtaagttac

SEQ ID NO: 144407 - DNA, 25 bp, Mus musculus
agaattctaggtagtgttgggcaca

SEQ ID NO: 144408 - DNA, 25 bp, Mus musculus
agaattctaggttgtgttgggcaca

SEQ ID NO: 144409 - DNA, 25 bp, Mus musculus
agaattctattgctttcactcaagt

SEQ ID NO: 144410 - DNA, 25 bp, Mus musculus
agaattctattggtttcactcaagt

SEQ ID NO: 144411 - DNA, 25 bp, Mus musculus
agaattctcaagctctgttttttgt

SEQ ID NO: 144412 - DNA, 25 bp, Mus musculus
agaattctcaaggtctgttttttgt

SEQ ID NO: 144413 - DNA, 25 bp, Mus musculus
agaattctcccaagtatccttagac

SEQ ID NO: 144414 - DNA, 25 bp, Mus musculus
agaattctcccatgtatccttagac

SEQ ID NO: 144415 - DNA, 25 bp, Mus musculus
agaattctctcaaatctagattttt

SEQ ID NO: 144416 - DNA, 25 bp, Mus musculus
agaattctctcatatctagattttt

SEQ ID NO: 144417 - DNA, 25 bp, Mus musculus
agaattctctgtatactcccgttct

SEQ ID NO: 144418 - DNA, 25 bp, Mus musculus
agaattctctgtttactcccgttct

SEQ ID NO: 144419 - DNA, 25 bp, Mus musculus
agaattctctttactctggtcctgg

SEQ ID NO: 144420 - DNA, 25 bp, Mus musculus
agaattctcttttctctggtcctgg

SEQ ID NO: 144421 - DNA, 25 bp, Mus musculus
agaattctgcatatcaggctctcac

SEQ ID NO: 144422 - DNA, 25 bp, Mus musculus
agaattctgcatttcaggctctcac

SEQ ID NO: 144423 - DNA, 25 bp, Mus musculus
agaattctgctgatcctatcccagg

SEQ ID NO: 144424 - DNA, 25 bp, Mus musculus
agaattctgctgttcctatcccagg

SEQ ID NO: 144425 - DNA, 25 bp, Mus musculus
agaattctgtttatacttgtagtca

SEQ ID NO: 144426 - DNA, 25 bp, Mus musculus
agaattctgtttttacttgtagtca

SEQ ID NO: 144427 - DNA, 25 bp, Mus musculus
agaattcttacccttcttgtctcag

SEQ ID NO: 144428 - DNA, 25 bp, Mus musculus
agaattcttaccgttcttgtctcag

SEQ ID NO: 144429 - DNA, 25 bp, Mus musculus
agaattcttgaactcctcttcttct

SEQ ID NO: 144430 - DNA, 25 bp, Mus musculus
agaattcttgaagtcctcttcttct

SEQ ID NO: 144431 - DNA, 25 bp, Mus musculus
agaattctttggattgcgctccaaa

SEQ ID NO: 144432 - DNA, 25 bp, Mus musculus
agaattctttggctggttcttaagt

SEQ ID NO: 144433 - DNA, 25 bp, Mus musculus
agaattctttgggtggttcttaagt

SEQ ID NO: 144434 - DNA, 25 bp, Mus musculus
agaattctttggtttgcgctccaaa

SEQ ID NO: 144435 - DNA, 25 bp, Mus musculus
agaattgaactgaagaacccaggtt

SEQ ID NO: 144436 - DNA, 25 bp, Mus musculus
agaattgaactgtagaacccaggtt

SEQ ID NO: 144437 - DNA, 25 bp, Mus musculus
agaattgacactaggttggactgct

SEQ ID NO: 144438 - DNA, 25 bp, Mus musculus
agaattgacactccttattttccat

SEQ ID NO: 144439 - DNA, 25 bp, Mus musculus
agaattgacactgcttattttccat

SEQ ID NO: 144440 - DNA, 25 bp, Mus musculus
agaattgacacttggttggactgct

SEQ ID NO: 144441 - DNA, 25 bp, Mus musculus
agaattgacattcagcctctgcact

SEQ ID NO: 144442 - DNA, 25 bp, Mus musculus
agaattgacattgagcctctgcact

SEQ ID NO: 144443 - DNA, 25 bp, Mus musculus
agaattgaccatactacctccagtt

SEQ ID NO: 144444 - DNA, 25 bp, Mus musculus
agaattgaccattctacctccagtt

SEQ ID NO: 144445 - DNA, 25 bp, Mus musculus
agaattgactaccttagctttcctt

SEQ ID NO: 144446 - DNA, 25 bp, Mus musculus
agaattgactacgttagctttcctt

SEQ ID NO: 144447 - DNA, 25 bp, Mus musculus
agaattgactagatgtcctctgaca

SEQ ID NO: 144448 - DNA, 25 bp, Mus musculus
agaattgactagttgtcctctgaca

SEQ ID NO: 144449 - DNA, 25 bp, Mus musculus
agaattgactctcccaaactgaaca

SEQ ID NO: 144450 - DNA, 25 bp, Mus musculus
agaattgactctcgctcaggatcca

SEQ ID NO: 144451 - DNA, 25 bp, Mus musculus
agaattgactctgccaaactgaaca

SEQ ID NO: 144452 - DNA, 25 bp, Mus musculus
agaattgactctggctcaggatcca

SEQ ID NO: 144453 - DNA, 25 bp, Mus musculus
agaattgagcccatggtctggttac

SEQ ID NO: 144454 - DNA, 25 bp, Mus musculus
agaattgagcccttggtctggttac

SEQ ID NO: 144455 - DNA, 25 bp, Mus musculus
agaattgagtctcccattggtcttc

SEQ ID NO: 144456 - DNA, 25 bp, Mus musculus
agaattgagtctctcctagtcacag

SEQ ID NO: 144457 - DNA, 25 bp, Mus musculus
agaattgagtctgccattggtcttc

SEQ ID NO: 144458 - DNA, 25 bp, Mus musculus
agaattgagtctgtcctagtcacag

SEQ ID NO: 144459 - DNA, 25 bp, Mus musculus
agaattgcagggacttctgcccctt

SEQ ID NO: 144460 - DNA, 25 bp, Mus musculus
agaattgcagggtcttctgcccctt

SEQ ID NO: 144461 - DNA, 25 bp, Mus musculus
agaattgcatccaacgcaggcagca

SEQ ID NO: 144462 - DNA, 25 bp, Mus musculus
agaattgcatcctacgcaggcagca

SEQ ID NO: 144463 - DNA, 25 bp, Mus musculus
agaattgcctaaattctgatgtgtt

SEQ ID NO: 144464 - DNA, 25 bp, Mus musculus
agaattgcctaatttctgatgtgtt

SEQ ID NO: 144465 - DNA, 25 bp, Mus musculus
agaattgcctacaggtctgtgaaca

SEQ ID NO: 144466 - DNA, 25 bp, Mus musculus
agaattgcctactggtctgtgaaca

SEQ ID NO: 144467 - DNA, 25 bp, Mus musculus
agaattgcctgtattcatcgttgtc

SEQ ID NO: 144468 - DNA, 25 bp, Mus musculus
agaattgcctgttttcatcgttgtc

SEQ ID NO: 144469 - DNA, 25 bp, Mus musculus
agaattgcggctatctcactgcaag

SEQ ID NO: 144470 - DNA, 25 bp, Mus musculus
agaattgcggctttctcactgcaag

SEQ ID NO: 144471 - DNA, 25 bp, Mus musculus
agaattgctcagaaggactgaacaa

SEQ ID NO: 144472 - DNA, 25 bp, Mus musculus
agaattgctcagtaggactgaacaa

SEQ ID NO: 144473 - DNA, 25 bp, Mus musculus
agaattgctctcaccaagcactggc

SEQ ID NO: 144474 - DNA, 25 bp, Mus musculus
agaattgctctctccaagcactggc

SEQ ID NO: 144475 - DNA, 25 bp, Mus musculus
agaattgctgatctctatctcgata

SEQ ID NO: 144476 - DNA, 25 bp, Mus musculus
agaattgctgatgtctatctcgata

SEQ ID NO: 144477 - DNA, 25 bp, Mus musculus
agaattgcttccattgacttcctct

SEQ ID NO: 144478 - DNA, 25 bp, Mus musculus
agaattgcttcctttgacttcctct

SEQ ID NO: 144479 - DNA, 25 bp, Mus musculus
agaattgcttctcgctgctgatgtg

SEQ ID NO: 144480 - DNA, 25 bp, Mus musculus
agaattgcttctggctgctgatgtg

SEQ ID NO: 144481 - DNA, 25 bp, Mus musculus
agaattgctttaaactgagtattga

SEQ ID NO: 144482 - DNA, 25 bp, Mus musculus
agaattgctttaatgatacgagtca

SEQ ID NO: 144483 - DNA, 25 bp, Mus musculus
agaattgctttatactgagtattga

SEQ ID NO: 144484 - DNA, 25 bp, Mus musculus
agaattgctttattgatacgagtca

SEQ ID NO: 144485 - DNA, 25 bp, Mus musculus
agaattggaccacggccaaggtgtc

SEQ ID NO: 144486 - DNA, 25 bp, Mus musculus
agaattggaccagggccaaggtgtc

SEQ ID NO: 144487 - DNA, 25 bp, Mus musculus
agaattggagtaagccctgaagatt

SEQ ID NO: 144488 - DNA, 25 bp, Mus musculus
agaattggagtatgccctgaagatt

SEQ ID NO: 144489 - DNA, 25 bp, Mus musculus
agaattggcatgagacagtgacaaa

SEQ ID NO: 144490 - DNA, 25 bp, Mus musculus
agaattggcatgtgacagtgacaaa

SEQ ID NO: 144491 - DNA, 25 bp, Mus musculus
agaattggccgcactgggcgttcag

SEQ ID NO: 144492 - DNA, 25 bp, Mus musculus
agaattggccgctctgggcgttcag

SEQ ID NO: 144493 - DNA, 25 bp, Mus musculus
agaattggctcgatcctgtgtgcat

SEQ ID NO: 144494 - DNA, 25 bp, Mus musculus
agaattggctcgttcctgtgtgcat

SEQ ID NO: 144495 - DNA, 25 bp, Mus musculus
agaattggcttgatttcaggatgtc

SEQ ID NO: 144496 - DNA, 25 bp, Mus musculus
agaattggcttgttttcaggatgtc

SEQ ID NO: 144497 - DNA, 25 bp, Mus musculus
agaattgggataagaccggtataaa

SEQ ID NO: 144498 - DNA, 25 bp, Mus musculus
agaattgggatatgaccggtataaa

SEQ ID NO: 144499 - DNA, 25 bp, Mus musculus
agaattggtctgagttcaaccattt

SEQ ID NO: 144500 - DNA, 25 bp, Mus musculus
agaattggtctgtgttcaaccattt

SEQ ID NO: 144501 - DNA, 25 bp, Mus musculus
agaattggtgcaatacagagctcat

SEQ ID NO: 144502 - DNA, 25 bp, Mus musculus
agaattggtgcattacagagctcat

SEQ ID NO: 144503 - DNA, 25 bp, Mus musculus
agaattgtagatacacacctccaca

SEQ ID NO: 144504 - DNA, 25 bp, Mus musculus
agaattgtagattcacacctccaca

SEQ ID NO: 144505 - DNA, 25 bp, Mus musculus
agaattgtccggaggccttgcttca

SEQ ID NO: 144506 - DNA, 25 bp, Mus musculus
agaattgtccggtggccttgcttca

SEQ ID NO: 144507 - DNA, 25 bp, Mus musculus
agaattgtctctcaggagcctgcaa

SEQ ID NO: 144508 - DNA, 25 bp, Mus musculus
agaattgtctctctgccctgtgatt

SEQ ID NO: 144509 - DNA, 25 bp, Mus musculus
agaattgtctctgaggagcctgcaa

SEQ ID NO: 144510 - DNA, 25 bp, Mus musculus
agaattgtctctgtgccctgtgatt

SEQ ID NO: 144511 - DNA, 25 bp, Mus musculus
agaattgtggcaacatcctcctgag

SEQ ID NO: 144512 - DNA, 25 bp, Mus musculus
agaattgtggcatcatcctcctgag

SEQ ID NO: 144513 - DNA, 25 bp, Mus musculus
agaattgttacaccgtatgattagt

SEQ ID NO: 144514 - DNA, 25 bp, Mus musculus
agaattgttacagcgtatgattagt

SEQ ID NO: 144515 - DNA, 25 bp, Mus musculus
agaattgttatcacgttcacgcatg

SEQ ID NO: 144516 - DNA, 25 bp, Mus musculus
agaattgttatctcgttcacgcatg

SEQ ID NO: 144517 - DNA, 25 bp, Mus musculus
agaattgttcctcggcacaaggact

SEQ ID NO: 144518 - DNA, 25 bp, Mus musculus
agaattgttcctgggcacaaggact

SEQ ID NO: 144519 - DNA, 25 bp, Mus musculus
agaattgttgctaggccacctgact

SEQ ID NO: 144520 - DNA, 25 bp, Mus musculus
agaattgttgcttggccacctgact

SEQ ID NO: 144521 - DNA, 25 bp, Mus musculus
agaattgttggacttcaccctttcg

SEQ ID NO: 144522 - DNA, 25 bp, Mus musculus
agaattgttggagttcaccctttcg

SEQ ID NO: 144523 - DNA, 25 bp, Mus musculus
agaatttacactctgcttacatcac

SEQ ID NO: 144524 - DNA, 25 bp, Mus musculus
agaatttacactgtgcttacatcac

SEQ ID NO: 144525 - DNA, 25 bp, Mus musculus
agaatttacggtcagcgtggctctt

SEQ ID NO: 144526 - DNA, 25 bp, Mus musculus
agaatttacggtgagcgtggctctt

SEQ ID NO: 144527 - DNA, 25 bp, Mus musculus
agaatttagcctcgtgggctcctag

SEQ ID NO: 144528 - DNA, 25 bp, Mus musculus
agaatttagcctggtgggctcctag

SEQ ID NO: 144529 - DNA, 25 bp, Mus musculus
agaatttagcgtccatatcttttga

SEQ ID NO: 144530 - DNA, 25 bp, Mus musculus
agaatttagcgtgcatatcttttga

SEQ ID NO: 144531 - DNA, 25 bp, Mus musculus
agaatttagtgcagtgtctttcaaa

SEQ ID NO: 144532 - DNA, 25 bp, Mus musculus
agaatttagtgctgtgtctttcaaa

SEQ ID NO: 144533 - DNA, 25 bp, Mus musculus
agaatttagtttactcacctgtggg

SEQ ID NO: 144534 - DNA, 25 bp, Mus musculus
agaatttagttttctcacctgtggg

SEQ ID NO: 144535 - DNA, 25 bp, Mus musculus
agaatttatcttaactgtacgctta

SEQ ID NO: 144536 - DNA, 25 bp, Mus musculus
agaatttatctttactgtacgctta

SEQ ID NO: 144537 - DNA, 25 bp, Mus musculus
agaatttattctctcttcttagact

SEQ ID NO: 144538 - DNA, 25 bp, Mus musculus
agaatttattctgtcttcttagact

SEQ ID NO: 144539 - DNA, 25 bp, Mus musculus
agaatttcaagacctcctgagccag

SEQ ID NO: 144540 - DNA, 25 bp, Mus musculus
agaatttcaagagctcctgagccag

SEQ ID NO: 144541 - DNA, 25 bp, Mus musculus
agaatttcaagcctccatcatgtct

SEQ ID NO: 144542 - DNA, 25 bp, Mus musculus
agaatttcaagcgtccatcatgtct

SEQ ID NO: 144543 - DNA, 25 bp, Mus musculus
agaatttcaagtcgaccgatacatt

SEQ ID NO: 144544 - DNA, 25 bp, Mus musculus
agaatttcaagtggaccgatacatt

SEQ ID NO: 144545 - DNA, 25 bp, Mus musculus
agaatttcacatataagccgggcat

SEQ ID NO: 144546 - DNA, 25 bp, Mus musculus
agaatttcacatttaagccgggcat

SEQ ID NO: 144547 - DNA, 25 bp, Mus musculus
agaatttcacttatctccatccaaa

SEQ ID NO: 144548 - DNA, 25 bp, Mus musculus
agaatttcacttttctccatccaaa

SEQ ID NO: 144549 - DNA, 25 bp, Mus musculus
agaatttcaggcaggctccatcaca

SEQ ID NO: 144550 - DNA, 25 bp, Mus musculus
agaatttcaggctggctccatcaca

SEQ ID NO: 144551 - DNA, 25 bp, Mus musculus
agaatttcatagactttgaagcaac

SEQ ID NO: 144552 - DNA, 25 bp, Mus musculus
agaatttcatagtctttgaagcaac

SEQ ID NO: 144553 - DNA, 25 bp, Mus musculus
agaatttcatcacggcttcctcatc

SEQ ID NO: 144554 - DNA, 25 bp, Mus musculus
agaatttcatcagggcttcctcatc

SEQ ID NO: 144555 - DNA, 25 bp, Mus musculus
agaatttccatgactgcaaggcatg

SEQ ID NO: 144556 - DNA, 25 bp, Mus musculus
agaatttccatgtctgcaaggcatg

SEQ ID NO: 144557 - DNA, 25 bp, Mus musculus
agaatttcccagacaggtagccagg

SEQ ID NO: 144558 - DNA, 25 bp, Mus musculus
agaatttcccagtcaggtagccagg

SEQ ID NO: 144559 - DNA, 25 bp, Mus musculus
agaatttcccgcaatctctatagat

SEQ ID NO: 144560 - DNA, 25 bp, Mus musculus
agaatttcccgctatctctatagat

SEQ ID NO: 144561 - DNA, 25 bp, Mus musculus
agaatttcccttaatgtccagtcag

SEQ ID NO: 144562 - DNA, 25 bp, Mus musculus
agaatttccctttatgtccagtcag

SEQ ID NO: 144563 - DNA, 25 bp, Mus musculus
agaatttcctagacgaaagcctttg

SEQ ID NO: 144564 - DNA, 25 bp, Mus musculus
agaatttcctagtcgaaagcctttg

SEQ ID NO: 144565 - DNA, 25 bp, Mus musculus
agaatttcctcacgacttccacatc

SEQ ID NO: 144566 - DNA, 25 bp, Mus musculus
agaatttcctcaggacttccacatc

SEQ ID NO: 144567 - DNA, 25 bp, Mus musculus
agaatttccttccatcctgaggctg

SEQ ID NO: 144568 - DNA, 25 bp, Mus musculus
agaatttccttccttgcctgtcact

SEQ ID NO: 144569 - DNA, 25 bp, Mus musculus
agaatttccttcgatcctgaggctg

SEQ ID NO: 144570 - DNA, 25 bp, Mus musculus
agaatttccttcgttgcctgtcact

SEQ ID NO: 144571 - DNA, 25 bp, Mus musculus
agaatttcgggacagtagccttcct

SEQ ID NO: 144572 - DNA, 25 bp, Mus musculus
agaatttcgggagagtagccttcct

SEQ ID NO: 144573 - DNA, 25 bp, Mus musculus
agaatttcggtactgcaggccctgg

SEQ ID NO: 144574 - DNA, 25 bp, Mus musculus
agaatttcggtagtgcaggccctgg

SEQ ID NO: 144575 - DNA, 25 bp, Mus musculus
agaatttctaccagtttttgatgag

SEQ ID NO: 144576 - DNA, 25 bp, Mus musculus
agaatttctacctgtttttgatgag

SEQ ID NO: 144577 - DNA, 25 bp, Mus musculus
agaatttctgaccagattccctctg

SEQ ID NO: 144578 - DNA, 25 bp, Mus musculus
agaatttctgacgagattccctctg

SEQ ID NO: 144579 - DNA, 25 bp, Mus musculus
agaatttctgttacccagctttggg

SEQ ID NO: 144580 - DNA, 25 bp, Mus musculus
agaatttctgtttcccagctttggg

SEQ ID NO: 144581 - DNA, 25 bp, Mus musculus
agaatttgagatcacactgagcaac

SEQ ID NO: 144582 - DNA, 25 bp, Mus musculus
agaatttgagatgacactgagcaac

SEQ ID NO: 144583 - DNA, 25 bp, Mus musculus
agaatttgagtgcacatctgtggaa

SEQ ID NO: 144584 - DNA, 25 bp, Mus musculus
agaatttgagtggacatctgtggaa

SEQ ID NO: 144585 - DNA, 25 bp, Mus musculus
agaatttgattcagccaccatactc

SEQ ID NO: 144586 - DNA, 25 bp, Mus musculus
agaatttgattctgccaccatactc

SEQ ID NO: 144587 - DNA, 25 bp, Mus musculus
agaatttgcctcatatgtaaacagt

SEQ ID NO: 144588 - DNA, 25 bp, Mus musculus
agaatttgcctcttatgtaaacagt

SEQ ID NO: 144589 - DNA, 25 bp, Mus musculus
agaatttgctccacatagcacctcc

SEQ ID NO: 144590 - DNA, 25 bp, Mus musculus
agaatttgctcctcatagcacctcc

SEQ ID NO: 144591 - DNA, 25 bp, Mus musculus
agaatttgctgacgccaaccccaaa

SEQ ID NO: 144592 - DNA, 25 bp, Mus musculus
agaatttgctgaggccaaccccaaa

SEQ ID NO: 144593 - DNA, 25 bp, Mus musculus
agaatttggcttctgctccaagctc

SEQ ID NO: 144594 - DNA, 25 bp, Mus musculus
agaatttggcttgtgctccaagctc

SEQ ID NO: 144595 - DNA, 25 bp, Mus musculus
agaatttggtctcttgactctctgc

SEQ ID NO: 144596 - DNA, 25 bp, Mus musculus
agaatttggtctgttgactctctgc

SEQ ID NO: 144597 - DNA, 25 bp, Mus musculus
agaatttggtgtagcctgtggtctt

SEQ ID NO: 144598 - DNA, 25 bp, Mus musculus
agaatttggtgttgcctgtggtctt

SEQ ID NO: 144599 - DNA, 25 bp, Mus musculus
agaatttggtttcgtctggctgctt

SEQ ID NO: 144600 - DNA, 25 bp, Mus musculus
agaatttggtttggtctggctgctt

SEQ ID NO: 144601 - DNA, 25 bp, Mus musculus
agaatttgtgtgatcctgtggcaca

SEQ ID NO: 144602 - DNA, 25 bp, Mus musculus
agaatttgtgtgttcctgtggcaca

SEQ ID NO: 144603 - DNA, 25 bp, Mus musculus
agaattttaagaaccggcggctctc

SEQ ID NO: 144604 - DNA, 25 bp, Mus musculus
agaattttaagatccggcggctctc

SEQ ID NO: 144605 - DNA, 25 bp, Mus musculus
agaattttacacattctctgcccca

SEQ ID NO: 144606 - DNA, 25 bp, Mus musculus
agaattttacactttctctgcccca

SEQ ID NO: 144607 - DNA, 25 bp, Mus musculus
agaattttacagagccgccagccca

SEQ ID NO: 144608 - DNA, 25 bp, Mus musculus
agaattttacagtgccgccagccca

SEQ ID NO: 144609 - DNA, 25 bp, Mus musculus
agaattttagctctttccctcaccg

SEQ ID NO: 144610 - DNA, 25 bp, Mus musculus
agaattttagctgtttccctcaccg

SEQ ID NO: 144611 - DNA, 25 bp, Mus musculus
agaattttcacacggagtctctctc

SEQ ID NO: 144612 - DNA, 25 bp, Mus musculus
agaattttcacagggagtctctctc

SEQ ID NO: 144613 - DNA, 25 bp, Mus musculus
agaattttcataacttccaggatta

SEQ ID NO: 144614 - DNA, 25 bp, Mus musculus
agaattttcatatcttccaggatta

SEQ ID NO: 144615 - DNA, 25 bp, Mus musculus
agaattttccctcggacagtgctag

SEQ ID NO: 144616 - DNA, 25 bp, Mus musculus
agaattttccctgggacagtgctag

SEQ ID NO: 144617 - DNA, 25 bp, Mus musculus
agaattttccttcgtgtctcccatc

SEQ ID NO: 144618 - DNA, 25 bp, Mus musculus
agaattttccttggtgtctcccatc

SEQ ID NO: 144619 - DNA, 25 bp, Mus musculus
agaattttgattcctaggtggccag

SEQ ID NO: 144620 - DNA, 25 bp, Mus musculus
agaattttgattctgttagcttaac

SEQ ID NO: 144621 - DNA, 25 bp, Mus musculus
agaattttgattgctaggtggccag

SEQ ID NO: 144622 - DNA, 25 bp, Mus musculus
agaattttgattgtgttagcttaac

SEQ ID NO: 144623 - DNA, 25 bp, Mus musculus
agaattttgcttctctatttagctt

SEQ ID NO: 144624 - DNA, 25 bp, Mus musculus
agaattttgcttgtctatttagctt

SEQ ID NO: 144625 - DNA, 25 bp, Mus musculus
agaattttggtgctaccctgagctg

SEQ ID NO: 144626 - DNA, 25 bp, Mus musculus
agaattttggtggtaccctgagctg

SEQ ID NO: 144627 - DNA, 25 bp, Mus musculus
agaattttgtaaaccccgtctcaag

SEQ ID NO: 144628 - DNA, 25 bp, Mus musculus
agaattttgtaatccccgtctcaag

SEQ ID NO: 144629 - DNA, 25 bp, Mus musculus
agaatttttataacccgctgctgcc

SEQ ID NO: 144630 - DNA, 25 bp, Mus musculus
agaatttttatatcccgctgctgcc

SEQ ID NO: 144631 - DNA, 25 bp, Mus musculus
agaatttttatcaccctccctagca

SEQ ID NO: 144632 - DNA, 25 bp, Mus musculus
agaatttttatctccctccctagca

SEQ ID NO: 144633 - DNA, 25 bp, Mus musculus
agaatttttgatccctgctttgagt

SEQ ID NO: 144634 - DNA, 25 bp, Mus musculus
agaatttttgatgcctgctttgagt

SEQ ID NO: 144635 - DNA, 25 bp, Mus musculus
agaatttttggcaaggagcataagc

SEQ ID NO: 144636 - DNA, 25 bp, Mus musculus
agaatttttggctaggagcataagc

SEQ ID NO: 144637 - DNA, 25 bp, Mus musculus
agaattttttctagtgctcaacaga

SEQ ID NO: 144638 - DNA, 25 bp, Mus musculus
agaattttttctccgcatttactcc

SEQ ID NO: 144639 - DNA, 25 bp, Mus musculus
agaattttttctgcgcatttactcc

SEQ ID NO: 144640 - DNA, 25 bp, Mus musculus
agaattttttcttgtgctcaacaga

SEQ ID NO: 144641 - DNA, 25 bp, Mus musculus
agacaaaaatcactatgcctccctg

SEQ ID NO: 144642 - DNA, 25 bp, Mus musculus
agacaaaaatcagtatgcctccctg

SEQ ID NO: 144643 - DNA, 25 bp, Mus musculus
agacaaaacacccacgcacatatgt

SEQ ID NO: 144644 - DNA, 25 bp, Mus musculus
agacaaaacaccgacgcacatatgt

SEQ ID NO: 144645 - DNA, 25 bp, Mus musculus
agacaaaacatcagctctcaggagg

SEQ ID NO: 144646 - DNA, 25 bp, Mus musculus
agacaaaacatctgctctcaggagg

SEQ ID NO: 144647 - DNA, 25 bp, Mus musculus
agacaaaagcttacatgcaccaccc

SEQ ID NO: 144648 - DNA, 25 bp, Mus musculus
agacaaaagctttcatgcaccaccc

SEQ ID NO: 144649 - DNA, 25 bp, Mus musculus
agacaaaatcttactgggctttgct

SEQ ID NO: 144650 - DNA, 25 bp, Mus musculus
agacaaaatctttctgggctttgct

SEQ ID NO: 144651 - DNA, 25 bp, Mus musculus
agacaaaatttgaagctgtgacgaa

SEQ ID NO: 144652 - DNA, 25 bp, Mus musculus
agacaaaatttgtagctgtgacgaa

SEQ ID NO: 144653 - DNA, 25 bp, Mus musculus
agacaaacacttaaccggcagtatg

SEQ ID NO: 144654 - DNA, 25 bp, Mus musculus
agacaaacacttcgcattggcccat

SEQ ID NO: 144655 - DNA, 25 bp, Mus musculus
agacaaacacttggcattggcccat

SEQ ID NO: 144656 - DNA, 25 bp, Mus musculus
agacaaacactttaccggcagtatg

SEQ ID NO: 144657 - DNA, 25 bp, Mus musculus
agacaaacagatcgcttgctcctca

SEQ ID NO: 144658 - DNA, 25 bp, Mus musculus
agacaaacagatggcttgctcctca

SEQ ID NO: 144659 - DNA, 25 bp, Mus musculus
agacaaaccctgcagacagccacga

SEQ ID NO: 144660 - DNA, 25 bp, Mus musculus
agacaaaccctggagacagccacga

SEQ ID NO: 144661 - DNA, 25 bp, Mus musculus
agacaaacctctaatggaagtgtga

SEQ ID NO: 144662 - DNA, 25 bp, Mus musculus
agacaaacctcttatggaagtgtga

SEQ ID NO: 144663 - DNA, 25 bp, Mus musculus
agacaaacggttatccagcttctca

SEQ ID NO: 144664 - DNA, 25 bp, Mus musculus
agacaaacggttttccagcttctca

SEQ ID NO: 144665 - DNA, 25 bp, Mus musculus
agacaaactaaaaatggcatgctaa

SEQ ID NO: 144666 - DNA, 25 bp, Mus musculus
agacaaactaaatatggcatgctaa

SEQ ID NO: 144667 - DNA, 25 bp, Mus musculus
agacaaactcacaggtcttcaccat

SEQ ID NO: 144668 - DNA, 25 bp, Mus musculus
agacaaactcactggtcttcaccat

SEQ ID NO: 144669 - DNA, 25 bp, Mus musculus
agacaaactgacaaaatcctcaaaa

SEQ ID NO: 144670 - DNA, 25 bp, Mus musculus
agacaaactgactaaatcctcaaaa

SEQ ID NO: 144671 - DNA, 25 bp, Mus musculus
agacaaacttaccatgtccctgtga

SEQ ID NO: 144672 - DNA, 25 bp, Mus musculus
agacaaacttacgatgtccctgtga

SEQ ID NO: 144673 - DNA, 25 bp, Mus musculus
agacaaacttcgcatgatctctctt

SEQ ID NO: 144674 - DNA, 25 bp, Mus musculus
agacaaacttcggatgatctctctt

SEQ ID NO: 144675 - DNA, 25 bp, Mus musculus
agacaaacttggctgtgttttgagc

SEQ ID NO: 144676 - DNA, 25 bp, Mus musculus
agacaaacttgggtgtgttttgagc

SEQ ID NO: 144677 - DNA, 25 bp, Mus musculus
agacaaactttgcagtaagcggaca

SEQ ID NO: 144678 - DNA, 25 bp, Mus musculus
agacaaactttggagtaagcggaca

SEQ ID NO: 144679 - DNA, 25 bp, Mus musculus
agacaaagagcaacttagaagtatt

SEQ ID NO: 144680 - DNA, 25 bp, Mus musculus
agacaaagagcatcttagaagtatt

SEQ ID NO: 144681 - DNA, 25 bp, Mus musculus
agacaaagagcccagcctaaccatg

SEQ ID NO: 144682 - DNA, 25 bp, Mus musculus
agacaaagagccgagcctaaccatg

SEQ ID NO: 144683 - DNA, 25 bp, Mus musculus
agacaaagccccattgtgcactgct

SEQ ID NO: 144684 - DNA, 25 bp, Mus musculus
agacaaagcccctttgtgcactgct

SEQ ID NO: 144685 - DNA, 25 bp, Mus musculus
agacaaagctctccctacatagaag

SEQ ID NO: 144686 - DNA, 25 bp, Mus musculus
agacaaagctctgcctacatagaag

SEQ ID NO: 144687 - DNA, 25 bp, Mus musculus
agacaaagcttgagcccaaatgtgg

SEQ ID NO: 144688 - DNA, 25 bp, Mus musculus
agacaaagcttgtgcccaaatgtgg

SEQ ID NO: 144689 - DNA, 25 bp, Mus musculus
agacaaaggcctagttctcagagcc

SEQ ID NO: 144690 - DNA, 25 bp, Mus musculus
agacaaaggccttgttctcagagcc

SEQ ID NO: 144691 - DNA, 25 bp, Mus musculus
agacaaaggttccatcttatccctc

SEQ ID NO: 144692 - DNA, 25 bp, Mus musculus
agacaaaggttcgatcttatccctc

SEQ ID NO: 144693 - DNA, 25 bp, Mus musculus
agacaaagtacgctatttcctcatg

SEQ ID NO: 144694 - DNA, 25 bp, Mus musculus
agacaaagtacggtatttcctcatg

SEQ ID NO: 144695 - DNA, 25 bp, Mus musculus
agacaaagtcttcagtgccctcaaa

SEQ ID NO: 144696 - DNA, 25 bp, Mus musculus
agacaaagtcttgagtgccctcaaa

SEQ ID NO: 144697 - DNA, 25 bp, Mus musculus
agacaaagttgactccaatgacagc

SEQ ID NO: 144698 - DNA, 25 bp, Mus musculus
agacaaagttgagtccaatgacagc

SEQ ID NO: 144699 - DNA, 25 bp, Mus musculus
agacaaataaaacgcagccctgccc

SEQ ID NO: 144700 - DNA, 25 bp, Mus musculus
agacaaataaaaggcagccctgccc

SEQ ID NO: 144701 - DNA, 25 bp, Mus musculus
agacaaatccctatacttctctttg

SEQ ID NO: 144702 - DNA, 25 bp, Mus musculus
agacaaatccctttacttctctttg

SEQ ID NO: 144703 - DNA, 25 bp, Mus musculus
agacaaatcggcaatctacagattg

SEQ ID NO: 144704 - DNA, 25 bp, Mus musculus
agacaaatcggctatctacagattg

SEQ ID NO: 144705 - DNA, 25 bp, Mus musculus
agacaaatctccctggatgtccaca

SEQ ID NO: 144706 - DNA, 25 bp, Mus musculus
agacaaatctccgtggatgtccaca

SEQ ID NO: 144707 - DNA, 25 bp, Mus musculus
agacaaatgacaagtgcttcctctt

SEQ ID NO: 144708 - DNA, 25 bp, Mus musculus
agacaaatgacatgtgcttcctctt

SEQ ID NO: 144709 - DNA, 25 bp, Mus musculus
agacaaatgggcactccctagacta

SEQ ID NO: 144710 - DNA, 25 bp, Mus musculus
agacaaatgggctctccctagacta

SEQ ID NO: 144711 - DNA, 25 bp, Mus musculus
agacaacaaggtcgcttcggtgtcc

SEQ ID NO: 144712 - DNA, 25 bp, Mus musculus
agacaacaaggtggcttcggtgtcc

SEQ ID NO: 144713 - DNA, 25 bp, Mus musculus
agacaacacagaagatcggctccct

SEQ ID NO: 144714 - DNA, 25 bp, Mus musculus
agacaacacagatgatcggctccct

SEQ ID NO: 144715 - DNA, 25 bp, Mus musculus
agacaacacattcatgccgaggagt

SEQ ID NO: 144716 - DNA, 25 bp, Mus musculus
agacaacacattgatgccgaggagt

SEQ ID NO: 144717 - DNA, 25 bp, Mus musculus
agacaacactgtcgtcttccctgtt

SEQ ID NO: 144718 - DNA, 25 bp, Mus musculus
agacaacactgtggtcttccctgtt

SEQ ID NO: 144719 - DNA, 25 bp, Mus musculus
agacaacacttactcaatcagatga

SEQ ID NO: 144720 - DNA, 25 bp, Mus musculus
agacaacacttagtcaatcagatga

SEQ ID NO: 144721 - DNA, 25 bp, Mus musculus
agacaacagcaaattctactacatt

SEQ ID NO: 144722 - DNA, 25 bp, Mus musculus
agacaacagcaatttctactacatt

SEQ ID NO: 144723 - DNA, 25 bp, Mus musculus
agacaacaggttactgcacactcgt

SEQ ID NO: 144724 - DNA, 25 bp, Mus musculus
agacaacaggtttctgcacactcgt

SEQ ID NO: 144725 - DNA, 25 bp, Mus musculus
agacaaccaagccagcagcatgcca

SEQ ID NO: 144726 - DNA, 25 bp, Mus musculus
agacaaccaagcgagcagcatgcca

SEQ ID NO: 144727 - DNA, 25 bp, Mus musculus
agacaaccagaactgcctgctcttg

SEQ ID NO: 144728 - DNA, 25 bp, Mus musculus
agacaaccagaagtgcctgctcttg

SEQ ID NO: 144729 - DNA, 25 bp, Mus musculus
agacaaccagacaagagcaagtgct

SEQ ID NO: 144730 - DNA, 25 bp, Mus musculus
agacaaccagactagagcaagtgct

SEQ ID NO: 144731 - DNA, 25 bp, Mus musculus
agacaaccatgccaggtgcaggcag

SEQ ID NO: 144732 - DNA, 25 bp, Mus musculus
agacaaccatgcgaggtgcaggcag

SEQ ID NO: 144733 - DNA, 25 bp, Mus musculus
agacaacccaaccaagactacatag

SEQ ID NO: 144734 - DNA, 25 bp, Mus musculus
agacaacccaacgaagactacatag

SEQ ID NO: 144735 - DNA, 25 bp, Mus musculus
agacaaccctggaagcacgcgctta

SEQ ID NO: 144736 - DNA, 25 bp, Mus musculus
agacaaccctggtagcacgcgctta

SEQ ID NO: 144737 - DNA, 25 bp, Mus musculus
agacaaccctgtcctgtaagcatgt

SEQ ID NO: 144738 - DNA, 25 bp, Mus musculus
agacaaccctgtgctgtaagcatgt

SEQ ID NO: 144739 - DNA, 25 bp, Mus musculus
agacaacccttgacaagcttgtgtt

SEQ ID NO: 144740 - DNA, 25 bp, Mus musculus
agacaacccttgtcaagcttgtgtt

SEQ ID NO: 144741 - DNA, 25 bp, Mus musculus
agacaaccgactactggcctgtgcg

SEQ ID NO: 144742 - DNA, 25 bp, Mus musculus
agacaaccgacttctggcctgtgcg

SEQ ID NO: 144743 - DNA, 25 bp, Mus musculus
agacaaccggccagtgagttttcaa

SEQ ID NO: 144744 - DNA, 25 bp, Mus musculus
agacaaccggcctgtgagttttcaa

SEQ ID NO: 144745 - DNA, 25 bp, Mus musculus
agacaaccgggactttgccattctg

SEQ ID NO: 144746 - DNA, 25 bp, Mus musculus
agacaaccgggagtttgccattctg

SEQ ID NO: 144747 - DNA, 25 bp, Mus musculus
agacaacctagtcatagctggccct

SEQ ID NO: 144748 - DNA, 25 bp, Mus musculus
agacaacctagtgatagctggccct

SEQ ID NO: 144749 - DNA, 25 bp, Mus musculus
agacaacctggtccgccctttcatg

SEQ ID NO: 144750 - DNA, 25 bp, Mus musculus
agacaacctggtgcgccctttcatg

SEQ ID NO: 144751 - DNA, 25 bp, Mus musculus
agacaacctgtaaactttctaatag

SEQ ID NO: 144752 - DNA, 25 bp, Mus musculus
agacaacctgtatactttctaatag

SEQ ID NO: 144753 - DNA, 25 bp, Mus musculus
agacaacctgttcgtcacctccatg

SEQ ID NO: 144754 - DNA, 25 bp, Mus musculus
agacaacctgttggtcacctccatg

SEQ ID NO: 144755 - DNA, 25 bp, Mus musculus
agacaaccttttatcagtgaccatg

SEQ ID NO: 144756 - DNA, 25 bp, Mus musculus
agacaaccttttttcagtgaccatg

SEQ ID NO: 144757 - DNA, 25 bp, Mus musculus
agacaacgagtgcttctgggtttct

SEQ ID NO: 144758 - DNA, 25 bp, Mus musculus
agacaacgagtggttctgggtttct

SEQ ID NO: 144759 - DNA, 25 bp, Mus musculus
agacaacgctcaacacctatagaaa

SEQ ID NO: 144760 - DNA, 25 bp, Mus musculus
agacaacgctcatcacctatagaaa

SEQ ID NO: 144761 - DNA, 25 bp, Mus musculus
agacaacgtgggagactggctccgc

SEQ ID NO: 144762 - DNA, 25 bp, Mus musculus
agacaacgtgggtgactggctccgc

SEQ ID NO: 144763 - DNA, 25 bp, Mus musculus
agacaactaaaccacaccaagaaag

SEQ ID NO: 144764 - DNA, 25 bp, Mus musculus
agacaactaaacgacaccaagaaag

SEQ ID NO: 144765 - DNA, 25 bp, Mus musculus
agacaactcacgcagtaggttctcc

SEQ ID NO: 144766 - DNA, 25 bp, Mus musculus
agacaactcacggagtaggttctcc

SEQ ID NO: 144767 - DNA, 25 bp, Mus musculus
agacaactctctagcatcttctaac

SEQ ID NO: 144768 - DNA, 25 bp, Mus musculus
agacaactctcttgcatcttctaac

SEQ ID NO: 144769 - DNA, 25 bp, Mus musculus
agacaactcttccagtcacttcttt

SEQ ID NO: 144770 - DNA, 25 bp, Mus musculus
agacaactcttcgagtcacttcttt

SEQ ID NO: 144771 - DNA, 25 bp, Mus musculus
agacaactgctcaatgatactcatt

SEQ ID NO: 144772 - DNA, 25 bp, Mus musculus
agacaactgctctatgatactcatt

SEQ ID NO: 144773 - DNA, 25 bp, Mus musculus
agacaactgtcaccaggaggctgct

SEQ ID NO: 144774 - DNA, 25 bp, Mus musculus
agacaactgtcaccattcactggct

SEQ ID NO: 144775 - DNA, 25 bp, Mus musculus
agacaactgtcagcaggaggctgct

SEQ ID NO: 144776 - DNA, 25 bp, Mus musculus
agacaactgtcagcattcactggct

SEQ ID NO: 144777 - DNA, 25 bp, Mus musculus
agacaacttcacactcctgggcaag

SEQ ID NO: 144778 - DNA, 25 bp, Mus musculus
agacaacttcactctcctgggcaag

SEQ ID NO: 144779 - DNA, 25 bp, Mus musculus
agacaacttctcagcctaacggaaa

SEQ ID NO: 144780 - DNA, 25 bp, Mus musculus
agacaacttctctgcctaacggaaa

SEQ ID NO: 144781 - DNA, 25 bp, Mus musculus
agacaactttccaagaggcctcagt

SEQ ID NO: 144782 - DNA, 25 bp, Mus musculus
agacaactttcctagaggcctcagt

SEQ ID NO: 144783 - DNA, 25 bp, Mus musculus
agacaagaacacacacgcacacatg

SEQ ID NO: 144784 - DNA, 25 bp, Mus musculus
agacaagaacactcacgcacacatg

SEQ ID NO: 144785 - DNA, 25 bp, Mus musculus
agacaagaactacatctctaggcaa

SEQ ID NO: 144786 - DNA, 25 bp, Mus musculus
agacaagaactagatctctaggcaa

SEQ ID NO: 144787 - DNA, 25 bp, Mus musculus
agacaagaagagcttcattcccgtg

SEQ ID NO: 144788 - DNA, 25 bp, Mus musculus
agacaagaagaggttcattcccgtg

SEQ ID NO: 144789 - DNA, 25 bp, Mus musculus
agacaagaatggcttacgggccaag

SEQ ID NO: 144790 - DNA, 25 bp, Mus musculus
agacaagaatgggttacgggccaag

SEQ ID NO: 144791 - DNA, 25 bp, Mus musculus
agacaagaattgaactcccctgacc

SEQ ID NO: 144792 - DNA, 25 bp, Mus musculus
agacaagaattgtactcccctgacc

SEQ ID NO: 144793 - DNA, 25 bp, Mus musculus
agacaagacggacgctttcaagcat

SEQ ID NO: 144794 - DNA, 25 bp, Mus musculus
agacaagacggaggctttcaagcat

SEQ ID NO: 144795 - DNA, 25 bp, Mus musculus
agacaagaggcccaggagccctcag

SEQ ID NO: 144796 - DNA, 25 bp, Mus musculus
agacaagaggccgaggagccctcag

SEQ ID NO: 144797 - DNA, 25 bp, Mus musculus
agacaagagtatcctggtcagcccc

SEQ ID NO: 144798 - DNA, 25 bp, Mus musculus
agacaagagtatgctggtcagcccc

SEQ ID NO: 144799 - DNA, 25 bp, Mus musculus
agacaagatcacacaaggtcatcct

SEQ ID NO: 144800 - DNA, 25 bp, Mus musculus
agacaagatcactcaaggtcatcct

SEQ ID NO: 144801 - DNA, 25 bp, Mus musculus
agacaagatgacacacacaccaggt

SEQ ID NO: 144802 - DNA, 25 bp, Mus musculus
agacaagatgactcacacaccaggt

SEQ ID NO: 144803 - DNA, 25 bp, Mus musculus
agacaagattgtactcagcgccagc

SEQ ID NO: 144804 - DNA, 25 bp, Mus musculus
agacaagattgttctcagcgccagc

SEQ ID NO: 144805 - DNA, 25 bp, Mus musculus
agacaagcacacacctgcaaagcag

SEQ ID NO: 144806 - DNA, 25 bp, Mus musculus
agacaagcacactcctgcaaagcag

SEQ ID NO: 144807 - DNA, 25 bp, Mus musculus
agacaagcaccccatccatgctgtg

SEQ ID NO: 144808 - DNA, 25 bp, Mus musculus
agacaagcacccgatccatgctgtg

SEQ ID NO: 144809 - DNA, 25 bp, Mus musculus
agacaagcagccacgaggcagggat

SEQ ID NO: 144810 - DNA, 25 bp, Mus musculus
agacaagcagcctcgaggcagggat

SEQ ID NO: 144811 - DNA, 25 bp, Mus musculus
agacaagcatgtcacctcgtcttgc

SEQ ID NO: 144812 - DNA, 25 bp, Mus musculus
agacaagcatgtgacctcgtcttgc

SEQ ID NO: 144813 - DNA, 25 bp, Mus musculus
agacaagccaagctggcctcagtga

SEQ ID NO: 144814 - DNA, 25 bp, Mus musculus
agacaagccaaggtggcctcagtga

SEQ ID NO: 144815 - DNA, 25 bp, Mus musculus
agacaagccagcctttggccaacct

SEQ ID NO: 144816 - DNA, 25 bp, Mus musculus
agacaagccagcgtttggccaacct

SEQ ID NO: 144817 - DNA, 25 bp, Mus musculus
agacaagccatgagcaagcttcctc

SEQ ID NO: 144818 - DNA, 25 bp, Mus musculus
agacaagccatgtgcaagcttcctc

SEQ ID NO: 144819 - DNA, 25 bp, Mus musculus
agacaagcccgaatcctgagtcaag

SEQ ID NO: 144820 - DNA, 25 bp, Mus musculus
agacaagcccgattcctgagtcaag

SEQ ID NO: 144821 - DNA, 25 bp, Mus musculus
agacaagcgcatcagaactctcgat

SEQ ID NO: 144822 - DNA, 25 bp, Mus musculus
agacaagcgcatgagaactctcgat

SEQ ID NO: 144823 - DNA, 25 bp, Mus musculus
agacaagcgtacatccaagttgtgg

SEQ ID NO: 144824 - DNA, 25 bp, Mus musculus
agacaagcgtacttccaagttgtgg

SEQ ID NO: 144825 - DNA, 25 bp, Mus musculus
agacaagcgtcaatcactcgggtga

SEQ ID NO: 144826 - DNA, 25 bp, Mus musculus
agacaagcgtcattcactcgggtga

SEQ ID NO: 144827 - DNA, 25 bp, Mus musculus
agacaagcgtgcaacatctggtggg

SEQ ID NO: 144828 - DNA, 25 bp, Mus musculus
agacaagcgtgctacatctggtggg

SEQ ID NO: 144829 - DNA, 25 bp, Mus musculus
agacaagctgccatgttactaccct

SEQ ID NO: 144830 - DNA, 25 bp, Mus musculus
agacaagctgccttgttactaccct

SEQ ID NO: 144831 - DNA, 25 bp, Mus musculus
agacaagcttccatggagctggtca

SEQ ID NO: 144832 - DNA, 25 bp, Mus musculus
agacaagcttccttggagctggtca

SEQ ID NO: 144833 - DNA, 25 bp, Mus musculus
agacaagctttcactatgtaatttg

SEQ ID NO: 144834 - DNA, 25 bp, Mus musculus
agacaagctttctctatgtaatttg

SEQ ID NO: 144835 - DNA, 25 bp, Mus musculus
agacaaggacccaggagcctgattc

SEQ ID NO: 144836 - DNA, 25 bp, Mus musculus
agacaaggacccatctactgaacct

SEQ ID NO: 144837 - DNA, 25 bp, Mus musculus
agacaaggaccctggagcctgattc

SEQ ID NO: 144838 - DNA, 25 bp, Mus musculus
agacaaggacccttctactgaacct

SEQ ID NO: 144839 - DNA, 25 bp, Mus musculus
agacaaggaggcacttaccgtcctg

SEQ ID NO: 144840 - DNA, 25 bp, Mus musculus
agacaaggaggctcttaccgtcctg

SEQ ID NO: 144841 - DNA, 25 bp, Mus musculus
agacaaggcagtaatgggaggtaca

SEQ ID NO: 144842 - DNA, 25 bp, Mus musculus
agacaaggcagttatgggaggtaca

SEQ ID NO: 144843 - DNA, 25 bp, Mus musculus
agacaaggccatccccagtggatct

SEQ ID NO: 144844 - DNA, 25 bp, Mus musculus
agacaaggccatgcccagtggatct

SEQ ID NO: 144845 - DNA, 25 bp, Mus musculus
agacaaggccgaactaatcctgccc

SEQ ID NO: 144846 - DNA, 25 bp, Mus musculus
agacaaggccgatctaatcctgccc

SEQ ID NO: 144847 - DNA, 25 bp, Mus musculus
agacaaggccttccagtgtggacgc

SEQ ID NO: 144848 - DNA, 25 bp, Mus musculus
agacaaggccttgcagtgtggacgc

SEQ ID NO: 144849 - DNA, 25 bp, Mus musculus
agacaaggctacacatagggaaacc

SEQ ID NO: 144850 - DNA, 25 bp, Mus musculus
agacaaggctactcatagggaaacc

SEQ ID NO: 144851 - DNA, 25 bp, Mus musculus
agacaaggctctaactgcaccaggg

SEQ ID NO: 144852 - DNA, 25 bp, Mus musculus
agacaaggctctacagtgttctttg

SEQ ID NO: 144853 - DNA, 25 bp, Mus musculus
agacaaggctcttactgcaccaggg

SEQ ID NO: 144854 - DNA, 25 bp, Mus musculus
agacaaggctcttcagtgttctttg

SEQ ID NO: 144855 - DNA, 25 bp, Mus musculus
agacaaggctgaacacataagggca

SEQ ID NO: 144856 - DNA, 25 bp, Mus musculus
agacaaggctgatcacataagggca

SEQ ID NO: 144857 - DNA, 25 bp, Mus musculus
agacaagggctgcatatgtaatcca

SEQ ID NO: 144858 - DNA, 25 bp, Mus musculus
agacaagggctggatatgtaatcca

SEQ ID NO: 144859 - DNA, 25 bp, Mus musculus
agacaaggtcgtctgctttgtgtcc

SEQ ID NO: 144860 - DNA, 25 bp, Mus musculus
agacaaggtcgtgtgctttgtgtcc

SEQ ID NO: 144861 - DNA, 25 bp, Mus musculus
agacaagtagctagggatcatattt

SEQ ID NO: 144862 - DNA, 25 bp, Mus musculus
agacaagtagcttgggatcatattt

SEQ ID NO: 144863 - DNA, 25 bp, Mus musculus
agacaagtcacaaaaccgtttcaag

SEQ ID NO: 144864 - DNA, 25 bp, Mus musculus
agacaagtcacataaccgtttcaag

SEQ ID NO: 144865 - DNA, 25 bp, Mus musculus
agacaagtcacccagtgccaaggat

SEQ ID NO: 144866 - DNA, 25 bp, Mus musculus
agacaagtcaccgagtgccaaggat

SEQ ID NO: 144867 - DNA, 25 bp, Mus musculus
agacaagtcatcaaacacctggata

SEQ ID NO: 144868 - DNA, 25 bp, Mus musculus
agacaagtcatctaacacctggata

SEQ ID NO: 144869 - DNA, 25 bp, Mus musculus
agacaagtcctgagccaaggccatg

SEQ ID NO: 144870 - DNA, 25 bp, Mus musculus
agacaagtcctgtgccaaggccatg

SEQ ID NO: 144871 - DNA, 25 bp, Mus musculus
agacaagtctgccaacaactgatca

SEQ ID NO: 144872 - DNA, 25 bp, Mus musculus
agacaagtctgcgaacaactgatca

SEQ ID NO: 144873 - DNA, 25 bp, Mus musculus
agacaagtctgtcaaaccgaatgaa

SEQ ID NO: 144874 - DNA, 25 bp, Mus musculus
agacaagtctgtgaaaccgaatgaa

SEQ ID NO: 144875 - DNA, 25 bp, Mus musculus
agacaagtgccccatcacatatgag

SEQ ID NO: 144876 - DNA, 25 bp, Mus musculus
agacaagtgcccgatcacatatgag

SEQ ID NO: 144877 - DNA, 25 bp, Mus musculus
agacaagtggccacatactgcaacc

SEQ ID NO: 144878 - DNA, 25 bp, Mus musculus
agacaagtggcctcatactgcaacc

SEQ ID NO: 144879 - DNA, 25 bp, Mus musculus
agacaagtgtatctctgatcatctc

SEQ ID NO: 144880 - DNA, 25 bp, Mus musculus
agacaagtgtatgtctgatcatctc

SEQ ID NO: 144881 - DNA, 25 bp, Mus musculus
agacaagtgtgaaggtcctctctct

SEQ ID NO: 144882 - DNA, 25 bp, Mus musculus
agacaagtgtgatggtcctctctct

SEQ ID NO: 144883 - DNA, 25 bp, Mus musculus
agacaagttcaaaaggctgcccctg

SEQ ID NO: 144884 - DNA, 25 bp, Mus musculus
agacaagttcaataggctgcccctg

SEQ ID NO: 144885 - DNA, 25 bp, Mus musculus
agacaagttcttcggattccaaaca

SEQ ID NO: 144886 - DNA, 25 bp, Mus musculus
agacaagttcttgggattccaaaca

SEQ ID NO: 144887 - DNA, 25 bp, Mus musculus
agacaagttgcaaattttacttaaa

SEQ ID NO: 144888 - DNA, 25 bp, Mus musculus
agacaagttgcatattttacttaaa

SEQ ID NO: 144889 - DNA, 25 bp, Mus musculus
agacaagttgttcctgtttctcggc

SEQ ID NO: 144890 - DNA, 25 bp, Mus musculus
agacaagttgttgctgtttctcggc

SEQ ID NO: 144891 - DNA, 25 bp, Mus musculus
agacaagtttgtccacatgccaaaa

SEQ ID NO: 144892 - DNA, 25 bp, Mus musculus
agacaagtttgtgcacatgccaaaa

SEQ ID NO: 144893 - DNA, 25 bp, Mus musculus
agacaataccagagtgccccacttc

SEQ ID NO: 144894 - DNA, 25 bp, Mus musculus
agacaataccagtgtgccccacttc

SEQ ID NO: 144895 - DNA, 25 bp, Mus musculus
agacaatcaaatacagctactgtgt

SEQ ID NO: 144896 - DNA, 25 bp, Mus musculus
agacaatcaaattcagctactgtgt

SEQ ID NO: 144897 - DNA, 25 bp, Mus musculus
agacaatcagcaatacaacacctcc

SEQ ID NO: 144898 - DNA, 25 bp, Mus musculus
agacaatcagcattacaacacctcc

SEQ ID NO: 144899 - DNA, 25 bp, Mus musculus
agacaatcagtgctggccatggctc

SEQ ID NO: 144900 - DNA, 25 bp, Mus musculus
agacaatcagtggtggccatggctc

SEQ ID NO: 144901 - DNA, 25 bp, Mus musculus
agacaatcagttcggacaatttttt

SEQ ID NO: 144902 - DNA, 25 bp, Mus musculus
agacaatcagttgggacaatttttt

SEQ ID NO: 144903 - DNA, 25 bp, Mus musculus
agacaatccatcatccttaaagcac

SEQ ID NO: 144904 - DNA, 25 bp, Mus musculus
agacaatccatcttccttaaagcac

SEQ ID NO: 144905 - DNA, 25 bp, Mus musculus
agacaatccatgctttaatgcacat

SEQ ID NO: 144906 - DNA, 25 bp, Mus musculus
agacaatccatggtttaatgcacat

SEQ ID NO: 144907 - DNA, 25 bp, Mus musculus
agacaatcccacacaggaatccttg

SEQ ID NO: 144908 - DNA, 25 bp, Mus musculus
agacaatcccactcaggaatccttg

SEQ ID NO: 144909 - DNA, 25 bp, Mus musculus
agacaatccgtcactgcaaacacag

SEQ ID NO: 144910 - DNA, 25 bp, Mus musculus
agacaatccgtctctgcaaacacag

SEQ ID NO: 144911 - DNA, 25 bp, Mus musculus
agacaatcctgtcgtattactgtga

SEQ ID NO: 144912 - DNA, 25 bp, Mus musculus
agacaatcctgtggtattactgtga

SEQ ID NO: 144913 - DNA, 25 bp, Mus musculus
agacaatctagactgagggtcagga

SEQ ID NO: 144914 - DNA, 25 bp, Mus musculus
agacaatctagagtgagggtcagga

SEQ ID NO: 144915 - DNA, 25 bp, Mus musculus
agacaatctagtatgctcctctgaa

SEQ ID NO: 144916 - DNA, 25 bp, Mus musculus
agacaatctagtttgctcctctgaa

SEQ ID NO: 144917 - DNA, 25 bp, Mus musculus
agacaatctgccatctccaggtggt

SEQ ID NO: 144918 - DNA, 25 bp, Mus musculus
agacaatctgccttctccaggtggt

SEQ ID NO: 144919 - DNA, 25 bp, Mus musculus
agacaatgaaacacagaactctgtg

SEQ ID NO: 144920 - DNA, 25 bp, Mus musculus
agacaatgaaactcagaactctgtg

SEQ ID NO: 144921 - DNA, 25 bp, Mus musculus
agacaatgaagccagtctcacctct

SEQ ID NO: 144922 - DNA, 25 bp, Mus musculus
agacaatgaagcgagtctcacctct

SEQ ID NO: 144923 - DNA, 25 bp, Mus musculus
agacaatgacaaaggcgatggcact

SEQ ID NO: 144924 - DNA, 25 bp, Mus musculus
agacaatgacaatggcgatggcact

SEQ ID NO: 144925 - DNA, 25 bp, Mus musculus
agacaatgacccaataccctgggaa

SEQ ID NO: 144926 - DNA, 25 bp, Mus musculus
agacaatgaccctataccctgggaa

SEQ ID NO: 144927 - DNA, 25 bp, Mus musculus
agacaatgagacctacctgcaccgc

SEQ ID NO: 144928 - DNA, 25 bp, Mus musculus
agacaatgagacgtacctgcaccgc

SEQ ID NO: 144929 - DNA, 25 bp, Mus musculus
agacaatgatgaccacctcttctcc

SEQ ID NO: 144930 - DNA, 25 bp, Mus musculus
agacaatgatgagcacctcttctcc

SEQ ID NO: 144931 - DNA, 25 bp, Mus musculus
agacaatgcaccaggtcgaacctgg

SEQ ID NO: 144932 - DNA, 25 bp, Mus musculus
agacaatgcacctggtcgaacctgg

SEQ ID NO: 144933 - DNA, 25 bp, Mus musculus
agacaatgccaccatggccatgcag

SEQ ID NO: 144934 - DNA, 25 bp, Mus musculus
agacaatgccacgatggccatgcag

SEQ ID NO: 144935 - DNA, 25 bp, Mus musculus
agacaatgctgacctgagccaggga

SEQ ID NO: 144936 - DNA, 25 bp, Mus musculus
agacaatgctgagctgagccaggga

SEQ ID NO: 144937 - DNA, 25 bp, Mus musculus
agacaatgctgtacctagcagtggg

SEQ ID NO: 144938 - DNA, 25 bp, Mus musculus
agacaatgctgttcctagcagtggg

SEQ ID NO: 144939 - DNA, 25 bp, Mus musculus
agacaatgctttactctgtgttgac

SEQ ID NO: 144940 - DNA, 25 bp, Mus musculus
agacaatgcttttctctgtgttgac

SEQ ID NO: 144941 - DNA, 25 bp, Mus musculus
agacaatgggctaagagcacctcct

SEQ ID NO: 144942 - DNA, 25 bp, Mus musculus
agacaatgggctactaatgtccctc

SEQ ID NO: 144943 - DNA, 25 bp, Mus musculus
agacaatgggcttagagcacctcct

SEQ ID NO: 144944 - DNA, 25 bp, Mus musculus
agacaatgggcttctaatgtccctc

SEQ ID NO: 144945 - DNA, 25 bp, Mus musculus
agacaatgtgccagctttggtccaa

SEQ ID NO: 144946 - DNA, 25 bp, Mus musculus
agacaatgtgcctgctttggtccaa

SEQ ID NO: 144947 - DNA, 25 bp, Mus musculus
agacaatgtggtaggacccagccca

SEQ ID NO: 144948 - DNA, 25 bp, Mus musculus
agacaatgtggttggacccagccca

SEQ ID NO: 144949 - DNA, 25 bp, Mus musculus
agacaattcactcgaactttcccag

SEQ ID NO: 144950 - DNA, 25 bp, Mus musculus
agacaattcactggaactttcccag

SEQ ID NO: 144951 - DNA, 25 bp, Mus musculus
agacaattctacatgcctcactggt

SEQ ID NO: 144952 - DNA, 25 bp, Mus musculus
agacaattctacttgcctcactggt

SEQ ID NO: 144953 - DNA, 25 bp, Mus musculus
agacaattgtctacctggcttgggc

SEQ ID NO: 144954 - DNA, 25 bp, Mus musculus
agacaattgtcttcctggcttgggc

SEQ ID NO: 144955 - DNA, 25 bp, Mus musculus
agacaatttatcatgcttacccctc

SEQ ID NO: 144956 - DNA, 25 bp, Mus musculus
agacaatttatcttgcttacccctc

SEQ ID NO: 144957 - DNA, 25 bp, Mus musculus
agacaatttgaaagattcccctatt

SEQ ID NO: 144958 - DNA, 25 bp, Mus musculus
agacaatttgaatgattcccctatt

SEQ ID NO: 144959 - DNA, 25 bp, Mus musculus
agacaatttttacagtgtggacaaa

SEQ ID NO: 144960 - DNA, 25 bp, Mus musculus
agacaatttttagagtgtggacaaa

SEQ ID NO: 144961 - DNA, 25 bp, Mus musculus
agacacaaaaacctatctctgcctc

SEQ ID NO: 144962 - DNA, 25 bp, Mus musculus
agacacaaaaacgtatctctgcctc

SEQ ID NO: 144963 - DNA, 25 bp, Mus musculus
agacacaaacggcaaggcacacagc

SEQ ID NO: 144964 - DNA, 25 bp, Mus musculus
agacacaaacgggaaggcacacagc

SEQ ID NO: 144965 - DNA, 25 bp, Mus musculus
agacacaacagtcctgcttagggca

SEQ ID NO: 144966 - DNA, 25 bp, Mus musculus
agacacaacagtgctgcttagggca

SEQ ID NO: 144967 - DNA, 25 bp, Mus musculus
agacacaaccctctaaggttgattg

SEQ ID NO: 144968 - DNA, 25 bp, Mus musculus
agacacaaccctgtaaggttgattg

SEQ ID NO: 144969 - DNA, 25 bp, Mus musculus
agacacaacgtgctactgaggactc

SEQ ID NO: 144970 - DNA, 25 bp, Mus musculus
agacacaacgtggtactgaggactc

SEQ ID NO: 144971 - DNA, 25 bp, Mus musculus
agacacaagctgaggtttttgaata

SEQ ID NO: 144972 - DNA, 25 bp, Mus musculus
agacacaagctgtggtttttgaata

SEQ ID NO: 144973 - DNA, 25 bp, Mus musculus
agacacaagtggactctgccgctgc

SEQ ID NO: 144974 - DNA, 25 bp, Mus musculus
agacacaagtggtctctgccgctgc

SEQ ID NO: 144975 - DNA, 25 bp, Mus musculus
agacacaatcaccaataccatgaca

SEQ ID NO: 144976 - DNA, 25 bp, Mus musculus
agacacaatcacgaataccatgaca

SEQ ID NO: 144977 - DNA, 25 bp, Mus musculus
agacacacaattcgagactgaactt

SEQ ID NO: 144978 - DNA, 25 bp, Mus musculus
agacacacaattggagactgaactt

SEQ ID NO: 144979 - DNA, 25 bp, Mus musculus
agacacacacacaggtttctggcct

SEQ ID NO: 144980 - DNA, 25 bp, Mus musculus
agacacacacactggtttctggcct

SEQ ID NO: 144981 - DNA, 25 bp, Mus musculus
agacacacactcaccgcagcagtgg

SEQ ID NO: 144982 - DNA, 25 bp, Mus musculus
agacacacactctccgcagcagtgg

SEQ ID NO: 144983 - DNA, 25 bp, Mus musculus
agacacacagctcctctctcagttg

SEQ ID NO: 144984 - DNA, 25 bp, Mus musculus
agacacacagctgctctctcagttg

SEQ ID NO: 144985 - DNA, 25 bp, Mus musculus
agacacacaggtccaagaggccgca

SEQ ID NO: 144986 - DNA, 25 bp, Mus musculus
agacacacaggtgcaagaggccgca

SEQ ID NO: 144987 - DNA, 25 bp, Mus musculus
agacacacatcgagacaagccaact

SEQ ID NO: 144988 - DNA, 25 bp, Mus musculus
agacacacatcgtgacaagccaact

SEQ ID NO: 144989 - DNA, 25 bp, Mus musculus
agacacacatgtcctgttaacaatt

SEQ ID NO: 144990 - DNA, 25 bp, Mus musculus
agacacacatgtgctgttaacaatt

SEQ ID NO: 144991 - DNA, 25 bp, Mus musculus
agacacaccaaacccgagcatcata

SEQ ID NO: 144992 - DNA, 25 bp, Mus musculus
agacacaccaaagccgagcatcata

SEQ ID NO: 144993 - DNA, 25 bp, Mus musculus
agacacacccatagtagatgccagg

SEQ ID NO: 144994 - DNA, 25 bp, Mus musculus
agacacacccattgtagatgccagg

SEQ ID NO: 144995 - DNA, 25 bp, Mus musculus
agacacaccctcacaatggacagat

SEQ ID NO: 144996 - DNA, 25 bp, Mus musculus
agacacaccctctcaatggacagat

SEQ ID NO: 144997 - DNA, 25 bp, Mus musculus
agacacacccttcccttatgaggat

SEQ ID NO: 144998 - DNA, 25 bp, Mus musculus
agacacacccttgccttatgaggat

SEQ ID NO: 144999 - DNA, 25 bp, Mus musculus
agacacacctgtctatcttcttggt

SEQ ID NO: 145000 - DNA, 25 bp, Mus musculus
agacacacctgtgtatcttcttggt

SEQ ID NO: 145001 - DNA, 25 bp, Mus musculus
agacacacgtccctggaggcaagct

SEQ ID NO: 145002 - DNA, 25 bp, Mus musculus
agacacacgtccgtggaggcaagct

SEQ ID NO: 145003 - DNA, 25 bp, Mus musculus
agacacactcatatcttgcaactga

SEQ ID NO: 145004 - DNA, 25 bp, Mus musculus
agacacactcatttcttgcaactga

SEQ ID NO: 145005 - DNA, 25 bp, Mus musculus
agacacactgcgagtatcaccgagg

SEQ ID NO: 145006 - DNA, 25 bp, Mus musculus
agacacactgcgtgtatcaccgagg

SEQ ID NO: 145007 - DNA, 25 bp, Mus musculus
agacacactggcctctactatgggt

SEQ ID NO: 145008 - DNA, 25 bp, Mus musculus
agacacactggcgtctactatgggt

SEQ ID NO: 145009 - DNA, 25 bp, Mus musculus
agacacagacctccctggatctcag

SEQ ID NO: 145010 - DNA, 25 bp, Mus musculus
agacacagacctcttgacaacattg

SEQ ID NO: 145011 - DNA, 25 bp, Mus musculus
agacacagacctgcctggatctcag

SEQ ID NO: 145012 - DNA, 25 bp, Mus musculus
agacacagacctgttgacaacattg

SEQ ID NO: 145013 - DNA, 25 bp, Mus musculus
agacacagagctcggcattgcggat

SEQ ID NO: 145014 - DNA, 25 bp, Mus musculus
agacacagagctgggcattgcggat

SEQ ID NO: 145015 - DNA, 25 bp, Mus musculus
agacacagatacaagcgtggcccct

SEQ ID NO: 145016 - DNA, 25 bp, Mus musculus
agacacagatactagcgtggcccct

SEQ ID NO: 145017 - DNA, 25 bp, Mus musculus
agacacagatgccagctcctttagt

SEQ ID NO: 145018 - DNA, 25 bp, Mus musculus
agacacagatgcgagctcctttagt

SEQ ID NO: 145019 - DNA, 25 bp, Mus musculus
agacacagcatgctcaccgtggtgg

SEQ ID NO: 145020 - DNA, 25 bp, Mus musculus
agacacagcatgcttactctgccac

SEQ ID NO: 145021 - DNA, 25 bp, Mus musculus
agacacagcatggtcaccgtggtgg

SEQ ID NO: 145022 - DNA, 25 bp, Mus musculus
agacacagcatggttactctgccac

SEQ ID NO: 145023 - DNA, 25 bp, Mus musculus
agacacagccagagctttgatcaaa

SEQ ID NO: 145024 - DNA, 25 bp, Mus musculus
agacacagccagtgctttgatcaaa

SEQ ID NO: 145025 - DNA, 25 bp, Mus musculus
agacacagccgaaggactggatgtt

SEQ ID NO: 145026 - DNA, 25 bp, Mus musculus
agacacagccgatggactggatgtt

SEQ ID NO: 145027 - DNA, 25 bp, Mus musculus
agacacagccttaatgatctcaggg

SEQ ID NO: 145028 - DNA, 25 bp, Mus musculus
agacacagcctttatgatctcaggg

SEQ ID NO: 145029 - DNA, 25 bp, Mus musculus
agacacagcttcattgtataaacag

SEQ ID NO: 145030 - DNA, 25 bp, Mus musculus
agacacagcttctttgtataaacag

SEQ ID NO: 145031 - DNA, 25 bp, Mus musculus
agacacaggaggacagaggctgctc

SEQ ID NO: 145032 - DNA, 25 bp, Mus musculus
agacacaggaggtcagaggctgctc

SEQ ID NO: 145033 - DNA, 25 bp, Mus musculus
agacacaggcacatggatactattt

SEQ ID NO: 145034 - DNA, 25 bp, Mus musculus
agacacaggcacttggatactattt

SEQ ID NO: 145035 - DNA, 25 bp, Mus musculus
agacacaggcgcagctctcgtaaga

SEQ ID NO: 145036 - DNA, 25 bp, Mus musculus
agacacaggcgctgctctcgtaaga

SEQ ID NO: 145037 - DNA, 25 bp, Mus musculus
agacacaggtctcacctctgggaga

SEQ ID NO: 145038 - DNA, 25 bp, Mus musculus
agacacaggtctgacctctgggaga

SEQ ID NO: 145039 - DNA, 25 bp, Mus musculus
agacacagtcagcatccatcagaat

SEQ ID NO: 145040 - DNA, 25 bp, Mus musculus
agacacagtcaggatccatcagaat

SEQ ID NO: 145041 - DNA, 25 bp, Mus musculus
agacacagtctcagtaattccccat

SEQ ID NO: 145042 - DNA, 25 bp, Mus musculus
agacacagtctctgtaattccccat

SEQ ID NO: 145043 - DNA, 25 bp, Mus musculus
agacacagtgatctgacctgtccca

SEQ ID NO: 145044 - DNA, 25 bp, Mus musculus
agacacagtgatgtgacctgtccca

SEQ ID NO: 145045 - DNA, 25 bp, Mus musculus
agacacagtggaccacacccagtgg

SEQ ID NO: 145046 - DNA, 25 bp, Mus musculus
agacacagtggagcacacccagtgg

SEQ ID NO: 145047 - DNA, 25 bp, Mus musculus
agacacatcactcggaccttgcctt

SEQ ID NO: 145048 - DNA, 25 bp, Mus musculus
agacacatcactgggaccttgcctt

SEQ ID NO: 145049 - DNA, 25 bp, Mus musculus
agacacatcctacacgcgagcagtg

SEQ ID NO: 145050 - DNA, 25 bp, Mus musculus
agacacatcctagacgcgagcagtg

SEQ ID NO: 145051 - DNA, 25 bp, Mus musculus
agacacatctttcgctctgacgaag

SEQ ID NO: 145052 - DNA, 25 bp, Mus musculus
agacacatctttggctctgacgaag

SEQ ID NO: 145053 - DNA, 25 bp, Mus musculus
agacacatgaatacttggcagaggg

SEQ ID NO: 145054 - DNA, 25 bp, Mus musculus
agacacatgaattcttggcagaggg

SEQ ID NO: 145055 - DNA, 25 bp, Mus musculus
agacacatgcacaggaaatggcaga

SEQ ID NO: 145056 - DNA, 25 bp, Mus musculus
agacacatgcactggaaatggcaga

SEQ ID NO: 145057 - DNA, 25 bp, Mus musculus
agacacatgctcagtgacttcctgg

SEQ ID NO: 145058 - DNA, 25 bp, Mus musculus
agacacatgctctgtgacttcctgg

SEQ ID NO: 145059 - DNA, 25 bp, Mus musculus
agacacattgtcagagtaccatttg

SEQ ID NO: 145060 - DNA, 25 bp, Mus musculus
agacacattgtctgagtaccatttg

SEQ ID NO: 145061 - DNA, 25 bp, Mus musculus
agacacatttgtacaggtctccctg

SEQ ID NO: 145062 - DNA, 25 bp, Mus musculus
agacacatttgtatccccactgctc

SEQ ID NO: 145063 - DNA, 25 bp, Mus musculus
agacacatttgttcaggtctccctg

SEQ ID NO: 145064 - DNA, 25 bp, Mus musculus
agacacatttgtttccccactgctc

SEQ ID NO: 145065 - DNA, 25 bp, Mus musculus
agacaccaaagccaaccttcgattt

SEQ ID NO: 145066 - DNA, 25 bp, Mus musculus
agacaccaaagcgaaccttcgattt

SEQ ID NO: 145067 - DNA, 25 bp, Mus musculus
agacaccaaattattggcacatttt

SEQ ID NO: 145068 - DNA, 25 bp, Mus musculus
agacaccaaatttttggcacatttt

SEQ ID NO: 145069 - DNA, 25 bp, Mus musculus
agacaccaagccagtgcatttgata

SEQ ID NO: 145070 - DNA, 25 bp, Mus musculus
agacaccaagcctgtgcatttgata

SEQ ID NO: 145071 - DNA, 25 bp, Mus musculus
agacaccaaggaacgctcagctggg

SEQ ID NO: 145072 - DNA, 25 bp, Mus musculus
agacaccaaggatcgctcagctggg

SEQ ID NO: 145073 - DNA, 25 bp, Mus musculus
agacaccaaggcctatggagataga

SEQ ID NO: 145074 - DNA, 25 bp, Mus musculus
agacaccaaggcgtatggagataga

SEQ ID NO: 145075 - DNA, 25 bp, Mus musculus
agacaccaatagagttaaccttgaa

SEQ ID NO: 145076 - DNA, 25 bp, Mus musculus
agacaccaatagtgttaaccttgaa

SEQ ID NO: 145077 - DNA, 25 bp, Mus musculus
agacaccaccacaactgactgaaat

SEQ ID NO: 145078 - DNA, 25 bp, Mus musculus
agacaccaccactactgactgaaat

SEQ ID NO: 145079 - DNA, 25 bp, Mus musculus
agacaccaccggaagtgagggctcc

SEQ ID NO: 145080 - DNA, 25 bp, Mus musculus
agacaccaccggtagtgagggctcc

SEQ ID NO: 145081 - DNA, 25 bp, Mus musculus
agacaccacgttctatctgagtaaa

SEQ ID NO: 145082 - DNA, 25 bp, Mus musculus
agacaccacgttgtatctgagtaaa

SEQ ID NO: 145083 - DNA, 25 bp, Mus musculus
agacaccactggctaggactttcct

SEQ ID NO: 145084 - DNA, 25 bp, Mus musculus
agacaccactgggtaggactttcct

SEQ ID NO: 145085 - DNA, 25 bp, Mus musculus
agacaccactttcacacagttccta

SEQ ID NO: 145086 - DNA, 25 bp, Mus musculus
agacaccactttgacacagttccta

SEQ ID NO: 145087 - DNA, 25 bp, Mus musculus
agacaccagaacacctgtgagggag

SEQ ID NO: 145088 - DNA, 25 bp, Mus musculus
agacaccagaactcctgtgagggag

SEQ ID NO: 145089 - DNA, 25 bp, Mus musculus
agacaccagctcctttagcatctta

SEQ ID NO: 145090 - DNA, 25 bp, Mus musculus
agacaccagctcgtttagcatctta

SEQ ID NO: 145091 - DNA, 25 bp, Mus musculus
agacaccagcttcctctagaggatt

SEQ ID NO: 145092 - DNA, 25 bp, Mus musculus
agacaccagcttgctctagaggatt

SEQ ID NO: 145093 - DNA, 25 bp, Mus musculus
agacaccaggatcttggctgtttgt

SEQ ID NO: 145094 - DNA, 25 bp, Mus musculus
agacaccaggatgttggctgtttgt

SEQ ID NO: 145095 - DNA, 25 bp, Mus musculus
agacaccaggccaacctcctagttt

SEQ ID NO: 145096 - DNA, 25 bp, Mus musculus
agacaccaggcctacctcctagttt

SEQ ID NO: 145097 - DNA, 25 bp, Mus musculus
agacaccagggcacaatcagcacac

SEQ ID NO: 145098 - DNA, 25 bp, Mus musculus
agacaccagggctcaatcagcacac

SEQ ID NO: 145099 - DNA, 25 bp, Mus musculus
agacaccatcagacgattcctctaa

SEQ ID NO: 145100 - DNA, 25 bp, Mus musculus
agacaccatcagtcgattcctctaa

SEQ ID NO: 145101 - DNA, 25 bp, Mus musculus
agacaccatctgctcggtgacacag

SEQ ID NO: 145102 - DNA, 25 bp, Mus musculus
agacaccatctggtcggtgacacag

SEQ ID NO: 145103 - DNA, 25 bp, Mus musculus
agacaccatggaattctctggcctg

SEQ ID NO: 145104 - DNA, 25 bp, Mus musculus
agacaccatggatttctctggcctg

SEQ ID NO: 145105 - DNA, 25 bp, Mus musculus
agacaccatggtcgcgtactggcga

SEQ ID NO: 145106 - DNA, 25 bp, Mus musculus
agacaccatggtggcgtactggcga

SEQ ID NO: 145107 - DNA, 25 bp, Mus musculus
agacacccacgcatctgcaggatgt

SEQ ID NO: 145108 - DNA, 25 bp, Mus musculus
agacacccacgcttctgcaggatgt

SEQ ID NO: 145109 - DNA, 25 bp, Mus musculus
agacacccagagcttgtcagcagtt

SEQ ID NO: 145110 - DNA, 25 bp, Mus musculus
agacacccagaggttgtcagcagtt

SEQ ID NO: 145111 - DNA, 25 bp, Mus musculus
agacacccagtgaaggttttcccat

SEQ ID NO: 145112 - DNA, 25 bp, Mus musculus
agacacccagtgactacctaatgct

SEQ ID NO: 145113 - DNA, 25 bp, Mus musculus
agacacccagtgtaggttttcccat

SEQ ID NO: 145114 - DNA, 25 bp, Mus musculus
agacacccagtgtctacctaatgct

SEQ ID NO: 145115 - DNA, 25 bp, Mus musculus
agacacccatgcaggtagttaccca

SEQ ID NO: 145116 - DNA, 25 bp, Mus musculus
agacacccatgctggtagttaccca

SEQ ID NO: 145117 - DNA, 25 bp, Mus musculus
agacaccccagtctctaaagtgctg

SEQ ID NO: 145118 - DNA, 25 bp, Mus musculus
agacaccccagtgtctaaagtgctg

SEQ ID NO: 145119 - DNA, 25 bp, Mus musculus
agacacccctccatgggtatggagt

SEQ ID NO: 145120 - DNA, 25 bp, Mus musculus
agacacccctccttgggtatggagt

SEQ ID NO: 145121 - DNA, 25 bp, Mus musculus
agacacccgtgacctgtggtctgta

SEQ ID NO: 145122 - DNA, 25 bp, Mus musculus
agacacccgtgagctgtggtctgta

SEQ ID NO: 145123 - DNA, 25 bp, Mus musculus
agacaccctaacacaagggcgagac

SEQ ID NO: 145124 - DNA, 25 bp, Mus musculus
agacaccctaactcaagggcgagac

SEQ ID NO: 145125 - DNA, 25 bp, Mus musculus
agacacccttcccagaaggtatggt

SEQ ID NO: 145126 - DNA, 25 bp, Mus musculus
agacacccttccgagaaggtatggt

SEQ ID NO: 145127 - DNA, 25 bp, Mus musculus
agacaccctttgaatttgacctctt

SEQ ID NO: 145128 - DNA, 25 bp, Mus musculus
agacaccctttgtatttgacctctt

SEQ ID NO: 145129 - DNA, 25 bp, Mus musculus
agacaccgacacatagcaaagcttg

SEQ ID NO: 145130 - DNA, 25 bp, Mus musculus
agacaccgacacttagcaaagcttg

SEQ ID NO: 145131 - DNA, 25 bp, Mus musculus
agacaccgagcaagcacgttgccag

SEQ ID NO: 145132 - DNA, 25 bp, Mus musculus
agacaccgagcatgcacgttgccag

SEQ ID NO: 145133 - DNA, 25 bp, Mus musculus
agacaccgcacactcctgggaaagc

SEQ ID NO: 145134 - DNA, 25 bp, Mus musculus
agacaccgcacagtcctgggaaagc

SEQ ID NO: 145135 - DNA, 25 bp, Mus musculus
agacaccgcccgaggcagcagagcg

SEQ ID NO: 145136 - DNA, 25 bp, Mus musculus
agacaccgcccgtggcagcagagcg

SEQ ID NO: 145137 - DNA, 25 bp, Mus musculus
agacaccgcgagagaactagccctt

SEQ ID NO: 145138 - DNA, 25 bp, Mus musculus
agacaccgcgagtgaactagccctt

SEQ ID NO: 145139 - DNA, 25 bp, Mus musculus
agacaccggaccaccaaccaggagg

SEQ ID NO: 145140 - DNA, 25 bp, Mus musculus
agacaccggacctccaaccaggagg

SEQ ID NO: 145141 - DNA, 25 bp, Mus musculus
agacaccggaggatgctacgggtat

SEQ ID NO: 145142 - DNA, 25 bp, Mus musculus
agacaccggaggttgctacgggtat

SEQ ID NO: 145143 - DNA, 25 bp, Mus musculus
agacaccggccgcattgaggttttc

SEQ ID NO: 145144 - DNA, 25 bp, Mus musculus
agacaccggccggattgaggttttc

SEQ ID NO: 145145 - DNA, 25 bp, Mus musculus
agacaccgtgctccagtgcaagtca

SEQ ID NO: 145146 - DNA, 25 bp, Mus musculus
agacaccgtgctgcagtgcaagtca

SEQ ID NO: 145147 - DNA, 25 bp, Mus musculus
agacacctaactacaggcttgttgt

SEQ ID NO: 145148 - DNA, 25 bp, Mus musculus
agacacctaacttcaggcttgttgt

SEQ ID NO: 145149 - DNA, 25 bp, Mus musculus
agacacctaagacgttgactgggtt

SEQ ID NO: 145150 - DNA, 25 bp, Mus musculus
agacacctaagaggttgactgggtt

SEQ ID NO: 145151 - DNA, 25 bp, Mus musculus
agacacctatgtcctagcacagaag

SEQ ID NO: 145152 - DNA, 25 bp, Mus musculus
agacacctatgtgctagcacagaag

SEQ ID NO: 145153 - DNA, 25 bp, Mus musculus
agacacctcagaagatgtgccctga

SEQ ID NO: 145154 - DNA, 25 bp, Mus musculus
agacacctcagatgatgtgccctga

SEQ ID NO: 145155 - DNA, 25 bp, Mus musculus
agacacctcagtattactgcctctt

SEQ ID NO: 145156 - DNA, 25 bp, Mus musculus
agacacctcagttttactgcctctt

SEQ ID NO: 145157 - DNA, 25 bp, Mus musculus
agacacctctctcgtgtacccagag

SEQ ID NO: 145158 - DNA, 25 bp, Mus musculus
agacacctctctggtgtacccagag

SEQ ID NO: 145159 - DNA, 25 bp, Mus musculus
agacacctctgcattggtttataga

SEQ ID NO: 145160 - DNA, 25 bp, Mus musculus
agacacctctgctttggtttataga

SEQ ID NO: 145161 - DNA, 25 bp, Mus musculus
agacacctgaccattttgttcaact

SEQ ID NO: 145162 - DNA, 25 bp, Mus musculus
agacacctgacctttttgttcaact

SEQ ID NO: 145163 - DNA, 25 bp, Mus musculus
agacacctgactcgcatataatttt

SEQ ID NO: 145164 - DNA, 25 bp, Mus musculus
agacacctgactggcatataatttt

SEQ ID NO: 145165 - DNA, 25 bp, Mus musculus
agacacctgaggatgcactctagtg

SEQ ID NO: 145166 - DNA, 25 bp, Mus musculus
agacacctgaggttgcactctagtg

SEQ ID NO: 145167 - DNA, 25 bp, Mus musculus
agacacctgattaggcaaccagcca

SEQ ID NO: 145168 - DNA, 25 bp, Mus musculus
agacacctgatttggcaaccagcca

SEQ ID NO: 145169 - DNA, 25 bp, Mus musculus
agacacctgcatatagtgccttttt

SEQ ID NO: 145170 - DNA, 25 bp, Mus musculus
agacacctgcatttagtgccttttt

SEQ ID NO: 145171 - DNA, 25 bp, Mus musculus
agacacctgcctcgtatttcagctg

SEQ ID NO: 145172 - DNA, 25 bp, Mus musculus
agacacctgcctggtatttcagctg

SEQ ID NO: 145173 - DNA, 25 bp, Mus musculus
agacacctgctgagggtcatctggc

SEQ ID NO: 145174 - DNA, 25 bp, Mus musculus
agacacctgctgtgggtcatctggc

SEQ ID NO: 145175 - DNA, 25 bp, Mus musculus
agacacctgggcatctgaagttgct

SEQ ID NO: 145176 - DNA, 25 bp, Mus musculus
agacacctgggcttctgaagttgct

SEQ ID NO: 145177 - DNA, 25 bp, Mus musculus
agacacctggtgacatctgcatctt

SEQ ID NO: 145178 - DNA, 25 bp, Mus musculus
agacacctggtgtcatctgcatctt

SEQ ID NO: 145179 - DNA, 25 bp, Mus musculus
agacacctgtaacttgtcttctgac

SEQ ID NO: 145180 - DNA, 25 bp, Mus musculus
agacacctgtaagttgtcttctgac

SEQ ID NO: 145181 - DNA, 25 bp, Mus musculus
agacacctgtctccagacagccttg

SEQ ID NO: 145182 - DNA, 25 bp, Mus musculus
agacacctgtctgcagacagccttg

SEQ ID NO: 145183 - DNA, 25 bp, Mus musculus
agacaccttcgcctgggatcgagga

SEQ ID NO: 145184 - DNA, 25 bp, Mus musculus
agacaccttcgcgtgggatcgagga

SEQ ID NO: 145185 - DNA, 25 bp, Mus musculus
agacaccttgaacggcctgatgtat

SEQ ID NO: 145186 - DNA, 25 bp, Mus musculus
agacaccttgaagggcctgatgtat

SEQ ID NO: 145187 - DNA, 25 bp, Mus musculus
agacacctttagatctggcgacggc

SEQ ID NO: 145188 - DNA, 25 bp, Mus musculus
agacacctttagttctggcgacggc

SEQ ID NO: 145189 - DNA, 25 bp, Mus musculus
agacacgaagtaagctgagtatagt

SEQ ID NO: 145190 - DNA, 25 bp, Mus musculus
agacacgaagtatgctgagtatagt

SEQ ID NO: 145191 - DNA, 25 bp, Mus musculus
agacacgaccacaacaactcagaag

SEQ ID NO: 145192 - DNA, 25 bp, Mus musculus
agacacgaccactacaactcagaag

SEQ ID NO: 145193 - DNA, 25 bp, Mus musculus
agacacgaccatatcacccattgcc

SEQ ID NO: 145194 - DNA, 25 bp, Mus musculus
agacacgaccatttcacccattgcc

SEQ ID NO: 145195 - DNA, 25 bp, Mus musculus
agacacgagtgtacgcgcggattcc

SEQ ID NO: 145196 - DNA, 25 bp, Mus musculus
agacacgagtgttcgcgcggattcc

SEQ ID NO: 145197 - DNA, 25 bp, Mus musculus
agacacgatgtgacctgcacagtct

SEQ ID NO: 145198 - DNA, 25 bp, Mus musculus
agacacgatgtgtcctgcacagtct

SEQ ID NO: 145199 - DNA, 25 bp, Mus musculus
agacacgctcagactccagtgtagt

SEQ ID NO: 145200 - DNA, 25 bp, Mus musculus
agacacgctcagtctccagtgtagt

SEQ ID NO: 145201 - DNA, 25 bp, Mus musculus
agacacggagaaagctgttcatgat

SEQ ID NO: 145202 - DNA, 25 bp, Mus musculus
agacacggagaatgctgttcatgat

SEQ ID NO: 145203 - DNA, 25 bp, Mus musculus
agacacggatacctgaggccacctg

SEQ ID NO: 145204 - DNA, 25 bp, Mus musculus
agacacggatacgtgaggccacctg

SEQ ID NO: 145205 - DNA, 25 bp, Mus musculus
agacacgggttcagagtgttcccat

SEQ ID NO: 145206 - DNA, 25 bp, Mus musculus
agacacgggttctgagtgttcccat

SEQ ID NO: 145207 - DNA, 25 bp, Mus musculus
agacacgggtttctcacaggattcc

SEQ ID NO: 145208 - DNA, 25 bp, Mus musculus
agacacgggtttgtcacaggattcc

SEQ ID NO: 145209 - DNA, 25 bp, Mus musculus
agacacgtcagaacgaacagccact

SEQ ID NO: 145210 - DNA, 25 bp, Mus musculus
agacacgtcagatcgaacagccact

SEQ ID NO: 145211 - DNA, 25 bp, Mus musculus
agacacgtcatgcatgcttggccca

SEQ ID NO: 145212 - DNA, 25 bp, Mus musculus
agacacgtcatggatgcttggccca

SEQ ID NO: 145213 - DNA, 25 bp, Mus musculus
agacacgtccccagaggttggattc

SEQ ID NO: 145214 - DNA, 25 bp, Mus musculus
agacacgtcccctgaggttggattc

SEQ ID NO: 145215 - DNA, 25 bp, Mus musculus
agacacgtctcacttctgggatgcc

SEQ ID NO: 145216 - DNA, 25 bp, Mus musculus
agacacgtctcagttctgggatgcc

SEQ ID NO: 145217 - DNA, 25 bp, Mus musculus
agacacgtgactactgtttcctgtg

SEQ ID NO: 145218 - DNA, 25 bp, Mus musculus
agacacgtgacttctgtttcctgtg

SEQ ID NO: 145219 - DNA, 25 bp, Mus musculus
agacacgtggagatactgacaaccc

SEQ ID NO: 145220 - DNA, 25 bp, Mus musculus
agacacgtggagttactgacaaccc

SEQ ID NO: 145221 - DNA, 25 bp, Mus musculus
agacacgtgtggacatcattccctg

SEQ ID NO: 145222 - DNA, 25 bp, Mus musculus
agacacgtgtggtcatcattccctg

SEQ ID NO: 145223 - DNA, 25 bp, Mus musculus
agacacgttctcctggagctgtgcg

SEQ ID NO: 145224 - DNA, 25 bp, Mus musculus
agacacgttctcgtggagctgtgcg

SEQ ID NO: 145225 - DNA, 25 bp, Mus musculus
agacacgtttccatacagacctggt

SEQ ID NO: 145226 - DNA, 25 bp, Mus musculus
agacacgtttccttacagacctggt

SEQ ID NO: 145227 - DNA, 25 bp, Mus musculus
agacactaaggaccgctggcgcagt

SEQ ID NO: 145228 - DNA, 25 bp, Mus musculus
agacactaaggagcgctggcgcagt

SEQ ID NO: 145229 - DNA, 25 bp, Mus musculus
agacactacagaccctggacagaag

SEQ ID NO: 145230 - DNA, 25 bp, Mus musculus
agacactacagagcctggacagaag

SEQ ID NO: 145231 - DNA, 25 bp, Mus musculus
agacactactgtccctcgtcggttg

SEQ ID NO: 145232 - DNA, 25 bp, Mus musculus
agacactactgtgcctcgtcggttg

SEQ ID NO: 145233 - DNA, 25 bp, Mus musculus
agacactatgccattctgcaggata

SEQ ID NO: 145234 - DNA, 25 bp, Mus musculus
agacactatgcctttctgcaggata

SEQ ID NO: 145235 - DNA, 25 bp, Mus musculus
agacactcaaggagcaaaggctggt

SEQ ID NO: 145236 - DNA, 25 bp, Mus musculus
agacactcaaggtgcaaaggctggt

SEQ ID NO: 145237 - DNA, 25 bp, Mus musculus
agacactcactcattattctagggt

SEQ ID NO: 145238 - DNA, 25 bp, Mus musculus
agacactcactctttattctagggt

SEQ ID NO: 145239 - DNA, 25 bp, Mus musculus
agacactcatagacaaaggatgcca

SEQ ID NO: 145240 - DNA, 25 bp, Mus musculus
agacactcatagtcaaaggatgcca

SEQ ID NO: 145241 - DNA, 25 bp, Mus musculus
agacactccaccatttgtcttctta

SEQ ID NO: 145242 - DNA, 25 bp, Mus musculus
agacactccaccttttgtcttctta

SEQ ID NO: 145243 - DNA, 25 bp, Mus musculus
agacactccagtaccgaggacattc

SEQ ID NO: 145244 - DNA, 25 bp, Mus musculus
agacactccagtatttcatataaac

SEQ ID NO: 145245 - DNA, 25 bp, Mus musculus
agacactccagttccgaggacattc

SEQ ID NO: 145246 - DNA, 25 bp, Mus musculus
agacactccagtttttcatataaac

SEQ ID NO: 145247 - DNA, 25 bp, Mus musculus
agacactccctacgcttatatattg

SEQ ID NO: 145248 - DNA, 25 bp, Mus musculus
agacactccctaggcttatatattg

SEQ ID NO: 145249 - DNA, 25 bp, Mus musculus
agacactccctgaagatgcacacgt

SEQ ID NO: 145250 - DNA, 25 bp, Mus musculus
agacactccctgtagatgcacacgt

SEQ ID NO: 145251 - DNA, 25 bp, Mus musculus
agacactccgataacctggcaggcg

SEQ ID NO: 145252 - DNA, 25 bp, Mus musculus
agacactccgattacctggcaggcg

SEQ ID NO: 145253 - DNA, 25 bp, Mus musculus
agacactcctctaagctcgagatag

SEQ ID NO: 145254 - DNA, 25 bp, Mus musculus
agacactcctcttagctcgagatag

SEQ ID NO: 145255 - DNA, 25 bp, Mus musculus
agacactcgccaatgaattttatgt

SEQ ID NO: 145256 - DNA, 25 bp, Mus musculus
agacactcgccattgaattttatgt

SEQ ID NO: 145257 - DNA, 25 bp, Mus musculus
agacactcgggaaccggccagggat

SEQ ID NO: 145258 - DNA, 25 bp, Mus musculus
agacactcgggatccggccagggat

SEQ ID NO: 145259 - DNA, 25 bp, Mus musculus
agacactctcgacgatattgcaaac

SEQ ID NO: 145260 - DNA, 25 bp, Mus musculus
agacactctcgaggatattgcaaac

SEQ ID NO: 145261 - DNA, 25 bp, Mus musculus
agacactctcttcccctccccttgg

SEQ ID NO: 145262 - DNA, 25 bp, Mus musculus
agacactctcttgccctccccttgg

SEQ ID NO: 145263 - DNA, 25 bp, Mus musculus
agacactgaactcggcttcatcttt

SEQ ID NO: 145264 - DNA, 25 bp, Mus musculus
agacactgaactgggcttcatcttt

SEQ ID NO: 145265 - DNA, 25 bp, Mus musculus
agacactgactcatcgtgagccaga

SEQ ID NO: 145266 - DNA, 25 bp, Mus musculus
agacactgactcttcgtgagccaga

SEQ ID NO: 145267 - DNA, 25 bp, Mus musculus
agacactgagagaaggctggatgca

SEQ ID NO: 145268 - DNA, 25 bp, Mus musculus
agacactgagagtaggctggatgca

SEQ ID NO: 145269 - DNA, 25 bp, Mus musculus
agacactgagttctgcaagtctgtg

SEQ ID NO: 145270 - DNA, 25 bp, Mus musculus
agacactgagttgtgcaagtctgtg

SEQ ID NO: 145271 - DNA, 25 bp, Mus musculus
agacactgatgtccctaaacgctcc

SEQ ID NO: 145272 - DNA, 25 bp, Mus musculus
agacactgatgtgcctaaacgctcc

SEQ ID NO: 145273 - DNA, 25 bp, Mus musculus
agacactgccctattgcacataagc

SEQ ID NO: 145274 - DNA, 25 bp, Mus musculus
agacactgcccttttgcacataagc

SEQ ID NO: 145275 - DNA, 25 bp, Mus musculus
agacactgctcacggcacaatgagt

SEQ ID NO: 145276 - DNA, 25 bp, Mus musculus
agacactgctcagggcacaatgagt

SEQ ID NO: 145277 - DNA, 25 bp, Mus musculus
agacactgctgacccctgaagctgg

SEQ ID NO: 145278 - DNA, 25 bp, Mus musculus
agacactgctgagccctgaagctgg

SEQ ID NO: 145279 - DNA, 25 bp, Mus musculus
agacactggaagacgttttctatga

SEQ ID NO: 145280 - DNA, 25 bp, Mus musculus
agacactggaagtcgttttctatga

SEQ ID NO: 145281 - DNA, 25 bp, Mus musculus
agacactggagaaatgctgcaagcc

SEQ ID NO: 145282 - DNA, 25 bp, Mus musculus
agacactggagatatgctgcaagcc

SEQ ID NO: 145283 - DNA, 25 bp, Mus musculus
agacactggattaaaggcacacaca

SEQ ID NO: 145284 - DNA, 25 bp, Mus musculus
agacactggatttaaggcacacaca

SEQ ID NO: 145285 - DNA, 25 bp, Mus musculus
agacactggcctcgtctgccaagtt

SEQ ID NO: 145286 - DNA, 25 bp, Mus musculus
agacactggcctggtctgccaagtt

SEQ ID NO: 145287 - DNA, 25 bp, Mus musculus
agacactggctgatctgcaactgga

SEQ ID NO: 145288 - DNA, 25 bp, Mus musculus
agacactggctgctagaggacatca

SEQ ID NO: 145289 - DNA, 25 bp, Mus musculus
agacactggctggtagaggacatca

SEQ ID NO: 145290 - DNA, 25 bp, Mus musculus
agacactggctgttctgcaactgga

SEQ ID NO: 145291 - DNA, 25 bp, Mus musculus
agacactgggctcctcttaggactg

SEQ ID NO: 145292 - DNA, 25 bp, Mus musculus
agacactgggctcgccggagtacaa

SEQ ID NO: 145293 - DNA, 25 bp, Mus musculus
agacactgggctgctcttaggactg

SEQ ID NO: 145294 - DNA, 25 bp, Mus musculus
agacactgggctggccggagtacaa

SEQ ID NO: 145295 - DNA, 25 bp, Mus musculus
agacactgggtgacctggtctatca

SEQ ID NO: 145296 - DNA, 25 bp, Mus musculus
agacactgggtgagccacagttccc

SEQ ID NO: 145297 - DNA, 25 bp, Mus musculus
agacactgggtgtcctggtctatca

SEQ ID NO: 145298 - DNA, 25 bp, Mus musculus
agacactgggtgtgccacagttccc

SEQ ID NO: 145299 - DNA, 25 bp, Mus musculus
agacactggtaccaacacctactgt

SEQ ID NO: 145300 - DNA, 25 bp, Mus musculus
agacactggtacgaacacctactgt

SEQ ID NO: 145301 - DNA, 25 bp, Mus musculus
agacactggtatcatctggtacact

SEQ ID NO: 145302 - DNA, 25 bp, Mus musculus
agacactggtatgatctggtacact

SEQ ID NO: 145303 - DNA, 25 bp, Mus musculus
agacactggtcgagcctgggagctt

SEQ ID NO: 145304 - DNA, 25 bp, Mus musculus
agacactggtcgtgcctgggagctt

SEQ ID NO: 145305 - DNA, 25 bp, Mus musculus
agacactggtgcaacatcttgtcct

SEQ ID NO: 145306 - DNA, 25 bp, Mus musculus
agacactggtgctacatcttgtcct

SEQ ID NO: 145307 - DNA, 25 bp, Mus musculus
agacactggttcaggatggacgcca

SEQ ID NO: 145308 - DNA, 25 bp, Mus musculus
agacactggttctggatggacgcca

SEQ ID NO: 145309 - DNA, 25 bp, Mus musculus
agacactgtactcaggccagggcca

SEQ ID NO: 145310 - DNA, 25 bp, Mus musculus
agacactgtactgaggccagggcca

SEQ ID NO: 145311 - DNA, 25 bp, Mus musculus
agacactgtcccagaaaggcttgca

SEQ ID NO: 145312 - DNA, 25 bp, Mus musculus
agacactgtccctgaaaggcttgca

SEQ ID NO: 145313 - DNA, 25 bp, Mus musculus
agacactgtgctagttccggtggag

SEQ ID NO: 145314 - DNA, 25 bp, Mus musculus
agacactgtgcttgttccggtggag

SEQ ID NO: 145315 - DNA, 25 bp, Mus musculus
agacactgttgcatcgtggacactg

SEQ ID NO: 145316 - DNA, 25 bp, Mus musculus
agacactgttgcttcgtggacactg

SEQ ID NO: 145317 - DNA, 25 bp, Mus musculus
agacacttaatacatcacccacata

SEQ ID NO: 145318 - DNA, 25 bp, Mus musculus
agacacttaatagatcacccacata

SEQ ID NO: 145319 - DNA, 25 bp, Mus musculus
agacacttagctcataggtcggaag

SEQ ID NO: 145320 - DNA, 25 bp, Mus musculus
agacacttagctgataggtcggaag

SEQ ID NO: 145321 - DNA, 25 bp, Mus musculus
agacacttcaccacacacctggaag

SEQ ID NO: 145322 - DNA, 25 bp, Mus musculus
agacacttcacctcacacctggaag

SEQ ID NO: 145323 - DNA, 25 bp, Mus musculus
agacacttcagcagcctttttgggc

SEQ ID NO: 145324 - DNA, 25 bp, Mus musculus
agacacttcagctgcctttttgggc

SEQ ID NO: 145325 - DNA, 25 bp, Mus musculus
agacacttccccaaagcaatcaaga

SEQ ID NO: 145326 - DNA, 25 bp, Mus musculus
agacacttccccaattgcatgggct

SEQ ID NO: 145327 - DNA, 25 bp, Mus musculus
agacacttcccctaagcaatcaaga

SEQ ID NO: 145328 - DNA, 25 bp, Mus musculus
agacacttcccctattgcatgggct

SEQ ID NO: 145329 - DNA, 25 bp, Mus musculus
agacacttccctattctggtgagaa

SEQ ID NO: 145330 - DNA, 25 bp, Mus musculus
agacacttcccttttctggtgagaa

SEQ ID NO: 145331 - DNA, 25 bp, Mus musculus
agacacttcctcagttctacagctt

SEQ ID NO: 145332 - DNA, 25 bp, Mus musculus
agacacttcctctgttctacagctt

SEQ ID NO: 145333 - DNA, 25 bp, Mus musculus
agacacttcctgagtatgtacactg

SEQ ID NO: 145334 - DNA, 25 bp, Mus musculus
agacacttcctgtgtatgtacactg

SEQ ID NO: 145335 - DNA, 25 bp, Mus musculus
agacacttctgtcaggcaggcttga

SEQ ID NO: 145336 - DNA, 25 bp, Mus musculus
agacacttctgtgaggcaggcttga

SEQ ID NO: 145337 - DNA, 25 bp, Mus musculus
agacacttgaccagaactgcatcca

SEQ ID NO: 145338 - DNA, 25 bp, Mus musculus
agacacttgacctgaactgcatcca

SEQ ID NO: 145339 - DNA, 25 bp, Mus musculus
agacacttgaggaaatagctatttt

SEQ ID NO: 145340 - DNA, 25 bp, Mus musculus
agacacttgaggtaatagctatttt

SEQ ID NO: 145341 - DNA, 25 bp, Mus musculus
agacacttgccaagtgaacctaaag

SEQ ID NO: 145342 - DNA, 25 bp, Mus musculus
agacacttgccatgtgaacctaaag

SEQ ID NO: 145343 - DNA, 25 bp, Mus musculus
agacacttgcccacatctttagaga

SEQ ID NO: 145344 - DNA, 25 bp, Mus musculus
agacacttgccctcatctttagaga

SEQ ID NO: 145345 - DNA, 25 bp, Mus musculus
agacacttgctgctatctatacata

SEQ ID NO: 145346 - DNA, 25 bp, Mus musculus
agacacttgctggtatctatacata

SEQ ID NO: 145347 - DNA, 25 bp, Mus musculus
agacacttggcacttgctgacacaa

SEQ ID NO: 145348 - DNA, 25 bp, Mus musculus
agacacttggcagttgctgacacaa

SEQ ID NO: 145349 - DNA, 25 bp, Mus musculus
agacacttggtacagacccatgcag

SEQ ID NO: 145350 - DNA, 25 bp, Mus musculus
agacacttggtagagacccatgcag

SEQ ID NO: 145351 - DNA, 25 bp, Mus musculus
agacactttcaaacctgaggcataa

SEQ ID NO: 145352 - DNA, 25 bp, Mus musculus
agacactttcaatcctgaggcataa

SEQ ID NO: 145353 - DNA, 25 bp, Mus musculus
agacactttgcacacctgaggccga

SEQ ID NO: 145354 - DNA, 25 bp, Mus musculus
agacactttgcagacctgaggccga

SEQ ID NO: 145355 - DNA, 25 bp, Mus musculus
agacactttggaatttcctaaagag

SEQ ID NO: 145356 - DNA, 25 bp, Mus musculus
agacactttggattttcctaaagag

SEQ ID NO: 145357 - DNA, 25 bp, Mus musculus
agacactttgttcttctcactttcc

SEQ ID NO: 145358 - DNA, 25 bp, Mus musculus
agacactttgttgttctcactttcc

SEQ ID NO: 145359 - DNA, 25 bp, Mus musculus
agacagaaacatagtgggccacacc

SEQ ID NO: 145360 - DNA, 25 bp, Mus musculus
agacagaaacattgtgggccacacc

SEQ ID NO: 145361 - DNA, 25 bp, Mus musculus
agacagaaacttcctgacttccagt

SEQ ID NO: 145362 - DNA, 25 bp, Mus musculus
agacagaaacttgctgacttccagt

SEQ ID NO: 145363 - DNA, 25 bp, Mus musculus
agacagaaccagctcccataacttg

SEQ ID NO: 145364 - DNA, 25 bp, Mus musculus
agacagaaccaggtcccataacttg

SEQ ID NO: 145365 - DNA, 25 bp, Mus musculus
agacagaacctcaggtttgccaacc

SEQ ID NO: 145366 - DNA, 25 bp, Mus musculus
agacagaacctctggtttgccaacc

SEQ ID NO: 145367 - DNA, 25 bp, Mus musculus
agacagaaccttacccttgggagca

SEQ ID NO: 145368 - DNA, 25 bp, Mus musculus
agacagaacctttcccttgggagca

SEQ ID NO: 145369 - DNA, 25 bp, Mus musculus
agacagaagagcatgtaccagccaa

SEQ ID NO: 145370 - DNA, 25 bp, Mus musculus
agacagaagagcttgtaccagccaa

SEQ ID NO: 145371 - DNA, 25 bp, Mus musculus
agacagaagattcctgaaactggga

SEQ ID NO: 145372 - DNA, 25 bp, Mus musculus
agacagaagattgctgaaactggga

SEQ ID NO: 145373 - DNA, 25 bp, Mus musculus
agacagaagtagcattactgcaagt

SEQ ID NO: 145374 - DNA, 25 bp, Mus musculus
agacagaagtaggattactgcaagt

SEQ ID NO: 145375 - DNA, 25 bp, Mus musculus
agacagaagtccaatgattcccacc

SEQ ID NO: 145376 - DNA, 25 bp, Mus musculus
agacagaagtcctatgattcccacc

SEQ ID NO: 145377 - DNA, 25 bp, Mus musculus
agacagaatgaaccctcagcgagct

SEQ ID NO: 145378 - DNA, 25 bp, Mus musculus
agacagaatgaagcctcagcgagct

SEQ ID NO: 145379 - DNA, 25 bp, Mus musculus
agacagaattgtcagtttgcagaca

SEQ ID NO: 145380 - DNA, 25 bp, Mus musculus
agacagaattgtgagtttgcagaca

SEQ ID NO: 145381 - DNA, 25 bp, Mus musculus
agacagacacagaccctgtgcagtg

SEQ ID NO: 145382 - DNA, 25 bp, Mus musculus
agacagacacagtccctgtgcagtg

SEQ ID NO: 145383 - DNA, 25 bp, Mus musculus
agacagacacccagcacgacagagt

SEQ ID NO: 145384 - DNA, 25 bp, Mus musculus
agacagacaccctgcacgacagagt

SEQ ID NO: 145385 - DNA, 25 bp, Mus musculus
agacagacactgagcaggcattgca

SEQ ID NO: 145386 - DNA, 25 bp, Mus musculus
agacagacactgtgcaggcattgca

SEQ ID NO: 145387 - DNA, 25 bp, Mus musculus
agacagacagatcggccctctatgt

SEQ ID NO: 145388 - DNA, 25 bp, Mus musculus
agacagacagatgggccctctatgt

SEQ ID NO: 145389 - DNA, 25 bp, Mus musculus
agacagacagctatatgcagccctt

SEQ ID NO: 145390 - DNA, 25 bp, Mus musculus
agacagacagctttatgcagccctt

SEQ ID NO: 145391 - DNA, 25 bp, Mus musculus
agacagacagttccttcagcttcat

SEQ ID NO: 145392 - DNA, 25 bp, Mus musculus
agacagacagttgcttcagcttcat

SEQ ID NO: 145393 - DNA, 25 bp, Mus musculus
agacagacatggctctgagtcctgc

SEQ ID NO: 145394 - DNA, 25 bp, Mus musculus
agacagacatgggtctgagtcctgc

SEQ ID NO: 145395 - DNA, 25 bp, Mus musculus
agacagacattgacgccgtggaggt

SEQ ID NO: 145396 - DNA, 25 bp, Mus musculus
agacagacattgtcgccgtggaggt

SEQ ID NO: 145397 - DNA, 25 bp, Mus musculus
agacagaccctgcacttcatttaag

SEQ ID NO: 145398 - DNA, 25 bp, Mus musculus
agacagaccctggacttcatttaag

SEQ ID NO: 145399 - DNA, 25 bp, Mus musculus
agacagaccgaaagcagtagaccag

SEQ ID NO: 145400 - DNA, 25 bp, Mus musculus
agacagaccgaatgcagtagaccag

SEQ ID NO: 145401 - DNA, 25 bp, Mus musculus
agacagacctgtcactgtgagtggt

SEQ ID NO: 145402 - DNA, 25 bp, Mus musculus
agacagacctgtgactgtgagtggt

SEQ ID NO: 145403 - DNA, 25 bp, Mus musculus
agacagacggacagctgtgacacac

SEQ ID NO: 145404 - DNA, 25 bp, Mus musculus
agacagacggactgctgtgacacac

SEQ ID NO: 145405 - DNA, 25 bp, Mus musculus
agacagacggatcgctttcacgggc

SEQ ID NO: 145406 - DNA, 25 bp, Mus musculus
agacagacggatggctttcacgggc

SEQ ID NO: 145407 - DNA, 25 bp, Mus musculus
agacagacggcaacttgtctttttt

SEQ ID NO: 145408 - DNA, 25 bp, Mus musculus
agacagacggcatcttgtctttttt

SEQ ID NO: 145409 - DNA, 25 bp, Mus musculus
agacagacgggacccgtttccattt

SEQ ID NO: 145410 - DNA, 25 bp, Mus musculus
agacagacgggagccgtttccattt

SEQ ID NO: 145411 - DNA, 25 bp, Mus musculus
agacagacgggtacatacatatatt

SEQ ID NO: 145412 - DNA, 25 bp, Mus musculus
agacagacgggttcatacatatatt

SEQ ID NO: 145413 - DNA, 25 bp, Mus musculus
agacagactcacactttggtttgcc

SEQ ID NO: 145414 - DNA, 25 bp, Mus musculus
agacagactcacagctgtagctctg

SEQ ID NO: 145415 - DNA, 25 bp, Mus musculus
agacagactcactctttggtttgcc

SEQ ID NO: 145416 - DNA, 25 bp, Mus musculus
agacagactcactgctgtagctctg

SEQ ID NO: 145417 - DNA, 25 bp, Mus musculus
agacagacttgacgttttcataata

SEQ ID NO: 145418 - DNA, 25 bp, Mus musculus
agacagacttgaggttttcataata

SEQ ID NO: 145419 - DNA, 25 bp, Mus musculus
agacagacttgcagcatttccgcat

SEQ ID NO: 145420 - DNA, 25 bp, Mus musculus
agacagacttgctgcatttccgcat

SEQ ID NO: 145421 - DNA, 25 bp, Mus musculus
agacagagaacaccgaatccaccca

SEQ ID NO: 145422 - DNA, 25 bp, Mus musculus
agacagagaacagcgaatccaccca

SEQ ID NO: 145423 - DNA, 25 bp, Mus musculus
agacagagatatatcatgccagttt

SEQ ID NO: 145424 - DNA, 25 bp, Mus musculus
agacagagatatttcatgccagttt

SEQ ID NO: 145425 - DNA, 25 bp, Mus musculus
agacagagcagaaccgccggacggt

SEQ ID NO: 145426 - DNA, 25 bp, Mus musculus
agacagagcagatccgccggacggt

SEQ ID NO: 145427 - DNA, 25 bp, Mus musculus
agacagagcattacttgcagcaaat

SEQ ID NO: 145428 - DNA, 25 bp, Mus musculus
agacagagcatttcttgcagcaaat

SEQ ID NO: 145429 - DNA, 25 bp, Mus musculus
agacagagccggacctgcagtatta

SEQ ID NO: 145430 - DNA, 25 bp, Mus musculus
agacagagccggtcctgcagtatta

SEQ ID NO: 145431 - DNA, 25 bp, Mus musculus
agacagaggcaaactgggctagtgt

SEQ ID NO: 145432 - DNA, 25 bp, Mus musculus
agacagaggcaatctgggctagtgt

SEQ ID NO: 145433 - DNA, 25 bp, Mus musculus
agacagaggcatagttgcccagcct

SEQ ID NO: 145434 - DNA, 25 bp, Mus musculus
agacagaggcattgttgcccagcct

SEQ ID NO: 145435 - DNA, 25 bp, Mus musculus
agacagaggccccaggactgagcaa

SEQ ID NO: 145436 - DNA, 25 bp, Mus musculus
agacagaggcccgaggactgagcaa

SEQ ID NO: 145437 - DNA, 25 bp, Mus musculus
agacagaggcttccctttataaaga

SEQ ID NO: 145438 - DNA, 25 bp, Mus musculus
agacagaggcttgcctttataaaga

SEQ ID NO: 145439 - DNA, 25 bp, Mus musculus
agacagaggttcagtgggtgacact

SEQ ID NO: 145440 - DNA, 25 bp, Mus musculus
agacagaggttctgtgggtgacact

SEQ ID NO: 145441 - DNA, 25 bp, Mus musculus
agacagagtaacacgggccaagagg

SEQ ID NO: 145442 - DNA, 25 bp, Mus musculus
agacagagtaactcgggccaagagg

SEQ ID NO: 145443 - DNA, 25 bp, Mus musculus
agacagagtgacacccacagcctgc

SEQ ID NO: 145444 - DNA, 25 bp, Mus musculus
agacagagtgactcccacagcctgc

SEQ ID NO: 145445 - DNA, 25 bp, Mus musculus
agacagagttacagctgtccgagga

SEQ ID NO: 145446 - DNA, 25 bp, Mus musculus
agacagagttactgctgtccgagga

SEQ ID NO: 145447 - DNA, 25 bp, Mus musculus
agacagatactgcacttacttcaat

SEQ ID NO: 145448 - DNA, 25 bp, Mus musculus
agacagatactggacttacttcaat

SEQ ID NO: 145449 - DNA, 25 bp, Mus musculus
agacagatccaaactaccagacgct

SEQ ID NO: 145450 - DNA, 25 bp, Mus musculus
agacagatccaatctaccagacgct

SEQ ID NO: 145451 - DNA, 25 bp, Mus musculus
agacagatcctaagtttcacaccac

SEQ ID NO: 145452 - DNA, 25 bp, Mus musculus
agacagatcctatgtttcacaccac

SEQ ID NO: 145453 - DNA, 25 bp, Mus musculus
agacagatcgctactggccagacta

SEQ ID NO: 145454 - DNA, 25 bp, Mus musculus
agacagatcgctagcatatttttaa

SEQ ID NO: 145455 - DNA, 25 bp, Mus musculus
agacagatcgcttctggccagacta

SEQ ID NO: 145456 - DNA, 25 bp, Mus musculus
agacagatcgcttgcatatttttaa

SEQ ID NO: 145457 - DNA, 25 bp, Mus musculus
agacagatcggcagctgggtcccgc

SEQ ID NO: 145458 - DNA, 25 bp, Mus musculus
agacagatcggctgctgggtcccgc

SEQ ID NO: 145459 - DNA, 25 bp, Mus musculus
agacagatcgtcagcattgcgagct

SEQ ID NO: 145460 - DNA, 25 bp, Mus musculus
agacagatcgtctgcattgcgagct

SEQ ID NO: 145461 - DNA, 25 bp, Mus musculus
agacagatcttgacatcttagggaa

SEQ ID NO: 145462 - DNA, 25 bp, Mus musculus
agacagatcttgtcatcttagggaa

SEQ ID NO: 145463 - DNA, 25 bp, Mus musculus
agacagatgacaacggttcccctgg

SEQ ID NO: 145464 - DNA, 25 bp, Mus musculus
agacagatgacatcggttcccctgg

SEQ ID NO: 145465 - DNA, 25 bp, Mus musculus
agacagatggtgagcccctattaat

SEQ ID NO: 145466 - DNA, 25 bp, Mus musculus
agacagatggtgtgcccctattaat

SEQ ID NO: 145467 - DNA, 25 bp, Mus musculus
agacagatgtccctaagttccagga

SEQ ID NO: 145468 - DNA, 25 bp, Mus musculus
agacagatgtccgtaagttccagga

SEQ ID NO: 145469 - DNA, 25 bp, Mus musculus
agacagattactcagaccacgcaac

SEQ ID NO: 145470 - DNA, 25 bp, Mus musculus
agacagattactgagaccacgcaac

SEQ ID NO: 145471 - DNA, 25 bp, Mus musculus
agacagattagaagccagcctggct

SEQ ID NO: 145472 - DNA, 25 bp, Mus musculus
agacagattagatgccagcctggct

SEQ ID NO: 145473 - DNA, 25 bp, Mus musculus
agacagattcccaccttgggagaac

SEQ ID NO: 145474 - DNA, 25 bp, Mus musculus
agacagattccctccttgggagaac

SEQ ID NO: 145475 - DNA, 25 bp, Mus musculus
agacagattcggaccagcagatttc

SEQ ID NO: 145476 - DNA, 25 bp, Mus musculus
agacagattcggtccagcagatttc

SEQ ID NO: 145477 - DNA, 25 bp, Mus musculus
agacagattggtatccttcatggga

SEQ ID NO: 145478 - DNA, 25 bp, Mus musculus
agacagattggtttccttcatggga

SEQ ID NO: 145479 - DNA, 25 bp, Mus musculus
agacagatttccaaccacagctggg

SEQ ID NO: 145480 - DNA, 25 bp, Mus musculus
agacagatttcctaccacagctggg

SEQ ID NO: 145481 - DNA, 25 bp, Mus musculus
agacagatttcgaagcagagcccac

SEQ ID NO: 145482 - DNA, 25 bp, Mus musculus
agacagatttcgtagcagagcccac

SEQ ID NO: 145483 - DNA, 25 bp, Mus musculus
agacagattttgatcctgcatcctg

SEQ ID NO: 145484 - DNA, 25 bp, Mus musculus
agacagattttgttcctgcatcctg

SEQ ID NO: 145485 - DNA, 25 bp, Mus musculus
agacagcaaacaacacagtcaggtg

SEQ ID NO: 145486 - DNA, 25 bp, Mus musculus
agacagcaaacatcacagtcaggtg

SEQ ID NO: 145487 - DNA, 25 bp, Mus musculus
agacagcaaagcatggaccccaggc

SEQ ID NO: 145488 - DNA, 25 bp, Mus musculus
agacagcaaagcttggaccccaggc

SEQ ID NO: 145489 - DNA, 25 bp, Mus musculus
agacagcaacttagcttggctcttt

SEQ ID NO: 145490 - DNA, 25 bp, Mus musculus
agacagcaactttgcttggctcttt

SEQ ID NO: 145491 - DNA, 25 bp, Mus musculus
agacagcacagacaaatggcatacc

SEQ ID NO: 145492 - DNA, 25 bp, Mus musculus
agacagcacagagaaatggcatacc

SEQ ID NO: 145493 - DNA, 25 bp, Mus musculus
agacagcacatcacagcctgaatct

SEQ ID NO: 145494 - DNA, 25 bp, Mus musculus
agacagcacatctcagcctgaatct

SEQ ID NO: 145495 - DNA, 25 bp, Mus musculus
agacagcaccagacagtggcttcat

SEQ ID NO: 145496 - DNA, 25 bp, Mus musculus
agacagcaccagtcagtggcttcat

SEQ ID NO: 145497 - DNA, 25 bp, Mus musculus
agacagcactcccattatttccctt

SEQ ID NO: 145498 - DNA, 25 bp, Mus musculus
agacagcactccgattatttccctt

SEQ ID NO: 145499 - DNA, 25 bp, Mus musculus
agacagcagaaccacggctcggccc

SEQ ID NO: 145500 - DNA, 25 bp, Mus musculus
agacagcagaacgacggctcggccc

SEQ ID NO: 145501 - DNA, 25 bp, Mus musculus
agacagcagcttaggtccggcaact

SEQ ID NO: 145502 - DNA, 25 bp, Mus musculus
agacagcagctttggtccggcaact

SEQ ID NO: 145503 - DNA, 25 bp, Mus musculus
agacagcaggagctccaaagagaat

SEQ ID NO: 145504 - DNA, 25 bp, Mus musculus
agacagcaggaggtccaaagagaat

SEQ ID NO: 145505 - DNA, 25 bp, Mus musculus
agacagcaggcaagtatccccatgg

SEQ ID NO: 145506 - DNA, 25 bp, Mus musculus
agacagcaggcaatccagtgtatgt

SEQ ID NO: 145507 - DNA, 25 bp, Mus musculus
agacagcaggcatgtatccccatgg

SEQ ID NO: 145508 - DNA, 25 bp, Mus musculus
agacagcaggcattccagtgtatgt

SEQ ID NO: 145509 - DNA, 25 bp, Mus musculus
agacagcaggttcccttgctaacat

SEQ ID NO: 145510 - DNA, 25 bp, Mus musculus
agacagcaggttgccttgctaacat

SEQ ID NO: 145511 - DNA, 25 bp, Mus musculus
agacagcataataccttacatcctc

SEQ ID NO: 145512 - DNA, 25 bp, Mus musculus
agacagcataattccttacatcctc

SEQ ID NO: 145513 - DNA, 25 bp, Mus musculus
agacagcatcggatcccatggcaga

SEQ ID NO: 145514 - DNA, 25 bp, Mus musculus
agacagcatcggatctcctggagct

SEQ ID NO: 145515 - DNA, 25 bp, Mus musculus
agacagcatcggttcccatggcaga

SEQ ID NO: 145516 - DNA, 25 bp, Mus musculus
agacagcatcggttctcctggagct

SEQ ID NO: 145517 - DNA, 25 bp, Mus musculus
agacagcatcttcctatgtatccca

SEQ ID NO: 145518 - DNA, 25 bp, Mus musculus
agacagcatcttgctatgtatccca

SEQ ID NO: 145519 - DNA, 25 bp, Mus musculus
agacagcatgacacacagttgggat

SEQ ID NO: 145520 - DNA, 25 bp, Mus musculus
agacagcatgactcacagttgggat

SEQ ID NO: 145521 - DNA, 25 bp, Mus musculus
agacagcatgcacgagtcccagtga

SEQ ID NO: 145522 - DNA, 25 bp, Mus musculus
agacagcatgcaggagtcccagtga

SEQ ID NO: 145523 - DNA, 25 bp, Mus musculus
agacagcatggtagtctccgcagtg

SEQ ID NO: 145524 - DNA, 25 bp, Mus musculus
agacagcatggttgtctccgcagtg

SEQ ID NO: 145525 - DNA, 25 bp, Mus musculus
agacagcattttctgccaaaccgtg

SEQ ID NO: 145526 - DNA, 25 bp, Mus musculus
agacagcattttgtgccaaaccgtg

SEQ ID NO: 145527 - DNA, 25 bp, Mus musculus
agacagccaagacctctctgctatg

SEQ ID NO: 145528 - DNA, 25 bp, Mus musculus
agacagccaagagctctctgctatg

SEQ ID NO: 145529 - DNA, 25 bp, Mus musculus
agacagccaatgacctgcgcagaca

SEQ ID NO: 145530 - DNA, 25 bp, Mus musculus
agacagccaatgtcctgcgcagaca

SEQ ID NO: 145531 - DNA, 25 bp, Mus musculus
agacagccacgactcttcagtgaaa

SEQ ID NO: 145532 - DNA, 25 bp, Mus musculus
agacagccacgagtcttcagtgaaa

SEQ ID NO: 145533 - DNA, 25 bp, Mus musculus
agacagccagatcgcagcagacagt

SEQ ID NO: 145534 - DNA, 25 bp, Mus musculus
agacagccagatggcagcagacagt

SEQ ID NO: 145535 - DNA, 25 bp, Mus musculus
agacagccagctaggttttccgcaa

SEQ ID NO: 145536 - DNA, 25 bp, Mus musculus
agacagccagcttggttttccgcaa

SEQ ID NO: 145537 - DNA, 25 bp, Mus musculus
agacagccaggtccttaccatcaat

SEQ ID NO: 145538 - DNA, 25 bp, Mus musculus
agacagccaggtgcttaccatcaat

SEQ ID NO: 145539 - DNA, 25 bp, Mus musculus
agacagccagtcaaatgcaaggatt

SEQ ID NO: 145540 - DNA, 25 bp, Mus musculus
agacagccagtctaatgcaaggatt

SEQ ID NO: 145541 - DNA, 25 bp, Mus musculus
agacagccatacaaaacccgggtat

SEQ ID NO: 145542 - DNA, 25 bp, Mus musculus
agacagccatactaaacccgggtat

SEQ ID NO: 145543 - DNA, 25 bp, Mus musculus
agacagcccaagattgtgtgagcca

SEQ ID NO: 145544 - DNA, 25 bp, Mus musculus
agacagcccaagtttgtgtgagcca

SEQ ID NO: 145545 - DNA, 25 bp, Mus musculus
agacagcccaggagacgacctcttt

SEQ ID NO: 145546 - DNA, 25 bp, Mus musculus
agacagcccaggtgacgacctcttt

SEQ ID NO: 145547 - DNA, 25 bp, Mus musculus
agacagccctagacctgttcaatat

SEQ ID NO: 145548 - DNA, 25 bp, Mus musculus
agacagccctagtcctgttcaatat

SEQ ID NO: 145549 - DNA, 25 bp, Mus musculus
agacagccctatcagaattgcctac

SEQ ID NO: 145550 - DNA, 25 bp, Mus musculus
agacagccctatctttatgtacgcc

SEQ ID NO: 145551 - DNA, 25 bp, Mus musculus
agacagccctatgagaattgcctac

SEQ ID NO: 145552 - DNA, 25 bp, Mus musculus
agacagccctatgtttatgtacgcc

SEQ ID NO: 145553 - DNA, 25 bp, Mus musculus
agacagccctttcagcttcccgttg

SEQ ID NO: 145554 - DNA, 25 bp, Mus musculus
agacagccctttgagcttcccgttg

SEQ ID NO: 145555 - DNA, 25 bp, Mus musculus
agacagcctcagagatcccatttta

SEQ ID NO: 145556 - DNA, 25 bp, Mus musculus
agacagcctcagtgatcccatttta

SEQ ID NO: 145557 - DNA, 25 bp, Mus musculus
agacagcctggacttcaagtaccct

SEQ ID NO: 145558 - DNA, 25 bp, Mus musculus
agacagcctggagttcaagtaccct

SEQ ID NO: 145559 - DNA, 25 bp, Mus musculus
agacagccttctaagacagcctttg

SEQ ID NO: 145560 - DNA, 25 bp, Mus musculus
agacagccttcttagacagcctttg

SEQ ID NO: 145561 - DNA, 25 bp, Mus musculus
agacagcgcagcagcagtatggctg

SEQ ID NO: 145562 - DNA, 25 bp, Mus musculus
agacagcgcagctgcagtatggctg

SEQ ID NO: 145563 - DNA, 25 bp, Mus musculus
agacagcgcaggaggttgttagcaa

SEQ ID NO: 145564 - DNA, 25 bp, Mus musculus
agacagcgcaggtggttgttagcaa

SEQ ID NO: 145565 - DNA, 25 bp, Mus musculus
agacagcgcagtcgagtctctgcca

SEQ ID NO: 145566 - DNA, 25 bp, Mus musculus
agacagcgcagtggagtctctgcca

SEQ ID NO: 145567 - DNA, 25 bp, Mus musculus
agacagcgggatcgtttcagtccag

SEQ ID NO: 145568 - DNA, 25 bp, Mus musculus
agacagcgggatggtttcagtccag

SEQ ID NO: 145569 - DNA, 25 bp, Mus musculus
agacagcgggcacagtgcatcagct

SEQ ID NO: 145570 - DNA, 25 bp, Mus musculus
agacagcgggcagagtgcatcagct

SEQ ID NO: 145571 - DNA, 25 bp, Mus musculus
agacagcgggtcatcagaactcaga

SEQ ID NO: 145572 - DNA, 25 bp, Mus musculus
agacagcgggtcttcagaactcaga

SEQ ID NO: 145573 - DNA, 25 bp, Mus musculus
agacagcggtacagggttgcttttt

SEQ ID NO: 145574 - DNA, 25 bp, Mus musculus
agacagcggtactgggttgcttttt

SEQ ID NO: 145575 - DNA, 25 bp, Mus musculus
agacagctaaaaactcatcatcata

SEQ ID NO: 145576 - DNA, 25 bp, Mus musculus
agacagctaaaatctcatcatcata

SEQ ID NO: 145577 - DNA, 25 bp, Mus musculus
agacagctagaaccggcgcgcgtta

SEQ ID NO: 145578 - DNA, 25 bp, Mus musculus
agacagctagaagcggcgcgcgtta

SEQ ID NO: 145579 - DNA, 25 bp, Mus musculus
agacagctagatctgcttcttttag

SEQ ID NO: 145580 - DNA, 25 bp, Mus musculus
agacagctagatgtgcttcttttag

SEQ ID NO: 145581 - DNA, 25 bp, Mus musculus
agacagctagctaacagtgtagtac

SEQ ID NO: 145582 - DNA, 25 bp, Mus musculus
agacagctagcttacagtgtagtac

SEQ ID NO: 145583 - DNA, 25 bp, Mus musculus
agacagctatggaacctcaccggaa

SEQ ID NO: 145584 - DNA, 25 bp, Mus musculus
agacagctatggtacctcaccggaa

SEQ ID NO: 145585 - DNA, 25 bp, Mus musculus
agacagctccctagggaccttggaa

SEQ ID NO: 145586 - DNA, 25 bp, Mus musculus
agacagctcccttgggaccttggaa

SEQ ID NO: 145587 - DNA, 25 bp, Mus musculus
agacagctcgatctcatcctgtcaa

SEQ ID NO: 145588 - DNA, 25 bp, Mus musculus
agacagctcgatgtcatcctgtcaa

SEQ ID NO: 145589 - DNA, 25 bp, Mus musculus
agacagctcggcactcttgagagaa

SEQ ID NO: 145590 - DNA, 25 bp, Mus musculus
agacagctcggctctcttgagagaa

SEQ ID NO: 145591 - DNA, 25 bp, Mus musculus
agacagctcgtcaaggacggccgag

SEQ ID NO: 145592 - DNA, 25 bp, Mus musculus
agacagctcgtctaggacggccgag

SEQ ID NO: 145593 - DNA, 25 bp, Mus musculus
agacagctctgcaaccaggagacat

SEQ ID NO: 145594 - DNA, 25 bp, Mus musculus
agacagctctgctaccaggagacat

SEQ ID NO: 145595 - DNA, 25 bp, Mus musculus
agacagctctttcagcctcattgca

SEQ ID NO: 145596 - DNA, 25 bp, Mus musculus
agacagctctttgagcctcattgca

SEQ ID NO: 145597 - DNA, 25 bp, Mus musculus
agacagctgagacttctccctccgt

SEQ ID NO: 145598 - DNA, 25 bp, Mus musculus
agacagctgagagttctccctccgt

SEQ ID NO: 145599 - DNA, 25 bp, Mus musculus
agacagctgctcacgggatttaaac

SEQ ID NO: 145600 - DNA, 25 bp, Mus musculus
agacagctgctctcgggatttaaac

SEQ ID NO: 145601 - DNA, 25 bp, Mus musculus
agacagctgctgagtgaccctctgt

SEQ ID NO: 145602 - DNA, 25 bp, Mus musculus
agacagctgctgtgtgaccctctgt

SEQ ID NO: 145603 - DNA, 25 bp, Mus musculus
agacagctggagacatctacactga

SEQ ID NO: 145604 - DNA, 25 bp, Mus musculus
agacagctggagtcatctacactga

SEQ ID NO: 145605 - DNA, 25 bp, Mus musculus
agacagctggtcaactgcattcggt

SEQ ID NO: 145606 - DNA, 25 bp, Mus musculus
agacagctggtctactgcattcggt

SEQ ID NO: 145607 - DNA, 25 bp, Mus musculus
agacagctgtagatcctgcttgtat

SEQ ID NO: 145608 - DNA, 25 bp, Mus musculus
agacagctgtagttcctgcttgtat

SEQ ID NO: 145609 - DNA, 25 bp, Mus musculus
agacagctgtcacctccaacttaaa

SEQ ID NO: 145610 - DNA, 25 bp, Mus musculus
agacagctgtcagctccaacttaaa

SEQ ID NO: 145611 - DNA, 25 bp, Mus musculus
agacagctgtctcggacattttcaa

SEQ ID NO: 145612 - DNA, 25 bp, Mus musculus
agacagctgtctgggacattttcaa

SEQ ID NO: 145613 - DNA, 25 bp, Mus musculus
agacagctgtgaccttccatgcagc

SEQ ID NO: 145614 - DNA, 25 bp, Mus musculus
agacagctgtgagcttccatgcagc

SEQ ID NO: 145615 - DNA, 25 bp, Mus musculus
agacagcttgacatttgtttgacat

SEQ ID NO: 145616 - DNA, 25 bp, Mus musculus
agacagcttgacttttgtttgacat

SEQ ID NO: 145617 - DNA, 25 bp, Mus musculus
agacagcttgcacaccctagggtcc

SEQ ID NO: 145618 - DNA, 25 bp, Mus musculus
agacagcttgcagaccctagggtcc

SEQ ID NO: 145619 - DNA, 25 bp, Mus musculus
agacagctttcaaatttagttgtaa

SEQ ID NO: 145620 - DNA, 25 bp, Mus musculus
agacagctttcatatttagttgtaa

SEQ ID NO: 145621 - DNA, 25 bp, Mus musculus
agacagctttgcctgcagtttacac

SEQ ID NO: 145622 - DNA, 25 bp, Mus musculus
agacagctttgcgtgcagtttacac

SEQ ID NO: 145623 - DNA, 25 bp, Mus musculus
agacagctttgtcctcactaggtga

SEQ ID NO: 145624 - DNA, 25 bp, Mus musculus
agacagctttgtgctcactaggtga

SEQ ID NO: 145625 - DNA, 25 bp, Mus musculus
agacagcttttgatgtgggatccaa

SEQ ID NO: 145626 - DNA, 25 bp, Mus musculus
agacagcttttgttgtgggatccaa

SEQ ID NO: 145627 - DNA, 25 bp, Mus musculus
agacaggaaagtccttgttacacaa

SEQ ID NO: 145628 - DNA, 25 bp, Mus musculus
agacaggaaagtgcttgttacacaa

SEQ ID NO: 145629 - DNA, 25 bp, Mus musculus
agacaggaagaacctactgcggctg

SEQ ID NO: 145630 - DNA, 25 bp, Mus musculus
agacaggaagaagctactgcggctg

SEQ ID NO: 145631 - DNA, 25 bp, Mus musculus
agacaggacacactgagctatgaat

SEQ ID NO: 145632 - DNA, 25 bp, Mus musculus
agacaggacacagtgagctatgaat

SEQ ID NO: 145633 - DNA, 25 bp, Mus musculus
agacaggacactctgtggacttcac

SEQ ID NO: 145634 - DNA, 25 bp, Mus musculus
agacaggacactgtgtggacttcac

SEQ ID NO: 145635 - DNA, 25 bp, Mus musculus
agacaggacagcaactaacattcat

SEQ ID NO: 145636 - DNA, 25 bp, Mus musculus
agacaggacagctactaacattcat

SEQ ID NO: 145637 - DNA, 25 bp, Mus musculus
agacaggacaggatacagcacgaat

SEQ ID NO: 145638 - DNA, 25 bp, Mus musculus
agacaggacaggttacagcacgaat

SEQ ID NO: 145639 - DNA, 25 bp, Mus musculus
agacaggacctaagcaacgcacaga

SEQ ID NO: 145640 - DNA, 25 bp, Mus musculus
agacaggacctatgcaacgcacaga

SEQ ID NO: 145641 - DNA, 25 bp, Mus musculus
agacaggacctgctaatccttctct

SEQ ID NO: 145642 - DNA, 25 bp, Mus musculus
agacaggacctgctgggtcactcta

SEQ ID NO: 145643 - DNA, 25 bp, Mus musculus
agacaggacctggtaatccttctct

SEQ ID NO: 145644 - DNA, 25 bp, Mus musculus
agacaggacctggtgggtcactcta

SEQ ID NO: 145645 - DNA, 25 bp, Mus musculus
agacaggagagtaacaagtggagat

SEQ ID NO: 145646 - DNA, 25 bp, Mus musculus
agacaggagagttacaagtggagat

SEQ ID NO: 145647 - DNA, 25 bp, Mus musculus
agacaggagcttcgcagccttgcgt

SEQ ID NO: 145648 - DNA, 25 bp, Mus musculus
agacaggagcttggcagccttgcgt

SEQ ID NO: 145649 - DNA, 25 bp, Mus musculus
agacaggaggcaaccgtgccttgct

SEQ ID NO: 145650 - DNA, 25 bp, Mus musculus
agacaggaggcaattttccctacct

SEQ ID NO: 145651 - DNA, 25 bp, Mus musculus
agacaggaggcatccgtgccttgct

SEQ ID NO: 145652 - DNA, 25 bp, Mus musculus
agacaggaggcatttttccctacct

SEQ ID NO: 145653 - DNA, 25 bp, Mus musculus
agacaggaggcccttcgccctaaag

SEQ ID NO: 145654 - DNA, 25 bp, Mus musculus
agacaggaggccgttcgccctaaag

SEQ ID NO: 145655 - DNA, 25 bp, Mus musculus
agacaggaggctcccgggtctcact

SEQ ID NO: 145656 - DNA, 25 bp, Mus musculus
agacaggaggctgccgggtctcact

SEQ ID NO: 145657 - DNA, 25 bp, Mus musculus
agacaggaggtcatcccgggagcta

SEQ ID NO: 145658 - DNA, 25 bp, Mus musculus
agacaggaggtcttcccgggagcta

SEQ ID NO: 145659 - DNA, 25 bp, Mus musculus
agacaggagtcacagtcaagtcacc

SEQ ID NO: 145660 - DNA, 25 bp, Mus musculus
agacaggagtcagagtcaagtcacc

SEQ ID NO: 145661 - DNA, 25 bp, Mus musculus
agacaggagtccaagctaccagtga

SEQ ID NO: 145662 - DNA, 25 bp, Mus musculus
agacaggagtcctagctaccagtga

SEQ ID NO: 145663 - DNA, 25 bp, Mus musculus
agacaggataacactggctcgcctt

SEQ ID NO: 145664 - DNA, 25 bp, Mus musculus
agacaggataactctggctcgcctt

SEQ ID NO: 145665 - DNA, 25 bp, Mus musculus
agacaggatcctcaactcaccagac

SEQ ID NO: 145666 - DNA, 25 bp, Mus musculus
agacaggatcctgaactcaccagac

SEQ ID NO: 145667 - DNA, 25 bp, Mus musculus
agacaggatctgacatgtttgccaa

SEQ ID NO: 145668 - DNA, 25 bp, Mus musculus
agacaggatctgtcatgtttgccaa

SEQ ID NO: 145669 - DNA, 25 bp, Mus musculus
agacaggcaccaacagggacagaat

SEQ ID NO: 145670 - DNA, 25 bp, Mus musculus
agacaggcaccatcagggacagaat

SEQ ID NO: 145671 - DNA, 25 bp, Mus musculus
agacaggcacccaacagacatgagc

SEQ ID NO: 145672 - DNA, 25 bp, Mus musculus
agacaggcacccatcatgagacagg

SEQ ID NO: 145673 - DNA, 25 bp, Mus musculus
agacaggcaccctacagacatgagc

SEQ ID NO: 145674 - DNA, 25 bp, Mus musculus
agacaggcacccttcatgagacagg

SEQ ID NO: 145675 - DNA, 25 bp, Mus musculus
agacaggcagccatgtttccaggtg

SEQ ID NO: 145676 - DNA, 25 bp, Mus musculus
agacaggcagccttgtttccaggtg

SEQ ID NO: 145677 - DNA, 25 bp, Mus musculus
agacaggcaggccatctgctacaga

SEQ ID NO: 145678 - DNA, 25 bp, Mus musculus
agacaggcaggcgatctgctacaga

SEQ ID NO: 145679 - DNA, 25 bp, Mus musculus
agacaggcatgcacacttagtgtaa

SEQ ID NO: 145680 - DNA, 25 bp, Mus musculus
agacaggcatgctcacttagtgtaa

SEQ ID NO: 145681 - DNA, 25 bp, Mus musculus
agacaggccagtcaaagagtctcct

SEQ ID NO: 145682 - DNA, 25 bp, Mus musculus
agacaggccagtgaaagagtctcct

SEQ ID NO: 145683 - DNA, 25 bp, Mus musculus
agacaggcccggcagagacagcctc

SEQ ID NO: 145684 - DNA, 25 bp, Mus musculus
agacaggcccgggagagacagcctc

SEQ ID NO: 145685 - DNA, 25 bp, Mus musculus
agacaggccctcatgaggcatgcag

SEQ ID NO: 145686 - DNA, 25 bp, Mus musculus
agacaggccctcttgaggcatgcag

SEQ ID NO: 145687 - DNA, 25 bp, Mus musculus
agacaggccgctctacgctgctgtg

SEQ ID NO: 145688 - DNA, 25 bp, Mus musculus
agacaggccgctgtacgctgctgtg

SEQ ID NO: 145689 - DNA, 25 bp, Mus musculus
agacaggcctgccaggctttctatc

SEQ ID NO: 145690 - DNA, 25 bp, Mus musculus
agacaggcctgcgaggctttctatc

SEQ ID NO: 145691 - DNA, 25 bp, Mus musculus
agacaggccttaagccaagccagaa

SEQ ID NO: 145692 - DNA, 25 bp, Mus musculus
agacaggccttatgccaagccagaa

SEQ ID NO: 145693 - DNA, 25 bp, Mus musculus
agacaggccttccagtccatgctac

SEQ ID NO: 145694 - DNA, 25 bp, Mus musculus
agacaggccttcgagtccatgctac

SEQ ID NO: 145695 - DNA, 25 bp, Mus musculus
agacaggctaggagagcaccacgcc

SEQ ID NO: 145696 - DNA, 25 bp, Mus musculus
agacaggctaggtgagcaccacgcc

SEQ ID NO: 145697 - DNA, 25 bp, Mus musculus
agacaggctggaagccactgggaaa

SEQ ID NO: 145698 - DNA, 25 bp, Mus musculus
agacaggctggatgccactgggaaa

SEQ ID NO: 145699 - DNA, 25 bp, Mus musculus
agacaggcttcacttcttgctgcca

SEQ ID NO: 145700 - DNA, 25 bp, Mus musculus
agacaggcttcagttcttgctgcca

SEQ ID NO: 145701 - DNA, 25 bp, Mus musculus
agacaggcttctatttctaccaccg

SEQ ID NO: 145702 - DNA, 25 bp, Mus musculus
agacaggcttctttttctaccaccg

SEQ ID NO: 145703 - DNA, 25 bp, Mus musculus
agacagggatccagcggcccaggat

SEQ ID NO: 145704 - DNA, 25 bp, Mus musculus
agacagggatccctgccacttgctg

SEQ ID NO: 145705 - DNA, 25 bp, Mus musculus
agacagggatccgtgccacttgctg

SEQ ID NO: 145706 - DNA, 25 bp, Mus musculus
agacagggatcctgcggcccaggat

SEQ ID NO: 145707 - DNA, 25 bp, Mus musculus
agacagggattgactccctctatga

SEQ ID NO: 145708 - DNA, 25 bp, Mus musculus
agacagggattgtctccctctatga

SEQ ID NO: 145709 - DNA, 25 bp, Mus musculus
agacagggcctcactttgcctcaac

SEQ ID NO: 145710 - DNA, 25 bp, Mus musculus
agacagggcctctctttgcctcaac

SEQ ID NO: 145711 - DNA, 25 bp, Mus musculus
agacagggccttcagccacttaatt

SEQ ID NO: 145712 - DNA, 25 bp, Mus musculus
agacagggccttgagccacttaatt

SEQ ID NO: 145713 - DNA, 25 bp, Mus musculus
agacagggtaggcaattcttccaca

SEQ ID NO: 145714 - DNA, 25 bp, Mus musculus
agacagggtagggaattcttccaca

SEQ ID NO: 145715 - DNA, 25 bp, Mus musculus
agacagggtcccattatgctctgac

SEQ ID NO: 145716 - DNA, 25 bp, Mus musculus
agacagggtccctttatgctctgac

SEQ ID NO: 145717 - DNA, 25 bp, Mus musculus
agacagggtcctaccattttgtata

SEQ ID NO: 145718 - DNA, 25 bp, Mus musculus
agacagggtcctatcatccgtgtgt

SEQ ID NO: 145719 - DNA, 25 bp, Mus musculus
agacagggtccttccattttgtata

SEQ ID NO: 145720 - DNA, 25 bp, Mus musculus
agacagggtcctttcatccgtgtgt

SEQ ID NO: 145721 - DNA, 25 bp, Mus musculus
agacagggtcttagcttttcttcac

SEQ ID NO: 145722 - DNA, 25 bp, Mus musculus
agacagggtctttgcttttcttcac

SEQ ID NO: 145723 - DNA, 25 bp, Mus musculus
agacagggtgctatatccatggact

SEQ ID NO: 145724 - DNA, 25 bp, Mus musculus
agacagggtgctttatccatggact

SEQ ID NO: 145725 - DNA, 25 bp, Mus musculus
agacaggtatcacacttctctttcg

SEQ ID NO: 145726 - DNA, 25 bp, Mus musculus
agacaggtatcagacttctctttcg

SEQ ID NO: 145727 - DNA, 25 bp, Mus musculus
agacaggtcaagcttgggctgccaa

SEQ ID NO: 145728 - DNA, 25 bp, Mus musculus
agacaggtcaaggttgggctgccaa

SEQ ID NO: 145729 - DNA, 25 bp, Mus musculus
agacaggtcagacgtttctcagttt

SEQ ID NO: 145730 - DNA, 25 bp, Mus musculus
agacaggtcagaggtttctcagttt

SEQ ID NO: 145731 - DNA, 25 bp, Mus musculus
agacaggtccccaaattgctatctg

SEQ ID NO: 145732 - DNA, 25 bp, Mus musculus
agacaggtcccctaattgctatctg

SEQ ID NO: 145733 - DNA, 25 bp, Mus musculus
agacaggtcctgatgttgccaacct

SEQ ID NO: 145734 - DNA, 25 bp, Mus musculus
agacaggtcctgttgttgccaacct

SEQ ID NO: 145735 - DNA, 25 bp, Mus musculus
agacaggtcggaattctgtgcctat

SEQ ID NO: 145736 - DNA, 25 bp, Mus musculus
agacaggtcggatttctgtgcctat

SEQ ID NO: 145737 - DNA, 25 bp, Mus musculus
agacaggtcgttaacaactaaatag

SEQ ID NO: 145738 - DNA, 25 bp, Mus musculus
agacaggtcgtttacaactaaatag

SEQ ID NO: 145739 - DNA, 25 bp, Mus musculus
agacaggtgctcactgtagctgcca

SEQ ID NO: 145740 - DNA, 25 bp, Mus musculus
agacaggtgctctctgtagctgcca

SEQ ID NO: 145741 - DNA, 25 bp, Mus musculus
agacaggtggctacataagtctcac

SEQ ID NO: 145742 - DNA, 25 bp, Mus musculus
agacaggtggcttcataagtctcac

SEQ ID NO: 145743 - DNA, 25 bp, Mus musculus
agacaggtgtccatcagtgatagca

SEQ ID NO: 145744 - DNA, 25 bp, Mus musculus
agacaggtgtccttcagtgatagca

SEQ ID NO: 145745 - DNA, 25 bp, Mus musculus
agacaggtgtgcacgctcgggttta

SEQ ID NO: 145746 - DNA, 25 bp, Mus musculus
agacaggtgtgctcgctcgggttta

SEQ ID NO: 145747 - DNA, 25 bp, Mus musculus
agacaggttcacagggaagactgaa

SEQ ID NO: 145748 - DNA, 25 bp, Mus musculus
agacaggttcactgggaagactgaa

SEQ ID NO: 145749 - DNA, 25 bp, Mus musculus
agacaggttcttactccatatccct

SEQ ID NO: 145750 - DNA, 25 bp, Mus musculus
agacaggttctttctccatatccct

SEQ ID NO: 145751 - DNA, 25 bp, Mus musculus
agacaggtttacatgctcacagact

SEQ ID NO: 145752 - DNA, 25 bp, Mus musculus
agacaggtttacttgctcacagact

SEQ ID NO: 145753 - DNA, 25 bp, Mus musculus
agacagtaaatcactctttccccag

SEQ ID NO: 145754 - DNA, 25 bp, Mus musculus
agacagtaaatctctctttccccag

SEQ ID NO: 145755 - DNA, 25 bp, Mus musculus
agacagtaaccaccttgctccgggc

SEQ ID NO: 145756 - DNA, 25 bp, Mus musculus
agacagtaaccagcttgctccgggc

SEQ ID NO: 145757 - DNA, 25 bp, Mus musculus
agacagtaactgaacacttcagaca

SEQ ID NO: 145758 - DNA, 25 bp, Mus musculus
agacagtaactgtacacttcagaca

SEQ ID NO: 145759 - DNA, 25 bp, Mus musculus
agacagtaaggccttgttccgtgac

SEQ ID NO: 145760 - DNA, 25 bp, Mus musculus
agacagtaaggcgttgttccgtgac

SEQ ID NO: 145761 - DNA, 25 bp, Mus musculus
agacagtaagttctggcctcgacct

SEQ ID NO: 145762 - DNA, 25 bp, Mus musculus
agacagtaagttgtggcctcgacct

SEQ ID NO: 145763 - DNA, 25 bp, Mus musculus
agacagtaatagcagaaccgactta

SEQ ID NO: 145764 - DNA, 25 bp, Mus musculus
agacagtaataggagaaccgactta

SEQ ID NO: 145765 - DNA, 25 bp, Mus musculus
agacagtaccttctctggatttctc

SEQ ID NO: 145766 - DNA, 25 bp, Mus musculus
agacagtaccttgtctggatttctc

SEQ ID NO: 145767 - DNA, 25 bp, Mus musculus
agacagtactatagattttaaagga

SEQ ID NO: 145768 - DNA, 25 bp, Mus musculus
agacagtactattgattttaaagga

SEQ ID NO: 145769 - DNA, 25 bp, Mus musculus
agacagtactcaacaatggatctct

SEQ ID NO: 145770 - DNA, 25 bp, Mus musculus
agacagtactcatcaatggatctct

SEQ ID NO: 145771 - DNA, 25 bp, Mus musculus
agacagtagctacacactagatgca

SEQ ID NO: 145772 - DNA, 25 bp, Mus musculus
agacagtagctagacactagatgca

SEQ ID NO: 145773 - DNA, 25 bp, Mus musculus
agacagtagctgaccattcgtctcc

SEQ ID NO: 145774 - DNA, 25 bp, Mus musculus
agacagtagctgtccattcgtctcc

SEQ ID NO: 145775 - DNA, 25 bp, Mus musculus
agacagtaggagactcactcgctgc

SEQ ID NO: 145776 - DNA, 25 bp, Mus musculus
agacagtaggagtctcactcgctgc

SEQ ID NO: 145777 - DNA, 25 bp, Mus musculus
agacagtaggctcctgagtcacctg

SEQ ID NO: 145778 - DNA, 25 bp, Mus musculus
agacagtaggctgctgagtcacctg

SEQ ID NO: 145779 - DNA, 25 bp, Mus musculus
agacagtatatcatggaactccata

SEQ ID NO: 145780 - DNA, 25 bp, Mus musculus
agacagtatatcttggaactccata

SEQ ID NO: 145781 - DNA, 25 bp, Mus musculus
agacagtatggcctccttagtggtt

SEQ ID NO: 145782 - DNA, 25 bp, Mus musculus
agacagtatggcgtccttagtggtt

SEQ ID NO: 145783 - DNA, 25 bp, Mus musculus
agacagtcaacacggcataggcatt

SEQ ID NO: 145784 - DNA, 25 bp, Mus musculus
agacagtcaacagggcataggcatt

SEQ ID NO: 145785 - DNA, 25 bp, Mus musculus
agacagtcacaaacgctgatgttgc

SEQ ID NO: 145786 - DNA, 25 bp, Mus musculus
agacagtcacaatcgctgatgttgc

SEQ ID NO: 145787 - DNA, 25 bp, Mus musculus
agacagtcagctacattacctacac

SEQ ID NO: 145788 - DNA, 25 bp, Mus musculus
agacagtcagcttcattacctacac

SEQ ID NO: 145789 - DNA, 25 bp, Mus musculus
agacagtcatgcagattgccttgcc

SEQ ID NO: 145790 - DNA, 25 bp, Mus musculus
agacagtcatgctgattgccttgcc

SEQ ID NO: 145791 - DNA, 25 bp, Mus musculus
agacagtccactcccttatttctgt

SEQ ID NO: 145792 - DNA, 25 bp, Mus musculus
agacagtccactgccttatttctgt

SEQ ID NO: 145793 - DNA, 25 bp, Mus musculus
agacagtccattacagcccaggaat

SEQ ID NO: 145794 - DNA, 25 bp, Mus musculus
agacagtccatttcagcccaggaat

SEQ ID NO: 145795 - DNA, 25 bp, Mus musculus
agacagtctaaaacaacacagggct

SEQ ID NO: 145796 - DNA, 25 bp, Mus musculus
agacagtctaaatcaacacagggct

SEQ ID NO: 145797 - DNA, 25 bp, Mus musculus
agacagtctactcaggctggcacga

SEQ ID NO: 145798 - DNA, 25 bp, Mus musculus
agacagtctactgaggctggcacga

SEQ ID NO: 145799 - DNA, 25 bp, Mus musculus
agacagtctagtagtctacctgccc

SEQ ID NO: 145800 - DNA, 25 bp, Mus musculus
agacagtctagttgtctacctgccc

SEQ ID NO: 145801 - DNA, 25 bp, Mus musculus
agacagtctgacacatcctctgtgg

SEQ ID NO: 145802 - DNA, 25 bp, Mus musculus
agacagtctgactcatcctctgtgg

SEQ ID NO: 145803 - DNA, 25 bp, Mus musculus
agacagtctgtgatgcccgtagtca

SEQ ID NO: 145804 - DNA, 25 bp, Mus musculus
agacagtctgtgttgcccgtagtca

SEQ ID NO: 145805 - DNA, 25 bp, Mus musculus
agacagtctgttaccattgccagaa

SEQ ID NO: 145806 - DNA, 25 bp, Mus musculus
agacagtctgtttccattgccagaa

SEQ ID NO: 145807 - DNA, 25 bp, Mus musculus
agacagtgaactagaccttggagac

SEQ ID NO: 145808 - DNA, 25 bp, Mus musculus
agacagtgaacttgaccttggagac

SEQ ID NO: 145809 - DNA, 25 bp, Mus musculus
agacagtgaaggcttgccatcgtaa

SEQ ID NO: 145810 - DNA, 25 bp, Mus musculus
agacagtgaagggttgccatcgtaa

SEQ ID NO: 145811 - DNA, 25 bp, Mus musculus
agacagtgacacaatccatgattag

SEQ ID NO: 145812 - DNA, 25 bp, Mus musculus
agacagtgacactatccatgattag

SEQ ID NO: 145813 - DNA, 25 bp, Mus musculus
agacagtgactcaggcgatcagctg

SEQ ID NO: 145814 - DNA, 25 bp, Mus musculus
agacagtgactctggcgatcagctg

SEQ ID NO: 145815 - DNA, 25 bp, Mus musculus
agacagtgacttattcctaggagga

SEQ ID NO: 145816 - DNA, 25 bp, Mus musculus
agacagtgactttttcctaggagga

SEQ ID NO: 145817 - DNA, 25 bp, Mus musculus
agacagtgagtgctgctttggcatt

SEQ ID NO: 145818 - DNA, 25 bp, Mus musculus
agacagtgagtggtgctttggcatt

SEQ ID NO: 145819 - DNA, 25 bp, Mus musculus
agacagtgatcccaatctggacccg

SEQ ID NO: 145820 - DNA, 25 bp, Mus musculus
agacagtgatccgaatctggacccg

SEQ ID NO: 145821 - DNA, 25 bp, Mus musculus
agacagtgatgtacctgagccgcac

SEQ ID NO: 145822 - DNA, 25 bp, Mus musculus
agacagtgatgttcctgagccgcac

SEQ ID NO: 145823 - DNA, 25 bp, Mus musculus
agacagtgcacgctgcaggccatgt

SEQ ID NO: 145824 - DNA, 25 bp, Mus musculus
agacagtgcacggtgcaggccatgt

SEQ ID NO: 145825 - DNA, 25 bp, Mus musculus
agacagtgccagatcttgacacaaa

SEQ ID NO: 145826 - DNA, 25 bp, Mus musculus
agacagtgccagttcttgacacaaa

SEQ ID NO: 145827 - DNA, 25 bp, Mus musculus
agacagtgcccaagagactcccatt

SEQ ID NO: 145828 - DNA, 25 bp, Mus musculus
agacagtgcccatgagactcccatt

SEQ ID NO: 145829 - DNA, 25 bp, Mus musculus
agacagtgcctaagggagccagtca

SEQ ID NO: 145830 - DNA, 25 bp, Mus musculus
agacagtgcctatgggagccagtca

SEQ ID NO: 145831 - DNA, 25 bp, Mus musculus
agacagtgcctcagctgattgggaa

SEQ ID NO: 145832 - DNA, 25 bp, Mus musculus
agacagtgcctctgctgattgggaa

SEQ ID NO: 145833 - DNA, 25 bp, Mus musculus
agacagtgctggattgacggcaccc

SEQ ID NO: 145834 - DNA, 25 bp, Mus musculus
agacagtgctggtttgacggcaccc

SEQ ID NO: 145835 - DNA, 25 bp, Mus musculus
agacagtggaatcaagtcggaagat

SEQ ID NO: 145836 - DNA, 25 bp, Mus musculus
agacagtggaatgaagtcggaagat

SEQ ID NO: 145837 - DNA, 25 bp, Mus musculus
agacagtggacgcacgcaaatgcag

SEQ ID NO: 145838 - DNA, 25 bp, Mus musculus
agacagtggacggacgcaaatgcag

SEQ ID NO: 145839 - DNA, 25 bp, Mus musculus
agacagtggcgtaggatggcaccct

SEQ ID NO: 145840 - DNA, 25 bp, Mus musculus
agacagtggcgttggatggcaccct

SEQ ID NO: 145841 - DNA, 25 bp, Mus musculus
agacagtggcttagaattggcccca

SEQ ID NO: 145842 - DNA, 25 bp, Mus musculus
agacagtggcttcccattagataag

SEQ ID NO: 145843 - DNA, 25 bp, Mus musculus
agacagtggcttgccattagataag

SEQ ID NO: 145844 - DNA, 25 bp, Mus musculus
agacagtggctttgaattggcccca

SEQ ID NO: 145845 - DNA, 25 bp, Mus musculus
agacagtgggacctaccagtgctgt

SEQ ID NO: 145846 - DNA, 25 bp, Mus musculus
agacagtgggacgtaccagtgctgt

SEQ ID NO: 145847 - DNA, 25 bp, Mus musculus
agacagtgggatagttaccgcctcc

SEQ ID NO: 145848 - DNA, 25 bp, Mus musculus
agacagtgggattgttaccgcctcc

SEQ ID NO: 145849 - DNA, 25 bp, Mus musculus
agacagtgtctcaaagcgccaacag

SEQ ID NO: 145850 - DNA, 25 bp, Mus musculus
agacagtgtctctaagcgccaacag

SEQ ID NO: 145851 - DNA, 25 bp, Mus musculus
agacagtgtcttactggttggcagc

SEQ ID NO: 145852 - DNA, 25 bp, Mus musculus
agacagtgtctttctggttggcagc

SEQ ID NO: 145853 - DNA, 25 bp, Mus musculus
agacagtgtgatcagcatggtgaca

SEQ ID NO: 145854 - DNA, 25 bp, Mus musculus
agacagtgtgatgagcatggtgaca

SEQ ID NO: 145855 - DNA, 25 bp, Mus musculus
agacagtgtgcccagtgtgccccgt

SEQ ID NO: 145856 - DNA, 25 bp, Mus musculus
agacagtgtgccgagtgtgccccgt

SEQ ID NO: 145857 - DNA, 25 bp, Mus musculus
agacagtgtgctcggctgctcctta

SEQ ID NO: 145858 - DNA, 25 bp, Mus musculus
agacagtgtgctgggctgctcctta

SEQ ID NO: 145859 - DNA, 25 bp, Mus musculus
agacagttacctcgctctgggactt

SEQ ID NO: 145860 - DNA, 25 bp, Mus musculus
agacagttacctggctctgggactt

SEQ ID NO: 145861 - DNA, 25 bp, Mus musculus
agacagttacttcctctggagcaga

SEQ ID NO: 145862 - DNA, 25 bp, Mus musculus
agacagttacttgctctggagcaga

SEQ ID NO: 145863 - DNA, 25 bp, Mus musculus
agacagttcaagatcacgggaggga

SEQ ID NO: 145864 - DNA, 25 bp, Mus musculus
agacagttcaagttcacgggaggga

SEQ ID NO: 145865 - DNA, 25 bp, Mus musculus
agacagttcaatctgatccctcctg

SEQ ID NO: 145866 - DNA, 25 bp, Mus musculus
agacagttcaatgtgatccctcctg

SEQ ID NO: 145867 - DNA, 25 bp, Mus musculus
agacagttcattccttctcttggca

SEQ ID NO: 145868 - DNA, 25 bp, Mus musculus
agacagttcattgcttctcttggca

SEQ ID NO: 145869 - DNA, 25 bp, Mus musculus
agacagttccacatcctggtgacta

SEQ ID NO: 145870 - DNA, 25 bp, Mus musculus
agacagttccacttcctggtgacta

SEQ ID NO: 145871 - DNA, 25 bp, Mus musculus
agacagttccctctatctagctctg

SEQ ID NO: 145872 - DNA, 25 bp, Mus musculus
agacagttccctgtatctagctctg

SEQ ID NO: 145873 - DNA, 25 bp, Mus musculus
agacagttcctgactttgtagccac

SEQ ID NO: 145874 - DNA, 25 bp, Mus musculus
agacagttcctgtctttgtagccac

SEQ ID NO: 145875 - DNA, 25 bp, Mus musculus
agacagttgcccagcgtctcaagtt

SEQ ID NO: 145876 - DNA, 25 bp, Mus musculus
agacagttgccctgcgtctcaagtt

SEQ ID NO: 145877 - DNA, 25 bp, Mus musculus
agacagttgcctctatgacctcgct

SEQ ID NO: 145878 - DNA, 25 bp, Mus musculus
agacagttgcctgtatgacctcgct

SEQ ID NO: 145879 - DNA, 25 bp, Mus musculus
agacagttgctgaccttattcctgt

SEQ ID NO: 145880 - DNA, 25 bp, Mus musculus
agacagttgctgattggctgaggtt

SEQ ID NO: 145881 - DNA, 25 bp, Mus musculus
agacagttgctgtccttattcctgt

SEQ ID NO: 145882 - DNA, 25 bp, Mus musculus
agacagttgctgtttggctgaggtt

SEQ ID NO: 145883 - DNA, 25 bp, Mus musculus
agacagttggacagcatggcctgca

SEQ ID NO: 145884 - DNA, 25 bp, Mus musculus
agacagttggactgcatggcctgca

SEQ ID NO: 145885 - DNA, 25 bp, Mus musculus
agacagttggcacttgacctctgtg

SEQ ID NO: 145886 - DNA, 25 bp, Mus musculus
agacagttggcagttgacctctgtg

SEQ ID NO: 145887 - DNA, 25 bp, Mus musculus
agacagttggtgacactcttctcag

SEQ ID NO: 145888 - DNA, 25 bp, Mus musculus
agacagttggtgtcactcttctcag

SEQ ID NO: 145889 - DNA, 25 bp, Mus musculus
agacagttgtacacgggcctggaga

SEQ ID NO: 145890 - DNA, 25 bp, Mus musculus
agacagttgtactcgggcctggaga

SEQ ID NO: 145891 - DNA, 25 bp, Mus musculus
agacagttgtttaaggatgtgtaca

SEQ ID NO: 145892 - DNA, 25 bp, Mus musculus
agacagttgttttaggatgtgtaca

SEQ ID NO: 145893 - DNA, 25 bp, Mus musculus
agacagtttgggagctctctgcaca

SEQ ID NO: 145894 - DNA, 25 bp, Mus musculus
agacagtttgggtgctctctgcaca

SEQ ID NO: 145895 - DNA, 25 bp, Mus musculus
agacagttttatcgccaagcaggag

SEQ ID NO: 145896 - DNA, 25 bp, Mus musculus
agacagttttatggccaagcaggag

SEQ ID NO: 145897 - DNA, 25 bp, Mus musculus
agacataaagtcagccgggcctcag

SEQ ID NO: 145898 - DNA, 25 bp, Mus musculus
agacataaagtctgccgggcctcag

SEQ ID NO: 145899 - DNA, 25 bp, Mus musculus
agacataaatggacccgtgccgctc

SEQ ID NO: 145900 - DNA, 25 bp, Mus musculus
agacataaatggtcccgtgccgctc

SEQ ID NO: 145901 - DNA, 25 bp, Mus musculus
agacataaccatctctaacagtgat

SEQ ID NO: 145902 - DNA, 25 bp, Mus musculus
agacataaccatgtctaacagtgat

SEQ ID NO: 145903 - DNA, 25 bp, Mus musculus
agacataactcaacattccccagaa

SEQ ID NO: 145904 - DNA, 25 bp, Mus musculus
agacataactcatcattccccagaa

SEQ ID NO: 145905 - DNA, 25 bp, Mus musculus
agacataagccccactctctaaact

SEQ ID NO: 145906 - DNA, 25 bp, Mus musculus
agacataagcccgactctctaaact

SEQ ID NO: 145907 - DNA, 25 bp, Mus musculus
agacataagcctctgagctctccag

SEQ ID NO: 145908 - DNA, 25 bp, Mus musculus
agacataagcctgtgagctctccag

SEQ ID NO: 145909 - DNA, 25 bp, Mus musculus
agacataagtatatgggctcccctg

SEQ ID NO: 145910 - DNA, 25 bp, Mus musculus
agacataagtatttgggctcccctg

SEQ ID NO: 145911 - DNA, 25 bp, Mus musculus
agacataatctcacagccaacttcc

SEQ ID NO: 145912 - DNA, 25 bp, Mus musculus
agacataatctctcagccaacttcc

SEQ ID NO: 145913 - DNA, 25 bp, Mus musculus
agacataattttacgttgaacgagc

SEQ ID NO: 145914 - DNA, 25 bp, Mus musculus
agacataatttttcgttgaacgagc

SEQ ID NO: 145915 - DNA, 25 bp, Mus musculus
agacatacacggacgggcacacatg

SEQ ID NO: 145916 - DNA, 25 bp, Mus musculus
agacatacacggtcgggcacacatg

SEQ ID NO: 145917 - DNA, 25 bp, Mus musculus
agacatacagccattgagctccatc

SEQ ID NO: 145918 - DNA, 25 bp, Mus musculus
agacatacagcctttgagctccatc

SEQ ID NO: 145919 - DNA, 25 bp, Mus musculus
agacatacaggacttaaaccctaca

SEQ ID NO: 145920 - DNA, 25 bp, Mus musculus
agacatacaggagttaaaccctaca

SEQ ID NO: 145921 - DNA, 25 bp, Mus musculus
agacatacatcgctccttccattgt

SEQ ID NO: 145922 - DNA, 25 bp, Mus musculus
agacatacatcggtccttccattgt

SEQ ID NO: 145923 - DNA, 25 bp, Mus musculus
agacatacatggacactcttccgga

SEQ ID NO: 145924 - DNA, 25 bp, Mus musculus
agacatacatggtcactcttccgga

SEQ ID NO: 145925 - DNA, 25 bp, Mus musculus
agacatactgtgaagtggctcaaca

SEQ ID NO: 145926 - DNA, 25 bp, Mus musculus
agacatactgtgtagtggctcaaca

SEQ ID NO: 145927 - DNA, 25 bp, Mus musculus
agacatacttatccagaaccctctg

SEQ ID NO: 145928 - DNA, 25 bp, Mus musculus
agacatacttatgcagaaccctctg

SEQ ID NO: 145929 - DNA, 25 bp, Mus musculus
agacatacttcaacctacatctgac

SEQ ID NO: 145930 - DNA, 25 bp, Mus musculus
agacatacttcatcctacatctgac

SEQ ID NO: 145931 - DNA, 25 bp, Mus musculus
agacatagcaccattgtgtggactc

SEQ ID NO: 145932 - DNA, 25 bp, Mus musculus
agacatagcacctttgtgtggactc

SEQ ID NO: 145933 - DNA, 25 bp, Mus musculus
agacatagctgtcgctttgcttctg

SEQ ID NO: 145934 - DNA, 25 bp, Mus musculus
agacatagctgtggctttgcttctg

SEQ ID NO: 145935 - DNA, 25 bp, Mus musculus
agacataggtgcagagccaccctcc

SEQ ID NO: 145936 - DNA, 25 bp, Mus musculus
agacataggtgctgagccaccctcc

SEQ ID NO: 145937 - DNA, 25 bp, Mus musculus
agacatagtgacacttcggacaggg

SEQ ID NO: 145938 - DNA, 25 bp, Mus musculus
agacatagtgactcttcggacaggg

SEQ ID NO: 145939 - DNA, 25 bp, Mus musculus
agacatagtggcacttacctttaat

SEQ ID NO: 145940 - DNA, 25 bp, Mus musculus
agacatagtggctcttacctttaat

SEQ ID NO: 145941 - DNA, 25 bp, Mus musculus
agacatagtttaccatgctgcctcc

SEQ ID NO: 145942 - DNA, 25 bp, Mus musculus
agacatagtttagcatgctgcctcc

SEQ ID NO: 145943 - DNA, 25 bp, Mus musculus
agacatagtttcagtgcggtgttag

SEQ ID NO: 145944 - DNA, 25 bp, Mus musculus
agacatagtttctgtgcggtgttag

SEQ ID NO: 145945 - DNA, 25 bp, Mus musculus
agacatataactaccacaggcctgc

SEQ ID NO: 145946 - DNA, 25 bp, Mus musculus
agacatataacttccacaggcctgc

SEQ ID NO: 145947 - DNA, 25 bp, Mus musculus
agacatatatatatctgctcagata

SEQ ID NO: 145948 - DNA, 25 bp, Mus musculus
agacatatatatttctgctcagata

SEQ ID NO: 145949 - DNA, 25 bp, Mus musculus
agacatatcagtaccgtactcagaa

SEQ ID NO: 145950 - DNA, 25 bp, Mus musculus
agacatatcagttccgtactcagaa

SEQ ID NO: 145951 - DNA, 25 bp, Mus musculus
agacatatcccaatccgaaagccat

SEQ ID NO: 145952 - DNA, 25 bp, Mus musculus
agacatatcccattccgaaagccat

SEQ ID NO: 145953 - DNA, 25 bp, Mus musculus
agacatatcctaacctacaggctga

SEQ ID NO: 145954 - DNA, 25 bp, Mus musculus
agacatatcctatcctacaggctga

SEQ ID NO: 145955 - DNA, 25 bp, Mus musculus
agacatatcgttctgtggtaattcg

SEQ ID NO: 145956 - DNA, 25 bp, Mus musculus
agacatatcgttgtgtggtaattcg

SEQ ID NO: 145957 - DNA, 25 bp, Mus musculus
agacatatgagcagatgcggtgcct

SEQ ID NO: 145958 - DNA, 25 bp, Mus musculus
agacatatgagctgatgcggtgcct

SEQ ID NO: 145959 - DNA, 25 bp, Mus musculus
agacatatgatcagctggccggaca

SEQ ID NO: 145960 - DNA, 25 bp, Mus musculus
agacatatgatctgctggccggaca

SEQ ID NO: 145961 - DNA, 25 bp, Mus musculus
agacatatgtcactgctataagcaa

SEQ ID NO: 145962 - DNA, 25 bp, Mus musculus
agacatatgtcagtgctataagcaa

SEQ ID NO: 145963 - DNA, 25 bp, Mus musculus
agacatatgtggaaagccttctggg

SEQ ID NO: 145964 - DNA, 25 bp, Mus musculus
agacatatgtggtaagccttctggg

SEQ ID NO: 145965 - DNA, 25 bp, Mus musculus
agacatattaccaggatgattgaaa

SEQ ID NO: 145966 - DNA, 25 bp, Mus musculus
agacatattacctggatgattgaaa

SEQ ID NO: 145967 - DNA, 25 bp, Mus musculus
agacatattgctactctgagattaa

SEQ ID NO: 145968 - DNA, 25 bp, Mus musculus
agacatattgcttctctgagattaa

SEQ ID NO: 145969 - DNA, 25 bp, Mus musculus
agacatattgtcactccaatatagg

SEQ ID NO: 145970 - DNA, 25 bp, Mus musculus
agacatattgtctctccaatatagg

SEQ ID NO: 145971 - DNA, 25 bp, Mus musculus
agacatcaaaggcttcatacgggtg

SEQ ID NO: 145972 - DNA, 25 bp, Mus musculus
agacatcaaagggttcatacgggtg

SEQ ID NO: 145973 - DNA, 25 bp, Mus musculus
agacatcaagaactaaacgagggca

SEQ ID NO: 145974 - DNA, 25 bp, Mus musculus
agacatcaagaagtaaacgagggca

SEQ ID NO: 145975 - DNA, 25 bp, Mus musculus
agacatcaagccctacagctgcgag

SEQ ID NO: 145976 - DNA, 25 bp, Mus musculus
agacatcaagccgtacagctgcgag

SEQ ID NO: 145977 - DNA, 25 bp, Mus musculus
agacatcaagtcacactatgccttc

SEQ ID NO: 145978 - DNA, 25 bp, Mus musculus
agacatcaagtctcactatgccttc

SEQ ID NO: 145979 - DNA, 25 bp, Mus musculus
agacatcaatcacaaggccacaaag

SEQ ID NO: 145980 - DNA, 25 bp, Mus musculus
agacatcaatcagaaggccacaaag

SEQ ID NO: 145981 - DNA, 25 bp, Mus musculus
agacatcaggacaatggttttccca

SEQ ID NO: 145982 - DNA, 25 bp, Mus musculus
agacatcaggactatggttttccca

SEQ ID NO: 145983 - DNA, 25 bp, Mus musculus
agacatcaggcaacatctgtccagt

SEQ ID NO: 145984 - DNA, 25 bp, Mus musculus
agacatcaggcatcatctgtccagt

SEQ ID NO: 145985 - DNA, 25 bp, Mus musculus
agacatcataggagcactgggtgga

SEQ ID NO: 145986 - DNA, 25 bp, Mus musculus
agacatcataggtgcactgggtgga

SEQ ID NO: 145987 - DNA, 25 bp, Mus musculus
agacatcatgagagcaaatcccagc

SEQ ID NO: 145988 - DNA, 25 bp, Mus musculus
agacatcatgagtgcaaatcccagc

SEQ ID NO: 145989 - DNA, 25 bp, Mus musculus
agacatcattccataatgtgcatat

SEQ ID NO: 145990 - DNA, 25 bp, Mus musculus
agacatcattccttaatgtgcatat

SEQ ID NO: 145991 - DNA, 25 bp, Mus musculus
agacatcattctaaggaaatcccct

SEQ ID NO: 145992 - DNA, 25 bp, Mus musculus
agacatcattcttaggaaatcccct

SEQ ID NO: 145993 - DNA, 25 bp, Mus musculus
agacatcattgcctgggtgtgacct

SEQ ID NO: 145994 - DNA, 25 bp, Mus musculus
agacatcattgcgtgggtgtgacct

SEQ ID NO: 145995 - DNA, 25 bp, Mus musculus
agacatcatttcagtatctctgagc

SEQ ID NO: 145996 - DNA, 25 bp, Mus musculus
agacatcatttctgtatctctgagc

SEQ ID NO: 145997 - DNA, 25 bp, Mus musculus
agacatccaggcagaaggttttgag

SEQ ID NO: 145998 - DNA, 25 bp, Mus musculus
agacatccaggctgaaggttttgag

SEQ ID NO: 145999 - DNA, 25 bp, Mus musculus
agacatccagtcagaacattcaaga

SEQ ID NO: 146000 - DNA, 25 bp, Mus musculus
agacatccagtctgaacattcaaga

SEQ ID NO: 146001 - DNA, 25 bp, Mus musculus
agacatcccaggctgtttctctcga

SEQ ID NO: 146002 - DNA, 25 bp, Mus musculus
agacatcccagggtgtttctctcga

SEQ ID NO: 146003 - DNA, 25 bp, Mus musculus
agacatccctctctagctggtgatt

SEQ ID NO: 146004 - DNA, 25 bp, Mus musculus
agacatccctctgtagctggtgatt

SEQ ID NO: 146005 - DNA, 25 bp, Mus musculus
agacatccctgcagcgaccaagaag

SEQ ID NO: 146006 - DNA, 25 bp, Mus musculus
agacatccctgctgcgaccaagaag

SEQ ID NO: 146007 - DNA, 25 bp, Mus musculus
agacatccgagacctagcccaccag

SEQ ID NO: 146008 - DNA, 25 bp, Mus musculus
agacatccgagagctagcccaccag

SEQ ID NO: 146009 - DNA, 25 bp, Mus musculus
agacatccgtcgctgtgactccagg

SEQ ID NO: 146010 - DNA, 25 bp, Mus musculus
agacatccgtcggtgtgactccagg

SEQ ID NO: 146011 - DNA, 25 bp, Mus musculus
agacatcctcaaccggaacatccag

SEQ ID NO: 146012 - DNA, 25 bp, Mus musculus
agacatcctcaagcggaacatccag

SEQ ID NO: 146013 - DNA, 25 bp, Mus musculus
agacatcctgagactcccagaggac

SEQ ID NO: 146014 - DNA, 25 bp, Mus musculus
agacatcctgagtctcccagaggac

SEQ ID NO: 146015 - DNA, 25 bp, Mus musculus
agacatcctggtctggtcagacaca

SEQ ID NO: 146016 - DNA, 25 bp, Mus musculus
agacatcctggtgtggtcagacaca

SEQ ID NO: 146017 - DNA, 25 bp, Mus musculus
agacatcctgttctattctttaaac

SEQ ID NO: 146018 - DNA, 25 bp, Mus musculus
agacatcctgttgtattctttaaac

SEQ ID NO: 146019 - DNA, 25 bp, Mus musculus
agacatccttctcagtgctgtggga

SEQ ID NO: 146020 - DNA, 25 bp, Mus musculus
agacatccttctgagtgctgtggga

SEQ ID NO: 146021 - DNA, 25 bp, Mus musculus
agacatccttgaatgctgggcttgc

SEQ ID NO: 146022 - DNA, 25 bp, Mus musculus
agacatccttgattgctgggcttgc

SEQ ID NO: 146023 - DNA, 25 bp, Mus musculus
agacatccttgccagaggttccaaa

SEQ ID NO: 146024 - DNA, 25 bp, Mus musculus
agacatccttgcgagaggttccaaa

SEQ ID NO: 146025 - DNA, 25 bp, Mus musculus
agacatcctttcaattgttaataaa

SEQ ID NO: 146026 - DNA, 25 bp, Mus musculus
agacatcctttctattgttaataaa

SEQ ID NO: 146027 - DNA, 25 bp, Mus musculus
agacatcgaccgagtactcatataa

SEQ ID NO: 146028 - DNA, 25 bp, Mus musculus
agacatcgaccgtgtactcatataa

SEQ ID NO: 146029 - DNA, 25 bp, Mus musculus
agacatcgctatataccctgttatc

SEQ ID NO: 146030 - DNA, 25 bp, Mus musculus
agacatcgctatttaccctgttatc

SEQ ID NO: 146031 - DNA, 25 bp, Mus musculus
agacatcggactcttaggcttcttc

SEQ ID NO: 146032 - DNA, 25 bp, Mus musculus
agacatcggactgttaggcttcttc

SEQ ID NO: 146033 - DNA, 25 bp, Mus musculus
agacatcgtcccatacaattcagta

SEQ ID NO: 146034 - DNA, 25 bp, Mus musculus
agacatcgtcccttacaattcagta

SEQ ID NO: 146035 - DNA, 25 bp, Mus musculus
agacatcgtctgacttgcagggttc

SEQ ID NO: 146036 - DNA, 25 bp, Mus musculus
agacatcgtctgtcttgcagggttc

SEQ ID NO: 146037 - DNA, 25 bp, Mus musculus
agacatcgtcttccctgaatagact

SEQ ID NO: 146038 - DNA, 25 bp, Mus musculus
agacatcgtcttgcctgaatagact

SEQ ID NO: 146039 - DNA, 25 bp, Mus musculus
agacatcgtttgattttcttgttga

SEQ ID NO: 146040 - DNA, 25 bp, Mus musculus
agacatcgtttgtttttcttgttga

SEQ ID NO: 146041 - DNA, 25 bp, Mus musculus
agacatctacaaatgccccttcagt

SEQ ID NO: 146042 - DNA, 25 bp, Mus musculus
agacatctacaattgccccttcagt

SEQ ID NO: 146043 - DNA, 25 bp, Mus musculus
agacatctaccgaagtccaatgcaa

SEQ ID NO: 146044 - DNA, 25 bp, Mus musculus
agacatctaccgtagtccaatgcaa

SEQ ID NO: 146045 - DNA, 25 bp, Mus musculus
agacatctatacactgccagcatta

SEQ ID NO: 146046 - DNA, 25 bp, Mus musculus
agacatctatactctgccagcatta

SEQ ID NO: 146047 - DNA, 25 bp, Mus musculus
agacatctatttaattccgactgct

SEQ ID NO: 146048 - DNA, 25 bp, Mus musculus
agacatctattttattccgactgct

SEQ ID NO: 146049 - DNA, 25 bp, Mus musculus
agacatctcagaatccttttaaaag

SEQ ID NO: 146050 - DNA, 25 bp, Mus musculus
agacatctcagattccttttaaaag

SEQ ID NO: 146051 - DNA, 25 bp, Mus musculus
agacatctccatcatcgggcagttt

SEQ ID NO: 146052 - DNA, 25 bp, Mus musculus
agacatctccatgatcgggcagttt

SEQ ID NO: 146053 - DNA, 25 bp, Mus musculus
agacatctcctgacaacacttaaag

SEQ ID NO: 146054 - DNA, 25 bp, Mus musculus
agacatctcctgtcaacacttaaag

SEQ ID NO: 146055 - DNA, 25 bp, Mus musculus
agacatctcgatcttgtttctaatg

SEQ ID NO: 146056 - DNA, 25 bp, Mus musculus
agacatctcgatgttgtttctaatg

SEQ ID NO: 146057 - DNA, 25 bp, Mus musculus
agacatctctcacacatacttacta

SEQ ID NO: 146058 - DNA, 25 bp, Mus musculus
agacatctctcagacatacttacta

SEQ ID NO: 146059 - DNA, 25 bp, Mus musculus
agacatctctgtatgtcctgttaca

SEQ ID NO: 146060 - DNA, 25 bp, Mus musculus
agacatctctgtttgtcctgttaca

SEQ ID NO: 146061 - DNA, 25 bp, Mus musculus
agacatctgccaccatttggcttca

SEQ ID NO: 146062 - DNA, 25 bp, Mus musculus
agacatctgccagcatttggcttca

SEQ ID NO: 146063 - DNA, 25 bp, Mus musculus
agacatctgctcaagtcctttgtgt

SEQ ID NO: 146064 - DNA, 25 bp, Mus musculus
agacatctgctctagtcctttgtgt

SEQ ID NO: 146065 - DNA, 25 bp, Mus musculus
agacatctggctactactatgaccc

SEQ ID NO: 146066 - DNA, 25 bp, Mus musculus
agacatctggcttctactatgaccc

SEQ ID NO: 146067 - DNA, 25 bp, Mus musculus
agacatctggttaatgggtgcttat

SEQ ID NO: 146068 - DNA, 25 bp, Mus musculus
agacatctggtttatgggtgcttat

SEQ ID NO: 146069 - DNA, 25 bp, Mus musculus
agacatctgtgtatttctcgtccaa

SEQ ID NO: 146070 - DNA, 25 bp, Mus musculus
agacatctgtgtttttctcgtccaa

SEQ ID NO: 146071 - DNA, 25 bp, Mus musculus
agacatcttatgattcttctgcctc

SEQ ID NO: 146072 - DNA, 25 bp, Mus musculus
agacatcttatgtttcttctgcctc

SEQ ID NO: 146073 - DNA, 25 bp, Mus musculus
agacatcttcatcggcacagctctt

SEQ ID NO: 146074 - DNA, 25 bp, Mus musculus
agacatcttcatgggcacagctctt

SEQ ID NO: 146075 - DNA, 25 bp, Mus musculus
agacatcttcttctttctctagtat

SEQ ID NO: 146076 - DNA, 25 bp, Mus musculus
agacatcttcttgtttctctagtat

SEQ ID NO: 146077 - DNA, 25 bp, Mus musculus
agacatcttgatcttagcctccagc

SEQ ID NO: 146078 - DNA, 25 bp, Mus musculus
agacatcttgatgttagcctccagc

SEQ ID NO: 146079 - DNA, 25 bp, Mus musculus
agacatcttgctcttgtggttgttg

SEQ ID NO: 146080 - DNA, 25 bp, Mus musculus
agacatcttgctgttgtggttgttg

SEQ ID NO: 146081 - DNA, 25 bp, Mus musculus
agacatctttcgcattaggaaatgc

SEQ ID NO: 146082 - DNA, 25 bp, Mus musculus
agacatctttcggattaggaaatgc

SEQ ID NO: 146083 - DNA, 25 bp, Mus musculus
agacatctttctcatgtgtcatctt

SEQ ID NO: 146084 - DNA, 25 bp, Mus musculus
agacatctttctcatttccatgaag

SEQ ID NO: 146085 - DNA, 25 bp, Mus musculus
agacatctttctgatgtgtcatctt

SEQ ID NO: 146086 - DNA, 25 bp, Mus musculus
agacatctttctgatttccatgaag

SEQ ID NO: 146087 - DNA, 25 bp, Mus musculus
agacatctttgacgcaagtcccaga

SEQ ID NO: 146088 - DNA, 25 bp, Mus musculus
agacatctttgaggcaagtcccaga

SEQ ID NO: 146089 - DNA, 25 bp, Mus musculus
agacatgaaaagaaaacatcggaaa

SEQ ID NO: 146090 - DNA, 25 bp, Mus musculus
agacatgaaaagtaaacatcggaaa

SEQ ID NO: 146091 - DNA, 25 bp, Mus musculus
agacatgaaaatcccacttctttac

SEQ ID NO: 146092 - DNA, 25 bp, Mus musculus
agacatgaaaatgccacttctttac

SEQ ID NO: 146093 - DNA, 25 bp, Mus musculus
agacatgaaccccaagatgaccttg

SEQ ID NO: 146094 - DNA, 25 bp, Mus musculus
agacatgaacccgaagatgaccttg

SEQ ID NO: 146095 - DNA, 25 bp, Mus musculus
agacatgaactgacgggacctcctc

SEQ ID NO: 146096 - DNA, 25 bp, Mus musculus
agacatgaactgtcgggacctcctc

SEQ ID NO: 146097 - DNA, 25 bp, Mus musculus
agacatgaattccttataacccaga

SEQ ID NO: 146098 - DNA, 25 bp, Mus musculus
agacatgaattcgttataacccaga

SEQ ID NO: 146099 - DNA, 25 bp, Mus musculus
agacatgacattccatttgtagaat

SEQ ID NO: 146100 - DNA, 25 bp, Mus musculus
agacatgacattgcatttgtagaat

SEQ ID NO: 146101 - DNA, 25 bp, Mus musculus
agacatgacgacagggatgcctctt

SEQ ID NO: 146102 - DNA, 25 bp, Mus musculus
agacatgacgactgggatgcctctt

SEQ ID NO: 146103 - DNA, 25 bp, Mus musculus
agacatgactctaacagcccaggac

SEQ ID NO: 146104 - DNA, 25 bp, Mus musculus
agacatgactctatcaaagtggttt

SEQ ID NO: 146105 - DNA, 25 bp, Mus musculus
agacatgactcttacagcccaggac

SEQ ID NO: 146106 - DNA, 25 bp, Mus musculus
agacatgactctttcaaagtggttt

SEQ ID NO: 146107 - DNA, 25 bp, Mus musculus
agacatgacttactgctttagagca

SEQ ID NO: 146108 - DNA, 25 bp, Mus musculus
agacatgacttagtgctttagagca

SEQ ID NO: 146109 - DNA, 25 bp, Mus musculus
agacatgagccactgtgtgtcaggc

SEQ ID NO: 146110 - DNA, 25 bp, Mus musculus
agacatgagccagtgtgtgtcaggc

SEQ ID NO: 146111 - DNA, 25 bp, Mus musculus
agacatgagctcagggcttactggt

SEQ ID NO: 146112 - DNA, 25 bp, Mus musculus
agacatgagctctgggcttactggt

SEQ ID NO: 146113 - DNA, 25 bp, Mus musculus
agacatgaggtcaaagcccttcgca

SEQ ID NO: 146114 - DNA, 25 bp, Mus musculus
agacatgaggtctaagcccttcgca

SEQ ID NO: 146115 - DNA, 25 bp, Mus musculus
agacatgagtcaccagcctggatta

SEQ ID NO: 146116 - DNA, 25 bp, Mus musculus
agacatgagtcagcagcctggatta

SEQ ID NO: 146117 - DNA, 25 bp, Mus musculus
agacatgatatcatcctgcatcctc

SEQ ID NO: 146118 - DNA, 25 bp, Mus musculus
agacatgatatcttcctgcatcctc

SEQ ID NO: 146119 - DNA, 25 bp, Mus musculus
agacatgatggtctgcttggcgttt

SEQ ID NO: 146120 - DNA, 25 bp, Mus musculus
agacatgatggtgtgcttggcgttt

SEQ ID NO: 146121 - DNA, 25 bp, Mus musculus
agacatgatgttcccaagaccttgc

SEQ ID NO: 146122 - DNA, 25 bp, Mus musculus
agacatgatgttgccaagaccttgc

SEQ ID NO: 146123 - DNA, 25 bp, Mus musculus
agacatgcagacatcttctctttcc

SEQ ID NO: 146124 - DNA, 25 bp, Mus musculus
agacatgcagacttcttctctttcc

SEQ ID NO: 146125 - DNA, 25 bp, Mus musculus
agacatgcagctaccctgtgcatca

SEQ ID NO: 146126 - DNA, 25 bp, Mus musculus
agacatgcagcttccctgtgcatca

SEQ ID NO: 146127 - DNA, 25 bp, Mus musculus
agacatgcattgaacattcactgta

SEQ ID NO: 146128 - DNA, 25 bp, Mus musculus
agacatgcattgtacattcactgta

SEQ ID NO: 146129 - DNA, 25 bp, Mus musculus
agacatgccatacaggtactttggg

SEQ ID NO: 146130 - DNA, 25 bp, Mus musculus
agacatgccatagaggtactttggg

SEQ ID NO: 146131 - DNA, 25 bp, Mus musculus
agacatgcctcccatagaagaccac

SEQ ID NO: 146132 - DNA, 25 bp, Mus musculus
agacatgcctccgatagaagaccac

SEQ ID NO: 146133 - DNA, 25 bp, Mus musculus
agacatgcctggacctggctataat

SEQ ID NO: 146134 - DNA, 25 bp, Mus musculus
agacatgcctggtcctggctataat

SEQ ID NO: 146135 - DNA, 25 bp, Mus musculus
agacatgcgctgaaacccagattaa

SEQ ID NO: 146136 - DNA, 25 bp, Mus musculus
agacatgcgctgtaacccagattaa

SEQ ID NO: 146137 - DNA, 25 bp, Mus musculus
agacatgcgttgatccttttattgg

SEQ ID NO: 146138 - DNA, 25 bp, Mus musculus
agacatgcgttgttccttttattgg

SEQ ID NO: 146139 - DNA, 25 bp, Mus musculus
agacatgctactatcttctctccac

SEQ ID NO: 146140 - DNA, 25 bp, Mus musculus
agacatgctactttcttctctccac

SEQ ID NO: 146141 - DNA, 25 bp, Mus musculus
agacatgctcagcagggttaacatg

SEQ ID NO: 146142 - DNA, 25 bp, Mus musculus
agacatgctcaggagggttaacatg

SEQ ID NO: 146143 - DNA, 25 bp, Mus musculus
agacatgctccaaagcaagctctca

SEQ ID NO: 146144 - DNA, 25 bp, Mus musculus
agacatgctccatagcaagctctca

SEQ ID NO: 146145 - DNA, 25 bp, Mus musculus
agacatgctctcagcaaataagtaa

SEQ ID NO: 146146 - DNA, 25 bp, Mus musculus
agacatgctctctgcaaataagtaa

SEQ ID NO: 146147 - DNA, 25 bp, Mus musculus
agacatgctggtaaagttcctccct

SEQ ID NO: 146148 - DNA, 25 bp, Mus musculus
agacatgctggttaagttcctccct

SEQ ID NO: 146149 - DNA, 25 bp, Mus musculus
agacatgctttgaagtgaagtatag

SEQ ID NO: 146150 - DNA, 25 bp, Mus musculus
agacatgctttgtagtgaagtatag

SEQ ID NO: 146151 - DNA, 25 bp, Mus musculus
agacatggacatcgccttacaaggg

SEQ ID NO: 146152 - DNA, 25 bp, Mus musculus
agacatggacatggccttacaaggg

SEQ ID NO: 146153 - DNA, 25 bp, Mus musculus
agacatggagatactctgccctggg

SEQ ID NO: 146154 - DNA, 25 bp, Mus musculus
agacatggagattctctgccctggg

SEQ ID NO: 146155 - DNA, 25 bp, Mus musculus
agacatggaggactggctcactata

SEQ ID NO: 146156 - DNA, 25 bp, Mus musculus
agacatggaggagtggctcactata

SEQ ID NO: 146157 - DNA, 25 bp, Mus musculus
agacatggccagctatcctgtccaa

SEQ ID NO: 146158 - DNA, 25 bp, Mus musculus
agacatggccaggtatcctgtccaa

SEQ ID NO: 146159 - DNA, 25 bp, Mus musculus
agacatggcccgaaacaagttctcc

SEQ ID NO: 146160 - DNA, 25 bp, Mus musculus
agacatggcccgtaacaagttctcc

SEQ ID NO: 146161 - DNA, 25 bp, Mus musculus
agacatggccctcggtattaccagt

SEQ ID NO: 146162 - DNA, 25 bp, Mus musculus
agacatggccctgggtattaccagt

SEQ ID NO: 146163 - DNA, 25 bp, Mus musculus
agacatggccggcatctgctagcac

SEQ ID NO: 146164 - DNA, 25 bp, Mus musculus
agacatggccgggatctgctagcac

SEQ ID NO: 146165 - DNA, 25 bp, Mus musculus
agacatggccttctacgactgtatg

SEQ ID NO: 146166 - DNA, 25 bp, Mus musculus
agacatggccttgtacgactgtatg

SEQ ID NO: 146167 - DNA, 25 bp, Mus musculus
agacatggcgaaattctggcagtag

SEQ ID NO: 146168 - DNA, 25 bp, Mus musculus
agacatggcgaatttctggcagtag

SEQ ID NO: 146169 - DNA, 25 bp, Mus musculus
agacatgggaccaggagcatcctcc

SEQ ID NO: 146170 - DNA, 25 bp, Mus musculus
agacatgggacctggagcatcctcc

SEQ ID NO: 146171 - DNA, 25 bp, Mus musculus
agacatgggactcacgctccggtaa

SEQ ID NO: 146172 - DNA, 25 bp, Mus musculus
agacatgggactgacgctccggtaa

SEQ ID NO: 146173 - DNA, 25 bp, Mus musculus
agacatgggatgagtgtctccatcc

SEQ ID NO: 146174 - DNA, 25 bp, Mus musculus
agacatgggatgtgtgtctccatcc

SEQ ID NO: 146175 - DNA, 25 bp, Mus musculus
agacatgggcaacctgtgggctaca

SEQ ID NO: 146176 - DNA, 25 bp, Mus musculus
agacatgggcaacttcagctctgtt

SEQ ID NO: 146177 - DNA, 25 bp, Mus musculus
agacatgggcaagctgtgggctaca

SEQ ID NO: 146178 - DNA, 25 bp, Mus musculus
agacatgggcaagttcagctctgtt

SEQ ID NO: 146179 - DNA, 25 bp, Mus musculus
agacatgggcacctgagttcagatc

SEQ ID NO: 146180 - DNA, 25 bp, Mus musculus
agacatgggcacgtgagttcagatc

SEQ ID NO: 146181 - DNA, 25 bp, Mus musculus
agacatgggtttcgtcttgagtgcc

SEQ ID NO: 146182 - DNA, 25 bp, Mus musculus
agacatgggtttggtcttgagtgcc

SEQ ID NO: 146183 - DNA, 25 bp, Mus musculus
agacatggtgtcatgctttcaatgt

SEQ ID NO: 146184 - DNA, 25 bp, Mus musculus
agacatggtgtcttgctttcaatgt

SEQ ID NO: 146185 - DNA, 25 bp, Mus musculus
agacatggtttaagctacactcaat

SEQ ID NO: 146186 - DNA, 25 bp, Mus musculus
agacatggtttatgctacactcaat

SEQ ID NO: 146187 - DNA, 25 bp, Mus musculus
agacatgtacctcattccattgggc

SEQ ID NO: 146188 - DNA, 25 bp, Mus musculus
agacatgtacctgattccattgggc

SEQ ID NO: 146189 - DNA, 25 bp, Mus musculus
agacatgtattcacccacagttctt

SEQ ID NO: 146190 - DNA, 25 bp, Mus musculus
agacatgtattccttattacccagt

SEQ ID NO: 146191 - DNA, 25 bp, Mus musculus
agacatgtattcgttattacccagt

SEQ ID NO: 146192 - DNA, 25 bp, Mus musculus
agacatgtattctcccacagttctt

SEQ ID NO: 146193 - DNA, 25 bp, Mus musculus
agacatgtcagcatgggagactgat

SEQ ID NO: 146194 - DNA, 25 bp, Mus musculus
agacatgtcagcttgggagactgat

SEQ ID NO: 146195 - DNA, 25 bp, Mus musculus
agacatgtccacactgtacttctaa

SEQ ID NO: 146196 - DNA, 25 bp, Mus musculus
agacatgtccactctgtacttctaa

SEQ ID NO: 146197 - DNA, 25 bp, Mus musculus
agacatgtcctcagtttcttctttt

SEQ ID NO: 146198 - DNA, 25 bp, Mus musculus
agacatgtcctctgtttcttctttt

SEQ ID NO: 146199 - DNA, 25 bp, Mus musculus
agacatgtcgtaaaagtgtgattct

SEQ ID NO: 146200 - DNA, 25 bp, Mus musculus
agacatgtcgtataagtgtgattct

SEQ ID NO: 146201 - DNA, 25 bp, Mus musculus
agacatgtctacagtcaccctgctg

SEQ ID NO: 146202 - DNA, 25 bp, Mus musculus
agacatgtctactgtcaccctgctg

SEQ ID NO: 146203 - DNA, 25 bp, Mus musculus
agacatgtctgaagctcctctctga

SEQ ID NO: 146204 - DNA, 25 bp, Mus musculus
agacatgtctgatgctcctctctga

SEQ ID NO: 146205 - DNA, 25 bp, Mus musculus
agacatgtctgcaccagttaaacat

SEQ ID NO: 146206 - DNA, 25 bp, Mus musculus
agacatgtctgctccagttaaacat

SEQ ID NO: 146207 - DNA, 25 bp, Mus musculus
agacatgtctgtccagcagggttct

SEQ ID NO: 146208 - DNA, 25 bp, Mus musculus
agacatgtctgtgcagcagggttct

SEQ ID NO: 146209 - DNA, 25 bp, Mus musculus
agacatgtgccaagctcatgctcta

SEQ ID NO: 146210 - DNA, 25 bp, Mus musculus
agacatgtgccactacgctctgttt

SEQ ID NO: 146211 - DNA, 25 bp, Mus musculus
agacatgtgccagtacgctctgttt

SEQ ID NO: 146212 - DNA, 25 bp, Mus musculus
agacatgtgccatgctcatgctcta

SEQ ID NO: 146213 - DNA, 25 bp, Mus musculus
agacatgtgcgaatcttccattact

SEQ ID NO: 146214 - DNA, 25 bp, Mus musculus
agacatgtgcgattcttccattact

SEQ ID NO: 146215 - DNA, 25 bp, Mus musculus
agacatgtggagattcgcggtgctt

SEQ ID NO: 146216 - DNA, 25 bp, Mus musculus
agacatgtggagtttcgcggtgctt

SEQ ID NO: 146217 - DNA, 25 bp, Mus musculus
agacatgtgtaccaatgctcgccgt

SEQ ID NO: 146218 - DNA, 25 bp, Mus musculus
agacatgtgtacgaatgctcgccgt

SEQ ID NO: 146219 - DNA, 25 bp, Mus musculus
agacatgtgtgtatctaggaccaga

SEQ ID NO: 146220 - DNA, 25 bp, Mus musculus
agacatgtgtgtttctaggaccaga

SEQ ID NO: 146221 - DNA, 25 bp, Mus musculus
agacatgtgttaatccttcggcaag

SEQ ID NO: 146222 - DNA, 25 bp, Mus musculus
agacatgtgttattccttcggcaag

SEQ ID NO: 146223 - DNA, 25 bp, Mus musculus
agacatgtgttcaagcagcccaagg

SEQ ID NO: 146224 - DNA, 25 bp, Mus musculus
agacatgtgttctagcagcccaagg

SEQ ID NO: 146225 - DNA, 25 bp, Mus musculus
agacatgttgaacgccatccggagg

SEQ ID NO: 146226 - DNA, 25 bp, Mus musculus
agacatgttgaaggccatccggagg

SEQ ID NO: 146227 - DNA, 25 bp, Mus musculus
agacatgttgagaggcgcctgctct

SEQ ID NO: 146228 - DNA, 25 bp, Mus musculus
agacatgttgagtggcgcctgctct

SEQ ID NO: 146229 - DNA, 25 bp, Mus musculus
agacatgtttctcgccctgaaagat

SEQ ID NO: 146230 - DNA, 25 bp, Mus musculus
agacatgtttctggccctgaaagat

SEQ ID NO: 146231 - DNA, 25 bp, Mus musculus
agacatgttttacgcccatttgcag

SEQ ID NO: 146232 - DNA, 25 bp, Mus musculus
agacatgttttaggcccatttgcag

SEQ ID NO: 146233 - DNA, 25 bp, Mus musculus
agacatgtttttagtcgtcgttatt

SEQ ID NO: 146234 - DNA, 25 bp, Mus musculus
agacatgttttttgtcgtcgttatt

SEQ ID NO: 146235 - DNA, 25 bp, Mus musculus
agacattacggcaaagcttcctttt

SEQ ID NO: 146236 - DNA, 25 bp, Mus musculus
agacattacggctaagcttcctttt

SEQ ID NO: 146237 - DNA, 25 bp, Mus musculus
agacattagactcgcggctgggaca

SEQ ID NO: 146238 - DNA, 25 bp, Mus musculus
agacattagactggcggctgggaca

SEQ ID NO: 146239 - DNA, 25 bp, Mus musculus
agacattagtagacgccagtgcggc

SEQ ID NO: 146240 - DNA, 25 bp, Mus musculus
agacattagtagtcgccagtgcggc

SEQ ID NO: 146241 - DNA, 25 bp, Mus musculus
agacattagtctcctggtaccttgg

SEQ ID NO: 146242 - DNA, 25 bp, Mus musculus
agacattagtctgctggtaccttgg

SEQ ID NO: 146243 - DNA, 25 bp, Mus musculus
agacattatcagcaggaagtgttct

SEQ ID NO: 146244 - DNA, 25 bp, Mus musculus
agacattatcaggaggaagtgttct

SEQ ID NO: 146245 - DNA, 25 bp, Mus musculus
agacattattaacttgaccaattgg

SEQ ID NO: 146246 - DNA, 25 bp, Mus musculus
agacattattaagttgaccaattgg

SEQ ID NO: 146247 - DNA, 25 bp, Mus musculus
agacattattctcttaaatcctcaa

SEQ ID NO: 146248 - DNA, 25 bp, Mus musculus
agacattattctgttaaatcctcaa

SEQ ID NO: 146249 - DNA, 25 bp, Mus musculus
agacattcaattaactcaaagccaa

SEQ ID NO: 146250 - DNA, 25 bp, Mus musculus
agacattcaatttactcaaagccaa

SEQ ID NO: 146251 - DNA, 25 bp, Mus musculus
agacattcacagacgggatagcgca

SEQ ID NO: 146252 - DNA, 25 bp, Mus musculus
agacattcacagtcgggatagcgca

SEQ ID NO: 146253 - DNA, 25 bp, Mus musculus
agacattcagtactgtgtccggcca

SEQ ID NO: 146254 - DNA, 25 bp, Mus musculus
agacattcagtagtgtgtccggcca

SEQ ID NO: 146255 - DNA, 25 bp, Mus musculus
agacattcataaccccgttaccggt

SEQ ID NO: 146256 - DNA, 25 bp, Mus musculus
agacattcataagcccgttaccggt

SEQ ID NO: 146257 - DNA, 25 bp, Mus musculus
agacattcccacataccattttggc

SEQ ID NO: 146258 - DNA, 25 bp, Mus musculus
agacattcccacttaccattttggc

SEQ ID NO: 146259 - DNA, 25 bp, Mus musculus
agacattcctcaaaatcactccttt

SEQ ID NO: 146260 - DNA, 25 bp, Mus musculus
agacattcctcataatcactccttt

SEQ ID NO: 146261 - DNA, 25 bp, Mus musculus
agacattctcctactaaacatcttc

SEQ ID NO: 146262 - DNA, 25 bp, Mus musculus
agacattctccttctaaacatcttc

SEQ ID NO: 146263 - DNA, 25 bp, Mus musculus
agacattctctcagtgagactccct

SEQ ID NO: 146264 - DNA, 25 bp, Mus musculus
agacattctctctgtgagactccct

SEQ ID NO: 146265 - DNA, 25 bp, Mus musculus
agacattctcttatcttcagtaatt

SEQ ID NO: 146266 - DNA, 25 bp, Mus musculus
agacattctcttcttaccctgctgt

SEQ ID NO: 146267 - DNA, 25 bp, Mus musculus
agacattctcttgttaccctgctgt

SEQ ID NO: 146268 - DNA, 25 bp, Mus musculus
agacattctcttttcttcagtaatt

SEQ ID NO: 146269 - DNA, 25 bp, Mus musculus
agacattcttatctgttccaccaca

SEQ ID NO: 146270 - DNA, 25 bp, Mus musculus
agacattcttatgtgttccaccaca

SEQ ID NO: 146271 - DNA, 25 bp, Mus musculus
agacattcttctacgcctgtcatct

SEQ ID NO: 146272 - DNA, 25 bp, Mus musculus
agacattcttcttcgcctgtcatct

SEQ ID NO: 146273 - DNA, 25 bp, Mus musculus
agacattgaagcattagacactatg

SEQ ID NO: 146274 - DNA, 25 bp, Mus musculus
agacattgaagctttagacactatg

SEQ ID NO: 146275 - DNA, 25 bp, Mus musculus
agacattgagaaacttccttgttac

SEQ ID NO: 146276 - DNA, 25 bp, Mus musculus
agacattgagaatcttccttgttac

SEQ ID NO: 146277 - DNA, 25 bp, Mus musculus
agacattgattcaactggaccggat

SEQ ID NO: 146278 - DNA, 25 bp, Mus musculus
agacattgattctactggaccggat

SEQ ID NO: 146279 - DNA, 25 bp, Mus musculus
agacattgcacaagtgttcctcaca

SEQ ID NO: 146280 - DNA, 25 bp, Mus musculus
agacattgcacatgtgttcctcaca

SEQ ID NO: 146281 - DNA, 25 bp, Mus musculus
agacattgcaccaggcgctgttaga

SEQ ID NO: 146282 - DNA, 25 bp, Mus musculus
agacattgcacctggcgctgttaga

SEQ ID NO: 146283 - DNA, 25 bp, Mus musculus
agacattgccataaggccacactct

SEQ ID NO: 146284 - DNA, 25 bp, Mus musculus
agacattgccattaggccacactct

SEQ ID NO: 146285 - DNA, 25 bp, Mus musculus
agacattgcgatcccaatgcagaag

SEQ ID NO: 146286 - DNA, 25 bp, Mus musculus
agacattgcgatgccaatgcagaag

SEQ ID NO: 146287 - DNA, 25 bp, Mus musculus
agacattgctatactgttttttata

SEQ ID NO: 146288 - DNA, 25 bp, Mus musculus
agacattgctattctgttttttata

SEQ ID NO: 146289 - DNA, 25 bp, Mus musculus
agacattgctgcagcggtacagcat

SEQ ID NO: 146290 - DNA, 25 bp, Mus musculus
agacattgctgctgcggtacagcat

SEQ ID NO: 146291 - DNA, 25 bp, Mus musculus
agacattgggtcaattccagctcat

SEQ ID NO: 146292 - DNA, 25 bp, Mus musculus
agacattgggtctattccagctcat

SEQ ID NO: 146293 - DNA, 25 bp, Mus musculus
agacattggtctactgaggtgggaa

SEQ ID NO: 146294 - DNA, 25 bp, Mus musculus
agacattggtcttctgaggtgggaa

SEQ ID NO: 146295 - DNA, 25 bp, Mus musculus
agacattggtgtaggcattgcagga

SEQ ID NO: 146296 - DNA, 25 bp, Mus musculus
agacattggtgttggcattgcagga

SEQ ID NO: 146297 - DNA, 25 bp, Mus musculus
agacattgtcctaacattatccagg

SEQ ID NO: 146298 - DNA, 25 bp, Mus musculus
agacattgtccttacattatccagg

SEQ ID NO: 146299 - DNA, 25 bp, Mus musculus
agacattgtcttccttggtggtttt

SEQ ID NO: 146300 - DNA, 25 bp, Mus musculus
agacattgtcttgcttggtggtttt

SEQ ID NO: 146301 - DNA, 25 bp, Mus musculus
agacattgtgacacacagaactcat

SEQ ID NO: 146302 - DNA, 25 bp, Mus musculus
agacattgtgactcacagaactcat

SEQ ID NO: 146303 - DNA, 25 bp, Mus musculus
agacattgttcaacagctggcctgt

SEQ ID NO: 146304 - DNA, 25 bp, Mus musculus
agacattgttcatcagctggcctgt

SEQ ID NO: 146305 - DNA, 25 bp, Mus musculus
agacattgtttcatcttccatgcca

SEQ ID NO: 146306 - DNA, 25 bp, Mus musculus
agacattgtttccatttggatgtga

SEQ ID NO: 146307 - DNA, 25 bp, Mus musculus
agacattgtttcgatttggatgtga

SEQ ID NO: 146308 - DNA, 25 bp, Mus musculus
agacattgtttcttcttccatgcca

SEQ ID NO: 146309 - DNA, 25 bp, Mus musculus
agacatttaactcttacgatggaat

SEQ ID NO: 146310 - DNA, 25 bp, Mus musculus
agacatttaactgttacgatggaat

SEQ ID NO: 146311 - DNA, 25 bp, Mus musculus
agacatttacacaatcccctgtaag

SEQ ID NO: 146312 - DNA, 25 bp, Mus musculus
agacatttacactatcccctgtaag

SEQ ID NO: 146313 - DNA, 25 bp, Mus musculus
agacatttatttacagctgctgcct

SEQ ID NO: 146314 - DNA, 25 bp, Mus musculus
agacatttattttcagctgctgcct

SEQ ID NO: 146315 - DNA, 25 bp, Mus musculus
agacatttcaacacactgagccaga

SEQ ID NO: 146316 - DNA, 25 bp, Mus musculus
agacatttcaactcactgagccaga

SEQ ID NO: 146317 - DNA, 25 bp, Mus musculus
agacatttcacaagttaggtggtaa

SEQ ID NO: 146318 - DNA, 25 bp, Mus musculus
agacatttcacatgttaggtggtaa

SEQ ID NO: 146319 - DNA, 25 bp, Mus musculus
agacatttcacccagactcagcggt

SEQ ID NO: 146320 - DNA, 25 bp, Mus musculus
agacatttcaccgagactcagcggt

SEQ ID NO: 146321 - DNA, 25 bp, Mus musculus
agacatttcattccctcttaaagcc

SEQ ID NO: 146322 - DNA, 25 bp, Mus musculus
agacatttcattgcctcttaaagcc

SEQ ID NO: 146323 - DNA, 25 bp, Mus musculus
agacatttcctaacctcagaacttc

SEQ ID NO: 146324 - DNA, 25 bp, Mus musculus
agacatttcctatcctcagaacttc

SEQ ID NO: 146325 - DNA, 25 bp, Mus musculus
agacatttctcccaggatagcattg

SEQ ID NO: 146326 - DNA, 25 bp, Mus musculus
agacatttctccgaggatagcattg

SEQ ID NO: 146327 - DNA, 25 bp, Mus musculus
agacatttctctcccattgcttgga

SEQ ID NO: 146328 - DNA, 25 bp, Mus musculus
agacatttctctcttgcaaacctcc

SEQ ID NO: 146329 - DNA, 25 bp, Mus musculus
agacatttctctgccattgcttgga

SEQ ID NO: 146330 - DNA, 25 bp, Mus musculus
agacatttctctgttgcaaacctcc

SEQ ID NO: 146331 - DNA, 25 bp, Mus musculus
agacatttgaacaccccagctggtg

SEQ ID NO: 146332 - DNA, 25 bp, Mus musculus
agacatttgaactccccagctggtg

SEQ ID NO: 146333 - DNA, 25 bp, Mus musculus
agacatttgccaactgtcagtttta

SEQ ID NO: 146334 - DNA, 25 bp, Mus musculus
agacatttgccatctgtcagtttta

SEQ ID NO: 146335 - DNA, 25 bp, Mus musculus
agacatttgcccagactgttagcct

SEQ ID NO: 146336 - DNA, 25 bp, Mus musculus
agacatttgccctgactgttagcct

SEQ ID NO: 146337 - DNA, 25 bp, Mus musculus
agacatttgtaaccactgtgtttta

SEQ ID NO: 146338 - DNA, 25 bp, Mus musculus
agacatttgtaagcactgtgtttta

SEQ ID NO: 146339 - DNA, 25 bp, Mus musculus
agacatttgtccctcacttgttcta

SEQ ID NO: 146340 - DNA, 25 bp, Mus musculus
agacatttgtccgtcacttgttcta

SEQ ID NO: 146341 - DNA, 25 bp, Mus musculus
agacattttcatcgcgtaaaagaca

SEQ ID NO: 146342 - DNA, 25 bp, Mus musculus
agacattttcatggcgtaaaagaca

SEQ ID NO: 146343 - DNA, 25 bp, Mus musculus
agacattttcttagcaaatctattg

SEQ ID NO: 146344 - DNA, 25 bp, Mus musculus
agacattttctttgcaaatctattg

SEQ ID NO: 146345 - DNA, 25 bp, Mus musculus
agacattttgagatttctgcagaat

SEQ ID NO: 146346 - DNA, 25 bp, Mus musculus
agacattttgagttttctgcagaat

SEQ ID NO: 146347 - DNA, 25 bp, Mus musculus
agacatttttccactcagcttctta

SEQ ID NO: 146348 - DNA, 25 bp, Mus musculus
agacatttttcctctcagcttctta

SEQ ID NO: 146349 - DNA, 25 bp, Mus musculus
agaccaaaacatacctatccctgaa

SEQ ID NO: 146350 - DNA, 25 bp, Mus musculus
agaccaaaacattcctatccctgaa

SEQ ID NO: 146351 - DNA, 25 bp, Mus musculus
agaccaaaagtcatctggctccttg

SEQ ID NO: 146352 - DNA, 25 bp, Mus musculus
agaccaaaagtcttctggctccttg

SEQ ID NO: 146353 - DNA, 25 bp, Mus musculus
agaccaaaccataactccatcagga

SEQ ID NO: 146354 - DNA, 25 bp, Mus musculus
agaccaaaccattactccatcagga

SEQ ID NO: 146355 - DNA, 25 bp, Mus musculus
agaccaaaccctcatttcagcaaag

SEQ ID NO: 146356 - DNA, 25 bp, Mus musculus
agaccaaaccctgatttcagcaaag

SEQ ID NO: 146357 - DNA, 25 bp, Mus musculus
agaccaaaccgaagccattgtctct

SEQ ID NO: 146358 - DNA, 25 bp, Mus musculus
agaccaaaccgatgccattgtctct

SEQ ID NO: 146359 - DNA, 25 bp, Mus musculus
agaccaaactacataactcacaaga

SEQ ID NO: 146360 - DNA, 25 bp, Mus musculus
agaccaaactacttaactcacaaga

SEQ ID NO: 146361 - DNA, 25 bp, Mus musculus
agaccaaactctctaatttcttgta

SEQ ID NO: 146362 - DNA, 25 bp, Mus musculus
agaccaaactctgtaatttcttgta

SEQ ID NO: 146363 - DNA, 25 bp, Mus musculus
agaccaaagatgaccccgaagctcc

SEQ ID NO: 146364 - DNA, 25 bp, Mus musculus
agaccaaagatgtccccgaagctcc

SEQ ID NO: 146365 - DNA, 25 bp, Mus musculus
agaccaaaggtaagatccactgata

SEQ ID NO: 146366 - DNA, 25 bp, Mus musculus
agaccaaaggtatgatccactgata

SEQ ID NO: 146367 - DNA, 25 bp, Mus musculus
agaccaaagtagaagctttccagac

SEQ ID NO: 146368 - DNA, 25 bp, Mus musculus
agaccaaagtagtagctttccagac

SEQ ID NO: 146369 - DNA, 25 bp, Mus musculus
agaccaaagttgatttacagctgtg

SEQ ID NO: 146370 - DNA, 25 bp, Mus musculus
agaccaaagttgttttacagctgtg

SEQ ID NO: 146371 - DNA, 25 bp, Mus musculus
agaccaaatctgatgatcgcccttt

SEQ ID NO: 146372 - DNA, 25 bp, Mus musculus
agaccaaatctgttgatcgcccttt

SEQ ID NO: 146373 - DNA, 25 bp, Mus musculus
agaccaaatttcagagctcctcttg

SEQ ID NO: 146374 - DNA, 25 bp, Mus musculus
agaccaaatttctgagctcctcttg

SEQ ID NO: 146375 - DNA, 25 bp, Mus musculus
agaccaacatctctttctttactga

SEQ ID NO: 146376 - DNA, 25 bp, Mus musculus
agaccaacatctgtttctttactga

SEQ ID NO: 146377 - DNA, 25 bp, Mus musculus
agaccaacccctacgaggaaatgtg

SEQ ID NO: 146378 - DNA, 25 bp, Mus musculus
agaccaaccccttcgaggaaatgtg

SEQ ID NO: 146379 - DNA, 25 bp, Mus musculus
agaccaaccgataatctctcctggg

SEQ ID NO: 146380 - DNA, 25 bp, Mus musculus
agaccaaccgattatctctcctggg

SEQ ID NO: 146381 - DNA, 25 bp, Mus musculus
agaccaacggctacatctgcgggtg

SEQ ID NO: 146382 - DNA, 25 bp, Mus musculus
agaccaacggcttcatctgcgggtg

SEQ ID NO: 146383 - DNA, 25 bp, Mus musculus
agaccaactcggagtcaatgccttt

SEQ ID NO: 146384 - DNA, 25 bp, Mus musculus
agaccaactcggtgtcaatgccttt

SEQ ID NO: 146385 - DNA, 25 bp, Mus musculus
agaccaactgttcacactttgtaga

SEQ ID NO: 146386 - DNA, 25 bp, Mus musculus
agaccaactgttgacactttgtaga

SEQ ID NO: 146387 - DNA, 25 bp, Mus musculus
agaccaacttccatttggtggctgt

SEQ ID NO: 146388 - DNA, 25 bp, Mus musculus
agaccaacttccttttggtggctgt

SEQ ID NO: 146389 - DNA, 25 bp, Mus musculus
agaccaacttggcagttcatgaaga

SEQ ID NO: 146390 - DNA, 25 bp, Mus musculus
agaccaacttgggagttcatgaaga

SEQ ID NO: 146391 - DNA, 25 bp, Mus musculus
agaccaagacaccggcaagtgtgag

SEQ ID NO: 146392 - DNA, 25 bp, Mus musculus
agaccaagacacgggcaagtgtgag

SEQ ID NO: 146393 - DNA, 25 bp, Mus musculus
agaccaagacggctgcttgccagaa

SEQ ID NO: 146394 - DNA, 25 bp, Mus musculus
agaccaagacgggtgcttgccagaa

SEQ ID NO: 146395 - DNA, 25 bp, Mus musculus
agaccaagagagactgcttatctgg

SEQ ID NO: 146396 - DNA, 25 bp, Mus musculus
agaccaagagagtctgcttatctgg

SEQ ID NO: 146397 - DNA, 25 bp, Mus musculus
agaccaagcactactcattctgaga

SEQ ID NO: 146398 - DNA, 25 bp, Mus musculus
agaccaagcacttctcattctgaga

SEQ ID NO: 146399 - DNA, 25 bp, Mus musculus
agaccaagccacagagcatgcttta

SEQ ID NO: 146400 - DNA, 25 bp, Mus musculus
agaccaagccactgagcatgcttta

SEQ ID NO: 146401 - DNA, 25 bp, Mus musculus
agaccaagccccaggcaatgtttac

SEQ ID NO: 146402 - DNA, 25 bp, Mus musculus
agaccaagcccctggcaatgtttac

SEQ ID NO: 146403 - DNA, 25 bp, Mus musculus
agaccaagccggcagctcgatgaga

SEQ ID NO: 146404 - DNA, 25 bp, Mus musculus
agaccaagccgggagctcgatgaga

SEQ ID NO: 146405 - DNA, 25 bp, Mus musculus
agaccaagcctcaatcctgggacaa

SEQ ID NO: 146406 - DNA, 25 bp, Mus musculus
agaccaagcctctatcctgggacaa

SEQ ID NO: 146407 - DNA, 25 bp, Mus musculus
agaccaagctgcagggcagtagcca

SEQ ID NO: 146408 - DNA, 25 bp, Mus musculus
agaccaagctgctgggcagtagcca

SEQ ID NO: 146409 - DNA, 25 bp, Mus musculus
agaccaagctggaaattagagattc

SEQ ID NO: 146410 - DNA, 25 bp, Mus musculus
agaccaagctggtaattagagattc

SEQ ID NO: 146411 - DNA, 25 bp, Mus musculus
agaccaaggactccaaccactttca

SEQ ID NO: 146412 - DNA, 25 bp, Mus musculus
agaccaaggactgcaaccactttca

SEQ ID NO: 146413 - DNA, 25 bp, Mus musculus
agaccaaggagaacaccatgcccca

SEQ ID NO: 146414 - DNA, 25 bp, Mus musculus
agaccaaggagatcaccatgcccca

SEQ ID NO: 146415 - DNA, 25 bp, Mus musculus
agaccaaggagcaggccaatgccgt

SEQ ID NO: 146416 - DNA, 25 bp, Mus musculus
agaccaaggagctggccaatgccgt

SEQ ID NO: 146417 - DNA, 25 bp, Mus musculus
agaccaagggagatccaggaacaag

SEQ ID NO: 146418 - DNA, 25 bp, Mus musculus
agaccaagggagttccaggaacaag

SEQ ID NO: 146419 - DNA, 25 bp, Mus musculus
agaccaagtcacagccagtttttgc

SEQ ID NO: 146420 - DNA, 25 bp, Mus musculus
agaccaagtcactgccagtttttgc

SEQ ID NO: 146421 - DNA, 25 bp, Mus musculus
agaccaatatttcttcgtatagttt

SEQ ID NO: 146422 - DNA, 25 bp, Mus musculus
agaccaatatttgttcgtatagttt

SEQ ID NO: 146423 - DNA, 25 bp, Mus musculus
agaccaatcagcagtgttgcactta

SEQ ID NO: 146424 - DNA, 25 bp, Mus musculus
agaccaatcagctgtgttgcactta

SEQ ID NO: 146425 - DNA, 25 bp, Mus musculus
agaccaatccaaaaggtcgattatt

SEQ ID NO: 146426 - DNA, 25 bp, Mus musculus
agaccaatccaataggtcgattatt

SEQ ID NO: 146427 - DNA, 25 bp, Mus musculus
agaccaatctatctccagactgttt

SEQ ID NO: 146428 - DNA, 25 bp, Mus musculus
agaccaatctatgtccagactgttt

SEQ ID NO: 146429 - DNA, 25 bp, Mus musculus
agaccaatcttcagccacctaaaaa

SEQ ID NO: 146430 - DNA, 25 bp, Mus musculus
agaccaatcttctgccacctaaaaa

SEQ ID NO: 146431 - DNA, 25 bp, Mus musculus
agaccaatgcaaaagaagactcaga

SEQ ID NO: 146432 - DNA, 25 bp, Mus musculus
agaccaatgcaatagaagactcaga

SEQ ID NO: 146433 - DNA, 25 bp, Mus musculus
agaccaatggctccaatttctttaa

SEQ ID NO: 146434 - DNA, 25 bp, Mus musculus
agaccaatggctgcaatttctttaa

SEQ ID NO: 146435 - DNA, 25 bp, Mus musculus
agaccaatgggccttggagtccccg

SEQ ID NO: 146436 - DNA, 25 bp, Mus musculus
agaccaatgggcgttggagtccccg

SEQ ID NO: 146437 - DNA, 25 bp, Mus musculus
agaccaatgtacaatgtgccagtgt

SEQ ID NO: 146438 - DNA, 25 bp, Mus musculus
agaccaatgtactatgtgccagtgt

SEQ ID NO: 146439 - DNA, 25 bp, Mus musculus
agaccacaaggcactttggctcttc

SEQ ID NO: 146440 - DNA, 25 bp, Mus musculus
agaccacaaggctctttggctcttc

SEQ ID NO: 146441 - DNA, 25 bp, Mus musculus
agaccacaccataggctgcgtgagt

SEQ ID NO: 146442 - DNA, 25 bp, Mus musculus
agaccacaccattggctgcgtgagt

SEQ ID NO: 146443 - DNA, 25 bp, Mus musculus
agaccacacgagaagagcgagtttc

SEQ ID NO: 146444 - DNA, 25 bp, Mus musculus
agaccacacgagtagagcgagtttc

SEQ ID NO: 146445 - DNA, 25 bp, Mus musculus
agaccacacggaacactgaggcact

SEQ ID NO: 146446 - DNA, 25 bp, Mus musculus
agaccacacggatcactgaggcact

SEQ ID NO: 146447 - DNA, 25 bp, Mus musculus
agaccacactagagacaggctctgt

SEQ ID NO: 146448 - DNA, 25 bp, Mus musculus
agaccacactagtgacaggctctgt

SEQ ID NO: 146449 - DNA, 25 bp, Mus musculus
agaccacactgcaaacagggacttc

SEQ ID NO: 146450 - DNA, 25 bp, Mus musculus
agaccacactgctaacagggacttc

SEQ ID NO: 146451 - DNA, 25 bp, Mus musculus
agaccacagacacgctttgacttta

SEQ ID NO: 146452 - DNA, 25 bp, Mus musculus
agaccacagacaggctttgacttta

SEQ ID NO: 146453 - DNA, 25 bp, Mus musculus
agaccacagactagcattcttcaga

SEQ ID NO: 146454 - DNA, 25 bp, Mus musculus
agaccacagacttgcattcttcaga

SEQ ID NO: 146455 - DNA, 25 bp, Mus musculus
agaccacagatgatgtcctgtattc

SEQ ID NO: 146456 - DNA, 25 bp, Mus musculus
agaccacagatgttgtcctgtattc

SEQ ID NO: 146457 - DNA, 25 bp, Mus musculus
agaccacagcccagagtttatccaa

SEQ ID NO: 146458 - DNA, 25 bp, Mus musculus
agaccacagcccaggttttgatgga

SEQ ID NO: 146459 - DNA, 25 bp, Mus musculus
agaccacagccctgagtttatccaa

SEQ ID NO: 146460 - DNA, 25 bp, Mus musculus
agaccacagccctggttttgatgga

SEQ ID NO: 146461 - DNA, 25 bp, Mus musculus
agaccacagtccctatgccatcaaa

SEQ ID NO: 146462 - DNA, 25 bp, Mus musculus
agaccacagtccgtatgccatcaaa

SEQ ID NO: 146463 - DNA, 25 bp, Mus musculus
agaccacagtctaaacccaagggct

SEQ ID NO: 146464 - DNA, 25 bp, Mus musculus
agaccacagtcttaacccaagggct

SEQ ID NO: 146465 - DNA, 25 bp, Mus musculus
agaccacagtgcatcctgcacagcg

SEQ ID NO: 146466 - DNA, 25 bp, Mus musculus
agaccacagtgcattctgtcaaaga

SEQ ID NO: 146467 - DNA, 25 bp, Mus musculus
agaccacagtgcctctagctacggt

SEQ ID NO: 146468 - DNA, 25 bp, Mus musculus
agaccacagtgcgtctagctacggt

SEQ ID NO: 146469 - DNA, 25 bp, Mus musculus
agaccacagtgcttcctgcacagcg

SEQ ID NO: 146470 - DNA, 25 bp, Mus musculus
agaccacagtgctttctgtcaaaga

SEQ ID NO: 146471 - DNA, 25 bp, Mus musculus
agaccacagttcaagcctcagggca

SEQ ID NO: 146472 - DNA, 25 bp, Mus musculus
agaccacagttctagcctcagggca

SEQ ID NO: 146473 - DNA, 25 bp, Mus musculus
agaccacataatctggccacctagg

SEQ ID NO: 146474 - DNA, 25 bp, Mus musculus
agaccacataatgtggccacctagg

SEQ ID NO: 146475 - DNA, 25 bp, Mus musculus
agaccacatcatacctgcttctaaa

SEQ ID NO: 146476 - DNA, 25 bp, Mus musculus
agaccacatcattcctgcttctaaa

SEQ ID NO: 146477 - DNA, 25 bp, Mus musculus
agaccacatgataaaggccaccgct

SEQ ID NO: 146478 - DNA, 25 bp, Mus musculus
agaccacatgattaaggccaccgct

SEQ ID NO: 146479 - DNA, 25 bp, Mus musculus
agaccacatgtcctattcatactgc

SEQ ID NO: 146480 - DNA, 25 bp, Mus musculus
agaccacatgtcgtattcatactgc

SEQ ID NO: 146481 - DNA, 25 bp, Mus musculus
agaccaccaaggcactgctcatttc

SEQ ID NO: 146482 - DNA, 25 bp, Mus musculus
agaccaccaagggactgctcatttc

SEQ ID NO: 146483 - DNA, 25 bp, Mus musculus
agaccaccacatcttcaactgctag

SEQ ID NO: 146484 - DNA, 25 bp, Mus musculus
agaccaccacatgttcaactgctag

SEQ ID NO: 146485 - DNA, 25 bp, Mus musculus
agaccaccagagatggccttcagaa

SEQ ID NO: 146486 - DNA, 25 bp, Mus musculus
agaccaccagagttggccttcagaa

SEQ ID NO: 146487 - DNA, 25 bp, Mus musculus
agaccaccaggacatagctttcggg

SEQ ID NO: 146488 - DNA, 25 bp, Mus musculus
agaccaccaggagatagctttcggg

SEQ ID NO: 146489 - DNA, 25 bp, Mus musculus
agaccaccagggacagggcgcagca

SEQ ID NO: 146490 - DNA, 25 bp, Mus musculus
agaccaccagggtcagggcgcagca

SEQ ID NO: 146491 - DNA, 25 bp, Mus musculus
agaccacccagaaaccacgaatgct

SEQ ID NO: 146492 - DNA, 25 bp, Mus musculus
agaccacccagataccacgaatgct

SEQ ID NO: 146493 - DNA, 25 bp, Mus musculus
agaccaccccagatttctagttatt

SEQ ID NO: 146494 - DNA, 25 bp, Mus musculus
agaccaccccagttttctagttatt

SEQ ID NO: 146495 - DNA, 25 bp, Mus musculus
agaccaccccgacaatttctgatct

SEQ ID NO: 146496 - DNA, 25 bp, Mus musculus
agaccaccccgagaatttctgatct

SEQ ID NO: 146497 - DNA, 25 bp, Mus musculus
agaccaccctggactacagtgtgaa

SEQ ID NO: 146498 - DNA, 25 bp, Mus musculus
agaccaccctggtctacagtgtgaa

SEQ ID NO: 146499 - DNA, 25 bp, Mus musculus
agaccacctccactgttgcataaac

SEQ ID NO: 146500 - DNA, 25 bp, Mus musculus
agaccacctccagtgttgcataaac

SEQ ID NO: 146501 - DNA, 25 bp, Mus musculus
agaccacctctgcacaagcataagg

SEQ ID NO: 146502 - DNA, 25 bp, Mus musculus
agaccacctctggacaagcataagg

SEQ ID NO: 146503 - DNA, 25 bp, Mus musculus
agaccacctgagcaccgtacaagag

SEQ ID NO: 146504 - DNA, 25 bp, Mus musculus
agaccacctgaggaccgtacaagag

SEQ ID NO: 146505 - DNA, 25 bp, Mus musculus
agaccaccttcaatcatgttctaac

SEQ ID NO: 146506 - DNA, 25 bp, Mus musculus
agaccaccttcattcatgttctaac

SEQ ID NO: 146507 - DNA, 25 bp, Mus musculus
agaccacctttcctctcaagaagga

SEQ ID NO: 146508 - DNA, 25 bp, Mus musculus
agaccacctttcgtctcaagaagga

SEQ ID NO: 146509 - DNA, 25 bp, Mus musculus
agaccacgaagtcttacttacagcc

SEQ ID NO: 146510 - DNA, 25 bp, Mus musculus
agaccacgaagtgttacttacagcc

SEQ ID NO: 146511 - DNA, 25 bp, Mus musculus
agaccacgacggagcggcctttcat

SEQ ID NO: 146512 - DNA, 25 bp, Mus musculus
agaccacgacggtgcggcctttcat

SEQ ID NO: 146513 - DNA, 25 bp, Mus musculus
agaccacgactcatctcaatgaacg

SEQ ID NO: 146514 - DNA, 25 bp, Mus musculus
agaccacgactcttctcaatgaacg

SEQ ID NO: 146515 - DNA, 25 bp, Mus musculus
agaccacgccttagggaagtattat

SEQ ID NO: 146516 - DNA, 25 bp, Mus musculus
agaccacgcctttgggaagtattat

SEQ ID NO: 146517 - DNA, 25 bp, Mus musculus
agaccacgctggaacagcagagctg

SEQ ID NO: 146518 - DNA, 25 bp, Mus musculus
agaccacgctggtacagcagagctg

SEQ ID NO: 146519 - DNA, 25 bp, Mus musculus
agaccacgggctcagtagagactac

SEQ ID NO: 146520 - DNA, 25 bp, Mus musculus
agaccacgggctgagtagagactac

SEQ ID NO: 146521 - DNA, 25 bp, Mus musculus
agaccacgtgaacttgccctttttg

SEQ ID NO: 146522 - DNA, 25 bp, Mus musculus
agaccacgtgaagttgccctttttg

SEQ ID NO: 146523 - DNA, 25 bp, Mus musculus
agaccactacataatgctgagcact

SEQ ID NO: 146524 - DNA, 25 bp, Mus musculus
agaccactacattatgctgagcact

SEQ ID NO: 146525 - DNA, 25 bp, Mus musculus
agaccactatgaattattactttta

SEQ ID NO: 146526 - DNA, 25 bp, Mus musculus
agaccactatgatttattactttta

SEQ ID NO: 146527 - DNA, 25 bp, Mus musculus
agaccactccctcaagtgacggatg

SEQ ID NO: 146528 - DNA, 25 bp, Mus musculus
agaccactccctgaagtgacggatg

SEQ ID NO: 146529 - DNA, 25 bp, Mus musculus
agaccactccgcacgtggagtacta

SEQ ID NO: 146530 - DNA, 25 bp, Mus musculus
agaccactccgctcgtggagtacta

SEQ ID NO: 146531 - DNA, 25 bp, Mus musculus
agaccactcctgaagctgatgactg

SEQ ID NO: 146532 - DNA, 25 bp, Mus musculus
agaccactcctgtagctgatgactg

SEQ ID NO: 146533 - DNA, 25 bp, Mus musculus
agaccactgaggagcatcctgcatc

SEQ ID NO: 146534 - DNA, 25 bp, Mus musculus
agaccactgaggagcatgcgctctg

SEQ ID NO: 146535 - DNA, 25 bp, Mus musculus
agaccactgaggtgcatcctgcatc

SEQ ID NO: 146536 - DNA, 25 bp, Mus musculus
agaccactgaggtgcatgcgctctg

SEQ ID NO: 146537 - DNA, 25 bp, Mus musculus
agaccactgatgaccccgaatatga

SEQ ID NO: 146538 - DNA, 25 bp, Mus musculus
agaccactgatgtccccgaatatga

SEQ ID NO: 146539 - DNA, 25 bp, Mus musculus
agaccactgcagacagacttcaaga

SEQ ID NO: 146540 - DNA, 25 bp, Mus musculus
agaccactgcagtcagacttcaaga

SEQ ID NO: 146541 - DNA, 25 bp, Mus musculus
agaccactgcatattgtgaactgca

SEQ ID NO: 146542 - DNA, 25 bp, Mus musculus
agaccactgcattttgtgaactgca

SEQ ID NO: 146543 - DNA, 25 bp, Mus musculus
agaccactgccaatgtaataacaca

SEQ ID NO: 146544 - DNA, 25 bp, Mus musculus
agaccactgccattgtaataacaca

SEQ ID NO: 146545 - DNA, 25 bp, Mus musculus
agaccactggcacaccaactgtcat

SEQ ID NO: 146546 - DNA, 25 bp, Mus musculus
agaccactggcagaccaactgtcat

SEQ ID NO: 146547 - DNA, 25 bp, Mus musculus
agaccactggctcaaccatgctgtg

SEQ ID NO: 146548 - DNA, 25 bp, Mus musculus
agaccactggctgaaccatgctgtg

SEQ ID NO: 146549 - DNA, 25 bp, Mus musculus
agaccactggtcatgtgttttctgc

SEQ ID NO: 146550 - DNA, 25 bp, Mus musculus
agaccactggtcttgtgttttctgc

SEQ ID NO: 146551 - DNA, 25 bp, Mus musculus
agaccactgtggctaaagttgactg

SEQ ID NO: 146552 - DNA, 25 bp, Mus musculus
agaccactgtgggtaaagttgactg

SEQ ID NO: 146553 - DNA, 25 bp, Mus musculus
agaccactgttgagcaatgcttgat

SEQ ID NO: 146554 - DNA, 25 bp, Mus musculus
agaccactgttgtgcaatgcttgat

SEQ ID NO: 146555 - DNA, 25 bp, Mus musculus
agaccacttagcagttcccataaag

SEQ ID NO: 146556 - DNA, 25 bp, Mus musculus
agaccacttagctgttcccataaag

SEQ ID NO: 146557 - DNA, 25 bp, Mus musculus
agaccacttcaaacctaatctgaac

SEQ ID NO: 146558 - DNA, 25 bp, Mus musculus
agaccacttcaatcctaatctgaac

SEQ ID NO: 146559 - DNA, 25 bp, Mus musculus
agaccacttctcactgttaacacaa

SEQ ID NO: 146560 - DNA, 25 bp, Mus musculus
agaccacttctctctgttaacacaa

SEQ ID NO: 146561 - DNA, 25 bp, Mus musculus
agaccacttcttccggtaagctgat

SEQ ID NO: 146562 - DNA, 25 bp, Mus musculus
agaccacttcttgcggtaagctgat

SEQ ID NO: 146563 - DNA, 25 bp, Mus musculus
agaccacttgacaggtaagactgga

SEQ ID NO: 146564 - DNA, 25 bp, Mus musculus
agaccacttgactggtaagactgga

SEQ ID NO: 146565 - DNA, 25 bp, Mus musculus
agaccagaatgaagccactctttat

SEQ ID NO: 146566 - DNA, 25 bp, Mus musculus
agaccagaatgatgccactctttat

SEQ ID NO: 146567 - DNA, 25 bp, Mus musculus
agaccagacatcacgggaccaggaa

SEQ ID NO: 146568 - DNA, 25 bp, Mus musculus
agaccagacatctcgggaccaggaa

SEQ ID NO: 146569 - DNA, 25 bp, Mus musculus
agaccagactcacttcaaactcata

SEQ ID NO: 146570 - DNA, 25 bp, Mus musculus
agaccagactcagttcaaactcata

SEQ ID NO: 146571 - DNA, 25 bp, Mus musculus
agaccagactccaaaatggaaacca

SEQ ID NO: 146572 - DNA, 25 bp, Mus musculus
agaccagactcctaaatggaaacca

SEQ ID NO: 146573 - DNA, 25 bp, Mus musculus
agaccagagacactgcccgggagca

SEQ ID NO: 146574 - DNA, 25 bp, Mus musculus
agaccagagacagtgcccgggagca

SEQ ID NO: 146575 - DNA, 25 bp, Mus musculus
agaccagagcccctgtagatgttac

SEQ ID NO: 146576 - DNA, 25 bp, Mus musculus
agaccagagcccgtgtagatgttac

SEQ ID NO: 146577 - DNA, 25 bp, Mus musculus
agaccagagcgacggcaagttcttc

SEQ ID NO: 146578 - DNA, 25 bp, Mus musculus
agaccagagcgagggcaagttcttc

SEQ ID NO: 146579 - DNA, 25 bp, Mus musculus
agaccagagcttcgagattcaggcc

SEQ ID NO: 146580 - DNA, 25 bp, Mus musculus
agaccagagcttggagattcaggcc

SEQ ID NO: 146581 - DNA, 25 bp, Mus musculus
agaccagagtctcttctctctgact

SEQ ID NO: 146582 - DNA, 25 bp, Mus musculus
agaccagagtctgttctctctgact

SEQ ID NO: 146583 - DNA, 25 bp, Mus musculus
agaccagagtgcattctctataatt

SEQ ID NO: 146584 - DNA, 25 bp, Mus musculus
agaccagagtgctttctctataatt

SEQ ID NO: 146585 - DNA, 25 bp, Mus musculus
agaccagatgagagtcctttaatca

SEQ ID NO: 146586 - DNA, 25 bp, Mus musculus
agaccagatgagtgtcctttaatca

SEQ ID NO: 146587 - DNA, 25 bp, Mus musculus
agaccagatgatcgcagtgcctgct

SEQ ID NO: 146588 - DNA, 25 bp, Mus musculus
agaccagatgatggcagtgcctgct

SEQ ID NO: 146589 - DNA, 25 bp, Mus musculus
agaccagatgcccagtttgacttgt

SEQ ID NO: 146590 - DNA, 25 bp, Mus musculus
agaccagatgccgagtttgacttgt

SEQ ID NO: 146591 - DNA, 25 bp, Mus musculus
agaccagatgtcaccagaaccaatt

SEQ ID NO: 146592 - DNA, 25 bp, Mus musculus
agaccagatgtctccagaaccaatt

SEQ ID NO: 146593 - DNA, 25 bp, Mus musculus
agaccagattctatgtatatgtact

SEQ ID NO: 146594 - DNA, 25 bp, Mus musculus
agaccagattctttgtatatgtact

SEQ ID NO: 146595 - DNA, 25 bp, Mus musculus
agaccagcaagcacatcaaagtcag

SEQ ID NO: 146596 - DNA, 25 bp, Mus musculus
agaccagcaagcctggcggcaagat

SEQ ID NO: 146597 - DNA, 25 bp, Mus musculus
agaccagcaagcgtggcggcaagat

SEQ ID NO: 146598 - DNA, 25 bp, Mus musculus
agaccagcaagctcatcaaagtcag

SEQ ID NO: 146599 - DNA, 25 bp, Mus musculus
agaccagcacctatttgatccagaa

SEQ ID NO: 146600 - DNA, 25 bp, Mus musculus
agaccagcacctctgttctgattct

SEQ ID NO: 146601 - DNA, 25 bp, Mus musculus
agaccagcacctgtgttctgattct

SEQ ID NO: 146602 - DNA, 25 bp, Mus musculus
agaccagcacctttttgatccagaa

SEQ ID NO: 146603 - DNA, 25 bp, Mus musculus
agaccagcacggcatacatgaaatc

SEQ ID NO: 146604 - DNA, 25 bp, Mus musculus
agaccagcacgggatacatgaaatc

SEQ ID NO: 146605 - DNA, 25 bp, Mus musculus
agaccagcaggaaggcaggccactt

SEQ ID NO: 146606 - DNA, 25 bp, Mus musculus
agaccagcaggacagtgagccctat

SEQ ID NO: 146607 - DNA, 25 bp, Mus musculus
agaccagcaggagagtgagccctat

SEQ ID NO: 146608 - DNA, 25 bp, Mus musculus
agaccagcaggatggcaggccactt

SEQ ID NO: 146609 - DNA, 25 bp, Mus musculus
agaccagcaggcctgctgcattctg

SEQ ID NO: 146610 - DNA, 25 bp, Mus musculus
agaccagcaggcgtgctgcattctg

SEQ ID NO: 146611 - DNA, 25 bp, Mus musculus
agaccagcaggtctgacaagccttt

SEQ ID NO: 146612 - DNA, 25 bp, Mus musculus
agaccagcaggtgtgacaagccttt

SEQ ID NO: 146613 - DNA, 25 bp, Mus musculus
agaccagcagtgactgccctggagc

SEQ ID NO: 146614 - DNA, 25 bp, Mus musculus
agaccagcagtgtctgccctggagc

SEQ ID NO: 146615 - DNA, 25 bp, Mus musculus
agaccagcatgccagtgtgcaagaa

SEQ ID NO: 146616 - DNA, 25 bp, Mus musculus
agaccagcatgcgagtgtgcaagaa

SEQ ID NO: 146617 - DNA, 25 bp, Mus musculus
agaccagcattaccaagagacccaa

SEQ ID NO: 146618 - DNA, 25 bp, Mus musculus
agaccagcattagcaagagacccaa

SEQ ID NO: 146619 - DNA, 25 bp, Mus musculus
agaccagccacaatcttgactcttt

SEQ ID NO: 146620 - DNA, 25 bp, Mus musculus
agaccagccacattcttgactcttt

SEQ ID NO: 146621 - DNA, 25 bp, Mus musculus
agaccagccctgatttgaggagtca

SEQ ID NO: 146622 - DNA, 25 bp, Mus musculus
agaccagccctgttttgaggagtca

SEQ ID NO: 146623 - DNA, 25 bp, Mus musculus
agaccagcccttacagaggctttcc

SEQ ID NO: 146624 - DNA, 25 bp, Mus musculus
agaccagcccttatgtcaaggagtt

SEQ ID NO: 146625 - DNA, 25 bp, Mus musculus
agaccagccctttcagaggctttcc

SEQ ID NO: 146626 - DNA, 25 bp, Mus musculus
agaccagcccttttgtcaaggagtt

SEQ ID NO: 146627 - DNA, 25 bp, Mus musculus
agaccagcctccagaaaggcgcagg

SEQ ID NO: 146628 - DNA, 25 bp, Mus musculus
agaccagcctcctgaaaggcgcagg

SEQ ID NO: 146629 - DNA, 25 bp, Mus musculus
agaccagcctgcaccagtattcttc

SEQ ID NO: 146630 - DNA, 25 bp, Mus musculus
agaccagcctgctccagtattcttc

SEQ ID NO: 146631 - DNA, 25 bp, Mus musculus
agaccagcctggatgaagtcatgaa

SEQ ID NO: 146632 - DNA, 25 bp, Mus musculus
agaccagcctggttgaagtcatgaa

SEQ ID NO: 146633 - DNA, 25 bp, Mus musculus
agaccagcgctcacacgggtgagaa

SEQ ID NO: 146634 - DNA, 25 bp, Mus musculus
agaccagcgctctcacgggtgagaa

SEQ ID NO: 146635 - DNA, 25 bp, Mus musculus
agaccagctaagcaaaagcagcctc

SEQ ID NO: 146636 - DNA, 25 bp, Mus musculus
agaccagctaaggaaaagcagcctc

SEQ ID NO: 146637 - DNA, 25 bp, Mus musculus
agaccagctacacaagggctttttt

SEQ ID NO: 146638 - DNA, 25 bp, Mus musculus
agaccagctacagaagggctttttt

SEQ ID NO: 146639 - DNA, 25 bp, Mus musculus
agaccagctattattcagggcccta

SEQ ID NO: 146640 - DNA, 25 bp, Mus musculus
agaccagctatttttcagggcccta

SEQ ID NO: 146641 - DNA, 25 bp, Mus musculus
agaccagctcagcatttccctggga

SEQ ID NO: 146642 - DNA, 25 bp, Mus musculus
agaccagctcaggatttccctggga

SEQ ID NO: 146643 - DNA, 25 bp, Mus musculus
agaccagctgtcagatcaaagtcaa

SEQ ID NO: 146644 - DNA, 25 bp, Mus musculus
agaccagctgtctgatcaaagtcaa

SEQ ID NO: 146645 - DNA, 25 bp, Mus musculus
agaccagctgtgatgttcgaagaca

SEQ ID NO: 146646 - DNA, 25 bp, Mus musculus
agaccagctgtgcatcggcactaaa

SEQ ID NO: 146647 - DNA, 25 bp, Mus musculus
agaccagctgtggatcggcactaaa

SEQ ID NO: 146648 - DNA, 25 bp, Mus musculus
agaccagctgtgttgttcgaagaca

SEQ ID NO: 146649 - DNA, 25 bp, Mus musculus
agaccagcttctaagtaacgacctg

SEQ ID NO: 146650 - DNA, 25 bp, Mus musculus
agaccagcttcttagtaacgacctg

SEQ ID NO: 146651 - DNA, 25 bp, Mus musculus
agaccagcttggaatctcattacaa

SEQ ID NO: 146652 - DNA, 25 bp, Mus musculus
agaccagcttggtatctcattacaa

SEQ ID NO: 146653 - DNA, 25 bp, Mus musculus
agaccagctttcacattggcctttg

SEQ ID NO: 146654 - DNA, 25 bp, Mus musculus
agaccagctttctcattggcctttg

SEQ ID NO: 146655 - DNA, 25 bp, Mus musculus
agaccaggaaccaacagactcttct

SEQ ID NO: 146656 - DNA, 25 bp, Mus musculus
agaccaggaacctacagactcttct

SEQ ID NO: 146657 - DNA, 25 bp, Mus musculus
agaccaggacatatcagacagcagt

SEQ ID NO: 146658 - DNA, 25 bp, Mus musculus
agaccaggacatccccgggcaagcc

SEQ ID NO: 146659 - DNA, 25 bp, Mus musculus
agaccaggacatgcccgggcaagcc

SEQ ID NO: 146660 - DNA, 25 bp, Mus musculus
agaccaggacatttcagacagcagt

SEQ ID NO: 146661 - DNA, 25 bp, Mus musculus
agaccaggaggacctcaacccttat

SEQ ID NO: 146662 - DNA, 25 bp, Mus musculus
agaccaggaggagctcaacccttat

SEQ ID NO: 146663 - DNA, 25 bp, Mus musculus
agaccaggaggcactcgatgtcttc

SEQ ID NO: 146664 - DNA, 25 bp, Mus musculus
agaccaggaggctctcgatgtcttc

SEQ ID NO: 146665 - DNA, 25 bp, Mus musculus
agaccaggcacaacatcttatgtaa

SEQ ID NO: 146666 - DNA, 25 bp, Mus musculus
agaccaggcacatcatcttatgtaa

SEQ ID NO: 146667 - DNA, 25 bp, Mus musculus
agaccaggcatgcaatcacacttct

SEQ ID NO: 146668 - DNA, 25 bp, Mus musculus
agaccaggcatggaatcacacttct

SEQ ID NO: 146669 - DNA, 25 bp, Mus musculus
agaccaggccgtcgacataatcctt

SEQ ID NO: 146670 - DNA, 25 bp, Mus musculus
agaccaggccgtggacataatcctt

SEQ ID NO: 146671 - DNA, 25 bp, Mus musculus
agaccaggcctgaaggagggtactt

SEQ ID NO: 146672 - DNA, 25 bp, Mus musculus
agaccaggcctgtaggagggtactt

SEQ ID NO: 146673 - DNA, 25 bp, Mus musculus
agaccaggctggcagagatgcacct

SEQ ID NO: 146674 - DNA, 25 bp, Mus musculus
agaccaggctgggagagatgcacct

SEQ ID NO: 146675 - DNA, 25 bp, Mus musculus
agaccaggctttcagggttgccaag

SEQ ID NO: 146676 - DNA, 25 bp, Mus musculus
agaccaggctttcctggaattctgt

SEQ ID NO: 146677 - DNA, 25 bp, Mus musculus
agaccaggctttgagggttgccaag

SEQ ID NO: 146678 - DNA, 25 bp, Mus musculus
agaccaggctttgctggaattctgt

SEQ ID NO: 146679 - DNA, 25 bp, Mus musculus
agaccagggagcagtcacctgagca

SEQ ID NO: 146680 - DNA, 25 bp, Mus musculus
agaccagggagctgtcacctgagca

SEQ ID NO: 146681 - DNA, 25 bp, Mus musculus
agaccagggataccagcgggcaacc

SEQ ID NO: 146682 - DNA, 25 bp, Mus musculus
agaccagggatagcagcgggcaacc

SEQ ID NO: 146683 - DNA, 25 bp, Mus musculus
agaccaggtcaaaggcggccccaag

SEQ ID NO: 146684 - DNA, 25 bp, Mus musculus
agaccaggtcaatggcggccccaag

SEQ ID NO: 146685 - DNA, 25 bp, Mus musculus
agaccaggtccacttggcttgcgca

SEQ ID NO: 146686 - DNA, 25 bp, Mus musculus
agaccaggtccagttggcttgcgca

SEQ ID NO: 146687 - DNA, 25 bp, Mus musculus
agaccaggtccgagtgatgctcaga

SEQ ID NO: 146688 - DNA, 25 bp, Mus musculus
agaccaggtccgtgtgatgctcaga

SEQ ID NO: 146689 - DNA, 25 bp, Mus musculus
agaccaggtctactactgtagcccc

SEQ ID NO: 146690 - DNA, 25 bp, Mus musculus
agaccaggtctagtactgtagcccc

SEQ ID NO: 146691 - DNA, 25 bp, Mus musculus
agaccagtatccattatcttctcag

SEQ ID NO: 146692 - DNA, 25 bp, Mus musculus
agaccagtatcctttatcttctcag

SEQ ID NO: 146693 - DNA, 25 bp, Mus musculus
agaccagtcagaatgcacacagagc

SEQ ID NO: 146694 - DNA, 25 bp, Mus musculus
agaccagtcagattgcacacagagc

SEQ ID NO: 146695 - DNA, 25 bp, Mus musculus
agaccagtcataactctactaaact

SEQ ID NO: 146696 - DNA, 25 bp, Mus musculus
agaccagtcatatctctactaaact

SEQ ID NO: 146697 - DNA, 25 bp, Mus musculus
agaccagtccagagctgtctgagga

SEQ ID NO: 146698 - DNA, 25 bp, Mus musculus
agaccagtccagtgctgtctgagga

SEQ ID NO: 146699 - DNA, 25 bp, Mus musculus
agaccagtccggcttggatgtgatc

SEQ ID NO: 146700 - DNA, 25 bp, Mus musculus
agaccagtccgggttggatgtgatc

SEQ ID NO: 146701 - DNA, 25 bp, Mus musculus
agaccagtgacgctcccagggaact

SEQ ID NO: 146702 - DNA, 25 bp, Mus musculus
agaccagtgacggtcccagggaact

SEQ ID NO: 146703 - DNA, 25 bp, Mus musculus
agaccagtgctgatgcagaggctca

SEQ ID NO: 146704 - DNA, 25 bp, Mus musculus
agaccagtgctgttgcagaggctca

SEQ ID NO: 146705 - DNA, 25 bp, Mus musculus
agaccagtgtcaagagtccttccta

SEQ ID NO: 146706 - DNA, 25 bp, Mus musculus
agaccagtgtcaattcccgggacat

SEQ ID NO: 146707 - DNA, 25 bp, Mus musculus
agaccagtgtcatgagtccttccta

SEQ ID NO: 146708 - DNA, 25 bp, Mus musculus
agaccagtgtcatttcccgggacat

SEQ ID NO: 146709 - DNA, 25 bp, Mus musculus
agaccagtgtcccaagtgttaccct

SEQ ID NO: 146710 - DNA, 25 bp, Mus musculus
agaccagtgtccgaagtgttaccct

SEQ ID NO: 146711 - DNA, 25 bp, Mus musculus
agaccagtgtgacgaccaaagagca

SEQ ID NO: 146712 - DNA, 25 bp, Mus musculus
agaccagtgtgaggaccaaagagca

SEQ ID NO: 146713 - DNA, 25 bp, Mus musculus
agaccagtgttcacaactaaacccg

SEQ ID NO: 146714 - DNA, 25 bp, Mus musculus
agaccagtgttctcaactaaacccg

SEQ ID NO: 146715 - DNA, 25 bp, Mus musculus
agaccagttcttcctttcatcatga

SEQ ID NO: 146716 - DNA, 25 bp, Mus musculus
agaccagttcttgctttcatcatga

SEQ ID NO: 146717 - DNA, 25 bp, Mus musculus
agaccagttgtcagctttgtacaga

SEQ ID NO: 146718 - DNA, 25 bp, Mus musculus
agaccagttgtccaaaagccagcaa

SEQ ID NO: 146719 - DNA, 25 bp, Mus musculus
agaccagttgtccttgggcattaac

SEQ ID NO: 146720 - DNA, 25 bp, Mus musculus
agaccagttgtcgaaaagccagcaa

SEQ ID NO: 146721 - DNA, 25 bp, Mus musculus
agaccagttgtcgttgggcattaac

SEQ ID NO: 146722 - DNA, 25 bp, Mus musculus
agaccagttgtctgctttgtacaga

SEQ ID NO: 146723 - DNA, 25 bp, Mus musculus
agaccagtttggctcacctgagact

SEQ ID NO: 146724 - DNA, 25 bp, Mus musculus
agaccagtttgggtcacctgagact

SEQ ID NO: 146725 - DNA, 25 bp, Mus musculus
agaccataaatgaccccagttcaca

SEQ ID NO: 146726 - DNA, 25 bp, Mus musculus
agaccataaatgtccccagttcaca

SEQ ID NO: 146727 - DNA, 25 bp, Mus musculus
agaccatacctcagataatcctttc

SEQ ID NO: 146728 - DNA, 25 bp, Mus musculus
agaccatacctctgataatcctttc

SEQ ID NO: 146729 - DNA, 25 bp, Mus musculus
agaccatagcttaaatcatcccatt

SEQ ID NO: 146730 - DNA, 25 bp, Mus musculus
agaccatagctttaatcatcccatt

SEQ ID NO: 146731 - DNA, 25 bp, Mus musculus
agaccataggctatcagtttcctag

SEQ ID NO: 146732 - DNA, 25 bp, Mus musculus
agaccataggctttcagtttcctag

SEQ ID NO: 146733 - DNA, 25 bp, Mus musculus
agaccatagttacaaggcctgcctt

SEQ ID NO: 146734 - DNA, 25 bp, Mus musculus
agaccatagttagaaggcctgcctt

SEQ ID NO: 146735 - DNA, 25 bp, Mus musculus
agaccatataccatctatccaaaag

SEQ ID NO: 146736 - DNA, 25 bp, Mus musculus
agaccatataccttctatccaaaag

SEQ ID NO: 146737 - DNA, 25 bp, Mus musculus
agaccatcaacaacgagcctgacat

SEQ ID NO: 146738 - DNA, 25 bp, Mus musculus
agaccatcaacatcgagcctgacat

SEQ ID NO: 146739 - DNA, 25 bp, Mus musculus
agaccatcaaggagcttattcagag

SEQ ID NO: 146740 - DNA, 25 bp, Mus musculus
agaccatcaaggtgcttattcagag

SEQ ID NO: 146741 - DNA, 25 bp, Mus musculus
agaccatcacatatctggagctgag

SEQ ID NO: 146742 - DNA, 25 bp, Mus musculus
agaccatcacatcctcagagtccag

SEQ ID NO: 146743 - DNA, 25 bp, Mus musculus
agaccatcacatgctcagagtccag

SEQ ID NO: 146744 - DNA, 25 bp, Mus musculus
agaccatcacatttctggagctgag

SEQ ID NO: 146745 - DNA, 25 bp, Mus musculus
agaccatcacccagtgtgctacaag

SEQ ID NO: 146746 - DNA, 25 bp, Mus musculus
agaccatcaccctgtgtgctacaag

SEQ ID NO: 146747 - DNA, 25 bp, Mus musculus
agaccatcagagagtgcacctccaa

SEQ ID NO: 146748 - DNA, 25 bp, Mus musculus
agaccatcagagtgtgcacctccaa

SEQ ID NO: 146749 - DNA, 25 bp, Mus musculus
agaccatcatctcttatgactctgc

SEQ ID NO: 146750 - DNA, 25 bp, Mus musculus
agaccatcatctgttatgactctgc

SEQ ID NO: 146751 - DNA, 25 bp, Mus musculus
agaccatccccacaggctataggca

SEQ ID NO: 146752 - DNA, 25 bp, Mus musculus
agaccatccccagaggctataggca

SEQ ID NO: 146753 - DNA, 25 bp, Mus musculus
agaccatcgaccctctgtcgggtaa

SEQ ID NO: 146754 - DNA, 25 bp, Mus musculus
agaccatcgaccgtctgtcgggtaa

SEQ ID NO: 146755 - DNA, 25 bp, Mus musculus
agaccatcggaacacacagctgtgt

SEQ ID NO: 146756 - DNA, 25 bp, Mus musculus
agaccatcggaagacacagctgtgt

SEQ ID NO: 146757 - DNA, 25 bp, Mus musculus
agaccatctctgatccagcatgtgg

SEQ ID NO: 146758 - DNA, 25 bp, Mus musculus
agaccatctctgttccagcatgtgg

SEQ ID NO: 146759 - DNA, 25 bp, Mus musculus
agaccatctgaactattatttgtat

SEQ ID NO: 146760 - DNA, 25 bp, Mus musculus
agaccatctgaagtattatttgtat

SEQ ID NO: 146761 - DNA, 25 bp, Mus musculus
agaccatctgctctggtgtcccaag

SEQ ID NO: 146762 - DNA, 25 bp, Mus musculus
agaccatctgctgtggtgtcccaag

SEQ ID NO: 146763 - DNA, 25 bp, Mus musculus
agaccatctgggaggacgaggacca

SEQ ID NO: 146764 - DNA, 25 bp, Mus musculus
agaccatctgggtggacgaggacca

SEQ ID NO: 146765 - DNA, 25 bp, Mus musculus
agaccatctggtaggagttgccaca

SEQ ID NO: 146766 - DNA, 25 bp, Mus musculus
agaccatctggttggagttgccaca

SEQ ID NO: 146767 - DNA, 25 bp, Mus musculus
agaccatctgtaatagctctgtgcc

SEQ ID NO: 146768 - DNA, 25 bp, Mus musculus
agaccatctgtattagctctgtgcc

SEQ ID NO: 146769 - DNA, 25 bp, Mus musculus
agaccatctgtgcacgtgtgtgact

SEQ ID NO: 146770 - DNA, 25 bp, Mus musculus
agaccatctgtggacgtgtgtgact

SEQ ID NO: 146771 - DNA, 25 bp, Mus musculus
agaccatcttaaaggcggccaggaa

SEQ ID NO: 146772 - DNA, 25 bp, Mus musculus
agaccatcttaatggcggccaggaa

SEQ ID NO: 146773 - DNA, 25 bp, Mus musculus
agaccatgaatgaggtgaaccccaa

SEQ ID NO: 146774 - DNA, 25 bp, Mus musculus
agaccatgaatgtggtgaaccccaa

SEQ ID NO: 146775 - DNA, 25 bp, Mus musculus
agaccatgacagaaagctccagctt

SEQ ID NO: 146776 - DNA, 25 bp, Mus musculus
agaccatgacagtaagctccagctt

SEQ ID NO: 146777 - DNA, 25 bp, Mus musculus
agaccatgactcataggagggcatc

SEQ ID NO: 146778 - DNA, 25 bp, Mus musculus
agaccatgactcttaggagggcatc

SEQ ID NO: 146779 - DNA, 25 bp, Mus musculus
agaccatgagtacacagaagctgtt

SEQ ID NO: 146780 - DNA, 25 bp, Mus musculus
agaccatgagtagacagaagctgtt

SEQ ID NO: 146781 - DNA, 25 bp, Mus musculus
agaccatgccacagaagctccgagc

SEQ ID NO: 146782 - DNA, 25 bp, Mus musculus
agaccatgccactgaagctccgagc

SEQ ID NO: 146783 - DNA, 25 bp, Mus musculus
agaccatgcgtaaccgtatgacaga

SEQ ID NO: 146784 - DNA, 25 bp, Mus musculus
agaccatgcgtatccgtatgacaga

SEQ ID NO: 146785 - DNA, 25 bp, Mus musculus
agaccatggtgaagagatcttctca

SEQ ID NO: 146786 - DNA, 25 bp, Mus musculus
agaccatggtgatgagatcttctca

SEQ ID NO: 146787 - DNA, 25 bp, Mus musculus
agaccatgtagaagcctagcctttt

SEQ ID NO: 146788 - DNA, 25 bp, Mus musculus
agaccatgtagatgcctagcctttt

SEQ ID NO: 146789 - DNA, 25 bp, Mus musculus
agaccatgtcatctacaccattcac

SEQ ID NO: 146790 - DNA, 25 bp, Mus musculus
agaccatgtcatgtacaccattcac

SEQ ID NO: 146791 - DNA, 25 bp, Mus musculus
agaccatgtgacagttcctctgcac

SEQ ID NO: 146792 - DNA, 25 bp, Mus musculus
agaccatgtgactgttcctctgcac

SEQ ID NO: 146793 - DNA, 25 bp, Mus musculus
agaccatgtgcacttctaagagagc

SEQ ID NO: 146794 - DNA, 25 bp, Mus musculus
agaccatgtgcagttctaagagagc

SEQ ID NO: 146795 - DNA, 25 bp, Mus musculus
agaccatgttaacggaagattccac

SEQ ID NO: 146796 - DNA, 25 bp, Mus musculus
agaccatgttaagggaagattccac

SEQ ID NO: 146797 - DNA, 25 bp, Mus musculus
agaccatgttctatactagactttt

SEQ ID NO: 146798 - DNA, 25 bp, Mus musculus
agaccatgttctttactagactttt

SEQ ID NO: 146799 - DNA, 25 bp, Mus musculus
agaccattagcaaccagactgacag

SEQ ID NO: 146800 - DNA, 25 bp, Mus musculus
agaccattagcatccagactgacag

SEQ ID NO: 146801 - DNA, 25 bp, Mus musculus
agaccattcattaaacctttcaaag

SEQ ID NO: 146802 - DNA, 25 bp, Mus musculus
agaccattcatttaacctttcaaag

SEQ ID NO: 146803 - DNA, 25 bp, Mus musculus
agaccattccagcttgggaggccga

SEQ ID NO: 146804 - DNA, 25 bp, Mus musculus
agaccattccaggttgggaggccga

SEQ ID NO: 146805 - DNA, 25 bp, Mus musculus
agaccattcctcagatggagagaag

SEQ ID NO: 146806 - DNA, 25 bp, Mus musculus
agaccattcctctgatggagagaag

SEQ ID NO: 146807 - DNA, 25 bp, Mus musculus
agaccattcggtactaccctctggg

SEQ ID NO: 146808 - DNA, 25 bp, Mus musculus
agaccattcggttctaccctctggg

SEQ ID NO: 146809 - DNA, 25 bp, Mus musculus
agaccattctctactgcgacttctt

SEQ ID NO: 146810 - DNA, 25 bp, Mus musculus
agaccattctcttctgcgacttctt

SEQ ID NO: 146811 - DNA, 25 bp, Mus musculus
agaccattgacaaccagcgcgttta

SEQ ID NO: 146812 - DNA, 25 bp, Mus musculus
agaccattgacatccagcgcgttta

SEQ ID NO: 146813 - DNA, 25 bp, Mus musculus
agaccattgagactgccaaacaaga

SEQ ID NO: 146814 - DNA, 25 bp, Mus musculus
agaccattgagagtgccaaacaaga

SEQ ID NO: 146815 - DNA, 25 bp, Mus musculus
agaccattgcagagagaacccgact

SEQ ID NO: 146816 - DNA, 25 bp, Mus musculus
agaccattgcagtgagaacccgact

SEQ ID NO: 146817 - DNA, 25 bp, Mus musculus
agaccattgcgcagtacaagttcgt

SEQ ID NO: 146818 - DNA, 25 bp, Mus musculus
agaccattgcgctgtacaagttcgt

SEQ ID NO: 146819 - DNA, 25 bp, Mus musculus
agaccattgcttatggctgtttgcc

SEQ ID NO: 146820 - DNA, 25 bp, Mus musculus
agaccattgcttttggctgtttgcc

SEQ ID NO: 146821 - DNA, 25 bp, Mus musculus
agaccattggctcgacccaagcatt

SEQ ID NO: 146822 - DNA, 25 bp, Mus musculus
agaccattggctggacccaagcatt

SEQ ID NO: 146823 - DNA, 25 bp, Mus musculus
agaccattgttgattcacctttgaa

SEQ ID NO: 146824 - DNA, 25 bp, Mus musculus
agaccattgttgtttcacctttgaa

SEQ ID NO: 146825 - DNA, 25 bp, Mus musculus
agaccatttaacacagcagtgcagt

SEQ ID NO: 146826 - DNA, 25 bp, Mus musculus
agaccatttaactcagcagtgcagt

SEQ ID NO: 146827 - DNA, 25 bp, Mus musculus
agaccatttacacggaccatcagaa

SEQ ID NO: 146828 - DNA, 25 bp, Mus musculus
agaccatttacagggaccatcagaa

SEQ ID NO: 146829 - DNA, 25 bp, Mus musculus
agaccatttcacagtctgtcacagc

SEQ ID NO: 146830 - DNA, 25 bp, Mus musculus
agaccatttcactgtctgtcacagc

SEQ ID NO: 146831 - DNA, 25 bp, Mus musculus
agaccatttctcactgtagacgcag

SEQ ID NO: 146832 - DNA, 25 bp, Mus musculus
agaccatttctctctgtagacgcag

SEQ ID NO: 146833 - DNA, 25 bp, Mus musculus
agaccatttctgagctaactttaga

SEQ ID NO: 146834 - DNA, 25 bp, Mus musculus
agaccatttctgtgctaactttaga

SEQ ID NO: 146835 - DNA, 25 bp, Mus musculus
agaccatttgcactggctccctcaa

SEQ ID NO: 146836 - DNA, 25 bp, Mus musculus
agaccatttgcagtggctccctcaa

SEQ ID NO: 146837 - DNA, 25 bp, Mus musculus
agaccatttggaagcgggagagtaa

SEQ ID NO: 146838 - DNA, 25 bp, Mus musculus
agaccatttggatgcgggagagtaa

SEQ ID NO: 146839 - DNA, 25 bp, Mus musculus
agaccattttatagcctagttgaca

SEQ ID NO: 146840 - DNA, 25 bp, Mus musculus
agaccattttattgcctagttgaca

SEQ ID NO: 146841 - DNA, 25 bp, Mus musculus
agaccattttcaagagtactccatc

SEQ ID NO: 146842 - DNA, 25 bp, Mus musculus
agaccattttcatgagtactccatc

SEQ ID NO: 146843 - DNA, 25 bp, Mus musculus
agacccaaactcagagctatagccc

SEQ ID NO: 146844 - DNA, 25 bp, Mus musculus
agacccaaactcatcgctaacgatt

SEQ ID NO: 146845 - DNA, 25 bp, Mus musculus
agacccaaactctgagctatagccc

SEQ ID NO: 146846 - DNA, 25 bp, Mus musculus
agacccaaactcttcgctaacgatt

SEQ ID NO: 146847 - DNA, 25 bp, Mus musculus
agacccaaagaaatgactccattta

SEQ ID NO: 146848 - DNA, 25 bp, Mus musculus
agacccaaagaattgactccattta

SEQ ID NO: 146849 - DNA, 25 bp, Mus musculus
agacccaaagggaagctcctctaag

SEQ ID NO: 146850 - DNA, 25 bp, Mus musculus
agacccaaagggtagctcctctaag

SEQ ID NO: 146851 - DNA, 25 bp, Mus musculus
agacccaaaggtaatttcatagcaa

SEQ ID NO: 146852 - DNA, 25 bp, Mus musculus
agacccaaaggttatttcatagcaa

SEQ ID NO: 146853 - DNA, 25 bp, Mus musculus
agacccaaatggcaccagtagtttg

SEQ ID NO: 146854 - DNA, 25 bp, Mus musculus
agacccaaatgggaccagtagtttg

SEQ ID NO: 146855 - DNA, 25 bp, Mus musculus
agacccaacattcatgttcacattt

SEQ ID NO: 146856 - DNA, 25 bp, Mus musculus
agacccaacattgatgttcacattt

SEQ ID NO: 146857 - DNA, 25 bp, Mus musculus
agacccaacctgaataatactgctt

SEQ ID NO: 146858 - DNA, 25 bp, Mus musculus
agacccaacctgtataatactgctt

SEQ ID NO: 146859 - DNA, 25 bp, Mus musculus
agacccaagagcagtcagctgccta

SEQ ID NO: 146860 - DNA, 25 bp, Mus musculus
agacccaagagctgtcagctgccta

SEQ ID NO: 146861 - DNA, 25 bp, Mus musculus
agacccaagcacccgaggccaggtg

SEQ ID NO: 146862 - DNA, 25 bp, Mus musculus
agacccaagcacgcgaggccaggtg

SEQ ID NO: 146863 - DNA, 25 bp, Mus musculus
agacccaagcatatgatttcctgca

SEQ ID NO: 146864 - DNA, 25 bp, Mus musculus
agacccaagcatttgatttcctgca

SEQ ID NO: 146865 - DNA, 25 bp, Mus musculus
agacccaagctgaggaagcccacat

SEQ ID NO: 146866 - DNA, 25 bp, Mus musculus
agacccaagctgtggaagcccacat

SEQ ID NO: 146867 - DNA, 25 bp, Mus musculus
agacccaagtcaacgtttatgccag

SEQ ID NO: 146868 - DNA, 25 bp, Mus musculus
agacccaagtcatcgtttatgccag

SEQ ID NO: 146869 - DNA, 25 bp, Mus musculus
agacccacaatcacagctattcaga

SEQ ID NO: 146870 - DNA, 25 bp, Mus musculus
agacccacaatctcagctattcaga

SEQ ID NO: 146871 - DNA, 25 bp, Mus musculus
agacccacacctcatggttcagtct

SEQ ID NO: 146872 - DNA, 25 bp, Mus musculus
agacccacacctgatggttcagtct

SEQ ID NO: 146873 - DNA, 25 bp, Mus musculus
agacccacagcaaatcctcagtgtt

SEQ ID NO: 146874 - DNA, 25 bp, Mus musculus
agacccacagcatatcctcagtgtt

SEQ ID NO: 146875 - DNA, 25 bp, Mus musculus
agacccacaggaagcaacaagaata

SEQ ID NO: 146876 - DNA, 25 bp, Mus musculus
agacccacaggatgcaacaagaata

SEQ ID NO: 146877 - DNA, 25 bp, Mus musculus
agacccacaggtatcacatagcttg

SEQ ID NO: 146878 - DNA, 25 bp, Mus musculus
agacccacaggtttcacatagcttg

SEQ ID NO: 146879 - DNA, 25 bp, Mus musculus
agacccacagtgctgcttcagccaa

SEQ ID NO: 146880 - DNA, 25 bp, Mus musculus
agacccacagtggtgcttcagccaa

SEQ ID NO: 146881 - DNA, 25 bp, Mus musculus
agacccacatgtatgcatccagaca

SEQ ID NO: 146882 - DNA, 25 bp, Mus musculus
agacccacatgtttgcatccagaca

SEQ ID NO: 146883 - DNA, 25 bp, Mus musculus
agacccaccctaagagtgaaccagt

SEQ ID NO: 146884 - DNA, 25 bp, Mus musculus
agacccaccctatgagtgaaccagt

SEQ ID NO: 146885 - DNA, 25 bp, Mus musculus
agacccacccttcagggaagctcag

SEQ ID NO: 146886 - DNA, 25 bp, Mus musculus
agacccacccttgagggaagctcag

SEQ ID NO: 146887 - DNA, 25 bp, Mus musculus
agacccacctagagtcgggcaggaa

SEQ ID NO: 146888 - DNA, 25 bp, Mus musculus
agacccacctagtgtcgggcaggaa

SEQ ID NO: 146889 - DNA, 25 bp, Mus musculus
agacccacctcacaggatctagctg

SEQ ID NO: 146890 - DNA, 25 bp, Mus musculus
agacccacctcagaggatctagctg

SEQ ID NO: 146891 - DNA, 25 bp, Mus musculus
agacccactcaaccagtcatcgaag

SEQ ID NO: 146892 - DNA, 25 bp, Mus musculus
agacccactcaagcagtcatcgaag

SEQ ID NO: 146893 - DNA, 25 bp, Mus musculus
agacccactgacagctccaggttgt

SEQ ID NO: 146894 - DNA, 25 bp, Mus musculus
agacccactgactgctccaggttgt

SEQ ID NO: 146895 - DNA, 25 bp, Mus musculus
agacccacttttcttggctgggcaa

SEQ ID NO: 146896 - DNA, 25 bp, Mus musculus
agacccacttttgttggctgggcaa

SEQ ID NO: 146897 - DNA, 25 bp, Mus musculus
agacccagaacaccgactggtacat

SEQ ID NO: 146898 - DNA, 25 bp, Mus musculus
agacccagaacagcgactggtacat

SEQ ID NO: 146899 - DNA, 25 bp, Mus musculus
agacccagaatgaaccccgtgtgcc

SEQ ID NO: 146900 - DNA, 25 bp, Mus musculus
agacccagaatgtaccccgtgtgcc

SEQ ID NO: 146901 - DNA, 25 bp, Mus musculus
agacccagaccgacctaggatgtct

SEQ ID NO: 146902 - DNA, 25 bp, Mus musculus
agacccagaccgtcctaggatgtct

SEQ ID NO: 146903 - DNA, 25 bp, Mus musculus
agacccagacgacgatttatccgaa

SEQ ID NO: 146904 - DNA, 25 bp, Mus musculus
agacccagacgaggatttatccgaa

SEQ ID NO: 146905 - DNA, 25 bp, Mus musculus
agacccagactcactctggagtcag

SEQ ID NO: 146906 - DNA, 25 bp, Mus musculus
agacccagactctctctggagtcag

SEQ ID NO: 146907 - DNA, 25 bp, Mus musculus
agacccagaggtaagatctcatcct

SEQ ID NO: 146908 - DNA, 25 bp, Mus musculus
agacccagaggttagatctcatcct

SEQ ID NO: 146909 - DNA, 25 bp, Mus musculus
agacccagagtgatatccacctcca

SEQ ID NO: 146910 - DNA, 25 bp, Mus musculus
agacccagagtgttatccacctcca

SEQ ID NO: 146911 - DNA, 25 bp, Mus musculus
agacccagcaaccatggactgtgga

SEQ ID NO: 146912 - DNA, 25 bp, Mus musculus
agacccagcaacgatggactgtgga

SEQ ID NO: 146913 - DNA, 25 bp, Mus musculus
agacccagcagaacacgtatctact

SEQ ID NO: 146914 - DNA, 25 bp, Mus musculus
agacccagcagatcacgtatctact

SEQ ID NO: 146915 - DNA, 25 bp, Mus musculus
agacccagcgaaaccatctacaaaa

SEQ ID NO: 146916 - DNA, 25 bp, Mus musculus
agacccagcgaatccatctacaaaa

SEQ ID NO: 146917 - DNA, 25 bp, Mus musculus
agacccagctggcatgatctttggc

SEQ ID NO: 146918 - DNA, 25 bp, Mus musculus
agacccagctgggatgatctttggc

SEQ ID NO: 146919 - DNA, 25 bp, Mus musculus
agacccaggagaaccaggactttga

SEQ ID NO: 146920 - DNA, 25 bp, Mus musculus
agacccaggagatccaggactttga

SEQ ID NO: 146921 - DNA, 25 bp, Mus musculus
agacccaggagtaagttgttaagct

SEQ ID NO: 146922 - DNA, 25 bp, Mus musculus
agacccaggagttagttgttaagct

SEQ ID NO: 146923 - DNA, 25 bp, Mus musculus
agacccaggcagagggctcatggtt

SEQ ID NO: 146924 - DNA, 25 bp, Mus musculus
agacccaggcagtgggctcatggtt

SEQ ID NO: 146925 - DNA, 25 bp, Mus musculus
agacccaggcatcttgtaacactgt

SEQ ID NO: 146926 - DNA, 25 bp, Mus musculus
agacccaggcatgttgtaacactgt

SEQ ID NO: 146927 - DNA, 25 bp, Mus musculus
agacccagggatagattggagctgc

SEQ ID NO: 146928 - DNA, 25 bp, Mus musculus
agacccagggatagtgtccaagcct

SEQ ID NO: 146929 - DNA, 25 bp, Mus musculus
agacccagggattgattggagctgc

SEQ ID NO: 146930 - DNA, 25 bp, Mus musculus
agacccagggattgtgtccaagcct

SEQ ID NO: 146931 - DNA, 25 bp, Mus musculus
agacccagggcaattgcttttcagg

SEQ ID NO: 146932 - DNA, 25 bp, Mus musculus
agacccagggcatttgcttttcagg

SEQ ID NO: 146933 - DNA, 25 bp, Mus musculus
agacccagggctagctttctgcagc

SEQ ID NO: 146934 - DNA, 25 bp, Mus musculus
agacccagggcttgctttctgcagc

SEQ ID NO: 146935 - DNA, 25 bp, Mus musculus
agacccaggtcaacagatacaagct

SEQ ID NO: 146936 - DNA, 25 bp, Mus musculus
agacccaggtcacacgggtgtcctt

SEQ ID NO: 146937 - DNA, 25 bp, Mus musculus
agacccaggtcagacgggtgtcctt

SEQ ID NO: 146938 - DNA, 25 bp, Mus musculus
agacccaggtcatcagatacaagct

SEQ ID NO: 146939 - DNA, 25 bp, Mus musculus
agacccagtaggagcaggtctcccc

SEQ ID NO: 146940 - DNA, 25 bp, Mus musculus
agacccagtaggtgcaggtctcccc

SEQ ID NO: 146941 - DNA, 25 bp, Mus musculus
agacccagtctgcaggttgaccgtc

SEQ ID NO: 146942 - DNA, 25 bp, Mus musculus
agacccagtctggaggttgaccgtc

SEQ ID NO: 146943 - DNA, 25 bp, Mus musculus
agacccagtgccagaagacgagaag

SEQ ID NO: 146944 - DNA, 25 bp, Mus musculus
agacccagtgcctgaagacgagaag

SEQ ID NO: 146945 - DNA, 25 bp, Mus musculus
agacccagtgctctgactttgatga

SEQ ID NO: 146946 - DNA, 25 bp, Mus musculus
agacccagtgctgtgactttgatga

SEQ ID NO: 146947 - DNA, 25 bp, Mus musculus
agacccagtggtcctgactacatca

SEQ ID NO: 146948 - DNA, 25 bp, Mus musculus
agacccagtggtgctgactacatca

SEQ ID NO: 146949 - DNA, 25 bp, Mus musculus
agacccagttgaattaagctttcct

SEQ ID NO: 146950 - DNA, 25 bp, Mus musculus
agacccagttgatttaagctttcct

SEQ ID NO: 146951 - DNA, 25 bp, Mus musculus
agacccatagctacatgtggctgct

SEQ ID NO: 146952 - DNA, 25 bp, Mus musculus
agacccatagcttcatgtggctgct

SEQ ID NO: 146953 - DNA, 25 bp, Mus musculus
agacccatatagaatatctttgatg

SEQ ID NO: 146954 - DNA, 25 bp, Mus musculus
agacccatatagtatatctttgatg

SEQ ID NO: 146955 - DNA, 25 bp, Mus musculus
agacccatatcaacattcgggaaat

SEQ ID NO: 146956 - DNA, 25 bp, Mus musculus
agacccatatcatcattcgggaaat

SEQ ID NO: 146957 - DNA, 25 bp, Mus musculus
agacccatcactccagtttctggtt

SEQ ID NO: 146958 - DNA, 25 bp, Mus musculus
agacccatcactgcagtttctggtt

SEQ ID NO: 146959 - DNA, 25 bp, Mus musculus
agacccatcatcagtagcattgtta

SEQ ID NO: 146960 - DNA, 25 bp, Mus musculus
agacccatcatctgtagcattgtta

SEQ ID NO: 146961 - DNA, 25 bp, Mus musculus
agacccatcattagatttttcttgt

SEQ ID NO: 146962 - DNA, 25 bp, Mus musculus
agacccatcatttgatttttcttgt

SEQ ID NO: 146963 - DNA, 25 bp, Mus musculus
agacccatctgaatcacgtccccag

SEQ ID NO: 146964 - DNA, 25 bp, Mus musculus
agacccatctgattcacgtccccag

SEQ ID NO: 146965 - DNA, 25 bp, Mus musculus
agacccatcttaccatctgggaggt

SEQ ID NO: 146966 - DNA, 25 bp, Mus musculus
agacccatcttagcatctgggaggt

SEQ ID NO: 146967 - DNA, 25 bp, Mus musculus
agacccatgacccaaacatcgaatg

SEQ ID NO: 146968 - DNA, 25 bp, Mus musculus
agacccatgaccgaaacatcgaatg

SEQ ID NO: 146969 - DNA, 25 bp, Mus musculus
agacccatgatactaagctttgaac

SEQ ID NO: 146970 - DNA, 25 bp, Mus musculus
agacccatgatagtaagctttgaac

SEQ ID NO: 146971 - DNA, 25 bp, Mus musculus
agacccatgcccagagagcagtgag

SEQ ID NO: 146972 - DNA, 25 bp, Mus musculus
agacccatgccctgagagcagtgag

SEQ ID NO: 146973 - DNA, 25 bp, Mus musculus
agacccatggcgcagagccccgata

SEQ ID NO: 146974 - DNA, 25 bp, Mus musculus
agacccatggcggagagccccgata

SEQ ID NO: 146975 - DNA, 25 bp, Mus musculus
agacccatgggacatgcatcctgtg

SEQ ID NO: 146976 - DNA, 25 bp, Mus musculus
agacccatgggagatgcatcctgtg

SEQ ID NO: 146977 - DNA, 25 bp, Mus musculus
agacccatgggcatcgctatcgagg

SEQ ID NO: 146978 - DNA, 25 bp, Mus musculus
agacccatgggcttcgctatcgagg

SEQ ID NO: 146979 - DNA, 25 bp, Mus musculus
agacccatgtatcgctatggagcaa

SEQ ID NO: 146980 - DNA, 25 bp, Mus musculus
agacccatgtatggctatggagcaa

SEQ ID NO: 146981 - DNA, 25 bp, Mus musculus
agacccattgtgacttgctgcagag

SEQ ID NO: 146982 - DNA, 25 bp, Mus musculus
agacccattgtgtcttgctgcagag

SEQ ID NO: 146983 - DNA, 25 bp, Mus musculus
agacccatttcaaccacataagtag

SEQ ID NO: 146984 - DNA, 25 bp, Mus musculus
agacccatttcatccacataagtag

SEQ ID NO: 146985 - DNA, 25 bp, Mus musculus
agaccccaaagccaaagtcctgtgg

SEQ ID NO: 146986 - DNA, 25 bp, Mus musculus
agaccccaaagcgaaagtcctgtgg

SEQ ID NO: 146987 - DNA, 25 bp, Mus musculus
agaccccaaaggcatgtgtgtatgt

SEQ ID NO: 146988 - DNA, 25 bp, Mus musculus
agaccccaaagggatgtgtgtatgt

SEQ ID NO: 146989 - DNA, 25 bp, Mus musculus
agaccccaactcatatcctgtatgg

SEQ ID NO: 146990 - DNA, 25 bp, Mus musculus
agaccccaactcttatcctgtatgg

SEQ ID NO: 146991 - DNA, 25 bp, Mus musculus
agaccccaatggcactttagactta

SEQ ID NO: 146992 - DNA, 25 bp, Mus musculus
agaccccaatgggactttagactta

SEQ ID NO: 146993 - DNA, 25 bp, Mus musculus
agaccccaattactacagacctcct

SEQ ID NO: 146994 - DNA, 25 bp, Mus musculus
agaccccaattagtacagacctcct

SEQ ID NO: 146995 - DNA, 25 bp, Mus musculus
agaccccacaaaaggcaaaccagag

SEQ ID NO: 146996 - DNA, 25 bp, Mus musculus
agaccccacaaatggcaaaccagag

SEQ ID NO: 146997 - DNA, 25 bp, Mus musculus
agaccccacaagagtccagctaagg

SEQ ID NO: 146998 - DNA, 25 bp, Mus musculus
agaccccacaagtgtccagctaagg

SEQ ID NO: 146999 - DNA, 25 bp, Mus musculus
agaccccacagtactaatagtgcag

SEQ ID NO: 147000 - DNA, 25 bp, Mus musculus
agaccccacagttctaatagtgcag

SEQ ID NO: 147001 - DNA, 25 bp, Mus musculus
agaccccacctgaactgtgttctaa

SEQ ID NO: 147002 - DNA, 25 bp, Mus musculus
agaccccacctgaaggtttggcaag

SEQ ID NO: 147003 - DNA, 25 bp, Mus musculus
agaccccacctgagccagggactaa

SEQ ID NO: 147004 - DNA, 25 bp, Mus musculus
agaccccacctgtactgtgttctaa

SEQ ID NO: 147005 - DNA, 25 bp, Mus musculus
agaccccacctgtaggtttggcaag

SEQ ID NO: 147006 - DNA, 25 bp, Mus musculus
agaccccacctgtgccagggactaa

SEQ ID NO: 147007 - DNA, 25 bp, Mus musculus
agaccccactggctggccagaaacg

SEQ ID NO: 147008 - DNA, 25 bp, Mus musculus
agaccccactgggtggccagaaacg

SEQ ID NO: 147009 - DNA, 25 bp, Mus musculus
agaccccagaaactctgctcctttt

SEQ ID NO: 147010 - DNA, 25 bp, Mus musculus
agaccccagaaagtctgctcctttt

SEQ ID NO: 147011 - DNA, 25 bp, Mus musculus
agaccccagaatccctggagtgagc

SEQ ID NO: 147012 - DNA, 25 bp, Mus musculus
agaccccagaatgcctggagtgagc

SEQ ID NO: 147013 - DNA, 25 bp, Mus musculus
agaccccagacaatttcccgtgagt

SEQ ID NO: 147014 - DNA, 25 bp, Mus musculus
agaccccagacattttcccgtgagt

SEQ ID NO: 147015 - DNA, 25 bp, Mus musculus
agaccccagcagacagtcccagaga

SEQ ID NO: 147016 - DNA, 25 bp, Mus musculus
agaccccagcagtcagtcccagaga

SEQ ID NO: 147017 - DNA, 25 bp, Mus musculus
agaccccagcatattggaggtgcca

SEQ ID NO: 147018 - DNA, 25 bp, Mus musculus
agaccccagcattttggaggtgcca

SEQ ID NO: 147019 - DNA, 25 bp, Mus musculus
agaccccagctcacaggttcagttt

SEQ ID NO: 147020 - DNA, 25 bp, Mus musculus
agaccccagctcataggcatcttgt

SEQ ID NO: 147021 - DNA, 25 bp, Mus musculus
agaccccagctctcaggttcagttt

SEQ ID NO: 147022 - DNA, 25 bp, Mus musculus
agaccccagctcttaggcatcttgt

SEQ ID NO: 147023 - DNA, 25 bp, Mus musculus
agaccccagtgtcaaacctctaggg

SEQ ID NO: 147024 - DNA, 25 bp, Mus musculus
agaccccagtgtgaaacctctaggg

SEQ ID NO: 147025 - DNA, 25 bp, Mus musculus
agaccccatctcacatgtagacaga

SEQ ID NO: 147026 - DNA, 25 bp, Mus musculus
agaccccatctctcatgtagacaga

SEQ ID NO: 147027 - DNA, 25 bp, Mus musculus
agaccccatggtactggatgacttc

SEQ ID NO: 147028 - DNA, 25 bp, Mus musculus
agaccccatggttctggatgacttc

SEQ ID NO: 147029 - DNA, 25 bp, Mus musculus
agaccccattccaaagcatttatta

SEQ ID NO: 147030 - DNA, 25 bp, Mus musculus
agaccccattcctaagcatttatta

SEQ ID NO: 147031 - DNA, 25 bp, Mus musculus
agaccccgaaaaactgctgggcaca

SEQ ID NO: 147032 - DNA, 25 bp, Mus musculus
agaccccgaaaatctgctgggcaca

SEQ ID NO: 147033 - DNA, 25 bp, Mus musculus
agaccccgaagaactacctgaagaa

SEQ ID NO: 147034 - DNA, 25 bp, Mus musculus
agaccccgaagatctacctgaagaa

SEQ ID NO: 147035 - DNA, 25 bp, Mus musculus
agaccccgatatcctgaagacctgt

SEQ ID NO: 147036 - DNA, 25 bp, Mus musculus
agaccccgatatgctgaagacctgt

SEQ ID NO: 147037 - DNA, 25 bp, Mus musculus
agaccccgattcagttctgtatgtt

SEQ ID NO: 147038 - DNA, 25 bp, Mus musculus
agaccccgattctgttctgtatgtt

SEQ ID NO: 147039 - DNA, 25 bp, Mus musculus
agaccccgctgcagagctgtcggtt

SEQ ID NO: 147040 - DNA, 25 bp, Mus musculus
agaccccgctgctgagctgtcggtt

SEQ ID NO: 147041 - DNA, 25 bp, Mus musculus
agaccccgcttcaataatgttcaac

SEQ ID NO: 147042 - DNA, 25 bp, Mus musculus
agaccccgcttctataatgttcaac

SEQ ID NO: 147043 - DNA, 25 bp, Mus musculus
agaccccgttcacacatttaggaat

SEQ ID NO: 147044 - DNA, 25 bp, Mus musculus
agaccccgttcagacatttaggaat

SEQ ID NO: 147045 - DNA, 25 bp, Mus musculus
agacccctaccaagacaagtcatga

SEQ ID NO: 147046 - DNA, 25 bp, Mus musculus
agacccctaccatgacaagtcatga

SEQ ID NO: 147047 - DNA, 25 bp, Mus musculus
agacccctagggagccactgaataa

SEQ ID NO: 147048 - DNA, 25 bp, Mus musculus
agacccctagggtgccactgaataa

SEQ ID NO: 147049 - DNA, 25 bp, Mus musculus
agacccctcagaatctactacagta

SEQ ID NO: 147050 - DNA, 25 bp, Mus musculus
agacccctcagattctactacagta

SEQ ID NO: 147051 - DNA, 25 bp, Mus musculus
agacccctcagcaggtagagtggat

SEQ ID NO: 147052 - DNA, 25 bp, Mus musculus
agacccctcagctggtagagtggat

SEQ ID NO: 147053 - DNA, 25 bp, Mus musculus
agacccctgaagagtgctgctgtga

SEQ ID NO: 147054 - DNA, 25 bp, Mus musculus
agacccctgaagtgtgctgctgtga

SEQ ID NO: 147055 - DNA, 25 bp, Mus musculus
agacccctgacaacgtgtttgcgag

SEQ ID NO: 147056 - DNA, 25 bp, Mus musculus
agacccctgacatcgtgtttgcgag

SEQ ID NO: 147057 - DNA, 25 bp, Mus musculus
agacccctgggacattggagaccct

SEQ ID NO: 147058 - DNA, 25 bp, Mus musculus
agacccctgggagattggagaccct

SEQ ID NO: 147059 - DNA, 25 bp, Mus musculus
agacccctgtggaatacccaatgga

SEQ ID NO: 147060 - DNA, 25 bp, Mus musculus
agacccctgtggtatacccaatgga

SEQ ID NO: 147061 - DNA, 25 bp, Mus musculus
agaccccttcagacttggatcagtt

SEQ ID NO: 147062 - DNA, 25 bp, Mus musculus
agaccccttcagtcttggatcagtt

SEQ ID NO: 147063 - DNA, 25 bp, Mus musculus
agaccccttcataaggcttagccag

SEQ ID NO: 147064 - DNA, 25 bp, Mus musculus
agaccccttcattaggcttagccag

SEQ ID NO: 147065 - DNA, 25 bp, Mus musculus
agaccccttgagactgattgtgtaa

SEQ ID NO: 147066 - DNA, 25 bp, Mus musculus
agaccccttgagtctgattgtgtaa

SEQ ID NO: 147067 - DNA, 25 bp, Mus musculus
agaccccttgtgatagagactgtgt

SEQ ID NO: 147068 - DNA, 25 bp, Mus musculus
agaccccttgtgttagagactgtgt

SEQ ID NO: 147069 - DNA, 25 bp, Mus musculus
agacccctttgaatgtgttccaggc

SEQ ID NO: 147070 - DNA, 25 bp, Mus musculus
agacccctttgattgtgttccaggc

SEQ ID NO: 147071 - DNA, 25 bp, Mus musculus
agacccgacaagatccatggcatta

SEQ ID NO: 147072 - DNA, 25 bp, Mus musculus
agacccgacaagttccatggcatta

SEQ ID NO: 147073 - DNA, 25 bp, Mus musculus
agacccgagtggactacttgctgaa

SEQ ID NO: 147074 - DNA, 25 bp, Mus musculus
agacccgagtggtctacttgctgaa

SEQ ID NO: 147075 - DNA, 25 bp, Mus musculus
agacccgatggtctgtgatcaccaa

SEQ ID NO: 147076 - DNA, 25 bp, Mus musculus
agacccgatggtgtgtgatcaccaa

SEQ ID NO: 147077 - DNA, 25 bp, Mus musculus
agacccgcctgccagatgaggatga

SEQ ID NO: 147078 - DNA, 25 bp, Mus musculus
agacccgcctgcgagatgaggatga

SEQ ID NO: 147079 - DNA, 25 bp, Mus musculus
agacccgcggcccaagaatcgatcg

SEQ ID NO: 147080 - DNA, 25 bp, Mus musculus
agacccgcggccgaagaatcgatcg

SEQ ID NO: 147081 - DNA, 25 bp, Mus musculus
agacccgcttccctgatttcctgga

SEQ ID NO: 147082 - DNA, 25 bp, Mus musculus
agacccgcttccgtgatttcctgga

SEQ ID NO: 147083 - DNA, 25 bp, Mus musculus
agacccggagtgcagcatagactgt

SEQ ID NO: 147084 - DNA, 25 bp, Mus musculus
agacccggagtggagcatagactgt

SEQ ID NO: 147085 - DNA, 25 bp, Mus musculus
agacccggctatatggcatcaccat

SEQ ID NO: 147086 - DNA, 25 bp, Mus musculus
agacccggctatctggccattcaag

SEQ ID NO: 147087 - DNA, 25 bp, Mus musculus
agacccggctatgtggccattcaag

SEQ ID NO: 147088 - DNA, 25 bp, Mus musculus
agacccggctatttggcatcaccat

SEQ ID NO: 147089 - DNA, 25 bp, Mus musculus
agacccggctctaagattcactgta

SEQ ID NO: 147090 - DNA, 25 bp, Mus musculus
agacccggctctcataaagaaaata

SEQ ID NO: 147091 - DNA, 25 bp, Mus musculus
agacccggctctgataaagaaaata

SEQ ID NO: 147092 - DNA, 25 bp, Mus musculus
agacccggctcttagattcactgta

SEQ ID NO: 147093 - DNA, 25 bp, Mus musculus
agacccggctgcacggtactgtaaa

SEQ ID NO: 147094 - DNA, 25 bp, Mus musculus
agacccggctgctcggtactgtaaa

SEQ ID NO: 147095 - DNA, 25 bp, Mus musculus
agacccgggatcatgggtgactagc

SEQ ID NO: 147096 - DNA, 25 bp, Mus musculus
agacccgggatcttgggtgactagc

SEQ ID NO: 147097 - DNA, 25 bp, Mus musculus
agacccggtgcacagctatcaaagg

SEQ ID NO: 147098 - DNA, 25 bp, Mus musculus
agacccggtgcagagctatcaaagg

SEQ ID NO: 147099 - DNA, 25 bp, Mus musculus
agacccggtggccactctgtgagaa

SEQ ID NO: 147100 - DNA, 25 bp, Mus musculus
agacccggtggcgactctgtgagaa

SEQ ID NO: 147101 - DNA, 25 bp, Mus musculus
agacccgtcttaccttgcaatagat

SEQ ID NO: 147102 - DNA, 25 bp, Mus musculus
agacccgtcttagcttgcaatagat

SEQ ID NO: 147103 - DNA, 25 bp, Mus musculus
agacccgtgcatcgaagagaccctt

SEQ ID NO: 147104 - DNA, 25 bp, Mus musculus
agacccgtgcatggaagagaccctt

SEQ ID NO: 147105 - DNA, 25 bp, Mus musculus
agacccgtgcctcaagttggatact

SEQ ID NO: 147106 - DNA, 25 bp, Mus musculus
agacccgtgcctgaagttggatact

SEQ ID NO: 147107 - DNA, 25 bp, Mus musculus
agacccgtttagatatccgcagatc

SEQ ID NO: 147108 - DNA, 25 bp, Mus musculus
agacccgtttagttatccgcagatc

SEQ ID NO: 147109 - DNA, 25 bp, Mus musculus
agacccgtttctatcatctttttct

SEQ ID NO: 147110 - DNA, 25 bp, Mus musculus
agacccgtttctttcatctttttct

SEQ ID NO: 147111 - DNA, 25 bp, Mus musculus
agaccctaagggaaagctcagcttt

SEQ ID NO: 147112 - DNA, 25 bp, Mus musculus
agaccctaagggacgcatctaccat

SEQ ID NO: 147113 - DNA, 25 bp, Mus musculus
agaccctaagggagaagaacagcag

SEQ ID NO: 147114 - DNA, 25 bp, Mus musculus
agaccctaagggtaagctcagcttt

SEQ ID NO: 147115 - DNA, 25 bp, Mus musculus
agaccctaagggtcgcatctaccat

SEQ ID NO: 147116 - DNA, 25 bp, Mus musculus
agaccctaagggtgaagaacagcag

SEQ ID NO: 147117 - DNA, 25 bp, Mus musculus
agaccctaccagactttgccagaag

SEQ ID NO: 147118 - DNA, 25 bp, Mus musculus
agaccctaccagtctttgccagaag

SEQ ID NO: 147119 - DNA, 25 bp, Mus musculus
agaccctactctccctgagaaagac

SEQ ID NO: 147120 - DNA, 25 bp, Mus musculus
agaccctactctgcctgagaaagac

SEQ ID NO: 147121 - DNA, 25 bp, Mus musculus
agaccctatctccaatgaatgaatg

SEQ ID NO: 147122 - DNA, 25 bp, Mus musculus
agaccctatctcgaatgaatgaatg

SEQ ID NO: 147123 - DNA, 25 bp, Mus musculus
agaccctcaattatgcggagcaagt

SEQ ID NO: 147124 - DNA, 25 bp, Mus musculus
agaccctcaattttgcggagcaagt

SEQ ID NO: 147125 - DNA, 25 bp, Mus musculus
agaccctcacatatcctttatttat

SEQ ID NO: 147126 - DNA, 25 bp, Mus musculus
agaccctcacatttcctttatttat

SEQ ID NO: 147127 - DNA, 25 bp, Mus musculus
agaccctcagcacttaccattgtaa

SEQ ID NO: 147128 - DNA, 25 bp, Mus musculus
agaccctcagcagttaccattgtaa

SEQ ID NO: 147129 - DNA, 25 bp, Mus musculus
agaccctcagctctactgtactgta

SEQ ID NO: 147130 - DNA, 25 bp, Mus musculus
agaccctcagctgtactgtactgta

SEQ ID NO: 147131 - DNA, 25 bp, Mus musculus
agaccctcagggaaggcccatgtgg

SEQ ID NO: 147132 - DNA, 25 bp, Mus musculus
agaccctcagggtaggcccatgtgg

SEQ ID NO: 147133 - DNA, 25 bp, Mus musculus
agaccctcatctactgaggcactgg

SEQ ID NO: 147134 - DNA, 25 bp, Mus musculus
agaccctcatcttctgaggcactgg

SEQ ID NO: 147135 - DNA, 25 bp, Mus musculus
agaccctccaatatccattcattgc

SEQ ID NO: 147136 - DNA, 25 bp, Mus musculus
agaccctccaatttccattcattgc

SEQ ID NO: 147137 - DNA, 25 bp, Mus musculus
agaccctccattcgagagtgaggat

SEQ ID NO: 147138 - DNA, 25 bp, Mus musculus
agaccctccattggagagtgaggat

SEQ ID NO: 147139 - DNA, 25 bp, Mus musculus
agaccctcccatatcagtgaatcaa

SEQ ID NO: 147140 - DNA, 25 bp, Mus musculus
agaccctcccatttcagtgaatcaa

SEQ ID NO: 147141 - DNA, 25 bp, Mus musculus
agaccctcctggctacatttggatc

SEQ ID NO: 147142 - DNA, 25 bp, Mus musculus
agaccctcctgggtacatttggatc

SEQ ID NO: 147143 - DNA, 25 bp, Mus musculus
agaccctcctgtctgcttaggataa

SEQ ID NO: 147144 - DNA, 25 bp, Mus musculus
agaccctcctgtgtgcttaggataa

SEQ ID NO: 147145 - DNA, 25 bp, Mus musculus
agaccctccttacctgtctgaggaa

SEQ ID NO: 147146 - DNA, 25 bp, Mus musculus
agaccctccttagctgtctgaggaa

SEQ ID NO: 147147 - DNA, 25 bp, Mus musculus
agaccctcgagacctggaagcgttc

SEQ ID NO: 147148 - DNA, 25 bp, Mus musculus
agaccctcgagagctggaagcgttc

SEQ ID NO: 147149 - DNA, 25 bp, Mus musculus
agaccctcgaggcacgtatcagtgt

SEQ ID NO: 147150 - DNA, 25 bp, Mus musculus
agaccctcgagggacgtatcagtgt

SEQ ID NO: 147151 - DNA, 25 bp, Mus musculus
agaccctcggctcgtattgcagcag

SEQ ID NO: 147152 - DNA, 25 bp, Mus musculus
agaccctcggctggtattgcagcag

SEQ ID NO: 147153 - DNA, 25 bp, Mus musculus
agaccctctcaacatgttatcccat

SEQ ID NO: 147154 - DNA, 25 bp, Mus musculus
agaccctctcaagatgttatcccat

SEQ ID NO: 147155 - DNA, 25 bp, Mus musculus
agaccctctccaaaatctggtacaa

SEQ ID NO: 147156 - DNA, 25 bp, Mus musculus
agaccctctccataatctggtacaa

SEQ ID NO: 147157 - DNA, 25 bp, Mus musculus
agaccctctctaccactggcaaagt

SEQ ID NO: 147158 - DNA, 25 bp, Mus musculus
agaccctctctagcactggcaaagt

SEQ ID NO: 147159 - DNA, 25 bp, Mus musculus
agaccctctgagaataccggttctg

SEQ ID NO: 147160 - DNA, 25 bp, Mus musculus
agaccctctgagtataccggttctg

SEQ ID NO: 147161 - DNA, 25 bp, Mus musculus
agaccctctgcacggaccaggagga

SEQ ID NO: 147162 - DNA, 25 bp, Mus musculus
agaccctctgcagggaccaggagga

SEQ ID NO: 147163 - DNA, 25 bp, Mus musculus
agaccctctggtaactattattttg

SEQ ID NO: 147164 - DNA, 25 bp, Mus musculus
agaccctctggttactattattttg

SEQ ID NO: 147165 - DNA, 25 bp, Mus musculus
agaccctctgtgagcggctcatgtg

SEQ ID NO: 147166 - DNA, 25 bp, Mus musculus
agaccctctgtgtgcggctcatgtg

SEQ ID NO: 147167 - DNA, 25 bp, Mus musculus
agaccctcttacactgtaaattgga

SEQ ID NO: 147168 - DNA, 25 bp, Mus musculus
agaccctcttacctaactacactat

SEQ ID NO: 147169 - DNA, 25 bp, Mus musculus
agaccctcttacgtaactacactat

SEQ ID NO: 147170 - DNA, 25 bp, Mus musculus
agaccctcttactctgtaaattgga

SEQ ID NO: 147171 - DNA, 25 bp, Mus musculus
agaccctcttagactacacttacac

SEQ ID NO: 147172 - DNA, 25 bp, Mus musculus
agaccctcttagtctacacttacac

SEQ ID NO: 147173 - DNA, 25 bp, Mus musculus
agaccctcttccatggccaggagga

SEQ ID NO: 147174 - DNA, 25 bp, Mus musculus
agaccctcttccttggccaggagga

SEQ ID NO: 147175 - DNA, 25 bp, Mus musculus
agaccctcttctagtttgccaaagc

SEQ ID NO: 147176 - DNA, 25 bp, Mus musculus
agaccctcttcttgtttgccaaagc

SEQ ID NO: 147177 - DNA, 25 bp, Mus musculus
agaccctcttgacccaaagtatggt

SEQ ID NO: 147178 - DNA, 25 bp, Mus musculus
agaccctcttgagccaaagtatggt

SEQ ID NO: 147179 - DNA, 25 bp, Mus musculus
agaccctcttggactctgtgtacag

SEQ ID NO: 147180 - DNA, 25 bp, Mus musculus
agaccctcttggtctctgtgtacag

SEQ ID NO: 147181 - DNA, 25 bp, Mus musculus
agaccctcttttctgaagactttag

SEQ ID NO: 147182 - DNA, 25 bp, Mus musculus
agaccctcttttgtgaagactttag

SEQ ID NO: 147183 - DNA, 25 bp, Mus musculus
agaccctgaaaaactccacttcaac

SEQ ID NO: 147184 - DNA, 25 bp, Mus musculus
agaccctgaaaatctccacttcaac

SEQ ID NO: 147185 - DNA, 25 bp, Mus musculus
agaccctgaaatccagcccatgaag

SEQ ID NO: 147186 - DNA, 25 bp, Mus musculus
agaccctgaaatgcagcccatgaag

SEQ ID NO: 147187 - DNA, 25 bp, Mus musculus
agaccctgaaccataggccactgag

SEQ ID NO: 147188 - DNA, 25 bp, Mus musculus
agaccctgaaccttaggccactgag

SEQ ID NO: 147189 - DNA, 25 bp, Mus musculus
agaccctgaagtcccgattgccaga

SEQ ID NO: 147190 - DNA, 25 bp, Mus musculus
agaccctgaagtgccgattgccaga

SEQ ID NO: 147191 - DNA, 25 bp, Mus musculus
agaccctgacacaccgagggactaa

SEQ ID NO: 147192 - DNA, 25 bp, Mus musculus
agaccctgacactccgagggactaa

SEQ ID NO: 147193 - DNA, 25 bp, Mus musculus
agaccctgacggattgttcactggt

SEQ ID NO: 147194 - DNA, 25 bp, Mus musculus
agaccctgacggtttgttcactggt

SEQ ID NO: 147195 - DNA, 25 bp, Mus musculus
agaccctgacgtaacgctggcggga

SEQ ID NO: 147196 - DNA, 25 bp, Mus musculus
agaccctgacgttacgctggcggga

SEQ ID NO: 147197 - DNA, 25 bp, Mus musculus
agaccctgagaccaagcagactgac

SEQ ID NO: 147198 - DNA, 25 bp, Mus musculus
agaccctgagacgaagcagactgac

SEQ ID NO: 147199 - DNA, 25 bp, Mus musculus
agaccctgaggtagaattgctatgt

SEQ ID NO: 147200 - DNA, 25 bp, Mus musculus
agaccctgaggttgaattgctatgt

SEQ ID NO: 147201 - DNA, 25 bp, Mus musculus
agaccctgagtgctatgtcggcctc

SEQ ID NO: 147202 - DNA, 25 bp, Mus musculus
agaccctgagtggtatgtcggcctc

SEQ ID NO: 147203 - DNA, 25 bp, Mus musculus
agaccctgatacaccaatgtcattt

SEQ ID NO: 147204 - DNA, 25 bp, Mus musculus
agaccctgatactccaatgtcattt

SEQ ID NO: 147205 - DNA, 25 bp, Mus musculus
agaccctgatccacaaaaccaataa

SEQ ID NO: 147206 - DNA, 25 bp, Mus musculus
agaccctgatcctcaaaaccaataa

SEQ ID NO: 147207 - DNA, 25 bp, Mus musculus
agaccctgattaagagacaccagga

SEQ ID NO: 147208 - DNA, 25 bp, Mus musculus
agaccctgattatgagacaccagga

SEQ ID NO: 147209 - DNA, 25 bp, Mus musculus
agaccctgcaaacacccatatgtgt

SEQ ID NO: 147210 - DNA, 25 bp, Mus musculus
agaccctgcaaagacccatatgtgt

SEQ ID NO: 147211 - DNA, 25 bp, Mus musculus
agaccctgcactaggagtctttggg

SEQ ID NO: 147212 - DNA, 25 bp, Mus musculus
agaccctgcacttggagtctttggg

SEQ ID NO: 147213 - DNA, 25 bp, Mus musculus
agaccctgccagagcagctgctgac

SEQ ID NO: 147214 - DNA, 25 bp, Mus musculus
agaccctgccagtgcagctgctgac

SEQ ID NO: 147215 - DNA, 25 bp, Mus musculus
agaccctgcccaacgctttcaaggt

SEQ ID NO: 147216 - DNA, 25 bp, Mus musculus
agaccctgcccatcgctttcaaggt

SEQ ID NO: 147217 - DNA, 25 bp, Mus musculus
agaccctgccctattcagaggagaa

SEQ ID NO: 147218 - DNA, 25 bp, Mus musculus
agaccctgcccttttcagaggagaa

SEQ ID NO: 147219 - DNA, 25 bp, Mus musculus
agaccctgccgcagcgagttgccga

SEQ ID NO: 147220 - DNA, 25 bp, Mus musculus
agaccctgccgctgcgagttgccga

SEQ ID NO: 147221 - DNA, 25 bp, Mus musculus
agaccctgcctccttaatatggaag

SEQ ID NO: 147222 - DNA, 25 bp, Mus musculus
agaccctgcctcgttaatatggaag

SEQ ID NO: 147223 - DNA, 25 bp, Mus musculus
agaccctgcctgaattcagaaatgt

SEQ ID NO: 147224 - DNA, 25 bp, Mus musculus
agaccctgcctgtattcagaaatgt

SEQ ID NO: 147225 - DNA, 25 bp, Mus musculus
agaccctgcgatagaatcctccggt

SEQ ID NO: 147226 - DNA, 25 bp, Mus musculus
agaccctgcgattgaatcctccggt

SEQ ID NO: 147227 - DNA, 25 bp, Mus musculus
agaccctggaagctcaacccatgtt

SEQ ID NO: 147228 - DNA, 25 bp, Mus musculus
agaccctggaaggtcaacccatgtt

SEQ ID NO: 147229 - DNA, 25 bp, Mus musculus
agaccctggcagatagttcactcag

SEQ ID NO: 147230 - DNA, 25 bp, Mus musculus
agaccctggcagttagttcactcag

SEQ ID NO: 147231 - DNA, 25 bp, Mus musculus
agaccctggctcatagtattactca

SEQ ID NO: 147232 - DNA, 25 bp, Mus musculus
agaccctggctcttagtattactca

SEQ ID NO: 147233 - DNA, 25 bp, Mus musculus
agaccctgggcaaggctggcattgt

SEQ ID NO: 147234 - DNA, 25 bp, Mus musculus
agaccctgggcatggctggcattgt

SEQ ID NO: 147235 - DNA, 25 bp, Mus musculus
agaccctgggctacccttggtggag

SEQ ID NO: 147236 - DNA, 25 bp, Mus musculus
agaccctgggcttcccttggtggag

SEQ ID NO: 147237 - DNA, 25 bp, Mus musculus
agaccctggtcgcaattgactggca

SEQ ID NO: 147238 - DNA, 25 bp, Mus musculus
agaccctggtcggaattgactggca

SEQ ID NO: 147239 - DNA, 25 bp, Mus musculus
agaccctggtgaagcattggatcaa

SEQ ID NO: 147240 - DNA, 25 bp, Mus musculus
agaccctggtgatgcattggatcaa

SEQ ID NO: 147241 - DNA, 25 bp, Mus musculus
agaccctggtggcattggtacctct

SEQ ID NO: 147242 - DNA, 25 bp, Mus musculus
agaccctggtgggattggtacctct

SEQ ID NO: 147243 - DNA, 25 bp, Mus musculus
agaccctggttacaatacccatgga

SEQ ID NO: 147244 - DNA, 25 bp, Mus musculus
agaccctggttagaatacccatgga

SEQ ID NO: 147245 - DNA, 25 bp, Mus musculus
agaccctgtagtcctttgtatctca

SEQ ID NO: 147246 - DNA, 25 bp, Mus musculus
agaccctgtagtgctttgtatctca

SEQ ID NO: 147247 - DNA, 25 bp, Mus musculus
agaccctgtcttaatgtcttaagct

SEQ ID NO: 147248 - DNA, 25 bp, Mus musculus
agaccctgtctttatgtcttaagct

SEQ ID NO: 147249 - DNA, 25 bp, Mus musculus
agaccctgtgatactgtccttagga

SEQ ID NO: 147250 - DNA, 25 bp, Mus musculus
agaccctgtgattctgtccttagga

SEQ ID NO: 147251 - DNA, 25 bp, Mus musculus
agaccctgtgccagaatggcattat

SEQ ID NO: 147252 - DNA, 25 bp, Mus musculus
agaccctgtgcctgaatggcattat

SEQ ID NO: 147253 - DNA, 25 bp, Mus musculus
agaccctgtgctactgcttgagtgg

SEQ ID NO: 147254 - DNA, 25 bp, Mus musculus
agaccctgtgcttctgcttgagtgg

SEQ ID NO: 147255 - DNA, 25 bp, Mus musculus
agaccctgtggacctgtcatcgttc

SEQ ID NO: 147256 - DNA, 25 bp, Mus musculus
agaccctgtggagctgtcatcgttc

SEQ ID NO: 147257 - DNA, 25 bp, Mus musculus
agaccctgtgggattggatgagatt

SEQ ID NO: 147258 - DNA, 25 bp, Mus musculus
agaccctgtgggtttggatgagatt

SEQ ID NO: 147259 - DNA, 25 bp, Mus musculus
agaccctgtggtcccctgaattgat

SEQ ID NO: 147260 - DNA, 25 bp, Mus musculus
agaccctgtggtgccctgaattgat

SEQ ID NO: 147261 - DNA, 25 bp, Mus musculus
agaccctgtttgactgacccgtggg

SEQ ID NO: 147262 - DNA, 25 bp, Mus musculus
agaccctgtttgtctgacccgtggg

SEQ ID NO: 147263 - DNA, 25 bp, Mus musculus
agacccttacatagctggactggcg

SEQ ID NO: 147264 - DNA, 25 bp, Mus musculus
agacccttacattgctggactggcg

SEQ ID NO: 147265 - DNA, 25 bp, Mus musculus
agacccttattcatgctatgcacag

SEQ ID NO: 147266 - DNA, 25 bp, Mus musculus
agacccttattcttgctatgcacag

SEQ ID NO: 147267 - DNA, 25 bp, Mus musculus
agacccttcacacgcagtgcatgca

SEQ ID NO: 147268 - DNA, 25 bp, Mus musculus
agacccttcacaggcagtgcatgca

SEQ ID NO: 147269 - DNA, 25 bp, Mus musculus
agacccttccatcctatgggttaga

SEQ ID NO: 147270 - DNA, 25 bp, Mus musculus
agacccttccatctggtgatgggaa

SEQ ID NO: 147271 - DNA, 25 bp, Mus musculus
agacccttccatgctatgggttaga

SEQ ID NO: 147272 - DNA, 25 bp, Mus musculus
agacccttccatgtggtgatgggaa

SEQ ID NO: 147273 - DNA, 25 bp, Mus musculus
agacccttctcacgagcttgttttt

SEQ ID NO: 147274 - DNA, 25 bp, Mus musculus
agacccttctcaggagcttgttttt

SEQ ID NO: 147275 - DNA, 25 bp, Mus musculus
agacccttgaagatgtagcttccga

SEQ ID NO: 147276 - DNA, 25 bp, Mus musculus
agacccttgaagttgtagcttccga

SEQ ID NO: 147277 - DNA, 25 bp, Mus musculus
agacccttgacaagcattcactagt

SEQ ID NO: 147278 - DNA, 25 bp, Mus musculus
agacccttgacatgcattcactagt

SEQ ID NO: 147279 - DNA, 25 bp, Mus musculus
agacccttgcacaccatggaggaag

SEQ ID NO: 147280 - DNA, 25 bp, Mus musculus
agacccttgcactccatggaggaag

SEQ ID NO: 147281 - DNA, 25 bp, Mus musculus
agacccttgctgatttacctttctg

SEQ ID NO: 147282 - DNA, 25 bp, Mus musculus
agacccttgctgttttacctttctg

SEQ ID NO: 147283 - DNA, 25 bp, Mus musculus
agacccttggagcttgtgcatacag

SEQ ID NO: 147284 - DNA, 25 bp, Mus musculus
agacccttggaggttgtgcatacag

SEQ ID NO: 147285 - DNA, 25 bp, Mus musculus
agacccttggataactcggtgtttg

SEQ ID NO: 147286 - DNA, 25 bp, Mus musculus
agacccttggattactcggtgtttg

SEQ ID NO: 147287 - DNA, 25 bp, Mus musculus
agacccttgggtcgtaatgactaca

SEQ ID NO: 147288 - DNA, 25 bp, Mus musculus
agacccttgggtggtaatgactaca

SEQ ID NO: 147289 - DNA, 25 bp, Mus musculus
agaccctttaacacgtcaatgtgga

SEQ ID NO: 147290 - DNA, 25 bp, Mus musculus
agaccctttaactcgtcaatgtgga

SEQ ID NO: 147291 - DNA, 25 bp, Mus musculus
agaccctttcagacatttcacatcc

SEQ ID NO: 147292 - DNA, 25 bp, Mus musculus
agaccctttcagtcatttcacatcc

SEQ ID NO: 147293 - DNA, 25 bp, Mus musculus
agaccctttctaagactggttggtt

SEQ ID NO: 147294 - DNA, 25 bp, Mus musculus
agaccctttctatgactggttggtt

SEQ ID NO: 147295 - DNA, 25 bp, Mus musculus
agaccctttggtctgtgagcccagt

SEQ ID NO: 147296 - DNA, 25 bp, Mus musculus
agaccctttggtgtgtgagcccagt

SEQ ID NO: 147297 - DNA, 25 bp, Mus musculus
agacccttttgacagtcacttattc

SEQ ID NO: 147298 - DNA, 25 bp, Mus musculus
agacccttttgagagtcacttattc

SEQ ID NO: 147299 - DNA, 25 bp, Mus musculus
agaccgacaggacctggagcagcca

SEQ ID NO: 147300 - DNA, 25 bp, Mus musculus
agaccgacaggagctggagcagcca

SEQ ID NO: 147301 - DNA, 25 bp, Mus musculus
agaccgacaggtcggtgctttccat

SEQ ID NO: 147302 - DNA, 25 bp, Mus musculus
agaccgacaggtgggtgctttccat

SEQ ID NO: 147303 - DNA, 25 bp, Mus musculus
agaccgaccaggcactcagacgagg

SEQ ID NO: 147304 - DNA, 25 bp, Mus musculus
agaccgaccagggactcagacgagg

SEQ ID NO: 147305 - DNA, 25 bp, Mus musculus
agaccgacctcaccgtgggctttga

SEQ ID NO: 147306 - DNA, 25 bp, Mus musculus
agaccgacctcactgttctcttaga

SEQ ID NO: 147307 - DNA, 25 bp, Mus musculus
agaccgacctcagcgtgggctttga

SEQ ID NO: 147308 - DNA, 25 bp, Mus musculus
agaccgacctcagtgttctcttaga

SEQ ID NO: 147309 - DNA, 25 bp, Mus musculus
agaccgaccttaacgatgcaatcac

SEQ ID NO: 147310 - DNA, 25 bp, Mus musculus
agaccgaccttatcgatgcaatcac

SEQ ID NO: 147311 - DNA, 25 bp, Mus musculus
agaccgaccttgatgtagagacaaa

SEQ ID NO: 147312 - DNA, 25 bp, Mus musculus
agaccgaccttgttgtagagacaaa

SEQ ID NO: 147313 - DNA, 25 bp, Mus musculus
agaccgactttgacaccctcgtcca

SEQ ID NO: 147314 - DNA, 25 bp, Mus musculus
agaccgactttgtcaccctcgtcca

SEQ ID NO: 147315 - DNA, 25 bp, Mus musculus
agaccgagagccacgatgacagctt

SEQ ID NO: 147316 - DNA, 25 bp, Mus musculus
agaccgagagcctcgatgacagctt

SEQ ID NO: 147317 - DNA, 25 bp, Mus musculus
agaccgagccagaaaccgagccaga

SEQ ID NO: 147318 - DNA, 25 bp, Mus musculus
agaccgagccagtaaccgagccaga

SEQ ID NO: 147319 - DNA, 25 bp, Mus musculus
agaccgagctttccggacatgctta

SEQ ID NO: 147320 - DNA, 25 bp, Mus musculus
agaccgagctttgcggacatgctta

SEQ ID NO: 147321 - DNA, 25 bp, Mus musculus
agaccgaggacgagcgcagccagct

SEQ ID NO: 147322 - DNA, 25 bp, Mus musculus
agaccgaggacgtgcgcagccagct

SEQ ID NO: 147323 - DNA, 25 bp, Mus musculus
agaccgagtcggaaacacaccatga

SEQ ID NO: 147324 - DNA, 25 bp, Mus musculus
agaccgagtcggtaacacaccatga

SEQ ID NO: 147325 - DNA, 25 bp, Mus musculus
agaccgagttacagtgttccctcat

SEQ ID NO: 147326 - DNA, 25 bp, Mus musculus
agaccgagttactgtgttccctcat

SEQ ID NO: 147327 - DNA, 25 bp, Mus musculus
agaccgagttagagtttgatgcgac

SEQ ID NO: 147328 - DNA, 25 bp, Mus musculus
agaccgagttagtgtttgatgcgac

SEQ ID NO: 147329 - DNA, 25 bp, Mus musculus
agaccgatccacaatgactgcgctg

SEQ ID NO: 147330 - DNA, 25 bp, Mus musculus
agaccgatccactatgactgcgctg

SEQ ID NO: 147331 - DNA, 25 bp, Mus musculus
agaccgatgcatcttacctttttca

SEQ ID NO: 147332 - DNA, 25 bp, Mus musculus
agaccgatgcatgttacctttttca

SEQ ID NO: 147333 - DNA, 25 bp, Mus musculus
agaccgcaacggcagcagagcagaa

SEQ ID NO: 147334 - DNA, 25 bp, Mus musculus
agaccgcaacgggagcagagcagaa

SEQ ID NO: 147335 - DNA, 25 bp, Mus musculus
agaccgcaagaaagtgctccggctg

SEQ ID NO: 147336 - DNA, 25 bp, Mus musculus
agaccgcaagaatgtgctccggctg

SEQ ID NO: 147337 - DNA, 25 bp, Mus musculus
agaccgcatgtacgtactcaggctt

SEQ ID NO: 147338 - DNA, 25 bp, Mus musculus
agaccgcatgtaggtactcaggctt

SEQ ID NO: 147339 - DNA, 25 bp, Mus musculus
agaccgcattcgcttcatcttggat

SEQ ID NO: 147340 - DNA, 25 bp, Mus musculus
agaccgcattcggttcatcttggat

SEQ ID NO: 147341 - DNA, 25 bp, Mus musculus
agaccgcattgacaggcgacgcgca

SEQ ID NO: 147342 - DNA, 25 bp, Mus musculus
agaccgcattgagaggcgacgcgca

SEQ ID NO: 147343 - DNA, 25 bp, Mus musculus
agaccgccagacagctcactgcgtt

SEQ ID NO: 147344 - DNA, 25 bp, Mus musculus
agaccgccagactgctcactgcgtt

SEQ ID NO: 147345 - DNA, 25 bp, Mus musculus
agaccgccatccaggccatgaatgg

SEQ ID NO: 147346 - DNA, 25 bp, Mus musculus
agaccgccatcctggccatgaatgg

SEQ ID NO: 147347 - DNA, 25 bp, Mus musculus
agaccgccatgcatttcatctctta

SEQ ID NO: 147348 - DNA, 25 bp, Mus musculus
agaccgccatgcttttcatctctta

SEQ ID NO: 147349 - DNA, 25 bp, Mus musculus
agaccgccgacaagagctgtacaag

SEQ ID NO: 147350 - DNA, 25 bp, Mus musculus
agaccgccgacatgagctgtacaag

SEQ ID NO: 147351 - DNA, 25 bp, Mus musculus
agaccgcttcagcacagagctagaa

SEQ ID NO: 147352 - DNA, 25 bp, Mus musculus
agaccgcttcaggacagagctagaa

SEQ ID NO: 147353 - DNA, 25 bp, Mus musculus
agaccgcttggtactagccagcatc

SEQ ID NO: 147354 - DNA, 25 bp, Mus musculus
agaccgcttggtcgctttttaacag

SEQ ID NO: 147355 - DNA, 25 bp, Mus musculus
agaccgcttggtggctttttaacag

SEQ ID NO: 147356 - DNA, 25 bp, Mus musculus
agaccgcttggttctagccagcatc

SEQ ID NO: 147357 - DNA, 25 bp, Mus musculus
agaccggaccagacgagctgcttta

SEQ ID NO: 147358 - DNA, 25 bp, Mus musculus
agaccggaccagtcgagctgcttta

SEQ ID NO: 147359 - DNA, 25 bp, Mus musculus
agaccggacggtcactctgggcatt

SEQ ID NO: 147360 - DNA, 25 bp, Mus musculus
agaccggacggtgactctgggcatt

SEQ ID NO: 147361 - DNA, 25 bp, Mus musculus
agaccggagaggctcctttcgaaag

SEQ ID NO: 147362 - DNA, 25 bp, Mus musculus
agaccggagagggtcctttcgaaag

SEQ ID NO: 147363 - DNA, 25 bp, Mus musculus
agaccggcaaagatcacgtgactgt

SEQ ID NO: 147364 - DNA, 25 bp, Mus musculus
agaccggcaaagttcacgtgactgt

SEQ ID NO: 147365 - DNA, 25 bp, Mus musculus
agaccggcacggatgaaaacccagt

SEQ ID NO: 147366 - DNA, 25 bp, Mus musculus
agaccggcacggttgaaaacccagt

SEQ ID NO: 147367 - DNA, 25 bp, Mus musculus
agaccggcagcgagaatacctttta

SEQ ID NO: 147368 - DNA, 25 bp, Mus musculus
agaccggcagcgtgaatacctttta

SEQ ID NO: 147369 - DNA, 25 bp, Mus musculus
agaccggccatcatccttggtggtt

SEQ ID NO: 147370 - DNA, 25 bp, Mus musculus
agaccggccatcttccttggtggtt

SEQ ID NO: 147371 - DNA, 25 bp, Mus musculus
agaccggcctagcttttccaacctg

SEQ ID NO: 147372 - DNA, 25 bp, Mus musculus
agaccggcctaggttttccaacctg

SEQ ID NO: 147373 - DNA, 25 bp, Mus musculus
agaccggcctcgatttgagcgtgtc

SEQ ID NO: 147374 - DNA, 25 bp, Mus musculus
agaccggcctcgttttgagcgtgtc

SEQ ID NO: 147375 - DNA, 25 bp, Mus musculus
agaccggcggcactactgtaacaat

SEQ ID NO: 147376 - DNA, 25 bp, Mus musculus
agaccggcggcagtactgtaacaat

SEQ ID NO: 147377 - DNA, 25 bp, Mus musculus
agaccggctccgagtgcggctcctg

SEQ ID NO: 147378 - DNA, 25 bp, Mus musculus
agaccggctccgtgtgcggctcctg

SEQ ID NO: 147379 - DNA, 25 bp, Mus musculus
agaccggctgtcagggttagctgac

SEQ ID NO: 147380 - DNA, 25 bp, Mus musculus
agaccggctgtctgggttagctgac

SEQ ID NO: 147381 - DNA, 25 bp, Mus musculus
agaccggcttttcttcttcagagaa

SEQ ID NO: 147382 - DNA, 25 bp, Mus musculus
agaccggcttttgttcttcagagaa

SEQ ID NO: 147383 - DNA, 25 bp, Mus musculus
agaccgggaagcacatcgacaagat

SEQ ID NO: 147384 - DNA, 25 bp, Mus musculus
agaccgggaagctcatcgacaagat

SEQ ID NO: 147385 - DNA, 25 bp, Mus musculus
agaccgggcttcagacgtgagtaac

SEQ ID NO: 147386 - DNA, 25 bp, Mus musculus
agaccgggcttctgacgtgagtaac

SEQ ID NO: 147387 - DNA, 25 bp, Mus musculus
agaccgggtgttagacttgtagatt

SEQ ID NO: 147388 - DNA, 25 bp, Mus musculus
agaccgggtgtttgacttgtagatt

SEQ ID NO: 147389 - DNA, 25 bp, Mus musculus
agaccgggttctactgcaatgggaa

SEQ ID NO: 147390 - DNA, 25 bp, Mus musculus
agaccgggttcttctgcaatgggaa

SEQ ID NO: 147391 - DNA, 25 bp, Mus musculus
agaccggtcctgacgttttgtgtca

SEQ ID NO: 147392 - DNA, 25 bp, Mus musculus
agaccggtcctgtcgttttgtgtca

SEQ ID NO: 147393 - DNA, 25 bp, Mus musculus
agaccggtgcagagtggtgatggta

SEQ ID NO: 147394 - DNA, 25 bp, Mus musculus
agaccggtgcagtgtggtgatggta

SEQ ID NO: 147395 - DNA, 25 bp, Mus musculus
agaccggtgctgagttactcatgac

SEQ ID NO: 147396 - DNA, 25 bp, Mus musculus
agaccggtgctgtgttactcatgac

SEQ ID NO: 147397 - DNA, 25 bp, Mus musculus
agaccggtgtccctttgtaggtgct

SEQ ID NO: 147398 - DNA, 25 bp, Mus musculus
agaccggtgtccgtttgtaggtgct

SEQ ID NO: 147399 - DNA, 25 bp, Mus musculus
agaccggttacaccaggactagaag

SEQ ID NO: 147400 - DNA, 25 bp, Mus musculus
agaccggttacagcaggactagaag

SEQ ID NO: 147401 - DNA, 25 bp, Mus musculus
agaccgtactttctggcagagccat

SEQ ID NO: 147402 - DNA, 25 bp, Mus musculus
agaccgtactttgtggcagagccat

SEQ ID NO: 147403 - DNA, 25 bp, Mus musculus
agaccgtagcccagaatccgactct

SEQ ID NO: 147404 - DNA, 25 bp, Mus musculus
agaccgtagccctgaatccgactct

SEQ ID NO: 147405 - DNA, 25 bp, Mus musculus
agaccgtattaccagtgatcatagt

SEQ ID NO: 147406 - DNA, 25 bp, Mus musculus
agaccgtattacgagtgatcatagt

SEQ ID NO: 147407 - DNA, 25 bp, Mus musculus
agaccgtcagtcacacgtgttggtt

SEQ ID NO: 147408 - DNA, 25 bp, Mus musculus
agaccgtcagtctcacgtgttggtt

SEQ ID NO: 147409 - DNA, 25 bp, Mus musculus
agaccgtcctggaggctgtgatcct

SEQ ID NO: 147410 - DNA, 25 bp, Mus musculus
agaccgtcctggtggctgtgatcct

SEQ ID NO: 147411 - DNA, 25 bp, Mus musculus
agaccgtcctgtatttccagtgtca

SEQ ID NO: 147412 - DNA, 25 bp, Mus musculus
agaccgtcctgtttttccagtgtca

SEQ ID NO: 147413 - DNA, 25 bp, Mus musculus
agaccgtgacagaaagacggcgatt

SEQ ID NO: 147414 - DNA, 25 bp, Mus musculus
agaccgtgacagtaagacggcgatt

SEQ ID NO: 147415 - DNA, 25 bp, Mus musculus
agaccgtgactcagccagcattgtt

SEQ ID NO: 147416 - DNA, 25 bp, Mus musculus
agaccgtgactctgccagcattgtt

SEQ ID NO: 147417 - DNA, 25 bp, Mus musculus
agaccgtgaggtcagtagaatcctg

SEQ ID NO: 147418 - DNA, 25 bp, Mus musculus
agaccgtgaggtgagtagaatcctg

SEQ ID NO: 147419 - DNA, 25 bp, Mus musculus
agaccgtggaagagtgctgttccct

SEQ ID NO: 147420 - DNA, 25 bp, Mus musculus
agaccgtggaagtgtgctgttccct

SEQ ID NO: 147421 - DNA, 25 bp, Mus musculus
agaccgtggccaagaacaaggacca

SEQ ID NO: 147422 - DNA, 25 bp, Mus musculus
agaccgtggccatgaacaaggacca

SEQ ID NO: 147423 - DNA, 25 bp, Mus musculus
agaccgtgggcaccctggacgcaca

SEQ ID NO: 147424 - DNA, 25 bp, Mus musculus
agaccgtgggcagcctggacgcaca

SEQ ID NO: 147425 - DNA, 25 bp, Mus musculus
agaccgtgtctgattgtcctccatc

SEQ ID NO: 147426 - DNA, 25 bp, Mus musculus
agaccgtgtctgtttgtcctccatc

SEQ ID NO: 147427 - DNA, 25 bp, Mus musculus
agaccgtgtttcacatgtagccttg

SEQ ID NO: 147428 - DNA, 25 bp, Mus musculus
agaccgtgtttctcatgtagccttg

SEQ ID NO: 147429 - DNA, 25 bp, Mus musculus
agaccgttataacatcaattgtgaa

SEQ ID NO: 147430 - DNA, 25 bp, Mus musculus
agaccgttataagatcaattgtgaa

SEQ ID NO: 147431 - DNA, 25 bp, Mus musculus
agaccgttcacaacaggctcttatg

SEQ ID NO: 147432 - DNA, 25 bp, Mus musculus
agaccgttcacatcaggctcttatg

SEQ ID NO: 147433 - DNA, 25 bp, Mus musculus
agaccgttcccacaagagagagcat

SEQ ID NO: 147434 - DNA, 25 bp, Mus musculus
agaccgttcccagaagagagagcat

SEQ ID NO: 147435 - DNA, 25 bp, Mus musculus
agaccgttcctgctagcaagtgaaa

SEQ ID NO: 147436 - DNA, 25 bp, Mus musculus
agaccgttcctggtagcaagtgaaa

SEQ ID NO: 147437 - DNA, 25 bp, Mus musculus
agaccgttgggtcgactgacctcac

SEQ ID NO: 147438 - DNA, 25 bp, Mus musculus
agaccgttgggtggactgacctcac

SEQ ID NO: 147439 - DNA, 25 bp, Mus musculus
agaccgtttaacatgggctgatgca

SEQ ID NO: 147440 - DNA, 25 bp, Mus musculus
agaccgtttaacttgggctgatgca

SEQ ID NO: 147441 - DNA, 25 bp, Mus musculus
agaccgtttctaattttgtccactg

SEQ ID NO: 147442 - DNA, 25 bp, Mus musculus
agaccgtttctatttttgtccactg

SEQ ID NO: 147443 - DNA, 25 bp, Mus musculus
agaccgtttggtacttaagcaatgg

SEQ ID NO: 147444 - DNA, 25 bp, Mus musculus
agaccgtttggttcttaagcaatgg

SEQ ID NO: 147445 - DNA, 25 bp, Mus musculus
agacctaaacacacaacctttgatg

SEQ ID NO: 147446 - DNA, 25 bp, Mus musculus
agacctaaacactcaacctttgatg

SEQ ID NO: 147447 - DNA, 25 bp, Mus musculus
agacctaaatcgatcagagtcttag

SEQ ID NO: 147448 - DNA, 25 bp, Mus musculus
agacctaaatcgttcagagtcttag

SEQ ID NO: 147449 - DNA, 25 bp, Mus musculus
agacctaagaatcgccgatggcgta

SEQ ID NO: 147450 - DNA, 25 bp, Mus musculus
agacctaagaatggccgatggcgta

SEQ ID NO: 147451 - DNA, 25 bp, Mus musculus
agacctaagatgatgctgactcagc

SEQ ID NO: 147452 - DNA, 25 bp, Mus musculus
agacctaagatgttgctgactcagc

SEQ ID NO: 147453 - DNA, 25 bp, Mus musculus
agacctaagtatcggctgtcccata

SEQ ID NO: 147454 - DNA, 25 bp, Mus musculus
agacctaagtatgggctgtcccata

SEQ ID NO: 147455 - DNA, 25 bp, Mus musculus
agacctaagtctaactggagggaca

SEQ ID NO: 147456 - DNA, 25 bp, Mus musculus
agacctaagtcttactggagggaca

SEQ ID NO: 147457 - DNA, 25 bp, Mus musculus
agacctaataatacctggcttaaag

SEQ ID NO: 147458 - DNA, 25 bp, Mus musculus
agacctaataattcctggcttaaag

SEQ ID NO: 147459 - DNA, 25 bp, Mus musculus
agacctaatccaacagagacctcgt

SEQ ID NO: 147460 - DNA, 25 bp, Mus musculus
agacctaatccatcagagacctcgt

SEQ ID NO: 147461 - DNA, 25 bp, Mus musculus
agacctaatctgatgttgggcctga

SEQ ID NO: 147462 - DNA, 25 bp, Mus musculus
agacctaatctgttgttgggcctga

SEQ ID NO: 147463 - DNA, 25 bp, Mus musculus
agacctaatgagatgatccttggaa

SEQ ID NO: 147464 - DNA, 25 bp, Mus musculus
agacctaatgagttgatccttggaa

SEQ ID NO: 147465 - DNA, 25 bp, Mus musculus
agacctacaacacttgctgagaaaa

SEQ ID NO: 147466 - DNA, 25 bp, Mus musculus
agacctacaacagttgctgagaaaa

SEQ ID NO: 147467 - DNA, 25 bp, Mus musculus
agacctacaaggactctggcgacca

SEQ ID NO: 147468 - DNA, 25 bp, Mus musculus
agacctacaaggtctctggcgacca

SEQ ID NO: 147469 - DNA, 25 bp, Mus musculus
agacctacagatctgattagtgaac

SEQ ID NO: 147470 - DNA, 25 bp, Mus musculus
agacctacagatgtgattagtgaac

SEQ ID NO: 147471 - DNA, 25 bp, Mus musculus
agacctacaggaaccgcttctggaa

SEQ ID NO: 147472 - DNA, 25 bp, Mus musculus
agacctacaggatccgcttctggaa

SEQ ID NO: 147473 - DNA, 25 bp, Mus musculus
agacctacattgatggccgtgctgt

SEQ ID NO: 147474 - DNA, 25 bp, Mus musculus
agacctacattgttggccgtgctgt

SEQ ID NO: 147475 - DNA, 25 bp, Mus musculus
agacctaccatgatgcacactttgt

SEQ ID NO: 147476 - DNA, 25 bp, Mus musculus
agacctaccatgttgcacactttgt

SEQ ID NO: 147477 - DNA, 25 bp, Mus musculus
agacctacgcaaagatgggctttgt

SEQ ID NO: 147478 - DNA, 25 bp, Mus musculus
agacctacgcaatgatgggctttgt

SEQ ID NO: 147479 - DNA, 25 bp, Mus musculus
agacctactgtacttctgttaaata

SEQ ID NO: 147480 - DNA, 25 bp, Mus musculus
agacctactgtagttctgttaaata

SEQ ID NO: 147481 - DNA, 25 bp, Mus musculus
agacctactgtgagacataagcaat

SEQ ID NO: 147482 - DNA, 25 bp, Mus musculus
agacctactgtgtgacataagcaat

SEQ ID NO: 147483 - DNA, 25 bp, Mus musculus
agacctacttctcccatttttctgt

SEQ ID NO: 147484 - DNA, 25 bp, Mus musculus
agacctacttctcggttcgaatcgc

SEQ ID NO: 147485 - DNA, 25 bp, Mus musculus
agacctacttctgccatttttctgt

SEQ ID NO: 147486 - DNA, 25 bp, Mus musculus
agacctacttctgggttcgaatcgc

SEQ ID NO: 147487 - DNA, 25 bp, Mus musculus
agacctagactccttgcctctgtct

SEQ ID NO: 147488 - DNA, 25 bp, Mus musculus
agacctagactcgttgcctctgtct

SEQ ID NO: 147489 - DNA, 25 bp, Mus musculus
agacctagagaccagttttactggg

SEQ ID NO: 147490 - DNA, 25 bp, Mus musculus
agacctagagacgagttttactggg

SEQ ID NO: 147491 - DNA, 25 bp, Mus musculus
agacctagagggaccagtgctctct

SEQ ID NO: 147492 - DNA, 25 bp, Mus musculus
agacctagagggtccagtgctctct

SEQ ID NO: 147493 - DNA, 25 bp, Mus musculus
agacctagagtccagcctacctagg

SEQ ID NO: 147494 - DNA, 25 bp, Mus musculus
agacctagagtcgagcctacctagg

SEQ ID NO: 147495 - DNA, 25 bp, Mus musculus
agacctagctgtagcatttctagct

SEQ ID NO: 147496 - DNA, 25 bp, Mus musculus
agacctagctgttgcatttctagct

SEQ ID NO: 147497 - DNA, 25 bp, Mus musculus
agacctagtgatctgtgcctggcgc

SEQ ID NO: 147498 - DNA, 25 bp, Mus musculus
agacctagtgatgtgtgcctggcgc

SEQ ID NO: 147499 - DNA, 25 bp, Mus musculus
agacctatatcaacacttgccagta

SEQ ID NO: 147500 - DNA, 25 bp, Mus musculus
agacctatatcaccgcctcgccagc

SEQ ID NO: 147501 - DNA, 25 bp, Mus musculus
agacctatatcagcgcctcgccagc

SEQ ID NO: 147502 - DNA, 25 bp, Mus musculus
agacctatatcatcacttgccagta

SEQ ID NO: 147503 - DNA, 25 bp, Mus musculus
agacctatccaaagtagagggcaaa

SEQ ID NO: 147504 - DNA, 25 bp, Mus musculus
agacctatccaatgtagagggcaaa

SEQ ID NO: 147505 - DNA, 25 bp, Mus musculus
agacctatctagcataaactgtcaa

SEQ ID NO: 147506 - DNA, 25 bp, Mus musculus
agacctatctaggataaactgtcaa

SEQ ID NO: 147507 - DNA, 25 bp, Mus musculus
agacctatctttcccacacactgag

SEQ ID NO: 147508 - DNA, 25 bp, Mus musculus
agacctatctttgccacacactgag

SEQ ID NO: 147509 - DNA, 25 bp, Mus musculus
agacctatgcctacagtgagaaccc

SEQ ID NO: 147510 - DNA, 25 bp, Mus musculus
agacctatgccttcagtgagaaccc

SEQ ID NO: 147511 - DNA, 25 bp, Mus musculus
agacctatgcttcgatgcagagaat

SEQ ID NO: 147512 - DNA, 25 bp, Mus musculus
agacctatgcttggatgcagagaat

SEQ ID NO: 147513 - DNA, 25 bp, Mus musculus
agacctatgttaattgcctcctgaa

SEQ ID NO: 147514 - DNA, 25 bp, Mus musculus
agacctatgttatttgcctcctgaa

SEQ ID NO: 147515 - DNA, 25 bp, Mus musculus
agacctattctcaggaccagagcca

SEQ ID NO: 147516 - DNA, 25 bp, Mus musculus
agacctattctctggaccagagcca

SEQ ID NO: 147517 - DNA, 25 bp, Mus musculus
agacctattgacaaaccctggcagc

SEQ ID NO: 147518 - DNA, 25 bp, Mus musculus
agacctattgactaaccctggcagc

SEQ ID NO: 147519 - DNA, 25 bp, Mus musculus
agacctatttctcctttttgtacat

SEQ ID NO: 147520 - DNA, 25 bp, Mus musculus
agacctatttctgctttttgtacat

SEQ ID NO: 147521 - DNA, 25 bp, Mus musculus
agacctattttcaggtttatcctag

SEQ ID NO: 147522 - DNA, 25 bp, Mus musculus
agacctattttctggtttatcctag

SEQ ID NO: 147523 - DNA, 25 bp, Mus musculus
agacctcaaaacactgttgtcagag

SEQ ID NO: 147524 - DNA, 25 bp, Mus musculus
agacctcaaaactctgttgtcagag

SEQ ID NO: 147525 - DNA, 25 bp, Mus musculus
agacctcaagagaaaaagcccatat

SEQ ID NO: 147526 - DNA, 25 bp, Mus musculus
agacctcaagagtaaaagcccatat

SEQ ID NO: 147527 - DNA, 25 bp, Mus musculus
agacctcaatgcactgaacctgcat

SEQ ID NO: 147528 - DNA, 25 bp, Mus musculus
agacctcaatgctctgaacctgcat

SEQ ID NO: 147529 - DNA, 25 bp, Mus musculus
agacctcaatttccctggtgagcac

SEQ ID NO: 147530 - DNA, 25 bp, Mus musculus
agacctcaatttgcctggtgagcac

SEQ ID NO: 147531 - DNA, 25 bp, Mus musculus
agacctcacagtctgcatgggtaag

SEQ ID NO: 147532 - DNA, 25 bp, Mus musculus
agacctcacagtgtgcatgggtaag

SEQ ID NO: 147533 - DNA, 25 bp, Mus musculus
agacctcaccgaagatagtgcgcac

SEQ ID NO: 147534 - DNA, 25 bp, Mus musculus
agacctcaccgatgatagtgcgcac

SEQ ID NO: 147535 - DNA, 25 bp, Mus musculus
agacctcacctgaaatgctcatttt

SEQ ID NO: 147536 - DNA, 25 bp, Mus musculus
agacctcacctgtaatgctcatttt

SEQ ID NO: 147537 - DNA, 25 bp, Mus musculus
agacctcacgacatgtgtgtcacct

SEQ ID NO: 147538 - DNA, 25 bp, Mus musculus
agacctcacgacttgtgtgtcacct

SEQ ID NO: 147539 - DNA, 25 bp, Mus musculus
agacctcacggtcccaaatggagct

SEQ ID NO: 147540 - DNA, 25 bp, Mus musculus
agacctcacggtgccaaatggagct

SEQ ID NO: 147541 - DNA, 25 bp, Mus musculus
agacctcagaggaccagctctcaga

SEQ ID NO: 147542 - DNA, 25 bp, Mus musculus
agacctcagaggtccagctctcaga

SEQ ID NO: 147543 - DNA, 25 bp, Mus musculus
agacctcagcacctccgaggatgat

SEQ ID NO: 147544 - DNA, 25 bp, Mus musculus
agacctcagcacgtccgaggatgat

SEQ ID NO: 147545 - DNA, 25 bp, Mus musculus
agacctcaggcacatcgtcacagag

SEQ ID NO: 147546 - DNA, 25 bp, Mus musculus
agacctcaggcagatcgtcacagag

SEQ ID NO: 147547 - DNA, 25 bp, Mus musculus
agacctcaggttccagagatacata

SEQ ID NO: 147548 - DNA, 25 bp, Mus musculus
agacctcaggttgcagagatacata

SEQ ID NO: 147549 - DNA, 25 bp, Mus musculus
agacctcagtggagtcatgtggaca

SEQ ID NO: 147550 - DNA, 25 bp, Mus musculus
agacctcagtggtgtcatgtggaca

SEQ ID NO: 147551 - DNA, 25 bp, Mus musculus
agacctcatccacctggtggagttc

SEQ ID NO: 147552 - DNA, 25 bp, Mus musculus
agacctcatccagctggtggagttc

SEQ ID NO: 147553 - DNA, 25 bp, Mus musculus
agacctcatgctatctgcaactgta

SEQ ID NO: 147554 - DNA, 25 bp, Mus musculus
agacctcatgctttctgcaactgta

SEQ ID NO: 147555 - DNA, 25 bp, Mus musculus
agacctcatggaacttgaagctgtc

SEQ ID NO: 147556 - DNA, 25 bp, Mus musculus
agacctcatggatcttgaagctgtc

SEQ ID NO: 147557 - DNA, 25 bp, Mus musculus
agacctccaagtcctgatatccact

SEQ ID NO: 147558 - DNA, 25 bp, Mus musculus
agacctccaagtgctgatatccact

SEQ ID NO: 147559 - DNA, 25 bp, Mus musculus
agacctccatggagcatgagctcaa

SEQ ID NO: 147560 - DNA, 25 bp, Mus musculus
agacctccatggtgcatgagctcaa

SEQ ID NO: 147561 - DNA, 25 bp, Mus musculus
agacctccatgtagtactttcccgt

SEQ ID NO: 147562 - DNA, 25 bp, Mus musculus
agacctccatgttgtactttcccgt

SEQ ID NO: 147563 - DNA, 25 bp, Mus musculus
agacctccctcgaaggcaggaaagc

SEQ ID NO: 147564 - DNA, 25 bp, Mus musculus
agacctccctcgtaggcaggaaagc

SEQ ID NO: 147565 - DNA, 25 bp, Mus musculus
agacctccctggaatccatgcaggt

SEQ ID NO: 147566 - DNA, 25 bp, Mus musculus
agacctccctggtatccatgcaggt

SEQ ID NO: 147567 - DNA, 25 bp, Mus musculus
agacctccgggtcttatggtcccat

SEQ ID NO: 147568 - DNA, 25 bp, Mus musculus
agacctccgggtgttatggtcccat

SEQ ID NO: 147569 - DNA, 25 bp, Mus musculus
agacctcctaccacaggaatctaat

SEQ ID NO: 147570 - DNA, 25 bp, Mus musculus
agacctcctacctcaggaatctaat

SEQ ID NO: 147571 - DNA, 25 bp, Mus musculus
agacctcctatgacgacctgatcag

SEQ ID NO: 147572 - DNA, 25 bp, Mus musculus
agacctcctatgtcgacctgatcag

SEQ ID NO: 147573 - DNA, 25 bp, Mus musculus
agacctcctcaacagcagcgggaga

SEQ ID NO: 147574 - DNA, 25 bp, Mus musculus
agacctcctcaagagcagcgggaga

SEQ ID NO: 147575 - DNA, 25 bp, Mus musculus
agacctcctggacttggcactggca

SEQ ID NO: 147576 - DNA, 25 bp, Mus musculus
agacctcctggagttggcactggca

SEQ ID NO: 147577 - DNA, 25 bp, Mus musculus
agacctccttcacatttcctagata

SEQ ID NO: 147578 - DNA, 25 bp, Mus musculus
agacctccttcagatttcctagata

SEQ ID NO: 147579 - DNA, 25 bp, Mus musculus
agacctccttccaaagcacaatagc

SEQ ID NO: 147580 - DNA, 25 bp, Mus musculus
agacctccttcctaagcacaatagc

SEQ ID NO: 147581 - DNA, 25 bp, Mus musculus
agacctcgaacaacattccagcaga

SEQ ID NO: 147582 - DNA, 25 bp, Mus musculus
agacctcgaacatcattccagcaga

SEQ ID NO: 147583 - DNA, 25 bp, Mus musculus
agacctcgacagagagactcgcagc

SEQ ID NO: 147584 - DNA, 25 bp, Mus musculus
agacctcgacagtgagactcgcagc

SEQ ID NO: 147585 - DNA, 25 bp, Mus musculus
agacctcgctgtcacctgaacttgt

SEQ ID NO: 147586 - DNA, 25 bp, Mus musculus
agacctcgctgtgacctgaacttgt

SEQ ID NO: 147587 - DNA, 25 bp, Mus musculus
agacctcggacgagttgaatgctgc

SEQ ID NO: 147588 - DNA, 25 bp, Mus musculus
agacctcggacgtgttgaatgctgc

SEQ ID NO: 147589 - DNA, 25 bp, Mus musculus
agacctcggcctcatgacctggaga

SEQ ID NO: 147590 - DNA, 25 bp, Mus musculus
agacctcggcctgatgacctggaga

SEQ ID NO: 147591 - DNA, 25 bp, Mus musculus
agacctcggctgattccctcatgag

SEQ ID NO: 147592 - DNA, 25 bp, Mus musculus
agacctcggctgtttccctcatgag

SEQ ID NO: 147593 - DNA, 25 bp, Mus musculus
agacctcggcttctgacacctagag

SEQ ID NO: 147594 - DNA, 25 bp, Mus musculus
agacctcggcttgtgacacctagag

SEQ ID NO: 147595 - DNA, 25 bp, Mus musculus
agacctcgggaacggcccacataga

SEQ ID NO: 147596 - DNA, 25 bp, Mus musculus
agacctcgggaagggcccacataga

SEQ ID NO: 147597 - DNA, 25 bp, Mus musculus
agacctcgtcgcacagaatggccat

SEQ ID NO: 147598 - DNA, 25 bp, Mus musculus
agacctcgtcgctcagaatggccat

SEQ ID NO: 147599 - DNA, 25 bp, Mus musculus
agacctcgtctgaactgagcatgta

SEQ ID NO: 147600 - DNA, 25 bp, Mus musculus
agacctcgtctgtactgagcatgta

SEQ ID NO: 147601 - DNA, 25 bp, Mus musculus
agacctctaattaaatggactgcat

SEQ ID NO: 147602 - DNA, 25 bp, Mus musculus
agacctctaatttaatggactgcat

SEQ ID NO: 147603 - DNA, 25 bp, Mus musculus
agacctctactgatcaggtagccat

SEQ ID NO: 147604 - DNA, 25 bp, Mus musculus
agacctctactgttcaggtagccat

SEQ ID NO: 147605 - DNA, 25 bp, Mus musculus
agacctctacttagcttgaactgtt

SEQ ID NO: 147606 - DNA, 25 bp, Mus musculus
agacctctactttgcttgaactgtt

SEQ ID NO: 147607 - DNA, 25 bp, Mus musculus
agacctctatctattactgtaacat

SEQ ID NO: 147608 - DNA, 25 bp, Mus musculus
agacctctatcttttactgtaacat

SEQ ID NO: 147609 - DNA, 25 bp, Mus musculus
agacctctcaagagcctctgataag

SEQ ID NO: 147610 - DNA, 25 bp, Mus musculus
agacctctcaagtgcctctgataag

SEQ ID NO: 147611 - DNA, 25 bp, Mus musculus
agacctctccctagttgaccagagg

SEQ ID NO: 147612 - DNA, 25 bp, Mus musculus
agacctctcccttgttgaccagagg

SEQ ID NO: 147613 - DNA, 25 bp, Mus musculus
agacctctctctactcaagggaata

SEQ ID NO: 147614 - DNA, 25 bp, Mus musculus
agacctctctcttctcaagggaata

SEQ ID NO: 147615 - DNA, 25 bp, Mus musculus
agacctctctggctgatgagcctaa

SEQ ID NO: 147616 - DNA, 25 bp, Mus musculus
agacctctctgggtgatgagcctaa

SEQ ID NO: 147617 - DNA, 25 bp, Mus musculus
agacctctgaatcgtggctcatgcc

SEQ ID NO: 147618 - DNA, 25 bp, Mus musculus
agacctctgaatggtggctcatgcc

SEQ ID NO: 147619 - DNA, 25 bp, Mus musculus
agacctctgataactggaagagcaa

SEQ ID NO: 147620 - DNA, 25 bp, Mus musculus
agacctctgatatctggaagagcaa

SEQ ID NO: 147621 - DNA, 25 bp, Mus musculus
agacctctgatcagactcagctctg

SEQ ID NO: 147622 - DNA, 25 bp, Mus musculus
agacctctgatctgactcagctctg

SEQ ID NO: 147623 - DNA, 25 bp, Mus musculus
agacctctgcacaccatgtgggcct

SEQ ID NO: 147624 - DNA, 25 bp, Mus musculus
agacctctgcactccatgtgggcct

SEQ ID NO: 147625 - DNA, 25 bp, Mus musculus
agacctctgtggatgccggatgcct

SEQ ID NO: 147626 - DNA, 25 bp, Mus musculus
agacctctgtggttgccggatgcct

SEQ ID NO: 147627 - DNA, 25 bp, Mus musculus
agacctctgtgtacattcctatgag

SEQ ID NO: 147628 - DNA, 25 bp, Mus musculus
agacctctgtgtcacttttgcagca

SEQ ID NO: 147629 - DNA, 25 bp, Mus musculus
agacctctgtgtgacttttgcagca

SEQ ID NO: 147630 - DNA, 25 bp, Mus musculus
agacctctgtgttcattcctatgag

SEQ ID NO: 147631 - DNA, 25 bp, Mus musculus
agacctcttcagaataactacctcc

SEQ ID NO: 147632 - DNA, 25 bp, Mus musculus
agacctcttcagtataactacctcc

SEQ ID NO: 147633 - DNA, 25 bp, Mus musculus
agacctcttccgaaatgcgggatgt

SEQ ID NO: 147634 - DNA, 25 bp, Mus musculus
agacctcttccgtaatgcgggatgt

SEQ ID NO: 147635 - DNA, 25 bp, Mus musculus
agacctcttcctcagtgtatgtaat

SEQ ID NO: 147636 - DNA, 25 bp, Mus musculus
agacctcttcctgagtgtatgtaat

SEQ ID NO: 147637 - DNA, 25 bp, Mus musculus
agacctcttcttaggttgatctggg

SEQ ID NO: 147638 - DNA, 25 bp, Mus musculus
agacctcttctttggttgatctggg

SEQ ID NO: 147639 - DNA, 25 bp, Mus musculus
agacctcttgatagggactatggca

SEQ ID NO: 147640 - DNA, 25 bp, Mus musculus
agacctcttgattgggactatggca

SEQ ID NO: 147641 - DNA, 25 bp, Mus musculus
agacctcttgcgattcagatctctg

SEQ ID NO: 147642 - DNA, 25 bp, Mus musculus
agacctcttgcgtttcagatctctg

SEQ ID NO: 147643 - DNA, 25 bp, Mus musculus
agacctctttccagtgtgcattgct

SEQ ID NO: 147644 - DNA, 25 bp, Mus musculus
agacctctttcctgtgtgcattgct

SEQ ID NO: 147645 - DNA, 25 bp, Mus musculus
agacctctttgtcttctgggtagaa

SEQ ID NO: 147646 - DNA, 25 bp, Mus musculus
agacctctttgtgttctgggtagaa

SEQ ID NO: 147647 - DNA, 25 bp, Mus musculus
agacctgaaagtagctgtccagact

SEQ ID NO: 147648 - DNA, 25 bp, Mus musculus
agacctgaaagttgctgtccagact

SEQ ID NO: 147649 - DNA, 25 bp, Mus musculus
agacctgaactgaggcagaactcgg

SEQ ID NO: 147650 - DNA, 25 bp, Mus musculus
agacctgaactgtggcagaactcgg

SEQ ID NO: 147651 - DNA, 25 bp, Mus musculus
agacctgaagccaaggcctgtggag

SEQ ID NO: 147652 - DNA, 25 bp, Mus musculus
agacctgaagcctaggcctgtggag

SEQ ID NO: 147653 - DNA, 25 bp, Mus musculus
agacctgaaggaactctcgtcccat

SEQ ID NO: 147654 - DNA, 25 bp, Mus musculus
agacctgaaggatctctcgtcccat

SEQ ID NO: 147655 - DNA, 25 bp, Mus musculus
agacctgaagtgatcatactgactt

SEQ ID NO: 147656 - DNA, 25 bp, Mus musculus
agacctgaagtgttcatactgactt

SEQ ID NO: 147657 - DNA, 25 bp, Mus musculus
agacctgaatgaagtgttcctgcct

SEQ ID NO: 147658 - DNA, 25 bp, Mus musculus
agacctgaatgacttccccatggtt

SEQ ID NO: 147659 - DNA, 25 bp, Mus musculus
agacctgaatgagttccccatggtt

SEQ ID NO: 147660 - DNA, 25 bp, Mus musculus
agacctgaatgatgtgttcctgcct

SEQ ID NO: 147661 - DNA, 25 bp, Mus musculus
agacctgaattacatgtgaacccat

SEQ ID NO: 147662 - DNA, 25 bp, Mus musculus
agacctgaattagatgtgaacccat

SEQ ID NO: 147663 - DNA, 25 bp, Mus musculus
agacctgaattcacctgctgtttta

SEQ ID NO: 147664 - DNA, 25 bp, Mus musculus
agacctgaattctcctgctgtttta

SEQ ID NO: 147665 - DNA, 25 bp, Mus musculus
agacctgaccccagagaaccagagg

SEQ ID NO: 147666 - DNA, 25 bp, Mus musculus
agacctgacccctgagaaccagagg

SEQ ID NO: 147667 - DNA, 25 bp, Mus musculus
agacctgacctcaatggcagtctgg

SEQ ID NO: 147668 - DNA, 25 bp, Mus musculus
agacctgacctctatggcagtctgg

SEQ ID NO: 147669 - DNA, 25 bp, Mus musculus
agacctgaccttcatgcatgccaag

SEQ ID NO: 147670 - DNA, 25 bp, Mus musculus
agacctgaccttgatgcatgccaag

SEQ ID NO: 147671 - DNA, 25 bp, Mus musculus
agacctgactccaactcaattatag

SEQ ID NO: 147672 - DNA, 25 bp, Mus musculus
agacctgactcctactcaattatag

SEQ ID NO: 147673 - DNA, 25 bp, Mus musculus
agacctgactgactccattgtgccg

SEQ ID NO: 147674 - DNA, 25 bp, Mus musculus
agacctgactgagtccattgtgccg

SEQ ID NO: 147675 - DNA, 25 bp, Mus musculus
agacctgactgtccgtattggagac

SEQ ID NO: 147676 - DNA, 25 bp, Mus musculus
agacctgactgtgcgtattggagac

SEQ ID NO: 147677 - DNA, 25 bp, Mus musculus
agacctgagaagcttgtaacccctg

SEQ ID NO: 147678 - DNA, 25 bp, Mus musculus
agacctgagaaggttgtaacccctg

SEQ ID NO: 147679 - DNA, 25 bp, Mus musculus
agacctgagaatcgacctgtgatct

SEQ ID NO: 147680 - DNA, 25 bp, Mus musculus
agacctgagaatggacctgtgatct

SEQ ID NO: 147681 - DNA, 25 bp, Mus musculus
agacctgagagcacacacttctggt

SEQ ID NO: 147682 - DNA, 25 bp, Mus musculus
agacctgagagctcacacttctggt

SEQ ID NO: 147683 - DNA, 25 bp, Mus musculus
agacctgagaggatcgatgcaaact

SEQ ID NO: 147684 - DNA, 25 bp, Mus musculus
agacctgagaggttcgatgcaaact

SEQ ID NO: 147685 - DNA, 25 bp, Mus musculus
agacctgagcaaagccttcctcagc

SEQ ID NO: 147686 - DNA, 25 bp, Mus musculus
agacctgagcaatgccttcctcagc

SEQ ID NO: 147687 - DNA, 25 bp, Mus musculus
agacctgagcatctttaggctgaga

SEQ ID NO: 147688 - DNA, 25 bp, Mus musculus
agacctgagcatgtttaggctgaga

SEQ ID NO: 147689 - DNA, 25 bp, Mus musculus
agacctgagccaccaatcgccaaag

SEQ ID NO: 147690 - DNA, 25 bp, Mus musculus
agacctgagccagcaatcgccaaag

SEQ ID NO: 147691 - DNA, 25 bp, Mus musculus
agacctgagccccagtgagcctatg

SEQ ID NO: 147692 - DNA, 25 bp, Mus musculus
agacctgagcccgagtgagcctatg

SEQ ID NO: 147693 - DNA, 25 bp, Mus musculus
agacctgagctcaaagtgcctggta

SEQ ID NO: 147694 - DNA, 25 bp, Mus musculus
agacctgagctcagcattcacgttc

SEQ ID NO: 147695 - DNA, 25 bp, Mus musculus
agacctgagctctaagtgcctggta

SEQ ID NO: 147696 - DNA, 25 bp, Mus musculus
agacctgagctctgcattcacgttc

SEQ ID NO: 147697 - DNA, 25 bp, Mus musculus
agacctgaggctaatttgctgggca

SEQ ID NO: 147698 - DNA, 25 bp, Mus musculus
agacctgaggcttatttgctgggca

SEQ ID NO: 147699 - DNA, 25 bp, Mus musculus
agacctgaggtcaaaaccacatcgc

SEQ ID NO: 147700 - DNA, 25 bp, Mus musculus
agacctgaggtctaaaccacatcgc

SEQ ID NO: 147701 - DNA, 25 bp, Mus musculus
agacctgagtagagtttccatggaa

SEQ ID NO: 147702 - DNA, 25 bp, Mus musculus
agacctgagtagtgtttccatggaa

SEQ ID NO: 147703 - DNA, 25 bp, Mus musculus
agacctgagtatcccatgtggcctg

SEQ ID NO: 147704 - DNA, 25 bp, Mus musculus
agacctgagtatgccatgtggcctg

SEQ ID NO: 147705 - DNA, 25 bp, Mus musculus
agacctgagtctactgcaacaagga

SEQ ID NO: 147706 - DNA, 25 bp, Mus musculus
agacctgagtcttctgcaacaagga

SEQ ID NO: 147707 - DNA, 25 bp, Mus musculus
agacctgagtttagaccctgacctt

SEQ ID NO: 147708 - DNA, 25 bp, Mus musculus
agacctgagttttgaccctgacctt

SEQ ID NO: 147709 - DNA, 25 bp, Mus musculus
agacctgataccagaaaccctgaca

SEQ ID NO: 147710 - DNA, 25 bp, Mus musculus
agacctgatacctgaaaccctgaca

SEQ ID NO: 147711 - DNA, 25 bp, Mus musculus
agacctgatcttctgcctgatgcag

SEQ ID NO: 147712 - DNA, 25 bp, Mus musculus
agacctgatcttgtgcctgatgcag

SEQ ID NO: 147713 - DNA, 25 bp, Mus musculus
agacctgatggtctctggttcctgc

SEQ ID NO: 147714 - DNA, 25 bp, Mus musculus
agacctgatggtgtctggttcctgc

SEQ ID NO: 147715 - DNA, 25 bp, Mus musculus
agacctgattctaaaacttgccaat

SEQ ID NO: 147716 - DNA, 25 bp, Mus musculus
agacctgattcttaaacttgccaat

SEQ ID NO: 147717 - DNA, 25 bp, Mus musculus
agacctgcagacaaattccgggcat

SEQ ID NO: 147718 - DNA, 25 bp, Mus musculus
agacctgcagactaattccgggcat

SEQ ID NO: 147719 - DNA, 25 bp, Mus musculus
agacctgcagatacttcaacacttc

SEQ ID NO: 147720 - DNA, 25 bp, Mus musculus
agacctgcagattcttcaacacttc

SEQ ID NO: 147721 - DNA, 25 bp, Mus musculus
agacctgcaggccaagctacagctg

SEQ ID NO: 147722 - DNA, 25 bp, Mus musculus
agacctgcaggcgaagctacagctg

SEQ ID NO: 147723 - DNA, 25 bp, Mus musculus
agacctgcatcacggactgctttat

SEQ ID NO: 147724 - DNA, 25 bp, Mus musculus
agacctgcatcagggactgctttat

SEQ ID NO: 147725 - DNA, 25 bp, Mus musculus
agacctgcattaacaaaatccccac

SEQ ID NO: 147726 - DNA, 25 bp, Mus musculus
agacctgcattatcaaaatccccac

SEQ ID NO: 147727 - DNA, 25 bp, Mus musculus
agacctgcattccttcttaacaaat

SEQ ID NO: 147728 - DNA, 25 bp, Mus musculus
agacctgcattcgttcttaacaaat

SEQ ID NO: 147729 - DNA, 25 bp, Mus musculus
agacctgcatttaatcttcaaatca

SEQ ID NO: 147730 - DNA, 25 bp, Mus musculus
agacctgcattttatcttcaaatca

SEQ ID NO: 147731 - DNA, 25 bp, Mus musculus
agacctgccaagagagtgaaacccc

SEQ ID NO: 147732 - DNA, 25 bp, Mus musculus
agacctgccaagtgagtgaaacccc

SEQ ID NO: 147733 - DNA, 25 bp, Mus musculus
agacctgccacaacagaaattcagg

SEQ ID NO: 147734 - DNA, 25 bp, Mus musculus
agacctgccacatcagaaattcagg

SEQ ID NO: 147735 - DNA, 25 bp, Mus musculus
agacctgccagacccatacagtgag

SEQ ID NO: 147736 - DNA, 25 bp, Mus musculus
agacctgccagagccatacagtgag

SEQ ID NO: 147737 - DNA, 25 bp, Mus musculus
agacctgccagccagtgcatgtggt

SEQ ID NO: 147738 - DNA, 25 bp, Mus musculus
agacctgccagcgagtgcatgtggt

SEQ ID NO: 147739 - DNA, 25 bp, Mus musculus
agacctgcccaccaatgagagcttt

SEQ ID NO: 147740 - DNA, 25 bp, Mus musculus
agacctgcccacgaatgagagcttt

SEQ ID NO: 147741 - DNA, 25 bp, Mus musculus
agacctgcccccagagcctggtaag

SEQ ID NO: 147742 - DNA, 25 bp, Mus musculus
agacctgccccctgagcctggtaag

SEQ ID NO: 147743 - DNA, 25 bp, Mus musculus
agacctgcccctatcagtagaggca

SEQ ID NO: 147744 - DNA, 25 bp, Mus musculus
agacctgcccctttcagtagaggca

SEQ ID NO: 147745 - DNA, 25 bp, Mus musculus
agacctgcccttcagaggacgtagg

SEQ ID NO: 147746 - DNA, 25 bp, Mus musculus
agacctgcccttgagaggacgtagg

SEQ ID NO: 147747 - DNA, 25 bp, Mus musculus
agacctgccgcactgtgtgcagagc

SEQ ID NO: 147748 - DNA, 25 bp, Mus musculus
agacctgccgcagtgtgtgcagagc

SEQ ID NO: 147749 - DNA, 25 bp, Mus musculus
agacctgccgtgagcttggttcctt

SEQ ID NO: 147750 - DNA, 25 bp, Mus musculus
agacctgccgtgtgcttggttcctt

SEQ ID NO: 147751 - DNA, 25 bp, Mus musculus
agacctgcctggactcgtttgcgtt

SEQ ID NO: 147752 - DNA, 25 bp, Mus musculus
agacctgcctggtctcgtttgcgtt

SEQ ID NO: 147753 - DNA, 25 bp, Mus musculus
agacctgccttaatgattcgcttgg

SEQ ID NO: 147754 - DNA, 25 bp, Mus musculus
agacctgccttattgattcgcttgg

SEQ ID NO: 147755 - DNA, 25 bp, Mus musculus
agacctgcgcctactggaatcgctt

SEQ ID NO: 147756 - DNA, 25 bp, Mus musculus
agacctgcgccttctggaatcgctt

SEQ ID NO: 147757 - DNA, 25 bp, Mus musculus
agacctgcggttattaaagtgatgc

SEQ ID NO: 147758 - DNA, 25 bp, Mus musculus
agacctgcggtttttaaagtgatgc

SEQ ID NO: 147759 - DNA, 25 bp, Mus musculus
agacctgctagtatcctggattgta

SEQ ID NO: 147760 - DNA, 25 bp, Mus musculus
agacctgctagtttcctggattgta

SEQ ID NO: 147761 - DNA, 25 bp, Mus musculus
agacctgctatgaaatatagatttt

SEQ ID NO: 147762 - DNA, 25 bp, Mus musculus
agacctgctatgtaatatagatttt

SEQ ID NO: 147763 - DNA, 25 bp, Mus musculus
agacctgctccactgtgttgatgcc

SEQ ID NO: 147764 - DNA, 25 bp, Mus musculus
agacctgctccagtgtgttgatgcc

SEQ ID NO: 147765 - DNA, 25 bp, Mus musculus
agacctgctctgaaccaatgctgtg

SEQ ID NO: 147766 - DNA, 25 bp, Mus musculus
agacctgctctgtaccaatgctgtg

SEQ ID NO: 147767 - DNA, 25 bp, Mus musculus
agacctgctcttatcggaaatgaaa

SEQ ID NO: 147768 - DNA, 25 bp, Mus musculus
agacctgctcttttcggaaatgaaa

SEQ ID NO: 147769 - DNA, 25 bp, Mus musculus
agacctgctgcaagcgtcactgcct

SEQ ID NO: 147770 - DNA, 25 bp, Mus musculus
agacctgctgcacggagactcgaaa

SEQ ID NO: 147771 - DNA, 25 bp, Mus musculus
agacctgctgcagggagactcgaaa

SEQ ID NO: 147772 - DNA, 25 bp, Mus musculus
agacctgctgcatgcgtcactgcct

SEQ ID NO: 147773 - DNA, 25 bp, Mus musculus
agacctgctggccagtttgactgaa

SEQ ID NO: 147774 - DNA, 25 bp, Mus musculus
agacctgctggcgagtttgactgaa

SEQ ID NO: 147775 - DNA, 25 bp, Mus musculus
agacctgcttaccatgtggcagcaa

SEQ ID NO: 147776 - DNA, 25 bp, Mus musculus
agacctgcttacgatgtggcagcaa

SEQ ID NO: 147777 - DNA, 25 bp, Mus musculus
agacctgcttatctataaaaaagaa

SEQ ID NO: 147778 - DNA, 25 bp, Mus musculus
agacctgcttatgtataaaaaagaa

SEQ ID NO: 147779 - DNA, 25 bp, Mus musculus
agacctgctttaaatctcagaatat

SEQ ID NO: 147780 - DNA, 25 bp, Mus musculus
agacctgctttatatctcagaatat

SEQ ID NO: 147781 - DNA, 25 bp, Mus musculus
agacctgctttcaggctcttagctg

SEQ ID NO: 147782 - DNA, 25 bp, Mus musculus
agacctgctttctggctcttagctg

SEQ ID NO: 147783 - DNA, 25 bp, Mus musculus
agacctggaaccaccggatgccggg

SEQ ID NO: 147784 - DNA, 25 bp, Mus musculus
agacctggaacctccggatgccggg

SEQ ID NO: 147785 - DNA, 25 bp, Mus musculus
agacctggaacgacacctcgccgcg

SEQ ID NO: 147786 - DNA, 25 bp, Mus musculus
agacctggaacgtcacctcgccgcg

SEQ ID NO: 147787 - DNA, 25 bp, Mus musculus
agacctggaactcactgcacaacca

SEQ ID NO: 147788 - DNA, 25 bp, Mus musculus
agacctggaactgactgcacaacca

SEQ ID NO: 147789 - DNA, 25 bp, Mus musculus
agacctggacagaaccaggcgtcca

SEQ ID NO: 147790 - DNA, 25 bp, Mus musculus
agacctggacagaagcagccagccc

SEQ ID NO: 147791 - DNA, 25 bp, Mus musculus
agacctggacagtaccaggcgtcca

SEQ ID NO: 147792 - DNA, 25 bp, Mus musculus
agacctggacagtagcagccagccc

SEQ ID NO: 147793 - DNA, 25 bp, Mus musculus
agacctggacttctaggcagagcct

SEQ ID NO: 147794 - DNA, 25 bp, Mus musculus
agacctggacttgtaggcagagcct

SEQ ID NO: 147795 - DNA, 25 bp, Mus musculus
agacctggagagaatcgtcgcccac

SEQ ID NO: 147796 - DNA, 25 bp, Mus musculus
agacctggagagtatcgtcgcccac

SEQ ID NO: 147797 - DNA, 25 bp, Mus musculus
agacctggaggtacctctttctagg

SEQ ID NO: 147798 - DNA, 25 bp, Mus musculus
agacctggaggttcctctttctagg

SEQ ID NO: 147799 - DNA, 25 bp, Mus musculus
agacctggagttctttttcaagatg

SEQ ID NO: 147800 - DNA, 25 bp, Mus musculus
agacctggagttgtttttcaagatg

SEQ ID NO: 147801 - DNA, 25 bp, Mus musculus
agacctggatatcgatgagccctga

SEQ ID NO: 147802 - DNA, 25 bp, Mus musculus
agacctggatatggatgagccctga

SEQ ID NO: 147803 - DNA, 25 bp, Mus musculus
agacctggatcaacaagccggacat

SEQ ID NO: 147804 - DNA, 25 bp, Mus musculus
agacctggatcacacatctctcctg

SEQ ID NO: 147805 - DNA, 25 bp, Mus musculus
agacctggatcagacatctctcctg

SEQ ID NO: 147806 - DNA, 25 bp, Mus musculus
agacctggatcatcaagccggacat

SEQ ID NO: 147807 - DNA, 25 bp, Mus musculus
agacctggcaggcagcactgaatcc

SEQ ID NO: 147808 - DNA, 25 bp, Mus musculus
agacctggcagggagcactgaatcc

SEQ ID NO: 147809 - DNA, 25 bp, Mus musculus
agacctggccacatcgagtttttgg

SEQ ID NO: 147810 - DNA, 25 bp, Mus musculus
agacctggccacttcgagtttttgg

SEQ ID NO: 147811 - DNA, 25 bp, Mus musculus
agacctggccagagttaagcttttg

SEQ ID NO: 147812 - DNA, 25 bp, Mus musculus
agacctggccagtgttaagcttttg

SEQ ID NO: 147813 - DNA, 25 bp, Mus musculus
agacctggccttccctatggcagac

SEQ ID NO: 147814 - DNA, 25 bp, Mus musculus
agacctggccttgcctatggcagac

SEQ ID NO: 147815 - DNA, 25 bp, Mus musculus
agacctggcggcatgagcccaagga

SEQ ID NO: 147816 - DNA, 25 bp, Mus musculus
agacctggcggcttgagcccaagga

SEQ ID NO: 147817 - DNA, 25 bp, Mus musculus
agacctggctgcatagagtagcccg

SEQ ID NO: 147818 - DNA, 25 bp, Mus musculus
agacctggctgcttagagtagcccg

SEQ ID NO: 147819 - DNA, 25 bp, Mus musculus
agacctggctttcgagaaaagacca

SEQ ID NO: 147820 - DNA, 25 bp, Mus musculus
agacctggctttggagaaaagacca

SEQ ID NO: 147821 - DNA, 25 bp, Mus musculus
agacctgggagaatggcagctactt

SEQ ID NO: 147822 - DNA, 25 bp, Mus musculus
agacctgggagattggcagctactt

SEQ ID NO: 147823 - DNA, 25 bp, Mus musculus
agacctgggagtctagctctctccg

SEQ ID NO: 147824 - DNA, 25 bp, Mus musculus
agacctgggagtgtagctctctccg

SEQ ID NO: 147825 - DNA, 25 bp, Mus musculus
agacctgggcacaggcatagatgaa

SEQ ID NO: 147826 - DNA, 25 bp, Mus musculus
agacctgggcactggcatagatgaa

SEQ ID NO: 147827 - DNA, 25 bp, Mus musculus
agacctgggcatctgtgttccacgt

SEQ ID NO: 147828 - DNA, 25 bp, Mus musculus
agacctgggcatgtgtgttccacgt

SEQ ID NO: 147829 - DNA, 25 bp, Mus musculus
agacctggtaccaagtggtcctgag

SEQ ID NO: 147830 - DNA, 25 bp, Mus musculus
agacctggtacctagtggtcctgag

SEQ ID NO: 147831 - DNA, 25 bp, Mus musculus
agacctggtagcaactgcaatcctg

SEQ ID NO: 147832 - DNA, 25 bp, Mus musculus
agacctggtagctactgcaatcctg

SEQ ID NO: 147833 - DNA, 25 bp, Mus musculus
agacctggtcagatgactcttcatc

SEQ ID NO: 147834 - DNA, 25 bp, Mus musculus
agacctggtcagttgactcttcatc

SEQ ID NO: 147835 - DNA, 25 bp, Mus musculus
agacctggtcgtagcttcggctgag

SEQ ID NO: 147836 - DNA, 25 bp, Mus musculus
agacctggtcgttgcttcggctgag

SEQ ID NO: 147837 - DNA, 25 bp, Mus musculus
agacctggtgagactgcaggtgccc

SEQ ID NO: 147838 - DNA, 25 bp, Mus musculus
agacctggtgagtctgcaggtgccc

SEQ ID NO: 147839 - DNA, 25 bp, Mus musculus
agacctggttagagcccttggacat

SEQ ID NO: 147840 - DNA, 25 bp, Mus musculus
agacctggttagtgcccttggacat

SEQ ID NO: 147841 - DNA, 25 bp, Mus musculus
agacctggttggctgaactataata

SEQ ID NO: 147842 - DNA, 25 bp, Mus musculus
agacctggttgggtgaactataata

SEQ ID NO: 147843 - DNA, 25 bp, Mus musculus
agacctggtttgattaagtttatca

SEQ ID NO: 147844 - DNA, 25 bp, Mus musculus
agacctggtttgtttaagtttatca

SEQ ID NO: 147845 - DNA, 25 bp, Mus musculus
agacctgtaccccaggtgccagggt

SEQ ID NO: 147846 - DNA, 25 bp, Mus musculus
agacctgtacccgaggtgccagggt

SEQ ID NO: 147847 - DNA, 25 bp, Mus musculus
agacctgtagctccgcctcagatgg

SEQ ID NO: 147848 - DNA, 25 bp, Mus musculus
agacctgtagctgcgcctcagatgg

SEQ ID NO: 147849 - DNA, 25 bp, Mus musculus
agacctgtaggtcggtgctcagaaa

SEQ ID NO: 147850 - DNA, 25 bp, Mus musculus
agacctgtaggtgggtgctcagaaa

SEQ ID NO: 147851 - DNA, 25 bp, Mus musculus
agacctgtagtgactatgctcaccc

SEQ ID NO: 147852 - DNA, 25 bp, Mus musculus
agacctgtagtgtctatgctcaccc

SEQ ID NO: 147853 - DNA, 25 bp, Mus musculus
agacctgtagttctcaacactgata

SEQ ID NO: 147854 - DNA, 25 bp, Mus musculus
agacctgtagttgtcaacactgata

SEQ ID NO: 147855 - DNA, 25 bp, Mus musculus
agacctgtcacaagtttccatataa

SEQ ID NO: 147856 - DNA, 25 bp, Mus musculus
agacctgtcacatgtttccatataa

SEQ ID NO: 147857 - DNA, 25 bp, Mus musculus
agacctgtcatgcaactgttgttca

SEQ ID NO: 147858 - DNA, 25 bp, Mus musculus
agacctgtcatggaactgttgttca

SEQ ID NO: 147859 - DNA, 25 bp, Mus musculus
agacctgtccatatgtatacccaag

SEQ ID NO: 147860 - DNA, 25 bp, Mus musculus
agacctgtccatttgtatacccaag

SEQ ID NO: 147861 - DNA, 25 bp, Mus musculus
agacctgtctgacatgccagcggag

SEQ ID NO: 147862 - DNA, 25 bp, Mus musculus
agacctgtctgagatgccagcggag

SEQ ID NO: 147863 - DNA, 25 bp, Mus musculus
agacctgtgctaaggccagtgtctt

SEQ ID NO: 147864 - DNA, 25 bp, Mus musculus
agacctgtgctatggccagtgtctt

SEQ ID NO: 147865 - DNA, 25 bp, Mus musculus
agacctgtggaaatatgtgcatctc

SEQ ID NO: 147866 - DNA, 25 bp, Mus musculus
agacctgtggaattatgtgcatctc

SEQ ID NO: 147867 - DNA, 25 bp, Mus musculus
agacctgtggagagacaatttgact

SEQ ID NO: 147868 - DNA, 25 bp, Mus musculus
agacctgtggagcagccacccacgc

SEQ ID NO: 147869 - DNA, 25 bp, Mus musculus
agacctgtggaggagccacccacgc

SEQ ID NO: 147870 - DNA, 25 bp, Mus musculus
agacctgtggagtgacaatttgact

SEQ ID NO: 147871 - DNA, 25 bp, Mus musculus
agacctgtggctcagtttcttctgt

SEQ ID NO: 147872 - DNA, 25 bp, Mus musculus
agacctgtggctgagtttcttctgt

SEQ ID NO: 147873 - DNA, 25 bp, Mus musculus
agacctgtgggtctgtttgcattct

SEQ ID NO: 147874 - DNA, 25 bp, Mus musculus
agacctgtgggtgtgtttgcattct

SEQ ID NO: 147875 - DNA, 25 bp, Mus musculus
agacctgtggtcattcctcgatgtt

SEQ ID NO: 147876 - DNA, 25 bp, Mus musculus
agacctgtggtcctctacagcaaca

SEQ ID NO: 147877 - DNA, 25 bp, Mus musculus
agacctgtggtcgtctacagcaaca

SEQ ID NO: 147878 - DNA, 25 bp, Mus musculus
agacctgtggtctttcctcgatgtt

SEQ ID NO: 147879 - DNA, 25 bp, Mus musculus
agacctgtgtggatagtgccttgtg

SEQ ID NO: 147880 - DNA, 25 bp, Mus musculus
agacctgtgtggttagtgccttgtg

SEQ ID NO: 147881 - DNA, 25 bp, Mus musculus
agacctgttatccacaagaccttga

SEQ ID NO: 147882 - DNA, 25 bp, Mus musculus
agacctgttatcgacaagaccttga

SEQ ID NO: 147883 - DNA, 25 bp, Mus musculus
agacctgttcgtacaactggaaagg

SEQ ID NO: 147884 - DNA, 25 bp, Mus musculus
agacctgttcgttcaactggaaagg

SEQ ID NO: 147885 - DNA, 25 bp, Mus musculus
agacctgttctgcagatggctgtat

SEQ ID NO: 147886 - DNA, 25 bp, Mus musculus
agacctgttctggagatggctgtat

SEQ ID NO: 147887 - DNA, 25 bp, Mus musculus
agacctgttggaagagtcctcatca

SEQ ID NO: 147888 - DNA, 25 bp, Mus musculus
agacctgttggatgagtcctcatca

SEQ ID NO: 147889 - DNA, 25 bp, Mus musculus
agacctgtttagctgcctagatggg

SEQ ID NO: 147890 - DNA, 25 bp, Mus musculus
agacctgtttaggtgcctagatggg

SEQ ID NO: 147891 - DNA, 25 bp, Mus musculus
agaccttaaatcaacccttgcctgg

SEQ ID NO: 147892 - DNA, 25 bp, Mus musculus
agaccttaaatctacccttgcctgg

SEQ ID NO: 147893 - DNA, 25 bp, Mus musculus
agaccttaagaaccccttgccagga

SEQ ID NO: 147894 - DNA, 25 bp, Mus musculus
agaccttaagaagcccttgccagga

SEQ ID NO: 147895 - DNA, 25 bp, Mus musculus
agaccttacagacctacttgaaaaa

SEQ ID NO: 147896 - DNA, 25 bp, Mus musculus
agaccttacagagctacttgaaaaa

SEQ ID NO: 147897 - DNA, 25 bp, Mus musculus
agaccttagaatcgtgtagccagta

SEQ ID NO: 147898 - DNA, 25 bp, Mus musculus
agaccttagaatggtgtagccagta

SEQ ID NO: 147899 - DNA, 25 bp, Mus musculus
agaccttagcctccaagagctgatt

SEQ ID NO: 147900 - DNA, 25 bp, Mus musculus
agaccttagcctgcaagagctgatt

SEQ ID NO: 147901 - DNA, 25 bp, Mus musculus
agaccttaggttctcagactccctg

SEQ ID NO: 147902 - DNA, 25 bp, Mus musculus
agaccttaggttgtcagactccctg

SEQ ID NO: 147903 - DNA, 25 bp, Mus musculus
agaccttatccaatctactcattca

SEQ ID NO: 147904 - DNA, 25 bp, Mus musculus
agaccttatccattctactcattca

SEQ ID NO: 147905 - DNA, 25 bp, Mus musculus
agaccttatgtaataaaaacactgc

SEQ ID NO: 147906 - DNA, 25 bp, Mus musculus
agaccttatgtattaaaaacactgc

SEQ ID NO: 147907 - DNA, 25 bp, Mus musculus
agaccttcaatacgatgcaatccca

SEQ ID NO: 147908 - DNA, 25 bp, Mus musculus
agaccttcaataggatgcaatccca

SEQ ID NO: 147909 - DNA, 25 bp, Mus musculus
agaccttcaatcaaccggcagggag

SEQ ID NO: 147910 - DNA, 25 bp, Mus musculus
agaccttcaatctaccggcagggag

SEQ ID NO: 147911 - DNA, 25 bp, Mus musculus
agaccttcacccaagcatggatggc

SEQ ID NO: 147912 - DNA, 25 bp, Mus musculus
agaccttcaccctagcatggatggc

SEQ ID NO: 147913 - DNA, 25 bp, Mus musculus
agaccttcactcagatcgagttgta

SEQ ID NO: 147914 - DNA, 25 bp, Mus musculus
agaccttcactctgatcgagttgta

SEQ ID NO: 147915 - DNA, 25 bp, Mus musculus
agaccttcagatcattcctatgccc

SEQ ID NO: 147916 - DNA, 25 bp, Mus musculus
agaccttcagatgattcctatgccc

SEQ ID NO: 147917 - DNA, 25 bp, Mus musculus
agaccttcagctacttcgccatgat

SEQ ID NO: 147918 - DNA, 25 bp, Mus musculus
agaccttcagcttcttcgccatgat

SEQ ID NO: 147919 - DNA, 25 bp, Mus musculus
agaccttcagttcctcaagtcccag

SEQ ID NO: 147920 - DNA, 25 bp, Mus musculus
agaccttcagttgctcaagtcccag

SEQ ID NO: 147921 - DNA, 25 bp, Mus musculus
agaccttcatgcatcactgtgggtt

SEQ ID NO: 147922 - DNA, 25 bp, Mus musculus
agaccttcatgcttcactgtgggtt

SEQ ID NO: 147923 - DNA, 25 bp, Mus musculus
agaccttccagcatcaggcagagca

SEQ ID NO: 147924 - DNA, 25 bp, Mus musculus
agaccttccagcttcaggcagagca

SEQ ID NO: 147925 - DNA, 25 bp, Mus musculus
agaccttccctcaggatatgtgtat

SEQ ID NO: 147926 - DNA, 25 bp, Mus musculus
agaccttccctctggatatgtgtat

SEQ ID NO: 147927 - DNA, 25 bp, Mus musculus
agaccttcctacactgtgctgtgta

SEQ ID NO: 147928 - DNA, 25 bp, Mus musculus
agaccttcctactctgtgctgtgta

SEQ ID NO: 147929 - DNA, 25 bp, Mus musculus
agaccttcgggaccgttcagtagtg

SEQ ID NO: 147930 - DNA, 25 bp, Mus musculus
agaccttcgggagcgttcagtagtg

SEQ ID NO: 147931 - DNA, 25 bp, Mus musculus
agaccttctaccatttattcattgg

SEQ ID NO: 147932 - DNA, 25 bp, Mus musculus
agaccttctaccttttattcattgg

SEQ ID NO: 147933 - DNA, 25 bp, Mus musculus
agaccttctcatcagttcagcttgc

SEQ ID NO: 147934 - DNA, 25 bp, Mus musculus
agaccttctcatgagttcagcttgc

SEQ ID NO: 147935 - DNA, 25 bp, Mus musculus
agaccttctccgcaactgtgaatgg

SEQ ID NO: 147936 - DNA, 25 bp, Mus musculus
agaccttctccggaactgtgaatgg

SEQ ID NO: 147937 - DNA, 25 bp, Mus musculus
agaccttctctcaatcaatcaatca

SEQ ID NO: 147938 - DNA, 25 bp, Mus musculus
agaccttctctctatcaatcaatca

SEQ ID NO: 147939 - DNA, 25 bp, Mus musculus
agaccttctctgcttcatccagtat

SEQ ID NO: 147940 - DNA, 25 bp, Mus musculus
agaccttctctggttcatccagtat

SEQ ID NO: 147941 - DNA, 25 bp, Mus musculus
agaccttctgatccggtacacacat

SEQ ID NO: 147942 - DNA, 25 bp, Mus musculus
agaccttctgatgcggtacacacat

SEQ ID NO: 147943 - DNA, 25 bp, Mus musculus
agaccttctgccaactgtagagcac

SEQ ID NO: 147944 - DNA, 25 bp, Mus musculus
agaccttctgcctactgtagagcac

SEQ ID NO: 147945 - DNA, 25 bp, Mus musculus
agaccttctgctcggtttcaacaag

SEQ ID NO: 147946 - DNA, 25 bp, Mus musculus
agaccttctgctgggtttcaacaag

SEQ ID NO: 147947 - DNA, 25 bp, Mus musculus
agaccttctggtatctctaccataa

SEQ ID NO: 147948 - DNA, 25 bp, Mus musculus
agaccttctggtttctctaccataa

SEQ ID NO: 147949 - DNA, 25 bp, Mus musculus
agaccttctgtacctcttcattatc

SEQ ID NO: 147950 - DNA, 25 bp, Mus musculus
agaccttctgtagctcttcattatc

SEQ ID NO: 147951 - DNA, 25 bp, Mus musculus
agaccttctttcatggactactttg

SEQ ID NO: 147952 - DNA, 25 bp, Mus musculus
agaccttctttcttggactactttg

SEQ ID NO: 147953 - DNA, 25 bp, Mus musculus
agaccttctttgacatacgtttcct

SEQ ID NO: 147954 - DNA, 25 bp, Mus musculus
agaccttctttgtcatacgtttcct

SEQ ID NO: 147955 - DNA, 25 bp, Mus musculus
agaccttcttttccttggtccagtg

SEQ ID NO: 147956 - DNA, 25 bp, Mus musculus
agaccttcttttgcttggtccagtg

SEQ ID NO: 147957 - DNA, 25 bp, Mus musculus
agaccttgaaagactcactttctag

SEQ ID NO: 147958 - DNA, 25 bp, Mus musculus
agaccttgaaagctggttccaggct

SEQ ID NO: 147959 - DNA, 25 bp, Mus musculus
agaccttgaaaggtggttccaggct

SEQ ID NO: 147960 - DNA, 25 bp, Mus musculus
agaccttgaaagtctcactttctag

SEQ ID NO: 147961 - DNA, 25 bp, Mus musculus
agaccttgaacaagctaaactcgag

SEQ ID NO: 147962 - DNA, 25 bp, Mus musculus
agaccttgaacatgctaaactcgag

SEQ ID NO: 147963 - DNA, 25 bp, Mus musculus
agaccttgaatcaccctagtggaaa

SEQ ID NO: 147964 - DNA, 25 bp, Mus musculus
agaccttgaatctccctagtggaaa

SEQ ID NO: 147965 - DNA, 25 bp, Mus musculus
agaccttgacttcgagtgacagtga

SEQ ID NO: 147966 - DNA, 25 bp, Mus musculus
agaccttgacttggagtgacagtga

SEQ ID NO: 147967 - DNA, 25 bp, Mus musculus
agaccttgagaacattctttccctc

SEQ ID NO: 147968 - DNA, 25 bp, Mus musculus
agaccttgagaagattctttccctc

SEQ ID NO: 147969 - DNA, 25 bp, Mus musculus
agaccttgaggtaggctactgttca

SEQ ID NO: 147970 - DNA, 25 bp, Mus musculus
agaccttgaggttggctactgttca

SEQ ID NO: 147971 - DNA, 25 bp, Mus musculus
agaccttgcacaagcagaccctggc

SEQ ID NO: 147972 - DNA, 25 bp, Mus musculus
agaccttgcacatgcagaccctggc

SEQ ID NO: 147973 - DNA, 25 bp, Mus musculus
agaccttgcactctttggacatgct

SEQ ID NO: 147974 - DNA, 25 bp, Mus musculus
agaccttgcactgtttggacatgct

SEQ ID NO: 147975 - DNA, 25 bp, Mus musculus
agaccttgccaacactttgaaagat

SEQ ID NO: 147976 - DNA, 25 bp, Mus musculus
agaccttgccaagactttgaaagat

SEQ ID NO: 147977 - DNA, 25 bp, Mus musculus
agaccttgccccattgagttttatt

SEQ ID NO: 147978 - DNA, 25 bp, Mus musculus
agaccttgcccctttgagttttatt

SEQ ID NO: 147979 - DNA, 25 bp, Mus musculus
agaccttgccttaggacttcataga

SEQ ID NO: 147980 - DNA, 25 bp, Mus musculus
agaccttgccttccgtgtgctgtta

SEQ ID NO: 147981 - DNA, 25 bp, Mus musculus
agaccttgccttgcgtgtgctgtta

SEQ ID NO: 147982 - DNA, 25 bp, Mus musculus
agaccttgcctttggacttcataga

SEQ ID NO: 147983 - DNA, 25 bp, Mus musculus
agaccttgctctaggctgtcctgaa

SEQ ID NO: 147984 - DNA, 25 bp, Mus musculus
agaccttgctcttggctgtcctgaa

SEQ ID NO: 147985 - DNA, 25 bp, Mus musculus
agaccttggaaaacttaggcttatt

SEQ ID NO: 147986 - DNA, 25 bp, Mus musculus
agaccttggaaatcttaggcttatt

SEQ ID NO: 147987 - DNA, 25 bp, Mus musculus
agaccttggactatcctgatttcac

SEQ ID NO: 147988 - DNA, 25 bp, Mus musculus
agaccttggactttcctgatttcac

SEQ ID NO: 147989 - DNA, 25 bp, Mus musculus
agaccttggatacattgcactctgt

SEQ ID NO: 147990 - DNA, 25 bp, Mus musculus
agaccttggatagattgcactctgt

SEQ ID NO: 147991 - DNA, 25 bp, Mus musculus
agaccttggcatcgactgggagctc

SEQ ID NO: 147992 - DNA, 25 bp, Mus musculus
agaccttggcatggactgggagctc

SEQ ID NO: 147993 - DNA, 25 bp, Mus musculus
agaccttggcctatcaactcgaggt

SEQ ID NO: 147994 - DNA, 25 bp, Mus musculus
agaccttggcctttcaactcgaggt

SEQ ID NO: 147995 - DNA, 25 bp, Mus musculus
agaccttgggacactacgatggccc

SEQ ID NO: 147996 - DNA, 25 bp, Mus musculus
agaccttgggactctacgatggccc

SEQ ID NO: 147997 - DNA, 25 bp, Mus musculus
agaccttgggtgacggcatgacgct

SEQ ID NO: 147998 - DNA, 25 bp, Mus musculus
agaccttgggtgtcggcatgacgct

SEQ ID NO: 147999 - DNA, 25 bp, Mus musculus
agaccttggtggatcgacagtcctt

SEQ ID NO: 148000 - DNA, 25 bp, Mus musculus
agaccttggtggttcgacagtcctt

SEQ ID NO: 148001 - DNA, 25 bp, Mus musculus
agaccttgtccaagctaggcaagta

SEQ ID NO: 148002 - DNA, 25 bp, Mus musculus
agaccttgtccatgctaggcaagta

SEQ ID NO: 148003 - DNA, 25 bp, Mus musculus
agaccttgtctcagagcacgaaaca

SEQ ID NO: 148004 - DNA, 25 bp, Mus musculus
agaccttgtctcatacaaagtgtga

SEQ ID NO: 148005 - DNA, 25 bp, Mus musculus
agaccttgtctctgagcacgaaaca

SEQ ID NO: 148006 - DNA, 25 bp, Mus musculus
agaccttgtctcttacaaagtgtga

SEQ ID NO: 148007 - DNA, 25 bp, Mus musculus
agaccttgtgaactcgtcaacgtga

SEQ ID NO: 148008 - DNA, 25 bp, Mus musculus
agaccttgtgaagtcgtcaacgtga

SEQ ID NO: 148009 - DNA, 25 bp, Mus musculus
agaccttgtgacattttgcaacctc

SEQ ID NO: 148010 - DNA, 25 bp, Mus musculus
agaccttgtgacctgtagctgccga

SEQ ID NO: 148011 - DNA, 25 bp, Mus musculus
agaccttgtgacgtgtagctgccga

SEQ ID NO: 148012 - DNA, 25 bp, Mus musculus
agaccttgtgactttttgcaacctc

SEQ ID NO: 148013 - DNA, 25 bp, Mus musculus
agaccttgtggtcagacctgttctt

SEQ ID NO: 148014 - DNA, 25 bp, Mus musculus
agaccttgtggtgagacctgttctt

SEQ ID NO: 148015 - DNA, 25 bp, Mus musculus
agaccttgtgtgagtatgttaatgt

SEQ ID NO: 148016 - DNA, 25 bp, Mus musculus
agaccttgtgtgtgtatgttaatgt

SEQ ID NO: 148017 - DNA, 25 bp, Mus musculus
agacctttaattaggacatgtggag

SEQ ID NO: 148018 - DNA, 25 bp, Mus musculus
agacctttaatttggacatgtggag

SEQ ID NO: 148019 - DNA, 25 bp, Mus musculus
agacctttagttacggctgtccctg

SEQ ID NO: 148020 - DNA, 25 bp, Mus musculus
agacctttagtttcggctgtccctg

SEQ ID NO: 148021 - DNA, 25 bp, Mus musculus
agacctttatcaatcctcagacagt

SEQ ID NO: 148022 - DNA, 25 bp, Mus musculus
agacctttatcattcctcagacagt

SEQ ID NO: 148023 - DNA, 25 bp, Mus musculus
agacctttcaccactggacaagtca

SEQ ID NO: 148024 - DNA, 25 bp, Mus musculus
agacctttcacctctggacaagtca

SEQ ID NO: 148025 - DNA, 25 bp, Mus musculus
agacctttcaggatactcatccaag

SEQ ID NO: 148026 - DNA, 25 bp, Mus musculus
agacctttcaggttactcatccaag

SEQ ID NO: 148027 - DNA, 25 bp, Mus musculus
agacctttcatacagagctttgtgt

SEQ ID NO: 148028 - DNA, 25 bp, Mus musculus
agacctttcatagagagctttgtgt

SEQ ID NO: 148029 - DNA, 25 bp, Mus musculus
agacctttcctcaatgctgccaatg

SEQ ID NO: 148030 - DNA, 25 bp, Mus musculus
agacctttcctcagttgatcttgtt

SEQ ID NO: 148031 - DNA, 25 bp, Mus musculus
agacctttcctctatgctgccaatg

SEQ ID NO: 148032 - DNA, 25 bp, Mus musculus
agacctttcctctgttgatcttgtt

SEQ ID NO: 148033 - DNA, 25 bp, Mus musculus
agacctttccttatggaccctatat

SEQ ID NO: 148034 - DNA, 25 bp, Mus musculus
agacctttccttttggaccctatat

SEQ ID NO: 148035 - DNA, 25 bp, Mus musculus
agacctttctgaaggacagcccaca

SEQ ID NO: 148036 - DNA, 25 bp, Mus musculus
agacctttctgatggacagcccaca

SEQ ID NO: 148037 - DNA, 25 bp, Mus musculus
agacctttgactcatctgcatataa

SEQ ID NO: 148038 - DNA, 25 bp, Mus musculus
agacctttgactgatctgcatataa

SEQ ID NO: 148039 - DNA, 25 bp, Mus musculus
agacctttgagaattcggagcctgt

SEQ ID NO: 148040 - DNA, 25 bp, Mus musculus
agacctttgagatttcggagcctgt

SEQ ID NO: 148041 - DNA, 25 bp, Mus musculus
agacctttgcaaagcatcaattgag

SEQ ID NO: 148042 - DNA, 25 bp, Mus musculus
agacctttgcaatgcatcaattgag

SEQ ID NO: 148043 - DNA, 25 bp, Mus musculus
agacctttgctcatctcagtgagct

SEQ ID NO: 148044 - DNA, 25 bp, Mus musculus
agacctttgctccttggcaggatct

SEQ ID NO: 148045 - DNA, 25 bp, Mus musculus
agacctttgctcgttggcaggatct

SEQ ID NO: 148046 - DNA, 25 bp, Mus musculus
agacctttgctcttctcagtgagct

SEQ ID NO: 148047 - DNA, 25 bp, Mus musculus
agacctttgtagctatagagagaac

SEQ ID NO: 148048 - DNA, 25 bp, Mus musculus
agacctttgtaggtatagagagaac

SEQ ID NO: 148049 - DNA, 25 bp, Mus musculus
agacctttgttaactgctctgtggt

SEQ ID NO: 148050 - DNA, 25 bp, Mus musculus
agacctttgttatctgctctgtggt

SEQ ID NO: 148051 - DNA, 25 bp, Mus musculus
agacctttgtttagtcggtgaggat

SEQ ID NO: 148052 - DNA, 25 bp, Mus musculus
agacctttgttttgtcggtgaggat

SEQ ID NO: 148053 - DNA, 25 bp, Mus musculus
agaccttttctcaggaatcgcgata

SEQ ID NO: 148054 - DNA, 25 bp, Mus musculus
agaccttttctctggaatcgcgata

SEQ ID NO: 148055 - DNA, 25 bp, Mus musculus
agaccttttgcgctgtacagatcga

SEQ ID NO: 148056 - DNA, 25 bp, Mus musculus
agaccttttgcggtgtacagatcga

SEQ ID NO: 148057 - DNA, 25 bp, Mus musculus
agaccttttgctcttagctttcaag

SEQ ID NO: 148058 - DNA, 25 bp, Mus musculus
agaccttttgctgttagctttcaag

SEQ ID NO: 148059 - DNA, 25 bp, Mus musculus
agaccttttggtactgtgtatgtgt

SEQ ID NO: 148060 - DNA, 25 bp, Mus musculus
agaccttttggttctgtgtatgtgt

SEQ ID NO: 148061 - DNA, 25 bp, Mus musculus
agaccttttgtcacatttctttgga

SEQ ID NO: 148062 - DNA, 25 bp, Mus musculus
agaccttttgtctcatttctttgga

SEQ ID NO: 148063 - DNA, 25 bp, Mus musculus
agacctttttataagcttatgcttg

SEQ ID NO: 148064 - DNA, 25 bp, Mus musculus
agacctttttattagcttatgcttg

SEQ ID NO: 148065 - DNA, 25 bp, Mus musculus
agacctttttccattttggtggcag

SEQ ID NO: 148066 - DNA, 25 bp, Mus musculus
agacctttttcctttttggtggcag

SEQ ID NO: 148067 - DNA, 25 bp, Mus musculus
agacctttttctcttagggagcaat

SEQ ID NO: 148068 - DNA, 25 bp, Mus musculus
agacctttttctgttagggagcaat

SEQ ID NO: 148069 - DNA, 25 bp, Mus musculus
agaccttttttcatagagaccactg

SEQ ID NO: 148070 - DNA, 25 bp, Mus musculus
agaccttttttcttagagaccactg

SEQ ID NO: 148071 - DNA, 25 bp, Mus musculus
agacgaaaagccacctcggtttgct

SEQ ID NO: 148072 - DNA, 25 bp, Mus musculus
agacgaaaagcctcctcggtttgct

SEQ ID NO: 148073 - DNA, 25 bp, Mus musculus
agacgaaagactcatgccgactccc

SEQ ID NO: 148074 - DNA, 25 bp, Mus musculus
agacgaaagactgatgccgactccc

SEQ ID NO: 148075 - DNA, 25 bp, Mus musculus
agacgaaatcttagcttgacaagct

SEQ ID NO: 148076 - DNA, 25 bp, Mus musculus
agacgaaatctttgcttgacaagct

SEQ ID NO: 148077 - DNA, 25 bp, Mus musculus
agacgaacacggatgccgggtgtca

SEQ ID NO: 148078 - DNA, 25 bp, Mus musculus
agacgaacacggttgccgggtgtca

SEQ ID NO: 148079 - DNA, 25 bp, Mus musculus
agacgaacgaatatactgactttgt

SEQ ID NO: 148080 - DNA, 25 bp, Mus musculus
agacgaacgaatttactgactttgt

SEQ ID NO: 148081 - DNA, 25 bp, Mus musculus
agacgaacggctatctcaacggcta

SEQ ID NO: 148082 - DNA, 25 bp, Mus musculus
agacgaacggctttctcaacggcta

SEQ ID NO: 148083 - DNA, 25 bp, Mus musculus
agacgaacttctagtctcgggcttg

SEQ ID NO: 148084 - DNA, 25 bp, Mus musculus
agacgaacttcttgtctcgggcttg

SEQ ID NO: 148085 - DNA, 25 bp, Mus musculus
agacgaagactgcttgtttctccta

SEQ ID NO: 148086 - DNA, 25 bp, Mus musculus
agacgaagactggttgtttctccta

SEQ ID NO: 148087 - DNA, 25 bp, Mus musculus
agacgaagggtcatcacctgagccg

SEQ ID NO: 148088 - DNA, 25 bp, Mus musculus
agacgaagggtcttcacctgagccg

SEQ ID NO: 148089 - DNA, 25 bp, Mus musculus
agacgaagtccactgttgcgtgcac

SEQ ID NO: 148090 - DNA, 25 bp, Mus musculus
agacgaagtccagtgttgcgtgcac

SEQ ID NO: 148091 - DNA, 25 bp, Mus musculus
agacgaagtgcccttagttgctcca

SEQ ID NO: 148092 - DNA, 25 bp, Mus musculus
agacgaagtgccgttagttgctcca

SEQ ID NO: 148093 - DNA, 25 bp, Mus musculus
agacgaattcgcattgaccccggtg

SEQ ID NO: 148094 - DNA, 25 bp, Mus musculus
agacgaattcgctttgaccccggtg

SEQ ID NO: 148095 - DNA, 25 bp, Mus musculus
agacgaatttatcagcagcttccag

SEQ ID NO: 148096 - DNA, 25 bp, Mus musculus
agacgaatttatgagcagcttccag

SEQ ID NO: 148097 - DNA, 25 bp, Mus musculus
agacgaatttgcacactgtgctgta

SEQ ID NO: 148098 - DNA, 25 bp, Mus musculus
agacgaatttgctcactgtgctgta

SEQ ID NO: 148099 - DNA, 25 bp, Mus musculus
agacgacaaggaaatctgactcttc

SEQ ID NO: 148100 - DNA, 25 bp, Mus musculus
agacgacaaggatatctgactcttc

SEQ ID NO: 148101 - DNA, 25 bp, Mus musculus
agacgacactctacagacgctcaag

SEQ ID NO: 148102 - DNA, 25 bp, Mus musculus
agacgacactcttcagacgctcaag

SEQ ID NO: 148103 - DNA, 25 bp, Mus musculus
agacgacagacaagagcccaacatt

SEQ ID NO: 148104 - DNA, 25 bp, Mus musculus
agacgacagacatgagcccaacatt

SEQ ID NO: 148105 - DNA, 25 bp, Mus musculus
agacgacagtgaacactcctccaga

SEQ ID NO: 148106 - DNA, 25 bp, Mus musculus
agacgacagtgatcactcctccaga

SEQ ID NO: 148107 - DNA, 25 bp, Mus musculus
agacgacatgacctttgccgagcaa

SEQ ID NO: 148108 - DNA, 25 bp, Mus musculus
agacgacatgacgtttgccgagcaa

SEQ ID NO: 148109 - DNA, 25 bp, Mus musculus
agacgacatggcagctttgaccaga

SEQ ID NO: 148110 - DNA, 25 bp, Mus musculus
agacgacatggctgctttgaccaga

SEQ ID NO: 148111 - DNA, 25 bp, Mus musculus
agacgacattgcacacatcagaacc

SEQ ID NO: 148112 - DNA, 25 bp, Mus musculus
agacgacattgctcacatcagaacc

SEQ ID NO: 148113 - DNA, 25 bp, Mus musculus
agacgaccaagcaggaaatcaccag

SEQ ID NO: 148114 - DNA, 25 bp, Mus musculus
agacgaccaagctggaaatcaccag

SEQ ID NO: 148115 - DNA, 25 bp, Mus musculus
agacgaccagaacaactaatcggat

SEQ ID NO: 148116 - DNA, 25 bp, Mus musculus
agacgaccagaagaactaatcggat

SEQ ID NO: 148117 - DNA, 25 bp, Mus musculus
agacgaccatctcggaatcgcggta

SEQ ID NO: 148118 - DNA, 25 bp, Mus musculus
agacgaccatctgggaatcgcggta

SEQ ID NO: 148119 - DNA, 25 bp, Mus musculus
agacgaccggacaacctggatccgt

SEQ ID NO: 148120 - DNA, 25 bp, Mus musculus
agacgaccggactacctggatccgt

SEQ ID NO: 148121 - DNA, 25 bp, Mus musculus
agacgacctcgtcttgccagggtta

SEQ ID NO: 148122 - DNA, 25 bp, Mus musculus
agacgacctcgtgttgccagggtta

SEQ ID NO: 148123 - DNA, 25 bp, Mus musculus
agacgacgcaagcatcagaggccac

SEQ ID NO: 148124 - DNA, 25 bp, Mus musculus
agacgacgcaaggatcagaggccac

SEQ ID NO: 148125 - DNA, 25 bp, Mus musculus
agacgacgcccgagctgcccgtgaa

SEQ ID NO: 148126 - DNA, 25 bp, Mus musculus
agacgacgcccgtgctgcccgtgaa

SEQ ID NO: 148127 - DNA, 25 bp, Mus musculus
agacgacgccgaatactaagaggac

SEQ ID NO: 148128 - DNA, 25 bp, Mus musculus
agacgacgccgattactaagaggac

SEQ ID NO: 148129 - DNA, 25 bp, Mus musculus
agacgacgcggcactggaagcgcaa

SEQ ID NO: 148130 - DNA, 25 bp, Mus musculus
agacgacgcggctctggaagcgcaa

SEQ ID NO: 148131 - DNA, 25 bp, Mus musculus
agacgacggttcatggtgggaccat

SEQ ID NO: 148132 - DNA, 25 bp, Mus musculus
agacgacggttcttggtgggaccat

SEQ ID NO: 148133 - DNA, 25 bp, Mus musculus
agacgactcgtgcactgaccagcca

SEQ ID NO: 148134 - DNA, 25 bp, Mus musculus
agacgactcgtggactgaccagcca

SEQ ID NO: 148135 - DNA, 25 bp, Mus musculus
agacgactggccacgagaggtatct

SEQ ID NO: 148136 - DNA, 25 bp, Mus musculus
agacgactggcctcgagaggtatct

SEQ ID NO: 148137 - DNA, 25 bp, Mus musculus
agacgacttctgacctcatcgattt

SEQ ID NO: 148138 - DNA, 25 bp, Mus musculus
agacgacttctgtcctcatcgattt

SEQ ID NO: 148139 - DNA, 25 bp, Mus musculus
agacgagaagtacctgcccgtagca

SEQ ID NO: 148140 - DNA, 25 bp, Mus musculus
agacgagaagtagctgcccgtagca

SEQ ID NO: 148141 - DNA, 25 bp, Mus musculus
agacgagactttcgcatcagggaat

SEQ ID NO: 148142 - DNA, 25 bp, Mus musculus
agacgagactttggcatcagggaat

SEQ ID NO: 148143 - DNA, 25 bp, Mus musculus
agacgagagaccatcactgagtagc

SEQ ID NO: 148144 - DNA, 25 bp, Mus musculus
agacgagagaccttcactgagtagc

SEQ ID NO: 148145 - DNA, 25 bp, Mus musculus
agacgagagagaccccagactgtgt

SEQ ID NO: 148146 - DNA, 25 bp, Mus musculus
agacgagagagagcccagactgtgt

SEQ ID NO: 148147 - DNA, 25 bp, Mus musculus
agacgagagccaacatcgactgggt

SEQ ID NO: 148148 - DNA, 25 bp, Mus musculus
agacgagagccatcatcgactgggt

SEQ ID NO: 148149 - DNA, 25 bp, Mus musculus
agacgagagtctattctaacttggg

SEQ ID NO: 148150 - DNA, 25 bp, Mus musculus
agacgagagtcttttctaacttggg

SEQ ID NO: 148151 - DNA, 25 bp, Mus musculus
agacgagccaccattgttgagtgaa

SEQ ID NO: 148152 - DNA, 25 bp, Mus musculus
agacgagccacctttgttgagtgaa

SEQ ID NO: 148153 - DNA, 25 bp, Mus musculus
agacgagcccagaggttcctttgcc

SEQ ID NO: 148154 - DNA, 25 bp, Mus musculus
agacgagcccagtggttcctttgcc

SEQ ID NO: 148155 - DNA, 25 bp, Mus musculus
agacgagcggcacacatgtgcgatt

SEQ ID NO: 148156 - DNA, 25 bp, Mus musculus
agacgagcggcagacatgtgcgatt

SEQ ID NO: 148157 - DNA, 25 bp, Mus musculus
agacgagctcagcaacgcacttcat

SEQ ID NO: 148158 - DNA, 25 bp, Mus musculus
agacgagctcaggaacgcacttcat

SEQ ID NO: 148159 - DNA, 25 bp, Mus musculus
agacgagctgacacagtcttctggc

SEQ ID NO: 148160 - DNA, 25 bp, Mus musculus
agacgagctgactcagtcttctggc

SEQ ID NO: 148161 - DNA, 25 bp, Mus musculus
agacgagctgcaagtggactacgag

SEQ ID NO: 148162 - DNA, 25 bp, Mus musculus
agacgagctgcatgtggactacgag

SEQ ID NO: 148163 - DNA, 25 bp, Mus musculus
agacgagctttgcttaaaatcgcac

SEQ ID NO: 148164 - DNA, 25 bp, Mus musculus
agacgagctttggttaaaatcgcac

SEQ ID NO: 148165 - DNA, 25 bp, Mus musculus
agacgaggaagtaccagcatggcct

SEQ ID NO: 148166 - DNA, 25 bp, Mus musculus
agacgaggaagttccagcatggcct

SEQ ID NO: 148167 - DNA, 25 bp, Mus musculus
agacgaggactgcacgccacgttgt

SEQ ID NO: 148168 - DNA, 25 bp, Mus musculus
agacgaggactggacgccacgttgt

SEQ ID NO: 148169 - DNA, 25 bp, Mus musculus
agacgaggagccagaggccaaagaa

SEQ ID NO: 148170 - DNA, 25 bp, Mus musculus
agacgaggagcctgaggccaaagaa

SEQ ID NO: 148171 - DNA, 25 bp, Mus musculus
agacgaggctgacgactactatgat

SEQ ID NO: 148172 - DNA, 25 bp, Mus musculus
agacgaggctgaggactactatgat

SEQ ID NO: 148173 - DNA, 25 bp, Mus musculus
agacgaggcttgctcttgcttctga

SEQ ID NO: 148174 - DNA, 25 bp, Mus musculus
agacgaggcttggtcttgcttctga

SEQ ID NO: 148175 - DNA, 25 bp, Mus musculus
agacgagggttgagcctgccagcct

SEQ ID NO: 148176 - DNA, 25 bp, Mus musculus
agacgagggttgtgcctgccagcct

SEQ ID NO: 148177 - DNA, 25 bp, Mus musculus
agacgaggtcctcttaggcagtatc

SEQ ID NO: 148178 - DNA, 25 bp, Mus musculus
agacgaggtcctgttaggcagtatc

SEQ ID NO: 148179 - DNA, 25 bp, Mus musculus
agacgagtacatccagggctggcct

SEQ ID NO: 148180 - DNA, 25 bp, Mus musculus
agacgagtacatgcagggctggcct

SEQ ID NO: 148181 - DNA, 25 bp, Mus musculus
agacgagtatcccttcaagtaccag

SEQ ID NO: 148182 - DNA, 25 bp, Mus musculus
agacgagtatccgttcaagtaccag

SEQ ID NO: 148183 - DNA, 25 bp, Mus musculus
agacgagtcgatccttcacctggca

SEQ ID NO: 148184 - DNA, 25 bp, Mus musculus
agacgagtcgatgcttcacctggca

SEQ ID NO: 148185 - DNA, 25 bp, Mus musculus
agacgagtctatccagcgctgttac

SEQ ID NO: 148186 - DNA, 25 bp, Mus musculus
agacgagtctatgcagcgctgttac

SEQ ID NO: 148187 - DNA, 25 bp, Mus musculus
agacgagtttctcggacggatcaat

SEQ ID NO: 148188 - DNA, 25 bp, Mus musculus
agacgagtttctgggacggatcaat

SEQ ID NO: 148189 - DNA, 25 bp, Mus musculus
agacgagtttgtactacctagcacc

SEQ ID NO: 148190 - DNA, 25 bp, Mus musculus
agacgagtttgttctacctagcacc

SEQ ID NO: 148191 - DNA, 25 bp, Mus musculus
agacgatacactaacacattgatag

SEQ ID NO: 148192 - DNA, 25 bp, Mus musculus
agacgatacacttacacattgatag

SEQ ID NO: 148193 - DNA, 25 bp, Mus musculus
agacgatacgctctctgcgggacac

SEQ ID NO: 148194 - DNA, 25 bp, Mus musculus
agacgatacgctgtctgcgggacac

SEQ ID NO: 148195 - DNA, 25 bp, Mus musculus
agacgatcaccaagagagagagaga

SEQ ID NO: 148196 - DNA, 25 bp, Mus musculus
agacgatcaccatgagagagagaga

SEQ ID NO: 148197 - DNA, 25 bp, Mus musculus
agacgatcagataccgtcgtagttc

SEQ ID NO: 148198 - DNA, 25 bp, Mus musculus
agacgatcagattccgtcgtagttc

SEQ ID NO: 148199 - DNA, 25 bp, Mus musculus
agacgatcctgccttcgttactggg

SEQ ID NO: 148200 - DNA, 25 bp, Mus musculus
agacgatcctgcgttcgttactggg

SEQ ID NO: 148201 - DNA, 25 bp, Mus musculus
agacgatctaccagggcctttggag

SEQ ID NO: 148202 - DNA, 25 bp, Mus musculus
agacgatctacctgggcctttggag

SEQ ID NO: 148203 - DNA, 25 bp, Mus musculus
agacgatggcataggccacctcaga

SEQ ID NO: 148204 - DNA, 25 bp, Mus musculus
agacgatggcattggccacctcaga

SEQ ID NO: 148205 - DNA, 25 bp, Mus musculus
agacgatggcgaagagagccccttg

SEQ ID NO: 148206 - DNA, 25 bp, Mus musculus
agacgatggcgatgagagccccttg

SEQ ID NO: 148207 - DNA, 25 bp, Mus musculus
agacgatgtgttatgtgccggagat

SEQ ID NO: 148208 - DNA, 25 bp, Mus musculus
agacgatgtgttttgtgccggagat

SEQ ID NO: 148209 - DNA, 25 bp, Mus musculus
agacgattaacaagtccatcacctc

SEQ ID NO: 148210 - DNA, 25 bp, Mus musculus
agacgattaacatgtccatcacctc

SEQ ID NO: 148211 - DNA, 25 bp, Mus musculus
agacgattacaaccggaggcgctgc

SEQ ID NO: 148212 - DNA, 25 bp, Mus musculus
agacgattacaagcggaggcgctgc

SEQ ID NO: 148213 - DNA, 25 bp, Mus musculus
agacgattgcttctcgtactttcgg

SEQ ID NO: 148214 - DNA, 25 bp, Mus musculus
agacgattgcttgtcgtactttcgg

SEQ ID NO: 148215 - DNA, 25 bp, Mus musculus
agacgattgtctctctcttcaggat

SEQ ID NO: 148216 - DNA, 25 bp, Mus musculus
agacgattgtctgtctcttcaggat

SEQ ID NO: 148217 - DNA, 25 bp, Mus musculus
agacgcaaagcaccagttggtgcca

SEQ ID NO: 148218 - DNA, 25 bp, Mus musculus
agacgcaaagcagcagttggtgcca

SEQ ID NO: 148219 - DNA, 25 bp, Mus musculus
agacgcacactgcaggttaccttga

SEQ ID NO: 148220 - DNA, 25 bp, Mus musculus
agacgcacactggaggttaccttga

SEQ ID NO: 148221 - DNA, 25 bp, Mus musculus
agacgcacgtggatgcagttgaccc

SEQ ID NO: 148222 - DNA, 25 bp, Mus musculus
agacgcacgtggttgcagttgaccc

SEQ ID NO: 148223 - DNA, 25 bp, Mus musculus
agacgcagatggaattttttaacct

SEQ ID NO: 148224 - DNA, 25 bp, Mus musculus
agacgcagatggtattttttaacct

SEQ ID NO: 148225 - DNA, 25 bp, Mus musculus
agacgcagccgcagtatgtggcctt

SEQ ID NO: 148226 - DNA, 25 bp, Mus musculus
agacgcagccgctgtatgtggcctt

SEQ ID NO: 148227 - DNA, 25 bp, Mus musculus
agacgcagggctatataccctacga

SEQ ID NO: 148228 - DNA, 25 bp, Mus musculus
agacgcagggctttataccctacga

SEQ ID NO: 148229 - DNA, 25 bp, Mus musculus
agacgcagggttctctccttgctct

SEQ ID NO: 148230 - DNA, 25 bp, Mus musculus
agacgcagggttgtctccttgctct

SEQ ID NO: 148231 - DNA, 25 bp, Mus musculus
agacgcagtacacggcaatgtttgt

SEQ ID NO: 148232 - DNA, 25 bp, Mus musculus
agacgcagtacagggcaatgtttgt

SEQ ID NO: 148233 - DNA, 25 bp, Mus musculus
agacgcagtgcgacgcagtgacgtc

SEQ ID NO: 148234 - DNA, 25 bp, Mus musculus
agacgcagtgcgtcgcagtgacgtc

SEQ ID NO: 148235 - DNA, 25 bp, Mus musculus
agacgcagttatctgtgcaccggca

SEQ ID NO: 148236 - DNA, 25 bp, Mus musculus
agacgcagttatgtgtgcaccggca

SEQ ID NO: 148237 - DNA, 25 bp, Mus musculus
agacgcatgttcatgttccacatca

SEQ ID NO: 148238 - DNA, 25 bp, Mus musculus
agacgcatgttcttgttccacatca

SEQ ID NO: 148239 - DNA, 25 bp, Mus musculus
agacgcattcacaagaggaccccgg

SEQ ID NO: 148240 - DNA, 25 bp, Mus musculus
agacgcattcactagaggaccccgg

SEQ ID NO: 148241 - DNA, 25 bp, Mus musculus
agacgcattctacccaaaatgtcac

SEQ ID NO: 148242 - DNA, 25 bp, Mus musculus
agacgcattctagccaaaatgtcac

SEQ ID NO: 148243 - DNA, 25 bp, Mus musculus
agacgcatttcaactagacccgcgg

SEQ ID NO: 148244 - DNA, 25 bp, Mus musculus
agacgcatttcatctagacccgcgg

SEQ ID NO: 148245 - DNA, 25 bp, Mus musculus
agacgccaagacatctttatatgct

SEQ ID NO: 148246 - DNA, 25 bp, Mus musculus
agacgccaagaccaagccaagactc

SEQ ID NO: 148247 - DNA, 25 bp, Mus musculus
agacgccaagacgaagccaagactc

SEQ ID NO: 148248 - DNA, 25 bp, Mus musculus
agacgccaagacttctttatatgct

SEQ ID NO: 148249 - DNA, 25 bp, Mus musculus
agacgccaagatacccgttgaagat

SEQ ID NO: 148250 - DNA, 25 bp, Mus musculus
agacgccaagattcccgttgaagat

SEQ ID NO: 148251 - DNA, 25 bp, Mus musculus
agacgccaagggaatgtgctttact

SEQ ID NO: 148252 - DNA, 25 bp, Mus musculus
agacgccaagggtatgtgctttact

SEQ ID NO: 148253 - DNA, 25 bp, Mus musculus
agacgccaccagatgaagatgctct

SEQ ID NO: 148254 - DNA, 25 bp, Mus musculus
agacgccaccagttgaagatgctct

SEQ ID NO: 148255 - DNA, 25 bp, Mus musculus
agacgccatcgtaggaaggcttggt

SEQ ID NO: 148256 - DNA, 25 bp, Mus musculus
agacgccatcgttggaaggcttggt

SEQ ID NO: 148257 - DNA, 25 bp, Mus musculus
agacgccatggtcttcacgcaaaag

SEQ ID NO: 148258 - DNA, 25 bp, Mus musculus
agacgccatggtgttcacgcaaaag

SEQ ID NO: 148259 - DNA, 25 bp, Mus musculus
agacgcccaaagactatacctgaca

SEQ ID NO: 148260 - DNA, 25 bp, Mus musculus
agacgcccaaagtctatacctgaca

SEQ ID NO: 148261 - DNA, 25 bp, Mus musculus
agacgcccgtccagtgaactcaagc

SEQ ID NO: 148262 - DNA, 25 bp, Mus musculus
agacgcccgtcctgtgaactcaagc

SEQ ID NO: 148263 - DNA, 25 bp, Mus musculus
agacgccctaaacttgtgtagctca

SEQ ID NO: 148264 - DNA, 25 bp, Mus musculus
agacgccctaaagttgtgtagctca

SEQ ID NO: 148265 - DNA, 25 bp, Mus musculus
agacgccctcaaatccgagaagaag

SEQ ID NO: 148266 - DNA, 25 bp, Mus musculus
agacgccctcaattccgagaagaag

SEQ ID NO: 148267 - DNA, 25 bp, Mus musculus
agacgccgcaggacagaaggctttt

SEQ ID NO: 148268 - DNA, 25 bp, Mus musculus
agacgccgcaggtcagaaggctttt

SEQ ID NO: 148269 - DNA, 25 bp, Mus musculus
agacgccggtggcaaattcagaaat

SEQ ID NO: 148270 - DNA, 25 bp, Mus musculus
agacgccggtgggaaattcagaaat

SEQ ID NO: 148271 - DNA, 25 bp, Mus musculus
agacgccgttgcctttgcggaccga

SEQ ID NO: 148272 - DNA, 25 bp, Mus musculus
agacgccgttgcgtttgcggaccga

SEQ ID NO: 148273 - DNA, 25 bp, Mus musculus
agacgcctctacctgtgggtggaac

SEQ ID NO: 148274 - DNA, 25 bp, Mus musculus
agacgcctctacgtgtgggtggaac

SEQ ID NO: 148275 - DNA, 25 bp, Mus musculus
agacgcctctgaatgccgcagaaga

SEQ ID NO: 148276 - DNA, 25 bp, Mus musculus
agacgcctctgattgccgcagaaga

SEQ ID NO: 148277 - DNA, 25 bp, Mus musculus
agacgcctgggtccattcttgttaa

SEQ ID NO: 148278 - DNA, 25 bp, Mus musculus
agacgcctgggtgcattcttgttaa

SEQ ID NO: 148279 - DNA, 25 bp, Mus musculus
agacgccttgctattgagtttggat

SEQ ID NO: 148280 - DNA, 25 bp, Mus musculus
agacgccttgcttttgagtttggat

SEQ ID NO: 148281 - DNA, 25 bp, Mus musculus
agacgcgagagacgtgcttccgaag

SEQ ID NO: 148282 - DNA, 25 bp, Mus musculus
agacgcgagagaggtgcttccgaag

SEQ ID NO: 148283 - DNA, 25 bp, Mus musculus
agacgcgaggccatgccgaggatcc

SEQ ID NO: 148284 - DNA, 25 bp, Mus musculus
agacgcgaggccttgccgaggatcc

SEQ ID NO: 148285 - DNA, 25 bp, Mus musculus
agacgcgccggcacgcttcctgcga

SEQ ID NO: 148286 - DNA, 25 bp, Mus musculus
agacgcgccggctcgcttcctgcga

SEQ ID NO: 148287 - DNA, 25 bp, Mus musculus
agacgcggtcctcgatatacttcag

SEQ ID NO: 148288 - DNA, 25 bp, Mus musculus
agacgcggtcctggatatacttcag

SEQ ID NO: 148289 - DNA, 25 bp, Mus musculus
agacgcgtaactcctaccagaattt

SEQ ID NO: 148290 - DNA, 25 bp, Mus musculus
agacgcgtaactgctaccagaattt

SEQ ID NO: 148291 - DNA, 25 bp, Mus musculus
agacgcgtcaaaccaaccggcctag

SEQ ID NO: 148292 - DNA, 25 bp, Mus musculus
agacgcgtcaaagcaaccggcctag

SEQ ID NO: 148293 - DNA, 25 bp, Mus musculus
agacgcgttctgcagacgagccaat

SEQ ID NO: 148294 - DNA, 25 bp, Mus musculus
agacgcgttctggagacgagccaat

SEQ ID NO: 148295 - DNA, 25 bp, Mus musculus
agacgcgtttccaggctatcttctc

SEQ ID NO: 148296 - DNA, 25 bp, Mus musculus
agacgcgtttcctggctatcttctc

SEQ ID NO: 148297 - DNA, 25 bp, Mus musculus
agacgctaacctaatctccttaaga

SEQ ID NO: 148298 - DNA, 25 bp, Mus musculus
agacgctaaccttatctccttaaga

SEQ ID NO: 148299 - DNA, 25 bp, Mus musculus
agacgctacaagacttgcccagcta

SEQ ID NO: 148300 - DNA, 25 bp, Mus musculus
agacgctacaagtcttgcccagcta

SEQ ID NO: 148301 - DNA, 25 bp, Mus musculus
agacgctacagtcgcagcttgctca

SEQ ID NO: 148302 - DNA, 25 bp, Mus musculus
agacgctacagtggcagcttgctca

SEQ ID NO: 148303 - DNA, 25 bp, Mus musculus
agacgctagcacaaactgacctggg

SEQ ID NO: 148304 - DNA, 25 bp, Mus musculus
agacgctagcactaactgacctggg

SEQ ID NO: 148305 - DNA, 25 bp, Mus musculus
agacgctcacacagcgttacgtgag

SEQ ID NO: 148306 - DNA, 25 bp, Mus musculus
agacgctcacactgcgttacgtgag

SEQ ID NO: 148307 - DNA, 25 bp, Mus musculus
agacgctcagcgacaaatcaggccc

SEQ ID NO: 148308 - DNA, 25 bp, Mus musculus
agacgctcagcgtcaaatcaggccc

SEQ ID NO: 148309 - DNA, 25 bp, Mus musculus
agacgctccaggcactagcaatggt

SEQ ID NO: 148310 - DNA, 25 bp, Mus musculus
agacgctccagggactagcaatggt

SEQ ID NO: 148311 - DNA, 25 bp, Mus musculus
agacgctccagtatgtccgacggga

SEQ ID NO: 148312 - DNA, 25 bp, Mus musculus
agacgctccagtttgtccgacggga

SEQ ID NO: 148313 - DNA, 25 bp, Mus musculus
agacgctccatacctggcggtgcag

SEQ ID NO: 148314 - DNA, 25 bp, Mus musculus
agacgctccatagctggcggtgcag

SEQ ID NO: 148315 - DNA, 25 bp, Mus musculus
agacgctccatcactgaaaccagga

SEQ ID NO: 148316 - DNA, 25 bp, Mus musculus
agacgctccatctctgaaaccagga

SEQ ID NO: 148317 - DNA, 25 bp, Mus musculus
agacgctcctgcaaatggctcagca

SEQ ID NO: 148318 - DNA, 25 bp, Mus musculus
agacgctcctgctaatggctcagca

SEQ ID NO: 148319 - DNA, 25 bp, Mus musculus
agacgctcctgtatgcccatggaat

SEQ ID NO: 148320 - DNA, 25 bp, Mus musculus
agacgctcctgtttgcccatggaat

SEQ ID NO: 148321 - DNA, 25 bp, Mus musculus
agacgctcctttcggttatttggct

SEQ ID NO: 148322 - DNA, 25 bp, Mus musculus
agacgctcctttgggttatttggct

SEQ ID NO: 148323 - DNA, 25 bp, Mus musculus
agacgctcgatgaggacgctgccca

SEQ ID NO: 148324 - DNA, 25 bp, Mus musculus
agacgctcgatgtggacgctgccca

SEQ ID NO: 148325 - DNA, 25 bp, Mus musculus
agacgctcgcttcggtgcagacgaa

SEQ ID NO: 148326 - DNA, 25 bp, Mus musculus
agacgctcgcttgggtgcagacgaa

SEQ ID NO: 148327 - DNA, 25 bp, Mus musculus
agacgctctagtcggcatcgggaca

SEQ ID NO: 148328 - DNA, 25 bp, Mus musculus
agacgctctagtgggcatcgggaca

SEQ ID NO: 148329 - DNA, 25 bp, Mus musculus
agacgctcttcgagaacctctgggc

SEQ ID NO: 148330 - DNA, 25 bp, Mus musculus
agacgctcttcgtgaacctctgggc

SEQ ID NO: 148331 - DNA, 25 bp, Mus musculus
agacgctgaagcctagaaaagctgg

SEQ ID NO: 148332 - DNA, 25 bp, Mus musculus
agacgctgaagcgtagaaaagctgg

SEQ ID NO: 148333 - DNA, 25 bp, Mus musculus
agacgctgacaaagtggacaatccc

SEQ ID NO: 148334 - DNA, 25 bp, Mus musculus
agacgctgacaatgtggacaatccc

SEQ ID NO: 148335 - DNA, 25 bp, Mus musculus
agacgctgacatcacctctaatgtt

SEQ ID NO: 148336 - DNA, 25 bp, Mus musculus
agacgctgacatgacctctaatgtt

SEQ ID NO: 148337 - DNA, 25 bp, Mus musculus
agacgctgagcccttggagatcatc

SEQ ID NO: 148338 - DNA, 25 bp, Mus musculus
agacgctgagccgttggagatcatc

SEQ ID NO: 148339 - DNA, 25 bp, Mus musculus
agacgctgattcacaaattggttga

SEQ ID NO: 148340 - DNA, 25 bp, Mus musculus
agacgctgattctcaaattggttga

SEQ ID NO: 148341 - DNA, 25 bp, Mus musculus
agacgctgcattccactattccagt

SEQ ID NO: 148342 - DNA, 25 bp, Mus musculus
agacgctgcattgcactattccagt

SEQ ID NO: 148343 - DNA, 25 bp, Mus musculus
agacgctgcctcagtcagttacggg

SEQ ID NO: 148344 - DNA, 25 bp, Mus musculus
agacgctgcctctgtcagttacggg

SEQ ID NO: 148345 - DNA, 25 bp, Mus musculus
agacgctgcgcaaagcggaccacag

SEQ ID NO: 148346 - DNA, 25 bp, Mus musculus
agacgctgcgcaaggagcaggcaca

SEQ ID NO: 148347 - DNA, 25 bp, Mus musculus
agacgctgcgcatagcggaccacag

SEQ ID NO: 148348 - DNA, 25 bp, Mus musculus
agacgctgcgcatggagcaggcaca

SEQ ID NO: 148349 - DNA, 25 bp, Mus musculus
agacgctggactaactgcgcgcggt

SEQ ID NO: 148350 - DNA, 25 bp, Mus musculus
agacgctggactatggctctggaga

SEQ ID NO: 148351 - DNA, 25 bp, Mus musculus
agacgctggacttactgcgcgcggt

SEQ ID NO: 148352 - DNA, 25 bp, Mus musculus
agacgctggactttggctctggaga

SEQ ID NO: 148353 - DNA, 25 bp, Mus musculus
agacgctgggtgctacactgtgtcc

SEQ ID NO: 148354 - DNA, 25 bp, Mus musculus
agacgctgggtggtacactgtgtcc

SEQ ID NO: 148355 - DNA, 25 bp, Mus musculus
agacgctgtgataaccagtctgtgc

SEQ ID NO: 148356 - DNA, 25 bp, Mus musculus
agacgctgtgattaccagtctgtgc

SEQ ID NO: 148357 - DNA, 25 bp, Mus musculus
agacgctgtgttccagagcttctag

SEQ ID NO: 148358 - DNA, 25 bp, Mus musculus
agacgctgtgttgcagagcttctag

SEQ ID NO: 148359 - DNA, 25 bp, Mus musculus
agacgctgttggcactgctcatctt

SEQ ID NO: 148360 - DNA, 25 bp, Mus musculus
agacgctgttgggactgctcatctt

SEQ ID NO: 148361 - DNA, 25 bp, Mus musculus
agacgcttctacaaacaggtgccct

SEQ ID NO: 148362 - DNA, 25 bp, Mus musculus
agacgcttctactaacaggtgccct

SEQ ID NO: 148363 - DNA, 25 bp, Mus musculus
agacgcttggccaggattggagccc

SEQ ID NO: 148364 - DNA, 25 bp, Mus musculus
agacgcttggcctggattggagccc

SEQ ID NO: 148365 - DNA, 25 bp, Mus musculus
agacgctttaggctcggccgagcaa

SEQ ID NO: 148366 - DNA, 25 bp, Mus musculus
agacgctttagggtcggccgagcaa

SEQ ID NO: 148367 - DNA, 25 bp, Mus musculus
agacgcttttctatctctgaaacga

SEQ ID NO: 148368 - DNA, 25 bp, Mus musculus
agacgcttttctttctctgaaacga

SEQ ID NO: 148369 - DNA, 25 bp, Mus musculus
agacggaaaccccacgtacaagcag

SEQ ID NO: 148370 - DNA, 25 bp, Mus musculus
agacggaaacccgacgtacaagcag

SEQ ID NO: 148371 - DNA, 25 bp, Mus musculus
agacggaaagcaacacgcggtgctc

SEQ ID NO: 148372 - DNA, 25 bp, Mus musculus
agacggaaagcatcacgcggtgctc

SEQ ID NO: 148373 - DNA, 25 bp, Mus musculus
agacggaaagcgacctcacctatgg

SEQ ID NO: 148374 - DNA, 25 bp, Mus musculus
agacggaaagcgtcctcacctatgg

SEQ ID NO: 148375 - DNA, 25 bp, Mus musculus
agacggaacaagcttcctgggctct

SEQ ID NO: 148376 - DNA, 25 bp, Mus musculus
agacggaacaaggttcctgggctct

SEQ ID NO: 148377 - DNA, 25 bp, Mus musculus
agacggaaccttactggatgcagag

SEQ ID NO: 148378 - DNA, 25 bp, Mus musculus
agacggaacctttctggatgcagag

SEQ ID NO: 148379 - DNA, 25 bp, Mus musculus
agacggaagcagattcctagtggaa

SEQ ID NO: 148380 - DNA, 25 bp, Mus musculus
agacggaagcagtttcctagtggaa

SEQ ID NO: 148381 - DNA, 25 bp, Mus musculus
agacggaagcccctctgagtgacag

SEQ ID NO: 148382 - DNA, 25 bp, Mus musculus
agacggaagcccgtctgagtgacag

SEQ ID NO: 148383 - DNA, 25 bp, Mus musculus
agacggaagctgctaccaggtcctg

SEQ ID NO: 148384 - DNA, 25 bp, Mus musculus
agacggaagctggtaccaggtcctg

SEQ ID NO: 148385 - DNA, 25 bp, Mus musculus
agacggaagggcatgtgacctttga

SEQ ID NO: 148386 - DNA, 25 bp, Mus musculus
agacggaagggcttgtgacctttga

SEQ ID NO: 148387 - DNA, 25 bp, Mus musculus
agacggaatgcgcttattgtgccct

SEQ ID NO: 148388 - DNA, 25 bp, Mus musculus
agacggaatgcggttattgtgccct

SEQ ID NO: 148389 - DNA, 25 bp, Mus musculus
agacggacacgacggcaccaactgt

SEQ ID NO: 148390 - DNA, 25 bp, Mus musculus
agacggacacgagggcaccaactgt

SEQ ID NO: 148391 - DNA, 25 bp, Mus musculus
agacggacagccagtgaccattcat

SEQ ID NO: 148392 - DNA, 25 bp, Mus musculus
agacggacagcctgtgaccattcat

SEQ ID NO: 148393 - DNA, 25 bp, Mus musculus
agacggacaggaagcatatcttcaa

SEQ ID NO: 148394 - DNA, 25 bp, Mus musculus
agacggacaggatgcatatcttcaa

SEQ ID NO: 148395 - DNA, 25 bp, Mus musculus
agacggaccctgaccctgcatttac

SEQ ID NO: 148396 - DNA, 25 bp, Mus musculus
agacggaccctgtccctgcatttac

SEQ ID NO: 148397 - DNA, 25 bp, Mus musculus
agacggacggacagagcctcagact

SEQ ID NO: 148398 - DNA, 25 bp, Mus musculus
agacggacggactgagcctcagact

SEQ ID NO: 148399 - DNA, 25 bp, Mus musculus
agacggactatcactcggaaactgc

SEQ ID NO: 148400 - DNA, 25 bp, Mus musculus
agacggactatctctcggaaactgc

SEQ ID NO: 148401 - DNA, 25 bp, Mus musculus
agacggactgctctgacacacctcc

SEQ ID NO: 148402 - DNA, 25 bp, Mus musculus
agacggactgctgtgacacacctcc

SEQ ID NO: 148403 - DNA, 25 bp, Mus musculus
agacggacttgaactgactgctctt

SEQ ID NO: 148404 - DNA, 25 bp, Mus musculus
agacggacttgatctgactgctctt

SEQ ID NO: 148405 - DNA, 25 bp, Mus musculus
agacggagagccaccataaggcgaa

SEQ ID NO: 148406 - DNA, 25 bp, Mus musculus
agacggagagcctccataaggcgaa

SEQ ID NO: 148407 - DNA, 25 bp, Mus musculus
agacggagagtgagaccttgctgca

SEQ ID NO: 148408 - DNA, 25 bp, Mus musculus
agacggagagtgtgaccttgctgca

SEQ ID NO: 148409 - DNA, 25 bp, Mus musculus
agacggagcccacttagcttgtcca

SEQ ID NO: 148410 - DNA, 25 bp, Mus musculus
agacggagcccagttagcttgtcca

SEQ ID NO: 148411 - DNA, 25 bp, Mus musculus
agacggaggctcacatgggtgctat

SEQ ID NO: 148412 - DNA, 25 bp, Mus musculus
agacggaggctctcatgggtgctat

SEQ ID NO: 148413 - DNA, 25 bp, Mus musculus
agacggagtgcaattctgcctatca

SEQ ID NO: 148414 - DNA, 25 bp, Mus musculus
agacggagtgcatttctgcctatca

SEQ ID NO: 148415 - DNA, 25 bp, Mus musculus
agacggatgcatctctctgagctcc

SEQ ID NO: 148416 - DNA, 25 bp, Mus musculus
agacggatgcatgtctctgagctcc

SEQ ID NO: 148417 - DNA, 25 bp, Mus musculus
agacggatggcaagcggtcccgaac

SEQ ID NO: 148418 - DNA, 25 bp, Mus musculus
agacggatggcatgcggtcccgaac

SEQ ID NO: 148419 - DNA, 25 bp, Mus musculus
agacggattcccaacgagcgcagca

SEQ ID NO: 148420 - DNA, 25 bp, Mus musculus
agacggattccctacgagcgcagca

SEQ ID NO: 148421 - DNA, 25 bp, Mus musculus
agacggattctgcactcgacttggg

SEQ ID NO: 148422 - DNA, 25 bp, Mus musculus
agacggattctggactcgacttggg

SEQ ID NO: 148423 - DNA, 25 bp, Mus musculus
agacggcaaagactactactatcag

SEQ ID NO: 148424 - DNA, 25 bp, Mus musculus
agacggcaaagagtactactatcag

SEQ ID NO: 148425 - DNA, 25 bp, Mus musculus
agacggcagagaactttaggcaatt

SEQ ID NO: 148426 - DNA, 25 bp, Mus musculus
agacggcagagatctttaggcaatt

SEQ ID NO: 148427 - DNA, 25 bp, Mus musculus
agacggcagtgtactgctctctggc

SEQ ID NO: 148428 - DNA, 25 bp, Mus musculus
agacggcagtgttctgctctctggc

SEQ ID NO: 148429 - DNA, 25 bp, Mus musculus
agacggcatcataactcagctcaca

SEQ ID NO: 148430 - DNA, 25 bp, Mus musculus
agacggcatcattactcagctcaca

SEQ ID NO: 148431 - DNA, 25 bp, Mus musculus
agacggccccagaattagttgacag

SEQ ID NO: 148432 - DNA, 25 bp, Mus musculus
agacggccccagtattagttgacag

SEQ ID NO: 148433 - DNA, 25 bp, Mus musculus
agacggccccggagtggacagcaca

SEQ ID NO: 148434 - DNA, 25 bp, Mus musculus
agacggccccggtgtggacagcaca

SEQ ID NO: 148435 - DNA, 25 bp, Mus musculus
agacggccgagtagttaagagcact

SEQ ID NO: 148436 - DNA, 25 bp, Mus musculus
agacggccgagtcatcagcgctgac

SEQ ID NO: 148437 - DNA, 25 bp, Mus musculus
agacggccgagtgatcagcgctgac

SEQ ID NO: 148438 - DNA, 25 bp, Mus musculus
agacggccgagttgttaagagcact

SEQ ID NO: 148439 - DNA, 25 bp, Mus musculus
agacggccgtggcaagtccaagcat

SEQ ID NO: 148440 - DNA, 25 bp, Mus musculus
agacggccgtgggaagtccaagcat

SEQ ID NO: 148441 - DNA, 25 bp, Mus musculus
agacggcgaggacttctaccccagt

SEQ ID NO: 148442 - DNA, 25 bp, Mus musculus
agacggcgaggagttctaccccagt

SEQ ID NO: 148443 - DNA, 25 bp, Mus musculus
agacggcggaatactcggcgactgc

SEQ ID NO: 148444 - DNA, 25 bp, Mus musculus
agacggcggaattctcggcgactgc

SEQ ID NO: 148445 - DNA, 25 bp, Mus musculus
agacggctctgcaaatcacagggct

SEQ ID NO: 148446 - DNA, 25 bp, Mus musculus
agacggctctgctaatcacagggct

SEQ ID NO: 148447 - DNA, 25 bp, Mus musculus
agacggctgagtagcgacgagcact

SEQ ID NO: 148448 - DNA, 25 bp, Mus musculus
agacggctgagttgcgacgagcact

SEQ ID NO: 148449 - DNA, 25 bp, Mus musculus
agacggctgtctcgctgatgccttc

SEQ ID NO: 148450 - DNA, 25 bp, Mus musculus
agacggctgtctggctgatgccttc

SEQ ID NO: 148451 - DNA, 25 bp, Mus musculus
agacggcttcatcattgagtggtga

SEQ ID NO: 148452 - DNA, 25 bp, Mus musculus
agacggcttcatgattgagtggtga

SEQ ID NO: 148453 - DNA, 25 bp, Mus musculus
agacggcttgtaatgctactgttca

SEQ ID NO: 148454 - DNA, 25 bp, Mus musculus
agacggcttgtattgctactgttca

SEQ ID NO: 148455 - DNA, 25 bp, Mus musculus
agacggcttgtgagactgtttggat

SEQ ID NO: 148456 - DNA, 25 bp, Mus musculus
agacggcttgtgtgactgtttggat

SEQ ID NO: 148457 - DNA, 25 bp, Mus musculus
agacggctttataacctcatacgca

SEQ ID NO: 148458 - DNA, 25 bp, Mus musculus
agacggctttattacctcatacgca

SEQ ID NO: 148459 - DNA, 25 bp, Mus musculus
agacgggacacactctcctcgagga

SEQ ID NO: 148460 - DNA, 25 bp, Mus musculus
agacgggacacagtctcctcgagga

SEQ ID NO: 148461 - DNA, 25 bp, Mus musculus
agacgggacacgcagaaagcttatc

SEQ ID NO: 148462 - DNA, 25 bp, Mus musculus
agacgggacacggagaaagcttatc

SEQ ID NO: 148463 - DNA, 25 bp, Mus musculus
agacgggagatcattgtagcctggc

SEQ ID NO: 148464 - DNA, 25 bp, Mus musculus
agacgggagatctttgtagcctggc

SEQ ID NO: 148465 - DNA, 25 bp, Mus musculus
agacgggagttcacagcatcaccag

SEQ ID NO: 148466 - DNA, 25 bp, Mus musculus
agacgggagttctcagcatcaccag

SEQ ID NO: 148467 - DNA, 25 bp, Mus musculus
agacgggatacaagccttcctttct

SEQ ID NO: 148468 - DNA, 25 bp, Mus musculus
agacgggatacatgccttcctttct

SEQ ID NO: 148469 - DNA, 25 bp, Mus musculus
agacgggatcctcatggccctgagc

SEQ ID NO: 148470 - DNA, 25 bp, Mus musculus
agacgggatcctgatggccctgagc

SEQ ID NO: 148471 - DNA, 25 bp, Mus musculus
agacgggcaagcacgatgtccaggt

SEQ ID NO: 148472 - DNA, 25 bp, Mus musculus
agacgggcaagctcgatgtccaggt

SEQ ID NO: 148473 - DNA, 25 bp, Mus musculus
agacgggcagcaagctcaggttcaa

SEQ ID NO: 148474 - DNA, 25 bp, Mus musculus
agacgggcagcatgctcaggttcaa

SEQ ID NO: 148475 - DNA, 25 bp, Mus musculus
agacgggccaacactgtagctaatg

SEQ ID NO: 148476 - DNA, 25 bp, Mus musculus
agacgggccaactctgtagctaatg

SEQ ID NO: 148477 - DNA, 25 bp, Mus musculus
agacgggcgaatatactcacatcag

SEQ ID NO: 148478 - DNA, 25 bp, Mus musculus
agacgggcgaatttactcacatcag

SEQ ID NO: 148479 - DNA, 25 bp, Mus musculus
agacgggctcacacattcagccatc

SEQ ID NO: 148480 - DNA, 25 bp, Mus musculus
agacgggctcactcattcagccatc

SEQ ID NO: 148481 - DNA, 25 bp, Mus musculus
agacgggctggcacagcgcaacctg

SEQ ID NO: 148482 - DNA, 25 bp, Mus musculus
agacgggctggctcagcgcaacctg

SEQ ID NO: 148483 - DNA, 25 bp, Mus musculus
agacgggctgtgattatactgataa

SEQ ID NO: 148484 - DNA, 25 bp, Mus musculus
agacgggctgtgtttatactgataa

SEQ ID NO: 148485 - DNA, 25 bp, Mus musculus
agacgggcttgactttttggaccat

SEQ ID NO: 148486 - DNA, 25 bp, Mus musculus
agacgggcttgagtttttggaccat

SEQ ID NO: 148487 - DNA, 25 bp, Mus musculus
agacgggtacatcggtgccacttta

SEQ ID NO: 148488 - DNA, 25 bp, Mus musculus
agacgggtacatgggtgccacttta

SEQ ID NO: 148489 - DNA, 25 bp, Mus musculus
agacgggtccacagccacgtgtgtc

SEQ ID NO: 148490 - DNA, 25 bp, Mus musculus
agacgggtccactgccacgtgtgtc

SEQ ID NO: 148491 - DNA, 25 bp, Mus musculus
agacgggtgcagagcccgcccgcca

SEQ ID NO: 148492 - DNA, 25 bp, Mus musculus
agacgggtgcagtgcccgcccgcca

SEQ ID NO: 148493 - DNA, 25 bp, Mus musculus
agacgggtgctgacccatccagaac

SEQ ID NO: 148494 - DNA, 25 bp, Mus musculus
agacgggtgctgtcccatccagaac

SEQ ID NO: 148495 - DNA, 25 bp, Mus musculus
agacgggtggagacttgtgccaaat

SEQ ID NO: 148496 - DNA, 25 bp, Mus musculus
agacgggtggagtcttgtgccaaat

SEQ ID NO: 148497 - DNA, 25 bp, Mus musculus
agacggtagaccagcattgcagcac

SEQ ID NO: 148498 - DNA, 25 bp, Mus musculus
agacggtagacctgcattgcagcac

SEQ ID NO: 148499 - DNA, 25 bp, Mus musculus
agacggtcagacacttagcctgggt

SEQ ID NO: 148500 - DNA, 25 bp, Mus musculus
agacggtcagactcttagcctgggt

SEQ ID NO: 148501 - DNA, 25 bp, Mus musculus
agacggtcagcaacagcacgggtga

SEQ ID NO: 148502 - DNA, 25 bp, Mus musculus
agacggtcagcaacgaggtcaagga

SEQ ID NO: 148503 - DNA, 25 bp, Mus musculus
agacggtcagcatcagcacgggtga

SEQ ID NO: 148504 - DNA, 25 bp, Mus musculus
agacggtcagcatcgaggtcaagga

SEQ ID NO: 148505 - DNA, 25 bp, Mus musculus
agacggtccagtattgaggatccaa

SEQ ID NO: 148506 - DNA, 25 bp, Mus musculus
agacggtccagttttgaggatccaa

SEQ ID NO: 148507 - DNA, 25 bp, Mus musculus
agacggtcgaacaactgcgcagggt

SEQ ID NO: 148508 - DNA, 25 bp, Mus musculus
agacggtcgaactactgcgcagggt

SEQ ID NO: 148509 - DNA, 25 bp, Mus musculus
agacggtctcaccatatacctctgt

SEQ ID NO: 148510 - DNA, 25 bp, Mus musculus
agacggtctcacgatatacctctgt

SEQ ID NO: 148511 - DNA, 25 bp, Mus musculus
agacggtctctcactgacactggag

SEQ ID NO: 148512 - DNA, 25 bp, Mus musculus
agacggtctctctctgacactggag

SEQ ID NO: 148513 - DNA, 25 bp, Mus musculus
agacggtgaacaagatgtccctgca

SEQ ID NO: 148514 - DNA, 25 bp, Mus musculus
agacggtgaacatgatgtccctgca

SEQ ID NO: 148515 - DNA, 25 bp, Mus musculus
agacggtgaccgaggtgccttggcc

SEQ ID NO: 148516 - DNA, 25 bp, Mus musculus
agacggtgaccgtggtgccttggcc

SEQ ID NO: 148517 - DNA, 25 bp, Mus musculus
agacggtgaggcagttcacagccct

SEQ ID NO: 148518 - DNA, 25 bp, Mus musculus
agacggtgaggctgttcacagccct

SEQ ID NO: 148519 - DNA, 25 bp, Mus musculus
agacggtggtggatgaatatactca

SEQ ID NO: 148520 - DNA, 25 bp, Mus musculus
agacggtggtggttgaatatactca

SEQ ID NO: 148521 - DNA, 25 bp, Mus musculus
agacggtgttctcagattgcaaggt

SEQ ID NO: 148522 - DNA, 25 bp, Mus musculus
agacggtgttctgagattgcaaggt

SEQ ID NO: 148523 - DNA, 25 bp, Mus musculus
agacggttactgacaaagtgccaca

SEQ ID NO: 148524 - DNA, 25 bp, Mus musculus
agacggttactgtcaaagtgccaca

SEQ ID NO: 148525 - DNA, 25 bp, Mus musculus
agacggttatgtatcttaaactgtc

SEQ ID NO: 148526 - DNA, 25 bp, Mus musculus
agacggttatgtttcttaaactgtc

SEQ ID NO: 148527 - DNA, 25 bp, Mus musculus
agacggttccagaagtctcgacgcc

SEQ ID NO: 148528 - DNA, 25 bp, Mus musculus
agacggttccagtagtctcgacgcc

SEQ ID NO: 148529 - DNA, 25 bp, Mus musculus
agacggttctagatccctttcagct

SEQ ID NO: 148530 - DNA, 25 bp, Mus musculus
agacggttctagttccctttcagct

SEQ ID NO: 148531 - DNA, 25 bp, Mus musculus
agacggttgagtatgagagttttga

SEQ ID NO: 148532 - DNA, 25 bp, Mus musculus
agacggttgagtttgagagttttga

SEQ ID NO: 148533 - DNA, 25 bp, Mus musculus
agacggttgcaaactgttgttgttt

SEQ ID NO: 148534 - DNA, 25 bp, Mus musculus
agacggttgcaatctgttgttgttt

SEQ ID NO: 148535 - DNA, 25 bp, Mus musculus
agacgtaagcaacctctggcttctc

SEQ ID NO: 148536 - DNA, 25 bp, Mus musculus
agacgtaagcaagctctggcttctc

SEQ ID NO: 148537 - DNA, 25 bp, Mus musculus
agacgtaatgccaccacctgatctg

SEQ ID NO: 148538 - DNA, 25 bp, Mus musculus
agacgtaatgcctccacctgatctg

SEQ ID NO: 148539 - DNA, 25 bp, Mus musculus
agacgtaccttcctcaccacagtat

SEQ ID NO: 148540 - DNA, 25 bp, Mus musculus
agacgtaccttcgtcaccacagtat

SEQ ID NO: 148541 - DNA, 25 bp, Mus musculus
agacgtactactaactgcctcagag

SEQ ID NO: 148542 - DNA, 25 bp, Mus musculus
agacgtactacttactgcctcagag

SEQ ID NO: 148543 - DNA, 25 bp, Mus musculus
agacgtagactaccgttctgatagg

SEQ ID NO: 148544 - DNA, 25 bp, Mus musculus
agacgtagactagcgttctgatagg

SEQ ID NO: 148545 - DNA, 25 bp, Mus musculus
agacgtagagccatcccgagcgctg

SEQ ID NO: 148546 - DNA, 25 bp, Mus musculus
agacgtagagccttcccgagcgctg

SEQ ID NO: 148547 - DNA, 25 bp, Mus musculus
agacgtagatcccacacaggctgga

SEQ ID NO: 148548 - DNA, 25 bp, Mus musculus
agacgtagatccgacacaggctgga

SEQ ID NO: 148549 - DNA, 25 bp, Mus musculus
agacgtagcgtcacctctgaaggag

SEQ ID NO: 148550 - DNA, 25 bp, Mus musculus
agacgtagcgtctcctctgaaggag

SEQ ID NO: 148551 - DNA, 25 bp, Mus musculus
agacgtcacgacagatctaacctct

SEQ ID NO: 148552 - DNA, 25 bp, Mus musculus
agacgtcacgactgatctaacctct

SEQ ID NO: 148553 - DNA, 25 bp, Mus musculus
agacgtcactacacagtggcaggca

SEQ ID NO: 148554 - DNA, 25 bp, Mus musculus
agacgtcactactcagtggcaggca

SEQ ID NO: 148555 - DNA, 25 bp, Mus musculus
agacgtcactctaaatgtctcagtg

SEQ ID NO: 148556 - DNA, 25 bp, Mus musculus
agacgtcactctcctccttgagtta

SEQ ID NO: 148557 - DNA, 25 bp, Mus musculus
agacgtcactctgctccttgagtta

SEQ ID NO: 148558 - DNA, 25 bp, Mus musculus
agacgtcactcttaatgtctcagtg

SEQ ID NO: 148559 - DNA, 25 bp, Mus musculus
agacgtcagctaccacaggacttga

SEQ ID NO: 148560 - DNA, 25 bp, Mus musculus
agacgtcagctagcacaggacttga

SEQ ID NO: 148561 - DNA, 25 bp, Mus musculus
agacgtcattacacagagctgcaca

SEQ ID NO: 148562 - DNA, 25 bp, Mus musculus
agacgtcattactcagagctgcaca

SEQ ID NO: 148563 - DNA, 25 bp, Mus musculus
agacgtccattgagcatcaacttca

SEQ ID NO: 148564 - DNA, 25 bp, Mus musculus
agacgtccattgtgcatcaacttca

SEQ ID NO: 148565 - DNA, 25 bp, Mus musculus
agacgtcccagtcctgcagaagtgg

SEQ ID NO: 148566 - DNA, 25 bp, Mus musculus
agacgtcccagtgctgcagaagtgg

SEQ ID NO: 148567 - DNA, 25 bp, Mus musculus
agacgtccccatcttcttacttgga

SEQ ID NO: 148568 - DNA, 25 bp, Mus musculus
agacgtccccatgttcttacttgga

SEQ ID NO: 148569 - DNA, 25 bp, Mus musculus
agacgtccctggatgatggcctaca

SEQ ID NO: 148570 - DNA, 25 bp, Mus musculus
agacgtccctggttgatggcctaca

SEQ ID NO: 148571 - DNA, 25 bp, Mus musculus
agacgtcgcactactgccaggactt

SEQ ID NO: 148572 - DNA, 25 bp, Mus musculus
agacgtcgcacttctgccaggactt

SEQ ID NO: 148573 - DNA, 25 bp, Mus musculus
agacgtcgtgaacacctgccatgat

SEQ ID NO: 148574 - DNA, 25 bp, Mus musculus
agacgtcgtgaagacctgccatgat

SEQ ID NO: 148575 - DNA, 25 bp, Mus musculus
agacgtctacatctatctgtgccaa

SEQ ID NO: 148576 - DNA, 25 bp, Mus musculus
agacgtctacatgtatctgtgccaa

SEQ ID NO: 148577 - DNA, 25 bp, Mus musculus
agacgtctagacaggcatacctatt

SEQ ID NO: 148578 - DNA, 25 bp, Mus musculus
agacgtctagactggcatacctatt

SEQ ID NO: 148579 - DNA, 25 bp, Mus musculus
agacgtctcatcagatagctccatg

SEQ ID NO: 148580 - DNA, 25 bp, Mus musculus
agacgtctcatctgatagctccatg

SEQ ID NO: 148581 - DNA, 25 bp, Mus musculus
agacgtctcctcattaacagtgtta

SEQ ID NO: 148582 - DNA, 25 bp, Mus musculus
agacgtctcctctttaacagtgtta

SEQ ID NO: 148583 - DNA, 25 bp, Mus musculus
agacgtctgcggagtccgagcatga

SEQ ID NO: 148584 - DNA, 25 bp, Mus musculus
agacgtctgcggtgtccgagcatga

SEQ ID NO: 148585 - DNA, 25 bp, Mus musculus
agacgtctgctaaaacgcgcgccaa

SEQ ID NO: 148586 - DNA, 25 bp, Mus musculus
agacgtctgctataacgcgcgccaa

SEQ ID NO: 148587 - DNA, 25 bp, Mus musculus
agacgtcttttgagttccacaccat

SEQ ID NO: 148588 - DNA, 25 bp, Mus musculus
agacgtcttttgtgttccacaccat

SEQ ID NO: 148589 - DNA, 25 bp, Mus musculus
agacgtgaccagaagcgattatgta

SEQ ID NO: 148590 - DNA, 25 bp, Mus musculus
agacgtgaccagtagcgattatgta

SEQ ID NO: 148591 - DNA, 25 bp, Mus musculus
agacgtgaggctcaagttcctaccc

SEQ ID NO: 148592 - DNA, 25 bp, Mus musculus
agacgtgaggctgaagttcctaccc

SEQ ID NO: 148593 - DNA, 25 bp, Mus musculus
agacgtgagttcagtttgtttacat

SEQ ID NO: 148594 - DNA, 25 bp, Mus musculus
agacgtgagttctgtttgtttacat

SEQ ID NO: 148595 - DNA, 25 bp, Mus musculus
agacgtgcaggaagtgtacaccaaa

SEQ ID NO: 148596 - DNA, 25 bp, Mus musculus
agacgtgcaggatgtgtacaccaaa

SEQ ID NO: 148597 - DNA, 25 bp, Mus musculus
agacgtgcaggtatagtccttcctt

SEQ ID NO: 148598 - DNA, 25 bp, Mus musculus
agacgtgcaggtttagtccttcctt

SEQ ID NO: 148599 - DNA, 25 bp, Mus musculus
agacgtggaaagacactgcacatgc

SEQ ID NO: 148600 - DNA, 25 bp, Mus musculus
agacgtggaaagtcactgcacatgc

SEQ ID NO: 148601 - DNA, 25 bp, Mus musculus
agacgtggagagaaccctgactacc

SEQ ID NO: 148602 - DNA, 25 bp, Mus musculus
agacgtggagagtaccctgactacc

SEQ ID NO: 148603 - DNA, 25 bp, Mus musculus
agacgtggcactcgctcatgacagt

SEQ ID NO: 148604 - DNA, 25 bp, Mus musculus
agacgtggcactggctcatgacagt

SEQ ID NO: 148605 - DNA, 25 bp, Mus musculus
agacgtggctcactgcttacagcat

SEQ ID NO: 148606 - DNA, 25 bp, Mus musculus
agacgtggctcagtgcttacagcat

SEQ ID NO: 148607 - DNA, 25 bp, Mus musculus
agacgtggcttaacatactcatggt

SEQ ID NO: 148608 - DNA, 25 bp, Mus musculus
agacgtggcttatcatactcatggt

SEQ ID NO: 148609 - DNA, 25 bp, Mus musculus
agacgtggcttcaaaagtgttccca

SEQ ID NO: 148610 - DNA, 25 bp, Mus musculus
agacgtggcttctaaagtgttccca

SEQ ID NO: 148611 - DNA, 25 bp, Mus musculus
agacgtgggaccaacagcacagaca

SEQ ID NO: 148612 - DNA, 25 bp, Mus musculus
agacgtgggacctacagcacagaca

SEQ ID NO: 148613 - DNA, 25 bp, Mus musculus
agacgtgggtgaaaggctgcactga

SEQ ID NO: 148614 - DNA, 25 bp, Mus musculus
agacgtgggtgataggctgcactga

SEQ ID NO: 148615 - DNA, 25 bp, Mus musculus
agacgtggtgggactccgagtccca

SEQ ID NO: 148616 - DNA, 25 bp, Mus musculus
agacgtggtgggtctccgagtccca

SEQ ID NO: 148617 - DNA, 25 bp, Mus musculus
agacgtgtagggaggacagtccgca

SEQ ID NO: 148618 - DNA, 25 bp, Mus musculus
agacgtgtagggtggacagtccgca

SEQ ID NO: 148619 - DNA, 25 bp, Mus musculus
agacgtgtatttatgtttgctgact

SEQ ID NO: 148620 - DNA, 25 bp, Mus musculus
agacgtgtatttttgtttgctgact

SEQ ID NO: 148621 - DNA, 25 bp, Mus musculus
agacgtgtgagaatacccgctgttt

SEQ ID NO: 148622 - DNA, 25 bp, Mus musculus
agacgtgtgagattacccgctgttt

SEQ ID NO: 148623 - DNA, 25 bp, Mus musculus
agacgtgtgccacacgtaacgtaac

SEQ ID NO: 148624 - DNA, 25 bp, Mus musculus
agacgtgtgccagacgtaacgtaac

SEQ ID NO: 148625 - DNA, 25 bp, Mus musculus
agacgtgtggacaccaatgatgtga

SEQ ID NO: 148626 - DNA, 25 bp, Mus musculus
agacgtgtggactccaatgatgtga

SEQ ID NO: 148627 - DNA, 25 bp, Mus musculus
agacgtgtgtacatcctcgccagag

SEQ ID NO: 148628 - DNA, 25 bp, Mus musculus
agacgtgtgtacttcctcgccagag

SEQ ID NO: 148629 - DNA, 25 bp, Mus musculus
agacgtgttaggctcaacttggcta

SEQ ID NO: 148630 - DNA, 25 bp, Mus musculus
agacgtgttagggtcaacttggcta

SEQ ID NO: 148631 - DNA, 25 bp, Mus musculus
agacgtgttatcatgtgtgctgtca

SEQ ID NO: 148632 - DNA, 25 bp, Mus musculus
agacgtgttatcttgtgtgctgtca

SEQ ID NO: 148633 - DNA, 25 bp, Mus musculus
agacgtgttctgcagtgtccaaact

SEQ ID NO: 148634 - DNA, 25 bp, Mus musculus
agacgtgttctggagtgtccaaact

SEQ ID NO: 148635 - DNA, 25 bp, Mus musculus
agacgttaatctcctggtgacatgc

SEQ ID NO: 148636 - DNA, 25 bp, Mus musculus
agacgttaatctgctggtgacatgc

SEQ ID NO: 148637 - DNA, 25 bp, Mus musculus
agacgttatactatgctgctttatt

SEQ ID NO: 148638 - DNA, 25 bp, Mus musculus
agacgttatactttgctgctttatt

SEQ ID NO: 148639 - DNA, 25 bp, Mus musculus
agacgttatcacacttggctcattt

SEQ ID NO: 148640 - DNA, 25 bp, Mus musculus
agacgttatcactcttggctcattt

SEQ ID NO: 148641 - DNA, 25 bp, Mus musculus
agacgttcagttcgcatactaacct

SEQ ID NO: 148642 - DNA, 25 bp, Mus musculus
agacgttcagttggcatactaacct

SEQ ID NO: 148643 - DNA, 25 bp, Mus musculus
agacgttcctgcctatgctccagca

SEQ ID NO: 148644 - DNA, 25 bp, Mus musculus
agacgttcctgccttgagaaagaat

SEQ ID NO: 148645 - DNA, 25 bp, Mus musculus
agacgttcctgcgtatgctccagca

SEQ ID NO: 148646 - DNA, 25 bp, Mus musculus
agacgttcctgcgttgagaaagaat

SEQ ID NO: 148647 - DNA, 25 bp, Mus musculus
agacgttcctggagttgcagacgct

SEQ ID NO: 148648 - DNA, 25 bp, Mus musculus
agacgttcctggtgttgcagacgct

SEQ ID NO: 148649 - DNA, 25 bp, Mus musculus
agacgttctagcacgcacattttaa

SEQ ID NO: 148650 - DNA, 25 bp, Mus musculus
agacgttctagctcgcacattttaa

SEQ ID NO: 148651 - DNA, 25 bp, Mus musculus
agacgttctctcaatgcctttttta

SEQ ID NO: 148652 - DNA, 25 bp, Mus musculus
agacgttctctctatgcctttttta

SEQ ID NO: 148653 - DNA, 25 bp, Mus musculus
agacgttgcttactctgatcttcat

SEQ ID NO: 148654 - DNA, 25 bp, Mus musculus
agacgttgcttagtctgatcttcat

SEQ ID NO: 148655 - DNA, 25 bp, Mus musculus
agacgttggcagacttggcgttacc

SEQ ID NO: 148656 - DNA, 25 bp, Mus musculus
agacgttggcagtcttggcgttacc

SEQ ID NO: 148657 - DNA, 25 bp, Mus musculus
agacgtttatgcacgtgccacatgc

SEQ ID NO: 148658 - DNA, 25 bp, Mus musculus
agacgtttatgctcgtgccacatgc

SEQ ID NO: 148659 - DNA, 25 bp, Mus musculus
agacgtttcagccagtattgtgcaa

SEQ ID NO: 148660 - DNA, 25 bp, Mus musculus
agacgtttcagcgagtattgtgcaa

SEQ ID NO: 148661 - DNA, 25 bp, Mus musculus
agacgtttgaaacggcaatctgacc

SEQ ID NO: 148662 - DNA, 25 bp, Mus musculus
agacgtttgaaagggcaatctgacc

SEQ ID NO: 148663 - DNA, 25 bp, Mus musculus
agacgtttggcccactgtgagagcc

SEQ ID NO: 148664 - DNA, 25 bp, Mus musculus
agacgtttggccgactgtgagagcc

SEQ ID NO: 148665 - DNA, 25 bp, Mus musculus
agacgtttgggtcggaatgccatca

SEQ ID NO: 148666 - DNA, 25 bp, Mus musculus
agacgtttgggtgggaatgccatca

SEQ ID NO: 148667 - DNA, 25 bp, Mus musculus
agacgttttacacacattcagttta

SEQ ID NO: 148668 - DNA, 25 bp, Mus musculus
agacgttttacagacattcagttta

SEQ ID NO: 148669 - DNA, 25 bp, Mus musculus
agacgttttgtcaccatgttgaata

SEQ ID NO: 148670 - DNA, 25 bp, Mus musculus
agacgttttgtctccatgttgaata

SEQ ID NO: 148671 - DNA, 25 bp, Mus musculus
agactaaaacccactggtgtgcccg

SEQ ID NO: 148672 - DNA, 25 bp, Mus musculus
agactaaaacccctgtgcagctgga

SEQ ID NO: 148673 - DNA, 25 bp, Mus musculus
agactaaaacccgtgtgcagctgga

SEQ ID NO: 148674 - DNA, 25 bp, Mus musculus
agactaaaaccctctggtgtgcccg

SEQ ID NO: 148675 - DNA, 25 bp, Mus musculus
agactaaaatagacccacctgaagg

SEQ ID NO: 148676 - DNA, 25 bp, Mus musculus
agactaaaatagtcccacctgaagg

SEQ ID NO: 148677 - DNA, 25 bp, Mus musculus
agactaaaattaaacctcagatggg

SEQ ID NO: 148678 - DNA, 25 bp, Mus musculus
agactaaaattatacctcagatggg

SEQ ID NO: 148679 - DNA, 25 bp, Mus musculus
agactaaacaataccctgggcaggg

SEQ ID NO: 148680 - DNA, 25 bp, Mus musculus
agactaaacaattccctgggcaggg

SEQ ID NO: 148681 - DNA, 25 bp, Mus musculus
agactaaagagtctgagcaggccct

SEQ ID NO: 148682 - DNA, 25 bp, Mus musculus
agactaaagagtgtgagcaggccct

SEQ ID NO: 148683 - DNA, 25 bp, Mus musculus
agactaaagtccaatcaacgatgag

SEQ ID NO: 148684 - DNA, 25 bp, Mus musculus
agactaaagtcctatcaacgatgag

SEQ ID NO: 148685 - DNA, 25 bp, Mus musculus
agactaaagttgagccttctgagaa

SEQ ID NO: 148686 - DNA, 25 bp, Mus musculus
agactaaagttgtgccttctgagaa

SEQ ID NO: 148687 - DNA, 25 bp, Mus musculus
agactaaatacacacatcctgccag

SEQ ID NO: 148688 - DNA, 25 bp, Mus musculus
agactaaatacagacatcctgccag

SEQ ID NO: 148689 - DNA, 25 bp, Mus musculus
agactaaatgccattactctgctac

SEQ ID NO: 148690 - DNA, 25 bp, Mus musculus
agactaaatgcctttactctgctac

SEQ ID NO: 148691 - DNA, 25 bp, Mus musculus
agactaaccatgctggctcgagtgt

SEQ ID NO: 148692 - DNA, 25 bp, Mus musculus
agactaaccatggtggctcgagtgt

SEQ ID NO: 148693 - DNA, 25 bp, Mus musculus
agactaacctaacttgctttgcctt

SEQ ID NO: 148694 - DNA, 25 bp, Mus musculus
agactaacctaagttgctttgcctt

SEQ ID NO: 148695 - DNA, 25 bp, Mus musculus
agactaacctcacctgactacacag

SEQ ID NO: 148696 - DNA, 25 bp, Mus musculus
agactaacctcagctgactacacag

SEQ ID NO: 148697 - DNA, 25 bp, Mus musculus
agactaacctctaactcagactgcc

SEQ ID NO: 148698 - DNA, 25 bp, Mus musculus
agactaacctcttactcagactgcc

SEQ ID NO: 148699 - DNA, 25 bp, Mus musculus
agactaacgagcacacctactctct

SEQ ID NO: 148700 - DNA, 25 bp, Mus musculus
agactaacgagctcacctactctct

SEQ ID NO: 148701 - DNA, 25 bp, Mus musculus
agactaactaaacctctgaccttgc

SEQ ID NO: 148702 - DNA, 25 bp, Mus musculus
agactaactaaagctctgaccttgc

SEQ ID NO: 148703 - DNA, 25 bp, Mus musculus
agactaacttggaccctctccagag

SEQ ID NO: 148704 - DNA, 25 bp, Mus musculus
agactaacttggtccctctccagag

SEQ ID NO: 148705 - DNA, 25 bp, Mus musculus
agactaagagtcacctggccatcca

SEQ ID NO: 148706 - DNA, 25 bp, Mus musculus
agactaagagtctcctggccatcca

SEQ ID NO: 148707 - DNA, 25 bp, Mus musculus
agactaagattacactttgctcagt

SEQ ID NO: 148708 - DNA, 25 bp, Mus musculus
agactaagattagactttgctcagt

SEQ ID NO: 148709 - DNA, 25 bp, Mus musculus
agactaagcacccacgttttgccag

SEQ ID NO: 148710 - DNA, 25 bp, Mus musculus
agactaagcaccgacgttttgccag

SEQ ID NO: 148711 - DNA, 25 bp, Mus musculus
agactaagcatcacagcataataat

SEQ ID NO: 148712 - DNA, 25 bp, Mus musculus
agactaagcatctcagcataataat

SEQ ID NO: 148713 - DNA, 25 bp, Mus musculus
agactaagttcgacgctggagctgt

SEQ ID NO: 148714 - DNA, 25 bp, Mus musculus
agactaagttcgtcgctggagctgt

SEQ ID NO: 148715 - DNA, 25 bp, Mus musculus
agactaatagtcacttgaaccggga

SEQ ID NO: 148716 - DNA, 25 bp, Mus musculus
agactaatagtctcttgaaccggga

SEQ ID NO: 148717 - DNA, 25 bp, Mus musculus
agactaatgctcctacagctctgtt

SEQ ID NO: 148718 - DNA, 25 bp, Mus musculus
agactaatgctcgtacagctctgtt

SEQ ID NO: 148719 - DNA, 25 bp, Mus musculus
agactaattatcaccgtgacactgc

SEQ ID NO: 148720 - DNA, 25 bp, Mus musculus
agactaattatctccgtgacactgc

SEQ ID NO: 148721 - DNA, 25 bp, Mus musculus
agactaatttggatggattttcaca

SEQ ID NO: 148722 - DNA, 25 bp, Mus musculus
agactaatttggttggattttcaca

SEQ ID NO: 148723 - DNA, 25 bp, Mus musculus
agactacaaacaagcagcttgccgt

SEQ ID NO: 148724 - DNA, 25 bp, Mus musculus
agactacaaacatgcagcttgccgt

SEQ ID NO: 148725 - DNA, 25 bp, Mus musculus
agactacaaagacctcctgagaacc

SEQ ID NO: 148726 - DNA, 25 bp, Mus musculus
agactacaaagagctcctgagaacc

SEQ ID NO: 148727 - DNA, 25 bp, Mus musculus
agactacacaggcttgatcatgaca

SEQ ID NO: 148728 - DNA, 25 bp, Mus musculus
agactacacagggttgatcatgaca

SEQ ID NO: 148729 - DNA, 25 bp, Mus musculus
agactacactgtccccgagcaggtg

SEQ ID NO: 148730 - DNA, 25 bp, Mus musculus
agactacactgtgcccgagcaggtg

SEQ ID NO: 148731 - DNA, 25 bp, Mus musculus
agactacagggcagagctccgggat

SEQ ID NO: 148732 - DNA, 25 bp, Mus musculus
agactacagggctgagctccgggat

SEQ ID NO: 148733 - DNA, 25 bp, Mus musculus
agactacaggtgagttaatgggcat

SEQ ID NO: 148734 - DNA, 25 bp, Mus musculus
agactacaggtgtgttaatgggcat

SEQ ID NO: 148735 - DNA, 25 bp, Mus musculus
agactacatagtagcctcctcgggc

SEQ ID NO: 148736 - DNA, 25 bp, Mus musculus
agactacatagttgcctcctcgggc

SEQ ID NO: 148737 - DNA, 25 bp, Mus musculus
agactacatccaagaacggctgcag

SEQ ID NO: 148738 - DNA, 25 bp, Mus musculus
agactacatccatgaacggctgcag

SEQ ID NO: 148739 - DNA, 25 bp, Mus musculus
agactacatgttattgccgctggaa

SEQ ID NO: 148740 - DNA, 25 bp, Mus musculus
agactacatgtttttgccgctggaa

SEQ ID NO: 148741 - DNA, 25 bp, Mus musculus
agactacattacatcctttgcatca

SEQ ID NO: 148742 - DNA, 25 bp, Mus musculus
agactacattacttcctttgcatca

SEQ ID NO: 148743 - DNA, 25 bp, Mus musculus
agactaccaacgcattactcgcaga

SEQ ID NO: 148744 - DNA, 25 bp, Mus musculus
agactaccaacggattactcgcaga

SEQ ID NO: 148745 - DNA, 25 bp, Mus musculus
agactaccagatatgtaccttcgtg

SEQ ID NO: 148746 - DNA, 25 bp, Mus musculus
agactaccagatttgtaccttcgtg

SEQ ID NO: 148747 - DNA, 25 bp, Mus musculus
agactaccagctacagcttccactt

SEQ ID NO: 148748 - DNA, 25 bp, Mus musculus
agactaccagcttcagcttccactt

SEQ ID NO: 148749 - DNA, 25 bp, Mus musculus
agactaccccagctttatgtttact

SEQ ID NO: 148750 - DNA, 25 bp, Mus musculus
agactaccccaggtttatgtttact

SEQ ID NO: 148751 - DNA, 25 bp, Mus musculus
agactacctaaccaacagtgcttct

SEQ ID NO: 148752 - DNA, 25 bp, Mus musculus
agactacctaacgaacagtgcttct

SEQ ID NO: 148753 - DNA, 25 bp, Mus musculus
agactacctaccacattcggaatta

SEQ ID NO: 148754 - DNA, 25 bp, Mus musculus
agactacctacctcattcggaatta

SEQ ID NO: 148755 - DNA, 25 bp, Mus musculus
agactaccttctcaatggtgggtat

SEQ ID NO: 148756 - DNA, 25 bp, Mus musculus
agactaccttctgaatggtgggtat

SEQ ID NO: 148757 - DNA, 25 bp, Mus musculus
agactacggagcctcagcctaagga

SEQ ID NO: 148758 - DNA, 25 bp, Mus musculus
agactacggagcgtcagcctaagga

SEQ ID NO: 148759 - DNA, 25 bp, Mus musculus
agactacggccaacaggaatctacc

SEQ ID NO: 148760 - DNA, 25 bp, Mus musculus
agactacggccatcaggaatctacc

SEQ ID NO: 148761 - DNA, 25 bp, Mus musculus
agactacgtgcacaaggacccaaag

SEQ ID NO: 148762 - DNA, 25 bp, Mus musculus
agactacgtgcagaaggacccaaag

SEQ ID NO: 148763 - DNA, 25 bp, Mus musculus
agactacgtgtcacaccaagactat

SEQ ID NO: 148764 - DNA, 25 bp, Mus musculus
agactacgtgtctcaccaagactat

SEQ ID NO: 148765 - DNA, 25 bp, Mus musculus
agactactaaacattgacctcccgt

SEQ ID NO: 148766 - DNA, 25 bp, Mus musculus
agactactaaactttgacctcccgt

SEQ ID NO: 148767 - DNA, 25 bp, Mus musculus
agactactaaatccctgcttgcctc

SEQ ID NO: 148768 - DNA, 25 bp, Mus musculus
agactactaaatgcctgcttgcctc

SEQ ID NO: 148769 - DNA, 25 bp, Mus musculus
agactactaagcacattgttcccct

SEQ ID NO: 148770 - DNA, 25 bp, Mus musculus
agactactaagctcattgttcccct

SEQ ID NO: 148771 - DNA, 25 bp, Mus musculus
agactactaccgactgtcacttggt

SEQ ID NO: 148772 - DNA, 25 bp, Mus musculus
agactactaccgtctgtcacttggt

SEQ ID NO: 148773 - DNA, 25 bp, Mus musculus
agactactactgcatgaccggctac

SEQ ID NO: 148774 - DNA, 25 bp, Mus musculus
agactactactggatgaccggctac

SEQ ID NO: 148775 - DNA, 25 bp, Mus musculus
agactactagtcaccggttactctg

SEQ ID NO: 148776 - DNA, 25 bp, Mus musculus
agactactagtctccggttactctg

SEQ ID NO: 148777 - DNA, 25 bp, Mus musculus
agactactatgacctgggctaccac

SEQ ID NO: 148778 - DNA, 25 bp, Mus musculus
agactactatgagctgggctaccac

SEQ ID NO: 148779 - DNA, 25 bp, Mus musculus
agactactattcagcttctacttcc

SEQ ID NO: 148780 - DNA, 25 bp, Mus musculus
agactactattctgcttctacttcc

SEQ ID NO: 148781 - DNA, 25 bp, Mus musculus
agactactccctcccattttatgag

SEQ ID NO: 148782 - DNA, 25 bp, Mus musculus
agactactccctgccattttatgag

SEQ ID NO: 148783 - DNA, 25 bp, Mus musculus
agactactcggccatgatcaagcac

SEQ ID NO: 148784 - DNA, 25 bp, Mus musculus
agactactcggcgatgatcaagcac

SEQ ID NO: 148785 - DNA, 25 bp, Mus musculus
agactactcttcaagaattcatcat

SEQ ID NO: 148786 - DNA, 25 bp, Mus musculus
agactactcttctagaattcatcat

SEQ ID NO: 148787 - DNA, 25 bp, Mus musculus
agactactgaaaagttctcctctga

SEQ ID NO: 148788 - DNA, 25 bp, Mus musculus
agactactgaaatgttctcctctga

SEQ ID NO: 148789 - DNA, 25 bp, Mus musculus
agactactgactagctagagccatt

SEQ ID NO: 148790 - DNA, 25 bp, Mus musculus
agactactgacttgctagagccatt

SEQ ID NO: 148791 - DNA, 25 bp, Mus musculus
agactactgcatatgtccacagctc

SEQ ID NO: 148792 - DNA, 25 bp, Mus musculus
agactactgcatttgtccacagctc

SEQ ID NO: 148793 - DNA, 25 bp, Mus musculus
agactactgtagacagggctactac

SEQ ID NO: 148794 - DNA, 25 bp, Mus musculus
agactactgtagtcagggctactac

SEQ ID NO: 148795 - DNA, 25 bp, Mus musculus
agactacttgccaaacaggttcaaa

SEQ ID NO: 148796 - DNA, 25 bp, Mus musculus
agactacttgcctaacaggttcaaa

SEQ ID NO: 148797 - DNA, 25 bp, Mus musculus
agactactttctatgctaggtgata

SEQ ID NO: 148798 - DNA, 25 bp, Mus musculus
agactactttctttgctaggtgata

SEQ ID NO: 148799 - DNA, 25 bp, Mus musculus
agactagaacccatccagagctgga

SEQ ID NO: 148800 - DNA, 25 bp, Mus musculus
agactagaacccttccagagctgga

SEQ ID NO: 148801 - DNA, 25 bp, Mus musculus
agactagaattcacctctgctcagg

SEQ ID NO: 148802 - DNA, 25 bp, Mus musculus
agactagaattctcctctgctcagg

SEQ ID NO: 148803 - DNA, 25 bp, Mus musculus
agactagactaccttgaactcagag

SEQ ID NO: 148804 - DNA, 25 bp, Mus musculus
agactagactacgttgaactcagag

SEQ ID NO: 148805 - DNA, 25 bp, Mus musculus
agactagagctcaggcacttgctgc

SEQ ID NO: 148806 - DNA, 25 bp, Mus musculus
agactagagctctggcacttgctgc

SEQ ID NO: 148807 - DNA, 25 bp, Mus musculus
agactagaggataatgtgataacac

SEQ ID NO: 148808 - DNA, 25 bp, Mus musculus
agactagaggattatgtgataacac

SEQ ID NO: 148809 - DNA, 25 bp, Mus musculus
agactagatgctacacactgagtga

SEQ ID NO: 148810 - DNA, 25 bp, Mus musculus
agactagatgctacccaatgacggg

SEQ ID NO: 148811 - DNA, 25 bp, Mus musculus
agactagatgcttcacactgagtga

SEQ ID NO: 148812 - DNA, 25 bp, Mus musculus
agactagatgcttcccaatgacggg

SEQ ID NO: 148813 - DNA, 25 bp, Mus musculus
agactagcacccagtgacctaccag

SEQ ID NO: 148814 - DNA, 25 bp, Mus musculus
agactagcaccctgtgacctaccag

SEQ ID NO: 148815 - DNA, 25 bp, Mus musculus
agactagccttcaacttttttatgt

SEQ ID NO: 148816 - DNA, 25 bp, Mus musculus
agactagccttctacttttttatgt

SEQ ID NO: 148817 - DNA, 25 bp, Mus musculus
agactagcctttcagctgtcaggca

SEQ ID NO: 148818 - DNA, 25 bp, Mus musculus
agactagcctttgagctgtcaggca

SEQ ID NO: 148819 - DNA, 25 bp, Mus musculus
agactagctccgctgacttggatca

SEQ ID NO: 148820 - DNA, 25 bp, Mus musculus
agactagctccggtgacttggatca

SEQ ID NO: 148821 - DNA, 25 bp, Mus musculus
agactagctcttacccaagggtata

SEQ ID NO: 148822 - DNA, 25 bp, Mus musculus
agactagctctttcccaagggtata

SEQ ID NO: 148823 - DNA, 25 bp, Mus musculus
agactagctgctaagttccatttat

SEQ ID NO: 148824 - DNA, 25 bp, Mus musculus
agactagctgcttagttccatttat

SEQ ID NO: 148825 - DNA, 25 bp, Mus musculus
agactagcttctcgcaatttggact

SEQ ID NO: 148826 - DNA, 25 bp, Mus musculus
agactagcttctggcaatttggact

SEQ ID NO: 148827 - DNA, 25 bp, Mus musculus
agactagcttgcaagtacgccactg

SEQ ID NO: 148828 - DNA, 25 bp, Mus musculus
agactagcttgctagtacgccactg

SEQ ID NO: 148829 - DNA, 25 bp, Mus musculus
agactaggactgactcacgggtgac

SEQ ID NO: 148830 - DNA, 25 bp, Mus musculus
agactaggactgtctcacgggtgac

SEQ ID NO: 148831 - DNA, 25 bp, Mus musculus
agactaggctgtctgagaactcaca

SEQ ID NO: 148832 - DNA, 25 bp, Mus musculus
agactaggctgtgtgagaactcaca

SEQ ID NO: 148833 - DNA, 25 bp, Mus musculus
agactagggagcatccccatttttg

SEQ ID NO: 148834 - DNA, 25 bp, Mus musculus
agactagggagcttccccatttttg

SEQ ID NO: 148835 - DNA, 25 bp, Mus musculus
agactagggagtatcctgtcctact

SEQ ID NO: 148836 - DNA, 25 bp, Mus musculus
agactagggagtttcctgtcctact

SEQ ID NO: 148837 - DNA, 25 bp, Mus musculus
agactaggtgcacgcaaagatcctt

SEQ ID NO: 148838 - DNA, 25 bp, Mus musculus
agactaggtgcaggcaaagatcctt

SEQ ID NO: 148839 - DNA, 25 bp, Mus musculus
agactagtcatcactctgtaggaat

SEQ ID NO: 148840 - DNA, 25 bp, Mus musculus
agactagtcatctctctgtaggaat

SEQ ID NO: 148841 - DNA, 25 bp, Mus musculus
agactagtccctcgcatgctacaga

SEQ ID NO: 148842 - DNA, 25 bp, Mus musculus
agactagtccctggcatgctacaga

SEQ ID NO: 148843 - DNA, 25 bp, Mus musculus
agactagtctcgctggagtcccgga

SEQ ID NO: 148844 - DNA, 25 bp, Mus musculus
agactagtctcggtggagtcccgga

SEQ ID NO: 148845 - DNA, 25 bp, Mus musculus
agactagtgcctcgaggtcagtctt

SEQ ID NO: 148846 - DNA, 25 bp, Mus musculus
agactagtgcctggaggtcagtctt

SEQ ID NO: 148847 - DNA, 25 bp, Mus musculus
agactagtgcttcctctagatggta

SEQ ID NO: 148848 - DNA, 25 bp, Mus musculus
agactagtgcttgctctagatggta

SEQ ID NO: 148849 - DNA, 25 bp, Mus musculus
agactagttttaagcacgatcccca

SEQ ID NO: 148850 - DNA, 25 bp, Mus musculus
agactagttttatgcacgatcccca

SEQ ID NO: 148851 - DNA, 25 bp, Mus musculus
agactataagccctacccaatgtac

SEQ ID NO: 148852 - DNA, 25 bp, Mus musculus
agactataagccgtacccaatgtac

SEQ ID NO: 148853 - DNA, 25 bp, Mus musculus
agactatactgacctgtctcctaac

SEQ ID NO: 148854 - DNA, 25 bp, Mus musculus
agactatactgagctgtctcctaac

SEQ ID NO: 148855 - DNA, 25 bp, Mus musculus
agactatatatgctggcctctggct

SEQ ID NO: 148856 - DNA, 25 bp, Mus musculus
agactatatatggtggcctctggct

SEQ ID NO: 148857 - DNA, 25 bp, Mus musculus
agactatatcgactgttctgtgtat

SEQ ID NO: 148858 - DNA, 25 bp, Mus musculus
agactatatcgagtgttctgtgtat

SEQ ID NO: 148859 - DNA, 25 bp, Mus musculus
agactatatgtcatttgctcttgtt

SEQ ID NO: 148860 - DNA, 25 bp, Mus musculus
agactatatgtcttttgctcttgtt

SEQ ID NO: 148861 - DNA, 25 bp, Mus musculus
agactatatttgctcatgcccagct

SEQ ID NO: 148862 - DNA, 25 bp, Mus musculus
agactatatttggtcatgcccagct

SEQ ID NO: 148863 - DNA, 25 bp, Mus musculus
agactatcagcacctgcagcggaga

SEQ ID NO: 148864 - DNA, 25 bp, Mus musculus
agactatcagcagctgcagcggaga

SEQ ID NO: 148865 - DNA, 25 bp, Mus musculus
agactatcatttctgccagcattgt

SEQ ID NO: 148866 - DNA, 25 bp, Mus musculus
agactatcatttgtgccagcattgt

SEQ ID NO: 148867 - DNA, 25 bp, Mus musculus
agactatccctcaggtacttgggtt

SEQ ID NO: 148868 - DNA, 25 bp, Mus musculus
agactatccctctggtacttgggtt

SEQ ID NO: 148869 - DNA, 25 bp, Mus musculus
agactatcctatacctgggagacta

SEQ ID NO: 148870 - DNA, 25 bp, Mus musculus
agactatcctattcctgggagacta

SEQ ID NO: 148871 - DNA, 25 bp, Mus musculus
agactatcgtgacccaaccctaaaa

SEQ ID NO: 148872 - DNA, 25 bp, Mus musculus
agactatcgtgagccaaccctaaaa

SEQ ID NO: 148873 - DNA, 25 bp, Mus musculus
agactatcttgcagtgtatagccca

SEQ ID NO: 148874 - DNA, 25 bp, Mus musculus
agactatcttgctgtgtatagccca

SEQ ID NO: 148875 - DNA, 25 bp, Mus musculus
agactatgacaacatccctactgtg

SEQ ID NO: 148876 - DNA, 25 bp, Mus musculus
agactatgacaagatccctactgtg

SEQ ID NO: 148877 - DNA, 25 bp, Mus musculus
agactatgaccacccataacattat

SEQ ID NO: 148878 - DNA, 25 bp, Mus musculus
agactatgaccagccataacattat

SEQ ID NO: 148879 - DNA, 25 bp, Mus musculus
agactatgactccttctcactagac

SEQ ID NO: 148880 - DNA, 25 bp, Mus musculus
agactatgactcgttctcactagac

SEQ ID NO: 148881 - DNA, 25 bp, Mus musculus
agactatgcctaaggagccaccggg

SEQ ID NO: 148882 - DNA, 25 bp, Mus musculus
agactatgcctatggagccaccggg

SEQ ID NO: 148883 - DNA, 25 bp, Mus musculus
agactatggcgcagaaacggattaa

SEQ ID NO: 148884 - DNA, 25 bp, Mus musculus
agactatggcgctgaaacggattaa

SEQ ID NO: 148885 - DNA, 25 bp, Mus musculus
agactatgtgttccttacctaagag

SEQ ID NO: 148886 - DNA, 25 bp, Mus musculus
agactatgtgttgcttacctaagag

SEQ ID NO: 148887 - DNA, 25 bp, Mus musculus
agactattagctcgcattccggcac

SEQ ID NO: 148888 - DNA, 25 bp, Mus musculus
agactattagctggcattccggcac

SEQ ID NO: 148889 - DNA, 25 bp, Mus musculus
agactattcaacagcagatttggac

SEQ ID NO: 148890 - DNA, 25 bp, Mus musculus
agactattcaactgcagatttggac

SEQ ID NO: 148891 - DNA, 25 bp, Mus musculus
agactattcagaagtgatcccactc

SEQ ID NO: 148892 - DNA, 25 bp, Mus musculus
agactattcagatgtgatcccactc

SEQ ID NO: 148893 - DNA, 25 bp, Mus musculus
agactattcaggcagtggtgtgcca

SEQ ID NO: 148894 - DNA, 25 bp, Mus musculus
agactattcagggagtggtgtgcca

SEQ ID NO: 148895 - DNA, 25 bp, Mus musculus
agactattctctccgtgtggacctg

SEQ ID NO: 148896 - DNA, 25 bp, Mus musculus
agactattctctgcgtgtggacctg

SEQ ID NO: 148897 - DNA, 25 bp, Mus musculus
agactattcttgctggagggctgct

SEQ ID NO: 148898 - DNA, 25 bp, Mus musculus
agactattcttggtggagggctgct

SEQ ID NO: 148899 - DNA, 25 bp, Mus musculus
agactattgctaatccagttccaag

SEQ ID NO: 148900 - DNA, 25 bp, Mus musculus
agactattgctattccagttccaag

SEQ ID NO: 148901 - DNA, 25 bp, Mus musculus
agactcaaacccatcgatgcagaca

SEQ ID NO: 148902 - DNA, 25 bp, Mus musculus
agactcaaacccttcgatgcagaca

SEQ ID NO: 148903 - DNA, 25 bp, Mus musculus
agactcaaacttactcatccttgcc

SEQ ID NO: 148904 - DNA, 25 bp, Mus musculus
agactcaaactttctcatccttgcc

SEQ ID NO: 148905 - DNA, 25 bp, Mus musculus
agactcaacactattcagtgccctg

SEQ ID NO: 148906 - DNA, 25 bp, Mus musculus
agactcaacacttttcagtgccctg

SEQ ID NO: 148907 - DNA, 25 bp, Mus musculus
agactcaacttcagttcctgacacc

SEQ ID NO: 148908 - DNA, 25 bp, Mus musculus
agactcaacttctgttcctgacacc

SEQ ID NO: 148909 - DNA, 25 bp, Mus musculus
agactcaacttgcactcgcgtatct

SEQ ID NO: 148910 - DNA, 25 bp, Mus musculus
agactcaacttggactcgcgtatct

SEQ ID NO: 148911 - DNA, 25 bp, Mus musculus
agactcaagaacctggcagaagccc

SEQ ID NO: 148912 - DNA, 25 bp, Mus musculus
agactcaagaacgtggcagaagccc

SEQ ID NO: 148913 - DNA, 25 bp, Mus musculus
agactcaaggacatccctggttcca

SEQ ID NO: 148914 - DNA, 25 bp, Mus musculus
agactcaaggacttccctggttcca

SEQ ID NO: 148915 - DNA, 25 bp, Mus musculus
agactcaaggccagacaagatccga

SEQ ID NO: 148916 - DNA, 25 bp, Mus musculus
agactcaaggcctgacaagatccga

SEQ ID NO: 148917 - DNA, 25 bp, Mus musculus
agactcaagggcagcgcgggactct

SEQ ID NO: 148918 - DNA, 25 bp, Mus musculus
agactcaagggctgcgcgggactct

SEQ ID NO: 148919 - DNA, 25 bp, Mus musculus
agactcaatcttcccacttgttaga

SEQ ID NO: 148920 - DNA, 25 bp, Mus musculus
agactcaatcttgccacttgttaga

SEQ ID NO: 148921 - DNA, 25 bp, Mus musculus
agactcaatgagagccacgtgctgc

SEQ ID NO: 148922 - DNA, 25 bp, Mus musculus
agactcaatgagtgccacgtgctgc

SEQ ID NO: 148923 - DNA, 25 bp, Mus musculus
agactcacacaccaggcttctagaa

SEQ ID NO: 148924 - DNA, 25 bp, Mus musculus
agactcacacacgaggcttctagaa

SEQ ID NO: 148925 - DNA, 25 bp, Mus musculus
agactcacagcaaacctgggtgcac

SEQ ID NO: 148926 - DNA, 25 bp, Mus musculus
agactcacagcatacctgggtgcac

SEQ ID NO: 148927 - DNA, 25 bp, Mus musculus
agactcaccacaatgaccgctgaat

SEQ ID NO: 148928 - DNA, 25 bp, Mus musculus
agactcaccacattgaccgctgaat

SEQ ID NO: 148929 - DNA, 25 bp, Mus musculus
agactcaccagaaattgcagcttag

SEQ ID NO: 148930 - DNA, 25 bp, Mus musculus
agactcaccagatattgcagcttag

SEQ ID NO: 148931 - DNA, 25 bp, Mus musculus
agactcacctagagtttagtgccct

SEQ ID NO: 148932 - DNA, 25 bp, Mus musculus
agactcacctagtgtttagtgccct

SEQ ID NO: 148933 - DNA, 25 bp, Mus musculus
agactcacggtcaggccagaagcag

SEQ ID NO: 148934 - DNA, 25 bp, Mus musculus
agactcacggtctggccagaagcag

SEQ ID NO: 148935 - DNA, 25 bp, Mus musculus
agactcacggtgactttgatggcca

SEQ ID NO: 148936 - DNA, 25 bp, Mus musculus
agactcacggtgtctttgatggcca

SEQ ID NO: 148937 - DNA, 25 bp, Mus musculus
agactcactcaacctccagagagag

SEQ ID NO: 148938 - DNA, 25 bp, Mus musculus
agactcactcaagctccagagagag

SEQ ID NO: 148939 - DNA, 25 bp, Mus musculus
agactcactctaaagctgggctaca

SEQ ID NO: 148940 - DNA, 25 bp, Mus musculus
agactcactctatagctgggctaca

SEQ ID NO: 148941 - DNA, 25 bp, Mus musculus
agactcacttctctggaaacggcct

SEQ ID NO: 148942 - DNA, 25 bp, Mus musculus
agactcacttctgtggaaacggcct

SEQ ID NO: 148943 - DNA, 25 bp, Mus musculus
agactcacttgactgtgccttaaca

SEQ ID NO: 148944 - DNA, 25 bp, Mus musculus
agactcacttgagtgtgccttaaca

SEQ ID NO: 148945 - DNA, 25 bp, Mus musculus
agactcacttgtattacatcccttc

SEQ ID NO: 148946 - DNA, 25 bp, Mus musculus
agactcacttgttttacatcccttc

SEQ ID NO: 148947 - DNA, 25 bp, Mus musculus
agactcagaccaagaggatctggag

SEQ ID NO: 148948 - DNA, 25 bp, Mus musculus
agactcagaccatgaggatctggag

SEQ ID NO: 148949 - DNA, 25 bp, Mus musculus
agactcagacggcccagcagctggt

SEQ ID NO: 148950 - DNA, 25 bp, Mus musculus
agactcagacgggccagcagctggt

SEQ ID NO: 148951 - DNA, 25 bp, Mus musculus
agactcagagagacatctgcctcct

SEQ ID NO: 148952 - DNA, 25 bp, Mus musculus
agactcagagagtcatctgcctcct

SEQ ID NO: 148953 - DNA, 25 bp, Mus musculus
agactcagaggcatgaaccgttact

SEQ ID NO: 148954 - DNA, 25 bp, Mus musculus
agactcagaggcttgaaccgttact

SEQ ID NO: 148955 - DNA, 25 bp, Mus musculus
agactcagatgacccttaagatctc

SEQ ID NO: 148956 - DNA, 25 bp, Mus musculus
agactcagatgagccttaagatctc

SEQ ID NO: 148957 - DNA, 25 bp, Mus musculus
agactcagcagaacctacggagcaa

SEQ ID NO: 148958 - DNA, 25 bp, Mus musculus
agactcagcagatcctacggagcaa

SEQ ID NO: 148959 - DNA, 25 bp, Mus musculus
agactcagcaggaggacatgtccag

SEQ ID NO: 148960 - DNA, 25 bp, Mus musculus
agactcagcaggtggacatgtccag

SEQ ID NO: 148961 - DNA, 25 bp, Mus musculus
agactcagcatcatcacccagtctg

SEQ ID NO: 148962 - DNA, 25 bp, Mus musculus
agactcagcatcttcacccagtctg

SEQ ID NO: 148963 - DNA, 25 bp, Mus musculus
agactcagccaactgatgaagagat

SEQ ID NO: 148964 - DNA, 25 bp, Mus musculus
agactcagccaagtgatgaagagat

SEQ ID NO: 148965 - DNA, 25 bp, Mus musculus
agactcagccatactatgacctagg

SEQ ID NO: 148966 - DNA, 25 bp, Mus musculus
agactcagccattctatgacctagg

SEQ ID NO: 148967 - DNA, 25 bp, Mus musculus
agactcagcctgagtgatcggcctg

SEQ ID NO: 148968 - DNA, 25 bp, Mus musculus
agactcagcctgtgtgatcggcctg

SEQ ID NO: 148969 - DNA, 25 bp, Mus musculus
agactcagctctagactactttcct

SEQ ID NO: 148970 - DNA, 25 bp, Mus musculus
agactcagctcttgactactttcct

SEQ ID NO: 148971 - DNA, 25 bp, Mus musculus
agactcagctgtattattctgcctc

SEQ ID NO: 148972 - DNA, 25 bp, Mus musculus
agactcagctgttttattctgcctc

SEQ ID NO: 148973 - DNA, 25 bp, Mus musculus
agactcaggaaaacatgaccagttt

SEQ ID NO: 148974 - DNA, 25 bp, Mus musculus
agactcaggaaatcatgaccagttt

SEQ ID NO: 148975 - DNA, 25 bp, Mus musculus
agactcaggactcgtgtcaacctat

SEQ ID NO: 148976 - DNA, 25 bp, Mus musculus
agactcaggactggtgtcaacctat

SEQ ID NO: 148977 - DNA, 25 bp, Mus musculus
agactcaggaggcccactgatctgt

SEQ ID NO: 148978 - DNA, 25 bp, Mus musculus
agactcaggagggccactgatctgt

SEQ ID NO: 148979 - DNA, 25 bp, Mus musculus
agactcaggagtcaccttcccttta

SEQ ID NO: 148980 - DNA, 25 bp, Mus musculus
agactcaggagtgaccttcccttta

SEQ ID NO: 148981 - DNA, 25 bp, Mus musculus
agactcaggccaactcgggtggaat

SEQ ID NO: 148982 - DNA, 25 bp, Mus musculus
agactcaggccatctcgggtggaat

SEQ ID NO: 148983 - DNA, 25 bp, Mus musculus
agactcaggcgaagtgctttatggc

SEQ ID NO: 148984 - DNA, 25 bp, Mus musculus
agactcaggcgatgtgctttatggc

SEQ ID NO: 148985 - DNA, 25 bp, Mus musculus
agactcaggcggcatctcggacagc

SEQ ID NO: 148986 - DNA, 25 bp, Mus musculus
agactcaggcgggatctcggacagc

SEQ ID NO: 148987 - DNA, 25 bp, Mus musculus
agactcaggcttctctgttgaactg

SEQ ID NO: 148988 - DNA, 25 bp, Mus musculus
agactcaggcttgtctgttgaactg

SEQ ID NO: 148989 - DNA, 25 bp, Mus musculus
agactcagggaacgcctcaggcctg

SEQ ID NO: 148990 - DNA, 25 bp, Mus musculus
agactcagggaaggcctcaggcctg

SEQ ID NO: 148991 - DNA, 25 bp, Mus musculus
agactcagtcccatgtgaccattat

SEQ ID NO: 148992 - DNA, 25 bp, Mus musculus
agactcagtcccttgtgaccattat

SEQ ID NO: 148993 - DNA, 25 bp, Mus musculus
agactcagtcgccttcatggaacgc

SEQ ID NO: 148994 - DNA, 25 bp, Mus musculus
agactcagtcgcgttcatggaacgc

SEQ ID NO: 148995 - DNA, 25 bp, Mus musculus
agactcagtggacatttgtgcaatt

SEQ ID NO: 148996 - DNA, 25 bp, Mus musculus
agactcagtggagatttgtgcaatt

SEQ ID NO: 148997 - DNA, 25 bp, Mus musculus
agactcagtggcctcattgtgcctg

SEQ ID NO: 148998 - DNA, 25 bp, Mus musculus
agactcagtggcgtcattgtgcctg

SEQ ID NO: 148999 - DNA, 25 bp, Mus musculus
agactcagtgggatgtatttatacg

SEQ ID NO: 149000 - DNA, 25 bp, Mus musculus
agactcagtgggttgtatttatacg

SEQ ID NO: 149001 - DNA, 25 bp, Mus musculus
agactcagtttgaatccaaagctgg

SEQ ID NO: 149002 - DNA, 25 bp, Mus musculus
agactcagtttgtatccaaagctgg

SEQ ID NO: 149003 - DNA, 25 bp, Mus musculus
agactcatctatctggttacttagt

SEQ ID NO: 149004 - DNA, 25 bp, Mus musculus
agactcatctatgtggttacttagt

SEQ ID NO: 149005 - DNA, 25 bp, Mus musculus
agactcatggcaatgtgtgggcaga

SEQ ID NO: 149006 - DNA, 25 bp, Mus musculus
agactcatggcaccagtcaggccca

SEQ ID NO: 149007 - DNA, 25 bp, Mus musculus
agactcatggcagcagtcaggccca

SEQ ID NO: 149008 - DNA, 25 bp, Mus musculus
agactcatggcattgtgtgggcaga

SEQ ID NO: 149009 - DNA, 25 bp, Mus musculus
agactcatgtaaacagttgacctat

SEQ ID NO: 149010 - DNA, 25 bp, Mus musculus
agactcatgtaatcagttgacctat

SEQ ID NO: 149011 - DNA, 25 bp, Mus musculus
agactcattagaactctgtacacaa

SEQ ID NO: 149012 - DNA, 25 bp, Mus musculus
agactcattagatctctgtacacaa

SEQ ID NO: 149013 - DNA, 25 bp, Mus musculus
agactcattgctcggaaaggctaat

SEQ ID NO: 149014 - DNA, 25 bp, Mus musculus
agactcattgctgggaaaggctaat

SEQ ID NO: 149015 - DNA, 25 bp, Mus musculus
agactcattgggattgtcaccctaa

SEQ ID NO: 149016 - DNA, 25 bp, Mus musculus
agactcattgggtttgtcaccctaa

SEQ ID NO: 149017 - DNA, 25 bp, Mus musculus
agactcatttacaaactctgcaaga

SEQ ID NO: 149018 - DNA, 25 bp, Mus musculus
agactcatttactaactctgcaaga

SEQ ID NO: 149019 - DNA, 25 bp, Mus musculus
agactcatttgtaggaagtgccaga

SEQ ID NO: 149020 - DNA, 25 bp, Mus musculus
agactcatttgttggaagtgccaga

SEQ ID NO: 149021 - DNA, 25 bp, Mus musculus
agactccaaagcaccaaattcttgc

SEQ ID NO: 149022 - DNA, 25 bp, Mus musculus
agactccaaagctccaaattcttgc

SEQ ID NO: 149023 - DNA, 25 bp, Mus musculus
agactccaacagagctcaagtgaaa

SEQ ID NO: 149024 - DNA, 25 bp, Mus musculus
agactccaacagtgctcaagtgaaa

SEQ ID NO: 149025 - DNA, 25 bp, Mus musculus
agactccaagagatattcaccgaaa

SEQ ID NO: 149026 - DNA, 25 bp, Mus musculus
agactccaagagttattcaccgaaa

SEQ ID NO: 149027 - DNA, 25 bp, Mus musculus
agactccacaaacatttttccaggg

SEQ ID NO: 149028 - DNA, 25 bp, Mus musculus
agactccacaaagatttttccaggg

SEQ ID NO: 149029 - DNA, 25 bp, Mus musculus
agactccacaccattgtctcattaa

SEQ ID NO: 149030 - DNA, 25 bp, Mus musculus
agactccacacctttgtctcattaa

SEQ ID NO: 149031 - DNA, 25 bp, Mus musculus
agactccaccacatatgcacatttt

SEQ ID NO: 149032 - DNA, 25 bp, Mus musculus
agactccaccacttatgcacatttt

SEQ ID NO: 149033 - DNA, 25 bp, Mus musculus
agactccactgcaggtgtgaaccca

SEQ ID NO: 149034 - DNA, 25 bp, Mus musculus
agactccactgctggtgtgaaccca

SEQ ID NO: 149035 - DNA, 25 bp, Mus musculus
agactccacttgctgctgagggctg

SEQ ID NO: 149036 - DNA, 25 bp, Mus musculus
agactccacttggtgctgagggctg

SEQ ID NO: 149037 - DNA, 25 bp, Mus musculus
agactccagagtcggtgttttgcct

SEQ ID NO: 149038 - DNA, 25 bp, Mus musculus
agactccagagtcttctgttgagca

SEQ ID NO: 149039 - DNA, 25 bp, Mus musculus
agactccagagtgggtgttttgcct

SEQ ID NO: 149040 - DNA, 25 bp, Mus musculus
agactccagagtgttctgttgagca

SEQ ID NO: 149041 - DNA, 25 bp, Mus musculus
agactccagatccttctagacaagt

SEQ ID NO: 149042 - DNA, 25 bp, Mus musculus
agactccagatcgttctagacaagt

SEQ ID NO: 149043 - DNA, 25 bp, Mus musculus
agactccagcaaagtggtacccggc

SEQ ID NO: 149044 - DNA, 25 bp, Mus musculus
agactccagcaatgtggtacccggc

SEQ ID NO: 149045 - DNA, 25 bp, Mus musculus
agactccaggcaagacacacatttc

SEQ ID NO: 149046 - DNA, 25 bp, Mus musculus
agactccaggcaccatgttcagtgt

SEQ ID NO: 149047 - DNA, 25 bp, Mus musculus
agactccaggcagcatgttcagtgt

SEQ ID NO: 149048 - DNA, 25 bp, Mus musculus
agactccaggcatgacacacatttc

SEQ ID NO: 149049 - DNA, 25 bp, Mus musculus
agactccagggaatagggcgtccta

SEQ ID NO: 149050 - DNA, 25 bp, Mus musculus
agactccagggattagggcgtccta

SEQ ID NO: 149051 - DNA, 25 bp, Mus musculus
agactccagtgtagtacaggtccca

SEQ ID NO: 149052 - DNA, 25 bp, Mus musculus
agactccagtgttgtacaggtccca

SEQ ID NO: 149053 - DNA, 25 bp, Mus musculus
agactccatcacactcatcagatga

SEQ ID NO: 149054 - DNA, 25 bp, Mus musculus
agactccatcactctcatcagatga

SEQ ID NO: 149055 - DNA, 25 bp, Mus musculus
agactccatgacaatgacaactctt

SEQ ID NO: 149056 - DNA, 25 bp, Mus musculus
agactccatgactatgacaactctt

SEQ ID NO: 149057 - DNA, 25 bp, Mus musculus
agactccatgcacgtcctttgtaag

SEQ ID NO: 149058 - DNA, 25 bp, Mus musculus
agactccatgcaggtcctttgtaag

SEQ ID NO: 149059 - DNA, 25 bp, Mus musculus
agactccatggcattggcaggcact

SEQ ID NO: 149060 - DNA, 25 bp, Mus musculus
agactccatggctttggcaggcact

SEQ ID NO: 149061 - DNA, 25 bp, Mus musculus
agactccattcgctgttgcattata

SEQ ID NO: 149062 - DNA, 25 bp, Mus musculus
agactccattcggtgttgcattata

SEQ ID NO: 149063 - DNA, 25 bp, Mus musculus
agactccattctaactcattccaac

SEQ ID NO: 149064 - DNA, 25 bp, Mus musculus
agactccattcttactcattccaac

SEQ ID NO: 149065 - DNA, 25 bp, Mus musculus
agactccattgacggtggcccagaa

SEQ ID NO: 149066 - DNA, 25 bp, Mus musculus
agactccattgagggtggcccagaa

SEQ ID NO: 149067 - DNA, 25 bp, Mus musculus
agactcccaacaccgactaatggtc

SEQ ID NO: 149068 - DNA, 25 bp, Mus musculus
agactcccaacagcgactaatggtc

SEQ ID NO: 149069 - DNA, 25 bp, Mus musculus
agactcccagacatttttacactca

SEQ ID NO: 149070 - DNA, 25 bp, Mus musculus
agactcccagacttttttacactca

SEQ ID NO: 149071 - DNA, 25 bp, Mus musculus
agactcccagagacagggtcatgtg

SEQ ID NO: 149072 - DNA, 25 bp, Mus musculus
agactcccagagtcagggtcatgtg

SEQ ID NO: 149073 - DNA, 25 bp, Mus musculus
agactcccagatctttaatgcagaa

SEQ ID NO: 149074 - DNA, 25 bp, Mus musculus
agactcccagatgtttaatgcagaa

SEQ ID NO: 149075 - DNA, 25 bp, Mus musculus
agactcccagctcgctatgaagaaa

SEQ ID NO: 149076 - DNA, 25 bp, Mus musculus
agactcccagctggctatgaagaaa

SEQ ID NO: 149077 - DNA, 25 bp, Mus musculus
agactcccagtgatctgtgtgcctc

SEQ ID NO: 149078 - DNA, 25 bp, Mus musculus
agactcccagtgttctgtgtgcctc

SEQ ID NO: 149079 - DNA, 25 bp, Mus musculus
agactcccatgaatccagcacagaa

SEQ ID NO: 149080 - DNA, 25 bp, Mus musculus
agactcccatgattccagcacagaa

SEQ ID NO: 149081 - DNA, 25 bp, Mus musculus
agactcccatgcacgtgtcatgttt

SEQ ID NO: 149082 - DNA, 25 bp, Mus musculus
agactcccatgctcgtgtcatgttt

SEQ ID NO: 149083 - DNA, 25 bp, Mus musculus
agactcccatttcaaaactcacttg

SEQ ID NO: 149084 - DNA, 25 bp, Mus musculus
agactcccatttgaaaactcacttg

SEQ ID NO: 149085 - DNA, 25 bp, Mus musculus
agactccccataagcaccacaatga

SEQ ID NO: 149086 - DNA, 25 bp, Mus musculus
agactccccatatgcaccacaatga

SEQ ID NO: 149087 - DNA, 25 bp, Mus musculus
agactccccgctcttgattattcaa

SEQ ID NO: 149088 - DNA, 25 bp, Mus musculus
agactccccgctgttgattattcaa

SEQ ID NO: 149089 - DNA, 25 bp, Mus musculus
agactccccgtgaagtggcgcagca

SEQ ID NO: 149090 - DNA, 25 bp, Mus musculus
agactccccgtgtagtggcgcagca

SEQ ID NO: 149091 - DNA, 25 bp, Mus musculus
agactcccctaaccccaggtggaag

SEQ ID NO: 149092 - DNA, 25 bp, Mus musculus
agactcccctaagcccaggtggaag

SEQ ID NO: 149093 - DNA, 25 bp, Mus musculus
agactcccctggatgaactcgcatg

SEQ ID NO: 149094 - DNA, 25 bp, Mus musculus
agactcccctggttgaactcgcatg

SEQ ID NO: 149095 - DNA, 25 bp, Mus musculus
agactcccggacacctcaggcagtg

SEQ ID NO: 149096 - DNA, 25 bp, Mus musculus
agactcccggactcctcaggcagtg

SEQ ID NO: 149097 - DNA, 25 bp, Mus musculus
agactccctgtgcagctgactgctt

SEQ ID NO: 149098 - DNA, 25 bp, Mus musculus
agactccctgtggagctgactgctt

SEQ ID NO: 149099 - DNA, 25 bp, Mus musculus
agactcccttagagaccctgggaga

SEQ ID NO: 149100 - DNA, 25 bp, Mus musculus
agactcccttagtgaccctgggaga

SEQ ID NO: 149101 - DNA, 25 bp, Mus musculus
agactccctttccaagtgattctgg

SEQ ID NO: 149102 - DNA, 25 bp, Mus musculus
agactccctttcgaagtgattctgg

SEQ ID NO: 149103 - DNA, 25 bp, Mus musculus
agactccgaagtcagagccagatct

SEQ ID NO: 149104 - DNA, 25 bp, Mus musculus
agactccgaagtgagagccagatct

SEQ ID NO: 149105 - DNA, 25 bp, Mus musculus
agactccgagggacctctactgtgt

SEQ ID NO: 149106 - DNA, 25 bp, Mus musculus
agactccgagggtcctctactgtgt

SEQ ID NO: 149107 - DNA, 25 bp, Mus musculus
agactccgatctcacagactgtcag

SEQ ID NO: 149108 - DNA, 25 bp, Mus musculus
agactccgatctgacagactgtcag

SEQ ID NO: 149109 - DNA, 25 bp, Mus musculus
agactccggagcatcctagaggaat

SEQ ID NO: 149110 - DNA, 25 bp, Mus musculus
agactccggagcttcctagaggaat

SEQ ID NO: 149111 - DNA, 25 bp, Mus musculus
agactccgggatactggtccgtcag

SEQ ID NO: 149112 - DNA, 25 bp, Mus musculus
agactccgggattctggtccgtcag

SEQ ID NO: 149113 - DNA, 25 bp, Mus musculus
agactccgggctctgcagactgaaa

SEQ ID NO: 149114 - DNA, 25 bp, Mus musculus
agactccgggctgtgcagactgaaa

SEQ ID NO: 149115 - DNA, 25 bp, Mus musculus
agactccggtgccatcacagaggat

SEQ ID NO: 149116 - DNA, 25 bp, Mus musculus
agactccggtgcgatcacagaggat

SEQ ID NO: 149117 - DNA, 25 bp, Mus musculus
agactccgtcagattctgcagaagt

SEQ ID NO: 149118 - DNA, 25 bp, Mus musculus
agactccgtcagtttctgcagaagt

SEQ ID NO: 149119 - DNA, 25 bp, Mus musculus
agactccgtcccactcatctggcgt

SEQ ID NO: 149120 - DNA, 25 bp, Mus musculus
agactccgtccctctcatctggcgt

SEQ ID NO: 149121 - DNA, 25 bp, Mus musculus
agactccgtgaacggtgagcctgtc

SEQ ID NO: 149122 - DNA, 25 bp, Mus musculus
agactccgtgaagggtgagcctgtc

SEQ ID NO: 149123 - DNA, 25 bp, Mus musculus
agactccgttcactgagctcctatg

SEQ ID NO: 149124 - DNA, 25 bp, Mus musculus
agactccgttcagtgagctcctatg

SEQ ID NO: 149125 - DNA, 25 bp, Mus musculus
agactccgtttgatggtgcactgaa

SEQ ID NO: 149126 - DNA, 25 bp, Mus musculus
agactccgtttgttggtgcactgaa

SEQ ID NO: 149127 - DNA, 25 bp, Mus musculus
agactcctacccagcaggcatggag

SEQ ID NO: 149128 - DNA, 25 bp, Mus musculus
agactcctaccctgcaggcatggag

SEQ ID NO: 149129 - DNA, 25 bp, Mus musculus
agactcctacctaatcctagatgaa

SEQ ID NO: 149130 - DNA, 25 bp, Mus musculus
agactcctaccttatcctagatgaa

SEQ ID NO: 149131 - DNA, 25 bp, Mus musculus
agactcctacttaaggccctgaatt

SEQ ID NO: 149132 - DNA, 25 bp, Mus musculus
agactcctactttaggccctgaatt

SEQ ID NO: 149133 - DNA, 25 bp, Mus musculus
agactcctcagcatcattaactcat

SEQ ID NO: 149134 - DNA, 25 bp, Mus musculus
agactcctcagcttcattaactcat

SEQ ID NO: 149135 - DNA, 25 bp, Mus musculus
agactcctcgccagattttggatgg

SEQ ID NO: 149136 - DNA, 25 bp, Mus musculus
agactcctcgcctgattttggatgg

SEQ ID NO: 149137 - DNA, 25 bp, Mus musculus
agactcctctagcaggctgctcctt

SEQ ID NO: 149138 - DNA, 25 bp, Mus musculus
agactcctctagctggcatgatgaa

SEQ ID NO: 149139 - DNA, 25 bp, Mus musculus
agactcctctaggaggctgctcctt

SEQ ID NO: 149140 - DNA, 25 bp, Mus musculus
agactcctctaggtggcatgatgaa

SEQ ID NO: 149141 - DNA, 25 bp, Mus musculus
agactcctgaaccacagacgggatg

SEQ ID NO: 149142 - DNA, 25 bp, Mus musculus
agactcctgaacgacagacgggatg

SEQ ID NO: 149143 - DNA, 25 bp, Mus musculus
agactcctgacgatcaagttcgcag

SEQ ID NO: 149144 - DNA, 25 bp, Mus musculus
agactcctgacgttcaagttcgcag

SEQ ID NO: 149145 - DNA, 25 bp, Mus musculus
agactcctgcagaccagtcacactg

SEQ ID NO: 149146 - DNA, 25 bp, Mus musculus
agactcctgcagaggccagcgtggc

SEQ ID NO: 149147 - DNA, 25 bp, Mus musculus
agactcctgcagtccagtcacactg

SEQ ID NO: 149148 - DNA, 25 bp, Mus musculus
agactcctgcagtggccagcgtggc

SEQ ID NO: 149149 - DNA, 25 bp, Mus musculus
agactcctgggaaacgaagacaaaa

SEQ ID NO: 149150 - DNA, 25 bp, Mus musculus
agactcctgggatacgaagacaaaa

SEQ ID NO: 149151 - DNA, 25 bp, Mus musculus
agactcctgtagattatcctctgac

SEQ ID NO: 149152 - DNA, 25 bp, Mus musculus
agactcctgtagtttatcctctgac

SEQ ID NO: 149153 - DNA, 25 bp, Mus musculus
agactcctgtctccagatgtccgga

SEQ ID NO: 149154 - DNA, 25 bp, Mus musculus
agactcctgtctgcagatgtccgga

SEQ ID NO: 149155 - DNA, 25 bp, Mus musculus
agactcctgtggacagaggcaacct

SEQ ID NO: 149156 - DNA, 25 bp, Mus musculus
agactcctgtggctatgtagaccca

SEQ ID NO: 149157 - DNA, 25 bp, Mus musculus
agactcctgtgggtatgtagaccca

SEQ ID NO: 149158 - DNA, 25 bp, Mus musculus
agactcctgtggtcagaggcaacct

SEQ ID NO: 149159 - DNA, 25 bp, Mus musculus
agactcctgtgtaaaaaccgttgca

SEQ ID NO: 149160 - DNA, 25 bp, Mus musculus
agactcctgtgttaaaaccgttgca

SEQ ID NO: 149161 - DNA, 25 bp, Mus musculus
agactccttaggacactcacacctt

SEQ ID NO: 149162 - DNA, 25 bp, Mus musculus
agactccttaggtcactcacacctt

SEQ ID NO: 149163 - DNA, 25 bp, Mus musculus
agactccttatcacagaccacatct

SEQ ID NO: 149164 - DNA, 25 bp, Mus musculus
agactccttatctcagaccacatct

SEQ ID NO: 149165 - DNA, 25 bp, Mus musculus
agactccttgccaaacttcaagacg

SEQ ID NO: 149166 - DNA, 25 bp, Mus musculus
agactccttgcctaacttcaagacg

SEQ ID NO: 149167 - DNA, 25 bp, Mus musculus
agactccttgctcactcggcgctta

SEQ ID NO: 149168 - DNA, 25 bp, Mus musculus
agactccttgctgactcggcgctta

SEQ ID NO: 149169 - DNA, 25 bp, Mus musculus
agactcctttctaatccctgtaagc

SEQ ID NO: 149170 - DNA, 25 bp, Mus musculus
agactcctttcttatccctgtaagc

SEQ ID NO: 149171 - DNA, 25 bp, Mus musculus
agactcctttgcagtcagatgtgtg

SEQ ID NO: 149172 - DNA, 25 bp, Mus musculus
agactcctttgctgtcagatgtgtg

SEQ ID NO: 149173 - DNA, 25 bp, Mus musculus
agactcgaaattagaactgaccaaa

SEQ ID NO: 149174 - DNA, 25 bp, Mus musculus
agactcgaaatttgaactgaccaaa

SEQ ID NO: 149175 - DNA, 25 bp, Mus musculus
agactcgaagctatgtgtttcctct

SEQ ID NO: 149176 - DNA, 25 bp, Mus musculus
agactcgaagctttgtgtttcctct

SEQ ID NO: 149177 - DNA, 25 bp, Mus musculus
agactcgaccttacagctttgctca

SEQ ID NO: 149178 - DNA, 25 bp, Mus musculus
agactcgacctttcagctttgctca

SEQ ID NO: 149179 - DNA, 25 bp, Mus musculus
agactcgacggtcggcagttgtctt

SEQ ID NO: 149180 - DNA, 25 bp, Mus musculus
agactcgacggtgggcagttgtctt

SEQ ID NO: 149181 - DNA, 25 bp, Mus musculus
agactcgagaaacttactgtgaagt

SEQ ID NO: 149182 - DNA, 25 bp, Mus musculus
agactcgagaaagttactgtgaagt

SEQ ID NO: 149183 - DNA, 25 bp, Mus musculus
agactcgagagcactggttcggcct

SEQ ID NO: 149184 - DNA, 25 bp, Mus musculus
agactcgagagctctggttcggcct

SEQ ID NO: 149185 - DNA, 25 bp, Mus musculus
agactcgaggtcagggcaaggccca

SEQ ID NO: 149186 - DNA, 25 bp, Mus musculus
agactcgaggtctgggcaaggccca

SEQ ID NO: 149187 - DNA, 25 bp, Mus musculus
agactcgagtgaagctgccttcggg

SEQ ID NO: 149188 - DNA, 25 bp, Mus musculus
agactcgagtgatgctgccttcggg

SEQ ID NO: 149189 - DNA, 25 bp, Mus musculus
agactcgagtgtacctgcagtatct

SEQ ID NO: 149190 - DNA, 25 bp, Mus musculus
agactcgagtgttcctgcagtatct

SEQ ID NO: 149191 - DNA, 25 bp, Mus musculus
agactcgctcccattcctgtcagtt

SEQ ID NO: 149192 - DNA, 25 bp, Mus musculus
agactcgctccctttcctgtcagtt

SEQ ID NO: 149193 - DNA, 25 bp, Mus musculus
agactcgctgagagcccagggtcat

SEQ ID NO: 149194 - DNA, 25 bp, Mus musculus
agactcgctgagtgcccagggtcat

SEQ ID NO: 149195 - DNA, 25 bp, Mus musculus
agactcggacacagttgcagggctg

SEQ ID NO: 149196 - DNA, 25 bp, Mus musculus
agactcggacacctctgtggactca

SEQ ID NO: 149197 - DNA, 25 bp, Mus musculus
agactcggacacgtctgtggactca

SEQ ID NO: 149198 - DNA, 25 bp, Mus musculus
agactcggacactgttgcagggctg

SEQ ID NO: 149199 - DNA, 25 bp, Mus musculus
agactcggaccactatgcttgaagt

SEQ ID NO: 149200 - DNA, 25 bp, Mus musculus
agactcggaccagtatgcttgaagt

SEQ ID NO: 149201 - DNA, 25 bp, Mus musculus
agactcggactgaatgcattgtgaa

SEQ ID NO: 149202 - DNA, 25 bp, Mus musculus
agactcggactgtatgcattgtgaa

SEQ ID NO: 149203 - DNA, 25 bp, Mus musculus
agactcggagacattctcttccaga

SEQ ID NO: 149204 - DNA, 25 bp, Mus musculus
agactcggagactttctcttccaga

SEQ ID NO: 149205 - DNA, 25 bp, Mus musculus
agactcggagcgactcatcgggttt

SEQ ID NO: 149206 - DNA, 25 bp, Mus musculus
agactcggagcgtctcatcgggttt

SEQ ID NO: 149207 - DNA, 25 bp, Mus musculus
agactcggatgacgccctactgaag

SEQ ID NO: 149208 - DNA, 25 bp, Mus musculus
agactcggatgaggccctactgaag

SEQ ID NO: 149209 - DNA, 25 bp, Mus musculus
agactcggcaacactagcattgttc

SEQ ID NO: 149210 - DNA, 25 bp, Mus musculus
agactcggcaactctagcattgttc

SEQ ID NO: 149211 - DNA, 25 bp, Mus musculus
agactcgggaggatctgctcagcat

SEQ ID NO: 149212 - DNA, 25 bp, Mus musculus
agactcgggaggttctgctcagcat

SEQ ID NO: 149213 - DNA, 25 bp, Mus musculus
agactcgggatcagtcggtgttagc

SEQ ID NO: 149214 - DNA, 25 bp, Mus musculus
agactcgggatctgtcggtgttagc

SEQ ID NO: 149215 - DNA, 25 bp, Mus musculus
agactcgggatgagggctccaaacc

SEQ ID NO: 149216 - DNA, 25 bp, Mus musculus
agactcgggatgtgggctccaaacc

SEQ ID NO: 149217 - DNA, 25 bp, Mus musculus
agactcgggcagatccagctgtgtg

SEQ ID NO: 149218 - DNA, 25 bp, Mus musculus
agactcgggcagttccagctgtgtg

SEQ ID NO: 149219 - DNA, 25 bp, Mus musculus
agactcggtagtcggaatgacagca

SEQ ID NO: 149220 - DNA, 25 bp, Mus musculus
agactcggtagtgggaatgacagca

SEQ ID NO: 149221 - DNA, 25 bp, Mus musculus
agactcggtgctcaaaacaatccaa

SEQ ID NO: 149222 - DNA, 25 bp, Mus musculus
agactcggtgctgaaaacaatccaa

SEQ ID NO: 149223 - DNA, 25 bp, Mus musculus
agactcggtgtgacagagactgcca

SEQ ID NO: 149224 - DNA, 25 bp, Mus musculus
agactcggtgtgtcagagactgcca

SEQ ID NO: 149225 - DNA, 25 bp, Mus musculus
agactcggttggctcttgttcagag

SEQ ID NO: 149226 - DNA, 25 bp, Mus musculus
agactcggttgggtcttgttcagag

SEQ ID NO: 149227 - DNA, 25 bp, Mus musculus
agactcgtacagatgaccagaccca

SEQ ID NO: 149228 - DNA, 25 bp, Mus musculus
agactcgtacagttgaccagaccca

SEQ ID NO: 149229 - DNA, 25 bp, Mus musculus
agactcgtactcagtccagggtcca

SEQ ID NO: 149230 - DNA, 25 bp, Mus musculus
agactcgtactctgtccagggtcca

SEQ ID NO: 149231 - DNA, 25 bp, Mus musculus
agactcgtctccaagcatcaaggat

SEQ ID NO: 149232 - DNA, 25 bp, Mus musculus
agactcgtctcctagcatcaaggat

SEQ ID NO: 149233 - DNA, 25 bp, Mus musculus
agactcgtgccgaattagccagcgt

SEQ ID NO: 149234 - DNA, 25 bp, Mus musculus
agactcgtgccgtattagccagcgt

SEQ ID NO: 149235 - DNA, 25 bp, Mus musculus
agactcgtgttcagcgtggctagca

SEQ ID NO: 149236 - DNA, 25 bp, Mus musculus
agactcgtgttctgcgtggctagca

SEQ ID NO: 149237 - DNA, 25 bp, Mus musculus
agactcgttcttcccaatttggtgt

SEQ ID NO: 149238 - DNA, 25 bp, Mus musculus
agactcgttcttgccaatttggtgt

SEQ ID NO: 149239 - DNA, 25 bp, Mus musculus
agactcgttgaaaccatatcccaat

SEQ ID NO: 149240 - DNA, 25 bp, Mus musculus
agactcgttgaatccatatcccaat

SEQ ID NO: 149241 - DNA, 25 bp, Mus musculus
agactctaaacacttctttcccaag

SEQ ID NO: 149242 - DNA, 25 bp, Mus musculus
agactctaaacagttctttcccaag

SEQ ID NO: 149243 - DNA, 25 bp, Mus musculus
agactctaatcccttctctttatat

SEQ ID NO: 149244 - DNA, 25 bp, Mus musculus
agactctaatccgttctctttatat

SEQ ID NO: 149245 - DNA, 25 bp, Mus musculus
agactctacagcaaaggacaggact

SEQ ID NO: 149246 - DNA, 25 bp, Mus musculus
agactctacagctaaggacaggact

SEQ ID NO: 149247 - DNA, 25 bp, Mus musculus
agactctacattatataagctccga

SEQ ID NO: 149248 - DNA, 25 bp, Mus musculus
agactctacattttataagctccga

SEQ ID NO: 149249 - DNA, 25 bp, Mus musculus
agactctagccaaataatctccagg

SEQ ID NO: 149250 - DNA, 25 bp, Mus musculus
agactctagccatataatctccagg

SEQ ID NO: 149251 - DNA, 25 bp, Mus musculus
agactctattaaactgggcctctgc

SEQ ID NO: 149252 - DNA, 25 bp, Mus musculus
agactctattaatctgggcctctgc

SEQ ID NO: 149253 - DNA, 25 bp, Mus musculus
agactctattctagatctcctggct

SEQ ID NO: 149254 - DNA, 25 bp, Mus musculus
agactctattcttgatctcctggct

SEQ ID NO: 149255 - DNA, 25 bp, Mus musculus
agactctcaaaacatgcacccctgg

SEQ ID NO: 149256 - DNA, 25 bp, Mus musculus
agactctcaaaagatgcacccctgg

SEQ ID NO: 149257 - DNA, 25 bp, Mus musculus
agactctcaatacaattcttctgta

SEQ ID NO: 149258 - DNA, 25 bp, Mus musculus
agactctcaatagaattcttctgta

SEQ ID NO: 149259 - DNA, 25 bp, Mus musculus
agactctcaattcccaagcttttta

SEQ ID NO: 149260 - DNA, 25 bp, Mus musculus
agactctcaattgccaagcttttta

SEQ ID NO: 149261 - DNA, 25 bp, Mus musculus
agactctcagagacaccctctttat

SEQ ID NO: 149262 - DNA, 25 bp, Mus musculus
agactctcagagtcaccctctttat

SEQ ID NO: 149263 - DNA, 25 bp, Mus musculus
agactctcagtgaccttccagaaga

SEQ ID NO: 149264 - DNA, 25 bp, Mus musculus
agactctcagtgtccttccagaaga

SEQ ID NO: 149265 - DNA, 25 bp, Mus musculus
agactctcatctaagctgtgtggaa

SEQ ID NO: 149266 - DNA, 25 bp, Mus musculus
agactctcatcttagctgtgtggaa

SEQ ID NO: 149267 - DNA, 25 bp, Mus musculus
agactctccctacagacctgggcag

SEQ ID NO: 149268 - DNA, 25 bp, Mus musculus
agactctccctagagacctgggcag

SEQ ID NO: 149269 - DNA, 25 bp, Mus musculus
agactctcccttcttgaggttcaga

SEQ ID NO: 149270 - DNA, 25 bp, Mus musculus
agactctcccttgttgaggttcaga

SEQ ID NO: 149271 - DNA, 25 bp, Mus musculus
agactctcctctctttaggaacaga

SEQ ID NO: 149272 - DNA, 25 bp, Mus musculus
agactctcctctgtttaggaacaga

SEQ ID NO: 149273 - DNA, 25 bp, Mus musculus
agactctctcaacattgcctggagt

SEQ ID NO: 149274 - DNA, 25 bp, Mus musculus
agactctctcaagattgcctggagt

SEQ ID NO: 149275 - DNA, 25 bp, Mus musculus
agactctctccaagtggaacctgac

SEQ ID NO: 149276 - DNA, 25 bp, Mus musculus
agactctctccatgtggaacctgac

SEQ ID NO: 149277 - DNA, 25 bp, Mus musculus
agactctctctacactccctgtgga

SEQ ID NO: 149278 - DNA, 25 bp, Mus musculus
agactctctctagactccctgtgga

SEQ ID NO: 149279 - DNA, 25 bp, Mus musculus
agactctctgcaattagatccccta

SEQ ID NO: 149280 - DNA, 25 bp, Mus musculus
agactctctgcatttagatccccta

SEQ ID NO: 149281 - DNA, 25 bp, Mus musculus
agactctctgcgcacacagctagcg

SEQ ID NO: 149282 - DNA, 25 bp, Mus musculus
agactctctgcggacacagctagcg

SEQ ID NO: 149283 - DNA, 25 bp, Mus musculus
agactctctggcattttgatatcaa

SEQ ID NO: 149284 - DNA, 25 bp, Mus musculus
agactctctggctttttgatatcaa

SEQ ID NO: 149285 - DNA, 25 bp, Mus musculus
agactctctgggactgcagttctga

SEQ ID NO: 149286 - DNA, 25 bp, Mus musculus
agactctctgggtctgcagttctga

SEQ ID NO: 149287 - DNA, 25 bp, Mus musculus
agactctctgtcatgatggtatcac

SEQ ID NO: 149288 - DNA, 25 bp, Mus musculus
agactctctgtcttgatggtatcac

SEQ ID NO: 149289 - DNA, 25 bp, Mus musculus
agactctctgtgctattgtgtttcc

SEQ ID NO: 149290 - DNA, 25 bp, Mus musculus
agactctctgtggtattgtgtttcc

SEQ ID NO: 149291 - DNA, 25 bp, Mus musculus
agactctcttccacatagttgtgaa

SEQ ID NO: 149292 - DNA, 25 bp, Mus musculus
agactctcttcctcatagttgtgaa

SEQ ID NO: 149293 - DNA, 25 bp, Mus musculus
agactctgacccctgctggaacatt

SEQ ID NO: 149294 - DNA, 25 bp, Mus musculus
agactctgacccgtgctggaacatt

SEQ ID NO: 149295 - DNA, 25 bp, Mus musculus
agactctgacctcatagacctcctg

SEQ ID NO: 149296 - DNA, 25 bp, Mus musculus
agactctgacctgatagacctcctg

SEQ ID NO: 149297 - DNA, 25 bp, Mus musculus
agactctgagcacatctgtggctca

SEQ ID NO: 149298 - DNA, 25 bp, Mus musculus
agactctgagcagatctgtggctca

SEQ ID NO: 149299 - DNA, 25 bp, Mus musculus
agactctgaggtctctactctcaca

SEQ ID NO: 149300 - DNA, 25 bp, Mus musculus
agactctgaggtgtctactctcaca

SEQ ID NO: 149301 - DNA, 25 bp, Mus musculus
agactctgagtcaggcttcagtgct

SEQ ID NO: 149302 - DNA, 25 bp, Mus musculus
agactctgagtctggcttcagtgct

SEQ ID NO: 149303 - DNA, 25 bp, Mus musculus
agactctgagtgattttctgactgt

SEQ ID NO: 149304 - DNA, 25 bp, Mus musculus
agactctgagtgtttttctgactgt

SEQ ID NO: 149305 - DNA, 25 bp, Mus musculus
agactctgcagcatatgagagccaa

SEQ ID NO: 149306 - DNA, 25 bp, Mus musculus
agactctgcagcttatgagagccaa

SEQ ID NO: 149307 - DNA, 25 bp, Mus musculus
agactctgcagtatcatccatttga

SEQ ID NO: 149308 - DNA, 25 bp, Mus musculus
agactctgcagtttcatccatttga

SEQ ID NO: 149309 - DNA, 25 bp, Mus musculus
agactctgccagctggatgtgccag

SEQ ID NO: 149310 - DNA, 25 bp, Mus musculus
agactctgccaggtggatgtgccag

SEQ ID NO: 149311 - DNA, 25 bp, Mus musculus
agactctgccatcctgagtgaatac

SEQ ID NO: 149312 - DNA, 25 bp, Mus musculus
agactctgccatctcttgagtgttc

SEQ ID NO: 149313 - DNA, 25 bp, Mus musculus
agactctgccatgctgagtgaatac

SEQ ID NO: 149314 - DNA, 25 bp, Mus musculus
agactctgccatgtcttgagtgttc

SEQ ID NO: 149315 - DNA, 25 bp, Mus musculus
agactctgcttccatagcccagggt

SEQ ID NO: 149316 - DNA, 25 bp, Mus musculus
agactctgcttcgatagcccagggt

SEQ ID NO: 149317 - DNA, 25 bp, Mus musculus
agactctgctttcgttaggagatgc

SEQ ID NO: 149318 - DNA, 25 bp, Mus musculus
agactctgctttggttaggagatgc

SEQ ID NO: 149319 - DNA, 25 bp, Mus musculus
agactctggacacctcacgctcgat

SEQ ID NO: 149320 - DNA, 25 bp, Mus musculus
agactctggacagctcacgctcgat

SEQ ID NO: 149321 - DNA, 25 bp, Mus musculus
agactctgggagactctgtagctca

SEQ ID NO: 149322 - DNA, 25 bp, Mus musculus
agactctgggagtctctgtagctca

SEQ ID NO: 149323 - DNA, 25 bp, Mus musculus
agactctgggctactcatggccttt

SEQ ID NO: 149324 - DNA, 25 bp, Mus musculus
agactctgggcttctcatggccttt

SEQ ID NO: 149325 - DNA, 25 bp, Mus musculus
agactctgggttcctgatcacttaa

SEQ ID NO: 149326 - DNA, 25 bp, Mus musculus
agactctgggttgctgatcacttaa

SEQ ID NO: 149327 - DNA, 25 bp, Mus musculus
agactctgtcctcttgcctgtgttt

SEQ ID NO: 149328 - DNA, 25 bp, Mus musculus
agactctgtcctgttgcctgtgttt

SEQ ID NO: 149329 - DNA, 25 bp, Mus musculus
agactctgtggccttcttattaaga

SEQ ID NO: 149330 - DNA, 25 bp, Mus musculus
agactctgtggcgttcttattaaga

SEQ ID NO: 149331 - DNA, 25 bp, Mus musculus
agactctgttatcttctactcaagg

SEQ ID NO: 149332 - DNA, 25 bp, Mus musculus
agactctgttatgttctactcaagg

SEQ ID NO: 149333 - DNA, 25 bp, Mus musculus
agactcttaagaactggccagttac

SEQ ID NO: 149334 - DNA, 25 bp, Mus musculus
agactcttaagatctggccagttac

SEQ ID NO: 149335 - DNA, 25 bp, Mus musculus
agactcttacctctctggaactata

SEQ ID NO: 149336 - DNA, 25 bp, Mus musculus
agactcttacctgtctggaactata

SEQ ID NO: 149337 - DNA, 25 bp, Mus musculus
agactcttcaaaatgccatcccaaa

SEQ ID NO: 149338 - DNA, 25 bp, Mus musculus
agactcttcaaattgccatcccaaa

SEQ ID NO: 149339 - DNA, 25 bp, Mus musculus
agactcttcacaccaagtttgcctt

SEQ ID NO: 149340 - DNA, 25 bp, Mus musculus
agactcttcacagcaagtttgcctt

SEQ ID NO: 149341 - DNA, 25 bp, Mus musculus
agactcttcataccctcacattata

SEQ ID NO: 149342 - DNA, 25 bp, Mus musculus
agactcttcatagcctcacattata

SEQ ID NO: 149343 - DNA, 25 bp, Mus musculus
agactcttcattagcacacggcttg

SEQ ID NO: 149344 - DNA, 25 bp, Mus musculus
agactcttcatttgcacacggcttg

SEQ ID NO: 149345 - DNA, 25 bp, Mus musculus
agactcttccctcaggtgcaatgca

SEQ ID NO: 149346 - DNA, 25 bp, Mus musculus
agactcttccctgaggtgcaatgca

SEQ ID NO: 149347 - DNA, 25 bp, Mus musculus
agactcttcctgagtcagcgaggct

SEQ ID NO: 149348 - DNA, 25 bp, Mus musculus
agactcttcctgtgtcagcgaggct

SEQ ID NO: 149349 - DNA, 25 bp, Mus musculus
agactcttctctacaaagtcctctg

SEQ ID NO: 149350 - DNA, 25 bp, Mus musculus
agactcttctctcggctaggattgt

SEQ ID NO: 149351 - DNA, 25 bp, Mus musculus
agactcttctctgggctaggattgt

SEQ ID NO: 149352 - DNA, 25 bp, Mus musculus
agactcttctcttcaaagtcctctg

SEQ ID NO: 149353 - DNA, 25 bp, Mus musculus
agactcttgattatgacccacctag

SEQ ID NO: 149354 - DNA, 25 bp, Mus musculus
agactcttgattttgacccacctag

SEQ ID NO: 149355 - DNA, 25 bp, Mus musculus
agactcttgctaccagctgcatatt

SEQ ID NO: 149356 - DNA, 25 bp, Mus musculus
agactcttgctagcagctgcatatt

SEQ ID NO: 149357 - DNA, 25 bp, Mus musculus
agactcttgctcaactaactcttgc

SEQ ID NO: 149358 - DNA, 25 bp, Mus musculus
agactcttgctctactaactcttgc

SEQ ID NO: 149359 - DNA, 25 bp, Mus musculus
agactcttgcttagcgtccacgatg

SEQ ID NO: 149360 - DNA, 25 bp, Mus musculus
agactcttgctttgcgtccacgatg

SEQ ID NO: 149361 - DNA, 25 bp, Mus musculus
agactcttgggaaagcctggccttg

SEQ ID NO: 149362 - DNA, 25 bp, Mus musculus
agactcttgggatagcctggccttg

SEQ ID NO: 149363 - DNA, 25 bp, Mus musculus
agactcttggtcatctctgccatga

SEQ ID NO: 149364 - DNA, 25 bp, Mus musculus
agactcttggtcttctctgccatga

SEQ ID NO: 149365 - DNA, 25 bp, Mus musculus
agactcttgtggcttccaaccactt

SEQ ID NO: 149366 - DNA, 25 bp, Mus musculus
agactcttgtgggttccaaccactt

SEQ ID NO: 149367 - DNA, 25 bp, Mus musculus
agactcttgtgtaaaccctttcgtg

SEQ ID NO: 149368 - DNA, 25 bp, Mus musculus
agactcttgtgttaaccctttcgtg

SEQ ID NO: 149369 - DNA, 25 bp, Mus musculus
agactcttgttgcagagttacttat

SEQ ID NO: 149370 - DNA, 25 bp, Mus musculus
agactcttgttggagagttacttat

SEQ ID NO: 149371 - DNA, 25 bp, Mus musculus
agactctttactcgactgcctggaa

SEQ ID NO: 149372 - DNA, 25 bp, Mus musculus
agactctttactggactgcctggaa

SEQ ID NO: 149373 - DNA, 25 bp, Mus musculus
agactctttattcaacactgccagc

SEQ ID NO: 149374 - DNA, 25 bp, Mus musculus
agactctttattgaacactgccagc

SEQ ID NO: 149375 - DNA, 25 bp, Mus musculus
agactctttcaacgcgggaggctca

SEQ ID NO: 149376 - DNA, 25 bp, Mus musculus
agactctttcaaggcgggaggctca

SEQ ID NO: 149377 - DNA, 25 bp, Mus musculus
agactctttgtgactgagggtggtc

SEQ ID NO: 149378 - DNA, 25 bp, Mus musculus
agactctttgtgtctgagggtggtc

SEQ ID NO: 149379 - DNA, 25 bp, Mus musculus
agactcttttgtaactagttctagg

SEQ ID NO: 149380 - DNA, 25 bp, Mus musculus
agactcttttgttactagttctagg

SEQ ID NO: 149381 - DNA, 25 bp, Mus musculus
agactctttttaaagcaccttcctt

SEQ ID NO: 149382 - DNA, 25 bp, Mus musculus
agactctttttatagcaccttcctt

SEQ ID NO: 149383 - DNA, 25 bp, Mus musculus
agactgaaaaccagagcgcgctcga

SEQ ID NO: 149384 - DNA, 25 bp, Mus musculus
agactgaaaacctgagcgcgctcga

SEQ ID NO: 149385 - DNA, 25 bp, Mus musculus
agactgaaaagcctgcacggaagaa

SEQ ID NO: 149386 - DNA, 25 bp, Mus musculus
agactgaaaagcgtgcacggaagaa

SEQ ID NO: 149387 - DNA, 25 bp, Mus musculus
agactgaaacttcaatcactgcaaa

SEQ ID NO: 149388 - DNA, 25 bp, Mus musculus
agactgaaacttgaatcactgcaaa

SEQ ID NO: 149389 - DNA, 25 bp, Mus musculus
agactgaaagatcggtctcttttca

SEQ ID NO: 149390 - DNA, 25 bp, Mus musculus
agactgaaagatgggtctcttttca

SEQ ID NO: 149391 - DNA, 25 bp, Mus musculus
agactgaaatgaaccctgggactgt

SEQ ID NO: 149392 - DNA, 25 bp, Mus musculus
agactgaaatgatccctgggactgt

SEQ ID NO: 149393 - DNA, 25 bp, Mus musculus
agactgaacgtcctgtgttgcttct

SEQ ID NO: 149394 - DNA, 25 bp, Mus musculus
agactgaacgtcgtgtgttgcttct

SEQ ID NO: 149395 - DNA, 25 bp, Mus musculus
agactgaactgaatggttgggtttt

SEQ ID NO: 149396 - DNA, 25 bp, Mus musculus
agactgaactgattggttgggtttt

SEQ ID NO: 149397 - DNA, 25 bp, Mus musculus
agactgaacttgacagcattgcccc

SEQ ID NO: 149398 - DNA, 25 bp, Mus musculus
agactgaacttgctacagcttggta

SEQ ID NO: 149399 - DNA, 25 bp, Mus musculus
agactgaacttggtacagcttggta

SEQ ID NO: 149400 - DNA, 25 bp, Mus musculus
agactgaacttgtcagcattgcccc

SEQ ID NO: 149401 - DNA, 25 bp, Mus musculus
agactgaagattcgaggctccctgg

SEQ ID NO: 149402 - DNA, 25 bp, Mus musculus
agactgaagattggaggctccctgg

SEQ ID NO: 149403 - DNA, 25 bp, Mus musculus
agactgaagcgcattggacctgccc

SEQ ID NO: 149404 - DNA, 25 bp, Mus musculus
agactgaagcgctttggacctgccc

SEQ ID NO: 149405 - DNA, 25 bp, Mus musculus
agactgaagctacgatccctttggt

SEQ ID NO: 149406 - DNA, 25 bp, Mus musculus
agactgaagctaggatccctttggt

SEQ ID NO: 149407 - DNA, 25 bp, Mus musculus
agactgaaggtacattctaagctca

SEQ ID NO: 149408 - DNA, 25 bp, Mus musculus
agactgaaggtagattctaagctca

SEQ ID NO: 149409 - DNA, 25 bp, Mus musculus
agactgaagtcacgtcctcgtgttt

SEQ ID NO: 149410 - DNA, 25 bp, Mus musculus
agactgaagtcaggtcctcgtgttt

SEQ ID NO: 149411 - DNA, 25 bp, Mus musculus
agactgaatcacagtgcctgttgat

SEQ ID NO: 149412 - DNA, 25 bp, Mus musculus
agactgaatcactgtgcctgttgat

SEQ ID NO: 149413 - DNA, 25 bp, Mus musculus
agactgaatcctagtttcttccagc

SEQ ID NO: 149414 - DNA, 25 bp, Mus musculus
agactgaatccttgtttcttccagc

SEQ ID NO: 149415 - DNA, 25 bp, Mus musculus
agactgaatgacagacttcccgtac

SEQ ID NO: 149416 - DNA, 25 bp, Mus musculus
agactgaatgactgacttcccgtac

SEQ ID NO: 149417 - DNA, 25 bp, Mus musculus
agactgaatgcaatcctgactataa

SEQ ID NO: 149418 - DNA, 25 bp, Mus musculus
agactgaatgcattcctgactataa

SEQ ID NO: 149419 - DNA, 25 bp, Mus musculus
agactgacaaagactctaggatcaa

SEQ ID NO: 149420 - DNA, 25 bp, Mus musculus
agactgacaaagtctctaggatcaa

SEQ ID NO: 149421 - DNA, 25 bp, Mus musculus
agactgacagagactggcacccagg

SEQ ID NO: 149422 - DNA, 25 bp, Mus musculus
agactgacagagtctggcacccagg

SEQ ID NO: 149423 - DNA, 25 bp, Mus musculus
agactgacagccctggtactgttct

SEQ ID NO: 149424 - DNA, 25 bp, Mus musculus
agactgacagccgtggtactgttct

SEQ ID NO: 149425 - DNA, 25 bp, Mus musculus
agactgacatacagggtgccctttc

SEQ ID NO: 149426 - DNA, 25 bp, Mus musculus
agactgacatactgggtgccctttc

SEQ ID NO: 149427 - DNA, 25 bp, Mus musculus
agactgacatctagctttgacaatc

SEQ ID NO: 149428 - DNA, 25 bp, Mus musculus
agactgacatcttgctttgacaatc

SEQ ID NO: 149429 - DNA, 25 bp, Mus musculus
agactgaccaacaagaagacctctt

SEQ ID NO: 149430 - DNA, 25 bp, Mus musculus
agactgaccaactagaagacctctt

SEQ ID NO: 149431 - DNA, 25 bp, Mus musculus
agactgacccctccctgttaagaag

SEQ ID NO: 149432 - DNA, 25 bp, Mus musculus
agactgacccctgcctgttaagaag

SEQ ID NO: 149433 - DNA, 25 bp, Mus musculus
agactgaccctgaccatgctgagtt

SEQ ID NO: 149434 - DNA, 25 bp, Mus musculus
agactgaccctgtccatgctgagtt

SEQ ID NO: 149435 - DNA, 25 bp, Mus musculus
agactgaccggtacgggacactcga

SEQ ID NO: 149436 - DNA, 25 bp, Mus musculus
agactgaccggttcgggacactcga

SEQ ID NO: 149437 - DNA, 25 bp, Mus musculus
agactgacctccatcattgagcggc

SEQ ID NO: 149438 - DNA, 25 bp, Mus musculus
agactgacctccttcattgagcggc

SEQ ID NO: 149439 - DNA, 25 bp, Mus musculus
agactgactcaccattacttgcttt

SEQ ID NO: 149440 - DNA, 25 bp, Mus musculus
agactgactcacgattacttgcttt

SEQ ID NO: 149441 - DNA, 25 bp, Mus musculus
agactgactctgatataggacccat

SEQ ID NO: 149442 - DNA, 25 bp, Mus musculus
agactgactctgttataggacccat

SEQ ID NO: 149443 - DNA, 25 bp, Mus musculus
agactgactgaaagattcctgcccc

SEQ ID NO: 149444 - DNA, 25 bp, Mus musculus
agactgactgaatgattcctgcccc

SEQ ID NO: 149445 - DNA, 25 bp, Mus musculus
agactgacttccactgcttcccaag

SEQ ID NO: 149446 - DNA, 25 bp, Mus musculus
agactgacttcctctgcttcccaag

SEQ ID NO: 149447 - DNA, 25 bp, Mus musculus
agactgagacaccaagcctcactca

SEQ ID NO: 149448 - DNA, 25 bp, Mus musculus
agactgagacacgaagcctcactca

SEQ ID NO: 149449 - DNA, 25 bp, Mus musculus
agactgagaccacccctttcagagg

SEQ ID NO: 149450 - DNA, 25 bp, Mus musculus
agactgagaccagccctttcagagg

SEQ ID NO: 149451 - DNA, 25 bp, Mus musculus
agactgagcaggcactggcgctcca

SEQ ID NO: 149452 - DNA, 25 bp, Mus musculus
agactgagcagggactggcgctcca

SEQ ID NO: 149453 - DNA, 25 bp, Mus musculus
agactgagcatcagctccatgttaa

SEQ ID NO: 149454 - DNA, 25 bp, Mus musculus
agactgagcatctgctccatgttaa

SEQ ID NO: 149455 - DNA, 25 bp, Mus musculus
agactgagcattagggtcctgggca

SEQ ID NO: 149456 - DNA, 25 bp, Mus musculus
agactgagcatttgggtcctgggca

SEQ ID NO: 149457 - DNA, 25 bp, Mus musculus
agactgagctggaatctgctgggct

SEQ ID NO: 149458 - DNA, 25 bp, Mus musculus
agactgagctggtatctgctgggct

SEQ ID NO: 149459 - DNA, 25 bp, Mus musculus
agactgaggacccagcagagcttat

SEQ ID NO: 149460 - DNA, 25 bp, Mus musculus
agactgaggaccgagcagagcttat

SEQ ID NO: 149461 - DNA, 25 bp, Mus musculus
agactgaggactaagggccacatca

SEQ ID NO: 149462 - DNA, 25 bp, Mus musculus
agactgaggacttagggccacatca

SEQ ID NO: 149463 - DNA, 25 bp, Mus musculus
agactgaggcatcctttgtggccct

SEQ ID NO: 149464 - DNA, 25 bp, Mus musculus
agactgaggcatgctttgtggccct

SEQ ID NO: 149465 - DNA, 25 bp, Mus musculus
agactgaggcttattgccacacctt

SEQ ID NO: 149466 - DNA, 25 bp, Mus musculus
agactgaggctttttgccacacctt

SEQ ID NO: 149467 - DNA, 25 bp, Mus musculus
agactgagtactccgaaagttcctg

SEQ ID NO: 149468 - DNA, 25 bp, Mus musculus
agactgagtactgcgaaagttcctg

SEQ ID NO: 149469 - DNA, 25 bp, Mus musculus
agactgagtcctcaggtttccgagt

SEQ ID NO: 149470 - DNA, 25 bp, Mus musculus
agactgagtcctgaggtttccgagt

SEQ ID NO: 149471 - DNA, 25 bp, Mus musculus
agactgagttttctccttgtccttt

SEQ ID NO: 149472 - DNA, 25 bp, Mus musculus
agactgagttttgtccttgtccttt

SEQ ID NO: 149473 - DNA, 25 bp, Mus musculus
agactgatcatcacgggactgtgtt

SEQ ID NO: 149474 - DNA, 25 bp, Mus musculus
agactgatcatcattcctgaggctc

SEQ ID NO: 149475 - DNA, 25 bp, Mus musculus
agactgatcatctcgggactgtgtt

SEQ ID NO: 149476 - DNA, 25 bp, Mus musculus
agactgatcatctttcctgaggctc

SEQ ID NO: 149477 - DNA, 25 bp, Mus musculus
agactgatctcactaacttctgaat

SEQ ID NO: 149478 - DNA, 25 bp, Mus musculus
agactgatctcagtaacttctgaat

SEQ ID NO: 149479 - DNA, 25 bp, Mus musculus
agactgatctgacctcaggttccca

SEQ ID NO: 149480 - DNA, 25 bp, Mus musculus
agactgatctgagctcaggttccca

SEQ ID NO: 149481 - DNA, 25 bp, Mus musculus
agactgatgagtatgggcacccaca

SEQ ID NO: 149482 - DNA, 25 bp, Mus musculus
agactgatgagtttgggcacccaca

SEQ ID NO: 149483 - DNA, 25 bp, Mus musculus
agactgatgatactgtttggcatga

SEQ ID NO: 149484 - DNA, 25 bp, Mus musculus
agactgatgatagtgtttggcatga

SEQ ID NO: 149485 - DNA, 25 bp, Mus musculus
agactgatgtccactagggctggga

SEQ ID NO: 149486 - DNA, 25 bp, Mus musculus
agactgatgtcctctagggctggga

SEQ ID NO: 149487 - DNA, 25 bp, Mus musculus
agactgcaaaggcaccaccagggta

SEQ ID NO: 149488 - DNA, 25 bp, Mus musculus
agactgcaaagggaccaccagggta

SEQ ID NO: 149489 - DNA, 25 bp, Mus musculus
agactgcacaaccttacttgttctc

SEQ ID NO: 149490 - DNA, 25 bp, Mus musculus
agactgcacaacgttacttgttctc

SEQ ID NO: 149491 - DNA, 25 bp, Mus musculus
agactgcacactatgctcaccatca

SEQ ID NO: 149492 - DNA, 25 bp, Mus musculus
agactgcacactttgctcaccatca

SEQ ID NO: 149493 - DNA, 25 bp, Mus musculus
agactgcacagacctgtccacacgt

SEQ ID NO: 149494 - DNA, 25 bp, Mus musculus
agactgcacagagctgtccacacgt

SEQ ID NO: 149495 - DNA, 25 bp, Mus musculus
agactgcacattcctgatggtgaga

SEQ ID NO: 149496 - DNA, 25 bp, Mus musculus
agactgcacattgctgatggtgaga

SEQ ID NO: 149497 - DNA, 25 bp, Mus musculus
agactgcacctgcaacacctgagcg

SEQ ID NO: 149498 - DNA, 25 bp, Mus musculus
agactgcacctggaacacctgagcg

SEQ ID NO: 149499 - DNA, 25 bp, Mus musculus
agactgcagaaacaccgtcctctca

SEQ ID NO: 149500 - DNA, 25 bp, Mus musculus
agactgcagaaagaccgtcctctca

SEQ ID NO: 149501 - DNA, 25 bp, Mus musculus
agactgcagagaccacgtcctgaga

SEQ ID NO: 149502 - DNA, 25 bp, Mus musculus
agactgcagagagcacgtcctgaga

SEQ ID NO: 149503 - DNA, 25 bp, Mus musculus
agactgcagagcaggtgctgtcgca

SEQ ID NO: 149504 - DNA, 25 bp, Mus musculus
agactgcagagctggtgctgtcgca

SEQ ID NO: 149505 - DNA, 25 bp, Mus musculus
agactgcaggcaaagccaccttctt

SEQ ID NO: 149506 - DNA, 25 bp, Mus musculus
agactgcaggcatagccaccttctt

SEQ ID NO: 149507 - DNA, 25 bp, Mus musculus
agactgcatattataactggcttta

SEQ ID NO: 149508 - DNA, 25 bp, Mus musculus
agactgcatattttaactggcttta

SEQ ID NO: 149509 - DNA, 25 bp, Mus musculus
agactgcatcaccttacgccataaa

SEQ ID NO: 149510 - DNA, 25 bp, Mus musculus
agactgcatcacgttacgccataaa

SEQ ID NO: 149511 - DNA, 25 bp, Mus musculus
agactgcatcctacacctttcaaag

SEQ ID NO: 149512 - DNA, 25 bp, Mus musculus
agactgcatccttcacctttcaaag

SEQ ID NO: 149513 - DNA, 25 bp, Mus musculus
agactgcatgcacactaattggaac

SEQ ID NO: 149514 - DNA, 25 bp, Mus musculus
agactgcatgcagactaattggaac

SEQ ID NO: 149515 - DNA, 25 bp, Mus musculus
agactgcattccacaagcatctcat

SEQ ID NO: 149516 - DNA, 25 bp, Mus musculus
agactgcattcctcaagcatctcat

SEQ ID NO: 149517 - DNA, 25 bp, Mus musculus
agactgcattcgcacagacacatgg

SEQ ID NO: 149518 - DNA, 25 bp, Mus musculus
agactgcattcggacagacacatgg

SEQ ID NO: 149519 - DNA, 25 bp, Mus musculus
agactgcattctcctgtgatgtgga

SEQ ID NO: 149520 - DNA, 25 bp, Mus musculus
agactgcattctgctgtgatgtgga

SEQ ID NO: 149521 - DNA, 25 bp, Mus musculus
agactgcatttcacacaagctgaag

SEQ ID NO: 149522 - DNA, 25 bp, Mus musculus
agactgcatttcccgtcccattttc

SEQ ID NO: 149523 - DNA, 25 bp, Mus musculus
agactgcatttcgcgtcccattttc

SEQ ID NO: 149524 - DNA, 25 bp, Mus musculus
agactgcatttctcacaagctgaag

SEQ ID NO: 149525 - DNA, 25 bp, Mus musculus
agactgccactcagttggttttcca

SEQ ID NO: 149526 - DNA, 25 bp, Mus musculus
agactgccactctgttggttttcca

SEQ ID NO: 149527 - DNA, 25 bp, Mus musculus
agactgccaggcacattaactgtac

SEQ ID NO: 149528 - DNA, 25 bp, Mus musculus
agactgccaggctcattaactgtac

SEQ ID NO: 149529 - DNA, 25 bp, Mus musculus
agactgccatttactcagctttaac

SEQ ID NO: 149530 - DNA, 25 bp, Mus musculus
agactgccattttctcagctttaac

SEQ ID NO: 149531 - DNA, 25 bp, Mus musculus
agactgcccatcataggtcctagga

SEQ ID NO: 149532 - DNA, 25 bp, Mus musculus
agactgcccatcttaggtcctagga

SEQ ID NO: 149533 - DNA, 25 bp, Mus musculus
agactgccccacagtagaattatgt

SEQ ID NO: 149534 - DNA, 25 bp, Mus musculus
agactgccccactgtagaattatgt

SEQ ID NO: 149535 - DNA, 25 bp, Mus musculus
agactgcccgtgattccctgtactt

SEQ ID NO: 149536 - DNA, 25 bp, Mus musculus
agactgcccgtgtttccctgtactt

SEQ ID NO: 149537 - DNA, 25 bp, Mus musculus
agactgccctcacgaactttcagca

SEQ ID NO: 149538 - DNA, 25 bp, Mus musculus
agactgccctcaggaactttcagca

SEQ ID NO: 149539 - DNA, 25 bp, Mus musculus
agactgccctgtccgggatcctgtt

SEQ ID NO: 149540 - DNA, 25 bp, Mus musculus
agactgccctgtgcgggatcctgtt

SEQ ID NO: 149541 - DNA, 25 bp, Mus musculus
agactgccgggtcctttgctttcag

SEQ ID NO: 149542 - DNA, 25 bp, Mus musculus
agactgccgggtgctttgctttcag

SEQ ID NO: 149543 - DNA, 25 bp, Mus musculus
agactgccgtgccacgtcagagtga

SEQ ID NO: 149544 - DNA, 25 bp, Mus musculus
agactgccgtgcgacgtcagagtga

SEQ ID NO: 149545 - DNA, 25 bp, Mus musculus
agactgcctgggagagagacattct

SEQ ID NO: 149546 - DNA, 25 bp, Mus musculus
agactgcctgggtgagagacattct

SEQ ID NO: 149547 - DNA, 25 bp, Mus musculus
agactgcctggtctagcatcagtgg

SEQ ID NO: 149548 - DNA, 25 bp, Mus musculus
agactgcctggtgtagcatcagtgg

SEQ ID NO: 149549 - DNA, 25 bp, Mus musculus
agactgcctttaacctaaccgtgag

SEQ ID NO: 149550 - DNA, 25 bp, Mus musculus
agactgcctttatcctaaccgtgag

SEQ ID NO: 149551 - DNA, 25 bp, Mus musculus
agactgcgaatcagagatccctgct

SEQ ID NO: 149552 - DNA, 25 bp, Mus musculus
agactgcgaatctgagatccctgct

SEQ ID NO: 149553 - DNA, 25 bp, Mus musculus
agactgcgaggtcacgcctgtgaca

SEQ ID NO: 149554 - DNA, 25 bp, Mus musculus
agactgcgaggtgacgcctgtgaca

SEQ ID NO: 149555 - DNA, 25 bp, Mus musculus
agactgcggtgtcgtgcatcttaca

SEQ ID NO: 149556 - DNA, 25 bp, Mus musculus
agactgcggtgtggtgcatcttaca

SEQ ID NO: 149557 - DNA, 25 bp, Mus musculus
agactgcgtctgatggatttggaaa

SEQ ID NO: 149558 - DNA, 25 bp, Mus musculus
agactgcgtctgttggatttggaaa

SEQ ID NO: 149559 - DNA, 25 bp, Mus musculus
agactgcgttctctggaacctggtg

SEQ ID NO: 149560 - DNA, 25 bp, Mus musculus
agactgcgttctgtggaacctggtg

SEQ ID NO: 149561 - DNA, 25 bp, Mus musculus
agactgctaagtcaacactctgccc

SEQ ID NO: 149562 - DNA, 25 bp, Mus musculus
agactgctaagtgaacactctgccc

SEQ ID NO: 149563 - DNA, 25 bp, Mus musculus
agactgctagtgcttttaaaattgt

SEQ ID NO: 149564 - DNA, 25 bp, Mus musculus
agactgctagtggttttaaaattgt

SEQ ID NO: 149565 - DNA, 25 bp, Mus musculus
agactgctcaaaccctggtgcctat

SEQ ID NO: 149566 - DNA, 25 bp, Mus musculus
agactgctcaaagcctggtgcctat

SEQ ID NO: 149567 - DNA, 25 bp, Mus musculus
agactgctcagacgtgccgccaatt

SEQ ID NO: 149568 - DNA, 25 bp, Mus musculus
agactgctcagaggtgccgccaatt

SEQ ID NO: 149569 - DNA, 25 bp, Mus musculus
agactgctctcaccttgcctagcac

SEQ ID NO: 149570 - DNA, 25 bp, Mus musculus
agactgctctcagcttgcctagcac

SEQ ID NO: 149571 - DNA, 25 bp, Mus musculus
agactgctctgcatacaacacggga

SEQ ID NO: 149572 - DNA, 25 bp, Mus musculus
agactgctctgcttacaacacggga

SEQ ID NO: 149573 - DNA, 25 bp, Mus musculus
agactgctgacaaatgtgcactccc

SEQ ID NO: 149574 - DNA, 25 bp, Mus musculus
agactgctgacatatgtgcactccc

SEQ ID NO: 149575 - DNA, 25 bp, Mus musculus
agactgcttagcacttgtgtccatt

SEQ ID NO: 149576 - DNA, 25 bp, Mus musculus
agactgcttagctcttgtgtccatt

SEQ ID NO: 149577 - DNA, 25 bp, Mus musculus
agactgcttatgaaggtggtcaagg

SEQ ID NO: 149578 - DNA, 25 bp, Mus musculus
agactgcttatgtaggtggtcaagg

SEQ ID NO: 149579 - DNA, 25 bp, Mus musculus
agactgcttgccaacaatacatggg

SEQ ID NO: 149580 - DNA, 25 bp, Mus musculus
agactgcttgcctacaatacatggg

SEQ ID NO: 149581 - DNA, 25 bp, Mus musculus
agactgcttgctagtgtaggtagta

SEQ ID NO: 149582 - DNA, 25 bp, Mus musculus
agactgcttgcttgtgtaggtagta

SEQ ID NO: 149583 - DNA, 25 bp, Mus musculus
agactgcttggaacaccttggtgac

SEQ ID NO: 149584 - DNA, 25 bp, Mus musculus
agactgcttggatcaccttggtgac

SEQ ID NO: 149585 - DNA, 25 bp, Mus musculus
agactgcttgttctggttttaactc

SEQ ID NO: 149586 - DNA, 25 bp, Mus musculus
agactgcttgttgtggttttaactc

SEQ ID NO: 149587 - DNA, 25 bp, Mus musculus
agactgctttccactgagaccattt

SEQ ID NO: 149588 - DNA, 25 bp, Mus musculus
agactgctttcctctgagaccattt

SEQ ID NO: 149589 - DNA, 25 bp, Mus musculus
agactgctttctactggcagcaatg

SEQ ID NO: 149590 - DNA, 25 bp, Mus musculus
agactgctttcttctggcagcaatg

SEQ ID NO: 149591 - DNA, 25 bp, Mus musculus
agactggaacctatcaagcctcata

SEQ ID NO: 149592 - DNA, 25 bp, Mus musculus
agactggaacctttcaagcctcata

SEQ ID NO: 149593 - DNA, 25 bp, Mus musculus
agactggaatttacctctgctacct

SEQ ID NO: 149594 - DNA, 25 bp, Mus musculus
agactggaattttcctctgctacct

SEQ ID NO: 149595 - DNA, 25 bp, Mus musculus
agactggaccatagactacacccgt

SEQ ID NO: 149596 - DNA, 25 bp, Mus musculus
agactggaccattgactacacccgt

SEQ ID NO: 149597 - DNA, 25 bp, Mus musculus
agactggacttaccctgagggcgtt

SEQ ID NO: 149598 - DNA, 25 bp, Mus musculus
agactggacttagcctgagggcgtt

SEQ ID NO: 149599 - DNA, 25 bp, Mus musculus
agactggagatgaactgtgccccac

SEQ ID NO: 149600 - DNA, 25 bp, Mus musculus
agactggagatgtactgtgccccac

SEQ ID NO: 149601 - DNA, 25 bp, Mus musculus
agactggagctcagtctttctgcta

SEQ ID NO: 149602 - DNA, 25 bp, Mus musculus
agactggagctctgtctttctgcta

SEQ ID NO: 149603 - DNA, 25 bp, Mus musculus
agactggagcttctgttcagcttgc

SEQ ID NO: 149604 - DNA, 25 bp, Mus musculus
agactggagcttgtgttcagcttgc

SEQ ID NO: 149605 - DNA, 25 bp, Mus musculus
agactggaggcccacgtcaaaggtt

SEQ ID NO: 149606 - DNA, 25 bp, Mus musculus
agactggaggccgacgtcaaaggtt

SEQ ID NO: 149607 - DNA, 25 bp, Mus musculus
agactggagggaactctgaacttgt

SEQ ID NO: 149608 - DNA, 25 bp, Mus musculus
agactggagggatctctgaacttgt

SEQ ID NO: 149609 - DNA, 25 bp, Mus musculus
agactggagtccaaaccctttgtca

SEQ ID NO: 149610 - DNA, 25 bp, Mus musculus
agactggagtcctaaccctttgtca

SEQ ID NO: 149611 - DNA, 25 bp, Mus musculus
agactggagtgaagccacttcctca

SEQ ID NO: 149612 - DNA, 25 bp, Mus musculus
agactggagtgatgccacttcctca

SEQ ID NO: 149613 - DNA, 25 bp, Mus musculus
agactggagtgccactttccacttt

SEQ ID NO: 149614 - DNA, 25 bp, Mus musculus
agactggagtgcgactttccacttt

SEQ ID NO: 149615 - DNA, 25 bp, Mus musculus
agactggatatgatttgctgtagat

SEQ ID NO: 149616 - DNA, 25 bp, Mus musculus
agactggatatgttttgctgtagat

SEQ ID NO: 149617 - DNA, 25 bp, Mus musculus
agactggatcacacagctccaaagg

SEQ ID NO: 149618 - DNA, 25 bp, Mus musculus
agactggatcactcagctccaaagg

SEQ ID NO: 149619 - DNA, 25 bp, Mus musculus
agactggatcccacatcagcacagg

SEQ ID NO: 149620 - DNA, 25 bp, Mus musculus
agactggatccctcatcagcacagg

SEQ ID NO: 149621 - DNA, 25 bp, Mus musculus
agactggattcgcatcagtgagatg

SEQ ID NO: 149622 - DNA, 25 bp, Mus musculus
agactggattcggatcagtgagatg

SEQ ID NO: 149623 - DNA, 25 bp, Mus musculus
agactggattctagctctcttctta

SEQ ID NO: 149624 - DNA, 25 bp, Mus musculus
agactggattcttgctctcttctta

SEQ ID NO: 149625 - DNA, 25 bp, Mus musculus
agactggcaagaacgcctctgacga

SEQ ID NO: 149626 - DNA, 25 bp, Mus musculus
agactggcaagatcgcctctgacga

SEQ ID NO: 149627 - DNA, 25 bp, Mus musculus
agactggcacagatttctgagaaag

SEQ ID NO: 149628 - DNA, 25 bp, Mus musculus
agactggcacagcaggccgccctag

SEQ ID NO: 149629 - DNA, 25 bp, Mus musculus
agactggcacaggaggccgccctag

SEQ ID NO: 149630 - DNA, 25 bp, Mus musculus
agactggcacagttttctgagaaag

SEQ ID NO: 149631 - DNA, 25 bp, Mus musculus
agactggcagccattgcttctggtt

SEQ ID NO: 149632 - DNA, 25 bp, Mus musculus
agactggcagcctttgcttctggtt

SEQ ID NO: 149633 - DNA, 25 bp, Mus musculus
agactggccactacaatgtcaccaa

SEQ ID NO: 149634 - DNA, 25 bp, Mus musculus
agactggccacttcaatgtcaccaa

SEQ ID NO: 149635 - DNA, 25 bp, Mus musculus
agactggccatcagctagtttacac

SEQ ID NO: 149636 - DNA, 25 bp, Mus musculus
agactggccatctgctagtttacac

SEQ ID NO: 149637 - DNA, 25 bp, Mus musculus
agactggcccacacaatactgcgag

SEQ ID NO: 149638 - DNA, 25 bp, Mus musculus
agactggcccactcaatactgcgag

SEQ ID NO: 149639 - DNA, 25 bp, Mus musculus
agactggcctcaagcctgtgattct

SEQ ID NO: 149640 - DNA, 25 bp, Mus musculus
agactggcctcatgcctgtgattct

SEQ ID NO: 149641 - DNA, 25 bp, Mus musculus
agactggccttgcattgtgtatgta

SEQ ID NO: 149642 - DNA, 25 bp, Mus musculus
agactggccttggattgtgtatgta

SEQ ID NO: 149643 - DNA, 25 bp, Mus musculus
agactggcgaccctacactaggttt

SEQ ID NO: 149644 - DNA, 25 bp, Mus musculus
agactggcgaccgtacactaggttt

SEQ ID NO: 149645 - DNA, 25 bp, Mus musculus
agactggcggaacagaccctggact

SEQ ID NO: 149646 - DNA, 25 bp, Mus musculus
agactggcggaagagaccctggact

SEQ ID NO: 149647 - DNA, 25 bp, Mus musculus
agactggctcagatgcttcaccagc

SEQ ID NO: 149648 - DNA, 25 bp, Mus musculus
agactggctcagttgcttcaccagc

SEQ ID NO: 149649 - DNA, 25 bp, Mus musculus
agactggctctcattctctgttcta

SEQ ID NO: 149650 - DNA, 25 bp, Mus musculus
agactggctctctttctctgttcta

SEQ ID NO: 149651 - DNA, 25 bp, Mus musculus
agactggctgccaagtagtagagat

SEQ ID NO: 149652 - DNA, 25 bp, Mus musculus
agactggctgcctagtagtagagat

SEQ ID NO: 149653 - DNA, 25 bp, Mus musculus
agactggctgctaccattacatttc

SEQ ID NO: 149654 - DNA, 25 bp, Mus musculus
agactggctgcttccattacatttc

SEQ ID NO: 149655 - DNA, 25 bp, Mus musculus
agactggctttaattctctacctat

SEQ ID NO: 149656 - DNA, 25 bp, Mus musculus
agactggctttatttctctacctat

SEQ ID NO: 149657 - DNA, 25 bp, Mus musculus
agactgggactgacacaccgggagc

SEQ ID NO: 149658 - DNA, 25 bp, Mus musculus
agactgggactgtcacaccgggagc

SEQ ID NO: 149659 - DNA, 25 bp, Mus musculus
agactgggacttcggcgtttgccta

SEQ ID NO: 149660 - DNA, 25 bp, Mus musculus
agactgggacttgggcgtttgccta

SEQ ID NO: 149661 - DNA, 25 bp, Mus musculus
agactgggagcccatcagaccaggt

SEQ ID NO: 149662 - DNA, 25 bp, Mus musculus
agactgggagccgatcagaccaggt

SEQ ID NO: 149663 - DNA, 25 bp, Mus musculus
agactgggccaacgttctttctcag

SEQ ID NO: 149664 - DNA, 25 bp, Mus musculus
agactgggccaaggttctttctcag

SEQ ID NO: 149665 - DNA, 25 bp, Mus musculus
agactgggccttagctgagttctct

SEQ ID NO: 149666 - DNA, 25 bp, Mus musculus
agactgggccttataccacgagaaa

SEQ ID NO: 149667 - DNA, 25 bp, Mus musculus
agactgggccttatataactcgagt

SEQ ID NO: 149668 - DNA, 25 bp, Mus musculus
agactgggcctttgctgagttctct

SEQ ID NO: 149669 - DNA, 25 bp, Mus musculus
agactgggccttttaccacgagaaa

SEQ ID NO: 149670 - DNA, 25 bp, Mus musculus
agactgggccttttataactcgagt

SEQ ID NO: 149671 - DNA, 25 bp, Mus musculus
agactgggtaggcacatcccactcc

SEQ ID NO: 149672 - DNA, 25 bp, Mus musculus
agactgggtagggacatcccactcc

SEQ ID NO: 149673 - DNA, 25 bp, Mus musculus
agactgggtttcagcccgttagtga

SEQ ID NO: 149674 - DNA, 25 bp, Mus musculus
agactgggtttctgcccgttagtga

SEQ ID NO: 149675 - DNA, 25 bp, Mus musculus
agactggtaaacaggagaccctgaa

SEQ ID NO: 149676 - DNA, 25 bp, Mus musculus
agactggtaaactggagaccctgaa

SEQ ID NO: 149677 - DNA, 25 bp, Mus musculus
agactggtcacaagccccaacaagg

SEQ ID NO: 149678 - DNA, 25 bp, Mus musculus
agactggtcacatgccccaacaagg

SEQ ID NO: 149679 - DNA, 25 bp, Mus musculus
agactggtcaccacttgtagcaaga

SEQ ID NO: 149680 - DNA, 25 bp, Mus musculus
agactggtcacctcttgtagcaaga

SEQ ID NO: 149681 - DNA, 25 bp, Mus musculus
agactggtctggctccatacatcaa

SEQ ID NO: 149682 - DNA, 25 bp, Mus musculus
agactggtctgggtccatacatcaa

SEQ ID NO: 149683 - DNA, 25 bp, Mus musculus
agactggtgagcagcactgtgtccg

SEQ ID NO: 149684 - DNA, 25 bp, Mus musculus
agactggtgagctgcactgtgtccg

SEQ ID NO: 149685 - DNA, 25 bp, Mus musculus
agactggtgcctaggcagctttttt

SEQ ID NO: 149686 - DNA, 25 bp, Mus musculus
agactggtgccttggcagctttttt

SEQ ID NO: 149687 - DNA, 25 bp, Mus musculus
agactggtgggacagtgctcctctt

SEQ ID NO: 149688 - DNA, 25 bp, Mus musculus
agactggtgggacccagactgactt

SEQ ID NO: 149689 - DNA, 25 bp, Mus musculus
agactggtgggagagtgctcctctt

SEQ ID NO: 149690 - DNA, 25 bp, Mus musculus
agactggtgggagccagactgactt

SEQ ID NO: 149691 - DNA, 25 bp, Mus musculus
agactggtgtcacactcctaggctc

SEQ ID NO: 149692 - DNA, 25 bp, Mus musculus
agactggtgtcagactcctaggctc

SEQ ID NO: 149693 - DNA, 25 bp, Mus musculus
agactggtgttcactttgtgacaat

SEQ ID NO: 149694 - DNA, 25 bp, Mus musculus
agactggtgttctctttgtgacaat

SEQ ID NO: 149695 - DNA, 25 bp, Mus musculus
agactggttgagactggttccagca

SEQ ID NO: 149696 - DNA, 25 bp, Mus musculus
agactggttgagcaagcactttatc

SEQ ID NO: 149697 - DNA, 25 bp, Mus musculus
agactggttgaggaagcactttatc

SEQ ID NO: 149698 - DNA, 25 bp, Mus musculus
agactggttgagtctggttccagca

SEQ ID NO: 149699 - DNA, 25 bp, Mus musculus
agactggttgtcagagctcttgctg

SEQ ID NO: 149700 - DNA, 25 bp, Mus musculus
agactggttgtctgagctcttgctg

SEQ ID NO: 149701 - DNA, 25 bp, Mus musculus
agactggtttaactgagcttgtcac

SEQ ID NO: 149702 - DNA, 25 bp, Mus musculus
agactggtttaagtgagcttgtcac

SEQ ID NO: 149703 - DNA, 25 bp, Mus musculus
agactggtttgcacttacaactctg

SEQ ID NO: 149704 - DNA, 25 bp, Mus musculus
agactggtttgctcttacaactctg

SEQ ID NO: 149705 - DNA, 25 bp, Mus musculus
agactgtaaagtattgtgtggaaat

SEQ ID NO: 149706 - DNA, 25 bp, Mus musculus
agactgtaaagttttgtgtggaaat

SEQ ID NO: 149707 - DNA, 25 bp, Mus musculus
agactgtaagttcctgcccaatcct

SEQ ID NO: 149708 - DNA, 25 bp, Mus musculus
agactgtaagttgctgcccaatcct

SEQ ID NO: 149709 - DNA, 25 bp, Mus musculus
agactgtaatatccctagaagccat

SEQ ID NO: 149710 - DNA, 25 bp, Mus musculus
agactgtaatatgcctagaagccat

SEQ ID NO: 149711 - DNA, 25 bp, Mus musculus
agactgtacacaagcattccttgct

SEQ ID NO: 149712 - DNA, 25 bp, Mus musculus
agactgtacacatgcattccttgct

SEQ ID NO: 149713 - DNA, 25 bp, Mus musculus
agactgtaccacaagggcatccaga

SEQ ID NO: 149714 - DNA, 25 bp, Mus musculus
agactgtaccactagggcatccaga

SEQ ID NO: 149715 - DNA, 25 bp, Mus musculus
agactgtacccaccctgactatgag

SEQ ID NO: 149716 - DNA, 25 bp, Mus musculus
agactgtacccagcctgactatgag

SEQ ID NO: 149717 - DNA, 25 bp, Mus musculus
agactgtactgcataggatattaaa

SEQ ID NO: 149718 - DNA, 25 bp, Mus musculus
agactgtactgcttaggatattaaa

SEQ ID NO: 149719 - DNA, 25 bp, Mus musculus
agactgtataggaagcactctgctc

SEQ ID NO: 149720 - DNA, 25 bp, Mus musculus
agactgtataggtagcactctgctc

SEQ ID NO: 149721 - DNA, 25 bp, Mus musculus
agactgtcacatcttgagccttcta

SEQ ID NO: 149722 - DNA, 25 bp, Mus musculus
agactgtcacatgttgagccttcta

SEQ ID NO: 149723 - DNA, 25 bp, Mus musculus
agactgtcagataccatcgtagtgg

SEQ ID NO: 149724 - DNA, 25 bp, Mus musculus
agactgtcagattccatcgtagtgg

SEQ ID NO: 149725 - DNA, 25 bp, Mus musculus
agactgtcaggccatacttgggact

SEQ ID NO: 149726 - DNA, 25 bp, Mus musculus
agactgtcaggcgatacttgggact

SEQ ID NO: 149727 - DNA, 25 bp, Mus musculus
agactgtcagtcactctaggcgagg

SEQ ID NO: 149728 - DNA, 25 bp, Mus musculus
agactgtcagtccagtcacacttac

SEQ ID NO: 149729 - DNA, 25 bp, Mus musculus
agactgtcagtcgagtcacacttac

SEQ ID NO: 149730 - DNA, 25 bp, Mus musculus
agactgtcagtctctctaggcgagg

SEQ ID NO: 149731 - DNA, 25 bp, Mus musculus
agactgtccagaaacttctcgatgc

SEQ ID NO: 149732 - DNA, 25 bp, Mus musculus
agactgtccagatacttctcgatgc

SEQ ID NO: 149733 - DNA, 25 bp, Mus musculus
agactgtccagcagaccgtgggcag

SEQ ID NO: 149734 - DNA, 25 bp, Mus musculus
agactgtccagctgaccgtgggcag

SEQ ID NO: 149735 - DNA, 25 bp, Mus musculus
agactgtccctaattgtcgccaaag

SEQ ID NO: 149736 - DNA, 25 bp, Mus musculus
agactgtccctatttgtcgccaaag

SEQ ID NO: 149737 - DNA, 25 bp, Mus musculus
agactgtccgcgcatctttgtgagc

SEQ ID NO: 149738 - DNA, 25 bp, Mus musculus
agactgtccgcggatctttgtgagc

SEQ ID NO: 149739 - DNA, 25 bp, Mus musculus
agactgtcctgcctgaaggtcttga

SEQ ID NO: 149740 - DNA, 25 bp, Mus musculus
agactgtcctgcctggatggtacac

SEQ ID NO: 149741 - DNA, 25 bp, Mus musculus
agactgtcctgcgtgaaggtcttga

SEQ ID NO: 149742 - DNA, 25 bp, Mus musculus
agactgtcctgcgtggatggtacac

SEQ ID NO: 149743 - DNA, 25 bp, Mus musculus
agactgtcctgtcgccaggccactt

SEQ ID NO: 149744 - DNA, 25 bp, Mus musculus
agactgtcctgtggccaggccactt

SEQ ID NO: 149745 - DNA, 25 bp, Mus musculus
agactgtccttccttgtaaccagag

SEQ ID NO: 149746 - DNA, 25 bp, Mus musculus
agactgtccttcgttgtaaccagag

SEQ ID NO: 149747 - DNA, 25 bp, Mus musculus
agactgtcctttagtgcctgtggta

SEQ ID NO: 149748 - DNA, 25 bp, Mus musculus
agactgtccttttgtgcctgtggta

SEQ ID NO: 149749 - DNA, 25 bp, Mus musculus
agactgtcgatgctactcacactag

SEQ ID NO: 149750 - DNA, 25 bp, Mus musculus
agactgtcgatggtactcacactag

SEQ ID NO: 149751 - DNA, 25 bp, Mus musculus
agactgtcgcgactttctctgtgat

SEQ ID NO: 149752 - DNA, 25 bp, Mus musculus
agactgtcgcgagtttctctgtgat

SEQ ID NO: 149753 - DNA, 25 bp, Mus musculus
agactgtgaaaaactaaatactcct

SEQ ID NO: 149754 - DNA, 25 bp, Mus musculus
agactgtgaaaatctaaatactcct

SEQ ID NO: 149755 - DNA, 25 bp, Mus musculus
agactgtgaagcactgtggcctgga

SEQ ID NO: 149756 - DNA, 25 bp, Mus musculus
agactgtgaagctctgtggcctgga

SEQ ID NO: 149757 - DNA, 25 bp, Mus musculus
agactgtgaagtcggcttcctttcc

SEQ ID NO: 149758 - DNA, 25 bp, Mus musculus
agactgtgaagtgggcttcctttcc

SEQ ID NO: 149759 - DNA, 25 bp, Mus musculus
agactgtgaatcctgtgctctgccc

SEQ ID NO: 149760 - DNA, 25 bp, Mus musculus
agactgtgaatcgtgtgctctgccc

SEQ ID NO: 149761 - DNA, 25 bp, Mus musculus
agactgtgacccatcatgtcagacc

SEQ ID NO: 149762 - DNA, 25 bp, Mus musculus
agactgtgacccttcatgtcagacc

SEQ ID NO: 149763 - DNA, 25 bp, Mus musculus
agactgtgatgtacacctgtggctt

SEQ ID NO: 149764 - DNA, 25 bp, Mus musculus
agactgtgatgttcacctgtggctt

SEQ ID NO: 149765 - DNA, 25 bp, Mus musculus
agactgtgcagacctccgcaggaca

SEQ ID NO: 149766 - DNA, 25 bp, Mus musculus
agactgtgcagagctccgcaggaca

SEQ ID NO: 149767 - DNA, 25 bp, Mus musculus
agactgtggaggcagcagcatcccc

SEQ ID NO: 149768 - DNA, 25 bp, Mus musculus
agactgtggagggagcagcatcccc

SEQ ID NO: 149769 - DNA, 25 bp, Mus musculus
agactgtggccgaagctgggaactt

SEQ ID NO: 149770 - DNA, 25 bp, Mus musculus
agactgtggccgtagctgggaactt

SEQ ID NO: 149771 - DNA, 25 bp, Mus musculus
agactgtggtgacttcgcccatgga

SEQ ID NO: 149772 - DNA, 25 bp, Mus musculus
agactgtggtgagttcgcccatgga

SEQ ID NO: 149773 - DNA, 25 bp, Mus musculus
agactgtggtgtatttactgagcgt

SEQ ID NO: 149774 - DNA, 25 bp, Mus musculus
agactgtggtgtttttactgagcgt

SEQ ID NO: 149775 - DNA, 25 bp, Mus musculus
agactgtgtaccatggatttgtctg

SEQ ID NO: 149776 - DNA, 25 bp, Mus musculus
agactgtgtaccttggatttgtctg

SEQ ID NO: 149777 - DNA, 25 bp, Mus musculus
agactgtgtctcagggattaagccc

SEQ ID NO: 149778 - DNA, 25 bp, Mus musculus
agactgtgtctccactgcaaagcga

SEQ ID NO: 149779 - DNA, 25 bp, Mus musculus
agactgtgtctcgactgcaaagcga

SEQ ID NO: 149780 - DNA, 25 bp, Mus musculus
agactgtgtctctgggattaagccc

SEQ ID NO: 149781 - DNA, 25 bp, Mus musculus
agactgtgtgtcctcaatggtgccc

SEQ ID NO: 149782 - DNA, 25 bp, Mus musculus
agactgtgtgtcgtcaatggtgccc

SEQ ID NO: 149783 - DNA, 25 bp, Mus musculus
agactgtgttaacatctccatttgt

SEQ ID NO: 149784 - DNA, 25 bp, Mus musculus
agactgtgttaagatctccatttgt

SEQ ID NO: 149785 - DNA, 25 bp, Mus musculus
agactgtgttacctccagagctggg

SEQ ID NO: 149786 - DNA, 25 bp, Mus musculus
agactgtgttacgtccagagctggg

SEQ ID NO: 149787 - DNA, 25 bp, Mus musculus
agactgtgttctcctctgactctgc

SEQ ID NO: 149788 - DNA, 25 bp, Mus musculus
agactgtgttctgctctgactctgc

SEQ ID NO: 149789 - DNA, 25 bp, Mus musculus
agactgtgttgtccttgttcatgtc

SEQ ID NO: 149790 - DNA, 25 bp, Mus musculus
agactgtgttgtgcttgttcatgtc

SEQ ID NO: 149791 - DNA, 25 bp, Mus musculus
agactgtgtttgatcaggagttcac

SEQ ID NO: 149792 - DNA, 25 bp, Mus musculus
agactgtgtttgttcaggagttcac

SEQ ID NO: 149793 - DNA, 25 bp, Mus musculus
agactgttagatactcggcgctgca

SEQ ID NO: 149794 - DNA, 25 bp, Mus musculus
agactgttagattctcggcgctgca

SEQ ID NO: 149795 - DNA, 25 bp, Mus musculus
agactgttagccctattgtaagcaa

SEQ ID NO: 149796 - DNA, 25 bp, Mus musculus
agactgttagccgtattgtaagcaa

SEQ ID NO: 149797 - DNA, 25 bp, Mus musculus
agactgttccatagactgttcctca

SEQ ID NO: 149798 - DNA, 25 bp, Mus musculus
agactgttccattgactgttcctca

SEQ ID NO: 149799 - DNA, 25 bp, Mus musculus
agactgttcggcatgagcctttgtc

SEQ ID NO: 149800 - DNA, 25 bp, Mus musculus
agactgttcggcttgagcctttgtc

SEQ ID NO: 149801 - DNA, 25 bp, Mus musculus
agactgttgctaccctgacctcatt

SEQ ID NO: 149802 - DNA, 25 bp, Mus musculus
agactgttgctagcctgacctcatt

SEQ ID NO: 149803 - DNA, 25 bp, Mus musculus
agactgttgctgatgggtactgtat

SEQ ID NO: 149804 - DNA, 25 bp, Mus musculus
agactgttgctgttgggtactgtat

SEQ ID NO: 149805 - DNA, 25 bp, Mus musculus
agactgttgggcatctagctgggtt

SEQ ID NO: 149806 - DNA, 25 bp, Mus musculus
agactgttgggcttctagctgggtt

SEQ ID NO: 149807 - DNA, 25 bp, Mus musculus
agactgtttcctcgcacttctgcat

SEQ ID NO: 149808 - DNA, 25 bp, Mus musculus
agactgtttcctggcacttctgcat

SEQ ID NO: 149809 - DNA, 25 bp, Mus musculus
agactgtttcggcaaagctgttaga

SEQ ID NO: 149810 - DNA, 25 bp, Mus musculus
agactgtttcgggaaagctgttaga

SEQ ID NO: 149811 - DNA, 25 bp, Mus musculus
agactgtttgataggattcctcaga

SEQ ID NO: 149812 - DNA, 25 bp, Mus musculus
agactgtttgattggattcctcaga

SEQ ID NO: 149813 - DNA, 25 bp, Mus musculus
agactgtttgccacatgcctgcctg

SEQ ID NO: 149814 - DNA, 25 bp, Mus musculus
agactgtttgcctcatgcctgcctg

SEQ ID NO: 149815 - DNA, 25 bp, Mus musculus
agactgttttagattccttgcagca

SEQ ID NO: 149816 - DNA, 25 bp, Mus musculus
agactgttttagtttccttgcagca

SEQ ID NO: 149817 - DNA, 25 bp, Mus musculus
agactgttttccaagctgattatga

SEQ ID NO: 149818 - DNA, 25 bp, Mus musculus
agactgttttcctagctgattatga

SEQ ID NO: 149819 - DNA, 25 bp, Mus musculus
agacttaaaagtcgcgtgcgttggc

SEQ ID NO: 149820 - DNA, 25 bp, Mus musculus
agacttaaaagtggcgtgcgttggc

SEQ ID NO: 149821 - DNA, 25 bp, Mus musculus
agacttaaatctctctcctacctgc

SEQ ID NO: 149822 - DNA, 25 bp, Mus musculus
agacttaaatctgtctcctacctgc

SEQ ID NO: 149823 - DNA, 25 bp, Mus musculus
agacttaagactctgcgtgacccat

SEQ ID NO: 149824 - DNA, 25 bp, Mus musculus
agacttaagactgtgcgtgacccat

SEQ ID NO: 149825 - DNA, 25 bp, Mus musculus
agacttaaggctcttccggcttaga

SEQ ID NO: 149826 - DNA, 25 bp, Mus musculus
agacttaaggctgttccggcttaga

SEQ ID NO: 149827 - DNA, 25 bp, Mus musculus
agacttaagtgaacagttgactggt

SEQ ID NO: 149828 - DNA, 25 bp, Mus musculus
agacttaagtgatcagttgactggt

SEQ ID NO: 149829 - DNA, 25 bp, Mus musculus
agacttaatcgaaaggttctggaag

SEQ ID NO: 149830 - DNA, 25 bp, Mus musculus
agacttaatcgataggttctggaag

SEQ ID NO: 149831 - DNA, 25 bp, Mus musculus
agacttaatcggcagctttctcaga

SEQ ID NO: 149832 - DNA, 25 bp, Mus musculus
agacttaatcgggagctttctcaga

SEQ ID NO: 149833 - DNA, 25 bp, Mus musculus
agacttacaccccagactatgacag

SEQ ID NO: 149834 - DNA, 25 bp, Mus musculus
agacttacacccgagactatgacag

SEQ ID NO: 149835 - DNA, 25 bp, Mus musculus
agacttacagcaccagtgagatcaa

SEQ ID NO: 149836 - DNA, 25 bp, Mus musculus
agacttacagcagcagtgagatcaa

SEQ ID NO: 149837 - DNA, 25 bp, Mus musculus
agacttacatgcagagtcaagactt

SEQ ID NO: 149838 - DNA, 25 bp, Mus musculus
agacttacatgctgagtcaagactt

SEQ ID NO: 149839 - DNA, 25 bp, Mus musculus
agacttacattacggaccaatacaa

SEQ ID NO: 149840 - DNA, 25 bp, Mus musculus
agacttacattagggaccaatacaa

SEQ ID NO: 149841 - DNA, 25 bp, Mus musculus
agacttaccaataacctcattcagc

SEQ ID NO: 149842 - DNA, 25 bp, Mus musculus
agacttaccaattacctcattcagc

SEQ ID NO: 149843 - DNA, 25 bp, Mus musculus
agacttaccgtaacaggacactcct

SEQ ID NO: 149844 - DNA, 25 bp, Mus musculus
agacttaccgtatcaggacactcct

SEQ ID NO: 149845 - DNA, 25 bp, Mus musculus
agacttacctcacaggccagatctg

SEQ ID NO: 149846 - DNA, 25 bp, Mus musculus
agacttacctcagaggccagatctg

SEQ ID NO: 149847 - DNA, 25 bp, Mus musculus
agacttacctctcgactagtgaaat

SEQ ID NO: 149848 - DNA, 25 bp, Mus musculus
agacttacctctggactagtgaaat

SEQ ID NO: 149849 - DNA, 25 bp, Mus musculus
agacttacgactcatgactagtagt

SEQ ID NO: 149850 - DNA, 25 bp, Mus musculus
agacttacgactgatgactagtagt

SEQ ID NO: 149851 - DNA, 25 bp, Mus musculus
agacttacgtagaactggcttgtta

SEQ ID NO: 149852 - DNA, 25 bp, Mus musculus
agacttacgtagtactggcttgtta

SEQ ID NO: 149853 - DNA, 25 bp, Mus musculus
agacttacgttaagccttttggact

SEQ ID NO: 149854 - DNA, 25 bp, Mus musculus
agacttacgttatgccttttggact

SEQ ID NO: 149855 - DNA, 25 bp, Mus musculus
agacttactactacatctcggtgcc

SEQ ID NO: 149856 - DNA, 25 bp, Mus musculus
agacttactacttcatctcggtgcc

SEQ ID NO: 149857 - DNA, 25 bp, Mus musculus
agacttactcctatgattctggtgt

SEQ ID NO: 149858 - DNA, 25 bp, Mus musculus
agacttactcctttgattctggtgt

SEQ ID NO: 149859 - DNA, 25 bp, Mus musculus
agacttagaagacccggcagaacct

SEQ ID NO: 149860 - DNA, 25 bp, Mus musculus
agacttagaagagccggcagaacct

SEQ ID NO: 149861 - DNA, 25 bp, Mus musculus
agacttagcagaagtcttcctcact

SEQ ID NO: 149862 - DNA, 25 bp, Mus musculus
agacttagcagatgtcttcctcact

SEQ ID NO: 149863 - DNA, 25 bp, Mus musculus
agacttagccccaggtgtggtggtc

SEQ ID NO: 149864 - DNA, 25 bp, Mus musculus
agacttagcccctggtgtggtggtc

SEQ ID NO: 149865 - DNA, 25 bp, Mus musculus
agacttagccttcggtacttcttgc

SEQ ID NO: 149866 - DNA, 25 bp, Mus musculus
agacttagccttgggtacttcttgc

SEQ ID NO: 149867 - DNA, 25 bp, Mus musculus
agacttagctgactgggacccatca

SEQ ID NO: 149868 - DNA, 25 bp, Mus musculus
agacttagctgagtgggacccatca

SEQ ID NO: 149869 - DNA, 25 bp, Mus musculus
agacttagcttccttgtttgcaggc

SEQ ID NO: 149870 - DNA, 25 bp, Mus musculus
agacttagcttcgttgtttgcaggc

SEQ ID NO: 149871 - DNA, 25 bp, Mus musculus
agacttaggtttcattaccagcacc

SEQ ID NO: 149872 - DNA, 25 bp, Mus musculus
agacttaggtttgattaccagcacc

SEQ ID NO: 149873 - DNA, 25 bp, Mus musculus
agacttagttggatttgtggctcat

SEQ ID NO: 149874 - DNA, 25 bp, Mus musculus
agacttagttggttttgtggctcat

SEQ ID NO: 149875 - DNA, 25 bp, Mus musculus
agacttatactcaatgaccactaac

SEQ ID NO: 149876 - DNA, 25 bp, Mus musculus
agacttatactctatgaccactaac

SEQ ID NO: 149877 - DNA, 25 bp, Mus musculus
agacttatcaccaccattacagctc

SEQ ID NO: 149878 - DNA, 25 bp, Mus musculus
agacttatcaccaggaggctcacca

SEQ ID NO: 149879 - DNA, 25 bp, Mus musculus
agacttatcacctccattacagctc

SEQ ID NO: 149880 - DNA, 25 bp, Mus musculus
agacttatcacctggaggctcacca

SEQ ID NO: 149881 - DNA, 25 bp, Mus musculus
agacttatcttcacgttgcttctta

SEQ ID NO: 149882 - DNA, 25 bp, Mus musculus
agacttatcttctcgttgcttctta

SEQ ID NO: 149883 - DNA, 25 bp, Mus musculus
agacttatcttgaggacctatcatt

SEQ ID NO: 149884 - DNA, 25 bp, Mus musculus
agacttatcttgtggacctatcatt

SEQ ID NO: 149885 - DNA, 25 bp, Mus musculus
agacttattggtctacggaggctgc

SEQ ID NO: 149886 - DNA, 25 bp, Mus musculus
agacttattggtgtacggaggctgc

SEQ ID NO: 149887 - DNA, 25 bp, Mus musculus
agacttatttccaatgcatcatttc

SEQ ID NO: 149888 - DNA, 25 bp, Mus musculus
agacttatttcctatgcatcatttc

SEQ ID NO: 149889 - DNA, 25 bp, Mus musculus
agacttcaacgaagcctttataaaa

SEQ ID NO: 149890 - DNA, 25 bp, Mus musculus
agacttcaacgatgcctttataaaa

SEQ ID NO: 149891 - DNA, 25 bp, Mus musculus
agacttcaagttagacaccccagtg

SEQ ID NO: 149892 - DNA, 25 bp, Mus musculus
agacttcaagtttgacaccccagtg

SEQ ID NO: 149893 - DNA, 25 bp, Mus musculus
agacttcacaacagcctctatcaca

SEQ ID NO: 149894 - DNA, 25 bp, Mus musculus
agacttcacaactgcctctatcaca

SEQ ID NO: 149895 - DNA, 25 bp, Mus musculus
agacttcacttcagaaccaccggct

SEQ ID NO: 149896 - DNA, 25 bp, Mus musculus
agacttcacttctgaaccaccggct

SEQ ID NO: 149897 - DNA, 25 bp, Mus musculus
agacttcagaatatattgagattgt

SEQ ID NO: 149898 - DNA, 25 bp, Mus musculus
agacttcagaatttattgagattgt

SEQ ID NO: 149899 - DNA, 25 bp, Mus musculus
agacttcagcaacccactgtatgaa

SEQ ID NO: 149900 - DNA, 25 bp, Mus musculus
agacttcagcaagccactgtatgaa

SEQ ID NO: 149901 - DNA, 25 bp, Mus musculus
agacttcaggacctgggatgccagt

SEQ ID NO: 149902 - DNA, 25 bp, Mus musculus
agacttcaggacgtgggatgccagt

SEQ ID NO: 149903 - DNA, 25 bp, Mus musculus
agacttcaggcacaacgagtgggtt

SEQ ID NO: 149904 - DNA, 25 bp, Mus musculus
agacttcaggcagaacgagtgggtt

SEQ ID NO: 149905 - DNA, 25 bp, Mus musculus
agacttcaggtcaaaccccatggtt

SEQ ID NO: 149906 - DNA, 25 bp, Mus musculus
agacttcaggtcagcttagagtgca

SEQ ID NO: 149907 - DNA, 25 bp, Mus musculus
agacttcaggtctaaccccatggtt

SEQ ID NO: 149908 - DNA, 25 bp, Mus musculus
agacttcaggtctgcttagagtgca

SEQ ID NO: 149909 - DNA, 25 bp, Mus musculus
agacttcagtctctctcaggtgctc

SEQ ID NO: 149910 - DNA, 25 bp, Mus musculus
agacttcagtctgtctcaggtgctc

SEQ ID NO: 149911 - DNA, 25 bp, Mus musculus
agacttcagtgaactcaggtcagca

SEQ ID NO: 149912 - DNA, 25 bp, Mus musculus
agacttcagtgatctcaggtcagca

SEQ ID NO: 149913 - DNA, 25 bp, Mus musculus
agacttcataaccactagctagctc

SEQ ID NO: 149914 - DNA, 25 bp, Mus musculus
agacttcataacgactagctagctc

SEQ ID NO: 149915 - DNA, 25 bp, Mus musculus
agacttcatatgagtaccatcaata

SEQ ID NO: 149916 - DNA, 25 bp, Mus musculus
agacttcatatgtgtaccatcaata

SEQ ID NO: 149917 - DNA, 25 bp, Mus musculus
agacttcatcttaactttcctgttg

SEQ ID NO: 149918 - DNA, 25 bp, Mus musculus
agacttcatctttactttcctgttg

SEQ ID NO: 149919 - DNA, 25 bp, Mus musculus
agacttcatgctagacggccaacgt

SEQ ID NO: 149920 - DNA, 25 bp, Mus musculus
agacttcatgcttgacggccaacgt

SEQ ID NO: 149921 - DNA, 25 bp, Mus musculus
agacttcatttcatttcaccaggct

SEQ ID NO: 149922 - DNA, 25 bp, Mus musculus
agacttcatttcttttcaccaggct

SEQ ID NO: 149923 - DNA, 25 bp, Mus musculus
agacttccacgcatgcatcaatgca

SEQ ID NO: 149924 - DNA, 25 bp, Mus musculus
agacttccacgcttgcatcaatgca

SEQ ID NO: 149925 - DNA, 25 bp, Mus musculus
agacttccagaaactcatccaatga

SEQ ID NO: 149926 - DNA, 25 bp, Mus musculus
agacttccagaatctcatccaatga

SEQ ID NO: 149927 - DNA, 25 bp, Mus musculus
agacttccagatcaaggctctctgc

SEQ ID NO: 149928 - DNA, 25 bp, Mus musculus
agacttccagatgaaggctctctgc

SEQ ID NO: 149929 - DNA, 25 bp, Mus musculus
agacttccatataagcttccttcaa

SEQ ID NO: 149930 - DNA, 25 bp, Mus musculus
agacttccatattagcttccttcaa

SEQ ID NO: 149931 - DNA, 25 bp, Mus musculus
agacttccatgaaaggtttctctgt

SEQ ID NO: 149932 - DNA, 25 bp, Mus musculus
agacttccatgataggtttctctgt

SEQ ID NO: 149933 - DNA, 25 bp, Mus musculus
agacttcccaatcactcttgtttta

SEQ ID NO: 149934 - DNA, 25 bp, Mus musculus
agacttcccaatgactcttgtttta

SEQ ID NO: 149935 - DNA, 25 bp, Mus musculus
agacttcccactccaaatactgtac

SEQ ID NO: 149936 - DNA, 25 bp, Mus musculus
agacttcccactgcaaatactgtac

SEQ ID NO: 149937 - DNA, 25 bp, Mus musculus
agacttcccagacccagatgactgg

SEQ ID NO: 149938 - DNA, 25 bp, Mus musculus
agacttcccagagccagatgactgg

SEQ ID NO: 149939 - DNA, 25 bp, Mus musculus
agacttcccctgacatctcagagtt

SEQ ID NO: 149940 - DNA, 25 bp, Mus musculus
agacttcccctgtcatctcagagtt

SEQ ID NO: 149941 - DNA, 25 bp, Mus musculus
agacttcccgacagtgcccaagctg

SEQ ID NO: 149942 - DNA, 25 bp, Mus musculus
agacttcccgactgtgcccaagctg

SEQ ID NO: 149943 - DNA, 25 bp, Mus musculus
agacttccctatctaccatttaaga

SEQ ID NO: 149944 - DNA, 25 bp, Mus musculus
agacttccctatgtaccatttaaga

SEQ ID NO: 149945 - DNA, 25 bp, Mus musculus
agacttccctctctacggttgtcgc

SEQ ID NO: 149946 - DNA, 25 bp, Mus musculus
agacttccctctgtacggttgtcgc

SEQ ID NO: 149947 - DNA, 25 bp, Mus musculus
agacttccctgtacccgcatatgac

SEQ ID NO: 149948 - DNA, 25 bp, Mus musculus
agacttccctgttcccgcatatgac

SEQ ID NO: 149949 - DNA, 25 bp, Mus musculus
agacttcccttccattaacgtggat

SEQ ID NO: 149950 - DNA, 25 bp, Mus musculus
agacttcccttcgattaacgtggat

SEQ ID NO: 149951 - DNA, 25 bp, Mus musculus
agacttccggaacattgagcctcat

SEQ ID NO: 149952 - DNA, 25 bp, Mus musculus
agacttccggaagattgagcctcat

SEQ ID NO: 149953 - DNA, 25 bp, Mus musculus
agacttccggtcacagatgcacaac

SEQ ID NO: 149954 - DNA, 25 bp, Mus musculus
agacttccggtctcagatgcacaac

SEQ ID NO: 149955 - DNA, 25 bp, Mus musculus
agacttcctaacagtggccccattc

SEQ ID NO: 149956 - DNA, 25 bp, Mus musculus
agacttcctaactgtggccccattc

SEQ ID NO: 149957 - DNA, 25 bp, Mus musculus
agacttcctagccagaacaaagtga

SEQ ID NO: 149958 - DNA, 25 bp, Mus musculus
agacttcctagcgagaacaaagtga

SEQ ID NO: 149959 - DNA, 25 bp, Mus musculus
agacttcctcacagaactgtcggtt

SEQ ID NO: 149960 - DNA, 25 bp, Mus musculus
agacttcctcactgaactgtcggtt

SEQ ID NO: 149961 - DNA, 25 bp, Mus musculus
agacttcctgctcaagtagatgtag

SEQ ID NO: 149962 - DNA, 25 bp, Mus musculus
agacttcctgctgaagtagatgtag

SEQ ID NO: 149963 - DNA, 25 bp, Mus musculus
agacttcctggactgttcttatgtg

SEQ ID NO: 149964 - DNA, 25 bp, Mus musculus
agacttcctggagtgttcttatgtg

SEQ ID NO: 149965 - DNA, 25 bp, Mus musculus
agacttcctggtattctggttctta

SEQ ID NO: 149966 - DNA, 25 bp, Mus musculus
agacttcctggttttctggttctta

SEQ ID NO: 149967 - DNA, 25 bp, Mus musculus
agacttcctgtacaagtggctcagt

SEQ ID NO: 149968 - DNA, 25 bp, Mus musculus
agacttcctgtagaagtggctcagt

SEQ ID NO: 149969 - DNA, 25 bp, Mus musculus
agacttcctttaatgctatattccg

SEQ ID NO: 149970 - DNA, 25 bp, Mus musculus
agacttcctttacccctttgatggg

SEQ ID NO: 149971 - DNA, 25 bp, Mus musculus
agacttcctttagccctttgatggg

SEQ ID NO: 149972 - DNA, 25 bp, Mus musculus
agacttcctttattgctatattccg

SEQ ID NO: 149973 - DNA, 25 bp, Mus musculus
agacttccttttagcaaagcacttg

SEQ ID NO: 149974 - DNA, 25 bp, Mus musculus
agacttcctttttgcaaagcacttg

SEQ ID NO: 149975 - DNA, 25 bp, Mus musculus
agacttcgaaaacctctggcgctgg

SEQ ID NO: 149976 - DNA, 25 bp, Mus musculus
agacttcgaaaagctctggcgctgg

SEQ ID NO: 149977 - DNA, 25 bp, Mus musculus
agacttcgacggagctgcctgggat

SEQ ID NO: 149978 - DNA, 25 bp, Mus musculus
agacttcgacggtgctgcctgggat

SEQ ID NO: 149979 - DNA, 25 bp, Mus musculus
agacttcgagcacgagatggccact

SEQ ID NO: 149980 - DNA, 25 bp, Mus musculus
agacttcgagcaggagatggccact

SEQ ID NO: 149981 - DNA, 25 bp, Mus musculus
agacttcgctttaacaacagggtgt

SEQ ID NO: 149982 - DNA, 25 bp, Mus musculus
agacttcgcttttacaacagggtgt

SEQ ID NO: 149983 - DNA, 25 bp, Mus musculus
agacttcgtccaaccagcagggaaa

SEQ ID NO: 149984 - DNA, 25 bp, Mus musculus
agacttcgtccatccagcagggaaa

SEQ ID NO: 149985 - DNA, 25 bp, Mus musculus
agacttcgtgaactggctgctggca

SEQ ID NO: 149986 - DNA, 25 bp, Mus musculus
agacttcgtgaagtggctgctggca

SEQ ID NO: 149987 - DNA, 25 bp, Mus musculus
agacttctaattatttcctgcctag

SEQ ID NO: 149988 - DNA, 25 bp, Mus musculus
agacttctaattttttcctgcctag

SEQ ID NO: 149989 - DNA, 25 bp, Mus musculus
agacttctagagattgcccacctga

SEQ ID NO: 149990 - DNA, 25 bp, Mus musculus
agacttctagagtttgcccacctga

SEQ ID NO: 149991 - DNA, 25 bp, Mus musculus
agacttctagcaccacctattttgt

SEQ ID NO: 149992 - DNA, 25 bp, Mus musculus
agacttctagcagcacctattttgt

SEQ ID NO: 149993 - DNA, 25 bp, Mus musculus
agacttctaggtcatgcatctaaga

SEQ ID NO: 149994 - DNA, 25 bp, Mus musculus
agacttctaggtgatgcatctaaga

SEQ ID NO: 149995 - DNA, 25 bp, Mus musculus
agacttctatcacatcactcaacct

SEQ ID NO: 149996 - DNA, 25 bp, Mus musculus
agacttctatcagatcactcaacct

SEQ ID NO: 149997 - DNA, 25 bp, Mus musculus
agacttctatggacacagctccctg

SEQ ID NO: 149998 - DNA, 25 bp, Mus musculus
agacttctatggtcacagctccctg

SEQ ID NO: 149999 - DNA, 25 bp, Mus musculus
agacttctatttacatgttaccatt

SEQ ID NO: 150000 - DNA, 25 bp, Mus musculus
agacttctatttagcaatgattttc

SEQ ID NO: 150001 - DNA, 25 bp, Mus musculus
agacttctattttcatgttaccatt

SEQ ID NO: 150002 - DNA, 25 bp, Mus musculus
agacttctattttgcaatgattttc

SEQ ID NO: 150003 - DNA, 25 bp, Mus musculus
agacttctcagactcgggcttctgt

SEQ ID NO: 150004 - DNA, 25 bp, Mus musculus
agacttctcagagtcgggcttctgt

SEQ ID NO: 150005 - DNA, 25 bp, Mus musculus
agacttctcatccaatcttatattg

SEQ ID NO: 150006 - DNA, 25 bp, Mus musculus
agacttctcatcgaatcttatattg

SEQ ID NO: 150007 - DNA, 25 bp, Mus musculus
agacttctctccacaatggtgacag

SEQ ID NO: 150008 - DNA, 25 bp, Mus musculus
agacttctctcctcaatggtgacag

SEQ ID NO: 150009 - DNA, 25 bp, Mus musculus
agacttctctttctgacggcaccca

SEQ ID NO: 150010 - DNA, 25 bp, Mus musculus
agacttctctttgtgacggcaccca

SEQ ID NO: 150011 - DNA, 25 bp, Mus musculus
agacttctgccaagccttgttctca

SEQ ID NO: 150012 - DNA, 25 bp, Mus musculus
agacttctgccatgccttgttctca

SEQ ID NO: 150013 - DNA, 25 bp, Mus musculus
agacttctgctcagagttcctggag

SEQ ID NO: 150014 - DNA, 25 bp, Mus musculus
agacttctgctctgagttcctggag

SEQ ID NO: 150015 - DNA, 25 bp, Mus musculus
agacttctgctgatgcagtgagccc

SEQ ID NO: 150016 - DNA, 25 bp, Mus musculus
agacttctgctgcacgcagcatgga

SEQ ID NO: 150017 - DNA, 25 bp, Mus musculus
agacttctgctggacgcagcatgga

SEQ ID NO: 150018 - DNA, 25 bp, Mus musculus
agacttctgctgttgcagtgagccc

SEQ ID NO: 150019 - DNA, 25 bp, Mus musculus
agacttctggcaaggcacgtttgac

SEQ ID NO: 150020 - DNA, 25 bp, Mus musculus
agacttctggcatggcacgtttgac

SEQ ID NO: 150021 - DNA, 25 bp, Mus musculus
agacttcttacaatcttctctcatt

SEQ ID NO: 150022 - DNA, 25 bp, Mus musculus
agacttcttacattcttctctcatt

SEQ ID NO: 150023 - DNA, 25 bp, Mus musculus
agacttcttccaaggaccacagaca

SEQ ID NO: 150024 - DNA, 25 bp, Mus musculus
agacttcttccatggaccacagaca

SEQ ID NO: 150025 - DNA, 25 bp, Mus musculus
agacttcttggtagcactagcccat

SEQ ID NO: 150026 - DNA, 25 bp, Mus musculus
agacttcttggttgcactagcccat

SEQ ID NO: 150027 - DNA, 25 bp, Mus musculus
agacttctttctatgtgccttgatg

SEQ ID NO: 150028 - DNA, 25 bp, Mus musculus
agacttctttctttgtgccttgatg

SEQ ID NO: 150029 - DNA, 25 bp, Mus musculus
agacttctttgactctgcagctatc

SEQ ID NO: 150030 - DNA, 25 bp, Mus musculus
agacttctttgagtctgcagctatc

SEQ ID NO: 150031 - DNA, 25 bp, Mus musculus
agacttcttttacagccaggcctga

SEQ ID NO: 150032 - DNA, 25 bp, Mus musculus
agacttcttttagagccaggcctga

SEQ ID NO: 150033 - DNA, 25 bp, Mus musculus
agacttcttttcacgtctctgactt

SEQ ID NO: 150034 - DNA, 25 bp, Mus musculus
agacttcttttctcgtctctgactt

SEQ ID NO: 150035 - DNA, 25 bp, Mus musculus
agacttgaacagaaggctcttcctc

SEQ ID NO: 150036 - DNA, 25 bp, Mus musculus
agacttgaacagtaggctcttcctc

SEQ ID NO: 150037 - DNA, 25 bp, Mus musculus
agacttgaactccattttctccaca

SEQ ID NO: 150038 - DNA, 25 bp, Mus musculus
agacttgaactcgattttctccaca

SEQ ID NO: 150039 - DNA, 25 bp, Mus musculus
agacttgaagtcacgacagatgagg

SEQ ID NO: 150040 - DNA, 25 bp, Mus musculus
agacttgaagtctcgacagatgagg

SEQ ID NO: 150041 - DNA, 25 bp, Mus musculus
agacttgaatcgcaaggacagaaca

SEQ ID NO: 150042 - DNA, 25 bp, Mus musculus
agacttgaatcggaaggacagaaca

SEQ ID NO: 150043 - DNA, 25 bp, Mus musculus
agacttgagataacacattctcaga

SEQ ID NO: 150044 - DNA, 25 bp, Mus musculus
agacttgagatacttgtggtttaaa

SEQ ID NO: 150045 - DNA, 25 bp, Mus musculus
agacttgagatagttgtggtttaaa

SEQ ID NO: 150046 - DNA, 25 bp, Mus musculus
agacttgagatatcacattctcaga

SEQ ID NO: 150047 - DNA, 25 bp, Mus musculus
agacttgagcaacgcacacatggat

SEQ ID NO: 150048 - DNA, 25 bp, Mus musculus
agacttgagcaaggcacacatggat

SEQ ID NO: 150049 - DNA, 25 bp, Mus musculus
agacttgagcttcggtcatcattgc

SEQ ID NO: 150050 - DNA, 25 bp, Mus musculus
agacttgagcttgggtcatcattgc

SEQ ID NO: 150051 - DNA, 25 bp, Mus musculus
agacttgagggactagtaacatctt

SEQ ID NO: 150052 - DNA, 25 bp, Mus musculus
agacttgagggagtagtaacatctt

SEQ ID NO: 150053 - DNA, 25 bp, Mus musculus
agacttgagtgacaggtatttccga

SEQ ID NO: 150054 - DNA, 25 bp, Mus musculus
agacttgagtgagaggtatttccga

SEQ ID NO: 150055 - DNA, 25 bp, Mus musculus
agacttgagtttctatactttaata

SEQ ID NO: 150056 - DNA, 25 bp, Mus musculus
agacttgagtttgtatactttaata

SEQ ID NO: 150057 - DNA, 25 bp, Mus musculus
agacttgataaaactggagcagctt

SEQ ID NO: 150058 - DNA, 25 bp, Mus musculus
agacttgataaatctggagcagctt

SEQ ID NO: 150059 - DNA, 25 bp, Mus musculus
agacttgatagtcccatttgtagat

SEQ ID NO: 150060 - DNA, 25 bp, Mus musculus
agacttgatagtgccatttgtagat

SEQ ID NO: 150061 - DNA, 25 bp, Mus musculus
agacttgatgctccagctcaggctg

SEQ ID NO: 150062 - DNA, 25 bp, Mus musculus
agacttgatgctgcagctcaggctg

SEQ ID NO: 150063 - DNA, 25 bp, Mus musculus
agacttgatgttaccttggctataa

SEQ ID NO: 150064 - DNA, 25 bp, Mus musculus
agacttgatgtttccttggctataa

SEQ ID NO: 150065 - DNA, 25 bp, Mus musculus
agacttgattaacacaggtgacgat

SEQ ID NO: 150066 - DNA, 25 bp, Mus musculus
agacttgattaagacaggtgacgat

SEQ ID NO: 150067 - DNA, 25 bp, Mus musculus
agacttgattctcagctctgttcgt

SEQ ID NO: 150068 - DNA, 25 bp, Mus musculus
agacttgattctgagctctgttcgt

SEQ ID NO: 150069 - DNA, 25 bp, Mus musculus
agacttgattggaagcacgctgagt

SEQ ID NO: 150070 - DNA, 25 bp, Mus musculus
agacttgattggtagcacgctgagt

SEQ ID NO: 150071 - DNA, 25 bp, Mus musculus
agacttgcaactacttgccccttgg

SEQ ID NO: 150072 - DNA, 25 bp, Mus musculus
agacttgcaacttcttgccccttgg

SEQ ID NO: 150073 - DNA, 25 bp, Mus musculus
agacttgcaagacctacgctgtgcc

SEQ ID NO: 150074 - DNA, 25 bp, Mus musculus
agacttgcaagagctacgctgtgcc

SEQ ID NO: 150075 - DNA, 25 bp, Mus musculus
agacttgcaggcagaaggattccct

SEQ ID NO: 150076 - DNA, 25 bp, Mus musculus
agacttgcaggctgaaggattccct

SEQ ID NO: 150077 - DNA, 25 bp, Mus musculus
agacttgccactactctgtagcaat

SEQ ID NO: 150078 - DNA, 25 bp, Mus musculus
agacttgccacttctctgtagcaat

SEQ ID NO: 150079 - DNA, 25 bp, Mus musculus
agacttgcctaacgatatctcacct

SEQ ID NO: 150080 - DNA, 25 bp, Mus musculus
agacttgcctaaggatatctcacct

SEQ ID NO: 150081 - DNA, 25 bp, Mus musculus
agacttgcctcaaacaactgagcca

SEQ ID NO: 150082 - DNA, 25 bp, Mus musculus
agacttgcctcatacaactgagcca

SEQ ID NO: 150083 - DNA, 25 bp, Mus musculus
agacttgcctctaactaactacgaa

SEQ ID NO: 150084 - DNA, 25 bp, Mus musculus
agacttgcctcttactaactacgaa

SEQ ID NO: 150085 - DNA, 25 bp, Mus musculus
agacttgcctgtacctagaggactt

SEQ ID NO: 150086 - DNA, 25 bp, Mus musculus
agacttgcctgtcattttgcccagc

SEQ ID NO: 150087 - DNA, 25 bp, Mus musculus
agacttgcctgtgattttgcccagc

SEQ ID NO: 150088 - DNA, 25 bp, Mus musculus
agacttgcctgttcctagaggactt

SEQ ID NO: 150089 - DNA, 25 bp, Mus musculus
agacttgctagtatggtagctggca

SEQ ID NO: 150090 - DNA, 25 bp, Mus musculus
agacttgctagtttggtagctggca

SEQ ID NO: 150091 - DNA, 25 bp, Mus musculus
agacttgctcacaactgacaggagt

SEQ ID NO: 150092 - DNA, 25 bp, Mus musculus
agacttgctcactactgacaggagt

SEQ ID NO: 150093 - DNA, 25 bp, Mus musculus
agacttgctcagctgatagatccag

SEQ ID NO: 150094 - DNA, 25 bp, Mus musculus
agacttgctcaggtgatagatccag

SEQ ID NO: 150095 - DNA, 25 bp, Mus musculus
agacttgctctcagactcactgcag

SEQ ID NO: 150096 - DNA, 25 bp, Mus musculus
agacttgctctctgactcactgcag

SEQ ID NO: 150097 - DNA, 25 bp, Mus musculus
agacttgctgaacaagggcctgtca

SEQ ID NO: 150098 - DNA, 25 bp, Mus musculus
agacttgctgaagaagggcctgtca

SEQ ID NO: 150099 - DNA, 25 bp, Mus musculus
agacttgctgctaagtcactcatgt

SEQ ID NO: 150100 - DNA, 25 bp, Mus musculus
agacttgctgcttagtcactcatgt

SEQ ID NO: 150101 - DNA, 25 bp, Mus musculus
agacttgctggcaggcatcttcatt

SEQ ID NO: 150102 - DNA, 25 bp, Mus musculus
agacttgctggctggcatcttcatt

SEQ ID NO: 150103 - DNA, 25 bp, Mus musculus
agacttgctggtcagatggcaactc

SEQ ID NO: 150104 - DNA, 25 bp, Mus musculus
agacttgctggtgagatggcaactc

SEQ ID NO: 150105 - DNA, 25 bp, Mus musculus
agacttgctttactctgtggacaaa

SEQ ID NO: 150106 - DNA, 25 bp, Mus musculus
agacttgctttagtctgtggacaaa

SEQ ID NO: 150107 - DNA, 25 bp, Mus musculus
agacttgctttccaagccaggcatt

SEQ ID NO: 150108 - DNA, 25 bp, Mus musculus
agacttgctttcgaagccaggcatt

SEQ ID NO: 150109 - DNA, 25 bp, Mus musculus
agacttggaagactacctgttgctc

SEQ ID NO: 150110 - DNA, 25 bp, Mus musculus
agacttggaagagtacctgttgctc

SEQ ID NO: 150111 - DNA, 25 bp, Mus musculus
agacttggagccacaatcccggaaa

SEQ ID NO: 150112 - DNA, 25 bp, Mus musculus
agacttggagcctcaatcccggaaa

SEQ ID NO: 150113 - DNA, 25 bp, Mus musculus
agacttggcatgacagtgagctctt

SEQ ID NO: 150114 - DNA, 25 bp, Mus musculus
agacttggcatgtcagtgagctctt

SEQ ID NO: 150115 - DNA, 25 bp, Mus musculus
agacttggctctagctgctgagttt

SEQ ID NO: 150116 - DNA, 25 bp, Mus musculus
agacttggctcttgctgctgagttt

SEQ ID NO: 150117 - DNA, 25 bp, Mus musculus
agacttggcttaaacctgtagcctc

SEQ ID NO: 150118 - DNA, 25 bp, Mus musculus
agacttggcttaattgggttgatac

SEQ ID NO: 150119 - DNA, 25 bp, Mus musculus
agacttggcttatacctgtagcctc

SEQ ID NO: 150120 - DNA, 25 bp, Mus musculus
agacttggcttatttgggttgatac

SEQ ID NO: 150121 - DNA, 25 bp, Mus musculus
agacttgggaccagccttgggacca

SEQ ID NO: 150122 - DNA, 25 bp, Mus musculus
agacttgggacctgccttgggacca

SEQ ID NO: 150123 - DNA, 25 bp, Mus musculus
agacttgggagtccctggcttcttc

SEQ ID NO: 150124 - DNA, 25 bp, Mus musculus
agacttgggagtctaatttctgact

SEQ ID NO: 150125 - DNA, 25 bp, Mus musculus
agacttgggagtgcctggcttcttc

SEQ ID NO: 150126 - DNA, 25 bp, Mus musculus
agacttgggagtgtaatttctgact

SEQ ID NO: 150127 - DNA, 25 bp, Mus musculus
agacttgggtttcctcacgttagct

SEQ ID NO: 150128 - DNA, 25 bp, Mus musculus
agacttgggtttgctcacgttagct

SEQ ID NO: 150129 - DNA, 25 bp, Mus musculus
agacttggtccaaactgcctgagct

SEQ ID NO: 150130 - DNA, 25 bp, Mus musculus
agacttggtccatactgcctgagct

SEQ ID NO: 150131 - DNA, 25 bp, Mus musculus
agacttggtccccagaatgagagac

SEQ ID NO: 150132 - DNA, 25 bp, Mus musculus
agacttggtcccgagaatgagagac

SEQ ID NO: 150133 - DNA, 25 bp, Mus musculus
agacttggtttgctatctctgccct

SEQ ID NO: 150134 - DNA, 25 bp, Mus musculus
agacttggtttggtatctctgccct

SEQ ID NO: 150135 - DNA, 25 bp, Mus musculus
agacttgtaatgctttcccctcctc

SEQ ID NO: 150136 - DNA, 25 bp, Mus musculus
agacttgtaatggtttcccctcctc

SEQ ID NO: 150137 - DNA, 25 bp, Mus musculus
agacttgtacacaggcgtgccttta

SEQ ID NO: 150138 - DNA, 25 bp, Mus musculus
agacttgtacactggcgtgccttta

SEQ ID NO: 150139 - DNA, 25 bp, Mus musculus
agacttgtacatatgaagacaccat

SEQ ID NO: 150140 - DNA, 25 bp, Mus musculus
agacttgtacatttgaagacaccat

SEQ ID NO: 150141 - DNA, 25 bp, Mus musculus
agacttgtatttcctcttacggttg

SEQ ID NO: 150142 - DNA, 25 bp, Mus musculus
agacttgtatttgctcttacggttg

SEQ ID NO: 150143 - DNA, 25 bp, Mus musculus
agacttgtcaccacagctgttccct

SEQ ID NO: 150144 - DNA, 25 bp, Mus musculus
agacttgtcacctcagctgttccct

SEQ ID NO: 150145 - DNA, 25 bp, Mus musculus
agacttgtcaggatctccctctgaa

SEQ ID NO: 150146 - DNA, 25 bp, Mus musculus
agacttgtcaggttctccctctgaa

SEQ ID NO: 150147 - DNA, 25 bp, Mus musculus
agacttgtccccatggtctcagatg

SEQ ID NO: 150148 - DNA, 25 bp, Mus musculus
agacttgtccccttggtctcagatg

SEQ ID NO: 150149 - DNA, 25 bp, Mus musculus
agacttgtcgtgctgttgctcatac

SEQ ID NO: 150150 - DNA, 25 bp, Mus musculus
agacttgtcgtggtgttgctcatac

SEQ ID NO: 150151 - DNA, 25 bp, Mus musculus
agacttgtctagcttccttagctaa

SEQ ID NO: 150152 - DNA, 25 bp, Mus musculus
agacttgtctaggttccttagctaa

SEQ ID NO: 150153 - DNA, 25 bp, Mus musculus
agacttgtctgcctgcattcagatg

SEQ ID NO: 150154 - DNA, 25 bp, Mus musculus
agacttgtctgcgtgcattcagatg

SEQ ID NO: 150155 - DNA, 25 bp, Mus musculus
agacttgtctttcattatcccctaa

SEQ ID NO: 150156 - DNA, 25 bp, Mus musculus
agacttgtctttgattatcccctaa

SEQ ID NO: 150157 - DNA, 25 bp, Mus musculus
agacttgtgaatcgcacctcctggg

SEQ ID NO: 150158 - DNA, 25 bp, Mus musculus
agacttgtgaatggcacctcctggg

SEQ ID NO: 150159 - DNA, 25 bp, Mus musculus
agacttgtgagtcagccctggctgc

SEQ ID NO: 150160 - DNA, 25 bp, Mus musculus
agacttgtgagtgagccctggctgc

SEQ ID NO: 150161 - DNA, 25 bp, Mus musculus
agacttgtgctaattattgtttttg

SEQ ID NO: 150162 - DNA, 25 bp, Mus musculus
agacttgtgctatttattgtttttg

SEQ ID NO: 150163 - DNA, 25 bp, Mus musculus
agacttgtggttactttacttcctg

SEQ ID NO: 150164 - DNA, 25 bp, Mus musculus
agacttgtggtttctttacttcctg

SEQ ID NO: 150165 - DNA, 25 bp, Mus musculus
agacttgtgtccagcgtggccgaag

SEQ ID NO: 150166 - DNA, 25 bp, Mus musculus
agacttgtgtcctgcgtggccgaag

SEQ ID NO: 150167 - DNA, 25 bp, Mus musculus
agacttgttaccacatactttggag

SEQ ID NO: 150168 - DNA, 25 bp, Mus musculus
agacttgttacctcatactttggag

SEQ ID NO: 150169 - DNA, 25 bp, Mus musculus
agacttgttcaccagcttagagact

SEQ ID NO: 150170 - DNA, 25 bp, Mus musculus
agacttgttcacgagcttagagact

SEQ ID NO: 150171 - DNA, 25 bp, Mus musculus
agacttgttccaccatctgtgagct

SEQ ID NO: 150172 - DNA, 25 bp, Mus musculus
agacttgttccagcatctgtgagct

SEQ ID NO: 150173 - DNA, 25 bp, Mus musculus
agacttgttccccacagcggccaag

SEQ ID NO: 150174 - DNA, 25 bp, Mus musculus
agacttgttcccgacagcggccaag

SEQ ID NO: 150175 - DNA, 25 bp, Mus musculus
agactttaaaagaggtgctgggagt

SEQ ID NO: 150176 - DNA, 25 bp, Mus musculus
agactttaaaagtggtgctgggagt

SEQ ID NO: 150177 - DNA, 25 bp, Mus musculus
agactttaactcaagctaagactaa

SEQ ID NO: 150178 - DNA, 25 bp, Mus musculus
agactttaactctagctaagactaa

SEQ ID NO: 150179 - DNA, 25 bp, Mus musculus
agactttaatctctattttctggat

SEQ ID NO: 150180 - DNA, 25 bp, Mus musculus
agactttaatctgtattttctggat

SEQ ID NO: 150181 - DNA, 25 bp, Mus musculus
agactttaccatctggagacgccta

SEQ ID NO: 150182 - DNA, 25 bp, Mus musculus
agactttaccatgtggagacgccta

SEQ ID NO: 150183 - DNA, 25 bp, Mus musculus
agactttaccctaagatctgtatgt

SEQ ID NO: 150184 - DNA, 25 bp, Mus musculus
agactttacccttagatctgtatgt

SEQ ID NO: 150185 - DNA, 25 bp, Mus musculus
agactttactttctgcactgggaat

SEQ ID NO: 150186 - DNA, 25 bp, Mus musculus
agactttactttgtgcactgggaat

SEQ ID NO: 150187 - DNA, 25 bp, Mus musculus
agactttagcctaagactctggcat

SEQ ID NO: 150188 - DNA, 25 bp, Mus musculus
agactttagccttagactctggcat

SEQ ID NO: 150189 - DNA, 25 bp, Mus musculus
agactttattctctgatccaggcga

SEQ ID NO: 150190 - DNA, 25 bp, Mus musculus
agactttattctgtgatccaggcga

SEQ ID NO: 150191 - DNA, 25 bp, Mus musculus
agactttattggagtgggcttctca

SEQ ID NO: 150192 - DNA, 25 bp, Mus musculus
agactttattggtgtgggcttctca

SEQ ID NO: 150193 - DNA, 25 bp, Mus musculus
agactttcaagtacactgtttataa

SEQ ID NO: 150194 - DNA, 25 bp, Mus musculus
agactttcaagttcactgtttataa

SEQ ID NO: 150195 - DNA, 25 bp, Mus musculus
agactttcagcacatttctcttatg

SEQ ID NO: 150196 - DNA, 25 bp, Mus musculus
agactttcagcagatttctcttatg

SEQ ID NO: 150197 - DNA, 25 bp, Mus musculus
agactttcagtgatctgtgtgcatc

SEQ ID NO: 150198 - DNA, 25 bp, Mus musculus
agactttcagtgttctgtgtgcatc

SEQ ID NO: 150199 - DNA, 25 bp, Mus musculus
agactttcagttatctcccttctca

SEQ ID NO: 150200 - DNA, 25 bp, Mus musculus
agactttcagttttctcccttctca

SEQ ID NO: 150201 - DNA, 25 bp, Mus musculus
agactttccaaacacagcctactgt

SEQ ID NO: 150202 - DNA, 25 bp, Mus musculus
agactttccaaagacagcctactgt

SEQ ID NO: 150203 - DNA, 25 bp, Mus musculus
agactttcctgacttccgtatgcat

SEQ ID NO: 150204 - DNA, 25 bp, Mus musculus
agactttcctgagttccgtatgcat

SEQ ID NO: 150205 - DNA, 25 bp, Mus musculus
agactttcctgccaggtccaaggag

SEQ ID NO: 150206 - DNA, 25 bp, Mus musculus
agactttcctgcgaggtccaaggag

SEQ ID NO: 150207 - DNA, 25 bp, Mus musculus
agactttccttcctgtggtcagaac

SEQ ID NO: 150208 - DNA, 25 bp, Mus musculus
agactttccttcgtgtggtcagaac

SEQ ID NO: 150209 - DNA, 25 bp, Mus musculus
agactttccttgatctgctcttaca

SEQ ID NO: 150210 - DNA, 25 bp, Mus musculus
agactttccttgttctgctcttaca

SEQ ID NO: 150211 - DNA, 25 bp, Mus musculus
agactttcgccacacacattcatgt

SEQ ID NO: 150212 - DNA, 25 bp, Mus musculus
agactttcgccagacacattcatgt

SEQ ID NO: 150213 - DNA, 25 bp, Mus musculus
agactttcggtcaagaccctacaga

SEQ ID NO: 150214 - DNA, 25 bp, Mus musculus
agactttcggtctagaccctacaga

SEQ ID NO: 150215 - DNA, 25 bp, Mus musculus
agactttctattaccggctccaggt

SEQ ID NO: 150216 - DNA, 25 bp, Mus musculus
agactttctatttccggctccaggt

SEQ ID NO: 150217 - DNA, 25 bp, Mus musculus
agactttctcaaagcaaatcaatgc

SEQ ID NO: 150218 - DNA, 25 bp, Mus musculus
agactttctcaatgcaaatcaatgc

SEQ ID NO: 150219 - DNA, 25 bp, Mus musculus
agactttctcagagaccctgatcca

SEQ ID NO: 150220 - DNA, 25 bp, Mus musculus
agactttctcagtgaccctgatcca

SEQ ID NO: 150221 - DNA, 25 bp, Mus musculus
agactttctgagcttactgatttgg

SEQ ID NO: 150222 - DNA, 25 bp, Mus musculus
agactttctgaggttactgatttgg

SEQ ID NO: 150223 - DNA, 25 bp, Mus musculus
agactttctgcaaattcctgtacac

SEQ ID NO: 150224 - DNA, 25 bp, Mus musculus
agactttctgcatattcctgtacac

SEQ ID NO: 150225 - DNA, 25 bp, Mus musculus
agactttctgctccttgacatcctt

SEQ ID NO: 150226 - DNA, 25 bp, Mus musculus
agactttctgctcggaatggctacg

SEQ ID NO: 150227 - DNA, 25 bp, Mus musculus
agactttctgctgcttgacatcctt

SEQ ID NO: 150228 - DNA, 25 bp, Mus musculus
agactttctgctgggaatggctacg

SEQ ID NO: 150229 - DNA, 25 bp, Mus musculus
agactttgaacaagtgctgggtaaa

SEQ ID NO: 150230 - DNA, 25 bp, Mus musculus
agactttgaacatgtgctgggtaaa

SEQ ID NO: 150231 - DNA, 25 bp, Mus musculus
agactttgaaccctttgacttcact

SEQ ID NO: 150232 - DNA, 25 bp, Mus musculus
agactttgaaccgtttgacttcact

SEQ ID NO: 150233 - DNA, 25 bp, Mus musculus
agactttgaagtccagagcagcagg

SEQ ID NO: 150234 - DNA, 25 bp, Mus musculus
agactttgaagtgcagagcagcagg

SEQ ID NO: 150235 - DNA, 25 bp, Mus musculus
agactttgacccagatcaatgtgta

SEQ ID NO: 150236 - DNA, 25 bp, Mus musculus
agactttgaccctgatcaatgtgta

SEQ ID NO: 150237 - DNA, 25 bp, Mus musculus
agactttgagctaacttcctttgac

SEQ ID NO: 150238 - DNA, 25 bp, Mus musculus
agactttgagcttacttcctttgac

SEQ ID NO: 150239 - DNA, 25 bp, Mus musculus
agactttgagtcacacggcagtgtc

SEQ ID NO: 150240 - DNA, 25 bp, Mus musculus
agactttgagtctcacggcagtgtc

SEQ ID NO: 150241 - DNA, 25 bp, Mus musculus
agactttgatgaaggttgcagccca

SEQ ID NO: 150242 - DNA, 25 bp, Mus musculus
agactttgatgatggttgcagccca

SEQ ID NO: 150243 - DNA, 25 bp, Mus musculus
agactttgcaacagatgggatcaca

SEQ ID NO: 150244 - DNA, 25 bp, Mus musculus
agactttgcaacatctttctggttc

SEQ ID NO: 150245 - DNA, 25 bp, Mus musculus
agactttgcaactgatgggatcaca

SEQ ID NO: 150246 - DNA, 25 bp, Mus musculus
agactttgcaacttctttctggttc

SEQ ID NO: 150247 - DNA, 25 bp, Mus musculus
agactttgcaccagaatcttagcca

SEQ ID NO: 150248 - DNA, 25 bp, Mus musculus
agactttgcacctgaatcttagcca

SEQ ID NO: 150249 - DNA, 25 bp, Mus musculus
agactttgccagctcctttaagatt

SEQ ID NO: 150250 - DNA, 25 bp, Mus musculus
agactttgccaggtcctttaagatt

SEQ ID NO: 150251 - DNA, 25 bp, Mus musculus
agactttgcctaattcctcaggatc

SEQ ID NO: 150252 - DNA, 25 bp, Mus musculus
agactttgcctatttcctcaggatc

SEQ ID NO: 150253 - DNA, 25 bp, Mus musculus
agactttgcctgagaatgctcatca

SEQ ID NO: 150254 - DNA, 25 bp, Mus musculus
agactttgcctgagactgattcctg

SEQ ID NO: 150255 - DNA, 25 bp, Mus musculus
agactttgcctgtgaatgctcatca

SEQ ID NO: 150256 - DNA, 25 bp, Mus musculus
agactttgcctgtgactgattcctg

SEQ ID NO: 150257 - DNA, 25 bp, Mus musculus
agactttgctacaatgaccttcctt

SEQ ID NO: 150258 - DNA, 25 bp, Mus musculus
agactttgctactatgaccttcctt

SEQ ID NO: 150259 - DNA, 25 bp, Mus musculus
agactttgctgcatattctgccttt

SEQ ID NO: 150260 - DNA, 25 bp, Mus musculus
agactttgctgcttattctgccttt

SEQ ID NO: 150261 - DNA, 25 bp, Mus musculus
agactttggcgccttttctgaacca

SEQ ID NO: 150262 - DNA, 25 bp, Mus musculus
agactttggcgcgttttctgaacca

SEQ ID NO: 150263 - DNA, 25 bp, Mus musculus
agactttgggtcatctcttggaagg

SEQ ID NO: 150264 - DNA, 25 bp, Mus musculus
agactttgggtcttctcttggaagg

SEQ ID NO: 150265 - DNA, 25 bp, Mus musculus
agactttgggttcgagtctcggtct

SEQ ID NO: 150266 - DNA, 25 bp, Mus musculus
agactttgggttggagtctcggtct

SEQ ID NO: 150267 - DNA, 25 bp, Mus musculus
agactttgtacacgatgtccccttt

SEQ ID NO: 150268 - DNA, 25 bp, Mus musculus
agactttgtacaggatgtccccttt

SEQ ID NO: 150269 - DNA, 25 bp, Mus musculus
agactttgtattactgcctgtcatc

SEQ ID NO: 150270 - DNA, 25 bp, Mus musculus
agactttgtatttctgcctgtcatc

SEQ ID NO: 150271 - DNA, 25 bp, Mus musculus
agactttgttcactgttctctggat

SEQ ID NO: 150272 - DNA, 25 bp, Mus musculus
agactttgttcagtgttctctggat

SEQ ID NO: 150273 - DNA, 25 bp, Mus musculus
agactttgttgtatgctgcttcgaa

SEQ ID NO: 150274 - DNA, 25 bp, Mus musculus
agactttgttgtttgctgcttcgaa

SEQ ID NO: 150275 - DNA, 25 bp, Mus musculus
agacttttataaagcctaccttcaa

SEQ ID NO: 150276 - DNA, 25 bp, Mus musculus
agacttttataatgcctaccttcaa

SEQ ID NO: 150277 - DNA, 25 bp, Mus musculus
agacttttatctcgcctaggacagg

SEQ ID NO: 150278 - DNA, 25 bp, Mus musculus
agacttttatctggcctaggacagg

SEQ ID NO: 150279 - DNA, 25 bp, Mus musculus
agacttttcagacgtgcggcgtgtc

SEQ ID NO: 150280 - DNA, 25 bp, Mus musculus
agacttttcagaggtgcggcgtgtc

SEQ ID NO: 150281 - DNA, 25 bp, Mus musculus
agacttttcccgacggacctgcaca

SEQ ID NO: 150282 - DNA, 25 bp, Mus musculus
agacttttcccgtcggacctgcaca

SEQ ID NO: 150283 - DNA, 25 bp, Mus musculus
agacttttcctgagggacctgaaca

SEQ ID NO: 150284 - DNA, 25 bp, Mus musculus
agacttttcctgatagagcagacca

SEQ ID NO: 150285 - DNA, 25 bp, Mus musculus
agacttttcctgtgggacctgaaca

SEQ ID NO: 150286 - DNA, 25 bp, Mus musculus
agacttttcctgttagagcagacca

SEQ ID NO: 150287 - DNA, 25 bp, Mus musculus
agacttttcgccacagcgtggtggt

SEQ ID NO: 150288 - DNA, 25 bp, Mus musculus
agacttttcgcctcagcgtggtggt

SEQ ID NO: 150289 - DNA, 25 bp, Mus musculus
agacttttctatatccagagggaca

SEQ ID NO: 150290 - DNA, 25 bp, Mus musculus
agacttttctatttccagagggaca

SEQ ID NO: 150291 - DNA, 25 bp, Mus musculus
agacttttctcgaggttttcatggt

SEQ ID NO: 150292 - DNA, 25 bp, Mus musculus
agacttttctcgtggttttcatggt

SEQ ID NO: 150293 - DNA, 25 bp, Mus musculus
agacttttgggcagctggagtttaa

SEQ ID NO: 150294 - DNA, 25 bp, Mus musculus
agacttttgggctgctggagtttaa

SEQ ID NO: 150295 - DNA, 25 bp, Mus musculus
agacttttgtctactattcgtgtaa

SEQ ID NO: 150296 - DNA, 25 bp, Mus musculus
agacttttgtcttctattcgtgtaa

SEQ ID NO: 150297 - DNA, 25 bp, Mus musculus
agacttttgttcaggctgggagata

SEQ ID NO: 150298 - DNA, 25 bp, Mus musculus
agacttttgttctggctgggagata

SEQ ID NO: 150299 - DNA, 25 bp, Mus musculus
agactttttacaaaatccccagatg

SEQ ID NO: 150300 - DNA, 25 bp, Mus musculus
agactttttacataatccccagatg

SEQ ID NO: 150301 - DNA, 25 bp, Mus musculus
agactttttagtctttctcaggcaa

SEQ ID NO: 150302 - DNA, 25 bp, Mus musculus
agactttttagtgtttctcaggcaa

SEQ ID NO: 150303 - DNA, 25 bp, Mus musculus
agactttttcaccacgaaccaaatg

SEQ ID NO: 150304 - DNA, 25 bp, Mus musculus
agactttttcacgacgaaccaaatg

SEQ ID NO: 150305 - DNA, 25 bp, Mus musculus
agacttttttacactcagccaagag

SEQ ID NO: 150306 - DNA, 25 bp, Mus musculus
agacttttttactctcagccaagag

SEQ ID NO: 150307 - DNA, 25 bp, Mus musculus
agagaaaaacccagtgcttcctact

SEQ ID NO: 150308 - DNA, 25 bp, Mus musculus
agagaaaaaccctgtgcttcctact

SEQ ID NO: 150309 - DNA, 25 bp, Mus musculus
agagaaaaatccactgccttcaaaa

SEQ ID NO: 150310 - DNA, 25 bp, Mus musculus
agagaaaaatcctctgccttcaaaa

SEQ ID NO: 150311 - DNA, 25 bp, Mus musculus
agagaaaaccatcaagtccttcagc

SEQ ID NO: 150312 - DNA, 25 bp, Mus musculus
agagaaaaccatcccttactcagac

SEQ ID NO: 150313 - DNA, 25 bp, Mus musculus
agagaaaaccatgaagtccttcagc

SEQ ID NO: 150314 - DNA, 25 bp, Mus musculus
agagaaaaccatgccttactcagac

SEQ ID NO: 150315 - DNA, 25 bp, Mus musculus
agagaaaacccaagccgggcagtgg

SEQ ID NO: 150316 - DNA, 25 bp, Mus musculus
agagaaaacccacagggcactaagg

SEQ ID NO: 150317 - DNA, 25 bp, Mus musculus
agagaaaacccagagggcactaagg

SEQ ID NO: 150318 - DNA, 25 bp, Mus musculus
agagaaaacccatgccgggcagtgg

SEQ ID NO: 150319 - DNA, 25 bp, Mus musculus
agagaaaaccccatgtgcattcttt

SEQ ID NO: 150320 - DNA, 25 bp, Mus musculus
agagaaaaccccttgtgcattcttt

SEQ ID NO: 150321 - DNA, 25 bp, Mus musculus
agagaaaacgcactcacctctctgt

SEQ ID NO: 150322 - DNA, 25 bp, Mus musculus
agagaaaacgcagtcacctctctgt

SEQ ID NO: 150323 - DNA, 25 bp, Mus musculus
agagaaaacgtaatgccagcccacc

SEQ ID NO: 150324 - DNA, 25 bp, Mus musculus
agagaaaacgtattgccagcccacc

SEQ ID NO: 150325 - DNA, 25 bp, Mus musculus
agagaaaacgtcagtccccaagagc

SEQ ID NO: 150326 - DNA, 25 bp, Mus musculus
agagaaaacgtctgtccccaagagc

SEQ ID NO: 150327 - DNA, 25 bp, Mus musculus
agagaaaactccatcctcaggtcag

SEQ ID NO: 150328 - DNA, 25 bp, Mus musculus
agagaaaactccttcctcaggtcag

SEQ ID NO: 150329 - DNA, 25 bp, Mus musculus
agagaaaagccaatacgtacgtatt

SEQ ID NO: 150330 - DNA, 25 bp, Mus musculus
agagaaaagccattacgtacgtatt

SEQ ID NO: 150331 - DNA, 25 bp, Mus musculus
agagaaaagcccatccctcaatgct

SEQ ID NO: 150332 - DNA, 25 bp, Mus musculus
agagaaaagcccttccctcaatgct

SEQ ID NO: 150333 - DNA, 25 bp, Mus musculus
agagaaaagcttaggtcttctggac

SEQ ID NO: 150334 - DNA, 25 bp, Mus musculus
agagaaaagctttggtcttctggac

SEQ ID NO: 150335 - DNA, 25 bp, Mus musculus
agagaaaatcctcaacattgtaaaa

SEQ ID NO: 150336 - DNA, 25 bp, Mus musculus
agagaaaatcctgaacattgtaaaa

SEQ ID NO: 150337 - DNA, 25 bp, Mus musculus
agagaaaccaacacatcctgcgctt

SEQ ID NO: 150338 - DNA, 25 bp, Mus musculus
agagaaaccaactcatcctgcgctt

SEQ ID NO: 150339 - DNA, 25 bp, Mus musculus
agagaaacccatagcccagatgcgt

SEQ ID NO: 150340 - DNA, 25 bp, Mus musculus
agagaaacccattgcccagatgcgt

SEQ ID NO: 150341 - DNA, 25 bp, Mus musculus
agagaaacctcaagtttccccagct

SEQ ID NO: 150342 - DNA, 25 bp, Mus musculus
agagaaacctcatgtttccccagct

SEQ ID NO: 150343 - DNA, 25 bp, Mus musculus
agagaaacctgcctcatctccgttc

SEQ ID NO: 150344 - DNA, 25 bp, Mus musculus
agagaaacctgcgtcatctccgttc

SEQ ID NO: 150345 - DNA, 25 bp, Mus musculus
agagaaacctggctcctatggtaaa

SEQ ID NO: 150346 - DNA, 25 bp, Mus musculus
agagaaacctgggtcctatggtaaa

SEQ ID NO: 150347 - DNA, 25 bp, Mus musculus
agagaaactactaccttggtggtgg

SEQ ID NO: 150348 - DNA, 25 bp, Mus musculus
agagaaactacttccttggtggtgg

SEQ ID NO: 150349 - DNA, 25 bp, Mus musculus
agagaaactagaacactgcctgtgg

SEQ ID NO: 150350 - DNA, 25 bp, Mus musculus
agagaaactagatcactgcctgtgg

SEQ ID NO: 150351 - DNA, 25 bp, Mus musculus
agagaaactaggaggcagcgccgtc

SEQ ID NO: 150352 - DNA, 25 bp, Mus musculus
agagaaactaggtggcagcgccgtc

SEQ ID NO: 150353 - DNA, 25 bp, Mus musculus
agagaaagaaatccagctaagacag

SEQ ID NO: 150354 - DNA, 25 bp, Mus musculus
agagaaagaaatgcagctaagacag

SEQ ID NO: 150355 - DNA, 25 bp, Mus musculus
agagaaagacccattctgtcctgtc

SEQ ID NO: 150356 - DNA, 25 bp, Mus musculus
agagaaagaccctttctgtcctgtc

SEQ ID NO: 150357 - DNA, 25 bp, Mus musculus
agagaaagcaggacgggatacttta

SEQ ID NO: 150358 - DNA, 25 bp, Mus musculus
agagaaagcaggtcgggatacttta

SEQ ID NO: 150359 - DNA, 25 bp, Mus musculus
agagaaagccacagactcatcgcag

SEQ ID NO: 150360 - DNA, 25 bp, Mus musculus
agagaaagccactgactcatcgcag

SEQ ID NO: 150361 - DNA, 25 bp, Mus musculus
agagaaagcccaactggtcacactg

SEQ ID NO: 150362 - DNA, 25 bp, Mus musculus
agagaaagcccatctggtcacactg

SEQ ID NO: 150363 - DNA, 25 bp, Mus musculus
agagaaagccctagatgcttccttt

SEQ ID NO: 150364 - DNA, 25 bp, Mus musculus
agagaaagccctcatctactcccag

SEQ ID NO: 150365 - DNA, 25 bp, Mus musculus
agagaaagccctcggcagagcttgt

SEQ ID NO: 150366 - DNA, 25 bp, Mus musculus
agagaaagccctgatctactcccag

SEQ ID NO: 150367 - DNA, 25 bp, Mus musculus
agagaaagccctgggcagagcttgt

SEQ ID NO: 150368 - DNA, 25 bp, Mus musculus
agagaaagcccttgatgcttccttt

SEQ ID NO: 150369 - DNA, 25 bp, Mus musculus
agagaaagctcaccacagactctgc

SEQ ID NO: 150370 - DNA, 25 bp, Mus musculus
agagaaagctcagcacagactctgc

SEQ ID NO: 150371 - DNA, 25 bp, Mus musculus
agagaaagctccagcacgcatggtt

SEQ ID NO: 150372 - DNA, 25 bp, Mus musculus
agagaaagctcctgcacgcatggtt

SEQ ID NO: 150373 - DNA, 25 bp, Mus musculus
agagaaagttgtatgcgcagccgct

SEQ ID NO: 150374 - DNA, 25 bp, Mus musculus
agagaaagttgtttgcgcagccgct

SEQ ID NO: 150375 - DNA, 25 bp, Mus musculus
agagaaataaaaagctggtcacaaa

SEQ ID NO: 150376 - DNA, 25 bp, Mus musculus
agagaaataaaatgctggtcacaaa

SEQ ID NO: 150377 - DNA, 25 bp, Mus musculus
agagaaatctggagttcctcatatt

SEQ ID NO: 150378 - DNA, 25 bp, Mus musculus
agagaaatctggtgttcctcatatt

SEQ ID NO: 150379 - DNA, 25 bp, Mus musculus
agagaaatgcctctacctgaatcca

SEQ ID NO: 150380 - DNA, 25 bp, Mus musculus
agagaaatgcctgtacctgaatcca

SEQ ID NO: 150381 - DNA, 25 bp, Mus musculus
agagaaatggcaaaccattcagcca

SEQ ID NO: 150382 - DNA, 25 bp, Mus musculus
agagaaatggcataccattcagcca

SEQ ID NO: 150383 - DNA, 25 bp, Mus musculus
agagaaatgggcctctccctgaagc

SEQ ID NO: 150384 - DNA, 25 bp, Mus musculus
agagaaatgggcgtctccctgaagc

SEQ ID NO: 150385 - DNA, 25 bp, Mus musculus
agagaaattcccatatattaactgc

SEQ ID NO: 150386 - DNA, 25 bp, Mus musculus
agagaaattcccttatattaactgc

SEQ ID NO: 150387 - DNA, 25 bp, Mus musculus
agagaaattgctagtctctccacct

SEQ ID NO: 150388 - DNA, 25 bp, Mus musculus
agagaaattgcttgtctctccacct

SEQ ID NO: 150389 - DNA, 25 bp, Mus musculus
agagaacaaccgactggaacagctg

SEQ ID NO: 150390 - DNA, 25 bp, Mus musculus
agagaacaaccgtctggaacagctg

SEQ ID NO: 150391 - DNA, 25 bp, Mus musculus
agagaacaataaccctcgcacggtt

SEQ ID NO: 150392 - DNA, 25 bp, Mus musculus
agagaacaataagcctcgcacggtt

SEQ ID NO: 150393 - DNA, 25 bp, Mus musculus
agagaacaatcccagctttctgctt

SEQ ID NO: 150394 - DNA, 25 bp, Mus musculus
agagaacaatccgagctttctgctt

SEQ ID NO: 150395 - DNA, 25 bp, Mus musculus
agagaacaatttcccactgtagaag

SEQ ID NO: 150396 - DNA, 25 bp, Mus musculus
agagaacaatttgccactgtagaag

SEQ ID NO: 150397 - DNA, 25 bp, Mus musculus
agagaacacaaaaacggcgccagac

SEQ ID NO: 150398 - DNA, 25 bp, Mus musculus
agagaacacaaatacggcgccagac

SEQ ID NO: 150399 - DNA, 25 bp, Mus musculus
agagaacaccgaatccacccagtag

SEQ ID NO: 150400 - DNA, 25 bp, Mus musculus
agagaacaccgattccacccagtag

SEQ ID NO: 150401 - DNA, 25 bp, Mus musculus
agagaacacgtcaaatttatccatt

SEQ ID NO: 150402 - DNA, 25 bp, Mus musculus
agagaacacgtctaatttatccatt

SEQ ID NO: 150403 - DNA, 25 bp, Mus musculus
agagaacactcccacaattctccag

SEQ ID NO: 150404 - DNA, 25 bp, Mus musculus
agagaacactccgacaattctccag

SEQ ID NO: 150405 - DNA, 25 bp, Mus musculus
agagaacagaagatcagggccatcc

SEQ ID NO: 150406 - DNA, 25 bp, Mus musculus
agagaacagaagttcagggccatcc

SEQ ID NO: 150407 - DNA, 25 bp, Mus musculus
agagaacagattccagcacattctc

SEQ ID NO: 150408 - DNA, 25 bp, Mus musculus
agagaacagattgcagcacattctc

SEQ ID NO: 150409 - DNA, 25 bp, Mus musculus
agagaacagcctcgcccggtccaag

SEQ ID NO: 150410 - DNA, 25 bp, Mus musculus
agagaacagcctggcccggtccaag

SEQ ID NO: 150411 - DNA, 25 bp, Mus musculus
agagaacagttcacggctcacatac

SEQ ID NO: 150412 - DNA, 25 bp, Mus musculus
agagaacagttctcggctcacatac

SEQ ID NO: 150413 - DNA, 25 bp, Mus musculus
agagaacagttgatgttccctttcc

SEQ ID NO: 150414 - DNA, 25 bp, Mus musculus
agagaacagttgttgttccctttcc

SEQ ID NO: 150415 - DNA, 25 bp, Mus musculus
agagaacataccagcaattactgag

SEQ ID NO: 150416 - DNA, 25 bp, Mus musculus
agagaacatacctgcaattactgag

SEQ ID NO: 150417 - DNA, 25 bp, Mus musculus
agagaacatattataggtgcacata

SEQ ID NO: 150418 - DNA, 25 bp, Mus musculus
agagaacatattttaggtgcacata

SEQ ID NO: 150419 - DNA, 25 bp, Mus musculus
agagaacatcccagtgcctttaacc

SEQ ID NO: 150420 - DNA, 25 bp, Mus musculus
agagaacatccctgtgcctttaacc

SEQ ID NO: 150421 - DNA, 25 bp, Mus musculus
agagaacatctgaagggaacaggtg

SEQ ID NO: 150422 - DNA, 25 bp, Mus musculus
agagaacatctgtagggaacaggtg

SEQ ID NO: 150423 - DNA, 25 bp, Mus musculus
agagaacattaaagccaggcatttt

SEQ ID NO: 150424 - DNA, 25 bp, Mus musculus
agagaacattaatgccaggcatttt

SEQ ID NO: 150425 - DNA, 25 bp, Mus musculus
agagaaccaaggactccccggtgca

SEQ ID NO: 150426 - DNA, 25 bp, Mus musculus
agagaaccaaggtctccccggtgca

SEQ ID NO: 150427 - DNA, 25 bp, Mus musculus
agagaaccacatactgctctccaga

SEQ ID NO: 150428 - DNA, 25 bp, Mus musculus
agagaaccacattctgctctccaga

SEQ ID NO: 150429 - DNA, 25 bp, Mus musculus
agagaaccaccaactacaagcgaga

SEQ ID NO: 150430 - DNA, 25 bp, Mus musculus
agagaaccaccatctacaagcgaga

SEQ ID NO: 150431 - DNA, 25 bp, Mus musculus
agagaaccaccccaagaagcctttg

SEQ ID NO: 150432 - DNA, 25 bp, Mus musculus
agagaaccacccgaagaagcctttg

SEQ ID NO: 150433 - DNA, 25 bp, Mus musculus
agagaaccatctcctagactttaat

SEQ ID NO: 150434 - DNA, 25 bp, Mus musculus
agagaaccatctgctagactttaat

SEQ ID NO: 150435 - DNA, 25 bp, Mus musculus
agagaacccataatccattcctatc

SEQ ID NO: 150436 - DNA, 25 bp, Mus musculus
agagaacccatattccattcctatc

SEQ ID NO: 150437 - DNA, 25 bp, Mus musculus
agagaacccatgcttttatggacac

SEQ ID NO: 150438 - DNA, 25 bp, Mus musculus
agagaacccatggttttatggacac

SEQ ID NO: 150439 - DNA, 25 bp, Mus musculus
agagaaccccttacagagacatctt

SEQ ID NO: 150440 - DNA, 25 bp, Mus musculus
agagaacccctttcagagacatctt

SEQ ID NO: 150441 - DNA, 25 bp, Mus musculus
agagaaccctcactgtcctctggga

SEQ ID NO: 150442 - DNA, 25 bp, Mus musculus
agagaaccctcagtgtcctctggga

SEQ ID NO: 150443 - DNA, 25 bp, Mus musculus
agagaaccctggctaatgcacttgc

SEQ ID NO: 150444 - DNA, 25 bp, Mus musculus
agagaaccctgggtaatgcacttgc

SEQ ID NO: 150445 - DNA, 25 bp, Mus musculus
agagaaccctttccgggatgcagaa

SEQ ID NO: 150446 - DNA, 25 bp, Mus musculus
agagaaccctttgcgggatgcagaa

SEQ ID NO: 150447 - DNA, 25 bp, Mus musculus
agagaaccgccgatcttgtgacacc

SEQ ID NO: 150448 - DNA, 25 bp, Mus musculus
agagaaccgccgttcttgtgacacc

SEQ ID NO: 150449 - DNA, 25 bp, Mus musculus
agagaacctagacactacacaaccc

SEQ ID NO: 150450 - DNA, 25 bp, Mus musculus
agagaacctagagactacacaaccc

SEQ ID NO: 150451 - DNA, 25 bp, Mus musculus
agagaacctcacctggctatggctg

SEQ ID NO: 150452 - DNA, 25 bp, Mus musculus
agagaacctcacgtggctatggctg

SEQ ID NO: 150453 - DNA, 25 bp, Mus musculus
agagaacctcataccagtatggaga

SEQ ID NO: 150454 - DNA, 25 bp, Mus musculus
agagaacctcattccagtatggaga

SEQ ID NO: 150455 - DNA, 25 bp, Mus musculus
agagaacctccaaaagcttccagat

SEQ ID NO: 150456 - DNA, 25 bp, Mus musculus
agagaacctccataagcttccagat

SEQ ID NO: 150457 - DNA, 25 bp, Mus musculus
agagaacctctgctcttacctctta

SEQ ID NO: 150458 - DNA, 25 bp, Mus musculus
agagaacctctggtcttacctctta

SEQ ID NO: 150459 - DNA, 25 bp, Mus musculus
agagaacctggtacctatgctttcc

SEQ ID NO: 150460 - DNA, 25 bp, Mus musculus
agagaacctggttcctatgctttcc

SEQ ID NO: 150461 - DNA, 25 bp, Mus musculus
agagaacctgtgagctcagctctta

SEQ ID NO: 150462 - DNA, 25 bp, Mus musculus
agagaacctgtgtgctcagctctta

SEQ ID NO: 150463 - DNA, 25 bp, Mus musculus
agagaacctttccacattagacact

SEQ ID NO: 150464 - DNA, 25 bp, Mus musculus
agagaacctttcgacattagacact

SEQ ID NO: 150465 - DNA, 25 bp, Mus musculus
agagaacctttgacacacttgataa

SEQ ID NO: 150466 - DNA, 25 bp, Mus musculus
agagaacctttgtcacacttgataa

SEQ ID NO: 150467 - DNA, 25 bp, Mus musculus
agagaacgctatacccagagtcctg

SEQ ID NO: 150468 - DNA, 25 bp, Mus musculus
agagaacgctattcccagagtcctg

SEQ ID NO: 150469 - DNA, 25 bp, Mus musculus
agagaacggccgattcattgcgggt

SEQ ID NO: 150470 - DNA, 25 bp, Mus musculus
agagaacggccgtttcattgcgggt

SEQ ID NO: 150471 - DNA, 25 bp, Mus musculus
agagaacggttcacagagccccgca

SEQ ID NO: 150472 - DNA, 25 bp, Mus musculus
agagaacggttctcagagccccgca

SEQ ID NO: 150473 - DNA, 25 bp, Mus musculus
agagaacgtcctaccaagtatttgg

SEQ ID NO: 150474 - DNA, 25 bp, Mus musculus
agagaacgtccttccaagtatttgg

SEQ ID NO: 150475 - DNA, 25 bp, Mus musculus
agagaacgtggcagctgacagatga

SEQ ID NO: 150476 - DNA, 25 bp, Mus musculus
agagaacgtggctgctgacagatga

SEQ ID NO: 150477 - DNA, 25 bp, Mus musculus
agagaactaaccacacagcactgtt

SEQ ID NO: 150478 - DNA, 25 bp, Mus musculus
agagaactaacctcacagcactgtt

SEQ ID NO: 150479 - DNA, 25 bp, Mus musculus
agagaactagacaccaagatgcaag

SEQ ID NO: 150480 - DNA, 25 bp, Mus musculus
agagaactagactccaagatgcaag

SEQ ID NO: 150481 - DNA, 25 bp, Mus musculus
agagaactatcccaatcctctgggt

SEQ ID NO: 150482 - DNA, 25 bp, Mus musculus
agagaactatccgaatcctctgggt

SEQ ID NO: 150483 - DNA, 25 bp, Mus musculus
agagaactcaagactgggctgccag

SEQ ID NO: 150484 - DNA, 25 bp, Mus musculus
agagaactcaagtctgggctgccag

SEQ ID NO: 150485 - DNA, 25 bp, Mus musculus
agagaactccatccaacttggtctt

SEQ ID NO: 150486 - DNA, 25 bp, Mus musculus
agagaactccatgcaacttggtctt

SEQ ID NO: 150487 - DNA, 25 bp, Mus musculus
agagaactccggcattctgctccag

SEQ ID NO: 150488 - DNA, 25 bp, Mus musculus
agagaactccgggattctgctccag

SEQ ID NO: 150489 - DNA, 25 bp, Mus musculus
agagaactcgcacgatgccttccgt

SEQ ID NO: 150490 - DNA, 25 bp, Mus musculus
agagaactcgcaggatgccttccgt

SEQ ID NO: 150491 - DNA, 25 bp, Mus musculus
agagaactctaaagcactactttcc

SEQ ID NO: 150492 - DNA, 25 bp, Mus musculus
agagaactctaatgcactactttcc

SEQ ID NO: 150493 - DNA, 25 bp, Mus musculus
agagaactgactacctcaaactgcc

SEQ ID NO: 150494 - DNA, 25 bp, Mus musculus
agagaactgacttcctcaaactgcc

SEQ ID NO: 150495 - DNA, 25 bp, Mus musculus
agagaactgagtctgtcctttcaaa

SEQ ID NO: 150496 - DNA, 25 bp, Mus musculus
agagaactgagtgtgtcctttcaaa

SEQ ID NO: 150497 - DNA, 25 bp, Mus musculus
agagaactggatcctgcagccctta

SEQ ID NO: 150498 - DNA, 25 bp, Mus musculus
agagaactggatgctgcagccctta

SEQ ID NO: 150499 - DNA, 25 bp, Mus musculus
agagaactgtgccagctagaccctg

SEQ ID NO: 150500 - DNA, 25 bp, Mus musculus
agagaactgtgcgagctagaccctg

SEQ ID NO: 150501 - DNA, 25 bp, Mus musculus
agagaactgtgtattcccgagtgcc

SEQ ID NO: 150502 - DNA, 25 bp, Mus musculus
agagaactgtgttttcccgagtgcc

SEQ ID NO: 150503 - DNA, 25 bp, Mus musculus
agagaacttctcacactggctaggc

SEQ ID NO: 150504 - DNA, 25 bp, Mus musculus
agagaacttctccactgtcactgta

SEQ ID NO: 150505 - DNA, 25 bp, Mus musculus
agagaacttctcgactgtcactgta

SEQ ID NO: 150506 - DNA, 25 bp, Mus musculus
agagaacttctctcactggctaggc

SEQ ID NO: 150507 - DNA, 25 bp, Mus musculus
agagaacttgcgagctagcggccca

SEQ ID NO: 150508 - DNA, 25 bp, Mus musculus
agagaacttgcgtgctagcggccca

SEQ ID NO: 150509 - DNA, 25 bp, Mus musculus
agagaacttggccagtcttactccc

SEQ ID NO: 150510 - DNA, 25 bp, Mus musculus
agagaacttggcgagtcttactccc

SEQ ID NO: 150511 - DNA, 25 bp, Mus musculus
agagaacttgtccaacttgaggcaa

SEQ ID NO: 150512 - DNA, 25 bp, Mus musculus
agagaacttgtcgaacttgaggcaa

SEQ ID NO: 150513 - DNA, 25 bp, Mus musculus
agagaagaacccctgttgcaagtac

SEQ ID NO: 150514 - DNA, 25 bp, Mus musculus
agagaagaacccgtgttgcaagtac

SEQ ID NO: 150515 - DNA, 25 bp, Mus musculus
agagaagaagccaaacctcaccctg

SEQ ID NO: 150516 - DNA, 25 bp, Mus musculus
agagaagaagcctaacctcaccctg

SEQ ID NO: 150517 - DNA, 25 bp, Mus musculus
agagaagaatgtcctgaagatcagc

SEQ ID NO: 150518 - DNA, 25 bp, Mus musculus
agagaagaatgtgctgaagatcagc

SEQ ID NO: 150519 - DNA, 25 bp, Mus musculus
agagaagaccgaccccaagcccagg

SEQ ID NO: 150520 - DNA, 25 bp, Mus musculus
agagaagaccgagcccaagcccagg

SEQ ID NO: 150521 - DNA, 25 bp, Mus musculus
agagaagacctcagaagtccccaag

SEQ ID NO: 150522 - DNA, 25 bp, Mus musculus
agagaagacctctgaagtccccaag

SEQ ID NO: 150523 - DNA, 25 bp, Mus musculus
agagaagactagcaagtgtgctcaa

SEQ ID NO: 150524 - DNA, 25 bp, Mus musculus
agagaagactaggaagtgtgctcaa

SEQ ID NO: 150525 - DNA, 25 bp, Mus musculus
agagaagactgcacccctgctgaca

SEQ ID NO: 150526 - DNA, 25 bp, Mus musculus
agagaagactgctcccctgctgaca

SEQ ID NO: 150527 - DNA, 25 bp, Mus musculus
agagaagagcagatccaaggccaag

SEQ ID NO: 150528 - DNA, 25 bp, Mus musculus
agagaagagcagttccaaggccaag

SEQ ID NO: 150529 - DNA, 25 bp, Mus musculus
agagaagagcatatattgtgttttg

SEQ ID NO: 150530 - DNA, 25 bp, Mus musculus
agagaagagcatcctgcagtgcagc

SEQ ID NO: 150531 - DNA, 25 bp, Mus musculus
agagaagagcatgctgcagtgcagc

SEQ ID NO: 150532 - DNA, 25 bp, Mus musculus
agagaagagcatttattgtgttttg

SEQ ID NO: 150533 - DNA, 25 bp, Mus musculus
agagaagagccgatgtgcctccctg

SEQ ID NO: 150534 - DNA, 25 bp, Mus musculus
agagaagagccgttgtgcctccctg

SEQ ID NO: 150535 - DNA, 25 bp, Mus musculus
agagaagagcttagatcccctagaa

SEQ ID NO: 150536 - DNA, 25 bp, Mus musculus
agagaagagctttgatcccctagaa

SEQ ID NO: 150537 - DNA, 25 bp, Mus musculus
agagaagaggctccccaacatagga

SEQ ID NO: 150538 - DNA, 25 bp, Mus musculus
agagaagaggctgcccaacatagga

SEQ ID NO: 150539 - DNA, 25 bp, Mus musculus
agagaagaggttctcttcctttgac

SEQ ID NO: 150540 - DNA, 25 bp, Mus musculus
agagaagaggttgtcttcctttgac

SEQ ID NO: 150541 - DNA, 25 bp, Mus musculus
agagaagagtccaccagaccagtca

SEQ ID NO: 150542 - DNA, 25 bp, Mus musculus
agagaagagtcctccagaccagtca

SEQ ID NO: 150543 - DNA, 25 bp, Mus musculus
agagaagcaaacatggctgcagctt

SEQ ID NO: 150544 - DNA, 25 bp, Mus musculus
agagaagcaaacttggctgcagctt

SEQ ID NO: 150545 - DNA, 25 bp, Mus musculus
agagaagcacggactggcatcatcc

SEQ ID NO: 150546 - DNA, 25 bp, Mus musculus
agagaagcacggtctggcatcatcc

SEQ ID NO: 150547 - DNA, 25 bp, Mus musculus
agagaagcacgtccccagaaacctc

SEQ ID NO: 150548 - DNA, 25 bp, Mus musculus
agagaagcacgtgcccagaaacctc

SEQ ID NO: 150549 - DNA, 25 bp, Mus musculus
agagaagccaccatgtagtcagagt

SEQ ID NO: 150550 - DNA, 25 bp, Mus musculus
agagaagccaccttgtagtcagagt

SEQ ID NO: 150551 - DNA, 25 bp, Mus musculus
agagaagcccagctctgagcccaga

SEQ ID NO: 150552 - DNA, 25 bp, Mus musculus
agagaagcccaggtctgagcccaga

SEQ ID NO: 150553 - DNA, 25 bp, Mus musculus
agagaagccccgagaggagctcttc

SEQ ID NO: 150554 - DNA, 25 bp, Mus musculus
agagaagccccgtgaggagctcttc

SEQ ID NO: 150555 - DNA, 25 bp, Mus musculus
agagaagcccgtctctgctcgagac

SEQ ID NO: 150556 - DNA, 25 bp, Mus musculus
agagaagcccgtgtctgctcgagac

SEQ ID NO: 150557 - DNA, 25 bp, Mus musculus
agagaagccctaagcgtgtgtcgtc

SEQ ID NO: 150558 - DNA, 25 bp, Mus musculus
agagaagccctatgcgtgtgtcgtc

SEQ ID NO: 150559 - DNA, 25 bp, Mus musculus
agagaagccctcattaagcatattt

SEQ ID NO: 150560 - DNA, 25 bp, Mus musculus
agagaagccctctttaagcatattt

SEQ ID NO: 150561 - DNA, 25 bp, Mus musculus
agagaagccgatagtgacacctgat

SEQ ID NO: 150562 - DNA, 25 bp, Mus musculus
agagaagccgattgtgacacctgat

SEQ ID NO: 150563 - DNA, 25 bp, Mus musculus
agagaagccggaactgcagcatgta

SEQ ID NO: 150564 - DNA, 25 bp, Mus musculus
agagaagccggatctgcagcatgta

SEQ ID NO: 150565 - DNA, 25 bp, Mus musculus
agagaagcctggaatcttttgtata

SEQ ID NO: 150566 - DNA, 25 bp, Mus musculus
agagaagcctggacagcagtgccaa

SEQ ID NO: 150567 - DNA, 25 bp, Mus musculus
agagaagcctggtatcttttgtata

SEQ ID NO: 150568 - DNA, 25 bp, Mus musculus
agagaagcctggtcagcagtgccaa

SEQ ID NO: 150569 - DNA, 25 bp, Mus musculus
agagaagcgccgctttgccgacgcc

SEQ ID NO: 150570 - DNA, 25 bp, Mus musculus
agagaagcgccggtttgccgacgcc

SEQ ID NO: 150571 - DNA, 25 bp, Mus musculus
agagaagctcatcgctggaatcctg

SEQ ID NO: 150572 - DNA, 25 bp, Mus musculus
agagaagctcatggctggaatcctg

SEQ ID NO: 150573 - DNA, 25 bp, Mus musculus
agagaagctctacctctgcaagccc

SEQ ID NO: 150574 - DNA, 25 bp, Mus musculus
agagaagctctagctctgcaagccc

SEQ ID NO: 150575 - DNA, 25 bp, Mus musculus
agagaagctgctattgccacttcag

SEQ ID NO: 150576 - DNA, 25 bp, Mus musculus
agagaagctgcttttgccacttcag

SEQ ID NO: 150577 - DNA, 25 bp, Mus musculus
agagaagcttggcatctgccttcag

SEQ ID NO: 150578 - DNA, 25 bp, Mus musculus
agagaagcttgggatctgccttcag

SEQ ID NO: 150579 - DNA, 25 bp, Mus musculus
agagaaggaccgattccgatgggac

SEQ ID NO: 150580 - DNA, 25 bp, Mus musculus
agagaaggaccgtttccgatgggac

SEQ ID NO: 150581 - DNA, 25 bp, Mus musculus
agagaaggacttcctctcatgcgac

SEQ ID NO: 150582 - DNA, 25 bp, Mus musculus
agagaaggacttgctctcatgcgac

SEQ ID NO: 150583 - DNA, 25 bp, Mus musculus
agagaaggagtcacctcgaggctcc

SEQ ID NO: 150584 - DNA, 25 bp, Mus musculus
agagaaggagtctcctcgaggctcc

SEQ ID NO: 150585 - DNA, 25 bp, Mus musculus
agagaaggccaactgcaccatccta

SEQ ID NO: 150586 - DNA, 25 bp, Mus musculus
agagaaggccaagtgcaccatccta

SEQ ID NO: 150587 - DNA, 25 bp, Mus musculus
agagaaggccacacaccacttaagg

SEQ ID NO: 150588 - DNA, 25 bp, Mus musculus
agagaaggccactcaccacttaagg

SEQ ID NO: 150589 - DNA, 25 bp, Mus musculus
agagaaggccttaggcagcagccag

SEQ ID NO: 150590 - DNA, 25 bp, Mus musculus
agagaaggcctttggcagcagccag

SEQ ID NO: 150591 - DNA, 25 bp, Mus musculus
agagaaggctggaccacccacacat

SEQ ID NO: 150592 - DNA, 25 bp, Mus musculus
agagaaggctggtccacccacacat

SEQ ID NO: 150593 - DNA, 25 bp, Mus musculus
agagaaggcttcctcggtgaggcac

SEQ ID NO: 150594 - DNA, 25 bp, Mus musculus
agagaaggcttcgtcggtgaggcac

SEQ ID NO: 150595 - DNA, 25 bp, Mus musculus
agagaaggtggcacttccaggcttt

SEQ ID NO: 150596 - DNA, 25 bp, Mus musculus
agagaaggtggctcttccaggcttt

SEQ ID NO: 150597 - DNA, 25 bp, Mus musculus
agagaaggtgtgacccgtgtgttga

SEQ ID NO: 150598 - DNA, 25 bp, Mus musculus
agagaaggtgtgtcccgtgtgttga

SEQ ID NO: 150599 - DNA, 25 bp, Mus musculus
agagaaggttgacactccgtccccg

SEQ ID NO: 150600 - DNA, 25 bp, Mus musculus
agagaaggttgagactccgtccccg

SEQ ID NO: 150601 - DNA, 25 bp, Mus musculus
agagaagtaactcccgcctttaaca

SEQ ID NO: 150602 - DNA, 25 bp, Mus musculus
agagaagtaactgccgcctttaaca

SEQ ID NO: 150603 - DNA, 25 bp, Mus musculus
agagaagtcaaaactgtcataatag

SEQ ID NO: 150604 - DNA, 25 bp, Mus musculus
agagaagtcaaatctgtcataatag

SEQ ID NO: 150605 - DNA, 25 bp, Mus musculus
agagaagtcacacctgagcccaggc

SEQ ID NO: 150606 - DNA, 25 bp, Mus musculus
agagaagtcacagctgagcccaggc

SEQ ID NO: 150607 - DNA, 25 bp, Mus musculus
agagaagtcagaagtccccttacca

SEQ ID NO: 150608 - DNA, 25 bp, Mus musculus
agagaagtcagatgtccccttacca

SEQ ID NO: 150609 - DNA, 25 bp, Mus musculus
agagaagtcagcctttgtttcctca

SEQ ID NO: 150610 - DNA, 25 bp, Mus musculus
agagaagtcagcgtttgtttcctca

SEQ ID NO: 150611 - DNA, 25 bp, Mus musculus
agagaagtcgccacttccaggctaa

SEQ ID NO: 150612 - DNA, 25 bp, Mus musculus
agagaagtcgcctcttccaggctaa

SEQ ID NO: 150613 - DNA, 25 bp, Mus musculus
agagaagtgactatcgctgaccgca

SEQ ID NO: 150614 - DNA, 25 bp, Mus musculus
agagaagtgactttcgctgaccgca

SEQ ID NO: 150615 - DNA, 25 bp, Mus musculus
agagaagtgtccatgttgatgtcac

SEQ ID NO: 150616 - DNA, 25 bp, Mus musculus
agagaagtgtccttgttgatgtcac

SEQ ID NO: 150617 - DNA, 25 bp, Mus musculus
agagaagtgttcctaatgcaaagac

SEQ ID NO: 150618 - DNA, 25 bp, Mus musculus
agagaagtgttcgtaatgcaaagac

SEQ ID NO: 150619 - DNA, 25 bp, Mus musculus
agagaagttagcagacagggctgcc

SEQ ID NO: 150620 - DNA, 25 bp, Mus musculus
agagaagttagctgacagggctgcc

SEQ ID NO: 150621 - DNA, 25 bp, Mus musculus
agagaagttcagatcaaggtcagga

SEQ ID NO: 150622 - DNA, 25 bp, Mus musculus
agagaagttcagttcaaggtcagga

SEQ ID NO: 150623 - DNA, 25 bp, Mus musculus
agagaataacctatatgcactgttg

SEQ ID NO: 150624 - DNA, 25 bp, Mus musculus
agagaataacctttatgcactgttg

SEQ ID NO: 150625 - DNA, 25 bp, Mus musculus
agagaatacttccatggctaccatg

SEQ ID NO: 150626 - DNA, 25 bp, Mus musculus
agagaatacttcgatggctaccatg

SEQ ID NO: 150627 - DNA, 25 bp, Mus musculus
agagaatagaatccctcattgaccg

SEQ ID NO: 150628 - DNA, 25 bp, Mus musculus
agagaatagaatgcctcattgaccg

SEQ ID NO: 150629 - DNA, 25 bp, Mus musculus
agagaatatcctactaggtgaagat

SEQ ID NO: 150630 - DNA, 25 bp, Mus musculus
agagaatatccttctaggtgaagat

SEQ ID NO: 150631 - DNA, 25 bp, Mus musculus
agagaatatctacccctctgttcaa

SEQ ID NO: 150632 - DNA, 25 bp, Mus musculus
agagaatatctagccctctgttcaa

SEQ ID NO: 150633 - DNA, 25 bp, Mus musculus
agagaatatgcgcttcctgtccagt

SEQ ID NO: 150634 - DNA, 25 bp, Mus musculus
agagaatatgcggttcctgtccagt

SEQ ID NO: 150635 - DNA, 25 bp, Mus musculus
agagaatattctacacagtcaacag

SEQ ID NO: 150636 - DNA, 25 bp, Mus musculus
agagaatattcttcacagtcaacag

SEQ ID NO: 150637 - DNA, 25 bp, Mus musculus
agagaatcacctcctctgttagggt

SEQ ID NO: 150638 - DNA, 25 bp, Mus musculus
agagaatcacctgctctgttagggt

SEQ ID NO: 150639 - DNA, 25 bp, Mus musculus
agagaatcaggtaacccagcctcag

SEQ ID NO: 150640 - DNA, 25 bp, Mus musculus
agagaatcaggttacccagcctcag

SEQ ID NO: 150641 - DNA, 25 bp, Mus musculus
agagaatccatactttcagtttcag

SEQ ID NO: 150642 - DNA, 25 bp, Mus musculus
agagaatccatagtttcagtttcag

SEQ ID NO: 150643 - DNA, 25 bp, Mus musculus
agagaatccatcaatctgatatgca

SEQ ID NO: 150644 - DNA, 25 bp, Mus musculus
agagaatccatctatctgatatgca

SEQ ID NO: 150645 - DNA, 25 bp, Mus musculus
agagaatcgcgtacctcagtggcta

SEQ ID NO: 150646 - DNA, 25 bp, Mus musculus
agagaatcgcgttcctcagtggcta

SEQ ID NO: 150647 - DNA, 25 bp, Mus musculus
agagaatcgtgtcgtggccttcttc

SEQ ID NO: 150648 - DNA, 25 bp, Mus musculus
agagaatcgtgtggtggccttcttc

SEQ ID NO: 150649 - DNA, 25 bp, Mus musculus
agagaatctccgctgttgcaagaac

SEQ ID NO: 150650 - DNA, 25 bp, Mus musculus
agagaatctccggtgttgcaagaac

SEQ ID NO: 150651 - DNA, 25 bp, Mus musculus
agagaatctgctcccatacgtgctc

SEQ ID NO: 150652 - DNA, 25 bp, Mus musculus
agagaatctgctgccatacgtgctc

SEQ ID NO: 150653 - DNA, 25 bp, Mus musculus
agagaatctgtcactgcactcatca

SEQ ID NO: 150654 - DNA, 25 bp, Mus musculus
agagaatctgtctctgcactcatca

SEQ ID NO: 150655 - DNA, 25 bp, Mus musculus
agagaatgagagagcctccttccct

SEQ ID NO: 150656 - DNA, 25 bp, Mus musculus
agagaatgagagtgcctccttccct

SEQ ID NO: 150657 - DNA, 25 bp, Mus musculus
agagaatgccaacctgcgcgttgtt

SEQ ID NO: 150658 - DNA, 25 bp, Mus musculus
agagaatgccaagctgcgcgttgtt

SEQ ID NO: 150659 - DNA, 25 bp, Mus musculus
agagaatgcgcacgtacgtttaatt

SEQ ID NO: 150660 - DNA, 25 bp, Mus musculus
agagaatgcgcaggtacgtttaatt

SEQ ID NO: 150661 - DNA, 25 bp, Mus musculus
agagaatggcacaatcctggcctgg

SEQ ID NO: 150662 - DNA, 25 bp, Mus musculus
agagaatggcactatcctggcctgg

SEQ ID NO: 150663 - DNA, 25 bp, Mus musculus
agagaatggcagatggacccctcct

SEQ ID NO: 150664 - DNA, 25 bp, Mus musculus
agagaatggcagttggacccctcct

SEQ ID NO: 150665 - DNA, 25 bp, Mus musculus
agagaatggcctcatgtgtccctcc

SEQ ID NO: 150666 - DNA, 25 bp, Mus musculus
agagaatggcctgatgtgtccctcc

SEQ ID NO: 150667 - DNA, 25 bp, Mus musculus
agagaatggctcagtctgtgactgt

SEQ ID NO: 150668 - DNA, 25 bp, Mus musculus
agagaatggctctgtctgtgactgt

SEQ ID NO: 150669 - DNA, 25 bp, Mus musculus
agagaatgggcacctctgggaaaca

SEQ ID NO: 150670 - DNA, 25 bp, Mus musculus
agagaatgggcagctctgggaaaca

SEQ ID NO: 150671 - DNA, 25 bp, Mus musculus
agagaatggtaactctcagcccaag

SEQ ID NO: 150672 - DNA, 25 bp, Mus musculus
agagaatggtaagtctcagcccaag

SEQ ID NO: 150673 - DNA, 25 bp, Mus musculus
agagaatggtctccagctctaagtg

SEQ ID NO: 150674 - DNA, 25 bp, Mus musculus
agagaatggtctgcagctctaagtg

SEQ ID NO: 150675 - DNA, 25 bp, Mus musculus
agagaatgtctacggcgtggcaccc

SEQ ID NO: 150676 - DNA, 25 bp, Mus musculus
agagaatgtctagggcgtggcaccc

SEQ ID NO: 150677 - DNA, 25 bp, Mus musculus
agagaatgtgtcaagcatgatcggg

SEQ ID NO: 150678 - DNA, 25 bp, Mus musculus
agagaatgtgtctagcatgatcggg

SEQ ID NO: 150679 - DNA, 25 bp, Mus musculus
agagaattaactccccttccagaag

SEQ ID NO: 150680 - DNA, 25 bp, Mus musculus
agagaattaactgcccttccagaag

SEQ ID NO: 150681 - DNA, 25 bp, Mus musculus
agagaattagtcactctgccctctc

SEQ ID NO: 150682 - DNA, 25 bp, Mus musculus
agagaattagtctctctgccctctc

SEQ ID NO: 150683 - DNA, 25 bp, Mus musculus
agagaattatccattcgtttgatct

SEQ ID NO: 150684 - DNA, 25 bp, Mus musculus
agagaattatcctttcgtttgatct

SEQ ID NO: 150685 - DNA, 25 bp, Mus musculus
agagaattatctaggttgcttacac

SEQ ID NO: 150686 - DNA, 25 bp, Mus musculus
agagaattatcttggttgcttacac

SEQ ID NO: 150687 - DNA, 25 bp, Mus musculus
agagaattcacaactggatccaaag

SEQ ID NO: 150688 - DNA, 25 bp, Mus musculus
agagaattcacatctggatccaaag

SEQ ID NO: 150689 - DNA, 25 bp, Mus musculus
agagaattcactcagcgcgagcagg

SEQ ID NO: 150690 - DNA, 25 bp, Mus musculus
agagaattcactgagcgcgagcagg

SEQ ID NO: 150691 - DNA, 25 bp, Mus musculus
agagaattcagaatccactgcctgg

SEQ ID NO: 150692 - DNA, 25 bp, Mus musculus
agagaattcagattccactgcctgg

SEQ ID NO: 150693 - DNA, 25 bp, Mus musculus
agagaattcattaacagtgccatat

SEQ ID NO: 150694 - DNA, 25 bp, Mus musculus
agagaattcatttacagtgccatat

SEQ ID NO: 150695 - DNA, 25 bp, Mus musculus
agagaattccaccactgtagacaga

SEQ ID NO: 150696 - DNA, 25 bp, Mus musculus
agagaattccacgactgtagacaga

SEQ ID NO: 150697 - DNA, 25 bp, Mus musculus
agagaattccagcaccttgccgcag

SEQ ID NO: 150698 - DNA, 25 bp, Mus musculus
agagaattccagctttttagatagt

SEQ ID NO: 150699 - DNA, 25 bp, Mus musculus
agagaattccaggaccttgccgcag

SEQ ID NO: 150700 - DNA, 25 bp, Mus musculus
agagaattccaggtttttagatagt

SEQ ID NO: 150701 - DNA, 25 bp, Mus musculus
agagaattccatatggttccctcca

SEQ ID NO: 150702 - DNA, 25 bp, Mus musculus
agagaattccatcacggacctgacc

SEQ ID NO: 150703 - DNA, 25 bp, Mus musculus
agagaattccatgacggacctgacc

SEQ ID NO: 150704 - DNA, 25 bp, Mus musculus
agagaattccatttggttccctcca

SEQ ID NO: 150705 - DNA, 25 bp, Mus musculus
agagaattcgaacgcattttccccg

SEQ ID NO: 150706 - DNA, 25 bp, Mus musculus
agagaattcgaaggcattttccccg

SEQ ID NO: 150707 - DNA, 25 bp, Mus musculus
agagaattctacaagcgatccagct

SEQ ID NO: 150708 - DNA, 25 bp, Mus musculus
agagaattctactagcgatccagct

SEQ ID NO: 150709 - DNA, 25 bp, Mus musculus
agagaattctgcacccatttctgta

SEQ ID NO: 150710 - DNA, 25 bp, Mus musculus
agagaattctgctcccatttctgta

SEQ ID NO: 150711 - DNA, 25 bp, Mus musculus
agagaattctttaatttgggacatc

SEQ ID NO: 150712 - DNA, 25 bp, Mus musculus
agagaattcttttatttgggacatc

SEQ ID NO: 150713 - DNA, 25 bp, Mus musculus
agagaattgacaccatctccagggc

SEQ ID NO: 150714 - DNA, 25 bp, Mus musculus
agagaattgacagcatctccagggc

SEQ ID NO: 150715 - DNA, 25 bp, Mus musculus
agagaattgctcattccctcgctgg

SEQ ID NO: 150716 - DNA, 25 bp, Mus musculus
agagaattgctctttccctcgctgg

SEQ ID NO: 150717 - DNA, 25 bp, Mus musculus
agagaatttcacaaacaagtagttt

SEQ ID NO: 150718 - DNA, 25 bp, Mus musculus
agagaatttcactaacaagtagttt

SEQ ID NO: 150719 - DNA, 25 bp, Mus musculus
agagaatttcccaattggccacttg

SEQ ID NO: 150720 - DNA, 25 bp, Mus musculus
agagaatttccctattggccacttg

SEQ ID NO: 150721 - DNA, 25 bp, Mus musculus
agagaatttctcagagggcccattt

SEQ ID NO: 150722 - DNA, 25 bp, Mus musculus
agagaatttctctgagggcccattt

SEQ ID NO: 150723 - DNA, 25 bp, Mus musculus
agagaatttctgcttccactataga

SEQ ID NO: 150724 - DNA, 25 bp, Mus musculus
agagaatttctggttccactataga

SEQ ID NO: 150725 - DNA, 25 bp, Mus musculus
agagaatttggtagtcagacttggt

SEQ ID NO: 150726 - DNA, 25 bp, Mus musculus
agagaatttggttgtcagacttggt

SEQ ID NO: 150727 - DNA, 25 bp, Mus musculus
agagacaaaagtcccacagcctcag

SEQ ID NO: 150728 - DNA, 25 bp, Mus musculus
agagacaaaagtgccacagcctcag

SEQ ID NO: 150729 - DNA, 25 bp, Mus musculus
agagacaaacatccctgaggctctc

SEQ ID NO: 150730 - DNA, 25 bp, Mus musculus
agagacaaacatgcctgaggctctc

SEQ ID NO: 150731 - DNA, 25 bp, Mus musculus
agagacaaagccctaagcctgctgc

SEQ ID NO: 150732 - DNA, 25 bp, Mus musculus
agagacaaagccgtaagcctgctgc

SEQ ID NO: 150733 - DNA, 25 bp, Mus musculus
agagacaaaggtcacaccctgactt

SEQ ID NO: 150734 - DNA, 25 bp, Mus musculus
agagacaaaggtgacaccctgactt

SEQ ID NO: 150735 - DNA, 25 bp, Mus musculus
agagacaaccgtcttggcaacatgt

SEQ ID NO: 150736 - DNA, 25 bp, Mus musculus
agagacaaccgtgttggcaacatgt

SEQ ID NO: 150737 - DNA, 25 bp, Mus musculus
agagacaactcaatgggcactgctg

SEQ ID NO: 150738 - DNA, 25 bp, Mus musculus
agagacaactcattgggcactgctg

SEQ ID NO: 150739 - DNA, 25 bp, Mus musculus
agagacaacttaacgctacgtaatg

SEQ ID NO: 150740 - DNA, 25 bp, Mus musculus
agagacaacttatcgctacgtaatg

SEQ ID NO: 150741 - DNA, 25 bp, Mus musculus
agagacaacttcaacctatacctgt

SEQ ID NO: 150742 - DNA, 25 bp, Mus musculus
agagacaacttctacctatacctgt

SEQ ID NO: 150743 - DNA, 25 bp, Mus musculus
agagacaaggaaaggccactgtgta

SEQ ID NO: 150744 - DNA, 25 bp, Mus musculus
agagacaaggaatggccactgtgta

SEQ ID NO: 150745 - DNA, 25 bp, Mus musculus
agagacaatatgacagggctcattg

SEQ ID NO: 150746 - DNA, 25 bp, Mus musculus
agagacaatatgtcagggctcattg

SEQ ID NO: 150747 - DNA, 25 bp, Mus musculus
agagacaatcatactctgggcattg

SEQ ID NO: 150748 - DNA, 25 bp, Mus musculus
agagacaatcattctctgggcattg

SEQ ID NO: 150749 - DNA, 25 bp, Mus musculus
agagacaatgttccctggcttgatt

SEQ ID NO: 150750 - DNA, 25 bp, Mus musculus
agagacaatgttgcctggcttgatt

SEQ ID NO: 150751 - DNA, 25 bp, Mus musculus
agagacacaaagatcccgggagctg

SEQ ID NO: 150752 - DNA, 25 bp, Mus musculus
agagacacaaagttcccgggagctg

SEQ ID NO: 150753 - DNA, 25 bp, Mus musculus
agagacacaacgacctccaagaagg

SEQ ID NO: 150754 - DNA, 25 bp, Mus musculus
agagacacaacgtcctccaagaagg

SEQ ID NO: 150755 - DNA, 25 bp, Mus musculus
agagacacaagtccctttatgtgtt

SEQ ID NO: 150756 - DNA, 25 bp, Mus musculus
agagacacaagtgcctttatgtgtt

SEQ ID NO: 150757 - DNA, 25 bp, Mus musculus
agagacacaccacaaggactccggt

SEQ ID NO: 150758 - DNA, 25 bp, Mus musculus
agagacacaccacctgaagaacagg

SEQ ID NO: 150759 - DNA, 25 bp, Mus musculus
agagacacaccagaaggactccggt

SEQ ID NO: 150760 - DNA, 25 bp, Mus musculus
agagacacaccagctgaagaacagg

SEQ ID NO: 150761 - DNA, 25 bp, Mus musculus
agagacacactcattcttctcaatc

SEQ ID NO: 150762 - DNA, 25 bp, Mus musculus
agagacacactctttcttctcaatc

SEQ ID NO: 150763 - DNA, 25 bp, Mus musculus
agagacacacttaaccatcagggac

SEQ ID NO: 150764 - DNA, 25 bp, Mus musculus
agagacacactttaccatcagggac

SEQ ID NO: 150765 - DNA, 25 bp, Mus musculus
agagacacagaacccgcccaggtgg

SEQ ID NO: 150766 - DNA, 25 bp, Mus musculus
agagacacagaagccgcccaggtgg

SEQ ID NO: 150767 - DNA, 25 bp, Mus musculus
agagacaccacaccatgctccagtt

SEQ ID NO: 150768 - DNA, 25 bp, Mus musculus
agagacaccacagcatgctccagtt

SEQ ID NO: 150769 - DNA, 25 bp, Mus musculus
agagacaccagcatcagtggcctgt

SEQ ID NO: 150770 - DNA, 25 bp, Mus musculus
agagacaccagcttcagtggcctgt

SEQ ID NO: 150771 - DNA, 25 bp, Mus musculus
agagacaccatcatgcaattccgct

SEQ ID NO: 150772 - DNA, 25 bp, Mus musculus
agagacaccatcttgcaattccgct

SEQ ID NO: 150773 - DNA, 25 bp, Mus musculus
agagacacccacctaccaggcaagg

SEQ ID NO: 150774 - DNA, 25 bp, Mus musculus
agagacacccacgtaccaggcaagg

SEQ ID NO: 150775 - DNA, 25 bp, Mus musculus
agagacaccggtcagccccgggagc

SEQ ID NO: 150776 - DNA, 25 bp, Mus musculus
agagacaccggtgagccccgggagc

SEQ ID NO: 150777 - DNA, 25 bp, Mus musculus
agagacacctaaaagggatggcttt

SEQ ID NO: 150778 - DNA, 25 bp, Mus musculus
agagacacctaacccttacataggc

SEQ ID NO: 150779 - DNA, 25 bp, Mus musculus
agagacacctaagccttacataggc

SEQ ID NO: 150780 - DNA, 25 bp, Mus musculus
agagacacctaatagggatggcttt

SEQ ID NO: 150781 - DNA, 25 bp, Mus musculus
agagacacctctcagtggctagtgg

SEQ ID NO: 150782 - DNA, 25 bp, Mus musculus
agagacacctctgagtggctagtgg

SEQ ID NO: 150783 - DNA, 25 bp, Mus musculus
agagacactgcacccctaagtcctt

SEQ ID NO: 150784 - DNA, 25 bp, Mus musculus
agagacactgcagccctaagtcctt

SEQ ID NO: 150785 - DNA, 25 bp, Mus musculus
agagacactgggatccagccaatat

SEQ ID NO: 150786 - DNA, 25 bp, Mus musculus
agagacactgggttccagccaatat

SEQ ID NO: 150787 - DNA, 25 bp, Mus musculus
agagacactggtattctctaacttt

SEQ ID NO: 150788 - DNA, 25 bp, Mus musculus
agagacactggttttctctaacttt

SEQ ID NO: 150789 - DNA, 25 bp, Mus musculus
agagacactgtaccactggtggctt

SEQ ID NO: 150790 - DNA, 25 bp, Mus musculus
agagacactgtagcactggtggctt

SEQ ID NO: 150791 - DNA, 25 bp, Mus musculus
agagacacttgaccagaactgcatc

SEQ ID NO: 150792 - DNA, 25 bp, Mus musculus
agagacacttgacttaacttctggg

SEQ ID NO: 150793 - DNA, 25 bp, Mus musculus
agagacacttgagcagaactgcatc

SEQ ID NO: 150794 - DNA, 25 bp, Mus musculus
agagacacttgagttaacttctggg

SEQ ID NO: 150795 - DNA, 25 bp, Mus musculus
agagacagacggcagcagctcactt

SEQ ID NO: 150796 - DNA, 25 bp, Mus musculus
agagacagacgggagcagctcactt

SEQ ID NO: 150797 - DNA, 25 bp, Mus musculus
agagacagactcaggtccatcacaa

SEQ ID NO: 150798 - DNA, 25 bp, Mus musculus
agagacagactcatgcgggatggca

SEQ ID NO: 150799 - DNA, 25 bp, Mus musculus
agagacagactctggtccatcacaa

SEQ ID NO: 150800 - DNA, 25 bp, Mus musculus
agagacagactcttgcgggatggca

SEQ ID NO: 150801 - DNA, 25 bp, Mus musculus
agagacagagaccttcctctcactt

SEQ ID NO: 150802 - DNA, 25 bp, Mus musculus
agagacagagacgttcctctcactt

SEQ ID NO: 150803 - DNA, 25 bp, Mus musculus
agagacagcaaccttactctcctaa

SEQ ID NO: 150804 - DNA, 25 bp, Mus musculus
agagacagcaacgttactctcctaa

SEQ ID NO: 150805 - DNA, 25 bp, Mus musculus
agagacagcccacgtttgtggtcta

SEQ ID NO: 150806 - DNA, 25 bp, Mus musculus
agagacagcccaggtttgtggtcta

SEQ ID NO: 150807 - DNA, 25 bp, Mus musculus
agagacagcggcaggataagtccct

SEQ ID NO: 150808 - DNA, 25 bp, Mus musculus
agagacagcggctggataagtccct

SEQ ID NO: 150809 - DNA, 25 bp, Mus musculus
agagacagctgccttatccaagaag

SEQ ID NO: 150810 - DNA, 25 bp, Mus musculus
agagacagctgcgttatccaagaag

SEQ ID NO: 150811 - DNA, 25 bp, Mus musculus
agagacaggaaacccgagactccaa

SEQ ID NO: 150812 - DNA, 25 bp, Mus musculus
agagacaggaaagccgagactccaa

SEQ ID NO: 150813 - DNA, 25 bp, Mus musculus
agagacaggcctcggaggtctctcc

SEQ ID NO: 150814 - DNA, 25 bp, Mus musculus
agagacaggcctgggaggtctctcc

SEQ ID NO: 150815 - DNA, 25 bp, Mus musculus
agagacaggctgatccccggagttt

SEQ ID NO: 150816 - DNA, 25 bp, Mus musculus
agagacaggctgttccccggagttt

SEQ ID NO: 150817 - DNA, 25 bp, Mus musculus
agagacagggctccgtcttctcttc

SEQ ID NO: 150818 - DNA, 25 bp, Mus musculus
agagacagggctgcgtcttctcttc

SEQ ID NO: 150819 - DNA, 25 bp, Mus musculus
agagacaggtggctcccaggtcact

SEQ ID NO: 150820 - DNA, 25 bp, Mus musculus
agagacaggtgggtcccaggtcact

SEQ ID NO: 150821 - DNA, 25 bp, Mus musculus
agagacagtagcagctaactccagc

SEQ ID NO: 150822 - DNA, 25 bp, Mus musculus
agagacagtagctgctaactccagc

SEQ ID NO: 150823 - DNA, 25 bp, Mus musculus
agagacagtcccctgtagtcttcca

SEQ ID NO: 150824 - DNA, 25 bp, Mus musculus
agagacagtcccgtgtagtcttcca

SEQ ID NO: 150825 - DNA, 25 bp, Mus musculus
agagacagtctccacactggtgttt

SEQ ID NO: 150826 - DNA, 25 bp, Mus musculus
agagacagtctcgacactggtgttt

SEQ ID NO: 150827 - DNA, 25 bp, Mus musculus
agagacagtctgagacgtccgagtc

SEQ ID NO: 150828 - DNA, 25 bp, Mus musculus
agagacagtctgtgacgtccgagtc

SEQ ID NO: 150829 - DNA, 25 bp, Mus musculus
agagacatacacaacaggcctgggt

SEQ ID NO: 150830 - DNA, 25 bp, Mus musculus
agagacatacactacaggcctgggt

SEQ ID NO: 150831 - DNA, 25 bp, Mus musculus
agagacatacgtacatccattcaag

SEQ ID NO: 150832 - DNA, 25 bp, Mus musculus
agagacatacgttcatccattcaag

SEQ ID NO: 150833 - DNA, 25 bp, Mus musculus
agagacatcacacacaccctggtgg

SEQ ID NO: 150834 - DNA, 25 bp, Mus musculus
agagacatcacagacaccctggtgg

SEQ ID NO: 150835 - DNA, 25 bp, Mus musculus
agagacatccttacgtaggcgagct

SEQ ID NO: 150836 - DNA, 25 bp, Mus musculus
agagacatcctttcgtaggcgagct

SEQ ID NO: 150837 - DNA, 25 bp, Mus musculus
agagacatcggaccttagatctggt

SEQ ID NO: 150838 - DNA, 25 bp, Mus musculus
agagacatcggagcttagatctggt

SEQ ID NO: 150839 - DNA, 25 bp, Mus musculus
agagacatcttcatttaccttacag

SEQ ID NO: 150840 - DNA, 25 bp, Mus musculus
agagacatcttcttttaccttacag

SEQ ID NO: 150841 - DNA, 25 bp, Mus musculus
agagacatgaaaatcccacttcttt

SEQ ID NO: 150842 - DNA, 25 bp, Mus musculus
agagacatgaaattcccacttcttt

SEQ ID NO: 150843 - DNA, 25 bp, Mus musculus
agagacatgaatctaggtggctttt

SEQ ID NO: 150844 - DNA, 25 bp, Mus musculus
agagacatgaatgtaggtggctttt

SEQ ID NO: 150845 - DNA, 25 bp, Mus musculus
agagacattattacttgtcctccaa

SEQ ID NO: 150846 - DNA, 25 bp, Mus musculus
agagacattatttcttgtcctccaa

SEQ ID NO: 150847 - DNA, 25 bp, Mus musculus
agagacattctgacttctctccctg

SEQ ID NO: 150848 - DNA, 25 bp, Mus musculus
agagacattctgtcttctctccctg

SEQ ID NO: 150849 - DNA, 25 bp, Mus musculus
agagacattgttaccatttggatgt

SEQ ID NO: 150850 - DNA, 25 bp, Mus musculus
agagacattgtttccatttggatgt

SEQ ID NO: 150851 - DNA, 25 bp, Mus musculus
agagacatttccaatggcattgctt

SEQ ID NO: 150852 - DNA, 25 bp, Mus musculus
agagacatttcctatggcattgctt

SEQ ID NO: 150853 - DNA, 25 bp, Mus musculus
agagacatttgaccaccttcattcc

SEQ ID NO: 150854 - DNA, 25 bp, Mus musculus
agagacatttgagcaccttcattcc

SEQ ID NO: 150855 - DNA, 25 bp, Mus musculus
agagacattttgatgtacctatgac

SEQ ID NO: 150856 - DNA, 25 bp, Mus musculus
agagacattttgttgtacctatgac

SEQ ID NO: 150857 - DNA, 25 bp, Mus musculus
agagaccaaactcaccttgggtgta

SEQ ID NO: 150858 - DNA, 25 bp, Mus musculus
agagaccaaactgaccttgggtgta

SEQ ID NO: 150859 - DNA, 25 bp, Mus musculus
agagaccaaagccattgcacccagc

SEQ ID NO: 150860 - DNA, 25 bp, Mus musculus
agagaccaaagcgattgcacccagc

SEQ ID NO: 150861 - DNA, 25 bp, Mus musculus
agagaccaacataacacagcccagg

SEQ ID NO: 150862 - DNA, 25 bp, Mus musculus
agagaccaacattacacagcccagg

SEQ ID NO: 150863 - DNA, 25 bp, Mus musculus
agagaccaagatacgcactcctgat

SEQ ID NO: 150864 - DNA, 25 bp, Mus musculus
agagaccaagatcggcactgtgaag

SEQ ID NO: 150865 - DNA, 25 bp, Mus musculus
agagaccaagatgggcactgtgaag

SEQ ID NO: 150866 - DNA, 25 bp, Mus musculus
agagaccaagattcgcactcctgat

SEQ ID NO: 150867 - DNA, 25 bp, Mus musculus
agagaccaatagacacttccagtga

SEQ ID NO: 150868 - DNA, 25 bp, Mus musculus
agagaccaatagtcacttccagtga

SEQ ID NO: 150869 - DNA, 25 bp, Mus musculus
agagaccaatttaaggcttcagaaa

SEQ ID NO: 150870 - DNA, 25 bp, Mus musculus
agagaccaattttaggcttcagaaa

SEQ ID NO: 150871 - DNA, 25 bp, Mus musculus
agagaccacagacgcttgctgctta

SEQ ID NO: 150872 - DNA, 25 bp, Mus musculus
agagaccacagaggcttgctgctta

SEQ ID NO: 150873 - DNA, 25 bp, Mus musculus
agagaccacagcagagattggcccc

SEQ ID NO: 150874 - DNA, 25 bp, Mus musculus
agagaccacagctgagattggcccc

SEQ ID NO: 150875 - DNA, 25 bp, Mus musculus
agagaccacaggaactgttcacatg

SEQ ID NO: 150876 - DNA, 25 bp, Mus musculus
agagaccacaggtactgttcacatg

SEQ ID NO: 150877 - DNA, 25 bp, Mus musculus
agagaccacatcctgtaacctggga

SEQ ID NO: 150878 - DNA, 25 bp, Mus musculus
agagaccacatcgtgtaacctggga

SEQ ID NO: 150879 - DNA, 25 bp, Mus musculus
agagaccaccatctgtcagccctcc

SEQ ID NO: 150880 - DNA, 25 bp, Mus musculus
agagaccaccatgtgtcagccctcc

SEQ ID NO: 150881 - DNA, 25 bp, Mus musculus
agagaccaccctcttggcaggacaa

SEQ ID NO: 150882 - DNA, 25 bp, Mus musculus
agagaccaccctgttggcaggacaa

SEQ ID NO: 150883 - DNA, 25 bp, Mus musculus
agagaccacgacactgctgtgtgca

SEQ ID NO: 150884 - DNA, 25 bp, Mus musculus
agagaccacgactctgctgtgtgca

SEQ ID NO: 150885 - DNA, 25 bp, Mus musculus
agagaccagactacatccgggacag

SEQ ID NO: 150886 - DNA, 25 bp, Mus musculus
agagaccagacttcatccgggacag

SEQ ID NO: 150887 - DNA, 25 bp, Mus musculus
agagaccagagtaccaaaacttcaa

SEQ ID NO: 150888 - DNA, 25 bp, Mus musculus
agagaccagagttccaaaacttcaa

SEQ ID NO: 150889 - DNA, 25 bp, Mus musculus
agagaccagatgcaggcctttccca

SEQ ID NO: 150890 - DNA, 25 bp, Mus musculus
agagaccagatggaggcctttccca

SEQ ID NO: 150891 - DNA, 25 bp, Mus musculus
agagaccagctaaaccactcagggc

SEQ ID NO: 150892 - DNA, 25 bp, Mus musculus
agagaccagctataccactcagggc

SEQ ID NO: 150893 - DNA, 25 bp, Mus musculus
agagaccaggaacctactaggataa

SEQ ID NO: 150894 - DNA, 25 bp, Mus musculus
agagaccaggaagctactaggataa

SEQ ID NO: 150895 - DNA, 25 bp, Mus musculus
agagaccaggttagagaaaagcagt

SEQ ID NO: 150896 - DNA, 25 bp, Mus musculus
agagaccaggtttgagaaaagcagt

SEQ ID NO: 150897 - DNA, 25 bp, Mus musculus
agagaccagtgcagttccctcaagg

SEQ ID NO: 150898 - DNA, 25 bp, Mus musculus
agagaccagtgctgttccctcaagg

SEQ ID NO: 150899 - DNA, 25 bp, Mus musculus
agagaccagtgtctgctccagcacc

SEQ ID NO: 150900 - DNA, 25 bp, Mus musculus
agagaccagtgtgtgctccagcacc

SEQ ID NO: 150901 - DNA, 25 bp, Mus musculus
agagaccatgctacccacgtgggaa

SEQ ID NO: 150902 - DNA, 25 bp, Mus musculus
agagaccatgcttcccacgtgggaa

SEQ ID NO: 150903 - DNA, 25 bp, Mus musculus
agagacccaccgctgttctgtgact

SEQ ID NO: 150904 - DNA, 25 bp, Mus musculus
agagacccaccggtgttctgtgact

SEQ ID NO: 150905 - DNA, 25 bp, Mus musculus
agagacccacctactgactgatgaa

SEQ ID NO: 150906 - DNA, 25 bp, Mus musculus
agagacccaccttctgactgatgaa

SEQ ID NO: 150907 - DNA, 25 bp, Mus musculus
agagacccagcacatacctctgagc

SEQ ID NO: 150908 - DNA, 25 bp, Mus musculus
agagacccagcagatacctctgagc

SEQ ID NO: 150909 - DNA, 25 bp, Mus musculus
agagacccagctcgcttatgtgtca

SEQ ID NO: 150910 - DNA, 25 bp, Mus musculus
agagacccagctggcttatgtgtca

SEQ ID NO: 150911 - DNA, 25 bp, Mus musculus
agagacccaggaagtaacctatgcc

SEQ ID NO: 150912 - DNA, 25 bp, Mus musculus
agagacccaggatgtaacctatgcc

SEQ ID NO: 150913 - DNA, 25 bp, Mus musculus
agagacccattcaaagcagacaaat

SEQ ID NO: 150914 - DNA, 25 bp, Mus musculus
agagacccattctaagcagacaaat

SEQ ID NO: 150915 - DNA, 25 bp, Mus musculus
agagaccccaaaatccagcctaggc

SEQ ID NO: 150916 - DNA, 25 bp, Mus musculus
agagaccccaaacgctacgtccaag

SEQ ID NO: 150917 - DNA, 25 bp, Mus musculus
agagaccccaaaggctacgtccaag

SEQ ID NO: 150918 - DNA, 25 bp, Mus musculus
agagaccccaaattccagcctaggc

SEQ ID NO: 150919 - DNA, 25 bp, Mus musculus
agagaccccagtccgttatcaggag

SEQ ID NO: 150920 - DNA, 25 bp, Mus musculus
agagaccccagtgcgttatcaggag

SEQ ID NO: 150921 - DNA, 25 bp, Mus musculus
agagaccccgaaatccagcctaggc

SEQ ID NO: 150922 - DNA, 25 bp, Mus musculus
agagaccccgaattccagcctaggc

SEQ ID NO: 150923 - DNA, 25 bp, Mus musculus
agagaccccgagcagtgcattcaga

SEQ ID NO: 150924 - DNA, 25 bp, Mus musculus
agagaccccgaggagtgcattcaga

SEQ ID NO: 150925 - DNA, 25 bp, Mus musculus
agagaccccgcacggctcagaagag

SEQ ID NO: 150926 - DNA, 25 bp, Mus musculus
agagaccccgcagggctcagaagag

SEQ ID NO: 150927 - DNA, 25 bp, Mus musculus
agagacccgacaccatggcatgact

SEQ ID NO: 150928 - DNA, 25 bp, Mus musculus
agagacccgacacggctcccaggag

SEQ ID NO: 150929 - DNA, 25 bp, Mus musculus
agagacccgacagcatggcatgact

SEQ ID NO: 150930 - DNA, 25 bp, Mus musculus
agagacccgacagggctcccaggag

SEQ ID NO: 150931 - DNA, 25 bp, Mus musculus
agagacccgtgtccagccaaagaac

SEQ ID NO: 150932 - DNA, 25 bp, Mus musculus
agagacccgtgtgcagccaaagaac

SEQ ID NO: 150933 - DNA, 25 bp, Mus musculus
agagaccctaacacaatcaagtgga

SEQ ID NO: 150934 - DNA, 25 bp, Mus musculus
agagaccctaactcaatcaagtgga

SEQ ID NO: 150935 - DNA, 25 bp, Mus musculus
agagaccctcaacaaccaatataca

SEQ ID NO: 150936 - DNA, 25 bp, Mus musculus
agagaccctcaagaaccaatataca

SEQ ID NO: 150937 - DNA, 25 bp, Mus musculus
agagaccctcggaggcagagtctcc

SEQ ID NO: 150938 - DNA, 25 bp, Mus musculus
agagaccctcggtggcagagtctcc

SEQ ID NO: 150939 - DNA, 25 bp, Mus musculus
agagaccctctgatggacaccctga

SEQ ID NO: 150940 - DNA, 25 bp, Mus musculus
agagaccctctgttggacaccctga

SEQ ID NO: 150941 - DNA, 25 bp, Mus musculus
agagaccctgctctgagttgcatca

SEQ ID NO: 150942 - DNA, 25 bp, Mus musculus
agagaccctgctgtgagttgcatca

SEQ ID NO: 150943 - DNA, 25 bp, Mus musculus
agagaccctggcaattgttctattc

SEQ ID NO: 150944 - DNA, 25 bp, Mus musculus
agagaccctggctattgttctattc

SEQ ID NO: 150945 - DNA, 25 bp, Mus musculus
agagaccctgggaagcctgtaccac

SEQ ID NO: 150946 - DNA, 25 bp, Mus musculus
agagaccctgggtagcctgtaccac

SEQ ID NO: 150947 - DNA, 25 bp, Mus musculus
agagaccgcacgactggtggctttt

SEQ ID NO: 150948 - DNA, 25 bp, Mus musculus
agagaccgcacgtctggtggctttt

SEQ ID NO: 150949 - DNA, 25 bp, Mus musculus
agagaccgccctctaccgaaagatg

SEQ ID NO: 150950 - DNA, 25 bp, Mus musculus
agagaccgccctgtaccgaaagatg

SEQ ID NO: 150951 - DNA, 25 bp, Mus musculus
agagaccgctggaagcacaggacat

SEQ ID NO: 150952 - DNA, 25 bp, Mus musculus
agagaccgctggtagcacaggacat

SEQ ID NO: 150953 - DNA, 25 bp, Mus musculus
agagaccgctgtcttcatgcaatca

SEQ ID NO: 150954 - DNA, 25 bp, Mus musculus
agagaccgctgtgttcatgcaatca

SEQ ID NO: 150955 - DNA, 25 bp, Mus musculus
agagaccggaatcttcttcaggagg

SEQ ID NO: 150956 - DNA, 25 bp, Mus musculus
agagaccggaatgttcttcaggagg

SEQ ID NO: 150957 - DNA, 25 bp, Mus musculus
agagaccggccgacatacgtgaacc

SEQ ID NO: 150958 - DNA, 25 bp, Mus musculus
agagaccggccgtcatacgtgaacc

SEQ ID NO: 150959 - DNA, 25 bp, Mus musculus
agagaccggttgctactttgtaaga

SEQ ID NO: 150960 - DNA, 25 bp, Mus musculus
agagaccggttggtactttgtaaga

SEQ ID NO: 150961 - DNA, 25 bp, Mus musculus
agagacctagacaccttgcctctgt

SEQ ID NO: 150962 - DNA, 25 bp, Mus musculus
agagacctagactccttgcctctgt

SEQ ID NO: 150963 - DNA, 25 bp, Mus musculus
agagacctagcaacgatacccgcac

SEQ ID NO: 150964 - DNA, 25 bp, Mus musculus
agagacctagcatcgatacccgcac

SEQ ID NO: 150965 - DNA, 25 bp, Mus musculus
agagacctagctagccacggtggct

SEQ ID NO: 150966 - DNA, 25 bp, Mus musculus
agagacctagcttgccacggtggct

SEQ ID NO: 150967 - DNA, 25 bp, Mus musculus
agagacctagtcaccagaccggatt

SEQ ID NO: 150968 - DNA, 25 bp, Mus musculus
agagacctagtctccagaccggatt

SEQ ID NO: 150969 - DNA, 25 bp, Mus musculus
agagacctatttcggcttcaaaaca

SEQ ID NO: 150970 - DNA, 25 bp, Mus musculus
agagacctatttgggcttcaaaaca

SEQ ID NO: 150971 - DNA, 25 bp, Mus musculus
agagacctcaagcaacaattcccag

SEQ ID NO: 150972 - DNA, 25 bp, Mus musculus
agagacctcaaggaacaattcccag

SEQ ID NO: 150973 - DNA, 25 bp, Mus musculus
agagacctcacccacttttgctgtg

SEQ ID NO: 150974 - DNA, 25 bp, Mus musculus
agagacctcaccgacttttgctgtg

SEQ ID NO: 150975 - DNA, 25 bp, Mus musculus
agagacctccaacggactctgggaa

SEQ ID NO: 150976 - DNA, 25 bp, Mus musculus
agagacctccaagggactctgggaa

SEQ ID NO: 150977 - DNA, 25 bp, Mus musculus
agagacctccagatacagctcgaga

SEQ ID NO: 150978 - DNA, 25 bp, Mus musculus
agagacctccagttacagctcgaga

SEQ ID NO: 150979 - DNA, 25 bp, Mus musculus
agagacctcctgcaggtcaagtgca

SEQ ID NO: 150980 - DNA, 25 bp, Mus musculus
agagacctcctggaggtcaagtgca

SEQ ID NO: 150981 - DNA, 25 bp, Mus musculus
agagacctcgctcttcaaggcctgg

SEQ ID NO: 150982 - DNA, 25 bp, Mus musculus
agagacctcgctgttcaaggcctgg

SEQ ID NO: 150983 - DNA, 25 bp, Mus musculus
agagacctctccattttactacaat

SEQ ID NO: 150984 - DNA, 25 bp, Mus musculus
agagacctctcctttttactacaat

SEQ ID NO: 150985 - DNA, 25 bp, Mus musculus
agagacctctctaggtggaggcctt

SEQ ID NO: 150986 - DNA, 25 bp, Mus musculus
agagacctctctcggctaccaagag

SEQ ID NO: 150987 - DNA, 25 bp, Mus musculus
agagacctctctgggctaccaagag

SEQ ID NO: 150988 - DNA, 25 bp, Mus musculus
agagacctctcttggtggaggcctt

SEQ ID NO: 150989 - DNA, 25 bp, Mus musculus
agagacctctgcctcgacagggtcc

SEQ ID NO: 150990 - DNA, 25 bp, Mus musculus
agagacctctgcgtcgacagggtcc

SEQ ID NO: 150991 - DNA, 25 bp, Mus musculus
agagacctctgtcaccaacctgttg

SEQ ID NO: 150992 - DNA, 25 bp, Mus musculus
agagacctctgtcgatgccggatgc

SEQ ID NO: 150993 - DNA, 25 bp, Mus musculus
agagacctctgtgaccaacctgttg

SEQ ID NO: 150994 - DNA, 25 bp, Mus musculus
agagacctctgtggatgccggatgc

SEQ ID NO: 150995 - DNA, 25 bp, Mus musculus
agagacctgattaccaataaacgta

SEQ ID NO: 150996 - DNA, 25 bp, Mus musculus
agagacctgatttccaataaacgta

SEQ ID NO: 150997 - DNA, 25 bp, Mus musculus
agagacctgcaaccattccctagac

SEQ ID NO: 150998 - DNA, 25 bp, Mus musculus
agagacctgcaagcattccctagac

SEQ ID NO: 150999 - DNA, 25 bp, Mus musculus
agagacctgccactacctgagacaa

SEQ ID NO: 151000 - DNA, 25 bp, Mus musculus
agagacctgccagtacctgagacaa

SEQ ID NO: 151001 - DNA, 25 bp, Mus musculus
agagacctgcctataaaatcataca

SEQ ID NO: 151002 - DNA, 25 bp, Mus musculus
agagacctgcctttaaaatcataca

SEQ ID NO: 151003 - DNA, 25 bp, Mus musculus
agagacctgctcataatgactgcaa

SEQ ID NO: 151004 - DNA, 25 bp, Mus musculus
agagacctgctcatctggtaaacag

SEQ ID NO: 151005 - DNA, 25 bp, Mus musculus
agagacctgctcttaatgactgcaa

SEQ ID NO: 151006 - DNA, 25 bp, Mus musculus
agagacctgctcttctggtaaacag

SEQ ID NO: 151007 - DNA, 25 bp, Mus musculus
agagacctgctgcaaatcagtactc

SEQ ID NO: 151008 - DNA, 25 bp, Mus musculus
agagacctgctggaaatcagtactc

SEQ ID NO: 151009 - DNA, 25 bp, Mus musculus
agagacctggaaagcgcacgcacac

SEQ ID NO: 151010 - DNA, 25 bp, Mus musculus
agagacctggaatgcgcacgcacac

SEQ ID NO: 151011 - DNA, 25 bp, Mus musculus
agagacctggctcctttacttctta

SEQ ID NO: 151012 - DNA, 25 bp, Mus musculus
agagacctggctgctttacttctta

SEQ ID NO: 151013 - DNA, 25 bp, Mus musculus
agagacctgttcctacaactggaaa

SEQ ID NO: 151014 - DNA, 25 bp, Mus musculus
agagacctgttcgtacaactggaaa

SEQ ID NO: 151015 - DNA, 25 bp, Mus musculus
agagaccttggcaacttagttctga

SEQ ID NO: 151016 - DNA, 25 bp, Mus musculus
agagaccttggctacttagttctga

SEQ ID NO: 151017 - DNA, 25 bp, Mus musculus
agagaccttgtcacccaaacagcaa

SEQ ID NO: 151018 - DNA, 25 bp, Mus musculus
agagaccttgtctcccaaacagcaa

SEQ ID NO: 151019 - DNA, 25 bp, Mus musculus
agagacctttcgacatcctgttgat

SEQ ID NO: 151020 - DNA, 25 bp, Mus musculus
agagacctttcgtcatcctgttgat

SEQ ID NO: 151021 - DNA, 25 bp, Mus musculus
agagacctttgaccttgttttccag

SEQ ID NO: 151022 - DNA, 25 bp, Mus musculus
agagacctttgagcttgttttccag

SEQ ID NO: 151023 - DNA, 25 bp, Mus musculus
agagaccttttgctgagtgtttatt

SEQ ID NO: 151024 - DNA, 25 bp, Mus musculus
agagaccttttggtgagtgtttatt

SEQ ID NO: 151025 - DNA, 25 bp, Mus musculus
agagacgatccccacaatcatggtt

SEQ ID NO: 151026 - DNA, 25 bp, Mus musculus
agagacgatcccgacaatcatggtt

SEQ ID NO: 151027 - DNA, 25 bp, Mus musculus
agagacgatgctccggagaaaccca

SEQ ID NO: 151028 - DNA, 25 bp, Mus musculus
agagacgatgctgcggagaaaccca

SEQ ID NO: 151029 - DNA, 25 bp, Mus musculus
agagacgatgttctcatctgccagt

SEQ ID NO: 151030 - DNA, 25 bp, Mus musculus
agagacgatgttgtcatctgccagt

SEQ ID NO: 151031 - DNA, 25 bp, Mus musculus
agagacgcaacaatcctgtggcatc

SEQ ID NO: 151032 - DNA, 25 bp, Mus musculus
agagacgcaacattcctgtggcatc

SEQ ID NO: 151033 - DNA, 25 bp, Mus musculus
agagacgcagacatccggccgaggc

SEQ ID NO: 151034 - DNA, 25 bp, Mus musculus
agagacgcagacttccggccgaggc

SEQ ID NO: 151035 - DNA, 25 bp, Mus musculus
agagacgcccagactcccgatgaat

SEQ ID NO: 151036 - DNA, 25 bp, Mus musculus
agagacgcccagtctcccgatgaat

SEQ ID NO: 151037 - DNA, 25 bp, Mus musculus
agagacgcctccagctggttcacca

SEQ ID NO: 151038 - DNA, 25 bp, Mus musculus
agagacgcctcctgctggttcacca

SEQ ID NO: 151039 - DNA, 25 bp, Mus musculus
agagacgctgtcatagagatccgca

SEQ ID NO: 151040 - DNA, 25 bp, Mus musculus
agagacgctgtcttagagatccgca

SEQ ID NO: 151041 - DNA, 25 bp, Mus musculus
agagacgcttctccagcatgtgtct

SEQ ID NO: 151042 - DNA, 25 bp, Mus musculus
agagacgcttctgcagcatgtgtct

SEQ ID NO: 151043 - DNA, 25 bp, Mus musculus
agagacgcttgcctatttcatctac

SEQ ID NO: 151044 - DNA, 25 bp, Mus musculus
agagacgcttgcgtatttcatctac

SEQ ID NO: 151045 - DNA, 25 bp, Mus musculus
agagacgctttcacttatttccagt

SEQ ID NO: 151046 - DNA, 25 bp, Mus musculus
agagacgctttctcttatttccagt

SEQ ID NO: 151047 - DNA, 25 bp, Mus musculus
agagacgctttgcaccttgactagc

SEQ ID NO: 151048 - DNA, 25 bp, Mus musculus
agagacgctttggaccttgactagc

SEQ ID NO: 151049 - DNA, 25 bp, Mus musculus
agagacggaaacaacacctgagccc

SEQ ID NO: 151050 - DNA, 25 bp, Mus musculus
agagacggaaactacacctgagccc

SEQ ID NO: 151051 - DNA, 25 bp, Mus musculus
agagacggacctcagacgtgcatca

SEQ ID NO: 151052 - DNA, 25 bp, Mus musculus
agagacggacctgagacgtgcatca

SEQ ID NO: 151053 - DNA, 25 bp, Mus musculus
agagacgggtggatcgccttctgtt

SEQ ID NO: 151054 - DNA, 25 bp, Mus musculus
agagacgggtggttcgccttctgtt

SEQ ID NO: 151055 - DNA, 25 bp, Mus musculus
agagacgtagctcgttttgcccaga

SEQ ID NO: 151056 - DNA, 25 bp, Mus musculus
agagacgtagctggttttgcccaga

SEQ ID NO: 151057 - DNA, 25 bp, Mus musculus
agagacgtaggcagtcctcactgag

SEQ ID NO: 151058 - DNA, 25 bp, Mus musculus
agagacgtaggctgtcctcactgag

SEQ ID NO: 151059 - DNA, 25 bp, Mus musculus
agagacgtcagtatgggcttcccga

SEQ ID NO: 151060 - DNA, 25 bp, Mus musculus
agagacgtcagtttgggcttcccga

SEQ ID NO: 151061 - DNA, 25 bp, Mus musculus
agagacgtcgcccacgagagcacac

SEQ ID NO: 151062 - DNA, 25 bp, Mus musculus
agagacgtcgccgacgagagcacac

SEQ ID NO: 151063 - DNA, 25 bp, Mus musculus
agagacgtctcaagatgtgggagca

SEQ ID NO: 151064 - DNA, 25 bp, Mus musculus
agagacgtctcatgatgtgggagca

SEQ ID NO: 151065 - DNA, 25 bp, Mus musculus
agagacgtctggaacgttgccttca

SEQ ID NO: 151066 - DNA, 25 bp, Mus musculus
agagacgtctggtacgttgccttca

SEQ ID NO: 151067 - DNA, 25 bp, Mus musculus
agagacgtgtccagggcttgaacag

SEQ ID NO: 151068 - DNA, 25 bp, Mus musculus
agagacgtgtcctgggcttgaacag

SEQ ID NO: 151069 - DNA, 25 bp, Mus musculus
agagactaacatccccaggtggtgt

SEQ ID NO: 151070 - DNA, 25 bp, Mus musculus
agagactaacatgcccaggtggtgt

SEQ ID NO: 151071 - DNA, 25 bp, Mus musculus
agagactaacttcttttatgtgtgt

SEQ ID NO: 151072 - DNA, 25 bp, Mus musculus
agagactaacttgttttatgtgtgt

SEQ ID NO: 151073 - DNA, 25 bp, Mus musculus
agagactaaggcctcttcaccaggt

SEQ ID NO: 151074 - DNA, 25 bp, Mus musculus
agagactaaggcgtcttcaccaggt

SEQ ID NO: 151075 - DNA, 25 bp, Mus musculus
agagactacaagacctgctgctcag

SEQ ID NO: 151076 - DNA, 25 bp, Mus musculus
agagactacaagtcctgctgctcag

SEQ ID NO: 151077 - DNA, 25 bp, Mus musculus
agagactacaccagacaaacttttc

SEQ ID NO: 151078 - DNA, 25 bp, Mus musculus
agagactacacctgacaaacttttc

SEQ ID NO: 151079 - DNA, 25 bp, Mus musculus
agagactacaggagccaggaattct

SEQ ID NO: 151080 - DNA, 25 bp, Mus musculus
agagactacaggtgccaggaattct

SEQ ID NO: 151081 - DNA, 25 bp, Mus musculus
agagactaccagatcaaacgattga

SEQ ID NO: 151082 - DNA, 25 bp, Mus musculus
agagactaccagttcaaacgattga

SEQ ID NO: 151083 - DNA, 25 bp, Mus musculus
agagactaccccagtttcagagcca

SEQ ID NO: 151084 - DNA, 25 bp, Mus musculus
agagactacccctgtttcagagcca

SEQ ID NO: 151085 - DNA, 25 bp, Mus musculus
agagactacctcattctcttcacgt

SEQ ID NO: 151086 - DNA, 25 bp, Mus musculus
agagactacctctttctcttcacgt

SEQ ID NO: 151087 - DNA, 25 bp, Mus musculus
agagactactggatcagctccaggc

SEQ ID NO: 151088 - DNA, 25 bp, Mus musculus
agagactactggttcagctccaggc

SEQ ID NO: 151089 - DNA, 25 bp, Mus musculus
agagactagctaccatgcttcccaa

SEQ ID NO: 151090 - DNA, 25 bp, Mus musculus
agagactagctagcatgcttcccaa

SEQ ID NO: 151091 - DNA, 25 bp, Mus musculus
agagactaggtcacggcctcatcat

SEQ ID NO: 151092 - DNA, 25 bp, Mus musculus
agagactaggtctcggcctcatcat

SEQ ID NO: 151093 - DNA, 25 bp, Mus musculus
agagactagtacaccacacagcaga

SEQ ID NO: 151094 - DNA, 25 bp, Mus musculus
agagactagtactccacacagcaga

SEQ ID NO: 151095 - DNA, 25 bp, Mus musculus
agagactatattatctcctttcccc

SEQ ID NO: 151096 - DNA, 25 bp, Mus musculus
agagactatattttctcctttcccc

SEQ ID NO: 151097 - DNA, 25 bp, Mus musculus
agagactatgcaattggccgctgcc

SEQ ID NO: 151098 - DNA, 25 bp, Mus musculus
agagactatgcatttggccgctgcc

SEQ ID NO: 151099 - DNA, 25 bp, Mus musculus
agagactatgtcattggtcctaatc

SEQ ID NO: 151100 - DNA, 25 bp, Mus musculus
agagactatgtctttggtcctaatc

SEQ ID NO: 151101 - DNA, 25 bp, Mus musculus
agagactcaagcacacggctttgta

SEQ ID NO: 151102 - DNA, 25 bp, Mus musculus
agagactcaagctcacggctttgta

SEQ ID NO: 151103 - DNA, 25 bp, Mus musculus
agagactcactcattgtgtcacgtt

SEQ ID NO: 151104 - DNA, 25 bp, Mus musculus
agagactcactctttgtgtcacgtt

SEQ ID NO: 151105 - DNA, 25 bp, Mus musculus
agagactcactgacctgatgcgcat

SEQ ID NO: 151106 - DNA, 25 bp, Mus musculus
agagactcactgtcctgatgcgcat

SEQ ID NO: 151107 - DNA, 25 bp, Mus musculus
agagactcagcacgcatgggtacca

SEQ ID NO: 151108 - DNA, 25 bp, Mus musculus
agagactcagcaggcatgggtacca

SEQ ID NO: 151109 - DNA, 25 bp, Mus musculus
agagactcagccataaccgtctctg

SEQ ID NO: 151110 - DNA, 25 bp, Mus musculus
agagactcagccttaaccgtctctg

SEQ ID NO: 151111 - DNA, 25 bp, Mus musculus
agagactcagtgaatacttttggct

SEQ ID NO: 151112 - DNA, 25 bp, Mus musculus
agagactcagtgtatacttttggct

SEQ ID NO: 151113 - DNA, 25 bp, Mus musculus
agagactcatgcaagggcctggcat

SEQ ID NO: 151114 - DNA, 25 bp, Mus musculus
agagactcatgctagggcctggcat

SEQ ID NO: 151115 - DNA, 25 bp, Mus musculus
agagactccagtaagtggcctgacc

SEQ ID NO: 151116 - DNA, 25 bp, Mus musculus
agagactccagttagtggcctgacc

SEQ ID NO: 151117 - DNA, 25 bp, Mus musculus
agagactccatcatccagaggttgc

SEQ ID NO: 151118 - DNA, 25 bp, Mus musculus
agagactccatcttccagaggttgc

SEQ ID NO: 151119 - DNA, 25 bp, Mus musculus
agagactcctatccacagctacttg

SEQ ID NO: 151120 - DNA, 25 bp, Mus musculus
agagactcctatgcacagctacttg

SEQ ID NO: 151121 - DNA, 25 bp, Mus musculus
agagactcgagtactttggaaatca

SEQ ID NO: 151122 - DNA, 25 bp, Mus musculus
agagactcgagttctttggaaatca

SEQ ID NO: 151123 - DNA, 25 bp, Mus musculus
agagactcgtgtccttaaagacctt

SEQ ID NO: 151124 - DNA, 25 bp, Mus musculus
agagactcgtgtgcttaaagacctt

SEQ ID NO: 151125 - DNA, 25 bp, Mus musculus
agagactctacaccgtccaaagatg

SEQ ID NO: 151126 - DNA, 25 bp, Mus musculus
agagactctacacctcaggatgaga

SEQ ID NO: 151127 - DNA, 25 bp, Mus musculus
agagactctacagcgtccaaagatg

SEQ ID NO: 151128 - DNA, 25 bp, Mus musculus
agagactctacagctcaggatgaga

SEQ ID NO: 151129 - DNA, 25 bp, Mus musculus
agagactctccacttcacggtggat

SEQ ID NO: 151130 - DNA, 25 bp, Mus musculus
agagactctccagttcacggtggat

SEQ ID NO: 151131 - DNA, 25 bp, Mus musculus
agagactctctactgtcttgttttt

SEQ ID NO: 151132 - DNA, 25 bp, Mus musculus
agagactctctagtgtcttgttttt

SEQ ID NO: 151133 - DNA, 25 bp, Mus musculus
agagactctgatctaagctgtcccc

SEQ ID NO: 151134 - DNA, 25 bp, Mus musculus
agagactctgatgtaagctgtcccc

SEQ ID NO: 151135 - DNA, 25 bp, Mus musculus
agagactctgctcatgttcctgtgg

SEQ ID NO: 151136 - DNA, 25 bp, Mus musculus
agagactctgctgatgttcctgtgg

SEQ ID NO: 151137 - DNA, 25 bp, Mus musculus
agagactctgttcgcagtcacttgt

SEQ ID NO: 151138 - DNA, 25 bp, Mus musculus
agagactctgttggcagtcacttgt

SEQ ID NO: 151139 - DNA, 25 bp, Mus musculus
agagactcttaacaacttgggaaat

SEQ ID NO: 151140 - DNA, 25 bp, Mus musculus
agagactcttaagaacttgggaaat

SEQ ID NO: 151141 - DNA, 25 bp, Mus musculus
agagactcttacatggttcctttca

SEQ ID NO: 151142 - DNA, 25 bp, Mus musculus
agagactcttacttggttcctttca

SEQ ID NO: 151143 - DNA, 25 bp, Mus musculus
agagactgaaagcaacgctgaaagt

SEQ ID NO: 151144 - DNA, 25 bp, Mus musculus
agagactgaaaggaacgctgaaagt

SEQ ID NO: 151145 - DNA, 25 bp, Mus musculus
agagactgacatagacattgcaaca

SEQ ID NO: 151146 - DNA, 25 bp, Mus musculus
agagactgacattgacattgcaaca

SEQ ID NO: 151147 - DNA, 25 bp, Mus musculus
agagactgacctcggtcctggagca

SEQ ID NO: 151148 - DNA, 25 bp, Mus musculus
agagactgacctgggtcctggagca

SEQ ID NO: 151149 - DNA, 25 bp, Mus musculus
agagactgaggtaaccccggaggct

SEQ ID NO: 151150 - DNA, 25 bp, Mus musculus
agagactgaggttaccccggaggct

SEQ ID NO: 151151 - DNA, 25 bp, Mus musculus
agagactgatacataggcccaggaa

SEQ ID NO: 151152 - DNA, 25 bp, Mus musculus
agagactgatacttaggcccaggaa

SEQ ID NO: 151153 - DNA, 25 bp, Mus musculus
agagactgattcagctctactggcc

SEQ ID NO: 151154 - DNA, 25 bp, Mus musculus
agagactgattctgctctactggcc

SEQ ID NO: 151155 - DNA, 25 bp, Mus musculus
agagactgattgcatcccactttat

SEQ ID NO: 151156 - DNA, 25 bp, Mus musculus
agagactgattggatcccactttat

SEQ ID NO: 151157 - DNA, 25 bp, Mus musculus
agagactgcataccccaaatagtga

SEQ ID NO: 151158 - DNA, 25 bp, Mus musculus
agagactgcatacttttcatttact

SEQ ID NO: 151159 - DNA, 25 bp, Mus musculus
agagactgcatagcccaaatagtga

SEQ ID NO: 151160 - DNA, 25 bp, Mus musculus
agagactgcatagttttcatttact

SEQ ID NO: 151161 - DNA, 25 bp, Mus musculus
agagactgccagctagtgaatcccc

SEQ ID NO: 151162 - DNA, 25 bp, Mus musculus
agagactgccaggtagtgaatcccc

SEQ ID NO: 151163 - DNA, 25 bp, Mus musculus
agagactgccgcatgccctgagcga

SEQ ID NO: 151164 - DNA, 25 bp, Mus musculus
agagactgccgcttgccctgagcga

SEQ ID NO: 151165 - DNA, 25 bp, Mus musculus
agagactgctccaggcatcgtttaa

SEQ ID NO: 151166 - DNA, 25 bp, Mus musculus
agagactgctcctggcatcgtttaa

SEQ ID NO: 151167 - DNA, 25 bp, Mus musculus
agagactggactccttaccactggc

SEQ ID NO: 151168 - DNA, 25 bp, Mus musculus
agagactggactgcttaccactggc

SEQ ID NO: 151169 - DNA, 25 bp, Mus musculus
agagactggagaatccagggagttt

SEQ ID NO: 151170 - DNA, 25 bp, Mus musculus
agagactggagattccagggagttt

SEQ ID NO: 151171 - DNA, 25 bp, Mus musculus
agagactggctcaggtgcccactag

SEQ ID NO: 151172 - DNA, 25 bp, Mus musculus
agagactggctctggtgcccactag

SEQ ID NO: 151173 - DNA, 25 bp, Mus musculus
agagactgggatacaatgcggtttc

SEQ ID NO: 151174 - DNA, 25 bp, Mus musculus
agagactgggatagcctggtgcaca

SEQ ID NO: 151175 - DNA, 25 bp, Mus musculus
agagactgggattcaatgcggtttc

SEQ ID NO: 151176 - DNA, 25 bp, Mus musculus
agagactgggattgcctggtgcaca

SEQ ID NO: 151177 - DNA, 25 bp, Mus musculus
agagactgggcaacgacacgctcct

SEQ ID NO: 151178 - DNA, 25 bp, Mus musculus
agagactgggcatcgacacgctcct

SEQ ID NO: 151179 - DNA, 25 bp, Mus musculus
agagactgtaaacgcgctgtcacgg

SEQ ID NO: 151180 - DNA, 25 bp, Mus musculus
agagactgtaaaggcgctgtcacgg

SEQ ID NO: 151181 - DNA, 25 bp, Mus musculus
agagactgtcctcagactctactcg

SEQ ID NO: 151182 - DNA, 25 bp, Mus musculus
agagactgtcctgagactctactcg

SEQ ID NO: 151183 - DNA, 25 bp, Mus musculus
agagactgtcgcaggatgcagtgac

SEQ ID NO: 151184 - DNA, 25 bp, Mus musculus
agagactgtcgctggatgcagtgac

SEQ ID NO: 151185 - DNA, 25 bp, Mus musculus
agagactgtctgaagaactcaggga

SEQ ID NO: 151186 - DNA, 25 bp, Mus musculus
agagactgtctgtagaactcaggga

SEQ ID NO: 151187 - DNA, 25 bp, Mus musculus
agagactgtgccagccactaccaaa

SEQ ID NO: 151188 - DNA, 25 bp, Mus musculus
agagactgtgcctgccactaccaaa

SEQ ID NO: 151189 - DNA, 25 bp, Mus musculus
agagactgtggtaccctccagggat

SEQ ID NO: 151190 - DNA, 25 bp, Mus musculus
agagactgtggttccctccagggat

SEQ ID NO: 151191 - DNA, 25 bp, Mus musculus
agagactgttcgcaactgtcctttc

SEQ ID NO: 151192 - DNA, 25 bp, Mus musculus
agagactgttcggaactgtcctttc

SEQ ID NO: 151193 - DNA, 25 bp, Mus musculus
agagactgttgcctgcctgaagctt

SEQ ID NO: 151194 - DNA, 25 bp, Mus musculus
agagactgttgcgtgcctgaagctt

SEQ ID NO: 151195 - DNA, 25 bp, Mus musculus
agagactgtttccacttttagctgg

SEQ ID NO: 151196 - DNA, 25 bp, Mus musculus
agagactgtttcgacttttagctgg

SEQ ID NO: 151197 - DNA, 25 bp, Mus musculus
agagactgtttgacgtcaagccttc

SEQ ID NO: 151198 - DNA, 25 bp, Mus musculus
agagactgtttgtcgtcaagccttc

SEQ ID NO: 151199 - DNA, 25 bp, Mus musculus
agagacttacagacttcgctttaac

SEQ ID NO: 151200 - DNA, 25 bp, Mus musculus
agagacttacagtcttcgctttaac

SEQ ID NO: 151201 - DNA, 25 bp, Mus musculus
agagacttacctatgtgttcacatg

SEQ ID NO: 151202 - DNA, 25 bp, Mus musculus
agagacttacctttgtgttcacatg

SEQ ID NO: 151203 - DNA, 25 bp, Mus musculus
agagacttagccacctttgatggtt

SEQ ID NO: 151204 - DNA, 25 bp, Mus musculus
agagacttagcctcctttgatggtt

SEQ ID NO: 151205 - DNA, 25 bp, Mus musculus
agagacttcaggctgtttgcccatt

SEQ ID NO: 151206 - DNA, 25 bp, Mus musculus
agagacttcagggtgtttgcccatt

SEQ ID NO: 151207 - DNA, 25 bp, Mus musculus
agagacttcattatccggcacaaag

SEQ ID NO: 151208 - DNA, 25 bp, Mus musculus
agagacttcattttccggcacaaag

SEQ ID NO: 151209 - DNA, 25 bp, Mus musculus
agagacttctgaaccatcctgacca

SEQ ID NO: 151210 - DNA, 25 bp, Mus musculus
agagacttctgatccatcctgacca

SEQ ID NO: 151211 - DNA, 25 bp, Mus musculus
agagacttgaggacagggaccaaat

SEQ ID NO: 151212 - DNA, 25 bp, Mus musculus
agagacttgaggtcagggaccaaat

SEQ ID NO: 151213 - DNA, 25 bp, Mus musculus
agagacttgcatcctagactgtagt

SEQ ID NO: 151214 - DNA, 25 bp, Mus musculus
agagacttgcatgctagactgtagt

SEQ ID NO: 151215 - DNA, 25 bp, Mus musculus
agagacttggcacgactttccccaa

SEQ ID NO: 151216 - DNA, 25 bp, Mus musculus
agagacttggcaggactttccccaa

SEQ ID NO: 151217 - DNA, 25 bp, Mus musculus
agagacttgtctaggttggttcagc

SEQ ID NO: 151218 - DNA, 25 bp, Mus musculus
agagacttgtcttggttggttcagc

SEQ ID NO: 151219 - DNA, 25 bp, Mus musculus
agagacttgtgtccgttccatccaa

SEQ ID NO: 151220 - DNA, 25 bp, Mus musculus
agagacttgtgtgcgttccatccaa

SEQ ID NO: 151221 - DNA, 25 bp, Mus musculus
agagactttccaaacaggctgtgag

SEQ ID NO: 151222 - DNA, 25 bp, Mus musculus
agagactttccatacaggctgtgag

SEQ ID NO: 151223 - DNA, 25 bp, Mus musculus
agagactttccgatcagcctctgac

SEQ ID NO: 151224 - DNA, 25 bp, Mus musculus
agagactttccgttcagcctctgac

SEQ ID NO: 151225 - DNA, 25 bp, Mus musculus
agagactttctaaacacactcctgc

SEQ ID NO: 151226 - DNA, 25 bp, Mus musculus
agagactttctatacacactcctgc

SEQ ID NO: 151227 - DNA, 25 bp, Mus musculus
agagactttggtcctggttggaaac

SEQ ID NO: 151228 - DNA, 25 bp, Mus musculus
agagactttggtgctggttggaaac

SEQ ID NO: 151229 - DNA, 25 bp, Mus musculus
agagacttttctaatatagcctatt

SEQ ID NO: 151230 - DNA, 25 bp, Mus musculus
agagacttttcttatatagcctatt

SEQ ID NO: 151231 - DNA, 25 bp, Mus musculus
agagagaacagtcgaaccgcccctg

SEQ ID NO: 151232 - DNA, 25 bp, Mus musculus
agagagaacagtggaaccgcccctg

SEQ ID NO: 151233 - DNA, 25 bp, Mus musculus
agagagaacccgactccctgtgaag

SEQ ID NO: 151234 - DNA, 25 bp, Mus musculus
agagagaacccgtctccctgtgaag

SEQ ID NO: 151235 - DNA, 25 bp, Mus musculus
agagagaacctaatacttgtgtgta

SEQ ID NO: 151236 - DNA, 25 bp, Mus musculus
agagagaacctattacttgtgtgta

SEQ ID NO: 151237 - DNA, 25 bp, Mus musculus
agagagaactaacccgactctggtc

SEQ ID NO: 151238 - DNA, 25 bp, Mus musculus
agagagaactaagccgactctggtc

SEQ ID NO: 151239 - DNA, 25 bp, Mus musculus
agagagaagcatagcgcctgcgcag

SEQ ID NO: 151240 - DNA, 25 bp, Mus musculus
agagagaagcattgcgcctgcgcag

SEQ ID NO: 151241 - DNA, 25 bp, Mus musculus
agagagaagggcctcctcctcctaa

SEQ ID NO: 151242 - DNA, 25 bp, Mus musculus
agagagaagggcgtcctcctcctaa

SEQ ID NO: 151243 - DNA, 25 bp, Mus musculus
agagagaagtcaacctcactcaata

SEQ ID NO: 151244 - DNA, 25 bp, Mus musculus
agagagaagtcatcctcactcaata

SEQ ID NO: 151245 - DNA, 25 bp, Mus musculus
agagagaagttgacatctcgcccca

SEQ ID NO: 151246 - DNA, 25 bp, Mus musculus
agagagaagttgtcatctcgcccca

SEQ ID NO: 151247 - DNA, 25 bp, Mus musculus
agagagaatcccacctagaactgag

SEQ ID NO: 151248 - DNA, 25 bp, Mus musculus
agagagaatccctcctagaactgag

SEQ ID NO: 151249 - DNA, 25 bp, Mus musculus
agagagaatggcacaatcctggcct

SEQ ID NO: 151250 - DNA, 25 bp, Mus musculus
agagagaatggctcaatcctggcct

SEQ ID NO: 151251 - DNA, 25 bp, Mus musculus
agagagacaccacgttcaccttggc

SEQ ID NO: 151252 - DNA, 25 bp, Mus musculus
agagagacaccacttttgcagccca

SEQ ID NO: 151253 - DNA, 25 bp, Mus musculus
agagagacaccaggttcaccttggc

SEQ ID NO: 151254 - DNA, 25 bp, Mus musculus
agagagacaccagttttgcagccca

SEQ ID NO: 151255 - DNA, 25 bp, Mus musculus
agagagacactgatggcgcatgcct

SEQ ID NO: 151256 - DNA, 25 bp, Mus musculus
agagagacactgttggcgcatgcct

SEQ ID NO: 151257 - DNA, 25 bp, Mus musculus
agagagacagcacggtccaccaaca

SEQ ID NO: 151258 - DNA, 25 bp, Mus musculus
agagagacagcagggtccaccaaca

SEQ ID NO: 151259 - DNA, 25 bp, Mus musculus
agagagacatctacaccaatataag

SEQ ID NO: 151260 - DNA, 25 bp, Mus musculus
agagagacatcttcaccaatataag

SEQ ID NO: 151261 - DNA, 25 bp, Mus musculus
agagagacatgcaaaccccagatat

SEQ ID NO: 151262 - DNA, 25 bp, Mus musculus
agagagacatgctaaccccagatat

SEQ ID NO: 151263 - DNA, 25 bp, Mus musculus
agagagacccacctactgactgatg

SEQ ID NO: 151264 - DNA, 25 bp, Mus musculus
agagagacccacgtactgactgatg

SEQ ID NO: 151265 - DNA, 25 bp, Mus musculus
agagagacctccctgggtttccaga

SEQ ID NO: 151266 - DNA, 25 bp, Mus musculus
agagagacctccgtgggtttccaga

SEQ ID NO: 151267 - DNA, 25 bp, Mus musculus
agagagacctgacccgtgaagtaca

SEQ ID NO: 151268 - DNA, 25 bp, Mus musculus
agagagacctgagccgtgaagtaca

SEQ ID NO: 151269 - DNA, 25 bp, Mus musculus
agagagacctggctattgtgtgaca

SEQ ID NO: 151270 - DNA, 25 bp, Mus musculus
agagagacctggctcatgttcctat

SEQ ID NO: 151271 - DNA, 25 bp, Mus musculus
agagagacctgggtattgtgtgaca

SEQ ID NO: 151272 - DNA, 25 bp, Mus musculus
agagagacctgggtcatgttcctat

SEQ ID NO: 151273 - DNA, 25 bp, Mus musculus
agagagacgcttaccggcctgtgga

SEQ ID NO: 151274 - DNA, 25 bp, Mus musculus
agagagacgctttccggcctgtgga

SEQ ID NO: 151275 - DNA, 25 bp, Mus musculus
agagagactcttcctggattccacg

SEQ ID NO: 151276 - DNA, 25 bp, Mus musculus
agagagactcttgctggattccacg

SEQ ID NO: 151277 - DNA, 25 bp, Mus musculus
agagagactgctcgtggttctggac

SEQ ID NO: 151278 - DNA, 25 bp, Mus musculus
agagagactgctggtggttctggac

SEQ ID NO: 151279 - DNA, 25 bp, Mus musculus
agagagacttcccaagtgtgtttct

SEQ ID NO: 151280 - DNA, 25 bp, Mus musculus
agagagacttccgaagtgtgtttct

SEQ ID NO: 151281 - DNA, 25 bp, Mus musculus
agagagacttctacaagctgcccag

SEQ ID NO: 151282 - DNA, 25 bp, Mus musculus
agagagacttcttcaagctgcccag

SEQ ID NO: 151283 - DNA, 25 bp, Mus musculus
agagagagaactaacccacttagcc

SEQ ID NO: 151284 - DNA, 25 bp, Mus musculus
agagagagaacttacccacttagcc

SEQ ID NO: 151285 - DNA, 25 bp, Mus musculus
agagagagaagccatagagtatttg

SEQ ID NO: 151286 - DNA, 25 bp, Mus musculus
agagagagaagcgatagagtatttg

SEQ ID NO: 151287 - DNA, 25 bp, Mus musculus
agagagagacttcgccagctcgtgt

SEQ ID NO: 151288 - DNA, 25 bp, Mus musculus
agagagagacttggccagctcgtgt

SEQ ID NO: 151289 - DNA, 25 bp, Mus musculus
agagagagatggctaccctccaggc

SEQ ID NO: 151290 - DNA, 25 bp, Mus musculus
agagagagatgggtaccctccaggc

SEQ ID NO: 151291 - DNA, 25 bp, Mus musculus
agagagagcacacgcgcactttctc

SEQ ID NO: 151292 - DNA, 25 bp, Mus musculus
agagagagcacaggcgcactttctc

SEQ ID NO: 151293 - DNA, 25 bp, Mus musculus
agagagagcactaacagggcagcaa

SEQ ID NO: 151294 - DNA, 25 bp, Mus musculus
agagagagcacttacagggcagcaa

SEQ ID NO: 151295 - DNA, 25 bp, Mus musculus
agagagagccccacacttttgcgca

SEQ ID NO: 151296 - DNA, 25 bp, Mus musculus
agagagagcccctcacttttgcgca

SEQ ID NO: 151297 - DNA, 25 bp, Mus musculus
agagagagcctgactggtgcattgc

SEQ ID NO: 151298 - DNA, 25 bp, Mus musculus
agagagagcctgtctggtgcattgc

SEQ ID NO: 151299 - DNA, 25 bp, Mus musculus
agagagagcggcatactgggctttt

SEQ ID NO: 151300 - DNA, 25 bp, Mus musculus
agagagagcggcttactgggctttt

SEQ ID NO: 151301 - DNA, 25 bp, Mus musculus
agagagagctccagtcattgaccaa

SEQ ID NO: 151302 - DNA, 25 bp, Mus musculus
agagagagctcctgtcattgaccaa

SEQ ID NO: 151303 - DNA, 25 bp, Mus musculus
agagagagctctctagtgtccatgg

SEQ ID NO: 151304 - DNA, 25 bp, Mus musculus
agagagagctctgtagtgtccatgg

SEQ ID NO: 151305 - DNA, 25 bp, Mus musculus
agagagagctggatcctgccatgag

SEQ ID NO: 151306 - DNA, 25 bp, Mus musculus
agagagagctggttcctgccatgag

SEQ ID NO: 151307 - DNA, 25 bp, Mus musculus
agagagaggcttattacattcagaa

SEQ ID NO: 151308 - DNA, 25 bp, Mus musculus
agagagaggctttttacattcagaa

SEQ ID NO: 151309 - DNA, 25 bp, Mus musculus
agagagaggtccaaccccgtgtggc

SEQ ID NO: 151310 - DNA, 25 bp, Mus musculus
agagagaggtcctaccccgtgtggc

SEQ ID NO: 151311 - DNA, 25 bp, Mus musculus
agagagaggtctccttccatggtgt

SEQ ID NO: 151312 - DNA, 25 bp, Mus musculus
agagagaggtctgcttccatggtgt

SEQ ID NO: 151313 - DNA, 25 bp, Mus musculus
agagagagtaccctaggtgctaaag

SEQ ID NO: 151314 - DNA, 25 bp, Mus musculus
agagagagtaccgtaggtgctaaag

SEQ ID NO: 151315 - DNA, 25 bp, Mus musculus
agagagagtattccgtcccaacaga

SEQ ID NO: 151316 - DNA, 25 bp, Mus musculus
agagagagtattgcgtcccaacaga

SEQ ID NO: 151317 - DNA, 25 bp, Mus musculus
agagagatcataacacaccctgcca

SEQ ID NO: 151318 - DNA, 25 bp, Mus musculus
agagagatcatatcacaccctgcca

SEQ ID NO: 151319 - DNA, 25 bp, Mus musculus
agagagatccagacatgcaacacaa

SEQ ID NO: 151320 - DNA, 25 bp, Mus musculus
agagagatccagaccgctattcgac

SEQ ID NO: 151321 - DNA, 25 bp, Mus musculus
agagagatccagtcatgcaacacaa

SEQ ID NO: 151322 - DNA, 25 bp, Mus musculus
agagagatccagtccgctattcgac

SEQ ID NO: 151323 - DNA, 25 bp, Mus musculus
agagagatcctacgcaaacccttag

SEQ ID NO: 151324 - DNA, 25 bp, Mus musculus
agagagatcctaggcaaacccttag

SEQ ID NO: 151325 - DNA, 25 bp, Mus musculus
agagagatcctcattttaagaagtg

SEQ ID NO: 151326 - DNA, 25 bp, Mus musculus
agagagatcctctttttaagaagtg

SEQ ID NO: 151327 - DNA, 25 bp, Mus musculus
agagagatcttgctactatgttaat

SEQ ID NO: 151328 - DNA, 25 bp, Mus musculus
agagagatcttggtactatgttaat

SEQ ID NO: 151329 - DNA, 25 bp, Mus musculus
agagagatgccactgcctgggacct

SEQ ID NO: 151330 - DNA, 25 bp, Mus musculus
agagagatgccagtgcctgggacct

SEQ ID NO: 151331 - DNA, 25 bp, Mus musculus
agagagatgcccagaaaacacactt

SEQ ID NO: 151332 - DNA, 25 bp, Mus musculus
agagagatgccctgaaaacacactt

SEQ ID NO: 151333 - DNA, 25 bp, Mus musculus
agagagatggcccaccctctgtgat

SEQ ID NO: 151334 - DNA, 25 bp, Mus musculus
agagagatggccgaccctctgtgat

SEQ ID NO: 151335 - DNA, 25 bp, Mus musculus
agagagattaatagctggcctggta

SEQ ID NO: 151336 - DNA, 25 bp, Mus musculus
agagagattaattgctggcctggta

SEQ ID NO: 151337 - DNA, 25 bp, Mus musculus
agagagattgcaaggcccctgtcta

SEQ ID NO: 151338 - DNA, 25 bp, Mus musculus
agagagattgcatggcccctgtcta

SEQ ID NO: 151339 - DNA, 25 bp, Mus musculus
agagagattgttccttcgtaaatac

SEQ ID NO: 151340 - DNA, 25 bp, Mus musculus
agagagattgttgcttcgtaaatac

SEQ ID NO: 151341 - DNA, 25 bp, Mus musculus
agagagattttcaaccctacaggta

SEQ ID NO: 151342 - DNA, 25 bp, Mus musculus
agagagattttctaccctacaggta

SEQ ID NO: 151343 - DNA, 25 bp, Mus musculus
agagagcaaaggctaccccatccta

SEQ ID NO: 151344 - DNA, 25 bp, Mus musculus
agagagcaaagggtaccccatccta

SEQ ID NO: 151345 - DNA, 25 bp, Mus musculus
agagagcaacaaaggattcacatac

SEQ ID NO: 151346 - DNA, 25 bp, Mus musculus
agagagcaacaatggattcacatac

SEQ ID NO: 151347 - DNA, 25 bp, Mus musculus
agagagcaagtaacatccagttcat

SEQ ID NO: 151348 - DNA, 25 bp, Mus musculus
agagagcaagtatcatccagttcat

SEQ ID NO: 151349 - DNA, 25 bp, Mus musculus
agagagcaagttcccacctcacttc

SEQ ID NO: 151350 - DNA, 25 bp, Mus musculus
agagagcaagttgccacctcacttc

SEQ ID NO: 151351 - DNA, 25 bp, Mus musculus
agagagcacagaaagcctgcctcta

SEQ ID NO: 151352 - DNA, 25 bp, Mus musculus
agagagcacagatagcctgcctcta

SEQ ID NO: 151353 - DNA, 25 bp, Mus musculus
agagagcacagtactgactccccgt

SEQ ID NO: 151354 - DNA, 25 bp, Mus musculus
agagagcacagttctgactccccgt

SEQ ID NO: 151355 - DNA, 25 bp, Mus musculus
agagagcacatcaaactctggcctg

SEQ ID NO: 151356 - DNA, 25 bp, Mus musculus
agagagcacatctaactctggcctg

SEQ ID NO: 151357 - DNA, 25 bp, Mus musculus
agagagcaccatccagtgggcctac

SEQ ID NO: 151358 - DNA, 25 bp, Mus musculus
agagagcaccatgcagtgggcctac

SEQ ID NO: 151359 - DNA, 25 bp, Mus musculus
agagagcagatcattgtctttttga

SEQ ID NO: 151360 - DNA, 25 bp, Mus musculus
agagagcagatctttgtctttttga

SEQ ID NO: 151361 - DNA, 25 bp, Mus musculus
agagagcagcacagtatcggcccct

SEQ ID NO: 151362 - DNA, 25 bp, Mus musculus
agagagcagcactgtatcggcccct

SEQ ID NO: 151363 - DNA, 25 bp, Mus musculus
agagagcagccgctgttctttacta

SEQ ID NO: 151364 - DNA, 25 bp, Mus musculus
agagagcagccggtgttctttacta

SEQ ID NO: 151365 - DNA, 25 bp, Mus musculus
agagagcagcttaggcacatcttaa

SEQ ID NO: 151366 - DNA, 25 bp, Mus musculus
agagagcagctttggcacatcttaa

SEQ ID NO: 151367 - DNA, 25 bp, Mus musculus
agagagcaggccaaccaagaaagaa

SEQ ID NO: 151368 - DNA, 25 bp, Mus musculus
agagagcaggcctaccaagaaagaa

SEQ ID NO: 151369 - DNA, 25 bp, Mus musculus
agagagcagggccagtcctgtccac

SEQ ID NO: 151370 - DNA, 25 bp, Mus musculus
agagagcagggcgagtcctgtccac

SEQ ID NO: 151371 - DNA, 25 bp, Mus musculus
agagagcagtagacacccttgttgg

SEQ ID NO: 151372 - DNA, 25 bp, Mus musculus
agagagcagtagtcacccttgttgg

SEQ ID NO: 151373 - DNA, 25 bp, Mus musculus
agagagcagtctacattttaagctg

SEQ ID NO: 151374 - DNA, 25 bp, Mus musculus
agagagcagtctccgtggctgccac

SEQ ID NO: 151375 - DNA, 25 bp, Mus musculus
agagagcagtctgcgtggctgccac

SEQ ID NO: 151376 - DNA, 25 bp, Mus musculus
agagagcagtcttcattttaagctg

SEQ ID NO: 151377 - DNA, 25 bp, Mus musculus
agagagcagtttccccttatgccag

SEQ ID NO: 151378 - DNA, 25 bp, Mus musculus
agagagcagtttgcccttatgccag

SEQ ID NO: 151379 - DNA, 25 bp, Mus musculus
agagagcatagccatatttgggatg

SEQ ID NO: 151380 - DNA, 25 bp, Mus musculus
agagagcatagcgatatttgggatg

SEQ ID NO: 151381 - DNA, 25 bp, Mus musculus
agagagcatccaactgacactaaca

SEQ ID NO: 151382 - DNA, 25 bp, Mus musculus
agagagcatccactgtcatgtacca

SEQ ID NO: 151383 - DNA, 25 bp, Mus musculus
agagagcatccagtgtcatgtacca

SEQ ID NO: 151384 - DNA, 25 bp, Mus musculus
agagagcatccatctgacactaaca

SEQ ID NO: 151385 - DNA, 25 bp, Mus musculus
agagagcatcgcatctctcctgtga

SEQ ID NO: 151386 - DNA, 25 bp, Mus musculus
agagagcatcgcttctctcctgtga

SEQ ID NO: 151387 - DNA, 25 bp, Mus musculus
agagagcatgcgctagctgcagcct

SEQ ID NO: 151388 - DNA, 25 bp, Mus musculus
agagagcatgcggtagctgcagcct

SEQ ID NO: 151389 - DNA, 25 bp, Mus musculus
agagagcattcacttagactgcagt

SEQ ID NO: 151390 - DNA, 25 bp, Mus musculus
agagagcattcagttagactgcagt

SEQ ID NO: 151391 - DNA, 25 bp, Mus musculus
agagagccacagcactatccagaaa

SEQ ID NO: 151392 - DNA, 25 bp, Mus musculus
agagagccacaggactatccagaaa

SEQ ID NO: 151393 - DNA, 25 bp, Mus musculus
agagagccaccccagtgctatttag

SEQ ID NO: 151394 - DNA, 25 bp, Mus musculus
agagagccacccgagtgctatttag

SEQ ID NO: 151395 - DNA, 25 bp, Mus musculus
agagagccactcagtatgcccgagt

SEQ ID NO: 151396 - DNA, 25 bp, Mus musculus
agagagccactctgtatgcccgagt

SEQ ID NO: 151397 - DNA, 25 bp, Mus musculus
agagagccagatactcacccaggga

SEQ ID NO: 151398 - DNA, 25 bp, Mus musculus
agagagccagattctcacccaggga

SEQ ID NO: 151399 - DNA, 25 bp, Mus musculus
agagagccagccctgccgagtcaag

SEQ ID NO: 151400 - DNA, 25 bp, Mus musculus
agagagccagccgtgccgagtcaag

SEQ ID NO: 151401 - DNA, 25 bp, Mus musculus
agagagccaggactgcacgctattg

SEQ ID NO: 151402 - DNA, 25 bp, Mus musculus
agagagccaggagtgcacgctattg

SEQ ID NO: 151403 - DNA, 25 bp, Mus musculus
agagagccatccaaggttcttgcag

SEQ ID NO: 151404 - DNA, 25 bp, Mus musculus
agagagccatcctaggttcttgcag

SEQ ID NO: 151405 - DNA, 25 bp, Mus musculus
agagagccattacctaccagattgc

SEQ ID NO: 151406 - DNA, 25 bp, Mus musculus
agagagccattagctaccagattgc

SEQ ID NO: 151407 - DNA, 25 bp, Mus musculus
agagagccatttctacttcggtgtg

SEQ ID NO: 151408 - DNA, 25 bp, Mus musculus
agagagccatttgtacttcggtgtg

SEQ ID NO: 151409 - DNA, 25 bp, Mus musculus
agagagccccacagaacatcttcaa

SEQ ID NO: 151410 - DNA, 25 bp, Mus musculus
agagagccccactgaacatcttcaa

SEQ ID NO: 151411 - DNA, 25 bp, Mus musculus
agagagccccatcacagctgtgtgt

SEQ ID NO: 151412 - DNA, 25 bp, Mus musculus
agagagccccatgacagctgtgtgt

SEQ ID NO: 151413 - DNA, 25 bp, Mus musculus
agagagccccgtatctataaacaca

SEQ ID NO: 151414 - DNA, 25 bp, Mus musculus
agagagccccgtttctataaacaca

SEQ ID NO: 151415 - DNA, 25 bp, Mus musculus
agagagccctccagggatttgtcag

SEQ ID NO: 151416 - DNA, 25 bp, Mus musculus
agagagccctcctgggatttgtcag

SEQ ID NO: 151417 - DNA, 25 bp, Mus musculus
agagagccgatcctgggccctcaga

SEQ ID NO: 151418 - DNA, 25 bp, Mus musculus
agagagccgatcgtgggccctcaga

SEQ ID NO: 151419 - DNA, 25 bp, Mus musculus
agagagccggctcctatctaactgt

SEQ ID NO: 151420 - DNA, 25 bp, Mus musculus
agagagccggctgctatctaactgt

SEQ ID NO: 151421 - DNA, 25 bp, Mus musculus
agagagcctaataagccgctggcct

SEQ ID NO: 151422 - DNA, 25 bp, Mus musculus
agagagcctaattagccgctggcct

SEQ ID NO: 151423 - DNA, 25 bp, Mus musculus
agagagcctaggacagatcagacac

SEQ ID NO: 151424 - DNA, 25 bp, Mus musculus
agagagcctaggtcagatcagacac

SEQ ID NO: 151425 - DNA, 25 bp, Mus musculus
agagagcctccgatatcctaagtag

SEQ ID NO: 151426 - DNA, 25 bp, Mus musculus
agagagcctccgttatcctaagtag

SEQ ID NO: 151427 - DNA, 25 bp, Mus musculus
agagagcctcgaaggcccttggagt

SEQ ID NO: 151428 - DNA, 25 bp, Mus musculus
agagagcctcgatggcccttggagt

SEQ ID NO: 151429 - DNA, 25 bp, Mus musculus
agagagcctctcatgttagcagatc

SEQ ID NO: 151430 - DNA, 25 bp, Mus musculus
agagagcctctcttgttagcagatc

SEQ ID NO: 151431 - DNA, 25 bp, Mus musculus
agagagcctctgctcggcttatgca

SEQ ID NO: 151432 - DNA, 25 bp, Mus musculus
agagagcctctggtcggcttatgca

SEQ ID NO: 151433 - DNA, 25 bp, Mus musculus
agagagcctcttacgattctttttg

SEQ ID NO: 151434 - DNA, 25 bp, Mus musculus
agagagcctctttcgattctttttg

SEQ ID NO: 151435 - DNA, 25 bp, Mus musculus
agagagcctgtcaggtgcattgcct

SEQ ID NO: 151436 - DNA, 25 bp, Mus musculus
agagagcctgtctggtgcattgcct

SEQ ID NO: 151437 - DNA, 25 bp, Mus musculus
agagagcgcagtcttctaagggcca

SEQ ID NO: 151438 - DNA, 25 bp, Mus musculus
agagagcgcagtgttctaagggcca

SEQ ID NO: 151439 - DNA, 25 bp, Mus musculus
agagagcgccaaccctcaggtcaaa

SEQ ID NO: 151440 - DNA, 25 bp, Mus musculus
agagagcgccaagcctcaggtcaaa

SEQ ID NO: 151441 - DNA, 25 bp, Mus musculus
agagagcggcatagggccccaagca

SEQ ID NO: 151442 - DNA, 25 bp, Mus musculus
agagagcggcattgggccccaagca

SEQ ID NO: 151443 - DNA, 25 bp, Mus musculus
agagagcgtgtcagctggtcttcat

SEQ ID NO: 151444 - DNA, 25 bp, Mus musculus
agagagcgtgtctgctggtcttcat

SEQ ID NO: 151445 - DNA, 25 bp, Mus musculus
agagagctaagcacatgggccttgt

SEQ ID NO: 151446 - DNA, 25 bp, Mus musculus
agagagctaagctcatgggccttgt

SEQ ID NO: 151447 - DNA, 25 bp, Mus musculus
agagagctactgaaggccccaagca

SEQ ID NO: 151448 - DNA, 25 bp, Mus musculus
agagagctactgtaggccccaagca

SEQ ID NO: 151449 - DNA, 25 bp, Mus musculus
agagagctaggccagtctcgtcaga

SEQ ID NO: 151450 - DNA, 25 bp, Mus musculus
agagagctaggcgagtctcgtcaga

SEQ ID NO: 151451 - DNA, 25 bp, Mus musculus
agagagctagtgacaatccctcact

SEQ ID NO: 151452 - DNA, 25 bp, Mus musculus
agagagctagtgtcaatccctcact

SEQ ID NO: 151453 - DNA, 25 bp, Mus musculus
agagagctatttccagtatgtgtta

SEQ ID NO: 151454 - DNA, 25 bp, Mus musculus
agagagctatttgcagtatgtgtta

SEQ ID NO: 151455 - DNA, 25 bp, Mus musculus
agagagctcaaaaatcccgaggcct

SEQ ID NO: 151456 - DNA, 25 bp, Mus musculus
agagagctcaaatatcccgaggcct

SEQ ID NO: 151457 - DNA, 25 bp, Mus musculus
agagagctcacccatggccactgag

SEQ ID NO: 151458 - DNA, 25 bp, Mus musculus
agagagctcaccgatggccactgag

SEQ ID NO: 151459 - DNA, 25 bp, Mus musculus
agagagctcacgagggctgtttgcc

SEQ ID NO: 151460 - DNA, 25 bp, Mus musculus
agagagctcacgtgggctgtttgcc

SEQ ID NO: 151461 - DNA, 25 bp, Mus musculus
agagagctcagaacctggcatgcca

SEQ ID NO: 151462 - DNA, 25 bp, Mus musculus
agagagctcagatcctggcatgcca

SEQ ID NO: 151463 - DNA, 25 bp, Mus musculus
agagagctccaactcctggtgaggt

SEQ ID NO: 151464 - DNA, 25 bp, Mus musculus
agagagctccaagtcctggtgaggt

SEQ ID NO: 151465 - DNA, 25 bp, Mus musculus
agagagctccatagggaaattccct

SEQ ID NO: 151466 - DNA, 25 bp, Mus musculus
agagagctccattgggaaattccct

SEQ ID NO: 151467 - DNA, 25 bp, Mus musculus
agagagctcccaccattttacttgg

SEQ ID NO: 151468 - DNA, 25 bp, Mus musculus
agagagctcccagcattttacttgg

SEQ ID NO: 151469 - DNA, 25 bp, Mus musculus
agagagctcctgctcagttctaact

SEQ ID NO: 151470 - DNA, 25 bp, Mus musculus
agagagctcctggtcagttctaact

SEQ ID NO: 151471 - DNA, 25 bp, Mus musculus
agagagctgacccttctccagctgt

SEQ ID NO: 151472 - DNA, 25 bp, Mus musculus
agagagctgaccgttctccagctgt

SEQ ID NO: 151473 - DNA, 25 bp, Mus musculus
agagagctgactactgcaccttgtc

SEQ ID NO: 151474 - DNA, 25 bp, Mus musculus
agagagctgacttctgcaccttgtc

SEQ ID NO: 151475 - DNA, 25 bp, Mus musculus
agagagctgccaacagaaaaactca

SEQ ID NO: 151476 - DNA, 25 bp, Mus musculus
agagagctgccacgccgcaagtatg

SEQ ID NO: 151477 - DNA, 25 bp, Mus musculus
agagagctgccaggccgcaagtatg

SEQ ID NO: 151478 - DNA, 25 bp, Mus musculus
agagagctgccatcagaaaaactca

SEQ ID NO: 151479 - DNA, 25 bp, Mus musculus
agagagctggcccttaccgatttgc

SEQ ID NO: 151480 - DNA, 25 bp, Mus musculus
agagagctggccgttaccgatttgc

SEQ ID NO: 151481 - DNA, 25 bp, Mus musculus
agagagctgttactactttgtaaag

SEQ ID NO: 151482 - DNA, 25 bp, Mus musculus
agagagctgttagtactttgtaaag

SEQ ID NO: 151483 - DNA, 25 bp, Mus musculus
agagagcttaccaaacatgtgcaaa

SEQ ID NO: 151484 - DNA, 25 bp, Mus musculus
agagagcttacctaacatgtgcaaa

SEQ ID NO: 151485 - DNA, 25 bp, Mus musculus
agagagcttcttaacctggtttact

SEQ ID NO: 151486 - DNA, 25 bp, Mus musculus
agagagcttcttccttaggctattt

SEQ ID NO: 151487 - DNA, 25 bp, Mus musculus
agagagcttcttgcttaggctattt

SEQ ID NO: 151488 - DNA, 25 bp, Mus musculus
agagagcttctttacctggtttact

SEQ ID NO: 151489 - DNA, 25 bp, Mus musculus
agagagcttgctccaggctgtagtt

SEQ ID NO: 151490 - DNA, 25 bp, Mus musculus
agagagcttgctgcaggctgtagtt

SEQ ID NO: 151491 - DNA, 25 bp, Mus musculus
agagagcttgttaagcaaacctgga

SEQ ID NO: 151492 - DNA, 25 bp, Mus musculus
agagagcttgtttagcaaacctgga

SEQ ID NO: 151493 - DNA, 25 bp, Mus musculus
agagagctttcactgatgctgtgaa

SEQ ID NO: 151494 - DNA, 25 bp, Mus musculus
agagagctttcagtgatgctgtgaa

SEQ ID NO: 151495 - DNA, 25 bp, Mus musculus
agagagctttctctgtttgcagttg

SEQ ID NO: 151496 - DNA, 25 bp, Mus musculus
agagagctttctgtgtttgcagttg

SEQ ID NO: 151497 - DNA, 25 bp, Mus musculus
agagaggaagctatccgaggcctga

SEQ ID NO: 151498 - DNA, 25 bp, Mus musculus
agagaggaagctttccgaggcctga

SEQ ID NO: 151499 - DNA, 25 bp, Mus musculus
agagaggacaaaactactcaggtga

SEQ ID NO: 151500 - DNA, 25 bp, Mus musculus
agagaggacaaatctactcaggtga

SEQ ID NO: 151501 - DNA, 25 bp, Mus musculus
agagaggacacgactgctccagagg

SEQ ID NO: 151502 - DNA, 25 bp, Mus musculus
agagaggacacgtctgctccagagg

SEQ ID NO: 151503 - DNA, 25 bp, Mus musculus
agagaggacaggctgcttacatagc

SEQ ID NO: 151504 - DNA, 25 bp, Mus musculus
agagaggacagggtgcttacatagc

SEQ ID NO: 151505 - DNA, 25 bp, Mus musculus
agagaggaccctcagtttgactgca

SEQ ID NO: 151506 - DNA, 25 bp, Mus musculus
agagaggaccctgagtttgactgca

SEQ ID NO: 151507 - DNA, 25 bp, Mus musculus
agagaggactccatgttgcacacat

SEQ ID NO: 151508 - DNA, 25 bp, Mus musculus
agagaggactccttgttgcacacat

SEQ ID NO: 151509 - DNA, 25 bp, Mus musculus
agagaggactttcggctgactattc

SEQ ID NO: 151510 - DNA, 25 bp, Mus musculus
agagaggactttgggctgactattc

SEQ ID NO: 151511 - DNA, 25 bp, Mus musculus
agagaggagactaacctttgcctcc

SEQ ID NO: 151512 - DNA, 25 bp, Mus musculus
agagaggagacttacctttgcctcc

SEQ ID NO: 151513 - DNA, 25 bp, Mus musculus
agagaggagagaaaactacgttcct

SEQ ID NO: 151514 - DNA, 25 bp, Mus musculus
agagaggagagataactacgttcct

SEQ ID NO: 151515 - DNA, 25 bp, Mus musculus
agagaggagtccaccgctaatgctc

SEQ ID NO: 151516 - DNA, 25 bp, Mus musculus
agagaggagtcctccgctaatgctc

SEQ ID NO: 151517 - DNA, 25 bp, Mus musculus
agagaggatcggatcattaccatgc

SEQ ID NO: 151518 - DNA, 25 bp, Mus musculus
agagaggatcggttcattaccatgc

SEQ ID NO: 151519 - DNA, 25 bp, Mus musculus
agagaggattccactacagcctcgc

SEQ ID NO: 151520 - DNA, 25 bp, Mus musculus
agagaggattcctctacagcctcgc

SEQ ID NO: 151521 - DNA, 25 bp, Mus musculus
agagaggcaaccctatcttcttcct

SEQ ID NO: 151522 - DNA, 25 bp, Mus musculus
agagaggcaaccgtatcttcttcct

SEQ ID NO: 151523 - DNA, 25 bp, Mus musculus
agagaggcaagcaacatgtgtaatt

SEQ ID NO: 151524 - DNA, 25 bp, Mus musculus
agagaggcaagccaggccaccctgc

SEQ ID NO: 151525 - DNA, 25 bp, Mus musculus
agagaggcaagcgaggccaccctgc

SEQ ID NO: 151526 - DNA, 25 bp, Mus musculus
agagaggcaagctacatgtgtaatt

SEQ ID NO: 151527 - DNA, 25 bp, Mus musculus
agagaggcacacactttcttgccaa

SEQ ID NO: 151528 - DNA, 25 bp, Mus musculus
agagaggcacactctttcttgccaa

SEQ ID NO: 151529 - DNA, 25 bp, Mus musculus
agagaggcagacatggtacccagct

SEQ ID NO: 151530 - DNA, 25 bp, Mus musculus
agagaggcagacttggtacccagct

SEQ ID NO: 151531 - DNA, 25 bp, Mus musculus
agagaggcaggtccccttgactctc

SEQ ID NO: 151532 - DNA, 25 bp, Mus musculus
agagaggcaggtctctctctagttc

SEQ ID NO: 151533 - DNA, 25 bp, Mus musculus
agagaggcaggtgcccttgactctc

SEQ ID NO: 151534 - DNA, 25 bp, Mus musculus
agagaggcaggtgtctctctagttc

SEQ ID NO: 151535 - DNA, 25 bp, Mus musculus
agagaggcagttatggtccagtgta

SEQ ID NO: 151536 - DNA, 25 bp, Mus musculus
agagaggcagttttggtccagtgta

SEQ ID NO: 151537 - DNA, 25 bp, Mus musculus
agagaggccagcacagtgtctcgtg

SEQ ID NO: 151538 - DNA, 25 bp, Mus musculus
agagaggccagctcagtgtctcgtg

SEQ ID NO: 151539 - DNA, 25 bp, Mus musculus
agagaggcccctcaggagctatcca

SEQ ID NO: 151540 - DNA, 25 bp, Mus musculus
agagaggcccctgaggagctatcca

SEQ ID NO: 151541 - DNA, 25 bp, Mus musculus
agagaggccctacatagcccagctt

SEQ ID NO: 151542 - DNA, 25 bp, Mus musculus
agagaggccctagatagcccagctt

SEQ ID NO: 151543 - DNA, 25 bp, Mus musculus
agagaggcctgtcactgggaaccta

SEQ ID NO: 151544 - DNA, 25 bp, Mus musculus
agagaggcctgtgactgggaaccta

SEQ ID NO: 151545 - DNA, 25 bp, Mus musculus
agagaggccttaaagcggccccgga

SEQ ID NO: 151546 - DNA, 25 bp, Mus musculus
agagaggccttatagcggccccgga

SEQ ID NO: 151547 - DNA, 25 bp, Mus musculus
agagaggctattcccagcacagcac

SEQ ID NO: 151548 - DNA, 25 bp, Mus musculus
agagaggctattgccagcacagcac

SEQ ID NO: 151549 - DNA, 25 bp, Mus musculus
agagaggctcttactagggccctca

SEQ ID NO: 151550 - DNA, 25 bp, Mus musculus
agagaggctctttctagggccctca

SEQ ID NO: 151551 - DNA, 25 bp, Mus musculus
agagaggctggaaagtaccgggact

SEQ ID NO: 151552 - DNA, 25 bp, Mus musculus
agagaggctggatagtaccgggact

SEQ ID NO: 151553 - DNA, 25 bp, Mus musculus
agagaggctgtgactcggttcctca

SEQ ID NO: 151554 - DNA, 25 bp, Mus musculus
agagaggctgtgtctcggttcctca

SEQ ID NO: 151555 - DNA, 25 bp, Mus musculus
agagaggcttttaacattcagaaga

SEQ ID NO: 151556 - DNA, 25 bp, Mus musculus
agagaggctttttacattcagaaga

SEQ ID NO: 151557 - DNA, 25 bp, Mus musculus
agagagggaagtcctcacctcccaa

SEQ ID NO: 151558 - DNA, 25 bp, Mus musculus
agagagggaagtgctcacctcccaa

SEQ ID NO: 151559 - DNA, 25 bp, Mus musculus
agagagggaggactcttgccccact

SEQ ID NO: 151560 - DNA, 25 bp, Mus musculus
agagagggaggagtcttgccccact

SEQ ID NO: 151561 - DNA, 25 bp, Mus musculus
agagagggcaacacttgccccaaga

SEQ ID NO: 151562 - DNA, 25 bp, Mus musculus
agagagggcaactcttgccccaaga

SEQ ID NO: 151563 - DNA, 25 bp, Mus musculus
agagagggcactcttctgagtcttc

SEQ ID NO: 151564 - DNA, 25 bp, Mus musculus
agagagggcactgttctgagtcttc

SEQ ID NO: 151565 - DNA, 25 bp, Mus musculus
agagagggcccaagcagccacatct

SEQ ID NO: 151566 - DNA, 25 bp, Mus musculus
agagagggcccatgcagccacatct

SEQ ID NO: 151567 - DNA, 25 bp, Mus musculus
agagagggcctcagtatggaatctt

SEQ ID NO: 151568 - DNA, 25 bp, Mus musculus
agagagggcctctgtatggaatctt

SEQ ID NO: 151569 - DNA, 25 bp, Mus musculus
agagagggccttaagtttgttcaat

SEQ ID NO: 151570 - DNA, 25 bp, Mus musculus
agagagggcctttagtttgttcaat

SEQ ID NO: 151571 - DNA, 25 bp, Mus musculus
agagagggcttcattggtgacctgc

SEQ ID NO: 151572 - DNA, 25 bp, Mus musculus
agagagggcttctttggtgacctgc

SEQ ID NO: 151573 - DNA, 25 bp, Mus musculus
agagagggtataaacgggcgccacc

SEQ ID NO: 151574 - DNA, 25 bp, Mus musculus
agagagggtatatacgggcgccacc

SEQ ID NO: 151575 - DNA, 25 bp, Mus musculus
agagagggtcgccaaatccacacgc

SEQ ID NO: 151576 - DNA, 25 bp, Mus musculus
agagagggtcgcgaaatccacacgc

SEQ ID NO: 151577 - DNA, 25 bp, Mus musculus
agagagggtctactaacttgccaga

SEQ ID NO: 151578 - DNA, 25 bp, Mus musculus
agagagggtctagtaacttgccaga

SEQ ID NO: 151579 - DNA, 25 bp, Mus musculus
agagagggtgctcacgtgcttttca

SEQ ID NO: 151580 - DNA, 25 bp, Mus musculus
agagagggtgctgacgtgcttttca

SEQ ID NO: 151581 - DNA, 25 bp, Mus musculus
agagagggttctctatgcctgcttc

SEQ ID NO: 151582 - DNA, 25 bp, Mus musculus
agagagggttctgtatgcctgcttc

SEQ ID NO: 151583 - DNA, 25 bp, Mus musculus
agagagggttttccttggctgatcc

SEQ ID NO: 151584 - DNA, 25 bp, Mus musculus
agagagggttttgcttggctgatcc

SEQ ID NO: 151585 - DNA, 25 bp, Mus musculus
agagaggtagagaccctccctggag

SEQ ID NO: 151586 - DNA, 25 bp, Mus musculus
agagaggtagagtccctccctggag

SEQ ID NO: 151587 - DNA, 25 bp, Mus musculus
agagaggtagccaggctgaacacag

SEQ ID NO: 151588 - DNA, 25 bp, Mus musculus
agagaggtagcctggctgaacacag

SEQ ID NO: 151589 - DNA, 25 bp, Mus musculus
agagaggtatcgctctccagggaat

SEQ ID NO: 151590 - DNA, 25 bp, Mus musculus
agagaggtatcggtctccagggaat

SEQ ID NO: 151591 - DNA, 25 bp, Mus musculus
agagaggtcatcaggcataatgcca

SEQ ID NO: 151592 - DNA, 25 bp, Mus musculus
agagaggtcatctggcataatgcca

SEQ ID NO: 151593 - DNA, 25 bp, Mus musculus
agagaggtccatccaacaatccccg

SEQ ID NO: 151594 - DNA, 25 bp, Mus musculus
agagaggtccatgcaacaatccccg

SEQ ID NO: 151595 - DNA, 25 bp, Mus musculus
agagaggtcctcatagaaactgcta

SEQ ID NO: 151596 - DNA, 25 bp, Mus musculus
agagaggtcctcttagaaactgcta

SEQ ID NO: 151597 - DNA, 25 bp, Mus musculus
agagaggtccttacatgatttaggc

SEQ ID NO: 151598 - DNA, 25 bp, Mus musculus
agagaggtcctttcatgatttaggc

SEQ ID NO: 151599 - DNA, 25 bp, Mus musculus
agagaggtctccctaggcactgctg

SEQ ID NO: 151600 - DNA, 25 bp, Mus musculus
agagaggtctccgtaggcactgctg

SEQ ID NO: 151601 - DNA, 25 bp, Mus musculus
agagaggtctgcatcttgctgtcac

SEQ ID NO: 151602 - DNA, 25 bp, Mus musculus
agagaggtctgcttcttgctgtcac

SEQ ID NO: 151603 - DNA, 25 bp, Mus musculus
agagaggtgaacagcagccacttgc

SEQ ID NO: 151604 - DNA, 25 bp, Mus musculus
agagaggtgaactgcagccacttgc

SEQ ID NO: 151605 - DNA, 25 bp, Mus musculus
agagaggtgcacaaatactataagt

SEQ ID NO: 151606 - DNA, 25 bp, Mus musculus
agagaggtgcactaatactataagt

SEQ ID NO: 151607 - DNA, 25 bp, Mus musculus
agagaggtgcttactagacaagatg

SEQ ID NO: 151608 - DNA, 25 bp, Mus musculus
agagaggtgctttctagacaagatg

SEQ ID NO: 151609 - DNA, 25 bp, Mus musculus
agagaggttcagactctaggcgtga

SEQ ID NO: 151610 - DNA, 25 bp, Mus musculus
agagaggttcagtctctaggcgtga

SEQ ID NO: 151611 - DNA, 25 bp, Mus musculus
agagaggttcggcatcctatccaag

SEQ ID NO: 151612 - DNA, 25 bp, Mus musculus
agagaggttcgggatcctatccaag

SEQ ID NO: 151613 - DNA, 25 bp, Mus musculus
agagaggttgtcagtctaactccca

SEQ ID NO: 151614 - DNA, 25 bp, Mus musculus
agagaggttgtctgtctaactccca

SEQ ID NO: 151615 - DNA, 25 bp, Mus musculus
agagaggttgttactgccggactgt

SEQ ID NO: 151616 - DNA, 25 bp, Mus musculus
agagaggttgtttctgccggactgt

SEQ ID NO: 151617 - DNA, 25 bp, Mus musculus
agagagtacgtcagagtctgcctac

SEQ ID NO: 151618 - DNA, 25 bp, Mus musculus
agagagtacgtctgagtctgcctac

SEQ ID NO: 151619 - DNA, 25 bp, Mus musculus
agagagtactccctcttttctaact

SEQ ID NO: 151620 - DNA, 25 bp, Mus musculus
agagagtactccgtcttttctaact

SEQ ID NO: 151621 - DNA, 25 bp, Mus musculus
agagagtagctcattcttcaaattt

SEQ ID NO: 151622 - DNA, 25 bp, Mus musculus
agagagtagctctttcttcaaattt

SEQ ID NO: 151623 - DNA, 25 bp, Mus musculus
agagagtagcttcccctacaatgtc

SEQ ID NO: 151624 - DNA, 25 bp, Mus musculus
agagagtagcttgccctacaatgtc

SEQ ID NO: 151625 - DNA, 25 bp, Mus musculus
agagagtatctcagtcgtcattgga

SEQ ID NO: 151626 - DNA, 25 bp, Mus musculus
agagagtatctctgtcgtcattgga

SEQ ID NO: 151627 - DNA, 25 bp, Mus musculus
agagagtatgaccatagcccatttt

SEQ ID NO: 151628 - DNA, 25 bp, Mus musculus
agagagtatgacgatagcccatttt

SEQ ID NO: 151629 - DNA, 25 bp, Mus musculus
agagagtcaaccagaactccctgct

SEQ ID NO: 151630 - DNA, 25 bp, Mus musculus
agagagtcaacctgaactccctgct

SEQ ID NO: 151631 - DNA, 25 bp, Mus musculus
agagagtcacctcgaacgtctcaca

SEQ ID NO: 151632 - DNA, 25 bp, Mus musculus
agagagtcacctggaacgtctcaca

SEQ ID NO: 151633 - DNA, 25 bp, Mus musculus
agagagtcactactgtgcccctggc

SEQ ID NO: 151634 - DNA, 25 bp, Mus musculus
agagagtcactagtgtgcccctggc

SEQ ID NO: 151635 - DNA, 25 bp, Mus musculus
agagagtcactcaggtgcttgtgtc

SEQ ID NO: 151636 - DNA, 25 bp, Mus musculus
agagagtcactctggtgcttgtgtc

SEQ ID NO: 151637 - DNA, 25 bp, Mus musculus
agagagtcacttccccagccttcat

SEQ ID NO: 151638 - DNA, 25 bp, Mus musculus
agagagtcacttgcccagccttcat

SEQ ID NO: 151639 - DNA, 25 bp, Mus musculus
agagagtcaggacttcttctttttt

SEQ ID NO: 151640 - DNA, 25 bp, Mus musculus
agagagtcaggagttcttctttttt

SEQ ID NO: 151641 - DNA, 25 bp, Mus musculus
agagagtccgacagagccctagctc

SEQ ID NO: 151642 - DNA, 25 bp, Mus musculus
agagagtccgactgagccctagctc

SEQ ID NO: 151643 - DNA, 25 bp, Mus musculus
agagagtccgtcaggtaagccctac

SEQ ID NO: 151644 - DNA, 25 bp, Mus musculus
agagagtccgtctggtaagccctac

SEQ ID NO: 151645 - DNA, 25 bp, Mus musculus
agagagtcctcacatgttccttcat

SEQ ID NO: 151646 - DNA, 25 bp, Mus musculus
agagagtcctcagatgttccttcat

SEQ ID NO: 151647 - DNA, 25 bp, Mus musculus
agagagtcgcctcctcagtaacatt

SEQ ID NO: 151648 - DNA, 25 bp, Mus musculus
agagagtcgcctgctcagtaacatt

SEQ ID NO: 151649 - DNA, 25 bp, Mus musculus
agagagtctgctattacttcatgtt

SEQ ID NO: 151650 - DNA, 25 bp, Mus musculus
agagagtctgcttttacttcatgtt

SEQ ID NO: 151651 - DNA, 25 bp, Mus musculus
agagagtcttatacccacagacctg

SEQ ID NO: 151652 - DNA, 25 bp, Mus musculus
agagagtcttattcccacagacctg

SEQ ID NO: 151653 - DNA, 25 bp, Mus musculus
agagagtcttgcaaactccccgtta

SEQ ID NO: 151654 - DNA, 25 bp, Mus musculus
agagagtcttgctaactccccgtta

SEQ ID NO: 151655 - DNA, 25 bp, Mus musculus
agagagtcttttcatggccggaaca

SEQ ID NO: 151656 - DNA, 25 bp, Mus musculus
agagagtcttttgatggccggaaca

SEQ ID NO: 151657 - DNA, 25 bp, Mus musculus
agagagtgatgcaccacaacagccc

SEQ ID NO: 151658 - DNA, 25 bp, Mus musculus
agagagtgatgctccacaacagccc

SEQ ID NO: 151659 - DNA, 25 bp, Mus musculus
agagagtgcaaaagccagccagtgc

SEQ ID NO: 151660 - DNA, 25 bp, Mus musculus
agagagtgcaaatgccagccagtgc

SEQ ID NO: 151661 - DNA, 25 bp, Mus musculus
agagagtgcagtccagagctcaagt

SEQ ID NO: 151662 - DNA, 25 bp, Mus musculus
agagagtgcagtgcagagctcaagt

SEQ ID NO: 151663 - DNA, 25 bp, Mus musculus
agagagtgcattacaccccgactga

SEQ ID NO: 151664 - DNA, 25 bp, Mus musculus
agagagtgcatttcaccccgactga

SEQ ID NO: 151665 - DNA, 25 bp, Mus musculus
agagagtgccagacacaccatcggt

SEQ ID NO: 151666 - DNA, 25 bp, Mus musculus
agagagtgccagtcacaccatcggt

SEQ ID NO: 151667 - DNA, 25 bp, Mus musculus
agagagtggtttacctgaagcagct

SEQ ID NO: 151668 - DNA, 25 bp, Mus musculus
agagagtggttttcctgaagcagct

SEQ ID NO: 151669 - DNA, 25 bp, Mus musculus
agagagtgtggcatcatccgcctca

SEQ ID NO: 151670 - DNA, 25 bp, Mus musculus
agagagtgtggcttcatccgcctca

SEQ ID NO: 151671 - DNA, 25 bp, Mus musculus
agagagttcaacctgcttgacccca

SEQ ID NO: 151672 - DNA, 25 bp, Mus musculus
agagagttcaacgtgcttgacccca

SEQ ID NO: 151673 - DNA, 25 bp, Mus musculus
agagagttcaagcttggacccattc

SEQ ID NO: 151674 - DNA, 25 bp, Mus musculus
agagagttcaaggttggacccattc

SEQ ID NO: 151675 - DNA, 25 bp, Mus musculus
agagagttcattctttccctccaga

SEQ ID NO: 151676 - DNA, 25 bp, Mus musculus
agagagttcattgtttccctccaga

SEQ ID NO: 151677 - DNA, 25 bp, Mus musculus
agagagttcccaaatccaaggcctc

SEQ ID NO: 151678 - DNA, 25 bp, Mus musculus
agagagttcccatatccaaggcctc

SEQ ID NO: 151679 - DNA, 25 bp, Mus musculus
agagagttccggattgttcagtcca

SEQ ID NO: 151680 - DNA, 25 bp, Mus musculus
agagagttccggtttgttcagtcca

SEQ ID NO: 151681 - DNA, 25 bp, Mus musculus
agagagttccgtaatagggtattca

SEQ ID NO: 151682 - DNA, 25 bp, Mus musculus
agagagttccgttatagggtattca

SEQ ID NO: 151683 - DNA, 25 bp, Mus musculus
agagagttctcaatggcgtcctcaa

SEQ ID NO: 151684 - DNA, 25 bp, Mus musculus
agagagttctcacactttggccaaa

SEQ ID NO: 151685 - DNA, 25 bp, Mus musculus
agagagttctcagactttggccaaa

SEQ ID NO: 151686 - DNA, 25 bp, Mus musculus
agagagttctcattggcgtcctcaa

SEQ ID NO: 151687 - DNA, 25 bp, Mus musculus
agagagttctctactaactgctgag

SEQ ID NO: 151688 - DNA, 25 bp, Mus musculus
agagagttctcttctaactgctgag

SEQ ID NO: 151689 - DNA, 25 bp, Mus musculus
agagagtttataccatgggacccat

SEQ ID NO: 151690 - DNA, 25 bp, Mus musculus
agagagtttatagcatgggacccat

SEQ ID NO: 151691 - DNA, 25 bp, Mus musculus
agagagtttattactccttctctgt

SEQ ID NO: 151692 - DNA, 25 bp, Mus musculus
agagagtttatttctccttctctgt

SEQ ID NO: 151693 - DNA, 25 bp, Mus musculus
agagagtttctaaaggcttgcctag

SEQ ID NO: 151694 - DNA, 25 bp, Mus musculus
agagagtttctacgagctcccaagc

SEQ ID NO: 151695 - DNA, 25 bp, Mus musculus
agagagtttctaggagctcccaagc

SEQ ID NO: 151696 - DNA, 25 bp, Mus musculus
agagagtttctataggcttgcctag

SEQ ID NO: 151697 - DNA, 25 bp, Mus musculus
agagataactagctcctgtttcgag

SEQ ID NO: 151698 - DNA, 25 bp, Mus musculus
agagataactaggtcctgtttcgag

SEQ ID NO: 151699 - DNA, 25 bp, Mus musculus
agagataagtctctcctggaacctg

SEQ ID NO: 151700 - DNA, 25 bp, Mus musculus
agagataagtctgtcctggaacctg

SEQ ID NO: 151701 - DNA, 25 bp, Mus musculus
agagataagtgtctggcattctgag

SEQ ID NO: 151702 - DNA, 25 bp, Mus musculus
agagataagtgtgtggcattctgag

SEQ ID NO: 151703 - DNA, 25 bp, Mus musculus
agagataatgtgctcagcacccctt

SEQ ID NO: 151704 - DNA, 25 bp, Mus musculus
agagataatgtggtcagcacccctt

SEQ ID NO: 151705 - DNA, 25 bp, Mus musculus
agagatacacagcaagtcttccacg

SEQ ID NO: 151706 - DNA, 25 bp, Mus musculus
agagatacacaggaagtcttccacg

SEQ ID NO: 151707 - DNA, 25 bp, Mus musculus
agagatacaccacagggcttgcagt

SEQ ID NO: 151708 - DNA, 25 bp, Mus musculus
agagatacaccagagggcttgcagt

SEQ ID NO: 151709 - DNA, 25 bp, Mus musculus
agagatacacgtacacttaccaagt

SEQ ID NO: 151710 - DNA, 25 bp, Mus musculus
agagatacacgttcacttaccaagt

SEQ ID NO: 151711 - DNA, 25 bp, Mus musculus
agagatacatttaccatttccccag

SEQ ID NO: 151712 - DNA, 25 bp, Mus musculus
agagatacattttccatttccccag

SEQ ID NO: 151713 - DNA, 25 bp, Mus musculus
agagataccgccacgttctgaccac

SEQ ID NO: 151714 - DNA, 25 bp, Mus musculus
agagataccgcctcgttctgaccac

SEQ ID NO: 151715 - DNA, 25 bp, Mus musculus
agagatacctgcacatccacattta

SEQ ID NO: 151716 - DNA, 25 bp, Mus musculus
agagatacctgctcatccacattta

SEQ ID NO: 151717 - DNA, 25 bp, Mus musculus
agagatagaaccattcctgaaggca

SEQ ID NO: 151718 - DNA, 25 bp, Mus musculus
agagatagaacctttcctgaaggca

SEQ ID NO: 151719 - DNA, 25 bp, Mus musculus
agagatagacctatcccagggtgca

SEQ ID NO: 151720 - DNA, 25 bp, Mus musculus
agagatagacctttcccagggtgca

SEQ ID NO: 151721 - DNA, 25 bp, Mus musculus
agagatagcagacttccccgaggcc

SEQ ID NO: 151722 - DNA, 25 bp, Mus musculus
agagatagcagagttccccgaggcc

SEQ ID NO: 151723 - DNA, 25 bp, Mus musculus
agagatagcatcctctcccagagtg

SEQ ID NO: 151724 - DNA, 25 bp, Mus musculus
agagatagcatcgtctcccagagtg

SEQ ID NO: 151725 - DNA, 25 bp, Mus musculus
agagatagcccaccatcttacacag

SEQ ID NO: 151726 - DNA, 25 bp, Mus musculus
agagatagcccagcatcttacacag

SEQ ID NO: 151727 - DNA, 25 bp, Mus musculus
agagatagcgacattcctctaccca

SEQ ID NO: 151728 - DNA, 25 bp, Mus musculus
agagatagcgactttcctctaccca

SEQ ID NO: 151729 - DNA, 25 bp, Mus musculus
agagatagctgaaccacatgtacca

SEQ ID NO: 151730 - DNA, 25 bp, Mus musculus
agagatagctgatccacatgtacca

SEQ ID NO: 151731 - DNA, 25 bp, Mus musculus
agagatagctgcaaaaacccttggg

SEQ ID NO: 151732 - DNA, 25 bp, Mus musculus
agagatagctgctaaaacccttggg

SEQ ID NO: 151733 - DNA, 25 bp, Mus musculus
agagataggaagcaccacctttctg

SEQ ID NO: 151734 - DNA, 25 bp, Mus musculus
agagataggaaggaccacctttctg

SEQ ID NO: 151735 - DNA, 25 bp, Mus musculus
agagatagtcaactccgtggttccc

SEQ ID NO: 151736 - DNA, 25 bp, Mus musculus
agagatagtcaagtccgtggttccc

SEQ ID NO: 151737 - DNA, 25 bp, Mus musculus
agagatagtgcaccttgcttcttgc

SEQ ID NO: 151738 - DNA, 25 bp, Mus musculus
agagatagtgcagcttgcttcttgc

SEQ ID NO: 151739 - DNA, 25 bp, Mus musculus
agagatatatgcctgggcccctaaa

SEQ ID NO: 151740 - DNA, 25 bp, Mus musculus
agagatatatgcgtgggcccctaaa

SEQ ID NO: 151741 - DNA, 25 bp, Mus musculus
agagatatctctacttctcaagcct

SEQ ID NO: 151742 - DNA, 25 bp, Mus musculus
agagatatctcttcttctcaagcct

SEQ ID NO: 151743 - DNA, 25 bp, Mus musculus
agagatatcttcagagctttcctaa

SEQ ID NO: 151744 - DNA, 25 bp, Mus musculus
agagatatcttctgagctttcctaa

SEQ ID NO: 151745 - DNA, 25 bp, Mus musculus
agagatatgctcacgacgtctggca

SEQ ID NO: 151746 - DNA, 25 bp, Mus musculus
agagatatgctctcgacgtctggca

SEQ ID NO: 151747 - DNA, 25 bp, Mus musculus
agagatatgtttccctcagcctctc

SEQ ID NO: 151748 - DNA, 25 bp, Mus musculus
agagatatgtttgcctcagcctctc

SEQ ID NO: 151749 - DNA, 25 bp, Mus musculus
agagatattagcattggctgttcac

SEQ ID NO: 151750 - DNA, 25 bp, Mus musculus
agagatattagctttggctgttcac

SEQ ID NO: 151751 - DNA, 25 bp, Mus musculus
agagatattcatagcatcatgccac

SEQ ID NO: 151752 - DNA, 25 bp, Mus musculus
agagatattcattgcatcatgccac

SEQ ID NO: 151753 - DNA, 25 bp, Mus musculus
agagatcaaaggacttcttacaaat

SEQ ID NO: 151754 - DNA, 25 bp, Mus musculus
agagatcaaaggtcttcttacaaat

SEQ ID NO: 151755 - DNA, 25 bp, Mus musculus
agagatcaactcacttcacaaagtc

SEQ ID NO: 151756 - DNA, 25 bp, Mus musculus
agagatcaactctcttcacaaagtc

SEQ ID NO: 151757 - DNA, 25 bp, Mus musculus
agagatcaagcaagctactgggata

SEQ ID NO: 151758 - DNA, 25 bp, Mus musculus
agagatcaagcatgctactgggata

SEQ ID NO: 151759 - DNA, 25 bp, Mus musculus
agagatcaataccagcttccgagag

SEQ ID NO: 151760 - DNA, 25 bp, Mus musculus
agagatcaatacgagcttccgagag

SEQ ID NO: 151761 - DNA, 25 bp, Mus musculus
agagatcaccagctctaccgatgat

SEQ ID NO: 151762 - DNA, 25 bp, Mus musculus
agagatcaccaggtctaccgatgat

SEQ ID NO: 151763 - DNA, 25 bp, Mus musculus
agagatcacctcatgcttgagaacg

SEQ ID NO: 151764 - DNA, 25 bp, Mus musculus
agagatcacctcttgcttgagaacg

SEQ ID NO: 151765 - DNA, 25 bp, Mus musculus
agagatcacttgacagcttcaaaag

SEQ ID NO: 151766 - DNA, 25 bp, Mus musculus
agagatcacttgtcagcttcaaaag

SEQ ID NO: 151767 - DNA, 25 bp, Mus musculus
agagatcaggaccattccttcctat

SEQ ID NO: 151768 - DNA, 25 bp, Mus musculus
agagatcaggacgattccttcctat

SEQ ID NO: 151769 - DNA, 25 bp, Mus musculus
agagatcagtcgctactccctggca

SEQ ID NO: 151770 - DNA, 25 bp, Mus musculus
agagatcagtcggtactccctggca

SEQ ID NO: 151771 - DNA, 25 bp, Mus musculus
agagatcatctgactaaacccctag

SEQ ID NO: 151772 - DNA, 25 bp, Mus musculus
agagatcatctgtctaaacccctag

SEQ ID NO: 151773 - DNA, 25 bp, Mus musculus
agagatcatgagacccattcccagc

SEQ ID NO: 151774 - DNA, 25 bp, Mus musculus
agagatcatgagtcccattcccagc

SEQ ID NO: 151775 - DNA, 25 bp, Mus musculus
agagatccaaatatagtccctagca

SEQ ID NO: 151776 - DNA, 25 bp, Mus musculus
agagatccaaatttagtccctagca

SEQ ID NO: 151777 - DNA, 25 bp, Mus musculus
agagatccaagccaacaagcctgaa

SEQ ID NO: 151778 - DNA, 25 bp, Mus musculus
agagatccaagccttgaccttgctg

SEQ ID NO: 151779 - DNA, 25 bp, Mus musculus
agagatccaagcgaacaagcctgaa

SEQ ID NO: 151780 - DNA, 25 bp, Mus musculus
agagatccaagcgttgaccttgctg

SEQ ID NO: 151781 - DNA, 25 bp, Mus musculus
agagatccaatgacatacagttatt

SEQ ID NO: 151782 - DNA, 25 bp, Mus musculus
agagatccaatgtcatacagttatt

SEQ ID NO: 151783 - DNA, 25 bp, Mus musculus
agagatccactgaccttgcctagcc

SEQ ID NO: 151784 - DNA, 25 bp, Mus musculus
agagatccactgtccttgcctagcc

SEQ ID NO: 151785 - DNA, 25 bp, Mus musculus
agagatccacttcccaggataaaaa

SEQ ID NO: 151786 - DNA, 25 bp, Mus musculus
agagatccacttgccaggataaaaa

SEQ ID NO: 151787 - DNA, 25 bp, Mus musculus
agagatccaggaccaccgggtccta

SEQ ID NO: 151788 - DNA, 25 bp, Mus musculus
agagatccaggacgaccgctgaagc

SEQ ID NO: 151789 - DNA, 25 bp, Mus musculus
agagatccaggagcaccgggtccta

SEQ ID NO: 151790 - DNA, 25 bp, Mus musculus
agagatccaggaggaccgctgaagc

SEQ ID NO: 151791 - DNA, 25 bp, Mus musculus
agagatccagttctgattccttcat

SEQ ID NO: 151792 - DNA, 25 bp, Mus musculus
agagatccagttgtgattccttcat

SEQ ID NO: 151793 - DNA, 25 bp, Mus musculus
agagatccatccattagctactgag

SEQ ID NO: 151794 - DNA, 25 bp, Mus musculus
agagatccatcctttagctactgag

SEQ ID NO: 151795 - DNA, 25 bp, Mus musculus
agagatcccactacacctgttattt

SEQ ID NO: 151796 - DNA, 25 bp, Mus musculus
agagatcccacttcacctgttattt

SEQ ID NO: 151797 - DNA, 25 bp, Mus musculus
agagatcccagcaaagacagttcct

SEQ ID NO: 151798 - DNA, 25 bp, Mus musculus
agagatcccagctaagacagttcct

SEQ ID NO: 151799 - DNA, 25 bp, Mus musculus
agagatcccatacatattttgtgtc

SEQ ID NO: 151800 - DNA, 25 bp, Mus musculus
agagatcccatagatattttgtgtc

SEQ ID NO: 151801 - DNA, 25 bp, Mus musculus
agagatcccatgaagtccgcattgc

SEQ ID NO: 151802 - DNA, 25 bp, Mus musculus
agagatcccatgtagtccgcattgc

SEQ ID NO: 151803 - DNA, 25 bp, Mus musculus
agagatccctgactctaaattcttt

SEQ ID NO: 151804 - DNA, 25 bp, Mus musculus
agagatccctgagtctaaattcttt

SEQ ID NO: 151805 - DNA, 25 bp, Mus musculus
agagatccgagtcgccgacatcaag

SEQ ID NO: 151806 - DNA, 25 bp, Mus musculus
agagatccgagtggccgacatcaag

SEQ ID NO: 151807 - DNA, 25 bp, Mus musculus
agagatcctagtcacagaagcctgc

SEQ ID NO: 151808 - DNA, 25 bp, Mus musculus
agagatcctagtgacagaagcctgc

SEQ ID NO: 151809 - DNA, 25 bp, Mus musculus
agagatcctcaactcggtggtggct

SEQ ID NO: 151810 - DNA, 25 bp, Mus musculus
agagatcctcaagtcggtggtggct

SEQ ID NO: 151811 - DNA, 25 bp, Mus musculus
agagatcctctgagaaggacagcat

SEQ ID NO: 151812 - DNA, 25 bp, Mus musculus
agagatcctctgtgaaggacagcat

SEQ ID NO: 151813 - DNA, 25 bp, Mus musculus
agagatcctgacagagaaacggtga

SEQ ID NO: 151814 - DNA, 25 bp, Mus musculus
agagatcctgactgagaaacggtga

SEQ ID NO: 151815 - DNA, 25 bp, Mus musculus
agagatcctgtaactttgggagaga

SEQ ID NO: 151816 - DNA, 25 bp, Mus musculus
agagatcctgtatctttgggagaga

SEQ ID NO: 151817 - DNA, 25 bp, Mus musculus
agagatccttataaaacacagcccc

SEQ ID NO: 151818 - DNA, 25 bp, Mus musculus
agagatccttattaaacacagcccc

SEQ ID NO: 151819 - DNA, 25 bp, Mus musculus
agagatcgagagagctttccgggcc

SEQ ID NO: 151820 - DNA, 25 bp, Mus musculus
agagatcgagagtgctttccgggcc

SEQ ID NO: 151821 - DNA, 25 bp, Mus musculus
agagatcgtgtgaccgctgacattc

SEQ ID NO: 151822 - DNA, 25 bp, Mus musculus
agagatcgtgtgtccgctgacattc

SEQ ID NO: 151823 - DNA, 25 bp, Mus musculus
agagatctacagagagaactccgtg

SEQ ID NO: 151824 - DNA, 25 bp, Mus musculus
agagatctacagtgagaactccgtg

SEQ ID NO: 151825 - DNA, 25 bp, Mus musculus
agagatctagagctcgtttaacagt

SEQ ID NO: 151826 - DNA, 25 bp, Mus musculus
agagatctagaggtcgtttaacagt

SEQ ID NO: 151827 - DNA, 25 bp, Mus musculus
agagatctatctccaatgcctacca

SEQ ID NO: 151828 - DNA, 25 bp, Mus musculus
agagatctatctgcaatgcctacca

SEQ ID NO: 151829 - DNA, 25 bp, Mus musculus
agagatctcagtcttaaggccctga

SEQ ID NO: 151830 - DNA, 25 bp, Mus musculus
agagatctcagtgttaaggccctga

SEQ ID NO: 151831 - DNA, 25 bp, Mus musculus
agagatctcatactggacccaggct

SEQ ID NO: 151832 - DNA, 25 bp, Mus musculus
agagatctcatagtggacccaggct

SEQ ID NO: 151833 - DNA, 25 bp, Mus musculus
agagatctcatgctttttgcctgat

SEQ ID NO: 151834 - DNA, 25 bp, Mus musculus
agagatctcatggtttttgcctgat

SEQ ID NO: 151835 - DNA, 25 bp, Mus musculus
agagatctccaacgtttgtaggtaa

SEQ ID NO: 151836 - DNA, 25 bp, Mus musculus
agagatctccaaggtttgtaggtaa

SEQ ID NO: 151837 - DNA, 25 bp, Mus musculus
agagatctccgaagacaatgcccgc

SEQ ID NO: 151838 - DNA, 25 bp, Mus musculus
agagatctccgatgacaatgcccgc

SEQ ID NO: 151839 - DNA, 25 bp, Mus musculus
agagatctcttaaatgctggcccta

SEQ ID NO: 151840 - DNA, 25 bp, Mus musculus
agagatctcttatatgctggcccta

SEQ ID NO: 151841 - DNA, 25 bp, Mus musculus
agagatctcttcaagcacttcgcag

SEQ ID NO: 151842 - DNA, 25 bp, Mus musculus
agagatctcttctagcacttcgcag

SEQ ID NO: 151843 - DNA, 25 bp, Mus musculus
agagatctgaatactggtcctcaca

SEQ ID NO: 151844 - DNA, 25 bp, Mus musculus
agagatctgaatcctttcctttgca

SEQ ID NO: 151845 - DNA, 25 bp, Mus musculus
agagatctgaatctacacagtgcaa

SEQ ID NO: 151846 - DNA, 25 bp, Mus musculus
agagatctgaatgctttcctttgca

SEQ ID NO: 151847 - DNA, 25 bp, Mus musculus
agagatctgaatgtacacagtgcaa

SEQ ID NO: 151848 - DNA, 25 bp, Mus musculus
agagatctgaattctggtcctcaca

SEQ ID NO: 151849 - DNA, 25 bp, Mus musculus
agagatctgcaaatccaccacttta

SEQ ID NO: 151850 - DNA, 25 bp, Mus musculus
agagatctgcaattccaccacttta

SEQ ID NO: 151851 - DNA, 25 bp, Mus musculus
agagatctgccgacctctgcctagg

SEQ ID NO: 151852 - DNA, 25 bp, Mus musculus
agagatctgccgtcctctgcctagg

SEQ ID NO: 151853 - DNA, 25 bp, Mus musculus
agagatctggataccaggcctggtc

SEQ ID NO: 151854 - DNA, 25 bp, Mus musculus
agagatctggattccaggcctggtc

SEQ ID NO: 151855 - DNA, 25 bp, Mus musculus
agagatctgtcaagctccccataag

SEQ ID NO: 151856 - DNA, 25 bp, Mus musculus
agagatctgtcatgctccccataag

SEQ ID NO: 151857 - DNA, 25 bp, Mus musculus
agagatcttacgctggtctgcttac

SEQ ID NO: 151858 - DNA, 25 bp, Mus musculus
agagatcttacggtggtctgcttac

SEQ ID NO: 151859 - DNA, 25 bp, Mus musculus
agagatcttagcagtgctcaagtca

SEQ ID NO: 151860 - DNA, 25 bp, Mus musculus
agagatcttagctgtgctcaagtca

SEQ ID NO: 151861 - DNA, 25 bp, Mus musculus
agagatcttcccaagagctaaacag

SEQ ID NO: 151862 - DNA, 25 bp, Mus musculus
agagatcttccctagagctaaacag

SEQ ID NO: 151863 - DNA, 25 bp, Mus musculus
agagatctttgacaatccccggcag

SEQ ID NO: 151864 - DNA, 25 bp, Mus musculus
agagatctttgagaatccccggcag

SEQ ID NO: 151865 - DNA, 25 bp, Mus musculus
agagatgaacctattggtggccctc

SEQ ID NO: 151866 - DNA, 25 bp, Mus musculus
agagatgaaccttttggtggccctc

SEQ ID NO: 151867 - DNA, 25 bp, Mus musculus
agagatgaagacacactgcccttcc

SEQ ID NO: 151868 - DNA, 25 bp, Mus musculus
agagatgaagactcactgcccttcc

SEQ ID NO: 151869 - DNA, 25 bp, Mus musculus
agagatgaagcaagctcggcccaca

SEQ ID NO: 151870 - DNA, 25 bp, Mus musculus
agagatgaagcatgctcggcccaca

SEQ ID NO: 151871 - DNA, 25 bp, Mus musculus
agagatgacacaaccactgcatggc

SEQ ID NO: 151872 - DNA, 25 bp, Mus musculus
agagatgacacactgaatgcctgtc

SEQ ID NO: 151873 - DNA, 25 bp, Mus musculus
agagatgacacagtgaatgcctgtc

SEQ ID NO: 151874 - DNA, 25 bp, Mus musculus
agagatgacacatccactgcatggc

SEQ ID NO: 151875 - DNA, 25 bp, Mus musculus
agagatgacagcaccacactaacca

SEQ ID NO: 151876 - DNA, 25 bp, Mus musculus
agagatgacagctccacactaacca

SEQ ID NO: 151877 - DNA, 25 bp, Mus musculus
agagatgacagtcccctaaagtagt

SEQ ID NO: 151878 - DNA, 25 bp, Mus musculus
agagatgacagtgccctaaagtagt

SEQ ID NO: 151879 - DNA, 25 bp, Mus musculus
agagatgacatcctctgtcctgact

SEQ ID NO: 151880 - DNA, 25 bp, Mus musculus
agagatgacatcgtctgtcctgact

SEQ ID NO: 151881 - DNA, 25 bp, Mus musculus
agagatgactcactcactccgtgtg

SEQ ID NO: 151882 - DNA, 25 bp, Mus musculus
agagatgactcagtcactccgtgtg

SEQ ID NO: 151883 - DNA, 25 bp, Mus musculus
agagatgagaccatgcagcctgcaa

SEQ ID NO: 151884 - DNA, 25 bp, Mus musculus
agagatgagaccttgcagcctgcaa

SEQ ID NO: 151885 - DNA, 25 bp, Mus musculus
agagatgagattatccaggctgctt

SEQ ID NO: 151886 - DNA, 25 bp, Mus musculus
agagatgagattttccaggctgctt

SEQ ID NO: 151887 - DNA, 25 bp, Mus musculus
agagatgagcagaacccaggaaatt

SEQ ID NO: 151888 - DNA, 25 bp, Mus musculus
agagatgagcagtacccaggaaatt

SEQ ID NO: 151889 - DNA, 25 bp, Mus musculus
agagatgagccactcctccctgagg

SEQ ID NO: 151890 - DNA, 25 bp, Mus musculus
agagatgagccagtcctccctgagg

SEQ ID NO: 151891 - DNA, 25 bp, Mus musculus
agagatgagtcccttttccactggc

SEQ ID NO: 151892 - DNA, 25 bp, Mus musculus
agagatgagtccgttttccactggc

SEQ ID NO: 151893 - DNA, 25 bp, Mus musculus
agagatgagtgcatgctcgcttgca

SEQ ID NO: 151894 - DNA, 25 bp, Mus musculus
agagatgagtgcttgctcgcttgca

SEQ ID NO: 151895 - DNA, 25 bp, Mus musculus
agagatgatcatctggagcgtccca

SEQ ID NO: 151896 - DNA, 25 bp, Mus musculus
agagatgatcatgtggagcgtccca

SEQ ID NO: 151897 - DNA, 25 bp, Mus musculus
agagatgatctgaaaggtagcttgg

SEQ ID NO: 151898 - DNA, 25 bp, Mus musculus
agagatgatctgtaaggtagcttgg

SEQ ID NO: 151899 - DNA, 25 bp, Mus musculus
agagatgatggcaacagggacgacc

SEQ ID NO: 151900 - DNA, 25 bp, Mus musculus
agagatgatggctacagggacgacc

SEQ ID NO: 151901 - DNA, 25 bp, Mus musculus
agagatgattccaggcggacttctg

SEQ ID NO: 151902 - DNA, 25 bp, Mus musculus
agagatgattcctggcggacttctg

SEQ ID NO: 151903 - DNA, 25 bp, Mus musculus
agagatgcaacgacttttccctctg

SEQ ID NO: 151904 - DNA, 25 bp, Mus musculus
agagatgcaacgtcttttccctctg

SEQ ID NO: 151905 - DNA, 25 bp, Mus musculus
agagatgcaatacgtccccgtggtc

SEQ ID NO: 151906 - DNA, 25 bp, Mus musculus
agagatgcaataggtccccgtggtc

SEQ ID NO: 151907 - DNA, 25 bp, Mus musculus
agagatgcaatcaactcgagacatt

SEQ ID NO: 151908 - DNA, 25 bp, Mus musculus
agagatgcaatctactcgagacatt

SEQ ID NO: 151909 - DNA, 25 bp, Mus musculus
agagatgcactcagagaacctctgg

SEQ ID NO: 151910 - DNA, 25 bp, Mus musculus
agagatgcactctgagaacctctgg

SEQ ID NO: 151911 - DNA, 25 bp, Mus musculus
agagatgcagagaaccctctcacag

SEQ ID NO: 151912 - DNA, 25 bp, Mus musculus
agagatgcagagatgaggtccttct

SEQ ID NO: 151913 - DNA, 25 bp, Mus musculus
agagatgcagagtaccctctcacag

SEQ ID NO: 151914 - DNA, 25 bp, Mus musculus
agagatgcagagttgaggtccttct

SEQ ID NO: 151915 - DNA, 25 bp, Mus musculus
agagatgcagtgattgctcaacgaa

SEQ ID NO: 151916 - DNA, 25 bp, Mus musculus
agagatgcagtgtttgctcaacgaa

SEQ ID NO: 151917 - DNA, 25 bp, Mus musculus
agagatgcatcccatgtgtgtactg

SEQ ID NO: 151918 - DNA, 25 bp, Mus musculus
agagatgcatccgatgtgtgtactg

SEQ ID NO: 151919 - DNA, 25 bp, Mus musculus
agagatgcatgaagacaaaccctgg

SEQ ID NO: 151920 - DNA, 25 bp, Mus musculus
agagatgcatgatgacaaaccctgg

SEQ ID NO: 151921 - DNA, 25 bp, Mus musculus
agagatgcatggaggtcttccgtcc

SEQ ID NO: 151922 - DNA, 25 bp, Mus musculus
agagatgcatggtggtcttccgtcc

SEQ ID NO: 151923 - DNA, 25 bp, Mus musculus
agagatgccaagctgcctcatgtgc

SEQ ID NO: 151924 - DNA, 25 bp, Mus musculus
agagatgccaaggtgcctcatgtgc

SEQ ID NO: 151925 - DNA, 25 bp, Mus musculus
agagatgccatgactccagcttgga

SEQ ID NO: 151926 - DNA, 25 bp, Mus musculus
agagatgccatgtctccagcttgga

SEQ ID NO: 151927 - DNA, 25 bp, Mus musculus
agagatgccccgattgcccagtgtg

SEQ ID NO: 151928 - DNA, 25 bp, Mus musculus
agagatgccccgtttgcccagtgtg

SEQ ID NO: 151929 - DNA, 25 bp, Mus musculus
agagatgcctagcttggctccatgt

SEQ ID NO: 151930 - DNA, 25 bp, Mus musculus
agagatgcctaggttggctccatgt

SEQ ID NO: 151931 - DNA, 25 bp, Mus musculus
agagatgcctatctgaagcctccag

SEQ ID NO: 151932 - DNA, 25 bp, Mus musculus
agagatgcctatgtgaagcctccag

SEQ ID NO: 151933 - DNA, 25 bp, Mus musculus
agagatgcctcaaatatgtggtgaa

SEQ ID NO: 151934 - DNA, 25 bp, Mus musculus
agagatgcctcatatatgtggtgaa

SEQ ID NO: 151935 - DNA, 25 bp, Mus musculus
agagatgcctttatctgtggtcagt

SEQ ID NO: 151936 - DNA, 25 bp, Mus musculus
agagatgcctttttctgtggtcagt

SEQ ID NO: 151937 - DNA, 25 bp, Mus musculus
agagatgcgagaagcttccgggaaa

SEQ ID NO: 151938 - DNA, 25 bp, Mus musculus
agagatgcgagatgcttccgggaaa

SEQ ID NO: 151939 - DNA, 25 bp, Mus musculus
agagatgcgcaaactcttcggcggt

SEQ ID NO: 151940 - DNA, 25 bp, Mus musculus
agagatgcgcaatctcttcggcggt

SEQ ID NO: 151941 - DNA, 25 bp, Mus musculus
agagatgcgtgtccctttgagaaac

SEQ ID NO: 151942 - DNA, 25 bp, Mus musculus
agagatgcgtgtgcctttgagaaac

SEQ ID NO: 151943 - DNA, 25 bp, Mus musculus
agagatgctagcatcttttttcctg

SEQ ID NO: 151944 - DNA, 25 bp, Mus musculus
agagatgctagcttcttttttcctg

SEQ ID NO: 151945 - DNA, 25 bp, Mus musculus
agagatgctcagctcgcaggcgctc

SEQ ID NO: 151946 - DNA, 25 bp, Mus musculus
agagatgctcaggtcgcaggcgctc

SEQ ID NO: 151947 - DNA, 25 bp, Mus musculus
agagatgctcataaaacccacctgc

SEQ ID NO: 151948 - DNA, 25 bp, Mus musculus
agagatgctcattaaacccacctgc

SEQ ID NO: 151949 - DNA, 25 bp, Mus musculus
agagatgctcgccacagaatccaca

SEQ ID NO: 151950 - DNA, 25 bp, Mus musculus
agagatgctcgcgacagaatccaca

SEQ ID NO: 151951 - DNA, 25 bp, Mus musculus
agagatgctcgtcctcaagcctgac

SEQ ID NO: 151952 - DNA, 25 bp, Mus musculus
agagatgctcgtgctcaagcctgac

SEQ ID NO: 151953 - DNA, 25 bp, Mus musculus
agagatgctctccagtcacaagatg

SEQ ID NO: 151954 - DNA, 25 bp, Mus musculus
agagatgctctcgagtcacaagatg

SEQ ID NO: 151955 - DNA, 25 bp, Mus musculus
agagatgctgaaaagatgttacctt

SEQ ID NO: 151956 - DNA, 25 bp, Mus musculus
agagatgctgaatagatgttacctt

SEQ ID NO: 151957 - DNA, 25 bp, Mus musculus
agagatgctggacacagacccgaag

SEQ ID NO: 151958 - DNA, 25 bp, Mus musculus
agagatgctggaccctccacctata

SEQ ID NO: 151959 - DNA, 25 bp, Mus musculus
agagatgctggactccagccaatct

SEQ ID NO: 151960 - DNA, 25 bp, Mus musculus
agagatgctggagacagacccgaag

SEQ ID NO: 151961 - DNA, 25 bp, Mus musculus
agagatgctggagcctccacctata

SEQ ID NO: 151962 - DNA, 25 bp, Mus musculus
agagatgctggagtccagccaatct

SEQ ID NO: 151963 - DNA, 25 bp, Mus musculus
agagatgctggcctgtctggtccaa

SEQ ID NO: 151964 - DNA, 25 bp, Mus musculus
agagatgctggcgtgtctggtccaa

SEQ ID NO: 151965 - DNA, 25 bp, Mus musculus
agagatgcttctcctctgtgcagtg

SEQ ID NO: 151966 - DNA, 25 bp, Mus musculus
agagatgcttctgctctgtgcagtg

SEQ ID NO: 151967 - DNA, 25 bp, Mus musculus
agagatggacacaggccttacattt

SEQ ID NO: 151968 - DNA, 25 bp, Mus musculus
agagatggacactggccttacattt

SEQ ID NO: 151969 - DNA, 25 bp, Mus musculus
agagatggacctattgagatgtaat

SEQ ID NO: 151970 - DNA, 25 bp, Mus musculus
agagatggaccttttgagatgtaat

SEQ ID NO: 151971 - DNA, 25 bp, Mus musculus
agagatggagcacgtggctccctca

SEQ ID NO: 151972 - DNA, 25 bp, Mus musculus
agagatggagcaggtggctccctca

SEQ ID NO: 151973 - DNA, 25 bp, Mus musculus
agagatggagtccttcgcagctacc

SEQ ID NO: 151974 - DNA, 25 bp, Mus musculus
agagatggagtcgttcgcagctacc

SEQ ID NO: 151975 - DNA, 25 bp, Mus musculus
agagatggcactagcctcaatccag

SEQ ID NO: 151976 - DNA, 25 bp, Mus musculus
agagatggcacttgcctcaatccag

SEQ ID NO: 151977 - DNA, 25 bp, Mus musculus
agagatggccatctccagttctgga

SEQ ID NO: 151978 - DNA, 25 bp, Mus musculus
agagatggccatgtccagttctgga

SEQ ID NO: 151979 - DNA, 25 bp, Mus musculus
agagatggccgaatgctgcctgcag

SEQ ID NO: 151980 - DNA, 25 bp, Mus musculus
agagatggccgattgctgcctgcag

SEQ ID NO: 151981 - DNA, 25 bp, Mus musculus
agagatggcctgaccacaaaggatt

SEQ ID NO: 151982 - DNA, 25 bp, Mus musculus
agagatggcctgtccacaaaggatt

SEQ ID NO: 151983 - DNA, 25 bp, Mus musculus
agagatggccttcactcagagacca

SEQ ID NO: 151984 - DNA, 25 bp, Mus musculus
agagatggccttcattgcccctcaa

SEQ ID NO: 151985 - DNA, 25 bp, Mus musculus
agagatggccttgactcagagacca

SEQ ID NO: 151986 - DNA, 25 bp, Mus musculus
agagatggccttgattgcccctcaa

SEQ ID NO: 151987 - DNA, 25 bp, Mus musculus
agagatggcgcaccacttgagagct

SEQ ID NO: 151988 - DNA, 25 bp, Mus musculus
agagatggcgcagcacttgagagct

SEQ ID NO: 151989 - DNA, 25 bp, Mus musculus
agagatggctcacgaccccggtgat

SEQ ID NO: 151990 - DNA, 25 bp, Mus musculus
agagatggctcaggaccccggtgat

SEQ ID NO: 151991 - DNA, 25 bp, Mus musculus
agagatggctcgctcagcagtcaga

SEQ ID NO: 151992 - DNA, 25 bp, Mus musculus
agagatggctcggtcagcagtcaga

SEQ ID NO: 151993 - DNA, 25 bp, Mus musculus
agagatggctggagtgtccctgtgt

SEQ ID NO: 151994 - DNA, 25 bp, Mus musculus
agagatggctggtgtgtccctgtgt

SEQ ID NO: 151995 - DNA, 25 bp, Mus musculus
agagatgggcagactataccacggg

SEQ ID NO: 151996 - DNA, 25 bp, Mus musculus
agagatgggcagtctataccacggg

SEQ ID NO: 151997 - DNA, 25 bp, Mus musculus
agagatggttgcactacaggctggc

SEQ ID NO: 151998 - DNA, 25 bp, Mus musculus
agagatggttgctctacaggctggc

SEQ ID NO: 151999 - DNA, 25 bp, Mus musculus
agagatgtaacaaggcttatgcaat

SEQ ID NO: 152000 - DNA, 25 bp, Mus musculus
agagatgtaacatggcttatgcaat

SEQ ID NO: 152001 - DNA, 25 bp, Mus musculus
agagatgtaagaacccttgcaactg

SEQ ID NO: 152002 - DNA, 25 bp, Mus musculus
agagatgtaagatcccttgcaactg

SEQ ID NO: 152003 - DNA, 25 bp, Mus musculus
agagatgtacttacctcctcttgtg

SEQ ID NO: 152004 - DNA, 25 bp, Mus musculus
agagatgtactttcctcctcttgtg

SEQ ID NO: 152005 - DNA, 25 bp, Mus musculus
agagatgtagccatgttcgtcctgc

SEQ ID NO: 152006 - DNA, 25 bp, Mus musculus
agagatgtagccttgttcgtcctgc

SEQ ID NO: 152007 - DNA, 25 bp, Mus musculus
agagatgtcaggatcccaacactgc

SEQ ID NO: 152008 - DNA, 25 bp, Mus musculus
agagatgtcaggttcccaacactgc

SEQ ID NO: 152009 - DNA, 25 bp, Mus musculus
agagatgtcatacccttccctaaat

SEQ ID NO: 152010 - DNA, 25 bp, Mus musculus
agagatgtcatagccttccctaaat

SEQ ID NO: 152011 - DNA, 25 bp, Mus musculus
agagatgtcggcagcttttctaagt

SEQ ID NO: 152012 - DNA, 25 bp, Mus musculus
agagatgtcggctgcttttctaagt

SEQ ID NO: 152013 - DNA, 25 bp, Mus musculus
agagatgtcggtctgtttcctcaca

SEQ ID NO: 152014 - DNA, 25 bp, Mus musculus
agagatgtcggtgtgtttcctcaca

SEQ ID NO: 152015 - DNA, 25 bp, Mus musculus
agagatgtcgtcctagccaaggaac

SEQ ID NO: 152016 - DNA, 25 bp, Mus musculus
agagatgtcgtcgtagccaaggaac

SEQ ID NO: 152017 - DNA, 25 bp, Mus musculus
agagatgtctctctcatgtcacttt

SEQ ID NO: 152018 - DNA, 25 bp, Mus musculus
agagatgtctctgtcatgtcacttt

SEQ ID NO: 152019 - DNA, 25 bp, Mus musculus
agagatgtctgaagtcctccggtct

SEQ ID NO: 152020 - DNA, 25 bp, Mus musculus
agagatgtctgatgtcctccggtct

SEQ ID NO: 152021 - DNA, 25 bp, Mus musculus
agagatgtgacaagccggccaaagg

SEQ ID NO: 152022 - DNA, 25 bp, Mus musculus
agagatgtgacatgccggccaaagg

SEQ ID NO: 152023 - DNA, 25 bp, Mus musculus
agagatgtgataaggcctcatgtct

SEQ ID NO: 152024 - DNA, 25 bp, Mus musculus
agagatgtgatatggcctcatgtct

SEQ ID NO: 152025 - DNA, 25 bp, Mus musculus
agagatgtgatcaggtttcctttca

SEQ ID NO: 152026 - DNA, 25 bp, Mus musculus
agagatgtgatctggtttcctttca

SEQ ID NO: 152027 - DNA, 25 bp, Mus musculus
agagatgtgtcaccgcatgtttgct

SEQ ID NO: 152028 - DNA, 25 bp, Mus musculus
agagatgtgtcagcgcatgtttgct

SEQ ID NO: 152029 - DNA, 25 bp, Mus musculus
agagatgtgtttcatcagcaagtca

SEQ ID NO: 152030 - DNA, 25 bp, Mus musculus
agagatgtgtttgatcagcaagtca

SEQ ID NO: 152031 - DNA, 25 bp, Mus musculus
agagatgttcagcagctcagagcac

SEQ ID NO: 152032 - DNA, 25 bp, Mus musculus
agagatgttcaggagctcagagcac

SEQ ID NO: 152033 - DNA, 25 bp, Mus musculus
agagatgttccgatgcactcattaa

SEQ ID NO: 152034 - DNA, 25 bp, Mus musculus
agagatgttccgttgcactcattaa

SEQ ID NO: 152035 - DNA, 25 bp, Mus musculus
agagatgttcttcttcatgtctggc

SEQ ID NO: 152036 - DNA, 25 bp, Mus musculus
agagatgttcttgttcatgtctggc

SEQ ID NO: 152037 - DNA, 25 bp, Mus musculus
agagatgtttcactgggagccactg

SEQ ID NO: 152038 - DNA, 25 bp, Mus musculus
agagatgtttcagtgggagccactg

SEQ ID NO: 152039 - DNA, 25 bp, Mus musculus
agagatgtttctatcactggcttca

SEQ ID NO: 152040 - DNA, 25 bp, Mus musculus
agagatgtttctttcactggcttca

SEQ ID NO: 152041 - DNA, 25 bp, Mus musculus
agagattaacccagacctcgacgtt

SEQ ID NO: 152042 - DNA, 25 bp, Mus musculus
agagattaaccctgacctcgacgtt

SEQ ID NO: 152043 - DNA, 25 bp, Mus musculus
agagattaagatctggcttcccggg

SEQ ID NO: 152044 - DNA, 25 bp, Mus musculus
agagattaagatgtggcttcccggg

SEQ ID NO: 152045 - DNA, 25 bp, Mus musculus
agagattacctcaggtcctgcctgg

SEQ ID NO: 152046 - DNA, 25 bp, Mus musculus
agagattacctctggtcctgcctgg

SEQ ID NO: 152047 - DNA, 25 bp, Mus musculus
agagattagcatatccatcccgtgt

SEQ ID NO: 152048 - DNA, 25 bp, Mus musculus
agagattagcatttccatcccgtgt

SEQ ID NO: 152049 - DNA, 25 bp, Mus musculus
agagattaggcgactcttccctcaa

SEQ ID NO: 152050 - DNA, 25 bp, Mus musculus
agagattaggcgtctcttccctcaa

SEQ ID NO: 152051 - DNA, 25 bp, Mus musculus
agagattaggtcagtctcccagcca

SEQ ID NO: 152052 - DNA, 25 bp, Mus musculus
agagattaggtctgtctcccagcca

SEQ ID NO: 152053 - DNA, 25 bp, Mus musculus
agagattatataacctggtactggg

SEQ ID NO: 152054 - DNA, 25 bp, Mus musculus
agagattatatatcctggtactggg

SEQ ID NO: 152055 - DNA, 25 bp, Mus musculus
agagattatcctcaatctgccctcg

SEQ ID NO: 152056 - DNA, 25 bp, Mus musculus
agagattatcctgaatctgccctcg

SEQ ID NO: 152057 - DNA, 25 bp, Mus musculus
agagattcaggaacacaggtttccc

SEQ ID NO: 152058 - DNA, 25 bp, Mus musculus
agagattcaggatcacaggtttccc

SEQ ID NO: 152059 - DNA, 25 bp, Mus musculus
agagattccacacatgctagcaagc

SEQ ID NO: 152060 - DNA, 25 bp, Mus musculus
agagattccacagatgctagcaagc

SEQ ID NO: 152061 - DNA, 25 bp, Mus musculus
agagattccatcctcatggcctaat

SEQ ID NO: 152062 - DNA, 25 bp, Mus musculus
agagattccatcgtcatggcctaat

SEQ ID NO: 152063 - DNA, 25 bp, Mus musculus
agagattccccgctgaccaagggtg

SEQ ID NO: 152064 - DNA, 25 bp, Mus musculus
agagattccccggtgaccaagggtg

SEQ ID NO: 152065 - DNA, 25 bp, Mus musculus
agagattcctcaacgaccctaagca

SEQ ID NO: 152066 - DNA, 25 bp, Mus musculus
agagattcctcatcgaccctaagca

SEQ ID NO: 152067 - DNA, 25 bp, Mus musculus
agagattcctctccccaatgagcgg

SEQ ID NO: 152068 - DNA, 25 bp, Mus musculus
agagattcctctgcccaatgagcgg

SEQ ID NO: 152069 - DNA, 25 bp, Mus musculus
agagattccttacattggccccttt

SEQ ID NO: 152070 - DNA, 25 bp, Mus musculus
agagattccttagattggccccttt

SEQ ID NO: 152071 - DNA, 25 bp, Mus musculus
agagattctttaaattaccttccaa

SEQ ID NO: 152072 - DNA, 25 bp, Mus musculus
agagattctttatattaccttccaa

SEQ ID NO: 152073 - DNA, 25 bp, Mus musculus
agagattgagctagaggttggtcct

SEQ ID NO: 152074 - DNA, 25 bp, Mus musculus
agagattgagcttgaggttggtcct

SEQ ID NO: 152075 - DNA, 25 bp, Mus musculus
agagattgatgccttagagtccaga

SEQ ID NO: 152076 - DNA, 25 bp, Mus musculus
agagattgatgcgttagagtccaga

SEQ ID NO: 152077 - DNA, 25 bp, Mus musculus
agagattgcctcatttgaatgttca

SEQ ID NO: 152078 - DNA, 25 bp, Mus musculus
agagattgcctcttttgaatgttca

SEQ ID NO: 152079 - DNA, 25 bp, Mus musculus
agagattgcttgatggcagccatat

SEQ ID NO: 152080 - DNA, 25 bp, Mus musculus
agagattgcttgttggcagccatat

SEQ ID NO: 152081 - DNA, 25 bp, Mus musculus
agagattgtcttccttctggagtcc

SEQ ID NO: 152082 - DNA, 25 bp, Mus musculus
agagattgtcttgcttctggagtcc

SEQ ID NO: 152083 - DNA, 25 bp, Mus musculus
agagattgtgtgaccccttctcggc

SEQ ID NO: 152084 - DNA, 25 bp, Mus musculus
agagattgtgtgtccccttctcggc

SEQ ID NO: 152085 - DNA, 25 bp, Mus musculus
agagattgttcacggcagtcttggc

SEQ ID NO: 152086 - DNA, 25 bp, Mus musculus
agagattgttcagggcagtcttggc

SEQ ID NO: 152087 - DNA, 25 bp, Mus musculus
agagattgttctcatcatcgccaag

SEQ ID NO: 152088 - DNA, 25 bp, Mus musculus
agagattgttctgatcatcgccaag

SEQ ID NO: 152089 - DNA, 25 bp, Mus musculus
agagattgttgtattgctgtgcctt

SEQ ID NO: 152090 - DNA, 25 bp, Mus musculus
agagattgttgttttgctgtgcctt

SEQ ID NO: 152091 - DNA, 25 bp, Mus musculus
agagatttaccgatggcccatcaag

SEQ ID NO: 152092 - DNA, 25 bp, Mus musculus
agagatttaccgttggcccatcaag

SEQ ID NO: 152093 - DNA, 25 bp, Mus musculus
agagatttactcaggacattttgcc

SEQ ID NO: 152094 - DNA, 25 bp, Mus musculus
agagatttactctggacattttgcc

SEQ ID NO: 152095 - DNA, 25 bp, Mus musculus
agagatttagtccaacatcatcatg

SEQ ID NO: 152096 - DNA, 25 bp, Mus musculus
agagatttagtcgaacatcatcatg

SEQ ID NO: 152097 - DNA, 25 bp, Mus musculus
agagatttccaccaacctcttatgg

SEQ ID NO: 152098 - DNA, 25 bp, Mus musculus
agagatttccacgaacctcttatgg

SEQ ID NO: 152099 - DNA, 25 bp, Mus musculus
agagatttcctactaatcccaacaa

SEQ ID NO: 152100 - DNA, 25 bp, Mus musculus
agagatttcctagtaatcccaacaa

SEQ ID NO: 152101 - DNA, 25 bp, Mus musculus
agagatttcctgaccttcggtcttg

SEQ ID NO: 152102 - DNA, 25 bp, Mus musculus
agagatttcctgtccttcggtcttg

SEQ ID NO: 152103 - DNA, 25 bp, Mus musculus
agagatttctgcctcagtctagtgt

SEQ ID NO: 152104 - DNA, 25 bp, Mus musculus
agagatttctgcgtcagtctagtgt

SEQ ID NO: 152105 - DNA, 25 bp, Mus musculus
agagatttgagacatgtggcttttc

SEQ ID NO: 152106 - DNA, 25 bp, Mus musculus
agagatttgagagatgtggcttttc

SEQ ID NO: 152107 - DNA, 25 bp, Mus musculus
agagatttgcatcgcttagcactgc

SEQ ID NO: 152108 - DNA, 25 bp, Mus musculus
agagatttgcatggcttagcactgc

SEQ ID NO: 152109 - DNA, 25 bp, Mus musculus
agagatttgctcatgtttttccgaa

SEQ ID NO: 152110 - DNA, 25 bp, Mus musculus
agagatttgctcttgtttttccgaa

SEQ ID NO: 152111 - DNA, 25 bp, Mus musculus
agagattttacacggctcctcagat

SEQ ID NO: 152112 - DNA, 25 bp, Mus musculus
agagattttacagggctcctcagat

SEQ ID NO: 152113 - DNA, 25 bp, Mus musculus
agagattttcttaatgtggcccatt

SEQ ID NO: 152114 - DNA, 25 bp, Mus musculus
agagattttctttatgtggcccatt

SEQ ID NO: 152115 - DNA, 25 bp, Mus musculus
agagcaaaaactaactacttcctga

SEQ ID NO: 152116 - DNA, 25 bp, Mus musculus
agagcaaaaacttactacttcctga

SEQ ID NO: 152117 - DNA, 25 bp, Mus musculus
agagcaaaatagcaacctggccggg

SEQ ID NO: 152118 - DNA, 25 bp, Mus musculus
agagcaaaataggaacctggccggg

SEQ ID NO: 152119 - DNA, 25 bp, Mus musculus
agagcaaacacgaaaggcctgggtg

SEQ ID NO: 152120 - DNA, 25 bp, Mus musculus
agagcaaacacgtaaggcctgggtg

SEQ ID NO: 152121 - DNA, 25 bp, Mus musculus
agagcaaacccaaagtcttgccttc

SEQ ID NO: 152122 - DNA, 25 bp, Mus musculus
agagcaaacccatagtcttgccttc

SEQ ID NO: 152123 - DNA, 25 bp, Mus musculus
agagcaaaccccaaggaggtgcctc

SEQ ID NO: 152124 - DNA, 25 bp, Mus musculus
agagcaaacccctaggaggtgcctc

SEQ ID NO: 152125 - DNA, 25 bp, Mus musculus
agagcaaacctgagactttactgtc

SEQ ID NO: 152126 - DNA, 25 bp, Mus musculus
agagcaaacctgcaagagctttatg

SEQ ID NO: 152127 - DNA, 25 bp, Mus musculus
agagcaaacctggaagagctttatg

SEQ ID NO: 152128 - DNA, 25 bp, Mus musculus
agagcaaacctgtgactttactgtc

SEQ ID NO: 152129 - DNA, 25 bp, Mus musculus
agagcaaaccttccagctgctgaag

SEQ ID NO: 152130 - DNA, 25 bp, Mus musculus
agagcaaaccttctctcttgcacta

SEQ ID NO: 152131 - DNA, 25 bp, Mus musculus
agagcaaaccttgcagctgctgaag

SEQ ID NO: 152132 - DNA, 25 bp, Mus musculus
agagcaaaccttgtctcttgcacta

SEQ ID NO: 152133 - DNA, 25 bp, Mus musculus
agagcaaacgatcccggccctgagc

SEQ ID NO: 152134 - DNA, 25 bp, Mus musculus
agagcaaacgatgccggccctgagc

SEQ ID NO: 152135 - DNA, 25 bp, Mus musculus
agagcaaactgcatctgcccaggtg

SEQ ID NO: 152136 - DNA, 25 bp, Mus musculus
agagcaaactgcttctgcccaggtg

SEQ ID NO: 152137 - DNA, 25 bp, Mus musculus
agagcaaactgtacccttggctgtg

SEQ ID NO: 152138 - DNA, 25 bp, Mus musculus
agagcaaactgttcccttggctgtg

SEQ ID NO: 152139 - DNA, 25 bp, Mus musculus
agagcaaagacaccattccattcca

SEQ ID NO: 152140 - DNA, 25 bp, Mus musculus
agagcaaagacagcattccattcca

SEQ ID NO: 152141 - DNA, 25 bp, Mus musculus
agagcaaaggtcaagcatatccatg

SEQ ID NO: 152142 - DNA, 25 bp, Mus musculus
agagcaaaggtctagcatatccatg

SEQ ID NO: 152143 - DNA, 25 bp, Mus musculus
agagcaaagtcacacatccgcttac

SEQ ID NO: 152144 - DNA, 25 bp, Mus musculus
agagcaaagtcagacatccgcttac

SEQ ID NO: 152145 - DNA, 25 bp, Mus musculus
agagcaaagttgacagtgaggcctg

SEQ ID NO: 152146 - DNA, 25 bp, Mus musculus
agagcaaagttgtcagtgaggcctg

SEQ ID NO: 152147 - DNA, 25 bp, Mus musculus
agagcaacaattaacctgggatcca

SEQ ID NO: 152148 - DNA, 25 bp, Mus musculus
agagcaacaatttacctgggatcca

SEQ ID NO: 152149 - DNA, 25 bp, Mus musculus
agagcaacacacagttcagttgtat

SEQ ID NO: 152150 - DNA, 25 bp, Mus musculus
agagcaacacactgttcagttgtat

SEQ ID NO: 152151 - DNA, 25 bp, Mus musculus
agagcaacacttatccaccttccta

SEQ ID NO: 152152 - DNA, 25 bp, Mus musculus
agagcaacacttttccaccttccta

SEQ ID NO: 152153 - DNA, 25 bp, Mus musculus
agagcaacagcaactttgtcacaag

SEQ ID NO: 152154 - DNA, 25 bp, Mus musculus
agagcaacagcatctttgtcacaag

SEQ ID NO: 152155 - DNA, 25 bp, Mus musculus
agagcaacaggacgtgctctcagct

SEQ ID NO: 152156 - DNA, 25 bp, Mus musculus
agagcaacaggaggtgctctcagct

SEQ ID NO: 152157 - DNA, 25 bp, Mus musculus
agagcaacaggtcgctccttgggat

SEQ ID NO: 152158 - DNA, 25 bp, Mus musculus
agagcaacaggtggctccttgggat

SEQ ID NO: 152159 - DNA, 25 bp, Mus musculus
agagcaacagtgagggtcgtccttc

SEQ ID NO: 152160 - DNA, 25 bp, Mus musculus
agagcaacagtgcacttaacctccg

SEQ ID NO: 152161 - DNA, 25 bp, Mus musculus
agagcaacagtggacttaacctccg

SEQ ID NO: 152162 - DNA, 25 bp, Mus musculus
agagcaacagtgtgggtcgtccttc

SEQ ID NO: 152163 - DNA, 25 bp, Mus musculus
agagcaaccagactcatcccgttta

SEQ ID NO: 152164 - DNA, 25 bp, Mus musculus
agagcaaccagagtcatcccgttta

SEQ ID NO: 152165 - DNA, 25 bp, Mus musculus
agagcaaccccgaagggccttgcgg

SEQ ID NO: 152166 - DNA, 25 bp, Mus musculus
agagcaaccccgtagggccttgcgg

SEQ ID NO: 152167 - DNA, 25 bp, Mus musculus
agagcaaccctaaggcaccctgaag

SEQ ID NO: 152168 - DNA, 25 bp, Mus musculus
agagcaaccctacatgttggtcctg

SEQ ID NO: 152169 - DNA, 25 bp, Mus musculus
agagcaaccctagatgttggtcctg

SEQ ID NO: 152170 - DNA, 25 bp, Mus musculus
agagcaaccctatggcaccctgaag

SEQ ID NO: 152171 - DNA, 25 bp, Mus musculus
agagcaacctctaacagcatgttca

SEQ ID NO: 152172 - DNA, 25 bp, Mus musculus
agagcaacctcttacagcatgttca

SEQ ID NO: 152173 - DNA, 25 bp, Mus musculus
agagcaacctgaagtattccctcct

SEQ ID NO: 152174 - DNA, 25 bp, Mus musculus
agagcaacctgatgtattccctcct

SEQ ID NO: 152175 - DNA, 25 bp, Mus musculus
agagcaacgggcatcggcttcttga

SEQ ID NO: 152176 - DNA, 25 bp, Mus musculus
agagcaacgggcttcggcttcttga

SEQ ID NO: 152177 - DNA, 25 bp, Mus musculus
agagcaacgtctcagagccagccaa

SEQ ID NO: 152178 - DNA, 25 bp, Mus musculus
agagcaacgtctgagagccagccaa

SEQ ID NO: 152179 - DNA, 25 bp, Mus musculus
agagcaacgtggatctgagcacctt

SEQ ID NO: 152180 - DNA, 25 bp, Mus musculus
agagcaacgtggttctgagcacctt

SEQ ID NO: 152181 - DNA, 25 bp, Mus musculus
agagcaactagtccgcttaactact

SEQ ID NO: 152182 - DNA, 25 bp, Mus musculus
agagcaactagtgcgcttaactact

SEQ ID NO: 152183 - DNA, 25 bp, Mus musculus
agagcaactgctagtgaatggcccc

SEQ ID NO: 152184 - DNA, 25 bp, Mus musculus
agagcaactgcttgtgaatggcccc

SEQ ID NO: 152185 - DNA, 25 bp, Mus musculus
agagcaactggccagcaggaccgtt

SEQ ID NO: 152186 - DNA, 25 bp, Mus musculus
agagcaactggcgagcaggaccgtt

SEQ ID NO: 152187 - DNA, 25 bp, Mus musculus
agagcaacttcgcacgttggcggta

SEQ ID NO: 152188 - DNA, 25 bp, Mus musculus
agagcaacttcggacgttggcggta

SEQ ID NO: 152189 - DNA, 25 bp, Mus musculus
agagcaacttggaagtctcagatgt

SEQ ID NO: 152190 - DNA, 25 bp, Mus musculus
agagcaacttggtagtctcagatgt

SEQ ID NO: 152191 - DNA, 25 bp, Mus musculus
agagcaagacttccagctggagata

SEQ ID NO: 152192 - DNA, 25 bp, Mus musculus
agagcaagacttgcagctggagata

SEQ ID NO: 152193 - DNA, 25 bp, Mus musculus
agagcaagagctcgcctatctggag

SEQ ID NO: 152194 - DNA, 25 bp, Mus musculus
agagcaagagctggcctatctggag

SEQ ID NO: 152195 - DNA, 25 bp, Mus musculus
agagcaagagtcctttctacctggt

SEQ ID NO: 152196 - DNA, 25 bp, Mus musculus
agagcaagagtcgtttctacctggt

SEQ ID NO: 152197 - DNA, 25 bp, Mus musculus
agagcaagatcacggtgctgcccgc

SEQ ID NO: 152198 - DNA, 25 bp, Mus musculus
agagcaagatcagggtgctgcccgc

SEQ ID NO: 152199 - DNA, 25 bp, Mus musculus
agagcaagcacaactgtaacctagt

SEQ ID NO: 152200 - DNA, 25 bp, Mus musculus
agagcaagcacatctgtaacctagt

SEQ ID NO: 152201 - DNA, 25 bp, Mus musculus
agagcaagcacgaggcctggcctcc

SEQ ID NO: 152202 - DNA, 25 bp, Mus musculus
agagcaagcacgtggcctggcctcc

SEQ ID NO: 152203 - DNA, 25 bp, Mus musculus
agagcaagccacatagcatccgagg

SEQ ID NO: 152204 - DNA, 25 bp, Mus musculus
agagcaagccacttagcatccgagg

SEQ ID NO: 152205 - DNA, 25 bp, Mus musculus
agagcaagccgacttgccctggctg

SEQ ID NO: 152206 - DNA, 25 bp, Mus musculus
agagcaagccgagttgccctggctg

SEQ ID NO: 152207 - DNA, 25 bp, Mus musculus
agagcaagcctcaggaagaaagatt

SEQ ID NO: 152208 - DNA, 25 bp, Mus musculus
agagcaagcctctggaagaaagatt

SEQ ID NO: 152209 - DNA, 25 bp, Mus musculus
agagcaagcggcaggtgaccgcccc

SEQ ID NO: 152210 - DNA, 25 bp, Mus musculus
agagcaagcggctggtgaccgcccc

SEQ ID NO: 152211 - DNA, 25 bp, Mus musculus
agagcaagctgccagtcttcagtct

SEQ ID NO: 152212 - DNA, 25 bp, Mus musculus
agagcaagctgcgagtcttcagtct

SEQ ID NO: 152213 - DNA, 25 bp, Mus musculus
agagcaagctggagccgtacacact

SEQ ID NO: 152214 - DNA, 25 bp, Mus musculus
agagcaagctggtgccgtacacact

SEQ ID NO: 152215 - DNA, 25 bp, Mus musculus
agagcaagctgtcctcagccctcgg

SEQ ID NO: 152216 - DNA, 25 bp, Mus musculus
agagcaagctgtgctcagccctcgg

SEQ ID NO: 152217 - DNA, 25 bp, Mus musculus
agagcaaggcccaggtgtgagctct

SEQ ID NO: 152218 - DNA, 25 bp, Mus musculus
agagcaaggccctggtgtgagctct

SEQ ID NO: 152219 - DNA, 25 bp, Mus musculus
agagcaaggctgactctggtgagca

SEQ ID NO: 152220 - DNA, 25 bp, Mus musculus
agagcaaggctgtctctggtgagca

SEQ ID NO: 152221 - DNA, 25 bp, Mus musculus
agagcaagggacagtttacgccttc

SEQ ID NO: 152222 - DNA, 25 bp, Mus musculus
agagcaagggactgtttacgccttc

SEQ ID NO: 152223 - DNA, 25 bp, Mus musculus
agagcaaggtgtccctgagttctgt

SEQ ID NO: 152224 - DNA, 25 bp, Mus musculus
agagcaaggtgtgcctgagttctgt

SEQ ID NO: 152225 - DNA, 25 bp, Mus musculus
agagcaagtcatcactagctgccac

SEQ ID NO: 152226 - DNA, 25 bp, Mus musculus
agagcaagtcatgactagctgccac

SEQ ID NO: 152227 - DNA, 25 bp, Mus musculus
agagcaagtgcacataccggaagtt

SEQ ID NO: 152228 - DNA, 25 bp, Mus musculus
agagcaagtgcagataccggaagtt

SEQ ID NO: 152229 - DNA, 25 bp, Mus musculus
agagcaagtgggactctgccatccc

SEQ ID NO: 152230 - DNA, 25 bp, Mus musculus
agagcaagtgggtctctgccatccc

SEQ ID NO: 152231 - DNA, 25 bp, Mus musculus
agagcaagttccatgatatcagaac

SEQ ID NO: 152232 - DNA, 25 bp, Mus musculus
agagcaagttccttgatatcagaac

SEQ ID NO: 152233 - DNA, 25 bp, Mus musculus
agagcaatacttactgttccagtta

SEQ ID NO: 152234 - DNA, 25 bp, Mus musculus
agagcaatactttctgttccagtta

SEQ ID NO: 152235 - DNA, 25 bp, Mus musculus
agagcaatgagaacacttccctgat

SEQ ID NO: 152236 - DNA, 25 bp, Mus musculus
agagcaatgagatcacttccctgat

SEQ ID NO: 152237 - DNA, 25 bp, Mus musculus
agagcaatggccagcagaatcaact

SEQ ID NO: 152238 - DNA, 25 bp, Mus musculus
agagcaatggcctgcagaatcaact

SEQ ID NO: 152239 - DNA, 25 bp, Mus musculus
agagcaatgtgcattccaatgaaat

SEQ ID NO: 152240 - DNA, 25 bp, Mus musculus
agagcaatgtgctttccaatgaaat

SEQ ID NO: 152241 - DNA, 25 bp, Mus musculus
agagcaattctcagatccctgggaa

SEQ ID NO: 152242 - DNA, 25 bp, Mus musculus
agagcaattctctgatccctgggaa

SEQ ID NO: 152243 - DNA, 25 bp, Mus musculus
agagcaattggacgtcccctactgg

SEQ ID NO: 152244 - DNA, 25 bp, Mus musculus
agagcaattggaggtcccctactgg

SEQ ID NO: 152245 - DNA, 25 bp, Mus musculus
agagcaattgttctcaactggcttg

SEQ ID NO: 152246 - DNA, 25 bp, Mus musculus
agagcaattgttgtcaactggcttg

SEQ ID NO: 152247 - DNA, 25 bp, Mus musculus
agagcacaaacgaccactgttcctc

SEQ ID NO: 152248 - DNA, 25 bp, Mus musculus
agagcacaaacgtccactgttcctc

SEQ ID NO: 152249 - DNA, 25 bp, Mus musculus
agagcacaacctagccaattacatg

SEQ ID NO: 152250 - DNA, 25 bp, Mus musculus
agagcacaaccttgccaattacatg

SEQ ID NO: 152251 - DNA, 25 bp, Mus musculus
agagcacaagccagtcttcctggga

SEQ ID NO: 152252 - DNA, 25 bp, Mus musculus
agagcacaagcctgtcttcctggga

SEQ ID NO: 152253 - DNA, 25 bp, Mus musculus
agagcacaaggacggcccagctgaa

SEQ ID NO: 152254 - DNA, 25 bp, Mus musculus
agagcacaaggagggcccagctgaa

SEQ ID NO: 152255 - DNA, 25 bp, Mus musculus
agagcacaaggcctcccactgttga

SEQ ID NO: 152256 - DNA, 25 bp, Mus musculus
agagcacaaggcgtcccactgttga

SEQ ID NO: 152257 - DNA, 25 bp, Mus musculus
agagcacacactacaccaattccta

SEQ ID NO: 152258 - DNA, 25 bp, Mus musculus
agagcacacacttcaccaattccta

SEQ ID NO: 152259 - DNA, 25 bp, Mus musculus
agagcacacagtcgacggcaagtcc

SEQ ID NO: 152260 - DNA, 25 bp, Mus musculus
agagcacacagtggacggcaagtcc

SEQ ID NO: 152261 - DNA, 25 bp, Mus musculus
agagcacacatgagtccccgatcac

SEQ ID NO: 152262 - DNA, 25 bp, Mus musculus
agagcacacatgtgtccccgatcac

SEQ ID NO: 152263 - DNA, 25 bp, Mus musculus
agagcacacattacaatcgttcata

SEQ ID NO: 152264 - DNA, 25 bp, Mus musculus
agagcacacatttcaatcgttcata

SEQ ID NO: 152265 - DNA, 25 bp, Mus musculus
agagcacaccgactggcctgaagaa

SEQ ID NO: 152266 - DNA, 25 bp, Mus musculus
agagcacaccgagtggcctgaagaa

SEQ ID NO: 152267 - DNA, 25 bp, Mus musculus
agagcacaccggaggcccaaagagg

SEQ ID NO: 152268 - DNA, 25 bp, Mus musculus
agagcacaccggtggcccaaagagg

SEQ ID NO: 152269 - DNA, 25 bp, Mus musculus
agagcacacgccctctggaaacttc

SEQ ID NO: 152270 - DNA, 25 bp, Mus musculus
agagcacacgccgtctggaaacttc

SEQ ID NO: 152271 - DNA, 25 bp, Mus musculus
agagcacacgggatgcgcttgtcaa

SEQ ID NO: 152272 - DNA, 25 bp, Mus musculus
agagcacacgggttgcgcttgtcaa

SEQ ID NO: 152273 - DNA, 25 bp, Mus musculus
agagcacacggtcccgctaaactat

SEQ ID NO: 152274 - DNA, 25 bp, Mus musculus
agagcacacggtgccgctaaactat

SEQ ID NO: 152275 - DNA, 25 bp, Mus musculus
agagcacacgttctcttccagagca

SEQ ID NO: 152276 - DNA, 25 bp, Mus musculus
agagcacacgttgtcttccagagca

SEQ ID NO: 152277 - DNA, 25 bp, Mus musculus
agagcacactcacagatgccccttt

SEQ ID NO: 152278 - DNA, 25 bp, Mus musculus
agagcacactcagagatgccccttt

SEQ ID NO: 152279 - DNA, 25 bp, Mus musculus
agagcacactggatgcttcttggac

SEQ ID NO: 152280 - DNA, 25 bp, Mus musculus
agagcacactggctgactgccctga

SEQ ID NO: 152281 - DNA, 25 bp, Mus musculus
agagcacactgggtgactgccctga

SEQ ID NO: 152282 - DNA, 25 bp, Mus musculus
agagcacactggttgcttcttggac

SEQ ID NO: 152283 - DNA, 25 bp, Mus musculus
agagcacacttccaccttgggacag

SEQ ID NO: 152284 - DNA, 25 bp, Mus musculus
agagcacacttcgaccttgggacag

SEQ ID NO: 152285 - DNA, 25 bp, Mus musculus
agagcacagactcgacttgcagcag

SEQ ID NO: 152286 - DNA, 25 bp, Mus musculus
agagcacagactggacttgcagcag

SEQ ID NO: 152287 - DNA, 25 bp, Mus musculus
agagcacagcaaacagcgcgtcctt

SEQ ID NO: 152288 - DNA, 25 bp, Mus musculus
agagcacagcaatcagcgcgtcctt

SEQ ID NO: 152289 - DNA, 25 bp, Mus musculus
agagcacagcacaagtttgttttag

SEQ ID NO: 152290 - DNA, 25 bp, Mus musculus
agagcacagcacacacagtgcagta

SEQ ID NO: 152291 - DNA, 25 bp, Mus musculus
agagcacagcacagcattaggcagg

SEQ ID NO: 152292 - DNA, 25 bp, Mus musculus
agagcacagcaccctgccatcagag

SEQ ID NO: 152293 - DNA, 25 bp, Mus musculus
agagcacagcacgctgccatcagag

SEQ ID NO: 152294 - DNA, 25 bp, Mus musculus
agagcacagcactagtttgttttag

SEQ ID NO: 152295 - DNA, 25 bp, Mus musculus
agagcacagcactcacagtgcagta

SEQ ID NO: 152296 - DNA, 25 bp, Mus musculus
agagcacagcactgcattaggcagg

SEQ ID NO: 152297 - DNA, 25 bp, Mus musculus
agagcacagcatccatgagatgcag

SEQ ID NO: 152298 - DNA, 25 bp, Mus musculus
agagcacagcatgcatgagatgcag

SEQ ID NO: 152299 - DNA, 25 bp, Mus musculus
agagcacaggaacacgggcaggact

SEQ ID NO: 152300 - DNA, 25 bp, Mus musculus
agagcacaggaagacgggcaggact

SEQ ID NO: 152301 - DNA, 25 bp, Mus musculus
agagcacagggtactgggacccctt

SEQ ID NO: 152302 - DNA, 25 bp, Mus musculus
agagcacagggttctgggacccctt

SEQ ID NO: 152303 - DNA, 25 bp, Mus musculus
agagcacataagatcctacctagga

SEQ ID NO: 152304 - DNA, 25 bp, Mus musculus
agagcacataagttcctacctagga

SEQ ID NO: 152305 - DNA, 25 bp, Mus musculus
agagcacatatcatatgcccctcaa

SEQ ID NO: 152306 - DNA, 25 bp, Mus musculus
agagcacatatcttatgcccctcaa

SEQ ID NO: 152307 - DNA, 25 bp, Mus musculus
agagcacatggaacttaagagatat

SEQ ID NO: 152308 - DNA, 25 bp, Mus musculus
agagcacatggatcttaagagatat

SEQ ID NO: 152309 - DNA, 25 bp, Mus musculus
agagcacatggcaccttctgtggaa

SEQ ID NO: 152310 - DNA, 25 bp, Mus musculus
agagcacatggctccttctgtggaa

SEQ ID NO: 152311 - DNA, 25 bp, Mus musculus
agagcacatgttcaatcccagatct

SEQ ID NO: 152312 - DNA, 25 bp, Mus musculus
agagcacatgttgaatcccagatct

SEQ ID NO: 152313 - DNA, 25 bp, Mus musculus
agagcacattcccaaggcatcctca

SEQ ID NO: 152314 - DNA, 25 bp, Mus musculus
agagcacattccgaaggcatcctca

SEQ ID NO: 152315 - DNA, 25 bp, Mus musculus
agagcacattttagggttttaattg

SEQ ID NO: 152316 - DNA, 25 bp, Mus musculus
agagcacattttcctactgatagaa

SEQ ID NO: 152317 - DNA, 25 bp, Mus musculus
agagcacattttgctactgatagaa

SEQ ID NO: 152318 - DNA, 25 bp, Mus musculus
agagcacatttttgggttttaattg

SEQ ID NO: 152319 - DNA, 25 bp, Mus musculus
agagcaccaaacctgtgaaaactaa

SEQ ID NO: 152320 - DNA, 25 bp, Mus musculus
agagcaccaaacgtgtgaaaactaa

SEQ ID NO: 152321 - DNA, 25 bp, Mus musculus
agagcaccaaggaagagaggccccg

SEQ ID NO: 152322 - DNA, 25 bp, Mus musculus
agagcaccaaggtagagaggccccg

SEQ ID NO: 152323 - DNA, 25 bp, Mus musculus
agagcaccaagtacatctgcagata

SEQ ID NO: 152324 - DNA, 25 bp, Mus musculus
agagcaccaagttcatctgcagata

SEQ ID NO: 152325 - DNA, 25 bp, Mus musculus
agagcaccacagcactgggatccaa

SEQ ID NO: 152326 - DNA, 25 bp, Mus musculus
agagcaccacaggactgggatccaa

SEQ ID NO: 152327 - DNA, 25 bp, Mus musculus
agagcaccacttaccaaagcacaaa

SEQ ID NO: 152328 - DNA, 25 bp, Mus musculus
agagcaccactttccaaagcacaaa

SEQ ID NO: 152329 - DNA, 25 bp, Mus musculus
agagcaccatctaaaacctcagtat

SEQ ID NO: 152330 - DNA, 25 bp, Mus musculus
agagcaccatcttaaacctcagtat

SEQ ID NO: 152331 - DNA, 25 bp, Mus musculus
agagcaccattccacgctaatgttt

SEQ ID NO: 152332 - DNA, 25 bp, Mus musculus
agagcaccattcgacgctaatgttt

SEQ ID NO: 152333 - DNA, 25 bp, Mus musculus
agagcacccacaacttaacttgttg

SEQ ID NO: 152334 - DNA, 25 bp, Mus musculus
agagcacccacatcttaacttgttg

SEQ ID NO: 152335 - DNA, 25 bp, Mus musculus
agagcacccagaacgagcctgtgtg

SEQ ID NO: 152336 - DNA, 25 bp, Mus musculus
agagcacccagatcgagcctgtgtg

SEQ ID NO: 152337 - DNA, 25 bp, Mus musculus
agagcacccagcagtctcagtttat

SEQ ID NO: 152338 - DNA, 25 bp, Mus musculus
agagcacccagctgtctcagtttat

SEQ ID NO: 152339 - DNA, 25 bp, Mus musculus
agagcaccccagactggcatgtggt

SEQ ID NO: 152340 - DNA, 25 bp, Mus musculus
agagcaccccagtctggcatgtggt

SEQ ID NO: 152341 - DNA, 25 bp, Mus musculus
agagcaccccatctggaaagcggta

SEQ ID NO: 152342 - DNA, 25 bp, Mus musculus
agagcaccccatgtggaaagcggta

SEQ ID NO: 152343 - DNA, 25 bp, Mus musculus
agagcacccctgatcatagcgagaa

SEQ ID NO: 152344 - DNA, 25 bp, Mus musculus
agagcacccctgttcatagcgagaa

SEQ ID NO: 152345 - DNA, 25 bp, Mus musculus
agagcacccgagagacccctttgtt

SEQ ID NO: 152346 - DNA, 25 bp, Mus musculus
agagcacccgagtgacccctttgtt

SEQ ID NO: 152347 - DNA, 25 bp, Mus musculus
agagcaccctctcggatttacataa

SEQ ID NO: 152348 - DNA, 25 bp, Mus musculus
agagcaccctctgggatttacataa

SEQ ID NO: 152349 - DNA, 25 bp, Mus musculus
agagcaccgcaacaggcttctgagt

SEQ ID NO: 152350 - DNA, 25 bp, Mus musculus
agagcaccgcaagaggcttctgagt

SEQ ID NO: 152351 - DNA, 25 bp, Mus musculus
agagcaccggctagaaccccagaag

SEQ ID NO: 152352 - DNA, 25 bp, Mus musculus
agagcaccggcttgaaccccagaag

SEQ ID NO: 152353 - DNA, 25 bp, Mus musculus
agagcacctcagactaccttgtggt

SEQ ID NO: 152354 - DNA, 25 bp, Mus musculus
agagcacctcagtctaccttgtggt

SEQ ID NO: 152355 - DNA, 25 bp, Mus musculus
agagcacctgacagtgaatccggaa

SEQ ID NO: 152356 - DNA, 25 bp, Mus musculus
agagcacctgactgtgaatccggaa

SEQ ID NO: 152357 - DNA, 25 bp, Mus musculus
agagcacctggtccatacagattgt

SEQ ID NO: 152358 - DNA, 25 bp, Mus musculus
agagcacctggtcggctctgccact

SEQ ID NO: 152359 - DNA, 25 bp, Mus musculus
agagcacctggtgcatacagattgt

SEQ ID NO: 152360 - DNA, 25 bp, Mus musculus
agagcacctggtgggctctgccact

SEQ ID NO: 152361 - DNA, 25 bp, Mus musculus
agagcacctgttacagtgggagcca

SEQ ID NO: 152362 - DNA, 25 bp, Mus musculus
agagcacctgtttcagtgggagcca

SEQ ID NO: 152363 - DNA, 25 bp, Mus musculus
agagcacgagctagtccctgagcac

SEQ ID NO: 152364 - DNA, 25 bp, Mus musculus
agagcacgagcttgtccctgagcac

SEQ ID NO: 152365 - DNA, 25 bp, Mus musculus
agagcacgcaccatgttcagcacca

SEQ ID NO: 152366 - DNA, 25 bp, Mus musculus
agagcacgcaccttgttcagcacca

SEQ ID NO: 152367 - DNA, 25 bp, Mus musculus
agagcacggcccacaggtcgcaacg

SEQ ID NO: 152368 - DNA, 25 bp, Mus musculus
agagcacggccctcaggtcgcaacg

SEQ ID NO: 152369 - DNA, 25 bp, Mus musculus
agagcacggtatatactctcctgac

SEQ ID NO: 152370 - DNA, 25 bp, Mus musculus
agagcacggtatttactctcctgac

SEQ ID NO: 152371 - DNA, 25 bp, Mus musculus
agagcacggtgcactgttagtctga

SEQ ID NO: 152372 - DNA, 25 bp, Mus musculus
agagcacggtgctctgttagtctga

SEQ ID NO: 152373 - DNA, 25 bp, Mus musculus
agagcacgtacgattagcccattta

SEQ ID NO: 152374 - DNA, 25 bp, Mus musculus
agagcacgtacgtttagcccattta

SEQ ID NO: 152375 - DNA, 25 bp, Mus musculus
agagcacgtatgacagccactctgt

SEQ ID NO: 152376 - DNA, 25 bp, Mus musculus
agagcacgtatgtcagccactctgt

SEQ ID NO: 152377 - DNA, 25 bp, Mus musculus
agagcacgtgtaacgtcaggtggat

SEQ ID NO: 152378 - DNA, 25 bp, Mus musculus
agagcacgtgtatcgtcaggtggat

SEQ ID NO: 152379 - DNA, 25 bp, Mus musculus
agagcacgtgttctttccgaagacc

SEQ ID NO: 152380 - DNA, 25 bp, Mus musculus
agagcacgtgttgtttccgaagacc

SEQ ID NO: 152381 - DNA, 25 bp, Mus musculus
agagcactaatgacttcagtagttt

SEQ ID NO: 152382 - DNA, 25 bp, Mus musculus
agagcactaatgtcttcagtagttt

SEQ ID NO: 152383 - DNA, 25 bp, Mus musculus
agagcactactcagagaagcttcgg

SEQ ID NO: 152384 - DNA, 25 bp, Mus musculus
agagcactactctgagaagcttcgg

SEQ ID NO: 152385 - DNA, 25 bp, Mus musculus
agagcactactgacctgttttgaga

SEQ ID NO: 152386 - DNA, 25 bp, Mus musculus
agagcactactgtcctgttttgaga

SEQ ID NO: 152387 - DNA, 25 bp, Mus musculus
agagcactatgcactcgccacattg

SEQ ID NO: 152388 - DNA, 25 bp, Mus musculus
agagcactatgctctcgccacattg

SEQ ID NO: 152389 - DNA, 25 bp, Mus musculus
agagcactcaagcactgcctagaac

SEQ ID NO: 152390 - DNA, 25 bp, Mus musculus
agagcactcaaggactgcctagaac

SEQ ID NO: 152391 - DNA, 25 bp, Mus musculus
agagcactcaccagggctgtacaag

SEQ ID NO: 152392 - DNA, 25 bp, Mus musculus
agagcactcacctgggctgtacaag

SEQ ID NO: 152393 - DNA, 25 bp, Mus musculus
agagcactcactaattggccctatc

SEQ ID NO: 152394 - DNA, 25 bp, Mus musculus
agagcactcacttattggccctatc

SEQ ID NO: 152395 - DNA, 25 bp, Mus musculus
agagcactcagccaatgcctcagaa

SEQ ID NO: 152396 - DNA, 25 bp, Mus musculus
agagcactcagcgaatgcctcagaa

SEQ ID NO: 152397 - DNA, 25 bp, Mus musculus
agagcactcctaattctgggagtta

SEQ ID NO: 152398 - DNA, 25 bp, Mus musculus
agagcactcctatttctgggagtta

SEQ ID NO: 152399 - DNA, 25 bp, Mus musculus
agagcactcgaacatggttctttcc

SEQ ID NO: 152400 - DNA, 25 bp, Mus musculus
agagcactcgaagatggttctttcc

SEQ ID NO: 152401 - DNA, 25 bp, Mus musculus
agagcactctgcctgtcagaccatg

SEQ ID NO: 152402 - DNA, 25 bp, Mus musculus
agagcactctgcgtgtcagaccatg

SEQ ID NO: 152403 - DNA, 25 bp, Mus musculus
agagcactgaatcactgactgtatc

SEQ ID NO: 152404 - DNA, 25 bp, Mus musculus
agagcactgaatgactgactgtatc

SEQ ID NO: 152405 - DNA, 25 bp, Mus musculus
agagcactgagtagcctggccttgg

SEQ ID NO: 152406 - DNA, 25 bp, Mus musculus
agagcactgagttgcctggccttgg

SEQ ID NO: 152407 - DNA, 25 bp, Mus musculus
agagcactgcatacagcgtgtcgta

SEQ ID NO: 152408 - DNA, 25 bp, Mus musculus
agagcactgcattcagcgtgtcgta

SEQ ID NO: 152409 - DNA, 25 bp, Mus musculus
agagcactgctaccaacagccagtc

SEQ ID NO: 152410 - DNA, 25 bp, Mus musculus
agagcactgctagcaacagccagtc

SEQ ID NO: 152411 - DNA, 25 bp, Mus musculus
agagcactggcccaatcctgagacc

SEQ ID NO: 152412 - DNA, 25 bp, Mus musculus
agagcactggccgaatcctgagacc

SEQ ID NO: 152413 - DNA, 25 bp, Mus musculus
agagcactgggtagccccttagcat

SEQ ID NO: 152414 - DNA, 25 bp, Mus musculus
agagcactgggttgccccttagcat

SEQ ID NO: 152415 - DNA, 25 bp, Mus musculus
agagcactgtagatttcaaggccca

SEQ ID NO: 152416 - DNA, 25 bp, Mus musculus
agagcactgtagttttcaaggccca

SEQ ID NO: 152417 - DNA, 25 bp, Mus musculus
agagcactgtcacctgccaggcatg

SEQ ID NO: 152418 - DNA, 25 bp, Mus musculus
agagcactgtcagctgccaggcatg

SEQ ID NO: 152419 - DNA, 25 bp, Mus musculus
agagcactgtggatcctaaaagcat

SEQ ID NO: 152420 - DNA, 25 bp, Mus musculus
agagcactgtggttcctaaaagcat

SEQ ID NO: 152421 - DNA, 25 bp, Mus musculus
agagcacttaatccctttgcagagg

SEQ ID NO: 152422 - DNA, 25 bp, Mus musculus
agagcacttaatgcctttgcagagg

SEQ ID NO: 152423 - DNA, 25 bp, Mus musculus
agagcacttcctccccttgtgaggc

SEQ ID NO: 152424 - DNA, 25 bp, Mus musculus
agagcacttcctgcccttgtgaggc

SEQ ID NO: 152425 - DNA, 25 bp, Mus musculus
agagcacttctactttttctccgct

SEQ ID NO: 152426 - DNA, 25 bp, Mus musculus
agagcacttctagtttttctccgct

SEQ ID NO: 152427 - DNA, 25 bp, Mus musculus
agagcacttctcaagtatttgtgaa

SEQ ID NO: 152428 - DNA, 25 bp, Mus musculus
agagcacttctctagtatttgtgaa

SEQ ID NO: 152429 - DNA, 25 bp, Mus musculus
agagcacttgaacaccttccttgaa

SEQ ID NO: 152430 - DNA, 25 bp, Mus musculus
agagcacttgaagaccttccttgaa

SEQ ID NO: 152431 - DNA, 25 bp, Mus musculus
agagcacttgatcccactggagaaa

SEQ ID NO: 152432 - DNA, 25 bp, Mus musculus
agagcacttgatgccactggagaaa

SEQ ID NO: 152433 - DNA, 25 bp, Mus musculus
agagcacttgctaacagcccagaca

SEQ ID NO: 152434 - DNA, 25 bp, Mus musculus
agagcacttgctctttcactgttaa

SEQ ID NO: 152435 - DNA, 25 bp, Mus musculus
agagcacttgctgtttcactgttaa

SEQ ID NO: 152436 - DNA, 25 bp, Mus musculus
agagcacttgcttacagcccagaca

SEQ ID NO: 152437 - DNA, 25 bp, Mus musculus
agagcacttggcaaggatgtgtaaa

SEQ ID NO: 152438 - DNA, 25 bp, Mus musculus
agagcacttggctaggatgtgtaaa

SEQ ID NO: 152439 - DNA, 25 bp, Mus musculus
agagcacttgttactggcagcagca

SEQ ID NO: 152440 - DNA, 25 bp, Mus musculus
agagcacttgtttctggcagcagca

SEQ ID NO: 152441 - DNA, 25 bp, Mus musculus
agagcacttttgacccatttgagaa

SEQ ID NO: 152442 - DNA, 25 bp, Mus musculus
agagcacttttgtcccatttgagaa

SEQ ID NO: 152443 - DNA, 25 bp, Mus musculus
agagcagaactgataggcccctctt

SEQ ID NO: 152444 - DNA, 25 bp, Mus musculus
agagcagaactgttaggcccctctt

SEQ ID NO: 152445 - DNA, 25 bp, Mus musculus
agagcagaagacctagtgaccaccc

SEQ ID NO: 152446 - DNA, 25 bp, Mus musculus
agagcagaagacgtagtgaccaccc

SEQ ID NO: 152447 - DNA, 25 bp, Mus musculus
agagcagaatcactgagccccacgg

SEQ ID NO: 152448 - DNA, 25 bp, Mus musculus
agagcagaatcagtgagccccacgg

SEQ ID NO: 152449 - DNA, 25 bp, Mus musculus
agagcagacaccacatcttggcttt

SEQ ID NO: 152450 - DNA, 25 bp, Mus musculus
agagcagacacctcatcttggcttt

SEQ ID NO: 152451 - DNA, 25 bp, Mus musculus
agagcagaccttcccacagtggtga

SEQ ID NO: 152452 - DNA, 25 bp, Mus musculus
agagcagaccttcgaggccctggaa

SEQ ID NO: 152453 - DNA, 25 bp, Mus musculus
agagcagaccttgccacagtggtga

SEQ ID NO: 152454 - DNA, 25 bp, Mus musculus
agagcagaccttggaggccctggaa

SEQ ID NO: 152455 - DNA, 25 bp, Mus musculus
agagcagactcacaacgatccagga

SEQ ID NO: 152456 - DNA, 25 bp, Mus musculus
agagcagactcagaacgatccagga

SEQ ID NO: 152457 - DNA, 25 bp, Mus musculus
agagcagagaccacttgaaccagct

SEQ ID NO: 152458 - DNA, 25 bp, Mus musculus
agagcagagacctcttgaaccagct

SEQ ID NO: 152459 - DNA, 25 bp, Mus musculus
agagcagagagtccatcttgagaac

SEQ ID NO: 152460 - DNA, 25 bp, Mus musculus
agagcagagagtgcatcttgagaac

SEQ ID NO: 152461 - DNA, 25 bp, Mus musculus
agagcagagcaacggcaagcaagca

SEQ ID NO: 152462 - DNA, 25 bp, Mus musculus
agagcagagcaacgtcgcactgcag

SEQ ID NO: 152463 - DNA, 25 bp, Mus musculus
agagcagagcaagggcaagcaagca

SEQ ID NO: 152464 - DNA, 25 bp, Mus musculus
agagcagagcaaggtcgcactgcag

SEQ ID NO: 152465 - DNA, 25 bp, Mus musculus
agagcagagccccttgtacatcacc

SEQ ID NO: 152466 - DNA, 25 bp, Mus musculus
agagcagagcccgttgtacatcacc

SEQ ID NO: 152467 - DNA, 25 bp, Mus musculus
agagcagagctaaatccggcctcag

SEQ ID NO: 152468 - DNA, 25 bp, Mus musculus
agagcagagctatatccggcctcag

SEQ ID NO: 152469 - DNA, 25 bp, Mus musculus
agagcagagctgaatcaacacctta

SEQ ID NO: 152470 - DNA, 25 bp, Mus musculus
agagcagagctgtatcaacacctta

SEQ ID NO: 152471 - DNA, 25 bp, Mus musculus
agagcagagtccaacccctattgat

SEQ ID NO: 152472 - DNA, 25 bp, Mus musculus
agagcagagtcctacccctattgat

SEQ ID NO: 152473 - DNA, 25 bp, Mus musculus
agagcagcaacaccaaccagatggt

SEQ ID NO: 152474 - DNA, 25 bp, Mus musculus
agagcagcaacagcaaccagatggt

SEQ ID NO: 152475 - DNA, 25 bp, Mus musculus
agagcagcacacacagcctataaaa

SEQ ID NO: 152476 - DNA, 25 bp, Mus musculus
agagcagcacactcagcctataaaa

SEQ ID NO: 152477 - DNA, 25 bp, Mus musculus
agagcagcaccaatttatgcatttg

SEQ ID NO: 152478 - DNA, 25 bp, Mus musculus
agagcagcaccattttatgcatttg

SEQ ID NO: 152479 - DNA, 25 bp, Mus musculus
agagcagcacctccagtgagacata

SEQ ID NO: 152480 - DNA, 25 bp, Mus musculus
agagcagcacctgcagtgagacata

SEQ ID NO: 152481 - DNA, 25 bp, Mus musculus
agagcagcacggcagcaacaatcca

SEQ ID NO: 152482 - DNA, 25 bp, Mus musculus
agagcagcacgggagcaacaatcca

SEQ ID NO: 152483 - DNA, 25 bp, Mus musculus
agagcagcagacaccagccagcaag

SEQ ID NO: 152484 - DNA, 25 bp, Mus musculus
agagcagcagactccagccagcaag

SEQ ID NO: 152485 - DNA, 25 bp, Mus musculus
agagcagcagcaagaagaccacgta

SEQ ID NO: 152486 - DNA, 25 bp, Mus musculus
agagcagcagcatgaagaccacgta

SEQ ID NO: 152487 - DNA, 25 bp, Mus musculus
agagcagcagcgaaggcaaggcccc

SEQ ID NO: 152488 - DNA, 25 bp, Mus musculus
agagcagcagcgtaggcaaggcccc

SEQ ID NO: 152489 - DNA, 25 bp, Mus musculus
agagcagcaggcaaacctcatcaaa

SEQ ID NO: 152490 - DNA, 25 bp, Mus musculus
agagcagcaggcaaaggcccagact

SEQ ID NO: 152491 - DNA, 25 bp, Mus musculus
agagcagcaggcacagaactccttc

SEQ ID NO: 152492 - DNA, 25 bp, Mus musculus
agagcagcaggctaacctcatcaaa

SEQ ID NO: 152493 - DNA, 25 bp, Mus musculus
agagcagcaggctaaggcccagact

SEQ ID NO: 152494 - DNA, 25 bp, Mus musculus
agagcagcaggctcagaactccttc

SEQ ID NO: 152495 - DNA, 25 bp, Mus musculus
agagcagcaggtatgctttcccgcc

SEQ ID NO: 152496 - DNA, 25 bp, Mus musculus
agagcagcaggtttgctttcccgcc

SEQ ID NO: 152497 - DNA, 25 bp, Mus musculus
agagcagcatatacctctagtctct

SEQ ID NO: 152498 - DNA, 25 bp, Mus musculus
agagcagcatattcctctagtctct

SEQ ID NO: 152499 - DNA, 25 bp, Mus musculus
agagcagcatctatgttgctcctgt

SEQ ID NO: 152500 - DNA, 25 bp, Mus musculus
agagcagcatctttgttgctcctgt

SEQ ID NO: 152501 - DNA, 25 bp, Mus musculus
agagcagcatgaagttacctagtaa

SEQ ID NO: 152502 - DNA, 25 bp, Mus musculus
agagcagcatgatgttacctagtaa

SEQ ID NO: 152503 - DNA, 25 bp, Mus musculus
agagcagcatgcagccgctgtagga

SEQ ID NO: 152504 - DNA, 25 bp, Mus musculus
agagcagcatgctgccgctgtagga

SEQ ID NO: 152505 - DNA, 25 bp, Mus musculus
agagcagcattcacagagagaccag

SEQ ID NO: 152506 - DNA, 25 bp, Mus musculus
agagcagcattctcagagagaccag

SEQ ID NO: 152507 - DNA, 25 bp, Mus musculus
agagcagccaccatgttcagattgg

SEQ ID NO: 152508 - DNA, 25 bp, Mus musculus
agagcagccaccttgttcagattgg

SEQ ID NO: 152509 - DNA, 25 bp, Mus musculus
agagcagccaggcttcttaacttcc

SEQ ID NO: 152510 - DNA, 25 bp, Mus musculus
agagcagccagggttcttaacttcc

SEQ ID NO: 152511 - DNA, 25 bp, Mus musculus
agagcagcccagatggcagtcccga

SEQ ID NO: 152512 - DNA, 25 bp, Mus musculus
agagcagcccagttggcagtcccga

SEQ ID NO: 152513 - DNA, 25 bp, Mus musculus
agagcagccccaccattgagcagac

SEQ ID NO: 152514 - DNA, 25 bp, Mus musculus
agagcagccccagcattgagcagac

SEQ ID NO: 152515 - DNA, 25 bp, Mus musculus
agagcagcccttcaggaggagctta

SEQ ID NO: 152516 - DNA, 25 bp, Mus musculus
agagcagcccttgaggaggagctta

SEQ ID NO: 152517 - DNA, 25 bp, Mus musculus
agagcagccgatacctggattgcga

SEQ ID NO: 152518 - DNA, 25 bp, Mus musculus
agagcagccgattcctggattgcga

SEQ ID NO: 152519 - DNA, 25 bp, Mus musculus
agagcagcctaaaaacctgcccttt

SEQ ID NO: 152520 - DNA, 25 bp, Mus musculus
agagcagcctaactcacagtgtcct

SEQ ID NO: 152521 - DNA, 25 bp, Mus musculus
agagcagcctaagtcacagtgtcct

SEQ ID NO: 152522 - DNA, 25 bp, Mus musculus
agagcagcctaataacctgcccttt

SEQ ID NO: 152523 - DNA, 25 bp, Mus musculus
agagcagcctcactctagccaggct

SEQ ID NO: 152524 - DNA, 25 bp, Mus musculus
agagcagcctcagtctagccaggct

SEQ ID NO: 152525 - DNA, 25 bp, Mus musculus
agagcagcctccagcgtggtatacc

SEQ ID NO: 152526 - DNA, 25 bp, Mus musculus
agagcagcctcctgcgtggtatacc

SEQ ID NO: 152527 - DNA, 25 bp, Mus musculus
agagcagcctctattcttcatggag

SEQ ID NO: 152528 - DNA, 25 bp, Mus musculus
agagcagcctcttttcttcatggag

SEQ ID NO: 152529 - DNA, 25 bp, Mus musculus
agagcagcctgtacaccgtgagcag

SEQ ID NO: 152530 - DNA, 25 bp, Mus musculus
agagcagcctgtacagcatacccga

SEQ ID NO: 152531 - DNA, 25 bp, Mus musculus
agagcagcctgttcaccgtgagcag

SEQ ID NO: 152532 - DNA, 25 bp, Mus musculus
agagcagcctgttcagcatacccga

SEQ ID NO: 152533 - DNA, 25 bp, Mus musculus
agagcagccttgagccaggagtact

SEQ ID NO: 152534 - DNA, 25 bp, Mus musculus
agagcagccttgagtgcactctctc

SEQ ID NO: 152535 - DNA, 25 bp, Mus musculus
agagcagccttgtgccaggagtact

SEQ ID NO: 152536 - DNA, 25 bp, Mus musculus
agagcagccttgtgtgcactctctc

SEQ ID NO: 152537 - DNA, 25 bp, Mus musculus
agagcagcgctgataacaccttccg

SEQ ID NO: 152538 - DNA, 25 bp, Mus musculus
agagcagcgctgttaacaccttccg

SEQ ID NO: 152539 - DNA, 25 bp, Mus musculus
agagcagcgcttatcttgcctttga

SEQ ID NO: 152540 - DNA, 25 bp, Mus musculus
agagcagcgcttttcttgcctttga

SEQ ID NO: 152541 - DNA, 25 bp, Mus musculus
agagcagcgtgtacaaggtcagccg

SEQ ID NO: 152542 - DNA, 25 bp, Mus musculus
agagcagcgtgttcaaggtcagccg

SEQ ID NO: 152543 - DNA, 25 bp, Mus musculus
agagcagcgtttaaggcctgcctta

SEQ ID NO: 152544 - DNA, 25 bp, Mus musculus
agagcagcgttttaggcctgcctta

SEQ ID NO: 152545 - DNA, 25 bp, Mus musculus
agagcagctagaagcgtggtctgaa

SEQ ID NO: 152546 - DNA, 25 bp, Mus musculus
agagcagctagatgcgtggtctgaa

SEQ ID NO: 152547 - DNA, 25 bp, Mus musculus
agagcagctaggacagccaagccct

SEQ ID NO: 152548 - DNA, 25 bp, Mus musculus
agagcagctaggtcagccaagccct

SEQ ID NO: 152549 - DNA, 25 bp, Mus musculus
agagcagctcaaagcagtggcccat

SEQ ID NO: 152550 - DNA, 25 bp, Mus musculus
agagcagctcaatgcagtggcccat

SEQ ID NO: 152551 - DNA, 25 bp, Mus musculus
agagcagctcaccttgagtttgcag

SEQ ID NO: 152552 - DNA, 25 bp, Mus musculus
agagcagctcacgttgagtttgcag

SEQ ID NO: 152553 - DNA, 25 bp, Mus musculus
agagcagctccaacatttttagaaa

SEQ ID NO: 152554 - DNA, 25 bp, Mus musculus
agagcagctccatcatttttagaaa

SEQ ID NO: 152555 - DNA, 25 bp, Mus musculus
agagcagctctcacacattctgcag

SEQ ID NO: 152556 - DNA, 25 bp, Mus musculus
agagcagctctctcacattctgcag

SEQ ID NO: 152557 - DNA, 25 bp, Mus musculus
agagcagctgaaccggttgtaccag

SEQ ID NO: 152558 - DNA, 25 bp, Mus musculus
agagcagctgaacgccacgggattc

SEQ ID NO: 152559 - DNA, 25 bp, Mus musculus
agagcagctgaagcggttgtaccag

SEQ ID NO: 152560 - DNA, 25 bp, Mus musculus
agagcagctgaaggccacgggattc

SEQ ID NO: 152561 - DNA, 25 bp, Mus musculus
agagcagctgccagctttccagtct

SEQ ID NO: 152562 - DNA, 25 bp, Mus musculus
agagcagctgcctgctttccagtct

SEQ ID NO: 152563 - DNA, 25 bp, Mus musculus
agagcagctggtctctgagctcaga

SEQ ID NO: 152564 - DNA, 25 bp, Mus musculus
agagcagctggtgtctgagctcaga

SEQ ID NO: 152565 - DNA, 25 bp, Mus musculus
agagcagctgtgacgtcaccctgga

SEQ ID NO: 152566 - DNA, 25 bp, Mus musculus
agagcagctgtgtcgtcaccctgga

SEQ ID NO: 152567 - DNA, 25 bp, Mus musculus
agagcagcttccaagagcctgtctc

SEQ ID NO: 152568 - DNA, 25 bp, Mus musculus
agagcagcttcctagagcctgtctc

SEQ ID NO: 152569 - DNA, 25 bp, Mus musculus
agagcagctttgactggtagcagca

SEQ ID NO: 152570 - DNA, 25 bp, Mus musculus
agagcagctttgtctggtagcagca

SEQ ID NO: 152571 - DNA, 25 bp, Mus musculus
agagcaggacatacgccacagcatt

SEQ ID NO: 152572 - DNA, 25 bp, Mus musculus
agagcaggacattcgccacagcatt

SEQ ID NO: 152573 - DNA, 25 bp, Mus musculus
agagcaggacctcatctccaatggc

SEQ ID NO: 152574 - DNA, 25 bp, Mus musculus
agagcaggacctgatctccaatggc

SEQ ID NO: 152575 - DNA, 25 bp, Mus musculus
agagcaggagagatcccaggacctc

SEQ ID NO: 152576 - DNA, 25 bp, Mus musculus
agagcaggagagctgtccctgtccc

SEQ ID NO: 152577 - DNA, 25 bp, Mus musculus
agagcaggagaggtgtccctgtccc

SEQ ID NO: 152578 - DNA, 25 bp, Mus musculus
agagcaggagagttcccaggacctc

SEQ ID NO: 152579 - DNA, 25 bp, Mus musculus
agagcaggagatctcctctctttgc

SEQ ID NO: 152580 - DNA, 25 bp, Mus musculus
agagcaggagatgtcctctctttgc

SEQ ID NO: 152581 - DNA, 25 bp, Mus musculus
agagcaggagcacccagactattac

SEQ ID NO: 152582 - DNA, 25 bp, Mus musculus
agagcaggagcagccagactattac

SEQ ID NO: 152583 - DNA, 25 bp, Mus musculus
agagcaggaggacgtcctaccagaa

SEQ ID NO: 152584 - DNA, 25 bp, Mus musculus
agagcaggaggaggtcctaccagaa

SEQ ID NO: 152585 - DNA, 25 bp, Mus musculus
agagcaggcacacagctccagggct

SEQ ID NO: 152586 - DNA, 25 bp, Mus musculus
agagcaggcacagagctccagggct

SEQ ID NO: 152587 - DNA, 25 bp, Mus musculus
agagcaggcagcatacatactagag

SEQ ID NO: 152588 - DNA, 25 bp, Mus musculus
agagcaggcagcttacatactagag

SEQ ID NO: 152589 - DNA, 25 bp, Mus musculus
agagcaggcagtcgcttatccaaac

SEQ ID NO: 152590 - DNA, 25 bp, Mus musculus
agagcaggcagtggcttatccaaac

SEQ ID NO: 152591 - DNA, 25 bp, Mus musculus
agagcaggccatcgaaagtcctccc

SEQ ID NO: 152592 - DNA, 25 bp, Mus musculus
agagcaggccatggaaagtcctccc

SEQ ID NO: 152593 - DNA, 25 bp, Mus musculus
agagcaggcccacgtgcctagactt

SEQ ID NO: 152594 - DNA, 25 bp, Mus musculus
agagcaggcccaggtgcctagactt

SEQ ID NO: 152595 - DNA, 25 bp, Mus musculus
agagcaggccgtatgggactccagc

SEQ ID NO: 152596 - DNA, 25 bp, Mus musculus
agagcaggccgtttgggactccagc

SEQ ID NO: 152597 - DNA, 25 bp, Mus musculus
agagcaggccttagcccagggtcac

SEQ ID NO: 152598 - DNA, 25 bp, Mus musculus
agagcaggcctttgcccagggtcac

SEQ ID NO: 152599 - DNA, 25 bp, Mus musculus
agagcaggcgtcagcaagcagactg

SEQ ID NO: 152600 - DNA, 25 bp, Mus musculus
agagcaggcgtctgcaagcagactg

SEQ ID NO: 152601 - DNA, 25 bp, Mus musculus
agagcaggcgttccttactcagagg

SEQ ID NO: 152602 - DNA, 25 bp, Mus musculus
agagcaggcgttgcttactcagagg

SEQ ID NO: 152603 - DNA, 25 bp, Mus musculus
agagcaggctctcgcatccaaacag

SEQ ID NO: 152604 - DNA, 25 bp, Mus musculus
agagcaggctctggcatccaaacag

SEQ ID NO: 152605 - DNA, 25 bp, Mus musculus
agagcaggcttcaagaactcaccgc

SEQ ID NO: 152606 - DNA, 25 bp, Mus musculus
agagcaggcttctagaactcaccgc

SEQ ID NO: 152607 - DNA, 25 bp, Mus musculus
agagcagggacaatgttttctgtat

SEQ ID NO: 152608 - DNA, 25 bp, Mus musculus
agagcagggacattgttttctgtat

SEQ ID NO: 152609 - DNA, 25 bp, Mus musculus
agagcagggcacctttcatgcagca

SEQ ID NO: 152610 - DNA, 25 bp, Mus musculus
agagcagggcacgtttcatgcagca

SEQ ID NO: 152611 - DNA, 25 bp, Mus musculus
agagcagggcatattaaccctccct

SEQ ID NO: 152612 - DNA, 25 bp, Mus musculus
agagcagggcattttaaccctccct

SEQ ID NO: 152613 - DNA, 25 bp, Mus musculus
agagcagggccaactcaggctagca

SEQ ID NO: 152614 - DNA, 25 bp, Mus musculus
agagcagggccatctcaggctagca

SEQ ID NO: 152615 - DNA, 25 bp, Mus musculus
agagcaggtagccactggctcttgt

SEQ ID NO: 152616 - DNA, 25 bp, Mus musculus
agagcaggtagcgactggctcttgt

SEQ ID NO: 152617 - DNA, 25 bp, Mus musculus
agagcaggtcagatttattttatgt

SEQ ID NO: 152618 - DNA, 25 bp, Mus musculus
agagcaggtcagttttattttatgt

SEQ ID NO: 152619 - DNA, 25 bp, Mus musculus
agagcaggtctgattctcggtgtaa

SEQ ID NO: 152620 - DNA, 25 bp, Mus musculus
agagcaggtctgctttacctttctt

SEQ ID NO: 152621 - DNA, 25 bp, Mus musculus
agagcaggtctggtttacctttctt

SEQ ID NO: 152622 - DNA, 25 bp, Mus musculus
agagcaggtctgtttctcggtgtaa

SEQ ID NO: 152623 - DNA, 25 bp, Mus musculus
agagcaggtgatccgccataggcct

SEQ ID NO: 152624 - DNA, 25 bp, Mus musculus
agagcaggtgatgcgccataggcct

SEQ ID NO: 152625 - DNA, 25 bp, Mus musculus
agagcaggtgctctgcattttccag

SEQ ID NO: 152626 - DNA, 25 bp, Mus musculus
agagcaggtgctgtgcattttccag

SEQ ID NO: 152627 - DNA, 25 bp, Mus musculus
agagcaggtggcagcctttcccaga

SEQ ID NO: 152628 - DNA, 25 bp, Mus musculus
agagcaggtggctgcctttcccaga

SEQ ID NO: 152629 - DNA, 25 bp, Mus musculus
agagcaggttccatattcgttcggc

SEQ ID NO: 152630 - DNA, 25 bp, Mus musculus
agagcaggttccttattcgttcggc

SEQ ID NO: 152631 - DNA, 25 bp, Mus musculus
agagcagtcaagatcctttcttgga

SEQ ID NO: 152632 - DNA, 25 bp, Mus musculus
agagcagtcaagttcctttcttgga

SEQ ID NO: 152633 - DNA, 25 bp, Mus musculus
agagcagtcaatcccctcttatcca

SEQ ID NO: 152634 - DNA, 25 bp, Mus musculus
agagcagtcaatgccctcttatcca

SEQ ID NO: 152635 - DNA, 25 bp, Mus musculus
agagcagtcacacttccttggtttt

SEQ ID NO: 152636 - DNA, 25 bp, Mus musculus
agagcagtcacagttccttggtttt

SEQ ID NO: 152637 - DNA, 25 bp, Mus musculus
agagcagtcactaatgtccccatga

SEQ ID NO: 152638 - DNA, 25 bp, Mus musculus
agagcagtcactatctgatccttct

SEQ ID NO: 152639 - DNA, 25 bp, Mus musculus
agagcagtcactcagcagtgctgcc

SEQ ID NO: 152640 - DNA, 25 bp, Mus musculus
agagcagtcactgagcagtgctgcc

SEQ ID NO: 152641 - DNA, 25 bp, Mus musculus
agagcagtcacttatgtccccatga

SEQ ID NO: 152642 - DNA, 25 bp, Mus musculus
agagcagtcactttctgatccttct

SEQ ID NO: 152643 - DNA, 25 bp, Mus musculus
agagcagtcagtatgacctgagtaa

SEQ ID NO: 152644 - DNA, 25 bp, Mus musculus
agagcagtcagtttgacctgagtaa

SEQ ID NO: 152645 - DNA, 25 bp, Mus musculus
agagcagtccaaactcatgctggta

SEQ ID NO: 152646 - DNA, 25 bp, Mus musculus
agagcagtccaatctcatgctggta

SEQ ID NO: 152647 - DNA, 25 bp, Mus musculus
agagcagtcccgatttctatcagac

SEQ ID NO: 152648 - DNA, 25 bp, Mus musculus
agagcagtcccgttttctatcagac

SEQ ID NO: 152649 - DNA, 25 bp, Mus musculus
agagcagtccttaccaagaggaaca

SEQ ID NO: 152650 - DNA, 25 bp, Mus musculus
agagcagtcctttccaagaggaaca

SEQ ID NO: 152651 - DNA, 25 bp, Mus musculus
agagcagtctgcacagcccttcttg

SEQ ID NO: 152652 - DNA, 25 bp, Mus musculus
agagcagtctgctcagcccttcttg

SEQ ID NO: 152653 - DNA, 25 bp, Mus musculus
agagcagtgattccctacacgttca

SEQ ID NO: 152654 - DNA, 25 bp, Mus musculus
agagcagtgattgcctacacgttca

SEQ ID NO: 152655 - DNA, 25 bp, Mus musculus
agagcagtgccgagtgaccctggct

SEQ ID NO: 152656 - DNA, 25 bp, Mus musculus
agagcagtgccgtgtgaccctggct

SEQ ID NO: 152657 - DNA, 25 bp, Mus musculus
agagcagtgcgtctagtaaatcgaa

SEQ ID NO: 152658 - DNA, 25 bp, Mus musculus
agagcagtgcgtgtagtaaatcgaa

SEQ ID NO: 152659 - DNA, 25 bp, Mus musculus
agagcagtggccaaaccagtgaggc

SEQ ID NO: 152660 - DNA, 25 bp, Mus musculus
agagcagtggcctaaccagtgaggc

SEQ ID NO: 152661 - DNA, 25 bp, Mus musculus
agagcagtggcgcacaggcccacac

SEQ ID NO: 152662 - DNA, 25 bp, Mus musculus
agagcagtggcggacaggcccacac

SEQ ID NO: 152663 - DNA, 25 bp, Mus musculus
agagcagtgggtcgcttccaatcca

SEQ ID NO: 152664 - DNA, 25 bp, Mus musculus
agagcagtgggtggcttccaatcca

SEQ ID NO: 152665 - DNA, 25 bp, Mus musculus
agagcagtgtcacaccatcctttgg

SEQ ID NO: 152666 - DNA, 25 bp, Mus musculus
agagcagtgtcagaccatcctttgg

SEQ ID NO: 152667 - DNA, 25 bp, Mus musculus
agagcagtgtccctctattgtccgc

SEQ ID NO: 152668 - DNA, 25 bp, Mus musculus
agagcagtgtccgtctattgtccgc

SEQ ID NO: 152669 - DNA, 25 bp, Mus musculus
agagcagtgtggagtccttgcccag

SEQ ID NO: 152670 - DNA, 25 bp, Mus musculus
agagcagtgtggtgtccttgcccag

SEQ ID NO: 152671 - DNA, 25 bp, Mus musculus
agagcagttcttcctggtaggacca

SEQ ID NO: 152672 - DNA, 25 bp, Mus musculus
agagcagttcttgctggtaggacca

SEQ ID NO: 152673 - DNA, 25 bp, Mus musculus
agagcagttgacacctgggtcctta

SEQ ID NO: 152674 - DNA, 25 bp, Mus musculus
agagcagttgactcctgggtcctta

SEQ ID NO: 152675 - DNA, 25 bp, Mus musculus
agagcagttggcctggtgaactgta

SEQ ID NO: 152676 - DNA, 25 bp, Mus musculus
agagcagttggcgtggtgaactgta

SEQ ID NO: 152677 - DNA, 25 bp, Mus musculus
agagcagtttcgatttctcagtcgg

SEQ ID NO: 152678 - DNA, 25 bp, Mus musculus
agagcagtttcgttttctcagtcgg

SEQ ID NO: 152679 - DNA, 25 bp, Mus musculus
agagcataccgcacttccggagggt

SEQ ID NO: 152680 - DNA, 25 bp, Mus musculus
agagcataccgctcttccggagggt

SEQ ID NO: 152681 - DNA, 25 bp, Mus musculus
agagcatactctcccacttctagca

SEQ ID NO: 152682 - DNA, 25 bp, Mus musculus
agagcatactctgccacttctagca

SEQ ID NO: 152683 - DNA, 25 bp, Mus musculus
agagcatatcagactgtctccttct

SEQ ID NO: 152684 - DNA, 25 bp, Mus musculus
agagcatatcagtctgtctccttct

SEQ ID NO: 152685 - DNA, 25 bp, Mus musculus
agagcatatcttacagtacccattg

SEQ ID NO: 152686 - DNA, 25 bp, Mus musculus
agagcatatctttcagtacccattg

SEQ ID NO: 152687 - DNA, 25 bp, Mus musculus
agagcatatggtaatctggaagtcc

SEQ ID NO: 152688 - DNA, 25 bp, Mus musculus
agagcatatggttatctggaagtcc

SEQ ID NO: 152689 - DNA, 25 bp, Mus musculus
agagcatcaagtctttgccacgatc

SEQ ID NO: 152690 - DNA, 25 bp, Mus musculus
agagcatcaagtgtttgccacgatc

SEQ ID NO: 152691 - DNA, 25 bp, Mus musculus
agagcatcacggctgatgacctcca

SEQ ID NO: 152692 - DNA, 25 bp, Mus musculus
agagcatcacgggtgatgacctcca

SEQ ID NO: 152693 - DNA, 25 bp, Mus musculus
agagcatcagctcaggctacagata

SEQ ID NO: 152694 - DNA, 25 bp, Mus musculus
agagcatcagctccttacaagccac

SEQ ID NO: 152695 - DNA, 25 bp, Mus musculus
agagcatcagctgaggctacagata

SEQ ID NO: 152696 - DNA, 25 bp, Mus musculus
agagcatcagctgcttacaagccac

SEQ ID NO: 152697 - DNA, 25 bp, Mus musculus
agagcatcatccaggccaacagcat

SEQ ID NO: 152698 - DNA, 25 bp, Mus musculus
agagcatcatcctggccaacagcat

SEQ ID NO: 152699 - DNA, 25 bp, Mus musculus
agagcatcatctcacagtgcatggt

SEQ ID NO: 152700 - DNA, 25 bp, Mus musculus
agagcatcatctgacagtgcatggt

SEQ ID NO: 152701 - DNA, 25 bp, Mus musculus
agagcatcatgtccgcttaactact

SEQ ID NO: 152702 - DNA, 25 bp, Mus musculus
agagcatcatgtgcgcttaactact

SEQ ID NO: 152703 - DNA, 25 bp, Mus musculus
agagcatcccacaatgctgctggat

SEQ ID NO: 152704 - DNA, 25 bp, Mus musculus
agagcatcccacctgagcgctcaat

SEQ ID NO: 152705 - DNA, 25 bp, Mus musculus
agagcatcccacgtgagcgctcaat

SEQ ID NO: 152706 - DNA, 25 bp, Mus musculus
agagcatcccactatgctgctggat

SEQ ID NO: 152707 - DNA, 25 bp, Mus musculus
agagcatcccggacttggcagctga

SEQ ID NO: 152708 - DNA, 25 bp, Mus musculus
agagcatcccggtcttggcagctga

SEQ ID NO: 152709 - DNA, 25 bp, Mus musculus
agagcatccgctacttggtaccgga

SEQ ID NO: 152710 - DNA, 25 bp, Mus musculus
agagcatccgcttcttggtaccgga

SEQ ID NO: 152711 - DNA, 25 bp, Mus musculus
agagcatcctcccaaggtgtgacaa

SEQ ID NO: 152712 - DNA, 25 bp, Mus musculus
agagcatcctccgaaggtgtgacaa

SEQ ID NO: 152713 - DNA, 25 bp, Mus musculus
agagcatcctgcagtttgtgttcac

SEQ ID NO: 152714 - DNA, 25 bp, Mus musculus
agagcatcctgctgtttgtgttcac

SEQ ID NO: 152715 - DNA, 25 bp, Mus musculus
agagcatcctggagctggcacaaca

SEQ ID NO: 152716 - DNA, 25 bp, Mus musculus
agagcatcctggtgctggcacaaca

SEQ ID NO: 152717 - DNA, 25 bp, Mus musculus
agagcatccttcagcacctggagtt

SEQ ID NO: 152718 - DNA, 25 bp, Mus musculus
agagcatccttctgcacctggagtt

SEQ ID NO: 152719 - DNA, 25 bp, Mus musculus
agagcatctactaactattcctttc

SEQ ID NO: 152720 - DNA, 25 bp, Mus musculus
agagcatctacttactattcctttc

SEQ ID NO: 152721 - DNA, 25 bp, Mus musculus
agagcatctcaacaagcaccagggc

SEQ ID NO: 152722 - DNA, 25 bp, Mus musculus
agagcatctcaagaagcaccagggc

SEQ ID NO: 152723 - DNA, 25 bp, Mus musculus
agagcatctcacaaaaggcagcata

SEQ ID NO: 152724 - DNA, 25 bp, Mus musculus
agagcatctcactaaaggcagcata

SEQ ID NO: 152725 - DNA, 25 bp, Mus musculus
agagcatctccaaggtctcaacttg

SEQ ID NO: 152726 - DNA, 25 bp, Mus musculus
agagcatctccatggtctcaacttg

SEQ ID NO: 152727 - DNA, 25 bp, Mus musculus
agagcatctcctactttgtagctgc

SEQ ID NO: 152728 - DNA, 25 bp, Mus musculus
agagcatctccttctttgtagctgc

SEQ ID NO: 152729 - DNA, 25 bp, Mus musculus
agagcatctgagaccccggtggaaa

SEQ ID NO: 152730 - DNA, 25 bp, Mus musculus
agagcatctgagtccccggtggaaa

SEQ ID NO: 152731 - DNA, 25 bp, Mus musculus
agagcatctgccctcgtcttctgga

SEQ ID NO: 152732 - DNA, 25 bp, Mus musculus
agagcatctgccgtcgtcttctgga

SEQ ID NO: 152733 - DNA, 25 bp, Mus musculus
agagcatctgcgctcctattgtgtg

SEQ ID NO: 152734 - DNA, 25 bp, Mus musculus
agagcatctgcggtcctattgtgtg

SEQ ID NO: 152735 - DNA, 25 bp, Mus musculus
agagcatctgtgaagaagtggacca

SEQ ID NO: 152736 - DNA, 25 bp, Mus musculus
agagcatctgtgtagaagtggacca

SEQ ID NO: 152737 - DNA, 25 bp, Mus musculus
agagcatcttccagtggttgggcta

SEQ ID NO: 152738 - DNA, 25 bp, Mus musculus
agagcatcttccataacacattaca

SEQ ID NO: 152739 - DNA, 25 bp, Mus musculus
agagcatcttcctgtggttgggcta

SEQ ID NO: 152740 - DNA, 25 bp, Mus musculus
agagcatcttccttaacacattaca

SEQ ID NO: 152741 - DNA, 25 bp, Mus musculus
agagcatctttcaaatccacacagc

SEQ ID NO: 152742 - DNA, 25 bp, Mus musculus
agagcatctttctaatccacacagc

SEQ ID NO: 152743 - DNA, 25 bp, Mus musculus
agagcatgagtcacagagtctctca

SEQ ID NO: 152744 - DNA, 25 bp, Mus musculus
agagcatgagtctcagagtctctca

SEQ ID NO: 152745 - DNA, 25 bp, Mus musculus
agagcatgcaaacgcccgcgtagat

SEQ ID NO: 152746 - DNA, 25 bp, Mus musculus
agagcatgcaaaggcccgcgtagat

SEQ ID NO: 152747 - DNA, 25 bp, Mus musculus
agagcatgcacacccagatgacaga

SEQ ID NO: 152748 - DNA, 25 bp, Mus musculus
agagcatgcacagccagatgacaga

SEQ ID NO: 152749 - DNA, 25 bp, Mus musculus
agagcatgccaacgtccgtaggtca

SEQ ID NO: 152750 - DNA, 25 bp, Mus musculus
agagcatgccaaggtccgtaggtca

SEQ ID NO: 152751 - DNA, 25 bp, Mus musculus
agagcatgccagaggctagtctcca

SEQ ID NO: 152752 - DNA, 25 bp, Mus musculus
agagcatgccagtggctagtctcca

SEQ ID NO: 152753 - DNA, 25 bp, Mus musculus
agagcatgcctgattgctgggttgc

SEQ ID NO: 152754 - DNA, 25 bp, Mus musculus
agagcatgcctgtttgctgggttgc

SEQ ID NO: 152755 - DNA, 25 bp, Mus musculus
agagcatgcgtacattttactgttc

SEQ ID NO: 152756 - DNA, 25 bp, Mus musculus
agagcatgcgtagattttactgttc

SEQ ID NO: 152757 - DNA, 25 bp, Mus musculus
agagcatgctctatcactacggtag

SEQ ID NO: 152758 - DNA, 25 bp, Mus musculus
agagcatgctctttcactacggtag

SEQ ID NO: 152759 - DNA, 25 bp, Mus musculus
agagcatgcttacggtctccaatag

SEQ ID NO: 152760 - DNA, 25 bp, Mus musculus
agagcatgcttagggtctccaatag

SEQ ID NO: 152761 - DNA, 25 bp, Mus musculus
agagcatgctttatgccaggtcgta

SEQ ID NO: 152762 - DNA, 25 bp, Mus musculus
agagcatgctttttgccaggtcgta

SEQ ID NO: 152763 - DNA, 25 bp, Mus musculus
agagcatggatgatgccaggcacgt

SEQ ID NO: 152764 - DNA, 25 bp, Mus musculus
agagcatggatgttgccaggcacgt

SEQ ID NO: 152765 - DNA, 25 bp, Mus musculus
agagcatggcccagggtacatttgg

SEQ ID NO: 152766 - DNA, 25 bp, Mus musculus
agagcatggccctgggtacatttgg

SEQ ID NO: 152767 - DNA, 25 bp, Mus musculus
agagcatggctcagttctcattgac

SEQ ID NO: 152768 - DNA, 25 bp, Mus musculus
agagcatggctctgttctcattgac

SEQ ID NO: 152769 - DNA, 25 bp, Mus musculus
agagcatgggccagatttcccctgg

SEQ ID NO: 152770 - DNA, 25 bp, Mus musculus
agagcatgggcctgatttcccctgg

SEQ ID NO: 152771 - DNA, 25 bp, Mus musculus
agagcatgggctctactgtcacggt

SEQ ID NO: 152772 - DNA, 25 bp, Mus musculus
agagcatgggctgtactgtcacggt

SEQ ID NO: 152773 - DNA, 25 bp, Mus musculus
agagcatgggtcatctgacagcccc

SEQ ID NO: 152774 - DNA, 25 bp, Mus musculus
agagcatgggtcttctgacagcccc

SEQ ID NO: 152775 - DNA, 25 bp, Mus musculus
agagcatggttgactcactgaccta

SEQ ID NO: 152776 - DNA, 25 bp, Mus musculus
agagcatggttgtctcactgaccta

SEQ ID NO: 152777 - DNA, 25 bp, Mus musculus
agagcatgtatcagttttcccctac

SEQ ID NO: 152778 - DNA, 25 bp, Mus musculus
agagcatgtatctgttttcccctac

SEQ ID NO: 152779 - DNA, 25 bp, Mus musculus
agagcatgtcatacatatttcacag

SEQ ID NO: 152780 - DNA, 25 bp, Mus musculus
agagcatgtcattcatatttcacag

SEQ ID NO: 152781 - DNA, 25 bp, Mus musculus
agagcatgtcccagggcagtttcag

SEQ ID NO: 152782 - DNA, 25 bp, Mus musculus
agagcatgtccctgggcagtttcag

SEQ ID NO: 152783 - DNA, 25 bp, Mus musculus
agagcatgtgggaagcctgtccctg

SEQ ID NO: 152784 - DNA, 25 bp, Mus musculus
agagcatgtgggtagcctgtccctg

SEQ ID NO: 152785 - DNA, 25 bp, Mus musculus
agagcatgttcaatccatccgacct

SEQ ID NO: 152786 - DNA, 25 bp, Mus musculus
agagcatgttcattccatccgacct

SEQ ID NO: 152787 - DNA, 25 bp, Mus musculus
agagcatgttttaagactttcctgt

SEQ ID NO: 152788 - DNA, 25 bp, Mus musculus
agagcatgtttttagactttcctgt

SEQ ID NO: 152789 - DNA, 25 bp, Mus musculus
agagcattaaaaactcaggtaagta

SEQ ID NO: 152790 - DNA, 25 bp, Mus musculus
agagcattaaaatctcaggtaagta

SEQ ID NO: 152791 - DNA, 25 bp, Mus musculus
agagcattagctctcatcattgtga

SEQ ID NO: 152792 - DNA, 25 bp, Mus musculus
agagcattagctgtcatcattgtga

SEQ ID NO: 152793 - DNA, 25 bp, Mus musculus
agagcattcaaactgtttttcatca

SEQ ID NO: 152794 - DNA, 25 bp, Mus musculus
agagcattcaaagtgtttttcatca

SEQ ID NO: 152795 - DNA, 25 bp, Mus musculus
agagcattcacccttattagttggt

SEQ ID NO: 152796 - DNA, 25 bp, Mus musculus
agagcattcaccgttattagttggt

SEQ ID NO: 152797 - DNA, 25 bp, Mus musculus
agagcattcagaccatcagttcact

SEQ ID NO: 152798 - DNA, 25 bp, Mus musculus
agagcattcagagcatcagttcact

SEQ ID NO: 152799 - DNA, 25 bp, Mus musculus
agagcattcagccagcgctgcttca

SEQ ID NO: 152800 - DNA, 25 bp, Mus musculus
agagcattcagcgagcgctgcttca

SEQ ID NO: 152801 - DNA, 25 bp, Mus musculus
agagcattccctctagcggcagcgt

SEQ ID NO: 152802 - DNA, 25 bp, Mus musculus
agagcattccctgtagcggcagcgt

SEQ ID NO: 152803 - DNA, 25 bp, Mus musculus
agagcattcctgagcctttctaatt

SEQ ID NO: 152804 - DNA, 25 bp, Mus musculus
agagcattcctgtgcctttctaatt

SEQ ID NO: 152805 - DNA, 25 bp, Mus musculus
agagcattcggcagggctgttgtca

SEQ ID NO: 152806 - DNA, 25 bp, Mus musculus
agagcattcggctgggctgttgtca

SEQ ID NO: 152807 - DNA, 25 bp, Mus musculus
agagcattctagaactgacctgtct

SEQ ID NO: 152808 - DNA, 25 bp, Mus musculus
agagcattctagtactgacctgtct

SEQ ID NO: 152809 - DNA, 25 bp, Mus musculus
agagcattctggactgagctgagca

SEQ ID NO: 152810 - DNA, 25 bp, Mus musculus
agagcattctggtctgagctgagca

SEQ ID NO: 152811 - DNA, 25 bp, Mus musculus
agagcattctttccaaacccaggtt

SEQ ID NO: 152812 - DNA, 25 bp, Mus musculus
agagcattctttgcaaacccaggtt

SEQ ID NO: 152813 - DNA, 25 bp, Mus musculus
agagcattgactcctgactcttaac

SEQ ID NO: 152814 - DNA, 25 bp, Mus musculus
agagcattgactgctgactcttaac

SEQ ID NO: 152815 - DNA, 25 bp, Mus musculus
agagcattgcaaactcccaaaagaa

SEQ ID NO: 152816 - DNA, 25 bp, Mus musculus
agagcattgcaatctcccaaaagaa

SEQ ID NO: 152817 - DNA, 25 bp, Mus musculus
agagcattgcagcactatgactggg

SEQ ID NO: 152818 - DNA, 25 bp, Mus musculus
agagcattgcaggactatgactggg

SEQ ID NO: 152819 - DNA, 25 bp, Mus musculus
agagcattgcgtacctttgaccaag

SEQ ID NO: 152820 - DNA, 25 bp, Mus musculus
agagcattgcgttcctttgaccaag

SEQ ID NO: 152821 - DNA, 25 bp, Mus musculus
agagcattggagattgtgtacatat

SEQ ID NO: 152822 - DNA, 25 bp, Mus musculus
agagcattggagtttgtgtacatat

SEQ ID NO: 152823 - DNA, 25 bp, Mus musculus
agagcattggccacacggtctacag

SEQ ID NO: 152824 - DNA, 25 bp, Mus musculus
agagcattggcctcacggtctacag

SEQ ID NO: 152825 - DNA, 25 bp, Mus musculus
agagcattgggcattcctgtaccca

SEQ ID NO: 152826 - DNA, 25 bp, Mus musculus
agagcattgggccagtgctggcaca

SEQ ID NO: 152827 - DNA, 25 bp, Mus musculus
agagcattgggcgagtgctggcaca

SEQ ID NO: 152828 - DNA, 25 bp, Mus musculus
agagcattgggctttcctgtaccca

SEQ ID NO: 152829 - DNA, 25 bp, Mus musculus
agagcattgtccaccatggagccac

SEQ ID NO: 152830 - DNA, 25 bp, Mus musculus
agagcattgtcctccatggagccac

SEQ ID NO: 152831 - DNA, 25 bp, Mus musculus
agagcattgttcattgtaccttgaa

SEQ ID NO: 152832 - DNA, 25 bp, Mus musculus
agagcattgttctttgtaccttgaa

SEQ ID NO: 152833 - DNA, 25 bp, Mus musculus
agagcattgtttagcctcgtctttc

SEQ ID NO: 152834 - DNA, 25 bp, Mus musculus
agagcattgtttccattaaaatcag

SEQ ID NO: 152835 - DNA, 25 bp, Mus musculus
agagcattgtttgcattaaaatcag

SEQ ID NO: 152836 - DNA, 25 bp, Mus musculus
agagcattgttttgcctcgtctttc

SEQ ID NO: 152837 - DNA, 25 bp, Mus musculus
agagcatttaagctctgtctaagac

SEQ ID NO: 152838 - DNA, 25 bp, Mus musculus
agagcatttaaggtctgtctaagac

SEQ ID NO: 152839 - DNA, 25 bp, Mus musculus
agagcatttcgcaggtgtcctttca

SEQ ID NO: 152840 - DNA, 25 bp, Mus musculus
agagcatttcgctggtgtcctttca

SEQ ID NO: 152841 - DNA, 25 bp, Mus musculus
agagcatttgcaacctgtgagaaga

SEQ ID NO: 152842 - DNA, 25 bp, Mus musculus
agagcatttgcatcctgtgagaaga

SEQ ID NO: 152843 - DNA, 25 bp, Mus musculus
agagcatttgccacgtcgacaacgt

SEQ ID NO: 152844 - DNA, 25 bp, Mus musculus
agagcatttgcctcgtcgacaacgt

SEQ ID NO: 152845 - DNA, 25 bp, Mus musculus
agagcatttgttcccattgtcgagc

SEQ ID NO: 152846 - DNA, 25 bp, Mus musculus
agagcatttgttgccattgtcgagc

SEQ ID NO: 152847 - DNA, 25 bp, Mus musculus
agagcatttttaatgggcctcacaa

SEQ ID NO: 152848 - DNA, 25 bp, Mus musculus
agagcatttttattgggcctcacaa

SEQ ID NO: 152849 - DNA, 25 bp, Mus musculus
agagccaaactccatctactgtgag

SEQ ID NO: 152850 - DNA, 25 bp, Mus musculus
agagccaaactcgatctactgtgag

SEQ ID NO: 152851 - DNA, 25 bp, Mus musculus
agagccaaagggagtcttcaaggaa

SEQ ID NO: 152852 - DNA, 25 bp, Mus musculus
agagccaaagggtgtcttcaaggaa

SEQ ID NO: 152853 - DNA, 25 bp, Mus musculus
agagccaaagtaacggactcgggag

SEQ ID NO: 152854 - DNA, 25 bp, Mus musculus
agagccaaagtatcggactcgggag

SEQ ID NO: 152855 - DNA, 25 bp, Mus musculus
agagccaaatgtacctgcctggagc

SEQ ID NO: 152856 - DNA, 25 bp, Mus musculus
agagccaaatgttcctgcctggagc

SEQ ID NO: 152857 - DNA, 25 bp, Mus musculus
agagccaaattaagacaccccaaca

SEQ ID NO: 152858 - DNA, 25 bp, Mus musculus
agagccaaattatgacaccccaaca

SEQ ID NO: 152859 - DNA, 25 bp, Mus musculus
agagccaacaccagggcaacttgtc

SEQ ID NO: 152860 - DNA, 25 bp, Mus musculus
agagccaacacctgggcaacttgtc

SEQ ID NO: 152861 - DNA, 25 bp, Mus musculus
agagccaaccatatgggtcacctac

SEQ ID NO: 152862 - DNA, 25 bp, Mus musculus
agagccaaccatttgggtcacctac

SEQ ID NO: 152863 - DNA, 25 bp, Mus musculus
agagccaacccactgtacactaaag

SEQ ID NO: 152864 - DNA, 25 bp, Mus musculus
agagccaacccagtgtacactaaag

SEQ ID NO: 152865 - DNA, 25 bp, Mus musculus
agagccaactacagtctgtgtgtta

SEQ ID NO: 152866 - DNA, 25 bp, Mus musculus
agagccaactactgtctgtgtgtta

SEQ ID NO: 152867 - DNA, 25 bp, Mus musculus
agagccaacttgcagacgtctcctg

SEQ ID NO: 152868 - DNA, 25 bp, Mus musculus
agagccaacttggagacgtctcctg

SEQ ID NO: 152869 - DNA, 25 bp, Mus musculus
agagccaagaaacgcctgcggcaga

SEQ ID NO: 152870 - DNA, 25 bp, Mus musculus
agagccaagaaaggcctgcggcaga

SEQ ID NO: 152871 - DNA, 25 bp, Mus musculus
agagccaagaccagagccggagttt

SEQ ID NO: 152872 - DNA, 25 bp, Mus musculus
agagccaagacctgagccggagttt

SEQ ID NO: 152873 - DNA, 25 bp, Mus musculus
agagccaagagtacagtttccctgt

SEQ ID NO: 152874 - DNA, 25 bp, Mus musculus
agagccaagagttcagtttccctgt

SEQ ID NO: 152875 - DNA, 25 bp, Mus musculus
agagccaagattagcctcgcctctg

SEQ ID NO: 152876 - DNA, 25 bp, Mus musculus
agagccaagatttgcctcgcctctg

SEQ ID NO: 152877 - DNA, 25 bp, Mus musculus
agagccaagccccactctacttatt

SEQ ID NO: 152878 - DNA, 25 bp, Mus musculus
agagccaagcccgactctacttatt

SEQ ID NO: 152879 - DNA, 25 bp, Mus musculus
agagccaagctgcacttcggacttt

SEQ ID NO: 152880 - DNA, 25 bp, Mus musculus
agagccaagctggacttcggacttt

SEQ ID NO: 152881 - DNA, 25 bp, Mus musculus
agagccaagcttcatcggagaccct

SEQ ID NO: 152882 - DNA, 25 bp, Mus musculus
agagccaagcttgatcggagaccct

SEQ ID NO: 152883 - DNA, 25 bp, Mus musculus
agagccaaggacactgtgctcacca

SEQ ID NO: 152884 - DNA, 25 bp, Mus musculus
agagccaaggactctgtgctcacca

SEQ ID NO: 152885 - DNA, 25 bp, Mus musculus
agagccaaggctcgtggtccctgat

SEQ ID NO: 152886 - DNA, 25 bp, Mus musculus
agagccaaggctggtggtccctgat

SEQ ID NO: 152887 - DNA, 25 bp, Mus musculus
agagccaagggcagagccaactcag

SEQ ID NO: 152888 - DNA, 25 bp, Mus musculus
agagccaagggctgagccaactcag

SEQ ID NO: 152889 - DNA, 25 bp, Mus musculus
agagccaagtcaacggcttctttgc

SEQ ID NO: 152890 - DNA, 25 bp, Mus musculus
agagccaagtcatcggcttctttgc

SEQ ID NO: 152891 - DNA, 25 bp, Mus musculus
agagccaatcacacttcagaagagc

SEQ ID NO: 152892 - DNA, 25 bp, Mus musculus
agagccaatcactcttcagaagagc

SEQ ID NO: 152893 - DNA, 25 bp, Mus musculus
agagccaatctgactcttcactgtg

SEQ ID NO: 152894 - DNA, 25 bp, Mus musculus
agagccaatctgtctcttcactgtg

SEQ ID NO: 152895 - DNA, 25 bp, Mus musculus
agagccaatgatcatatttccttta

SEQ ID NO: 152896 - DNA, 25 bp, Mus musculus
agagccaatgatgatatttccttta

SEQ ID NO: 152897 - DNA, 25 bp, Mus musculus
agagccaattggatccctgtaacgt

SEQ ID NO: 152898 - DNA, 25 bp, Mus musculus
agagccaattggttccctgtaacgt

SEQ ID NO: 152899 - DNA, 25 bp, Mus musculus
agagccacacccaaagccaaagagt

SEQ ID NO: 152900 - DNA, 25 bp, Mus musculus
agagccacaccctaagccaaagagt

SEQ ID NO: 152901 - DNA, 25 bp, Mus musculus
agagccacaccgcactagagcaatg

SEQ ID NO: 152902 - DNA, 25 bp, Mus musculus
agagccacaccggactagagcaatg

SEQ ID NO: 152903 - DNA, 25 bp, Mus musculus
agagccacagcacaggagtcaagtc

SEQ ID NO: 152904 - DNA, 25 bp, Mus musculus
agagccacagcagaggagtcaagtc

SEQ ID NO: 152905 - DNA, 25 bp, Mus musculus
agagccacagcccaaggaacttcaa

SEQ ID NO: 152906 - DNA, 25 bp, Mus musculus
agagccacagcccagtctgcggatg

SEQ ID NO: 152907 - DNA, 25 bp, Mus musculus
agagccacagccgaaggaacttcaa

SEQ ID NO: 152908 - DNA, 25 bp, Mus musculus
agagccacagccgagtctgcggatg

SEQ ID NO: 152909 - DNA, 25 bp, Mus musculus
agagccacagctacatttttcattt

SEQ ID NO: 152910 - DNA, 25 bp, Mus musculus
agagccacagctaccagtgttggac

SEQ ID NO: 152911 - DNA, 25 bp, Mus musculus
agagccacagctcacctgtgtggaa

SEQ ID NO: 152912 - DNA, 25 bp, Mus musculus
agagccacagctgacctgtgtggaa

SEQ ID NO: 152913 - DNA, 25 bp, Mus musculus
agagccacagcttcatttttcattt

SEQ ID NO: 152914 - DNA, 25 bp, Mus musculus
agagccacagcttccagtgttggac

SEQ ID NO: 152915 - DNA, 25 bp, Mus musculus
agagccacaggcatgagtccttgat

SEQ ID NO: 152916 - DNA, 25 bp, Mus musculus
agagccacaggcttgagtccttgat

SEQ ID NO: 152917 - DNA, 25 bp, Mus musculus
agagccacatctacagtgtagagct

SEQ ID NO: 152918 - DNA, 25 bp, Mus musculus
agagccacatcttcagtgtagagct

SEQ ID NO: 152919 - DNA, 25 bp, Mus musculus
agagccacatggatgatctgacccc

SEQ ID NO: 152920 - DNA, 25 bp, Mus musculus
agagccacatggttgatctgacccc

SEQ ID NO: 152921 - DNA, 25 bp, Mus musculus
agagccacatttatcatcacaccag

SEQ ID NO: 152922 - DNA, 25 bp, Mus musculus
agagccacatttttcatcacaccag

SEQ ID NO: 152923 - DNA, 25 bp, Mus musculus
agagccaccacccagagacacggga

SEQ ID NO: 152924 - DNA, 25 bp, Mus musculus
agagccaccaccgagagacacggga

SEQ ID NO: 152925 - DNA, 25 bp, Mus musculus
agagccaccactagtattctgtgat

SEQ ID NO: 152926 - DNA, 25 bp, Mus musculus
agagccaccacttgtattctgtgat

SEQ ID NO: 152927 - DNA, 25 bp, Mus musculus
agagccaccagcagtcagaatagca

SEQ ID NO: 152928 - DNA, 25 bp, Mus musculus
agagccaccagctgtcagaatagca

SEQ ID NO: 152929 - DNA, 25 bp, Mus musculus
agagccaccatcagcttgagcaaga

SEQ ID NO: 152930 - DNA, 25 bp, Mus musculus
agagccaccatctgcttgagcaaga

SEQ ID NO: 152931 - DNA, 25 bp, Mus musculus
agagccacccacattttctataaaa

SEQ ID NO: 152932 - DNA, 25 bp, Mus musculus
agagccacccactttttctataaaa

SEQ ID NO: 152933 - DNA, 25 bp, Mus musculus
agagccaccccgaggatgctggaaa

SEQ ID NO: 152934 - DNA, 25 bp, Mus musculus
agagccaccccgtggatgctggaaa

SEQ ID NO: 152935 - DNA, 25 bp, Mus musculus
agagccaccctcagtggactaagtg

SEQ ID NO: 152936 - DNA, 25 bp, Mus musculus
agagccaccctctgtggactaagtg

SEQ ID NO: 152937 - DNA, 25 bp, Mus musculus
agagccaccgtgagtcgcactcgga

SEQ ID NO: 152938 - DNA, 25 bp, Mus musculus
agagccaccgtgtgtcgcactcgga

SEQ ID NO: 152939 - DNA, 25 bp, Mus musculus
agagccaccttccaagctcaaaaaa

SEQ ID NO: 152940 - DNA, 25 bp, Mus musculus
agagccaccttcgaagctcaaaaaa

SEQ ID NO: 152941 - DNA, 25 bp, Mus musculus
agagccacgccacagactgcagaga

SEQ ID NO: 152942 - DNA, 25 bp, Mus musculus
agagccacgccagagactgcagaga

SEQ ID NO: 152943 - DNA, 25 bp, Mus musculus
agagccacgcgtacggttatgtaaa

SEQ ID NO: 152944 - DNA, 25 bp, Mus musculus
agagccacgcgttcggttatgtaaa

SEQ ID NO: 152945 - DNA, 25 bp, Mus musculus
agagccacggtgcagccaaggccaa

SEQ ID NO: 152946 - DNA, 25 bp, Mus musculus
agagccacggtggagccaaggccaa

SEQ ID NO: 152947 - DNA, 25 bp, Mus musculus
agagccactagtaggtctccctttt

SEQ ID NO: 152948 - DNA, 25 bp, Mus musculus
agagccactagttggtctccctttt

SEQ ID NO: 152949 - DNA, 25 bp, Mus musculus
agagccactcagaaggtccagaggt

SEQ ID NO: 152950 - DNA, 25 bp, Mus musculus
agagccactcagtaggtccagaggt

SEQ ID NO: 152951 - DNA, 25 bp, Mus musculus
agagccactctacggagccacggag

SEQ ID NO: 152952 - DNA, 25 bp, Mus musculus
agagccactctagggagccacggag

SEQ ID NO: 152953 - DNA, 25 bp, Mus musculus
agagccactctcataattctacgct

SEQ ID NO: 152954 - DNA, 25 bp, Mus musculus
agagccactctcttaattctacgct

SEQ ID NO: 152955 - DNA, 25 bp, Mus musculus
agagccactgcacaagtttccggat

SEQ ID NO: 152956 - DNA, 25 bp, Mus musculus
agagccactgcacggtaacaagggt

SEQ ID NO: 152957 - DNA, 25 bp, Mus musculus
agagccactgcagaagtttccggat

SEQ ID NO: 152958 - DNA, 25 bp, Mus musculus
agagccactgcagggtaacaagggt

SEQ ID NO: 152959 - DNA, 25 bp, Mus musculus
agagccactggcctttacagcccaa

SEQ ID NO: 152960 - DNA, 25 bp, Mus musculus
agagccactggcgtttacagcccaa

SEQ ID NO: 152961 - DNA, 25 bp, Mus musculus
agagccactgtactgtcactacgta

SEQ ID NO: 152962 - DNA, 25 bp, Mus musculus
agagccactgtagtgtcactacgta

SEQ ID NO: 152963 - DNA, 25 bp, Mus musculus
agagccacttgaagtctgctacaat

SEQ ID NO: 152964 - DNA, 25 bp, Mus musculus
agagccacttgatgtctgctacaat

SEQ ID NO: 152965 - DNA, 25 bp, Mus musculus
agagccactttcacaagtgtcccaa

SEQ ID NO: 152966 - DNA, 25 bp, Mus musculus
agagccactttcagagactatgcct

SEQ ID NO: 152967 - DNA, 25 bp, Mus musculus
agagccactttctcaagtgtcccaa

SEQ ID NO: 152968 - DNA, 25 bp, Mus musculus
agagccactttctgagactatgcct

SEQ ID NO: 152969 - DNA, 25 bp, Mus musculus
agagccagacacagacaggtggccc

SEQ ID NO: 152970 - DNA, 25 bp, Mus musculus
agagccagacactgacaggtggccc

SEQ ID NO: 152971 - DNA, 25 bp, Mus musculus
agagccagacagaagcgatcacccc

SEQ ID NO: 152972 - DNA, 25 bp, Mus musculus
agagccagacagtagcgatcacccc

SEQ ID NO: 152973 - DNA, 25 bp, Mus musculus
agagccagactgacgactgccttga

SEQ ID NO: 152974 - DNA, 25 bp, Mus musculus
agagccagactgcacccagctggag

SEQ ID NO: 152975 - DNA, 25 bp, Mus musculus
agagccagactggacccagctggag

SEQ ID NO: 152976 - DNA, 25 bp, Mus musculus
agagccagactgtcgactgccttga

SEQ ID NO: 152977 - DNA, 25 bp, Mus musculus
agagccagagacactcctgtagaga

SEQ ID NO: 152978 - DNA, 25 bp, Mus musculus
agagccagagactctcctgtagaga

SEQ ID NO: 152979 - DNA, 25 bp, Mus musculus
agagccagagatcaggcacttggtt

SEQ ID NO: 152980 - DNA, 25 bp, Mus musculus
agagccagagatgaggcacttggtt

SEQ ID NO: 152981 - DNA, 25 bp, Mus musculus
agagccagagctacgggacaccatc

SEQ ID NO: 152982 - DNA, 25 bp, Mus musculus
agagccagagcttcgggacaccatc

SEQ ID NO: 152983 - DNA, 25 bp, Mus musculus
agagccagaggactcggtcacctca

SEQ ID NO: 152984 - DNA, 25 bp, Mus musculus
agagccagaggagtcggtcacctca

SEQ ID NO: 152985 - DNA, 25 bp, Mus musculus
agagccagatctaccatgacatcat

SEQ ID NO: 152986 - DNA, 25 bp, Mus musculus
agagccagatcttccatgacatcat

SEQ ID NO: 152987 - DNA, 25 bp, Mus musculus
agagccagcaatccttaatgtttac

SEQ ID NO: 152988 - DNA, 25 bp, Mus musculus
agagccagcaatctttggtgggcac

SEQ ID NO: 152989 - DNA, 25 bp, Mus musculus
agagccagcaatgcttaatgtttac

SEQ ID NO: 152990 - DNA, 25 bp, Mus musculus
agagccagcaatgtttggtgggcac

SEQ ID NO: 152991 - DNA, 25 bp, Mus musculus
agagccagcaccatagtccgtcatg

SEQ ID NO: 152992 - DNA, 25 bp, Mus musculus
agagccagcaccttagtccgtcatg

SEQ ID NO: 152993 - DNA, 25 bp, Mus musculus
agagccagcatcacggacagcagag

SEQ ID NO: 152994 - DNA, 25 bp, Mus musculus
agagccagcatctcggacagcagag

SEQ ID NO: 152995 - DNA, 25 bp, Mus musculus
agagccagcccgaggctgtcgttcc

SEQ ID NO: 152996 - DNA, 25 bp, Mus musculus
agagccagcccgtggctgtcgttcc

SEQ ID NO: 152997 - DNA, 25 bp, Mus musculus
agagccagcgccagagcgtcaggca

SEQ ID NO: 152998 - DNA, 25 bp, Mus musculus
agagccagcgcctgagcgtcaggca

SEQ ID NO: 152999 - DNA, 25 bp, Mus musculus
agagccagctcccaaaggtcacaaa

SEQ ID NO: 153000 - DNA, 25 bp, Mus musculus
agagccagctccgaaaggtcacaaa

SEQ ID NO: 153001 - DNA, 25 bp, Mus musculus
agagccagctgcaacgtgagctagt

SEQ ID NO: 153002 - DNA, 25 bp, Mus musculus
agagccagctgcatcgatccagagg

SEQ ID NO: 153003 - DNA, 25 bp, Mus musculus
agagccagctgctacgtgagctagt

SEQ ID NO: 153004 - DNA, 25 bp, Mus musculus
agagccagctgcttcgatccagagg

SEQ ID NO: 153005 - DNA, 25 bp, Mus musculus
agagccaggaccagtcttcaaaaaa

SEQ ID NO: 153006 - DNA, 25 bp, Mus musculus
agagccaggaccagtgctcttttaa

SEQ ID NO: 153007 - DNA, 25 bp, Mus musculus
agagccaggacctgtcttcaaaaaa

SEQ ID NO: 153008 - DNA, 25 bp, Mus musculus
agagccaggacctgtgctcttttaa

SEQ ID NO: 153009 - DNA, 25 bp, Mus musculus
agagccaggagcaccccgaagccga

SEQ ID NO: 153010 - DNA, 25 bp, Mus musculus
agagccaggagctccccgaagccga

SEQ ID NO: 153011 - DNA, 25 bp, Mus musculus
agagccaggagtacaacatcttgtt

SEQ ID NO: 153012 - DNA, 25 bp, Mus musculus
agagccaggagttcaacatcttgtt

SEQ ID NO: 153013 - DNA, 25 bp, Mus musculus
agagccaggcaaatctgtctgcctt

SEQ ID NO: 153014 - DNA, 25 bp, Mus musculus
agagccaggcaattctgtctgcctt

SEQ ID NO: 153015 - DNA, 25 bp, Mus musculus
agagccaggccaagagggctgctca

SEQ ID NO: 153016 - DNA, 25 bp, Mus musculus
agagccaggccactacatgtaatca

SEQ ID NO: 153017 - DNA, 25 bp, Mus musculus
agagccaggccagtacatgtaatca

SEQ ID NO: 153018 - DNA, 25 bp, Mus musculus
agagccaggccatgagggctgctca

SEQ ID NO: 153019 - DNA, 25 bp, Mus musculus
agagccaggcctaaaccctgaaggg

SEQ ID NO: 153020 - DNA, 25 bp, Mus musculus
agagccaggcctcctggtacacatt

SEQ ID NO: 153021 - DNA, 25 bp, Mus musculus
agagccaggcctctctttctgttct

SEQ ID NO: 153022 - DNA, 25 bp, Mus musculus
agagccaggcctgctggtacacatt

SEQ ID NO: 153023 - DNA, 25 bp, Mus musculus
agagccaggcctgtctttctgttct

SEQ ID NO: 153024 - DNA, 25 bp, Mus musculus
agagccaggccttaaccctgaaggg

SEQ ID NO: 153025 - DNA, 25 bp, Mus musculus
agagccaggctaagcttaactgtct

SEQ ID NO: 153026 - DNA, 25 bp, Mus musculus
agagccaggctatgcttaactgtct

SEQ ID NO: 153027 - DNA, 25 bp, Mus musculus
agagccaggcttcatcatgtgaact

SEQ ID NO: 153028 - DNA, 25 bp, Mus musculus
agagccaggcttgatcatgtgaact

SEQ ID NO: 153029 - DNA, 25 bp, Mus musculus
agagccagggctcaaagcattctca

SEQ ID NO: 153030 - DNA, 25 bp, Mus musculus
agagccagggctctccttctacctt

SEQ ID NO: 153031 - DNA, 25 bp, Mus musculus
agagccagggctgaaagcattctca

SEQ ID NO: 153032 - DNA, 25 bp, Mus musculus
agagccagggctgtccttctacctt

SEQ ID NO: 153033 - DNA, 25 bp, Mus musculus
agagccagggtcactttggagagac

SEQ ID NO: 153034 - DNA, 25 bp, Mus musculus
agagccagggtctctttggagagac

SEQ ID NO: 153035 - DNA, 25 bp, Mus musculus
agagccaggtctaaacagtaattca

SEQ ID NO: 153036 - DNA, 25 bp, Mus musculus
agagccaggtctatgtgtctgtaga

SEQ ID NO: 153037 - DNA, 25 bp, Mus musculus
agagccaggtcttaacagtaattca

SEQ ID NO: 153038 - DNA, 25 bp, Mus musculus
agagccaggtctttgtgtctgtaga

SEQ ID NO: 153039 - DNA, 25 bp, Mus musculus
agagccaggtgtctcaaccttgtgt

SEQ ID NO: 153040 - DNA, 25 bp, Mus musculus
agagccaggtgtgtcaaccttgtgt

SEQ ID NO: 153041 - DNA, 25 bp, Mus musculus
agagccagtcaactgctttcttaac

SEQ ID NO: 153042 - DNA, 25 bp, Mus musculus
agagccagtcaagtgctttcttaac

SEQ ID NO: 153043 - DNA, 25 bp, Mus musculus
agagccagtgagactgggccttgaa

SEQ ID NO: 153044 - DNA, 25 bp, Mus musculus
agagccagtgagtctgggccttgaa

SEQ ID NO: 153045 - DNA, 25 bp, Mus musculus
agagccagtgcgaatatttcctttc

SEQ ID NO: 153046 - DNA, 25 bp, Mus musculus
agagccagtgcgtatatttcctttc

SEQ ID NO: 153047 - DNA, 25 bp, Mus musculus
agagccagttggaaagcagccttac

SEQ ID NO: 153048 - DNA, 25 bp, Mus musculus
agagccagttggtaagcagccttac

SEQ ID NO: 153049 - DNA, 25 bp, Mus musculus
agagccataatgcaggaccctagac

SEQ ID NO: 153050 - DNA, 25 bp, Mus musculus
agagccataatggaggaccctagac

SEQ ID NO: 153051 - DNA, 25 bp, Mus musculus
agagccatacttccagttccaggat

SEQ ID NO: 153052 - DNA, 25 bp, Mus musculus
agagccatacttgcagttccaggat

SEQ ID NO: 153053 - DNA, 25 bp, Mus musculus
agagccatagccagcaagaaagaag

SEQ ID NO: 153054 - DNA, 25 bp, Mus musculus
agagccatagcctgcaagaaagaag

SEQ ID NO: 153055 - DNA, 25 bp, Mus musculus
agagccatatacagagaccctgtct

SEQ ID NO: 153056 - DNA, 25 bp, Mus musculus
agagccatatacctcgtcctgtggc

SEQ ID NO: 153057 - DNA, 25 bp, Mus musculus
agagccatatacgtcgtcctgtggc

SEQ ID NO: 153058 - DNA, 25 bp, Mus musculus
agagccatatactgagaccctgtct

SEQ ID NO: 153059 - DNA, 25 bp, Mus musculus
agagccatatgcctcttccagctgc

SEQ ID NO: 153060 - DNA, 25 bp, Mus musculus
agagccatatgcgtcttccagctgc

SEQ ID NO: 153061 - DNA, 25 bp, Mus musculus
agagccatcaccaaggtcagttcct

SEQ ID NO: 153062 - DNA, 25 bp, Mus musculus
agagccatcacctaggtcagttcct

SEQ ID NO: 153063 - DNA, 25 bp, Mus musculus
agagccatcacgaagcttgccgact

SEQ ID NO: 153064 - DNA, 25 bp, Mus musculus
agagccatcacgtagcttgccgact

SEQ ID NO: 153065 - DNA, 25 bp, Mus musculus
agagccatccctataaagccaacag

SEQ ID NO: 153066 - DNA, 25 bp, Mus musculus
agagccatccctttaaagccaacag

SEQ ID NO: 153067 - DNA, 25 bp, Mus musculus
agagccatccttatgcgttagtgag

SEQ ID NO: 153068 - DNA, 25 bp, Mus musculus
agagccatccttttgcgttagtgag

SEQ ID NO: 153069 - DNA, 25 bp, Mus musculus
agagccatcggcagcaaggccacgt

SEQ ID NO: 153070 - DNA, 25 bp, Mus musculus
agagccatcggctgcaaggccacgt

SEQ ID NO: 153071 - DNA, 25 bp, Mus musculus
agagccatctggagttgtaaacatc

SEQ ID NO: 153072 - DNA, 25 bp, Mus musculus
agagccatctggtgttgtaaacatc

SEQ ID NO: 153073 - DNA, 25 bp, Mus musculus
agagccatcttccacagcctgggaa

SEQ ID NO: 153074 - DNA, 25 bp, Mus musculus
agagccatcttcgacagcctgggaa

SEQ ID NO: 153075 - DNA, 25 bp, Mus musculus
agagccatgaagcatctgccgtagc

SEQ ID NO: 153076 - DNA, 25 bp, Mus musculus
agagccatgaaggatctgccgtagc

SEQ ID NO: 153077 - DNA, 25 bp, Mus musculus
agagccatgaatcagctgcaactca

SEQ ID NO: 153078 - DNA, 25 bp, Mus musculus
agagccatgaatgagctgcaactca

SEQ ID NO: 153079 - DNA, 25 bp, Mus musculus
agagccatgaccagcatctcagaaa

SEQ ID NO: 153080 - DNA, 25 bp, Mus musculus
agagccatgacctgcatctcagaaa

SEQ ID NO: 153081 - DNA, 25 bp, Mus musculus
agagccatgattcggcgtcggccat

SEQ ID NO: 153082 - DNA, 25 bp, Mus musculus
agagccatgattgggcgtcggccat

SEQ ID NO: 153083 - DNA, 25 bp, Mus musculus
agagccatgcctcaagacctgatca

SEQ ID NO: 153084 - DNA, 25 bp, Mus musculus
agagccatgcctgaagacctgatca

SEQ ID NO: 153085 - DNA, 25 bp, Mus musculus
agagccatgctcatggtcccacaga

SEQ ID NO: 153086 - DNA, 25 bp, Mus musculus
agagccatgctcttggtcccacaga

SEQ ID NO: 153087 - DNA, 25 bp, Mus musculus
agagccatggacaccacactgtgaa

SEQ ID NO: 153088 - DNA, 25 bp, Mus musculus
agagccatggactccacactgtgaa

SEQ ID NO: 153089 - DNA, 25 bp, Mus musculus
agagccatggttaatctggaagatg

SEQ ID NO: 153090 - DNA, 25 bp, Mus musculus
agagccatggtttatctggaagatg

SEQ ID NO: 153091 - DNA, 25 bp, Mus musculus
agagccatgtcaacatctgctgctt

SEQ ID NO: 153092 - DNA, 25 bp, Mus musculus
agagccatgtcaccgggcatcaatg

SEQ ID NO: 153093 - DNA, 25 bp, Mus musculus
agagccatgtcagcgggcatcaatg

SEQ ID NO: 153094 - DNA, 25 bp, Mus musculus
agagccatgtcatcatctgctgctt

SEQ ID NO: 153095 - DNA, 25 bp, Mus musculus
agagccatgtctaattccttcagtg

SEQ ID NO: 153096 - DNA, 25 bp, Mus musculus
agagccatgtcttattccttcagtg

SEQ ID NO: 153097 - DNA, 25 bp, Mus musculus
agagccatgtgcaaaggttccgcct

SEQ ID NO: 153098 - DNA, 25 bp, Mus musculus
agagccatgtgctaaggttccgcct

SEQ ID NO: 153099 - DNA, 25 bp, Mus musculus
agagccatgtgtatggtgtattcca

SEQ ID NO: 153100 - DNA, 25 bp, Mus musculus
agagccatgtgtttggtgtattcca

SEQ ID NO: 153101 - DNA, 25 bp, Mus musculus
agagccatgttacccacgtgtgtct

SEQ ID NO: 153102 - DNA, 25 bp, Mus musculus
agagccatgttagccacgtgtgtct

SEQ ID NO: 153103 - DNA, 25 bp, Mus musculus
agagccattactagtgcctttctac

SEQ ID NO: 153104 - DNA, 25 bp, Mus musculus
agagccattacttgtgcctttctac

SEQ ID NO: 153105 - DNA, 25 bp, Mus musculus
agagccattattccggaattccgtc

SEQ ID NO: 153106 - DNA, 25 bp, Mus musculus
agagccattattgcggaattccgtc

SEQ ID NO: 153107 - DNA, 25 bp, Mus musculus
agagccattcaccaactatagcaag

SEQ ID NO: 153108 - DNA, 25 bp, Mus musculus
agagccattcacgaactatagcaag

SEQ ID NO: 153109 - DNA, 25 bp, Mus musculus
agagccattcctactgtgacacagg

SEQ ID NO: 153110 - DNA, 25 bp, Mus musculus
agagccattccttctgtgacacagg

SEQ ID NO: 153111 - DNA, 25 bp, Mus musculus
agagccattgggacccttgtttatt

SEQ ID NO: 153112 - DNA, 25 bp, Mus musculus
agagccattgggtcccttgtttatt

SEQ ID NO: 153113 - DNA, 25 bp, Mus musculus
agagccatttcactgggtgcagcct

SEQ ID NO: 153114 - DNA, 25 bp, Mus musculus
agagccatttcagtgggtgcagcct

SEQ ID NO: 153115 - DNA, 25 bp, Mus musculus
agagcccaaacaagatgtgtctgtg

SEQ ID NO: 153116 - DNA, 25 bp, Mus musculus
agagcccaaacatgatgtgtctgtg

SEQ ID NO: 153117 - DNA, 25 bp, Mus musculus
agagcccaacatccaaatcctgtaa

SEQ ID NO: 153118 - DNA, 25 bp, Mus musculus
agagcccaacatgcaaatcctgtaa

SEQ ID NO: 153119 - DNA, 25 bp, Mus musculus
agagcccaagaaaatcttactcatg

SEQ ID NO: 153120 - DNA, 25 bp, Mus musculus
agagcccaagaatatcttactcatg

SEQ ID NO: 153121 - DNA, 25 bp, Mus musculus
agagcccaagaccagtgataccaaa

SEQ ID NO: 153122 - DNA, 25 bp, Mus musculus
agagcccaagacgagtgataccaaa

SEQ ID NO: 153123 - DNA, 25 bp, Mus musculus
agagcccaagccaagaggcggccat

SEQ ID NO: 153124 - DNA, 25 bp, Mus musculus
agagcccaagcctagaggcggccat

SEQ ID NO: 153125 - DNA, 25 bp, Mus musculus
agagcccaatctaaggtctgcagag

SEQ ID NO: 153126 - DNA, 25 bp, Mus musculus
agagcccaatcttaggtctgcagag

SEQ ID NO: 153127 - DNA, 25 bp, Mus musculus
agagcccaatgcaaaggacccctat

SEQ ID NO: 153128 - DNA, 25 bp, Mus musculus
agagcccaatgctaaggacccctat

SEQ ID NO: 153129 - DNA, 25 bp, Mus musculus
agagcccacatgattcttatctctt

SEQ ID NO: 153130 - DNA, 25 bp, Mus musculus
agagcccacatgtttcttatctctt

SEQ ID NO: 153131 - DNA, 25 bp, Mus musculus
agagcccaccgcaacgacatggaga

SEQ ID NO: 153132 - DNA, 25 bp, Mus musculus
agagcccaccgctacgacatggaga

SEQ ID NO: 153133 - DNA, 25 bp, Mus musculus
agagcccaccggaggagctgtgaac

SEQ ID NO: 153134 - DNA, 25 bp, Mus musculus
agagcccaccggtggagctgtgaac

SEQ ID NO: 153135 - DNA, 25 bp, Mus musculus
agagcccacctaacaggaggatttt

SEQ ID NO: 153136 - DNA, 25 bp, Mus musculus
agagcccacctatcaggaggatttt

SEQ ID NO: 153137 - DNA, 25 bp, Mus musculus
agagcccacgtcaagggataccaag

SEQ ID NO: 153138 - DNA, 25 bp, Mus musculus
agagcccacgtctagggataccaag

SEQ ID NO: 153139 - DNA, 25 bp, Mus musculus
agagcccactgacgatcaaaatgat

SEQ ID NO: 153140 - DNA, 25 bp, Mus musculus
agagcccactgaggatcaaaatgat

SEQ ID NO: 153141 - DNA, 25 bp, Mus musculus
agagcccactggagagcttaagaaa

SEQ ID NO: 153142 - DNA, 25 bp, Mus musculus
agagcccactggtgagcttaagaaa

SEQ ID NO: 153143 - DNA, 25 bp, Mus musculus
agagcccagaggcaccctgggaaca

SEQ ID NO: 153144 - DNA, 25 bp, Mus musculus
agagcccagaggcttccaaactgta

SEQ ID NO: 153145 - DNA, 25 bp, Mus musculus
agagcccagagggaccctgggaaca

SEQ ID NO: 153146 - DNA, 25 bp, Mus musculus
agagcccagagggttccaaactgta

SEQ ID NO: 153147 - DNA, 25 bp, Mus musculus
agagcccagattcgcgctgcagctt

SEQ ID NO: 153148 - DNA, 25 bp, Mus musculus
agagcccagattggcgctgcagctt

SEQ ID NO: 153149 - DNA, 25 bp, Mus musculus
agagcccagcaaagaggtcccacca

SEQ ID NO: 153150 - DNA, 25 bp, Mus musculus
agagcccagcaatgaggtcccacca

SEQ ID NO: 153151 - DNA, 25 bp, Mus musculus
agagcccagcatcacttgctcagat

SEQ ID NO: 153152 - DNA, 25 bp, Mus musculus
agagcccagcatgacttgctcagat

SEQ ID NO: 153153 - DNA, 25 bp, Mus musculus
agagcccagccacacatgtttttat

SEQ ID NO: 153154 - DNA, 25 bp, Mus musculus
agagcccagccagacatgtttttat

SEQ ID NO: 153155 - DNA, 25 bp, Mus musculus
agagcccagcctagaagccaggtgt

SEQ ID NO: 153156 - DNA, 25 bp, Mus musculus
agagcccagccttgaagccaggtgt

SEQ ID NO: 153157 - DNA, 25 bp, Mus musculus
agagcccagctaaattgctgtgatt

SEQ ID NO: 153158 - DNA, 25 bp, Mus musculus
agagcccagctatattgctgtgatt

SEQ ID NO: 153159 - DNA, 25 bp, Mus musculus
agagcccagctgaagcggtgcttag

SEQ ID NO: 153160 - DNA, 25 bp, Mus musculus
agagcccagctgtagcggtgcttag

SEQ ID NO: 153161 - DNA, 25 bp, Mus musculus
agagcccaggccacagagtgtgtga

SEQ ID NO: 153162 - DNA, 25 bp, Mus musculus
agagcccaggccatttgcatgatta

SEQ ID NO: 153163 - DNA, 25 bp, Mus musculus
agagcccaggcctcagagtgtgtga

SEQ ID NO: 153164 - DNA, 25 bp, Mus musculus
agagcccaggccttttgcatgatta

SEQ ID NO: 153165 - DNA, 25 bp, Mus musculus
agagcccagggaaactaagccatta

SEQ ID NO: 153166 - DNA, 25 bp, Mus musculus
agagcccagggatactaagccatta

SEQ ID NO: 153167 - DNA, 25 bp, Mus musculus
agagcccaggttattggcttgccac

SEQ ID NO: 153168 - DNA, 25 bp, Mus musculus
agagcccaggtttttggcttgccac

SEQ ID NO: 153169 - DNA, 25 bp, Mus musculus
agagcccatgtaccaggcatgctgc

SEQ ID NO: 153170 - DNA, 25 bp, Mus musculus
agagcccatgtagcaggcatgctgc

SEQ ID NO: 153171 - DNA, 25 bp, Mus musculus
agagcccattggatccaagcacctc

SEQ ID NO: 153172 - DNA, 25 bp, Mus musculus
agagcccattggttccaagcacctc

SEQ ID NO: 153173 - DNA, 25 bp, Mus musculus
agagcccattttaatgtgctgcagg

SEQ ID NO: 153174 - DNA, 25 bp, Mus musculus
agagcccattttcatagcatcgttt

SEQ ID NO: 153175 - DNA, 25 bp, Mus musculus
agagcccattttgatagcatcgttt

SEQ ID NO: 153176 - DNA, 25 bp, Mus musculus
agagcccatttttatgtgctgcagg

SEQ ID NO: 153177 - DNA, 25 bp, Mus musculus
agagccccaattcctactttatgga

SEQ ID NO: 153178 - DNA, 25 bp, Mus musculus
agagccccaattgctactttatgga

SEQ ID NO: 153179 - DNA, 25 bp, Mus musculus
agagccccacagagtcttggcaagt

SEQ ID NO: 153180 - DNA, 25 bp, Mus musculus
agagccccacagtgtcttggcaagt

SEQ ID NO: 153181 - DNA, 25 bp, Mus musculus
agagccccagtaacagcccggtgaa

SEQ ID NO: 153182 - DNA, 25 bp, Mus musculus
agagccccagtacaactattgagca

SEQ ID NO: 153183 - DNA, 25 bp, Mus musculus
agagccccagtagaactattgagca

SEQ ID NO: 153184 - DNA, 25 bp, Mus musculus
agagccccagtatcagcccggtgaa

SEQ ID NO: 153185 - DNA, 25 bp, Mus musculus
agagccccagtgcaccatttctctg

SEQ ID NO: 153186 - DNA, 25 bp, Mus musculus
agagccccagtggaccatttctctg

SEQ ID NO: 153187 - DNA, 25 bp, Mus musculus
agagccccatctctttagacgagga

SEQ ID NO: 153188 - DNA, 25 bp, Mus musculus
agagccccatctgtttagacgagga

SEQ ID NO: 153189 - DNA, 25 bp, Mus musculus
agagccccgaagaggactccaggta

SEQ ID NO: 153190 - DNA, 25 bp, Mus musculus
agagccccgaagtggactccaggta

SEQ ID NO: 153191 - DNA, 25 bp, Mus musculus
agagccccgcagctagtgtcaagac

SEQ ID NO: 153192 - DNA, 25 bp, Mus musculus
agagccccgcaggtagtgtcaagac

SEQ ID NO: 153193 - DNA, 25 bp, Mus musculus
agagccccgggccatctgatgatgt

SEQ ID NO: 153194 - DNA, 25 bp, Mus musculus
agagccccgggcgatctgatgatgt

SEQ ID NO: 153195 - DNA, 25 bp, Mus musculus
agagccccggtaatctgattgtatt

SEQ ID NO: 153196 - DNA, 25 bp, Mus musculus
agagccccggtattctgattgtatt

SEQ ID NO: 153197 - DNA, 25 bp, Mus musculus
agagcccctcagatacagttgtcct

SEQ ID NO: 153198 - DNA, 25 bp, Mus musculus
agagcccctcagttacagttgtcct

SEQ ID NO: 153199 - DNA, 25 bp, Mus musculus
agagcccctccaaggaagtttgctt

SEQ ID NO: 153200 - DNA, 25 bp, Mus musculus
agagcccctccaaggacgctgaggc

SEQ ID NO: 153201 - DNA, 25 bp, Mus musculus
agagcccctccatggaagtttgctt

SEQ ID NO: 153202 - DNA, 25 bp, Mus musculus
agagcccctccatggacgctgaggc

SEQ ID NO: 153203 - DNA, 25 bp, Mus musculus
agagcccctctgaacatttgtatat

SEQ ID NO: 153204 - DNA, 25 bp, Mus musculus
agagcccctctgctggtctttttct

SEQ ID NO: 153205 - DNA, 25 bp, Mus musculus
agagcccctctggtggtctttttct

SEQ ID NO: 153206 - DNA, 25 bp, Mus musculus
agagcccctctgtacatttgtatat

SEQ ID NO: 153207 - DNA, 25 bp, Mus musculus
agagcccctgccaaacatagctgac

SEQ ID NO: 153208 - DNA, 25 bp, Mus musculus
agagcccctgccatcagctatgtaa

SEQ ID NO: 153209 - DNA, 25 bp, Mus musculus
agagcccctgcctaacatagctgac

SEQ ID NO: 153210 - DNA, 25 bp, Mus musculus
agagcccctgccttcagctatgtaa

SEQ ID NO: 153211 - DNA, 25 bp, Mus musculus
agagcccctgtaatgtccctatagg

SEQ ID NO: 153212 - DNA, 25 bp, Mus musculus
agagcccctgtattgtccctatagg

SEQ ID NO: 153213 - DNA, 25 bp, Mus musculus
agagccccttcaagtgcgatcctga

SEQ ID NO: 153214 - DNA, 25 bp, Mus musculus
agagccccttcatgtgcgatcctga

SEQ ID NO: 153215 - DNA, 25 bp, Mus musculus
agagccccttctactaggccagtgg

SEQ ID NO: 153216 - DNA, 25 bp, Mus musculus
agagccccttcttctaggccagtgg

SEQ ID NO: 153217 - DNA, 25 bp, Mus musculus
agagcccgaaggacttgcgcttctg

SEQ ID NO: 153218 - DNA, 25 bp, Mus musculus
agagcccgaaggtcttgcgcttctg

SEQ ID NO: 153219 - DNA, 25 bp, Mus musculus
agagcccgagtacagtctacctgga

SEQ ID NO: 153220 - DNA, 25 bp, Mus musculus
agagcccgagtagagtctacctgga

SEQ ID NO: 153221 - DNA, 25 bp, Mus musculus
agagcccgccatacagtgtctatct

SEQ ID NO: 153222 - DNA, 25 bp, Mus musculus
agagcccgccattcagtgtctatct

SEQ ID NO: 153223 - DNA, 25 bp, Mus musculus
agagcccggactagcagagccagcg

SEQ ID NO: 153224 - DNA, 25 bp, Mus musculus
agagcccggacttgcagagccagcg

SEQ ID NO: 153225 - DNA, 25 bp, Mus musculus
agagcccggctgctaagcaagtact

SEQ ID NO: 153226 - DNA, 25 bp, Mus musculus
agagcccggctggtaagcaagtact

SEQ ID NO: 153227 - DNA, 25 bp, Mus musculus
agagcccggtgcagcttggacaaac

SEQ ID NO: 153228 - DNA, 25 bp, Mus musculus
agagcccggtgctgcttggacaaac

SEQ ID NO: 153229 - DNA, 25 bp, Mus musculus
agagcccgtgttacattctgacgcc

SEQ ID NO: 153230 - DNA, 25 bp, Mus musculus
agagcccgtgttcttgctgtggcaa

SEQ ID NO: 153231 - DNA, 25 bp, Mus musculus
agagcccgtgttgttgctgtggcaa

SEQ ID NO: 153232 - DNA, 25 bp, Mus musculus
agagcccgtgtttcattctgacgcc

SEQ ID NO: 153233 - DNA, 25 bp, Mus musculus
agagccctaatgctaggttgtcatt

SEQ ID NO: 153234 - DNA, 25 bp, Mus musculus
agagccctaatggtaggttgtcatt

SEQ ID NO: 153235 - DNA, 25 bp, Mus musculus
agagccctacaaataaggcgggaat

SEQ ID NO: 153236 - DNA, 25 bp, Mus musculus
agagccctacaattaaggcgggaat

SEQ ID NO: 153237 - DNA, 25 bp, Mus musculus
agagccctagaccttccttgaactt

SEQ ID NO: 153238 - DNA, 25 bp, Mus musculus
agagccctagacgttccttgaactt

SEQ ID NO: 153239 - DNA, 25 bp, Mus musculus
agagccctagctcctccagagctgg

SEQ ID NO: 153240 - DNA, 25 bp, Mus musculus
agagccctagctgctccagagctgg

SEQ ID NO: 153241 - DNA, 25 bp, Mus musculus
agagccctaggtattgtaatcaatt

SEQ ID NO: 153242 - DNA, 25 bp, Mus musculus
agagccctaggttttgtaatcaatt

SEQ ID NO: 153243 - DNA, 25 bp, Mus musculus
agagccctagtccaggattaacctt

SEQ ID NO: 153244 - DNA, 25 bp, Mus musculus
agagccctagtcgaggattaacctt

SEQ ID NO: 153245 - DNA, 25 bp, Mus musculus
agagccctatcgagcaggagtgcat

SEQ ID NO: 153246 - DNA, 25 bp, Mus musculus
agagccctatcgtgcaggagtgcat

SEQ ID NO: 153247 - DNA, 25 bp, Mus musculus
agagccctatctagtccatgtgtgt

SEQ ID NO: 153248 - DNA, 25 bp, Mus musculus
agagccctatcttgtccatgtgtgt

SEQ ID NO: 153249 - DNA, 25 bp, Mus musculus
agagccctatgactgtgatgttccc

SEQ ID NO: 153250 - DNA, 25 bp, Mus musculus
agagccctatgagtgtgatgttccc

SEQ ID NO: 153251 - DNA, 25 bp, Mus musculus
agagccctatgcatgtttcatcacg

SEQ ID NO: 153252 - DNA, 25 bp, Mus musculus
agagccctatgcttgtttcatcacg

SEQ ID NO: 153253 - DNA, 25 bp, Mus musculus
agagccctcaaaagtggaaagcaga

SEQ ID NO: 153254 - DNA, 25 bp, Mus musculus
agagccctcaaatgtggaaagcaga

SEQ ID NO: 153255 - DNA, 25 bp, Mus musculus
agagccctcacaagacacggatgga

SEQ ID NO: 153256 - DNA, 25 bp, Mus musculus
agagccctcacatgacacggatgga

SEQ ID NO: 153257 - DNA, 25 bp, Mus musculus
agagccctcagaagtgcccttgggt

SEQ ID NO: 153258 - DNA, 25 bp, Mus musculus
agagccctcagacttactgtcttgc

SEQ ID NO: 153259 - DNA, 25 bp, Mus musculus
agagccctcagagttactgtcttgc

SEQ ID NO: 153260 - DNA, 25 bp, Mus musculus
agagccctcagatgtgcccttgggt

SEQ ID NO: 153261 - DNA, 25 bp, Mus musculus
agagccctcagccaatctagaactt

SEQ ID NO: 153262 - DNA, 25 bp, Mus musculus
agagccctcagccacaaatacggtg

SEQ ID NO: 153263 - DNA, 25 bp, Mus musculus
agagccctcagcgaatctagaactt

SEQ ID NO: 153264 - DNA, 25 bp, Mus musculus
agagccctcagcgacaaatacggtg

SEQ ID NO: 153265 - DNA, 25 bp, Mus musculus
agagccctcaggctgaaggacagct

SEQ ID NO: 153266 - DNA, 25 bp, Mus musculus
agagccctcagggtgaaggacagct

SEQ ID NO: 153267 - DNA, 25 bp, Mus musculus
agagccctcatgcacgctatctgtc

SEQ ID NO: 153268 - DNA, 25 bp, Mus musculus
agagccctcatggacgctatctgtc

SEQ ID NO: 153269 - DNA, 25 bp, Mus musculus
agagccctccttctgcttgttcttg

SEQ ID NO: 153270 - DNA, 25 bp, Mus musculus
agagccctccttgtgcttgttcttg

SEQ ID NO: 153271 - DNA, 25 bp, Mus musculus
agagccctcgtgctttatgctttac

SEQ ID NO: 153272 - DNA, 25 bp, Mus musculus
agagccctcgtggtttatgctttac

SEQ ID NO: 153273 - DNA, 25 bp, Mus musculus
agagccctgagcattgttgtagaca

SEQ ID NO: 153274 - DNA, 25 bp, Mus musculus
agagccctgagctttgttgtagaca

SEQ ID NO: 153275 - DNA, 25 bp, Mus musculus
agagccctgagtatcctggatgtgc

SEQ ID NO: 153276 - DNA, 25 bp, Mus musculus
agagccctgagtttcctggatgtgc

SEQ ID NO: 153277 - DNA, 25 bp, Mus musculus
agagccctgatgcatgtctcctaac

SEQ ID NO: 153278 - DNA, 25 bp, Mus musculus
agagccctgatggatgtctcctaac

SEQ ID NO: 153279 - DNA, 25 bp, Mus musculus
agagccctgattacctttgctggga

SEQ ID NO: 153280 - DNA, 25 bp, Mus musculus
agagccctgatttcctttgctggga

SEQ ID NO: 153281 - DNA, 25 bp, Mus musculus
agagccctgcaacatggctgccgct

SEQ ID NO: 153282 - DNA, 25 bp, Mus musculus
agagccctgcaagatggctgccgct

SEQ ID NO: 153283 - DNA, 25 bp, Mus musculus
agagccctgcacacatgaggcaaga

SEQ ID NO: 153284 - DNA, 25 bp, Mus musculus
agagccctgcacactcgatagagca

SEQ ID NO: 153285 - DNA, 25 bp, Mus musculus
agagccctgcactcatgaggcaaga

SEQ ID NO: 153286 - DNA, 25 bp, Mus musculus
agagccctgcactctcgatagagca

SEQ ID NO: 153287 - DNA, 25 bp, Mus musculus
agagccctgccaaggcgaaaacggt

SEQ ID NO: 153288 - DNA, 25 bp, Mus musculus
agagccctgccatggcgaaaacggt

SEQ ID NO: 153289 - DNA, 25 bp, Mus musculus
agagccctgccccaacaaatgagga

SEQ ID NO: 153290 - DNA, 25 bp, Mus musculus
agagccctgcccgaacaaatgagga

SEQ ID NO: 153291 - DNA, 25 bp, Mus musculus
agagccctgctgatataggttctga

SEQ ID NO: 153292 - DNA, 25 bp, Mus musculus
agagccctgctgttataggttctga

SEQ ID NO: 153293 - DNA, 25 bp, Mus musculus
agagccctgcttcaacacttagtta

SEQ ID NO: 153294 - DNA, 25 bp, Mus musculus
agagccctgcttctaacactccttt

SEQ ID NO: 153295 - DNA, 25 bp, Mus musculus
agagccctgcttgaacacttagtta

SEQ ID NO: 153296 - DNA, 25 bp, Mus musculus
agagccctgcttgtaacactccttt

SEQ ID NO: 153297 - DNA, 25 bp, Mus musculus
agagccctgggtactacattctatc

SEQ ID NO: 153298 - DNA, 25 bp, Mus musculus
agagccctgggttctacattctatc

SEQ ID NO: 153299 - DNA, 25 bp, Mus musculus
agagccctggtcacaccaggaagtg

SEQ ID NO: 153300 - DNA, 25 bp, Mus musculus
agagccctggtcaggaggtacttgc

SEQ ID NO: 153301 - DNA, 25 bp, Mus musculus
agagccctggtcagtggccttggat

SEQ ID NO: 153302 - DNA, 25 bp, Mus musculus
agagccctggtctcaccaggaagtg

SEQ ID NO: 153303 - DNA, 25 bp, Mus musculus
agagccctggtctggaggtacttgc

SEQ ID NO: 153304 - DNA, 25 bp, Mus musculus
agagccctggtctgtggccttggat

SEQ ID NO: 153305 - DNA, 25 bp, Mus musculus
agagccctgtgacattttctggaag

SEQ ID NO: 153306 - DNA, 25 bp, Mus musculus
agagccctgtgagattttctggaag

SEQ ID NO: 153307 - DNA, 25 bp, Mus musculus
agagccctgtggaggtcaagtttcc

SEQ ID NO: 153308 - DNA, 25 bp, Mus musculus
agagccctgtggtggtcaagtttcc

SEQ ID NO: 153309 - DNA, 25 bp, Mus musculus
agagcccttcagaaagtgaggaccc

SEQ ID NO: 153310 - DNA, 25 bp, Mus musculus
agagcccttcagtaagtgaggaccc

SEQ ID NO: 153311 - DNA, 25 bp, Mus musculus
agagcccttcctacagtgggtgttt

SEQ ID NO: 153312 - DNA, 25 bp, Mus musculus
agagcccttccttcagtgggtgttt

SEQ ID NO: 153313 - DNA, 25 bp, Mus musculus
agagcccttctgatgaggactacat

SEQ ID NO: 153314 - DNA, 25 bp, Mus musculus
agagcccttctgttgaggactacat

SEQ ID NO: 153315 - DNA, 25 bp, Mus musculus
agagcccttgatcaggacatgtcag

SEQ ID NO: 153316 - DNA, 25 bp, Mus musculus
agagcccttgatgaggacatgtcag

SEQ ID NO: 153317 - DNA, 25 bp, Mus musculus
agagcccttgtaccctttatctggc

SEQ ID NO: 153318 - DNA, 25 bp, Mus musculus
agagcccttgtagcctttatctggc

SEQ ID NO: 153319 - DNA, 25 bp, Mus musculus
agagcccttgttactcttgtagaga

SEQ ID NO: 153320 - DNA, 25 bp, Mus musculus
agagcccttgttcggacagtcacac

SEQ ID NO: 153321 - DNA, 25 bp, Mus musculus
agagcccttgttgggacagtcacac

SEQ ID NO: 153322 - DNA, 25 bp, Mus musculus
agagcccttgtttctcttgtagaga

SEQ ID NO: 153323 - DNA, 25 bp, Mus musculus
agagccctttatcccagggtccaag

SEQ ID NO: 153324 - DNA, 25 bp, Mus musculus
agagccctttatgccagggtccaag

SEQ ID NO: 153325 - DNA, 25 bp, Mus musculus
agagccctttctattgctgagaggt

SEQ ID NO: 153326 - DNA, 25 bp, Mus musculus
agagccctttcttttgctgagaggt

SEQ ID NO: 153327 - DNA, 25 bp, Mus musculus
agagccgaagacagccctagggaat

SEQ ID NO: 153328 - DNA, 25 bp, Mus musculus
agagccgaagactgccctagggaat

SEQ ID NO: 153329 - DNA, 25 bp, Mus musculus
agagccgaatggcagaaatgccaat

SEQ ID NO: 153330 - DNA, 25 bp, Mus musculus
agagccgaatgggagaaatgccaat

SEQ ID NO: 153331 - DNA, 25 bp, Mus musculus
agagccgactttccacagcgcagct

SEQ ID NO: 153332 - DNA, 25 bp, Mus musculus
agagccgactttgcacagcgcagct

SEQ ID NO: 153333 - DNA, 25 bp, Mus musculus
agagccgagcagcagcttcatgcca

SEQ ID NO: 153334 - DNA, 25 bp, Mus musculus
agagccgagcaggagcttcatgcca

SEQ ID NO: 153335 - DNA, 25 bp, Mus musculus
agagccgatacacttgctttagtaa

SEQ ID NO: 153336 - DNA, 25 bp, Mus musculus
agagccgatacagttgctttagtaa

SEQ ID NO: 153337 - DNA, 25 bp, Mus musculus
agagccgattgtcccaacgaggact

SEQ ID NO: 153338 - DNA, 25 bp, Mus musculus
agagccgattgtgccaacgaggact

SEQ ID NO: 153339 - DNA, 25 bp, Mus musculus
agagccgcaagcagtctgtcacatc

SEQ ID NO: 153340 - DNA, 25 bp, Mus musculus
agagccgcaagctgtctgtcacatc

SEQ ID NO: 153341 - DNA, 25 bp, Mus musculus
agagccgcagcgacttggccagcag

SEQ ID NO: 153342 - DNA, 25 bp, Mus musculus
agagccgcagcgtcttggccagcag

SEQ ID NO: 153343 - DNA, 25 bp, Mus musculus
agagccgcagctacaacgactgggt

SEQ ID NO: 153344 - DNA, 25 bp, Mus musculus
agagccgcagctcataaccagttct

SEQ ID NO: 153345 - DNA, 25 bp, Mus musculus
agagccgcagctgataaccagttct

SEQ ID NO: 153346 - DNA, 25 bp, Mus musculus
agagccgcagcttcaacgactgggt

SEQ ID NO: 153347 - DNA, 25 bp, Mus musculus
agagccgcagtcagtttcaattctc

SEQ ID NO: 153348 - DNA, 25 bp, Mus musculus
agagccgcagtctgtttcaattctc

SEQ ID NO: 153349 - DNA, 25 bp, Mus musculus
agagccgcatccctttgccttgggt

SEQ ID NO: 153350 - DNA, 25 bp, Mus musculus
agagccgcatccgtttgccttgggt

SEQ ID NO: 153351 - DNA, 25 bp, Mus musculus
agagccgcatggaacaccgctggta

SEQ ID NO: 153352 - DNA, 25 bp, Mus musculus
agagccgcatggaggttttctcctg

SEQ ID NO: 153353 - DNA, 25 bp, Mus musculus
agagccgcatggtacaccgctggta

SEQ ID NO: 153354 - DNA, 25 bp, Mus musculus
agagccgcatggtggttttctcctg

SEQ ID NO: 153355 - DNA, 25 bp, Mus musculus
agagccgccgccagtacatcatgtt

SEQ ID NO: 153356 - DNA, 25 bp, Mus musculus
agagccgccgcctgtacatcatgtt

SEQ ID NO: 153357 - DNA, 25 bp, Mus musculus
agagccgcgtttactctgtggccga

SEQ ID NO: 153358 - DNA, 25 bp, Mus musculus
agagccgcgttttctctgtggccga

SEQ ID NO: 153359 - DNA, 25 bp, Mus musculus
agagccgctcccatagttaagtggt

SEQ ID NO: 153360 - DNA, 25 bp, Mus musculus
agagccgctcccttagttaagtggt

SEQ ID NO: 153361 - DNA, 25 bp, Mus musculus
agagccgctcggcaaaccaagatca

SEQ ID NO: 153362 - DNA, 25 bp, Mus musculus
agagccgctcgggaaaccaagatca

SEQ ID NO: 153363 - DNA, 25 bp, Mus musculus
agagccgctgcaagtggtggcctca

SEQ ID NO: 153364 - DNA, 25 bp, Mus musculus
agagccgctgcacagctacttctga

SEQ ID NO: 153365 - DNA, 25 bp, Mus musculus
agagccgctgcagagctacttctga

SEQ ID NO: 153366 - DNA, 25 bp, Mus musculus
agagccgctgcatgtggtggcctca

SEQ ID NO: 153367 - DNA, 25 bp, Mus musculus
agagccgctgggacaacggccttcg

SEQ ID NO: 153368 - DNA, 25 bp, Mus musculus
agagccgctgggtcaacggccttcg

SEQ ID NO: 153369 - DNA, 25 bp, Mus musculus
agagccgctgtacatgtgccacaca

SEQ ID NO: 153370 - DNA, 25 bp, Mus musculus
agagccgctgtagatgtgccacaca

SEQ ID NO: 153371 - DNA, 25 bp, Mus musculus
agagccggaagcatcaactgaaata

SEQ ID NO: 153372 - DNA, 25 bp, Mus musculus
agagccggaagcttcaactgaaata

SEQ ID NO: 153373 - DNA, 25 bp, Mus musculus
agagccggaattcaagttcacactt

SEQ ID NO: 153374 - DNA, 25 bp, Mus musculus
agagccggaattgaagttcacactt

SEQ ID NO: 153375 - DNA, 25 bp, Mus musculus
agagccggactaagtgcagccccag

SEQ ID NO: 153376 - DNA, 25 bp, Mus musculus
agagccggactatgtgcagccccag

SEQ ID NO: 153377 - DNA, 25 bp, Mus musculus
agagccggagagcacatctgtctca

SEQ ID NO: 153378 - DNA, 25 bp, Mus musculus
agagccggagaggacatctgtctca

SEQ ID NO: 153379 - DNA, 25 bp, Mus musculus
agagccggatctcagtgccggttca

SEQ ID NO: 153380 - DNA, 25 bp, Mus musculus
agagccggatctgagtgccggttca

SEQ ID NO: 153381 - DNA, 25 bp, Mus musculus
agagccggattcatccaatgtgcag

SEQ ID NO: 153382 - DNA, 25 bp, Mus musculus
agagccggattcttccaatgtgcag

SEQ ID NO: 153383 - DNA, 25 bp, Mus musculus
agagccggcaaaccagtgctccaga

SEQ ID NO: 153384 - DNA, 25 bp, Mus musculus
agagccggcaaagcagtgctccaga

SEQ ID NO: 153385 - DNA, 25 bp, Mus musculus
agagccggcttcagattggccagag

SEQ ID NO: 153386 - DNA, 25 bp, Mus musculus
agagccggcttctgattggccagag

SEQ ID NO: 153387 - DNA, 25 bp, Mus musculus
agagccggtctcagaactgctgctt

SEQ ID NO: 153388 - DNA, 25 bp, Mus musculus
agagccggtctctgaactgctgctt

SEQ ID NO: 153389 - DNA, 25 bp, Mus musculus
agagccggtttaattttcattatcg

SEQ ID NO: 153390 - DNA, 25 bp, Mus musculus
agagccggtttatttttcattatcg

SEQ ID NO: 153391 - DNA, 25 bp, Mus musculus
agagccgtaatgacgttggccttgc

SEQ ID NO: 153392 - DNA, 25 bp, Mus musculus
agagccgtaatgtcgttggccttgc

SEQ ID NO: 153393 - DNA, 25 bp, Mus musculus
agagccgtacacaccaatggttagt

SEQ ID NO: 153394 - DNA, 25 bp, Mus musculus
agagccgtacactccaatggttagt

SEQ ID NO: 153395 - DNA, 25 bp, Mus musculus
agagccgtacccacgaagacctctt

SEQ ID NO: 153396 - DNA, 25 bp, Mus musculus
agagccgtaccctcgaagacctctt

SEQ ID NO: 153397 - DNA, 25 bp, Mus musculus
agagccgtatgtctggccactgagc

SEQ ID NO: 153398 - DNA, 25 bp, Mus musculus
agagccgtatgtgtggccactgagc

SEQ ID NO: 153399 - DNA, 25 bp, Mus musculus
agagccgtctcaagctggcagtatt

SEQ ID NO: 153400 - DNA, 25 bp, Mus musculus
agagccgtctcatgctggcagtatt

SEQ ID NO: 153401 - DNA, 25 bp, Mus musculus
agagccgtctctatgaaccgaggga

SEQ ID NO: 153402 - DNA, 25 bp, Mus musculus
agagccgtctctccgtgtgtattac

SEQ ID NO: 153403 - DNA, 25 bp, Mus musculus
agagccgtctctgcgtgtgtattac

SEQ ID NO: 153404 - DNA, 25 bp, Mus musculus
agagccgtctctttgaaccgaggga

SEQ ID NO: 153405 - DNA, 25 bp, Mus musculus
agagccgtgaccctggaggcacctt

SEQ ID NO: 153406 - DNA, 25 bp, Mus musculus
agagccgtgaccgtggaggcacctt

SEQ ID NO: 153407 - DNA, 25 bp, Mus musculus
agagccgtgcaacatcccagggagt

SEQ ID NO: 153408 - DNA, 25 bp, Mus musculus
agagccgtgcaagatcccagggagt

SEQ ID NO: 153409 - DNA, 25 bp, Mus musculus
agagccgtgctgacttcagagtttc

SEQ ID NO: 153410 - DNA, 25 bp, Mus musculus
agagccgtgctgtcttcagagtttc

SEQ ID NO: 153411 - DNA, 25 bp, Mus musculus
agagccgttcagactggcagatctt

SEQ ID NO: 153412 - DNA, 25 bp, Mus musculus
agagccgttcagtctggcagatctt

SEQ ID NO: 153413 - DNA, 25 bp, Mus musculus
agagccgttccaacagcctgtgttt

SEQ ID NO: 153414 - DNA, 25 bp, Mus musculus
agagccgttccaccgtctagtaaaa

SEQ ID NO: 153415 - DNA, 25 bp, Mus musculus
agagccgttccagcgtctagtaaaa

SEQ ID NO: 153416 - DNA, 25 bp, Mus musculus
agagccgttccatcagcctgtgttt

SEQ ID NO: 153417 - DNA, 25 bp, Mus musculus
agagccgttcttcccatcctttctg

SEQ ID NO: 153418 - DNA, 25 bp, Mus musculus
agagccgttcttgccatcctttctg

SEQ ID NO: 153419 - DNA, 25 bp, Mus musculus
agagccgttggaagatctcttccca

SEQ ID NO: 153420 - DNA, 25 bp, Mus musculus
agagccgttggatgatctcttccca

SEQ ID NO: 153421 - DNA, 25 bp, Mus musculus
agagcctaacaacatagcattgcta

SEQ ID NO: 153422 - DNA, 25 bp, Mus musculus
agagcctaacaagatagcattgcta

SEQ ID NO: 153423 - DNA, 25 bp, Mus musculus
agagcctaacagagggtagcaggac

SEQ ID NO: 153424 - DNA, 25 bp, Mus musculus
agagcctaacagtgggtagcaggac

SEQ ID NO: 153425 - DNA, 25 bp, Mus musculus
agagcctaagagacctcacggcaca

SEQ ID NO: 153426 - DNA, 25 bp, Mus musculus
agagcctaagagtcctcacggcaca

SEQ ID NO: 153427 - DNA, 25 bp, Mus musculus
agagcctaattcatcactcagttct

SEQ ID NO: 153428 - DNA, 25 bp, Mus musculus
agagcctaattcttcactcagttct

SEQ ID NO: 153429 - DNA, 25 bp, Mus musculus
agagcctacaagatttgtgttgaga

SEQ ID NO: 153430 - DNA, 25 bp, Mus musculus
agagcctacaagttttgtgttgaga

SEQ ID NO: 153431 - DNA, 25 bp, Mus musculus
agagcctacagaaggtaccaaattt

SEQ ID NO: 153432 - DNA, 25 bp, Mus musculus
agagcctacagaattttagttactg

SEQ ID NO: 153433 - DNA, 25 bp, Mus musculus
agagcctacagatggtaccaaattt

SEQ ID NO: 153434 - DNA, 25 bp, Mus musculus
agagcctacagatttttagttactg

SEQ ID NO: 153435 - DNA, 25 bp, Mus musculus
agagcctacattagtcattgacctg

SEQ ID NO: 153436 - DNA, 25 bp, Mus musculus
agagcctacatttgtcattgacctg

SEQ ID NO: 153437 - DNA, 25 bp, Mus musculus
agagcctactagcatttgcctacac

SEQ ID NO: 153438 - DNA, 25 bp, Mus musculus
agagcctactaggatttgcctacac

SEQ ID NO: 153439 - DNA, 25 bp, Mus musculus
agagcctacttcagcttacagctta

SEQ ID NO: 153440 - DNA, 25 bp, Mus musculus
agagcctacttctgcttacagctta

SEQ ID NO: 153441 - DNA, 25 bp, Mus musculus
agagcctagcggctgcccattctaa

SEQ ID NO: 153442 - DNA, 25 bp, Mus musculus
agagcctagcgggtgcccattctaa

SEQ ID NO: 153443 - DNA, 25 bp, Mus musculus
agagcctagctgaatgtccgaagga

SEQ ID NO: 153444 - DNA, 25 bp, Mus musculus
agagcctagctgtatgtccgaagga

SEQ ID NO: 153445 - DNA, 25 bp, Mus musculus
agagcctagcttcttccctaattct

SEQ ID NO: 153446 - DNA, 25 bp, Mus musculus
agagcctagcttgttccctaattct

SEQ ID NO: 153447 - DNA, 25 bp, Mus musculus
agagcctaggaactgagaacctttt

SEQ ID NO: 153448 - DNA, 25 bp, Mus musculus
agagcctaggaagtgagaacctttt

SEQ ID NO: 153449 - DNA, 25 bp, Mus musculus
agagcctagtgaacctggctagaat

SEQ ID NO: 153450 - DNA, 25 bp, Mus musculus
agagcctagtgatcctggctagaat

SEQ ID NO: 153451 - DNA, 25 bp, Mus musculus
agagcctatattaaaacagaaacag

SEQ ID NO: 153452 - DNA, 25 bp, Mus musculus
agagcctatatttaaacagaaacag

SEQ ID NO: 153453 - DNA, 25 bp, Mus musculus
agagcctatcctcctatgctgtgga

SEQ ID NO: 153454 - DNA, 25 bp, Mus musculus
agagcctatcctgctatgctgtgga

SEQ ID NO: 153455 - DNA, 25 bp, Mus musculus
agagcctatgctaatactcccatga

SEQ ID NO: 153456 - DNA, 25 bp, Mus musculus
agagcctatgcttatactcccatga

SEQ ID NO: 153457 - DNA, 25 bp, Mus musculus
agagcctatggcacaacctgcactt

SEQ ID NO: 153458 - DNA, 25 bp, Mus musculus
agagcctatggcatctagtgaccac

SEQ ID NO: 153459 - DNA, 25 bp, Mus musculus
agagcctatggctcaacctgcactt

SEQ ID NO: 153460 - DNA, 25 bp, Mus musculus
agagcctatggcttctagtgaccac

SEQ ID NO: 153461 - DNA, 25 bp, Mus musculus
agagcctcaaaaatcagacctgtag

SEQ ID NO: 153462 - DNA, 25 bp, Mus musculus
agagcctcaaaattcagacctgtag

SEQ ID NO: 153463 - DNA, 25 bp, Mus musculus
agagcctcaaagaccctggtacaag

SEQ ID NO: 153464 - DNA, 25 bp, Mus musculus
agagcctcaaagtccctggtacaag

SEQ ID NO: 153465 - DNA, 25 bp, Mus musculus
agagcctcaaggaagacagcagaac

SEQ ID NO: 153466 - DNA, 25 bp, Mus musculus
agagcctcaaggtagacagcagaac

SEQ ID NO: 153467 - DNA, 25 bp, Mus musculus
agagcctcaatgacaacgatgcctg

SEQ ID NO: 153468 - DNA, 25 bp, Mus musculus
agagcctcaatgtcaacgatgcctg

SEQ ID NO: 153469 - DNA, 25 bp, Mus musculus
agagcctcagcaaggtctacactat

SEQ ID NO: 153470 - DNA, 25 bp, Mus musculus
agagcctcagcaccttggcggtccg

SEQ ID NO: 153471 - DNA, 25 bp, Mus musculus
agagcctcagcagcttggcggtccg

SEQ ID NO: 153472 - DNA, 25 bp, Mus musculus
agagcctcagcatggtctacactat

SEQ ID NO: 153473 - DNA, 25 bp, Mus musculus
agagcctcaggtaaactccctagat

SEQ ID NO: 153474 - DNA, 25 bp, Mus musculus
agagcctcaggttaactccctagat

SEQ ID NO: 153475 - DNA, 25 bp, Mus musculus
agagcctcagtcactatggcaccat

SEQ ID NO: 153476 - DNA, 25 bp, Mus musculus
agagcctcagtctctatggcaccat

SEQ ID NO: 153477 - DNA, 25 bp, Mus musculus
agagcctcatctactacaggaatga

SEQ ID NO: 153478 - DNA, 25 bp, Mus musculus
agagcctcatcttctacaggaatga

SEQ ID NO: 153479 - DNA, 25 bp, Mus musculus
agagcctcccctatgttaggaccgg

SEQ ID NO: 153480 - DNA, 25 bp, Mus musculus
agagcctcccctttgttaggaccgg

SEQ ID NO: 153481 - DNA, 25 bp, Mus musculus
agagcctccctgaagggctaccagt

SEQ ID NO: 153482 - DNA, 25 bp, Mus musculus
agagcctccctgtagggctaccagt

SEQ ID NO: 153483 - DNA, 25 bp, Mus musculus
agagcctccgatattgcctaagaaa

SEQ ID NO: 153484 - DNA, 25 bp, Mus musculus
agagcctccgattttgcctaagaaa

SEQ ID NO: 153485 - DNA, 25 bp, Mus musculus
agagcctccgtgagtaatcattcag

SEQ ID NO: 153486 - DNA, 25 bp, Mus musculus
agagcctccgtgtgtaatcattcag

SEQ ID NO: 153487 - DNA, 25 bp, Mus musculus
agagcctcctgtagcccatgatagt

SEQ ID NO: 153488 - DNA, 25 bp, Mus musculus
agagcctcctgttgcccatgatagt

SEQ ID NO: 153489 - DNA, 25 bp, Mus musculus
agagcctccttgattgagttctgtc

SEQ ID NO: 153490 - DNA, 25 bp, Mus musculus
agagcctccttgtttgagttctgtc

SEQ ID NO: 153491 - DNA, 25 bp, Mus musculus
agagcctcgaatcacacccacggat

SEQ ID NO: 153492 - DNA, 25 bp, Mus musculus
agagcctcgaatgacacccacggat

SEQ ID NO: 153493 - DNA, 25 bp, Mus musculus
agagcctcgatccttcaaacctgat

SEQ ID NO: 153494 - DNA, 25 bp, Mus musculus
agagcctcgatcgttcaaacctgat

SEQ ID NO: 153495 - DNA, 25 bp, Mus musculus
agagcctcggacagaatggccttca

SEQ ID NO: 153496 - DNA, 25 bp, Mus musculus
agagcctcggactgaatggccttca

SEQ ID NO: 153497 - DNA, 25 bp, Mus musculus
agagcctcgtttcgttctacttaca

SEQ ID NO: 153498 - DNA, 25 bp, Mus musculus
agagcctcgtttggttctacttaca

SEQ ID NO: 153499 - DNA, 25 bp, Mus musculus
agagcctctaagctgaagagtttga

SEQ ID NO: 153500 - DNA, 25 bp, Mus musculus
agagcctctaaggtgaagagtttga

SEQ ID NO: 153501 - DNA, 25 bp, Mus musculus
agagcctctagcatctcagtggaga

SEQ ID NO: 153502 - DNA, 25 bp, Mus musculus
agagcctctagcttctcagtggaga

SEQ ID NO: 153503 - DNA, 25 bp, Mus musculus
agagcctctatgagtgctgacctaa

SEQ ID NO: 153504 - DNA, 25 bp, Mus musculus
agagcctctatgtgtgctgacctaa

SEQ ID NO: 153505 - DNA, 25 bp, Mus musculus
agagcctctctcaggagcgtatcta

SEQ ID NO: 153506 - DNA, 25 bp, Mus musculus
agagcctctctctggagcgtatcta

SEQ ID NO: 153507 - DNA, 25 bp, Mus musculus
agagcctctcttagctgtcattgat

SEQ ID NO: 153508 - DNA, 25 bp, Mus musculus
agagcctctctttgctgtcattgat

SEQ ID NO: 153509 - DNA, 25 bp, Mus musculus
agagcctctgaaacatctagtgaca

SEQ ID NO: 153510 - DNA, 25 bp, Mus musculus
agagcctctgaatcatctagtgaca

SEQ ID NO: 153511 - DNA, 25 bp, Mus musculus
agagcctctgcaagtttgagatccc

SEQ ID NO: 153512 - DNA, 25 bp, Mus musculus
agagcctctgcatgtttgagatccc

SEQ ID NO: 153513 - DNA, 25 bp, Mus musculus
agagcctctgccaacaacaaccgag

SEQ ID NO: 153514 - DNA, 25 bp, Mus musculus
agagcctctgcctacaacaaccgag

SEQ ID NO: 153515 - DNA, 25 bp, Mus musculus
agagcctctggaaaagcgttgtgat

SEQ ID NO: 153516 - DNA, 25 bp, Mus musculus
agagcctctggataagcgttgtgat

SEQ ID NO: 153517 - DNA, 25 bp, Mus musculus
agagcctctgggatcgtctcttcct

SEQ ID NO: 153518 - DNA, 25 bp, Mus musculus
agagcctctgggttcgtctcttcct

SEQ ID NO: 153519 - DNA, 25 bp, Mus musculus
agagcctcttccagtcagtatttgt

SEQ ID NO: 153520 - DNA, 25 bp, Mus musculus
agagcctcttcctgtcagtatttgt

SEQ ID NO: 153521 - DNA, 25 bp, Mus musculus
agagcctgacctcccaggagagtga

SEQ ID NO: 153522 - DNA, 25 bp, Mus musculus
agagcctgacctgccaggagagtga

SEQ ID NO: 153523 - DNA, 25 bp, Mus musculus
agagcctgactaatgcttctggaat

SEQ ID NO: 153524 - DNA, 25 bp, Mus musculus
agagcctgactattgcttctggaat

SEQ ID NO: 153525 - DNA, 25 bp, Mus musculus
agagcctgagacatgcacatctacc

SEQ ID NO: 153526 - DNA, 25 bp, Mus musculus
agagcctgagacttgcacatctacc

SEQ ID NO: 153527 - DNA, 25 bp, Mus musculus
agagcctgagccagtgaaaccagaa

SEQ ID NO: 153528 - DNA, 25 bp, Mus musculus
agagcctgagcctgtgaaaccagaa

SEQ ID NO: 153529 - DNA, 25 bp, Mus musculus
agagcctgagctcccttgattggca

SEQ ID NO: 153530 - DNA, 25 bp, Mus musculus
agagcctgagctgccttgattggca

SEQ ID NO: 153531 - DNA, 25 bp, Mus musculus
agagcctgagggagaaggtcaactc

SEQ ID NO: 153532 - DNA, 25 bp, Mus musculus
agagcctgagggtgaaggtcaactc

SEQ ID NO: 153533 - DNA, 25 bp, Mus musculus
agagcctgataaactgagacctggt

SEQ ID NO: 153534 - DNA, 25 bp, Mus musculus
agagcctgataatctgagacctggt

SEQ ID NO: 153535 - DNA, 25 bp, Mus musculus
agagcctgatgacaacccatcctcg

SEQ ID NO: 153536 - DNA, 25 bp, Mus musculus
agagcctgatgagaacccatcctcg

SEQ ID NO: 153537 - DNA, 25 bp, Mus musculus
agagcctgatgcctgagtttaaccc

SEQ ID NO: 153538 - DNA, 25 bp, Mus musculus
agagcctgatgcgtgagtttaaccc

SEQ ID NO: 153539 - DNA, 25 bp, Mus musculus
agagcctgcagcagcgatgtggatt

SEQ ID NO: 153540 - DNA, 25 bp, Mus musculus
agagcctgcagcatttagtaaccgg

SEQ ID NO: 153541 - DNA, 25 bp, Mus musculus
agagcctgcagctgcgatgtggatt

SEQ ID NO: 153542 - DNA, 25 bp, Mus musculus
agagcctgcagcttttagtaaccgg

SEQ ID NO: 153543 - DNA, 25 bp, Mus musculus
agagcctgccagatttatctcgttt

SEQ ID NO: 153544 - DNA, 25 bp, Mus musculus
agagcctgccagttttatctcgttt

SEQ ID NO: 153545 - DNA, 25 bp, Mus musculus
agagcctgcctaaatgatgttcaag

SEQ ID NO: 153546 - DNA, 25 bp, Mus musculus
agagcctgcctacacagtgatacac

SEQ ID NO: 153547 - DNA, 25 bp, Mus musculus
agagcctgcctagacagtgatacac

SEQ ID NO: 153548 - DNA, 25 bp, Mus musculus
agagcctgcctatatgatgttcaag

SEQ ID NO: 153549 - DNA, 25 bp, Mus musculus
agagcctgccttaaagactggtttt

SEQ ID NO: 153550 - DNA, 25 bp, Mus musculus
agagcctgcctttaagactggtttt

SEQ ID NO: 153551 - DNA, 25 bp, Mus musculus
agagcctgctagcagaacccaacat

SEQ ID NO: 153552 - DNA, 25 bp, Mus musculus
agagcctgctaggagaacccaacat

SEQ ID NO: 153553 - DNA, 25 bp, Mus musculus
agagcctgctcaacatgcacgaagt

SEQ ID NO: 153554 - DNA, 25 bp, Mus musculus
agagcctgctcactgtcggaggaca

SEQ ID NO: 153555 - DNA, 25 bp, Mus musculus
agagcctgctcagtgtcggaggaca

SEQ ID NO: 153556 - DNA, 25 bp, Mus musculus
agagcctgctcatcatgcacgaagt

SEQ ID NO: 153557 - DNA, 25 bp, Mus musculus
agagcctgctgaaacgataccaacc

SEQ ID NO: 153558 - DNA, 25 bp, Mus musculus
agagcctgctgatacgataccaacc

SEQ ID NO: 153559 - DNA, 25 bp, Mus musculus
agagcctgctgccacacaaggctgc

SEQ ID NO: 153560 - DNA, 25 bp, Mus musculus
agagcctgctgcgacacaaggctgc

SEQ ID NO: 153561 - DNA, 25 bp, Mus musculus
agagcctgcttcaatgctctgtaag

SEQ ID NO: 153562 - DNA, 25 bp, Mus musculus
agagcctgcttctatgctctgtaag

SEQ ID NO: 153563 - DNA, 25 bp, Mus musculus
agagcctggcacatagcctgaggac

SEQ ID NO: 153564 - DNA, 25 bp, Mus musculus
agagcctggcacttagcctgaggac

SEQ ID NO: 153565 - DNA, 25 bp, Mus musculus
agagcctggcagaggagatcccaag

SEQ ID NO: 153566 - DNA, 25 bp, Mus musculus
agagcctggcagtggagatcccaag

SEQ ID NO: 153567 - DNA, 25 bp, Mus musculus
agagcctggctcaatctagactggc

SEQ ID NO: 153568 - DNA, 25 bp, Mus musculus
agagcctggctcactatgggcagca

SEQ ID NO: 153569 - DNA, 25 bp, Mus musculus
agagcctggctctatctagactggc

SEQ ID NO: 153570 - DNA, 25 bp, Mus musculus
agagcctggctctctatgggcagca

SEQ ID NO: 153571 - DNA, 25 bp, Mus musculus
agagcctgggacacagcctcggagt

SEQ ID NO: 153572 - DNA, 25 bp, Mus musculus
agagcctgggacagctttgcagcca

SEQ ID NO: 153573 - DNA, 25 bp, Mus musculus
agagcctgggactcagcctcggagt

SEQ ID NO: 153574 - DNA, 25 bp, Mus musculus
agagcctgggactgctttgcagcca

SEQ ID NO: 153575 - DNA, 25 bp, Mus musculus
agagcctgggcaaagcatggcccag

SEQ ID NO: 153576 - DNA, 25 bp, Mus musculus
agagcctgggcatagcatggcccag

SEQ ID NO: 153577 - DNA, 25 bp, Mus musculus
agagcctgggccacaggcgcacagc

SEQ ID NO: 153578 - DNA, 25 bp, Mus musculus
agagcctgggccatcactgccagtg

SEQ ID NO: 153579 - DNA, 25 bp, Mus musculus
agagcctgggcctcaggcgcacagc

SEQ ID NO: 153580 - DNA, 25 bp, Mus musculus
agagcctgggccttcactgccagtg

SEQ ID NO: 153581 - DNA, 25 bp, Mus musculus
agagcctgggtcaatttgcaggtaa

SEQ ID NO: 153582 - DNA, 25 bp, Mus musculus
agagcctgggtcacagcgtggactc

SEQ ID NO: 153583 - DNA, 25 bp, Mus musculus
agagcctgggtctatttgcaggtaa

SEQ ID NO: 153584 - DNA, 25 bp, Mus musculus
agagcctgggtctcagcgtggactc

SEQ ID NO: 153585 - DNA, 25 bp, Mus musculus
agagcctgggtgctacctctggcaa

SEQ ID NO: 153586 - DNA, 25 bp, Mus musculus
agagcctgggtggtacctctggcaa

SEQ ID NO: 153587 - DNA, 25 bp, Mus musculus
agagcctggtctcctttacggatga

SEQ ID NO: 153588 - DNA, 25 bp, Mus musculus
agagcctggtctgctttacggatga

SEQ ID NO: 153589 - DNA, 25 bp, Mus musculus
agagcctgtcatagctggcctggac

SEQ ID NO: 153590 - DNA, 25 bp, Mus musculus
agagcctgtcattgctggcctggac

SEQ ID NO: 153591 - DNA, 25 bp, Mus musculus
agagcctgtccaaaacctgcacagt

SEQ ID NO: 153592 - DNA, 25 bp, Mus musculus
agagcctgtccataacctgcacagt

SEQ ID NO: 153593 - DNA, 25 bp, Mus musculus
agagcctgtctcagggaattgcccc

SEQ ID NO: 153594 - DNA, 25 bp, Mus musculus
agagcctgtctccaggcagcattga

SEQ ID NO: 153595 - DNA, 25 bp, Mus musculus
agagcctgtctcgaggcagcattga

SEQ ID NO: 153596 - DNA, 25 bp, Mus musculus
agagcctgtctctgggaattgcccc

SEQ ID NO: 153597 - DNA, 25 bp, Mus musculus
agagcctgtgctctgccagtggtca

SEQ ID NO: 153598 - DNA, 25 bp, Mus musculus
agagcctgtgctgtgccagtggtca

SEQ ID NO: 153599 - DNA, 25 bp, Mus musculus
agagcctgtggaagcctgtagccca

SEQ ID NO: 153600 - DNA, 25 bp, Mus musculus
agagcctgtggatgcctgtagccca

SEQ ID NO: 153601 - DNA, 25 bp, Mus musculus
agagcctgttggcttttccttatcg

SEQ ID NO: 153602 - DNA, 25 bp, Mus musculus
agagcctgttgggttttccttatcg

SEQ ID NO: 153603 - DNA, 25 bp, Mus musculus
agagcctgttgtattgccccaaatc

SEQ ID NO: 153604 - DNA, 25 bp, Mus musculus
agagcctgttgttttgccccaaatc

SEQ ID NO: 153605 - DNA, 25 bp, Mus musculus
agagccttacgaaacagctaacaaa

SEQ ID NO: 153606 - DNA, 25 bp, Mus musculus
agagccttacgatacagctaacaaa

SEQ ID NO: 153607 - DNA, 25 bp, Mus musculus
agagccttcattagtgtccacggga

SEQ ID NO: 153608 - DNA, 25 bp, Mus musculus
agagccttcatttgtgtccacggga

SEQ ID NO: 153609 - DNA, 25 bp, Mus musculus
agagccttccaccagatcttaagtt

SEQ ID NO: 153610 - DNA, 25 bp, Mus musculus
agagccttccacgagatcttaagtt

SEQ ID NO: 153611 - DNA, 25 bp, Mus musculus
agagccttcccgagcgctgctcttg

SEQ ID NO: 153612 - DNA, 25 bp, Mus musculus
agagccttcccgtgcgctgctcttg

SEQ ID NO: 153613 - DNA, 25 bp, Mus musculus
agagccttcctaagccatggtggtt

SEQ ID NO: 153614 - DNA, 25 bp, Mus musculus
agagccttcctatgccatggtggtt

SEQ ID NO: 153615 - DNA, 25 bp, Mus musculus
agagccttcctcctgttagtgacta

SEQ ID NO: 153616 - DNA, 25 bp, Mus musculus
agagccttcctcgtgttagtgacta

SEQ ID NO: 153617 - DNA, 25 bp, Mus musculus
agagccttcgagcaccaccgtgtgg

SEQ ID NO: 153618 - DNA, 25 bp, Mus musculus
agagccttcgaggaccaccgtgtgg

SEQ ID NO: 153619 - DNA, 25 bp, Mus musculus
agagccttcgtacccaagcaaagtt

SEQ ID NO: 153620 - DNA, 25 bp, Mus musculus
agagccttcgtagccaagcaaagtt

SEQ ID NO: 153621 - DNA, 25 bp, Mus musculus
agagccttctagacatcgttggttt

SEQ ID NO: 153622 - DNA, 25 bp, Mus musculus
agagccttctagtcatcgttggttt

SEQ ID NO: 153623 - DNA, 25 bp, Mus musculus
agagccttctccatagccactgtaa

SEQ ID NO: 153624 - DNA, 25 bp, Mus musculus
agagccttctccttagccactgtaa

SEQ ID NO: 153625 - DNA, 25 bp, Mus musculus
agagccttctgcagtgttcacaggt

SEQ ID NO: 153626 - DNA, 25 bp, Mus musculus
agagccttctgcatagtatttaaga

SEQ ID NO: 153627 - DNA, 25 bp, Mus musculus
agagccttctgctgtgttcacaggt

SEQ ID NO: 153628 - DNA, 25 bp, Mus musculus
agagccttctgcttagtatttaaga

SEQ ID NO: 153629 - DNA, 25 bp, Mus musculus
agagccttcttcctgatggtagcgg

SEQ ID NO: 153630 - DNA, 25 bp, Mus musculus
agagccttcttcgtgatggtagcgg

SEQ ID NO: 153631 - DNA, 25 bp, Mus musculus
agagccttctttcataccaggacat

SEQ ID NO: 153632 - DNA, 25 bp, Mus musculus
agagccttctttgataccaggacat

SEQ ID NO: 153633 - DNA, 25 bp, Mus musculus
agagccttgacactcctggtacaaa

SEQ ID NO: 153634 - DNA, 25 bp, Mus musculus
agagccttgacagtcctggtacaaa

SEQ ID NO: 153635 - DNA, 25 bp, Mus musculus
agagccttgcatctgaactgggaca

SEQ ID NO: 153636 - DNA, 25 bp, Mus musculus
agagccttgcatgtgaactgggaca

SEQ ID NO: 153637 - DNA, 25 bp, Mus musculus
agagccttgccaagtattctcttgc

SEQ ID NO: 153638 - DNA, 25 bp, Mus musculus
agagccttgccatgtattctcttgc

SEQ ID NO: 153639 - DNA, 25 bp, Mus musculus
agagccttgccccaagcatgttttt

SEQ ID NO: 153640 - DNA, 25 bp, Mus musculus
agagccttgcccgaagcatgttttt

SEQ ID NO: 153641 - DNA, 25 bp, Mus musculus
agagccttgctgagactcaatgtga

SEQ ID NO: 153642 - DNA, 25 bp, Mus musculus
agagccttgctgtgactcaatgtga

SEQ ID NO: 153643 - DNA, 25 bp, Mus musculus
agagccttggctactgacagtcctt

SEQ ID NO: 153644 - DNA, 25 bp, Mus musculus
agagccttggcttctgacagtcctt

SEQ ID NO: 153645 - DNA, 25 bp, Mus musculus
agagccttgtctagctgagtcattc

SEQ ID NO: 153646 - DNA, 25 bp, Mus musculus
agagccttgtcttgctgagtcattc

SEQ ID NO: 153647 - DNA, 25 bp, Mus musculus
agagccttgtgcagctgtagaagag

SEQ ID NO: 153648 - DNA, 25 bp, Mus musculus
agagccttgtgcattaaaatcttca

SEQ ID NO: 153649 - DNA, 25 bp, Mus musculus
agagccttgtgctgctgtagaagag

SEQ ID NO: 153650 - DNA, 25 bp, Mus musculus
agagccttgtgctttaaaatcttca

SEQ ID NO: 153651 - DNA, 25 bp, Mus musculus
agagccttgtgtattaaccactgag

SEQ ID NO: 153652 - DNA, 25 bp, Mus musculus
agagccttgtgtcttgtctagagaa

SEQ ID NO: 153653 - DNA, 25 bp, Mus musculus
agagccttgtgtgttgtctagagaa

SEQ ID NO: 153654 - DNA, 25 bp, Mus musculus
agagccttgtgttttaaccactgag

SEQ ID NO: 153655 - DNA, 25 bp, Mus musculus
agagccttgttacagacctagccag

SEQ ID NO: 153656 - DNA, 25 bp, Mus musculus
agagccttgttagagacctagccag

SEQ ID NO: 153657 - DNA, 25 bp, Mus musculus
agagccttgttcaccctcggtgtgc

SEQ ID NO: 153658 - DNA, 25 bp, Mus musculus
agagccttgttctccctcggtgtgc

SEQ ID NO: 153659 - DNA, 25 bp, Mus musculus
agagcctttcctatgatgccaatac

SEQ ID NO: 153660 - DNA, 25 bp, Mus musculus
agagcctttcctttgatgccaatac

SEQ ID NO: 153661 - DNA, 25 bp, Mus musculus
agagcctttctcactgaacccattg

SEQ ID NO: 153662 - DNA, 25 bp, Mus musculus
agagcctttctctctgaacccattg

SEQ ID NO: 153663 - DNA, 25 bp, Mus musculus
agagcctttcttctcagacttaccg

SEQ ID NO: 153664 - DNA, 25 bp, Mus musculus
agagcctttcttgtcagacttaccg

SEQ ID NO: 153665 - DNA, 25 bp, Mus musculus
agagcctttgatatgggagcaactg

SEQ ID NO: 153666 - DNA, 25 bp, Mus musculus
agagcctttgatttgggagcaactg

SEQ ID NO: 153667 - DNA, 25 bp, Mus musculus
agagcctttgttcagcattaagctt

SEQ ID NO: 153668 - DNA, 25 bp, Mus musculus
agagcctttgttgagcattaagctt

SEQ ID NO: 153669 - DNA, 25 bp, Mus musculus
agagcgaagcccaatctggagactt

SEQ ID NO: 153670 - DNA, 25 bp, Mus musculus
agagcgaagccctatctggagactt

SEQ ID NO: 153671 - DNA, 25 bp, Mus musculus
agagcgaagggcagggctgacctca

SEQ ID NO: 153672 - DNA, 25 bp, Mus musculus
agagcgaagggctgggctgacctca

SEQ ID NO: 153673 - DNA, 25 bp, Mus musculus
agagcgaagtccctggtgctttcac

SEQ ID NO: 153674 - DNA, 25 bp, Mus musculus
agagcgaagtccgtggtgctttcac

SEQ ID NO: 153675 - DNA, 25 bp, Mus musculus
agagcgacaactcgatggcggccct

SEQ ID NO: 153676 - DNA, 25 bp, Mus musculus
agagcgacaactggatggcggccct

SEQ ID NO: 153677 - DNA, 25 bp, Mus musculus
agagcgacagctactctgggttcag

SEQ ID NO: 153678 - DNA, 25 bp, Mus musculus
agagcgacagcttctctgggttcag

SEQ ID NO: 153679 - DNA, 25 bp, Mus musculus
agagcgacaggaatgcaggctcaca

SEQ ID NO: 153680 - DNA, 25 bp, Mus musculus
agagcgacaggattgcaggctcaca

SEQ ID NO: 153681 - DNA, 25 bp, Mus musculus
agagcgacatcaaggtattcccctt

SEQ ID NO: 153682 - DNA, 25 bp, Mus musculus
agagcgacatcatggtattcccctt

SEQ ID NO: 153683 - DNA, 25 bp, Mus musculus
agagcgaccgtgcatgtgccgccat

SEQ ID NO: 153684 - DNA, 25 bp, Mus musculus
agagcgaccgtggatgtgccgccat

SEQ ID NO: 153685 - DNA, 25 bp, Mus musculus
agagcgacgcttactacgtgaggtg

SEQ ID NO: 153686 - DNA, 25 bp, Mus musculus
agagcgacgctttctacgtgaggtg

SEQ ID NO: 153687 - DNA, 25 bp, Mus musculus
agagcgactgctctgtacatcacga

SEQ ID NO: 153688 - DNA, 25 bp, Mus musculus
agagcgactgctgtgtacatcacga

SEQ ID NO: 153689 - DNA, 25 bp, Mus musculus
agagcgagacccagaccgagaccct

SEQ ID NO: 153690 - DNA, 25 bp, Mus musculus
agagcgagaccctgaccgagaccct

SEQ ID NO: 153691 - DNA, 25 bp, Mus musculus
agagcgagagctaaggccttcatct

SEQ ID NO: 153692 - DNA, 25 bp, Mus musculus
agagcgagagcttaggccttcatct

SEQ ID NO: 153693 - DNA, 25 bp, Mus musculus
agagcgaggctgagctccagtatga

SEQ ID NO: 153694 - DNA, 25 bp, Mus musculus
agagcgaggctgtgctccagtatga

SEQ ID NO: 153695 - DNA, 25 bp, Mus musculus
agagcgaggtctacccagaatatat

SEQ ID NO: 153696 - DNA, 25 bp, Mus musculus
agagcgaggtcttcccagaatatat

SEQ ID NO: 153697 - DNA, 25 bp, Mus musculus
agagcgatcactaggatctccccag

SEQ ID NO: 153698 - DNA, 25 bp, Mus musculus
agagcgatcacttggatctccccag

SEQ ID NO: 153699 - DNA, 25 bp, Mus musculus
agagcgatctttccattcattttca

SEQ ID NO: 153700 - DNA, 25 bp, Mus musculus
agagcgatctttgcattcattttca

SEQ ID NO: 153701 - DNA, 25 bp, Mus musculus
agagcgatgcggagtgccattttcc

SEQ ID NO: 153702 - DNA, 25 bp, Mus musculus
agagcgatgcggtgtgccattttcc

SEQ ID NO: 153703 - DNA, 25 bp, Mus musculus
agagcgcaaggcatacaccagaaaa

SEQ ID NO: 153704 - DNA, 25 bp, Mus musculus
agagcgcaaggcttacaccagaaaa

SEQ ID NO: 153705 - DNA, 25 bp, Mus musculus
agagcgcaataccaacatgagtttc

SEQ ID NO: 153706 - DNA, 25 bp, Mus musculus
agagcgcaatacgaacatgagtttc

SEQ ID NO: 153707 - DNA, 25 bp, Mus musculus
agagcgcacaagatcttccagtcag

SEQ ID NO: 153708 - DNA, 25 bp, Mus musculus
agagcgcacaagttcttccagtcag

SEQ ID NO: 153709 - DNA, 25 bp, Mus musculus
agagcgcaccatcttctccttggag

SEQ ID NO: 153710 - DNA, 25 bp, Mus musculus
agagcgcaccatgttctccttggag

SEQ ID NO: 153711 - DNA, 25 bp, Mus musculus
agagcgcagaagatcccactgcata

SEQ ID NO: 153712 - DNA, 25 bp, Mus musculus
agagcgcagaagttcccactgcata

SEQ ID NO: 153713 - DNA, 25 bp, Mus musculus
agagcgcagatcagggccgagtgat

SEQ ID NO: 153714 - DNA, 25 bp, Mus musculus
agagcgcagatctgggccgagtgat

SEQ ID NO: 153715 - DNA, 25 bp, Mus musculus
agagcgcatacgctgtgtgttcttc

SEQ ID NO: 153716 - DNA, 25 bp, Mus musculus
agagcgcatacggtgtgtgttcttc

SEQ ID NO: 153717 - DNA, 25 bp, Mus musculus
agagcgcatctcatgggagtgacaa

SEQ ID NO: 153718 - DNA, 25 bp, Mus musculus
agagcgcatctcttgggagtgacaa

SEQ ID NO: 153719 - DNA, 25 bp, Mus musculus
agagcgccagagctcctgacaaagt

SEQ ID NO: 153720 - DNA, 25 bp, Mus musculus
agagcgccagaggtcctgacaaagt

SEQ ID NO: 153721 - DNA, 25 bp, Mus musculus
agagcgccatatactgtgcccttga

SEQ ID NO: 153722 - DNA, 25 bp, Mus musculus
agagcgccatattctgtgcccttga

SEQ ID NO: 153723 - DNA, 25 bp, Mus musculus
agagcgccatggcactcctgcagaa

SEQ ID NO: 153724 - DNA, 25 bp, Mus musculus
agagcgccatgggactcctgcagaa

SEQ ID NO: 153725 - DNA, 25 bp, Mus musculus
agagcgccccatacatcgatcaggt

SEQ ID NO: 153726 - DNA, 25 bp, Mus musculus
agagcgccccattcatcgatcaggt

SEQ ID NO: 153727 - DNA, 25 bp, Mus musculus
agagcgccgaacaggaagtcacata

SEQ ID NO: 153728 - DNA, 25 bp, Mus musculus
agagcgccgaacatgctgccccagt

SEQ ID NO: 153729 - DNA, 25 bp, Mus musculus
agagcgccgaactggaagtcacata

SEQ ID NO: 153730 - DNA, 25 bp, Mus musculus
agagcgccgaacttgctgccccagt

SEQ ID NO: 153731 - DNA, 25 bp, Mus musculus
agagcgccgggcagaaaacctgaga

SEQ ID NO: 153732 - DNA, 25 bp, Mus musculus
agagcgccgggctgaaaacctgaga

SEQ ID NO: 153733 - DNA, 25 bp, Mus musculus
agagcgcctaagatctggacattga

SEQ ID NO: 153734 - DNA, 25 bp, Mus musculus
agagcgcctaagttctggacattga

SEQ ID NO: 153735 - DNA, 25 bp, Mus musculus
agagcgcctgatattcgcctgtgga

SEQ ID NO: 153736 - DNA, 25 bp, Mus musculus
agagcgcctgatcgtcaacttgcaa

SEQ ID NO: 153737 - DNA, 25 bp, Mus musculus
agagcgcctgatggtcaacttgcaa

SEQ ID NO: 153738 - DNA, 25 bp, Mus musculus
agagcgcctgattttcgcctgtgga

SEQ ID NO: 153739 - DNA, 25 bp, Mus musculus
agagcgcgaataacctcctgaaagg

SEQ ID NO: 153740 - DNA, 25 bp, Mus musculus
agagcgcgaatatcctcctgaaagg

SEQ ID NO: 153741 - DNA, 25 bp, Mus musculus
agagcgcgacatcatcgtgctgcag

SEQ ID NO: 153742 - DNA, 25 bp, Mus musculus
agagcgcgacatgatcgtgctgcag

SEQ ID NO: 153743 - DNA, 25 bp, Mus musculus
agagcgcggccaccagcagacacag

SEQ ID NO: 153744 - DNA, 25 bp, Mus musculus
agagcgcggccagcagcagacacag

SEQ ID NO: 153745 - DNA, 25 bp, Mus musculus
agagcgctcacaatcctataaagga

SEQ ID NO: 153746 - DNA, 25 bp, Mus musculus
agagcgctcacattcctataaagga

SEQ ID NO: 153747 - DNA, 25 bp, Mus musculus
agagcgctcactctgatgttgcaca

SEQ ID NO: 153748 - DNA, 25 bp, Mus musculus
agagcgctcactgtgatgttgcaca

SEQ ID NO: 153749 - DNA, 25 bp, Mus musculus
agagcgctcagtctgtcccagctgg

SEQ ID NO: 153750 - DNA, 25 bp, Mus musculus
agagcgctcagtgtgtcccagctgg

SEQ ID NO: 153751 - DNA, 25 bp, Mus musculus
agagcgctccttcatggccatggac

SEQ ID NO: 153752 - DNA, 25 bp, Mus musculus
agagcgctccttgatggccatggac

SEQ ID NO: 153753 - DNA, 25 bp, Mus musculus
agagcgctcgctctctgaggagcac

SEQ ID NO: 153754 - DNA, 25 bp, Mus musculus
agagcgctcgctgtctgaggagcac

SEQ ID NO: 153755 - DNA, 25 bp, Mus musculus
agagcgctctggctttggtttttat

SEQ ID NO: 153756 - DNA, 25 bp, Mus musculus
agagcgctctgggtttggtttttat

SEQ ID NO: 153757 - DNA, 25 bp, Mus musculus
agagcgctgagaagccgccagagct

SEQ ID NO: 153758 - DNA, 25 bp, Mus musculus
agagcgctgagatgccgccagagct

SEQ ID NO: 153759 - DNA, 25 bp, Mus musculus
agagcgcttagtatacagtagttca

SEQ ID NO: 153760 - DNA, 25 bp, Mus musculus
agagcgcttagtttacagtagttca

SEQ ID NO: 153761 - DNA, 25 bp, Mus musculus
agagcgcttgagaccaggcttcctg

SEQ ID NO: 153762 - DNA, 25 bp, Mus musculus
agagcgcttgagtccaggcttcctg

SEQ ID NO: 153763 - DNA, 25 bp, Mus musculus
agagcggaccctacgtggagacccg

SEQ ID NO: 153764 - DNA, 25 bp, Mus musculus
agagcggacccttcgtggagacccg

SEQ ID NO: 153765 - DNA, 25 bp, Mus musculus
agagcggactcaccaagagcaccca

SEQ ID NO: 153766 - DNA, 25 bp, Mus musculus
agagcggactcagcaagagcaccca

SEQ ID NO: 153767 - DNA, 25 bp, Mus musculus
agagcggagcgaagaccaaggacct

SEQ ID NO: 153768 - DNA, 25 bp, Mus musculus
agagcggagcgatgaccaaggacct

SEQ ID NO: 153769 - DNA, 25 bp, Mus musculus
agagcggaggaaactcgagccacgt

SEQ ID NO: 153770 - DNA, 25 bp, Mus musculus
agagcggaggaatctcgagccacgt

SEQ ID NO: 153771 - DNA, 25 bp, Mus musculus
agagcggaggcgactcacaagcttt

SEQ ID NO: 153772 - DNA, 25 bp, Mus musculus
agagcggaggcgtctcacaagcttt

SEQ ID NO: 153773 - DNA, 25 bp, Mus musculus
agagcggatgctacagaacagacta

SEQ ID NO: 153774 - DNA, 25 bp, Mus musculus
agagcggatgcttcagaacagacta

SEQ ID NO: 153775 - DNA, 25 bp, Mus musculus
agagcggcaagcagcgctactccta

SEQ ID NO: 153776 - DNA, 25 bp, Mus musculus
agagcggcaagctgcgctactccta

SEQ ID NO: 153777 - DNA, 25 bp, Mus musculus
agagcggcaccgaggcaagatcact

SEQ ID NO: 153778 - DNA, 25 bp, Mus musculus
agagcggcaccgtggcaagatcact

SEQ ID NO: 153779 - DNA, 25 bp, Mus musculus
agagcggcacgtccaagtacggcga

SEQ ID NO: 153780 - DNA, 25 bp, Mus musculus
agagcggcacgtgcaagtacggcga

SEQ ID NO: 153781 - DNA, 25 bp, Mus musculus
agagcggcagcaatggatcgatcca

SEQ ID NO: 153782 - DNA, 25 bp, Mus musculus
agagcggcagcacttccgagagttc

SEQ ID NO: 153783 - DNA, 25 bp, Mus musculus
agagcggcagcagttccgagagttc

SEQ ID NO: 153784 - DNA, 25 bp, Mus musculus
agagcggcagcattggatcgatcca

SEQ ID NO: 153785 - DNA, 25 bp, Mus musculus
agagcggccctcattacttaaagtg

SEQ ID NO: 153786 - DNA, 25 bp, Mus musculus
agagcggccctctttacttaaagtg

SEQ ID NO: 153787 - DNA, 25 bp, Mus musculus
agagcggccgacaaagtgcagaaaa

SEQ ID NO: 153788 - DNA, 25 bp, Mus musculus
agagcggccgactaagtgcagaaaa

SEQ ID NO: 153789 - DNA, 25 bp, Mus musculus
agagcggccgcgagctaccacgact

SEQ ID NO: 153790 - DNA, 25 bp, Mus musculus
agagcggccgcgtgctaccacgact

SEQ ID NO: 153791 - DNA, 25 bp, Mus musculus
agagcggcctctctcggtggctact

SEQ ID NO: 153792 - DNA, 25 bp, Mus musculus
agagcggcctctgtcggtggctact

SEQ ID NO: 153793 - DNA, 25 bp, Mus musculus
agagcggcctttcctgctggttagt

SEQ ID NO: 153794 - DNA, 25 bp, Mus musculus
agagcggcctttgctgctggttagt

SEQ ID NO: 153795 - DNA, 25 bp, Mus musculus
agagcggctaccctgaaggccaaga

SEQ ID NO: 153796 - DNA, 25 bp, Mus musculus
agagcggctaccgtgaaggccaaga

SEQ ID NO: 153797 - DNA, 25 bp, Mus musculus
agagcggctgctctggctaacacag

SEQ ID NO: 153798 - DNA, 25 bp, Mus musculus
agagcggctgctgtggctaacacag

SEQ ID NO: 153799 - DNA, 25 bp, Mus musculus
agagcggtcagccacttctgtagac

SEQ ID NO: 153800 - DNA, 25 bp, Mus musculus
agagcggtcagcgacttctgtagac

SEQ ID NO: 153801 - DNA, 25 bp, Mus musculus
agagcggtgaagctgagcaactctc

SEQ ID NO: 153802 - DNA, 25 bp, Mus musculus
agagcggtgaaggtgagcaactctc

SEQ ID NO: 153803 - DNA, 25 bp, Mus musculus
agagcggtgagcagcactcgcatca

SEQ ID NO: 153804 - DNA, 25 bp, Mus musculus
agagcggtgagctgcactcgcatca

SEQ ID NO: 153805 - DNA, 25 bp, Mus musculus
agagcggtgctaaccacatctggga

SEQ ID NO: 153806 - DNA, 25 bp, Mus musculus
agagcggtgctatccacatctggga

SEQ ID NO: 153807 - DNA, 25 bp, Mus musculus
agagcggttgcaaggataccaggtt

SEQ ID NO: 153808 - DNA, 25 bp, Mus musculus
agagcggttgcatggataccaggtt

SEQ ID NO: 153809 - DNA, 25 bp, Mus musculus
agagcgtacgttatactcctgattg

SEQ ID NO: 153810 - DNA, 25 bp, Mus musculus
agagcgtacgttatattcctgattg

SEQ ID NO: 153811 - DNA, 25 bp, Mus musculus
agagcgtacgttttactcctgattg

SEQ ID NO: 153812 - DNA, 25 bp, Mus musculus
agagcgtacgttttattcctgattg

SEQ ID NO: 153813 - DNA, 25 bp, Mus musculus
agagcgtatctgagcatttgggaaa

SEQ ID NO: 153814 - DNA, 25 bp, Mus musculus
agagcgtatctgtgcatttgggaaa

SEQ ID NO: 153815 - DNA, 25 bp, Mus musculus
agagcgtcaacacggagatgtcacc

SEQ ID NO: 153816 - DNA, 25 bp, Mus musculus
agagcgtcaacagggagatgtcacc

SEQ ID NO: 153817 - DNA, 25 bp, Mus musculus
agagcgtcacttatgcccaggacaa

SEQ ID NO: 153818 - DNA, 25 bp, Mus musculus
agagcgtcacttttgcccaggacaa

SEQ ID NO: 153819 - DNA, 25 bp, Mus musculus
agagcgtcagacaaagtggttcaca

SEQ ID NO: 153820 - DNA, 25 bp, Mus musculus
agagcgtcagactaagtggttcaca

SEQ ID NO: 153821 - DNA, 25 bp, Mus musculus
agagcgtccattcctttatccaggg

SEQ ID NO: 153822 - DNA, 25 bp, Mus musculus
agagcgtccattgctttatccaggg

SEQ ID NO: 153823 - DNA, 25 bp, Mus musculus
agagcgtcctggagcatcttagctg

SEQ ID NO: 153824 - DNA, 25 bp, Mus musculus
agagcgtcctggtgcatcttagctg

SEQ ID NO: 153825 - DNA, 25 bp, Mus musculus
agagcgtcctgtcaactcggctgct

SEQ ID NO: 153826 - DNA, 25 bp, Mus musculus
agagcgtcctgtgaactcggctgct

SEQ ID NO: 153827 - DNA, 25 bp, Mus musculus
agagcgtcgtgacatcttcccgcaa

SEQ ID NO: 153828 - DNA, 25 bp, Mus musculus
agagcgtcgtgagatcttcccgcaa

SEQ ID NO: 153829 - DNA, 25 bp, Mus musculus
agagcgtctattacttctctggaga

SEQ ID NO: 153830 - DNA, 25 bp, Mus musculus
agagcgtctatttcttctctggaga

SEQ ID NO: 153831 - DNA, 25 bp, Mus musculus
agagcgtctcaactgtagaacggat

SEQ ID NO: 153832 - DNA, 25 bp, Mus musculus
agagcgtctcaagtgtagaacggat

SEQ ID NO: 153833 - DNA, 25 bp, Mus musculus
agagcgtgacctagcagtcgcctat

SEQ ID NO: 153834 - DNA, 25 bp, Mus musculus
agagcgtgaccttgcagtcgcctat

SEQ ID NO: 153835 - DNA, 25 bp, Mus musculus
agagcgtgacgtctatctgacctat

SEQ ID NO: 153836 - DNA, 25 bp, Mus musculus
agagcgtgacgtgtatctgacctat

SEQ ID NO: 153837 - DNA, 25 bp, Mus musculus
agagcgtgcagcagtggccattcag

SEQ ID NO: 153838 - DNA, 25 bp, Mus musculus
agagcgtgcagctgtggccattcag

SEQ ID NO: 153839 - DNA, 25 bp, Mus musculus
agagcgtggcatcattaacctgtct

SEQ ID NO: 153840 - DNA, 25 bp, Mus musculus
agagcgtggcatgattaacctgtct

SEQ ID NO: 153841 - DNA, 25 bp, Mus musculus
agagcgtgtgcacactgcagatcac

SEQ ID NO: 153842 - DNA, 25 bp, Mus musculus
agagcgtgtgcagactgcagatcac

SEQ ID NO: 153843 - DNA, 25 bp, Mus musculus
agagcgttaactccgtgtgttgttt

SEQ ID NO: 153844 - DNA, 25 bp, Mus musculus
agagcgttaactgcgtgtgttgttt

SEQ ID NO: 153845 - DNA, 25 bp, Mus musculus
agagcgttccgtacatcaagctgga

SEQ ID NO: 153846 - DNA, 25 bp, Mus musculus
agagcgttccgttcatcaagctgga

SEQ ID NO: 153847 - DNA, 25 bp, Mus musculus
agagcgttctgcatcagtttggaga

SEQ ID NO: 153848 - DNA, 25 bp, Mus musculus
agagcgttctgcttcagtttggaga

SEQ ID NO: 153849 - DNA, 25 bp, Mus musculus
agagcgtttcagatcaacaccttta

SEQ ID NO: 153850 - DNA, 25 bp, Mus musculus
agagcgtttcagttcaacaccttta

SEQ ID NO: 153851 - DNA, 25 bp, Mus musculus
agagcgtttgctatgttcccgatat

SEQ ID NO: 153852 - DNA, 25 bp, Mus musculus
agagcgtttgctttgttcccgatat

SEQ ID NO: 153853 - DNA, 25 bp, Mus musculus
agagctaaaccccacagttcggtgg

SEQ ID NO: 153854 - DNA, 25 bp, Mus musculus
agagctaaacccgacagttcggtgg

SEQ ID NO: 153855 - DNA, 25 bp, Mus musculus
agagctaaagatcccttctgtacag

SEQ ID NO: 153856 - DNA, 25 bp, Mus musculus
agagctaaagatgccttctgtacag

SEQ ID NO: 153857 - DNA, 25 bp, Mus musculus
agagctaaccacaccatcagtaaac

SEQ ID NO: 153858 - DNA, 25 bp, Mus musculus
agagctaaccactccatcagtaaac

SEQ ID NO: 153859 - DNA, 25 bp, Mus musculus
agagctaaccgcaaccagcactgag

SEQ ID NO: 153860 - DNA, 25 bp, Mus musculus
agagctaaccgctaccagcactgag

SEQ ID NO: 153861 - DNA, 25 bp, Mus musculus
agagctaactgaaagtcatgatgca

SEQ ID NO: 153862 - DNA, 25 bp, Mus musculus
agagctaactgatagtcatgatgca

SEQ ID NO: 153863 - DNA, 25 bp, Mus musculus
agagctaagagcatccttcagttcc

SEQ ID NO: 153864 - DNA, 25 bp, Mus musculus
agagctaagagcttccttcagttcc

SEQ ID NO: 153865 - DNA, 25 bp, Mus musculus
agagctaaggatccccgagacaaaa

SEQ ID NO: 153866 - DNA, 25 bp, Mus musculus
agagctaaggatgcccgagacaaaa

SEQ ID NO: 153867 - DNA, 25 bp, Mus musculus
agagctaatacaagccgacgggcgc

SEQ ID NO: 153868 - DNA, 25 bp, Mus musculus
agagctaatacatgccgacgggcgc

SEQ ID NO: 153869 - DNA, 25 bp, Mus musculus
agagctaatcttattaaaccttcag

SEQ ID NO: 153870 - DNA, 25 bp, Mus musculus
agagctaatctttttaaaccttcag

SEQ ID NO: 153871 - DNA, 25 bp, Mus musculus
agagctaatgagaatcaccagacaa

SEQ ID NO: 153872 - DNA, 25 bp, Mus musculus
agagctaatgagtatcaccagacaa

SEQ ID NO: 153873 - DNA, 25 bp, Mus musculus
agagctaatgcaacccgtcatgtgg

SEQ ID NO: 153874 - DNA, 25 bp, Mus musculus
agagctaatgcatcccgtcatgtgg

SEQ ID NO: 153875 - DNA, 25 bp, Mus musculus
agagctaatgtaaacggccacccaa

SEQ ID NO: 153876 - DNA, 25 bp, Mus musculus
agagctaatgtatacggccacccaa

SEQ ID NO: 153877 - DNA, 25 bp, Mus musculus
agagctacaaggacactgaggtaat

SEQ ID NO: 153878 - DNA, 25 bp, Mus musculus
agagctacaaggattcctgctgtat

SEQ ID NO: 153879 - DNA, 25 bp, Mus musculus
agagctacaaggtcactgaggtaat

SEQ ID NO: 153880 - DNA, 25 bp, Mus musculus
agagctacaaggtttcctgctgtat

SEQ ID NO: 153881 - DNA, 25 bp, Mus musculus
agagctacaatccaagaccagactg

SEQ ID NO: 153882 - DNA, 25 bp, Mus musculus
agagctacaatcgaagaccagactg

SEQ ID NO: 153883 - DNA, 25 bp, Mus musculus
agagctacacaactttttgtcagaa

SEQ ID NO: 153884 - DNA, 25 bp, Mus musculus
agagctacacaagtttttgtcagaa

SEQ ID NO: 153885 - DNA, 25 bp, Mus musculus
agagctacacatcctcttggcaatg

SEQ ID NO: 153886 - DNA, 25 bp, Mus musculus
agagctacacatgctcttggcaatg

SEQ ID NO: 153887 - DNA, 25 bp, Mus musculus
agagctacacctctcagaagtggta

SEQ ID NO: 153888 - DNA, 25 bp, Mus musculus
agagctacacctgtcagaagtggta

SEQ ID NO: 153889 - DNA, 25 bp, Mus musculus
agagctacagatacatgcctttaaa

SEQ ID NO: 153890 - DNA, 25 bp, Mus musculus
agagctacagattcatgcctttaaa

SEQ ID NO: 153891 - DNA, 25 bp, Mus musculus
agagctacagcaaactattccgggt

SEQ ID NO: 153892 - DNA, 25 bp, Mus musculus
agagctacagcatactattccgggt

SEQ ID NO: 153893 - DNA, 25 bp, Mus musculus
agagctacagcgaaccaaccctatc

SEQ ID NO: 153894 - DNA, 25 bp, Mus musculus
agagctacagcgtaccaaccctatc

SEQ ID NO: 153895 - DNA, 25 bp, Mus musculus
agagctacagctccctaaggtgcct

SEQ ID NO: 153896 - DNA, 25 bp, Mus musculus
agagctacagctgcctaaggtgcct

SEQ ID NO: 153897 - DNA, 25 bp, Mus musculus
agagctacaggcagtgaattctgtc

SEQ ID NO: 153898 - DNA, 25 bp, Mus musculus
agagctacaggctgtgaattctgtc

SEQ ID NO: 153899 - DNA, 25 bp, Mus musculus
agagctacagttccatcttcattac

SEQ ID NO: 153900 - DNA, 25 bp, Mus musculus
agagctacagttgcatcttcattac

SEQ ID NO: 153901 - DNA, 25 bp, Mus musculus
agagctacatctcagccctaggctg

SEQ ID NO: 153902 - DNA, 25 bp, Mus musculus
agagctacatctgagccctaggctg

SEQ ID NO: 153903 - DNA, 25 bp, Mus musculus
agagctacatggacgttgtgtgtta

SEQ ID NO: 153904 - DNA, 25 bp, Mus musculus
agagctacatggtcgttgtgtgtta

SEQ ID NO: 153905 - DNA, 25 bp, Mus musculus
agagctaccagactgtcctatacgg

SEQ ID NO: 153906 - DNA, 25 bp, Mus musculus
agagctaccagagtgtcctatacgg

SEQ ID NO: 153907 - DNA, 25 bp, Mus musculus
agagctaccatcaggtatctgccag

SEQ ID NO: 153908 - DNA, 25 bp, Mus musculus
agagctaccatctggtatctgccag

SEQ ID NO: 153909 - DNA, 25 bp, Mus musculus
agagctaccctgagactgatcacgg

SEQ ID NO: 153910 - DNA, 25 bp, Mus musculus
agagctaccctgtgactgatcacgg

SEQ ID NO: 153911 - DNA, 25 bp, Mus musculus
agagctacgaaaactgtgctgagaa

SEQ ID NO: 153912 - DNA, 25 bp, Mus musculus
agagctacgaaatctgtgctgagaa

SEQ ID NO: 153913 - DNA, 25 bp, Mus musculus
agagctacgattacccctttgggat

SEQ ID NO: 153914 - DNA, 25 bp, Mus musculus
agagctacgatttcccctttgggat

SEQ ID NO: 153915 - DNA, 25 bp, Mus musculus
agagctacgcagaaaggtcctctct

SEQ ID NO: 153916 - DNA, 25 bp, Mus musculus
agagctacgcagtaaggtcctctct

SEQ ID NO: 153917 - DNA, 25 bp, Mus musculus
agagctactcagctttccacatcag

SEQ ID NO: 153918 - DNA, 25 bp, Mus musculus
agagctactcaggtttccacatcag

SEQ ID NO: 153919 - DNA, 25 bp, Mus musculus
agagctactccaactacgtgtacaa

SEQ ID NO: 153920 - DNA, 25 bp, Mus musculus
agagctactccatctacgtgtacaa

SEQ ID NO: 153921 - DNA, 25 bp, Mus musculus
agagctactcggagtacgtgtacaa

SEQ ID NO: 153922 - DNA, 25 bp, Mus musculus
agagctactcggtgtacgtgtacaa

SEQ ID NO: 153923 - DNA, 25 bp, Mus musculus
agagctactgttactcatggtgctg

SEQ ID NO: 153924 - DNA, 25 bp, Mus musculus
agagctactgttcgttcacggctgc

SEQ ID NO: 153925 - DNA, 25 bp, Mus musculus
agagctactgttggttcacggctgc

SEQ ID NO: 153926 - DNA, 25 bp, Mus musculus
agagctactgtttctcatggtgctg

SEQ ID NO: 153927 - DNA, 25 bp, Mus musculus
agagctacttctatgacagccaaga

SEQ ID NO: 153928 - DNA, 25 bp, Mus musculus
agagctacttctttgacagccaaga

SEQ ID NO: 153929 - DNA, 25 bp, Mus musculus
agagctagaacactccaaccatagg

SEQ ID NO: 153930 - DNA, 25 bp, Mus musculus
agagctagaacagtccaaccatagg

SEQ ID NO: 153931 - DNA, 25 bp, Mus musculus
agagctagagaactgcctttgtttc

SEQ ID NO: 153932 - DNA, 25 bp, Mus musculus
agagctagagaagtgcctttgtttc

SEQ ID NO: 153933 - DNA, 25 bp, Mus musculus
agagctagagaccttgcgtgccatg

SEQ ID NO: 153934 - DNA, 25 bp, Mus musculus
agagctagagacgttgcgtgccatg

SEQ ID NO: 153935 - DNA, 25 bp, Mus musculus
agagctagaggactccacactgcgc

SEQ ID NO: 153936 - DNA, 25 bp, Mus musculus
agagctagaggagtccacactgcgc

SEQ ID NO: 153937 - DNA, 25 bp, Mus musculus
agagctagataaacccctgcactga

SEQ ID NO: 153938 - DNA, 25 bp, Mus musculus
agagctagataatcccctgcactga

SEQ ID NO: 153939 - DNA, 25 bp, Mus musculus
agagctagcacacgctggtcagcag

SEQ ID NO: 153940 - DNA, 25 bp, Mus musculus
agagctagcacaggctggtcagcag

SEQ ID NO: 153941 - DNA, 25 bp, Mus musculus
agagctagcactatgtttcttctcc

SEQ ID NO: 153942 - DNA, 25 bp, Mus musculus
agagctagcactttgtttcttctcc

SEQ ID NO: 153943 - DNA, 25 bp, Mus musculus
agagctagcagcaacaccttatgtt

SEQ ID NO: 153944 - DNA, 25 bp, Mus musculus
agagctagcagctacaccttatgtt

SEQ ID NO: 153945 - DNA, 25 bp, Mus musculus
agagctagccaccactgtttctgtg

SEQ ID NO: 153946 - DNA, 25 bp, Mus musculus
agagctagccacgactgtttctgtg

SEQ ID NO: 153947 - DNA, 25 bp, Mus musculus
agagctagctccaggacataacata

SEQ ID NO: 153948 - DNA, 25 bp, Mus musculus
agagctagctcctggacataacata

SEQ ID NO: 153949 - DNA, 25 bp, Mus musculus
agagctagctctacaagcaagcccc

SEQ ID NO: 153950 - DNA, 25 bp, Mus musculus
agagctagctcttcaagcaagcccc

SEQ ID NO: 153951 - DNA, 25 bp, Mus musculus
agagctaggagacctcttcatgcac

SEQ ID NO: 153952 - DNA, 25 bp, Mus musculus
agagctaggagagctcttcatgcac

SEQ ID NO: 153953 - DNA, 25 bp, Mus musculus
agagctaggatcaaaggcctgcatc

SEQ ID NO: 153954 - DNA, 25 bp, Mus musculus
agagctaggatcaaatgtgtgtcct

SEQ ID NO: 153955 - DNA, 25 bp, Mus musculus
agagctaggatctaaggcctgcatc

SEQ ID NO: 153956 - DNA, 25 bp, Mus musculus
agagctaggatctaatgtgtgtcct

SEQ ID NO: 153957 - DNA, 25 bp, Mus musculus
agagctaggctcactgttgctccta

SEQ ID NO: 153958 - DNA, 25 bp, Mus musculus
agagctaggctctctgttgctccta

SEQ ID NO: 153959 - DNA, 25 bp, Mus musculus
agagctagggaaacaggaggccatt

SEQ ID NO: 153960 - DNA, 25 bp, Mus musculus
agagctagggaatcaggaggccatt

SEQ ID NO: 153961 - DNA, 25 bp, Mus musculus
agagctaggtggacaagtgatcaga

SEQ ID NO: 153962 - DNA, 25 bp, Mus musculus
agagctaggtggtcaagtgatcaga

SEQ ID NO: 153963 - DNA, 25 bp, Mus musculus
agagctagtctgcatgttctagaca

SEQ ID NO: 153964 - DNA, 25 bp, Mus musculus
agagctagtctggatgttctagaca

SEQ ID NO: 153965 - DNA, 25 bp, Mus musculus
agagctagtgctcactggtctgcag

SEQ ID NO: 153966 - DNA, 25 bp, Mus musculus
agagctagtgctgactggtctgcag

SEQ ID NO: 153967 - DNA, 25 bp, Mus musculus
agagctagttccatgcatacgaaat

SEQ ID NO: 153968 - DNA, 25 bp, Mus musculus
agagctagttccttgcatacgaaat

SEQ ID NO: 153969 - DNA, 25 bp, Mus musculus
agagctagttgaatcccagggacca

SEQ ID NO: 153970 - DNA, 25 bp, Mus musculus
agagctagttgattcccagggacca

SEQ ID NO: 153971 - DNA, 25 bp, Mus musculus
agagctagtttcacaaaccctgcac

SEQ ID NO: 153972 - DNA, 25 bp, Mus musculus
agagctagtttctcaaaccctgcac

SEQ ID NO: 153973 - DNA, 25 bp, Mus musculus
agagctataagcatccatctttagt

SEQ ID NO: 153974 - DNA, 25 bp, Mus musculus
agagctataagcttccatctttagt

SEQ ID NO: 153975 - DNA, 25 bp, Mus musculus
agagctatcagcctggacgcttcat

SEQ ID NO: 153976 - DNA, 25 bp, Mus musculus
agagctatcagcgtggacgcttcat

SEQ ID NO: 153977 - DNA, 25 bp, Mus musculus
agagctatcatgacagcctctgcag

SEQ ID NO: 153978 - DNA, 25 bp, Mus musculus
agagctatcatgtcagcctctgcag

SEQ ID NO: 153979 - DNA, 25 bp, Mus musculus
agagctatccaacagggaacctcaa

SEQ ID NO: 153980 - DNA, 25 bp, Mus musculus
agagctatccaagagggaacctcaa

SEQ ID NO: 153981 - DNA, 25 bp, Mus musculus
agagctatccccaacaacagatttc

SEQ ID NO: 153982 - DNA, 25 bp, Mus musculus
agagctatcccctacaacagatttc

SEQ ID NO: 153983 - DNA, 25 bp, Mus musculus
agagctatccctacagcatctatca

SEQ ID NO: 153984 - DNA, 25 bp, Mus musculus
agagctatcccttcagcatctatca

SEQ ID NO: 153985 - DNA, 25 bp, Mus musculus
agagctatctagcacagccacagtc

SEQ ID NO: 153986 - DNA, 25 bp, Mus musculus
agagctatctaggacagccacagtc

SEQ ID NO: 153987 - DNA, 25 bp, Mus musculus
agagctatcttcagtagcccaaagg

SEQ ID NO: 153988 - DNA, 25 bp, Mus musculus
agagctatcttctgtagcccaaagg

SEQ ID NO: 153989 - DNA, 25 bp, Mus musculus
agagctatgattcttcctggttctt

SEQ ID NO: 153990 - DNA, 25 bp, Mus musculus
agagctatgattgttcctggttctt

SEQ ID NO: 153991 - DNA, 25 bp, Mus musculus
agagctatggcacctttgtgatcag

SEQ ID NO: 153992 - DNA, 25 bp, Mus musculus
agagctatggcagctttgtgatcag

SEQ ID NO: 153993 - DNA, 25 bp, Mus musculus
agagctatgtccagaccgggtgcac

SEQ ID NO: 153994 - DNA, 25 bp, Mus musculus
agagctatgtcctgaccgggtgcac

SEQ ID NO: 153995 - DNA, 25 bp, Mus musculus
agagctatgtctacctgtccaagat

SEQ ID NO: 153996 - DNA, 25 bp, Mus musculus
agagctatgtcttcctgtccaagat

SEQ ID NO: 153997 - DNA, 25 bp, Mus musculus
agagctatgtgcagggtttcatatg

SEQ ID NO: 153998 - DNA, 25 bp, Mus musculus
agagctatgtgctgggtttcatatg

SEQ ID NO: 153999 - DNA, 25 bp, Mus musculus
agagctattccacattctctgtcag

SEQ ID NO: 154000 - DNA, 25 bp, Mus musculus
agagctattccagattctctgtcag

SEQ ID NO: 154001 - DNA, 25 bp, Mus musculus
agagctattcgacaagaccatctta

SEQ ID NO: 154002 - DNA, 25 bp, Mus musculus
agagctattcgagaagaccatctta

SEQ ID NO: 154003 - DNA, 25 bp, Mus musculus
agagctattctgaccagtacttgat

SEQ ID NO: 154004 - DNA, 25 bp, Mus musculus
agagctattctgtccagtacttgat

SEQ ID NO: 154005 - DNA, 25 bp, Mus musculus
agagctattcttagaggacagtatt

SEQ ID NO: 154006 - DNA, 25 bp, Mus musculus
agagctattctttgaggacagtatt

SEQ ID NO: 154007 - DNA, 25 bp, Mus musculus
agagctattgatcggtctcaacccc

SEQ ID NO: 154008 - DNA, 25 bp, Mus musculus
agagctattgatgggtctcaacccc

SEQ ID NO: 154009 - DNA, 25 bp, Mus musculus
agagctatttgactcccaggtccag

SEQ ID NO: 154010 - DNA, 25 bp, Mus musculus
agagctatttgagtcccaggtccag

SEQ ID NO: 154011 - DNA, 25 bp, Mus musculus
agagctcaaaataccatgtcatcac

SEQ ID NO: 154012 - DNA, 25 bp, Mus musculus
agagctcaaaattccatgtcatcac

SEQ ID NO: 154013 - DNA, 25 bp, Mus musculus
agagctcaacatcataaaggcacat

SEQ ID NO: 154014 - DNA, 25 bp, Mus musculus
agagctcaacatcgcggcacttctg

SEQ ID NO: 154015 - DNA, 25 bp, Mus musculus
agagctcaacatgataaaggcacat

SEQ ID NO: 154016 - DNA, 25 bp, Mus musculus
agagctcaacatggcggcacttctg

SEQ ID NO: 154017 - DNA, 25 bp, Mus musculus
agagctcaagagatgtgccacattt

SEQ ID NO: 154018 - DNA, 25 bp, Mus musculus
agagctcaagagcttagcctttccc

SEQ ID NO: 154019 - DNA, 25 bp, Mus musculus
agagctcaagaggttagcctttccc

SEQ ID NO: 154020 - DNA, 25 bp, Mus musculus
agagctcaagagttgtgccacattt

SEQ ID NO: 154021 - DNA, 25 bp, Mus musculus
agagctcaaggcatctctagtctta

SEQ ID NO: 154022 - DNA, 25 bp, Mus musculus
agagctcaaggcttctctagtctta

SEQ ID NO: 154023 - DNA, 25 bp, Mus musculus
agagctcaatgtccctattttgtac

SEQ ID NO: 154024 - DNA, 25 bp, Mus musculus
agagctcaatgtgcctattttgtac

SEQ ID NO: 154025 - DNA, 25 bp, Mus musculus
agagctcaccctcatgggctatctg

SEQ ID NO: 154026 - DNA, 25 bp, Mus musculus
agagctcaccctgatgggctatctg

SEQ ID NO: 154027 - DNA, 25 bp, Mus musculus
agagctcaccttcaggttaccattt

SEQ ID NO: 154028 - DNA, 25 bp, Mus musculus
agagctcaccttgaggttaccattt

SEQ ID NO: 154029 - DNA, 25 bp, Mus musculus
agagctcacgtcagcatggtgacct

SEQ ID NO: 154030 - DNA, 25 bp, Mus musculus
agagctcacgtctgcatggtgacct

SEQ ID NO: 154031 - DNA, 25 bp, Mus musculus
agagctcacgtgcacattagcaagt

SEQ ID NO: 154032 - DNA, 25 bp, Mus musculus
agagctcacgtggacattagcaagt

SEQ ID NO: 154033 - DNA, 25 bp, Mus musculus
agagctcagaggaaactccatgcaa

SEQ ID NO: 154034 - DNA, 25 bp, Mus musculus
agagctcagaggtaactccatgcaa

SEQ ID NO: 154035 - DNA, 25 bp, Mus musculus
agagctcagattctccttatgttcc

SEQ ID NO: 154036 - DNA, 25 bp, Mus musculus
agagctcagattgtccttatgttcc

SEQ ID NO: 154037 - DNA, 25 bp, Mus musculus
agagctcagcagattctcgaggcta

SEQ ID NO: 154038 - DNA, 25 bp, Mus musculus
agagctcagcagtttctcgaggcta

SEQ ID NO: 154039 - DNA, 25 bp, Mus musculus
agagctcagcgtagctccagcatca

SEQ ID NO: 154040 - DNA, 25 bp, Mus musculus
agagctcagcgttgctccagcatca

SEQ ID NO: 154041 - DNA, 25 bp, Mus musculus
agagctcagctccttggacaacgtc

SEQ ID NO: 154042 - DNA, 25 bp, Mus musculus
agagctcagctcgttggacaacgtc

SEQ ID NO: 154043 - DNA, 25 bp, Mus musculus
agagctcaggccagtctgctccgtc

SEQ ID NO: 154044 - DNA, 25 bp, Mus musculus
agagctcaggcctgtctgctccgtc

SEQ ID NO: 154045 - DNA, 25 bp, Mus musculus
agagctcaggctctgcgaattcaca

SEQ ID NO: 154046 - DNA, 25 bp, Mus musculus
agagctcaggctgtgcgaattcaca

SEQ ID NO: 154047 - DNA, 25 bp, Mus musculus
agagctcagggcattgaccacttgg

SEQ ID NO: 154048 - DNA, 25 bp, Mus musculus
agagctcagggctttgaccacttgg

SEQ ID NO: 154049 - DNA, 25 bp, Mus musculus
agagctcagtaaccctaaatcccgt

SEQ ID NO: 154050 - DNA, 25 bp, Mus musculus
agagctcagtaagcctaaatcccgt

SEQ ID NO: 154051 - DNA, 25 bp, Mus musculus
agagctcataagctcgaggcctcgt

SEQ ID NO: 154052 - DNA, 25 bp, Mus musculus
agagctcataaggtcgaggcctcgt

SEQ ID NO: 154053 - DNA, 25 bp, Mus musculus
agagctcatcacaaggtctactaag

SEQ ID NO: 154054 - DNA, 25 bp, Mus musculus
agagctcatcactaggtctactaag

SEQ ID NO: 154055 - DNA, 25 bp, Mus musculus
agagctcatccaaaacctttttgtg

SEQ ID NO: 154056 - DNA, 25 bp, Mus musculus
agagctcatccataacctttttgtg

SEQ ID NO: 154057 - DNA, 25 bp, Mus musculus
agagctcatctacccctggaggcag

SEQ ID NO: 154058 - DNA, 25 bp, Mus musculus
agagctcatctagccctggaggcag

SEQ ID NO: 154059 - DNA, 25 bp, Mus musculus
agagctcatctcaaaccgtgcatgt

SEQ ID NO: 154060 - DNA, 25 bp, Mus musculus
agagctcatctctaaccgtgcatgt

SEQ ID NO: 154061 - DNA, 25 bp, Mus musculus
agagctcatgagctgaccaactcag

SEQ ID NO: 154062 - DNA, 25 bp, Mus musculus
agagctcatgaggtgaccaactcag

SEQ ID NO: 154063 - DNA, 25 bp, Mus musculus
agagctcatgctctgaggctgtgcc

SEQ ID NO: 154064 - DNA, 25 bp, Mus musculus
agagctcatgctgtgaggctgtgcc

SEQ ID NO: 154065 - DNA, 25 bp, Mus musculus
agagctcatggaacctagagagcgg

SEQ ID NO: 154066 - DNA, 25 bp, Mus musculus
agagctcatggatcctagagagcgg

SEQ ID NO: 154067 - DNA, 25 bp, Mus musculus
agagctcatgttaggtaactgctaa

SEQ ID NO: 154068 - DNA, 25 bp, Mus musculus
agagctcatgttatctcagctacaa

SEQ ID NO: 154069 - DNA, 25 bp, Mus musculus
agagctcatgtttggtaactgctaa

SEQ ID NO: 154070 - DNA, 25 bp, Mus musculus
agagctcatgttttctcagctacaa

SEQ ID NO: 154071 - DNA, 25 bp, Mus musculus
agagctcattgtagacgtaggtgtc

SEQ ID NO: 154072 - DNA, 25 bp, Mus musculus
agagctcattgttgacgtaggtgtc

SEQ ID NO: 154073 - DNA, 25 bp, Mus musculus
agagctccaaaaactctctatccaa

SEQ ID NO: 154074 - DNA, 25 bp, Mus musculus
agagctccaaaatctctctatccaa

SEQ ID NO: 154075 - DNA, 25 bp, Mus musculus
agagctccaaccagcagcagcatcg

SEQ ID NO: 154076 - DNA, 25 bp, Mus musculus
agagctccaacctgcagcagcatcg

SEQ ID NO: 154077 - DNA, 25 bp, Mus musculus
agagctccaaggcactgtggctatc

SEQ ID NO: 154078 - DNA, 25 bp, Mus musculus
agagctccaagggactgtggctatc

SEQ ID NO: 154079 - DNA, 25 bp, Mus musculus
agagctccacgacagtgagttccac

SEQ ID NO: 154080 - DNA, 25 bp, Mus musculus
agagctccacgagagtgagttccac

SEQ ID NO: 154081 - DNA, 25 bp, Mus musculus
agagctccagacaggctcttcaatc

SEQ ID NO: 154082 - DNA, 25 bp, Mus musculus
agagctccagactggctcttcaatc

SEQ ID NO: 154083 - DNA, 25 bp, Mus musculus
agagctccagagagtttgccgaaaa

SEQ ID NO: 154084 - DNA, 25 bp, Mus musculus
agagctccagagtgtttgccgaaaa

SEQ ID NO: 154085 - DNA, 25 bp, Mus musculus
agagctccagatcggcagttgcagt

SEQ ID NO: 154086 - DNA, 25 bp, Mus musculus
agagctccagatgggcagttgcagt

SEQ ID NO: 154087 - DNA, 25 bp, Mus musculus
agagctccagctatccagaatcttc

SEQ ID NO: 154088 - DNA, 25 bp, Mus musculus
agagctccagctttccagaatcttc

SEQ ID NO: 154089 - DNA, 25 bp, Mus musculus
agagctccaggcacttgtgagcctt

SEQ ID NO: 154090 - DNA, 25 bp, Mus musculus
agagctccaggctcttgtgagcctt

SEQ ID NO: 154091 - DNA, 25 bp, Mus musculus
agagctccagtgaaagcctgatgct

SEQ ID NO: 154092 - DNA, 25 bp, Mus musculus
agagctccagtgtaagcctgatgct

SEQ ID NO: 154093 - DNA, 25 bp, Mus musculus
agagctccattcctgaatcgtcaag

SEQ ID NO: 154094 - DNA, 25 bp, Mus musculus
agagctccattcgtgaatcgtcaag

SEQ ID NO: 154095 - DNA, 25 bp, Mus musculus
agagctccattgactgtcttgcttt

SEQ ID NO: 154096 - DNA, 25 bp, Mus musculus
agagctccattgtctgtcttgcttt

SEQ ID NO: 154097 - DNA, 25 bp, Mus musculus
agagctcccagactcagtacatctc

SEQ ID NO: 154098 - DNA, 25 bp, Mus musculus
agagctcccagagtcagtacatctc

SEQ ID NO: 154099 - DNA, 25 bp, Mus musculus
agagctccccacaataacagttgct

SEQ ID NO: 154100 - DNA, 25 bp, Mus musculus
agagctccccactataacagttgct

SEQ ID NO: 154101 - DNA, 25 bp, Mus musculus
agagctccctccaaggctactgaaa

SEQ ID NO: 154102 - DNA, 25 bp, Mus musculus
agagctccctcctaggctactgaaa

SEQ ID NO: 154103 - DNA, 25 bp, Mus musculus
agagctccctgcctaccgaggatgc

SEQ ID NO: 154104 - DNA, 25 bp, Mus musculus
agagctccctgcgtaccgaggatgc

SEQ ID NO: 154105 - DNA, 25 bp, Mus musculus
agagctccctgtctctatcatagag

SEQ ID NO: 154106 - DNA, 25 bp, Mus musculus
agagctccctgtgtctatcatagag

SEQ ID NO: 154107 - DNA, 25 bp, Mus musculus
agagctccgcaaccaggaaggccag

SEQ ID NO: 154108 - DNA, 25 bp, Mus musculus
agagctccgcaagcaggaaggccag

SEQ ID NO: 154109 - DNA, 25 bp, Mus musculus
agagctccggctatttgcggtgtgt

SEQ ID NO: 154110 - DNA, 25 bp, Mus musculus
agagctccggctttttgcggtgtgt

SEQ ID NO: 154111 - DNA, 25 bp, Mus musculus
agagctcctaaacgctgagttcctc

SEQ ID NO: 154112 - DNA, 25 bp, Mus musculus
agagctcctaaaggctgagttcctc

SEQ ID NO: 154113 - DNA, 25 bp, Mus musculus
agagctcctatcacagaactcaggt

SEQ ID NO: 154114 - DNA, 25 bp, Mus musculus
agagctcctatctcagaactcaggt

SEQ ID NO: 154115 - DNA, 25 bp, Mus musculus
agagctcctcacagagtgggacctg

SEQ ID NO: 154116 - DNA, 25 bp, Mus musculus
agagctcctcactgagtgggacctg

SEQ ID NO: 154117 - DNA, 25 bp, Mus musculus
agagctcctcagaggctgccaggat

SEQ ID NO: 154118 - DNA, 25 bp, Mus musculus
agagctcctcagtggctgccaggat

SEQ ID NO: 154119 - DNA, 25 bp, Mus musculus
agagctcctccaactagtgcagcat

SEQ ID NO: 154120 - DNA, 25 bp, Mus musculus
agagctcctccatctagtgcagcat

SEQ ID NO: 154121 - DNA, 25 bp, Mus musculus
agagctcctccccttttgatggtgt

SEQ ID NO: 154122 - DNA, 25 bp, Mus musculus
agagctcctcccgttttgatggtgt

SEQ ID NO: 154123 - DNA, 25 bp, Mus musculus
agagctcctgagaccgctgtcatta

SEQ ID NO: 154124 - DNA, 25 bp, Mus musculus
agagctcctgagaccttcagttcct

SEQ ID NO: 154125 - DNA, 25 bp, Mus musculus
agagctcctgagtccgctgtcatta

SEQ ID NO: 154126 - DNA, 25 bp, Mus musculus
agagctcctgagtccttcagttcct

SEQ ID NO: 154127 - DNA, 25 bp, Mus musculus
agagctcctgctagggtcctggata

SEQ ID NO: 154128 - DNA, 25 bp, Mus musculus
agagctcctgcttgggtcctggata

SEQ ID NO: 154129 - DNA, 25 bp, Mus musculus
agagctcctggacgtagcagttcct

SEQ ID NO: 154130 - DNA, 25 bp, Mus musculus
agagctcctggaggtagcagttcct

SEQ ID NO: 154131 - DNA, 25 bp, Mus musculus
agagctcctggtctcccatgaagat

SEQ ID NO: 154132 - DNA, 25 bp, Mus musculus
agagctcctggtgtcccatgaagat

SEQ ID NO: 154133 - DNA, 25 bp, Mus musculus
agagctcctgttacatgatggtcaa

SEQ ID NO: 154134 - DNA, 25 bp, Mus musculus
agagctcctgttattgcacactgtt

SEQ ID NO: 154135 - DNA, 25 bp, Mus musculus
agagctcctgtttcatgatggtcaa

SEQ ID NO: 154136 - DNA, 25 bp, Mus musculus
agagctcctgtttttgcacactgtt

SEQ ID NO: 154137 - DNA, 25 bp, Mus musculus
agagctccttccaagttctgcaagt

SEQ ID NO: 154138 - DNA, 25 bp, Mus musculus
agagctccttcccttgagactatgg

SEQ ID NO: 154139 - DNA, 25 bp, Mus musculus
agagctccttccgttgagactatgg

SEQ ID NO: 154140 - DNA, 25 bp, Mus musculus
agagctccttcctagttctgcaagt

SEQ ID NO: 154141 - DNA, 25 bp, Mus musculus
agagctcgaggacctgtcgcccagc

SEQ ID NO: 154142 - DNA, 25 bp, Mus musculus
agagctcgaggagctgtcgcccagc

SEQ ID NO: 154143 - DNA, 25 bp, Mus musculus
agagctcgataaagcccggtaccag

SEQ ID NO: 154144 - DNA, 25 bp, Mus musculus
agagctcgataatgcccggtaccag

SEQ ID NO: 154145 - DNA, 25 bp, Mus musculus
agagctcgattaattgccttgacaa

SEQ ID NO: 154146 - DNA, 25 bp, Mus musculus
agagctcgattatttgccttgacaa

SEQ ID NO: 154147 - DNA, 25 bp, Mus musculus
agagctcggataatttctctctgga

SEQ ID NO: 154148 - DNA, 25 bp, Mus musculus
agagctcggatattttctctctgga

SEQ ID NO: 154149 - DNA, 25 bp, Mus musculus
agagctcgggttcaacagccagaat

SEQ ID NO: 154150 - DNA, 25 bp, Mus musculus
agagctcgggttgaacagccagaat

SEQ ID NO: 154151 - DNA, 25 bp, Mus musculus
agagctctactcctcaggtgttcct

SEQ ID NO: 154152 - DNA, 25 bp, Mus musculus
agagctctactcgtcaggtgttcct

SEQ ID NO: 154153 - DNA, 25 bp, Mus musculus
agagctctactgactacctactaat

SEQ ID NO: 154154 - DNA, 25 bp, Mus musculus
agagctctactgtctacctactaat

SEQ ID NO: 154155 - DNA, 25 bp, Mus musculus
agagctctagacaggccaccgcgga

SEQ ID NO: 154156 - DNA, 25 bp, Mus musculus
agagctctagactggccaccgcgga

SEQ ID NO: 154157 - DNA, 25 bp, Mus musculus
agagctctagagcaccaccaacttc

SEQ ID NO: 154158 - DNA, 25 bp, Mus musculus
agagctctagaggaccaccaacttc

SEQ ID NO: 154159 - DNA, 25 bp, Mus musculus
agagctctatctctatcagtgaccc

SEQ ID NO: 154160 - DNA, 25 bp, Mus musculus
agagctctatctgtatcagtgaccc

SEQ ID NO: 154161 - DNA, 25 bp, Mus musculus
agagctctattcaccttatgtcggg

SEQ ID NO: 154162 - DNA, 25 bp, Mus musculus
agagctctattctccttatgtcggg

SEQ ID NO: 154163 - DNA, 25 bp, Mus musculus
agagctctcagacatgtccgcctaa

SEQ ID NO: 154164 - DNA, 25 bp, Mus musculus
agagctctcagacgctgcttggaag

SEQ ID NO: 154165 - DNA, 25 bp, Mus musculus
agagctctcagagatgtccgcctaa

SEQ ID NO: 154166 - DNA, 25 bp, Mus musculus
agagctctcagaggctgcttggaag

SEQ ID NO: 154167 - DNA, 25 bp, Mus musculus
agagctctcatacctcatcatgatg

SEQ ID NO: 154168 - DNA, 25 bp, Mus musculus
agagctctcatagctcatcatgatg

SEQ ID NO: 154169 - DNA, 25 bp, Mus musculus
agagctctccagcaagctatcaaga

SEQ ID NO: 154170 - DNA, 25 bp, Mus musculus
agagctctccaggaagctatcaaga

SEQ ID NO: 154171 - DNA, 25 bp, Mus musculus
agagctctccctagaagcagcagaa

SEQ ID NO: 154172 - DNA, 25 bp, Mus musculus
agagctctcccttgaagcagcagaa

SEQ ID NO: 154173 - DNA, 25 bp, Mus musculus
agagctctcgttatgaattacttag

SEQ ID NO: 154174 - DNA, 25 bp, Mus musculus
agagctctcgttttgaattacttag

SEQ ID NO: 154175 - DNA, 25 bp, Mus musculus
agagctctctaacgacagacccgtg

SEQ ID NO: 154176 - DNA, 25 bp, Mus musculus
agagctctctaaggacagacccgtg

SEQ ID NO: 154177 - DNA, 25 bp, Mus musculus
agagctctctcacctttatcagtgg

SEQ ID NO: 154178 - DNA, 25 bp, Mus musculus
agagctctctcagctttatcagtgg

SEQ ID NO: 154179 - DNA, 25 bp, Mus musculus
agagctctctctcagattgcaggta

SEQ ID NO: 154180 - DNA, 25 bp, Mus musculus
agagctctctctcgatcagctttac

SEQ ID NO: 154181 - DNA, 25 bp, Mus musculus
agagctctctctgagattgcaggta

SEQ ID NO: 154182 - DNA, 25 bp, Mus musculus
agagctctctctggatcagctttac

SEQ ID NO: 154183 - DNA, 25 bp, Mus musculus
agagctctctgaaggtctggcatta

SEQ ID NO: 154184 - DNA, 25 bp, Mus musculus
agagctctctgatggtctggcatta

SEQ ID NO: 154185 - DNA, 25 bp, Mus musculus
agagctctctgtcatggcaagtggc

SEQ ID NO: 154186 - DNA, 25 bp, Mus musculus
agagctctctgtgatggcaagtggc

SEQ ID NO: 154187 - DNA, 25 bp, Mus musculus
agagctctgaccaaagaggccagct

SEQ ID NO: 154188 - DNA, 25 bp, Mus musculus
agagctctgacctaagaggccagct

SEQ ID NO: 154189 - DNA, 25 bp, Mus musculus
agagctctgactcgaacgtttttgc

SEQ ID NO: 154190 - DNA, 25 bp, Mus musculus
agagctctgactggaacgtttttgc

SEQ ID NO: 154191 - DNA, 25 bp, Mus musculus
agagctctgagcaacttttctagac

SEQ ID NO: 154192 - DNA, 25 bp, Mus musculus
agagctctgagctacttttctagac

SEQ ID NO: 154193 - DNA, 25 bp, Mus musculus
agagctctgattacaagtgttgtca

SEQ ID NO: 154194 - DNA, 25 bp, Mus musculus
agagctctgatttcaagtgttgtca

SEQ ID NO: 154195 - DNA, 25 bp, Mus musculus
agagctctgcagaaaaattgctgaa

SEQ ID NO: 154196 - DNA, 25 bp, Mus musculus
agagctctgcagtaaaattgctgaa

SEQ ID NO: 154197 - DNA, 25 bp, Mus musculus
agagctctgccaacatctcatgatc

SEQ ID NO: 154198 - DNA, 25 bp, Mus musculus
agagctctgccatcatctcatgatc

SEQ ID NO: 154199 - DNA, 25 bp, Mus musculus
agagctctgctacttattcagccac

SEQ ID NO: 154200 - DNA, 25 bp, Mus musculus
agagctctgctagttattcagccac

SEQ ID NO: 154201 - DNA, 25 bp, Mus musculus
agagctctggatccagggcctcttt

SEQ ID NO: 154202 - DNA, 25 bp, Mus musculus
agagctctggatgcagggcctcttt

SEQ ID NO: 154203 - DNA, 25 bp, Mus musculus
agagctctggccaagcactgacatg

SEQ ID NO: 154204 - DNA, 25 bp, Mus musculus
agagctctggccagatgtcatctgt

SEQ ID NO: 154205 - DNA, 25 bp, Mus musculus
agagctctggcctagcactgacatg

SEQ ID NO: 154206 - DNA, 25 bp, Mus musculus
agagctctggcctgatgtcatctgt

SEQ ID NO: 154207 - DNA, 25 bp, Mus musculus
agagctctgggaccttggctatgac

SEQ ID NO: 154208 - DNA, 25 bp, Mus musculus
agagctctgggagcttggctatgac

SEQ ID NO: 154209 - DNA, 25 bp, Mus musculus
agagctctgggcacagtgagctaga

SEQ ID NO: 154210 - DNA, 25 bp, Mus musculus
agagctctgggctcagtgagctaga

SEQ ID NO: 154211 - DNA, 25 bp, Mus musculus
agagctctggtcaatgtgctgcttt

SEQ ID NO: 154212 - DNA, 25 bp, Mus musculus
agagctctggtctatgtgctgcttt

SEQ ID NO: 154213 - DNA, 25 bp, Mus musculus
agagctctgtaaagcctgattgggc

SEQ ID NO: 154214 - DNA, 25 bp, Mus musculus
agagctctgtaaagtgccgatggca

SEQ ID NO: 154215 - DNA, 25 bp, Mus musculus
agagctctgtaatgcctgattgggc

SEQ ID NO: 154216 - DNA, 25 bp, Mus musculus
agagctctgtaatgtgccgatggca

SEQ ID NO: 154217 - DNA, 25 bp, Mus musculus
agagctctgtacaaggttttccata

SEQ ID NO: 154218 - DNA, 25 bp, Mus musculus
agagctctgtactaggttttccata

SEQ ID NO: 154219 - DNA, 25 bp, Mus musculus
agagctctgtcacaatgttcgcact

SEQ ID NO: 154220 - DNA, 25 bp, Mus musculus
agagctctgtcagaatgttcgcact

SEQ ID NO: 154221 - DNA, 25 bp, Mus musculus
agagctctgtccagccacaagtttg

SEQ ID NO: 154222 - DNA, 25 bp, Mus musculus
agagctctgtcctgccacaagtttg

SEQ ID NO: 154223 - DNA, 25 bp, Mus musculus
agagctctgtgcacagaccttggcc

SEQ ID NO: 154224 - DNA, 25 bp, Mus musculus
agagctctgtgctcagaccttggcc

SEQ ID NO: 154225 - DNA, 25 bp, Mus musculus
agagctcttaccactgataggaact

SEQ ID NO: 154226 - DNA, 25 bp, Mus musculus
agagctcttacctctgataggaact

SEQ ID NO: 154227 - DNA, 25 bp, Mus musculus
agagctcttaggacggcttgggtat

SEQ ID NO: 154228 - DNA, 25 bp, Mus musculus
agagctcttaggtcggcttgggtat

SEQ ID NO: 154229 - DNA, 25 bp, Mus musculus
agagctcttcagacacgtcattgga

SEQ ID NO: 154230 - DNA, 25 bp, Mus musculus
agagctcttcagtcacgtcattgga

SEQ ID NO: 154231 - DNA, 25 bp, Mus musculus
agagctcttcatcccactgacagga

SEQ ID NO: 154232 - DNA, 25 bp, Mus musculus
agagctcttcatgccactgacagga

SEQ ID NO: 154233 - DNA, 25 bp, Mus musculus
agagctcttccgaagcactcctgaa

SEQ ID NO: 154234 - DNA, 25 bp, Mus musculus
agagctcttccgtagcactcctgaa

SEQ ID NO: 154235 - DNA, 25 bp, Mus musculus
agagctctttccaattgacgatgtc

SEQ ID NO: 154236 - DNA, 25 bp, Mus musculus
agagctctttcctattgacgatgtc

SEQ ID NO: 154237 - DNA, 25 bp, Mus musculus
agagctcttttcacttaattcgcca

SEQ ID NO: 154238 - DNA, 25 bp, Mus musculus
agagctcttttctcttaattcgcca

SEQ ID NO: 154239 - DNA, 25 bp, Mus musculus
agagctgaaagccatcacccaatga

SEQ ID NO: 154240 - DNA, 25 bp, Mus musculus
agagctgaaagcgatcacccaatga

SEQ ID NO: 154241 - DNA, 25 bp, Mus musculus
agagctgaacaccttctacctgaag

SEQ ID NO: 154242 - DNA, 25 bp, Mus musculus
agagctgaacacgttctacctgaag

SEQ ID NO: 154243 - DNA, 25 bp, Mus musculus
agagctgaacagatggaacccacaa

SEQ ID NO: 154244 - DNA, 25 bp, Mus musculus
agagctgaacagttggaacccacaa

SEQ ID NO: 154245 - DNA, 25 bp, Mus musculus
agagctgaagatagtgccctgtcac

SEQ ID NO: 154246 - DNA, 25 bp, Mus musculus
agagctgaagattgtgccctgtcac

SEQ ID NO: 154247 - DNA, 25 bp, Mus musculus
agagctgaagcacccgacaaccacc

SEQ ID NO: 154248 - DNA, 25 bp, Mus musculus
agagctgaagcagccgacaaccacc

SEQ ID NO: 154249 - DNA, 25 bp, Mus musculus
agagctgaagtaccatctcagtttt

SEQ ID NO: 154250 - DNA, 25 bp, Mus musculus
agagctgaagtagcatctcagtttt

SEQ ID NO: 154251 - DNA, 25 bp, Mus musculus
agagctgaagtcacagcccgtgttt

SEQ ID NO: 154252 - DNA, 25 bp, Mus musculus
agagctgaagtctcagcccgtgttt

SEQ ID NO: 154253 - DNA, 25 bp, Mus musculus
agagctgacagcatcgggtccactg

SEQ ID NO: 154254 - DNA, 25 bp, Mus musculus
agagctgacagcttcgggtccactg

SEQ ID NO: 154255 - DNA, 25 bp, Mus musculus
agagctgaccagattgccaatgagt

SEQ ID NO: 154256 - DNA, 25 bp, Mus musculus
agagctgaccagtttgccaatgagt

SEQ ID NO: 154257 - DNA, 25 bp, Mus musculus
agagctgaccttatttgcttaccag

SEQ ID NO: 154258 - DNA, 25 bp, Mus musculus
agagctgaccttttttgcttaccag

SEQ ID NO: 154259 - DNA, 25 bp, Mus musculus
agagctgacgctagttaactgagaa

SEQ ID NO: 154260 - DNA, 25 bp, Mus musculus
agagctgacgcttgttaactgagaa

SEQ ID NO: 154261 - DNA, 25 bp, Mus musculus
agagctgacggaagtttaccagaaa

SEQ ID NO: 154262 - DNA, 25 bp, Mus musculus
agagctgacggatgtttaccagaaa

SEQ ID NO: 154263 - DNA, 25 bp, Mus musculus
agagctgactaaagcatcgcctgac

SEQ ID NO: 154264 - DNA, 25 bp, Mus musculus
agagctgactaatgcatcgcctgac

SEQ ID NO: 154265 - DNA, 25 bp, Mus musculus
agagctgactgaatgcaaggcacta

SEQ ID NO: 154266 - DNA, 25 bp, Mus musculus
agagctgactgattgcaaggcacta

SEQ ID NO: 154267 - DNA, 25 bp, Mus musculus
agagctgactggagtggcccatccc

SEQ ID NO: 154268 - DNA, 25 bp, Mus musculus
agagctgactggtgtggcccatccc

SEQ ID NO: 154269 - DNA, 25 bp, Mus musculus
agagctgacttcatcctgagagttt

SEQ ID NO: 154270 - DNA, 25 bp, Mus musculus
agagctgacttcatgacaggcttta

SEQ ID NO: 154271 - DNA, 25 bp, Mus musculus
agagctgacttcttcctgagagttt

SEQ ID NO: 154272 - DNA, 25 bp, Mus musculus
agagctgacttcttgacaggcttta

SEQ ID NO: 154273 - DNA, 25 bp, Mus musculus
agagctgagcccactggttgaagca

SEQ ID NO: 154274 - DNA, 25 bp, Mus musculus
agagctgagccctctggttgaagca

SEQ ID NO: 154275 - DNA, 25 bp, Mus musculus
agagctgagctcacgaagcagaatg

SEQ ID NO: 154276 - DNA, 25 bp, Mus musculus
agagctgagctctcgaagcagaatg

SEQ ID NO: 154277 - DNA, 25 bp, Mus musculus
agagctgagcttcaatttcctgtta

SEQ ID NO: 154278 - DNA, 25 bp, Mus musculus
agagctgagcttcgctgcctcttta

SEQ ID NO: 154279 - DNA, 25 bp, Mus musculus
agagctgagcttgaatttcctgtta

SEQ ID NO: 154280 - DNA, 25 bp, Mus musculus
agagctgagcttggctgcctcttta

SEQ ID NO: 154281 - DNA, 25 bp, Mus musculus
agagctgaggacacacactgattgt

SEQ ID NO: 154282 - DNA, 25 bp, Mus musculus
agagctgaggactcacactgattgt

SEQ ID NO: 154283 - DNA, 25 bp, Mus musculus
agagctgaggatcaggggacacaca

SEQ ID NO: 154284 - DNA, 25 bp, Mus musculus
agagctgaggatgaggggacacaca

SEQ ID NO: 154285 - DNA, 25 bp, Mus musculus
agagctgaggtgacctgctacttct

SEQ ID NO: 154286 - DNA, 25 bp, Mus musculus
agagctgaggtgtcctgctacttct

SEQ ID NO: 154287 - DNA, 25 bp, Mus musculus
agagctgagtccagggttgaacaaa

SEQ ID NO: 154288 - DNA, 25 bp, Mus musculus
agagctgagtcctgggttgaacaaa

SEQ ID NO: 154289 - DNA, 25 bp, Mus musculus
agagctgagtgaccccacccacaat

SEQ ID NO: 154290 - DNA, 25 bp, Mus musculus
agagctgagtgagcccacccacaat

SEQ ID NO: 154291 - DNA, 25 bp, Mus musculus
agagctgatcccctttgtgaagcct

SEQ ID NO: 154292 - DNA, 25 bp, Mus musculus
agagctgatcccgtttgtgaagcct

SEQ ID NO: 154293 - DNA, 25 bp, Mus musculus
agagctgatctcaacgtgaacatga

SEQ ID NO: 154294 - DNA, 25 bp, Mus musculus
agagctgatctctacgtgaacatga

SEQ ID NO: 154295 - DNA, 25 bp, Mus musculus
agagctgatgtaatccagggcctgg

SEQ ID NO: 154296 - DNA, 25 bp, Mus musculus
agagctgatgtattccagggcctgg

SEQ ID NO: 154297 - DNA, 25 bp, Mus musculus
agagctgatgtcaggaatccacaag

SEQ ID NO: 154298 - DNA, 25 bp, Mus musculus
agagctgatgtctggaatccacaag

SEQ ID NO: 154299 - DNA, 25 bp, Mus musculus
agagctgatgttcccgtcttatctc

SEQ ID NO: 154300 - DNA, 25 bp, Mus musculus
agagctgatgttgccgtcttatctc

SEQ ID NO: 154301 - DNA, 25 bp, Mus musculus
agagctgattccaaaaacttatgca

SEQ ID NO: 154302 - DNA, 25 bp, Mus musculus
agagctgattccaggagtccccaaa

SEQ ID NO: 154303 - DNA, 25 bp, Mus musculus
agagctgattcctaaaacttatgca

SEQ ID NO: 154304 - DNA, 25 bp, Mus musculus
agagctgattcctggagtccccaaa

SEQ ID NO: 154305 - DNA, 25 bp, Mus musculus
agagctgattgaacatcgccacact

SEQ ID NO: 154306 - DNA, 25 bp, Mus musculus
agagctgattgacccaatcttccac

SEQ ID NO: 154307 - DNA, 25 bp, Mus musculus
agagctgattgagccaatcttccac

SEQ ID NO: 154308 - DNA, 25 bp, Mus musculus
agagctgattgatcatcgccacact

SEQ ID NO: 154309 - DNA, 25 bp, Mus musculus
agagctgatttcaccacaatgccag

SEQ ID NO: 154310 - DNA, 25 bp, Mus musculus
agagctgatttctccacaatgccag

SEQ ID NO: 154311 - DNA, 25 bp, Mus musculus
agagctgcaaagaactgcgccttct

SEQ ID NO: 154312 - DNA, 25 bp, Mus musculus
agagctgcaaagtactgcgccttct

SEQ ID NO: 154313 - DNA, 25 bp, Mus musculus
agagctgcacacagtggtcacctgc

SEQ ID NO: 154314 - DNA, 25 bp, Mus musculus
agagctgcacactgtggtcacctgc

SEQ ID NO: 154315 - DNA, 25 bp, Mus musculus
agagctgcacccacccgacagagag

SEQ ID NO: 154316 - DNA, 25 bp, Mus musculus
agagctgcaccctcccgacagagag

SEQ ID NO: 154317 - DNA, 25 bp, Mus musculus
agagctgcaccgctggtggcttccc

SEQ ID NO: 154318 - DNA, 25 bp, Mus musculus
agagctgcaccggtggtggcttccc

SEQ ID NO: 154319 - DNA, 25 bp, Mus musculus
agagctgcacttcgcctcagctggc

SEQ ID NO: 154320 - DNA, 25 bp, Mus musculus
agagctgcacttggcctcagctggc

SEQ ID NO: 154321 - DNA, 25 bp, Mus musculus
agagctgcaggaaccagaccccaga

SEQ ID NO: 154322 - DNA, 25 bp, Mus musculus
agagctgcaggatccagaccccaga

SEQ ID NO: 154323 - DNA, 25 bp, Mus musculus
agagctgcaggccagattatgccta

SEQ ID NO: 154324 - DNA, 25 bp, Mus musculus
agagctgcaggcgagattatgccta

SEQ ID NO: 154325 - DNA, 25 bp, Mus musculus
agagctgcatcgacttattcaagaa

SEQ ID NO: 154326 - DNA, 25 bp, Mus musculus
agagctgcatcgtcttattcaagaa

SEQ ID NO: 154327 - DNA, 25 bp, Mus musculus
agagctgcatttaaccctgagagga

SEQ ID NO: 154328 - DNA, 25 bp, Mus musculus
agagctgcattttaccctgagagga

SEQ ID NO: 154329 - DNA, 25 bp, Mus musculus
agagctgccaacctcctttcactgt

SEQ ID NO: 154330 - DNA, 25 bp, Mus musculus
agagctgccaacgtcctttcactgt

SEQ ID NO: 154331 - DNA, 25 bp, Mus musculus
agagctgccattcttttcatcttta

SEQ ID NO: 154332 - DNA, 25 bp, Mus musculus
agagctgccattgttttcatcttta

SEQ ID NO: 154333 - DNA, 25 bp, Mus musculus
agagctgcccctcggattgcatcag

SEQ ID NO: 154334 - DNA, 25 bp, Mus musculus
agagctgcccctgggattgcatcag

SEQ ID NO: 154335 - DNA, 25 bp, Mus musculus
agagctgccgacacatggaggccga

SEQ ID NO: 154336 - DNA, 25 bp, Mus musculus
agagctgccgactcatggaggccga

SEQ ID NO: 154337 - DNA, 25 bp, Mus musculus
agagctgccgctcctgtgaatgctg

SEQ ID NO: 154338 - DNA, 25 bp, Mus musculus
agagctgccgctgctgtgaatgctg

SEQ ID NO: 154339 - DNA, 25 bp, Mus musculus
agagctgcctcacagcaacttggaa

SEQ ID NO: 154340 - DNA, 25 bp, Mus musculus
agagctgcctcagagcaacttggaa

SEQ ID NO: 154341 - DNA, 25 bp, Mus musculus
agagctgcctcgcaggttaagaaca

SEQ ID NO: 154342 - DNA, 25 bp, Mus musculus
agagctgcctcggaggttaagaaca

SEQ ID NO: 154343 - DNA, 25 bp, Mus musculus
agagctgcctgtcggatgcctgacc

SEQ ID NO: 154344 - DNA, 25 bp, Mus musculus
agagctgcctgtgggatgcctgacc

SEQ ID NO: 154345 - DNA, 25 bp, Mus musculus
agagctgcgaggaggccctggacat

SEQ ID NO: 154346 - DNA, 25 bp, Mus musculus
agagctgcgaggtggccctggacat

SEQ ID NO: 154347 - DNA, 25 bp, Mus musculus
agagctgcgggcagtatggcttccc

SEQ ID NO: 154348 - DNA, 25 bp, Mus musculus
agagctgcgggctgtatggcttccc

SEQ ID NO: 154349 - DNA, 25 bp, Mus musculus
agagctgcgtacacaacttatcaaa

SEQ ID NO: 154350 - DNA, 25 bp, Mus musculus
agagctgcgtactcaacttatcaaa

SEQ ID NO: 154351 - DNA, 25 bp, Mus musculus
agagctgcgtctctttgtgttgcca

SEQ ID NO: 154352 - DNA, 25 bp, Mus musculus
agagctgcgtctgtttgtgttgcca

SEQ ID NO: 154353 - DNA, 25 bp, Mus musculus
agagctgctagtcgttttcctgaga

SEQ ID NO: 154354 - DNA, 25 bp, Mus musculus
agagctgctagtggttttcctgaga

SEQ ID NO: 154355 - DNA, 25 bp, Mus musculus
agagctgctatgattcctctgcctc

SEQ ID NO: 154356 - DNA, 25 bp, Mus musculus
agagctgctatgtttcctctgcctc

SEQ ID NO: 154357 - DNA, 25 bp, Mus musculus
agagctgctcatagtgaatccagaa

SEQ ID NO: 154358 - DNA, 25 bp, Mus musculus
agagctgctcattgtgaatccagaa

SEQ ID NO: 154359 - DNA, 25 bp, Mus musculus
agagctgctccaatcagatccgtgg

SEQ ID NO: 154360 - DNA, 25 bp, Mus musculus
agagctgctccattcagatccgtgg

SEQ ID NO: 154361 - DNA, 25 bp, Mus musculus
agagctgctcgacatgcactgtgga

SEQ ID NO: 154362 - DNA, 25 bp, Mus musculus
agagctgctcgacccaccaatgtag

SEQ ID NO: 154363 - DNA, 25 bp, Mus musculus
agagctgctcgagatgcactgtgga

SEQ ID NO: 154364 - DNA, 25 bp, Mus musculus
agagctgctcgagccaccaatgtag

SEQ ID NO: 154365 - DNA, 25 bp, Mus musculus
agagctgctctgactgtttttattt

SEQ ID NO: 154366 - DNA, 25 bp, Mus musculus
agagctgctctgtctgtttttattt

SEQ ID NO: 154367 - DNA, 25 bp, Mus musculus
agagctgctgatagtgaatctcaaa

SEQ ID NO: 154368 - DNA, 25 bp, Mus musculus
agagctgctgattgtgaatctcaaa

SEQ ID NO: 154369 - DNA, 25 bp, Mus musculus
agagctgctgcaattctcccatctt

SEQ ID NO: 154370 - DNA, 25 bp, Mus musculus
agagctgctgcaccactttgaaaaa

SEQ ID NO: 154371 - DNA, 25 bp, Mus musculus
agagctgctgcagcactttgaaaaa

SEQ ID NO: 154372 - DNA, 25 bp, Mus musculus
agagctgctgcatttctcccatctt

SEQ ID NO: 154373 - DNA, 25 bp, Mus musculus
agagctgctgcgatagcactaggca

SEQ ID NO: 154374 - DNA, 25 bp, Mus musculus
agagctgctgcgttagcactaggca

SEQ ID NO: 154375 - DNA, 25 bp, Mus musculus
agagctgctgctatatccaaatgct

SEQ ID NO: 154376 - DNA, 25 bp, Mus musculus
agagctgctgctttatccaaatgct

SEQ ID NO: 154377 - DNA, 25 bp, Mus musculus
agagctgctggaaactagactgtat

SEQ ID NO: 154378 - DNA, 25 bp, Mus musculus
agagctgctggaagtctgaactcct

SEQ ID NO: 154379 - DNA, 25 bp, Mus musculus
agagctgctggatactagactgtat

SEQ ID NO: 154380 - DNA, 25 bp, Mus musculus
agagctgctggatgtctgaactcct

SEQ ID NO: 154381 - DNA, 25 bp, Mus musculus
agagctgctgtaaaagtccttcaaa

SEQ ID NO: 154382 - DNA, 25 bp, Mus musculus
agagctgctgtataagtccttcaaa

SEQ ID NO: 154383 - DNA, 25 bp, Mus musculus
agagctgctgttctagactctacag

SEQ ID NO: 154384 - DNA, 25 bp, Mus musculus
agagctgctgttgtagactctacag

SEQ ID NO: 154385 - DNA, 25 bp, Mus musculus
agagctgcttccaactgtcattgag

SEQ ID NO: 154386 - DNA, 25 bp, Mus musculus
agagctgcttcccttaactgtggga

SEQ ID NO: 154387 - DNA, 25 bp, Mus musculus
agagctgcttccgttaactgtggga

SEQ ID NO: 154388 - DNA, 25 bp, Mus musculus
agagctgcttcctactgtcattgag

SEQ ID NO: 154389 - DNA, 25 bp, Mus musculus
agagctgcttctaaactttgtacta

SEQ ID NO: 154390 - DNA, 25 bp, Mus musculus
agagctgcttctctggcgctatccc

SEQ ID NO: 154391 - DNA, 25 bp, Mus musculus
agagctgcttctgtggcgctatccc

SEQ ID NO: 154392 - DNA, 25 bp, Mus musculus
agagctgcttcttaactttgtacta

SEQ ID NO: 154393 - DNA, 25 bp, Mus musculus
agagctgcttggataacgccccgtg

SEQ ID NO: 154394 - DNA, 25 bp, Mus musculus
agagctgcttggttaacgccccgtg

SEQ ID NO: 154395 - DNA, 25 bp, Mus musculus
agagctgctttcaaggctaccatgt

SEQ ID NO: 154396 - DNA, 25 bp, Mus musculus
agagctgctttctaggctaccatgt

SEQ ID NO: 154397 - DNA, 25 bp, Mus musculus
agagctggactccatactggacgtt

SEQ ID NO: 154398 - DNA, 25 bp, Mus musculus
agagctggactcgatactggacgtt

SEQ ID NO: 154399 - DNA, 25 bp, Mus musculus
agagctggactgaggaggaccttca

SEQ ID NO: 154400 - DNA, 25 bp, Mus musculus
agagctggactgtggaggaccttca

SEQ ID NO: 154401 - DNA, 25 bp, Mus musculus
agagctggagagcattcccacttct

SEQ ID NO: 154402 - DNA, 25 bp, Mus musculus
agagctggagaggattcccacttct

SEQ ID NO: 154403 - DNA, 25 bp, Mus musculus
agagctggagccctagaatccctgt

SEQ ID NO: 154404 - DNA, 25 bp, Mus musculus
agagctggagccgtagaatccctgt

SEQ ID NO: 154405 - DNA, 25 bp, Mus musculus
agagctggagctaactggcccaatc

SEQ ID NO: 154406 - DNA, 25 bp, Mus musculus
agagctggagctctcgcccttcagt

SEQ ID NO: 154407 - DNA, 25 bp, Mus musculus
agagctggagctgtcgcccttcagt

SEQ ID NO: 154408 - DNA, 25 bp, Mus musculus
agagctggagcttactggcccaatc

SEQ ID NO: 154409 - DNA, 25 bp, Mus musculus
agagctggattactcgctgtttcct

SEQ ID NO: 154410 - DNA, 25 bp, Mus musculus
agagctggattagtcgctgtttcct

SEQ ID NO: 154411 - DNA, 25 bp, Mus musculus
agagctggattcatcaccttcttta

SEQ ID NO: 154412 - DNA, 25 bp, Mus musculus
agagctggattcttcaccttcttta

SEQ ID NO: 154413 - DNA, 25 bp, Mus musculus
agagctggcaacactatcttacttc

SEQ ID NO: 154414 - DNA, 25 bp, Mus musculus
agagctggcaactctatcttacttc

SEQ ID NO: 154415 - DNA, 25 bp, Mus musculus
agagctggcagtcatacgttaccaa

SEQ ID NO: 154416 - DNA, 25 bp, Mus musculus
agagctggcagtgatacgttaccaa

SEQ ID NO: 154417 - DNA, 25 bp, Mus musculus
agagctggcatacaggactgccacc

SEQ ID NO: 154418 - DNA, 25 bp, Mus musculus
agagctggcatagaggactgccacc

SEQ ID NO: 154419 - DNA, 25 bp, Mus musculus
agagctggcatgacccgagtctttg

SEQ ID NO: 154420 - DNA, 25 bp, Mus musculus
agagctggcatgtcccgagtctttg

SEQ ID NO: 154421 - DNA, 25 bp, Mus musculus
agagctggccaaactgcgggacctg

SEQ ID NO: 154422 - DNA, 25 bp, Mus musculus
agagctggccaatctgcgggacctg

SEQ ID NO: 154423 - DNA, 25 bp, Mus musculus
agagctggcccaagattctagatga

SEQ ID NO: 154424 - DNA, 25 bp, Mus musculus
agagctggcccatgattctagatga

SEQ ID NO: 154425 - DNA, 25 bp, Mus musculus
agagctggccgaaccatggctagca

SEQ ID NO: 154426 - DNA, 25 bp, Mus musculus
agagctggccgatccatggctagca

SEQ ID NO: 154427 - DNA, 25 bp, Mus musculus
agagctggcctccattcaaggttgc

SEQ ID NO: 154428 - DNA, 25 bp, Mus musculus
agagctggcctcgattcaaggttgc

SEQ ID NO: 154429 - DNA, 25 bp, Mus musculus
agagctggctggacctcactaaact

SEQ ID NO: 154430 - DNA, 25 bp, Mus musculus
agagctggctggtcctcactaaact

SEQ ID NO: 154431 - DNA, 25 bp, Mus musculus
agagctggctgtcactctgaaacca

SEQ ID NO: 154432 - DNA, 25 bp, Mus musculus
agagctggctgtgactctgaaacca

SEQ ID NO: 154433 - DNA, 25 bp, Mus musculus
agagctgggactaggcccatcatct

SEQ ID NO: 154434 - DNA, 25 bp, Mus musculus
agagctgggacttggcccatcatct

SEQ ID NO: 154435 - DNA, 25 bp, Mus musculus
agagctgggagcatcgtccacagga

SEQ ID NO: 154436 - DNA, 25 bp, Mus musculus
agagctgggagcttcgtccacagga

SEQ ID NO: 154437 - DNA, 25 bp, Mus musculus
agagctgggattatagacatgtgtc

SEQ ID NO: 154438 - DNA, 25 bp, Mus musculus
agagctgggattcagcacttcctcg

SEQ ID NO: 154439 - DNA, 25 bp, Mus musculus
agagctgggattccccacagcccaa

SEQ ID NO: 154440 - DNA, 25 bp, Mus musculus
agagctgggattgagcacttcctcg

SEQ ID NO: 154441 - DNA, 25 bp, Mus musculus
agagctgggattgcccacagcccaa

SEQ ID NO: 154442 - DNA, 25 bp, Mus musculus
agagctgggattttagacatgtgtc

SEQ ID NO: 154443 - DNA, 25 bp, Mus musculus
agagctgggcatacttcaagtcaga

SEQ ID NO: 154444 - DNA, 25 bp, Mus musculus
agagctgggcattcttcaagtcaga

SEQ ID NO: 154445 - DNA, 25 bp, Mus musculus
agagctgggtaaccctcaaagctgt

SEQ ID NO: 154446 - DNA, 25 bp, Mus musculus
agagctgggtaagcctcaaagctgt

SEQ ID NO: 154447 - DNA, 25 bp, Mus musculus
agagctgggttcattttgcctccaa

SEQ ID NO: 154448 - DNA, 25 bp, Mus musculus
agagctgggttctttttgcctccaa

SEQ ID NO: 154449 - DNA, 25 bp, Mus musculus
agagctggtacccatggacccagaa

SEQ ID NO: 154450 - DNA, 25 bp, Mus musculus
agagctggtaccgatggacccagaa

SEQ ID NO: 154451 - DNA, 25 bp, Mus musculus
agagctggtatcctgaagcccattt

SEQ ID NO: 154452 - DNA, 25 bp, Mus musculus
agagctggtatcgtgaagcccattt

SEQ ID NO: 154453 - DNA, 25 bp, Mus musculus
agagctggtcccatcaccaggttcc

SEQ ID NO: 154454 - DNA, 25 bp, Mus musculus
agagctggtcccttcaccaggttcc

SEQ ID NO: 154455 - DNA, 25 bp, Mus musculus
agagctggtgggatgaccaactcaa

SEQ ID NO: 154456 - DNA, 25 bp, Mus musculus
agagctggtgggttgaccaactcaa

SEQ ID NO: 154457 - DNA, 25 bp, Mus musculus
agagctgtaatacttccgaggatga

SEQ ID NO: 154458 - DNA, 25 bp, Mus musculus
agagctgtaatagttccgaggatga

SEQ ID NO: 154459 - DNA, 25 bp, Mus musculus
agagctgtacaaaacccaggcctgc

SEQ ID NO: 154460 - DNA, 25 bp, Mus musculus
agagctgtacaatacccaggcctgc

SEQ ID NO: 154461 - DNA, 25 bp, Mus musculus
agagctgtaccgcagacagaccttt

SEQ ID NO: 154462 - DNA, 25 bp, Mus musculus
agagctgtaccggagacagaccttt

SEQ ID NO: 154463 - DNA, 25 bp, Mus musculus
agagctgtactcagtatcatacgat

SEQ ID NO: 154464 - DNA, 25 bp, Mus musculus
agagctgtactctgtatcatacgat

SEQ ID NO: 154465 - DNA, 25 bp, Mus musculus
agagctgtacttcagccgttgacca

SEQ ID NO: 154466 - DNA, 25 bp, Mus musculus
agagctgtacttgagccgttgacca

SEQ ID NO: 154467 - DNA, 25 bp, Mus musculus
agagctgtagcaccgaccccacgtc

SEQ ID NO: 154468 - DNA, 25 bp, Mus musculus
agagctgtagcaccttgtctgaggc

SEQ ID NO: 154469 - DNA, 25 bp, Mus musculus
agagctgtagcagcgaccccacgtc

SEQ ID NO: 154470 - DNA, 25 bp, Mus musculus
agagctgtagcagcttgtctgaggc

SEQ ID NO: 154471 - DNA, 25 bp, Mus musculus
agagctgtaggaaagcaccctgact

SEQ ID NO: 154472 - DNA, 25 bp, Mus musculus
agagctgtaggatagcaccctgact

SEQ ID NO: 154473 - DNA, 25 bp, Mus musculus
agagctgtagtaatgtcccttgcac

SEQ ID NO: 154474 - DNA, 25 bp, Mus musculus
agagctgtagtattgtcccttgcac

SEQ ID NO: 154475 - DNA, 25 bp, Mus musculus
agagctgtatagaggtacctccagc

SEQ ID NO: 154476 - DNA, 25 bp, Mus musculus
agagctgtatagtggtacctccagc

SEQ ID NO: 154477 - DNA, 25 bp, Mus musculus
agagctgtcagcctacaaccaggga

SEQ ID NO: 154478 - DNA, 25 bp, Mus musculus
agagctgtcagcgtacaaccaggga

SEQ ID NO: 154479 - DNA, 25 bp, Mus musculus
agagctgtccagctaagaggctgca

SEQ ID NO: 154480 - DNA, 25 bp, Mus musculus
agagctgtccaggtaagaggctgca

SEQ ID NO: 154481 - DNA, 25 bp, Mus musculus
agagctgtccccacaggagctgctg

SEQ ID NO: 154482 - DNA, 25 bp, Mus musculus
agagctgtcccctcaggagctgctg

SEQ ID NO: 154483 - DNA, 25 bp, Mus musculus
agagctgtcccgctggcttaagttc

SEQ ID NO: 154484 - DNA, 25 bp, Mus musculus
agagctgtcccggtggcttaagttc

SEQ ID NO: 154485 - DNA, 25 bp, Mus musculus
agagctgtcctccaggcctggtgtt

SEQ ID NO: 154486 - DNA, 25 bp, Mus musculus
agagctgtcctcgaggcctggtgtt

SEQ ID NO: 154487 - DNA, 25 bp, Mus musculus
agagctgtcctgaatcgaagtgatc

SEQ ID NO: 154488 - DNA, 25 bp, Mus musculus
agagctgtcctgtatcgaagtgatc

SEQ ID NO: 154489 - DNA, 25 bp, Mus musculus
agagctgtccttcggcaaaggtgct

SEQ ID NO: 154490 - DNA, 25 bp, Mus musculus
agagctgtccttgggcaaaggtgct

SEQ ID NO: 154491 - DNA, 25 bp, Mus musculus
agagctgtcgagatctgtcgttaga

SEQ ID NO: 154492 - DNA, 25 bp, Mus musculus
agagctgtcgagttctgtcgttaga

SEQ ID NO: 154493 - DNA, 25 bp, Mus musculus
agagctgtcgtcactgtagccagat

SEQ ID NO: 154494 - DNA, 25 bp, Mus musculus
agagctgtcgtctctgtagccagat

SEQ ID NO: 154495 - DNA, 25 bp, Mus musculus
agagctgtctacacaactgcagttt

SEQ ID NO: 154496 - DNA, 25 bp, Mus musculus
agagctgtctactcaactgcagttt

SEQ ID NO: 154497 - DNA, 25 bp, Mus musculus
agagctgtctccagctgacgagaaa

SEQ ID NO: 154498 - DNA, 25 bp, Mus musculus
agagctgtctccagtcttatagagt

SEQ ID NO: 154499 - DNA, 25 bp, Mus musculus
agagctgtctcctgctgacgagaaa

SEQ ID NO: 154500 - DNA, 25 bp, Mus musculus
agagctgtctcctgtcttatagagt

SEQ ID NO: 154501 - DNA, 25 bp, Mus musculus
agagctgtctgacaaaagaacaaag

SEQ ID NO: 154502 - DNA, 25 bp, Mus musculus
agagctgtctgagaaaagaacaaag

SEQ ID NO: 154503 - DNA, 25 bp, Mus musculus
agagctgtctggcattcattggctg

SEQ ID NO: 154504 - DNA, 25 bp, Mus musculus
agagctgtctgggattcattggctg

SEQ ID NO: 154505 - DNA, 25 bp, Mus musculus
agagctgtctttagcattctgctgg

SEQ ID NO: 154506 - DNA, 25 bp, Mus musculus
agagctgtctttccacaaacgtgta

SEQ ID NO: 154507 - DNA, 25 bp, Mus musculus
agagctgtctttgcacaaacgtgta

SEQ ID NO: 154508 - DNA, 25 bp, Mus musculus
agagctgtcttttgcattctgctgg

SEQ ID NO: 154509 - DNA, 25 bp, Mus musculus
agagctgtgaagattctttctaaaa

SEQ ID NO: 154510 - DNA, 25 bp, Mus musculus
agagctgtgaagtttctttctaaaa

SEQ ID NO: 154511 - DNA, 25 bp, Mus musculus
agagctgtgacaccgccaaacactc

SEQ ID NO: 154512 - DNA, 25 bp, Mus musculus
agagctgtgacagcgccaaacactc

SEQ ID NO: 154513 - DNA, 25 bp, Mus musculus
agagctgtgacccttgtcctttgac

SEQ ID NO: 154514 - DNA, 25 bp, Mus musculus
agagctgtgaccgttgtcctttgac

SEQ ID NO: 154515 - DNA, 25 bp, Mus musculus
agagctgtgagccagcttccgcatt

SEQ ID NO: 154516 - DNA, 25 bp, Mus musculus
agagctgtgagcgagcttccgcatt

SEQ ID NO: 154517 - DNA, 25 bp, Mus musculus
agagctgtgagtacacatgggtgct

SEQ ID NO: 154518 - DNA, 25 bp, Mus musculus
agagctgtgagttcacatgggtgct

SEQ ID NO: 154519 - DNA, 25 bp, Mus musculus
agagctgtgcagacgctggtatcca

SEQ ID NO: 154520 - DNA, 25 bp, Mus musculus
agagctgtgcagtcgctggtatcca

SEQ ID NO: 154521 - DNA, 25 bp, Mus musculus
agagctgtgctactggagatcaata

SEQ ID NO: 154522 - DNA, 25 bp, Mus musculus
agagctgtgctagtggagatcaata

SEQ ID NO: 154523 - DNA, 25 bp, Mus musculus
agagctgtgctcaatttacctttag

SEQ ID NO: 154524 - DNA, 25 bp, Mus musculus
agagctgtgctccaatatgagagat

SEQ ID NO: 154525 - DNA, 25 bp, Mus musculus
agagctgtgctcgaatatgagagat

SEQ ID NO: 154526 - DNA, 25 bp, Mus musculus
agagctgtgctctatttacctttag

SEQ ID NO: 154527 - DNA, 25 bp, Mus musculus
agagctgtggataactgcattttca

SEQ ID NO: 154528 - DNA, 25 bp, Mus musculus
agagctgtggattactgcattttca

SEQ ID NO: 154529 - DNA, 25 bp, Mus musculus
agagctgtggcaactgagggactaa

SEQ ID NO: 154530 - DNA, 25 bp, Mus musculus
agagctgtggcatctgagggactaa

SEQ ID NO: 154531 - DNA, 25 bp, Mus musculus
agagctgtggccagacttgaagcac

SEQ ID NO: 154532 - DNA, 25 bp, Mus musculus
agagctgtggcctgacttgaagcac

SEQ ID NO: 154533 - DNA, 25 bp, Mus musculus
agagctgtgggcaacttctgggttt

SEQ ID NO: 154534 - DNA, 25 bp, Mus musculus
agagctgtgggctacttctgggttt

SEQ ID NO: 154535 - DNA, 25 bp, Mus musculus
agagctgtggtgctcattcttttct

SEQ ID NO: 154536 - DNA, 25 bp, Mus musculus
agagctgtggtggtcattcttttct

SEQ ID NO: 154537 - DNA, 25 bp, Mus musculus
agagctgtgtggctctcttccataa

SEQ ID NO: 154538 - DNA, 25 bp, Mus musculus
agagctgtgtgggtctcttccataa

SEQ ID NO: 154539 - DNA, 25 bp, Mus musculus
agagctgtgtgtccttgcaggactt

SEQ ID NO: 154540 - DNA, 25 bp, Mus musculus
agagctgtgtgtgcttgcaggactt

SEQ ID NO: 154541 - DNA, 25 bp, Mus musculus
agagctgttcaaacttgccaaggat

SEQ ID NO: 154542 - DNA, 25 bp, Mus musculus
agagctgttcaatcttgccaaggat

SEQ ID NO: 154543 - DNA, 25 bp, Mus musculus
agagctgttcccctgttgggtgaaa

SEQ ID NO: 154544 - DNA, 25 bp, Mus musculus
agagctgttcccgtgttgggtgaaa

SEQ ID NO: 154545 - DNA, 25 bp, Mus musculus
agagctgttcctctaactcctgagt

SEQ ID NO: 154546 - DNA, 25 bp, Mus musculus
agagctgttcctgtaactcctgagt

SEQ ID NO: 154547 - DNA, 25 bp, Mus musculus
agagctgttctcattcagaagcatt

SEQ ID NO: 154548 - DNA, 25 bp, Mus musculus
agagctgttctctttcagaagcatt

SEQ ID NO: 154549 - DNA, 25 bp, Mus musculus
agagctgttctgagctggccaagaa

SEQ ID NO: 154550 - DNA, 25 bp, Mus musculus
agagctgttctgtgctggccaagaa

SEQ ID NO: 154551 - DNA, 25 bp, Mus musculus
agagctgttcttagttactttgata

SEQ ID NO: 154552 - DNA, 25 bp, Mus musculus
agagctgttctttgttactttgata

SEQ ID NO: 154553 - DNA, 25 bp, Mus musculus
agagctgttggtactcattgctgac

SEQ ID NO: 154554 - DNA, 25 bp, Mus musculus
agagctgttggtcgaagccatcaca

SEQ ID NO: 154555 - DNA, 25 bp, Mus musculus
agagctgttggtggaagccatcaca

SEQ ID NO: 154556 - DNA, 25 bp, Mus musculus
agagctgttggttctcattgctgac

SEQ ID NO: 154557 - DNA, 25 bp, Mus musculus
agagctgttgtaactggcttccttt

SEQ ID NO: 154558 - DNA, 25 bp, Mus musculus
agagctgttgtatctggcttccttt

SEQ ID NO: 154559 - DNA, 25 bp, Mus musculus
agagctgtttaccaaccacaagcac

SEQ ID NO: 154560 - DNA, 25 bp, Mus musculus
agagctgtttacgaaccacaagcac

SEQ ID NO: 154561 - DNA, 25 bp, Mus musculus
agagctgtttctacttcttccagac

SEQ ID NO: 154562 - DNA, 25 bp, Mus musculus
agagctgtttctcccttaatgcaaa

SEQ ID NO: 154563 - DNA, 25 bp, Mus musculus
agagctgtttctgccttaatgcaaa

SEQ ID NO: 154564 - DNA, 25 bp, Mus musculus
agagctgtttcttcttcttccagac

SEQ ID NO: 154565 - DNA, 25 bp, Mus musculus
agagctgtttgcaacgaatgtgggc

SEQ ID NO: 154566 - DNA, 25 bp, Mus musculus
agagctgtttgctacgaatgtgggc

SEQ ID NO: 154567 - DNA, 25 bp, Mus musculus
agagcttaaacaacctgacggcctt

SEQ ID NO: 154568 - DNA, 25 bp, Mus musculus
agagcttaaacatcctgacggcctt

SEQ ID NO: 154569 - DNA, 25 bp, Mus musculus
agagcttaacaactattcttcccca

SEQ ID NO: 154570 - DNA, 25 bp, Mus musculus
agagcttaacaagtattcttcccca

SEQ ID NO: 154571 - DNA, 25 bp, Mus musculus
agagcttaacacatttcctgtataa

SEQ ID NO: 154572 - DNA, 25 bp, Mus musculus
agagcttaacacttttcctgtataa

SEQ ID NO: 154573 - DNA, 25 bp, Mus musculus
agagcttaacccatcctggactgct

SEQ ID NO: 154574 - DNA, 25 bp, Mus musculus
agagcttaacccttcctggactgct

SEQ ID NO: 154575 - DNA, 25 bp, Mus musculus
agagcttaatgcctagccgtgctga

SEQ ID NO: 154576 - DNA, 25 bp, Mus musculus
agagcttaatgcgtagccgtgctga

SEQ ID NO: 154577 - DNA, 25 bp, Mus musculus
agagcttacagcagagctgccgaca

SEQ ID NO: 154578 - DNA, 25 bp, Mus musculus
agagcttacagctgagctgccgaca

SEQ ID NO: 154579 - DNA, 25 bp, Mus musculus
agagcttactccagcatatttctaa

SEQ ID NO: 154580 - DNA, 25 bp, Mus musculus
agagcttactcctgcatatttctaa

SEQ ID NO: 154581 - DNA, 25 bp, Mus musculus
agagcttagcccactctacatggag

SEQ ID NO: 154582 - DNA, 25 bp, Mus musculus
agagcttagccctctctacatggag

SEQ ID NO: 154583 - DNA, 25 bp, Mus musculus
agagcttagtgcaccatacagggtt

SEQ ID NO: 154584 - DNA, 25 bp, Mus musculus
agagcttagtgctccatacagggtt

SEQ ID NO: 154585 - DNA, 25 bp, Mus musculus
agagcttattacatatttgtgcgaa

SEQ ID NO: 154586 - DNA, 25 bp, Mus musculus
agagcttattacttatttgtgcgaa

SEQ ID NO: 154587 - DNA, 25 bp, Mus musculus
agagcttattttactccacctcctg

SEQ ID NO: 154588 - DNA, 25 bp, Mus musculus
agagcttatttttctccacctcctg

SEQ ID NO: 154589 - DNA, 25 bp, Mus musculus
agagcttcaatgagctgcaactaca

SEQ ID NO: 154590 - DNA, 25 bp, Mus musculus
agagcttcaatgtgctgcaactaca

SEQ ID NO: 154591 - DNA, 25 bp, Mus musculus
agagcttcacacagcttctttaggc

SEQ ID NO: 154592 - DNA, 25 bp, Mus musculus
agagcttcacactgcttctttaggc

SEQ ID NO: 154593 - DNA, 25 bp, Mus musculus
agagcttcacccctgcatttgtgag

SEQ ID NO: 154594 - DNA, 25 bp, Mus musculus
agagcttcacccgtgcatttgtgag

SEQ ID NO: 154595 - DNA, 25 bp, Mus musculus
agagcttcacctatcagactcactt

SEQ ID NO: 154596 - DNA, 25 bp, Mus musculus
agagcttcacctttcagactcactt

SEQ ID NO: 154597 - DNA, 25 bp, Mus musculus
agagcttcacggcaaaatgcaagta

SEQ ID NO: 154598 - DNA, 25 bp, Mus musculus
agagcttcacgggaaaatgcaagta

SEQ ID NO: 154599 - DNA, 25 bp, Mus musculus
agagcttcacgtatgctacagtgtg

SEQ ID NO: 154600 - DNA, 25 bp, Mus musculus
agagcttcacgtttgctacagtgtg

SEQ ID NO: 154601 - DNA, 25 bp, Mus musculus
agagcttcagaaatagtgggagttt

SEQ ID NO: 154602 - DNA, 25 bp, Mus musculus
agagcttcagaattagtgggagttt

SEQ ID NO: 154603 - DNA, 25 bp, Mus musculus
agagcttcagatactttacagagga

SEQ ID NO: 154604 - DNA, 25 bp, Mus musculus
agagcttcagattctttacagagga

SEQ ID NO: 154605 - DNA, 25 bp, Mus musculus
agagcttccaccagctgcttaaaag

SEQ ID NO: 154606 - DNA, 25 bp, Mus musculus
agagcttccacctgctgcttaaaag

SEQ ID NO: 154607 - DNA, 25 bp, Mus musculus
agagcttcccacatcctagagagag

SEQ ID NO: 154608 - DNA, 25 bp, Mus musculus
agagcttcccacttcctagagagag

SEQ ID NO: 154609 - DNA, 25 bp, Mus musculus
agagcttcccctcaagtttatccag

SEQ ID NO: 154610 - DNA, 25 bp, Mus musculus
agagcttcccctgaagtttatccag

SEQ ID NO: 154611 - DNA, 25 bp, Mus musculus
agagcttccgacatgcagcttgaag

SEQ ID NO: 154612 - DNA, 25 bp, Mus musculus
agagcttccgacttgcagcttgaag

SEQ ID NO: 154613 - DNA, 25 bp, Mus musculus
agagcttccggaagcagaacaccct

SEQ ID NO: 154614 - DNA, 25 bp, Mus musculus
agagcttccggatgcagaacaccct

SEQ ID NO: 154615 - DNA, 25 bp, Mus musculus
agagcttcctaacagacttcccgag

SEQ ID NO: 154616 - DNA, 25 bp, Mus musculus
agagcttcctaagagacttcccgag

SEQ ID NO: 154617 - DNA, 25 bp, Mus musculus
agagcttcctggctgcccttgagag

SEQ ID NO: 154618 - DNA, 25 bp, Mus musculus
agagcttcctgggtgcccttgagag

SEQ ID NO: 154619 - DNA, 25 bp, Mus musculus
agagcttccttgcttccattgtgaa

SEQ ID NO: 154620 - DNA, 25 bp, Mus musculus
agagcttccttggttccattgtgaa

SEQ ID NO: 154621 - DNA, 25 bp, Mus musculus
agagcttcctttctaaccgtatctg

SEQ ID NO: 154622 - DNA, 25 bp, Mus musculus
agagcttcctttgtaaccgtatctg

SEQ ID NO: 154623 - DNA, 25 bp, Mus musculus
agagcttcggctactttatgagagt

SEQ ID NO: 154624 - DNA, 25 bp, Mus musculus
agagcttcggcttctttatgagagt

SEQ ID NO: 154625 - DNA, 25 bp, Mus musculus
agagcttcgtctaccaatctgaaac

SEQ ID NO: 154626 - DNA, 25 bp, Mus musculus
agagcttcgtctccgacccggatga

SEQ ID NO: 154627 - DNA, 25 bp, Mus musculus
agagcttcgtctgcgacccggatga

SEQ ID NO: 154628 - DNA, 25 bp, Mus musculus
agagcttcgtcttccaatctgaaac

SEQ ID NO: 154629 - DNA, 25 bp, Mus musculus
agagcttcgtttattgatcctgaca

SEQ ID NO: 154630 - DNA, 25 bp, Mus musculus
agagcttcgttttttgatcctgaca

SEQ ID NO: 154631 - DNA, 25 bp, Mus musculus
agagcttctaaaccaaagccctgcc

SEQ ID NO: 154632 - DNA, 25 bp, Mus musculus
agagcttctaaagcaaagccctgcc

SEQ ID NO: 154633 - DNA, 25 bp, Mus musculus
agagcttctcagacagggctgggct

SEQ ID NO: 154634 - DNA, 25 bp, Mus musculus
agagcttctcagatcggcagcagat

SEQ ID NO: 154635 - DNA, 25 bp, Mus musculus
agagcttctcagtcagggctgggct

SEQ ID NO: 154636 - DNA, 25 bp, Mus musculus
agagcttctcagttcggcagcagat

SEQ ID NO: 154637 - DNA, 25 bp, Mus musculus
agagcttctcatctgtggtctggga

SEQ ID NO: 154638 - DNA, 25 bp, Mus musculus
agagcttctcatcttcattgcactc

SEQ ID NO: 154639 - DNA, 25 bp, Mus musculus
agagcttctcatgtgtggtctggga

SEQ ID NO: 154640 - DNA, 25 bp, Mus musculus
agagcttctcatgttcattgcactc

SEQ ID NO: 154641 - DNA, 25 bp, Mus musculus
agagcttctcccatttctggatgct

SEQ ID NO: 154642 - DNA, 25 bp, Mus musculus
agagcttctcccttttctggatgct

SEQ ID NO: 154643 - DNA, 25 bp, Mus musculus
agagcttctccgattgttcaacttt

SEQ ID NO: 154644 - DNA, 25 bp, Mus musculus
agagcttctccgtttgttcaacttt

SEQ ID NO: 154645 - DNA, 25 bp, Mus musculus
agagcttctcctccccgagatgtgc

SEQ ID NO: 154646 - DNA, 25 bp, Mus musculus
agagcttctcctgcccgagatgtgc

SEQ ID NO: 154647 - DNA, 25 bp, Mus musculus
agagcttctctaaggctgcttggag

SEQ ID NO: 154648 - DNA, 25 bp, Mus musculus
agagcttctctatggctgcttggag

SEQ ID NO: 154649 - DNA, 25 bp, Mus musculus
agagcttctctcagcagcttttaga

SEQ ID NO: 154650 - DNA, 25 bp, Mus musculus
agagcttctctctgcagcttttaga

SEQ ID NO: 154651 - DNA, 25 bp, Mus musculus
agagcttctgaaagtgctttatgca

SEQ ID NO: 154652 - DNA, 25 bp, Mus musculus
agagcttctgaatgtgctttatgca

SEQ ID NO: 154653 - DNA, 25 bp, Mus musculus
agagcttctggcctgtgctctacag

SEQ ID NO: 154654 - DNA, 25 bp, Mus musculus
agagcttctggcgtgtgctctacag

SEQ ID NO: 154655 - DNA, 25 bp, Mus musculus
agagcttctgggattctggtactcc

SEQ ID NO: 154656 - DNA, 25 bp, Mus musculus
agagcttctgggtttctggtactcc

SEQ ID NO: 154657 - DNA, 25 bp, Mus musculus
agagcttctgttagctggtcattcc

SEQ ID NO: 154658 - DNA, 25 bp, Mus musculus
agagcttctgtttgctggtcattcc

SEQ ID NO: 154659 - DNA, 25 bp, Mus musculus
agagcttcttccaagcattcgcatt

SEQ ID NO: 154660 - DNA, 25 bp, Mus musculus
agagcttcttcctagcattcgcatt

SEQ ID NO: 154661 - DNA, 25 bp, Mus musculus
agagcttcttgcctagtggtttgat

SEQ ID NO: 154662 - DNA, 25 bp, Mus musculus
agagcttcttgcgtagtggtttgat

SEQ ID NO: 154663 - DNA, 25 bp, Mus musculus
agagcttcttgtaacatttctgcag

SEQ ID NO: 154664 - DNA, 25 bp, Mus musculus
agagcttcttgttacatttctgcag

SEQ ID NO: 154665 - DNA, 25 bp, Mus musculus
agagcttctttgcacggcctagaga

SEQ ID NO: 154666 - DNA, 25 bp, Mus musculus
agagcttctttggacggcctagaga

SEQ ID NO: 154667 - DNA, 25 bp, Mus musculus
agagcttgaactcagcgagtgcttc

SEQ ID NO: 154668 - DNA, 25 bp, Mus musculus
agagcttgaactgagcgagtgcttc

SEQ ID NO: 154669 - DNA, 25 bp, Mus musculus
agagcttgacccacggcaaaggaaa

SEQ ID NO: 154670 - DNA, 25 bp, Mus musculus
agagcttgaccctcggcaaaggaaa

SEQ ID NO: 154671 - DNA, 25 bp, Mus musculus
agagcttgagacctgggacatttaa

SEQ ID NO: 154672 - DNA, 25 bp, Mus musculus
agagcttgagacgtgggacatttaa

SEQ ID NO: 154673 - DNA, 25 bp, Mus musculus
agagcttgagttaaggagacacatc

SEQ ID NO: 154674 - DNA, 25 bp, Mus musculus
agagcttgagtttaggagacacatc

SEQ ID NO: 154675 - DNA, 25 bp, Mus musculus
agagcttgatttaacagggcttaac

SEQ ID NO: 154676 - DNA, 25 bp, Mus musculus
agagcttgattttacagggcttaac

SEQ ID NO: 154677 - DNA, 25 bp, Mus musculus
agagcttgcacaaccgccactgaat

SEQ ID NO: 154678 - DNA, 25 bp, Mus musculus
agagcttgcacatccgccactgaat

SEQ ID NO: 154679 - DNA, 25 bp, Mus musculus
agagcttgccagagacttgctgaat

SEQ ID NO: 154680 - DNA, 25 bp, Mus musculus
agagcttgccagtgacttgctgaat

SEQ ID NO: 154681 - DNA, 25 bp, Mus musculus
agagcttgctggattgtcatcactc

SEQ ID NO: 154682 - DNA, 25 bp, Mus musculus
agagcttgctggtttgtcatcactc

SEQ ID NO: 154683 - DNA, 25 bp, Mus musculus
agagcttgcttgcttgcagttccca

SEQ ID NO: 154684 - DNA, 25 bp, Mus musculus
agagcttgcttggttgcagttccca

SEQ ID NO: 154685 - DNA, 25 bp, Mus musculus
agagcttggatcagtcactgcagaa

SEQ ID NO: 154686 - DNA, 25 bp, Mus musculus
agagcttggatctgtcactgcagaa

SEQ ID NO: 154687 - DNA, 25 bp, Mus musculus
agagcttggcaacgtcaccgtagat

SEQ ID NO: 154688 - DNA, 25 bp, Mus musculus
agagcttggcaaggtcaccgtagat

SEQ ID NO: 154689 - DNA, 25 bp, Mus musculus
agagcttggcccacagtagcatcag

SEQ ID NO: 154690 - DNA, 25 bp, Mus musculus
agagcttggccctcagtagcatcag

SEQ ID NO: 154691 - DNA, 25 bp, Mus musculus
agagcttgggacatgtgactgaatc

SEQ ID NO: 154692 - DNA, 25 bp, Mus musculus
agagcttgggacttgtgactgaatc

SEQ ID NO: 154693 - DNA, 25 bp, Mus musculus
agagcttgggccaatccacttcatt

SEQ ID NO: 154694 - DNA, 25 bp, Mus musculus
agagcttgggcctatccacttcatt

SEQ ID NO: 154695 - DNA, 25 bp, Mus musculus
agagcttgtaatagagctgctggct

SEQ ID NO: 154696 - DNA, 25 bp, Mus musculus
agagcttgtaattgagctgctggct

SEQ ID NO: 154697 - DNA, 25 bp, Mus musculus
agagcttgtacacctggacgactct

SEQ ID NO: 154698 - DNA, 25 bp, Mus musculus
agagcttgtacagctggacgactct

SEQ ID NO: 154699 - DNA, 25 bp, Mus musculus
agagcttgtaccatgactcccaaac

SEQ ID NO: 154700 - DNA, 25 bp, Mus musculus
agagcttgtaccttgactcccaaac

SEQ ID NO: 154701 - DNA, 25 bp, Mus musculus
agagcttgtactatgtccattttat

SEQ ID NO: 154702 - DNA, 25 bp, Mus musculus
agagcttgtactttgtccattttat

SEQ ID NO: 154703 - DNA, 25 bp, Mus musculus
agagcttgtcatcagcttctttggt

SEQ ID NO: 154704 - DNA, 25 bp, Mus musculus
agagcttgtcatgagcttctttggt

SEQ ID NO: 154705 - DNA, 25 bp, Mus musculus
agagcttgtccccagagaacatggt

SEQ ID NO: 154706 - DNA, 25 bp, Mus musculus
agagcttgtcccgagagaacatggt

SEQ ID NO: 154707 - DNA, 25 bp, Mus musculus
agagcttgtctcaggtcccagatgt

SEQ ID NO: 154708 - DNA, 25 bp, Mus musculus
agagcttgtctctggtcccagatgt

SEQ ID NO: 154709 - DNA, 25 bp, Mus musculus
agagcttgtctgcatttcagccata

SEQ ID NO: 154710 - DNA, 25 bp, Mus musculus
agagcttgtctggatttcagccata

SEQ ID NO: 154711 - DNA, 25 bp, Mus musculus
agagcttgtggccagcctctgcagc

SEQ ID NO: 154712 - DNA, 25 bp, Mus musculus
agagcttgtggcgagcctctgcagc

SEQ ID NO: 154713 - DNA, 25 bp, Mus musculus
agagcttgtgtcacttccagatgac

SEQ ID NO: 154714 - DNA, 25 bp, Mus musculus
agagcttgtgtctcttccagatgac

SEQ ID NO: 154715 - DNA, 25 bp, Mus musculus
agagcttgttcccatggagtatgtc

SEQ ID NO: 154716 - DNA, 25 bp, Mus musculus
agagcttgttccgatggagtatgtc

SEQ ID NO: 154717 - DNA, 25 bp, Mus musculus
agagcttgttggctttgtcactggc

SEQ ID NO: 154718 - DNA, 25 bp, Mus musculus
agagcttgttgggtttgtcactggc

SEQ ID NO: 154719 - DNA, 25 bp, Mus musculus
agagcttgtttcactcagagttcca

SEQ ID NO: 154720 - DNA, 25 bp, Mus musculus
agagcttgtttctctcagagttcca

SEQ ID NO: 154721 - DNA, 25 bp, Mus musculus
agagcttgtttgacgtgttctacct

SEQ ID NO: 154722 - DNA, 25 bp, Mus musculus
agagcttgtttgtcgtgttctacct

SEQ ID NO: 154723 - DNA, 25 bp, Mus musculus
agagctttaacaatcctccagggct

SEQ ID NO: 154724 - DNA, 25 bp, Mus musculus
agagctttaacattcctccagggct

SEQ ID NO: 154725 - DNA, 25 bp, Mus musculus
agagctttaaggctgggttccagat

SEQ ID NO: 154726 - DNA, 25 bp, Mus musculus
agagctttaagggtgggttccagat

SEQ ID NO: 154727 - DNA, 25 bp, Mus musculus
agagctttacaaatcctctctctct

SEQ ID NO: 154728 - DNA, 25 bp, Mus musculus
agagctttacaattcctctctctct

SEQ ID NO: 154729 - DNA, 25 bp, Mus musculus
agagctttacagagccacgacatgg

SEQ ID NO: 154730 - DNA, 25 bp, Mus musculus
agagctttacagtgccacgacatgg

SEQ ID NO: 154731 - DNA, 25 bp, Mus musculus
agagctttaggcaggctgagacgcc

SEQ ID NO: 154732 - DNA, 25 bp, Mus musculus
agagctttaggctggctgagacgcc

SEQ ID NO: 154733 - DNA, 25 bp, Mus musculus
agagctttatcaactcgctgatttc

SEQ ID NO: 154734 - DNA, 25 bp, Mus musculus
agagctttatcatctcgctgatttc

SEQ ID NO: 154735 - DNA, 25 bp, Mus musculus
agagctttcagtcatgctgtgaata

SEQ ID NO: 154736 - DNA, 25 bp, Mus musculus
agagctttcagtgatgctgtgaata

SEQ ID NO: 154737 - DNA, 25 bp, Mus musculus
agagctttcatgagtcagaaggcag

SEQ ID NO: 154738 - DNA, 25 bp, Mus musculus
agagctttcatgtgtcagaaggcag

SEQ ID NO: 154739 - DNA, 25 bp, Mus musculus
agagctttcccaatacgccttgcta

SEQ ID NO: 154740 - DNA, 25 bp, Mus musculus
agagctttcccacagtgaggtcccc

SEQ ID NO: 154741 - DNA, 25 bp, Mus musculus
agagctttcccagagtgaggtcccc

SEQ ID NO: 154742 - DNA, 25 bp, Mus musculus
agagctttcccattacgccttgcta

SEQ ID NO: 154743 - DNA, 25 bp, Mus musculus
agagctttccctatttgatgtcatg

SEQ ID NO: 154744 - DNA, 25 bp, Mus musculus
agagctttccctttttgatgtcatg

SEQ ID NO: 154745 - DNA, 25 bp, Mus musculus
agagctttctagattaattcagaca

SEQ ID NO: 154746 - DNA, 25 bp, Mus musculus
agagctttctagtttaattcagaca

SEQ ID NO: 154747 - DNA, 25 bp, Mus musculus
agagctttctctctccatgtggttg

SEQ ID NO: 154748 - DNA, 25 bp, Mus musculus
agagctttctctgtccatgtggttg

SEQ ID NO: 154749 - DNA, 25 bp, Mus musculus
agagctttggtcagctggatcccaa

SEQ ID NO: 154750 - DNA, 25 bp, Mus musculus
agagctttggtctgctggatcccaa

SEQ ID NO: 154751 - DNA, 25 bp, Mus musculus
agagctttggttatgcatcagagta

SEQ ID NO: 154752 - DNA, 25 bp, Mus musculus
agagctttggttctgtactgatgaa

SEQ ID NO: 154753 - DNA, 25 bp, Mus musculus
agagctttggttgtgtactgatgaa

SEQ ID NO: 154754 - DNA, 25 bp, Mus musculus
agagctttggttttgcatcagagta

SEQ ID NO: 154755 - DNA, 25 bp, Mus musculus
agagctttgtagagtcgcttctctc

SEQ ID NO: 154756 - DNA, 25 bp, Mus musculus
agagctttgtagtgtcgcttctctc

SEQ ID NO: 154757 - DNA, 25 bp, Mus musculus
agagctttgtgcagaacctgggaaa

SEQ ID NO: 154758 - DNA, 25 bp, Mus musculus
agagctttgtgctgaacctgggaaa

SEQ ID NO: 154759 - DNA, 25 bp, Mus musculus
agagcttttatcctgacaggagaac

SEQ ID NO: 154760 - DNA, 25 bp, Mus musculus
agagcttttatcgtgacaggagaac

SEQ ID NO: 154761 - DNA, 25 bp, Mus musculus
agagcttttcagagttgtaatacct

SEQ ID NO: 154762 - DNA, 25 bp, Mus musculus
agagcttttcagtgttgtaatacct

SEQ ID NO: 154763 - DNA, 25 bp, Mus musculus
agagcttttccaaggttgtcttcat

SEQ ID NO: 154764 - DNA, 25 bp, Mus musculus
agagcttttccatggttgtcttcat

SEQ ID NO: 154765 - DNA, 25 bp, Mus musculus
agagcttttctcctttaagcagaaa

SEQ ID NO: 154766 - DNA, 25 bp, Mus musculus
agagcttttctcgtttaagcagaaa

SEQ ID NO: 154767 - DNA, 25 bp, Mus musculus
agagcttttgacacctttgaccaaa

SEQ ID NO: 154768 - DNA, 25 bp, Mus musculus
agagcttttgacctcagggctccac

SEQ ID NO: 154769 - DNA, 25 bp, Mus musculus
agagcttttgacgtcagggctccac

SEQ ID NO: 154770 - DNA, 25 bp, Mus musculus
agagcttttgactcctttgaccaaa

SEQ ID NO: 154771 - DNA, 25 bp, Mus musculus
agaggaaaacgaccctgctgtcatt

SEQ ID NO: 154772 - DNA, 25 bp, Mus musculus
agaggaaaacgagcctgctgtcatt

SEQ ID NO: 154773 - DNA, 25 bp, Mus musculus
agaggaaaactgctccccagagaca

SEQ ID NO: 154774 - DNA, 25 bp, Mus musculus
agaggaaaactggtccccagagaca

SEQ ID NO: 154775 - DNA, 25 bp, Mus musculus
agaggaaaatagctctaggtctgga

SEQ ID NO: 154776 - DNA, 25 bp, Mus musculus
agaggaaaataggtctaggtctgga

SEQ ID NO: 154777 - DNA, 25 bp, Mus musculus
agaggaaacttgagctggcgcgtct

SEQ ID NO: 154778 - DNA, 25 bp, Mus musculus
agaggaaacttgtgctggcgcgtct

SEQ ID NO: 154779 - DNA, 25 bp, Mus musculus
agaggaaagctgacttggcttgaat

SEQ ID NO: 154780 - DNA, 25 bp, Mus musculus
agaggaaagctgtcttggcttgaat

SEQ ID NO: 154781 - DNA, 25 bp, Mus musculus
agaggaaaggaacaccccgccacat

SEQ ID NO: 154782 - DNA, 25 bp, Mus musculus
agaggaaaggaagaccccgccacat

SEQ ID NO: 154783 - DNA, 25 bp, Mus musculus
agaggaaaggcaccctgcctcaaat

SEQ ID NO: 154784 - DNA, 25 bp, Mus musculus
agaggaaaggcagcctgcctcaaat

SEQ ID NO: 154785 - DNA, 25 bp, Mus musculus
agaggaaaggtgaccagcatcccta

SEQ ID NO: 154786 - DNA, 25 bp, Mus musculus
agaggaaaggtgtccagcatcccta

SEQ ID NO: 154787 - DNA, 25 bp, Mus musculus
agaggaaagtgcactctttgttata

SEQ ID NO: 154788 - DNA, 25 bp, Mus musculus
agaggaaagtgctctctttgttata

SEQ ID NO: 154789 - DNA, 25 bp, Mus musculus
agaggaaatcgcagctctgctctct

SEQ ID NO: 154790 - DNA, 25 bp, Mus musculus
agaggaaatcgctgctctgctctct

SEQ ID NO: 154791 - DNA, 25 bp, Mus musculus
agaggaaattctctcctgagcctac

SEQ ID NO: 154792 - DNA, 25 bp, Mus musculus
agaggaaattctgtcctgagcctac

SEQ ID NO: 154793 - DNA, 25 bp, Mus musculus
agaggaacacttcccaaaccctgag

SEQ ID NO: 154794 - DNA, 25 bp, Mus musculus
agaggaacacttgccaaaccctgag

SEQ ID NO: 154795 - DNA, 25 bp, Mus musculus
agaggaacagggagcaccaaggccc

SEQ ID NO: 154796 - DNA, 25 bp, Mus musculus
agaggaacagggtgcaccaaggccc

SEQ ID NO: 154797 - DNA, 25 bp, Mus musculus
agaggaacccaacctgctggcccag

SEQ ID NO: 154798 - DNA, 25 bp, Mus musculus
agaggaacccaagctgctggcccag

SEQ ID NO: 154799 - DNA, 25 bp, Mus musculus
agaggaacccatctactgccttaga

SEQ ID NO: 154800 - DNA, 25 bp, Mus musculus
agaggaacccatgtactgccttaga

SEQ ID NO: 154801 - DNA, 25 bp, Mus musculus
agaggaacccctacccaaatgcaga

SEQ ID NO: 154802 - DNA, 25 bp, Mus musculus
agaggaaccccttcccaaatgcaga

SEQ ID NO: 154803 - DNA, 25 bp, Mus musculus
agaggaaccctcactgactggtgca

SEQ ID NO: 154804 - DNA, 25 bp, Mus musculus
agaggaaccctctctgactggtgca

SEQ ID NO: 154805 - DNA, 25 bp, Mus musculus
agaggaaccgaacccaagtaccaca

SEQ ID NO: 154806 - DNA, 25 bp, Mus musculus
agaggaaccgaagccaagtaccaca

SEQ ID NO: 154807 - DNA, 25 bp, Mus musculus
agaggaacctggcagtttgactcca

SEQ ID NO: 154808 - DNA, 25 bp, Mus musculus
agaggaacctgggagtttgactcca

SEQ ID NO: 154809 - DNA, 25 bp, Mus musculus
agaggaacgtaacacagccagcctt

SEQ ID NO: 154810 - DNA, 25 bp, Mus musculus
agaggaacgtaagacagccagcctt

SEQ ID NO: 154811 - DNA, 25 bp, Mus musculus
agaggaactcaaaggccaggtccct

SEQ ID NO: 154812 - DNA, 25 bp, Mus musculus
agaggaactcaatggccaggtccct

SEQ ID NO: 154813 - DNA, 25 bp, Mus musculus
agaggaactgccacacttccaggaa

SEQ ID NO: 154814 - DNA, 25 bp, Mus musculus
agaggaactgcctcacttccaggaa

SEQ ID NO: 154815 - DNA, 25 bp, Mus musculus
agaggaactggtccaagccaggccc

SEQ ID NO: 154816 - DNA, 25 bp, Mus musculus
agaggaactggtgcaagccaggccc

SEQ ID NO: 154817 - DNA, 25 bp, Mus musculus
agaggaacttcaagacgccctgacc

SEQ ID NO: 154818 - DNA, 25 bp, Mus musculus
agaggaacttcatgacgccctgacc

SEQ ID NO: 154819 - DNA, 25 bp, Mus musculus
agaggaagaccaacaggccggctct

SEQ ID NO: 154820 - DNA, 25 bp, Mus musculus
agaggaagaccacccaatccagata

SEQ ID NO: 154821 - DNA, 25 bp, Mus musculus
agaggaagaccagccaatccagata

SEQ ID NO: 154822 - DNA, 25 bp, Mus musculus
agaggaagaccatcaggccggctct

SEQ ID NO: 154823 - DNA, 25 bp, Mus musculus
agaggaagaccgactcttcatcctc

SEQ ID NO: 154824 - DNA, 25 bp, Mus musculus
agaggaagaccgtctcttcatcctc

SEQ ID NO: 154825 - DNA, 25 bp, Mus musculus
agaggaagatgcagacccctgtgag

SEQ ID NO: 154826 - DNA, 25 bp, Mus musculus
agaggaagatgctgacccctgtgag

SEQ ID NO: 154827 - DNA, 25 bp, Mus musculus
agaggaagcagaatcagggcctgct

SEQ ID NO: 154828 - DNA, 25 bp, Mus musculus
agaggaagcagattcagggcctgct

SEQ ID NO: 154829 - DNA, 25 bp, Mus musculus
agaggaagcagtacctgcccatttc

SEQ ID NO: 154830 - DNA, 25 bp, Mus musculus
agaggaagcagttcctgcccatttc

SEQ ID NO: 154831 - DNA, 25 bp, Mus musculus
agaggaagcctccatttacagtcgc

SEQ ID NO: 154832 - DNA, 25 bp, Mus musculus
agaggaagcctcgatttacagtcgc

SEQ ID NO: 154833 - DNA, 25 bp, Mus musculus
agaggaagccttcctgcgatccagt

SEQ ID NO: 154834 - DNA, 25 bp, Mus musculus
agaggaagccttgctgcgatccagt

SEQ ID NO: 154835 - DNA, 25 bp, Mus musculus
agaggaagcgagagcgttcacccac

SEQ ID NO: 154836 - DNA, 25 bp, Mus musculus
agaggaagcgagtgcgttcacccac

SEQ ID NO: 154837 - DNA, 25 bp, Mus musculus
agaggaagctatacagccagggact

SEQ ID NO: 154838 - DNA, 25 bp, Mus musculus
agaggaagctattcagccagggact

SEQ ID NO: 154839 - DNA, 25 bp, Mus musculus
agaggaagctccagagcctgttcca

SEQ ID NO: 154840 - DNA, 25 bp, Mus musculus
agaggaagctcctgagcctgttcca

SEQ ID NO: 154841 - DNA, 25 bp, Mus musculus
agaggaagctctccgttgtctttca

SEQ ID NO: 154842 - DNA, 25 bp, Mus musculus
agaggaagctctcgccacattttct

SEQ ID NO: 154843 - DNA, 25 bp, Mus musculus
agaggaagctctgcgttgtctttca

SEQ ID NO: 154844 - DNA, 25 bp, Mus musculus
agaggaagctctggccacattttct

SEQ ID NO: 154845 - DNA, 25 bp, Mus musculus
agaggaaggaccagagggccgccat

SEQ ID NO: 154846 - DNA, 25 bp, Mus musculus
agaggaaggacctgagggccgccat

SEQ ID NO: 154847 - DNA, 25 bp, Mus musculus
agaggaaggtctcatgctacctcca

SEQ ID NO: 154848 - DNA, 25 bp, Mus musculus
agaggaaggtctgatgctacctcca

SEQ ID NO: 154849 - DNA, 25 bp, Mus musculus
agaggaagtaccagggcctgagccc

SEQ ID NO: 154850 - DNA, 25 bp, Mus musculus
agaggaagtacctgggcctgagccc

SEQ ID NO: 154851 - DNA, 25 bp, Mus musculus
agaggaagtcccactgtgtgcagaa

SEQ ID NO: 154852 - DNA, 25 bp, Mus musculus
agaggaagtccctctgtgtgcagaa

SEQ ID NO: 154853 - DNA, 25 bp, Mus musculus
agaggaagtcctaggtccttctgga

SEQ ID NO: 154854 - DNA, 25 bp, Mus musculus
agaggaagtccttggtccttctgga

SEQ ID NO: 154855 - DNA, 25 bp, Mus musculus
agaggaagtcgacttcttcccctga

SEQ ID NO: 154856 - DNA, 25 bp, Mus musculus
agaggaagtcgagttcttcccctga

SEQ ID NO: 154857 - DNA, 25 bp, Mus musculus
agaggaagtggtatgccagcaacat

SEQ ID NO: 154858 - DNA, 25 bp, Mus musculus
agaggaagtggtttgccagcaacat

SEQ ID NO: 154859 - DNA, 25 bp, Mus musculus
agaggaagtgttatcactgccccac

SEQ ID NO: 154860 - DNA, 25 bp, Mus musculus
agaggaagtgttttcactgccccac

SEQ ID NO: 154861 - DNA, 25 bp, Mus musculus
agaggaataggcatccccagctggc

SEQ ID NO: 154862 - DNA, 25 bp, Mus musculus
agaggaataggcttccccagctggc

SEQ ID NO: 154863 - DNA, 25 bp, Mus musculus
agaggaatcgcacaaccaagcgagc

SEQ ID NO: 154864 - DNA, 25 bp, Mus musculus
agaggaatcgcagaaccaagcgagc

SEQ ID NO: 154865 - DNA, 25 bp, Mus musculus
agaggaatcgttcagagtcttctcg

SEQ ID NO: 154866 - DNA, 25 bp, Mus musculus
agaggaatcgttgagagtcttctcg

SEQ ID NO: 154867 - DNA, 25 bp, Mus musculus
agaggaatctaacgtcccaattaag

SEQ ID NO: 154868 - DNA, 25 bp, Mus musculus
agaggaatctaaggtcccaattaag

SEQ ID NO: 154869 - DNA, 25 bp, Mus musculus
agaggaatctggatttgcctgcatg

SEQ ID NO: 154870 - DNA, 25 bp, Mus musculus
agaggaatctggcacccgctctgag

SEQ ID NO: 154871 - DNA, 25 bp, Mus musculus
agaggaatctgggacccgctctgag

SEQ ID NO: 154872 - DNA, 25 bp, Mus musculus
agaggaatctggttttgcctgcatg

SEQ ID NO: 154873 - DNA, 25 bp, Mus musculus
agaggaatgattctcccttacctgc

SEQ ID NO: 154874 - DNA, 25 bp, Mus musculus
agaggaatgattgtcccttacctgc

SEQ ID NO: 154875 - DNA, 25 bp, Mus musculus
agaggaatgcagcatgtgatgccca

SEQ ID NO: 154876 - DNA, 25 bp, Mus musculus
agaggaatgcaggatgtgatgccca

SEQ ID NO: 154877 - DNA, 25 bp, Mus musculus
agaggaattcccaccaattcagctt

SEQ ID NO: 154878 - DNA, 25 bp, Mus musculus
agaggaattccctccaattcagctt

SEQ ID NO: 154879 - DNA, 25 bp, Mus musculus
agaggaattctcatctcttgtccct

SEQ ID NO: 154880 - DNA, 25 bp, Mus musculus
agaggaattctcttctcttgtccct

SEQ ID NO: 154881 - DNA, 25 bp, Mus musculus
agaggaattgccattccttgcactt

SEQ ID NO: 154882 - DNA, 25 bp, Mus musculus
agaggaattgcctttccttgcactt

SEQ ID NO: 154883 - DNA, 25 bp, Mus musculus
agaggaatttctcttccgcacagct

SEQ ID NO: 154884 - DNA, 25 bp, Mus musculus
agaggaatttctgttccgcacagct

SEQ ID NO: 154885 - DNA, 25 bp, Mus musculus
agaggaatttgaagccccgagacca

SEQ ID NO: 154886 - DNA, 25 bp, Mus musculus
agaggaatttgatgccccgagacca

SEQ ID NO: 154887 - DNA, 25 bp, Mus musculus
agaggacaaaagaacctggcccaag

SEQ ID NO: 154888 - DNA, 25 bp, Mus musculus
agaggacaaaagtacctggcccaag

SEQ ID NO: 154889 - DNA, 25 bp, Mus musculus
agaggacaaagcaattcccgctcgg

SEQ ID NO: 154890 - DNA, 25 bp, Mus musculus
agaggacaaagctattcccgctcgg

SEQ ID NO: 154891 - DNA, 25 bp, Mus musculus
agaggacaaatcaactcaggtgaat

SEQ ID NO: 154892 - DNA, 25 bp, Mus musculus
agaggacaaatctactcaggtgaat

SEQ ID NO: 154893 - DNA, 25 bp, Mus musculus
agaggacaaccacgactgctgtgca

SEQ ID NO: 154894 - DNA, 25 bp, Mus musculus
agaggacaaccaggactgctgtgca

SEQ ID NO: 154895 - DNA, 25 bp, Mus musculus
agaggacaactcatgcttggctctc

SEQ ID NO: 154896 - DNA, 25 bp, Mus musculus
agaggacaactcttgcttggctctc

SEQ ID NO: 154897 - DNA, 25 bp, Mus musculus
agaggacaagatcaccatgagtact

SEQ ID NO: 154898 - DNA, 25 bp, Mus musculus
agaggacaagatgaccatgagtact

SEQ ID NO: 154899 - DNA, 25 bp, Mus musculus
agaggacaaggtcttctgccctgaa

SEQ ID NO: 154900 - DNA, 25 bp, Mus musculus
agaggacaaggtgttctgccctgaa

SEQ ID NO: 154901 - DNA, 25 bp, Mus musculus
agaggacaatgccaagccctccttg

SEQ ID NO: 154902 - DNA, 25 bp, Mus musculus
agaggacaatgcgaagccctccttg

SEQ ID NO: 154903 - DNA, 25 bp, Mus musculus
agaggacacaacaagtcttatgggt

SEQ ID NO: 154904 - DNA, 25 bp, Mus musculus
agaggacacaactagtcttatgggt

SEQ ID NO: 154905 - DNA, 25 bp, Mus musculus
agaggacacatgagcttctccgaaa

SEQ ID NO: 154906 - DNA, 25 bp, Mus musculus
agaggacacatgtgcttctccgaaa

SEQ ID NO: 154907 - DNA, 25 bp, Mus musculus
agaggacacctgaggccttgacacc

SEQ ID NO: 154908 - DNA, 25 bp, Mus musculus
agaggacacctgtggccttgacacc

SEQ ID NO: 154909 - DNA, 25 bp, Mus musculus
agaggacaccttacaaaaggcagaa

SEQ ID NO: 154910 - DNA, 25 bp, Mus musculus
agaggacacctttcaaaaggcagaa

SEQ ID NO: 154911 - DNA, 25 bp, Mus musculus
agaggacactcccaggcagcatgtg

SEQ ID NO: 154912 - DNA, 25 bp, Mus musculus
agaggacactccgaggcagcatgtg

SEQ ID NO: 154913 - DNA, 25 bp, Mus musculus
agaggacactgtcaggcaccaagtc

SEQ ID NO: 154914 - DNA, 25 bp, Mus musculus
agaggacactgtgaggcaccaagtc

SEQ ID NO: 154915 - DNA, 25 bp, Mus musculus
agaggacagacacgctggcatctcc

SEQ ID NO: 154916 - DNA, 25 bp, Mus musculus
agaggacagacaggctggcatctcc

SEQ ID NO: 154917 - DNA, 25 bp, Mus musculus
agaggacagatactccagggtaact

SEQ ID NO: 154918 - DNA, 25 bp, Mus musculus
agaggacagatagtccagggtaact

SEQ ID NO: 154919 - DNA, 25 bp, Mus musculus
agaggacagcaacaacagattaaga

SEQ ID NO: 154920 - DNA, 25 bp, Mus musculus
agaggacagcaagaacagattaaga

SEQ ID NO: 154921 - DNA, 25 bp, Mus musculus
agaggacagcacaaactcgctccat

SEQ ID NO: 154922 - DNA, 25 bp, Mus musculus
agaggacagcactaactcgctccat

SEQ ID NO: 154923 - DNA, 25 bp, Mus musculus
agaggacagcagaggcttccgcctg

SEQ ID NO: 154924 - DNA, 25 bp, Mus musculus
agaggacagcagtggcttccgcctg

SEQ ID NO: 154925 - DNA, 25 bp, Mus musculus
agaggacagcttccatgcggtaatt

SEQ ID NO: 154926 - DNA, 25 bp, Mus musculus
agaggacagcttgcatgcggtaatt

SEQ ID NO: 154927 - DNA, 25 bp, Mus musculus
agaggacaggaccaacttgaaacaa

SEQ ID NO: 154928 - DNA, 25 bp, Mus musculus
agaggacaggacgaacttgaaacaa

SEQ ID NO: 154929 - DNA, 25 bp, Mus musculus
agaggacagtctctgtttagaggaa

SEQ ID NO: 154930 - DNA, 25 bp, Mus musculus
agaggacagtctgtgtttagaggaa

SEQ ID NO: 154931 - DNA, 25 bp, Mus musculus
agaggacagttcaaggtccagctcc

SEQ ID NO: 154932 - DNA, 25 bp, Mus musculus
agaggacagttctaggtccagctcc

SEQ ID NO: 154933 - DNA, 25 bp, Mus musculus
agaggacatacgattgttttctggt

SEQ ID NO: 154934 - DNA, 25 bp, Mus musculus
agaggacatacgtttgttttctggt

SEQ ID NO: 154935 - DNA, 25 bp, Mus musculus
agaggacataggagccaaagtgcca

SEQ ID NO: 154936 - DNA, 25 bp, Mus musculus
agaggacataggtgccaaagtgcca

SEQ ID NO: 154937 - DNA, 25 bp, Mus musculus
agaggacatcaaccgcctgacctgt

SEQ ID NO: 154938 - DNA, 25 bp, Mus musculus
agaggacatcaagcgcctgacctgt

SEQ ID NO: 154939 - DNA, 25 bp, Mus musculus
agaggacatcgacaccaagccagtt

SEQ ID NO: 154940 - DNA, 25 bp, Mus musculus
agaggacatcgagaccaagccagtt

SEQ ID NO: 154941 - DNA, 25 bp, Mus musculus
agaggacattacaccagtcacctgc

SEQ ID NO: 154942 - DNA, 25 bp, Mus musculus
agaggacattactccagtcacctgc

SEQ ID NO: 154943 - DNA, 25 bp, Mus musculus
agaggacatttacatcaccacagaa

SEQ ID NO: 154944 - DNA, 25 bp, Mus musculus
agaggacatttagatcaccacagaa

SEQ ID NO: 154945 - DNA, 25 bp, Mus musculus
agaggacattttccactgtggagtc

SEQ ID NO: 154946 - DNA, 25 bp, Mus musculus
agaggacattttgcactgtggagtc

SEQ ID NO: 154947 - DNA, 25 bp, Mus musculus
agaggaccaagtatcctccctgttg

SEQ ID NO: 154948 - DNA, 25 bp, Mus musculus
agaggaccaagtttcctccctgttg

SEQ ID NO: 154949 - DNA, 25 bp, Mus musculus
agaggaccaataccagctgtgctac

SEQ ID NO: 154950 - DNA, 25 bp, Mus musculus
agaggaccaatagcagctgtgctac

SEQ ID NO: 154951 - DNA, 25 bp, Mus musculus
agaggaccagaacctactagtgaga

SEQ ID NO: 154952 - DNA, 25 bp, Mus musculus
agaggaccagaagctactagtgaga

SEQ ID NO: 154953 - DNA, 25 bp, Mus musculus
agaggaccagagaccaccctgtcag

SEQ ID NO: 154954 - DNA, 25 bp, Mus musculus
agaggaccagagatggcctgccatc

SEQ ID NO: 154955 - DNA, 25 bp, Mus musculus
agaggaccagagtccaccctgtcag

SEQ ID NO: 154956 - DNA, 25 bp, Mus musculus
agaggaccagagttggcctgccatc

SEQ ID NO: 154957 - DNA, 25 bp, Mus musculus
agaggaccagctcactcccaagaag

SEQ ID NO: 154958 - DNA, 25 bp, Mus musculus
agaggaccagctgactcccaagaag

SEQ ID NO: 154959 - DNA, 25 bp, Mus musculus
agaggaccatgaaaccaagctcaaa

SEQ ID NO: 154960 - DNA, 25 bp, Mus musculus
agaggaccatgataccaagctcaaa

SEQ ID NO: 154961 - DNA, 25 bp, Mus musculus
agaggacccatgatcaggccctaat

SEQ ID NO: 154962 - DNA, 25 bp, Mus musculus
agaggacccatgttcaggccctaat

SEQ ID NO: 154963 - DNA, 25 bp, Mus musculus
agaggacccgaaacagctgacctgt

SEQ ID NO: 154964 - DNA, 25 bp, Mus musculus
agaggacccgaatcagctgacctgt

SEQ ID NO: 154965 - DNA, 25 bp, Mus musculus
agaggacccggcactggacagtctg

SEQ ID NO: 154966 - DNA, 25 bp, Mus musculus
agaggacccggctctggacagtctg

SEQ ID NO: 154967 - DNA, 25 bp, Mus musculus
agaggaccctagaactgtctgcatc

SEQ ID NO: 154968 - DNA, 25 bp, Mus musculus
agaggaccctagtactgtctgcatc

SEQ ID NO: 154969 - DNA, 25 bp, Mus musculus
agaggaccctatccactcactgtag

SEQ ID NO: 154970 - DNA, 25 bp, Mus musculus
agaggaccctatgcactcactgtag

SEQ ID NO: 154971 - DNA, 25 bp, Mus musculus
agaggacccttcatgtaacctgtgt

SEQ ID NO: 154972 - DNA, 25 bp, Mus musculus
agaggacccttcttgtaacctgtgt

SEQ ID NO: 154973 - DNA, 25 bp, Mus musculus
agaggaccgagtctggaccccagct

SEQ ID NO: 154974 - DNA, 25 bp, Mus musculus
agaggaccgagtgtggaccccagct

SEQ ID NO: 154975 - DNA, 25 bp, Mus musculus
agaggaccgcaacccgcagctggca

SEQ ID NO: 154976 - DNA, 25 bp, Mus musculus
agaggaccgcaagccgcagctggca

SEQ ID NO: 154977 - DNA, 25 bp, Mus musculus
agaggaccggctcgttctctgagcc

SEQ ID NO: 154978 - DNA, 25 bp, Mus musculus
agaggaccggctggttctctgagcc

SEQ ID NO: 154979 - DNA, 25 bp, Mus musculus
agaggacctatgatcagttccaaca

SEQ ID NO: 154980 - DNA, 25 bp, Mus musculus
agaggacctatgttcagttccaaca

SEQ ID NO: 154981 - DNA, 25 bp, Mus musculus
agaggacctcgtacaaagtctgcct

SEQ ID NO: 154982 - DNA, 25 bp, Mus musculus
agaggacctcgttcaaagtctgcct

SEQ ID NO: 154983 - DNA, 25 bp, Mus musculus
agaggacctcttcccttctgaactg

SEQ ID NO: 154984 - DNA, 25 bp, Mus musculus
agaggacctcttgccttctgaactg

SEQ ID NO: 154985 - DNA, 25 bp, Mus musculus
agaggacctggcattagttccctgc

SEQ ID NO: 154986 - DNA, 25 bp, Mus musculus
agaggacctggctttagttccctgc

SEQ ID NO: 154987 - DNA, 25 bp, Mus musculus
agaggaccttcgacctggaggtgat

SEQ ID NO: 154988 - DNA, 25 bp, Mus musculus
agaggaccttcgtcctggaggtgat

SEQ ID NO: 154989 - DNA, 25 bp, Mus musculus
agaggacgcatcaactcgggtgaat

SEQ ID NO: 154990 - DNA, 25 bp, Mus musculus
agaggacgcatctactcgggtgaat

SEQ ID NO: 154991 - DNA, 25 bp, Mus musculus
agaggacgccccagtgtcttgagtg

SEQ ID NO: 154992 - DNA, 25 bp, Mus musculus
agaggacgcccctgtgtcttgagtg

SEQ ID NO: 154993 - DNA, 25 bp, Mus musculus
agaggacgctatcgttcccttgggt

SEQ ID NO: 154994 - DNA, 25 bp, Mus musculus
agaggacgctatggttcccttgggt

SEQ ID NO: 154995 - DNA, 25 bp, Mus musculus
agaggacggcagataccagcctcct

SEQ ID NO: 154996 - DNA, 25 bp, Mus musculus
agaggacggcagttaccagcctcct

SEQ ID NO: 154997 - DNA, 25 bp, Mus musculus
agaggacggtctactagccccaaga

SEQ ID NO: 154998 - DNA, 25 bp, Mus musculus
agaggacggtcttctagccccaaga

SEQ ID NO: 154999 - DNA, 25 bp, Mus musculus
agaggacgtcggcttcatgaagaac

SEQ ID NO: 155000 - DNA, 25 bp, Mus musculus
agaggacgtcgggttcatgaagaac

SEQ ID NO: 155001 - DNA, 25 bp, Mus musculus
agaggactaacaatattcctgtaat

SEQ ID NO: 155002 - DNA, 25 bp, Mus musculus
agaggactaacattattcctgtaat

SEQ ID NO: 155003 - DNA, 25 bp, Mus musculus
agaggactagagcagccctcgcctt

SEQ ID NO: 155004 - DNA, 25 bp, Mus musculus
agaggactagaggagccctcgcctt

SEQ ID NO: 155005 - DNA, 25 bp, Mus musculus
agaggactatccaacctcctaggaa

SEQ ID NO: 155006 - DNA, 25 bp, Mus musculus
agaggactatcctacctcctaggaa

SEQ ID NO: 155007 - DNA, 25 bp, Mus musculus
agaggactcaggacatgtgggctca

SEQ ID NO: 155008 - DNA, 25 bp, Mus musculus
agaggactcaggtcatgtgggctca

SEQ ID NO: 155009 - DNA, 25 bp, Mus musculus
agaggactcattacttaggctagta

SEQ ID NO: 155010 - DNA, 25 bp, Mus musculus
agaggactcatttcttaggctagta

SEQ ID NO: 155011 - DNA, 25 bp, Mus musculus
agaggactcctaccggaaacaggtg

SEQ ID NO: 155012 - DNA, 25 bp, Mus musculus
agaggactcctagcggaaacaggtg

SEQ ID NO: 155013 - DNA, 25 bp, Mus musculus
agaggactcgaaagcgcccctggga

SEQ ID NO: 155014 - DNA, 25 bp, Mus musculus
agaggactcgaatgcgcccctggga

SEQ ID NO: 155015 - DNA, 25 bp, Mus musculus
agaggactcggcagagggaccccaa

SEQ ID NO: 155016 - DNA, 25 bp, Mus musculus
agaggactcggctgagggaccccaa

SEQ ID NO: 155017 - DNA, 25 bp, Mus musculus
agaggactctaacggaagcctcctt

SEQ ID NO: 155018 - DNA, 25 bp, Mus musculus
agaggactctaagggaagcctcctt

SEQ ID NO: 155019 - DNA, 25 bp, Mus musculus
agaggactctccatgtcccaggatc

SEQ ID NO: 155020 - DNA, 25 bp, Mus musculus
agaggactctccttgtcccaggatc

SEQ ID NO: 155021 - DNA, 25 bp, Mus musculus
agaggactctctcagcattgcagct

SEQ ID NO: 155022 - DNA, 25 bp, Mus musculus
agaggactctctgagcattgcagct

SEQ ID NO: 155023 - DNA, 25 bp, Mus musculus
agaggactctgcctcgggatctgat

SEQ ID NO: 155024 - DNA, 25 bp, Mus musculus
agaggactctgcgtcgggatctgat

SEQ ID NO: 155025 - DNA, 25 bp, Mus musculus
agaggactgaacagttcctgacccc

SEQ ID NO: 155026 - DNA, 25 bp, Mus musculus
agaggactgaactgttcctgacccc

SEQ ID NO: 155027 - DNA, 25 bp, Mus musculus
agaggactgaatatctaggctgcaa

SEQ ID NO: 155028 - DNA, 25 bp, Mus musculus
agaggactgaatttctaggctgcaa

SEQ ID NO: 155029 - DNA, 25 bp, Mus musculus
agaggactgcaaccttgcctgcgga

SEQ ID NO: 155030 - DNA, 25 bp, Mus musculus
agaggactgcaagcttgcctgcgga

SEQ ID NO: 155031 - DNA, 25 bp, Mus musculus
agaggactggatcctccgggctttc

SEQ ID NO: 155032 - DNA, 25 bp, Mus musculus
agaggactggatgctccgggctttc

SEQ ID NO: 155033 - DNA, 25 bp, Mus musculus
agaggactgggaatcacggcaagaa

SEQ ID NO: 155034 - DNA, 25 bp, Mus musculus
agaggactgggattcacggcaagaa

SEQ ID NO: 155035 - DNA, 25 bp, Mus musculus
agaggactggtcacatggatcccct

SEQ ID NO: 155036 - DNA, 25 bp, Mus musculus
agaggactggtctcatggatcccct

SEQ ID NO: 155037 - DNA, 25 bp, Mus musculus
agaggactgtcacgactgagagctc

SEQ ID NO: 155038 - DNA, 25 bp, Mus musculus
agaggactgtcaggactgagagctc

SEQ ID NO: 155039 - DNA, 25 bp, Mus musculus
agaggactgtgccttcagtctcaca

SEQ ID NO: 155040 - DNA, 25 bp, Mus musculus
agaggactgtgcgttcagtctcaca

SEQ ID NO: 155041 - DNA, 25 bp, Mus musculus
agaggactgtgtactgggcttcttc

SEQ ID NO: 155042 - DNA, 25 bp, Mus musculus
agaggactgtgtagcttctgttgag

SEQ ID NO: 155043 - DNA, 25 bp, Mus musculus
agaggactgtgttctgggcttcttc

SEQ ID NO: 155044 - DNA, 25 bp, Mus musculus
agaggactgtgttgcttctgttgag

SEQ ID NO: 155045 - DNA, 25 bp, Mus musculus
agaggacttagcatgggctcccaca

SEQ ID NO: 155046 - DNA, 25 bp, Mus musculus
agaggacttagcttgggctcccaca

SEQ ID NO: 155047 - DNA, 25 bp, Mus musculus
agaggacttagtcccaccttcagtt

SEQ ID NO: 155048 - DNA, 25 bp, Mus musculus
agaggacttagtgccaccttcagtt

SEQ ID NO: 155049 - DNA, 25 bp, Mus musculus
agaggacttctgcagattctatgaa

SEQ ID NO: 155050 - DNA, 25 bp, Mus musculus
agaggacttctggagattctatgaa

SEQ ID NO: 155051 - DNA, 25 bp, Mus musculus
agaggacttgcgatccggaaacctg

SEQ ID NO: 155052 - DNA, 25 bp, Mus musculus
agaggacttgcgttccggaaacctg

SEQ ID NO: 155053 - DNA, 25 bp, Mus musculus
agaggacttggtctcttataaggga

SEQ ID NO: 155054 - DNA, 25 bp, Mus musculus
agaggacttggtgtcttataaggga

SEQ ID NO: 155055 - DNA, 25 bp, Mus musculus
agaggactttctacagggcccgttg

SEQ ID NO: 155056 - DNA, 25 bp, Mus musculus
agaggactttcttcagggcccgttg

SEQ ID NO: 155057 - DNA, 25 bp, Mus musculus
agaggagaaagtatttgtcccagca

SEQ ID NO: 155058 - DNA, 25 bp, Mus musculus
agaggagaaagtttttgtcccagca

SEQ ID NO: 155059 - DNA, 25 bp, Mus musculus
agaggagaaataccattaccacaga

SEQ ID NO: 155060 - DNA, 25 bp, Mus musculus
agaggagaaatagcattaccacaga

SEQ ID NO: 155061 - DNA, 25 bp, Mus musculus
agaggagaagcaacataggacccgc

SEQ ID NO: 155062 - DNA, 25 bp, Mus musculus
agaggagaagcatcataggacccgc

SEQ ID NO: 155063 - DNA, 25 bp, Mus musculus
agaggagaagctactgttgcctgcc

SEQ ID NO: 155064 - DNA, 25 bp, Mus musculus
agaggagaagctcggtccctacctt

SEQ ID NO: 155065 - DNA, 25 bp, Mus musculus
agaggagaagctgggtccctacctt

SEQ ID NO: 155066 - DNA, 25 bp, Mus musculus
agaggagaagcttctgttgcctgcc

SEQ ID NO: 155067 - DNA, 25 bp, Mus musculus
agaggagaatctctcatggctccct

SEQ ID NO: 155068 - DNA, 25 bp, Mus musculus
agaggagaatctgtcatggctccct

SEQ ID NO: 155069 - DNA, 25 bp, Mus musculus
agaggagacaatcaactgttgtaac

SEQ ID NO: 155070 - DNA, 25 bp, Mus musculus
agaggagacaatgaactgttgtaac

SEQ ID NO: 155071 - DNA, 25 bp, Mus musculus
agaggagacaccctcgatggtccaa

SEQ ID NO: 155072 - DNA, 25 bp, Mus musculus
agaggagacaccgtcgatggtccaa

SEQ ID NO: 155073 - DNA, 25 bp, Mus musculus
agaggagacctcatccaatctctac

SEQ ID NO: 155074 - DNA, 25 bp, Mus musculus
agaggagacctcttccaatctctac

SEQ ID NO: 155075 - DNA, 25 bp, Mus musculus
agaggagacggtcgttcccaccata

SEQ ID NO: 155076 - DNA, 25 bp, Mus musculus
agaggagacggtggttcccaccata

SEQ ID NO: 155077 - DNA, 25 bp, Mus musculus
agaggagactgcctcacacaggacc

SEQ ID NO: 155078 - DNA, 25 bp, Mus musculus
agaggagactgcgtcacacaggacc

SEQ ID NO: 155079 - DNA, 25 bp, Mus musculus
agaggagagcccactgaggatcaaa

SEQ ID NO: 155080 - DNA, 25 bp, Mus musculus
agaggagagccctctgaggatcaaa

SEQ ID NO: 155081 - DNA, 25 bp, Mus musculus
agaggagagctccagtgaacacctg

SEQ ID NO: 155082 - DNA, 25 bp, Mus musculus
agaggagagctcgagtgaacacctg

SEQ ID NO: 155083 - DNA, 25 bp, Mus musculus
agaggagaggcccacctttgagtac

SEQ ID NO: 155084 - DNA, 25 bp, Mus musculus
agaggagaggccgacctttgagtac

SEQ ID NO: 155085 - DNA, 25 bp, Mus musculus
agaggagagggcagtctagacaaca

SEQ ID NO: 155086 - DNA, 25 bp, Mus musculus
agaggagagggctgtctagacaaca

SEQ ID NO: 155087 - DNA, 25 bp, Mus musculus
agaggagagtaaccacatcactgca

SEQ ID NO: 155088 - DNA, 25 bp, Mus musculus
agaggagagtaagcacatcactgca

SEQ ID NO: 155089 - DNA, 25 bp, Mus musculus
agaggagagttcctcgtccgagcac

SEQ ID NO: 155090 - DNA, 25 bp, Mus musculus
agaggagagttcgtcgtccgagcac

SEQ ID NO: 155091 - DNA, 25 bp, Mus musculus
agaggagatcatacggagtgctaca

SEQ ID NO: 155092 - DNA, 25 bp, Mus musculus
agaggagatcattcggagtgctaca

SEQ ID NO: 155093 - DNA, 25 bp, Mus musculus
agaggagatgatagacaccacctcc

SEQ ID NO: 155094 - DNA, 25 bp, Mus musculus
agaggagatgatcccttcagagcaa

SEQ ID NO: 155095 - DNA, 25 bp, Mus musculus
agaggagatgatgccttcagagcaa

SEQ ID NO: 155096 - DNA, 25 bp, Mus musculus
agaggagatgattgacaccacctcc

SEQ ID NO: 155097 - DNA, 25 bp, Mus musculus
agaggagatgcaaccagtgatgtga

SEQ ID NO: 155098 - DNA, 25 bp, Mus musculus
agaggagatgcatccagtgatgtga

SEQ ID NO: 155099 - DNA, 25 bp, Mus musculus
agaggagatgcgatctgcatttcct

SEQ ID NO: 155100 - DNA, 25 bp, Mus musculus
agaggagatgcgttctgcatttcct

SEQ ID NO: 155101 - DNA, 25 bp, Mus musculus
agaggagcaactacgccagggacag

SEQ ID NO: 155102 - DNA, 25 bp, Mus musculus
agaggagcaacttcgccagggacag

SEQ ID NO: 155103 - DNA, 25 bp, Mus musculus
agaggagcacaaagttgggaagaca

SEQ ID NO: 155104 - DNA, 25 bp, Mus musculus
agaggagcacaatgttgggaagaca

SEQ ID NO: 155105 - DNA, 25 bp, Mus musculus
agaggagcaccaccggcaagtcgtc

SEQ ID NO: 155106 - DNA, 25 bp, Mus musculus
agaggagcaccagcggcaagtcgtc

SEQ ID NO: 155107 - DNA, 25 bp, Mus musculus
agaggagcagctactagcagtgcaa

SEQ ID NO: 155108 - DNA, 25 bp, Mus musculus
agaggagcagcttctagcagtgcaa

SEQ ID NO: 155109 - DNA, 25 bp, Mus musculus
agaggagcataacgcctgacctggc

SEQ ID NO: 155110 - DNA, 25 bp, Mus musculus
agaggagcataaggcctgacctggc

SEQ ID NO: 155111 - DNA, 25 bp, Mus musculus
agaggagcatcacagaagccctgga

SEQ ID NO: 155112 - DNA, 25 bp, Mus musculus
agaggagcatcagagaagccctgga

SEQ ID NO: 155113 - DNA, 25 bp, Mus musculus
agaggagcatctcggtcgctgtcct

SEQ ID NO: 155114 - DNA, 25 bp, Mus musculus
agaggagcatctgggtcgctgtcct

SEQ ID NO: 155115 - DNA, 25 bp, Mus musculus
agaggagcattcaccgtctactgtc

SEQ ID NO: 155116 - DNA, 25 bp, Mus musculus
agaggagcattctccgtctactgtc

SEQ ID NO: 155117 - DNA, 25 bp, Mus musculus
agaggagccagaccttctcttgcta

SEQ ID NO: 155118 - DNA, 25 bp, Mus musculus
agaggagccagagcttctcttgcta

SEQ ID NO: 155119 - DNA, 25 bp, Mus musculus
agaggagcccggcatgcggagtccc

SEQ ID NO: 155120 - DNA, 25 bp, Mus musculus
agaggagcccgggatgcggagtccc

SEQ ID NO: 155121 - DNA, 25 bp, Mus musculus
agaggagcccttaaattttcaaatg

SEQ ID NO: 155122 - DNA, 25 bp, Mus musculus
agaggagcccttcgaggtcactcag

SEQ ID NO: 155123 - DNA, 25 bp, Mus musculus
agaggagcccttggaggtcactcag

SEQ ID NO: 155124 - DNA, 25 bp, Mus musculus
agaggagccctttaattttcaaatg

SEQ ID NO: 155125 - DNA, 25 bp, Mus musculus
agaggagcctcaccagccatatttt

SEQ ID NO: 155126 - DNA, 25 bp, Mus musculus
agaggagcctcacccatgtgagcca

SEQ ID NO: 155127 - DNA, 25 bp, Mus musculus
agaggagcctcagcagccatatttt

SEQ ID NO: 155128 - DNA, 25 bp, Mus musculus
agaggagcctcagccatgtgagcca

SEQ ID NO: 155129 - DNA, 25 bp, Mus musculus
agaggagcctccatcctcagtatac

SEQ ID NO: 155130 - DNA, 25 bp, Mus musculus
agaggagcctccttcctcagtatac

SEQ ID NO: 155131 - DNA, 25 bp, Mus musculus
agaggagcctgtactgtaatcggtc

SEQ ID NO: 155132 - DNA, 25 bp, Mus musculus
agaggagcctgttctgtaatcggtc

SEQ ID NO: 155133 - DNA, 25 bp, Mus musculus
agaggagcgccaactctccaagatg

SEQ ID NO: 155134 - DNA, 25 bp, Mus musculus
agaggagcgccatctctccaagatg

SEQ ID NO: 155135 - DNA, 25 bp, Mus musculus
agaggagcgcggctcgcgcagctca

SEQ ID NO: 155136 - DNA, 25 bp, Mus musculus
agaggagcgcgggtcgcgcagctca

SEQ ID NO: 155137 - DNA, 25 bp, Mus musculus
agaggagcggctatattcacacttt

SEQ ID NO: 155138 - DNA, 25 bp, Mus musculus
agaggagcggctttattcacacttt

SEQ ID NO: 155139 - DNA, 25 bp, Mus musculus
agaggagcgtctcatcatggcctaa

SEQ ID NO: 155140 - DNA, 25 bp, Mus musculus
agaggagcgtctgatcatggcctaa

SEQ ID NO: 155141 - DNA, 25 bp, Mus musculus
agaggagcgtgccatgatctctttc

SEQ ID NO: 155142 - DNA, 25 bp, Mus musculus
agaggagcgtgcgatgatctctttc

SEQ ID NO: 155143 - DNA, 25 bp, Mus musculus
agaggagctccgctgaagccctgca

SEQ ID NO: 155144 - DNA, 25 bp, Mus musculus
agaggagctccggtgaagccctgca

SEQ ID NO: 155145 - DNA, 25 bp, Mus musculus
agaggagctcggatctacgcagaaa

SEQ ID NO: 155146 - DNA, 25 bp, Mus musculus
agaggagctcggttctacgcagaaa

SEQ ID NO: 155147 - DNA, 25 bp, Mus musculus
agaggagctctgaggccagacctac

SEQ ID NO: 155148 - DNA, 25 bp, Mus musculus
agaggagctctgtggccagacctac

SEQ ID NO: 155149 - DNA, 25 bp, Mus musculus
agaggagctgcgagccatattccag

SEQ ID NO: 155150 - DNA, 25 bp, Mus musculus
agaggagctgcgtgccatattccag

SEQ ID NO: 155151 - DNA, 25 bp, Mus musculus
agaggagctgctcccgactcagacc

SEQ ID NO: 155152 - DNA, 25 bp, Mus musculus
agaggagctgctgccgactcagacc

SEQ ID NO: 155153 - DNA, 25 bp, Mus musculus
agaggagctggcatcagccctaagc

SEQ ID NO: 155154 - DNA, 25 bp, Mus musculus
agaggagctggcttcagccctaagc

SEQ ID NO: 155155 - DNA, 25 bp, Mus musculus
agaggagcttcgacgagagctgcct

SEQ ID NO: 155156 - DNA, 25 bp, Mus musculus
agaggagcttcgtcgagagctgcct

SEQ ID NO: 155157 - DNA, 25 bp, Mus musculus
agaggagcttgtcccaatccaggag

SEQ ID NO: 155158 - DNA, 25 bp, Mus musculus
agaggagcttgtgccaatccaggag

SEQ ID NO: 155159 - DNA, 25 bp, Mus musculus
agaggaggaaataagatgcccacgt

SEQ ID NO: 155160 - DNA, 25 bp, Mus musculus
agaggaggaaattagatgcccacgt

SEQ ID NO: 155161 - DNA, 25 bp, Mus musculus
agaggaggaacacccgaccacgtct

SEQ ID NO: 155162 - DNA, 25 bp, Mus musculus
agaggaggaacagccgaccacgtct

SEQ ID NO: 155163 - DNA, 25 bp, Mus musculus
agaggaggaaccctctcgcactggg

SEQ ID NO: 155164 - DNA, 25 bp, Mus musculus
agaggaggaaccgtctcgcactggg

SEQ ID NO: 155165 - DNA, 25 bp, Mus musculus
agaggaggaagaatggagccaacca

SEQ ID NO: 155166 - DNA, 25 bp, Mus musculus
agaggaggaagattggagccaacca

SEQ ID NO: 155167 - DNA, 25 bp, Mus musculus
agaggaggacgcctgacctgtttct

SEQ ID NO: 155168 - DNA, 25 bp, Mus musculus
agaggaggacgcgtgacctgtttct

SEQ ID NO: 155169 - DNA, 25 bp, Mus musculus
agaggaggagacacgctctttgcct

SEQ ID NO: 155170 - DNA, 25 bp, Mus musculus
agaggaggagactcgctctttgcct

SEQ ID NO: 155171 - DNA, 25 bp, Mus musculus
agaggaggagcgaccttctcacacc

SEQ ID NO: 155172 - DNA, 25 bp, Mus musculus
agaggaggagcgtccttctcacacc

SEQ ID NO: 155173 - DNA, 25 bp, Mus musculus
agaggaggaggcacatccgctacgt

SEQ ID NO: 155174 - DNA, 25 bp, Mus musculus
agaggaggaggctcatccgctacgt

SEQ ID NO: 155175 - DNA, 25 bp, Mus musculus
agaggaggagttctcttccttgcca

SEQ ID NO: 155176 - DNA, 25 bp, Mus musculus
agaggaggagttgtcttccttgcca

SEQ ID NO: 155177 - DNA, 25 bp, Mus musculus
agaggaggcacccatgttctagaag

SEQ ID NO: 155178 - DNA, 25 bp, Mus musculus
agaggaggcaccgatgttctagaag

SEQ ID NO: 155179 - DNA, 25 bp, Mus musculus
agaggaggccaactttgcacaggtt

SEQ ID NO: 155180 - DNA, 25 bp, Mus musculus
agaggaggccaagtttgcacaggtt

SEQ ID NO: 155181 - DNA, 25 bp, Mus musculus
agaggaggccccacggcagagcatc

SEQ ID NO: 155182 - DNA, 25 bp, Mus musculus
agaggaggcccctcggcagagcatc

SEQ ID NO: 155183 - DNA, 25 bp, Mus musculus
agaggaggcctgactacccttgcct

SEQ ID NO: 155184 - DNA, 25 bp, Mus musculus
agaggaggcctgatgctctctttgc

SEQ ID NO: 155185 - DNA, 25 bp, Mus musculus
agaggaggcctgtctacccttgcct

SEQ ID NO: 155186 - DNA, 25 bp, Mus musculus
agaggaggcctgttgctctctttgc

SEQ ID NO: 155187 - DNA, 25 bp, Mus musculus
agaggaggctgcagtatcatcccta

SEQ ID NO: 155188 - DNA, 25 bp, Mus musculus
agaggaggctgctgtatcatcccta

SEQ ID NO: 155189 - DNA, 25 bp, Mus musculus
agaggagggcttacccttgcaaggc

SEQ ID NO: 155190 - DNA, 25 bp, Mus musculus
agaggagggctttcccttgcaaggc

SEQ ID NO: 155191 - DNA, 25 bp, Mus musculus
agaggagggtcacttctggctcatc

SEQ ID NO: 155192 - DNA, 25 bp, Mus musculus
agaggagggtcagttctggctcatc

SEQ ID NO: 155193 - DNA, 25 bp, Mus musculus
agaggagggtctctgttagccacca

SEQ ID NO: 155194 - DNA, 25 bp, Mus musculus
agaggagggtctgtgttagccacca

SEQ ID NO: 155195 - DNA, 25 bp, Mus musculus
agaggaggtactcaagtgccgatca

SEQ ID NO: 155196 - DNA, 25 bp, Mus musculus
agaggaggtactgaagtgccgatca

SEQ ID NO: 155197 - DNA, 25 bp, Mus musculus
agaggaggtggccttccatgcctca

SEQ ID NO: 155198 - DNA, 25 bp, Mus musculus
agaggaggtggcgttccatgcctca

SEQ ID NO: 155199 - DNA, 25 bp, Mus musculus
agaggaggtgtgacctttccaagct

SEQ ID NO: 155200 - DNA, 25 bp, Mus musculus
agaggaggtgtgtcctttccaagct

SEQ ID NO: 155201 - DNA, 25 bp, Mus musculus
agaggagtacgtcctgtccaaggct

SEQ ID NO: 155202 - DNA, 25 bp, Mus musculus
agaggagtacgtgctgtccaaggct

SEQ ID NO: 155203 - DNA, 25 bp, Mus musculus
agaggagtcactagtccgctgacag

SEQ ID NO: 155204 - DNA, 25 bp, Mus musculus
agaggagtcactccagactgtggca

SEQ ID NO: 155205 - DNA, 25 bp, Mus musculus
agaggagtcactgcagactgtggca

SEQ ID NO: 155206 - DNA, 25 bp, Mus musculus
agaggagtcacttgtccgctgacag

SEQ ID NO: 155207 - DNA, 25 bp, Mus musculus
agaggagtccaccactctcatgaat

SEQ ID NO: 155208 - DNA, 25 bp, Mus musculus
agaggagtccacgactctcatgaat

SEQ ID NO: 155209 - DNA, 25 bp, Mus musculus
agaggagtcctcagatcctgttttt

SEQ ID NO: 155210 - DNA, 25 bp, Mus musculus
agaggagtcctctgatcctgttttt

SEQ ID NO: 155211 - DNA, 25 bp, Mus musculus
agaggagtctccagccggcctgaaa

SEQ ID NO: 155212 - DNA, 25 bp, Mus musculus
agaggagtctccattgttggtggca

SEQ ID NO: 155213 - DNA, 25 bp, Mus musculus
agaggagtctcctgccggcctgaaa

SEQ ID NO: 155214 - DNA, 25 bp, Mus musculus
agaggagtctcctttgttggtggca

SEQ ID NO: 155215 - DNA, 25 bp, Mus musculus
agaggagtcttgacatctccatctc

SEQ ID NO: 155216 - DNA, 25 bp, Mus musculus
agaggagtcttgtcatctccatctc

SEQ ID NO: 155217 - DNA, 25 bp, Mus musculus
agaggagtgacaccacacttggtat

SEQ ID NO: 155218 - DNA, 25 bp, Mus musculus
agaggagtgacacccgaatgacagc

SEQ ID NO: 155219 - DNA, 25 bp, Mus musculus
agaggagtgacagcacacttggtat

SEQ ID NO: 155220 - DNA, 25 bp, Mus musculus
agaggagtgacagccgaatgacagc

SEQ ID NO: 155221 - DNA, 25 bp, Mus musculus
agaggagtgactccacacttgtatt

SEQ ID NO: 155222 - DNA, 25 bp, Mus musculus
agaggagtgactgcacacttgtatt

SEQ ID NO: 155223 - DNA, 25 bp, Mus musculus
agaggagtgcatctcccagcaccca

SEQ ID NO: 155224 - DNA, 25 bp, Mus musculus
agaggagtgcatgtcccagcaccca

SEQ ID NO: 155225 - DNA, 25 bp, Mus musculus
agaggagtggtcagccctgagtcca

SEQ ID NO: 155226 - DNA, 25 bp, Mus musculus
agaggagtggtctgccctgagtcca

SEQ ID NO: 155227 - DNA, 25 bp, Mus musculus
agaggagtgtcccaaaccacctagc

SEQ ID NO: 155228 - DNA, 25 bp, Mus musculus
agaggagtgtccgaaaccacctagc

SEQ ID NO: 155229 - DNA, 25 bp, Mus musculus
agaggagttctcagggcacctttgt

SEQ ID NO: 155230 - DNA, 25 bp, Mus musculus
agaggagttctctgggcacctttgt

SEQ ID NO: 155231 - DNA, 25 bp, Mus musculus
agaggagttgacatcttcaagcaga

SEQ ID NO: 155232 - DNA, 25 bp, Mus musculus
agaggagttgacttcttcaagcaga

SEQ ID NO: 155233 - DNA, 25 bp, Mus musculus
agaggagttttcagccacctgtaac

SEQ ID NO: 155234 - DNA, 25 bp, Mus musculus
agaggagttttctgccacctgtaac

SEQ ID NO: 155235 - DNA, 25 bp, Mus musculus
agaggataagcaccgcatcccctgg

SEQ ID NO: 155236 - DNA, 25 bp, Mus musculus
agaggataagcagcgcatcccctgg

SEQ ID NO: 155237 - DNA, 25 bp, Mus musculus
agaggataccctcacctatgctgac

SEQ ID NO: 155238 - DNA, 25 bp, Mus musculus
agaggataccctgacctatgctgac

SEQ ID NO: 155239 - DNA, 25 bp, Mus musculus
agaggatacctcactcggcctctta

SEQ ID NO: 155240 - DNA, 25 bp, Mus musculus
agaggatacctctctcggcctctta

SEQ ID NO: 155241 - DNA, 25 bp, Mus musculus
agaggataccttcgtcctaggcctg

SEQ ID NO: 155242 - DNA, 25 bp, Mus musculus
agaggataccttggtcctaggcctg

SEQ ID NO: 155243 - DNA, 25 bp, Mus musculus
agaggatactctcggactgccaatt

SEQ ID NO: 155244 - DNA, 25 bp, Mus musculus
agaggatactctcgtctgcatccaa

SEQ ID NO: 155245 - DNA, 25 bp, Mus musculus
agaggatactctgggactgccaatt

SEQ ID NO: 155246 - DNA, 25 bp, Mus musculus
agaggatactctggtctgcatccaa

SEQ ID NO: 155247 - DNA, 25 bp, Mus musculus
agaggatagcttcctgttggcatcc

SEQ ID NO: 155248 - DNA, 25 bp, Mus musculus
agaggatagcttgctgttggcatcc

SEQ ID NO: 155249 - DNA, 25 bp, Mus musculus
agaggatcaaccctgaactgaatca

SEQ ID NO: 155250 - DNA, 25 bp, Mus musculus
agaggatcaaccgtgaactgaatca

SEQ ID NO: 155251 - DNA, 25 bp, Mus musculus
agaggatcaagcctagccaggacct

SEQ ID NO: 155252 - DNA, 25 bp, Mus musculus
agaggatcaagcgtagccaggacct

SEQ ID NO: 155253 - DNA, 25 bp, Mus musculus
agaggatcacagacatgcttgcctt

SEQ ID NO: 155254 - DNA, 25 bp, Mus musculus
agaggatcacagtcatgcttgcctt

SEQ ID NO: 155255 - DNA, 25 bp, Mus musculus
agaggatcaccaatcctgtgcgaga

SEQ ID NO: 155256 - DNA, 25 bp, Mus musculus
agaggatcaccattcctgtgcgaga

SEQ ID NO: 155257 - DNA, 25 bp, Mus musculus
agaggatcaccccacatggtttgtg

SEQ ID NO: 155258 - DNA, 25 bp, Mus musculus
agaggatcacccgacatggtttgtg

SEQ ID NO: 155259 - DNA, 25 bp, Mus musculus
agaggatcacgcagctccgacaggt

SEQ ID NO: 155260 - DNA, 25 bp, Mus musculus
agaggatcacgctgctccgacaggt

SEQ ID NO: 155261 - DNA, 25 bp, Mus musculus
agaggatcatccctgagcacaagaa

SEQ ID NO: 155262 - DNA, 25 bp, Mus musculus
agaggatcatccgtgagcacaagaa

SEQ ID NO: 155263 - DNA, 25 bp, Mus musculus
agaggatcatggctctacgggcact

SEQ ID NO: 155264 - DNA, 25 bp, Mus musculus
agaggatcatgggtctacgggcact

SEQ ID NO: 155265 - DNA, 25 bp, Mus musculus
agaggatccaccaagtcactcagtg

SEQ ID NO: 155266 - DNA, 25 bp, Mus musculus
agaggatccacctagtcactcagtg

SEQ ID NO: 155267 - DNA, 25 bp, Mus musculus
agaggatccagacactcttctttgt

SEQ ID NO: 155268 - DNA, 25 bp, Mus musculus
agaggatccagacgccccagcaaga

SEQ ID NO: 155269 - DNA, 25 bp, Mus musculus
agaggatccagagactcttctttgt

SEQ ID NO: 155270 - DNA, 25 bp, Mus musculus
agaggatccagaggccccagcaaga

SEQ ID NO: 155271 - DNA, 25 bp, Mus musculus
agaggatccctgaggtcacttagcc

SEQ ID NO: 155272 - DNA, 25 bp, Mus musculus
agaggatccctgcttcacctaaaag

SEQ ID NO: 155273 - DNA, 25 bp, Mus musculus
agaggatccctggttcacctaaaag

SEQ ID NO: 155274 - DNA, 25 bp, Mus musculus
agaggatccctgtggtcacttagcc

SEQ ID NO: 155275 - DNA, 25 bp, Mus musculus
agaggatccggcaagcagactcctt

SEQ ID NO: 155276 - DNA, 25 bp, Mus musculus
agaggatccggctagcagactcctt

SEQ ID NO: 155277 - DNA, 25 bp, Mus musculus
agaggatccgttcctggctttgtat

SEQ ID NO: 155278 - DNA, 25 bp, Mus musculus
agaggatccgttgctggctttgtat

SEQ ID NO: 155279 - DNA, 25 bp, Mus musculus
agaggatcctacaggctgagctgtc

SEQ ID NO: 155280 - DNA, 25 bp, Mus musculus
agaggatcctactggctgagctgtc

SEQ ID NO: 155281 - DNA, 25 bp, Mus musculus
agaggatcgcttatcctgatgtttc

SEQ ID NO: 155282 - DNA, 25 bp, Mus musculus
agaggatcgcttttcctgatgtttc

SEQ ID NO: 155283 - DNA, 25 bp, Mus musculus
agaggatcgtgacttctagcccatc

SEQ ID NO: 155284 - DNA, 25 bp, Mus musculus
agaggatcgtgagttctagcccatc

SEQ ID NO: 155285 - DNA, 25 bp, Mus musculus
agaggatctaagaggtctgttgaga

SEQ ID NO: 155286 - DNA, 25 bp, Mus musculus
agaggatctaagtggtctgttgaga

SEQ ID NO: 155287 - DNA, 25 bp, Mus musculus
agaggatctagcacctttttctggc

SEQ ID NO: 155288 - DNA, 25 bp, Mus musculus
agaggatctagctcctttttctggc

SEQ ID NO: 155289 - DNA, 25 bp, Mus musculus
agaggatctagtaccctctgctggc

SEQ ID NO: 155290 - DNA, 25 bp, Mus musculus
agaggatctagttccctctgctggc

SEQ ID NO: 155291 - DNA, 25 bp, Mus musculus
agaggatctatgaaaccaccgtgga

SEQ ID NO: 155292 - DNA, 25 bp, Mus musculus
agaggatctatgtaaccaccgtgga

SEQ ID NO: 155293 - DNA, 25 bp, Mus musculus
agaggatctctcagcatggcggctc

SEQ ID NO: 155294 - DNA, 25 bp, Mus musculus
agaggatctctctgcatggcggctc

SEQ ID NO: 155295 - DNA, 25 bp, Mus musculus
agaggatctctgaaccatacgctgg

SEQ ID NO: 155296 - DNA, 25 bp, Mus musculus
agaggatctctgtaccatacgctgg

SEQ ID NO: 155297 - DNA, 25 bp, Mus musculus
agaggatctggcactcggagcccaa

SEQ ID NO: 155298 - DNA, 25 bp, Mus musculus
agaggatctggctctcggagcccaa

SEQ ID NO: 155299 - DNA, 25 bp, Mus musculus
agaggatcttcccactgctagggac

SEQ ID NO: 155300 - DNA, 25 bp, Mus musculus
agaggatcttccgactgctagggac

SEQ ID NO: 155301 - DNA, 25 bp, Mus musculus
agaggatcttggaccagagctgcca

SEQ ID NO: 155302 - DNA, 25 bp, Mus musculus
agaggatcttggtccagagctgcca

SEQ ID NO: 155303 - DNA, 25 bp, Mus musculus
agaggatctttaccggaccttcgat

SEQ ID NO: 155304 - DNA, 25 bp, Mus musculus
agaggatctttagcggaccttcgat

SEQ ID NO: 155305 - DNA, 25 bp, Mus musculus
agaggatgatccattccttctgtac

SEQ ID NO: 155306 - DNA, 25 bp, Mus musculus
agaggatgatcctttccttctgtac

SEQ ID NO: 155307 - DNA, 25 bp, Mus musculus
agaggatgcacacgaacggccatgt

SEQ ID NO: 155308 - DNA, 25 bp, Mus musculus
agaggatgcacaggaacggccatgt

SEQ ID NO: 155309 - DNA, 25 bp, Mus musculus
agaggatgccaaacaacccgaggcg

SEQ ID NO: 155310 - DNA, 25 bp, Mus musculus
agaggatgccaaagtcttcgcaagt

SEQ ID NO: 155311 - DNA, 25 bp, Mus musculus
agaggatgccaatcaacccgaggcg

SEQ ID NO: 155312 - DNA, 25 bp, Mus musculus
agaggatgccaatgtcttcgcaagt

SEQ ID NO: 155313 - DNA, 25 bp, Mus musculus
agaggatgctcaccgatgccggctt

SEQ ID NO: 155314 - DNA, 25 bp, Mus musculus
agaggatgctcagcgatgccggctt

SEQ ID NO: 155315 - DNA, 25 bp, Mus musculus
agaggatgctggcaactaccgctgt

SEQ ID NO: 155316 - DNA, 25 bp, Mus musculus
agaggatgctgggaactaccgctgt

SEQ ID NO: 155317 - DNA, 25 bp, Mus musculus
agaggatgctgtccgcctttgagac

SEQ ID NO: 155318 - DNA, 25 bp, Mus musculus
agaggatgctgtgcgcctttgagac

SEQ ID NO: 155319 - DNA, 25 bp, Mus musculus
agaggatgctttcccggtgcttagc

SEQ ID NO: 155320 - DNA, 25 bp, Mus musculus
agaggatgctttccctaagagccac

SEQ ID NO: 155321 - DNA, 25 bp, Mus musculus
agaggatgctttgccggtgcttagc

SEQ ID NO: 155322 - DNA, 25 bp, Mus musculus
agaggatgctttgcctaagagccac

SEQ ID NO: 155323 - DNA, 25 bp, Mus musculus
agaggatggaatcccctcctctggc

SEQ ID NO: 155324 - DNA, 25 bp, Mus musculus
agaggatggaatgccctcctctggc

SEQ ID NO: 155325 - DNA, 25 bp, Mus musculus
agaggatggctgaactaaacacact

SEQ ID NO: 155326 - DNA, 25 bp, Mus musculus
agaggatggctgtactaaacacact

SEQ ID NO: 155327 - DNA, 25 bp, Mus musculus
agaggatgggtgatccatgactcaa

SEQ ID NO: 155328 - DNA, 25 bp, Mus musculus
agaggatgggtgttccatgactcaa

SEQ ID NO: 155329 - DNA, 25 bp, Mus musculus
agaggatggtatccgaccacttcca

SEQ ID NO: 155330 - DNA, 25 bp, Mus musculus
agaggatggtatgcgaccacttcca

SEQ ID NO: 155331 - DNA, 25 bp, Mus musculus
agaggatggtcccactgtccagttc

SEQ ID NO: 155332 - DNA, 25 bp, Mus musculus
agaggatggtccgactgtccagttc

SEQ ID NO: 155333 - DNA, 25 bp, Mus musculus
agaggatgtatgacatctcactcac

SEQ ID NO: 155334 - DNA, 25 bp, Mus musculus
agaggatgtatgtcatctcactcac

SEQ ID NO: 155335 - DNA, 25 bp, Mus musculus
agaggatgtgtcaggtctcgtttcc

SEQ ID NO: 155336 - DNA, 25 bp, Mus musculus
agaggatgtgtctggtctcgtttcc

SEQ ID NO: 155337 - DNA, 25 bp, Mus musculus
agaggatgttgcattttgtgtgacc

SEQ ID NO: 155338 - DNA, 25 bp, Mus musculus
agaggatgttgctttttgtgtgacc

SEQ ID NO: 155339 - DNA, 25 bp, Mus musculus
agaggatgttgtctgctgtcactgc

SEQ ID NO: 155340 - DNA, 25 bp, Mus musculus
agaggatgttgtgtgctgtcactgc

SEQ ID NO: 155341 - DNA, 25 bp, Mus musculus
agaggattagacacctctcccagag

SEQ ID NO: 155342 - DNA, 25 bp, Mus musculus
agaggattagactcctctcccagag

SEQ ID NO: 155343 - DNA, 25 bp, Mus musculus
agaggattcactatggcgtcggagt

SEQ ID NO: 155344 - DNA, 25 bp, Mus musculus
agaggattcactttggcgtcggagt

SEQ ID NO: 155345 - DNA, 25 bp, Mus musculus
agaggattcagtattatgattcatt

SEQ ID NO: 155346 - DNA, 25 bp, Mus musculus
agaggattcagttttatgattcatt

SEQ ID NO: 155347 - DNA, 25 bp, Mus musculus
agaggattcataccctcgtcggcat

SEQ ID NO: 155348 - DNA, 25 bp, Mus musculus
agaggattcatagcctcgtcggcat

SEQ ID NO: 155349 - DNA, 25 bp, Mus musculus
agaggattctcgcttattctgctgc

SEQ ID NO: 155350 - DNA, 25 bp, Mus musculus
agaggattctcggttattctgctgc

SEQ ID NO: 155351 - DNA, 25 bp, Mus musculus
agaggattctgccttgagctttgcg

SEQ ID NO: 155352 - DNA, 25 bp, Mus musculus
agaggattctgcgttgagctttgcg

SEQ ID NO: 155353 - DNA, 25 bp, Mus musculus
agaggattctgtaagcaggctttgt

SEQ ID NO: 155354 - DNA, 25 bp, Mus musculus
agaggattctgttagcaggctttgt

SEQ ID NO: 155355 - DNA, 25 bp, Mus musculus
agaggattgactccgcaaggctagt

SEQ ID NO: 155356 - DNA, 25 bp, Mus musculus
agaggattgactgcgcaaggctagt

SEQ ID NO: 155357 - DNA, 25 bp, Mus musculus
agaggattgtgtccccaacagttgc

SEQ ID NO: 155358 - DNA, 25 bp, Mus musculus
agaggattgtgtgcccaacagttgc

SEQ ID NO: 155359 - DNA, 25 bp, Mus musculus
agaggatttagtagcaccggtccat

SEQ ID NO: 155360 - DNA, 25 bp, Mus musculus
agaggatttagttgcaccggtccat

SEQ ID NO: 155361 - DNA, 25 bp, Mus musculus
agaggatttccacagaattggagat

SEQ ID NO: 155362 - DNA, 25 bp, Mus musculus
agaggatttccagagaattggagat

SEQ ID NO: 155363 - DNA, 25 bp, Mus musculus
agaggatttcggctcagacccagac

SEQ ID NO: 155364 - DNA, 25 bp, Mus musculus
agaggatttcgggtcagacccagac

SEQ ID NO: 155365 - DNA, 25 bp, Mus musculus
agaggatttctgagttgccaaagct

SEQ ID NO: 155366 - DNA, 25 bp, Mus musculus
agaggatttctgtgttgccaaagct

SEQ ID NO: 155367 - DNA, 25 bp, Mus musculus
agaggatttgtgaccatcgtgcccc

SEQ ID NO: 155368 - DNA, 25 bp, Mus musculus
agaggatttgtgtccatcgtgcccc

SEQ ID NO: 155369 - DNA, 25 bp, Mus musculus
agaggcaaaagaatgactagtgaga

SEQ ID NO: 155370 - DNA, 25 bp, Mus musculus
agaggcaaaagattgactagtgaga

SEQ ID NO: 155371 - DNA, 25 bp, Mus musculus
agaggcaaagctatgattcattgac

SEQ ID NO: 155372 - DNA, 25 bp, Mus musculus
agaggcaaagctttgattcattgac

SEQ ID NO: 155373 - DNA, 25 bp, Mus musculus
agaggcaaatctcccgtgcttgctt

SEQ ID NO: 155374 - DNA, 25 bp, Mus musculus
agaggcaaatctgccgtgcttgctt

SEQ ID NO: 155375 - DNA, 25 bp, Mus musculus
agaggcaacatccaacgtgctaggg

SEQ ID NO: 155376 - DNA, 25 bp, Mus musculus
agaggcaacatcgaacgtgctaggg

SEQ ID NO: 155377 - DNA, 25 bp, Mus musculus
agaggcaacctgcacgatgccctga

SEQ ID NO: 155378 - DNA, 25 bp, Mus musculus
agaggcaacctggacgatgccctga

SEQ ID NO: 155379 - DNA, 25 bp, Mus musculus
agaggcaacgtcagcagccggagca

SEQ ID NO: 155380 - DNA, 25 bp, Mus musculus
agaggcaacgtctgcagccggagca

SEQ ID NO: 155381 - DNA, 25 bp, Mus musculus
agaggcaagatactcctacgtcttc

SEQ ID NO: 155382 - DNA, 25 bp, Mus musculus
agaggcaagatagtcctacgtcttc

SEQ ID NO: 155383 - DNA, 25 bp, Mus musculus
agaggcaagccactagtactcccca

SEQ ID NO: 155384 - DNA, 25 bp, Mus musculus
agaggcaagccagtagtactcccca

SEQ ID NO: 155385 - DNA, 25 bp, Mus musculus
agaggcaatgacctcctgctgaagc

SEQ ID NO: 155386 - DNA, 25 bp, Mus musculus
agaggcaatgacgtcctgctgaagc

SEQ ID NO: 155387 - DNA, 25 bp, Mus musculus
agaggcaatggtaccttatctcagc

SEQ ID NO: 155388 - DNA, 25 bp, Mus musculus
agaggcaatggttccttatctcagc

SEQ ID NO: 155389 - DNA, 25 bp, Mus musculus
agaggcaatgtaccagaattctgca

SEQ ID NO: 155390 - DNA, 25 bp, Mus musculus
agaggcaatgtagcagaattctgca

SEQ ID NO: 155391 - DNA, 25 bp, Mus musculus
agaggcacaaccctgcacacaggag

SEQ ID NO: 155392 - DNA, 25 bp, Mus musculus
agaggcacaaccgtgcacacaggag

SEQ ID NO: 155393 - DNA, 25 bp, Mus musculus
agaggcacaagccaggtcctgctgt

SEQ ID NO: 155394 - DNA, 25 bp, Mus musculus
agaggcacaagcgaggtcctgctgt

SEQ ID NO: 155395 - DNA, 25 bp, Mus musculus
agaggcacagcaacagagttcctga

SEQ ID NO: 155396 - DNA, 25 bp, Mus musculus
agaggcacagcatcagagttcctga

SEQ ID NO: 155397 - DNA, 25 bp, Mus musculus
agaggcaccagacagtaagaaagct

SEQ ID NO: 155398 - DNA, 25 bp, Mus musculus
agaggcaccagagagtaagaaagct

SEQ ID NO: 155399 - DNA, 25 bp, Mus musculus
agaggcaccatgattccaagagttc

SEQ ID NO: 155400 - DNA, 25 bp, Mus musculus
agaggcaccatgtttccaagagttc

SEQ ID NO: 155401 - DNA, 25 bp, Mus musculus
agaggcacctccatgagtggacggt

SEQ ID NO: 155402 - DNA, 25 bp, Mus musculus
agaggcacctccttgagtggacggt

SEQ ID NO: 155403 - DNA, 25 bp, Mus musculus
agaggcacgatcagaggcccggtct

SEQ ID NO: 155404 - DNA, 25 bp, Mus musculus
agaggcacgatctgaggcccggtct

SEQ ID NO: 155405 - DNA, 25 bp, Mus musculus
agaggcacgattacaggagcacatg

SEQ ID NO: 155406 - DNA, 25 bp, Mus musculus
agaggcacgatttcaggagcacatg

SEQ ID NO: 155407 - DNA, 25 bp, Mus musculus
agaggcacgcatctacgtggctaat

SEQ ID NO: 155408 - DNA, 25 bp, Mus musculus
agaggcacgcatgtacgtggctaat

SEQ ID NO: 155409 - DNA, 25 bp, Mus musculus
agaggcacgcgtctgtctatgtctg

SEQ ID NO: 155410 - DNA, 25 bp, Mus musculus
agaggcacgcgtgtgtctatgtctg

SEQ ID NO: 155411 - DNA, 25 bp, Mus musculus
agaggcacgtgactcaagttccctt

SEQ ID NO: 155412 - DNA, 25 bp, Mus musculus
agaggcacgtgagtcaagttccctt

SEQ ID NO: 155413 - DNA, 25 bp, Mus musculus
agaggcactcagaaactgcatgcag

SEQ ID NO: 155414 - DNA, 25 bp, Mus musculus
agaggcactcagtaactgcatgcag

SEQ ID NO: 155415 - DNA, 25 bp, Mus musculus
agaggcactcctagacttatgaata

SEQ ID NO: 155416 - DNA, 25 bp, Mus musculus
agaggcactccttgacttatgaata

SEQ ID NO: 155417 - DNA, 25 bp, Mus musculus
agaggcactgccaaagtgggagcat

SEQ ID NO: 155418 - DNA, 25 bp, Mus musculus
agaggcactgcctaagtgggagcat

SEQ ID NO: 155419 - DNA, 25 bp, Mus musculus
agaggcactggacgagacacgacta

SEQ ID NO: 155420 - DNA, 25 bp, Mus musculus
agaggcactggaggagacacgacta

SEQ ID NO: 155421 - DNA, 25 bp, Mus musculus
agaggcactggcatgtacgtcttca

SEQ ID NO: 155422 - DNA, 25 bp, Mus musculus
agaggcactggcattgtctctgctc

SEQ ID NO: 155423 - DNA, 25 bp, Mus musculus
agaggcactggcttgtacgtcttca

SEQ ID NO: 155424 - DNA, 25 bp, Mus musculus
agaggcactggctttgtctctgctc

SEQ ID NO: 155425 - DNA, 25 bp, Mus musculus
agaggcacttggcatgttgacgaac

SEQ ID NO: 155426 - DNA, 25 bp, Mus musculus
agaggcacttgggatgttgacgaac

SEQ ID NO: 155427 - DNA, 25 bp, Mus musculus
agaggcagaaatctcccgtatccgg

SEQ ID NO: 155428 - DNA, 25 bp, Mus musculus
agaggcagaaatgtcccgtatccgg

SEQ ID NO: 155429 - DNA, 25 bp, Mus musculus
agaggcagaactacgaggatcgcac

SEQ ID NO: 155430 - DNA, 25 bp, Mus musculus
agaggcagaacttcgaggatcgcac

SEQ ID NO: 155431 - DNA, 25 bp, Mus musculus
agaggcagacctcactgtttcttga

SEQ ID NO: 155432 - DNA, 25 bp, Mus musculus
agaggcagacctgactgtttcttga

SEQ ID NO: 155433 - DNA, 25 bp, Mus musculus
agaggcagacgccagaagctgctct

SEQ ID NO: 155434 - DNA, 25 bp, Mus musculus
agaggcagacgcgagaagctgctct

SEQ ID NO: 155435 - DNA, 25 bp, Mus musculus
agaggcagacggattgcttctctcc

SEQ ID NO: 155436 - DNA, 25 bp, Mus musculus
agaggcagacggtttgcttctctcc

SEQ ID NO: 155437 - DNA, 25 bp, Mus musculus
agaggcagactcacaggacacccga

SEQ ID NO: 155438 - DNA, 25 bp, Mus musculus
agaggcagactctcaggacacccga

SEQ ID NO: 155439 - DNA, 25 bp, Mus musculus
agaggcagagcaacgatgtagtgaa

SEQ ID NO: 155440 - DNA, 25 bp, Mus musculus
agaggcagagcaactcggtacagga

SEQ ID NO: 155441 - DNA, 25 bp, Mus musculus
agaggcagagcaagcagcccgctga

SEQ ID NO: 155442 - DNA, 25 bp, Mus musculus
agaggcagagcatcgatgtagtgaa

SEQ ID NO: 155443 - DNA, 25 bp, Mus musculus
agaggcagagcatctcggtacagga

SEQ ID NO: 155444 - DNA, 25 bp, Mus musculus
agaggcagagcatgcagcccgctga

SEQ ID NO: 155445 - DNA, 25 bp, Mus musculus
agaggcagatgaaatctggccacga

SEQ ID NO: 155446 - DNA, 25 bp, Mus musculus
agaggcagatgatatctggccacga

SEQ ID NO: 155447 - DNA, 25 bp, Mus musculus
agaggcagattgcaactctcccgct

SEQ ID NO: 155448 - DNA, 25 bp, Mus musculus
agaggcagattggaactctcccgct

SEQ ID NO: 155449 - DNA, 25 bp, Mus musculus
agaggcagcatcctgttcacgtgga

SEQ ID NO: 155450 - DNA, 25 bp, Mus musculus
agaggcagcatcgtgttcacgtgga

SEQ ID NO: 155451 - DNA, 25 bp, Mus musculus
agaggcagccaacctctgcagatga

SEQ ID NO: 155452 - DNA, 25 bp, Mus musculus
agaggcagccaagctctgcagatga

SEQ ID NO: 155453 - DNA, 25 bp, Mus musculus
agaggcagccatcgaccacagggat

SEQ ID NO: 155454 - DNA, 25 bp, Mus musculus
agaggcagccatggaccacagggat

SEQ ID NO: 155455 - DNA, 25 bp, Mus musculus
agaggcagcccgacttagaattgtt

SEQ ID NO: 155456 - DNA, 25 bp, Mus musculus
agaggcagcccgtcttagaattgtt

SEQ ID NO: 155457 - DNA, 25 bp, Mus musculus
agaggcagctcgagactcacttttg

SEQ ID NO: 155458 - DNA, 25 bp, Mus musculus
agaggcagctcgtgactcacttttg

SEQ ID NO: 155459 - DNA, 25 bp, Mus musculus
agaggcaggagaatccctgaactct

SEQ ID NO: 155460 - DNA, 25 bp, Mus musculus
agaggcaggagattccctgaactct

SEQ ID NO: 155461 - DNA, 25 bp, Mus musculus
agaggcaggcacatcggagtttaaa

SEQ ID NO: 155462 - DNA, 25 bp, Mus musculus
agaggcaggcacttcggagtttaaa

SEQ ID NO: 155463 - DNA, 25 bp, Mus musculus
agaggcaggcccatgctgggtccct

SEQ ID NO: 155464 - DNA, 25 bp, Mus musculus
agaggcaggcccttgctgggtccct

SEQ ID NO: 155465 - DNA, 25 bp, Mus musculus
agaggcaggctcactttccaacttg

SEQ ID NO: 155466 - DNA, 25 bp, Mus musculus
agaggcaggctctctttccaacttg

SEQ ID NO: 155467 - DNA, 25 bp, Mus musculus
agaggcagggatcactccatttcat

SEQ ID NO: 155468 - DNA, 25 bp, Mus musculus
agaggcagggatgactccatttcat

SEQ ID NO: 155469 - DNA, 25 bp, Mus musculus
agaggcagggccacaattccatgcc

SEQ ID NO: 155470 - DNA, 25 bp, Mus musculus
agaggcagggcctcaattccatgcc

SEQ ID NO: 155471 - DNA, 25 bp, Mus musculus
agaggcaggtcaacctgtgctgcac

SEQ ID NO: 155472 - DNA, 25 bp, Mus musculus
agaggcaggtcatcctgtgctgcac

SEQ ID NO: 155473 - DNA, 25 bp, Mus musculus
agaggcagtacacggcagagccaga

SEQ ID NO: 155474 - DNA, 25 bp, Mus musculus
agaggcagtacagggcagagccaga

SEQ ID NO: 155475 - DNA, 25 bp, Mus musculus
agaggcagtcaacacaggtcagaaa

SEQ ID NO: 155476 - DNA, 25 bp, Mus musculus
agaggcagtcaagacaggtcagaaa

SEQ ID NO: 155477 - DNA, 25 bp, Mus musculus
agaggcagtccaccacctagtggta

SEQ ID NO: 155478 - DNA, 25 bp, Mus musculus
agaggcagtccagcacctagtggta

SEQ ID NO: 155479 - DNA, 25 bp, Mus musculus
agaggcagtcctctgtgactacaca

SEQ ID NO: 155480 - DNA, 25 bp, Mus musculus
agaggcagtcctgtgtgactacaca

SEQ ID NO: 155481 - DNA, 25 bp, Mus musculus
agaggcagtcggatcagttctagga

SEQ ID NO: 155482 - DNA, 25 bp, Mus musculus
agaggcagtcggttcagttctagga

SEQ ID NO: 155483 - DNA, 25 bp, Mus musculus
agaggcagtgtcaggcatacaagca

SEQ ID NO: 155484 - DNA, 25 bp, Mus musculus
agaggcagtgtctggcatacaagca

SEQ ID NO: 155485 - DNA, 25 bp, Mus musculus
agaggcatccctctggtaagaggca

SEQ ID NO: 155486 - DNA, 25 bp, Mus musculus
agaggcatccctgtggtaagaggca

SEQ ID NO: 155487 - DNA, 25 bp, Mus musculus
agaggcatcctcaagctgcaaaggc

SEQ ID NO: 155488 - DNA, 25 bp, Mus musculus
agaggcatcctctagctgcaaaggc

SEQ ID NO: 155489 - DNA, 25 bp, Mus musculus
agaggcatcggcacggaacttggac

SEQ ID NO: 155490 - DNA, 25 bp, Mus musculus
agaggcatcggctcggaacttggac

SEQ ID NO: 155491 - DNA, 25 bp, Mus musculus
agaggcatctttaccatctgttaac

SEQ ID NO: 155492 - DNA, 25 bp, Mus musculus
agaggcatcttttccatctgttaac

SEQ ID NO: 155493 - DNA, 25 bp, Mus musculus
agaggcatgaggcaccatactacct

SEQ ID NO: 155494 - DNA, 25 bp, Mus musculus
agaggcatgagggaccatactacct

SEQ ID NO: 155495 - DNA, 25 bp, Mus musculus
agaggcatgctcagtcttccagttc

SEQ ID NO: 155496 - DNA, 25 bp, Mus musculus
agaggcatgctctgtcttccagttc

SEQ ID NO: 155497 - DNA, 25 bp, Mus musculus
agaggcattaacaggtccccagact

SEQ ID NO: 155498 - DNA, 25 bp, Mus musculus
agaggcattaactggtccccagact

SEQ ID NO: 155499 - DNA, 25 bp, Mus musculus
agaggcattgaaatccttagagcaa

SEQ ID NO: 155500 - DNA, 25 bp, Mus musculus
agaggcattgaattccttagagcaa

SEQ ID NO: 155501 - DNA, 25 bp, Mus musculus
agaggcattgctcctgagcccgcac

SEQ ID NO: 155502 - DNA, 25 bp, Mus musculus
agaggcattgctgctgagcccgcac

SEQ ID NO: 155503 - DNA, 25 bp, Mus musculus
agaggcattggaaagtgaggaacac

SEQ ID NO: 155504 - DNA, 25 bp, Mus musculus
agaggcattggatagtgaggaacac

SEQ ID NO: 155505 - DNA, 25 bp, Mus musculus
agaggccaaactaccacctgtggat

SEQ ID NO: 155506 - DNA, 25 bp, Mus musculus
agaggccaaacttccacctgtggat

SEQ ID NO: 155507 - DNA, 25 bp, Mus musculus
agaggccaaagtacctgcgactatc

SEQ ID NO: 155508 - DNA, 25 bp, Mus musculus
agaggccaaagttcctgcgactatc

SEQ ID NO: 155509 - DNA, 25 bp, Mus musculus
agaggccaagcaaggtctccagcct

SEQ ID NO: 155510 - DNA, 25 bp, Mus musculus
agaggccaagcatggtctccagcct

SEQ ID NO: 155511 - DNA, 25 bp, Mus musculus
agaggccaagggaggaggcttgctc

SEQ ID NO: 155512 - DNA, 25 bp, Mus musculus
agaggccaagggtggaggcttgctc

SEQ ID NO: 155513 - DNA, 25 bp, Mus musculus
agaggccaagttagtagtcttacag

SEQ ID NO: 155514 - DNA, 25 bp, Mus musculus
agaggccaagtttgtagtcttacag

SEQ ID NO: 155515 - DNA, 25 bp, Mus musculus
agaggccacaacagaactctaccag

SEQ ID NO: 155516 - DNA, 25 bp, Mus musculus
agaggccacaactgaactctaccag

SEQ ID NO: 155517 - DNA, 25 bp, Mus musculus
agaggccacacaaggtccagacact

SEQ ID NO: 155518 - DNA, 25 bp, Mus musculus
agaggccacacatggtccagacact

SEQ ID NO: 155519 - DNA, 25 bp, Mus musculus
agaggccacactccttactgaccta

SEQ ID NO: 155520 - DNA, 25 bp, Mus musculus
agaggccacactgcttactgaccta

SEQ ID NO: 155521 - DNA, 25 bp, Mus musculus
agaggccacagaaggtcggctgatt

SEQ ID NO: 155522 - DNA, 25 bp, Mus musculus
agaggccacagaccattgggtgccc

SEQ ID NO: 155523 - DNA, 25 bp, Mus musculus
agaggccacagagcattgggtgccc

SEQ ID NO: 155524 - DNA, 25 bp, Mus musculus
agaggccacagatggtcggctgatt

SEQ ID NO: 155525 - DNA, 25 bp, Mus musculus
agaggccacagtatttccattgttt

SEQ ID NO: 155526 - DNA, 25 bp, Mus musculus
agaggccacagtttttccattgttt

SEQ ID NO: 155527 - DNA, 25 bp, Mus musculus
agaggccaccagagaaacaagatat

SEQ ID NO: 155528 - DNA, 25 bp, Mus musculus
agaggccaccagctagccactgtct

SEQ ID NO: 155529 - DNA, 25 bp, Mus musculus
agaggccaccaggtagccactgtct

SEQ ID NO: 155530 - DNA, 25 bp, Mus musculus
agaggccaccagtgaaacaagatat

SEQ ID NO: 155531 - DNA, 25 bp, Mus musculus
agaggccaccctatgtggaccatct

SEQ ID NO: 155532 - DNA, 25 bp, Mus musculus
agaggccaccctttgtggaccatct

SEQ ID NO: 155533 - DNA, 25 bp, Mus musculus
agaggccacgatccatcgggctgtt

SEQ ID NO: 155534 - DNA, 25 bp, Mus musculus
agaggccacgatgcatcgggctgtt

SEQ ID NO: 155535 - DNA, 25 bp, Mus musculus
agaggccactctcccagtgagcatt

SEQ ID NO: 155536 - DNA, 25 bp, Mus musculus
agaggccactctctccggccagtgt

SEQ ID NO: 155537 - DNA, 25 bp, Mus musculus
agaggccactctgccagtgagcatt

SEQ ID NO: 155538 - DNA, 25 bp, Mus musculus
agaggccactctgtccggccagtgt

SEQ ID NO: 155539 - DNA, 25 bp, Mus musculus
agaggccacttcacttagtagagaa

SEQ ID NO: 155540 - DNA, 25 bp, Mus musculus
agaggccacttctcttagtagagaa

SEQ ID NO: 155541 - DNA, 25 bp, Mus musculus
agaggccagatactaaggtcaggat

SEQ ID NO: 155542 - DNA, 25 bp, Mus musculus
agaggccagatagtaaggtcaggat

SEQ ID NO: 155543 - DNA, 25 bp, Mus musculus
agaggccagatccacgttgtcacag

SEQ ID NO: 155544 - DNA, 25 bp, Mus musculus
agaggccagatcgacgttgtcacag

SEQ ID NO: 155545 - DNA, 25 bp, Mus musculus
agaggccagattagacttccgacat

SEQ ID NO: 155546 - DNA, 25 bp, Mus musculus
agaggccagatttgacttccgacat

SEQ ID NO: 155547 - DNA, 25 bp, Mus musculus
agaggccagcctagcttgcatctca

SEQ ID NO: 155548 - DNA, 25 bp, Mus musculus
agaggccagccttgcttgcatctca

SEQ ID NO: 155549 - DNA, 25 bp, Mus musculus
agaggccagctgactgcctgacttt

SEQ ID NO: 155550 - DNA, 25 bp, Mus musculus
agaggccagctgtctgcctgacttt

SEQ ID NO: 155551 - DNA, 25 bp, Mus musculus
agaggccaggctcctgtttctcagg

SEQ ID NO: 155552 - DNA, 25 bp, Mus musculus
agaggccaggctgctgtttctcagg

SEQ ID NO: 155553 - DNA, 25 bp, Mus musculus
agaggccagggcacaaggccttctt

SEQ ID NO: 155554 - DNA, 25 bp, Mus musculus
agaggccagggctcaaggccttctt

SEQ ID NO: 155555 - DNA, 25 bp, Mus musculus
agaggccaggtgactccagagccag

SEQ ID NO: 155556 - DNA, 25 bp, Mus musculus
agaggccaggtgtctccagagccag

SEQ ID NO: 155557 - DNA, 25 bp, Mus musculus
agaggccatctgacctagaattgca

SEQ ID NO: 155558 - DNA, 25 bp, Mus musculus
agaggccatctgtcctagaattgca

SEQ ID NO: 155559 - DNA, 25 bp, Mus musculus
agaggccatgctcacagtgtgtccc

SEQ ID NO: 155560 - DNA, 25 bp, Mus musculus
agaggccatgctgacagtgtgtccc

SEQ ID NO: 155561 - DNA, 25 bp, Mus musculus
agaggccatggcaccacaatgcctg

SEQ ID NO: 155562 - DNA, 25 bp, Mus musculus
agaggccatggctccacaatgcctg

SEQ ID NO: 155563 - DNA, 25 bp, Mus musculus
agaggccattgtattttctgggact

SEQ ID NO: 155564 - DNA, 25 bp, Mus musculus
agaggccattgttttttctgggact

SEQ ID NO: 155565 - DNA, 25 bp, Mus musculus
agaggcccaaacagggctctggtgt

SEQ ID NO: 155566 - DNA, 25 bp, Mus musculus
agaggcccaaactgggctctggtgt

SEQ ID NO: 155567 - DNA, 25 bp, Mus musculus
agaggcccaccactggacttggctg

SEQ ID NO: 155568 - DNA, 25 bp, Mus musculus
agaggcccaccagtggacttggctg

SEQ ID NO: 155569 - DNA, 25 bp, Mus musculus
agaggcccacctcacagagttgctt

SEQ ID NO: 155570 - DNA, 25 bp, Mus musculus
agaggcccacctgacagagttgctt

SEQ ID NO: 155571 - DNA, 25 bp, Mus musculus
agaggcccacgtcgaccacagcgga

SEQ ID NO: 155572 - DNA, 25 bp, Mus musculus
agaggcccacgtggaccacagcgga

SEQ ID NO: 155573 - DNA, 25 bp, Mus musculus
agaggcccagataaagaggagaaat

SEQ ID NO: 155574 - DNA, 25 bp, Mus musculus
agaggcccagattaagaggagaaat

SEQ ID NO: 155575 - DNA, 25 bp, Mus musculus
agaggcccaggcctgcaacagttac

SEQ ID NO: 155576 - DNA, 25 bp, Mus musculus
agaggcccaggcgtgcaacagttac

SEQ ID NO: 155577 - DNA, 25 bp, Mus musculus
agaggcccatgcaggtaggcagctt

SEQ ID NO: 155578 - DNA, 25 bp, Mus musculus
agaggcccatgctggtaggcagctt

SEQ ID NO: 155579 - DNA, 25 bp, Mus musculus
agaggccccacgacgtcctgagaat

SEQ ID NO: 155580 - DNA, 25 bp, Mus musculus
agaggccccacgtcgtcctgagaat

SEQ ID NO: 155581 - DNA, 25 bp, Mus musculus
agaggcccctggacctggctacatg

SEQ ID NO: 155582 - DNA, 25 bp, Mus musculus
agaggcccctggtcctggctacatg

SEQ ID NO: 155583 - DNA, 25 bp, Mus musculus
agaggccccttactctgtgagtaat

SEQ ID NO: 155584 - DNA, 25 bp, Mus musculus
agaggccccttagtctgtgagtaat

SEQ ID NO: 155585 - DNA, 25 bp, Mus musculus
agaggccccttcaggttcctgggtg

SEQ ID NO: 155586 - DNA, 25 bp, Mus musculus
agaggccccttctggttcctgggtg

SEQ ID NO: 155587 - DNA, 25 bp, Mus musculus
agaggcccgagaagctctcagatta

SEQ ID NO: 155588 - DNA, 25 bp, Mus musculus
agaggcccgagatgctctcagatta

SEQ ID NO: 155589 - DNA, 25 bp, Mus musculus
agaggcccgagcatcttggccttga

SEQ ID NO: 155590 - DNA, 25 bp, Mus musculus
agaggcccgagcttcttggccttga

SEQ ID NO: 155591 - DNA, 25 bp, Mus musculus
agaggccctacaacagcagtgctag

SEQ ID NO: 155592 - DNA, 25 bp, Mus musculus
agaggccctacatcagcagtgctag

SEQ ID NO: 155593 - DNA, 25 bp, Mus musculus
agaggccctacgcaacaggctggca

SEQ ID NO: 155594 - DNA, 25 bp, Mus musculus
agaggccctacggaacaggctggca

SEQ ID NO: 155595 - DNA, 25 bp, Mus musculus
agaggccctagaagacatgatccta

SEQ ID NO: 155596 - DNA, 25 bp, Mus musculus
agaggccctagatgacatgatccta

SEQ ID NO: 155597 - DNA, 25 bp, Mus musculus
agaggccctcccatttgtgactgct

SEQ ID NO: 155598 - DNA, 25 bp, Mus musculus
agaggccctcccttttgtgactgct

SEQ ID NO: 155599 - DNA, 25 bp, Mus musculus
agaggccctctacaccggagaatgt

SEQ ID NO: 155600 - DNA, 25 bp, Mus musculus
agaggccctctactctcgtgttttt

SEQ ID NO: 155601 - DNA, 25 bp, Mus musculus
agaggccctctagaccggagaatgt

SEQ ID NO: 155602 - DNA, 25 bp, Mus musculus
agaggccctctagtctcgtgttttt

SEQ ID NO: 155603 - DNA, 25 bp, Mus musculus
agaggccctggaaacctaacacaga

SEQ ID NO: 155604 - DNA, 25 bp, Mus musculus
agaggccctggacatcccggttgca

SEQ ID NO: 155605 - DNA, 25 bp, Mus musculus
agaggccctggagatcccggttgca

SEQ ID NO: 155606 - DNA, 25 bp, Mus musculus
agaggccctggatacctaacacaga

SEQ ID NO: 155607 - DNA, 25 bp, Mus musculus
agaggccctgggactggatcctacc

SEQ ID NO: 155608 - DNA, 25 bp, Mus musculus
agaggccctgggtctggatcctacc

SEQ ID NO: 155609 - DNA, 25 bp, Mus musculus
agaggccctggtcagcattttctgc

SEQ ID NO: 155610 - DNA, 25 bp, Mus musculus
agaggccctggtgagcattttctgc

SEQ ID NO: 155611 - DNA, 25 bp, Mus musculus
agaggcccttagcacctgctgaaag

SEQ ID NO: 155612 - DNA, 25 bp, Mus musculus
agaggcccttaggacctgctgaaag

SEQ ID NO: 155613 - DNA, 25 bp, Mus musculus
agaggcccttccacgctgcgctggt

SEQ ID NO: 155614 - DNA, 25 bp, Mus musculus
agaggcccttcctcgctgcgctggt

SEQ ID NO: 155615 - DNA, 25 bp, Mus musculus
agaggcccttggaccattgaaaatt

SEQ ID NO: 155616 - DNA, 25 bp, Mus musculus
agaggcccttggtccattgaaaatt

SEQ ID NO: 155617 - DNA, 25 bp, Mus musculus
agaggccgaatgagtgctcccctgg

SEQ ID NO: 155618 - DNA, 25 bp, Mus musculus
agaggccgaatgtgtgctcccctgg

SEQ ID NO: 155619 - DNA, 25 bp, Mus musculus
agaggccgagcaactcttgagtgcc

SEQ ID NO: 155620 - DNA, 25 bp, Mus musculus
agaggccgagcatctcttgagtgcc

SEQ ID NO: 155621 - DNA, 25 bp, Mus musculus
agaggccgcagcacatatgcagctg

SEQ ID NO: 155622 - DNA, 25 bp, Mus musculus
agaggccgcagctcatatgcagctg

SEQ ID NO: 155623 - DNA, 25 bp, Mus musculus
agaggccgcaggatgctctggaaat

SEQ ID NO: 155624 - DNA, 25 bp, Mus musculus
agaggccgcaggttgctctggaaat

SEQ ID NO: 155625 - DNA, 25 bp, Mus musculus
agaggccggacgattgaccagatct

SEQ ID NO: 155626 - DNA, 25 bp, Mus musculus
agaggccggacgtttgaccagatct

SEQ ID NO: 155627 - DNA, 25 bp, Mus musculus
agaggccgggctagcaacaagacca

SEQ ID NO: 155628 - DNA, 25 bp, Mus musculus
agaggccgggcttgcaacaagacca

SEQ ID NO: 155629 - DNA, 25 bp, Mus musculus
agaggccgtccaccgaagctgagca

SEQ ID NO: 155630 - DNA, 25 bp, Mus musculus
agaggccgtccagcgaagctgagca

SEQ ID NO: 155631 - DNA, 25 bp, Mus musculus
agaggcctaaggatccctgaagagc

SEQ ID NO: 155632 - DNA, 25 bp, Mus musculus
agaggcctaaggttccctgaagagc

SEQ ID NO: 155633 - DNA, 25 bp, Mus musculus
agaggcctaagtaccagcagctggt

SEQ ID NO: 155634 - DNA, 25 bp, Mus musculus
agaggcctaagttccagcagctggt

SEQ ID NO: 155635 - DNA, 25 bp, Mus musculus
agaggcctacgaccttggccgcaga

SEQ ID NO: 155636 - DNA, 25 bp, Mus musculus
agaggcctacgagcttggccgcaga

SEQ ID NO: 155637 - DNA, 25 bp, Mus musculus
agaggcctacgtcaagatccagctt

SEQ ID NO: 155638 - DNA, 25 bp, Mus musculus
agaggcctacgtgaagatccagctt

SEQ ID NO: 155639 - DNA, 25 bp, Mus musculus
agaggcctacttataagcagctggt

SEQ ID NO: 155640 - DNA, 25 bp, Mus musculus
agaggcctacttatatatctataaa

SEQ ID NO: 155641 - DNA, 25 bp, Mus musculus
agaggcctacttttaagcagctggt

SEQ ID NO: 155642 - DNA, 25 bp, Mus musculus
agaggcctacttttatatctataaa

SEQ ID NO: 155643 - DNA, 25 bp, Mus musculus
agaggcctatccagactagagaaga

SEQ ID NO: 155644 - DNA, 25 bp, Mus musculus
agaggcctatcctgactagagaaga

SEQ ID NO: 155645 - DNA, 25 bp, Mus musculus
agaggcctcaacacttcaggctgaa

SEQ ID NO: 155646 - DNA, 25 bp, Mus musculus
agaggcctcaactcttcaggctgaa

SEQ ID NO: 155647 - DNA, 25 bp, Mus musculus
agaggcctcacaactgattttctgg

SEQ ID NO: 155648 - DNA, 25 bp, Mus musculus
agaggcctcacatctgattttctgg

SEQ ID NO: 155649 - DNA, 25 bp, Mus musculus
agaggcctccagctaaagcccagag

SEQ ID NO: 155650 - DNA, 25 bp, Mus musculus
agaggcctccagctgtgttttctac

SEQ ID NO: 155651 - DNA, 25 bp, Mus musculus
agaggcctccagctttgccattaca

SEQ ID NO: 155652 - DNA, 25 bp, Mus musculus
agaggcctccaggtaaagcccagag

SEQ ID NO: 155653 - DNA, 25 bp, Mus musculus
agaggcctccaggtgtgttttctac

SEQ ID NO: 155654 - DNA, 25 bp, Mus musculus
agaggcctccaggtttgccattaca

SEQ ID NO: 155655 - DNA, 25 bp, Mus musculus
agaggcctccataagactgatcaag

SEQ ID NO: 155656 - DNA, 25 bp, Mus musculus
agaggcctccattagactgatcaag

SEQ ID NO: 155657 - DNA, 25 bp, Mus musculus
agaggcctcccaagggtaggaccat

SEQ ID NO: 155658 - DNA, 25 bp, Mus musculus
agaggcctcccatgggtaggaccat

SEQ ID NO: 155659 - DNA, 25 bp, Mus musculus
agaggcctccttatgtgtgaaaatg

SEQ ID NO: 155660 - DNA, 25 bp, Mus musculus
agaggcctccttttgtgtgaaaatg

SEQ ID NO: 155661 - DNA, 25 bp, Mus musculus
agaggcctcgagaggctactgcact

SEQ ID NO: 155662 - DNA, 25 bp, Mus musculus
agaggcctcgagtggctactgcact

SEQ ID NO: 155663 - DNA, 25 bp, Mus musculus
agaggcctcgccaagaacacagcga

SEQ ID NO: 155664 - DNA, 25 bp, Mus musculus
agaggcctcgcctagaacacagcga

SEQ ID NO: 155665 - DNA, 25 bp, Mus musculus
agaggcctctcaatgtcattacctt

SEQ ID NO: 155666 - DNA, 25 bp, Mus musculus
agaggcctctcattgtcattacctt

SEQ ID NO: 155667 - DNA, 25 bp, Mus musculus
agaggcctctgcagtgcaaaccctg

SEQ ID NO: 155668 - DNA, 25 bp, Mus musculus
agaggcctctgcatggtatgagctc

SEQ ID NO: 155669 - DNA, 25 bp, Mus musculus
agaggcctctgctgtgcaaaccctg

SEQ ID NO: 155670 - DNA, 25 bp, Mus musculus
agaggcctctgcttggtatgagctc

SEQ ID NO: 155671 - DNA, 25 bp, Mus musculus
agaggcctgaccactctctaagggt

SEQ ID NO: 155672 - DNA, 25 bp, Mus musculus
agaggcctgacctctctctaagggt

SEQ ID NO: 155673 - DNA, 25 bp, Mus musculus
agaggcctgactcgtcttcccgagg

SEQ ID NO: 155674 - DNA, 25 bp, Mus musculus
agaggcctgactggtcttcccgagg

SEQ ID NO: 155675 - DNA, 25 bp, Mus musculus
agaggcctgagcagatgcaatctgt

SEQ ID NO: 155676 - DNA, 25 bp, Mus musculus
agaggcctgagctgatgcaatctgt

SEQ ID NO: 155677 - DNA, 25 bp, Mus musculus
agaggcctgcacattgctttgctag

SEQ ID NO: 155678 - DNA, 25 bp, Mus musculus
agaggcctgcacctttaagccgaat

SEQ ID NO: 155679 - DNA, 25 bp, Mus musculus
agaggcctgcacgtttaagccgaat

SEQ ID NO: 155680 - DNA, 25 bp, Mus musculus
agaggcctgcactttgctttgctag

SEQ ID NO: 155681 - DNA, 25 bp, Mus musculus
agaggcctgcctcagtgacacattc

SEQ ID NO: 155682 - DNA, 25 bp, Mus musculus
agaggcctgcctgagtgacacattc

SEQ ID NO: 155683 - DNA, 25 bp, Mus musculus
agaggcctgggcacaccggcgtcac

SEQ ID NO: 155684 - DNA, 25 bp, Mus musculus
agaggcctgggcagattaggaccaa

SEQ ID NO: 155685 - DNA, 25 bp, Mus musculus
agaggcctgggctcaccggcgtcac

SEQ ID NO: 155686 - DNA, 25 bp, Mus musculus
agaggcctgggctgattaggaccaa

SEQ ID NO: 155687 - DNA, 25 bp, Mus musculus
agaggcctggtcataggctattctc

SEQ ID NO: 155688 - DNA, 25 bp, Mus musculus
agaggcctggtcttaggctattctc

SEQ ID NO: 155689 - DNA, 25 bp, Mus musculus
agaggcctgtaaaatgtataagcat

SEQ ID NO: 155690 - DNA, 25 bp, Mus musculus
agaggcctgtaatatgtataagcat

SEQ ID NO: 155691 - DNA, 25 bp, Mus musculus
agaggcctgtgcactgctgaagttc

SEQ ID NO: 155692 - DNA, 25 bp, Mus musculus
agaggcctgtgctctgctgaagttc

SEQ ID NO: 155693 - DNA, 25 bp, Mus musculus
agaggccttatacacaacttacaaa

SEQ ID NO: 155694 - DNA, 25 bp, Mus musculus
agaggccttatagacaacttacaaa

SEQ ID NO: 155695 - DNA, 25 bp, Mus musculus
agaggccttattacttactgtgctg

SEQ ID NO: 155696 - DNA, 25 bp, Mus musculus
agaggccttatttcttactgtgctg

SEQ ID NO: 155697 - DNA, 25 bp, Mus musculus
agaggccttcaaatcatacgctgat

SEQ ID NO: 155698 - DNA, 25 bp, Mus musculus
agaggccttcaattcatacgctgat

SEQ ID NO: 155699 - DNA, 25 bp, Mus musculus
agaggccttccaaaattcagtacat

SEQ ID NO: 155700 - DNA, 25 bp, Mus musculus
agaggccttccataattcagtacat

SEQ ID NO: 155701 - DNA, 25 bp, Mus musculus
agaggccttccgaaattcagcacag

SEQ ID NO: 155702 - DNA, 25 bp, Mus musculus
agaggccttccgtaattcagcacag

SEQ ID NO: 155703 - DNA, 25 bp, Mus musculus
agaggccttcctattctatagacca

SEQ ID NO: 155704 - DNA, 25 bp, Mus musculus
agaggccttccttttctatagacca

SEQ ID NO: 155705 - DNA, 25 bp, Mus musculus
agaggccttctacaggaggcacaga

SEQ ID NO: 155706 - DNA, 25 bp, Mus musculus
agaggccttctacatgatccgattc

SEQ ID NO: 155707 - DNA, 25 bp, Mus musculus
agaggccttctagaggaggcacaga

SEQ ID NO: 155708 - DNA, 25 bp, Mus musculus
agaggccttctagatgatccgattc

SEQ ID NO: 155709 - DNA, 25 bp, Mus musculus
agaggccttggacaggatcgtccat

SEQ ID NO: 155710 - DNA, 25 bp, Mus musculus
agaggccttggaccactggatctga

SEQ ID NO: 155711 - DNA, 25 bp, Mus musculus
agaggccttggagaggatcgtccat

SEQ ID NO: 155712 - DNA, 25 bp, Mus musculus
agaggccttggagcactggatctga

SEQ ID NO: 155713 - DNA, 25 bp, Mus musculus
agaggccttgtcaggtctgctgatc

SEQ ID NO: 155714 - DNA, 25 bp, Mus musculus
agaggccttgtctggtctgctgatc

SEQ ID NO: 155715 - DNA, 25 bp, Mus musculus
agaggcctttagcaacctttgccaa

SEQ ID NO: 155716 - DNA, 25 bp, Mus musculus
agaggcctttaggaacctttgccaa

SEQ ID NO: 155717 - DNA, 25 bp, Mus musculus
agaggccttttcactgtaggacatc

SEQ ID NO: 155718 - DNA, 25 bp, Mus musculus
agaggccttttcattgtttgaccgg

SEQ ID NO: 155719 - DNA, 25 bp, Mus musculus
agaggccttttcctgacaagatgtg

SEQ ID NO: 155720 - DNA, 25 bp, Mus musculus
agaggccttttcgtgacaagatgtg

SEQ ID NO: 155721 - DNA, 25 bp, Mus musculus
agaggccttttctctgtaggacatc

SEQ ID NO: 155722 - DNA, 25 bp, Mus musculus
agaggccttttctttgtttgaccgg

SEQ ID NO: 155723 - DNA, 25 bp, Mus musculus
agaggcgaagccaggctctcaccat

SEQ ID NO: 155724 - DNA, 25 bp, Mus musculus
agaggcgaagcctggctctcaccat

SEQ ID NO: 155725 - DNA, 25 bp, Mus musculus
agaggcgaatctccggtgtctacca

SEQ ID NO: 155726 - DNA, 25 bp, Mus musculus
agaggcgaatctgcggtgtctacca

SEQ ID NO: 155727 - DNA, 25 bp, Mus musculus
agaggcgacaggaggctatcactat

SEQ ID NO: 155728 - DNA, 25 bp, Mus musculus
agaggcgacaggtggctatcactat

SEQ ID NO: 155729 - DNA, 25 bp, Mus musculus
agaggcgacgtactcaccggagtga

SEQ ID NO: 155730 - DNA, 25 bp, Mus musculus
agaggcgacgtagtcaccggagtga

SEQ ID NO: 155731 - DNA, 25 bp, Mus musculus
agaggcgatctcaggacatccgaaa

SEQ ID NO: 155732 - DNA, 25 bp, Mus musculus
agaggcgatctctggacatccgaaa

SEQ ID NO: 155733 - DNA, 25 bp, Mus musculus
agaggcgccggaagagggctctgga

SEQ ID NO: 155734 - DNA, 25 bp, Mus musculus
agaggcgccggatgagggctctgga

SEQ ID NO: 155735 - DNA, 25 bp, Mus musculus
agaggcgcctccaaaatgggctact

SEQ ID NO: 155736 - DNA, 25 bp, Mus musculus
agaggcgcctcctaaatgggctact

SEQ ID NO: 155737 - DNA, 25 bp, Mus musculus
agaggcgcctttagatccgtccaag

SEQ ID NO: 155738 - DNA, 25 bp, Mus musculus
agaggcgccttttgatccgtccaag

SEQ ID NO: 155739 - DNA, 25 bp, Mus musculus
agaggcgctcatcacagaatactgt

SEQ ID NO: 155740 - DNA, 25 bp, Mus musculus
agaggcgctcatgacagaatactgt

SEQ ID NO: 155741 - DNA, 25 bp, Mus musculus
agaggcgctctacatcctcatggtg

SEQ ID NO: 155742 - DNA, 25 bp, Mus musculus
agaggcgctctagatcctcatggtg

SEQ ID NO: 155743 - DNA, 25 bp, Mus musculus
agaggcgctggtacattctgactga

SEQ ID NO: 155744 - DNA, 25 bp, Mus musculus
agaggcgctggttcattctgactga

SEQ ID NO: 155745 - DNA, 25 bp, Mus musculus
agaggcgctgtaaaatcctggctcg

SEQ ID NO: 155746 - DNA, 25 bp, Mus musculus
agaggcgctgtataatcctggctcg

SEQ ID NO: 155747 - DNA, 25 bp, Mus musculus
agaggcggagaaaccctgaattcaa

SEQ ID NO: 155748 - DNA, 25 bp, Mus musculus
agaggcggagaatccctgaattcaa

SEQ ID NO: 155749 - DNA, 25 bp, Mus musculus
agaggcgggcacaagaatataagca

SEQ ID NO: 155750 - DNA, 25 bp, Mus musculus
agaggcgggcactagaatataagca

SEQ ID NO: 155751 - DNA, 25 bp, Mus musculus
agaggcggtcctctgtctcgttcca

SEQ ID NO: 155752 - DNA, 25 bp, Mus musculus
agaggcggtcctgtgtctcgttcca

SEQ ID NO: 155753 - DNA, 25 bp, Mus musculus
agaggcgtgctacgcagacttcaca

SEQ ID NO: 155754 - DNA, 25 bp, Mus musculus
agaggcgtgctaggcagacttcaca

SEQ ID NO: 155755 - DNA, 25 bp, Mus musculus
agaggcgtggcaagcggtctcctaa

SEQ ID NO: 155756 - DNA, 25 bp, Mus musculus
agaggcgtggcatgcggtctcctaa

SEQ ID NO: 155757 - DNA, 25 bp, Mus musculus
agaggcgttacaaggcagctcgtca

SEQ ID NO: 155758 - DNA, 25 bp, Mus musculus
agaggcgttacatggcagctcgtca

SEQ ID NO: 155759 - DNA, 25 bp, Mus musculus
agaggcgttgtgaagcattctcacg

SEQ ID NO: 155760 - DNA, 25 bp, Mus musculus
agaggcgttgtgtagcattctcacg

SEQ ID NO: 155761 - DNA, 25 bp, Mus musculus
agaggctaaaccatccaatgagaaa

SEQ ID NO: 155762 - DNA, 25 bp, Mus musculus
agaggctaaaccttccaatgagaaa

SEQ ID NO: 155763 - DNA, 25 bp, Mus musculus
agaggctaactcagtttacttaatt

SEQ ID NO: 155764 - DNA, 25 bp, Mus musculus
agaggctaactctgtttacttaatt

SEQ ID NO: 155765 - DNA, 25 bp, Mus musculus
agaggctacagcagccactacaatt

SEQ ID NO: 155766 - DNA, 25 bp, Mus musculus
agaggctacagctgccactacaatt

SEQ ID NO: 155767 - DNA, 25 bp, Mus musculus
agaggctactgtcggatcaatggca

SEQ ID NO: 155768 - DNA, 25 bp, Mus musculus
agaggctactgtcttccaccagtga

SEQ ID NO: 155769 - DNA, 25 bp, Mus musculus
agaggctactgtgggatcaatggca

SEQ ID NO: 155770 - DNA, 25 bp, Mus musculus
agaggctactgtgttccaccagtga

SEQ ID NO: 155771 - DNA, 25 bp, Mus musculus
agaggctagaaacgccatcctgctg

SEQ ID NO: 155772 - DNA, 25 bp, Mus musculus
agaggctagaaaggccatcctgctg

SEQ ID NO: 155773 - DNA, 25 bp, Mus musculus
agaggctagaagaaccatccgggtt

SEQ ID NO: 155774 - DNA, 25 bp, Mus musculus
agaggctagaagtaccatccgggtt

SEQ ID NO: 155775 - DNA, 25 bp, Mus musculus
agaggctagcaaaacatccccggtc

SEQ ID NO: 155776 - DNA, 25 bp, Mus musculus
agaggctagcaatacatccccggtc

SEQ ID NO: 155777 - DNA, 25 bp, Mus musculus
agaggctagctccaaccagcagact

SEQ ID NO: 155778 - DNA, 25 bp, Mus musculus
agaggctagctcgaaccagcagact

SEQ ID NO: 155779 - DNA, 25 bp, Mus musculus
agaggctaggcccattttcatgcag

SEQ ID NO: 155780 - DNA, 25 bp, Mus musculus
agaggctaggccgattttcatgcag

SEQ ID NO: 155781 - DNA, 25 bp, Mus musculus
agaggctagtctccactctgacatc

SEQ ID NO: 155782 - DNA, 25 bp, Mus musculus
agaggctagtctgcactctgacatc

SEQ ID NO: 155783 - DNA, 25 bp, Mus musculus
agaggctataataagggcattgata

SEQ ID NO: 155784 - DNA, 25 bp, Mus musculus
agaggctataattagggcattgata

SEQ ID NO: 155785 - DNA, 25 bp, Mus musculus
agaggctatcacatgggcacctgtt

SEQ ID NO: 155786 - DNA, 25 bp, Mus musculus
agaggctatcacttgggcacctgtt

SEQ ID NO: 155787 - DNA, 25 bp, Mus musculus
agaggctatgacatccctggcctgg

SEQ ID NO: 155788 - DNA, 25 bp, Mus musculus
agaggctatgacttccctggcctgg

SEQ ID NO: 155789 - DNA, 25 bp, Mus musculus
agaggctattgaatgcaacttacaa

SEQ ID NO: 155790 - DNA, 25 bp, Mus musculus
agaggctattgattgcaacttacaa

SEQ ID NO: 155791 - DNA, 25 bp, Mus musculus
agaggctattttcgttacgcgtttg

SEQ ID NO: 155792 - DNA, 25 bp, Mus musculus
agaggctattttggttacgcgtttg

SEQ ID NO: 155793 - DNA, 25 bp, Mus musculus
agaggctcaacacatcccactgaag

SEQ ID NO: 155794 - DNA, 25 bp, Mus musculus
agaggctcaacagatcccactgaag

SEQ ID NO: 155795 - DNA, 25 bp, Mus musculus
agaggctcacggctcctgagaccca

SEQ ID NO: 155796 - DNA, 25 bp, Mus musculus
agaggctcacgggtcctgagaccca

SEQ ID NO: 155797 - DNA, 25 bp, Mus musculus
agaggctcagcgatccagggttact

SEQ ID NO: 155798 - DNA, 25 bp, Mus musculus
agaggctcagcgttccagggttact

SEQ ID NO: 155799 - DNA, 25 bp, Mus musculus
agaggctcaggtccaacttcatttc

SEQ ID NO: 155800 - DNA, 25 bp, Mus musculus
agaggctcaggtgcaacttcatttc

SEQ ID NO: 155801 - DNA, 25 bp, Mus musculus
agaggctcagttaagggacagtgca

SEQ ID NO: 155802 - DNA, 25 bp, Mus musculus
agaggctcagtttagggacagtgca

SEQ ID NO: 155803 - DNA, 25 bp, Mus musculus
agaggctcataaccctctgtaactt

SEQ ID NO: 155804 - DNA, 25 bp, Mus musculus
agaggctcataagcctctgtaactt

SEQ ID NO: 155805 - DNA, 25 bp, Mus musculus
agaggctcatcacccggctggagaa

SEQ ID NO: 155806 - DNA, 25 bp, Mus musculus
agaggctcatcagccggctggagaa

SEQ ID NO: 155807 - DNA, 25 bp, Mus musculus
agaggctcatggagcgcattggcgt

SEQ ID NO: 155808 - DNA, 25 bp, Mus musculus
agaggctcatggtgcgcattggcgt

SEQ ID NO: 155809 - DNA, 25 bp, Mus musculus
agaggctccaggaccaattaacttc

SEQ ID NO: 155810 - DNA, 25 bp, Mus musculus
agaggctccaggtccaattaacttc

SEQ ID NO: 155811 - DNA, 25 bp, Mus musculus
agaggctcccagaggttatctccaa

SEQ ID NO: 155812 - DNA, 25 bp, Mus musculus
agaggctcccagtggttatctccaa

SEQ ID NO: 155813 - DNA, 25 bp, Mus musculus
agaggctccctcaaggcgaaaagct

SEQ ID NO: 155814 - DNA, 25 bp, Mus musculus
agaggctccctctaggcgaaaagct

SEQ ID NO: 155815 - DNA, 25 bp, Mus musculus
agaggctccctgcatcctgaacaag

SEQ ID NO: 155816 - DNA, 25 bp, Mus musculus
agaggctccctggatcctgaacaag

SEQ ID NO: 155817 - DNA, 25 bp, Mus musculus
agaggctccgctacctagactacac

SEQ ID NO: 155818 - DNA, 25 bp, Mus musculus
agaggctccgcttcctagactacac

SEQ ID NO: 155819 - DNA, 25 bp, Mus musculus
agaggctcctagatcacatggctcc

SEQ ID NO: 155820 - DNA, 25 bp, Mus musculus
agaggctcctagttcacatggctcc

SEQ ID NO: 155821 - DNA, 25 bp, Mus musculus
agaggctcctgaagtagtatctccc

SEQ ID NO: 155822 - DNA, 25 bp, Mus musculus
agaggctcctgacgcacatctgtga

SEQ ID NO: 155823 - DNA, 25 bp, Mus musculus
agaggctcctgaggcacatctgtga

SEQ ID NO: 155824 - DNA, 25 bp, Mus musculus
agaggctcctgatgtagtatctccc

SEQ ID NO: 155825 - DNA, 25 bp, Mus musculus
agaggctcctggagaatcctctcct

SEQ ID NO: 155826 - DNA, 25 bp, Mus musculus
agaggctcctggtgaatcctctcct

SEQ ID NO: 155827 - DNA, 25 bp, Mus musculus
agaggctccttgaggtagaagttgt

SEQ ID NO: 155828 - DNA, 25 bp, Mus musculus
agaggctccttgctggctgatccgt

SEQ ID NO: 155829 - DNA, 25 bp, Mus musculus
agaggctccttggtggctgatccgt

SEQ ID NO: 155830 - DNA, 25 bp, Mus musculus
agaggctccttgtggtagaagttgt

SEQ ID NO: 155831 - DNA, 25 bp, Mus musculus
agaggctcgaggcagccgcccagcg

SEQ ID NO: 155832 - DNA, 25 bp, Mus musculus
agaggctcgagggagccgcccagcg

SEQ ID NO: 155833 - DNA, 25 bp, Mus musculus
agaggctcgcagaataccagtaggg

SEQ ID NO: 155834 - DNA, 25 bp, Mus musculus
agaggctcgcagtataccagtaggg

SEQ ID NO: 155835 - DNA, 25 bp, Mus musculus
agaggctcgcgtccaatcctagcat

SEQ ID NO: 155836 - DNA, 25 bp, Mus musculus
agaggctcgcgtgcaatcctagcat

SEQ ID NO: 155837 - DNA, 25 bp, Mus musculus
agaggctcgttgatggccacaatct

SEQ ID NO: 155838 - DNA, 25 bp, Mus musculus
agaggctcgttgttggccacaatct

SEQ ID NO: 155839 - DNA, 25 bp, Mus musculus
agaggctctacgacagcgactggat

SEQ ID NO: 155840 - DNA, 25 bp, Mus musculus
agaggctctacgtcagcgactggat

SEQ ID NO: 155841 - DNA, 25 bp, Mus musculus
agaggctctagtcaccaaggccctg

SEQ ID NO: 155842 - DNA, 25 bp, Mus musculus
agaggctctagtgaccaaggccctg

SEQ ID NO: 155843 - DNA, 25 bp, Mus musculus
agaggctctctacggacaggtggaa

SEQ ID NO: 155844 - DNA, 25 bp, Mus musculus
agaggctctctagggacaggtggaa

SEQ ID NO: 155845 - DNA, 25 bp, Mus musculus
agaggctctgccagaattccagtta

SEQ ID NO: 155846 - DNA, 25 bp, Mus musculus
agaggctctgccctttgaagactgt

SEQ ID NO: 155847 - DNA, 25 bp, Mus musculus
agaggctctgccgtttgaagactgt

SEQ ID NO: 155848 - DNA, 25 bp, Mus musculus
agaggctctgcctgaattccagtta

SEQ ID NO: 155849 - DNA, 25 bp, Mus musculus
agaggctctggccaggacgacccca

SEQ ID NO: 155850 - DNA, 25 bp, Mus musculus
agaggctctggcgaggacgacccca

SEQ ID NO: 155851 - DNA, 25 bp, Mus musculus
agaggctctgggacaacatttgctg

SEQ ID NO: 155852 - DNA, 25 bp, Mus musculus
agaggctctgggtcaacatttgctg

SEQ ID NO: 155853 - DNA, 25 bp, Mus musculus
agaggctctggtcccttctactggc

SEQ ID NO: 155854 - DNA, 25 bp, Mus musculus
agaggctctggtgccttctactggc

SEQ ID NO: 155855 - DNA, 25 bp, Mus musculus
agaggctctgtaccatttgctggca

SEQ ID NO: 155856 - DNA, 25 bp, Mus musculus
agaggctctgtagcatttgctggca

SEQ ID NO: 155857 - DNA, 25 bp, Mus musculus
agaggctcttaaaccagctgtctag

SEQ ID NO: 155858 - DNA, 25 bp, Mus musculus
agaggctcttaatccagctgtctag

SEQ ID NO: 155859 - DNA, 25 bp, Mus musculus
agaggctgaaacagatgcatctccc

SEQ ID NO: 155860 - DNA, 25 bp, Mus musculus
agaggctgaaactgatgcatctccc

SEQ ID NO: 155861 - DNA, 25 bp, Mus musculus
agaggctgaagcatcggatgcagaa

SEQ ID NO: 155862 - DNA, 25 bp, Mus musculus
agaggctgaagcttcggatgcagaa

SEQ ID NO: 155863 - DNA, 25 bp, Mus musculus
agaggctgaaggactttctcgacat

SEQ ID NO: 155864 - DNA, 25 bp, Mus musculus
agaggctgaaggtctttctcgacat

SEQ ID NO: 155865 - DNA, 25 bp, Mus musculus
agaggctgagaaagctggataatcc

SEQ ID NO: 155866 - DNA, 25 bp, Mus musculus
agaggctgagaatgctggataatcc

SEQ ID NO: 155867 - DNA, 25 bp, Mus musculus
agaggctgagacactgaccgctagt

SEQ ID NO: 155868 - DNA, 25 bp, Mus musculus
agaggctgagactctgaccgctagt

SEQ ID NO: 155869 - DNA, 25 bp, Mus musculus
agaggctgagcgagccctcagaaag

SEQ ID NO: 155870 - DNA, 25 bp, Mus musculus
agaggctgagcgtgccctcagaaag

SEQ ID NO: 155871 - DNA, 25 bp, Mus musculus
agaggctgagctaagcctacctctg

SEQ ID NO: 155872 - DNA, 25 bp, Mus musculus
agaggctgagcttagcctacctctg

SEQ ID NO: 155873 - DNA, 25 bp, Mus musculus
agaggctgaggaaacccttccatct

SEQ ID NO: 155874 - DNA, 25 bp, Mus musculus
agaggctgaggatacccttccatct

SEQ ID NO: 155875 - DNA, 25 bp, Mus musculus
agaggctgagtaacatggcacatgc

SEQ ID NO: 155876 - DNA, 25 bp, Mus musculus
agaggctgagtaattgtagtgcaca

SEQ ID NO: 155877 - DNA, 25 bp, Mus musculus
agaggctgagtatcatggcacatgc

SEQ ID NO: 155878 - DNA, 25 bp, Mus musculus
agaggctgagtatttgtagtgcaca

SEQ ID NO: 155879 - DNA, 25 bp, Mus musculus
agaggctgatccatcgcgaggagtt

SEQ ID NO: 155880 - DNA, 25 bp, Mus musculus
agaggctgatccttcgcgaggagtt

SEQ ID NO: 155881 - DNA, 25 bp, Mus musculus
agaggctgatgcaacttgtcaccga

SEQ ID NO: 155882 - DNA, 25 bp, Mus musculus
agaggctgatgcatggcctgtctga

SEQ ID NO: 155883 - DNA, 25 bp, Mus musculus
agaggctgatgctacttgtcaccga

SEQ ID NO: 155884 - DNA, 25 bp, Mus musculus
agaggctgatgcttggcctgtctga

SEQ ID NO: 155885 - DNA, 25 bp, Mus musculus
agaggctgcaacacagcacctgcag

SEQ ID NO: 155886 - DNA, 25 bp, Mus musculus
agaggctgcaactcagcacctgcag

SEQ ID NO: 155887 - DNA, 25 bp, Mus musculus
agaggctgcaccaatatcctgaata

SEQ ID NO: 155888 - DNA, 25 bp, Mus musculus
agaggctgcacctatatcctgaata

SEQ ID NO: 155889 - DNA, 25 bp, Mus musculus
agaggctgcactcggttcaggcact

SEQ ID NO: 155890 - DNA, 25 bp, Mus musculus
agaggctgcactgggttcaggcact

SEQ ID NO: 155891 - DNA, 25 bp, Mus musculus
agaggctgcagaaccctgtggtgat

SEQ ID NO: 155892 - DNA, 25 bp, Mus musculus
agaggctgcagatccctgtggtgat

SEQ ID NO: 155893 - DNA, 25 bp, Mus musculus
agaggctgcagcaacagagcatcaa

SEQ ID NO: 155894 - DNA, 25 bp, Mus musculus
agaggctgcagcaccactgaagctc

SEQ ID NO: 155895 - DNA, 25 bp, Mus musculus
agaggctgcagccgcaccaaagctc

SEQ ID NO: 155896 - DNA, 25 bp, Mus musculus
agaggctgcagcggcaccaaagctc

SEQ ID NO: 155897 - DNA, 25 bp, Mus musculus
agaggctgcagctacagagcatcaa

SEQ ID NO: 155898 - DNA, 25 bp, Mus musculus
agaggctgcagctccactgaagctc

SEQ ID NO: 155899 - DNA, 25 bp, Mus musculus
agaggctgcagtactgaggtgaaac

SEQ ID NO: 155900 - DNA, 25 bp, Mus musculus
agaggctgcagttctgaggtgaaac

SEQ ID NO: 155901 - DNA, 25 bp, Mus musculus
agaggctgcatccatttaactacaa

SEQ ID NO: 155902 - DNA, 25 bp, Mus musculus
agaggctgcatcgatttaactacaa

SEQ ID NO: 155903 - DNA, 25 bp, Mus musculus
agaggctgccgtctggtgctatttt

SEQ ID NO: 155904 - DNA, 25 bp, Mus musculus
agaggctgccgtgtggtgctatttt

SEQ ID NO: 155905 - DNA, 25 bp, Mus musculus
agaggctggtctaaatccctcagcc

SEQ ID NO: 155906 - DNA, 25 bp, Mus musculus
agaggctggtcttaatccctcagcc

SEQ ID NO: 155907 - DNA, 25 bp, Mus musculus
agaggctgtagtacttgagcaagct

SEQ ID NO: 155908 - DNA, 25 bp, Mus musculus
agaggctgtagttcttgagcaagct

SEQ ID NO: 155909 - DNA, 25 bp, Mus musculus
agaggctgtcagctctaccattgta

SEQ ID NO: 155910 - DNA, 25 bp, Mus musculus
agaggctgtcaggtctaccattgta

SEQ ID NO: 155911 - DNA, 25 bp, Mus musculus
agaggctgtctgctagcctagctgt

SEQ ID NO: 155912 - DNA, 25 bp, Mus musculus
agaggctgtctggtagcctagctgt

SEQ ID NO: 155913 - DNA, 25 bp, Mus musculus
agaggctgtgccagtctgttccacc

SEQ ID NO: 155914 - DNA, 25 bp, Mus musculus
agaggctgtgcctgtctgttccacc

SEQ ID NO: 155915 - DNA, 25 bp, Mus musculus
agaggctgtgtgacggcatgacttc

SEQ ID NO: 155916 - DNA, 25 bp, Mus musculus
agaggctgtgtgtcggcatgacttc

SEQ ID NO: 155917 - DNA, 25 bp, Mus musculus
agaggctgttctatgcagctgtctc

SEQ ID NO: 155918 - DNA, 25 bp, Mus musculus
agaggctgttctttgcagctgtctc

SEQ ID NO: 155919 - DNA, 25 bp, Mus musculus
agaggctgttgacactgagatcctg

SEQ ID NO: 155920 - DNA, 25 bp, Mus musculus
agaggctgttgacgccgccaacaaa

SEQ ID NO: 155921 - DNA, 25 bp, Mus musculus
agaggctgttgagactgagatcctg

SEQ ID NO: 155922 - DNA, 25 bp, Mus musculus
agaggctgttgaggccgccaacaaa

SEQ ID NO: 155923 - DNA, 25 bp, Mus musculus
agaggctgtttaacgcctgggctgc

SEQ ID NO: 155924 - DNA, 25 bp, Mus musculus
agaggctgtttatcgcctgggctgc

SEQ ID NO: 155925 - DNA, 25 bp, Mus musculus
agaggctgtttcattaccctgccgt

SEQ ID NO: 155926 - DNA, 25 bp, Mus musculus
agaggctgtttctttaccctgccgt

SEQ ID NO: 155927 - DNA, 25 bp, Mus musculus
agaggcttaagcaactccaggatgc

SEQ ID NO: 155928 - DNA, 25 bp, Mus musculus
agaggcttaagccaagtgtagcaca

SEQ ID NO: 155929 - DNA, 25 bp, Mus musculus
agaggcttaagcgaagtgtagcaca

SEQ ID NO: 155930 - DNA, 25 bp, Mus musculus
agaggcttaagctactccaggatgc

SEQ ID NO: 155931 - DNA, 25 bp, Mus musculus
agaggcttactcagcatctgcttgt

SEQ ID NO: 155932 - DNA, 25 bp, Mus musculus
agaggcttactctgcatctgcttgt

SEQ ID NO: 155933 - DNA, 25 bp, Mus musculus
agaggcttagacacttcttcaaagc

SEQ ID NO: 155934 - DNA, 25 bp, Mus musculus
agaggcttagactcttcttcaaagc

SEQ ID NO: 155935 - DNA, 25 bp, Mus musculus
agaggcttagtccttgtcatggcaa

SEQ ID NO: 155936 - DNA, 25 bp, Mus musculus
agaggcttagtcgttgtcatggcaa

SEQ ID NO: 155937 - DNA, 25 bp, Mus musculus
agaggcttataccaccctcagctac

SEQ ID NO: 155938 - DNA, 25 bp, Mus musculus
agaggcttatacgaccctcagctac

SEQ ID NO: 155939 - DNA, 25 bp, Mus musculus
agaggcttcactatctgcggaaatc

SEQ ID NO: 155940 - DNA, 25 bp, Mus musculus
agaggcttcactttctgcggaaatc

SEQ ID NO: 155941 - DNA, 25 bp, Mus musculus
agaggcttcatcactggtcgcctac

SEQ ID NO: 155942 - DNA, 25 bp, Mus musculus
agaggcttcatctctggtcgcctac

SEQ ID NO: 155943 - DNA, 25 bp, Mus musculus
agaggcttccctcatgagggttgaa

SEQ ID NO: 155944 - DNA, 25 bp, Mus musculus
agaggcttccctgatgagggttgaa

SEQ ID NO: 155945 - DNA, 25 bp, Mus musculus
agaggcttccgacaagtgcagctgc

SEQ ID NO: 155946 - DNA, 25 bp, Mus musculus
agaggcttccgagaagtgcagctgc

SEQ ID NO: 155947 - DNA, 25 bp, Mus musculus
agaggcttcctccaaaacagatgaa

SEQ ID NO: 155948 - DNA, 25 bp, Mus musculus
agaggcttcctcgaaaacagatgaa

SEQ ID NO: 155949 - DNA, 25 bp, Mus musculus
agaggcttgactagggacctcctgt

SEQ ID NO: 155950 - DNA, 25 bp, Mus musculus
agaggcttgacttgggacctcctgt

SEQ ID NO: 155951 - DNA, 25 bp, Mus musculus
agaggcttggccaccagcccagatc

SEQ ID NO: 155952 - DNA, 25 bp, Mus musculus
agaggcttggcctccagcccagatc

SEQ ID NO: 155953 - DNA, 25 bp, Mus musculus
agaggcttggctcctattgactggc

SEQ ID NO: 155954 - DNA, 25 bp, Mus musculus
agaggcttggctgctattgactggc

SEQ ID NO: 155955 - DNA, 25 bp, Mus musculus
agaggcttgggcatcctagttctta

SEQ ID NO: 155956 - DNA, 25 bp, Mus musculus
agaggcttgggcttcctagttctta

SEQ ID NO: 155957 - DNA, 25 bp, Mus musculus
agaggcttggttctgtgcttcgtca

SEQ ID NO: 155958 - DNA, 25 bp, Mus musculus
agaggcttggttgtgtgcttcgtca

SEQ ID NO: 155959 - DNA, 25 bp, Mus musculus
agaggcttgtttccatttgcttctg

SEQ ID NO: 155960 - DNA, 25 bp, Mus musculus
agaggcttgtttgcatttgcttctg

SEQ ID NO: 155961 - DNA, 25 bp, Mus musculus
agaggctttcatctcaccatgtgag

SEQ ID NO: 155962 - DNA, 25 bp, Mus musculus
agaggctttcatgtcaccatgtgag

SEQ ID NO: 155963 - DNA, 25 bp, Mus musculus
agaggctttgccctgcacagactgg

SEQ ID NO: 155964 - DNA, 25 bp, Mus musculus
agaggctttgccgtgcacagactgg

SEQ ID NO: 155965 - DNA, 25 bp, Mus musculus
agaggcttttctcgttggcaaccag

SEQ ID NO: 155966 - DNA, 25 bp, Mus musculus
agaggcttttctggttggcaaccag

SEQ ID NO: 155967 - DNA, 25 bp, Mus musculus
agagggaaaatccaggcgtgctcct

SEQ ID NO: 155968 - DNA, 25 bp, Mus musculus
agagggaaaatcgaggcgtgctcct

SEQ ID NO: 155969 - DNA, 25 bp, Mus musculus
agagggaaacacctggcatgaccca

SEQ ID NO: 155970 - DNA, 25 bp, Mus musculus
agagggaaacacgtggcatgaccca

SEQ ID NO: 155971 - DNA, 25 bp, Mus musculus
agagggaaacatcacttctcctccg

SEQ ID NO: 155972 - DNA, 25 bp, Mus musculus
agagggaaacatgacttctcctccg

SEQ ID NO: 155973 - DNA, 25 bp, Mus musculus
agagggaaagctaatctgctgcagc

SEQ ID NO: 155974 - DNA, 25 bp, Mus musculus
agagggaaagcttatctgctgcagc

SEQ ID NO: 155975 - DNA, 25 bp, Mus musculus
agagggaacaatagcgtgtctttgt

SEQ ID NO: 155976 - DNA, 25 bp, Mus musculus
agagggaacaattgcgtgtctttgt

SEQ ID NO: 155977 - DNA, 25 bp, Mus musculus
agagggaacagcacacccagttttc

SEQ ID NO: 155978 - DNA, 25 bp, Mus musculus
agagggaacagctcacccagttttc

SEQ ID NO: 155979 - DNA, 25 bp, Mus musculus
agagggaaccctacagctactgagg

SEQ ID NO: 155980 - DNA, 25 bp, Mus musculus
agagggaacccttcagctactgagg

SEQ ID NO: 155981 - DNA, 25 bp, Mus musculus
agagggaactatagacagagcagga

SEQ ID NO: 155982 - DNA, 25 bp, Mus musculus
agagggaactattgacagagcagga

SEQ ID NO: 155983 - DNA, 25 bp, Mus musculus
agagggaactgcacggatgccttac

SEQ ID NO: 155984 - DNA, 25 bp, Mus musculus
agagggaactgcagtgaccccaccc

SEQ ID NO: 155985 - DNA, 25 bp, Mus musculus
agagggaactgctcggatgccttac

SEQ ID NO: 155986 - DNA, 25 bp, Mus musculus
agagggaactgctgtgaccccaccc

SEQ ID NO: 155987 - DNA, 25 bp, Mus musculus
agagggaacttgactggctgctttt

SEQ ID NO: 155988 - DNA, 25 bp, Mus musculus
agagggaacttgtctggctgctttt

SEQ ID NO: 155989 - DNA, 25 bp, Mus musculus
agagggaagccgagatccactccag

SEQ ID NO: 155990 - DNA, 25 bp, Mus musculus
agagggaagccgtgatccactccag

SEQ ID NO: 155991 - DNA, 25 bp, Mus musculus
agagggaatcgtctccacattactg

SEQ ID NO: 155992 - DNA, 25 bp, Mus musculus
agagggaatcgtgtccacattactg

SEQ ID NO: 155993 - DNA, 25 bp, Mus musculus
agagggacacaactcaacctgtacc

SEQ ID NO: 155994 - DNA, 25 bp, Mus musculus
agagggacacaagtcaacctgtacc

SEQ ID NO: 155995 - DNA, 25 bp, Mus musculus
agagggacacagctgaactagcctg

SEQ ID NO: 155996 - DNA, 25 bp, Mus musculus
agagggacacaggtgaactagcctg

SEQ ID NO: 155997 - DNA, 25 bp, Mus musculus
agagggacagaaacacagacgcaac

SEQ ID NO: 155998 - DNA, 25 bp, Mus musculus
agagggacagaatcacagacgcaac

SEQ ID NO: 155999 - DNA, 25 bp, Mus musculus
agagggacagctccaccgatttcct

SEQ ID NO: 156000 - DNA, 25 bp, Mus musculus
agagggacagctgcaccgatttcct

SEQ ID NO: 156001 - DNA, 25 bp, Mus musculus
agagggacaggaaccactcggctgc

SEQ ID NO: 156002 - DNA, 25 bp, Mus musculus
agagggacaggatccactcggctgc

SEQ ID NO: 156003 - DNA, 25 bp, Mus musculus
agagggacatctcgcgatttcttga

SEQ ID NO: 156004 - DNA, 25 bp, Mus musculus
agagggacatctggcgatttcttga

SEQ ID NO: 156005 - DNA, 25 bp, Mus musculus
agagggacatgcaagcctactgttg

SEQ ID NO: 156006 - DNA, 25 bp, Mus musculus
agagggacatgctagcctactgttg

SEQ ID NO: 156007 - DNA, 25 bp, Mus musculus
agagggaccaagaccccagaaatgt

SEQ ID NO: 156008 - DNA, 25 bp, Mus musculus
agagggaccaagtccccagaaatgt

SEQ ID NO: 156009 - DNA, 25 bp, Mus musculus
agagggaccactcctgaactggagc

SEQ ID NO: 156010 - DNA, 25 bp, Mus musculus
agagggaccactgctgaactggagc

SEQ ID NO: 156011 - DNA, 25 bp, Mus musculus
agagggaccagtactcgcctgatga

SEQ ID NO: 156012 - DNA, 25 bp, Mus musculus
agagggaccagttctcgcctgatga

SEQ ID NO: 156013 - DNA, 25 bp, Mus musculus
agagggacctcaattacatccgcag

SEQ ID NO: 156014 - DNA, 25 bp, Mus musculus
agagggacctcatttacatccgcag

SEQ ID NO: 156015 - DNA, 25 bp, Mus musculus
agagggacctccatctctcctgaag

SEQ ID NO: 156016 - DNA, 25 bp, Mus musculus
agagggacctccttctctcctgaag

SEQ ID NO: 156017 - DNA, 25 bp, Mus musculus
agagggacctgacttctctggcctg

SEQ ID NO: 156018 - DNA, 25 bp, Mus musculus
agagggacctgagttctctggcctg

SEQ ID NO: 156019 - DNA, 25 bp, Mus musculus
agagggacctgcagtacgtagtcct

SEQ ID NO: 156020 - DNA, 25 bp, Mus musculus
agagggacctgctgtacgtagtcct

SEQ ID NO: 156021 - DNA, 25 bp, Mus musculus
agagggacgctgagcactggacttc

SEQ ID NO: 156022 - DNA, 25 bp, Mus musculus
agagggacgctgtgcactggacttc

SEQ ID NO: 156023 - DNA, 25 bp, Mus musculus
agagggacgcttcatggtgttattt

SEQ ID NO: 156024 - DNA, 25 bp, Mus musculus
agagggacgcttgatggtgttattt

SEQ ID NO: 156025 - DNA, 25 bp, Mus musculus
agagggactacaagcccaggctctg

SEQ ID NO: 156026 - DNA, 25 bp, Mus musculus
agagggactacatgcccaggctctg

SEQ ID NO: 156027 - DNA, 25 bp, Mus musculus
agagggactctgagccaatgcctgc

SEQ ID NO: 156028 - DNA, 25 bp, Mus musculus
agagggactctgtgccaatgcctgc

SEQ ID NO: 156029 - DNA, 25 bp, Mus musculus
agagggacttcgagccaataggttt

SEQ ID NO: 156030 - DNA, 25 bp, Mus musculus
agagggacttcgtgccaataggttt

SEQ ID NO: 156031 - DNA, 25 bp, Mus musculus
agagggagagcgctgttaatacata

SEQ ID NO: 156032 - DNA, 25 bp, Mus musculus
agagggagagcggtgttaatacata

SEQ ID NO: 156033 - DNA, 25 bp, Mus musculus
agagggagagctactttctgccttc

SEQ ID NO: 156034 - DNA, 25 bp, Mus musculus
agagggagagcttctttctgccttc

SEQ ID NO: 156035 - DNA, 25 bp, Mus musculus
agagggagagttaccccctcagatg

SEQ ID NO: 156036 - DNA, 25 bp, Mus musculus
agagggagagtttccccctcagatg

SEQ ID NO: 156037 - DNA, 25 bp, Mus musculus
agagggagattgaggcctttgccca

SEQ ID NO: 156038 - DNA, 25 bp, Mus musculus
agagggagattgtggcctttgccca

SEQ ID NO: 156039 - DNA, 25 bp, Mus musculus
agagggagcccacaggctttctttc

SEQ ID NO: 156040 - DNA, 25 bp, Mus musculus
agagggagcccaccctggcatagca

SEQ ID NO: 156041 - DNA, 25 bp, Mus musculus
agagggagcccagaggctttctttc

SEQ ID NO: 156042 - DNA, 25 bp, Mus musculus
agagggagcccagcctggcatagca

SEQ ID NO: 156043 - DNA, 25 bp, Mus musculus
agagggagccccacctgaatatcgg

SEQ ID NO: 156044 - DNA, 25 bp, Mus musculus
agagggagcccctcctgaatatcgg

SEQ ID NO: 156045 - DNA, 25 bp, Mus musculus
agagggagcctacgcatgcatgcaa

SEQ ID NO: 156046 - DNA, 25 bp, Mus musculus
agagggagcctaggcatgcatgcaa

SEQ ID NO: 156047 - DNA, 25 bp, Mus musculus
agagggagcgccaacatttctcact

SEQ ID NO: 156048 - DNA, 25 bp, Mus musculus
agagggagcgcctacatttctcact

SEQ ID NO: 156049 - DNA, 25 bp, Mus musculus
agagggagcgttcgacatattgctt

SEQ ID NO: 156050 - DNA, 25 bp, Mus musculus
agagggagcgttggacatattgctt

SEQ ID NO: 156051 - DNA, 25 bp, Mus musculus
agagggagctccatagttgggtcct

SEQ ID NO: 156052 - DNA, 25 bp, Mus musculus
agagggagctccttagttgggtcct

SEQ ID NO: 156053 - DNA, 25 bp, Mus musculus
agagggaggagaatcattgcaagtt

SEQ ID NO: 156054 - DNA, 25 bp, Mus musculus
agagggaggagattcattgcaagtt

SEQ ID NO: 156055 - DNA, 25 bp, Mus musculus
agagggaggcatactgccttccttt

SEQ ID NO: 156056 - DNA, 25 bp, Mus musculus
agagggaggcattctgccttccttt

SEQ ID NO: 156057 - DNA, 25 bp, Mus musculus
agagggaggccactcagaatatagt

SEQ ID NO: 156058 - DNA, 25 bp, Mus musculus
agagggaggccagtcagaatatagt

SEQ ID NO: 156059 - DNA, 25 bp, Mus musculus
agagggaggtgtactatctgtgtac

SEQ ID NO: 156060 - DNA, 25 bp, Mus musculus
agagggaggtgttctatctgtgtac

SEQ ID NO: 156061 - DNA, 25 bp, Mus musculus
agagggagtcctatgccaacggatg

SEQ ID NO: 156062 - DNA, 25 bp, Mus musculus
agagggagtcctttgccaacggatg

SEQ ID NO: 156063 - DNA, 25 bp, Mus musculus
agagggagtcgtctttcagatcctg

SEQ ID NO: 156064 - DNA, 25 bp, Mus musculus
agagggagtcgtgtttcagatcctg

SEQ ID NO: 156065 - DNA, 25 bp, Mus musculus
agagggagtctgactttcccactca

SEQ ID NO: 156066 - DNA, 25 bp, Mus musculus
agagggagtctgtctttcccactca

SEQ ID NO: 156067 - DNA, 25 bp, Mus musculus
agagggagtgagagggttgagaagc

SEQ ID NO: 156068 - DNA, 25 bp, Mus musculus
agagggagtgagtgggttgagaagc

SEQ ID NO: 156069 - DNA, 25 bp, Mus musculus
agagggagtggaagtcttagcagcc

SEQ ID NO: 156070 - DNA, 25 bp, Mus musculus
agagggagtggatgtcttagcagcc

SEQ ID NO: 156071 - DNA, 25 bp, Mus musculus
agagggagtttgacaaccctgacac

SEQ ID NO: 156072 - DNA, 25 bp, Mus musculus
agagggagtttgtcaaccctgacac

SEQ ID NO: 156073 - DNA, 25 bp, Mus musculus
agagggatgacccagccttagtttc

SEQ ID NO: 156074 - DNA, 25 bp, Mus musculus
agagggatgaccgagccttagtttc

SEQ ID NO: 156075 - DNA, 25 bp, Mus musculus
agagggatgcgcacctgctcaggca

SEQ ID NO: 156076 - DNA, 25 bp, Mus musculus
agagggatgcgctcctgctcaggca

SEQ ID NO: 156077 - DNA, 25 bp, Mus musculus
agagggattccacttccattactcc

SEQ ID NO: 156078 - DNA, 25 bp, Mus musculus
agagggattccagttccattactcc

SEQ ID NO: 156079 - DNA, 25 bp, Mus musculus
agagggattcccctgtcaagccagt

SEQ ID NO: 156080 - DNA, 25 bp, Mus musculus
agagggattcccgtgtcaagccagt

SEQ ID NO: 156081 - DNA, 25 bp, Mus musculus
agagggattgtcactggctcgagaa

SEQ ID NO: 156082 - DNA, 25 bp, Mus musculus
agagggattgtctctggctcgagaa

SEQ ID NO: 156083 - DNA, 25 bp, Mus musculus
agagggattgtgacacttcgttcgg

SEQ ID NO: 156084 - DNA, 25 bp, Mus musculus
agagggattgtgacccactggttga

SEQ ID NO: 156085 - DNA, 25 bp, Mus musculus
agagggattgtgtcacttcgttcgg

SEQ ID NO: 156086 - DNA, 25 bp, Mus musculus
agagggattgtgtcccactggttga

SEQ ID NO: 156087 - DNA, 25 bp, Mus musculus
agagggcaaagacaacctgtcagcc

SEQ ID NO: 156088 - DNA, 25 bp, Mus musculus
agagggcaaagagaacctgtcagcc

SEQ ID NO: 156089 - DNA, 25 bp, Mus musculus
agagggcaacttagggaatcattcc

SEQ ID NO: 156090 - DNA, 25 bp, Mus musculus
agagggcaactttgggaatcattcc

SEQ ID NO: 156091 - DNA, 25 bp, Mus musculus
agagggcaagacatcagatcggacc

SEQ ID NO: 156092 - DNA, 25 bp, Mus musculus
agagggcaagacttcagatcggacc

SEQ ID NO: 156093 - DNA, 25 bp, Mus musculus
agagggcaagagatcacgttcaggt

SEQ ID NO: 156094 - DNA, 25 bp, Mus musculus
agagggcaagagttcacgttcaggt

SEQ ID NO: 156095 - DNA, 25 bp, Mus musculus
agagggcaagccaaccattttattc

SEQ ID NO: 156096 - DNA, 25 bp, Mus musculus
agagggcaagcctaccattttattc

SEQ ID NO: 156097 - DNA, 25 bp, Mus musculus
agagggcaagcgactcccaaggaat

SEQ ID NO: 156098 - DNA, 25 bp, Mus musculus
agagggcaagcgtctcccaaggaat

SEQ ID NO: 156099 - DNA, 25 bp, Mus musculus
agagggcaatggaccccttggaact

SEQ ID NO: 156100 - DNA, 25 bp, Mus musculus
agagggcaatggtccccttggaact

SEQ ID NO: 156101 - DNA, 25 bp, Mus musculus
agagggcacccactattccatgttt

SEQ ID NO: 156102 - DNA, 25 bp, Mus musculus
agagggcacccagtattccatgttt

SEQ ID NO: 156103 - DNA, 25 bp, Mus musculus
agagggcacctgagcagatctgtgt

SEQ ID NO: 156104 - DNA, 25 bp, Mus musculus
agagggcacctgtgcagatctgtgt

SEQ ID NO: 156105 - DNA, 25 bp, Mus musculus
agagggcaccttattacttcgagat

SEQ ID NO: 156106 - DNA, 25 bp, Mus musculus
agagggcacctttttacttcgagat

SEQ ID NO: 156107 - DNA, 25 bp, Mus musculus
agagggcactctagcgaccttctga

SEQ ID NO: 156108 - DNA, 25 bp, Mus musculus
agagggcactcttgcgaccttctga

SEQ ID NO: 156109 - DNA, 25 bp, Mus musculus
agagggcactgcaatgcaccgggct

SEQ ID NO: 156110 - DNA, 25 bp, Mus musculus
agagggcactgctatgcaccgggct

SEQ ID NO: 156111 - DNA, 25 bp, Mus musculus
agagggcactggagccctgcacagc

SEQ ID NO: 156112 - DNA, 25 bp, Mus musculus
agagggcactggtgccctgcacagc

SEQ ID NO: 156113 - DNA, 25 bp, Mus musculus
agagggcacttgaaaaacgcattac

SEQ ID NO: 156114 - DNA, 25 bp, Mus musculus
agagggcacttgtaaaacgcattac

SEQ ID NO: 156115 - DNA, 25 bp, Mus musculus
agagggcagaaaccagccttcacct

SEQ ID NO: 156116 - DNA, 25 bp, Mus musculus
agagggcagaaagcagccttcacct

SEQ ID NO: 156117 - DNA, 25 bp, Mus musculus
agagggcagctcagaatggaagcca

SEQ ID NO: 156118 - DNA, 25 bp, Mus musculus
agagggcagctccttgtgtttacca

SEQ ID NO: 156119 - DNA, 25 bp, Mus musculus
agagggcagctcgttgtgtttacca

SEQ ID NO: 156120 - DNA, 25 bp, Mus musculus
agagggcagctctgaatggaagcca

SEQ ID NO: 156121 - DNA, 25 bp, Mus musculus
agagggcagcttacagtgatccgtt

SEQ ID NO: 156122 - DNA, 25 bp, Mus musculus
agagggcagctttcagtgatccgtt

SEQ ID NO: 156123 - DNA, 25 bp, Mus musculus
agagggcagggcaccttgttttatt

SEQ ID NO: 156124 - DNA, 25 bp, Mus musculus
agagggcagggctccttgttttatt

SEQ ID NO: 156125 - DNA, 25 bp, Mus musculus
agagggcatcaccatgagagcacgt

SEQ ID NO: 156126 - DNA, 25 bp, Mus musculus
agagggcatcacgatgagagcacgt

SEQ ID NO: 156127 - DNA, 25 bp, Mus musculus
agagggcatcgaacggatcctagtt

SEQ ID NO: 156128 - DNA, 25 bp, Mus musculus
agagggcatcgatcggatcctagtt

SEQ ID NO: 156129 - DNA, 25 bp, Mus musculus
agagggcatctcacccaggtgaccc

SEQ ID NO: 156130 - DNA, 25 bp, Mus musculus
agagggcatctctcccaggtgaccc

SEQ ID NO: 156131 - DNA, 25 bp, Mus musculus
agagggcatctgaggccaagacccc

SEQ ID NO: 156132 - DNA, 25 bp, Mus musculus
agagggcatctgtggccaagacccc

SEQ ID NO: 156133 - DNA, 25 bp, Mus musculus
agagggcatgcacctgtaacagctt

SEQ ID NO: 156134 - DNA, 25 bp, Mus musculus
agagggcatgcagctgtaacagctt

SEQ ID NO: 156135 - DNA, 25 bp, Mus musculus
agagggcatgcccagcagactccca

SEQ ID NO: 156136 - DNA, 25 bp, Mus musculus
agagggcatgccgagcagactccca

SEQ ID NO: 156137 - DNA, 25 bp, Mus musculus
agagggcattctactttttagcttt

SEQ ID NO: 156138 - DNA, 25 bp, Mus musculus
agagggcattcttctttttagcttt

SEQ ID NO: 156139 - DNA, 25 bp, Mus musculus
agagggccaacccagatgggaccaa

SEQ ID NO: 156140 - DNA, 25 bp, Mus musculus
agagggccaaccgagatgggaccaa

SEQ ID NO: 156141 - DNA, 25 bp, Mus musculus
agagggccaacgaagccttggccat

SEQ ID NO: 156142 - DNA, 25 bp, Mus musculus
agagggccaacgtagccttggccat

SEQ ID NO: 156143 - DNA, 25 bp, Mus musculus
agagggccaagtccaggaattgaca

SEQ ID NO: 156144 - DNA, 25 bp, Mus musculus
agagggccaagtgcaggaattgaca

SEQ ID NO: 156145 - DNA, 25 bp, Mus musculus
agagggccacatccagccactgaat

SEQ ID NO: 156146 - DNA, 25 bp, Mus musculus
agagggccacatgcagccactgaat

SEQ ID NO: 156147 - DNA, 25 bp, Mus musculus
agagggccaccaatctgacttactg

SEQ ID NO: 156148 - DNA, 25 bp, Mus musculus
agagggccaccattctgacttactg

SEQ ID NO: 156149 - DNA, 25 bp, Mus musculus
agagggccagatatcgatctcctgc

SEQ ID NO: 156150 - DNA, 25 bp, Mus musculus
agagggccagatttcgatctcctgc

SEQ ID NO: 156151 - DNA, 25 bp, Mus musculus
agagggccaggtactgtccagcaaa

SEQ ID NO: 156152 - DNA, 25 bp, Mus musculus
agagggccaggttctgtccagcaaa

SEQ ID NO: 156153 - DNA, 25 bp, Mus musculus
agagggcccacacccgagttagccg

SEQ ID NO: 156154 - DNA, 25 bp, Mus musculus
agagggcccacagccgagttagccg

SEQ ID NO: 156155 - DNA, 25 bp, Mus musculus
agagggcctatcctatttctcacct

SEQ ID NO: 156156 - DNA, 25 bp, Mus musculus
agagggcctatcgtatttctcacct

SEQ ID NO: 156157 - DNA, 25 bp, Mus musculus
agagggcctcagacatttatcacag

SEQ ID NO: 156158 - DNA, 25 bp, Mus musculus
agagggcctcagtcatttatcacag

SEQ ID NO: 156159 - DNA, 25 bp, Mus musculus
agagggcctctaattgtaacaatgt

SEQ ID NO: 156160 - DNA, 25 bp, Mus musculus
agagggcctctatttgtaacaatgt

SEQ ID NO: 156161 - DNA, 25 bp, Mus musculus
agagggcctctcagtcagcttggtg

SEQ ID NO: 156162 - DNA, 25 bp, Mus musculus
agagggcctctctgtcagcttggtg

SEQ ID NO: 156163 - DNA, 25 bp, Mus musculus
agagggcctgccagggactcatgct

SEQ ID NO: 156164 - DNA, 25 bp, Mus musculus
agagggcctgcctgggactcatgct

SEQ ID NO: 156165 - DNA, 25 bp, Mus musculus
agagggcctgctactcatgggcact

SEQ ID NO: 156166 - DNA, 25 bp, Mus musculus
agagggcctgctcatcatcgaggct

SEQ ID NO: 156167 - DNA, 25 bp, Mus musculus
agagggcctgctgatcatcgaggct

SEQ ID NO: 156168 - DNA, 25 bp, Mus musculus
agagggcctgcttctcatgggcact

SEQ ID NO: 156169 - DNA, 25 bp, Mus musculus
agagggcctgggagtccaccagccc

SEQ ID NO: 156170 - DNA, 25 bp, Mus musculus
agagggcctgggtgtccaccagccc

SEQ ID NO: 156171 - DNA, 25 bp, Mus musculus
agagggcctgttattgcctgggcaa

SEQ ID NO: 156172 - DNA, 25 bp, Mus musculus
agagggcctgtttttgcctgggcaa

SEQ ID NO: 156173 - DNA, 25 bp, Mus musculus
agagggcgacacagtgaccaggaca

SEQ ID NO: 156174 - DNA, 25 bp, Mus musculus
agagggcgacactgtgaccaggaca

SEQ ID NO: 156175 - DNA, 25 bp, Mus musculus
agagggcgcacgctcaacctcaaag

SEQ ID NO: 156176 - DNA, 25 bp, Mus musculus
agagggcgcacggtcaacctcaaag

SEQ ID NO: 156177 - DNA, 25 bp, Mus musculus
agagggcgcagcagtgatccagatc

SEQ ID NO: 156178 - DNA, 25 bp, Mus musculus
agagggcgcagctgtgatccagatc

SEQ ID NO: 156179 - DNA, 25 bp, Mus musculus
agagggcggcatatctatctgtact

SEQ ID NO: 156180 - DNA, 25 bp, Mus musculus
agagggcggcatttctatctgtact

SEQ ID NO: 156181 - DNA, 25 bp, Mus musculus
agagggcggcgccaactccggcttc

SEQ ID NO: 156182 - DNA, 25 bp, Mus musculus
agagggcggcgcgaactccggcttc

SEQ ID NO: 156183 - DNA, 25 bp, Mus musculus
agagggcgggatagtcagtgttctt

SEQ ID NO: 156184 - DNA, 25 bp, Mus musculus
agagggcgggattgtcagtgttctt

SEQ ID NO: 156185 - DNA, 25 bp, Mus musculus
agagggcgtcacacagcactaaagg

SEQ ID NO: 156186 - DNA, 25 bp, Mus musculus
agagggcgtcactcagcactaaagg

SEQ ID NO: 156187 - DNA, 25 bp, Mus musculus
agagggcgtgtcaccctctagtggc

SEQ ID NO: 156188 - DNA, 25 bp, Mus musculus
agagggcgtgtctccctctagtggc

SEQ ID NO: 156189 - DNA, 25 bp, Mus musculus
agagggctaaggcaagccagcagtg

SEQ ID NO: 156190 - DNA, 25 bp, Mus musculus
agagggctaagggaagccagcagtg

SEQ ID NO: 156191 - DNA, 25 bp, Mus musculus
agagggctaccacacagctctgctg

SEQ ID NO: 156192 - DNA, 25 bp, Mus musculus
agagggctaccagacagctctgctg

SEQ ID NO: 156193 - DNA, 25 bp, Mus musculus
agagggctacttacctggactgaac

SEQ ID NO: 156194 - DNA, 25 bp, Mus musculus
agagggctacttcagtgtctctact

SEQ ID NO: 156195 - DNA, 25 bp, Mus musculus
agagggctacttgagtgtctctact

SEQ ID NO: 156196 - DNA, 25 bp, Mus musculus
agagggctactttcctggactgaac

SEQ ID NO: 156197 - DNA, 25 bp, Mus musculus
agagggctagttcctttgccacagc

SEQ ID NO: 156198 - DNA, 25 bp, Mus musculus
agagggctagttgctttgccacagc

SEQ ID NO: 156199 - DNA, 25 bp, Mus musculus
agagggctatgacctcccttacaac

SEQ ID NO: 156200 - DNA, 25 bp, Mus musculus
agagggctatgagctcccttacaac

SEQ ID NO: 156201 - DNA, 25 bp, Mus musculus
agagggctcagcagtcaacaacact

SEQ ID NO: 156202 - DNA, 25 bp, Mus musculus
agagggctcagctgtcaacaacact

SEQ ID NO: 156203 - DNA, 25 bp, Mus musculus
agagggctcctaaaggtctgccagt

SEQ ID NO: 156204 - DNA, 25 bp, Mus musculus
agagggctcctataggtctgccagt

SEQ ID NO: 156205 - DNA, 25 bp, Mus musculus
agagggctcctgattcaactgtgaa

SEQ ID NO: 156206 - DNA, 25 bp, Mus musculus
agagggctcctgtttcaactgtgaa

SEQ ID NO: 156207 - DNA, 25 bp, Mus musculus
agagggctcggaacttccccggtga

SEQ ID NO: 156208 - DNA, 25 bp, Mus musculus
agagggctcggatcttccccggtga

SEQ ID NO: 156209 - DNA, 25 bp, Mus musculus
agagggctctcacccagagttggct

SEQ ID NO: 156210 - DNA, 25 bp, Mus musculus
agagggctctcagccagagttggct

SEQ ID NO: 156211 - DNA, 25 bp, Mus musculus
agagggctctgacactgactactga

SEQ ID NO: 156212 - DNA, 25 bp, Mus musculus
agagggctctgagactgactactga

SEQ ID NO: 156213 - DNA, 25 bp, Mus musculus
agagggctctgtacgacgcgtaaac

SEQ ID NO: 156214 - DNA, 25 bp, Mus musculus
agagggctctgttcgacgcgtaaac

SEQ ID NO: 156215 - DNA, 25 bp, Mus musculus
agagggctgagccttctcttctgtc

SEQ ID NO: 156216 - DNA, 25 bp, Mus musculus
agagggctgagcgttctcttctgtc

SEQ ID NO: 156217 - DNA, 25 bp, Mus musculus
agagggctgcctactaccctactca

SEQ ID NO: 156218 - DNA, 25 bp, Mus musculus
agagggctgccttctaccctactca

SEQ ID NO: 156219 - DNA, 25 bp, Mus musculus
agagggctgcttaatcatattgtac

SEQ ID NO: 156220 - DNA, 25 bp, Mus musculus
agagggctgcttctacaatgctgac

SEQ ID NO: 156221 - DNA, 25 bp, Mus musculus
agagggctgcttgtacaatgctgac

SEQ ID NO: 156222 - DNA, 25 bp, Mus musculus
agagggctgctttatcatattgtac

SEQ ID NO: 156223 - DNA, 25 bp, Mus musculus
agagggctgggtaccatcaggcctt

SEQ ID NO: 156224 - DNA, 25 bp, Mus musculus
agagggctgggttccatcaggcctt

SEQ ID NO: 156225 - DNA, 25 bp, Mus musculus
agagggctggtaacccaggagtact

SEQ ID NO: 156226 - DNA, 25 bp, Mus musculus
agagggctggtatcccaggagtact

SEQ ID NO: 156227 - DNA, 25 bp, Mus musculus
agagggcttactcgacaaactggtc

SEQ ID NO: 156228 - DNA, 25 bp, Mus musculus
agagggcttactggacaaactggtc

SEQ ID NO: 156229 - DNA, 25 bp, Mus musculus
agagggcttcggagatgccgcactc

SEQ ID NO: 156230 - DNA, 25 bp, Mus musculus
agagggcttcggtgatgccgcactc

SEQ ID NO: 156231 - DNA, 25 bp, Mus musculus
agagggcttgttatccagctctgcc

SEQ ID NO: 156232 - DNA, 25 bp, Mus musculus
agagggcttgttttccagctctgcc

SEQ ID NO: 156233 - DNA, 25 bp, Mus musculus
agagggctttccagtgacggtgacc

SEQ ID NO: 156234 - DNA, 25 bp, Mus musculus
agagggctttcctgtgacggtgacc

SEQ ID NO: 156235 - DNA, 25 bp, Mus musculus
agagggctttctcttctatgtcatt

SEQ ID NO: 156236 - DNA, 25 bp, Mus musculus
agagggctttctgttctatgtcatt

SEQ ID NO: 156237 - DNA, 25 bp, Mus musculus
agagggctttgtaccagtgagtatt

SEQ ID NO: 156238 - DNA, 25 bp, Mus musculus
agagggctttgtcctgtgtctgtca

SEQ ID NO: 156239 - DNA, 25 bp, Mus musculus
agagggctttgtgctgtgtctgtca

SEQ ID NO: 156240 - DNA, 25 bp, Mus musculus
agagggctttgttccagtgagtatt

SEQ ID NO: 156241 - DNA, 25 bp, Mus musculus
agaggggactcccaatgaccccaat

SEQ ID NO: 156242 - DNA, 25 bp, Mus musculus
agaggggactccgaatgaccccaat

SEQ ID NO: 156243 - DNA, 25 bp, Mus musculus
agaggggggtacctgcatcccatcc

SEQ ID NO: 156244 - DNA, 25 bp, Mus musculus
agaggggggtacgtgcatcccatcc

SEQ ID NO: 156245 - DNA, 25 bp, Mus musculus
agaggggttctgcaaacacccgcca

SEQ ID NO: 156246 - DNA, 25 bp, Mus musculus
agaggggttctggaaacacccgcca

SEQ ID NO: 156247 - DNA, 25 bp, Mus musculus
agagggtaacatctgccggcacttg

SEQ ID NO: 156248 - DNA, 25 bp, Mus musculus
agagggtaacatgtgccggcacttg

SEQ ID NO: 156249 - DNA, 25 bp, Mus musculus
agagggtaaccaactcgtcgcacat

SEQ ID NO: 156250 - DNA, 25 bp, Mus musculus
agagggtaaccatctcgtcgcacat

SEQ ID NO: 156251 - DNA, 25 bp, Mus musculus
agagggtacacgctcttacactgcg

SEQ ID NO: 156252 - DNA, 25 bp, Mus musculus
agagggtacacggtcttacactgcg

SEQ ID NO: 156253 - DNA, 25 bp, Mus musculus
agagggtacaggctgctgctcacca

SEQ ID NO: 156254 - DNA, 25 bp, Mus musculus
agagggtacagggtgctgctcacca

SEQ ID NO: 156255 - DNA, 25 bp, Mus musculus
agagggtaccttcagccttgagcca

SEQ ID NO: 156256 - DNA, 25 bp, Mus musculus
agagggtaccttgagccttgagcca

SEQ ID NO: 156257 - DNA, 25 bp, Mus musculus
agagggtacgtacgccttagtcact

SEQ ID NO: 156258 - DNA, 25 bp, Mus musculus
agagggtacgtaggccttagtcact

SEQ ID NO: 156259 - DNA, 25 bp, Mus musculus
agagggtacttccattgcctgtcct

SEQ ID NO: 156260 - DNA, 25 bp, Mus musculus
agagggtacttcgattgcctgtcct

SEQ ID NO: 156261 - DNA, 25 bp, Mus musculus
agagggtagagcaacactgtcacct

SEQ ID NO: 156262 - DNA, 25 bp, Mus musculus
agagggtagagctacactgtcacct

SEQ ID NO: 156263 - DNA, 25 bp, Mus musculus
agagggtattcgcaggcccagcatc

SEQ ID NO: 156264 - DNA, 25 bp, Mus musculus
agagggtattcggaggcccagcatc

SEQ ID NO: 156265 - DNA, 25 bp, Mus musculus
agagggtatttaactgaagcccctc

SEQ ID NO: 156266 - DNA, 25 bp, Mus musculus
agagggtatttatctgaagcccctc

SEQ ID NO: 156267 - DNA, 25 bp, Mus musculus
agagggtcaaccactgagcttcaaa

SEQ ID NO: 156268 - DNA, 25 bp, Mus musculus
agagggtcaacctctgagcttcaaa

SEQ ID NO: 156269 - DNA, 25 bp, Mus musculus
agagggtcaccaaccttcgggcagg

SEQ ID NO: 156270 - DNA, 25 bp, Mus musculus
agagggtcaccatccttcgggcagg

SEQ ID NO: 156271 - DNA, 25 bp, Mus musculus
agagggtcacctcggtcctgaagtc

SEQ ID NO: 156272 - DNA, 25 bp, Mus musculus
agagggtcacctgggtcctgaagtc

SEQ ID NO: 156273 - DNA, 25 bp, Mus musculus
agagggtccagtctacactccactc

SEQ ID NO: 156274 - DNA, 25 bp, Mus musculus
agagggtccagtgtacactccactc

SEQ ID NO: 156275 - DNA, 25 bp, Mus musculus
agagggtccgccacaagacacgcag

SEQ ID NO: 156276 - DNA, 25 bp, Mus musculus
agagggtccgcctcaagacacgcag

SEQ ID NO: 156277 - DNA, 25 bp, Mus musculus
agagggtcctgaagtggccacgcca

SEQ ID NO: 156278 - DNA, 25 bp, Mus musculus
agagggtcctgatgtggccacgcca

SEQ ID NO: 156279 - DNA, 25 bp, Mus musculus
agagggtctcccaggcctccatgcg

SEQ ID NO: 156280 - DNA, 25 bp, Mus musculus
agagggtctccctggcctccatgcg

SEQ ID NO: 156281 - DNA, 25 bp, Mus musculus
agagggtctctgagggcctcctgct

SEQ ID NO: 156282 - DNA, 25 bp, Mus musculus
agagggtctctgtgggcctcctgct

SEQ ID NO: 156283 - DNA, 25 bp, Mus musculus
agagggtgaactccatgacagccac

SEQ ID NO: 156284 - DNA, 25 bp, Mus musculus
agagggtgaactgcatgacagccac

SEQ ID NO: 156285 - DNA, 25 bp, Mus musculus
agagggtgacctccgtatcatgcca

SEQ ID NO: 156286 - DNA, 25 bp, Mus musculus
agagggtgacctgcgtatcatgcca

SEQ ID NO: 156287 - DNA, 25 bp, Mus musculus
agagggtgacgacactgccgacctt

SEQ ID NO: 156288 - DNA, 25 bp, Mus musculus
agagggtgacgagactgccgacctt

SEQ ID NO: 156289 - DNA, 25 bp, Mus musculus
agagggtgactcagctctccaggaa

SEQ ID NO: 156290 - DNA, 25 bp, Mus musculus
agagggtgactctgctctccaggaa

SEQ ID NO: 156291 - DNA, 25 bp, Mus musculus
agagggtgccctatatttgttcatc

SEQ ID NO: 156292 - DNA, 25 bp, Mus musculus
agagggtgccctttatttgttcatc

SEQ ID NO: 156293 - DNA, 25 bp, Mus musculus
agagggtgccgaatcccttgacctc

SEQ ID NO: 156294 - DNA, 25 bp, Mus musculus
agagggtgccgattcccttgacctc

SEQ ID NO: 156295 - DNA, 25 bp, Mus musculus
agagggtgcggaatccatccggacc

SEQ ID NO: 156296 - DNA, 25 bp, Mus musculus
agagggtgcggattccatccggacc

SEQ ID NO: 156297 - DNA, 25 bp, Mus musculus
agagggtggcaacgtcaagaccatc

SEQ ID NO: 156298 - DNA, 25 bp, Mus musculus
agagggtggcaaggtcaagaccatc

SEQ ID NO: 156299 - DNA, 25 bp, Mus musculus
agagggtgtacaaagaggacttcca

SEQ ID NO: 156300 - DNA, 25 bp, Mus musculus
agagggtgtacatagaggacttcca

SEQ ID NO: 156301 - DNA, 25 bp, Mus musculus
agagggtgtgagaacaagttcttgc

SEQ ID NO: 156302 - DNA, 25 bp, Mus musculus
agagggtgtgagtacaagttcttgc

SEQ ID NO: 156303 - DNA, 25 bp, Mus musculus
agagggtgtgtgacgcccatgtcca

SEQ ID NO: 156304 - DNA, 25 bp, Mus musculus
agagggtgtgtgtcgcccatgtcca

SEQ ID NO: 156305 - DNA, 25 bp, Mus musculus
agagggttcattcctcaagctgggc

SEQ ID NO: 156306 - DNA, 25 bp, Mus musculus
agagggttcattgctcaagctgggc

SEQ ID NO: 156307 - DNA, 25 bp, Mus musculus
agagggttcccacacttatccaact

SEQ ID NO: 156308 - DNA, 25 bp, Mus musculus
agagggttcccacagatgctggaca

SEQ ID NO: 156309 - DNA, 25 bp, Mus musculus
agagggttcccagacttatccaact

SEQ ID NO: 156310 - DNA, 25 bp, Mus musculus
agagggttcccagagatgctggaca

SEQ ID NO: 156311 - DNA, 25 bp, Mus musculus
agagggttccttcctggcagctatt

SEQ ID NO: 156312 - DNA, 25 bp, Mus musculus
agagggttccttgctggcagctatt

SEQ ID NO: 156313 - DNA, 25 bp, Mus musculus
agagggttgagcaccagcagacaga

SEQ ID NO: 156314 - DNA, 25 bp, Mus musculus
agagggttgagctccagcagacaga

SEQ ID NO: 156315 - DNA, 25 bp, Mus musculus
agagggttgcccatatactacgcca

SEQ ID NO: 156316 - DNA, 25 bp, Mus musculus
agagggttgcccttatactacgcca

SEQ ID NO: 156317 - DNA, 25 bp, Mus musculus
agagggttggagctccacctgccct

SEQ ID NO: 156318 - DNA, 25 bp, Mus musculus
agagggttggaggtccacctgccct

SEQ ID NO: 156319 - DNA, 25 bp, Mus musculus
agagggtttacaccacgggcactat

SEQ ID NO: 156320 - DNA, 25 bp, Mus musculus
agagggtttacagcacgggcactat

SEQ ID NO: 156321 - DNA, 25 bp, Mus musculus
agagggtttattagcttgacacttc

SEQ ID NO: 156322 - DNA, 25 bp, Mus musculus
agagggtttatttgcttgacacttc

SEQ ID NO: 156323 - DNA, 25 bp, Mus musculus
agagggtttccacatttgtgagcca

SEQ ID NO: 156324 - DNA, 25 bp, Mus musculus
agagggtttccagatttgtgagcca

SEQ ID NO: 156325 - DNA, 25 bp, Mus musculus
agagggtttcctctctgaactgtgt

SEQ ID NO: 156326 - DNA, 25 bp, Mus musculus
agagggtttcctgtctgaactgtgt

SEQ ID NO: 156327 - DNA, 25 bp, Mus musculus
agagggtttctacatatgctgcttc

SEQ ID NO: 156328 - DNA, 25 bp, Mus musculus
agagggtttctagatatgctgcttc

SEQ ID NO: 156329 - DNA, 25 bp, Mus musculus
agagggtttggcacttccacatcaa

SEQ ID NO: 156330 - DNA, 25 bp, Mus musculus
agagggtttggctcttccacatcaa

SEQ ID NO: 156331 - DNA, 25 bp, Mus musculus
agagggttttaacccacatgtaagt

SEQ ID NO: 156332 - DNA, 25 bp, Mus musculus
agagggttttaagccacatgtaagt

SEQ ID NO: 156333 - DNA, 25 bp, Mus musculus
agagggttttgtcacattggccttc

SEQ ID NO: 156334 - DNA, 25 bp, Mus musculus
agagggttttgtgacattggccttc

SEQ ID NO: 156335 - DNA, 25 bp, Mus musculus
agaggtaaactcagccgacacctga

SEQ ID NO: 156336 - DNA, 25 bp, Mus musculus
agaggtaaactcctgggcctgtagc

SEQ ID NO: 156337 - DNA, 25 bp, Mus musculus
agaggtaaactcgtgggcctgtagc

SEQ ID NO: 156338 - DNA, 25 bp, Mus musculus
agaggtaaactctgccgacacctga

SEQ ID NO: 156339 - DNA, 25 bp, Mus musculus
agaggtaacagacacctcccagtgt

SEQ ID NO: 156340 - DNA, 25 bp, Mus musculus
agaggtaacagagacctcccagtgt

SEQ ID NO: 156341 - DNA, 25 bp, Mus musculus
agaggtaacccacgtcagcgggctt

SEQ ID NO: 156342 - DNA, 25 bp, Mus musculus
agaggtaacccaggtcagcgggctt

SEQ ID NO: 156343 - DNA, 25 bp, Mus musculus
agaggtaagtcactggtgcccagct

SEQ ID NO: 156344 - DNA, 25 bp, Mus musculus
agaggtaagtcagtggtgcccagct

SEQ ID NO: 156345 - DNA, 25 bp, Mus musculus
agaggtaagttccagagtccctctg

SEQ ID NO: 156346 - DNA, 25 bp, Mus musculus
agaggtaagttcgagagtccctctg

SEQ ID NO: 156347 - DNA, 25 bp, Mus musculus
agaggtacactgatccctttgtttg

SEQ ID NO: 156348 - DNA, 25 bp, Mus musculus
agaggtacactgttccctttgtttg

SEQ ID NO: 156349 - DNA, 25 bp, Mus musculus
agaggtacagtgctgagtctcctgc

SEQ ID NO: 156350 - DNA, 25 bp, Mus musculus
agaggtacagtggtgagtctcctgc

SEQ ID NO: 156351 - DNA, 25 bp, Mus musculus
agaggtacatggaatggcccagcca

SEQ ID NO: 156352 - DNA, 25 bp, Mus musculus
agaggtacatggtatggcccagcca

SEQ ID NO: 156353 - DNA, 25 bp, Mus musculus
agaggtaccaccacagcagggatcc

SEQ ID NO: 156354 - DNA, 25 bp, Mus musculus
agaggtaccacctcagcagggatcc

SEQ ID NO: 156355 - DNA, 25 bp, Mus musculus
agaggtaccagacagtccccagtgt

SEQ ID NO: 156356 - DNA, 25 bp, Mus musculus
agaggtaccagagagtccccagtgt

SEQ ID NO: 156357 - DNA, 25 bp, Mus musculus
agaggtacccctcagatccaggctg

SEQ ID NO: 156358 - DNA, 25 bp, Mus musculus
agaggtacccctgagatccaggctg

SEQ ID NO: 156359 - DNA, 25 bp, Mus musculus
agaggtaccgacatgttccctatgg

SEQ ID NO: 156360 - DNA, 25 bp, Mus musculus
agaggtaccgacttgttccctatgg

SEQ ID NO: 156361 - DNA, 25 bp, Mus musculus
agaggtacctacagtaaatcaggaa

SEQ ID NO: 156362 - DNA, 25 bp, Mus musculus
agaggtacctactgtaaatcaggaa

SEQ ID NO: 156363 - DNA, 25 bp, Mus musculus
agaggtacctggaaggcatccacag

SEQ ID NO: 156364 - DNA, 25 bp, Mus musculus
agaggtacctggtaggcatccacag

SEQ ID NO: 156365 - DNA, 25 bp, Mus musculus
agaggtacgcacctggaaccctccg

SEQ ID NO: 156366 - DNA, 25 bp, Mus musculus
agaggtacgcacgtggaaccctccg

SEQ ID NO: 156367 - DNA, 25 bp, Mus musculus
agaggtactagaacgcttatggcca

SEQ ID NO: 156368 - DNA, 25 bp, Mus musculus
agaggtactagatcgcttatggcca

SEQ ID NO: 156369 - DNA, 25 bp, Mus musculus
agaggtactctcatctcccggtgag

SEQ ID NO: 156370 - DNA, 25 bp, Mus musculus
agaggtactctcttctcccggtgag

SEQ ID NO: 156371 - DNA, 25 bp, Mus musculus
agaggtacttctaactgctcagttt

SEQ ID NO: 156372 - DNA, 25 bp, Mus musculus
agaggtacttcttactgctcagttt

SEQ ID NO: 156373 - DNA, 25 bp, Mus musculus
agaggtagacatccattgctgccga

SEQ ID NO: 156374 - DNA, 25 bp, Mus musculus
agaggtagacatgcattgctgccga

SEQ ID NO: 156375 - DNA, 25 bp, Mus musculus
agaggtagactccatcctttacaga

SEQ ID NO: 156376 - DNA, 25 bp, Mus musculus
agaggtagactcgatcctttacaga

SEQ ID NO: 156377 - DNA, 25 bp, Mus musculus
agaggtagagcccaggtccatcagc

SEQ ID NO: 156378 - DNA, 25 bp, Mus musculus
agaggtagagccgaggtccatcagc

SEQ ID NO: 156379 - DNA, 25 bp, Mus musculus
agaggtagcaacagctgggctcact

SEQ ID NO: 156380 - DNA, 25 bp, Mus musculus
agaggtagcaactgctgggctcact

SEQ ID NO: 156381 - DNA, 25 bp, Mus musculus
agaggtagctctccgtgcatgtaag

SEQ ID NO: 156382 - DNA, 25 bp, Mus musculus
agaggtagctctgcgtgcatgtaag

SEQ ID NO: 156383 - DNA, 25 bp, Mus musculus
agaggtaggacgcctgcccaccatg

SEQ ID NO: 156384 - DNA, 25 bp, Mus musculus
agaggtaggacggctgcccaccatg

SEQ ID NO: 156385 - DNA, 25 bp, Mus musculus
agaggtagtcatagccatgcgtccg

SEQ ID NO: 156386 - DNA, 25 bp, Mus musculus
agaggtagtcattgccatgcgtccg

SEQ ID NO: 156387 - DNA, 25 bp, Mus musculus
agaggtagtgagctccttcccagag

SEQ ID NO: 156388 - DNA, 25 bp, Mus musculus
agaggtagtgaggtccttcccagag

SEQ ID NO: 156389 - DNA, 25 bp, Mus musculus
agaggtagttacagttgcccttcga

SEQ ID NO: 156390 - DNA, 25 bp, Mus musculus
agaggtagttactgttgcccttcga

SEQ ID NO: 156391 - DNA, 25 bp, Mus musculus
agaggtatacacacactctgctttc

SEQ ID NO: 156392 - DNA, 25 bp, Mus musculus
agaggtatacactcactctgctttc

SEQ ID NO: 156393 - DNA, 25 bp, Mus musculus
agaggtatacatcaagagctggtga

SEQ ID NO: 156394 - DNA, 25 bp, Mus musculus
agaggtatacatgaagagctggtga

SEQ ID NO: 156395 - DNA, 25 bp, Mus musculus
agaggtatagctccattgtatgtca

SEQ ID NO: 156396 - DNA, 25 bp, Mus musculus
agaggtatagctgcattgtatgtca

SEQ ID NO: 156397 - DNA, 25 bp, Mus musculus
agaggtatatggagctgacatcagc

SEQ ID NO: 156398 - DNA, 25 bp, Mus musculus
agaggtatatggtgctgacatcagc

SEQ ID NO: 156399 - DNA, 25 bp, Mus musculus
agaggtatctcaactaatagggctc

SEQ ID NO: 156400 - DNA, 25 bp, Mus musculus
agaggtatctcatctaatagggctc

SEQ ID NO: 156401 - DNA, 25 bp, Mus musculus
agaggtatctgtcggtttgcaaaag

SEQ ID NO: 156402 - DNA, 25 bp, Mus musculus
agaggtatctgtgggtttgcaaaag

SEQ ID NO: 156403 - DNA, 25 bp, Mus musculus
agaggtatgcaaccttgcctttacc

SEQ ID NO: 156404 - DNA, 25 bp, Mus musculus
agaggtatgcaagcttgcctttacc

SEQ ID NO: 156405 - DNA, 25 bp, Mus musculus
agaggtatgggtaacagaggcaaaa

SEQ ID NO: 156406 - DNA, 25 bp, Mus musculus
agaggtatgggttacagaggcaaaa

SEQ ID NO: 156407 - DNA, 25 bp, Mus musculus
agaggtattgagaacgtttccaaca

SEQ ID NO: 156408 - DNA, 25 bp, Mus musculus
agaggtattgagtacgtttccaaca

SEQ ID NO: 156409 - DNA, 25 bp, Mus musculus
agaggtattggcacctcccagagtt

SEQ ID NO: 156410 - DNA, 25 bp, Mus musculus
agaggtattggctcctcccagagtt

SEQ ID NO: 156411 - DNA, 25 bp, Mus musculus
agaggtattgtcatccgtatgacta

SEQ ID NO: 156412 - DNA, 25 bp, Mus musculus
agaggtattgtcttccgtatgacta

SEQ ID NO: 156413 - DNA, 25 bp, Mus musculus
agaggtcaactcagcaagccagcta

SEQ ID NO: 156414 - DNA, 25 bp, Mus musculus
agaggtcaactcagtgggcttcctg

SEQ ID NO: 156415 - DNA, 25 bp, Mus musculus
agaggtcaactctgcaagccagcta

SEQ ID NO: 156416 - DNA, 25 bp, Mus musculus
agaggtcaactctgtgggcttcctg

SEQ ID NO: 156417 - DNA, 25 bp, Mus musculus
agaggtcaagtacggtttccactgg

SEQ ID NO: 156418 - DNA, 25 bp, Mus musculus
agaggtcaagtagggtttccactgg

SEQ ID NO: 156419 - DNA, 25 bp, Mus musculus
agaggtcacaagacagtctgaagca

SEQ ID NO: 156420 - DNA, 25 bp, Mus musculus
agaggtcacaagtcagtctgaagca

SEQ ID NO: 156421 - DNA, 25 bp, Mus musculus
agaggtcacagccttccagcggttg

SEQ ID NO: 156422 - DNA, 25 bp, Mus musculus
agaggtcacagcgttccagcggttg

SEQ ID NO: 156423 - DNA, 25 bp, Mus musculus
agaggtcacagtcgcgactgctcaa

SEQ ID NO: 156424 - DNA, 25 bp, Mus musculus
agaggtcacagtggcgactgctcaa

SEQ ID NO: 156425 - DNA, 25 bp, Mus musculus
agaggtcacatcaactactgtcgaa

SEQ ID NO: 156426 - DNA, 25 bp, Mus musculus
agaggtcacatcagagccgttttca

SEQ ID NO: 156427 - DNA, 25 bp, Mus musculus
agaggtcacatctactactgtcgaa

SEQ ID NO: 156428 - DNA, 25 bp, Mus musculus
agaggtcacatctgagccgttttca

SEQ ID NO: 156429 - DNA, 25 bp, Mus musculus
agaggtcaccagaagggctccttag

SEQ ID NO: 156430 - DNA, 25 bp, Mus musculus
agaggtcaccagtagggctccttag

SEQ ID NO: 156431 - DNA, 25 bp, Mus musculus
agaggtcacctacggcatggtcgcc

SEQ ID NO: 156432 - DNA, 25 bp, Mus musculus
agaggtcacctagggcatggtcgcc

SEQ ID NO: 156433 - DNA, 25 bp, Mus musculus
agaggtcacgggagtcagtctccct

SEQ ID NO: 156434 - DNA, 25 bp, Mus musculus
agaggtcacgggtgtcagtctccct

SEQ ID NO: 156435 - DNA, 25 bp, Mus musculus
agaggtcacgttcttcttagcagag

SEQ ID NO: 156436 - DNA, 25 bp, Mus musculus
agaggtcacgttgttcttagcagag

SEQ ID NO: 156437 - DNA, 25 bp, Mus musculus
agaggtcaggacagcttttctaggt

SEQ ID NO: 156438 - DNA, 25 bp, Mus musculus
agaggtcaggaccatctttcatgct

SEQ ID NO: 156439 - DNA, 25 bp, Mus musculus
agaggtcaggacgatctttcatgct

SEQ ID NO: 156440 - DNA, 25 bp, Mus musculus
agaggtcaggactgcttttctaggt

SEQ ID NO: 156441 - DNA, 25 bp, Mus musculus
agaggtcaggctccacccaaccagt

SEQ ID NO: 156442 - DNA, 25 bp, Mus musculus
agaggtcaggctgcacccaaccagt

SEQ ID NO: 156443 - DNA, 25 bp, Mus musculus
agaggtcagggtctggtcccatctc

SEQ ID NO: 156444 - DNA, 25 bp, Mus musculus
agaggtcagggtgtggtcccatctc

SEQ ID NO: 156445 - DNA, 25 bp, Mus musculus
agaggtcatcataatctgtacataa

SEQ ID NO: 156446 - DNA, 25 bp, Mus musculus
agaggtcatcattatctgtacataa

SEQ ID NO: 156447 - DNA, 25 bp, Mus musculus
agaggtcatgcgctcccattaatgt

SEQ ID NO: 156448 - DNA, 25 bp, Mus musculus
agaggtcatgcggtcccattaatgt

SEQ ID NO: 156449 - DNA, 25 bp, Mus musculus
agaggtcatgtcctccttgtaccca

SEQ ID NO: 156450 - DNA, 25 bp, Mus musculus
agaggtcatgtcgtccttgtaccca

SEQ ID NO: 156451 - DNA, 25 bp, Mus musculus
agaggtcattgcaagaatcgtggat

SEQ ID NO: 156452 - DNA, 25 bp, Mus musculus
agaggtcattgctagaatcgtggat

SEQ ID NO: 156453 - DNA, 25 bp, Mus musculus
agaggtccaagtaagccagcccgtg

SEQ ID NO: 156454 - DNA, 25 bp, Mus musculus
agaggtccaagttagccagcccgtg

SEQ ID NO: 156455 - DNA, 25 bp, Mus musculus
agaggtccacttaagggcaggctgc

SEQ ID NO: 156456 - DNA, 25 bp, Mus musculus
agaggtccactttagggcaggctgc

SEQ ID NO: 156457 - DNA, 25 bp, Mus musculus
agaggtccagaccattctttgagtc

SEQ ID NO: 156458 - DNA, 25 bp, Mus musculus
agaggtccagacgattctttgagtc

SEQ ID NO: 156459 - DNA, 25 bp, Mus musculus
agaggtccagtcacaccaacaagaa

SEQ ID NO: 156460 - DNA, 25 bp, Mus musculus
agaggtccagtctcaccaacaagaa

SEQ ID NO: 156461 - DNA, 25 bp, Mus musculus
agaggtccatcaaagtcaagggtca

SEQ ID NO: 156462 - DNA, 25 bp, Mus musculus
agaggtccatcatagtcaagggtca

SEQ ID NO: 156463 - DNA, 25 bp, Mus musculus
agaggtcccaatctcatcgtcgtaa

SEQ ID NO: 156464 - DNA, 25 bp, Mus musculus
agaggtcccaatgtcatcgtcgtaa

SEQ ID NO: 156465 - DNA, 25 bp, Mus musculus
agaggtcccaccagacgcagcatca

SEQ ID NO: 156466 - DNA, 25 bp, Mus musculus
agaggtcccacctgacgcagcatca

SEQ ID NO: 156467 - DNA, 25 bp, Mus musculus
agaggtcccagtatgaaatcctcaa

SEQ ID NO: 156468 - DNA, 25 bp, Mus musculus
agaggtcccagtttgaaatcctcaa

SEQ ID NO: 156469 - DNA, 25 bp, Mus musculus
agaggtcccatgaccttggcagtgt

SEQ ID NO: 156470 - DNA, 25 bp, Mus musculus
agaggtcccatgtccttggcagtgt

SEQ ID NO: 156471 - DNA, 25 bp, Mus musculus
agaggtcccctccagatagcaagag

SEQ ID NO: 156472 - DNA, 25 bp, Mus musculus
agaggtcccctcgagatagcaagag

SEQ ID NO: 156473 - DNA, 25 bp, Mus musculus
agaggtcccgaacttgggctcactt

SEQ ID NO: 156474 - DNA, 25 bp, Mus musculus
agaggtcccgaagttgggctcactt

SEQ ID NO: 156475 - DNA, 25 bp, Mus musculus
agaggtccctgtccctgatgataag

SEQ ID NO: 156476 - DNA, 25 bp, Mus musculus
agaggtccctgtgcctgatgataag

SEQ ID NO: 156477 - DNA, 25 bp, Mus musculus
agaggtcccttacagtttagatgcc

SEQ ID NO: 156478 - DNA, 25 bp, Mus musculus
agaggtcccttagagtttagatgcc

SEQ ID NO: 156479 - DNA, 25 bp, Mus musculus
agaggtcctaacaacccactaggtg

SEQ ID NO: 156480 - DNA, 25 bp, Mus musculus
agaggtcctaactacccactaggtg

SEQ ID NO: 156481 - DNA, 25 bp, Mus musculus
agaggtcctataccctccctgaaag

SEQ ID NO: 156482 - DNA, 25 bp, Mus musculus
agaggtcctatagcctccctgaaag

SEQ ID NO: 156483 - DNA, 25 bp, Mus musculus
agaggtcctgaccagattggctgca

SEQ ID NO: 156484 - DNA, 25 bp, Mus musculus
agaggtcctgacgagattggctgca

SEQ ID NO: 156485 - DNA, 25 bp, Mus musculus
agaggtcctggtctcagacagaacc

SEQ ID NO: 156486 - DNA, 25 bp, Mus musculus
agaggtcctggtgtcagacagaacc

SEQ ID NO: 156487 - DNA, 25 bp, Mus musculus
agaggtcgatgaactggtacttcag

SEQ ID NO: 156488 - DNA, 25 bp, Mus musculus
agaggtcgatgatctggtacttcag

SEQ ID NO: 156489 - DNA, 25 bp, Mus musculus
agaggtcgccgaagtgccaggaata

SEQ ID NO: 156490 - DNA, 25 bp, Mus musculus
agaggtcgccgatgtgccaggaata

SEQ ID NO: 156491 - DNA, 25 bp, Mus musculus
agaggtcggcaacctactgtctgca

SEQ ID NO: 156492 - DNA, 25 bp, Mus musculus
agaggtcggcaagctactgtctgca

SEQ ID NO: 156493 - DNA, 25 bp, Mus musculus
agaggtcggcacataacttaccact

SEQ ID NO: 156494 - DNA, 25 bp, Mus musculus
agaggtcggcacttaacttaccact

SEQ ID NO: 156495 - DNA, 25 bp, Mus musculus
agaggtctaaagcagtacaagtatt

SEQ ID NO: 156496 - DNA, 25 bp, Mus musculus
agaggtctaaaggagtacaagtatt

SEQ ID NO: 156497 - DNA, 25 bp, Mus musculus
agaggtctataacccaggtctcttg

SEQ ID NO: 156498 - DNA, 25 bp, Mus musculus
agaggtctataagccaggtctcttg

SEQ ID NO: 156499 - DNA, 25 bp, Mus musculus
agaggtctcagaaccctaaggtgat

SEQ ID NO: 156500 - DNA, 25 bp, Mus musculus
agaggtctcagacttgatccgcagt

SEQ ID NO: 156501 - DNA, 25 bp, Mus musculus
agaggtctcagagttgatccgcagt

SEQ ID NO: 156502 - DNA, 25 bp, Mus musculus
agaggtctcagatccctaaggtgat

SEQ ID NO: 156503 - DNA, 25 bp, Mus musculus
agaggtctccaaatgacaccccaag

SEQ ID NO: 156504 - DNA, 25 bp, Mus musculus
agaggtctccaattgacaccccaag

SEQ ID NO: 156505 - DNA, 25 bp, Mus musculus
agaggtctccatatggctccaggtc

SEQ ID NO: 156506 - DNA, 25 bp, Mus musculus
agaggtctccatttggctccaggtc

SEQ ID NO: 156507 - DNA, 25 bp, Mus musculus
agaggtctcccaagctctccagggc

SEQ ID NO: 156508 - DNA, 25 bp, Mus musculus
agaggtctcccatgctctccagggc

SEQ ID NO: 156509 - DNA, 25 bp, Mus musculus
agaggtctcctaacattatcaattg

SEQ ID NO: 156510 - DNA, 25 bp, Mus musculus
agaggtctcctatcattatcaattg

SEQ ID NO: 156511 - DNA, 25 bp, Mus musculus
agaggtctctaacccaacagcctag

SEQ ID NO: 156512 - DNA, 25 bp, Mus musculus
agaggtctctaacctggagtctccg

SEQ ID NO: 156513 - DNA, 25 bp, Mus musculus
agaggtctctaagccaacagcctag

SEQ ID NO: 156514 - DNA, 25 bp, Mus musculus
agaggtctctaagctggagtctccg

SEQ ID NO: 156515 - DNA, 25 bp, Mus musculus
agaggtctctctcgaaccccaagga

SEQ ID NO: 156516 - DNA, 25 bp, Mus musculus
agaggtctctctggaaccccaagga

SEQ ID NO: 156517 - DNA, 25 bp, Mus musculus
agaggtctctgactccaccacaggc

SEQ ID NO: 156518 - DNA, 25 bp, Mus musculus
agaggtctctgagtccaccacaggc

SEQ ID NO: 156519 - DNA, 25 bp, Mus musculus
agaggtctgctcatcatactgttac

SEQ ID NO: 156520 - DNA, 25 bp, Mus musculus
agaggtctgctcttcatactgttac

SEQ ID NO: 156521 - DNA, 25 bp, Mus musculus
agaggtctgctgaacgagctacttt

SEQ ID NO: 156522 - DNA, 25 bp, Mus musculus
agaggtctgctgtacgagctacttt

SEQ ID NO: 156523 - DNA, 25 bp, Mus musculus
agaggtctgggaaaacatattacat

SEQ ID NO: 156524 - DNA, 25 bp, Mus musculus
agaggtctgggataacatattacat

SEQ ID NO: 156525 - DNA, 25 bp, Mus musculus
agaggtcttaatagacatcacagaa

SEQ ID NO: 156526 - DNA, 25 bp, Mus musculus
agaggtcttaattgacatcacagaa

SEQ ID NO: 156527 - DNA, 25 bp, Mus musculus
agaggtcttagtaacagccacccgg

SEQ ID NO: 156528 - DNA, 25 bp, Mus musculus
agaggtcttagttacagccacccgg

SEQ ID NO: 156529 - DNA, 25 bp, Mus musculus
agaggtcttgaaactcctggaattg

SEQ ID NO: 156530 - DNA, 25 bp, Mus musculus
agaggtcttgaatctcctggaattg

SEQ ID NO: 156531 - DNA, 25 bp, Mus musculus
agaggtcttgacagtgaggtgccat

SEQ ID NO: 156532 - DNA, 25 bp, Mus musculus
agaggtcttgactgtgaggtgccat

SEQ ID NO: 156533 - DNA, 25 bp, Mus musculus
agaggtcttggtacacatcggatac

SEQ ID NO: 156534 - DNA, 25 bp, Mus musculus
agaggtcttggttcacatcggatac

SEQ ID NO: 156535 - DNA, 25 bp, Mus musculus
agaggtgacaggctatgctccccat

SEQ ID NO: 156536 - DNA, 25 bp, Mus musculus
agaggtgacagggtatgctccccat

SEQ ID NO: 156537 - DNA, 25 bp, Mus musculus
agaggtgacagtccaagtgcctcag

SEQ ID NO: 156538 - DNA, 25 bp, Mus musculus
agaggtgacagtgcaagtgcctcag

SEQ ID NO: 156539 - DNA, 25 bp, Mus musculus
agaggtgaccagagcgctgtcctca

SEQ ID NO: 156540 - DNA, 25 bp, Mus musculus
agaggtgaccagtgcgctgtcctca

SEQ ID NO: 156541 - DNA, 25 bp, Mus musculus
agaggtgaccccacctgtgggaaga

SEQ ID NO: 156542 - DNA, 25 bp, Mus musculus
agaggtgacccctcctgtgggaaga

SEQ ID NO: 156543 - DNA, 25 bp, Mus musculus
agaggtgacctgaatcccaacagca

SEQ ID NO: 156544 - DNA, 25 bp, Mus musculus
agaggtgacctgtatcccaacagca

SEQ ID NO: 156545 - DNA, 25 bp, Mus musculus
agaggtgagactacccagaaggctt

SEQ ID NO: 156546 - DNA, 25 bp, Mus musculus
agaggtgagacttcccagaaggctt

SEQ ID NO: 156547 - DNA, 25 bp, Mus musculus
agaggtgagagtcgctttattaaag

SEQ ID NO: 156548 - DNA, 25 bp, Mus musculus
agaggtgagagtggctttattaaag

SEQ ID NO: 156549 - DNA, 25 bp, Mus musculus
agaggtgagattcccatccgagtgt

SEQ ID NO: 156550 - DNA, 25 bp, Mus musculus
agaggtgagattgccatccgagtgt

SEQ ID NO: 156551 - DNA, 25 bp, Mus musculus
agaggtgagcctaagttactcagca

SEQ ID NO: 156552 - DNA, 25 bp, Mus musculus
agaggtgagccttagttactcagca

SEQ ID NO: 156553 - DNA, 25 bp, Mus musculus
agaggtgaggacctgctcttctcta

SEQ ID NO: 156554 - DNA, 25 bp, Mus musculus
agaggtgaggacgtgctcttctcta

SEQ ID NO: 156555 - DNA, 25 bp, Mus musculus
agaggtgagggtccacgtcttccct

SEQ ID NO: 156556 - DNA, 25 bp, Mus musculus
agaggtgagggtgcacgtcttccct

SEQ ID NO: 156557 - DNA, 25 bp, Mus musculus
agaggtgagtctagcttccctcaag

SEQ ID NO: 156558 - DNA, 25 bp, Mus musculus
agaggtgagtcttgcttccctcaag

SEQ ID NO: 156559 - DNA, 25 bp, Mus musculus
agaggtgataaacatgcccagctaa

SEQ ID NO: 156560 - DNA, 25 bp, Mus musculus
agaggtgataaagatgcccagctaa

SEQ ID NO: 156561 - DNA, 25 bp, Mus musculus
agaggtgcaaagaggccttcgtcag

SEQ ID NO: 156562 - DNA, 25 bp, Mus musculus
agaggtgcaaagtggccttcgtcag

SEQ ID NO: 156563 - DNA, 25 bp, Mus musculus
agaggtgcaactcgccatcgagcag

SEQ ID NO: 156564 - DNA, 25 bp, Mus musculus
agaggtgcaactggccatcgagcag

SEQ ID NO: 156565 - DNA, 25 bp, Mus musculus
agaggtgcacatacaactcagtttg

SEQ ID NO: 156566 - DNA, 25 bp, Mus musculus
agaggtgcacatacgagtcgcttca

SEQ ID NO: 156567 - DNA, 25 bp, Mus musculus
agaggtgcacattcaactcagtttg

SEQ ID NO: 156568 - DNA, 25 bp, Mus musculus
agaggtgcacattcgagtcgcttca

SEQ ID NO: 156569 - DNA, 25 bp, Mus musculus
agaggtgcactcacaccagtgtgaa

SEQ ID NO: 156570 - DNA, 25 bp, Mus musculus
agaggtgcactcagacataattagt

SEQ ID NO: 156571 - DNA, 25 bp, Mus musculus
agaggtgcactctcaccagtgtgaa

SEQ ID NO: 156572 - DNA, 25 bp, Mus musculus
agaggtgcactctgacataattagt

SEQ ID NO: 156573 - DNA, 25 bp, Mus musculus
agaggtgcccagaggtccttggaat

SEQ ID NO: 156574 - DNA, 25 bp, Mus musculus
agaggtgcccagtggtccttggaat

SEQ ID NO: 156575 - DNA, 25 bp, Mus musculus
agaggtgcctgtaacgaaccacttc

SEQ ID NO: 156576 - DNA, 25 bp, Mus musculus
agaggtgcctgttacgaaccacttc

SEQ ID NO: 156577 - DNA, 25 bp, Mus musculus
agaggtgcctttagtatccccaaat

SEQ ID NO: 156578 - DNA, 25 bp, Mus musculus
agaggtgccttttgtatccccaaat

SEQ ID NO: 156579 - DNA, 25 bp, Mus musculus
agaggtgcgctcagttctctgtggc

SEQ ID NO: 156580 - DNA, 25 bp, Mus musculus
agaggtgcgctctgttctctgtggc

SEQ ID NO: 156581 - DNA, 25 bp, Mus musculus
agaggtgctctccagctattaggaa

SEQ ID NO: 156582 - DNA, 25 bp, Mus musculus
agaggtgctctcgagctattaggaa

SEQ ID NO: 156583 - DNA, 25 bp, Mus musculus
agaggtgctggtcgttaactcccaa

SEQ ID NO: 156584 - DNA, 25 bp, Mus musculus
agaggtgctggtggttaactcccaa

SEQ ID NO: 156585 - DNA, 25 bp, Mus musculus
agaggtgctgtcatgtgtcttgctc

SEQ ID NO: 156586 - DNA, 25 bp, Mus musculus
agaggtgctgtcttgtgtcttgctc

SEQ ID NO: 156587 - DNA, 25 bp, Mus musculus
agaggtgcttcacctttcacaacag

SEQ ID NO: 156588 - DNA, 25 bp, Mus musculus
agaggtgcttcagctttcacaacag

SEQ ID NO: 156589 - DNA, 25 bp, Mus musculus
agaggtggacccaggttcattccaa

SEQ ID NO: 156590 - DNA, 25 bp, Mus musculus
agaggtggaccctggttcattccaa

SEQ ID NO: 156591 - DNA, 25 bp, Mus musculus
agaggtggcacgagatcctgatcat

SEQ ID NO: 156592 - DNA, 25 bp, Mus musculus
agaggtggcacgtgatcctgatcat

SEQ ID NO: 156593 - DNA, 25 bp, Mus musculus
agaggtggcataagaccaacagaaa

SEQ ID NO: 156594 - DNA, 25 bp, Mus musculus
agaggtggcatatgaccaacagaaa

SEQ ID NO: 156595 - DNA, 25 bp, Mus musculus
agaggtggccacagcagaaaacgag

SEQ ID NO: 156596 - DNA, 25 bp, Mus musculus
agaggtggccactgcagaaaacgag

SEQ ID NO: 156597 - DNA, 25 bp, Mus musculus
agaggtggcccgaaagctggtcatc

SEQ ID NO: 156598 - DNA, 25 bp, Mus musculus
agaggtggcccgtaagctggtcatc

SEQ ID NO: 156599 - DNA, 25 bp, Mus musculus
agaggtggccctagtttacagtgag

SEQ ID NO: 156600 - DNA, 25 bp, Mus musculus
agaggtggcccttgtttacagtgag

SEQ ID NO: 156601 - DNA, 25 bp, Mus musculus
agaggtggcctgatcaggtgctaca

SEQ ID NO: 156602 - DNA, 25 bp, Mus musculus
agaggtggcctgttcaggtgctaca

SEQ ID NO: 156603 - DNA, 25 bp, Mus musculus
agaggtggccttagccaaacagtca

SEQ ID NO: 156604 - DNA, 25 bp, Mus musculus
agaggtggcctttgccaaacagtca

SEQ ID NO: 156605 - DNA, 25 bp, Mus musculus
agaggtggcgaacgtgtactgagtg

SEQ ID NO: 156606 - DNA, 25 bp, Mus musculus
agaggtggcgaaggtgtactgagtg

SEQ ID NO: 156607 - DNA, 25 bp, Mus musculus
agaggtggcgcacaatcccactcaa

SEQ ID NO: 156608 - DNA, 25 bp, Mus musculus
agaggtggcgcagaatcccactcaa

SEQ ID NO: 156609 - DNA, 25 bp, Mus musculus
agaggtggctggctttctttgtacc

SEQ ID NO: 156610 - DNA, 25 bp, Mus musculus
agaggtggctgggtttctttgtacc

SEQ ID NO: 156611 - DNA, 25 bp, Mus musculus
agaggtgggagcaacactcattctt

SEQ ID NO: 156612 - DNA, 25 bp, Mus musculus
agaggtgggagctacactcattctt

SEQ ID NO: 156613 - DNA, 25 bp, Mus musculus
agaggtgggctgaaacctacaggct

SEQ ID NO: 156614 - DNA, 25 bp, Mus musculus
agaggtgggctgtaacctacaggct

SEQ ID NO: 156615 - DNA, 25 bp, Mus musculus
agaggtgggttcaactgtttcacag

SEQ ID NO: 156616 - DNA, 25 bp, Mus musculus
agaggtgggttctactgtttcacag

SEQ ID NO: 156617 - DNA, 25 bp, Mus musculus
agaggtggtctacttttcatccctt

SEQ ID NO: 156618 - DNA, 25 bp, Mus musculus
agaggtggtctagttttcatccctt

SEQ ID NO: 156619 - DNA, 25 bp, Mus musculus
agaggtggtctcattagctccatgt

SEQ ID NO: 156620 - DNA, 25 bp, Mus musculus
agaggtggtctctttagctccatgt

SEQ ID NO: 156621 - DNA, 25 bp, Mus musculus
agaggtggtctgaaaggtcctccca

SEQ ID NO: 156622 - DNA, 25 bp, Mus musculus
agaggtggtctgtaaggtcctccca

SEQ ID NO: 156623 - DNA, 25 bp, Mus musculus
agaggtggtcttacccattttgata

SEQ ID NO: 156624 - DNA, 25 bp, Mus musculus
agaggtggtcttagcatctgcagaa

SEQ ID NO: 156625 - DNA, 25 bp, Mus musculus
agaggtggtctttcccattttgata

SEQ ID NO: 156626 - DNA, 25 bp, Mus musculus
agaggtggtctttgcatctgcagaa

SEQ ID NO: 156627 - DNA, 25 bp, Mus musculus
agaggtggtgacactagtcagcccc

SEQ ID NO: 156628 - DNA, 25 bp, Mus musculus
agaggtggtgactctagtcagcccc

SEQ ID NO: 156629 - DNA, 25 bp, Mus musculus
agaggtggtggtcctttggtctcag

SEQ ID NO: 156630 - DNA, 25 bp, Mus musculus
agaggtggtggtgctttggtctcag

SEQ ID NO: 156631 - DNA, 25 bp, Mus musculus
agaggtgtacagactttctaaaaca

SEQ ID NO: 156632 - DNA, 25 bp, Mus musculus
agaggtgtacagtctttctaaaaca

SEQ ID NO: 156633 - DNA, 25 bp, Mus musculus
agaggtgtactcagcctggatacag

SEQ ID NO: 156634 - DNA, 25 bp, Mus musculus
agaggtgtactctgcctggatacag

SEQ ID NO: 156635 - DNA, 25 bp, Mus musculus
agaggtgtccctaaagcttcaatgg

SEQ ID NO: 156636 - DNA, 25 bp, Mus musculus
agaggtgtcccttaagcttcaatgg

SEQ ID NO: 156637 - DNA, 25 bp, Mus musculus
agaggtgtccgcaggaactcctcct

SEQ ID NO: 156638 - DNA, 25 bp, Mus musculus
agaggtgtccgctggaactcctcct

SEQ ID NO: 156639 - DNA, 25 bp, Mus musculus
agaggtgtccttctacagcgtgaac

SEQ ID NO: 156640 - DNA, 25 bp, Mus musculus
agaggtgtccttgtacagcgtgaac

SEQ ID NO: 156641 - DNA, 25 bp, Mus musculus
agaggtgtctatattcatactgtgg

SEQ ID NO: 156642 - DNA, 25 bp, Mus musculus
agaggtgtctattttcatactgtgg

SEQ ID NO: 156643 - DNA, 25 bp, Mus musculus
agaggtgtctccagctaggatctgc

SEQ ID NO: 156644 - DNA, 25 bp, Mus musculus
agaggtgtctcctgctaggatctgc

SEQ ID NO: 156645 - DNA, 25 bp, Mus musculus
agaggtgtctttagttcctcggtca

SEQ ID NO: 156646 - DNA, 25 bp, Mus musculus
agaggtgtcttttgttcctcggtca

SEQ ID NO: 156647 - DNA, 25 bp, Mus musculus
agaggtgtgaggaccacttggtttc

SEQ ID NO: 156648 - DNA, 25 bp, Mus musculus
agaggtgtgaggagctaccacgcct

SEQ ID NO: 156649 - DNA, 25 bp, Mus musculus
agaggtgtgaggtccacttggtttc

SEQ ID NO: 156650 - DNA, 25 bp, Mus musculus
agaggtgtgaggtgctaccacgcct

SEQ ID NO: 156651 - DNA, 25 bp, Mus musculus
agaggtgtgcgtcaccagtatccac

SEQ ID NO: 156652 - DNA, 25 bp, Mus musculus
agaggtgtgcgtgaccagtatccac

SEQ ID NO: 156653 - DNA, 25 bp, Mus musculus
agaggtgtgctgcttccttcctcgg

SEQ ID NO: 156654 - DNA, 25 bp, Mus musculus
agaggtgtgctggttccttcctcgg

SEQ ID NO: 156655 - DNA, 25 bp, Mus musculus
agaggtgtgtgcctggacatactca

SEQ ID NO: 156656 - DNA, 25 bp, Mus musculus
agaggtgtgtgcgtggacatactca

SEQ ID NO: 156657 - DNA, 25 bp, Mus musculus
agaggtgttcacatgctctctttgc

SEQ ID NO: 156658 - DNA, 25 bp, Mus musculus
agaggtgttcacttgctctctttgc

SEQ ID NO: 156659 - DNA, 25 bp, Mus musculus
agaggtgttcccagccttgtgcaga

SEQ ID NO: 156660 - DNA, 25 bp, Mus musculus
agaggtgttccctgccttgtgcaga

SEQ ID NO: 156661 - DNA, 25 bp, Mus musculus
agaggtgttctccactggttctcca

SEQ ID NO: 156662 - DNA, 25 bp, Mus musculus
agaggtgttctcgactggttctcca

SEQ ID NO: 156663 - DNA, 25 bp, Mus musculus
agaggtgttgccagagtccagttcc

SEQ ID NO: 156664 - DNA, 25 bp, Mus musculus
agaggtgttgcctgagtccagttcc

SEQ ID NO: 156665 - DNA, 25 bp, Mus musculus
agaggtgtttcaacaggcagacctg

SEQ ID NO: 156666 - DNA, 25 bp, Mus musculus
agaggtgtttcatcaggcagacctg

SEQ ID NO: 156667 - DNA, 25 bp, Mus musculus
agaggttaaagcattgcatgcaaaa

SEQ ID NO: 156668 - DNA, 25 bp, Mus musculus
agaggttaaagctttgcatgcaaaa

SEQ ID NO: 156669 - DNA, 25 bp, Mus musculus
agaggttaaggcagctcgggctttc

SEQ ID NO: 156670 - DNA, 25 bp, Mus musculus
agaggttaaggctgctcgggctttc

SEQ ID NO: 156671 - DNA, 25 bp, Mus musculus
agaggttacttcatggcctctactc

SEQ ID NO: 156672 - DNA, 25 bp, Mus musculus
agaggttacttcttggcctctactc

SEQ ID NO: 156673 - DNA, 25 bp, Mus musculus
agaggttagcctatgtgctgtacta

SEQ ID NO: 156674 - DNA, 25 bp, Mus musculus
agaggttagcctcagtttgctggaa

SEQ ID NO: 156675 - DNA, 25 bp, Mus musculus
agaggttagcctgagtttgctggaa

SEQ ID NO: 156676 - DNA, 25 bp, Mus musculus
agaggttagcctttgtgctgtacta

SEQ ID NO: 156677 - DNA, 25 bp, Mus musculus
agaggttagtccagcacttgttcac

SEQ ID NO: 156678 - DNA, 25 bp, Mus musculus
agaggttagtcctgcacttgttcac

SEQ ID NO: 156679 - DNA, 25 bp, Mus musculus
agaggttcaagcacctgcaggagtt

SEQ ID NO: 156680 - DNA, 25 bp, Mus musculus
agaggttcaagctcctgcaggagtt

SEQ ID NO: 156681 - DNA, 25 bp, Mus musculus
agaggttcactcatgcagatcagaa

SEQ ID NO: 156682 - DNA, 25 bp, Mus musculus
agaggttcactcttgcagatcagaa

SEQ ID NO: 156683 - DNA, 25 bp, Mus musculus
agaggttcagaacattaactcccag

SEQ ID NO: 156684 - DNA, 25 bp, Mus musculus
agaggttcagaagattaactcccag

SEQ ID NO: 156685 - DNA, 25 bp, Mus musculus
agaggttccatgagactgggagtaa

SEQ ID NO: 156686 - DNA, 25 bp, Mus musculus
agaggttccatgtgactgggagtaa

SEQ ID NO: 156687 - DNA, 25 bp, Mus musculus
agaggttcccctacaatgttagtga

SEQ ID NO: 156688 - DNA, 25 bp, Mus musculus
agaggttccccttcaatgttagtga

SEQ ID NO: 156689 - DNA, 25 bp, Mus musculus
agaggttcccgactcacttgctatt

SEQ ID NO: 156690 - DNA, 25 bp, Mus musculus
agaggttcccgagtcacttgctatt

SEQ ID NO: 156691 - DNA, 25 bp, Mus musculus
agaggttccgatatcctgaagctac

SEQ ID NO: 156692 - DNA, 25 bp, Mus musculus
agaggttccgatttcctgaagctac

SEQ ID NO: 156693 - DNA, 25 bp, Mus musculus
agaggttccgttccctgtctgaggc

SEQ ID NO: 156694 - DNA, 25 bp, Mus musculus
agaggttccgttgcctgtctgaggc

SEQ ID NO: 156695 - DNA, 25 bp, Mus musculus
agaggttcctgcatgttcatcctat

SEQ ID NO: 156696 - DNA, 25 bp, Mus musculus
agaggttcctgccaaagaaatccaa

SEQ ID NO: 156697 - DNA, 25 bp, Mus musculus
agaggttcctgcgaaagaaatccaa

SEQ ID NO: 156698 - DNA, 25 bp, Mus musculus
agaggttcctgcttgttcatcctat

SEQ ID NO: 156699 - DNA, 25 bp, Mus musculus
agaggttcctgtcaactcaggtcag

SEQ ID NO: 156700 - DNA, 25 bp, Mus musculus
agaggttcctgtgaactcaggtcag

SEQ ID NO: 156701 - DNA, 25 bp, Mus musculus
agaggttccttcacgttgtctttgg

SEQ ID NO: 156702 - DNA, 25 bp, Mus musculus
agaggttccttcagtccaccagagg

SEQ ID NO: 156703 - DNA, 25 bp, Mus musculus
agaggttccttctcgttgtctttgg

SEQ ID NO: 156704 - DNA, 25 bp, Mus musculus
agaggttccttctgtccaccagagg

SEQ ID NO: 156705 - DNA, 25 bp, Mus musculus
agaggttctaatccacgtgcagcga

SEQ ID NO: 156706 - DNA, 25 bp, Mus musculus
agaggttctaatgcacgtgcagcga

SEQ ID NO: 156707 - DNA, 25 bp, Mus musculus
agaggttctacgcttgtcccttgtg

SEQ ID NO: 156708 - DNA, 25 bp, Mus musculus
agaggttctacggttgtcccttgtg

SEQ ID NO: 156709 - DNA, 25 bp, Mus musculus
agaggttctaggactgcacactggc

SEQ ID NO: 156710 - DNA, 25 bp, Mus musculus
agaggttctaggtctgcacactggc

SEQ ID NO: 156711 - DNA, 25 bp, Mus musculus
agaggttctagtcggctttcatttc

SEQ ID NO: 156712 - DNA, 25 bp, Mus musculus
agaggttctagtgggctttcatttc

SEQ ID NO: 156713 - DNA, 25 bp, Mus musculus
agaggttctcctaacgttctctggt

SEQ ID NO: 156714 - DNA, 25 bp, Mus musculus
agaggttctccttacgttctctggt

SEQ ID NO: 156715 - DNA, 25 bp, Mus musculus
agaggttctggcacccacgtcaaga

SEQ ID NO: 156716 - DNA, 25 bp, Mus musculus
agaggttctggctcccacgtcaaga

SEQ ID NO: 156717 - DNA, 25 bp, Mus musculus
agaggttctgggatcccctggagct

SEQ ID NO: 156718 - DNA, 25 bp, Mus musculus
agaggttctgggttcccctggagct

SEQ ID NO: 156719 - DNA, 25 bp, Mus musculus
agaggttctgtcactacttactcaa

SEQ ID NO: 156720 - DNA, 25 bp, Mus musculus
agaggttctgtctctacttactcaa

SEQ ID NO: 156721 - DNA, 25 bp, Mus musculus
agaggttgagccatacctggtccta

SEQ ID NO: 156722 - DNA, 25 bp, Mus musculus
agaggttgagccttacctggtccta

SEQ ID NO: 156723 - DNA, 25 bp, Mus musculus
agaggttgatctcgactgaaggaca

SEQ ID NO: 156724 - DNA, 25 bp, Mus musculus
agaggttgatctggactgaaggaca

SEQ ID NO: 156725 - DNA, 25 bp, Mus musculus
agaggttgccccattatgtagcttc

SEQ ID NO: 156726 - DNA, 25 bp, Mus musculus
agaggttgcccctttatgtagcttc

SEQ ID NO: 156727 - DNA, 25 bp, Mus musculus
agaggttgccctcttaagactgctc

SEQ ID NO: 156728 - DNA, 25 bp, Mus musculus
agaggttgccctgttaagactgctc

SEQ ID NO: 156729 - DNA, 25 bp, Mus musculus
agaggttgctccagactccatgatc

SEQ ID NO: 156730 - DNA, 25 bp, Mus musculus
agaggttgctcctgactccatgatc

SEQ ID NO: 156731 - DNA, 25 bp, Mus musculus
agaggttggaagatctccgctccac

SEQ ID NO: 156732 - DNA, 25 bp, Mus musculus
agaggttggaagttctccgctccac

SEQ ID NO: 156733 - DNA, 25 bp, Mus musculus
agaggttgtctcattgttgtgaact

SEQ ID NO: 156734 - DNA, 25 bp, Mus musculus
agaggttgtctctttgttgtgaact

SEQ ID NO: 156735 - DNA, 25 bp, Mus musculus
agaggttgtgtccttgctgccgtta

SEQ ID NO: 156736 - DNA, 25 bp, Mus musculus
agaggttgtgtcgttgctgccgtta

SEQ ID NO: 156737 - DNA, 25 bp, Mus musculus
agaggttgtttaaagtagctccagg

SEQ ID NO: 156738 - DNA, 25 bp, Mus musculus
agaggttgtttatagtagctccagg

SEQ ID NO: 156739 - DNA, 25 bp, Mus musculus
agaggttgtttgaaaccattggccg

SEQ ID NO: 156740 - DNA, 25 bp, Mus musculus
agaggttgtttgtaaccattggccg

SEQ ID NO: 156741 - DNA, 25 bp, Mus musculus
agaggtttaaccagtcttctctgga

SEQ ID NO: 156742 - DNA, 25 bp, Mus musculus
agaggtttaacctgtcttctctgga

SEQ ID NO: 156743 - DNA, 25 bp, Mus musculus
agaggtttacagagcttggtaggaa

SEQ ID NO: 156744 - DNA, 25 bp, Mus musculus
agaggtttacagtgcttggtaggaa

SEQ ID NO: 156745 - DNA, 25 bp, Mus musculus
agaggtttacctctgagcaggcctt

SEQ ID NO: 156746 - DNA, 25 bp, Mus musculus
agaggtttacctgtgagcaggcctt

SEQ ID NO: 156747 - DNA, 25 bp, Mus musculus
agaggtttagcgagctgcttccgat

SEQ ID NO: 156748 - DNA, 25 bp, Mus musculus
agaggtttagcgtgctgcttccgat

SEQ ID NO: 156749 - DNA, 25 bp, Mus musculus
agaggtttcaccaggacccagtggg

SEQ ID NO: 156750 - DNA, 25 bp, Mus musculus
agaggtttcacctggacccagtggg

SEQ ID NO: 156751 - DNA, 25 bp, Mus musculus
agaggtttcagccacatgagttcaa

SEQ ID NO: 156752 - DNA, 25 bp, Mus musculus
agaggtttcagcgacatgagttcaa

SEQ ID NO: 156753 - DNA, 25 bp, Mus musculus
agaggtttccacaagggcttctcag

SEQ ID NO: 156754 - DNA, 25 bp, Mus musculus
agaggtttccactagggcttctcag

SEQ ID NO: 156755 - DNA, 25 bp, Mus musculus
agaggtttcccaatcctcctaggag

SEQ ID NO: 156756 - DNA, 25 bp, Mus musculus
agaggtttcccattcctcctaggag

SEQ ID NO: 156757 - DNA, 25 bp, Mus musculus
agaggtttcgagaggctctctgatc

SEQ ID NO: 156758 - DNA, 25 bp, Mus musculus
agaggtttcgagtggctctctgatc

SEQ ID NO: 156759 - DNA, 25 bp, Mus musculus
agaggtttcgtactgtacttcccag

SEQ ID NO: 156760 - DNA, 25 bp, Mus musculus
agaggtttcgtagtgtacttcccag

SEQ ID NO: 156761 - DNA, 25 bp, Mus musculus
agaggtttgaccaggccagggccct

SEQ ID NO: 156762 - DNA, 25 bp, Mus musculus
agaggtttgacccatttattctgaa

SEQ ID NO: 156763 - DNA, 25 bp, Mus musculus
agaggtttgaccgatttattctgaa

SEQ ID NO: 156764 - DNA, 25 bp, Mus musculus
agaggtttgacctggccagggccct

SEQ ID NO: 156765 - DNA, 25 bp, Mus musculus
agaggtttgattcatcgtgtccctg

SEQ ID NO: 156766 - DNA, 25 bp, Mus musculus
agaggtttgattgatcgtgtccctg

SEQ ID NO: 156767 - DNA, 25 bp, Mus musculus
agaggtttggacagacccggcaagt

SEQ ID NO: 156768 - DNA, 25 bp, Mus musculus
agaggtttggactgacccggcaagt

SEQ ID NO: 156769 - DNA, 25 bp, Mus musculus
agaggtttgttaagctattgtagaa

SEQ ID NO: 156770 - DNA, 25 bp, Mus musculus
agaggtttgttatgctattgtagaa

SEQ ID NO: 156771 - DNA, 25 bp, Mus musculus
agaggttttattccttcctctctca

SEQ ID NO: 156772 - DNA, 25 bp, Mus musculus
agaggttttattgcttcctctctca

SEQ ID NO: 156773 - DNA, 25 bp, Mus musculus
agaggttttgctactccttgtagcc

SEQ ID NO: 156774 - DNA, 25 bp, Mus musculus
agaggttttgcttctccttgtagcc

SEQ ID NO: 156775 - DNA, 25 bp, Mus musculus
agaggttttgtgctctttcgggcac

SEQ ID NO: 156776 - DNA, 25 bp, Mus musculus
agaggttttgtggtctttcgggcac

SEQ ID NO: 156777 - DNA, 25 bp, Mus musculus
agaggtttttgtctgaccacccaca

SEQ ID NO: 156778 - DNA, 25 bp, Mus musculus
agaggtttttgtgtgaccacccaca

SEQ ID NO: 156779 - DNA, 25 bp, Mus musculus
agagtaaaacctccttcacaacact

SEQ ID NO: 156780 - DNA, 25 bp, Mus musculus
agagtaaaacctgcttcacaacact

SEQ ID NO: 156781 - DNA, 25 bp, Mus musculus
agagtaaactcacggcattgggctt

SEQ ID NO: 156782 - DNA, 25 bp, Mus musculus
agagtaaactcagggcattgggctt

SEQ ID NO: 156783 - DNA, 25 bp, Mus musculus
agagtaaagcacctcccaggacttg

SEQ ID NO: 156784 - DNA, 25 bp, Mus musculus
agagtaaagcacgtcccaggacttg

SEQ ID NO: 156785 - DNA, 25 bp, Mus musculus
agagtaaagtctccaaccaaattag

SEQ ID NO: 156786 - DNA, 25 bp, Mus musculus
agagtaaagtctgcaaccaaattag

SEQ ID NO: 156787 - DNA, 25 bp, Mus musculus
agagtaaatcccaactgcctcttga

SEQ ID NO: 156788 - DNA, 25 bp, Mus musculus
agagtaaatccctactgcctcttga

SEQ ID NO: 156789 - DNA, 25 bp, Mus musculus
agagtaaatgctctctacctctggc

SEQ ID NO: 156790 - DNA, 25 bp, Mus musculus
agagtaaatgctgtctacctctggc

SEQ ID NO: 156791 - DNA, 25 bp, Mus musculus
agagtaaccactaagatatcttagg

SEQ ID NO: 156792 - DNA, 25 bp, Mus musculus
agagtaaccacttagatatcttagg

SEQ ID NO: 156793 - DNA, 25 bp, Mus musculus
agagtaaccagacggcagcctttag

SEQ ID NO: 156794 - DNA, 25 bp, Mus musculus
agagtaaccagagggcagcctttag

SEQ ID NO: 156795 - DNA, 25 bp, Mus musculus
agagtaaccccactcagcgtgacta

SEQ ID NO: 156796 - DNA, 25 bp, Mus musculus
agagtaaccccagtcagcgtgacta

SEQ ID NO: 156797 - DNA, 25 bp, Mus musculus
agagtaacgcacacagcccaaggct

SEQ ID NO: 156798 - DNA, 25 bp, Mus musculus
agagtaacgcactcagcccaaggct

SEQ ID NO: 156799 - DNA, 25 bp, Mus musculus
agagtaactataacctgcccatgca

SEQ ID NO: 156800 - DNA, 25 bp, Mus musculus
agagtaactatatcctgcccatgca

SEQ ID NO: 156801 - DNA, 25 bp, Mus musculus
agagtaactcctcctggcacactgg

SEQ ID NO: 156802 - DNA, 25 bp, Mus musculus
agagtaactcctgctggcacactgg

SEQ ID NO: 156803 - DNA, 25 bp, Mus musculus
agagtaactttgcatcgctctccca

SEQ ID NO: 156804 - DNA, 25 bp, Mus musculus
agagtaactttggatcgctctccca

SEQ ID NO: 156805 - DNA, 25 bp, Mus musculus
agagtaagaagaccaaaccagcaca

SEQ ID NO: 156806 - DNA, 25 bp, Mus musculus
agagtaagaagagcaaaccagcaca

SEQ ID NO: 156807 - DNA, 25 bp, Mus musculus
agagtaagaagcaccactcccgtgt

SEQ ID NO: 156808 - DNA, 25 bp, Mus musculus
agagtaagaagctccactcccgtgt

SEQ ID NO: 156809 - DNA, 25 bp, Mus musculus
agagtaagctgacctcatgcctgag

SEQ ID NO: 156810 - DNA, 25 bp, Mus musculus
agagtaagctgagctcatgcctgag

SEQ ID NO: 156811 - DNA, 25 bp, Mus musculus
agagtaaggcatctggatccgacca

SEQ ID NO: 156812 - DNA, 25 bp, Mus musculus
agagtaaggcatgtggatccgacca

SEQ ID NO: 156813 - DNA, 25 bp, Mus musculus
agagtaagggctccccagacctggc

SEQ ID NO: 156814 - DNA, 25 bp, Mus musculus
agagtaagggctgcccagacctggc

SEQ ID NO: 156815 - DNA, 25 bp, Mus musculus
agagtaaggtcaacctccttggtca

SEQ ID NO: 156816 - DNA, 25 bp, Mus musculus
agagtaaggtcatcctccttggtca

SEQ ID NO: 156817 - DNA, 25 bp, Mus musculus
agagtaataccgctccttggatgga

SEQ ID NO: 156818 - DNA, 25 bp, Mus musculus
agagtaataccggtccttggatgga

SEQ ID NO: 156819 - DNA, 25 bp, Mus musculus
agagtaatatgaaaaaccacactat

SEQ ID NO: 156820 - DNA, 25 bp, Mus musculus
agagtaatatgataaaccacactat

SEQ ID NO: 156821 - DNA, 25 bp, Mus musculus
agagtaatcctcattcttgctggtg

SEQ ID NO: 156822 - DNA, 25 bp, Mus musculus
agagtaatcctctttcttgctggtg

SEQ ID NO: 156823 - DNA, 25 bp, Mus musculus
agagtaatctgtaagtgttcattct

SEQ ID NO: 156824 - DNA, 25 bp, Mus musculus
agagtaatctgttagtgttcattct

SEQ ID NO: 156825 - DNA, 25 bp, Mus musculus
agagtaatgccaattacccacacac

SEQ ID NO: 156826 - DNA, 25 bp, Mus musculus
agagtaatgccatttacccacacac

SEQ ID NO: 156827 - DNA, 25 bp, Mus musculus
agagtaatggctctcactttcctcg

SEQ ID NO: 156828 - DNA, 25 bp, Mus musculus
agagtaatggctgtcactttcctcg

SEQ ID NO: 156829 - DNA, 25 bp, Mus musculus
agagtaatgtgcatgcgaagacccc

SEQ ID NO: 156830 - DNA, 25 bp, Mus musculus
agagtaatgtgcttgcgaagacccc

SEQ ID NO: 156831 - DNA, 25 bp, Mus musculus
agagtaattactcccacctacacgg

SEQ ID NO: 156832 - DNA, 25 bp, Mus musculus
agagtaattactgccacctacacgg

SEQ ID NO: 156833 - DNA, 25 bp, Mus musculus
agagtaattctgcttgccaaatgac

SEQ ID NO: 156834 - DNA, 25 bp, Mus musculus
agagtaattctggttgccaaatgac

SEQ ID NO: 156835 - DNA, 25 bp, Mus musculus
agagtacaacccagaacccgctgaa

SEQ ID NO: 156836 - DNA, 25 bp, Mus musculus
agagtacaaccctgaacccgctgaa

SEQ ID NO: 156837 - DNA, 25 bp, Mus musculus
agagtacaagcaccctgagctctcc

SEQ ID NO: 156838 - DNA, 25 bp, Mus musculus
agagtacaagcagcctgagctctcc

SEQ ID NO: 156839 - DNA, 25 bp, Mus musculus
agagtacaagctcatcctgtccaca

SEQ ID NO: 156840 - DNA, 25 bp, Mus musculus
agagtacaagctgatcctgtccaca

SEQ ID NO: 156841 - DNA, 25 bp, Mus musculus
agagtacaagtaactgctcctggcc

SEQ ID NO: 156842 - DNA, 25 bp, Mus musculus
agagtacaagtatctgctcctggcc

SEQ ID NO: 156843 - DNA, 25 bp, Mus musculus
agagtacacagacgcgcccagagct

SEQ ID NO: 156844 - DNA, 25 bp, Mus musculus
agagtacacagaggcgcccagagct

SEQ ID NO: 156845 - DNA, 25 bp, Mus musculus
agagtacaccctcctctgccaagag

SEQ ID NO: 156846 - DNA, 25 bp, Mus musculus
agagtacaccctgctctgccaagag

SEQ ID NO: 156847 - DNA, 25 bp, Mus musculus
agagtacacctcaggacatttctcc

SEQ ID NO: 156848 - DNA, 25 bp, Mus musculus
agagtacacctctggacatttctcc

SEQ ID NO: 156849 - DNA, 25 bp, Mus musculus
agagtacacttaaaccacaccagag

SEQ ID NO: 156850 - DNA, 25 bp, Mus musculus
agagtacacttataccacaccagag

SEQ ID NO: 156851 - DNA, 25 bp, Mus musculus
agagtacagagacatccagccgcct

SEQ ID NO: 156852 - DNA, 25 bp, Mus musculus
agagtacagagagatccagccgcct

SEQ ID NO: 156853 - DNA, 25 bp, Mus musculus
agagtacagctgcagtgaccacaaa

SEQ ID NO: 156854 - DNA, 25 bp, Mus musculus
agagtacagctggagtgaccacaaa

SEQ ID NO: 156855 - DNA, 25 bp, Mus musculus
agagtacattcgagcgctgcagcgg

SEQ ID NO: 156856 - DNA, 25 bp, Mus musculus
agagtacattcgtgcgctgcagcgg

SEQ ID NO: 156857 - DNA, 25 bp, Mus musculus
agagtaccacctctgatgcttcaga

SEQ ID NO: 156858 - DNA, 25 bp, Mus musculus
agagtaccacctgtgatgcttcaga

SEQ ID NO: 156859 - DNA, 25 bp, Mus musculus
agagtaccccagatttgcacattta

SEQ ID NO: 156860 - DNA, 25 bp, Mus musculus
agagtaccccagttttgcacattta

SEQ ID NO: 156861 - DNA, 25 bp, Mus musculus
agagtacccgggagtcgcctgagcc

SEQ ID NO: 156862 - DNA, 25 bp, Mus musculus
agagtacccgggtgtcgcctgagcc

SEQ ID NO: 156863 - DNA, 25 bp, Mus musculus
agagtacctagcctgcaggtgtttc

SEQ ID NO: 156864 - DNA, 25 bp, Mus musculus
agagtacctagcgtgcaggtgtttc

SEQ ID NO: 156865 - DNA, 25 bp, Mus musculus
agagtacctcgcaacagcagcagat

SEQ ID NO: 156866 - DNA, 25 bp, Mus musculus
agagtacctcgctacagcagcagat

SEQ ID NO: 156867 - DNA, 25 bp, Mus musculus
agagtacctgctaaacagattttaa

SEQ ID NO: 156868 - DNA, 25 bp, Mus musculus
agagtacctgcttaacagattttaa

SEQ ID NO: 156869 - DNA, 25 bp, Mus musculus
agagtacctgtaacagcttcctgcc

SEQ ID NO: 156870 - DNA, 25 bp, Mus musculus
agagtacctgtatcagcttcctgcc

SEQ ID NO: 156871 - DNA, 25 bp, Mus musculus
agagtaccttccaacgtttgtctgt

SEQ ID NO: 156872 - DNA, 25 bp, Mus musculus
agagtaccttccagaccgactgagg

SEQ ID NO: 156873 - DNA, 25 bp, Mus musculus
agagtaccttcctacgtttgtctgt

SEQ ID NO: 156874 - DNA, 25 bp, Mus musculus
agagtaccttcctgaccgactgagg

SEQ ID NO: 156875 - DNA, 25 bp, Mus musculus
agagtacgtccaagccaaccctagg

SEQ ID NO: 156876 - DNA, 25 bp, Mus musculus
agagtacgtccatgccaaccctagg

SEQ ID NO: 156877 - DNA, 25 bp, Mus musculus
agagtacgtgcgcacgcgtatgcat

SEQ ID NO: 156878 - DNA, 25 bp, Mus musculus
agagtacgtgcggacgcgtatgcat

SEQ ID NO: 156879 - DNA, 25 bp, Mus musculus
agagtactcaccaccaggtagggct

SEQ ID NO: 156880 - DNA, 25 bp, Mus musculus
agagtactcacctccaggtagggct

SEQ ID NO: 156881 - DNA, 25 bp, Mus musculus
agagtactccacactgcacaatagc

SEQ ID NO: 156882 - DNA, 25 bp, Mus musculus
agagtactccactctgcacaatagc

SEQ ID NO: 156883 - DNA, 25 bp, Mus musculus
agagtactgcctcgttcctgatgca

SEQ ID NO: 156884 - DNA, 25 bp, Mus musculus
agagtactgcctggttcctgatgca

SEQ ID NO: 156885 - DNA, 25 bp, Mus musculus
agagtactggtgctatcacctccat

SEQ ID NO: 156886 - DNA, 25 bp, Mus musculus
agagtactggtggtatcacctccat

SEQ ID NO: 156887 - DNA, 25 bp, Mus musculus
agagtactgtataccctgtgtgtta

SEQ ID NO: 156888 - DNA, 25 bp, Mus musculus
agagtactgtattccctgtgtgtta

SEQ ID NO: 156889 - DNA, 25 bp, Mus musculus
agagtactgtcaccctggagcgagt

SEQ ID NO: 156890 - DNA, 25 bp, Mus musculus
agagtactgtcagcctggagcgagt

SEQ ID NO: 156891 - DNA, 25 bp, Mus musculus
agagtacttagccacagagacctgg

SEQ ID NO: 156892 - DNA, 25 bp, Mus musculus
agagtacttagcgacagagacctgg

SEQ ID NO: 156893 - DNA, 25 bp, Mus musculus
agagtacttattcacccatcctcag

SEQ ID NO: 156894 - DNA, 25 bp, Mus musculus
agagtacttattgacccatcctcag

SEQ ID NO: 156895 - DNA, 25 bp, Mus musculus
agagtacttcacctgggctggattt

SEQ ID NO: 156896 - DNA, 25 bp, Mus musculus
agagtacttcacgtgggctggattt

SEQ ID NO: 156897 - DNA, 25 bp, Mus musculus
agagtacttcttcttcttgcagaag

SEQ ID NO: 156898 - DNA, 25 bp, Mus musculus
agagtacttcttgttcttgcagaag

SEQ ID NO: 156899 - DNA, 25 bp, Mus musculus
agagtacttttgaactgtaacttat

SEQ ID NO: 156900 - DNA, 25 bp, Mus musculus
agagtacttttgtactgtaacttat

SEQ ID NO: 156901 - DNA, 25 bp, Mus musculus
agagtagaagcaccggtgtccaccc

SEQ ID NO: 156902 - DNA, 25 bp, Mus musculus
agagtagaagcagcggtgtccaccc

SEQ ID NO: 156903 - DNA, 25 bp, Mus musculus
agagtagaatcccagacccaacctg

SEQ ID NO: 156904 - DNA, 25 bp, Mus musculus
agagtagaatccgagacccaacctg

SEQ ID NO: 156905 - DNA, 25 bp, Mus musculus
agagtagacatgacctccaggcact

SEQ ID NO: 156906 - DNA, 25 bp, Mus musculus
agagtagacatgtcctccaggcact

SEQ ID NO: 156907 - DNA, 25 bp, Mus musculus
agagtagagattaccacaaccagtg

SEQ ID NO: 156908 - DNA, 25 bp, Mus musculus
agagtagagatttccacaaccagtg

SEQ ID NO: 156909 - DNA, 25 bp, Mus musculus
agagtagagctgctctctctggtgc

SEQ ID NO: 156910 - DNA, 25 bp, Mus musculus
agagtagagctggtctctctggtgc

SEQ ID NO: 156911 - DNA, 25 bp, Mus musculus
agagtagatacgatttttgaggcaa

SEQ ID NO: 156912 - DNA, 25 bp, Mus musculus
agagtagatacgttttttgaggcaa

SEQ ID NO: 156913 - DNA, 25 bp, Mus musculus
agagtagcagttctgttgttccctg

SEQ ID NO: 156914 - DNA, 25 bp, Mus musculus
agagtagcagttgtgttgttccctg

SEQ ID NO: 156915 - DNA, 25 bp, Mus musculus
agagtagccagccacgagccccagg

SEQ ID NO: 156916 - DNA, 25 bp, Mus musculus
agagtagccagcgacgagccccagg

SEQ ID NO: 156917 - DNA, 25 bp, Mus musculus
agagtagccatcacatagagcttaa

SEQ ID NO: 156918 - DNA, 25 bp, Mus musculus
agagtagccatctcatagagcttaa

SEQ ID NO: 156919 - DNA, 25 bp, Mus musculus
agagtagcccaaccacaaagtgtga

SEQ ID NO: 156920 - DNA, 25 bp, Mus musculus
agagtagcccaagcacaaagtgtga

SEQ ID NO: 156921 - DNA, 25 bp, Mus musculus
agagtagcccatctctcggctgtac

SEQ ID NO: 156922 - DNA, 25 bp, Mus musculus
agagtagcccatgtctcggctgtac

SEQ ID NO: 156923 - DNA, 25 bp, Mus musculus
agagtagcctggacatttggcagct

SEQ ID NO: 156924 - DNA, 25 bp, Mus musculus
agagtagcctggtcatttggcagct

SEQ ID NO: 156925 - DNA, 25 bp, Mus musculus
agagtagctcttcccgaggatcatc

SEQ ID NO: 156926 - DNA, 25 bp, Mus musculus
agagtagctcttgccgaggatcatc

SEQ ID NO: 156927 - DNA, 25 bp, Mus musculus
agagtagctgacagaggctcccaag

SEQ ID NO: 156928 - DNA, 25 bp, Mus musculus
agagtagctgactgaggctcccaag

SEQ ID NO: 156929 - DNA, 25 bp, Mus musculus
agagtagctgttaccaatggcccgc

SEQ ID NO: 156930 - DNA, 25 bp, Mus musculus
agagtagctgtttccaatggcccgc

SEQ ID NO: 156931 - DNA, 25 bp, Mus musculus
agagtagcttctagctgccccggag

SEQ ID NO: 156932 - DNA, 25 bp, Mus musculus
agagtagcttcttgctgccccggag

SEQ ID NO: 156933 - DNA, 25 bp, Mus musculus
agagtagctttcaagcctctctgct

SEQ ID NO: 156934 - DNA, 25 bp, Mus musculus
agagtagctttctagcctctctgct

SEQ ID NO: 156935 - DNA, 25 bp, Mus musculus
agagtaggaagcatgccagagtcaa

SEQ ID NO: 156936 - DNA, 25 bp, Mus musculus
agagtaggaagcttgccagagtcaa

SEQ ID NO: 156937 - DNA, 25 bp, Mus musculus
agagtaggacccaagcttcatgcat

SEQ ID NO: 156938 - DNA, 25 bp, Mus musculus
agagtaggaccctagcttcatgcat

SEQ ID NO: 156939 - DNA, 25 bp, Mus musculus
agagtaggccccatgcttatcagta

SEQ ID NO: 156940 - DNA, 25 bp, Mus musculus
agagtaggccccttgcttatcagta

SEQ ID NO: 156941 - DNA, 25 bp, Mus musculus
agagtaggggcaccttcctagcgca

SEQ ID NO: 156942 - DNA, 25 bp, Mus musculus
agagtaggggcagcttcctagcgca

SEQ ID NO: 156943 - DNA, 25 bp, Mus musculus
agagtagggtggagagacccttcct

SEQ ID NO: 156944 - DNA, 25 bp, Mus musculus
agagtagggtggtgagacccttcct

SEQ ID NO: 156945 - DNA, 25 bp, Mus musculus
agagtaggtcaaagctcccctgcag

SEQ ID NO: 156946 - DNA, 25 bp, Mus musculus
agagtaggtcaatgctcccctgcag

SEQ ID NO: 156947 - DNA, 25 bp, Mus musculus
agagtaggttctactctctgtatct

SEQ ID NO: 156948 - DNA, 25 bp, Mus musculus
agagtaggttcttctctctgtatct

SEQ ID NO: 156949 - DNA, 25 bp, Mus musculus
agagtagtaaccagtgaaacgaaga

SEQ ID NO: 156950 - DNA, 25 bp, Mus musculus
agagtagtaacctgtgaaacgaaga

SEQ ID NO: 156951 - DNA, 25 bp, Mus musculus
agagtagtctgaaatttatccttca

SEQ ID NO: 156952 - DNA, 25 bp, Mus musculus
agagtagtctgatatttatccttca

SEQ ID NO: 156953 - DNA, 25 bp, Mus musculus
agagtagtggacatgttacctttca

SEQ ID NO: 156954 - DNA, 25 bp, Mus musculus
agagtagtggacttgttacctttca

SEQ ID NO: 156955 - DNA, 25 bp, Mus musculus
agagtagtggtaattcaccggcgcc

SEQ ID NO: 156956 - DNA, 25 bp, Mus musculus
agagtagtggtatttcaccggcgcc

SEQ ID NO: 156957 - DNA, 25 bp, Mus musculus
agagtataaactcccaccgtagcgg

SEQ ID NO: 156958 - DNA, 25 bp, Mus musculus
agagtataaactgccaccgtagcgg

SEQ ID NO: 156959 - DNA, 25 bp, Mus musculus
agagtataactcagcccaagggcct

SEQ ID NO: 156960 - DNA, 25 bp, Mus musculus
agagtataactctgcccaagggcct

SEQ ID NO: 156961 - DNA, 25 bp, Mus musculus
agagtataagttaagctgctggtgc

SEQ ID NO: 156962 - DNA, 25 bp, Mus musculus
agagtataagtttagctgctggtgc

SEQ ID NO: 156963 - DNA, 25 bp, Mus musculus
agagtatcatggcagatggtaacca

SEQ ID NO: 156964 - DNA, 25 bp, Mus musculus
agagtatcatgggagatggtaacca

SEQ ID NO: 156965 - DNA, 25 bp, Mus musculus
agagtatcccgtcttggtcaccagg

SEQ ID NO: 156966 - DNA, 25 bp, Mus musculus
agagtatcccgtgttggtcaccagg

SEQ ID NO: 156967 - DNA, 25 bp, Mus musculus
agagtatccgtgatctctgcacttg

SEQ ID NO: 156968 - DNA, 25 bp, Mus musculus
agagtatccgtgttctctgcacttg

SEQ ID NO: 156969 - DNA, 25 bp, Mus musculus
agagtatccttcctgcaggctggaa

SEQ ID NO: 156970 - DNA, 25 bp, Mus musculus
agagtatccttcgtgcaggctggaa

SEQ ID NO: 156971 - DNA, 25 bp, Mus musculus
agagtatcggacctacgcagcacag

SEQ ID NO: 156972 - DNA, 25 bp, Mus musculus
agagtatcggacgtacgcagcacag

SEQ ID NO: 156973 - DNA, 25 bp, Mus musculus
agagtatcttaactggctccttccc

SEQ ID NO: 156974 - DNA, 25 bp, Mus musculus
agagtatcttaagtggctccttccc

SEQ ID NO: 156975 - DNA, 25 bp, Mus musculus
agagtatcttggaggctccctgcag

SEQ ID NO: 156976 - DNA, 25 bp, Mus musculus
agagtatcttggtggctccctgcag

SEQ ID NO: 156977 - DNA, 25 bp, Mus musculus
agagtatgcaataggctagccgatt

SEQ ID NO: 156978 - DNA, 25 bp, Mus musculus
agagtatgcaattggctagccgatt

SEQ ID NO: 156979 - DNA, 25 bp, Mus musculus
agagtatgctgaattcagcgttcaa

SEQ ID NO: 156980 - DNA, 25 bp, Mus musculus
agagtatgctgatttcagcgttcaa

SEQ ID NO: 156981 - DNA, 25 bp, Mus musculus
agagtatgctgccatcaactccatg

SEQ ID NO: 156982 - DNA, 25 bp, Mus musculus
agagtatgctgcgatcaactccatg

SEQ ID NO: 156983 - DNA, 25 bp, Mus musculus
agagtatggcgaatggactccccag

SEQ ID NO: 156984 - DNA, 25 bp, Mus musculus
agagtatggcgattggactccccag

SEQ ID NO: 156985 - DNA, 25 bp, Mus musculus
agagtatgtataacctcacagccac

SEQ ID NO: 156986 - DNA, 25 bp, Mus musculus
agagtatgtatatcctcacagccac

SEQ ID NO: 156987 - DNA, 25 bp, Mus musculus
agagtatgttctatctctccaccat

SEQ ID NO: 156988 - DNA, 25 bp, Mus musculus
agagtatgttctttctctccaccat

SEQ ID NO: 156989 - DNA, 25 bp, Mus musculus
agagtatgttttcccagtggctaca

SEQ ID NO: 156990 - DNA, 25 bp, Mus musculus
agagtatgttttgccagtggctaca

SEQ ID NO: 156991 - DNA, 25 bp, Mus musculus
agagtattaagcagcctggaccagc

SEQ ID NO: 156992 - DNA, 25 bp, Mus musculus
agagtattaagctgcctggaccagc

SEQ ID NO: 156993 - DNA, 25 bp, Mus musculus
agagtattcaacctggtttcagatt

SEQ ID NO: 156994 - DNA, 25 bp, Mus musculus
agagtattcaacgtggtttcagatt

SEQ ID NO: 156995 - DNA, 25 bp, Mus musculus
agagtattcccaaggtctctgccca

SEQ ID NO: 156996 - DNA, 25 bp, Mus musculus
agagtattcccatggtctctgccca

SEQ ID NO: 156997 - DNA, 25 bp, Mus musculus
agagtattgccgatgtccattgcca

SEQ ID NO: 156998 - DNA, 25 bp, Mus musculus
agagtattgccgttgtccattgcca

SEQ ID NO: 156999 - DNA, 25 bp, Mus musculus
agagtattgctcatccctccagaag

SEQ ID NO: 157000 - DNA, 25 bp, Mus musculus
agagtattgctcttccctccagaag

SEQ ID NO: 157001 - DNA, 25 bp, Mus musculus
agagtattggctcagcagcttccta

SEQ ID NO: 157002 - DNA, 25 bp, Mus musculus
agagtattggctgagcagcttccta

SEQ ID NO: 157003 - DNA, 25 bp, Mus musculus
agagtatttctacctatttcccact

SEQ ID NO: 157004 - DNA, 25 bp, Mus musculus
agagtatttctagctatttcccact

SEQ ID NO: 157005 - DNA, 25 bp, Mus musculus
agagtatttgatattgctgaccatg

SEQ ID NO: 157006 - DNA, 25 bp, Mus musculus
agagtatttgattttgctgaccatg

SEQ ID NO: 157007 - DNA, 25 bp, Mus musculus
agagtatttgcaacttgccgggcgt

SEQ ID NO: 157008 - DNA, 25 bp, Mus musculus
agagtatttgcatcttgccgggcgt

SEQ ID NO: 157009 - DNA, 25 bp, Mus musculus
agagtatttgttctggccgaggcca

SEQ ID NO: 157010 - DNA, 25 bp, Mus musculus
agagtatttgttgtggccgaggcca

SEQ ID NO: 157011 - DNA, 25 bp, Mus musculus
agagtattttcaatactccctaaat

SEQ ID NO: 157012 - DNA, 25 bp, Mus musculus
agagtattttcattactccctaaat

SEQ ID NO: 157013 - DNA, 25 bp, Mus musculus
agagtattttgtccatctgagattg

SEQ ID NO: 157014 - DNA, 25 bp, Mus musculus
agagtattttgtgcatctgagattg

SEQ ID NO: 157015 - DNA, 25 bp, Mus musculus
agagtcaaaccgagtgatcaccaga

SEQ ID NO: 157016 - DNA, 25 bp, Mus musculus
agagtcaaaccgtgtgatcaccaga

SEQ ID NO: 157017 - DNA, 25 bp, Mus musculus
agagtcaaagaaacccttccatgcc

SEQ ID NO: 157018 - DNA, 25 bp, Mus musculus
agagtcaaagaatcccttccatgcc

SEQ ID NO: 157019 - DNA, 25 bp, Mus musculus
agagtcaaagatccccaagtggttt

SEQ ID NO: 157020 - DNA, 25 bp, Mus musculus
agagtcaaagatgcccaagtggttt

SEQ ID NO: 157021 - DNA, 25 bp, Mus musculus
agagtcaaggagcttctgccccatg

SEQ ID NO: 157022 - DNA, 25 bp, Mus musculus
agagtcaaggaggttctgccccatg

SEQ ID NO: 157023 - DNA, 25 bp, Mus musculus
agagtcaagtcaccctggacagccc

SEQ ID NO: 157024 - DNA, 25 bp, Mus musculus
agagtcaagtcagcctggacagccc

SEQ ID NO: 157025 - DNA, 25 bp, Mus musculus
agagtcaatattaggctggtcgcga

SEQ ID NO: 157026 - DNA, 25 bp, Mus musculus
agagtcaatatttggctggtcgcga

SEQ ID NO: 157027 - DNA, 25 bp, Mus musculus
agagtcaatcccaggcctctaaggg

SEQ ID NO: 157028 - DNA, 25 bp, Mus musculus
agagtcaatccctggcctctaaggg

SEQ ID NO: 157029 - DNA, 25 bp, Mus musculus
agagtcaatctgaccctctagatgg

SEQ ID NO: 157030 - DNA, 25 bp, Mus musculus
agagtcaatctgtccctctagatgg

SEQ ID NO: 157031 - DNA, 25 bp, Mus musculus
agagtcacaaggcagtctgagtcaa

SEQ ID NO: 157032 - DNA, 25 bp, Mus musculus
agagtcacaagggagtctgagtcaa

SEQ ID NO: 157033 - DNA, 25 bp, Mus musculus
agagtcacacatacatacttgctga

SEQ ID NO: 157034 - DNA, 25 bp, Mus musculus
agagtcacacattcatacttgctga

SEQ ID NO: 157035 - DNA, 25 bp, Mus musculus
agagtcacacgcattctttaccaga

SEQ ID NO: 157036 - DNA, 25 bp, Mus musculus
agagtcacacgctttctttaccaga

SEQ ID NO: 157037 - DNA, 25 bp, Mus musculus
agagtcacacttactcgtgcacatc

SEQ ID NO: 157038 - DNA, 25 bp, Mus musculus
agagtcacactttctcgtgcacatc

SEQ ID NO: 157039 - DNA, 25 bp, Mus musculus
agagtcacagctcacctgggtggat

SEQ ID NO: 157040 - DNA, 25 bp, Mus musculus
agagtcacagctgacctgggtggat

SEQ ID NO: 157041 - DNA, 25 bp, Mus musculus
agagtcacaggaacagcgggcccga

SEQ ID NO: 157042 - DNA, 25 bp, Mus musculus
agagtcacaggatcagcgggcccga

SEQ ID NO: 157043 - DNA, 25 bp, Mus musculus
agagtcacagtcaggtcttgctcag

SEQ ID NO: 157044 - DNA, 25 bp, Mus musculus
agagtcacagtctggtcttgctcag

SEQ ID NO: 157045 - DNA, 25 bp, Mus musculus
agagtcaccacactgccaaattgta

SEQ ID NO: 157046 - DNA, 25 bp, Mus musculus
agagtcaccacagtgccaaattgta

SEQ ID NO: 157047 - DNA, 25 bp, Mus musculus
agagtcaccactacagcccagtgtt

SEQ ID NO: 157048 - DNA, 25 bp, Mus musculus
agagtcaccacttcagcccagtgtt

SEQ ID NO: 157049 - DNA, 25 bp, Mus musculus
agagtcaccatacatcacaggccat

SEQ ID NO: 157050 - DNA, 25 bp, Mus musculus
agagtcaccatagatcacaggccat

SEQ ID NO: 157051 - DNA, 25 bp, Mus musculus
agagtcacccagctatggaggcgcc

SEQ ID NO: 157052 - DNA, 25 bp, Mus musculus
agagtcacccaggtatggaggcgcc

SEQ ID NO: 157053 - DNA, 25 bp, Mus musculus
agagtcaccctcattatatcttgtc

SEQ ID NO: 157054 - DNA, 25 bp, Mus musculus
agagtcaccctctttatatcttgtc

SEQ ID NO: 157055 - DNA, 25 bp, Mus musculus
agagtcacggcacgtgctggctacc

SEQ ID NO: 157056 - DNA, 25 bp, Mus musculus
agagtcacggcaggtgctggctacc

SEQ ID NO: 157057 - DNA, 25 bp, Mus musculus
agagtcacgtgacagctgcccggat

SEQ ID NO: 157058 - DNA, 25 bp, Mus musculus
agagtcacgtgagagctgcccggat

SEQ ID NO: 157059 - DNA, 25 bp, Mus musculus
agagtcactatcctattacttgggt

SEQ ID NO: 157060 - DNA, 25 bp, Mus musculus
agagtcactatcgtattacttgggt

SEQ ID NO: 157061 - DNA, 25 bp, Mus musculus
agagtcactccaccctggcatggtg

SEQ ID NO: 157062 - DNA, 25 bp, Mus musculus
agagtcactccagcctggcatggtg

SEQ ID NO: 157063 - DNA, 25 bp, Mus musculus
agagtcactcctactattactacct

SEQ ID NO: 157064 - DNA, 25 bp, Mus musculus
agagtcactccttctattactacct

SEQ ID NO: 157065 - DNA, 25 bp, Mus musculus
agagtcactctcaagcggaaggcgc

SEQ ID NO: 157066 - DNA, 25 bp, Mus musculus
agagtcactctctagcggaaggcgc

SEQ ID NO: 157067 - DNA, 25 bp, Mus musculus
agagtcactctgatgggtggcccag

SEQ ID NO: 157068 - DNA, 25 bp, Mus musculus
agagtcactctgttgggtggcccag

SEQ ID NO: 157069 - DNA, 25 bp, Mus musculus
agagtcactgctatcctgtactgca

SEQ ID NO: 157070 - DNA, 25 bp, Mus musculus
agagtcactgctttcctgtactgca

SEQ ID NO: 157071 - DNA, 25 bp, Mus musculus
agagtcactggactgctggtcgtca

SEQ ID NO: 157072 - DNA, 25 bp, Mus musculus
agagtcactggagtgctggtcgtca

SEQ ID NO: 157073 - DNA, 25 bp, Mus musculus
agagtcacttagacctttgcacagc

SEQ ID NO: 157074 - DNA, 25 bp, Mus musculus
agagtcacttagtcctttgcacagc

SEQ ID NO: 157075 - DNA, 25 bp, Mus musculus
agagtcacttctcagtttcagccag

SEQ ID NO: 157076 - DNA, 25 bp, Mus musculus
agagtcacttctgagtttcagccag

SEQ ID NO: 157077 - DNA, 25 bp, Mus musculus
agagtcagaagcattgcctagagca

SEQ ID NO: 157078 - DNA, 25 bp, Mus musculus
agagtcagaagctttgcctagagca

SEQ ID NO: 157079 - DNA, 25 bp, Mus musculus
agagtcagacgcatgtcctgctctg

SEQ ID NO: 157080 - DNA, 25 bp, Mus musculus
agagtcagacgcttgtcctgctctg

SEQ ID NO: 157081 - DNA, 25 bp, Mus musculus
agagtcagagcgagatgctgccgct

SEQ ID NO: 157082 - DNA, 25 bp, Mus musculus
agagtcagagcgtgatgctgccgct

SEQ ID NO: 157083 - DNA, 25 bp, Mus musculus
agagtcagagttctgctgtctttct

SEQ ID NO: 157084 - DNA, 25 bp, Mus musculus
agagtcagagttgtgctgtctttct

SEQ ID NO: 157085 - DNA, 25 bp, Mus musculus
agagtcagcactcggcctttaacga

SEQ ID NO: 157086 - DNA, 25 bp, Mus musculus
agagtcagcactgggcctttaacga

SEQ ID NO: 157087 - DNA, 25 bp, Mus musculus
agagtcagcagaactgtcgccaggc

SEQ ID NO: 157088 - DNA, 25 bp, Mus musculus
agagtcagcagatctgtcgccaggc

SEQ ID NO: 157089 - DNA, 25 bp, Mus musculus
agagtcagcagcagtacgacccttc

SEQ ID NO: 157090 - DNA, 25 bp, Mus musculus
agagtcagcagctgtacgacccttc

SEQ ID NO: 157091 - DNA, 25 bp, Mus musculus
agagtcagcgcccaatcttgtggac

SEQ ID NO: 157092 - DNA, 25 bp, Mus musculus
agagtcagcgccgaatcttgtggac

SEQ ID NO: 157093 - DNA, 25 bp, Mus musculus
agagtcagctgtagtcagcagtcca

SEQ ID NO: 157094 - DNA, 25 bp, Mus musculus
agagtcagctgttgtcagcagtcca

SEQ ID NO: 157095 - DNA, 25 bp, Mus musculus
agagtcaggagcacagggccattcc

SEQ ID NO: 157096 - DNA, 25 bp, Mus musculus
agagtcaggagctcagggccattcc

SEQ ID NO: 157097 - DNA, 25 bp, Mus musculus
agagtcaggcccacgtatagagcga

SEQ ID NO: 157098 - DNA, 25 bp, Mus musculus
agagtcaggccctcgtatagagcga

SEQ ID NO: 157099 - DNA, 25 bp, Mus musculus
agagtcaggcggagctcatgagtct

SEQ ID NO: 157100 - DNA, 25 bp, Mus musculus
agagtcaggcggtgctcatgagtct

SEQ ID NO: 157101 - DNA, 25 bp, Mus musculus
agagtcaggctcactagccgtaaaa

SEQ ID NO: 157102 - DNA, 25 bp, Mus musculus
agagtcaggctctctagccgtaaaa

SEQ ID NO: 157103 - DNA, 25 bp, Mus musculus
agagtcagggcgatgtctcagcatt

SEQ ID NO: 157104 - DNA, 25 bp, Mus musculus
agagtcagggcgcttactccgactt

SEQ ID NO: 157105 - DNA, 25 bp, Mus musculus
agagtcagggcggttactccgactt

SEQ ID NO: 157106 - DNA, 25 bp, Mus musculus
agagtcagggcgttgtctcagcatt

SEQ ID NO: 157107 - DNA, 25 bp, Mus musculus
agagtcaggtccacgggaaccctat

SEQ ID NO: 157108 - DNA, 25 bp, Mus musculus
agagtcaggtcctcgggaaccctat

SEQ ID NO: 157109 - DNA, 25 bp, Mus musculus
agagtcaggtcgatctcggtattac

SEQ ID NO: 157110 - DNA, 25 bp, Mus musculus
agagtcaggtcgttctcggtattac

SEQ ID NO: 157111 - DNA, 25 bp, Mus musculus
agagtcagtagtagtgcccttgtca

SEQ ID NO: 157112 - DNA, 25 bp, Mus musculus
agagtcagtagttgtgcccttgtca

SEQ ID NO: 157113 - DNA, 25 bp, Mus musculus
agagtcagtcacaacaggtaccatg

SEQ ID NO: 157114 - DNA, 25 bp, Mus musculus
agagtcagtcactacaggtaccatg

SEQ ID NO: 157115 - DNA, 25 bp, Mus musculus
agagtcagtctcactcagagatgaa

SEQ ID NO: 157116 - DNA, 25 bp, Mus musculus
agagtcagtctctctcagagatgaa

SEQ ID NO: 157117 - DNA, 25 bp, Mus musculus
agagtcagtgagatggtttcctttc

SEQ ID NO: 157118 - DNA, 25 bp, Mus musculus
agagtcagtgagttggtttcctttc

SEQ ID NO: 157119 - DNA, 25 bp, Mus musculus
agagtcagtggtcagtctcagtgca

SEQ ID NO: 157120 - DNA, 25 bp, Mus musculus
agagtcagtggtgagtctcagtgca

SEQ ID NO: 157121 - DNA, 25 bp, Mus musculus
agagtcagttctcacctaccacatg

SEQ ID NO: 157122 - DNA, 25 bp, Mus musculus
agagtcagttctgacctaccacatg

SEQ ID NO: 157123 - DNA, 25 bp, Mus musculus
agagtcataagaaacctgccaagga

SEQ ID NO: 157124 - DNA, 25 bp, Mus musculus
agagtcataagatacctgccaagga

SEQ ID NO: 157125 - DNA, 25 bp, Mus musculus
agagtcatacacagtgtccacctac

SEQ ID NO: 157126 - DNA, 25 bp, Mus musculus
agagtcatacactgtgtccacctac

SEQ ID NO: 157127 - DNA, 25 bp, Mus musculus
agagtcatatgaacttggctggcaa

SEQ ID NO: 157128 - DNA, 25 bp, Mus musculus
agagtcatatgatcttggctggcaa

SEQ ID NO: 157129 - DNA, 25 bp, Mus musculus
agagtcatattgcactagttgggta

SEQ ID NO: 157130 - DNA, 25 bp, Mus musculus
agagtcatattggactagttgggta

SEQ ID NO: 157131 - DNA, 25 bp, Mus musculus
agagtcatcagtcaacgttacgtct

SEQ ID NO: 157132 - DNA, 25 bp, Mus musculus
agagtcatcagtgaacgttacgtct

SEQ ID NO: 157133 - DNA, 25 bp, Mus musculus
agagtcatctgacggtcttgcttcc

SEQ ID NO: 157134 - DNA, 25 bp, Mus musculus
agagtcatctgagggtcttgcttcc

SEQ ID NO: 157135 - DNA, 25 bp, Mus musculus
agagtcatgatcatctcgtcattcc

SEQ ID NO: 157136 - DNA, 25 bp, Mus musculus
agagtcatgatcttctcgtcattcc

SEQ ID NO: 157137 - DNA, 25 bp, Mus musculus
agagtcatgcaaagtgtgtcatcac

SEQ ID NO: 157138 - DNA, 25 bp, Mus musculus
agagtcatgcaatgtgtgtcatcac

SEQ ID NO: 157139 - DNA, 25 bp, Mus musculus
agagtcatgcagcacctgtggcatt

SEQ ID NO: 157140 - DNA, 25 bp, Mus musculus
agagtcatgcaggacctgtggcatt

SEQ ID NO: 157141 - DNA, 25 bp, Mus musculus
agagtcatgtagcagggacctaacc

SEQ ID NO: 157142 - DNA, 25 bp, Mus musculus
agagtcatgtaggagggacctaacc

SEQ ID NO: 157143 - DNA, 25 bp, Mus musculus
agagtcatgtctatatcgatttggg

SEQ ID NO: 157144 - DNA, 25 bp, Mus musculus
agagtcatgtctttatcgatttggg

SEQ ID NO: 157145 - DNA, 25 bp, Mus musculus
agagtcattaagagtaaccccagag

SEQ ID NO: 157146 - DNA, 25 bp, Mus musculus
agagtcattaagcttccaggtaacc

SEQ ID NO: 157147 - DNA, 25 bp, Mus musculus
agagtcattaaggttccaggtaacc

SEQ ID NO: 157148 - DNA, 25 bp, Mus musculus
agagtcattaagtgtaaccccagag

SEQ ID NO: 157149 - DNA, 25 bp, Mus musculus
agagtcattcggagaacttctgcca

SEQ ID NO: 157150 - DNA, 25 bp, Mus musculus
agagtcattcggtgaacttctgcca

SEQ ID NO: 157151 - DNA, 25 bp, Mus musculus
agagtcattgatctcgcaccatgtg

SEQ ID NO: 157152 - DNA, 25 bp, Mus musculus
agagtcattgatgtcgcaccatgtg

SEQ ID NO: 157153 - DNA, 25 bp, Mus musculus
agagtcattgcccatggtttgcagt

SEQ ID NO: 157154 - DNA, 25 bp, Mus musculus
agagtcattgccgatggtttgcagt

SEQ ID NO: 157155 - DNA, 25 bp, Mus musculus
agagtcattgtgaagcttccataat

SEQ ID NO: 157156 - DNA, 25 bp, Mus musculus
agagtcattgtgtagcttccataat

SEQ ID NO: 157157 - DNA, 25 bp, Mus musculus
agagtcattgttcccaagttggtct

SEQ ID NO: 157158 - DNA, 25 bp, Mus musculus
agagtcattgttgccaagttggtct

SEQ ID NO: 157159 - DNA, 25 bp, Mus musculus
agagtcattttgactatccaataat

SEQ ID NO: 157160 - DNA, 25 bp, Mus musculus
agagtcattttgtctatccaataat

SEQ ID NO: 157161 - DNA, 25 bp, Mus musculus
agagtccaacacaggctcctatagg

SEQ ID NO: 157162 - DNA, 25 bp, Mus musculus
agagtccaacactggctcctatagg

SEQ ID NO: 157163 - DNA, 25 bp, Mus musculus
agagtccacacacatccattttaaa

SEQ ID NO: 157164 - DNA, 25 bp, Mus musculus
agagtccacacagatccattttaaa

SEQ ID NO: 157165 - DNA, 25 bp, Mus musculus
agagtccacagtaccttccaaggca

SEQ ID NO: 157166 - DNA, 25 bp, Mus musculus
agagtccacagttccttccaaggca

SEQ ID NO: 157167 - DNA, 25 bp, Mus musculus
agagtccaccatattcttatgtttg

SEQ ID NO: 157168 - DNA, 25 bp, Mus musculus
agagtccaccattttcttatgtttg

SEQ ID NO: 157169 - DNA, 25 bp, Mus musculus
agagtccaccttccacctggtgctg

SEQ ID NO: 157170 - DNA, 25 bp, Mus musculus
agagtccaccttgcacctggtgctg

SEQ ID NO: 157171 - DNA, 25 bp, Mus musculus
agagtccacgtgctgatcttgtgct

SEQ ID NO: 157172 - DNA, 25 bp, Mus musculus
agagtccacgtggtgatcttgtgct

SEQ ID NO: 157173 - DNA, 25 bp, Mus musculus
agagtccactctcatcacgtttgtg

SEQ ID NO: 157174 - DNA, 25 bp, Mus musculus
agagtccactctgatcacgtttgtg

SEQ ID NO: 157175 - DNA, 25 bp, Mus musculus
agagtccactgcaacagaacgcctg

SEQ ID NO: 157176 - DNA, 25 bp, Mus musculus
agagtccactgctacagaacgcctg

SEQ ID NO: 157177 - DNA, 25 bp, Mus musculus
agagtccagagtcatcaacgcccgg

SEQ ID NO: 157178 - DNA, 25 bp, Mus musculus
agagtccagagtcgcgtccatccag

SEQ ID NO: 157179 - DNA, 25 bp, Mus musculus
agagtccagagtgatcaacgcccgg

SEQ ID NO: 157180 - DNA, 25 bp, Mus musculus
agagtccagagtggcgtccatccag

SEQ ID NO: 157181 - DNA, 25 bp, Mus musculus
agagtccagctcagaacacagttgc

SEQ ID NO: 157182 - DNA, 25 bp, Mus musculus
agagtccagctctgaacacagttgc

SEQ ID NO: 157183 - DNA, 25 bp, Mus musculus
agagtccagtgcaaggagtcatcaa

SEQ ID NO: 157184 - DNA, 25 bp, Mus musculus
agagtccagtgctaggagtcatcaa

SEQ ID NO: 157185 - DNA, 25 bp, Mus musculus
agagtccatgatactgacgtatcac

SEQ ID NO: 157186 - DNA, 25 bp, Mus musculus
agagtccatgatccatcagtctccc

SEQ ID NO: 157187 - DNA, 25 bp, Mus musculus
agagtccatgatgcatcagtctccc

SEQ ID NO: 157188 - DNA, 25 bp, Mus musculus
agagtccatgattctgacgtatcac

SEQ ID NO: 157189 - DNA, 25 bp, Mus musculus
agagtccatgccagttccttgtctg

SEQ ID NO: 157190 - DNA, 25 bp, Mus musculus
agagtccatgcctgttccttgtctg

SEQ ID NO: 157191 - DNA, 25 bp, Mus musculus
agagtccatgctctggaagctccag

SEQ ID NO: 157192 - DNA, 25 bp, Mus musculus
agagtccatgctgtggaagctccag

SEQ ID NO: 157193 - DNA, 25 bp, Mus musculus
agagtccattgaccgaagctcttta

SEQ ID NO: 157194 - DNA, 25 bp, Mus musculus
agagtccattgagcgaagctcttta

SEQ ID NO: 157195 - DNA, 25 bp, Mus musculus
agagtcccagttccctttgggatga

SEQ ID NO: 157196 - DNA, 25 bp, Mus musculus
agagtcccagttgcctttgggatga

SEQ ID NO: 157197 - DNA, 25 bp, Mus musculus
agagtccccgacaagtgccagcatc

SEQ ID NO: 157198 - DNA, 25 bp, Mus musculus
agagtccccgactagtgccagcatc

SEQ ID NO: 157199 - DNA, 25 bp, Mus musculus
agagtccccggaaagttgccactgg

SEQ ID NO: 157200 - DNA, 25 bp, Mus musculus
agagtccccggatagttgccactgg

SEQ ID NO: 157201 - DNA, 25 bp, Mus musculus
agagtccccgtaatctgtgtgcagt

SEQ ID NO: 157202 - DNA, 25 bp, Mus musculus
agagtccccgtattctgtgtgcagt

SEQ ID NO: 157203 - DNA, 25 bp, Mus musculus
agagtcccctgaagtgcatgatcca

SEQ ID NO: 157204 - DNA, 25 bp, Mus musculus
agagtcccctgatgtgcatgatcca

SEQ ID NO: 157205 - DNA, 25 bp, Mus musculus
agagtcccctttctggatcatcggt

SEQ ID NO: 157206 - DNA, 25 bp, Mus musculus
agagtcccctttgtggatcatcggt

SEQ ID NO: 157207 - DNA, 25 bp, Mus musculus
agagtccctcctcatgctgggaagt

SEQ ID NO: 157208 - DNA, 25 bp, Mus musculus
agagtccctcctgatgctgggaagt

SEQ ID NO: 157209 - DNA, 25 bp, Mus musculus
agagtccctcttagaccaggagaga

SEQ ID NO: 157210 - DNA, 25 bp, Mus musculus
agagtccctctttgaccaggagaga

SEQ ID NO: 157211 - DNA, 25 bp, Mus musculus
agagtccctgcccagcagatttggt

SEQ ID NO: 157212 - DNA, 25 bp, Mus musculus
agagtccctgccgagcagatttggt

SEQ ID NO: 157213 - DNA, 25 bp, Mus musculus
agagtccctgcgcagtatttcacaa

SEQ ID NO: 157214 - DNA, 25 bp, Mus musculus
agagtccctgcggagtatttcacaa

SEQ ID NO: 157215 - DNA, 25 bp, Mus musculus
agagtccctggaacttcggctacag

SEQ ID NO: 157216 - DNA, 25 bp, Mus musculus
agagtccctggatcttcggctacag

SEQ ID NO: 157217 - DNA, 25 bp, Mus musculus
agagtccctggtcaatccatttgct

SEQ ID NO: 157218 - DNA, 25 bp, Mus musculus
agagtccctggtgaatccatttgct

SEQ ID NO: 157219 - DNA, 25 bp, Mus musculus
agagtccctgttactgcttggaagt

SEQ ID NO: 157220 - DNA, 25 bp, Mus musculus
agagtccctgttccgatatcatcac

SEQ ID NO: 157221 - DNA, 25 bp, Mus musculus
agagtccctgttgcgatatcatcac

SEQ ID NO: 157222 - DNA, 25 bp, Mus musculus
agagtccctgtttctgcttggaagt

SEQ ID NO: 157223 - DNA, 25 bp, Mus musculus
agagtcccttaaccaagccagctgt

SEQ ID NO: 157224 - DNA, 25 bp, Mus musculus
agagtcccttaagcaagccagctgt

SEQ ID NO: 157225 - DNA, 25 bp, Mus musculus
agagtcccttctcttggaagccata

SEQ ID NO: 157226 - DNA, 25 bp, Mus musculus
agagtcccttctgttggaagccata

SEQ ID NO: 157227 - DNA, 25 bp, Mus musculus
agagtccgaaacagggctccacact

SEQ ID NO: 157228 - DNA, 25 bp, Mus musculus
agagtccgaaactgggctccacact

SEQ ID NO: 157229 - DNA, 25 bp, Mus musculus
agagtccggcctcagatcctgggac

SEQ ID NO: 157230 - DNA, 25 bp, Mus musculus
agagtccggcctgagatcctgggac

SEQ ID NO: 157231 - DNA, 25 bp, Mus musculus
agagtcctaatgagcctgtcagcag

SEQ ID NO: 157232 - DNA, 25 bp, Mus musculus
agagtcctaatgtgcctgtcagcag

SEQ ID NO: 157233 - DNA, 25 bp, Mus musculus
agagtcctatccactgccaaagtgc

SEQ ID NO: 157234 - DNA, 25 bp, Mus musculus
agagtcctatcctctgccaaagtgc

SEQ ID NO: 157235 - DNA, 25 bp, Mus musculus
agagtcctcagccaaaagccttact

SEQ ID NO: 157236 - DNA, 25 bp, Mus musculus
agagtcctcagcgaaaagccttact

SEQ ID NO: 157237 - DNA, 25 bp, Mus musculus
agagtcctcattactgtgaagcaga

SEQ ID NO: 157238 - DNA, 25 bp, Mus musculus
agagtcctcatttctgtgaagcaga

SEQ ID NO: 157239 - DNA, 25 bp, Mus musculus
agagtcctccccacagaaagacagg

SEQ ID NO: 157240 - DNA, 25 bp, Mus musculus
agagtcctcccctcagaaagacagg

SEQ ID NO: 157241 - DNA, 25 bp, Mus musculus
agagtcctctctcaaggaccctgag

SEQ ID NO: 157242 - DNA, 25 bp, Mus musculus
agagtcctctctgaaggaccctgag

SEQ ID NO: 157243 - DNA, 25 bp, Mus musculus
agagtcctctgtcatgtgagcggct

SEQ ID NO: 157244 - DNA, 25 bp, Mus musculus
agagtcctctgtgatgtgagcggct

SEQ ID NO: 157245 - DNA, 25 bp, Mus musculus
agagtcctgaatacctactgggttg

SEQ ID NO: 157246 - DNA, 25 bp, Mus musculus
agagtcctgaattcctactgggttg

SEQ ID NO: 157247 - DNA, 25 bp, Mus musculus
agagtcctgagaagtatgcttggca

SEQ ID NO: 157248 - DNA, 25 bp, Mus musculus
agagtcctgagatgtatgcttggca

SEQ ID NO: 157249 - DNA, 25 bp, Mus musculus
agagtcctgccgcagacttgactta

SEQ ID NO: 157250 - DNA, 25 bp, Mus musculus
agagtcctgccggagacttgactta

SEQ ID NO: 157251 - DNA, 25 bp, Mus musculus
agagtcctgcctcgtttatattctg

SEQ ID NO: 157252 - DNA, 25 bp, Mus musculus
agagtcctgcctggtttatattctg

SEQ ID NO: 157253 - DNA, 25 bp, Mus musculus
agagtcctgctacctcagtcagtat

SEQ ID NO: 157254 - DNA, 25 bp, Mus musculus
agagtcctgctagctcagtcagtat

SEQ ID NO: 157255 - DNA, 25 bp, Mus musculus
agagtcctgctgagtaaattgtaaa

SEQ ID NO: 157256 - DNA, 25 bp, Mus musculus
agagtcctgctgtgtaaattgtaaa

SEQ ID NO: 157257 - DNA, 25 bp, Mus musculus
agagtcctggctcaaaaggctgtcc

SEQ ID NO: 157258 - DNA, 25 bp, Mus musculus
agagtcctggctgaaaaggctgtcc

SEQ ID NO: 157259 - DNA, 25 bp, Mus musculus
agagtcctggtgcacagccttcatt

SEQ ID NO: 157260 - DNA, 25 bp, Mus musculus
agagtcctggtggacagccttcatt

SEQ ID NO: 157261 - DNA, 25 bp, Mus musculus
agagtcctgtagctagctcgtgact

SEQ ID NO: 157262 - DNA, 25 bp, Mus musculus
agagtcctgtaggtagctcgtgact

SEQ ID NO: 157263 - DNA, 25 bp, Mus musculus
agagtcctgttaacacttagcaccc

SEQ ID NO: 157264 - DNA, 25 bp, Mus musculus
agagtcctgttatcacttagcaccc

SEQ ID NO: 157265 - DNA, 25 bp, Mus musculus
agagtccttaggagcgggtgtcaat

SEQ ID NO: 157266 - DNA, 25 bp, Mus musculus
agagtccttaggtgcgggtgtcaat

SEQ ID NO: 157267 - DNA, 25 bp, Mus musculus
agagtccttcggactcaaggcagca

SEQ ID NO: 157268 - DNA, 25 bp, Mus musculus
agagtccttcggtctcaaggcagca

SEQ ID NO: 157269 - DNA, 25 bp, Mus musculus
agagtccttctgaaattgtcccttc

SEQ ID NO: 157270 - DNA, 25 bp, Mus musculus
agagtccttctgtaattgtcccttc

SEQ ID NO: 157271 - DNA, 25 bp, Mus musculus
agagtccttgagatattccttagag

SEQ ID NO: 157272 - DNA, 25 bp, Mus musculus
agagtccttgagttattccttagag

SEQ ID NO: 157273 - DNA, 25 bp, Mus musculus
agagtccttgatcggcagctgtgct

SEQ ID NO: 157274 - DNA, 25 bp, Mus musculus
agagtccttgatgggcagctgtgct

SEQ ID NO: 157275 - DNA, 25 bp, Mus musculus
agagtcctttctcactgtagttctg

SEQ ID NO: 157276 - DNA, 25 bp, Mus musculus
agagtcctttctgactgtagttctg

SEQ ID NO: 157277 - DNA, 25 bp, Mus musculus
agagtcctttgacaggcgtgatcct

SEQ ID NO: 157278 - DNA, 25 bp, Mus musculus
agagtcctttgagaggcgtgatcct

SEQ ID NO: 157279 - DNA, 25 bp, Mus musculus
agagtcgaagaccagcggcagacat

SEQ ID NO: 157280 - DNA, 25 bp, Mus musculus
agagtcgaagacgagcggcagacat

SEQ ID NO: 157281 - DNA, 25 bp, Mus musculus
agagtcgaagctcgtctttgataat

SEQ ID NO: 157282 - DNA, 25 bp, Mus musculus
agagtcgaagctggtctttgataat

SEQ ID NO: 157283 - DNA, 25 bp, Mus musculus
agagtcgagcatcctgggcctcaag

SEQ ID NO: 157284 - DNA, 25 bp, Mus musculus
agagtcgagcatgctgggcctcaag

SEQ ID NO: 157285 - DNA, 25 bp, Mus musculus
agagtcgatatgatgccttaattac

SEQ ID NO: 157286 - DNA, 25 bp, Mus musculus
agagtcgatatgttgccttaattac

SEQ ID NO: 157287 - DNA, 25 bp, Mus musculus
agagtcgcctggagagccagtacct

SEQ ID NO: 157288 - DNA, 25 bp, Mus musculus
agagtcgcctggtgagccagtacct

SEQ ID NO: 157289 - DNA, 25 bp, Mus musculus
agagtcgccttcatcagtcactata

SEQ ID NO: 157290 - DNA, 25 bp, Mus musculus
agagtcgccttcttcagtcactata

SEQ ID NO: 157291 - DNA, 25 bp, Mus musculus
agagtcgctaaaaaccttggttctg

SEQ ID NO: 157292 - DNA, 25 bp, Mus musculus
agagtcgctaaataccttggttctg

SEQ ID NO: 157293 - DNA, 25 bp, Mus musculus
agagtcgctcagaaacatgtgccct

SEQ ID NO: 157294 - DNA, 25 bp, Mus musculus
agagtcgctcagtaacatgtgccct

SEQ ID NO: 157295 - DNA, 25 bp, Mus musculus
agagtcgctcttcccttcctttgat

SEQ ID NO: 157296 - DNA, 25 bp, Mus musculus
agagtcgctcttgccttcctttgat

SEQ ID NO: 157297 - DNA, 25 bp, Mus musculus
agagtcgcttagaggtgcagcagct

SEQ ID NO: 157298 - DNA, 25 bp, Mus musculus
agagtcgcttagtggtgcagcagct

SEQ ID NO: 157299 - DNA, 25 bp, Mus musculus
agagtcggactcctgaaaatcagaa

SEQ ID NO: 157300 - DNA, 25 bp, Mus musculus
agagtcggactcgtgaaaatcagaa

SEQ ID NO: 157301 - DNA, 25 bp, Mus musculus
agagtcggaggtccccagcttgacc

SEQ ID NO: 157302 - DNA, 25 bp, Mus musculus
agagtcggaggtgcccagcttgacc

SEQ ID NO: 157303 - DNA, 25 bp, Mus musculus
agagtcggatgtatgacccactacc

SEQ ID NO: 157304 - DNA, 25 bp, Mus musculus
agagtcggatgtttgacccactacc

SEQ ID NO: 157305 - DNA, 25 bp, Mus musculus
agagtcggcaaaaccggcagttcca

SEQ ID NO: 157306 - DNA, 25 bp, Mus musculus
agagtcggcaaatccggcagttcca

SEQ ID NO: 157307 - DNA, 25 bp, Mus musculus
agagtcggcacacgtgaacttccag

SEQ ID NO: 157308 - DNA, 25 bp, Mus musculus
agagtcggcacaggtgaacttccag

SEQ ID NO: 157309 - DNA, 25 bp, Mus musculus
agagtcggcagcaacgctcaggtct

SEQ ID NO: 157310 - DNA, 25 bp, Mus musculus
agagtcggcagctacgctcaggtct

SEQ ID NO: 157311 - DNA, 25 bp, Mus musculus
agagtcggccggaacacattcactg

SEQ ID NO: 157312 - DNA, 25 bp, Mus musculus
agagtcggccggtacacattcactg

SEQ ID NO: 157313 - DNA, 25 bp, Mus musculus
agagtcggttccaaggctttcaggg

SEQ ID NO: 157314 - DNA, 25 bp, Mus musculus
agagtcggttcctaggctttcaggg

SEQ ID NO: 157315 - DNA, 25 bp, Mus musculus
agagtcggttgaaagctgcctccag

SEQ ID NO: 157316 - DNA, 25 bp, Mus musculus
agagtcggttgatagctgcctccag

SEQ ID NO: 157317 - DNA, 25 bp, Mus musculus
agagtcgtagctcctggcaccagag

SEQ ID NO: 157318 - DNA, 25 bp, Mus musculus
agagtcgtagctgctggcaccagag

SEQ ID NO: 157319 - DNA, 25 bp, Mus musculus
agagtcgtcggtaccagcacttctc

SEQ ID NO: 157320 - DNA, 25 bp, Mus musculus
agagtcgtcggttccagcacttctc

SEQ ID NO: 157321 - DNA, 25 bp, Mus musculus
agagtcgtctgaccagagtggcact

SEQ ID NO: 157322 - DNA, 25 bp, Mus musculus
agagtcgtctgagcagagtggcact

SEQ ID NO: 157323 - DNA, 25 bp, Mus musculus
agagtcgtgaatagagctcgccaga

SEQ ID NO: 157324 - DNA, 25 bp, Mus musculus
agagtcgtgaattgagctcgccaga

SEQ ID NO: 157325 - DNA, 25 bp, Mus musculus
agagtcgttctgagtctgcagacct

SEQ ID NO: 157326 - DNA, 25 bp, Mus musculus
agagtcgttctgtgtctgcagacct

SEQ ID NO: 157327 - DNA, 25 bp, Mus musculus
agagtctaaagccagacgcccaggt

SEQ ID NO: 157328 - DNA, 25 bp, Mus musculus
agagtctaaagcgagacgcccaggt

SEQ ID NO: 157329 - DNA, 25 bp, Mus musculus
agagtctaagaacattgaacacttt

SEQ ID NO: 157330 - DNA, 25 bp, Mus musculus
agagtctaagaagattgaacacttt

SEQ ID NO: 157331 - DNA, 25 bp, Mus musculus
agagtctaatctcagggccttaacc

SEQ ID NO: 157332 - DNA, 25 bp, Mus musculus
agagtctaatctgagggccttaacc

SEQ ID NO: 157333 - DNA, 25 bp, Mus musculus
agagtctacactacaggctgtggct

SEQ ID NO: 157334 - DNA, 25 bp, Mus musculus
agagtctacacttcaggctgtggct

SEQ ID NO: 157335 - DNA, 25 bp, Mus musculus
agagtctagaggaattgccaacatt

SEQ ID NO: 157336 - DNA, 25 bp, Mus musculus
agagtctagaggtattgccaacatt

SEQ ID NO: 157337 - DNA, 25 bp, Mus musculus
agagtctagcagacggctcgggatc

SEQ ID NO: 157338 - DNA, 25 bp, Mus musculus
agagtctagcagtcggctcgggatc

SEQ ID NO: 157339 - DNA, 25 bp, Mus musculus
agagtctagcccattgttcagcctg

SEQ ID NO: 157340 - DNA, 25 bp, Mus musculus
agagtctagccctttgttcagcctg

SEQ ID NO: 157341 - DNA, 25 bp, Mus musculus
agagtctaggatcggttcattacat

SEQ ID NO: 157342 - DNA, 25 bp, Mus musculus
agagtctaggatgggttcattacat

SEQ ID NO: 157343 - DNA, 25 bp, Mus musculus
agagtctaggcaacccttaccagga

SEQ ID NO: 157344 - DNA, 25 bp, Mus musculus
agagtctaggcatcccttaccagga

SEQ ID NO: 157345 - DNA, 25 bp, Mus musculus
agagtctagtaactgtctctagcca

SEQ ID NO: 157346 - DNA, 25 bp, Mus musculus
agagtctagtaagtgtctctagcca

SEQ ID NO: 157347 - DNA, 25 bp, Mus musculus
agagtctatagtctgaacctggcca

SEQ ID NO: 157348 - DNA, 25 bp, Mus musculus
agagtctatagtgtgaacctggcca

SEQ ID NO: 157349 - DNA, 25 bp, Mus musculus
agagtctatgtgagactttggcatg

SEQ ID NO: 157350 - DNA, 25 bp, Mus musculus
agagtctatgtgtgactttggcatg

SEQ ID NO: 157351 - DNA, 25 bp, Mus musculus
agagtctcaaggagatgcctgcctt

SEQ ID NO: 157352 - DNA, 25 bp, Mus musculus
agagtctcaaggtgatgcctgcctt

SEQ ID NO: 157353 - DNA, 25 bp, Mus musculus
agagtctcactgagctgtcatctga

SEQ ID NO: 157354 - DNA, 25 bp, Mus musculus
agagtctcactgtgctgtcatctga

SEQ ID NO: 157355 - DNA, 25 bp, Mus musculus
agagtctcagagctagtggcatgat

SEQ ID NO: 157356 - DNA, 25 bp, Mus musculus
agagtctcagaggtagtggcatgat

SEQ ID NO: 157357 - DNA, 25 bp, Mus musculus
agagtctcagccctgaagccacatt

SEQ ID NO: 157358 - DNA, 25 bp, Mus musculus
agagtctcagccgtgaagccacatt

SEQ ID NO: 157359 - DNA, 25 bp, Mus musculus
agagtctcagtaaaagagcaatgca

SEQ ID NO: 157360 - DNA, 25 bp, Mus musculus
agagtctcagtataagagcaatgca

SEQ ID NO: 157361 - DNA, 25 bp, Mus musculus
agagtctcccagagtcatgtcttct

SEQ ID NO: 157362 - DNA, 25 bp, Mus musculus
agagtctcccagatagccctgctgg

SEQ ID NO: 157363 - DNA, 25 bp, Mus musculus
agagtctcccagtgtcatgtcttct

SEQ ID NO: 157364 - DNA, 25 bp, Mus musculus
agagtctcccagttagccctgctgg

SEQ ID NO: 157365 - DNA, 25 bp, Mus musculus
agagtctccccaacatgcaagatac

SEQ ID NO: 157366 - DNA, 25 bp, Mus musculus
agagtctccccatcatgcaagatac

SEQ ID NO: 157367 - DNA, 25 bp, Mus musculus
agagtctccctgatgaagtttgtgt

SEQ ID NO: 157368 - DNA, 25 bp, Mus musculus
agagtctccctgttgaagtttgtgt

SEQ ID NO: 157369 - DNA, 25 bp, Mus musculus
agagtctcctgccaataacactgaa

SEQ ID NO: 157370 - DNA, 25 bp, Mus musculus
agagtctcctgcgaataacactgaa

SEQ ID NO: 157371 - DNA, 25 bp, Mus musculus
agagtctccttgcagcctacaggct

SEQ ID NO: 157372 - DNA, 25 bp, Mus musculus
agagtctccttggagcctacaggct

SEQ ID NO: 157373 - DNA, 25 bp, Mus musculus
agagtctcctttccgacatatcttc

SEQ ID NO: 157374 - DNA, 25 bp, Mus musculus
agagtctcctttgcgacatatcttc

SEQ ID NO: 157375 - DNA, 25 bp, Mus musculus
agagtctcgcttaaaaccctttcag

SEQ ID NO: 157376 - DNA, 25 bp, Mus musculus
agagtctcgctttaaaccctttcag

SEQ ID NO: 157377 - DNA, 25 bp, Mus musculus
agagtctcggctctgacgcggtctt

SEQ ID NO: 157378 - DNA, 25 bp, Mus musculus
agagtctcggctgtgacgcggtctt

SEQ ID NO: 157379 - DNA, 25 bp, Mus musculus
agagtctctaatcttgcctactccc

SEQ ID NO: 157380 - DNA, 25 bp, Mus musculus
agagtctctaatgttgcctactccc

SEQ ID NO: 157381 - DNA, 25 bp, Mus musculus
agagtctctccgctcaaaggttgat

SEQ ID NO: 157382 - DNA, 25 bp, Mus musculus
agagtctctccggtcaaaggttgat

SEQ ID NO: 157383 - DNA, 25 bp, Mus musculus
agagtctctgacaccaagtccaaag

SEQ ID NO: 157384 - DNA, 25 bp, Mus musculus
agagtctctgacagccatggtatac

SEQ ID NO: 157385 - DNA, 25 bp, Mus musculus
agagtctctgacagttgagtcctgc

SEQ ID NO: 157386 - DNA, 25 bp, Mus musculus
agagtctctgactccaagtccaaag

SEQ ID NO: 157387 - DNA, 25 bp, Mus musculus
agagtctctgactgccatggtatac

SEQ ID NO: 157388 - DNA, 25 bp, Mus musculus
agagtctctgactgttgagtcctgc

SEQ ID NO: 157389 - DNA, 25 bp, Mus musculus
agagtctctgctagccatgtttgat

SEQ ID NO: 157390 - DNA, 25 bp, Mus musculus
agagtctctgcttgccatgtttgat

SEQ ID NO: 157391 - DNA, 25 bp, Mus musculus
agagtctctgtcactgcgattcttg

SEQ ID NO: 157392 - DNA, 25 bp, Mus musculus
agagtctctgtctctgcgattcttg

SEQ ID NO: 157393 - DNA, 25 bp, Mus musculus
agagtctctttacgccccaaatcta

SEQ ID NO: 157394 - DNA, 25 bp, Mus musculus
agagtctctttaggccccaaatcta

SEQ ID NO: 157395 - DNA, 25 bp, Mus musculus
agagtctgaactccggatccctatt

SEQ ID NO: 157396 - DNA, 25 bp, Mus musculus
agagtctgaactgcggatccctatt

SEQ ID NO: 157397 - DNA, 25 bp, Mus musculus
agagtctgacacaaggttttcacag

SEQ ID NO: 157398 - DNA, 25 bp, Mus musculus
agagtctgacactaggttttcacag

SEQ ID NO: 157399 - DNA, 25 bp, Mus musculus
agagtctgactgcttggctacgtac

SEQ ID NO: 157400 - DNA, 25 bp, Mus musculus
agagtctgactggttggctacgtac

SEQ ID NO: 157401 - DNA, 25 bp, Mus musculus
agagtctgagccagatgttcaccct

SEQ ID NO: 157402 - DNA, 25 bp, Mus musculus
agagtctgagcctgatgttcaccct

SEQ ID NO: 157403 - DNA, 25 bp, Mus musculus
agagtctgcacacgcctaggcttac

SEQ ID NO: 157404 - DNA, 25 bp, Mus musculus
agagtctgcacaggcctaggcttac

SEQ ID NO: 157405 - DNA, 25 bp, Mus musculus
agagtctgccacctatcagcaggaa

SEQ ID NO: 157406 - DNA, 25 bp, Mus musculus
agagtctgccacgtatcagcaggaa

SEQ ID NO: 157407 - DNA, 25 bp, Mus musculus
agagtctgcccacctgaggactaag

SEQ ID NO: 157408 - DNA, 25 bp, Mus musculus
agagtctgcccagctgaggactaag

SEQ ID NO: 157409 - DNA, 25 bp, Mus musculus
agagtctgccgtccggacagctgct

SEQ ID NO: 157410 - DNA, 25 bp, Mus musculus
agagtctgccgtgcggacagctgct

SEQ ID NO: 157411 - DNA, 25 bp, Mus musculus
agagtctgcctgctttgggcatgca

SEQ ID NO: 157412 - DNA, 25 bp, Mus musculus
agagtctgcctggtttgggcatgca

SEQ ID NO: 157413 - DNA, 25 bp, Mus musculus
agagtctgccttatccttagaatag

SEQ ID NO: 157414 - DNA, 25 bp, Mus musculus
agagtctgccttttccttagaatag

SEQ ID NO: 157415 - DNA, 25 bp, Mus musculus
agagtctgcttgctcagagcctttc

SEQ ID NO: 157416 - DNA, 25 bp, Mus musculus
agagtctgcttggtcagagcctttc

SEQ ID NO: 157417 - DNA, 25 bp, Mus musculus
agagtctggacaactggctcgggaa

SEQ ID NO: 157418 - DNA, 25 bp, Mus musculus
agagtctggacaatttctggccttc

SEQ ID NO: 157419 - DNA, 25 bp, Mus musculus
agagtctggacatctggctcgggaa

SEQ ID NO: 157420 - DNA, 25 bp, Mus musculus
agagtctggacattttctggccttc

SEQ ID NO: 157421 - DNA, 25 bp, Mus musculus
agagtctggagaaagctcccttccc

SEQ ID NO: 157422 - DNA, 25 bp, Mus musculus
agagtctggagatagctcccttccc

SEQ ID NO: 157423 - DNA, 25 bp, Mus musculus
agagtctggcatacctgcattttag

SEQ ID NO: 157424 - DNA, 25 bp, Mus musculus
agagtctggcattcctgcattttag

SEQ ID NO: 157425 - DNA, 25 bp, Mus musculus
agagtctggcctctcttaactagaa

SEQ ID NO: 157426 - DNA, 25 bp, Mus musculus
agagtctggcctgtcttaactagaa

SEQ ID NO: 157427 - DNA, 25 bp, Mus musculus
agagtctgggcacctacaggctcag

SEQ ID NO: 157428 - DNA, 25 bp, Mus musculus
agagtctgggcagctacaggctcag

SEQ ID NO: 157429 - DNA, 25 bp, Mus musculus
agagtctggtaccagaccacgcacg

SEQ ID NO: 157430 - DNA, 25 bp, Mus musculus
agagtctggtacgagaccacgcacg

SEQ ID NO: 157431 - DNA, 25 bp, Mus musculus
agagtctggttgagcacggatcccg

SEQ ID NO: 157432 - DNA, 25 bp, Mus musculus
agagtctggttgtgcacggatcccg

SEQ ID NO: 157433 - DNA, 25 bp, Mus musculus
agagtctgtctcctgcagaatgtct

SEQ ID NO: 157434 - DNA, 25 bp, Mus musculus
agagtctgtctcgtgcagaatgtct

SEQ ID NO: 157435 - DNA, 25 bp, Mus musculus
agagtctgtggcatccaccaaccag

SEQ ID NO: 157436 - DNA, 25 bp, Mus musculus
agagtctgtggcttccaccaaccag

SEQ ID NO: 157437 - DNA, 25 bp, Mus musculus
agagtctgtgtgaacaaagctagcg

SEQ ID NO: 157438 - DNA, 25 bp, Mus musculus
agagtctgtgtgtacaaagctagcg

SEQ ID NO: 157439 - DNA, 25 bp, Mus musculus
agagtctgttctcacatacacacct

SEQ ID NO: 157440 - DNA, 25 bp, Mus musculus
agagtctgttctgacatacacacct

SEQ ID NO: 157441 - DNA, 25 bp, Mus musculus
agagtctgtttgcatttgacacggg

SEQ ID NO: 157442 - DNA, 25 bp, Mus musculus
agagtctgtttggatttgacacggg

SEQ ID NO: 157443 - DNA, 25 bp, Mus musculus
agagtcttatatccctgtgtctgag

SEQ ID NO: 157444 - DNA, 25 bp, Mus musculus
agagtcttatatgcctgtgtctgag

SEQ ID NO: 157445 - DNA, 25 bp, Mus musculus
agagtcttcaagcagcgacagtggt

SEQ ID NO: 157446 - DNA, 25 bp, Mus musculus
agagtcttcaaggagcgacagtggt

SEQ ID NO: 157447 - DNA, 25 bp, Mus musculus
agagtcttcccactttttcttctgt

SEQ ID NO: 157448 - DNA, 25 bp, Mus musculus
agagtcttcccagtttttcttctgt

SEQ ID NO: 157449 - DNA, 25 bp, Mus musculus
agagtcttcctcatgatgtgtagtg

SEQ ID NO: 157450 - DNA, 25 bp, Mus musculus
agagtcttcctcttgatgtgtagtg

SEQ ID NO: 157451 - DNA, 25 bp, Mus musculus
agagtcttctaaaccgtgaacccaa

SEQ ID NO: 157452 - DNA, 25 bp, Mus musculus
agagtcttctaatccgtgaacccaa

SEQ ID NO: 157453 - DNA, 25 bp, Mus musculus
agagtcttctagaatgttctctgaa

SEQ ID NO: 157454 - DNA, 25 bp, Mus musculus
agagtcttctagtatgttctctgaa

SEQ ID NO: 157455 - DNA, 25 bp, Mus musculus
agagtcttctataatgtaccatgct

SEQ ID NO: 157456 - DNA, 25 bp, Mus musculus
agagtcttctattatgtaccatgct

SEQ ID NO: 157457 - DNA, 25 bp, Mus musculus
agagtcttctctcggtaattgctgg

SEQ ID NO: 157458 - DNA, 25 bp, Mus musculus
agagtcttctctgggtaattgctgg

SEQ ID NO: 157459 - DNA, 25 bp, Mus musculus
agagtcttgctgaaacagccccagc

SEQ ID NO: 157460 - DNA, 25 bp, Mus musculus
agagtcttgctgtaacagccccagc

SEQ ID NO: 157461 - DNA, 25 bp, Mus musculus
agagtcttgtcaactcgtcaccatg

SEQ ID NO: 157462 - DNA, 25 bp, Mus musculus
agagtcttgtcatctcgtcaccatg

SEQ ID NO: 157463 - DNA, 25 bp, Mus musculus
agagtcttttgaatgcgctgtgtac

SEQ ID NO: 157464 - DNA, 25 bp, Mus musculus
agagtcttttgattgcgctgtgtac

SEQ ID NO: 157465 - DNA, 25 bp, Mus musculus
agagtgaaaactagcctggcatgtg

SEQ ID NO: 157466 - DNA, 25 bp, Mus musculus
agagtgaaaacttgcctggcatgtg

SEQ ID NO: 157467 - DNA, 25 bp, Mus musculus
agagtgaaacgtctggtcccatgca

SEQ ID NO: 157468 - DNA, 25 bp, Mus musculus
agagtgaaacgtgtggtcccatgca

SEQ ID NO: 157469 - DNA, 25 bp, Mus musculus
agagtgaaagcaacttcctccttgt

SEQ ID NO: 157470 - DNA, 25 bp, Mus musculus
agagtgaaagcatcttcctccttgt

SEQ ID NO: 157471 - DNA, 25 bp, Mus musculus
agagtgaaatcacgagcctcccaag

SEQ ID NO: 157472 - DNA, 25 bp, Mus musculus
agagtgaaatcaggagcctcccaag

SEQ ID NO: 157473 - DNA, 25 bp, Mus musculus
agagtgaacagcagccaccgtcgga

SEQ ID NO: 157474 - DNA, 25 bp, Mus musculus
agagtgaacagctgccaccgtcgga

SEQ ID NO: 157475 - DNA, 25 bp, Mus musculus
agagtgaacagtatcagccccggtt

SEQ ID NO: 157476 - DNA, 25 bp, Mus musculus
agagtgaacagtttcagccccggtt

SEQ ID NO: 157477 - DNA, 25 bp, Mus musculus
agagtgaacctgaggcacagtccca

SEQ ID NO: 157478 - DNA, 25 bp, Mus musculus
agagtgaacctgtggcacagtccca

SEQ ID NO: 157479 - DNA, 25 bp, Mus musculus
agagtgaactatcgacacgtcccca

SEQ ID NO: 157480 - DNA, 25 bp, Mus musculus
agagtgaactatggacacgtcccca

SEQ ID NO: 157481 - DNA, 25 bp, Mus musculus
agagtgaactgcctttcataccgct

SEQ ID NO: 157482 - DNA, 25 bp, Mus musculus
agagtgaactgcgtttcataccgct

SEQ ID NO: 157483 - DNA, 25 bp, Mus musculus
agagtgaacttaacaccctggcttc

SEQ ID NO: 157484 - DNA, 25 bp, Mus musculus
agagtgaacttatcaccctggcttc

SEQ ID NO: 157485 - DNA, 25 bp, Mus musculus
agagtgaagactatgctttccccac

SEQ ID NO: 157486 - DNA, 25 bp, Mus musculus
agagtgaagactttgctttccccac

SEQ ID NO: 157487 - DNA, 25 bp, Mus musculus
agagtgaagcccacgggatccattc

SEQ ID NO: 157488 - DNA, 25 bp, Mus musculus
agagtgaagccctcgggatccattc

SEQ ID NO: 157489 - DNA, 25 bp, Mus musculus
agagtgaagcctcacacctgagttc

SEQ ID NO: 157490 - DNA, 25 bp, Mus musculus
agagtgaagcctgacacctgagttc

SEQ ID NO: 157491 - DNA, 25 bp, Mus musculus
agagtgaagtcaacgtgtgctataa

SEQ ID NO: 157492 - DNA, 25 bp, Mus musculus
agagtgaagtcatcgtgtgctataa

SEQ ID NO: 157493 - DNA, 25 bp, Mus musculus
agagtgaagtctcccattgcccggc

SEQ ID NO: 157494 - DNA, 25 bp, Mus musculus
agagtgaagtctgccattgcccggc

SEQ ID NO: 157495 - DNA, 25 bp, Mus musculus
agagtgaatctgaaattgtgccaaa

SEQ ID NO: 157496 - DNA, 25 bp, Mus musculus
agagtgaatctgtaattgtgccaaa

SEQ ID NO: 157497 - DNA, 25 bp, Mus musculus
agagtgacacacagttgggtgaaca

SEQ ID NO: 157498 - DNA, 25 bp, Mus musculus
agagtgacacactgttgggtgaaca

SEQ ID NO: 157499 - DNA, 25 bp, Mus musculus
agagtgacacggcacccgatagcga

SEQ ID NO: 157500 - DNA, 25 bp, Mus musculus
agagtgacacgggacccgatagcga

SEQ ID NO: 157501 - DNA, 25 bp, Mus musculus
agagtgacactacgcctgaagtcca

SEQ ID NO: 157502 - DNA, 25 bp, Mus musculus
agagtgacactaggcctgaagtcca

SEQ ID NO: 157503 - DNA, 25 bp, Mus musculus
agagtgacagacaactcctcccttc

SEQ ID NO: 157504 - DNA, 25 bp, Mus musculus
agagtgacagactactcctcccttc

SEQ ID NO: 157505 - DNA, 25 bp, Mus musculus
agagtgacagatacaccagaatttc

SEQ ID NO: 157506 - DNA, 25 bp, Mus musculus
agagtgacagattcaccagaatttc

SEQ ID NO: 157507 - DNA, 25 bp, Mus musculus
agagtgacatcgacagcaccgcgga

SEQ ID NO: 157508 - DNA, 25 bp, Mus musculus
agagtgacatcgtcagcaccgcgga

SEQ ID NO: 157509 - DNA, 25 bp, Mus musculus
agagtgaccagaagcagggctacct

SEQ ID NO: 157510 - DNA, 25 bp, Mus musculus
agagtgaccagatgcagggctacct

SEQ ID NO: 157511 - DNA, 25 bp, Mus musculus
agagtgaccaggatgtgggcattca

SEQ ID NO: 157512 - DNA, 25 bp, Mus musculus
agagtgaccaggttgtgggcattca

SEQ ID NO: 157513 - DNA, 25 bp, Mus musculus
agagtgaccattaaacttgaccctt

SEQ ID NO: 157514 - DNA, 25 bp, Mus musculus
agagtgaccatttaacttgaccctt

SEQ ID NO: 157515 - DNA, 25 bp, Mus musculus
agagtgacccacacctgaaccctga

SEQ ID NO: 157516 - DNA, 25 bp, Mus musculus
agagtgacccactcctgaaccctga

SEQ ID NO: 157517 - DNA, 25 bp, Mus musculus
agagtgaccccgagtctggagaaga

SEQ ID NO: 157518 - DNA, 25 bp, Mus musculus
agagtgaccccgtgtctggagaaga

SEQ ID NO: 157519 - DNA, 25 bp, Mus musculus
agagtgaccctcctttcatcggaaa

SEQ ID NO: 157520 - DNA, 25 bp, Mus musculus
agagtgaccctcgtttcatcggaaa

SEQ ID NO: 157521 - DNA, 25 bp, Mus musculus
agagtgaccgataagcgctgctcca

SEQ ID NO: 157522 - DNA, 25 bp, Mus musculus
agagtgaccgattagcgctgctcca

SEQ ID NO: 157523 - DNA, 25 bp, Mus musculus
agagtgaccgtcctggctgctgctt

SEQ ID NO: 157524 - DNA, 25 bp, Mus musculus
agagtgaccgtcgtggctgctgctt

SEQ ID NO: 157525 - DNA, 25 bp, Mus musculus
agagtgacctctctgttattgcttc

SEQ ID NO: 157526 - DNA, 25 bp, Mus musculus
agagtgacctctgtgttattgcttc

SEQ ID NO: 157527 - DNA, 25 bp, Mus musculus
agagtgacctggaaccacttctcac

SEQ ID NO: 157528 - DNA, 25 bp, Mus musculus
agagtgacctggtaccacttctcac

SEQ ID NO: 157529 - DNA, 25 bp, Mus musculus
agagtgactcccaaaaattgagact

SEQ ID NO: 157530 - DNA, 25 bp, Mus musculus
agagtgactccctaaaattgagact

SEQ ID NO: 157531 - DNA, 25 bp, Mus musculus
agagtgactgagaagcctgactata

SEQ ID NO: 157532 - DNA, 25 bp, Mus musculus
agagtgactgagtagcctgactata

SEQ ID NO: 157533 - DNA, 25 bp, Mus musculus
agagtgactgcaactcatcgccatt

SEQ ID NO: 157534 - DNA, 25 bp, Mus musculus
agagtgactgcatctcatcgccatt

SEQ ID NO: 157535 - DNA, 25 bp, Mus musculus
agagtgactgctcagtgtctcctta

SEQ ID NO: 157536 - DNA, 25 bp, Mus musculus
agagtgactgctgagtgtctcctta

SEQ ID NO: 157537 - DNA, 25 bp, Mus musculus
agagtgactggcatcttcagctgga

SEQ ID NO: 157538 - DNA, 25 bp, Mus musculus
agagtgactggcttcttcagctgga

SEQ ID NO: 157539 - DNA, 25 bp, Mus musculus
agagtgacttaaccctgtctgtgct

SEQ ID NO: 157540 - DNA, 25 bp, Mus musculus
agagtgacttaagcctgtctgtgct

SEQ ID NO: 157541 - DNA, 25 bp, Mus musculus
agagtgagaagcatcctcctggtgg

SEQ ID NO: 157542 - DNA, 25 bp, Mus musculus
agagtgagaagcttcctcctggtgg

SEQ ID NO: 157543 - DNA, 25 bp, Mus musculus
agagtgagacatctgctgaggcaca

SEQ ID NO: 157544 - DNA, 25 bp, Mus musculus
agagtgagacatgtgctgaggcaca

SEQ ID NO: 157545 - DNA, 25 bp, Mus musculus
agagtgagacccatggttcgctgga

SEQ ID NO: 157546 - DNA, 25 bp, Mus musculus
agagtgagacccttggttcgctgga

SEQ ID NO: 157547 - DNA, 25 bp, Mus musculus
agagtgagactccttatcgctgttt

SEQ ID NO: 157548 - DNA, 25 bp, Mus musculus
agagtgagactcgttatcgctgttt

SEQ ID NO: 157549 - DNA, 25 bp, Mus musculus
agagtgagattgactcacctctggg

SEQ ID NO: 157550 - DNA, 25 bp, Mus musculus
agagtgagattgtctcacctctggg

SEQ ID NO: 157551 - DNA, 25 bp, Mus musculus
agagtgagcactcctttggccctaa

SEQ ID NO: 157552 - DNA, 25 bp, Mus musculus
agagtgagcactgctttggccctaa

SEQ ID NO: 157553 - DNA, 25 bp, Mus musculus
agagtgagcagaaccattccgacca

SEQ ID NO: 157554 - DNA, 25 bp, Mus musculus
agagtgagcagatccattccgacca

SEQ ID NO: 157555 - DNA, 25 bp, Mus musculus
agagtgagcctgacactgcccagag

SEQ ID NO: 157556 - DNA, 25 bp, Mus musculus
agagtgagcctgtcactgcccagag

SEQ ID NO: 157557 - DNA, 25 bp, Mus musculus
agagtgagcgtcatgtccctgtccc

SEQ ID NO: 157558 - DNA, 25 bp, Mus musculus
agagtgagcgtcttgtccctgtccc

SEQ ID NO: 157559 - DNA, 25 bp, Mus musculus
agagtgaggacccatcgtgcccgcc

SEQ ID NO: 157560 - DNA, 25 bp, Mus musculus
agagtgaggaccgatcgtgcccgcc

SEQ ID NO: 157561 - DNA, 25 bp, Mus musculus
agagtgaggagaaagccttgcacag

SEQ ID NO: 157562 - DNA, 25 bp, Mus musculus
agagtgaggagatagccttgcacag

SEQ ID NO: 157563 - DNA, 25 bp, Mus musculus
agagtgaggcagactctgtacagtt

SEQ ID NO: 157564 - DNA, 25 bp, Mus musculus
agagtgaggcagtctctgtacagtt

SEQ ID NO: 157565 - DNA, 25 bp, Mus musculus
agagtgaggcctcctttttgctcag

SEQ ID NO: 157566 - DNA, 25 bp, Mus musculus
agagtgaggcctgctttttgctcag

SEQ ID NO: 157567 - DNA, 25 bp, Mus musculus
agagtgagtaagaccacgaccgtgg

SEQ ID NO: 157568 - DNA, 25 bp, Mus musculus
agagtgagtaagtccacgaccgtgg

SEQ ID NO: 157569 - DNA, 25 bp, Mus musculus
agagtgagtcctccacagacagtga

SEQ ID NO: 157570 - DNA, 25 bp, Mus musculus
agagtgagtcctgcacagacagtga

SEQ ID NO: 157571 - DNA, 25 bp, Mus musculus
agagtgagtgacatttattttttgt

SEQ ID NO: 157572 - DNA, 25 bp, Mus musculus
agagtgagtgacttttattttttgt

SEQ ID NO: 157573 - DNA, 25 bp, Mus musculus
agagtgagtgagaccatatatcctg

SEQ ID NO: 157574 - DNA, 25 bp, Mus musculus
agagtgagtgagtccatatatcctg

SEQ ID NO: 157575 - DNA, 25 bp, Mus musculus
agagtgagtggcacgttgctcctaa

SEQ ID NO: 157576 - DNA, 25 bp, Mus musculus
agagtgagtggctcgttgctcctaa

SEQ ID NO: 157577 - DNA, 25 bp, Mus musculus
agagtgagttcacctcctcatgggt

SEQ ID NO: 157578 - DNA, 25 bp, Mus musculus
agagtgagttcagctcctcatgggt

SEQ ID NO: 157579 - DNA, 25 bp, Mus musculus
agagtgagttgtccatgctgtccct

SEQ ID NO: 157580 - DNA, 25 bp, Mus musculus
agagtgagttgtgcatgctgtccct

SEQ ID NO: 157581 - DNA, 25 bp, Mus musculus
agagtgataggtagtttctgccgct

SEQ ID NO: 157582 - DNA, 25 bp, Mus musculus
agagtgataggttgtttctgccgct

SEQ ID NO: 157583 - DNA, 25 bp, Mus musculus
agagtgatcgccatgcacagagata

SEQ ID NO: 157584 - DNA, 25 bp, Mus musculus
agagtgatcgccttgcacagagata

SEQ ID NO: 157585 - DNA, 25 bp, Mus musculus
agagtgatggatcttctcccaactg

SEQ ID NO: 157586 - DNA, 25 bp, Mus musculus
agagtgatggatgttctcccaactg

SEQ ID NO: 157587 - DNA, 25 bp, Mus musculus
agagtgattgtgagcttggaattaa

SEQ ID NO: 157588 - DNA, 25 bp, Mus musculus
agagtgattgtgtgcttggaattaa

SEQ ID NO: 157589 - DNA, 25 bp, Mus musculus
agagtgatttctatatatccaataa

SEQ ID NO: 157590 - DNA, 25 bp, Mus musculus
agagtgatttctttatatccaataa

SEQ ID NO: 157591 - DNA, 25 bp, Mus musculus
agagtgcaaatgcacctcctgcaag

SEQ ID NO: 157592 - DNA, 25 bp, Mus musculus
agagtgcaaatggacctcctgcaag

SEQ ID NO: 157593 - DNA, 25 bp, Mus musculus
agagtgcaaggacaagcccctggca

SEQ ID NO: 157594 - DNA, 25 bp, Mus musculus
agagtgcaaggagaagcccctggca

SEQ ID NO: 157595 - DNA, 25 bp, Mus musculus
agagtgcaaggtccttctgggaaac

SEQ ID NO: 157596 - DNA, 25 bp, Mus musculus
agagtgcaaggtgcttctgggaaac

SEQ ID NO: 157597 - DNA, 25 bp, Mus musculus
agagtgcaccaaactgtgtgtggaa

SEQ ID NO: 157598 - DNA, 25 bp, Mus musculus
agagtgcaccaatctgtgtgtggaa

SEQ ID NO: 157599 - DNA, 25 bp, Mus musculus
agagtgcacgtgagtcctccagaag

SEQ ID NO: 157600 - DNA, 25 bp, Mus musculus
agagtgcacgtgtgtcctccagaag

SEQ ID NO: 157601 - DNA, 25 bp, Mus musculus
agagtgcagtacagctcaggcacag

SEQ ID NO: 157602 - DNA, 25 bp, Mus musculus
agagtgcagtactgctcaggcacag

SEQ ID NO: 157603 - DNA, 25 bp, Mus musculus
agagtgcagtgactgaacccagcct

SEQ ID NO: 157604 - DNA, 25 bp, Mus musculus
agagtgcagtgagtgaacccagcct

SEQ ID NO: 157605 - DNA, 25 bp, Mus musculus
agagtgcatcggcattcccctacac

SEQ ID NO: 157606 - DNA, 25 bp, Mus musculus
agagtgcatcgggattcccctacac

SEQ ID NO: 157607 - DNA, 25 bp, Mus musculus
agagtgcattccaccttagatgatg

SEQ ID NO: 157608 - DNA, 25 bp, Mus musculus
agagtgcattcctccttagatgatg

SEQ ID NO: 157609 - DNA, 25 bp, Mus musculus
agagtgccacagaggtccgtctgaa

SEQ ID NO: 157610 - DNA, 25 bp, Mus musculus
agagtgccacagtggtccgtctgaa

SEQ ID NO: 157611 - DNA, 25 bp, Mus musculus
agagtgccaccgcatgccagagtga

SEQ ID NO: 157612 - DNA, 25 bp, Mus musculus
agagtgccaccggatgccagagtga

SEQ ID NO: 157613 - DNA, 25 bp, Mus musculus
agagtgccaggtcttgctgagctcc

SEQ ID NO: 157614 - DNA, 25 bp, Mus musculus
agagtgccaggtgttgctgagctcc

SEQ ID NO: 157615 - DNA, 25 bp, Mus musculus
agagtgccagtgagcttgagtccct

SEQ ID NO: 157616 - DNA, 25 bp, Mus musculus
agagtgccagtgtgcttgagtccct

SEQ ID NO: 157617 - DNA, 25 bp, Mus musculus
agagtgccagttctagttctgttat

SEQ ID NO: 157618 - DNA, 25 bp, Mus musculus
agagtgccagttgtagttctgttat

SEQ ID NO: 157619 - DNA, 25 bp, Mus musculus
agagtgccatatcgtagtgcttaca

SEQ ID NO: 157620 - DNA, 25 bp, Mus musculus
agagtgccatatggtagtgcttaca

SEQ ID NO: 157621 - DNA, 25 bp, Mus musculus
agagtgcccaccatgagagaagcca

SEQ ID NO: 157622 - DNA, 25 bp, Mus musculus
agagtgcccaccttgagagaagcca

SEQ ID NO: 157623 - DNA, 25 bp, Mus musculus
agagtgcccactcgcttaaaacgca

SEQ ID NO: 157624 - DNA, 25 bp, Mus musculus
agagtgcccactggcttaaaacgca

SEQ ID NO: 157625 - DNA, 25 bp, Mus musculus
agagtgcccgccatgaattaggcct

SEQ ID NO: 157626 - DNA, 25 bp, Mus musculus
agagtgcccgccttgaattaggcct

SEQ ID NO: 157627 - DNA, 25 bp, Mus musculus
agagtgcccttaacataatgatttg

SEQ ID NO: 157628 - DNA, 25 bp, Mus musculus
agagtgcccttatcataatgatttg

SEQ ID NO: 157629 - DNA, 25 bp, Mus musculus
agagtgcccttgagatgcccaatgg

SEQ ID NO: 157630 - DNA, 25 bp, Mus musculus
agagtgcccttgtgatgcccaatgg

SEQ ID NO: 157631 - DNA, 25 bp, Mus musculus
agagtgccggccagaataggatata

SEQ ID NO: 157632 - DNA, 25 bp, Mus musculus
agagtgccggcctgaataggatata

SEQ ID NO: 157633 - DNA, 25 bp, Mus musculus
agagtgccggctcgctggaccattc

SEQ ID NO: 157634 - DNA, 25 bp, Mus musculus
agagtgccggctggctggaccattc

SEQ ID NO: 157635 - DNA, 25 bp, Mus musculus
agagtgccgtgtctgtacagcagcc

SEQ ID NO: 157636 - DNA, 25 bp, Mus musculus
agagtgccgtgtgtgtacagcagcc

SEQ ID NO: 157637 - DNA, 25 bp, Mus musculus
agagtgcctctgaatggccctcggt

SEQ ID NO: 157638 - DNA, 25 bp, Mus musculus
agagtgcctctgtatggccctcggt

SEQ ID NO: 157639 - DNA, 25 bp, Mus musculus
agagtgcctcttcaaggttctccca

SEQ ID NO: 157640 - DNA, 25 bp, Mus musculus
agagtgcctcttgaaggttctccca

SEQ ID NO: 157641 - DNA, 25 bp, Mus musculus
agagtgcctggaccttcctttggac

SEQ ID NO: 157642 - DNA, 25 bp, Mus musculus
agagtgcctggagcttcctttggac

SEQ ID NO: 157643 - DNA, 25 bp, Mus musculus
agagtgcctggtacacagctccaaa

SEQ ID NO: 157644 - DNA, 25 bp, Mus musculus
agagtgcctggttcacagctccaaa

SEQ ID NO: 157645 - DNA, 25 bp, Mus musculus
agagtgccttccagttaggacaggg

SEQ ID NO: 157646 - DNA, 25 bp, Mus musculus
agagtgccttcctgttaggacaggg

SEQ ID NO: 157647 - DNA, 25 bp, Mus musculus
agagtgccttggaagtgacgccaga

SEQ ID NO: 157648 - DNA, 25 bp, Mus musculus
agagtgccttggtagtgacgccaga

SEQ ID NO: 157649 - DNA, 25 bp, Mus musculus
agagtgcgcccacgagaaacaagct

SEQ ID NO: 157650 - DNA, 25 bp, Mus musculus
agagtgcgcccaggagaaacaagct

SEQ ID NO: 157651 - DNA, 25 bp, Mus musculus
agagtgcgcctgattgtaactcacg

SEQ ID NO: 157652 - DNA, 25 bp, Mus musculus
agagtgcgcctgtttgtaactcacg

SEQ ID NO: 157653 - DNA, 25 bp, Mus musculus
agagtgctaatccagccagccagtt

SEQ ID NO: 157654 - DNA, 25 bp, Mus musculus
agagtgctaatcgagccagccagtt

SEQ ID NO: 157655 - DNA, 25 bp, Mus musculus
agagtgctacatagcacccttgtga

SEQ ID NO: 157656 - DNA, 25 bp, Mus musculus
agagtgctacattgcacccttgtga

SEQ ID NO: 157657 - DNA, 25 bp, Mus musculus
agagtgctagctacatcattttatc

SEQ ID NO: 157658 - DNA, 25 bp, Mus musculus
agagtgctagcttcatcattttatc

SEQ ID NO: 157659 - DNA, 25 bp, Mus musculus
agagtgctagtccagcacagggccc

SEQ ID NO: 157660 - DNA, 25 bp, Mus musculus
agagtgctagtcgagcacagggccc

SEQ ID NO: 157661 - DNA, 25 bp, Mus musculus
agagtgctatgcctctcatttagcc

SEQ ID NO: 157662 - DNA, 25 bp, Mus musculus
agagtgctatgcgtctcatttagcc

SEQ ID NO: 157663 - DNA, 25 bp, Mus musculus
agagtgctctcaacgcctacaaggt

SEQ ID NO: 157664 - DNA, 25 bp, Mus musculus
agagtgctctcatcgcctacaaggt

SEQ ID NO: 157665 - DNA, 25 bp, Mus musculus
agagtgctctggacttgtatctggc

SEQ ID NO: 157666 - DNA, 25 bp, Mus musculus
agagtgctctggtcttgtatctggc

SEQ ID NO: 157667 - DNA, 25 bp, Mus musculus
agagtgctctgtccagccatttgag

SEQ ID NO: 157668 - DNA, 25 bp, Mus musculus
agagtgctctgtgcagccatttgag

SEQ ID NO: 157669 - DNA, 25 bp, Mus musculus
agagtgctgcttcaccactgaacta

SEQ ID NO: 157670 - DNA, 25 bp, Mus musculus
agagtgctgcttcttcaccatgtgg

SEQ ID NO: 157671 - DNA, 25 bp, Mus musculus
agagtgctgcttgaccactgaacta

SEQ ID NO: 157672 - DNA, 25 bp, Mus musculus
agagtgctgcttgttcaccatgtgg

SEQ ID NO: 157673 - DNA, 25 bp, Mus musculus
agagtgctggacaccggctggccaa

SEQ ID NO: 157674 - DNA, 25 bp, Mus musculus
agagtgctggactccggctggccaa

SEQ ID NO: 157675 - DNA, 25 bp, Mus musculus
agagtgctgggcatgggcttcttcc

SEQ ID NO: 157676 - DNA, 25 bp, Mus musculus
agagtgctgggcttgggcttcttcc

SEQ ID NO: 157677 - DNA, 25 bp, Mus musculus
agagtgctgtgacctcttcccttgg

SEQ ID NO: 157678 - DNA, 25 bp, Mus musculus
agagtgctgtgagctcttcccttgg

SEQ ID NO: 157679 - DNA, 25 bp, Mus musculus
agagtgctgttcacctaaagggcta

SEQ ID NO: 157680 - DNA, 25 bp, Mus musculus
agagtgctgttctcctaaagggcta

SEQ ID NO: 157681 - DNA, 25 bp, Mus musculus
agagtgcttccacaattgtgtttga

SEQ ID NO: 157682 - DNA, 25 bp, Mus musculus
agagtgcttccagaattgtgtttga

SEQ ID NO: 157683 - DNA, 25 bp, Mus musculus
agagtgcttcctctcagaatgtcgc

SEQ ID NO: 157684 - DNA, 25 bp, Mus musculus
agagtgcttcctgtcagaatgtcgc

SEQ ID NO: 157685 - DNA, 25 bp, Mus musculus
agagtgcttcgcagtgaaccctgca

SEQ ID NO: 157686 - DNA, 25 bp, Mus musculus
agagtgcttcgctgtgaaccctgca

SEQ ID NO: 157687 - DNA, 25 bp, Mus musculus
agagtgcttgacaagcactggcttc

SEQ ID NO: 157688 - DNA, 25 bp, Mus musculus
agagtgcttgactagcactggcttc

SEQ ID NO: 157689 - DNA, 25 bp, Mus musculus
agagtgcttgatcccatgctcccat

SEQ ID NO: 157690 - DNA, 25 bp, Mus musculus
agagtgcttgatgccatgctcccat

SEQ ID NO: 157691 - DNA, 25 bp, Mus musculus
agagtgcttgccaactatgcatgga

SEQ ID NO: 157692 - DNA, 25 bp, Mus musculus
agagtgcttgcctactatgcatgga

SEQ ID NO: 157693 - DNA, 25 bp, Mus musculus
agagtgcttgctctttattgttatt

SEQ ID NO: 157694 - DNA, 25 bp, Mus musculus
agagtgcttgctgtttattgttatt

SEQ ID NO: 157695 - DNA, 25 bp, Mus musculus
agagtggaaccacattcctcctacg

SEQ ID NO: 157696 - DNA, 25 bp, Mus musculus
agagtggaaccagattcctcctacg

SEQ ID NO: 157697 - DNA, 25 bp, Mus musculus
agagtggaactcataggtgtggaaa

SEQ ID NO: 157698 - DNA, 25 bp, Mus musculus
agagtggaactcttaggtgtggaaa

SEQ ID NO: 157699 - DNA, 25 bp, Mus musculus
agagtggaccaactgctttaatgca

SEQ ID NO: 157700 - DNA, 25 bp, Mus musculus
agagtggaccaagtgctttaatgca

SEQ ID NO: 157701 - DNA, 25 bp, Mus musculus
agagtggacctgcaagcctactgga

SEQ ID NO: 157702 - DNA, 25 bp, Mus musculus
agagtggacctggaagcctactgga

SEQ ID NO: 157703 - DNA, 25 bp, Mus musculus
agagtggacggccagggtttaggct

SEQ ID NO: 157704 - DNA, 25 bp, Mus musculus
agagtggacggcgagggtttaggct

SEQ ID NO: 157705 - DNA, 25 bp, Mus musculus
agagtggactaaagcgcggacccgc

SEQ ID NO: 157706 - DNA, 25 bp, Mus musculus
agagtggactaatgcgcggacccgc

SEQ ID NO: 157707 - DNA, 25 bp, Mus musculus
agagtggactgcctttttagccctt

SEQ ID NO: 157708 - DNA, 25 bp, Mus musculus
agagtggactgcgtttttagccctt

SEQ ID NO: 157709 - DNA, 25 bp, Mus musculus
agagtggagcctactgttgcctgaa

SEQ ID NO: 157710 - DNA, 25 bp, Mus musculus
agagtggagcctctgctctgctctg

SEQ ID NO: 157711 - DNA, 25 bp, Mus musculus
agagtggagcctgtgctctgctctg

SEQ ID NO: 157712 - DNA, 25 bp, Mus musculus
agagtggagccttctgttgcctgaa

SEQ ID NO: 157713 - DNA, 25 bp, Mus musculus
agagtggagtcaccttaacacccag

SEQ ID NO: 157714 - DNA, 25 bp, Mus musculus
agagtggagtcagcttaacacccag

SEQ ID NO: 157715 - DNA, 25 bp, Mus musculus
agagtggatcacaactatctcagat

SEQ ID NO: 157716 - DNA, 25 bp, Mus musculus
agagtggatcactactatctcagat

SEQ ID NO: 157717 - DNA, 25 bp, Mus musculus
agagtggcacagctctgcgcccaga

SEQ ID NO: 157718 - DNA, 25 bp, Mus musculus
agagtggcacaggtctgcgcccaga

SEQ ID NO: 157719 - DNA, 25 bp, Mus musculus
agagtggcaggtacctagaatccca

SEQ ID NO: 157720 - DNA, 25 bp, Mus musculus
agagtggcaggttcctagaatccca

SEQ ID NO: 157721 - DNA, 25 bp, Mus musculus
agagtggcctagagttgctttccga

SEQ ID NO: 157722 - DNA, 25 bp, Mus musculus
agagtggcctagtgttgctttccga

SEQ ID NO: 157723 - DNA, 25 bp, Mus musculus
agagtggccttgagctgtccctctg

SEQ ID NO: 157724 - DNA, 25 bp, Mus musculus
agagtggccttgtgctgtccctctg

SEQ ID NO: 157725 - DNA, 25 bp, Mus musculus
agagtggcctttcgtccttctgctc

SEQ ID NO: 157726 - DNA, 25 bp, Mus musculus
agagtggcctttggtccttctgctc

SEQ ID NO: 157727 - DNA, 25 bp, Mus musculus
agagtggcgctgcaaatatttcaac

SEQ ID NO: 157728 - DNA, 25 bp, Mus musculus
agagtggcgctggaaatatttcaac

SEQ ID NO: 157729 - DNA, 25 bp, Mus musculus
agagtggcgtgcacagtttagacag

SEQ ID NO: 157730 - DNA, 25 bp, Mus musculus
agagtggcgtgctcagtttagacag

SEQ ID NO: 157731 - DNA, 25 bp, Mus musculus
agagtggctagcactccccggagag

SEQ ID NO: 157732 - DNA, 25 bp, Mus musculus
agagtggctagctctccccggagag

SEQ ID NO: 157733 - DNA, 25 bp, Mus musculus
agagtggctaggacaccctcacagg

SEQ ID NO: 157734 - DNA, 25 bp, Mus musculus
agagtggctaggtcaccctcacagg

SEQ ID NO: 157735 - DNA, 25 bp, Mus musculus
agagtggctctaattgtggcccgtt

SEQ ID NO: 157736 - DNA, 25 bp, Mus musculus
agagtggctctatttgtggcccgtt

SEQ ID NO: 157737 - DNA, 25 bp, Mus musculus
agagtggctctcataaggtctaagt

SEQ ID NO: 157738 - DNA, 25 bp, Mus musculus
agagtggctctcttaaggtctaagt

SEQ ID NO: 157739 - DNA, 25 bp, Mus musculus
agagtggcttctccaaggttacctt

SEQ ID NO: 157740 - DNA, 25 bp, Mus musculus
agagtggcttctgcaaggttacctt

SEQ ID NO: 157741 - DNA, 25 bp, Mus musculus
agagtggctttcaggcttgctgcca

SEQ ID NO: 157742 - DNA, 25 bp, Mus musculus
agagtggctttctggcttgctgcca

SEQ ID NO: 157743 - DNA, 25 bp, Mus musculus
agagtgggaagtacttgcagctcca

SEQ ID NO: 157744 - DNA, 25 bp, Mus musculus
agagtgggaagttcttgcagctcca

SEQ ID NO: 157745 - DNA, 25 bp, Mus musculus
agagtgggaccgagccttcaggcct

SEQ ID NO: 157746 - DNA, 25 bp, Mus musculus
agagtgggaccgtgccttcaggcct

SEQ ID NO: 157747 - DNA, 25 bp, Mus musculus
agagtgggaggaaccagctcctaaa

SEQ ID NO: 157748 - DNA, 25 bp, Mus musculus
agagtgggaggatccagctcctaaa

SEQ ID NO: 157749 - DNA, 25 bp, Mus musculus
agagtgggcgcacctcaggcttcta

SEQ ID NO: 157750 - DNA, 25 bp, Mus musculus
agagtgggcgcagctcaggcttcta

SEQ ID NO: 157751 - DNA, 25 bp, Mus musculus
agagtgggctatctccaggaagttc

SEQ ID NO: 157752 - DNA, 25 bp, Mus musculus
agagtgggctatgtccaggaagttc

SEQ ID NO: 157753 - DNA, 25 bp, Mus musculus
agagtgggctttcactgtaagtgtt

SEQ ID NO: 157754 - DNA, 25 bp, Mus musculus
agagtgggctttgactgtaagtgtt

SEQ ID NO: 157755 - DNA, 25 bp, Mus musculus
agagtgggtgatccacaaccttcct

SEQ ID NO: 157756 - DNA, 25 bp, Mus musculus
agagtgggtgatgcacaaccttcct

SEQ ID NO: 157757 - DNA, 25 bp, Mus musculus
agagtggtagagatatcctggaatc

SEQ ID NO: 157758 - DNA, 25 bp, Mus musculus
agagtggtagagttatcctggaatc

SEQ ID NO: 157759 - DNA, 25 bp, Mus musculus
agagtggtatttctgtccctatggg

SEQ ID NO: 157760 - DNA, 25 bp, Mus musculus
agagtggtatttgtgtccctatggg

SEQ ID NO: 157761 - DNA, 25 bp, Mus musculus
agagtggtcaccaggctgaaagagc

SEQ ID NO: 157762 - DNA, 25 bp, Mus musculus
agagtggtcacctggctgaaagagc

SEQ ID NO: 157763 - DNA, 25 bp, Mus musculus
agagtggtccagagtcatgcgctgc

SEQ ID NO: 157764 - DNA, 25 bp, Mus musculus
agagtggtccagtgtcatgcgctgc

SEQ ID NO: 157765 - DNA, 25 bp, Mus musculus
agagtggtctagattagtggttata

SEQ ID NO: 157766 - DNA, 25 bp, Mus musculus
agagtggtctagtttagtggttata

SEQ ID NO: 157767 - DNA, 25 bp, Mus musculus
agagtggtctatcggcccttgttac

SEQ ID NO: 157768 - DNA, 25 bp, Mus musculus
agagtggtctatgggcccttgttac

SEQ ID NO: 157769 - DNA, 25 bp, Mus musculus
agagtggtctgtaagctccatcagc

SEQ ID NO: 157770 - DNA, 25 bp, Mus musculus
agagtggtctgttagctccatcagc

SEQ ID NO: 157771 - DNA, 25 bp, Mus musculus
agagtggtctttacaacactcctcc

SEQ ID NO: 157772 - DNA, 25 bp, Mus musculus
agagtggtcttttcaacactcctcc

SEQ ID NO: 157773 - DNA, 25 bp, Mus musculus
agagtggtgagaactccttcctggg

SEQ ID NO: 157774 - DNA, 25 bp, Mus musculus
agagtggtgagatctccttcctggg

SEQ ID NO: 157775 - DNA, 25 bp, Mus musculus
agagtggtgatgctaagctgtaaac

SEQ ID NO: 157776 - DNA, 25 bp, Mus musculus
agagtggtgatggtaagctgtaaac

SEQ ID NO: 157777 - DNA, 25 bp, Mus musculus
agagtggtgttacctctgatctttt

SEQ ID NO: 157778 - DNA, 25 bp, Mus musculus
agagtggtgttagctctgatctttt

SEQ ID NO: 157779 - DNA, 25 bp, Mus musculus
agagtggttccaatactggccattc

SEQ ID NO: 157780 - DNA, 25 bp, Mus musculus
agagtggttccattactggccattc

SEQ ID NO: 157781 - DNA, 25 bp, Mus musculus
agagtggttcccacatttgttgtta

SEQ ID NO: 157782 - DNA, 25 bp, Mus musculus
agagtggttccctcatttgttgtta

SEQ ID NO: 157783 - DNA, 25 bp, Mus musculus
agagtggttccgagagcgcaaccca

SEQ ID NO: 157784 - DNA, 25 bp, Mus musculus
agagtggttccgtgagcgcaaccca

SEQ ID NO: 157785 - DNA, 25 bp, Mus musculus
agagtggtttctatgccctttgtac

SEQ ID NO: 157786 - DNA, 25 bp, Mus musculus
agagtggtttctttgccctttgtac

SEQ ID NO: 157787 - DNA, 25 bp, Mus musculus
agagtggtttgaacatcatggtcat

SEQ ID NO: 157788 - DNA, 25 bp, Mus musculus
agagtggtttgatcatcatggtcat

SEQ ID NO: 157789 - DNA, 25 bp, Mus musculus
agagtgtactccctgttctaacttc

SEQ ID NO: 157790 - DNA, 25 bp, Mus musculus
agagtgtactccgtgttctaacttc

SEQ ID NO: 157791 - DNA, 25 bp, Mus musculus
agagtgtagtgaacttgtgcaaaga

SEQ ID NO: 157792 - DNA, 25 bp, Mus musculus
agagtgtagtgatcttgtgcaaaga

SEQ ID NO: 157793 - DNA, 25 bp, Mus musculus
agagtgtatgtcagagtgtgtagat

SEQ ID NO: 157794 - DNA, 25 bp, Mus musculus
agagtgtatgtctgagtgtgtagat

SEQ ID NO: 157795 - DNA, 25 bp, Mus musculus
agagtgtcaagacagcctgttaaca

SEQ ID NO: 157796 - DNA, 25 bp, Mus musculus
agagtgtcaagagagcctgttaaca

SEQ ID NO: 157797 - DNA, 25 bp, Mus musculus
agagtgtcacacaaggcaactgtgt

SEQ ID NO: 157798 - DNA, 25 bp, Mus musculus
agagtgtcacactaggcaactgtgt

SEQ ID NO: 157799 - DNA, 25 bp, Mus musculus
agagtgtcagatcgcccaagcttga

SEQ ID NO: 157800 - DNA, 25 bp, Mus musculus
agagtgtcagatggcccaagcttga

SEQ ID NO: 157801 - DNA, 25 bp, Mus musculus
agagtgtcagtaaccctggggctga

SEQ ID NO: 157802 - DNA, 25 bp, Mus musculus
agagtgtcagtatccctggggctga

SEQ ID NO: 157803 - DNA, 25 bp, Mus musculus
agagtgtcagttaaatcgccccagc

SEQ ID NO: 157804 - DNA, 25 bp, Mus musculus
agagtgtcagtttaatcgccccagc

SEQ ID NO: 157805 - DNA, 25 bp, Mus musculus
agagtgtccaagacggccagggtca

SEQ ID NO: 157806 - DNA, 25 bp, Mus musculus
agagtgtccaagtcggccagggtca

SEQ ID NO: 157807 - DNA, 25 bp, Mus musculus
agagtgtcctctccaggagttccaa

SEQ ID NO: 157808 - DNA, 25 bp, Mus musculus
agagtgtcctctcgcagctctttgg

SEQ ID NO: 157809 - DNA, 25 bp, Mus musculus
agagtgtcctctgcaggagttccaa

SEQ ID NO: 157810 - DNA, 25 bp, Mus musculus
agagtgtcctctggcagctctttgg

SEQ ID NO: 157811 - DNA, 25 bp, Mus musculus
agagtgtcgtcaacagtgaggagca

SEQ ID NO: 157812 - DNA, 25 bp, Mus musculus
agagtgtcgtcatcagtgaggagca

SEQ ID NO: 157813 - DNA, 25 bp, Mus musculus
agagtgtctagtctttcagggtcca

SEQ ID NO: 157814 - DNA, 25 bp, Mus musculus
agagtgtctagtgtttcagggtcca

SEQ ID NO: 157815 - DNA, 25 bp, Mus musculus
agagtgtctctaaatgctgtccagc

SEQ ID NO: 157816 - DNA, 25 bp, Mus musculus
agagtgtctctatatgctgtccagc

SEQ ID NO: 157817 - DNA, 25 bp, Mus musculus
agagtgtctttgatggccactgtta

SEQ ID NO: 157818 - DNA, 25 bp, Mus musculus
agagtgtctttgttggccactgtta

SEQ ID NO: 157819 - DNA, 25 bp, Mus musculus
agagtgtgacggcatagtcccagtc

SEQ ID NO: 157820 - DNA, 25 bp, Mus musculus
agagtgtgacgggatagtcccagtc

SEQ ID NO: 157821 - DNA, 25 bp, Mus musculus
agagtgtgactcagccttgggtgcc

SEQ ID NO: 157822 - DNA, 25 bp, Mus musculus
agagtgtgactctgccttgggtgcc

SEQ ID NO: 157823 - DNA, 25 bp, Mus musculus
agagtgtgagatcctatgccttata

SEQ ID NO: 157824 - DNA, 25 bp, Mus musculus
agagtgtgagatgctatgccttata

SEQ ID NO: 157825 - DNA, 25 bp, Mus musculus
agagtgtgatgcattcttgccctag

SEQ ID NO: 157826 - DNA, 25 bp, Mus musculus
agagtgtgatgctttcttgccctag

SEQ ID NO: 157827 - DNA, 25 bp, Mus musculus
agagtgtgcgttatctgctcaatgc

SEQ ID NO: 157828 - DNA, 25 bp, Mus musculus
agagtgtgcgttctggatgacatca

SEQ ID NO: 157829 - DNA, 25 bp, Mus musculus
agagtgtgcgttgtggatgacatca

SEQ ID NO: 157830 - DNA, 25 bp, Mus musculus
agagtgtgcgttttctgctcaatgc

SEQ ID NO: 157831 - DNA, 25 bp, Mus musculus
agagtgtggacaaaggttcctccca

SEQ ID NO: 157832 - DNA, 25 bp, Mus musculus
agagtgtggacataggttcctccca

SEQ ID NO: 157833 - DNA, 25 bp, Mus musculus
agagtgtggatgatcacgtccaagt

SEQ ID NO: 157834 - DNA, 25 bp, Mus musculus
agagtgtggatgttcacgtccaagt

SEQ ID NO: 157835 - DNA, 25 bp, Mus musculus
agagtgtggcatcctctgtcactaa

SEQ ID NO: 157836 - DNA, 25 bp, Mus musculus
agagtgtggcatgctctgtcactaa

SEQ ID NO: 157837 - DNA, 25 bp, Mus musculus
agagtgtggccaaggctttctccag

SEQ ID NO: 157838 - DNA, 25 bp, Mus musculus
agagtgtggccatggctttctccag

SEQ ID NO: 157839 - DNA, 25 bp, Mus musculus
agagtgtggcccagcaggagtcaac

SEQ ID NO: 157840 - DNA, 25 bp, Mus musculus
agagtgtggccctgcaggagtcaac

SEQ ID NO: 157841 - DNA, 25 bp, Mus musculus
agagtgtgggaccttgcttgaccta

SEQ ID NO: 157842 - DNA, 25 bp, Mus musculus
agagtgtgggacgttgcttgaccta

SEQ ID NO: 157843 - DNA, 25 bp, Mus musculus
agagtgtgggtcagtgttcccgacc

SEQ ID NO: 157844 - DNA, 25 bp, Mus musculus
agagtgtgggtctgtgttcccgacc

SEQ ID NO: 157845 - DNA, 25 bp, Mus musculus
agagtgtggtcccttgctaaagttc

SEQ ID NO: 157846 - DNA, 25 bp, Mus musculus
agagtgtggtccgttgctaaagttc

SEQ ID NO: 157847 - DNA, 25 bp, Mus musculus
agagtgtggttgctgtctttgttct

SEQ ID NO: 157848 - DNA, 25 bp, Mus musculus
agagtgtggttggtgtctttgttct

SEQ ID NO: 157849 - DNA, 25 bp, Mus musculus
agagtgtggtttccgccgagattca

SEQ ID NO: 157850 - DNA, 25 bp, Mus musculus
agagtgtggtttgcgccgagattca

SEQ ID NO: 157851 - DNA, 25 bp, Mus musculus
agagtgtgtcggatggcttttatca

SEQ ID NO: 157852 - DNA, 25 bp, Mus musculus
agagtgtgtcggttggcttttatca

SEQ ID NO: 157853 - DNA, 25 bp, Mus musculus
agagtgtgtctcagatgcctggcat

SEQ ID NO: 157854 - DNA, 25 bp, Mus musculus
agagtgtgtctctgatgcctggcat

SEQ ID NO: 157855 - DNA, 25 bp, Mus musculus
agagtgtgttccaacgctgtggtct

SEQ ID NO: 157856 - DNA, 25 bp, Mus musculus
agagtgtgttcctacgctgtggtct

SEQ ID NO: 157857 - DNA, 25 bp, Mus musculus
agagtgttaagtatctggctgcctt

SEQ ID NO: 157858 - DNA, 25 bp, Mus musculus
agagtgttaagtttctggctgcctt

SEQ ID NO: 157859 - DNA, 25 bp, Mus musculus
agagtgttcaaaccaggcccgagcc

SEQ ID NO: 157860 - DNA, 25 bp, Mus musculus
agagtgttcaaagcaggcccgagcc

SEQ ID NO: 157861 - DNA, 25 bp, Mus musculus
agagtgttcacccacaaatgcagct

SEQ ID NO: 157862 - DNA, 25 bp, Mus musculus
agagtgttcaccgacaaatgcagct

SEQ ID NO: 157863 - DNA, 25 bp, Mus musculus
agagtgttcatcctaatatcccata

SEQ ID NO: 157864 - DNA, 25 bp, Mus musculus
agagtgttcatcgtaatatcccata

SEQ ID NO: 157865 - DNA, 25 bp, Mus musculus
agagtgttcgcgccaagtcagagcc

SEQ ID NO: 157866 - DNA, 25 bp, Mus musculus
agagtgttcgcggcaagtcagagcc

SEQ ID NO: 157867 - DNA, 25 bp, Mus musculus
agagtgttcgttcacccaacctcaa

SEQ ID NO: 157868 - DNA, 25 bp, Mus musculus
agagtgttcgttgacccaacctcaa

SEQ ID NO: 157869 - DNA, 25 bp, Mus musculus
agagtgttgcagattccttgataga

SEQ ID NO: 157870 - DNA, 25 bp, Mus musculus
agagtgttgcagtttccttgataga

SEQ ID NO: 157871 - DNA, 25 bp, Mus musculus
agagtgttgtccagtgacaggagtt

SEQ ID NO: 157872 - DNA, 25 bp, Mus musculus
agagtgttgtcctgtgacaggagtt

SEQ ID NO: 157873 - DNA, 25 bp, Mus musculus
agagtgttgtctcttcgttgtagca

SEQ ID NO: 157874 - DNA, 25 bp, Mus musculus
agagtgttgtctgttcgttgtagca

SEQ ID NO: 157875 - DNA, 25 bp, Mus musculus
agagtgtttgaaagattctgccggg

SEQ ID NO: 157876 - DNA, 25 bp, Mus musculus
agagtgtttgaatgattctgccggg

SEQ ID NO: 157877 - DNA, 25 bp, Mus musculus
agagttaaccgcatccaaggaaaca

SEQ ID NO: 157878 - DNA, 25 bp, Mus musculus
agagttaaccgcttccaaggaaaca

SEQ ID NO: 157879 - DNA, 25 bp, Mus musculus
agagttaactatcctgatcagtctt

SEQ ID NO: 157880 - DNA, 25 bp, Mus musculus
agagttaactatgctgatcagtctt

SEQ ID NO: 157881 - DNA, 25 bp, Mus musculus
agagttaagacaccgaagcccagaa

SEQ ID NO: 157882 - DNA, 25 bp, Mus musculus
agagttaagacagcgaagcccagaa

SEQ ID NO: 157883 - DNA, 25 bp, Mus musculus
agagttaagataagcatgccatgcc

SEQ ID NO: 157884 - DNA, 25 bp, Mus musculus
agagttaagatatgcatgccatgcc

SEQ ID NO: 157885 - DNA, 25 bp, Mus musculus
agagttaagcccatagtctgctctt

SEQ ID NO: 157886 - DNA, 25 bp, Mus musculus
agagttaagcccttagtctgctctt

SEQ ID NO: 157887 - DNA, 25 bp, Mus musculus
agagttaatcctacttcttatccac

SEQ ID NO: 157888 - DNA, 25 bp, Mus musculus
agagttaatccttcttcttatccac

SEQ ID NO: 157889 - DNA, 25 bp, Mus musculus
agagttacaaccattgtcagtgcct

SEQ ID NO: 157890 - DNA, 25 bp, Mus musculus
agagttacaacctttgtcagtgcct

SEQ ID NO: 157891 - DNA, 25 bp, Mus musculus
agagttacatgaagagacctgtctc

SEQ ID NO: 157892 - DNA, 25 bp, Mus musculus
agagttacatgatgagacctgtctc

SEQ ID NO: 157893 - DNA, 25 bp, Mus musculus
agagttaccacgcagtgagcctgtt

SEQ ID NO: 157894 - DNA, 25 bp, Mus musculus
agagttaccacggagtgagcctgtt

SEQ ID NO: 157895 - DNA, 25 bp, Mus musculus
agagttaccctgcatattttcattg

SEQ ID NO: 157896 - DNA, 25 bp, Mus musculus
agagttaccctggatattttcattg

SEQ ID NO: 157897 - DNA, 25 bp, Mus musculus
agagttaccgagctactgttgagat

SEQ ID NO: 157898 - DNA, 25 bp, Mus musculus
agagttaccgaggtactgttgagat

SEQ ID NO: 157899 - DNA, 25 bp, Mus musculus
agagttacctgtccacttctgacat

SEQ ID NO: 157900 - DNA, 25 bp, Mus musculus
agagttacctgtgcacttctgacat

SEQ ID NO: 157901 - DNA, 25 bp, Mus musculus
agagttacgagcagcgttacttcca

SEQ ID NO: 157902 - DNA, 25 bp, Mus musculus
agagttacgagctgcgttacttcca

SEQ ID NO: 157903 - DNA, 25 bp, Mus musculus
agagttacgccaaggactcctgtgt

SEQ ID NO: 157904 - DNA, 25 bp, Mus musculus
agagttacgccatggactcctgtgt

SEQ ID NO: 157905 - DNA, 25 bp, Mus musculus
agagttacggctccaacgcctgaca

SEQ ID NO: 157906 - DNA, 25 bp, Mus musculus
agagttacggctgcaacgcctgaca

SEQ ID NO: 157907 - DNA, 25 bp, Mus musculus
agagttactactcgcgggcgacact

SEQ ID NO: 157908 - DNA, 25 bp, Mus musculus
agagttactactctgttctgcggca

SEQ ID NO: 157909 - DNA, 25 bp, Mus musculus
agagttactactggcgggcgacact

SEQ ID NO: 157910 - DNA, 25 bp, Mus musculus
agagttactactgtgttctgcggca

SEQ ID NO: 157911 - DNA, 25 bp, Mus musculus
agagttactctgattattcacttta

SEQ ID NO: 157912 - DNA, 25 bp, Mus musculus
agagttactctgtttattcacttta

SEQ ID NO: 157913 - DNA, 25 bp, Mus musculus
agagttactgtcagcctgaggcaaa

SEQ ID NO: 157914 - DNA, 25 bp, Mus musculus
agagttactgtctgcctgaggcaaa

SEQ ID NO: 157915 - DNA, 25 bp, Mus musculus
agagttagagccctcacttctgcag

SEQ ID NO: 157916 - DNA, 25 bp, Mus musculus
agagttagagccgtcacttctgcag

SEQ ID NO: 157917 - DNA, 25 bp, Mus musculus
agagttagcagcaactgctccttat

SEQ ID NO: 157918 - DNA, 25 bp, Mus musculus
agagttagcagctactgctccttat

SEQ ID NO: 157919 - DNA, 25 bp, Mus musculus
agagttagccttagtacctactccg

SEQ ID NO: 157920 - DNA, 25 bp, Mus musculus
agagttagcctttgtacctactccg

SEQ ID NO: 157921 - DNA, 25 bp, Mus musculus
agagttagggcacttctcccacccg

SEQ ID NO: 157922 - DNA, 25 bp, Mus musculus
agagttagggcagttctcccacccg

SEQ ID NO: 157923 - DNA, 25 bp, Mus musculus
agagttatacaacctttgccctttg

SEQ ID NO: 157924 - DNA, 25 bp, Mus musculus
agagttatacaagctttgccctttg

SEQ ID NO: 157925 - DNA, 25 bp, Mus musculus
agagttatactgacggatatccggc

SEQ ID NO: 157926 - DNA, 25 bp, Mus musculus
agagttatactgtcggatatccggc

SEQ ID NO: 157927 - DNA, 25 bp, Mus musculus
agagttataggccactcatggctac

SEQ ID NO: 157928 - DNA, 25 bp, Mus musculus
agagttataggcgactcatggctac

SEQ ID NO: 157929 - DNA, 25 bp, Mus musculus
agagttatatgcatggcttgtgata

SEQ ID NO: 157930 - DNA, 25 bp, Mus musculus
agagttatatgcttggcttgtgata

SEQ ID NO: 157931 - DNA, 25 bp, Mus musculus
agagttatcacccatgctgctaggt

SEQ ID NO: 157932 - DNA, 25 bp, Mus musculus
agagttatcaccgatgctgctaggt

SEQ ID NO: 157933 - DNA, 25 bp, Mus musculus
agagttatccaacgtgtcatagcaa

SEQ ID NO: 157934 - DNA, 25 bp, Mus musculus
agagttatccaaggtgtcatagcaa

SEQ ID NO: 157935 - DNA, 25 bp, Mus musculus
agagttatgtgaagctgccctccgc

SEQ ID NO: 157936 - DNA, 25 bp, Mus musculus
agagttatgtgatgctgccctccgc

SEQ ID NO: 157937 - DNA, 25 bp, Mus musculus
agagttattactaatgcccagcgcc

SEQ ID NO: 157938 - DNA, 25 bp, Mus musculus
agagttattacttatgcccagcgcc

SEQ ID NO: 157939 - DNA, 25 bp, Mus musculus
agagttcaaacactgctgttcacac

SEQ ID NO: 157940 - DNA, 25 bp, Mus musculus
agagttcaaacagtgctgttcacac

SEQ ID NO: 157941 - DNA, 25 bp, Mus musculus
agagttcaaacccaaggacctacag

SEQ ID NO: 157942 - DNA, 25 bp, Mus musculus
agagttcaaaccgaaggacctacag

SEQ ID NO: 157943 - DNA, 25 bp, Mus musculus
agagttcaactcaggcctaggtcat

SEQ ID NO: 157944 - DNA, 25 bp, Mus musculus
agagttcaactcatccacaacaggc

SEQ ID NO: 157945 - DNA, 25 bp, Mus musculus
agagttcaactctggcctaggtcat

SEQ ID NO: 157946 - DNA, 25 bp, Mus musculus
agagttcaactcttccacaacaggc

SEQ ID NO: 157947 - DNA, 25 bp, Mus musculus
agagttcaacttattggtttgcata

SEQ ID NO: 157948 - DNA, 25 bp, Mus musculus
agagttcaactttttggtttgcata

SEQ ID NO: 157949 - DNA, 25 bp, Mus musculus
agagttcaagacattggcgcctttt

SEQ ID NO: 157950 - DNA, 25 bp, Mus musculus
agagttcaagactttggcgcctttt

SEQ ID NO: 157951 - DNA, 25 bp, Mus musculus
agagttcaatgtcggtgctgctagt

SEQ ID NO: 157952 - DNA, 25 bp, Mus musculus
agagttcaatgtgggtgctgctagt

SEQ ID NO: 157953 - DNA, 25 bp, Mus musculus
agagttcacagcagagggaccttct

SEQ ID NO: 157954 - DNA, 25 bp, Mus musculus
agagttcacagctgagggaccttct

SEQ ID NO: 157955 - DNA, 25 bp, Mus musculus
agagttcaccatccgttggtaccgc

SEQ ID NO: 157956 - DNA, 25 bp, Mus musculus
agagttcaccatgcgttggtaccgc

SEQ ID NO: 157957 - DNA, 25 bp, Mus musculus
agagttcacggacgactgcccctct

SEQ ID NO: 157958 - DNA, 25 bp, Mus musculus
agagttcacggaggactgcccctct

SEQ ID NO: 157959 - DNA, 25 bp, Mus musculus
agagttcagaaacgcctccggtcac

SEQ ID NO: 157960 - DNA, 25 bp, Mus musculus
agagttcagaaaggcctccggtcac

SEQ ID NO: 157961 - DNA, 25 bp, Mus musculus
agagttcagaggacttcgtgttcac

SEQ ID NO: 157962 - DNA, 25 bp, Mus musculus
agagttcagaggtcttcgtgttcac

SEQ ID NO: 157963 - DNA, 25 bp, Mus musculus
agagttcagcctccctgaggaatga

SEQ ID NO: 157964 - DNA, 25 bp, Mus musculus
agagttcagcctgcctgaggaatga

SEQ ID NO: 157965 - DNA, 25 bp, Mus musculus
agagttcaggcaagtcctgcagcgg

SEQ ID NO: 157966 - DNA, 25 bp, Mus musculus
agagttcaggcatgtcctgcagcgg

SEQ ID NO: 157967 - DNA, 25 bp, Mus musculus
agagttcatctgaacccagctatta

SEQ ID NO: 157968 - DNA, 25 bp, Mus musculus
agagttcatctgtacccagctatta

SEQ ID NO: 157969 - DNA, 25 bp, Mus musculus
agagttcatggtcctcagctacata

SEQ ID NO: 157970 - DNA, 25 bp, Mus musculus
agagttcatggtgctcagctacata

SEQ ID NO: 157971 - DNA, 25 bp, Mus musculus
agagttcatgttaactggtgactta

SEQ ID NO: 157972 - DNA, 25 bp, Mus musculus
agagttcatgtttactggtgactta

SEQ ID NO: 157973 - DNA, 25 bp, Mus musculus
agagttcattctcgcagagcccaga

SEQ ID NO: 157974 - DNA, 25 bp, Mus musculus
agagttcattctggcagagcccaga

SEQ ID NO: 157975 - DNA, 25 bp, Mus musculus
agagttcatttccttagggtgaata

SEQ ID NO: 157976 - DNA, 25 bp, Mus musculus
agagttcatttcgttagggtgaata

SEQ ID NO: 157977 - DNA, 25 bp, Mus musculus
agagttccaaaccacttagggccat

SEQ ID NO: 157978 - DNA, 25 bp, Mus musculus
agagttccaaacgacttagggccat

SEQ ID NO: 157979 - DNA, 25 bp, Mus musculus
agagttccaaagaggctgagcagta

SEQ ID NO: 157980 - DNA, 25 bp, Mus musculus
agagttccaaagtggctgagcagta

SEQ ID NO: 157981 - DNA, 25 bp, Mus musculus
agagttccacccagatgaggttccc

SEQ ID NO: 157982 - DNA, 25 bp, Mus musculus
agagttccaccctgatgaggttccc

SEQ ID NO: 157983 - DNA, 25 bp, Mus musculus
agagttccactgatctatggtcctc

SEQ ID NO: 157984 - DNA, 25 bp, Mus musculus
agagttccactgttctatggtcctc

SEQ ID NO: 157985 - DNA, 25 bp, Mus musculus
agagttccagcaaatcgttcccatc

SEQ ID NO: 157986 - DNA, 25 bp, Mus musculus
agagttccagcatatcgttcccatc

SEQ ID NO: 157987 - DNA, 25 bp, Mus musculus
agagttccagctatgacagcctgat

SEQ ID NO: 157988 - DNA, 25 bp, Mus musculus
agagttccagctttgacagcctgat

SEQ ID NO: 157989 - DNA, 25 bp, Mus musculus
agagttccatatcagcttagggtac

SEQ ID NO: 157990 - DNA, 25 bp, Mus musculus
agagttccatatgagcttagggtac

SEQ ID NO: 157991 - DNA, 25 bp, Mus musculus
agagttccatcgacagggcgactgt

SEQ ID NO: 157992 - DNA, 25 bp, Mus musculus
agagttccatcgtcagggcgactgt

SEQ ID NO: 157993 - DNA, 25 bp, Mus musculus
agagttcccaaactctcatgttccc

SEQ ID NO: 157994 - DNA, 25 bp, Mus musculus
agagttcccaaagtctcatgttccc

SEQ ID NO: 157995 - DNA, 25 bp, Mus musculus
agagttcccacaccacccgagggag

SEQ ID NO: 157996 - DNA, 25 bp, Mus musculus
agagttcccacagcacccgagggag

SEQ ID NO: 157997 - DNA, 25 bp, Mus musculus
agagttcccctcacagaatgatata

SEQ ID NO: 157998 - DNA, 25 bp, Mus musculus
agagttcccctctcagaatgatata

SEQ ID NO: 157999 - DNA, 25 bp, Mus musculus
agagttcccggcatgctgatgcatg

SEQ ID NO: 158000 - DNA, 25 bp, Mus musculus
agagttcccggcttgctgatgcatg

SEQ ID NO: 158001 - DNA, 25 bp, Mus musculus
agagttccctgcaaatgattccatt

SEQ ID NO: 158002 - DNA, 25 bp, Mus musculus
agagttccctgctaatgattccatt

SEQ ID NO: 158003 - DNA, 25 bp, Mus musculus
agagttccggcaagggtcacgcaga

SEQ ID NO: 158004 - DNA, 25 bp, Mus musculus
agagttccggcatgggtcacgcaga

SEQ ID NO: 158005 - DNA, 25 bp, Mus musculus
agagttccgggcaactagactgggt

SEQ ID NO: 158006 - DNA, 25 bp, Mus musculus
agagttccgggctactagactgggt

SEQ ID NO: 158007 - DNA, 25 bp, Mus musculus
agagttccgtcccagagaatgttcc

SEQ ID NO: 158008 - DNA, 25 bp, Mus musculus
agagttccgtccgagagaatgttcc

SEQ ID NO: 158009 - DNA, 25 bp, Mus musculus
agagttccgtgcacttcttgaccag

SEQ ID NO: 158010 - DNA, 25 bp, Mus musculus
agagttccgtgctcttcttgaccag

SEQ ID NO: 158011 - DNA, 25 bp, Mus musculus
agagttcctaccagtagacccttga

SEQ ID NO: 158012 - DNA, 25 bp, Mus musculus
agagttcctacctgtagacccttga

SEQ ID NO: 158013 - DNA, 25 bp, Mus musculus
agagttcctccaacttgatgaaatt

SEQ ID NO: 158014 - DNA, 25 bp, Mus musculus
agagttcctccatcttgatgaaatt

SEQ ID NO: 158015 - DNA, 25 bp, Mus musculus
agagttcctccccatcaaagagctg

SEQ ID NO: 158016 - DNA, 25 bp, Mus musculus
agagttcctcccgatcaaagagctg

SEQ ID NO: 158017 - DNA, 25 bp, Mus musculus
agagttcctgcgcacttacgcttat

SEQ ID NO: 158018 - DNA, 25 bp, Mus musculus
agagttcctgcggacttacgcttat

SEQ ID NO: 158019 - DNA, 25 bp, Mus musculus
agagttcctgggacctaaagccaga

SEQ ID NO: 158020 - DNA, 25 bp, Mus musculus
agagttcctgggtcctaaagccaga

SEQ ID NO: 158021 - DNA, 25 bp, Mus musculus
agagttccttatatccagcagtcaa

SEQ ID NO: 158022 - DNA, 25 bp, Mus musculus
agagttccttatttccagcagtcaa

SEQ ID NO: 158023 - DNA, 25 bp, Mus musculus
agagttcgacagcagtcaccacatg

SEQ ID NO: 158024 - DNA, 25 bp, Mus musculus
agagttcgacaggagtcaccacatg

SEQ ID NO: 158025 - DNA, 25 bp, Mus musculus
agagttcgacgacgtgacagcagat

SEQ ID NO: 158026 - DNA, 25 bp, Mus musculus
agagttcgacgaggtgacagcagat

SEQ ID NO: 158027 - DNA, 25 bp, Mus musculus
agagttcgatggacacacacgccag

SEQ ID NO: 158028 - DNA, 25 bp, Mus musculus
agagttcgatggtcacacacgccag

SEQ ID NO: 158029 - DNA, 25 bp, Mus musculus
agagttcggctgctacagttccaaa

SEQ ID NO: 158030 - DNA, 25 bp, Mus musculus
agagttcggctggtacagttccaaa

SEQ ID NO: 158031 - DNA, 25 bp, Mus musculus
agagttcgtggacgactgccccttc

SEQ ID NO: 158032 - DNA, 25 bp, Mus musculus
agagttcgtggaggactgccccttc

SEQ ID NO: 158033 - DNA, 25 bp, Mus musculus
agagttcgttttcattgggcaatcc

SEQ ID NO: 158034 - DNA, 25 bp, Mus musculus
agagttcgttttgattgggcaatcc

SEQ ID NO: 158035 - DNA, 25 bp, Mus musculus
agagttctaactcctttgcctctgc

SEQ ID NO: 158036 - DNA, 25 bp, Mus musculus
agagttctaactgctttgcctctgc

SEQ ID NO: 158037 - DNA, 25 bp, Mus musculus
agagttctacgaaagctgctactgt

SEQ ID NO: 158038 - DNA, 25 bp, Mus musculus
agagttctacgatagctgctactgt

SEQ ID NO: 158039 - DNA, 25 bp, Mus musculus
agagttctaggtctcatttagttta

SEQ ID NO: 158040 - DNA, 25 bp, Mus musculus
agagttctaggtgtcatttagttta

SEQ ID NO: 158041 - DNA, 25 bp, Mus musculus
agagttctcacactcctcctaagtt

SEQ ID NO: 158042 - DNA, 25 bp, Mus musculus
agagttctcacagtcctcctaagtt

SEQ ID NO: 158043 - DNA, 25 bp, Mus musculus
agagttctcaccctggttccctggt

SEQ ID NO: 158044 - DNA, 25 bp, Mus musculus
agagttctcaccgtggttccctggt

SEQ ID NO: 158045 - DNA, 25 bp, Mus musculus
agagttctcagtagtagctgagtgc

SEQ ID NO: 158046 - DNA, 25 bp, Mus musculus
agagttctcagttgtagctgagtgc

SEQ ID NO: 158047 - DNA, 25 bp, Mus musculus
agagttctctacacctattgattcc

SEQ ID NO: 158048 - DNA, 25 bp, Mus musculus
agagttctctactcctattgattcc

SEQ ID NO: 158049 - DNA, 25 bp, Mus musculus
agagttctctttatagagccacatg

SEQ ID NO: 158050 - DNA, 25 bp, Mus musculus
agagttctctttttagagccacatg

SEQ ID NO: 158051 - DNA, 25 bp, Mus musculus
agagttctgaacatcagcctgggtc

SEQ ID NO: 158052 - DNA, 25 bp, Mus musculus
agagttctgaacatcctgtttgata

SEQ ID NO: 158053 - DNA, 25 bp, Mus musculus
agagttctgaacttcagcctgggtc

SEQ ID NO: 158054 - DNA, 25 bp, Mus musculus
agagttctgaacttcctgtttgata

SEQ ID NO: 158055 - DNA, 25 bp, Mus musculus
agagttctgaccctgttgttatcac

SEQ ID NO: 158056 - DNA, 25 bp, Mus musculus
agagttctgaccgtgttgttatcac

SEQ ID NO: 158057 - DNA, 25 bp, Mus musculus
agagttctgactcctttcgaagcga

SEQ ID NO: 158058 - DNA, 25 bp, Mus musculus
agagttctgactgctttcgaagcga

SEQ ID NO: 158059 - DNA, 25 bp, Mus musculus
agagttctgcatctgcatcgggaac

SEQ ID NO: 158060 - DNA, 25 bp, Mus musculus
agagttctgcatgtgcatcgggaac

SEQ ID NO: 158061 - DNA, 25 bp, Mus musculus
agagttctgcccactgtaggcagga

SEQ ID NO: 158062 - DNA, 25 bp, Mus musculus
agagttctgcccagcccttttaaag

SEQ ID NO: 158063 - DNA, 25 bp, Mus musculus
agagttctgccctctgtaggcagga

SEQ ID NO: 158064 - DNA, 25 bp, Mus musculus
agagttctgccctgcccttttaaag

SEQ ID NO: 158065 - DNA, 25 bp, Mus musculus
agagttctgcctccttaggcatgaa

SEQ ID NO: 158066 - DNA, 25 bp, Mus musculus
agagttctgcctgcttaggcatgaa

SEQ ID NO: 158067 - DNA, 25 bp, Mus musculus
agagttctgcgtctttacccagtca

SEQ ID NO: 158068 - DNA, 25 bp, Mus musculus
agagttctgcgtgtttacccagtca

SEQ ID NO: 158069 - DNA, 25 bp, Mus musculus
agagttctggcgaccgagacgggaa

SEQ ID NO: 158070 - DNA, 25 bp, Mus musculus
agagttctggcgtccgagacgggaa

SEQ ID NO: 158071 - DNA, 25 bp, Mus musculus
agagttcttctacccagagttggta

SEQ ID NO: 158072 - DNA, 25 bp, Mus musculus
agagttcttctagccagagttggta

SEQ ID NO: 158073 - DNA, 25 bp, Mus musculus
agagttctttagatccatgggacat

SEQ ID NO: 158074 - DNA, 25 bp, Mus musculus
agagttctttagttccatgggacat

SEQ ID NO: 158075 - DNA, 25 bp, Mus musculus
agagttgaatctcagggatccggca

SEQ ID NO: 158076 - DNA, 25 bp, Mus musculus
agagttgaatctgagggatccggca

SEQ ID NO: 158077 - DNA, 25 bp, Mus musculus
agagttgaatgtagtggcacaccgt

SEQ ID NO: 158078 - DNA, 25 bp, Mus musculus
agagttgaatgttgtggcacaccgt

SEQ ID NO: 158079 - DNA, 25 bp, Mus musculus
agagttgaattccagctgcttccgt

SEQ ID NO: 158080 - DNA, 25 bp, Mus musculus
agagttgaattcgagctgcttccgt

SEQ ID NO: 158081 - DNA, 25 bp, Mus musculus
agagttgaccataggcttgctttgg

SEQ ID NO: 158082 - DNA, 25 bp, Mus musculus
agagttgaccattggcttgctttgg

SEQ ID NO: 158083 - DNA, 25 bp, Mus musculus
agagttgactgcaaagacctacctt

SEQ ID NO: 158084 - DNA, 25 bp, Mus musculus
agagttgactgcctgtgacactctt

SEQ ID NO: 158085 - DNA, 25 bp, Mus musculus
agagttgactgcgtgtgacactctt

SEQ ID NO: 158086 - DNA, 25 bp, Mus musculus
agagttgactgctaagacctacctt

SEQ ID NO: 158087 - DNA, 25 bp, Mus musculus
agagttgacttccaagcttctgccc

SEQ ID NO: 158088 - DNA, 25 bp, Mus musculus
agagttgacttcgaagcttctgccc

SEQ ID NO: 158089 - DNA, 25 bp, Mus musculus
agagttgagagacaccgggtcccta

SEQ ID NO: 158090 - DNA, 25 bp, Mus musculus
agagttgagagagaccgggtcccta

SEQ ID NO: 158091 - DNA, 25 bp, Mus musculus
agagttgagatcatagtgcccacat

SEQ ID NO: 158092 - DNA, 25 bp, Mus musculus
agagttgagatcttagtgcccacat

SEQ ID NO: 158093 - DNA, 25 bp, Mus musculus
agagttgagttcctccttatttcca

SEQ ID NO: 158094 - DNA, 25 bp, Mus musculus
agagttgagttcgtccttatttcca

SEQ ID NO: 158095 - DNA, 25 bp, Mus musculus
agagttgatccaacctaacactgag

SEQ ID NO: 158096 - DNA, 25 bp, Mus musculus
agagttgatccatcctaacactgag

SEQ ID NO: 158097 - DNA, 25 bp, Mus musculus
agagttgcaagtcagctaaaatcaa

SEQ ID NO: 158098 - DNA, 25 bp, Mus musculus
agagttgcaagtcctgagcgcaaac

SEQ ID NO: 158099 - DNA, 25 bp, Mus musculus
agagttgcaagtgagctaaaatcaa

SEQ ID NO: 158100 - DNA, 25 bp, Mus musculus
agagttgcaagtgctgagcgcaaac

SEQ ID NO: 158101 - DNA, 25 bp, Mus musculus
agagttgcaatgaacagtgttgtca

SEQ ID NO: 158102 - DNA, 25 bp, Mus musculus
agagttgcaatgtacagtgttgtca

SEQ ID NO: 158103 - DNA, 25 bp, Mus musculus
agagttgcatggactccttagtagt

SEQ ID NO: 158104 - DNA, 25 bp, Mus musculus
agagttgcatggtctccttagtagt

SEQ ID NO: 158105 - DNA, 25 bp, Mus musculus
agagttgccaaactggtgtccagaa

SEQ ID NO: 158106 - DNA, 25 bp, Mus musculus
agagttgccaaagtggtgtccagaa

SEQ ID NO: 158107 - DNA, 25 bp, Mus musculus
agagttgccagtaccccgcagtagt

SEQ ID NO: 158108 - DNA, 25 bp, Mus musculus
agagttgccagttccccgcagtagt

SEQ ID NO: 158109 - DNA, 25 bp, Mus musculus
agagttgccgtaatgctttctgaga

SEQ ID NO: 158110 - DNA, 25 bp, Mus musculus
agagttgccgtattgctttctgaga

SEQ ID NO: 158111 - DNA, 25 bp, Mus musculus
agagttgcctgcaggttagactaac

SEQ ID NO: 158112 - DNA, 25 bp, Mus musculus
agagttgcctgctggttagactaac

SEQ ID NO: 158113 - DNA, 25 bp, Mus musculus
agagttgctaggcttcctctgaccc

SEQ ID NO: 158114 - DNA, 25 bp, Mus musculus
agagttgctagggttcctctgaccc

SEQ ID NO: 158115 - DNA, 25 bp, Mus musculus
agagttgctcagctctgctgtaagt

SEQ ID NO: 158116 - DNA, 25 bp, Mus musculus
agagttgctcaggtctgctgtaagt

SEQ ID NO: 158117 - DNA, 25 bp, Mus musculus
agagttgctcccaagtgtagtctcc

SEQ ID NO: 158118 - DNA, 25 bp, Mus musculus
agagttgctccctagtgtagtctcc

SEQ ID NO: 158119 - DNA, 25 bp, Mus musculus
agagttgctgaactatctctccttg

SEQ ID NO: 158120 - DNA, 25 bp, Mus musculus
agagttgctgaagtatctctccttg

SEQ ID NO: 158121 - DNA, 25 bp, Mus musculus
agagttgctgacatgggttgatcca

SEQ ID NO: 158122 - DNA, 25 bp, Mus musculus
agagttgctgacttgggttgatcca

SEQ ID NO: 158123 - DNA, 25 bp, Mus musculus
agagttgcttcgaggaccttgtggc

SEQ ID NO: 158124 - DNA, 25 bp, Mus musculus
agagttgcttcgtggaccttgtggc

SEQ ID NO: 158125 - DNA, 25 bp, Mus musculus
agagttgctttcactcgttttgcat

SEQ ID NO: 158126 - DNA, 25 bp, Mus musculus
agagttgctttcagccccagaggac

SEQ ID NO: 158127 - DNA, 25 bp, Mus musculus
agagttgctttctctcgttttgcat

SEQ ID NO: 158128 - DNA, 25 bp, Mus musculus
agagttgctttctgccccagaggac

SEQ ID NO: 158129 - DNA, 25 bp, Mus musculus
agagttggaccgatgctgtgcgcct

SEQ ID NO: 158130 - DNA, 25 bp, Mus musculus
agagttggaccgttgctgtgcgcct

SEQ ID NO: 158131 - DNA, 25 bp, Mus musculus
agagttggatttacagatctgacca

SEQ ID NO: 158132 - DNA, 25 bp, Mus musculus
agagttggattttcagatctgacca

SEQ ID NO: 158133 - DNA, 25 bp, Mus musculus
agagttggcatacctcagtactaac

SEQ ID NO: 158134 - DNA, 25 bp, Mus musculus
agagttggcatagctcagtactaac

SEQ ID NO: 158135 - DNA, 25 bp, Mus musculus
agagttggccagattcatcttttct

SEQ ID NO: 158136 - DNA, 25 bp, Mus musculus
agagttggccagtttcatcttttct

SEQ ID NO: 158137 - DNA, 25 bp, Mus musculus
agagttggcctcattactgttgctc

SEQ ID NO: 158138 - DNA, 25 bp, Mus musculus
agagttggcctctttactgttgctc

SEQ ID NO: 158139 - DNA, 25 bp, Mus musculus
agagttggctcacccaacatgggct

SEQ ID NO: 158140 - DNA, 25 bp, Mus musculus
agagttggctcagccaacatgggct

SEQ ID NO: 158141 - DNA, 25 bp, Mus musculus
agagttgggcatcatcccttgcagt

SEQ ID NO: 158142 - DNA, 25 bp, Mus musculus
agagttgggcatgatcccttgcagt

SEQ ID NO: 158143 - DNA, 25 bp, Mus musculus
agagttgggcctaggtccttgcgct

SEQ ID NO: 158144 - DNA, 25 bp, Mus musculus
agagttgggccttggtccttgcgct

SEQ ID NO: 158145 - DNA, 25 bp, Mus musculus
agagttggtccacaattcgtgccct

SEQ ID NO: 158146 - DNA, 25 bp, Mus musculus
agagttggtccagaattcgtgccct

SEQ ID NO: 158147 - DNA, 25 bp, Mus musculus
agagttgtacaacctttaccacaga

SEQ ID NO: 158148 - DNA, 25 bp, Mus musculus
agagttgtacaagctttaccacaga

SEQ ID NO: 158149 - DNA, 25 bp, Mus musculus
agagttgtatttcgacttagcaagt

SEQ ID NO: 158150 - DNA, 25 bp, Mus musculus
agagttgtatttggacttagcaagt

SEQ ID NO: 158151 - DNA, 25 bp, Mus musculus
agagttgtcaaactgcctagtgcag

SEQ ID NO: 158152 - DNA, 25 bp, Mus musculus
agagttgtcaaagtgcctagtgcag

SEQ ID NO: 158153 - DNA, 25 bp, Mus musculus
agagttgtcaagcaggttttcccga

SEQ ID NO: 158154 - DNA, 25 bp, Mus musculus
agagttgtcaaggaggttttcccga

SEQ ID NO: 158155 - DNA, 25 bp, Mus musculus
agagttgtcagaacctgggttgctt

SEQ ID NO: 158156 - DNA, 25 bp, Mus musculus
agagttgtcagatcctgggttgctt

SEQ ID NO: 158157 - DNA, 25 bp, Mus musculus
agagttgtccagagcatggcccgct

SEQ ID NO: 158158 - DNA, 25 bp, Mus musculus
agagttgtccagtgcatggcccgct

SEQ ID NO: 158159 - DNA, 25 bp, Mus musculus
agagttgtcgagatccctggccagc

SEQ ID NO: 158160 - DNA, 25 bp, Mus musculus
agagttgtcgagttccctggccagc

SEQ ID NO: 158161 - DNA, 25 bp, Mus musculus
agagttgtctacaggtttcactggc

SEQ ID NO: 158162 - DNA, 25 bp, Mus musculus
agagttgtctactggtttcactggc

SEQ ID NO: 158163 - DNA, 25 bp, Mus musculus
agagttgtgcgactttgcagcctgc

SEQ ID NO: 158164 - DNA, 25 bp, Mus musculus
agagttgtgcgagtttgcagcctgc

SEQ ID NO: 158165 - DNA, 25 bp, Mus musculus
agagttgttaccacatgttcaaatg

SEQ ID NO: 158166 - DNA, 25 bp, Mus musculus
agagttgttacctcatgttcaaatg

SEQ ID NO: 158167 - DNA, 25 bp, Mus musculus
agagttgttagtccaacacaccaag

SEQ ID NO: 158168 - DNA, 25 bp, Mus musculus
agagttgttagtgcaacacaccaag

SEQ ID NO: 158169 - DNA, 25 bp, Mus musculus
agagttgttgatcctgtccggagtt

SEQ ID NO: 158170 - DNA, 25 bp, Mus musculus
agagttgttgatgctgtccggagtt

SEQ ID NO: 158171 - DNA, 25 bp, Mus musculus
agagttgtttttactgtcatgtcaa

SEQ ID NO: 158172 - DNA, 25 bp, Mus musculus
agagttgttttttctgtcatgtcaa

SEQ ID NO: 158173 - DNA, 25 bp, Mus musculus
agagtttaattcactattatgggaa

SEQ ID NO: 158174 - DNA, 25 bp, Mus musculus
agagtttaattctctattatgggaa

SEQ ID NO: 158175 - DNA, 25 bp, Mus musculus
agagtttagactcctccagctggga

SEQ ID NO: 158176 - DNA, 25 bp, Mus musculus
agagtttagactgctccagctggga

SEQ ID NO: 158177 - DNA, 25 bp, Mus musculus
agagtttagagtacgggtctgacct

SEQ ID NO: 158178 - DNA, 25 bp, Mus musculus
agagtttagagttcgggtctgacct

SEQ ID NO: 158179 - DNA, 25 bp, Mus musculus
agagtttagcacctggactgtgtgt

SEQ ID NO: 158180 - DNA, 25 bp, Mus musculus
agagtttagcacgtggactgtgtgt

SEQ ID NO: 158181 - DNA, 25 bp, Mus musculus
agagtttatgcccttgacttacaag

SEQ ID NO: 158182 - DNA, 25 bp, Mus musculus
agagtttatgccgttgacttacaag

SEQ ID NO: 158183 - DNA, 25 bp, Mus musculus
agagtttcacaacctgcagcgatga

SEQ ID NO: 158184 - DNA, 25 bp, Mus musculus
agagtttcacaagctgcagcgatga

SEQ ID NO: 158185 - DNA, 25 bp, Mus musculus
agagtttcacttagagcttcaccct

SEQ ID NO: 158186 - DNA, 25 bp, Mus musculus
agagtttcactttgagcttcaccct

SEQ ID NO: 158187 - DNA, 25 bp, Mus musculus
agagtttcagagcacgctcacactt

SEQ ID NO: 158188 - DNA, 25 bp, Mus musculus
agagtttcagaggacgctcacactt

SEQ ID NO: 158189 - DNA, 25 bp, Mus musculus
agagtttccaacagttctgacagct

SEQ ID NO: 158190 - DNA, 25 bp, Mus musculus
agagtttccaactgttctgacagct

SEQ ID NO: 158191 - DNA, 25 bp, Mus musculus
agagtttccaccacctgcggaagga

SEQ ID NO: 158192 - DNA, 25 bp, Mus musculus
agagtttccacctcctgcggaagga

SEQ ID NO: 158193 - DNA, 25 bp, Mus musculus
agagtttccagaccttcaacatctc

SEQ ID NO: 158194 - DNA, 25 bp, Mus musculus
agagtttccagagcttcaacatctc

SEQ ID NO: 158195 - DNA, 25 bp, Mus musculus
agagtttccataagtatatgggccc

SEQ ID NO: 158196 - DNA, 25 bp, Mus musculus
agagtttccatatgtatatgggccc

SEQ ID NO: 158197 - DNA, 25 bp, Mus musculus
agagtttccatcacctcaaacgtat

SEQ ID NO: 158198 - DNA, 25 bp, Mus musculus
agagtttccatctcctcaaacgtat

SEQ ID NO: 158199 - DNA, 25 bp, Mus musculus
agagtttccatgactatttgctaat

SEQ ID NO: 158200 - DNA, 25 bp, Mus musculus
agagtttccatgaggaccagggcct

SEQ ID NO: 158201 - DNA, 25 bp, Mus musculus
agagtttccatgtctatttgctaat

SEQ ID NO: 158202 - DNA, 25 bp, Mus musculus
agagtttccatgtggaccagggcct

SEQ ID NO: 158203 - DNA, 25 bp, Mus musculus
agagtttcctagacatggaggacta

SEQ ID NO: 158204 - DNA, 25 bp, Mus musculus
agagtttcctagtcatggaggacta

SEQ ID NO: 158205 - DNA, 25 bp, Mus musculus
agagtttcctgcaaaagccgtgtcc

SEQ ID NO: 158206 - DNA, 25 bp, Mus musculus
agagtttcctgctaaagccgtgtcc

SEQ ID NO: 158207 - DNA, 25 bp, Mus musculus
agagtttctactagaaatctcagaa

SEQ ID NO: 158208 - DNA, 25 bp, Mus musculus
agagtttctacttgaaatctcagaa

SEQ ID NO: 158209 - DNA, 25 bp, Mus musculus
agagtttctagcagagactttccaa

SEQ ID NO: 158210 - DNA, 25 bp, Mus musculus
agagtttctagcatattccaggaag

SEQ ID NO: 158211 - DNA, 25 bp, Mus musculus
agagtttctagctgagactttccaa

SEQ ID NO: 158212 - DNA, 25 bp, Mus musculus
agagtttctagcttattccaggaag

SEQ ID NO: 158213 - DNA, 25 bp, Mus musculus
agagtttctattacatctagtaata

SEQ ID NO: 158214 - DNA, 25 bp, Mus musculus
agagtttctatttcatctagtaata

SEQ ID NO: 158215 - DNA, 25 bp, Mus musculus
agagtttctcacaccatcatgtata

SEQ ID NO: 158216 - DNA, 25 bp, Mus musculus
agagtttctcactccatcatgtata

SEQ ID NO: 158217 - DNA, 25 bp, Mus musculus
agagtttctcctcttgtcatcattg

SEQ ID NO: 158218 - DNA, 25 bp, Mus musculus
agagtttctcctgttgtcatcattg

SEQ ID NO: 158219 - DNA, 25 bp, Mus musculus
agagtttctctacactcacggcgtg

SEQ ID NO: 158220 - DNA, 25 bp, Mus musculus
agagtttctctagactcacggcgtg

SEQ ID NO: 158221 - DNA, 25 bp, Mus musculus
agagtttctgctcatcatctagtac

SEQ ID NO: 158222 - DNA, 25 bp, Mus musculus
agagtttctgctgatcatctagtac

SEQ ID NO: 158223 - DNA, 25 bp, Mus musculus
agagtttcttgccatcctccggtgc

SEQ ID NO: 158224 - DNA, 25 bp, Mus musculus
agagtttcttgcgatcctccggtgc

SEQ ID NO: 158225 - DNA, 25 bp, Mus musculus
agagtttgaacaaagcgcaccccac

SEQ ID NO: 158226 - DNA, 25 bp, Mus musculus
agagtttgaacatagcgcaccccac

SEQ ID NO: 158227 - DNA, 25 bp, Mus musculus
agagtttgacccatttgtcggctca

SEQ ID NO: 158228 - DNA, 25 bp, Mus musculus
agagtttgacccttttgtcggctca

SEQ ID NO: 158229 - DNA, 25 bp, Mus musculus
agagtttgagccaaagtcggtaaca

SEQ ID NO: 158230 - DNA, 25 bp, Mus musculus
agagtttgagcctaagtcggtaaca

SEQ ID NO: 158231 - DNA, 25 bp, Mus musculus
agagtttgagctcgccctctggaac

SEQ ID NO: 158232 - DNA, 25 bp, Mus musculus
agagtttgagctggccctctggaac

SEQ ID NO: 158233 - DNA, 25 bp, Mus musculus
agagtttgagtgacccgggaatgtt

SEQ ID NO: 158234 - DNA, 25 bp, Mus musculus
agagtttgagtgtcccgggaatgtt

SEQ ID NO: 158235 - DNA, 25 bp, Mus musculus
agagtttgcagaatgaacccctaaa

SEQ ID NO: 158236 - DNA, 25 bp, Mus musculus
agagtttgcagattgaacccctaaa

SEQ ID NO: 158237 - DNA, 25 bp, Mus musculus
agagtttgccagatcaagatgatga

SEQ ID NO: 158238 - DNA, 25 bp, Mus musculus
agagtttgccagttcaagatgatga

SEQ ID NO: 158239 - DNA, 25 bp, Mus musculus
agagtttgccttcctggtacagtgt

SEQ ID NO: 158240 - DNA, 25 bp, Mus musculus
agagtttgccttgctggtacagtgt

SEQ ID NO: 158241 - DNA, 25 bp, Mus musculus
agagtttgctgccaaggccgcctcc

SEQ ID NO: 158242 - DNA, 25 bp, Mus musculus
agagtttgctgcgaaggccgcctcc

SEQ ID NO: 158243 - DNA, 25 bp, Mus musculus
agagtttgggtacgtgaacacagta

SEQ ID NO: 158244 - DNA, 25 bp, Mus musculus
agagtttgggtaggtgaacacagta

SEQ ID NO: 158245 - DNA, 25 bp, Mus musculus
agagtttgtgttcatttgatgtgac

SEQ ID NO: 158246 - DNA, 25 bp, Mus musculus
agagtttgtgttgatttgatgtgac

SEQ ID NO: 158247 - DNA, 25 bp, Mus musculus
agagtttgttatctgtgagggtcca

SEQ ID NO: 158248 - DNA, 25 bp, Mus musculus
agagtttgttatgtgtgagggtcca

SEQ ID NO: 158249 - DNA, 25 bp, Mus musculus
agagttttagccactgagtaccaag

SEQ ID NO: 158250 - DNA, 25 bp, Mus musculus
agagttttagcctctgagtaccaag

SEQ ID NO: 158251 - DNA, 25 bp, Mus musculus
agagttttcacaagctgtcaaccca

SEQ ID NO: 158252 - DNA, 25 bp, Mus musculus
agagttttcacatgctgtcaaccca

SEQ ID NO: 158253 - DNA, 25 bp, Mus musculus
agagttttcataccatgggagctaa

SEQ ID NO: 158254 - DNA, 25 bp, Mus musculus
agagttttcatagcatgggagctaa

SEQ ID NO: 158255 - DNA, 25 bp, Mus musculus
agagttttccctctagagatctact

SEQ ID NO: 158256 - DNA, 25 bp, Mus musculus
agagttttccctgtagagatctact

SEQ ID NO: 158257 - DNA, 25 bp, Mus musculus
agagttttcttacagtcagtctgca

SEQ ID NO: 158258 - DNA, 25 bp, Mus musculus
agagttttcttagagtcagtctgca

SEQ ID NO: 158259 - DNA, 25 bp, Mus musculus
agagttttgttaagcccatgcccca

SEQ ID NO: 158260 - DNA, 25 bp, Mus musculus
agagttttgttatgcccatgcccca

SEQ ID NO: 158261 - DNA, 25 bp, Mus musculus
agagtttttattacagacacacaag

SEQ ID NO: 158262 - DNA, 25 bp, Mus musculus
agagtttttatttcagacacacaag

SEQ ID NO: 158263 - DNA, 25 bp, Mus musculus
agagtttttgagcaatggcccgccg

SEQ ID NO: 158264 - DNA, 25 bp, Mus musculus
agagtttttgaggaatggcccgccg

SEQ ID NO: 158265 - DNA, 25 bp, Mus musculus
agataaaaactgacccacggatgaa

SEQ ID NO: 158266 - DNA, 25 bp, Mus musculus
agataaaaactgtcccacggatgaa

SEQ ID NO: 158267 - DNA, 25 bp, Mus musculus
agataaaaccttcagacctccttat

SEQ ID NO: 158268 - DNA, 25 bp, Mus musculus
agataaaaccttgagacctccttat

SEQ ID NO: 158269 - DNA, 25 bp, Mus musculus
agataaaactcacggctctgccacg

SEQ ID NO: 158270 - DNA, 25 bp, Mus musculus
agataaaactcagggctctgccacg

SEQ ID NO: 158271 - DNA, 25 bp, Mus musculus
agataaacagttacacatggtgcag

SEQ ID NO: 158272 - DNA, 25 bp, Mus musculus
agataaacagtttcacatggtgcag

SEQ ID NO: 158273 - DNA, 25 bp, Mus musculus
agataaacattacacaggccccact

SEQ ID NO: 158274 - DNA, 25 bp, Mus musculus
agataaacattagacaggccccact

SEQ ID NO: 158275 - DNA, 25 bp, Mus musculus
agataaaccactccgtctcattttt

SEQ ID NO: 158276 - DNA, 25 bp, Mus musculus
agataaaccactgcgtctcattttt

SEQ ID NO: 158277 - DNA, 25 bp, Mus musculus
agataaacccaaacactgccaactt

SEQ ID NO: 158278 - DNA, 25 bp, Mus musculus
agataaacccaatcactgccaactt

SEQ ID NO: 158279 - DNA, 25 bp, Mus musculus
agataaacccttacactgcgtattg

SEQ ID NO: 158280 - DNA, 25 bp, Mus musculus
agataaaccctttcactgcgtattg

SEQ ID NO: 158281 - DNA, 25 bp, Mus musculus
agataaaccgctcctttgaccaggt

SEQ ID NO: 158282 - DNA, 25 bp, Mus musculus
agataaaccgctgctttgaccaggt

SEQ ID NO: 158283 - DNA, 25 bp, Mus musculus
agataaacctgtcccatttgatgag

SEQ ID NO: 158284 - DNA, 25 bp, Mus musculus
agataaacctgtgccatttgatgag

SEQ ID NO: 158285 - DNA, 25 bp, Mus musculus
agataaacgggaccaccttcaataa

SEQ ID NO: 158286 - DNA, 25 bp, Mus musculus
agataaacgggagcaccttcaataa

SEQ ID NO: 158287 - DNA, 25 bp, Mus musculus
agataaactgatcccttcatgagga

SEQ ID NO: 158288 - DNA, 25 bp, Mus musculus
agataaactgatgccttcatgagga

SEQ ID NO: 158289 - DNA, 25 bp, Mus musculus
agataaacttgtcatcccttcccag

SEQ ID NO: 158290 - DNA, 25 bp, Mus musculus
agataaacttgtgatcccttcccag

SEQ ID NO: 158291 - DNA, 25 bp, Mus musculus
agataaaggccaccttccagggctc

SEQ ID NO: 158292 - DNA, 25 bp, Mus musculus
agataaaggccagcttccagggctc

SEQ ID NO: 158293 - DNA, 25 bp, Mus musculus
agataaaggtcacccgccctggaat

SEQ ID NO: 158294 - DNA, 25 bp, Mus musculus
agataaaggtcagccgccctggaat

SEQ ID NO: 158295 - DNA, 25 bp, Mus musculus
agataaagtcccagctccatgtgga

SEQ ID NO: 158296 - DNA, 25 bp, Mus musculus
agataaagtccctgctccatgtgga

SEQ ID NO: 158297 - DNA, 25 bp, Mus musculus
agataaatcatgctcgttcctcctg

SEQ ID NO: 158298 - DNA, 25 bp, Mus musculus
agataaatcatggtcgttcctcctg

SEQ ID NO: 158299 - DNA, 25 bp, Mus musculus
agataaatcctcacttgatggcccc

SEQ ID NO: 158300 - DNA, 25 bp, Mus musculus
agataaatcctctcttgatggcccc

SEQ ID NO: 158301 - DNA, 25 bp, Mus musculus
agataaatgtctatcggtctcagaa

SEQ ID NO: 158302 - DNA, 25 bp, Mus musculus
agataaatgtctttcggtctcagaa

SEQ ID NO: 158303 - DNA, 25 bp, Mus musculus
agataaattgtcaaccagctgagcc

SEQ ID NO: 158304 - DNA, 25 bp, Mus musculus
agataaattgtctaccagctgagcc

SEQ ID NO: 158305 - DNA, 25 bp, Mus musculus
agataacacccacatcctactagtt

SEQ ID NO: 158306 - DNA, 25 bp, Mus musculus
agataacacccagatcctactagtt

SEQ ID NO: 158307 - DNA, 25 bp, Mus musculus
agataacactttagtccaggacgat

SEQ ID NO: 158308 - DNA, 25 bp, Mus musculus
agataacacttttgtccaggacgat

SEQ ID NO: 158309 - DNA, 25 bp, Mus musculus
agataacagtatcgaagccgggcgt

SEQ ID NO: 158310 - DNA, 25 bp, Mus musculus
agataacagtatggaagccgggcgt

SEQ ID NO: 158311 - DNA, 25 bp, Mus musculus
agataacagtcaagtggagatgaaa

SEQ ID NO: 158312 - DNA, 25 bp, Mus musculus
agataacagtcatgtggagatgaaa

SEQ ID NO: 158313 - DNA, 25 bp, Mus musculus
agataacataacattggattgtctt

SEQ ID NO: 158314 - DNA, 25 bp, Mus musculus
agataacataactttggattgtctt

SEQ ID NO: 158315 - DNA, 25 bp, Mus musculus
agataacataccctgaatcacttaa

SEQ ID NO: 158316 - DNA, 25 bp, Mus musculus
agataacataccgtgaatcacttaa

SEQ ID NO: 158317 - DNA, 25 bp, Mus musculus
agataaccactaaggccacactgct

SEQ ID NO: 158318 - DNA, 25 bp, Mus musculus
agataaccactatggccacactgct

SEQ ID NO: 158319 - DNA, 25 bp, Mus musculus
agataacccatgagctttaacctac

SEQ ID NO: 158320 - DNA, 25 bp, Mus musculus
agataacccatgtgctttaacctac

SEQ ID NO: 158321 - DNA, 25 bp, Mus musculus
agataaccccataaatctgttagga

SEQ ID NO: 158322 - DNA, 25 bp, Mus musculus
agataaccccattaatctgttagga

SEQ ID NO: 158323 - DNA, 25 bp, Mus musculus
agataaccctcaactatgctcttgt

SEQ ID NO: 158324 - DNA, 25 bp, Mus musculus
agataaccctcatctatgctcttgt

SEQ ID NO: 158325 - DNA, 25 bp, Mus musculus
agataaccctgcagagacttgatgt

SEQ ID NO: 158326 - DNA, 25 bp, Mus musculus
agataaccctgctgagacttgatgt

SEQ ID NO: 158327 - DNA, 25 bp, Mus musculus
agataacccttgatgcgatgcggca

SEQ ID NO: 158328 - DNA, 25 bp, Mus musculus
agataacccttgttgcgatgcggca

SEQ ID NO: 158329 - DNA, 25 bp, Mus musculus
agataacctctgaccatcagcacct

SEQ ID NO: 158330 - DNA, 25 bp, Mus musculus
agataacctctgtccatcagcacct

SEQ ID NO: 158331 - DNA, 25 bp, Mus musculus
agataacctggcacttcgatatgga

SEQ ID NO: 158332 - DNA, 25 bp, Mus musculus
agataacctggcatggcctggctgg

SEQ ID NO: 158333 - DNA, 25 bp, Mus musculus
agataacctggctcttcgatatgga

SEQ ID NO: 158334 - DNA, 25 bp, Mus musculus
agataacctggcttggcctggctgg

SEQ ID NO: 158335 - DNA, 25 bp, Mus musculus
agataacctgttcagcttgtgcctt

SEQ ID NO: 158336 - DNA, 25 bp, Mus musculus
agataacctgttgagcttgtgcctt

SEQ ID NO: 158337 - DNA, 25 bp, Mus musculus
agataaccttctcgtgaccggcggc

SEQ ID NO: 158338 - DNA, 25 bp, Mus musculus
agataaccttctggtgaccggcggc

SEQ ID NO: 158339 - DNA, 25 bp, Mus musculus
agataacctttgctgtacccttaat

SEQ ID NO: 158340 - DNA, 25 bp, Mus musculus
agataacctttggtgtacccttaat

SEQ ID NO: 158341 - DNA, 25 bp, Mus musculus
agataacgaaagaagcaggtgctaa

SEQ ID NO: 158342 - DNA, 25 bp, Mus musculus
agataacgaaagtagcaggtgctaa

SEQ ID NO: 158343 - DNA, 25 bp, Mus musculus
agataacgatgacaggtgacctcaa

SEQ ID NO: 158344 - DNA, 25 bp, Mus musculus
agataacgatgagaggtgacctcaa

SEQ ID NO: 158345 - DNA, 25 bp, Mus musculus
agataactcagtcggcatccagcaa

SEQ ID NO: 158346 - DNA, 25 bp, Mus musculus
agataactcagtgggcatccagcaa

SEQ ID NO: 158347 - DNA, 25 bp, Mus musculus
agataactccgcacatggctgcatt

SEQ ID NO: 158348 - DNA, 25 bp, Mus musculus
agataactccgctcatggctgcatt

SEQ ID NO: 158349 - DNA, 25 bp, Mus musculus
agataactctgaatctttcccatcc

SEQ ID NO: 158350 - DNA, 25 bp, Mus musculus
agataactctgattctttcccatcc

SEQ ID NO: 158351 - DNA, 25 bp, Mus musculus
agataactcttcatggagactagga

SEQ ID NO: 158352 - DNA, 25 bp, Mus musculus
agataactcttcttggagactagga

SEQ ID NO: 158353 - DNA, 25 bp, Mus musculus
agataactgcacctctcagatcacc

SEQ ID NO: 158354 - DNA, 25 bp, Mus musculus
agataactgcacgtctcagatcacc

SEQ ID NO: 158355 - DNA, 25 bp, Mus musculus
agataacttggaccctgatttaaag

SEQ ID NO: 158356 - DNA, 25 bp, Mus musculus
agataacttggagcctgatttaaag

SEQ ID NO: 158357 - DNA, 25 bp, Mus musculus
agataactttacattgagtattttt

SEQ ID NO: 158358 - DNA, 25 bp, Mus musculus
agataactttactttgagtattttt

SEQ ID NO: 158359 - DNA, 25 bp, Mus musculus
agataagaaaggaggcacacgcctt

SEQ ID NO: 158360 - DNA, 25 bp, Mus musculus
agataagaaaggtggcacacgcctt

SEQ ID NO: 158361 - DNA, 25 bp, Mus musculus
agataagaacatccttgccctccgt

SEQ ID NO: 158362 - DNA, 25 bp, Mus musculus
agataagaacatgcttgccctccgt

SEQ ID NO: 158363 - DNA, 25 bp, Mus musculus
agataagacaccaaacactcgatat

SEQ ID NO: 158364 - DNA, 25 bp, Mus musculus
agataagacacctaacactcgatat

SEQ ID NO: 158365 - DNA, 25 bp, Mus musculus
agataagactacatcatgtgtttca

SEQ ID NO: 158366 - DNA, 25 bp, Mus musculus
agataagactacttcatgtgtttca

SEQ ID NO: 158367 - DNA, 25 bp, Mus musculus
agataagagtctccacagccaacac

SEQ ID NO: 158368 - DNA, 25 bp, Mus musculus
agataagagtctgcacagccaacac

SEQ ID NO: 158369 - DNA, 25 bp, Mus musculus
agataagataggctgtcggttcaac

SEQ ID NO: 158370 - DNA, 25 bp, Mus musculus
agataagatagggtgtcggttcaac

SEQ ID NO: 158371 - DNA, 25 bp, Mus musculus
agataagattgcaacctctcctggt

SEQ ID NO: 158372 - DNA, 25 bp, Mus musculus
agataagattgctacctctcctggt

SEQ ID NO: 158373 - DNA, 25 bp, Mus musculus
agataagcactaagacctgtcctat

SEQ ID NO: 158374 - DNA, 25 bp, Mus musculus
agataagcactatgacctgtcctat

SEQ ID NO: 158375 - DNA, 25 bp, Mus musculus
agataagcatcccactgacatcatc

SEQ ID NO: 158376 - DNA, 25 bp, Mus musculus
agataagcatccgactgacatcatc

SEQ ID NO: 158377 - DNA, 25 bp, Mus musculus
agataagcatgtagtctacccttgt

SEQ ID NO: 158378 - DNA, 25 bp, Mus musculus
agataagcatgttgtctacccttgt

SEQ ID NO: 158379 - DNA, 25 bp, Mus musculus
agataagcattaacccctctggaaa

SEQ ID NO: 158380 - DNA, 25 bp, Mus musculus
agataagcattatcccctctggaaa

SEQ ID NO: 158381 - DNA, 25 bp, Mus musculus
agataagccagaagcccctgctttc

SEQ ID NO: 158382 - DNA, 25 bp, Mus musculus
agataagccagatgcccctgctttc

SEQ ID NO: 158383 - DNA, 25 bp, Mus musculus
agataagcgcaaactgcagcaggag

SEQ ID NO: 158384 - DNA, 25 bp, Mus musculus
agataagcgcaatctgcagcaggag

SEQ ID NO: 158385 - DNA, 25 bp, Mus musculus
agataagctgctctccatgagaaag

SEQ ID NO: 158386 - DNA, 25 bp, Mus musculus
agataagctgctgtccatgagaaag

SEQ ID NO: 158387 - DNA, 25 bp, Mus musculus
agataagcttaaagtggtgtactac

SEQ ID NO: 158388 - DNA, 25 bp, Mus musculus
agataagcttaatgtggtgtactac

SEQ ID NO: 158389 - DNA, 25 bp, Mus musculus
agataaggaacacccttgtcacctc

SEQ ID NO: 158390 - DNA, 25 bp, Mus musculus
agataaggaacagccttgtcacctc

SEQ ID NO: 158391 - DNA, 25 bp, Mus musculus
agataaggacctcaactctgctggg

SEQ ID NO: 158392 - DNA, 25 bp, Mus musculus
agataaggacctgaactctgctggg

SEQ ID NO: 158393 - DNA, 25 bp, Mus musculus
agataaggaggcagcccgactacgg

SEQ ID NO: 158394 - DNA, 25 bp, Mus musculus
agataaggaggctgcccgactacgg

SEQ ID NO: 158395 - DNA, 25 bp, Mus musculus
agataaggaggtatgttcccatgta

SEQ ID NO: 158396 - DNA, 25 bp, Mus musculus
agataaggaggtttgttcccatgta

SEQ ID NO: 158397 - DNA, 25 bp, Mus musculus
agataaggcagtctccttgcaccca

SEQ ID NO: 158398 - DNA, 25 bp, Mus musculus
agataaggcagtgtccttgcaccca

SEQ ID NO: 158399 - DNA, 25 bp, Mus musculus
agataaggccacctcctctctcagg

SEQ ID NO: 158400 - DNA, 25 bp, Mus musculus
agataaggccacgtcctctctcagg

SEQ ID NO: 158401 - DNA, 25 bp, Mus musculus
agataaggccagaccacagacacca

SEQ ID NO: 158402 - DNA, 25 bp, Mus musculus
agataaggccagtccacagacacca

SEQ ID NO: 158403 - DNA, 25 bp, Mus musculus
agataaggcctgctcctggccccag

SEQ ID NO: 158404 - DNA, 25 bp, Mus musculus
agataaggcctggtcctggccccag

SEQ ID NO: 158405 - DNA, 25 bp, Mus musculus
agataagggcttactccttgctgct

SEQ ID NO: 158406 - DNA, 25 bp, Mus musculus
agataagggctttctccttgctgct

SEQ ID NO: 158407 - DNA, 25 bp, Mus musculus
agataaggtatcaccaagccaatga

SEQ ID NO: 158408 - DNA, 25 bp, Mus musculus
agataaggtatctccaagccaatga

SEQ ID NO: 158409 - DNA, 25 bp, Mus musculus
agataagtacttctggttatcagtt

SEQ ID NO: 158410 - DNA, 25 bp, Mus musculus
agataagtacttgtggttatcagtt

SEQ ID NO: 158411 - DNA, 25 bp, Mus musculus
agataagtagacctcattattcctc

SEQ ID NO: 158412 - DNA, 25 bp, Mus musculus
agataagtagacgtcattattcctc

SEQ ID NO: 158413 - DNA, 25 bp, Mus musculus
agataagtagtcagttcccctccat

SEQ ID NO: 158414 - DNA, 25 bp, Mus musculus
agataagtagtctgttcccctccat

SEQ ID NO: 158415 - DNA, 25 bp, Mus musculus
agataagtccatcctgagagctgga

SEQ ID NO: 158416 - DNA, 25 bp, Mus musculus
agataagtccatgctgagagctgga

SEQ ID NO: 158417 - DNA, 25 bp, Mus musculus
agataagtgcccaaacagttcctat

SEQ ID NO: 158418 - DNA, 25 bp, Mus musculus
agataagtgcccatgcagccatttt

SEQ ID NO: 158419 - DNA, 25 bp, Mus musculus
agataagtgccctaacagttcctat

SEQ ID NO: 158420 - DNA, 25 bp, Mus musculus
agataagtgcccttgcagccatttt

SEQ ID NO: 158421 - DNA, 25 bp, Mus musculus
agataagtgtgtcccagacactggc

SEQ ID NO: 158422 - DNA, 25 bp, Mus musculus
agataagtgtgtgccagacactggc

SEQ ID NO: 158423 - DNA, 25 bp, Mus musculus
agataagttatgcacctgcccctcc

SEQ ID NO: 158424 - DNA, 25 bp, Mus musculus
agataagttatggacctgcccctcc

SEQ ID NO: 158425 - DNA, 25 bp, Mus musculus
agataagtttccactctctgtgggc

SEQ ID NO: 158426 - DNA, 25 bp, Mus musculus
agataagtttcctctctctgtgggc

SEQ ID NO: 158427 - DNA, 25 bp, Mus musculus
agataataaaatctagccctagccc

SEQ ID NO: 158428 - DNA, 25 bp, Mus musculus
agataataaaatgtagccctagccc

SEQ ID NO: 158429 - DNA, 25 bp, Mus musculus
agataataacccatgaaggcacggg

SEQ ID NO: 158430 - DNA, 25 bp, Mus musculus
agataataacccttgaaggcacggg

SEQ ID NO: 158431 - DNA, 25 bp, Mus musculus
agataataatcaagttctctggaac

SEQ ID NO: 158432 - DNA, 25 bp, Mus musculus
agataataatcatgttctctggaac

SEQ ID NO: 158433 - DNA, 25 bp, Mus musculus
agataataccagctcggccattgcc

SEQ ID NO: 158434 - DNA, 25 bp, Mus musculus
agataataccaggtcggccattgcc

SEQ ID NO: 158435 - DNA, 25 bp, Mus musculus
agataatacctcagtgacccggagc

SEQ ID NO: 158436 - DNA, 25 bp, Mus musculus
agataatacctctgtgacccggagc

SEQ ID NO: 158437 - DNA, 25 bp, Mus musculus
agataatactctacattttgtccat

SEQ ID NO: 158438 - DNA, 25 bp, Mus musculus
agataatactcttcattttgtccat

SEQ ID NO: 158439 - DNA, 25 bp, Mus musculus
agataatagtgcctccagatttgga

SEQ ID NO: 158440 - DNA, 25 bp, Mus musculus
agataatagtgcgtccagatttgga

SEQ ID NO: 158441 - DNA, 25 bp, Mus musculus
agataatatggaaatttcacactcc

SEQ ID NO: 158442 - DNA, 25 bp, Mus musculus
agataatatggatatttcacactcc

SEQ ID NO: 158443 - DNA, 25 bp, Mus musculus
agataatattgccttcctccagaca

SEQ ID NO: 158444 - DNA, 25 bp, Mus musculus
agataatattgcgttcctccagaca

SEQ ID NO: 158445 - DNA, 25 bp, Mus musculus
agataatcacttctccaggagagcc

SEQ ID NO: 158446 - DNA, 25 bp, Mus musculus
agataatcacttgtccaggagagcc

SEQ ID NO: 158447 - DNA, 25 bp, Mus musculus
agataatccagcacggactgacctt

SEQ ID NO: 158448 - DNA, 25 bp, Mus musculus
agataatccagctcggactgacctt

SEQ ID NO: 158449 - DNA, 25 bp, Mus musculus
agataatccattacctaaggacaag

SEQ ID NO: 158450 - DNA, 25 bp, Mus musculus
agataatccatttcctaaggacaag

SEQ ID NO: 158451 - DNA, 25 bp, Mus musculus
agataatcctgaccagatctgccca

SEQ ID NO: 158452 - DNA, 25 bp, Mus musculus
agataatcctgagcagatctgccca

SEQ ID NO: 158453 - DNA, 25 bp, Mus musculus
agataatctctcatctataactgga

SEQ ID NO: 158454 - DNA, 25 bp, Mus musculus
agataatctctcttctataactgga

SEQ ID NO: 158455 - DNA, 25 bp, Mus musculus
agataatcttccattggctcattct

SEQ ID NO: 158456 - DNA, 25 bp, Mus musculus
agataatcttcctttggctcattct

SEQ ID NO: 158457 - DNA, 25 bp, Mus musculus
agataatcttggctctgtgctttaa

SEQ ID NO: 158458 - DNA, 25 bp, Mus musculus
agataatcttgggtctgtgctttaa

SEQ ID NO: 158459 - DNA, 25 bp, Mus musculus
agataatcttgtccctgctcctcac

SEQ ID NO: 158460 - DNA, 25 bp, Mus musculus
agataatcttgtgcctgctcctcac

SEQ ID NO: 158461 - DNA, 25 bp, Mus musculus
agataatgcccacctaatagaacag

SEQ ID NO: 158462 - DNA, 25 bp, Mus musculus
agataatgcccagctaatagaacag

SEQ ID NO: 158463 - DNA, 25 bp, Mus musculus
agataatgccccaaggattcctagg

SEQ ID NO: 158464 - DNA, 25 bp, Mus musculus
agataatgcccctaggattcctagg

SEQ ID NO: 158465 - DNA, 25 bp, Mus musculus
agataatgtcatactccccttgtat

SEQ ID NO: 158466 - DNA, 25 bp, Mus musculus
agataatgtcattctccccttgtat

SEQ ID NO: 158467 - DNA, 25 bp, Mus musculus
agataatgtccccacactgtggctt

SEQ ID NO: 158468 - DNA, 25 bp, Mus musculus
agataatgtcccgacactgtggctt

SEQ ID NO: 158469 - DNA, 25 bp, Mus musculus
agataatgtgaactccgcaggcaga

SEQ ID NO: 158470 - DNA, 25 bp, Mus musculus
agataatgtgaagtccgcaggcaga

SEQ ID NO: 158471 - DNA, 25 bp, Mus musculus
agataatgtgggactctctgagcac

SEQ ID NO: 158472 - DNA, 25 bp, Mus musculus
agataatgtgggtctctctgagcac

SEQ ID NO: 158473 - DNA, 25 bp, Mus musculus
agataattcacacttgccctcggat

SEQ ID NO: 158474 - DNA, 25 bp, Mus musculus
agataattcacagttgccctcggat

SEQ ID NO: 158475 - DNA, 25 bp, Mus musculus
agataattgctgcatcacttgagcc

SEQ ID NO: 158476 - DNA, 25 bp, Mus musculus
agataattgctggatcacttgagcc

SEQ ID NO: 158477 - DNA, 25 bp, Mus musculus
agatacaaagaaatctgcctagaca

SEQ ID NO: 158478 - DNA, 25 bp, Mus musculus
agatacaaagaattctgcctagaca

SEQ ID NO: 158479 - DNA, 25 bp, Mus musculus
agatacaaagctccaggatgtccct

SEQ ID NO: 158480 - DNA, 25 bp, Mus musculus
agatacaaagctgcaggatgtccct

SEQ ID NO: 158481 - DNA, 25 bp, Mus musculus
agatacaacataaccgatgacacag

SEQ ID NO: 158482 - DNA, 25 bp, Mus musculus
agatacaacatatccgatgacacag

SEQ ID NO: 158483 - DNA, 25 bp, Mus musculus
agatacaaccccagtgcattccatt

SEQ ID NO: 158484 - DNA, 25 bp, Mus musculus
agatacaacccctgtgcattccatt

SEQ ID NO: 158485 - DNA, 25 bp, Mus musculus
agatacaaccgacggactatcccca

SEQ ID NO: 158486 - DNA, 25 bp, Mus musculus
agatacaaccgagggactatcccca

SEQ ID NO: 158487 - DNA, 25 bp, Mus musculus
agatacaacctcaggtctgggtgtt

SEQ ID NO: 158488 - DNA, 25 bp, Mus musculus
agatacaacctctggtctgggtgtt

SEQ ID NO: 158489 - DNA, 25 bp, Mus musculus
agatacaactttaacctctatgggt

SEQ ID NO: 158490 - DNA, 25 bp, Mus musculus
agatacaacttttacctctatgggt

SEQ ID NO: 158491 - DNA, 25 bp, Mus musculus
agatacaagtatcggcacaacgcag

SEQ ID NO: 158492 - DNA, 25 bp, Mus musculus
agatacaagtatgggcacaacgcag

SEQ ID NO: 158493 - DNA, 25 bp, Mus musculus
agatacacagttagttgctgttgct

SEQ ID NO: 158494 - DNA, 25 bp, Mus musculus
agatacacagtttgttgctgttgct

SEQ ID NO: 158495 - DNA, 25 bp, Mus musculus
agatacacctaaagatgacctccag

SEQ ID NO: 158496 - DNA, 25 bp, Mus musculus
agatacacctaatgatgacctccag

SEQ ID NO: 158497 - DNA, 25 bp, Mus musculus
agatacacgatcaccagtacaaaat

SEQ ID NO: 158498 - DNA, 25 bp, Mus musculus
agatacacgatctccagtacaaaat

SEQ ID NO: 158499 - DNA, 25 bp, Mus musculus
agatacacgtacacttaccaagtgt

SEQ ID NO: 158500 - DNA, 25 bp, Mus musculus
agatacacgtactcttaccaagtgt

SEQ ID NO: 158501 - DNA, 25 bp, Mus musculus
agatacactccacataccatactgt

SEQ ID NO: 158502 - DNA, 25 bp, Mus musculus
agatacactccagataccatactgt

SEQ ID NO: 158503 - DNA, 25 bp, Mus musculus
agatacactgacaggctgtgtcaca

SEQ ID NO: 158504 - DNA, 25 bp, Mus musculus
agatacactgactggctgtgtcaca

SEQ ID NO: 158505 - DNA, 25 bp, Mus musculus
agatacactgcacgctttgactggt

SEQ ID NO: 158506 - DNA, 25 bp, Mus musculus
agatacactgcaggctttgactggt

SEQ ID NO: 158507 - DNA, 25 bp, Mus musculus
agatacactggaacctgctttgctg

SEQ ID NO: 158508 - DNA, 25 bp, Mus musculus
agatacactggatcctgctttgctg

SEQ ID NO: 158509 - DNA, 25 bp, Mus musculus
agatacagaatcaaatcaggagagg

SEQ ID NO: 158510 - DNA, 25 bp, Mus musculus
agatacagaatctaatcaggagagg

SEQ ID NO: 158511 - DNA, 25 bp, Mus musculus
agatacagagacacgggtgacttcc

SEQ ID NO: 158512 - DNA, 25 bp, Mus musculus
agatacagagactcgggtgacttcc

SEQ ID NO: 158513 - DNA, 25 bp, Mus musculus
agatacagcagaatccagggcagga

SEQ ID NO: 158514 - DNA, 25 bp, Mus musculus
agatacagcagattccagggcagga

SEQ ID NO: 158515 - DNA, 25 bp, Mus musculus
agatacaggcccctggcatgtattt

SEQ ID NO: 158516 - DNA, 25 bp, Mus musculus
agatacaggcccgtggcatgtattt

SEQ ID NO: 158517 - DNA, 25 bp, Mus musculus
agatacaggcgccatcgcagccgtt

SEQ ID NO: 158518 - DNA, 25 bp, Mus musculus
agatacaggcgcgatcgcagccgtt

SEQ ID NO: 158519 - DNA, 25 bp, Mus musculus
agatacaggtcaacaaggacttccc

SEQ ID NO: 158520 - DNA, 25 bp, Mus musculus
agatacaggtcatcaaggacttccc

SEQ ID NO: 158521 - DNA, 25 bp, Mus musculus
agatacagtgctccgtgagctttgg

SEQ ID NO: 158522 - DNA, 25 bp, Mus musculus
agatacagtgctgcgtgagctttgg

SEQ ID NO: 158523 - DNA, 25 bp, Mus musculus
agatacagtgtcacacaggctgaaa

SEQ ID NO: 158524 - DNA, 25 bp, Mus musculus
agatacagtgtctcacaggctgaaa

SEQ ID NO: 158525 - DNA, 25 bp, Mus musculus
agatacagtgttacgttgtaaccac

SEQ ID NO: 158526 - DNA, 25 bp, Mus musculus
agatacagtgtttcgttgtaaccac

SEQ ID NO: 158527 - DNA, 25 bp, Mus musculus
agatacagttcaaccacttcaagta

SEQ ID NO: 158528 - DNA, 25 bp, Mus musculus
agatacagttcatccacttcaagta

SEQ ID NO: 158529 - DNA, 25 bp, Mus musculus
agatacatcaagatctgctcggcat

SEQ ID NO: 158530 - DNA, 25 bp, Mus musculus
agatacatcaagttctgctcggcat

SEQ ID NO: 158531 - DNA, 25 bp, Mus musculus
agatacatccagctatcctgacagc

SEQ ID NO: 158532 - DNA, 25 bp, Mus musculus
agatacatccaggtatcctgacagc

SEQ ID NO: 158533 - DNA, 25 bp, Mus musculus
agatacatggtcacatcgttctgtt

SEQ ID NO: 158534 - DNA, 25 bp, Mus musculus
agatacatggtctcatcgttctgtt

SEQ ID NO: 158535 - DNA, 25 bp, Mus musculus
agatacatgtctacctgtgtctttc

SEQ ID NO: 158536 - DNA, 25 bp, Mus musculus
agatacatgtcttcctgtgtctttc

SEQ ID NO: 158537 - DNA, 25 bp, Mus musculus
agatacatgtttactcctgtgaaat

SEQ ID NO: 158538 - DNA, 25 bp, Mus musculus
agatacatgttttctcctgtgaaat

SEQ ID NO: 158539 - DNA, 25 bp, Mus musculus
agatacattctgcagtgtggcaatt

SEQ ID NO: 158540 - DNA, 25 bp, Mus musculus
agatacattctggagtgtggcaatt

SEQ ID NO: 158541 - DNA, 25 bp, Mus musculus
agatacattgtacgtggaatcacta

SEQ ID NO: 158542 - DNA, 25 bp, Mus musculus
agatacattgtaggtggaatcacta

SEQ ID NO: 158543 - DNA, 25 bp, Mus musculus
agatacatttccagggtcccttgaa

SEQ ID NO: 158544 - DNA, 25 bp, Mus musculus
agatacatttcctgggtcccttgaa

SEQ ID NO: 158545 - DNA, 25 bp, Mus musculus
agatacatttctaagtcctccctga

SEQ ID NO: 158546 - DNA, 25 bp, Mus musculus
agatacatttcttagtcctccctga

SEQ ID NO: 158547 - DNA, 25 bp, Mus musculus
agataccaacctcaagatgacactg

SEQ ID NO: 158548 - DNA, 25 bp, Mus musculus
agataccaacctgaagatgacactg

SEQ ID NO: 158549 - DNA, 25 bp, Mus musculus
agataccaaggcctggtccatcctt

SEQ ID NO: 158550 - DNA, 25 bp, Mus musculus
agataccaaggcgtggtccatcctt

SEQ ID NO: 158551 - DNA, 25 bp, Mus musculus
agataccaatggcttgctaaaaaga

SEQ ID NO: 158552 - DNA, 25 bp, Mus musculus
agataccaatgggttgctaaaaaga

SEQ ID NO: 158553 - DNA, 25 bp, Mus musculus
agataccagaagacctttgaaagca

SEQ ID NO: 158554 - DNA, 25 bp, Mus musculus
agataccagaagtcctttgaaagca

SEQ ID NO: 158555 - DNA, 25 bp, Mus musculus
agataccagactcagaaacctgcca

SEQ ID NO: 158556 - DNA, 25 bp, Mus musculus
agataccagactgagaaacctgcca

SEQ ID NO: 158557 - DNA, 25 bp, Mus musculus
agataccaggcaagactcttaggct

SEQ ID NO: 158558 - DNA, 25 bp, Mus musculus
agataccaggcatgactcttaggct

SEQ ID NO: 158559 - DNA, 25 bp, Mus musculus
agataccagtgcaggcacacctgtt

SEQ ID NO: 158560 - DNA, 25 bp, Mus musculus
agataccagtgctggcacacctgtt

SEQ ID NO: 158561 - DNA, 25 bp, Mus musculus
agataccatgtaaccctttcctagg

SEQ ID NO: 158562 - DNA, 25 bp, Mus musculus
agataccatgtatccctttcctagg

SEQ ID NO: 158563 - DNA, 25 bp, Mus musculus
agataccattgcatctattctcctg

SEQ ID NO: 158564 - DNA, 25 bp, Mus musculus
agataccattgcttctattctcctg

SEQ ID NO: 158565 - DNA, 25 bp, Mus musculus
agatacccagcaatacacatttgtg

SEQ ID NO: 158566 - DNA, 25 bp, Mus musculus
agatacccagcattacacatttgtg

SEQ ID NO: 158567 - DNA, 25 bp, Mus musculus
agataccccacacagtctggcaggc

SEQ ID NO: 158568 - DNA, 25 bp, Mus musculus
agataccccacagagtctggcaggc

SEQ ID NO: 158569 - DNA, 25 bp, Mus musculus
agatacccctttcagagcccagaag

SEQ ID NO: 158570 - DNA, 25 bp, Mus musculus
agatacccctttgagagcccagaag

SEQ ID NO: 158571 - DNA, 25 bp, Mus musculus
agataccctccactgagctcttgta

SEQ ID NO: 158572 - DNA, 25 bp, Mus musculus
agataccctccagtgagctcttgta

SEQ ID NO: 158573 - DNA, 25 bp, Mus musculus
agataccctcttaacttgtgacatg

SEQ ID NO: 158574 - DNA, 25 bp, Mus musculus
agataccctctttacttgtgacatg

SEQ ID NO: 158575 - DNA, 25 bp, Mus musculus
agataccctgtcacatgttttccac

SEQ ID NO: 158576 - DNA, 25 bp, Mus musculus
agataccctgtcactaagtaatcaa

SEQ ID NO: 158577 - DNA, 25 bp, Mus musculus
agataccctgtctcatgttttccac

SEQ ID NO: 158578 - DNA, 25 bp, Mus musculus
agataccctgtctctaagtaatcaa

SEQ ID NO: 158579 - DNA, 25 bp, Mus musculus
agataccgaaggatgtgctccaccc

SEQ ID NO: 158580 - DNA, 25 bp, Mus musculus
agataccgaaggttgtgctccaccc

SEQ ID NO: 158581 - DNA, 25 bp, Mus musculus
agatacctattcaatgcaactacaa

SEQ ID NO: 158582 - DNA, 25 bp, Mus musculus
agatacctattctatgcaactacaa

SEQ ID NO: 158583 - DNA, 25 bp, Mus musculus
agatacctatttctcagatgtctct

SEQ ID NO: 158584 - DNA, 25 bp, Mus musculus
agatacctatttgtcagatgtctct

SEQ ID NO: 158585 - DNA, 25 bp, Mus musculus
agatacctcagtccgtaatgtgctt

SEQ ID NO: 158586 - DNA, 25 bp, Mus musculus
agatacctcagtgcgtaatgtgctt

SEQ ID NO: 158587 - DNA, 25 bp, Mus musculus
agatacctcggtcataactatgcaa

SEQ ID NO: 158588 - DNA, 25 bp, Mus musculus
agatacctcggtgataactatgcaa

SEQ ID NO: 158589 - DNA, 25 bp, Mus musculus
agatacctcttcagtacactattaa

SEQ ID NO: 158590 - DNA, 25 bp, Mus musculus
agatacctcttctgtacactattaa

SEQ ID NO: 158591 - DNA, 25 bp, Mus musculus
agatacctgaagactgaacccatcc

SEQ ID NO: 158592 - DNA, 25 bp, Mus musculus
agatacctgaagtctgaacccatcc

SEQ ID NO: 158593 - DNA, 25 bp, Mus musculus
agatacctgctactacaaactttgt

SEQ ID NO: 158594 - DNA, 25 bp, Mus musculus
agatacctgctagtacaaactttgt

SEQ ID NO: 158595 - DNA, 25 bp, Mus musculus
agatacctgctcagagtgttctggt

SEQ ID NO: 158596 - DNA, 25 bp, Mus musculus
agatacctgctctgagtgttctggt

SEQ ID NO: 158597 - DNA, 25 bp, Mus musculus
agatacctggacctctgggtgacct

SEQ ID NO: 158598 - DNA, 25 bp, Mus musculus
agatacctggacgtctgggtgacct

SEQ ID NO: 158599 - DNA, 25 bp, Mus musculus
agatacctgtacattcttccatcat

SEQ ID NO: 158600 - DNA, 25 bp, Mus musculus
agatacctgtactttcttccatcat

SEQ ID NO: 158601 - DNA, 25 bp, Mus musculus
agatacgacggacgctttgactact

SEQ ID NO: 158602 - DNA, 25 bp, Mus musculus
agatacgacggaggctttgactact

SEQ ID NO: 158603 - DNA, 25 bp, Mus musculus
agatacgatcgcctacttgctgtct

SEQ ID NO: 158604 - DNA, 25 bp, Mus musculus
agatacgatcgcgtacttgctgtct

SEQ ID NO: 158605 - DNA, 25 bp, Mus musculus
agatacgcgctaccttctggtgctg

SEQ ID NO: 158606 - DNA, 25 bp, Mus musculus
agatacgcgctagcttctggtgctg

SEQ ID NO: 158607 - DNA, 25 bp, Mus musculus
agatacgcttaacggcttagccaca

SEQ ID NO: 158608 - DNA, 25 bp, Mus musculus
agatacgcttaagggcttagccaca

SEQ ID NO: 158609 - DNA, 25 bp, Mus musculus
agatacgctttccaagtgctttgct

SEQ ID NO: 158610 - DNA, 25 bp, Mus musculus
agatacgctttcgaagtgctttgct

SEQ ID NO: 158611 - DNA, 25 bp, Mus musculus
agatacggcttcagcctactacaaa

SEQ ID NO: 158612 - DNA, 25 bp, Mus musculus
agatacggcttctgcctactacaaa

SEQ ID NO: 158613 - DNA, 25 bp, Mus musculus
agatacggtctcctgaactgacttc

SEQ ID NO: 158614 - DNA, 25 bp, Mus musculus
agatacggtctcgtgaactgacttc

SEQ ID NO: 158615 - DNA, 25 bp, Mus musculus
agatacgtgacacacacttggcttc

SEQ ID NO: 158616 - DNA, 25 bp, Mus musculus
agatacgtgacagacacttggcttc

SEQ ID NO: 158617 - DNA, 25 bp, Mus musculus
agatacgtgtagaggtgtttcagaa

SEQ ID NO: 158618 - DNA, 25 bp, Mus musculus
agatacgtgtagtggtgtttcagaa

SEQ ID NO: 158619 - DNA, 25 bp, Mus musculus
agatacgttttgctcacattgtcct

SEQ ID NO: 158620 - DNA, 25 bp, Mus musculus
agatacgttttggtcacattgtcct

SEQ ID NO: 158621 - DNA, 25 bp, Mus musculus
agatactaagatactgtgtgcacca

SEQ ID NO: 158622 - DNA, 25 bp, Mus musculus
agatactaagattctgtgtgcacca

SEQ ID NO: 158623 - DNA, 25 bp, Mus musculus
agatactaccggcaaatgttttact

SEQ ID NO: 158624 - DNA, 25 bp, Mus musculus
agatactaccgggaaatgttttact

SEQ ID NO: 158625 - DNA, 25 bp, Mus musculus
agatactacctcaacccagtaggac

SEQ ID NO: 158626 - DNA, 25 bp, Mus musculus
agatactacctctacccagtaggac

SEQ ID NO: 158627 - DNA, 25 bp, Mus musculus
agatactagaggagactgccccgtg

SEQ ID NO: 158628 - DNA, 25 bp, Mus musculus
agatactagaggtgactgccccgtg

SEQ ID NO: 158629 - DNA, 25 bp, Mus musculus
agatactagtctcatgcatctgcct

SEQ ID NO: 158630 - DNA, 25 bp, Mus musculus
agatactagtctgatgcatctgcct

SEQ ID NO: 158631 - DNA, 25 bp, Mus musculus
agatactatattacgtactcaggga

SEQ ID NO: 158632 - DNA, 25 bp, Mus musculus
agatactatatttcgtactcaggga

SEQ ID NO: 158633 - DNA, 25 bp, Mus musculus
agatactcaagaaccactgcagcga

SEQ ID NO: 158634 - DNA, 25 bp, Mus musculus
agatactcaagatccactgcagcga

SEQ ID NO: 158635 - DNA, 25 bp, Mus musculus
agatactcacttcagggttttaaga

SEQ ID NO: 158636 - DNA, 25 bp, Mus musculus
agatactcacttgagggttttaaga

SEQ ID NO: 158637 - DNA, 25 bp, Mus musculus
agatactcattcatcaccacactgt

SEQ ID NO: 158638 - DNA, 25 bp, Mus musculus
agatactcattcttcaccacactgt

SEQ ID NO: 158639 - DNA, 25 bp, Mus musculus
agatactccaccacgtctaggtgtc

SEQ ID NO: 158640 - DNA, 25 bp, Mus musculus
agatactccacctcgtctaggtgtc

SEQ ID NO: 158641 - DNA, 25 bp, Mus musculus
agatactccgtgactggctccagct

SEQ ID NO: 158642 - DNA, 25 bp, Mus musculus
agatactccgtgtctggctccagct

SEQ ID NO: 158643 - DNA, 25 bp, Mus musculus
agatactcgatcctatggtgtccac

SEQ ID NO: 158644 - DNA, 25 bp, Mus musculus
agatactcgatcgtatggtgtccac

SEQ ID NO: 158645 - DNA, 25 bp, Mus musculus
agatactcgctcatctctgggacag

SEQ ID NO: 158646 - DNA, 25 bp, Mus musculus
agatactcgctcttctctgggacag

SEQ ID NO: 158647 - DNA, 25 bp, Mus musculus
agatactgaattcaaagtggcttgg

SEQ ID NO: 158648 - DNA, 25 bp, Mus musculus
agatactgaattgaaagtggcttgg

SEQ ID NO: 158649 - DNA, 25 bp, Mus musculus
agatactgagccaccaatgaggcag

SEQ ID NO: 158650 - DNA, 25 bp, Mus musculus
agatactgagcctccaatgaggcag

SEQ ID NO: 158651 - DNA, 25 bp, Mus musculus
agatactgcagaccactccaagctt

SEQ ID NO: 158652 - DNA, 25 bp, Mus musculus
agatactgcagagcactccaagctt

SEQ ID NO: 158653 - DNA, 25 bp, Mus musculus
agatactgctcaacgggcagcgcaa

SEQ ID NO: 158654 - DNA, 25 bp, Mus musculus
agatactgctcatcgggcagcgcaa

SEQ ID NO: 158655 - DNA, 25 bp, Mus musculus
agatactgctggaagagcccctgta

SEQ ID NO: 158656 - DNA, 25 bp, Mus musculus
agatactgctggtagagcccctgta

SEQ ID NO: 158657 - DNA, 25 bp, Mus musculus
agatactggcccagtctgaattttc

SEQ ID NO: 158658 - DNA, 25 bp, Mus musculus
agatactggccctgtctgaattttc

SEQ ID NO: 158659 - DNA, 25 bp, Mus musculus
agatactggtacaacacccttgttc

SEQ ID NO: 158660 - DNA, 25 bp, Mus musculus
agatactggtactacacccttgttc

SEQ ID NO: 158661 - DNA, 25 bp, Mus musculus
agatactgtggcctgctggtaccat

SEQ ID NO: 158662 - DNA, 25 bp, Mus musculus
agatactgtggcgtgctggtaccat

SEQ ID NO: 158663 - DNA, 25 bp, Mus musculus
agatacttactgcaagggaaggtcc

SEQ ID NO: 158664 - DNA, 25 bp, Mus musculus
agatacttactggaagggaaggtcc

SEQ ID NO: 158665 - DNA, 25 bp, Mus musculus
agatacttccccaaatcttagctac

SEQ ID NO: 158666 - DNA, 25 bp, Mus musculus
agatacttcccctaatcttagctac

SEQ ID NO: 158667 - DNA, 25 bp, Mus musculus
agatacttccctaaactctaccatc

SEQ ID NO: 158668 - DNA, 25 bp, Mus musculus
agatacttcccttaactctaccatc

SEQ ID NO: 158669 - DNA, 25 bp, Mus musculus
agatacttcctcagtcatcaacgct

SEQ ID NO: 158670 - DNA, 25 bp, Mus musculus
agatacttcctctgtcatcaacgct

SEQ ID NO: 158671 - DNA, 25 bp, Mus musculus
agatacttgatcatgctggagcaga

SEQ ID NO: 158672 - DNA, 25 bp, Mus musculus
agatacttgatcatttaactggcat

SEQ ID NO: 158673 - DNA, 25 bp, Mus musculus
agatacttgatcttgctggagcaga

SEQ ID NO: 158674 - DNA, 25 bp, Mus musculus
agatacttgatcttttaactggcat

SEQ ID NO: 158675 - DNA, 25 bp, Mus musculus
agatacttggtcatactggttttat

SEQ ID NO: 158676 - DNA, 25 bp, Mus musculus
agatacttggtcttactggttttat

SEQ ID NO: 158677 - DNA, 25 bp, Mus musculus
agatacttgtctcccgtagtctatt

SEQ ID NO: 158678 - DNA, 25 bp, Mus musculus
agatacttgtctgccgtagtctatt

SEQ ID NO: 158679 - DNA, 25 bp, Mus musculus
agatactttatcactgtttgccaga

SEQ ID NO: 158680 - DNA, 25 bp, Mus musculus
agatactttatcctttaggttccag

SEQ ID NO: 158681 - DNA, 25 bp, Mus musculus
agatactttatcgtttaggttccag

SEQ ID NO: 158682 - DNA, 25 bp, Mus musculus
agatactttatctctgtttgccaga

SEQ ID NO: 158683 - DNA, 25 bp, Mus musculus
agatactttccactttaggctcaca

SEQ ID NO: 158684 - DNA, 25 bp, Mus musculus
agatactttccagtttaggctcaca

SEQ ID NO: 158685 - DNA, 25 bp, Mus musculus
agatactttgatcccattggagctc

SEQ ID NO: 158686 - DNA, 25 bp, Mus musculus
agatactttgatctctcctttctat

SEQ ID NO: 158687 - DNA, 25 bp, Mus musculus
agatactttgatgccattggagctc

SEQ ID NO: 158688 - DNA, 25 bp, Mus musculus
agatactttgatgtctcctttctat

SEQ ID NO: 158689 - DNA, 25 bp, Mus musculus
agatactttgcaaggtgacccgtca

SEQ ID NO: 158690 - DNA, 25 bp, Mus musculus
agatactttgcatggtgacccgtca

SEQ ID NO: 158691 - DNA, 25 bp, Mus musculus
agatagaaacagaatccctcctccc

SEQ ID NO: 158692 - DNA, 25 bp, Mus musculus
agatagaaacagtatccctcctccc

SEQ ID NO: 158693 - DNA, 25 bp, Mus musculus
agatagaaaccacccaaataaccat

SEQ ID NO: 158694 - DNA, 25 bp, Mus musculus
agatagaaaccagccaaataaccat

SEQ ID NO: 158695 - DNA, 25 bp, Mus musculus
agatagaaacgacccctgccacatc

SEQ ID NO: 158696 - DNA, 25 bp, Mus musculus
agatagaaacgagccctgccacatc

SEQ ID NO: 158697 - DNA, 25 bp, Mus musculus
agatagaaatgtagagtccctcttt

SEQ ID NO: 158698 - DNA, 25 bp, Mus musculus
agatagaaatgttgagtccctcttt

SEQ ID NO: 158699 - DNA, 25 bp, Mus musculus
agatagaacctgctccttggttagc

SEQ ID NO: 158700 - DNA, 25 bp, Mus musculus
agatagaacctggtccttggttagc

SEQ ID NO: 158701 - DNA, 25 bp, Mus musculus
agatagaaccttcattgccccagag

SEQ ID NO: 158702 - DNA, 25 bp, Mus musculus
agatagaaccttgattgccccagag

SEQ ID NO: 158703 - DNA, 25 bp, Mus musculus
agatagaagtccatctggtcctgct

SEQ ID NO: 158704 - DNA, 25 bp, Mus musculus
agatagaagtccttctggtcctgct

SEQ ID NO: 158705 - DNA, 25 bp, Mus musculus
agatagaatgctccagcgaccgtga

SEQ ID NO: 158706 - DNA, 25 bp, Mus musculus
agatagaatgctgcagcgaccgtga

SEQ ID NO: 158707 - DNA, 25 bp, Mus musculus
agatagacctctaagtttaaggcca

SEQ ID NO: 158708 - DNA, 25 bp, Mus musculus
agatagacctcttagtttaaggcca

SEQ ID NO: 158709 - DNA, 25 bp, Mus musculus
agatagacctgtattcagccaccag

SEQ ID NO: 158710 - DNA, 25 bp, Mus musculus
agatagacctgttttcagccaccag

SEQ ID NO: 158711 - DNA, 25 bp, Mus musculus
agatagactttcaggcattcccata

SEQ ID NO: 158712 - DNA, 25 bp, Mus musculus
agatagactttctggcattcccata

SEQ ID NO: 158713 - DNA, 25 bp, Mus musculus
agatagagactcatactgtccctgt

SEQ ID NO: 158714 - DNA, 25 bp, Mus musculus
agatagagactcttactgtccctgt

SEQ ID NO: 158715 - DNA, 25 bp, Mus musculus
agatagagagcacctgcccaggtgt

SEQ ID NO: 158716 - DNA, 25 bp, Mus musculus
agatagagagcagctgcccaggtgt

SEQ ID NO: 158717 - DNA, 25 bp, Mus musculus
agatagagccccactctgagtctgg

SEQ ID NO: 158718 - DNA, 25 bp, Mus musculus
agatagagcccctctctgagtctgg

SEQ ID NO: 158719 - DNA, 25 bp, Mus musculus
agatagagccctagtttatcccagt

SEQ ID NO: 158720 - DNA, 25 bp, Mus musculus
agatagagcccttgtttatcccagt

SEQ ID NO: 158721 - DNA, 25 bp, Mus musculus
agatagaggcagatatcacggctgt

SEQ ID NO: 158722 - DNA, 25 bp, Mus musculus
agatagaggcagttatcacggctgt

SEQ ID NO: 158723 - DNA, 25 bp, Mus musculus
agatagagggccaccaggacgccgt

SEQ ID NO: 158724 - DNA, 25 bp, Mus musculus
agatagagggcctccaggacgccgt

SEQ ID NO: 158725 - DNA, 25 bp, Mus musculus
agatagagtacaccacttcactgca

SEQ ID NO: 158726 - DNA, 25 bp, Mus musculus
agatagagtacagcacttcactgca

SEQ ID NO: 158727 - DNA, 25 bp, Mus musculus
agatagagtgcacctcacgctcaag

SEQ ID NO: 158728 - DNA, 25 bp, Mus musculus
agatagagtgcagctcacgctcaag

SEQ ID NO: 158729 - DNA, 25 bp, Mus musculus
agatagagttcacggccattctggc

SEQ ID NO: 158730 - DNA, 25 bp, Mus musculus
agatagagttcagggccattctggc

SEQ ID NO: 158731 - DNA, 25 bp, Mus musculus
agatagagttttatcctccatggtc

SEQ ID NO: 158732 - DNA, 25 bp, Mus musculus
agatagagttttttcctccatggtc

SEQ ID NO: 158733 - DNA, 25 bp, Mus musculus
agatagatacttatagttctcaaaa

SEQ ID NO: 158734 - DNA, 25 bp, Mus musculus
agatagatacttttagttctcaaaa

SEQ ID NO: 158735 - DNA, 25 bp, Mus musculus
agatagatagttcctcggctgagat

SEQ ID NO: 158736 - DNA, 25 bp, Mus musculus
agatagatagttgctcggctgagat

SEQ ID NO: 158737 - DNA, 25 bp, Mus musculus
agatagatatgacaaatccctgcta

SEQ ID NO: 158738 - DNA, 25 bp, Mus musculus
agatagatatgagaaatccctgcta

SEQ ID NO: 158739 - DNA, 25 bp, Mus musculus
agatagatgatcatcgtccttgctg

SEQ ID NO: 158740 - DNA, 25 bp, Mus musculus
agatagatgatcttcgtccttgctg

SEQ ID NO: 158741 - DNA, 25 bp, Mus musculus
agatagattgatctgggtaggccca

SEQ ID NO: 158742 - DNA, 25 bp, Mus musculus
agatagattgatgtgggtaggccca

SEQ ID NO: 158743 - DNA, 25 bp, Mus musculus
agatagcaaactacttcctgagacc

SEQ ID NO: 158744 - DNA, 25 bp, Mus musculus
agatagcaaacttcttcctgagacc

SEQ ID NO: 158745 - DNA, 25 bp, Mus musculus
agatagcacatcaggcctgctggat

SEQ ID NO: 158746 - DNA, 25 bp, Mus musculus
agatagcacatctggcctgctggat

SEQ ID NO: 158747 - DNA, 25 bp, Mus musculus
agatagcactcaactacaggaggca

SEQ ID NO: 158748 - DNA, 25 bp, Mus musculus
agatagcactcatctacaggaggca

SEQ ID NO: 158749 - DNA, 25 bp, Mus musculus
agatagcactgaaggccctgaagat

SEQ ID NO: 158750 - DNA, 25 bp, Mus musculus
agatagcactgatggccctgaagat

SEQ ID NO: 158751 - DNA, 25 bp, Mus musculus
agatagcagacactgggaccagctg

SEQ ID NO: 158752 - DNA, 25 bp, Mus musculus
agatagcagacagtgggaccagctg

SEQ ID NO: 158753 - DNA, 25 bp, Mus musculus
agatagcaggcacacactctccatt

SEQ ID NO: 158754 - DNA, 25 bp, Mus musculus
agatagcaggcagacactctccatt

SEQ ID NO: 158755 - DNA, 25 bp, Mus musculus
agatagcatgcacccacacaagaac

SEQ ID NO: 158756 - DNA, 25 bp, Mus musculus
agatagcatgcagccacacaagaac

SEQ ID NO: 158757 - DNA, 25 bp, Mus musculus
agatagcatgttcagcagccgtacc

SEQ ID NO: 158758 - DNA, 25 bp, Mus musculus
agatagcatgttgagcagccgtacc

SEQ ID NO: 158759 - DNA, 25 bp, Mus musculus
agatagcattttcctcccttgatcc

SEQ ID NO: 158760 - DNA, 25 bp, Mus musculus
agatagcattttgctcccttgatcc

SEQ ID NO: 158761 - DNA, 25 bp, Mus musculus
agatagccacgacctttagaagcct

SEQ ID NO: 158762 - DNA, 25 bp, Mus musculus
agatagccacgagctttagaagcct

SEQ ID NO: 158763 - DNA, 25 bp, Mus musculus
agatagccagagatgagccctgact

SEQ ID NO: 158764 - DNA, 25 bp, Mus musculus
agatagccagagttgagccctgact

SEQ ID NO: 158765 - DNA, 25 bp, Mus musculus
agatagccagggagttttctcaccc

SEQ ID NO: 158766 - DNA, 25 bp, Mus musculus
agatagccagggtgttttctcaccc

SEQ ID NO: 158767 - DNA, 25 bp, Mus musculus
agatagccagttcgtttgtaacctt

SEQ ID NO: 158768 - DNA, 25 bp, Mus musculus
agatagccagttggtttgtaacctt

SEQ ID NO: 158769 - DNA, 25 bp, Mus musculus
agatagccatgtccagctccaggtc

SEQ ID NO: 158770 - DNA, 25 bp, Mus musculus
agatagccatgtgcagctccaggtc

SEQ ID NO: 158771 - DNA, 25 bp, Mus musculus
agatagccattgctgttggcactgc

SEQ ID NO: 158772 - DNA, 25 bp, Mus musculus
agatagccattggtgttggcactgc

SEQ ID NO: 158773 - DNA, 25 bp, Mus musculus
agatagcccatcacttgagtagcat

SEQ ID NO: 158774 - DNA, 25 bp, Mus musculus
agatagcccatcagttaagagaaca

SEQ ID NO: 158775 - DNA, 25 bp, Mus musculus
agatagcccatctcttgagtagcat

SEQ ID NO: 158776 - DNA, 25 bp, Mus musculus
agatagcccatctgttaagagaaca

SEQ ID NO: 158777 - DNA, 25 bp, Mus musculus
agatagccccttactgtttgtgtac

SEQ ID NO: 158778 - DNA, 25 bp, Mus musculus
agatagcccctttctgtttgtgtac

SEQ ID NO: 158779 - DNA, 25 bp, Mus musculus
agatagccctgtcctggtggtattt

SEQ ID NO: 158780 - DNA, 25 bp, Mus musculus
agatagccctgtgctggtggtattt

SEQ ID NO: 158781 - DNA, 25 bp, Mus musculus
agatagccggctatgtcacgcatct

SEQ ID NO: 158782 - DNA, 25 bp, Mus musculus
agatagccggctttgtcacgcatct

SEQ ID NO: 158783 - DNA, 25 bp, Mus musculus
agatagcctaatacatttcttatat

SEQ ID NO: 158784 - DNA, 25 bp, Mus musculus
agatagcctaattcatttcttatat

SEQ ID NO: 158785 - DNA, 25 bp, Mus musculus
agatagcctacccactggattgcta

SEQ ID NO: 158786 - DNA, 25 bp, Mus musculus
agatagcctaccgactggattgcta

SEQ ID NO: 158787 - DNA, 25 bp, Mus musculus
agatagcctgcacggctcctgtgca

SEQ ID NO: 158788 - DNA, 25 bp, Mus musculus
agatagcctgcagggctcctgtgca

SEQ ID NO: 158789 - DNA, 25 bp, Mus musculus
agatagcctggaatacctgtctcac

SEQ ID NO: 158790 - DNA, 25 bp, Mus musculus
agatagcctggattacctgtctcac

SEQ ID NO: 158791 - DNA, 25 bp, Mus musculus
agatagcctggtcttgtcagcatcc

SEQ ID NO: 158792 - DNA, 25 bp, Mus musculus
agatagcctggtgttgtcagcatcc

SEQ ID NO: 158793 - DNA, 25 bp, Mus musculus
agatagcctgtgagagatcaactca

SEQ ID NO: 158794 - DNA, 25 bp, Mus musculus
agatagcctgtgtgagatcaactca

SEQ ID NO: 158795 - DNA, 25 bp, Mus musculus
agatagcgctcacattctactttga

SEQ ID NO: 158796 - DNA, 25 bp, Mus musculus
agatagcgctcagattctactttga

SEQ ID NO: 158797 - DNA, 25 bp, Mus musculus
agatagcgggaaactctctgcaggc

SEQ ID NO: 158798 - DNA, 25 bp, Mus musculus
agatagcgggaatctctctgcaggc

SEQ ID NO: 158799 - DNA, 25 bp, Mus musculus
agatagcgggcacctcttcctttta

SEQ ID NO: 158800 - DNA, 25 bp, Mus musculus
agatagcgggcagctcttcctttta

SEQ ID NO: 158801 - DNA, 25 bp, Mus musculus
agatagctatcaccggtggtttcat

SEQ ID NO: 158802 - DNA, 25 bp, Mus musculus
agatagctatcagcggtggtttcat

SEQ ID NO: 158803 - DNA, 25 bp, Mus musculus
agatagctattaaatcctgaattat

SEQ ID NO: 158804 - DNA, 25 bp, Mus musculus
agatagctattatatcctgaattat

SEQ ID NO: 158805 - DNA, 25 bp, Mus musculus
agatagctcagtaggcatagtgctt

SEQ ID NO: 158806 - DNA, 25 bp, Mus musculus
agatagctcagttggcatagtgctt

SEQ ID NO: 158807 - DNA, 25 bp, Mus musculus
agatagctcctacacttgactgtta

SEQ ID NO: 158808 - DNA, 25 bp, Mus musculus
agatagctcctagacttgactgtta

SEQ ID NO: 158809 - DNA, 25 bp, Mus musculus
agatagctctgtaggtgcttcaact

SEQ ID NO: 158810 - DNA, 25 bp, Mus musculus
agatagctctgtagtcatcagccca

SEQ ID NO: 158811 - DNA, 25 bp, Mus musculus
agatagctctgttggtgcttcaact

SEQ ID NO: 158812 - DNA, 25 bp, Mus musculus
agatagctctgttgtcatcagccca

SEQ ID NO: 158813 - DNA, 25 bp, Mus musculus
agatagctgctacccatggatgacc

SEQ ID NO: 158814 - DNA, 25 bp, Mus musculus
agatagctgctagccatggatgacc

SEQ ID NO: 158815 - DNA, 25 bp, Mus musculus
agatagctgtgcatttgcaaggaca

SEQ ID NO: 158816 - DNA, 25 bp, Mus musculus
agatagctgtgcttttgcaaggaca

SEQ ID NO: 158817 - DNA, 25 bp, Mus musculus
agatagctgtgtactaagtttcttt

SEQ ID NO: 158818 - DNA, 25 bp, Mus musculus
agatagctgtgttctaagtttcttt

SEQ ID NO: 158819 - DNA, 25 bp, Mus musculus
agatagcttcatagccctgggaaag

SEQ ID NO: 158820 - DNA, 25 bp, Mus musculus
agatagcttcattgccctgggaaag

SEQ ID NO: 158821 - DNA, 25 bp, Mus musculus
agatagcttgggattttaacatggc

SEQ ID NO: 158822 - DNA, 25 bp, Mus musculus
agatagcttgggtttttaacatggc

SEQ ID NO: 158823 - DNA, 25 bp, Mus musculus
agataggaaaatcaccctgaggtgc

SEQ ID NO: 158824 - DNA, 25 bp, Mus musculus
agataggaaaatgaccctgaggtgc

SEQ ID NO: 158825 - DNA, 25 bp, Mus musculus
agataggaccctcgatgtgcacagt

SEQ ID NO: 158826 - DNA, 25 bp, Mus musculus
agataggaccctggatgtgcacagt

SEQ ID NO: 158827 - DNA, 25 bp, Mus musculus
agataggagaatcctcctgctgcct

SEQ ID NO: 158828 - DNA, 25 bp, Mus musculus
agataggagaatgctcctgctgcct

SEQ ID NO: 158829 - DNA, 25 bp, Mus musculus
agataggagactcgattttcttctt

SEQ ID NO: 158830 - DNA, 25 bp, Mus musculus
agataggagactggattttcttctt

SEQ ID NO: 158831 - DNA, 25 bp, Mus musculus
agataggagcccagcttcgagtgga

SEQ ID NO: 158832 - DNA, 25 bp, Mus musculus
agataggagccctgcttcgagtgga

SEQ ID NO: 158833 - DNA, 25 bp, Mus musculus
agataggaggcccaaggaatctctc

SEQ ID NO: 158834 - DNA, 25 bp, Mus musculus
agataggaggccgaaggaatctctc

SEQ ID NO: 158835 - DNA, 25 bp, Mus musculus
agataggcacacaagagctgggttc

SEQ ID NO: 158836 - DNA, 25 bp, Mus musculus
agataggcacactagagctgggttc

SEQ ID NO: 158837 - DNA, 25 bp, Mus musculus
agataggccaatacccaacaccaga

SEQ ID NO: 158838 - DNA, 25 bp, Mus musculus
agataggccaattcccaacaccaga

SEQ ID NO: 158839 - DNA, 25 bp, Mus musculus
agataggcccagagtcttggcattc

SEQ ID NO: 158840 - DNA, 25 bp, Mus musculus
agataggcccagtgtcttggcattc

SEQ ID NO: 158841 - DNA, 25 bp, Mus musculus
agataggcccctcgatgtgccccag

SEQ ID NO: 158842 - DNA, 25 bp, Mus musculus
agataggcccctggatgtgccccag

SEQ ID NO: 158843 - DNA, 25 bp, Mus musculus
agataggccgtgatactgtgttttg

SEQ ID NO: 158844 - DNA, 25 bp, Mus musculus
agataggccgtgttactgtgttttg

SEQ ID NO: 158845 - DNA, 25 bp, Mus musculus
agataggctccgcattccttccgtc

SEQ ID NO: 158846 - DNA, 25 bp, Mus musculus
agataggctccggattccttccgtc

SEQ ID NO: 158847 - DNA, 25 bp, Mus musculus
agatagggactcaccttgtcatgct

SEQ ID NO: 158848 - DNA, 25 bp, Mus musculus
agatagggactctccttgtcatgct

SEQ ID NO: 158849 - DNA, 25 bp, Mus musculus
agatagggatcgcttccagcttggc

SEQ ID NO: 158850 - DNA, 25 bp, Mus musculus
agatagggatcggttccagcttggc

SEQ ID NO: 158851 - DNA, 25 bp, Mus musculus
agatagggcgcccactgctgtctac

SEQ ID NO: 158852 - DNA, 25 bp, Mus musculus
agatagggcgccgactgctgtctac

SEQ ID NO: 158853 - DNA, 25 bp, Mus musculus
agatagggctaacactccttcctgc

SEQ ID NO: 158854 - DNA, 25 bp, Mus musculus
agatagggctaagactccttcctgc

SEQ ID NO: 158855 - DNA, 25 bp, Mus musculus
agatagggctagagaccaaatttcc

SEQ ID NO: 158856 - DNA, 25 bp, Mus musculus
agatagggctagtgaccaaatttcc

SEQ ID NO: 158857 - DNA, 25 bp, Mus musculus
agatagggctccattatttccgtat

SEQ ID NO: 158858 - DNA, 25 bp, Mus musculus
agatagggctcctttatttccgtat

SEQ ID NO: 158859 - DNA, 25 bp, Mus musculus
agatagggtggcacattctgaagga

SEQ ID NO: 158860 - DNA, 25 bp, Mus musculus
agatagggtggctcattctgaagga

SEQ ID NO: 158861 - DNA, 25 bp, Mus musculus
agataggtacagatatccaatgtat

SEQ ID NO: 158862 - DNA, 25 bp, Mus musculus
agataggtacagttatccaatgtat

SEQ ID NO: 158863 - DNA, 25 bp, Mus musculus
agataggtaccacgcctgacattat

SEQ ID NO: 158864 - DNA, 25 bp, Mus musculus
agataggtaccaggcctgacattat

SEQ ID NO: 158865 - DNA, 25 bp, Mus musculus
agataggtatgacgtgccccccctg

SEQ ID NO: 158866 - DNA, 25 bp, Mus musculus
agataggtatgaggtgccccccctg

SEQ ID NO: 158867 - DNA, 25 bp, Mus musculus
agataggtccctaagccctagctat

SEQ ID NO: 158868 - DNA, 25 bp, Mus musculus
agataggtcccttagccctagctat

SEQ ID NO: 158869 - DNA, 25 bp, Mus musculus
agataggtgccaacatgaccagtgt

SEQ ID NO: 158870 - DNA, 25 bp, Mus musculus
agataggtgccatcatgaccagtgt

SEQ ID NO: 158871 - DNA, 25 bp, Mus musculus
agataggttatcattccgagctagc

SEQ ID NO: 158872 - DNA, 25 bp, Mus musculus
agataggttatctttccgagctagc

SEQ ID NO: 158873 - DNA, 25 bp, Mus musculus
agataggttcatcccgcaagcgtga

SEQ ID NO: 158874 - DNA, 25 bp, Mus musculus
agataggttcatgccgcaagcgtga

SEQ ID NO: 158875 - DNA, 25 bp, Mus musculus
agatagtacaggctgtgcccagttc

SEQ ID NO: 158876 - DNA, 25 bp, Mus musculus
agatagtacagggtgtgcccagttc

SEQ ID NO: 158877 - DNA, 25 bp, Mus musculus
agatagtagagcaccgggtcctgtc

SEQ ID NO: 158878 - DNA, 25 bp, Mus musculus
agatagtagagctccgggtcctgtc

SEQ ID NO: 158879 - DNA, 25 bp, Mus musculus
agatagtagggtacctcacagccca

SEQ ID NO: 158880 - DNA, 25 bp, Mus musculus
agatagtagggttcctcacagccca

SEQ ID NO: 158881 - DNA, 25 bp, Mus musculus
agatagtatagtaccttcctccatg

SEQ ID NO: 158882 - DNA, 25 bp, Mus musculus
agatagtatagttccttcctccatg

SEQ ID NO: 158883 - DNA, 25 bp, Mus musculus
agatagtattgcagcataccccgtg

SEQ ID NO: 158884 - DNA, 25 bp, Mus musculus
agatagtattgctgcataccccgtg

SEQ ID NO: 158885 - DNA, 25 bp, Mus musculus
agatagtccaggcttggccttcgct

SEQ ID NO: 158886 - DNA, 25 bp, Mus musculus
agatagtccagggttggccttcgct

SEQ ID NO: 158887 - DNA, 25 bp, Mus musculus
agatagtcccctctctgctttaacc

SEQ ID NO: 158888 - DNA, 25 bp, Mus musculus
agatagtcccctgtctgctttaacc

SEQ ID NO: 158889 - DNA, 25 bp, Mus musculus
agatagtctcacatctgccgaggac

SEQ ID NO: 158890 - DNA, 25 bp, Mus musculus
agatagtctcacttctgccgaggac

SEQ ID NO: 158891 - DNA, 25 bp, Mus musculus
agatagtctcccatagttgctcagg

SEQ ID NO: 158892 - DNA, 25 bp, Mus musculus
agatagtctcccttagttgctcagg

SEQ ID NO: 158893 - DNA, 25 bp, Mus musculus
agatagtcttcaaagcctttggcaa

SEQ ID NO: 158894 - DNA, 25 bp, Mus musculus
agatagtcttcatagcctttggcaa

SEQ ID NO: 158895 - DNA, 25 bp, Mus musculus
agatagtgagccagggtcaataaaa

SEQ ID NO: 158896 - DNA, 25 bp, Mus musculus
agatagtgagcctgggtcaataaaa

SEQ ID NO: 158897 - DNA, 25 bp, Mus musculus
agatagtggaccagtgtgggaaccc

SEQ ID NO: 158898 - DNA, 25 bp, Mus musculus
agatagtggacctgtgtgggaaccc

SEQ ID NO: 158899 - DNA, 25 bp, Mus musculus
agatagtggagtccagcaagagatc

SEQ ID NO: 158900 - DNA, 25 bp, Mus musculus
agatagtggagtctctgtgcacaaa

SEQ ID NO: 158901 - DNA, 25 bp, Mus musculus
agatagtggagtgcagcaagagatc

SEQ ID NO: 158902 - DNA, 25 bp, Mus musculus
agatagtggagtgtctgtgcacaaa

SEQ ID NO: 158903 - DNA, 25 bp, Mus musculus
agatagtggtggctgtaccctgact

SEQ ID NO: 158904 - DNA, 25 bp, Mus musculus
agatagtggtgggtgtaccctgact

SEQ ID NO: 158905 - DNA, 25 bp, Mus musculus
agatagtgtctgaacattgccagaa

SEQ ID NO: 158906 - DNA, 25 bp, Mus musculus
agatagtgtctgtacattgccagaa

SEQ ID NO: 158907 - DNA, 25 bp, Mus musculus
agatagtgtcttaacttggctttgc

SEQ ID NO: 158908 - DNA, 25 bp, Mus musculus
agatagtgtctttacttggctttgc

SEQ ID NO: 158909 - DNA, 25 bp, Mus musculus
agatagttactcatgtgtagcccag

SEQ ID NO: 158910 - DNA, 25 bp, Mus musculus
agatagttactcttgtgtagcccag

SEQ ID NO: 158911 - DNA, 25 bp, Mus musculus
agatagttatcaatccccatgccta

SEQ ID NO: 158912 - DNA, 25 bp, Mus musculus
agatagttatcattccccatgccta

SEQ ID NO: 158913 - DNA, 25 bp, Mus musculus
agatagttccacactgccttttaga

SEQ ID NO: 158914 - DNA, 25 bp, Mus musculus
agatagttccactctgccttttaga

SEQ ID NO: 158915 - DNA, 25 bp, Mus musculus
agatagttgtttcaagctcctgccc

SEQ ID NO: 158916 - DNA, 25 bp, Mus musculus
agatagttgtttgaagctcctgccc

SEQ ID NO: 158917 - DNA, 25 bp, Mus musculus
agatagtttatcatgctctccaaaa

SEQ ID NO: 158918 - DNA, 25 bp, Mus musculus
agatagtttatcttgctctccaaaa

SEQ ID NO: 158919 - DNA, 25 bp, Mus musculus
agatagtttctgcaacatttggaat

SEQ ID NO: 158920 - DNA, 25 bp, Mus musculus
agatagtttctggaacatttggaat

SEQ ID NO: 158921 - DNA, 25 bp, Mus musculus
agatataaaatcagtgttagctttg

SEQ ID NO: 158922 - DNA, 25 bp, Mus musculus
agatataaaatctgtgttagctttg

SEQ ID NO: 158923 - DNA, 25 bp, Mus musculus
agatataaacttatctcccatctgg

SEQ ID NO: 158924 - DNA, 25 bp, Mus musculus
agatataaacttttctcccatctgg

SEQ ID NO: 158925 - DNA, 25 bp, Mus musculus
agatataaccagaagctgatcttca

SEQ ID NO: 158926 - DNA, 25 bp, Mus musculus
agatataaccagtagctgatcttca

SEQ ID NO: 158927 - DNA, 25 bp, Mus musculus
agatataacttgaccacccgccgtg

SEQ ID NO: 158928 - DNA, 25 bp, Mus musculus
agatataacttgtccacccgccgtg

SEQ ID NO: 158929 - DNA, 25 bp, Mus musculus
agatataagcgcaagctctctgtaa

SEQ ID NO: 158930 - DNA, 25 bp, Mus musculus
agatataagcgctagctctctgtaa

SEQ ID NO: 158931 - DNA, 25 bp, Mus musculus
agatataagtatattggctacattg

SEQ ID NO: 158932 - DNA, 25 bp, Mus musculus
agatataagtattttggctacattg

SEQ ID NO: 158933 - DNA, 25 bp, Mus musculus
agatataatttacttgccaacttta

SEQ ID NO: 158934 - DNA, 25 bp, Mus musculus
agatataatttagttgccaacttta

SEQ ID NO: 158935 - DNA, 25 bp, Mus musculus
agatatacaccaccagacccaacag

SEQ ID NO: 158936 - DNA, 25 bp, Mus musculus
agatatacaccagcagacccaacag

SEQ ID NO: 158937 - DNA, 25 bp, Mus musculus
agatatacagtgctgacctacctcc

SEQ ID NO: 158938 - DNA, 25 bp, Mus musculus
agatatacagtggtgacctacctcc

SEQ ID NO: 158939 - DNA, 25 bp, Mus musculus
agatatacctccagtttgcaataac

SEQ ID NO: 158940 - DNA, 25 bp, Mus musculus
agatatacctcctgtttgcaataac

SEQ ID NO: 158941 - DNA, 25 bp, Mus musculus
agatatacctgcagtggagcccaga

SEQ ID NO: 158942 - DNA, 25 bp, Mus musculus
agatatacctgctgtggagcccaga

SEQ ID NO: 158943 - DNA, 25 bp, Mus musculus
agatatacttgccttcccaagttct

SEQ ID NO: 158944 - DNA, 25 bp, Mus musculus
agatatacttgcgttcccaagttct

SEQ ID NO: 158945 - DNA, 25 bp, Mus musculus
agatatagctcgagtctgccatgcg

SEQ ID NO: 158946 - DNA, 25 bp, Mus musculus
agatatagctcgtgtctgccatgcg

SEQ ID NO: 158947 - DNA, 25 bp, Mus musculus
agatatagcttccaagagatgtaat

SEQ ID NO: 158948 - DNA, 25 bp, Mus musculus
agatatagcttcgaagagatgtaat

SEQ ID NO: 158949 - DNA, 25 bp, Mus musculus
agatataggtctccttggcacaagg

SEQ ID NO: 158950 - DNA, 25 bp, Mus musculus
agatataggtctgcttggcacaagg

SEQ ID NO: 158951 - DNA, 25 bp, Mus musculus
agatatatacatactggcttgcttt

SEQ ID NO: 158952 - DNA, 25 bp, Mus musculus
agatatatacattctggcttgcttt

SEQ ID NO: 158953 - DNA, 25 bp, Mus musculus
agatatatcggcattacttttaaat

SEQ ID NO: 158954 - DNA, 25 bp, Mus musculus
agatatatcggctttacttttaaat

SEQ ID NO: 158955 - DNA, 25 bp, Mus musculus
agatatatgtggcttccttttcgca

SEQ ID NO: 158956 - DNA, 25 bp, Mus musculus
agatatatgtgggttccttttcgca

SEQ ID NO: 158957 - DNA, 25 bp, Mus musculus
agatatattgttcctagtgaatgta

SEQ ID NO: 158958 - DNA, 25 bp, Mus musculus
agatatattgttgctagtgaatgta

SEQ ID NO: 158959 - DNA, 25 bp, Mus musculus
agatatatttacctcccgatctggg

SEQ ID NO: 158960 - DNA, 25 bp, Mus musculus
agatatatttacgtcccgatctggg

SEQ ID NO: 158961 - DNA, 25 bp, Mus musculus
agatatcaaaccagcggcactttat

SEQ ID NO: 158962 - DNA, 25 bp, Mus musculus
agatatcaaacctgcggcactttat

SEQ ID NO: 158963 - DNA, 25 bp, Mus musculus
agatatcaacgacgctttcaaggag

SEQ ID NO: 158964 - DNA, 25 bp, Mus musculus
agatatcaacgaggctttcaaggag

SEQ ID NO: 158965 - DNA, 25 bp, Mus musculus
agatatcaagtcagtggccagtcct

SEQ ID NO: 158966 - DNA, 25 bp, Mus musculus
agatatcaagtctgtggccagtcct

SEQ ID NO: 158967 - DNA, 25 bp, Mus musculus
agatatcaccacctggcaaccgggt

SEQ ID NO: 158968 - DNA, 25 bp, Mus musculus
agatatcaccacgtggcaaccgggt

SEQ ID NO: 158969 - DNA, 25 bp, Mus musculus
agatatcacggtatctaaaagaatt

SEQ ID NO: 158970 - DNA, 25 bp, Mus musculus
agatatcacggtttctaaaagaatt

SEQ ID NO: 158971 - DNA, 25 bp, Mus musculus
agatatcagaagagagcactaccct

SEQ ID NO: 158972 - DNA, 25 bp, Mus musculus
agatatcagaagtgagcactaccct

SEQ ID NO: 158973 - DNA, 25 bp, Mus musculus
agatatcagacccagatggatctct

SEQ ID NO: 158974 - DNA, 25 bp, Mus musculus
agatatcagaccgagatggatctct

SEQ ID NO: 158975 - DNA, 25 bp, Mus musculus
agatatcagccaccgtctgccttca

SEQ ID NO: 158976 - DNA, 25 bp, Mus musculus
agatatcagccagcgtctgccttca

SEQ ID NO: 158977 - DNA, 25 bp, Mus musculus
agatatcaggttattcctacactga

SEQ ID NO: 158978 - DNA, 25 bp, Mus musculus
agatatcaggtttttcctacactga

SEQ ID NO: 158979 - DNA, 25 bp, Mus musculus
agatatcatactccttcaactccca

SEQ ID NO: 158980 - DNA, 25 bp, Mus musculus
agatatcatactgcttcaactccca

SEQ ID NO: 158981 - DNA, 25 bp, Mus musculus
agatatcatcctctgtacctctata

SEQ ID NO: 158982 - DNA, 25 bp, Mus musculus
agatatcatcctgtgtacctctata

SEQ ID NO: 158983 - DNA, 25 bp, Mus musculus
agatatccaactccagcacggagct

SEQ ID NO: 158984 - DNA, 25 bp, Mus musculus
agatatccaactgcagcacggagct

SEQ ID NO: 158985 - DNA, 25 bp, Mus musculus
agatatccacctcccgaacaaggaa

SEQ ID NO: 158986 - DNA, 25 bp, Mus musculus
agatatccacctgccgaacaaggaa

SEQ ID NO: 158987 - DNA, 25 bp, Mus musculus
agatatccagctagcacgccgcata

SEQ ID NO: 158988 - DNA, 25 bp, Mus musculus
agatatccagcttgcacgccgcata

SEQ ID NO: 158989 - DNA, 25 bp, Mus musculus
agatatcccacgctggatgctccat

SEQ ID NO: 158990 - DNA, 25 bp, Mus musculus
agatatcccacggtggatgctccat

SEQ ID NO: 158991 - DNA, 25 bp, Mus musculus
agatatccccgcatcagtggcctgg

SEQ ID NO: 158992 - DNA, 25 bp, Mus musculus
agatatccccgcttcagtggcctgg

SEQ ID NO: 158993 - DNA, 25 bp, Mus musculus
agatatccctctccagcacatctaa

SEQ ID NO: 158994 - DNA, 25 bp, Mus musculus
agatatccctctgcagcacatctaa

SEQ ID NO: 158995 - DNA, 25 bp, Mus musculus
agatatccctgcatccagttgggaa

SEQ ID NO: 158996 - DNA, 25 bp, Mus musculus
agatatccctgcttccagttgggaa

SEQ ID NO: 158997 - DNA, 25 bp, Mus musculus
agatatcccttactgatcctccatg

SEQ ID NO: 158998 - DNA, 25 bp, Mus musculus
agatatcccttagtgatcctccatg

SEQ ID NO: 158999 - DNA, 25 bp, Mus musculus
agatatccgtacactggttcggtta

SEQ ID NO: 159000 - DNA, 25 bp, Mus musculus
agatatccgtactctggttcggtta

SEQ ID NO: 159001 - DNA, 25 bp, Mus musculus
agatatcctatgaagtttcccctgg

SEQ ID NO: 159002 - DNA, 25 bp, Mus musculus
agatatcctatgtagtttcccctgg

SEQ ID NO: 159003 - DNA, 25 bp, Mus musculus
agatatcctcatccaatacgatcgg

SEQ ID NO: 159004 - DNA, 25 bp, Mus musculus
agatatcctcatgcaatacgatcgg

SEQ ID NO: 159005 - DNA, 25 bp, Mus musculus
agatatcctgcgaatccatgggtgc

SEQ ID NO: 159006 - DNA, 25 bp, Mus musculus
agatatcctgcgtatccatgggtgc

SEQ ID NO: 159007 - DNA, 25 bp, Mus musculus
agatatccttttcctctcagggcat

SEQ ID NO: 159008 - DNA, 25 bp, Mus musculus
agatatccttttgctctcagggcat

SEQ ID NO: 159009 - DNA, 25 bp, Mus musculus
agatatcgcaccctatgacattggg

SEQ ID NO: 159010 - DNA, 25 bp, Mus musculus
agatatcgcaccgtatgacattggg

SEQ ID NO: 159011 - DNA, 25 bp, Mus musculus
agatatctacctagacttccccaaa

SEQ ID NO: 159012 - DNA, 25 bp, Mus musculus
agatatctaccttgacttccccaaa

SEQ ID NO: 159013 - DNA, 25 bp, Mus musculus
agatatctcggaaaccaggagctcc

SEQ ID NO: 159014 - DNA, 25 bp, Mus musculus
agatatctcggataccaggagctcc

SEQ ID NO: 159015 - DNA, 25 bp, Mus musculus
agatatctctccatattacccgctg

SEQ ID NO: 159016 - DNA, 25 bp, Mus musculus
agatatctctccttattacccgctg

SEQ ID NO: 159017 - DNA, 25 bp, Mus musculus
agatatctctgcaattgacacatga

SEQ ID NO: 159018 - DNA, 25 bp, Mus musculus
agatatctctgctattgacacatga

SEQ ID NO: 159019 - DNA, 25 bp, Mus musculus
agatatctgaatattgactccaaag

SEQ ID NO: 159020 - DNA, 25 bp, Mus musculus
agatatctgaattttgactccaaag

SEQ ID NO: 159021 - DNA, 25 bp, Mus musculus
agatatctgaccatagcctttgctg

SEQ ID NO: 159022 - DNA, 25 bp, Mus musculus
agatatctgaccttagcctttgctg

SEQ ID NO: 159023 - DNA, 25 bp, Mus musculus
agatatctggccactgtctagctga

SEQ ID NO: 159024 - DNA, 25 bp, Mus musculus
agatatctggcctctgtctagctga

SEQ ID NO: 159025 - DNA, 25 bp, Mus musculus
agatatctgtcccaactcaggcttc

SEQ ID NO: 159026 - DNA, 25 bp, Mus musculus
agatatctgtccgaactcaggcttc

SEQ ID NO: 159027 - DNA, 25 bp, Mus musculus
agatatcttcatacacatgcgcata

SEQ ID NO: 159028 - DNA, 25 bp, Mus musculus
agatatcttcattcacatgcgcata

SEQ ID NO: 159029 - DNA, 25 bp, Mus musculus
agatatcttctcctgttctcaggct

SEQ ID NO: 159030 - DNA, 25 bp, Mus musculus
agatatcttctcgtgttctcaggct

SEQ ID NO: 159031 - DNA, 25 bp, Mus musculus
agatatcttgacattctaattcctt

SEQ ID NO: 159032 - DNA, 25 bp, Mus musculus
agatatcttgactttctaattcctt

SEQ ID NO: 159033 - DNA, 25 bp, Mus musculus
agatatcttgttctcatcgtggctc

SEQ ID NO: 159034 - DNA, 25 bp, Mus musculus
agatatcttgttgtcatcgtggctc

SEQ ID NO: 159035 - DNA, 25 bp, Mus musculus
agatatctttatccagcgccaagtc

SEQ ID NO: 159036 - DNA, 25 bp, Mus musculus
agatatctttatgcagcgccaagtc

SEQ ID NO: 159037 - DNA, 25 bp, Mus musculus
agatatctttccagagacacttgca

SEQ ID NO: 159038 - DNA, 25 bp, Mus musculus
agatatctttcctgagacacttgca

SEQ ID NO: 159039 - DNA, 25 bp, Mus musculus
agatatgaaggcagatgccctcctc

SEQ ID NO: 159040 - DNA, 25 bp, Mus musculus
agatatgaaggctgatgccctcctc

SEQ ID NO: 159041 - DNA, 25 bp, Mus musculus
agatatgaagtgatcccctcaggag

SEQ ID NO: 159042 - DNA, 25 bp, Mus musculus
agatatgaagtgttcccctcaggag

SEQ ID NO: 159043 - DNA, 25 bp, Mus musculus
agatatgacatcactcctgagcaga

SEQ ID NO: 159044 - DNA, 25 bp, Mus musculus
agatatgacatctctcctgagcaga

SEQ ID NO: 159045 - DNA, 25 bp, Mus musculus
agatatgacgagatccgtcgccact

SEQ ID NO: 159046 - DNA, 25 bp, Mus musculus
agatatgacgagttccgtcgccact

SEQ ID NO: 159047 - DNA, 25 bp, Mus musculus
agatatgacgtgctggcctactttg

SEQ ID NO: 159048 - DNA, 25 bp, Mus musculus
agatatgacgtggtggcctactttg

SEQ ID NO: 159049 - DNA, 25 bp, Mus musculus
agatatgagccccacggcataggct

SEQ ID NO: 159050 - DNA, 25 bp, Mus musculus
agatatgagcccgacggcataggct

SEQ ID NO: 159051 - DNA, 25 bp, Mus musculus
agatatgagcctccaaggctgccct

SEQ ID NO: 159052 - DNA, 25 bp, Mus musculus
agatatgagcctgcaaggctgccct

SEQ ID NO: 159053 - DNA, 25 bp, Mus musculus
agatatgcaacaccatgttcaggtt

SEQ ID NO: 159054 - DNA, 25 bp, Mus musculus
agatatgcaacagcatgttcaggtt

SEQ ID NO: 159055 - DNA, 25 bp, Mus musculus
agatatgcacagagggcttttctct

SEQ ID NO: 159056 - DNA, 25 bp, Mus musculus
agatatgcacagtgggcttttctct

SEQ ID NO: 159057 - DNA, 25 bp, Mus musculus
agatatgcacttcgcaagacctgag

SEQ ID NO: 159058 - DNA, 25 bp, Mus musculus
agatatgcacttggcaagacctgag

SEQ ID NO: 159059 - DNA, 25 bp, Mus musculus
agatatgcagccattgtgttacaat

SEQ ID NO: 159060 - DNA, 25 bp, Mus musculus
agatatgcagcctttgtgttacaat

SEQ ID NO: 159061 - DNA, 25 bp, Mus musculus
agatatgccatcaccatggttctga

SEQ ID NO: 159062 - DNA, 25 bp, Mus musculus
agatatgccatctccatggttctga

SEQ ID NO: 159063 - DNA, 25 bp, Mus musculus
agatatgcccaacactccttaatgt

SEQ ID NO: 159064 - DNA, 25 bp, Mus musculus
agatatgcccaagactccttaatgt

SEQ ID NO: 159065 - DNA, 25 bp, Mus musculus
agatatgcctccctgctgtaacaca

SEQ ID NO: 159066 - DNA, 25 bp, Mus musculus
agatatgcctccgtgctgtaacaca

SEQ ID NO: 159067 - DNA, 25 bp, Mus musculus
agatatgcgcatagataccagtctc

SEQ ID NO: 159068 - DNA, 25 bp, Mus musculus
agatatgcgcattgataccagtctc

SEQ ID NO: 159069 - DNA, 25 bp, Mus musculus
agatatgcgggtaccagtgtcggca

SEQ ID NO: 159070 - DNA, 25 bp, Mus musculus
agatatgcgggttccagtgtcggca

SEQ ID NO: 159071 - DNA, 25 bp, Mus musculus
agatatgctacacgaccttcgcggc

SEQ ID NO: 159072 - DNA, 25 bp, Mus musculus
agatatgctacaggaccttcgcggc

SEQ ID NO: 159073 - DNA, 25 bp, Mus musculus
agatatgctattacaaaacttcgat

SEQ ID NO: 159074 - DNA, 25 bp, Mus musculus
agatatgctatttcaaaacttcgat

SEQ ID NO: 159075 - DNA, 25 bp, Mus musculus
agatatgctgacaaggctgaggacc

SEQ ID NO: 159076 - DNA, 25 bp, Mus musculus
agatatgctgactaggctgaggacc

SEQ ID NO: 159077 - DNA, 25 bp, Mus musculus
agatatgctgtacttgcctcctcta

SEQ ID NO: 159078 - DNA, 25 bp, Mus musculus
agatatgctgtagttgcctcctcta

SEQ ID NO: 159079 - DNA, 25 bp, Mus musculus
agatatggaaacactcctccacaga

SEQ ID NO: 159080 - DNA, 25 bp, Mus musculus
agatatggaaactctcctccacaga

SEQ ID NO: 159081 - DNA, 25 bp, Mus musculus
agatatggacccattttctgtctca

SEQ ID NO: 159082 - DNA, 25 bp, Mus musculus
agatatggaccctttttctgtctca

SEQ ID NO: 159083 - DNA, 25 bp, Mus musculus
agatatggacctacacttggtgcat

SEQ ID NO: 159084 - DNA, 25 bp, Mus musculus
agatatggaccttcacttggtgcat

SEQ ID NO: 159085 - DNA, 25 bp, Mus musculus
agatatggatggaatggcttctcag

SEQ ID NO: 159086 - DNA, 25 bp, Mus musculus
agatatggatggtatggcttctcag

SEQ ID NO: 159087 - DNA, 25 bp, Mus musculus
agatatggcaatacaggcacagcaa

SEQ ID NO: 159088 - DNA, 25 bp, Mus musculus
agatatggcaattcaggcacagcaa

SEQ ID NO: 159089 - DNA, 25 bp, Mus musculus
agatatggcctcatacagtatttaa

SEQ ID NO: 159090 - DNA, 25 bp, Mus musculus
agatatggcctcttacagtatttaa

SEQ ID NO: 159091 - DNA, 25 bp, Mus musculus
agatatggctacacccctagctgag

SEQ ID NO: 159092 - DNA, 25 bp, Mus musculus
agatatggctactcccctagctgag

SEQ ID NO: 159093 - DNA, 25 bp, Mus musculus
agatatggctgtaggctgtaacatt

SEQ ID NO: 159094 - DNA, 25 bp, Mus musculus
agatatggctgttggctgtaacatt

SEQ ID NO: 159095 - DNA, 25 bp, Mus musculus
agatatgggctcaggttttttgttt

SEQ ID NO: 159096 - DNA, 25 bp, Mus musculus
agatatgggctctggttttttgttt

SEQ ID NO: 159097 - DNA, 25 bp, Mus musculus
agatatgtacacctcagtcacctgc

SEQ ID NO: 159098 - DNA, 25 bp, Mus musculus
agatatgtacacgtcagtcacctgc

SEQ ID NO: 159099 - DNA, 25 bp, Mus musculus
agatatgtacataccacagtgctgt

SEQ ID NO: 159100 - DNA, 25 bp, Mus musculus
agatatgtacattccacagtgctgt

SEQ ID NO: 159101 - DNA, 25 bp, Mus musculus
agatatgtcccactgtacttgctgt

SEQ ID NO: 159102 - DNA, 25 bp, Mus musculus
agatatgtcccagtgtacttgctgt

SEQ ID NO: 159103 - DNA, 25 bp, Mus musculus
agatatgtctgtctgctttaccatg

SEQ ID NO: 159104 - DNA, 25 bp, Mus musculus
agatatgtctgtgtgctttaccatg

SEQ ID NO: 159105 - DNA, 25 bp, Mus musculus
agatatgtgtccaagcttcagaatc

SEQ ID NO: 159106 - DNA, 25 bp, Mus musculus
agatatgtgtcctagcttcagaatc

SEQ ID NO: 159107 - DNA, 25 bp, Mus musculus
agatatgtgtctcatccctcatcca

SEQ ID NO: 159108 - DNA, 25 bp, Mus musculus
agatatgtgtctgatccctcatcca

SEQ ID NO: 159109 - DNA, 25 bp, Mus musculus
agatatgttcagacacctttccttt

SEQ ID NO: 159110 - DNA, 25 bp, Mus musculus
agatatgttcagtcacctttccttt

SEQ ID NO: 159111 - DNA, 25 bp, Mus musculus
agatatgttctcagccaggccgaga

SEQ ID NO: 159112 - DNA, 25 bp, Mus musculus
agatatgttctctgccaggccgaga

SEQ ID NO: 159113 - DNA, 25 bp, Mus musculus
agatatgttgaaccctaccaaattc

SEQ ID NO: 159114 - DNA, 25 bp, Mus musculus
agatatgttgaagcctaccaaattc

SEQ ID NO: 159115 - DNA, 25 bp, Mus musculus
agatatgttttgatagcccaacccc

SEQ ID NO: 159116 - DNA, 25 bp, Mus musculus
agatatgttttgttagcccaacccc

SEQ ID NO: 159117 - DNA, 25 bp, Mus musculus
agatattaacacctgcatcccgata

SEQ ID NO: 159118 - DNA, 25 bp, Mus musculus
agatattaacacgtgcatcccgata

SEQ ID NO: 159119 - DNA, 25 bp, Mus musculus
agatattagctcagccttgtggctg

SEQ ID NO: 159120 - DNA, 25 bp, Mus musculus
agatattagctctgccttgtggctg

SEQ ID NO: 159121 - DNA, 25 bp, Mus musculus
agatattatgtactggtcaaggacc

SEQ ID NO: 159122 - DNA, 25 bp, Mus musculus
agatattatgtagtggtcaaggacc

SEQ ID NO: 159123 - DNA, 25 bp, Mus musculus
agatattctctcatattcataaatg

SEQ ID NO: 159124 - DNA, 25 bp, Mus musculus
agatattctctcttattcataaatg

SEQ ID NO: 159125 - DNA, 25 bp, Mus musculus
agatattctgggagtagctgttcca

SEQ ID NO: 159126 - DNA, 25 bp, Mus musculus
agatattctgggtgtagctgttcca

SEQ ID NO: 159127 - DNA, 25 bp, Mus musculus
agatattctgtcaacttggctctag

SEQ ID NO: 159128 - DNA, 25 bp, Mus musculus
agatattctgtctacttggctctag

SEQ ID NO: 159129 - DNA, 25 bp, Mus musculus
agatattcttacatcagttcatgat

SEQ ID NO: 159130 - DNA, 25 bp, Mus musculus
agatattcttacttcagttcatgat

SEQ ID NO: 159131 - DNA, 25 bp, Mus musculus
agatattgaatgcaaacagctcccc

SEQ ID NO: 159132 - DNA, 25 bp, Mus musculus
agatattgaatggaaacagctcccc

SEQ ID NO: 159133 - DNA, 25 bp, Mus musculus
agatattgattcaggaggctcaaaa

SEQ ID NO: 159134 - DNA, 25 bp, Mus musculus
agatattgattctggaggctcaaaa

SEQ ID NO: 159135 - DNA, 25 bp, Mus musculus
agatattgccaaagatgccctacag

SEQ ID NO: 159136 - DNA, 25 bp, Mus musculus
agatattgccaatgatgccctacag

SEQ ID NO: 159137 - DNA, 25 bp, Mus musculus
agatattgccacagagcgtgcccag

SEQ ID NO: 159138 - DNA, 25 bp, Mus musculus
agatattgccactgagcgtgcccag

SEQ ID NO: 159139 - DNA, 25 bp, Mus musculus
agatattgcctcctccgaggacatg

SEQ ID NO: 159140 - DNA, 25 bp, Mus musculus
agatattgcctcgtccgaggacatg

SEQ ID NO: 159141 - DNA, 25 bp, Mus musculus
agatattggtgcacgctgggacaca

SEQ ID NO: 159142 - DNA, 25 bp, Mus musculus
agatattggtgctcgctgggacaca

SEQ ID NO: 159143 - DNA, 25 bp, Mus musculus
agatatttatatagcaggccatggc

SEQ ID NO: 159144 - DNA, 25 bp, Mus musculus
agatatttatattgcaggccatggc

SEQ ID NO: 159145 - DNA, 25 bp, Mus musculus
agatatttatttacagcgttggctt

SEQ ID NO: 159146 - DNA, 25 bp, Mus musculus
agatatttattttcagcgttggctt

SEQ ID NO: 159147 - DNA, 25 bp, Mus musculus
agatatttcaaactctcctaggtga

SEQ ID NO: 159148 - DNA, 25 bp, Mus musculus
agatatttcaaagtctcctaggtga

SEQ ID NO: 159149 - DNA, 25 bp, Mus musculus
agatatttcaatctacactgcctgc

SEQ ID NO: 159150 - DNA, 25 bp, Mus musculus
agatatttcaatgtacactgcctgc

SEQ ID NO: 159151 - DNA, 25 bp, Mus musculus
agatatttcagcaaagtggactttg

SEQ ID NO: 159152 - DNA, 25 bp, Mus musculus
agatatttcagctaagtggactttg

SEQ ID NO: 159153 - DNA, 25 bp, Mus musculus
agatatttcccaaatgtcctccagt

SEQ ID NO: 159154 - DNA, 25 bp, Mus musculus
agatatttcccatatgtcctccagt

SEQ ID NO: 159155 - DNA, 25 bp, Mus musculus
agatatttccgtactccagtgccat

SEQ ID NO: 159156 - DNA, 25 bp, Mus musculus
agatatttccgttctccagtgccat

SEQ ID NO: 159157 - DNA, 25 bp, Mus musculus
agatatttctaaccatctcccaaag

SEQ ID NO: 159158 - DNA, 25 bp, Mus musculus
agatatttctaagcatctcccaaag

SEQ ID NO: 159159 - DNA, 25 bp, Mus musculus
agatatttctagaccttacgttgtt

SEQ ID NO: 159160 - DNA, 25 bp, Mus musculus
agatatttctagtccttacgttgtt

SEQ ID NO: 159161 - DNA, 25 bp, Mus musculus
agatatttcttaagcaatacatcca

SEQ ID NO: 159162 - DNA, 25 bp, Mus musculus
agatatttcttatgcaatacatcca

SEQ ID NO: 159163 - DNA, 25 bp, Mus musculus
agatatttgtcactgcctatacctg

SEQ ID NO: 159164 - DNA, 25 bp, Mus musculus
agatatttgtcagtgcctatacctg

SEQ ID NO: 159165 - DNA, 25 bp, Mus musculus
agatattttacccttgcttgcagtg

SEQ ID NO: 159166 - DNA, 25 bp, Mus musculus
agatattttaccgttgcttgcagtg

SEQ ID NO: 159167 - DNA, 25 bp, Mus musculus
agatattttactcgaacatgctctg

SEQ ID NO: 159168 - DNA, 25 bp, Mus musculus
agatattttactggaacatgctctg

SEQ ID NO: 159169 - DNA, 25 bp, Mus musculus
agatattttcctctcggataaaata

SEQ ID NO: 159170 - DNA, 25 bp, Mus musculus
agatattttcctgtcggataaaata

SEQ ID NO: 159171 - DNA, 25 bp, Mus musculus
agatatttttcgcttcctaccttag

SEQ ID NO: 159172 - DNA, 25 bp, Mus musculus
agatatttttcggttcctaccttag

SEQ ID NO: 159173 - DNA, 25 bp, Mus musculus
agatatttttctcctgtagttaaca

SEQ ID NO: 159174 - DNA, 25 bp, Mus musculus
agatatttttctgctgtagttaaca

SEQ ID NO: 159175 - DNA, 25 bp, Mus musculus
agatcaaaagatatggtccttttta

SEQ ID NO: 159176 - DNA, 25 bp, Mus musculus
agatcaaaagatttggtccttttta

SEQ ID NO: 159177 - DNA, 25 bp, Mus musculus
agatcaaacagcattgccgcttctg

SEQ ID NO: 159178 - DNA, 25 bp, Mus musculus
agatcaaacagctttgccgcttctg

SEQ ID NO: 159179 - DNA, 25 bp, Mus musculus
agatcaaacatcacactgcctttgc

SEQ ID NO: 159180 - DNA, 25 bp, Mus musculus
agatcaaacatctcactgcctttgc

SEQ ID NO: 159181 - DNA, 25 bp, Mus musculus
agatcaaagagcatttcttctcttc

SEQ ID NO: 159182 - DNA, 25 bp, Mus musculus
agatcaaagagcttttcttctcttc

SEQ ID NO: 159183 - DNA, 25 bp, Mus musculus
agatcaaagatacccaagccttcgg

SEQ ID NO: 159184 - DNA, 25 bp, Mus musculus
agatcaaagatagccaagccttcgg

SEQ ID NO: 159185 - DNA, 25 bp, Mus musculus
agatcaaaggccagggcactgctgt

SEQ ID NO: 159186 - DNA, 25 bp, Mus musculus
agatcaaaggcctgggcactgctgt

SEQ ID NO: 159187 - DNA, 25 bp, Mus musculus
agatcaacagcacgtttccctcttg

SEQ ID NO: 159188 - DNA, 25 bp, Mus musculus
agatcaacagcaggtttccctcttg

SEQ ID NO: 159189 - DNA, 25 bp, Mus musculus
agatcaacatccaccaccaagagtg

SEQ ID NO: 159190 - DNA, 25 bp, Mus musculus
agatcaacatcctccaccaagagtg

SEQ ID NO: 159191 - DNA, 25 bp, Mus musculus
agatcaaccataagcggtaccaccc

SEQ ID NO: 159192 - DNA, 25 bp, Mus musculus
agatcaaccatatgcggtaccaccc

SEQ ID NO: 159193 - DNA, 25 bp, Mus musculus
agatcaacccctagcagacacagag

SEQ ID NO: 159194 - DNA, 25 bp, Mus musculus
agatcaaccccttgcagacacagag

SEQ ID NO: 159195 - DNA, 25 bp, Mus musculus
agatcaaccgcaatttccacgaacg

SEQ ID NO: 159196 - DNA, 25 bp, Mus musculus
agatcaaccgcattttccacgaacg

SEQ ID NO: 159197 - DNA, 25 bp, Mus musculus
agatcaacctgcagtgacgcgggac

SEQ ID NO: 159198 - DNA, 25 bp, Mus musculus
agatcaacctgctgtgacgcgggac

SEQ ID NO: 159199 - DNA, 25 bp, Mus musculus
agatcaacgttgcaccttggctgaa

SEQ ID NO: 159200 - DNA, 25 bp, Mus musculus
agatcaacgttggaccttggctgaa

SEQ ID NO: 159201 - DNA, 25 bp, Mus musculus
agatcaactcagacctcgggatgtt

SEQ ID NO: 159202 - DNA, 25 bp, Mus musculus
agatcaactcagtcctcgggatgtt

SEQ ID NO: 159203 - DNA, 25 bp, Mus musculus
agatcaactccacgcgctacaagac

SEQ ID NO: 159204 - DNA, 25 bp, Mus musculus
agatcaactccaggcgctacaagac

SEQ ID NO: 159205 - DNA, 25 bp, Mus musculus
agatcaacttgtctctgcgaatccc

SEQ ID NO: 159206 - DNA, 25 bp, Mus musculus
agatcaacttgtgtctgcgaatccc

SEQ ID NO: 159207 - DNA, 25 bp, Mus musculus
agatcaagaagcactgtcatctaaa

SEQ ID NO: 159208 - DNA, 25 bp, Mus musculus
agatcaagaagctctgtcatctaaa

SEQ ID NO: 159209 - DNA, 25 bp, Mus musculus
agatcaagcctaagccaacagccag

SEQ ID NO: 159210 - DNA, 25 bp, Mus musculus
agatcaagcctatgccaacagccag

SEQ ID NO: 159211 - DNA, 25 bp, Mus musculus
agatcaagcgaactgcccggacttc

SEQ ID NO: 159212 - DNA, 25 bp, Mus musculus
agatcaagcgaagtgcccggacttc

SEQ ID NO: 159213 - DNA, 25 bp, Mus musculus
agatcaagcgtgaacagaagctgaa

SEQ ID NO: 159214 - DNA, 25 bp, Mus musculus
agatcaagcgtgtacagaagctgaa

SEQ ID NO: 159215 - DNA, 25 bp, Mus musculus
agatcaaggccaacaagtcgacaac

SEQ ID NO: 159216 - DNA, 25 bp, Mus musculus
agatcaaggccatcaagtcgacaac

SEQ ID NO: 159217 - DNA, 25 bp, Mus musculus
agatcaaggccccttgtttcctgag

SEQ ID NO: 159218 - DNA, 25 bp, Mus musculus
agatcaaggcccgttgtttcctgag

SEQ ID NO: 159219 - DNA, 25 bp, Mus musculus
agatcaagggttaagaattcagcaa

SEQ ID NO: 159220 - DNA, 25 bp, Mus musculus
agatcaagggtttagaattcagcaa

SEQ ID NO: 159221 - DNA, 25 bp, Mus musculus
agatcaagtcacactcagatccctg

SEQ ID NO: 159222 - DNA, 25 bp, Mus musculus
agatcaagtcactctcagatccctg

SEQ ID NO: 159223 - DNA, 25 bp, Mus musculus
agatcaagtcgtccttctggcaggc

SEQ ID NO: 159224 - DNA, 25 bp, Mus musculus
agatcaagtcgtgcttctggcaggc

SEQ ID NO: 159225 - DNA, 25 bp, Mus musculus
agatcaagtggcactggtgtggctc

SEQ ID NO: 159226 - DNA, 25 bp, Mus musculus
agatcaagtggctctggtgtggctc

SEQ ID NO: 159227 - DNA, 25 bp, Mus musculus
agatcaagtgtgagctccgtgtcct

SEQ ID NO: 159228 - DNA, 25 bp, Mus musculus
agatcaagtgtgtgctccgtgtcct

SEQ ID NO: 159229 - DNA, 25 bp, Mus musculus
agatcaatcctactgcattctctgg

SEQ ID NO: 159230 - DNA, 25 bp, Mus musculus
agatcaatcctagtgcattctctgg

SEQ ID NO: 159231 - DNA, 25 bp, Mus musculus
agatcaatcgagaacacagaagaaa

SEQ ID NO: 159232 - DNA, 25 bp, Mus musculus
agatcaatcgagtacacagaagaaa

SEQ ID NO: 159233 - DNA, 25 bp, Mus musculus
agatcaatctgcagtgggcctgaac

SEQ ID NO: 159234 - DNA, 25 bp, Mus musculus
agatcaatctgctgtgggcctgaac

SEQ ID NO: 159235 - DNA, 25 bp, Mus musculus
agatcaatctgtaatctacggcaga

SEQ ID NO: 159236 - DNA, 25 bp, Mus musculus
agatcaatctgtacgtgagttccag

SEQ ID NO: 159237 - DNA, 25 bp, Mus musculus
agatcaatctgttatctacggcaga

SEQ ID NO: 159238 - DNA, 25 bp, Mus musculus
agatcaatctgttcgtgagttccag

SEQ ID NO: 159239 - DNA, 25 bp, Mus musculus
agatcaatgaagacgttttctaaca

SEQ ID NO: 159240 - DNA, 25 bp, Mus musculus
agatcaatgaagtcgttttctaaca

SEQ ID NO: 159241 - DNA, 25 bp, Mus musculus
agatcaatggcaaccgctggcacta

SEQ ID NO: 159242 - DNA, 25 bp, Mus musculus
agatcaatggcatccgctggcacta

SEQ ID NO: 159243 - DNA, 25 bp, Mus musculus
agatcaatggtgagcactcctcatt

SEQ ID NO: 159244 - DNA, 25 bp, Mus musculus
agatcaatggtgtgcactcctcatt

SEQ ID NO: 159245 - DNA, 25 bp, Mus musculus
agatcaatgtgcactacaaccgcat

SEQ ID NO: 159246 - DNA, 25 bp, Mus musculus
agatcaatgtgctctacaaccgcat

SEQ ID NO: 159247 - DNA, 25 bp, Mus musculus
agatcaatgttgcttccagaccctc

SEQ ID NO: 159248 - DNA, 25 bp, Mus musculus
agatcaatgttggttccagaccctc

SEQ ID NO: 159249 - DNA, 25 bp, Mus musculus
agatcacaagtgcaaggctatcctt

SEQ ID NO: 159250 - DNA, 25 bp, Mus musculus
agatcacaagtggaaggctatcctt

SEQ ID NO: 159251 - DNA, 25 bp, Mus musculus
agatcacacaaacccacctaagctg

SEQ ID NO: 159252 - DNA, 25 bp, Mus musculus
agatcacacaaagccacctaagctg

SEQ ID NO: 159253 - DNA, 25 bp, Mus musculus
agatcacacaccctatcctgacttt

SEQ ID NO: 159254 - DNA, 25 bp, Mus musculus
agatcacacaccgtatcctgacttt

SEQ ID NO: 159255 - DNA, 25 bp, Mus musculus
agatcacacattctgaaccctcctg

SEQ ID NO: 159256 - DNA, 25 bp, Mus musculus
agatcacacattgtgaaccctcctg

SEQ ID NO: 159257 - DNA, 25 bp, Mus musculus
agatcacacctgatagcactgctgc

SEQ ID NO: 159258 - DNA, 25 bp, Mus musculus
agatcacacctgttagcactgctgc

SEQ ID NO: 159259 - DNA, 25 bp, Mus musculus
agatcacactagactgtaagtccag

SEQ ID NO: 159260 - DNA, 25 bp, Mus musculus
agatcacactagaggcaccgcacat

SEQ ID NO: 159261 - DNA, 25 bp, Mus musculus
agatcacactagtctgtaagtccag

SEQ ID NO: 159262 - DNA, 25 bp, Mus musculus
agatcacactagtggcaccgcacat

SEQ ID NO: 159263 - DNA, 25 bp, Mus musculus
agatcacagaatcgctggaccctaa

SEQ ID NO: 159264 - DNA, 25 bp, Mus musculus
agatcacagaatggctggaccctaa

SEQ ID NO: 159265 - DNA, 25 bp, Mus musculus
agatcacagctacagctcccatgag

SEQ ID NO: 159266 - DNA, 25 bp, Mus musculus
agatcacagctagagctcccatgag

SEQ ID NO: 159267 - DNA, 25 bp, Mus musculus
agatcacagctcaccggcagcaaga

SEQ ID NO: 159268 - DNA, 25 bp, Mus musculus
agatcacagctcacgcctgtttaga

SEQ ID NO: 159269 - DNA, 25 bp, Mus musculus
agatcacagctcagttcctatagaa

SEQ ID NO: 159270 - DNA, 25 bp, Mus musculus
agatcacagctctccggcagcaaga

SEQ ID NO: 159271 - DNA, 25 bp, Mus musculus
agatcacagctctcgcctgtttaga

SEQ ID NO: 159272 - DNA, 25 bp, Mus musculus
agatcacagctctgttcctatagaa

SEQ ID NO: 159273 - DNA, 25 bp, Mus musculus
agatcacaggacatgacccatcatc

SEQ ID NO: 159274 - DNA, 25 bp, Mus musculus
agatcacaggacttgacccatcatc

SEQ ID NO: 159275 - DNA, 25 bp, Mus musculus
agatcacaggctctgcttacatgtt

SEQ ID NO: 159276 - DNA, 25 bp, Mus musculus
agatcacaggctgtgcttacatgtt

SEQ ID NO: 159277 - DNA, 25 bp, Mus musculus
agatcacagtcaatgacctacctgt

SEQ ID NO: 159278 - DNA, 25 bp, Mus musculus
agatcacagtcattgacctacctgt

SEQ ID NO: 159279 - DNA, 25 bp, Mus musculus
agatcacagtttccttgtacttata

SEQ ID NO: 159280 - DNA, 25 bp, Mus musculus
agatcacagtttgcttgtacttata

SEQ ID NO: 159281 - DNA, 25 bp, Mus musculus
agatcacatccaaagctctgtagcc

SEQ ID NO: 159282 - DNA, 25 bp, Mus musculus
agatcacatccatagctctgtagcc

SEQ ID NO: 159283 - DNA, 25 bp, Mus musculus
agatcacatgacctttagcccttac

SEQ ID NO: 159284 - DNA, 25 bp, Mus musculus
agatcacatgacgtttagcccttac

SEQ ID NO: 159285 - DNA, 25 bp, Mus musculus
agatcacatgttccttttagtgccg

SEQ ID NO: 159286 - DNA, 25 bp, Mus musculus
agatcacatgttgcttttagtgccg

SEQ ID NO: 159287 - DNA, 25 bp, Mus musculus
agatcaccaactcgctgacctacag

SEQ ID NO: 159288 - DNA, 25 bp, Mus musculus
agatcaccaactggctgacctacag

SEQ ID NO: 159289 - DNA, 25 bp, Mus musculus
agatcaccaagcactgatccaactc

SEQ ID NO: 159290 - DNA, 25 bp, Mus musculus
agatcaccaagctctgatccaactc

SEQ ID NO: 159291 - DNA, 25 bp, Mus musculus
agatcaccacacatagctagtgata

SEQ ID NO: 159292 - DNA, 25 bp, Mus musculus
agatcaccacacttagctagtgata

SEQ ID NO: 159293 - DNA, 25 bp, Mus musculus
agatcaccaccacgacgctgaaggc

SEQ ID NO: 159294 - DNA, 25 bp, Mus musculus
agatcaccaccaggacgctgaaggc

SEQ ID NO: 159295 - DNA, 25 bp, Mus musculus
agatcaccaccgcagctcaggacga

SEQ ID NO: 159296 - DNA, 25 bp, Mus musculus
agatcaccaccggagctcaggacga

SEQ ID NO: 159297 - DNA, 25 bp, Mus musculus
agatcaccaggaactcctacctgct

SEQ ID NO: 159298 - DNA, 25 bp, Mus musculus
agatcaccaggatctcctacctgct

SEQ ID NO: 159299 - DNA, 25 bp, Mus musculus
agatcaccaggcagaaacacgccaa

SEQ ID NO: 159300 - DNA, 25 bp, Mus musculus
agatcaccaggctgaaacacgccaa

SEQ ID NO: 159301 - DNA, 25 bp, Mus musculus
agatcaccagtgacgccaaggcctt

SEQ ID NO: 159302 - DNA, 25 bp, Mus musculus
agatcaccagtgtcgccaaggcctt

SEQ ID NO: 159303 - DNA, 25 bp, Mus musculus
agatcaccatcccatgtgtacctgg

SEQ ID NO: 159304 - DNA, 25 bp, Mus musculus
agatcaccatccgatgtgtacctgg

SEQ ID NO: 159305 - DNA, 25 bp, Mus musculus
agatcaccatgactctcggaagaga

SEQ ID NO: 159306 - DNA, 25 bp, Mus musculus
agatcaccatgagtctcggaagaga

SEQ ID NO: 159307 - DNA, 25 bp, Mus musculus
agatcaccattaattccccagaaag

SEQ ID NO: 159308 - DNA, 25 bp, Mus musculus
agatcaccattatttccccagaaag

SEQ ID NO: 159309 - DNA, 25 bp, Mus musculus
agatcaccattgctttatattgtag

SEQ ID NO: 159310 - DNA, 25 bp, Mus musculus
agatcaccattggtttatattgtag

SEQ ID NO: 159311 - DNA, 25 bp, Mus musculus
agatcaccatttccgactgtggaca

SEQ ID NO: 159312 - DNA, 25 bp, Mus musculus
agatcaccatttgcgactgtggaca

SEQ ID NO: 159313 - DNA, 25 bp, Mus musculus
agatcacccacaataaagcgcagcc

SEQ ID NO: 159314 - DNA, 25 bp, Mus musculus
agatcacccacattaaagcgcagcc

SEQ ID NO: 159315 - DNA, 25 bp, Mus musculus
agatcacccctaacagaacagttcc

SEQ ID NO: 159316 - DNA, 25 bp, Mus musculus
agatcacccctatcagaacagttcc

SEQ ID NO: 159317 - DNA, 25 bp, Mus musculus
agatcaccgagaagtctactaagac

SEQ ID NO: 159318 - DNA, 25 bp, Mus musculus
agatcaccgagatgtctactaagac

SEQ ID NO: 159319 - DNA, 25 bp, Mus musculus
agatcaccgggaccgcatgattcga

SEQ ID NO: 159320 - DNA, 25 bp, Mus musculus
agatcaccgggagcgcatgattcga

SEQ ID NO: 159321 - DNA, 25 bp, Mus musculus
agatcacctcttaagattttcaaaa

SEQ ID NO: 159322 - DNA, 25 bp, Mus musculus
agatcacctctttagattttcaaaa

SEQ ID NO: 159323 - DNA, 25 bp, Mus musculus
agatcacctgcaccgccaaaaacaa

SEQ ID NO: 159324 - DNA, 25 bp, Mus musculus
agatcacctgcagcgccaaaaacaa

SEQ ID NO: 159325 - DNA, 25 bp, Mus musculus
agatcacctggccacagtttgtaaa

SEQ ID NO: 159326 - DNA, 25 bp, Mus musculus
agatcacctggcgacagtttgtaaa

SEQ ID NO: 159327 - DNA, 25 bp, Mus musculus
agatcacctgtaaaacccagtcttc

SEQ ID NO: 159328 - DNA, 25 bp, Mus musculus
agatcacctgtataacccagtcttc

SEQ ID NO: 159329 - DNA, 25 bp, Mus musculus
agatcacctgttacgctgtgggaac

SEQ ID NO: 159330 - DNA, 25 bp, Mus musculus
agatcacctgttcacttgttctgaa

SEQ ID NO: 159331 - DNA, 25 bp, Mus musculus
agatcacctgttgacttgttctgaa

SEQ ID NO: 159332 - DNA, 25 bp, Mus musculus
agatcacctgtttcgctgtgggaac

SEQ ID NO: 159333 - DNA, 25 bp, Mus musculus
agatcaccttgaccctcttctgttg

SEQ ID NO: 159334 - DNA, 25 bp, Mus musculus
agatcaccttgagcctcttctgttg

SEQ ID NO: 159335 - DNA, 25 bp, Mus musculus
agatcacgagatcggttcttctgcc

SEQ ID NO: 159336 - DNA, 25 bp, Mus musculus
agatcacgagatgggttcttctgcc

SEQ ID NO: 159337 - DNA, 25 bp, Mus musculus
agatcacgcttaagccatgaaccat

SEQ ID NO: 159338 - DNA, 25 bp, Mus musculus
agatcacgcttatgccatgaaccat

SEQ ID NO: 159339 - DNA, 25 bp, Mus musculus
agatcacggtacaggtgtgtctcca

SEQ ID NO: 159340 - DNA, 25 bp, Mus musculus
agatcacggtactggtgtgtctcca

SEQ ID NO: 159341 - DNA, 25 bp, Mus musculus
agatcacgtgctagtgccaggttcc

SEQ ID NO: 159342 - DNA, 25 bp, Mus musculus
agatcacgtgcttgtgccaggttcc

SEQ ID NO: 159343 - DNA, 25 bp, Mus musculus
agatcactaggtattattaactggg

SEQ ID NO: 159344 - DNA, 25 bp, Mus musculus
agatcactaggttttattaactggg

SEQ ID NO: 159345 - DNA, 25 bp, Mus musculus
agatcactcggaaattcaggctgaa

SEQ ID NO: 159346 - DNA, 25 bp, Mus musculus
agatcactcggatattcaggctgaa

SEQ ID NO: 159347 - DNA, 25 bp, Mus musculus
agatcactctacaaaccaagctcag

SEQ ID NO: 159348 - DNA, 25 bp, Mus musculus
agatcactctactaaccaagctcag

SEQ ID NO: 159349 - DNA, 25 bp, Mus musculus
agatcactctcaagaagcaccagat

SEQ ID NO: 159350 - DNA, 25 bp, Mus musculus
agatcactctcacaaaagccacaag

SEQ ID NO: 159351 - DNA, 25 bp, Mus musculus
agatcactctcagaaaagccacaag

SEQ ID NO: 159352 - DNA, 25 bp, Mus musculus
agatcactctcatgaagcaccagat

SEQ ID NO: 159353 - DNA, 25 bp, Mus musculus
agatcactctggactaggacatttc

SEQ ID NO: 159354 - DNA, 25 bp, Mus musculus
agatcactctggtctaggacatttc

SEQ ID NO: 159355 - DNA, 25 bp, Mus musculus
agatcactgaagacagccctggtaa

SEQ ID NO: 159356 - DNA, 25 bp, Mus musculus
agatcactgaagtcagccctggtaa

SEQ ID NO: 159357 - DNA, 25 bp, Mus musculus
agatcactggtaacatggtctgtgc

SEQ ID NO: 159358 - DNA, 25 bp, Mus musculus
agatcactggtatcatggtctgtgc

SEQ ID NO: 159359 - DNA, 25 bp, Mus musculus
agatcactggttattccacttctgt

SEQ ID NO: 159360 - DNA, 25 bp, Mus musculus
agatcactggtttttccacttctgt

SEQ ID NO: 159361 - DNA, 25 bp, Mus musculus
agatcactgtttagatttgccgtag

SEQ ID NO: 159362 - DNA, 25 bp, Mus musculus
agatcactgttttgatttgccgtag

SEQ ID NO: 159363 - DNA, 25 bp, Mus musculus
agatcacttgaacccagctaggcaa

SEQ ID NO: 159364 - DNA, 25 bp, Mus musculus
agatcacttgaagccagctaggcaa

SEQ ID NO: 159365 - DNA, 25 bp, Mus musculus
agatcacttggtagccttacagttg

SEQ ID NO: 159366 - DNA, 25 bp, Mus musculus
agatcacttggttgccttacagttg

SEQ ID NO: 159367 - DNA, 25 bp, Mus musculus
agatcactttggacagtctaccggg

SEQ ID NO: 159368 - DNA, 25 bp, Mus musculus
agatcactttggtcagtctaccggg

SEQ ID NO: 159369 - DNA, 25 bp, Mus musculus
agatcagaagtaattcccacatcac

SEQ ID NO: 159370 - DNA, 25 bp, Mus musculus
agatcagaagtatttcccacatcac

SEQ ID NO: 159371 - DNA, 25 bp, Mus musculus
agatcagacagaaagcctcacggta

SEQ ID NO: 159372 - DNA, 25 bp, Mus musculus
agatcagacagatagcctcacggta

SEQ ID NO: 159373 - DNA, 25 bp, Mus musculus
agatcagaccatcttcagaagctac

SEQ ID NO: 159374 - DNA, 25 bp, Mus musculus
agatcagaccatgttcagaagctac

SEQ ID NO: 159375 - DNA, 25 bp, Mus musculus
agatcagaccctattggctttgact

SEQ ID NO: 159376 - DNA, 25 bp, Mus musculus
agatcagacccttttggctttgact

SEQ ID NO: 159377 - DNA, 25 bp, Mus musculus
agatcagacgtaactgctcctactt

SEQ ID NO: 159378 - DNA, 25 bp, Mus musculus
agatcagacgtatctgctcctactt

SEQ ID NO: 159379 - DNA, 25 bp, Mus musculus
agatcagagcccatggttatctctt

SEQ ID NO: 159380 - DNA, 25 bp, Mus musculus
agatcagagcccttggttatctctt

SEQ ID NO: 159381 - DNA, 25 bp, Mus musculus
agatcagagcgaagtaccccgaccg

SEQ ID NO: 159382 - DNA, 25 bp, Mus musculus
agatcagagcgatgtaccccgaccg

SEQ ID NO: 159383 - DNA, 25 bp, Mus musculus
agatcagagcttccaactcagcctg

SEQ ID NO: 159384 - DNA, 25 bp, Mus musculus
agatcagagcttgcaactcagcctg

SEQ ID NO: 159385 - DNA, 25 bp, Mus musculus
agatcagaggcacgcttgtctttgt

SEQ ID NO: 159386 - DNA, 25 bp, Mus musculus
agatcagaggcaggcttgtctttgt

SEQ ID NO: 159387 - DNA, 25 bp, Mus musculus
agatcagatcagagaggtaacttct

SEQ ID NO: 159388 - DNA, 25 bp, Mus musculus
agatcagatcagtgaggtaacttct

SEQ ID NO: 159389 - DNA, 25 bp, Mus musculus
agatcagattgacaccaggagtttc

SEQ ID NO: 159390 - DNA, 25 bp, Mus musculus
agatcagattgagaccaggagtttc

SEQ ID NO: 159391 - DNA, 25 bp, Mus musculus
agatcagatttgctctatcggtatg

SEQ ID NO: 159392 - DNA, 25 bp, Mus musculus
agatcagatttggtctatcggtatg

SEQ ID NO: 159393 - DNA, 25 bp, Mus musculus
agatcagcaaagcaagtcctccgtc

SEQ ID NO: 159394 - DNA, 25 bp, Mus musculus
agatcagcaaaggaagtcctccgtc

SEQ ID NO: 159395 - DNA, 25 bp, Mus musculus
agatcagcaaggatcttgcctggct

SEQ ID NO: 159396 - DNA, 25 bp, Mus musculus
agatcagcaaggttcttgcctggct

SEQ ID NO: 159397 - DNA, 25 bp, Mus musculus
agatcagcataaaggcactccgccg

SEQ ID NO: 159398 - DNA, 25 bp, Mus musculus
agatcagcataatggcactccgccg

SEQ ID NO: 159399 - DNA, 25 bp, Mus musculus
agatcagcatggcatcactcaccca

SEQ ID NO: 159400 - DNA, 25 bp, Mus musculus
agatcagcatgggatcactcaccca

SEQ ID NO: 159401 - DNA, 25 bp, Mus musculus
agatcagccactaagaattcaaatt

SEQ ID NO: 159402 - DNA, 25 bp, Mus musculus
agatcagccacttagaattcaaatt

SEQ ID NO: 159403 - DNA, 25 bp, Mus musculus
agatcagccagcctaacacagatgt

SEQ ID NO: 159404 - DNA, 25 bp, Mus musculus
agatcagccagcgtaacacagatgt

SEQ ID NO: 159405 - DNA, 25 bp, Mus musculus
agatcagcccaaaccatttctaatg

SEQ ID NO: 159406 - DNA, 25 bp, Mus musculus
agatcagcccaatccatttctaatg

SEQ ID NO: 159407 - DNA, 25 bp, Mus musculus
agatcagccgaaacaaccctggcga

SEQ ID NO: 159408 - DNA, 25 bp, Mus musculus
agatcagccgaatcaaccctggcga

SEQ ID NO: 159409 - DNA, 25 bp, Mus musculus
agatcagccgtgcttagggtccctt

SEQ ID NO: 159410 - DNA, 25 bp, Mus musculus
agatcagccgtggttagggtccctt

SEQ ID NO: 159411 - DNA, 25 bp, Mus musculus
agatcagcctcactgcatggcttgt

SEQ ID NO: 159412 - DNA, 25 bp, Mus musculus
agatcagcctcagtgcatggcttgt

SEQ ID NO: 159413 - DNA, 25 bp, Mus musculus
agatcagcctctactgttgagttga

SEQ ID NO: 159414 - DNA, 25 bp, Mus musculus
agatcagcctcttctgttgagttga

SEQ ID NO: 159415 - DNA, 25 bp, Mus musculus
agatcagcctgcatttcagcaactg

SEQ ID NO: 159416 - DNA, 25 bp, Mus musculus
agatcagcctgcttttcagcaactg

SEQ ID NO: 159417 - DNA, 25 bp, Mus musculus
agatcagcgagaacgtgaccatgat

SEQ ID NO: 159418 - DNA, 25 bp, Mus musculus
agatcagcgagatcgtgaccatgat

SEQ ID NO: 159419 - DNA, 25 bp, Mus musculus
agatcagcgaggacatcttcagccc

SEQ ID NO: 159420 - DNA, 25 bp, Mus musculus
agatcagcgaggtcatcttcagccc

SEQ ID NO: 159421 - DNA, 25 bp, Mus musculus
agatcagcgctgagcactcacggga

SEQ ID NO: 159422 - DNA, 25 bp, Mus musculus
agatcagcgctgtgcactcacggga

SEQ ID NO: 159423 - DNA, 25 bp, Mus musculus
agatcagctgcactttcttgtgcca

SEQ ID NO: 159424 - DNA, 25 bp, Mus musculus
agatcagctgcagtttcttgtgcca

SEQ ID NO: 159425 - DNA, 25 bp, Mus musculus
agatcagctgctacgcccagatttt

SEQ ID NO: 159426 - DNA, 25 bp, Mus musculus
agatcagctgcttcgcccagatttt

SEQ ID NO: 159427 - DNA, 25 bp, Mus musculus
agatcagctgtgactagttggagaa

SEQ ID NO: 159428 - DNA, 25 bp, Mus musculus
agatcagctgtgtctagttggagaa

SEQ ID NO: 159429 - DNA, 25 bp, Mus musculus
agatcagcttagattttgatattat

SEQ ID NO: 159430 - DNA, 25 bp, Mus musculus
agatcagcttagtttttgatattat

SEQ ID NO: 159431 - DNA, 25 bp, Mus musculus
agatcagcttctagcagagaggact

SEQ ID NO: 159432 - DNA, 25 bp, Mus musculus
agatcagcttcttgcagagaggact

SEQ ID NO: 159433 - DNA, 25 bp, Mus musculus
agatcaggacacagaaccttcccaa

SEQ ID NO: 159434 - DNA, 25 bp, Mus musculus
agatcaggacactgaaccttcccaa

SEQ ID NO: 159435 - DNA, 25 bp, Mus musculus
agatcaggcccaatgatggaaccat

SEQ ID NO: 159436 - DNA, 25 bp, Mus musculus
agatcaggcccattgatggaaccat

SEQ ID NO: 159437 - DNA, 25 bp, Mus musculus
agatcaggcgctcatgcacctcaat

SEQ ID NO: 159438 - DNA, 25 bp, Mus musculus
agatcaggcgctgatgcacctcaat

SEQ ID NO: 159439 - DNA, 25 bp, Mus musculus
agatcaggctacctcgatgtctcaa

SEQ ID NO: 159440 - DNA, 25 bp, Mus musculus
agatcaggctacgtcgatgtctcaa

SEQ ID NO: 159441 - DNA, 25 bp, Mus musculus
agatcaggctctctagctaggaagc

SEQ ID NO: 159442 - DNA, 25 bp, Mus musculus
agatcaggctctgtagctaggaagc

SEQ ID NO: 159443 - DNA, 25 bp, Mus musculus
agatcaggctgcagagaccattgaa

SEQ ID NO: 159444 - DNA, 25 bp, Mus musculus
agatcaggctgctgagaccattgaa

SEQ ID NO: 159445 - DNA, 25 bp, Mus musculus
agatcaggctgtcagcaagccggta

SEQ ID NO: 159446 - DNA, 25 bp, Mus musculus
agatcaggctgtgagcaagccggta

SEQ ID NO: 159447 - DNA, 25 bp, Mus musculus
agatcagggtgaacctttccttcac

SEQ ID NO: 159448 - DNA, 25 bp, Mus musculus
agatcagggtgatcctttccttcac

SEQ ID NO: 159449 - DNA, 25 bp, Mus musculus
agatcaggtggacactggagtgaca

SEQ ID NO: 159450 - DNA, 25 bp, Mus musculus
agatcaggtggagactggagtgaca

SEQ ID NO: 159451 - DNA, 25 bp, Mus musculus
agatcaggtggcagcgtaggtatca

SEQ ID NO: 159452 - DNA, 25 bp, Mus musculus
agatcaggtggctgcgtaggtatca

SEQ ID NO: 159453 - DNA, 25 bp, Mus musculus
agatcagtaactagcaccatgtaaa

SEQ ID NO: 159454 - DNA, 25 bp, Mus musculus
agatcagtaacttgcaccatgtaaa

SEQ ID NO: 159455 - DNA, 25 bp, Mus musculus
agatcagtagctcgaggcactctcc

SEQ ID NO: 159456 - DNA, 25 bp, Mus musculus
agatcagtagctggaggcactctcc

SEQ ID NO: 159457 - DNA, 25 bp, Mus musculus
agatcagtaggcctgtcagcactgg

SEQ ID NO: 159458 - DNA, 25 bp, Mus musculus
agatcagtaggcgtgtcagcactgg

SEQ ID NO: 159459 - DNA, 25 bp, Mus musculus
agatcagtattgaacaccctctgcc

SEQ ID NO: 159460 - DNA, 25 bp, Mus musculus
agatcagtattgtacaccctctgcc

SEQ ID NO: 159461 - DNA, 25 bp, Mus musculus
agatcagtcagacggaacaagtttt

SEQ ID NO: 159462 - DNA, 25 bp, Mus musculus
agatcagtcagagggaacaagtttt

SEQ ID NO: 159463 - DNA, 25 bp, Mus musculus
agatcagtcatcacatctcgagctg

SEQ ID NO: 159464 - DNA, 25 bp, Mus musculus
agatcagtcatctcatctcgagctg

SEQ ID NO: 159465 - DNA, 25 bp, Mus musculus
agatcagtccagatttggctgcagt

SEQ ID NO: 159466 - DNA, 25 bp, Mus musculus
agatcagtccagttttggctgcagt

SEQ ID NO: 159467 - DNA, 25 bp, Mus musculus
agatcagtctgtcttctcatacata

SEQ ID NO: 159468 - DNA, 25 bp, Mus musculus
agatcagtctgtgttctcatacata

SEQ ID NO: 159469 - DNA, 25 bp, Mus musculus
agatcagtgatcctactcctgtaat

SEQ ID NO: 159470 - DNA, 25 bp, Mus musculus
agatcagtgatcgtactcctgtaat

SEQ ID NO: 159471 - DNA, 25 bp, Mus musculus
agatcagtgattccctagagacaga

SEQ ID NO: 159472 - DNA, 25 bp, Mus musculus
agatcagtgattgcctagagacaga

SEQ ID NO: 159473 - DNA, 25 bp, Mus musculus
agatcagtgctcaaccaagggccag

SEQ ID NO: 159474 - DNA, 25 bp, Mus musculus
agatcagtgctctaccaagggccag

SEQ ID NO: 159475 - DNA, 25 bp, Mus musculus
agatcagtgtccctcaaatgtggcc

SEQ ID NO: 159476 - DNA, 25 bp, Mus musculus
agatcagtgtccgtcaaatgtggcc

SEQ ID NO: 159477 - DNA, 25 bp, Mus musculus
agatcagtgtggcagccatgcctgt

SEQ ID NO: 159478 - DNA, 25 bp, Mus musculus
agatcagtgtgggagccatgcctgt

SEQ ID NO: 159479 - DNA, 25 bp, Mus musculus
agatcagttcatcaccagcctgatc

SEQ ID NO: 159480 - DNA, 25 bp, Mus musculus
agatcagttcatgaccagcctgatc

SEQ ID NO: 159481 - DNA, 25 bp, Mus musculus
agatcagttgatacaaaatttcatt

SEQ ID NO: 159482 - DNA, 25 bp, Mus musculus
agatcagttgattcaaaatttcatt

SEQ ID NO: 159483 - DNA, 25 bp, Mus musculus
agatcagttgccactacagtagttt

SEQ ID NO: 159484 - DNA, 25 bp, Mus musculus
agatcagttgcctctacagtagttt

SEQ ID NO: 159485 - DNA, 25 bp, Mus musculus
agatcagttgttaggctgcctgctc

SEQ ID NO: 159486 - DNA, 25 bp, Mus musculus
agatcagttgtttggctgcctgctc

SEQ ID NO: 159487 - DNA, 25 bp, Mus musculus
agatcagtttgcagtgggattcaca

SEQ ID NO: 159488 - DNA, 25 bp, Mus musculus
agatcagtttgctgtgggattcaca

SEQ ID NO: 159489 - DNA, 25 bp, Mus musculus
agatcataaaacactctgctccctt

SEQ ID NO: 159490 - DNA, 25 bp, Mus musculus
agatcataaaactctctgctccctt

SEQ ID NO: 159491 - DNA, 25 bp, Mus musculus
agatcataaccacttctcttcttct

SEQ ID NO: 159492 - DNA, 25 bp, Mus musculus
agatcataaccagttctcttcttct

SEQ ID NO: 159493 - DNA, 25 bp, Mus musculus
agatcataagccactgttccttgga

SEQ ID NO: 159494 - DNA, 25 bp, Mus musculus
agatcataagcctctgttccttgga

SEQ ID NO: 159495 - DNA, 25 bp, Mus musculus
agatcataatgtattgctccccgac

SEQ ID NO: 159496 - DNA, 25 bp, Mus musculus
agatcataatgttttgctccccgac

SEQ ID NO: 159497 - DNA, 25 bp, Mus musculus
agatcataattcagcaacattttta

SEQ ID NO: 159498 - DNA, 25 bp, Mus musculus
agatcataattctgcaacattttta

SEQ ID NO: 159499 - DNA, 25 bp, Mus musculus
agatcatactgtaagtcggcttgaa

SEQ ID NO: 159500 - DNA, 25 bp, Mus musculus
agatcatactgttagtcggcttgaa

SEQ ID NO: 159501 - DNA, 25 bp, Mus musculus
agatcatacttcacgtggtaggagc

SEQ ID NO: 159502 - DNA, 25 bp, Mus musculus
agatcatacttctcgtggtaggagc

SEQ ID NO: 159503 - DNA, 25 bp, Mus musculus
agatcatagggcagtgttccaggaa

SEQ ID NO: 159504 - DNA, 25 bp, Mus musculus
agatcatagggctgtgttccaggaa

SEQ ID NO: 159505 - DNA, 25 bp, Mus musculus
agatcatagtgtacagtgtcctctg

SEQ ID NO: 159506 - DNA, 25 bp, Mus musculus
agatcatagtgttcagtgtcctctg

SEQ ID NO: 159507 - DNA, 25 bp, Mus musculus
agatcatatggcacgggcggacaaa

SEQ ID NO: 159508 - DNA, 25 bp, Mus musculus
agatcatatggctcgggcggacaaa

SEQ ID NO: 159509 - DNA, 25 bp, Mus musculus
agatcatattctctgtgcgtggcat

SEQ ID NO: 159510 - DNA, 25 bp, Mus musculus
agatcatattctgtgtgcgtggcat

SEQ ID NO: 159511 - DNA, 25 bp, Mus musculus
agatcatcaaccagcgggacctcta

SEQ ID NO: 159512 - DNA, 25 bp, Mus musculus
agatcatcaacctgcgggacctcta

SEQ ID NO: 159513 - DNA, 25 bp, Mus musculus
agatcatcaatactgcctcaattca

SEQ ID NO: 159514 - DNA, 25 bp, Mus musculus
agatcatcaatagtgcctcaattca

SEQ ID NO: 159515 - DNA, 25 bp, Mus musculus
agatcatcacataggaactggttgc

SEQ ID NO: 159516 - DNA, 25 bp, Mus musculus
agatcatcacattggaactggttgc

SEQ ID NO: 159517 - DNA, 25 bp, Mus musculus
agatcatcacccaggtgtccagcag

SEQ ID NO: 159518 - DNA, 25 bp, Mus musculus
agatcatcaccctggtgtccagcag

SEQ ID NO: 159519 - DNA, 25 bp, Mus musculus
agatcatcagagaaagcatccggaa

SEQ ID NO: 159520 - DNA, 25 bp, Mus musculus
agatcatcagagtaagcatccggaa

SEQ ID NO: 159521 - DNA, 25 bp, Mus musculus
agatcatcagcaaggccagcctagg

SEQ ID NO: 159522 - DNA, 25 bp, Mus musculus
agatcatcagcatggccagcctagg

SEQ ID NO: 159523 - DNA, 25 bp, Mus musculus
agatcatcagccacagaaacgttcc

SEQ ID NO: 159524 - DNA, 25 bp, Mus musculus
agatcatcagcctcagaaacgttcc

SEQ ID NO: 159525 - DNA, 25 bp, Mus musculus
agatcatcatcaacatacaggttat

SEQ ID NO: 159526 - DNA, 25 bp, Mus musculus
agatcatcatcaactgacagggagg

SEQ ID NO: 159527 - DNA, 25 bp, Mus musculus
agatcatcatcatcatacaggttat

SEQ ID NO: 159528 - DNA, 25 bp, Mus musculus
agatcatcatcatctgacagggagg

SEQ ID NO: 159529 - DNA, 25 bp, Mus musculus
agatcatcatctaccaggtcgtctt

SEQ ID NO: 159530 - DNA, 25 bp, Mus musculus
agatcatcatcttccaggtcgtctt

SEQ ID NO: 159531 - DNA, 25 bp, Mus musculus
agatcatccctaactgtacaccaag

SEQ ID NO: 159532 - DNA, 25 bp, Mus musculus
agatcatccctatctgtacaccaag

SEQ ID NO: 159533 - DNA, 25 bp, Mus musculus
agatcatccgcaaagaaatccccgc

SEQ ID NO: 159534 - DNA, 25 bp, Mus musculus
agatcatccgcatagaaatccccgc

SEQ ID NO: 159535 - DNA, 25 bp, Mus musculus
agatcatcgcgtatcttcacagcaa

SEQ ID NO: 159536 - DNA, 25 bp, Mus musculus
agatcatcgcgtttcttcacagcaa

SEQ ID NO: 159537 - DNA, 25 bp, Mus musculus
agatcatcggacatttctatgccag

SEQ ID NO: 159538 - DNA, 25 bp, Mus musculus
agatcatcggacttttctatgccag

SEQ ID NO: 159539 - DNA, 25 bp, Mus musculus
agatcatctacaacgctaacaagtg

SEQ ID NO: 159540 - DNA, 25 bp, Mus musculus
agatcatctacatcgctaacaagtg

SEQ ID NO: 159541 - DNA, 25 bp, Mus musculus
agatcatctacccacgctacgctgg

SEQ ID NO: 159542 - DNA, 25 bp, Mus musculus
agatcatctaccgacgctacgctgg

SEQ ID NO: 159543 - DNA, 25 bp, Mus musculus
agatcatctattccaaatctcccac

SEQ ID NO: 159544 - DNA, 25 bp, Mus musculus
agatcatctattgcaaatctcccac

SEQ ID NO: 159545 - DNA, 25 bp, Mus musculus
agatcatctcccactacgaagaaga

SEQ ID NO: 159546 - DNA, 25 bp, Mus musculus
agatcatctccctctacgaagaaga

SEQ ID NO: 159547 - DNA, 25 bp, Mus musculus
agatcatctctccagattactttcc

SEQ ID NO: 159548 - DNA, 25 bp, Mus musculus
agatcatctctcgagattactttcc

SEQ ID NO: 159549 - DNA, 25 bp, Mus musculus
agatcatctctgagcaagtgcccaa

SEQ ID NO: 159550 - DNA, 25 bp, Mus musculus
agatcatctctgtgcaagtgcccaa

SEQ ID NO: 159551 - DNA, 25 bp, Mus musculus
agatcatcttatccacctctgtgtg

SEQ ID NO: 159552 - DNA, 25 bp, Mus musculus
agatcatcttatgcacctctgtgtg

SEQ ID NO: 159553 - DNA, 25 bp, Mus musculus
agatcatgaaagaacctgagctggt

SEQ ID NO: 159554 - DNA, 25 bp, Mus musculus
agatcatgaaagtacctgagctggt

SEQ ID NO: 159555 - DNA, 25 bp, Mus musculus
agatcatgagttcagggccatcctg

SEQ ID NO: 159556 - DNA, 25 bp, Mus musculus
agatcatgagttgagggccatcctg

SEQ ID NO: 159557 - DNA, 25 bp, Mus musculus
agatcatgccggaagctcactccca

SEQ ID NO: 159558 - DNA, 25 bp, Mus musculus
agatcatgccggtagctcactccca

SEQ ID NO: 159559 - DNA, 25 bp, Mus musculus
agatcatgctaccttttgtctctcg

SEQ ID NO: 159560 - DNA, 25 bp, Mus musculus
agatcatgctacgttttgtctctcg

SEQ ID NO: 159561 - DNA, 25 bp, Mus musculus
agatcatgctggactagcgctcaca

SEQ ID NO: 159562 - DNA, 25 bp, Mus musculus
agatcatgctggtctagcgctcaca

SEQ ID NO: 159563 - DNA, 25 bp, Mus musculus
agatcatggcagagggagacctcaa

SEQ ID NO: 159564 - DNA, 25 bp, Mus musculus
agatcatggcagtgggagacctcaa

SEQ ID NO: 159565 - DNA, 25 bp, Mus musculus
agatcatggcccagacctgagcttt

SEQ ID NO: 159566 - DNA, 25 bp, Mus musculus
agatcatggccctgacctgagcttt

SEQ ID NO: 159567 - DNA, 25 bp, Mus musculus
agatcatggtttatgtgcttctaaa

SEQ ID NO: 159568 - DNA, 25 bp, Mus musculus
agatcatggtttttgtgcttctaaa

SEQ ID NO: 159569 - DNA, 25 bp, Mus musculus
agatcatgtataccgtgggctactc

SEQ ID NO: 159570 - DNA, 25 bp, Mus musculus
agatcatgtatagcgtgggctactc

SEQ ID NO: 159571 - DNA, 25 bp, Mus musculus
agatcatgtcccatcgagctgctgt

SEQ ID NO: 159572 - DNA, 25 bp, Mus musculus
agatcatgtcccttcgagctgctgt

SEQ ID NO: 159573 - DNA, 25 bp, Mus musculus
agatcatgtctaacattcattcaaa

SEQ ID NO: 159574 - DNA, 25 bp, Mus musculus
agatcatgtctatcattcattcaaa

SEQ ID NO: 159575 - DNA, 25 bp, Mus musculus
agatcatgtttgagaccttcaacac

SEQ ID NO: 159576 - DNA, 25 bp, Mus musculus
agatcatgtttgtgaccttcaacac

SEQ ID NO: 159577 - DNA, 25 bp, Mus musculus
agatcattaagaaccgagcccagac

SEQ ID NO: 159578 - DNA, 25 bp, Mus musculus
agatcattaagatccgagcccagac

SEQ ID NO: 159579 - DNA, 25 bp, Mus musculus
agatcattacctcggaaacggttca

SEQ ID NO: 159580 - DNA, 25 bp, Mus musculus
agatcattacctgggaaacggttca

SEQ ID NO: 159581 - DNA, 25 bp, Mus musculus
agatcattcgacacccagactataa

SEQ ID NO: 159582 - DNA, 25 bp, Mus musculus
agatcattcgactcccagactataa

SEQ ID NO: 159583 - DNA, 25 bp, Mus musculus
agatcattctgcctatgccttctgc

SEQ ID NO: 159584 - DNA, 25 bp, Mus musculus
agatcattctgcgtatgccttctgc

SEQ ID NO: 159585 - DNA, 25 bp, Mus musculus
agatcattgagtaccaggttcactg

SEQ ID NO: 159586 - DNA, 25 bp, Mus musculus
agatcattgagttccaggttcactg

SEQ ID NO: 159587 - DNA, 25 bp, Mus musculus
agatcattggctccgcagctccttg

SEQ ID NO: 159588 - DNA, 25 bp, Mus musculus
agatcattggctgcgcagctccttg

SEQ ID NO: 159589 - DNA, 25 bp, Mus musculus
agatcattgtgcagggtctgttacc

SEQ ID NO: 159590 - DNA, 25 bp, Mus musculus
agatcattgtgctgggtctgttacc

SEQ ID NO: 159591 - DNA, 25 bp, Mus musculus
agatcatttgcgagactgagtcgaa

SEQ ID NO: 159592 - DNA, 25 bp, Mus musculus
agatcatttgcgtgactgagtcgaa

SEQ ID NO: 159593 - DNA, 25 bp, Mus musculus
agatccaaactaccagacgctgaca

SEQ ID NO: 159594 - DNA, 25 bp, Mus musculus
agatccaaactagcagacgctgaca

SEQ ID NO: 159595 - DNA, 25 bp, Mus musculus
agatccaaactcatagtctcatccc

SEQ ID NO: 159596 - DNA, 25 bp, Mus musculus
agatccaaactcttagtctcatccc

SEQ ID NO: 159597 - DNA, 25 bp, Mus musculus
agatccaaatgacagctgcaccccg

SEQ ID NO: 159598 - DNA, 25 bp, Mus musculus
agatccaaatgacccattcgcagga

SEQ ID NO: 159599 - DNA, 25 bp, Mus musculus
agatccaaatgagagctgcaccccg

SEQ ID NO: 159600 - DNA, 25 bp, Mus musculus
agatccaaatgagccattcgcagga

SEQ ID NO: 159601 - DNA, 25 bp, Mus musculus
agatccaaccttccaattacctatt

SEQ ID NO: 159602 - DNA, 25 bp, Mus musculus
agatccaaccttgcaattacctatt

SEQ ID NO: 159603 - DNA, 25 bp, Mus musculus
agatccaactatagctccagaacag

SEQ ID NO: 159604 - DNA, 25 bp, Mus musculus
agatccaactattgctccagaacag

SEQ ID NO: 159605 - DNA, 25 bp, Mus musculus
agatccaacttccagcctactatgg

SEQ ID NO: 159606 - DNA, 25 bp, Mus musculus
agatccaacttcgagcctactatgg

SEQ ID NO: 159607 - DNA, 25 bp, Mus musculus
agatccaagatacctcataggtcct

SEQ ID NO: 159608 - DNA, 25 bp, Mus musculus
agatccaagatagctcataggtcct

SEQ ID NO: 159609 - DNA, 25 bp, Mus musculus
agatccaagctgagaagacgtgaag

SEQ ID NO: 159610 - DNA, 25 bp, Mus musculus
agatccaagctgtgaagacgtgaag

SEQ ID NO: 159611 - DNA, 25 bp, Mus musculus
agatccaaggcacggctggccctga

SEQ ID NO: 159612 - DNA, 25 bp, Mus musculus
agatccaaggcagggctggccctga

SEQ ID NO: 159613 - DNA, 25 bp, Mus musculus
agatccaagtataggcacccacaca

SEQ ID NO: 159614 - DNA, 25 bp, Mus musculus
agatccaagtattggcacccacaca

SEQ ID NO: 159615 - DNA, 25 bp, Mus musculus
agatccaatcccacccttgctgagt

SEQ ID NO: 159616 - DNA, 25 bp, Mus musculus
agatccaatccctcccttgctgagt

SEQ ID NO: 159617 - DNA, 25 bp, Mus musculus
agatccacactgagacctggtctga

SEQ ID NO: 159618 - DNA, 25 bp, Mus musculus
agatccacactgcaacttgtccatc

SEQ ID NO: 159619 - DNA, 25 bp, Mus musculus
agatccacactggaacttgtccatc

SEQ ID NO: 159620 - DNA, 25 bp, Mus musculus
agatccacactgtgacctggtctga

SEQ ID NO: 159621 - DNA, 25 bp, Mus musculus
agatccacagaaccgcgagtctcgt

SEQ ID NO: 159622 - DNA, 25 bp, Mus musculus
agatccacagaagcgcgagtctcgt

SEQ ID NO: 159623 - DNA, 25 bp, Mus musculus
agatccacaggacttcacgatgtaa

SEQ ID NO: 159624 - DNA, 25 bp, Mus musculus
agatccacaggagttcacgatgtaa

SEQ ID NO: 159625 - DNA, 25 bp, Mus musculus
agatccaccacccagagtaatagaa

SEQ ID NO: 159626 - DNA, 25 bp, Mus musculus
agatccaccaccgagagtaatagaa

SEQ ID NO: 159627 - DNA, 25 bp, Mus musculus
agatccaccactacatgaatggcag

SEQ ID NO: 159628 - DNA, 25 bp, Mus musculus
agatccaccacttcatgaatggcag

SEQ ID NO: 159629 - DNA, 25 bp, Mus musculus
agatccaccagaaggcaccagtcgt

SEQ ID NO: 159630 - DNA, 25 bp, Mus musculus
agatccaccagatggcaccagtcgt

SEQ ID NO: 159631 - DNA, 25 bp, Mus musculus
agatccacccagatcaagtcatgag

SEQ ID NO: 159632 - DNA, 25 bp, Mus musculus
agatccacccagttcaagtcatgag

SEQ ID NO: 159633 - DNA, 25 bp, Mus musculus
agatccacccctatgccacagtgag

SEQ ID NO: 159634 - DNA, 25 bp, Mus musculus
agatccacccctttgccacagtgag

SEQ ID NO: 159635 - DNA, 25 bp, Mus musculus
agatccaccgtgcaaacaggacttg

SEQ ID NO: 159636 - DNA, 25 bp, Mus musculus
agatccaccgtggaaacaggacttg

SEQ ID NO: 159637 - DNA, 25 bp, Mus musculus
agatccacctacattttcagctgac

SEQ ID NO: 159638 - DNA, 25 bp, Mus musculus
agatccacctactttttcagctgac

SEQ ID NO: 159639 - DNA, 25 bp, Mus musculus
agatccactcgacattccggaggcg

SEQ ID NO: 159640 - DNA, 25 bp, Mus musculus
agatccactcgagattccggaggcg

SEQ ID NO: 159641 - DNA, 25 bp, Mus musculus
agatccactcgtctgtgtcttctga

SEQ ID NO: 159642 - DNA, 25 bp, Mus musculus
agatccactcgtgtgtgtcttctga

SEQ ID NO: 159643 - DNA, 25 bp, Mus musculus
agatccactgacatggtttctcatt

SEQ ID NO: 159644 - DNA, 25 bp, Mus musculus
agatccactgacttggtttctcatt

SEQ ID NO: 159645 - DNA, 25 bp, Mus musculus
agatccactgccagtgaagcgatca

SEQ ID NO: 159646 - DNA, 25 bp, Mus musculus
agatccactgcctgtgaagcgatca

SEQ ID NO: 159647 - DNA, 25 bp, Mus musculus
agatccactgtgagacttccaagtt

SEQ ID NO: 159648 - DNA, 25 bp, Mus musculus
agatccactgtgtgacttccaagtt

SEQ ID NO: 159649 - DNA, 25 bp, Mus musculus
agatccactgttaccttcacgttag

SEQ ID NO: 159650 - DNA, 25 bp, Mus musculus
agatccactgtttccttcacgttag

SEQ ID NO: 159651 - DNA, 25 bp, Mus musculus
agatccacttcacggcccaagtgag

SEQ ID NO: 159652 - DNA, 25 bp, Mus musculus
agatccacttcagggcccaagtgag

SEQ ID NO: 159653 - DNA, 25 bp, Mus musculus
agatccacttttcacattccactat

SEQ ID NO: 159654 - DNA, 25 bp, Mus musculus
agatccacttttgacattccactat

SEQ ID NO: 159655 - DNA, 25 bp, Mus musculus
agatccagaacacattaacctcgcc

SEQ ID NO: 159656 - DNA, 25 bp, Mus musculus
agatccagaacagattaacctcgcc

SEQ ID NO: 159657 - DNA, 25 bp, Mus musculus
agatccagaggcaagcaccattcta

SEQ ID NO: 159658 - DNA, 25 bp, Mus musculus
agatccagaggctagcaccattcta

SEQ ID NO: 159659 - DNA, 25 bp, Mus musculus
agatccagatccaaccagaaggctc

SEQ ID NO: 159660 - DNA, 25 bp, Mus musculus
agatccagatccctattgaggccaa

SEQ ID NO: 159661 - DNA, 25 bp, Mus musculus
agatccagatccgtattgaggccaa

SEQ ID NO: 159662 - DNA, 25 bp, Mus musculus
agatccagatcctaccagaaggctc

SEQ ID NO: 159663 - DNA, 25 bp, Mus musculus
agatccagatgtcgccagtaatcac

SEQ ID NO: 159664 - DNA, 25 bp, Mus musculus
agatccagatgtggccagtaatcac

SEQ ID NO: 159665 - DNA, 25 bp, Mus musculus
agatccagcataccaccaatcaaag

SEQ ID NO: 159666 - DNA, 25 bp, Mus musculus
agatccagcatagcaccaatcaaag

SEQ ID NO: 159667 - DNA, 25 bp, Mus musculus
agatccagcattactcgtcttaaat

SEQ ID NO: 159668 - DNA, 25 bp, Mus musculus
agatccagcatttctcgtcttaaat

SEQ ID NO: 159669 - DNA, 25 bp, Mus musculus
agatccagctaaaggtgtcacgtga

SEQ ID NO: 159670 - DNA, 25 bp, Mus musculus
agatccagctaatggtgtcacgtga

SEQ ID NO: 159671 - DNA, 25 bp, Mus musculus
agatccagctctatttcgcatgctt

SEQ ID NO: 159672 - DNA, 25 bp, Mus musculus
agatccagctctcagatgggtgtga

SEQ ID NO: 159673 - DNA, 25 bp, Mus musculus
agatccagctctgagatgggtgtga

SEQ ID NO: 159674 - DNA, 25 bp, Mus musculus
agatccagctctttttcgcatgctt

SEQ ID NO: 159675 - DNA, 25 bp, Mus musculus
agatccagctggaaaactgaagtat

SEQ ID NO: 159676 - DNA, 25 bp, Mus musculus
agatccagctggtaaactgaagtat

SEQ ID NO: 159677 - DNA, 25 bp, Mus musculus
agatccagcttaagttaaaccagag

SEQ ID NO: 159678 - DNA, 25 bp, Mus musculus
agatccagcttatgttaaaccagag

SEQ ID NO: 159679 - DNA, 25 bp, Mus musculus
agatccaggactatccagctactgg

SEQ ID NO: 159680 - DNA, 25 bp, Mus musculus
agatccaggactttccagctactgg

SEQ ID NO: 159681 - DNA, 25 bp, Mus musculus
agatccagtccaagctgagcaagga

SEQ ID NO: 159682 - DNA, 25 bp, Mus musculus
agatccagtccatgctgagcaagga

SEQ ID NO: 159683 - DNA, 25 bp, Mus musculus
agatccagtcccaagagacctcaga

SEQ ID NO: 159684 - DNA, 25 bp, Mus musculus
agatccagtccctagagacctcaga

SEQ ID NO: 159685 - DNA, 25 bp, Mus musculus
agatccagttagacctgaggctgat

SEQ ID NO: 159686 - DNA, 25 bp, Mus musculus
agatccagttagtcctgaggctgat

SEQ ID NO: 159687 - DNA, 25 bp, Mus musculus
agatccagttgtcattccttcatcc

SEQ ID NO: 159688 - DNA, 25 bp, Mus musculus
agatccagttgtctccgtaccttgt

SEQ ID NO: 159689 - DNA, 25 bp, Mus musculus
agatccagttgtgattccttcatcc

SEQ ID NO: 159690 - DNA, 25 bp, Mus musculus
agatccagttgtgtccgtaccttgt

SEQ ID NO: 159691 - DNA, 25 bp, Mus musculus
agatccatatctacagtgcaacccc

SEQ ID NO: 159692 - DNA, 25 bp, Mus musculus
agatccatatctcaatccgctgctc

SEQ ID NO: 159693 - DNA, 25 bp, Mus musculus
agatccatatctgaatccgctgctc

SEQ ID NO: 159694 - DNA, 25 bp, Mus musculus
agatccatatcttcagtgcaacccc

SEQ ID NO: 159695 - DNA, 25 bp, Mus musculus
agatccatcaagcatttacatagta

SEQ ID NO: 159696 - DNA, 25 bp, Mus musculus
agatccatcaaggatttacatagta

SEQ ID NO: 159697 - DNA, 25 bp, Mus musculus
agatccatccctaggttcttcattc

SEQ ID NO: 159698 - DNA, 25 bp, Mus musculus
agatccatcccttggttcttcattc

SEQ ID NO: 159699 - DNA, 25 bp, Mus musculus
agatccatcggaacgggaaactgct

SEQ ID NO: 159700 - DNA, 25 bp, Mus musculus
agatccatcggatcgggaaactgct

SEQ ID NO: 159701 - DNA, 25 bp, Mus musculus
agatccatctataattcttagccat

SEQ ID NO: 159702 - DNA, 25 bp, Mus musculus
agatccatctattattcttagccat

SEQ ID NO: 159703 - DNA, 25 bp, Mus musculus
agatccatgcaaactgccgtatccg

SEQ ID NO: 159704 - DNA, 25 bp, Mus musculus
agatccatgcaatctgccgtatccg

SEQ ID NO: 159705 - DNA, 25 bp, Mus musculus
agatccatgcgaagtgctcctgtag

SEQ ID NO: 159706 - DNA, 25 bp, Mus musculus
agatccatgcgatgtgctcctgtag

SEQ ID NO: 159707 - DNA, 25 bp, Mus musculus
agatccatgttgactcctttaagcc

SEQ ID NO: 159708 - DNA, 25 bp, Mus musculus
agatccatgttgtctcctttaagcc

SEQ ID NO: 159709 - DNA, 25 bp, Mus musculus
agatccattgcacaagacctcgcca

SEQ ID NO: 159710 - DNA, 25 bp, Mus musculus
agatccattgcagaagacctcgcca

SEQ ID NO: 159711 - DNA, 25 bp, Mus musculus
agatccatttccattcatttactaa

SEQ ID NO: 159712 - DNA, 25 bp, Mus musculus
agatccatttcctttcatttactaa

SEQ ID NO: 159713 - DNA, 25 bp, Mus musculus
agatcccaaggacctggagccacgg

SEQ ID NO: 159714 - DNA, 25 bp, Mus musculus
agatcccaaggagctggagccacgg

SEQ ID NO: 159715 - DNA, 25 bp, Mus musculus
agatcccaagtgagcagtgttccca

SEQ ID NO: 159716 - DNA, 25 bp, Mus musculus
agatcccaagtgtgcagtgttccca

SEQ ID NO: 159717 - DNA, 25 bp, Mus musculus
agatcccaagttcaacaaaagacgg

SEQ ID NO: 159718 - DNA, 25 bp, Mus musculus
agatcccaagttgaacaaaagacgg

SEQ ID NO: 159719 - DNA, 25 bp, Mus musculus
agatcccaatccacattctagaagt

SEQ ID NO: 159720 - DNA, 25 bp, Mus musculus
agatcccaatcctcattctagaagt

SEQ ID NO: 159721 - DNA, 25 bp, Mus musculus
agatcccaatgacaggccaggttcc

SEQ ID NO: 159722 - DNA, 25 bp, Mus musculus
agatcccaatgagaggccaggttcc

SEQ ID NO: 159723 - DNA, 25 bp, Mus musculus
agatcccacgctcgataggccctgg

SEQ ID NO: 159724 - DNA, 25 bp, Mus musculus
agatcccacgctggataggccctgg

SEQ ID NO: 159725 - DNA, 25 bp, Mus musculus
agatcccactacagagagttatgag

SEQ ID NO: 159726 - DNA, 25 bp, Mus musculus
agatcccactactgagagttatgag

SEQ ID NO: 159727 - DNA, 25 bp, Mus musculus
agatcccagaccagaaaggcggccg

SEQ ID NO: 159728 - DNA, 25 bp, Mus musculus
agatcccagacctgaaaggcggccg

SEQ ID NO: 159729 - DNA, 25 bp, Mus musculus
agatcccagattcactgccctagag

SEQ ID NO: 159730 - DNA, 25 bp, Mus musculus
agatcccagattgactgccctagag

SEQ ID NO: 159731 - DNA, 25 bp, Mus musculus
agatcccagcaacgttgcggaccct

SEQ ID NO: 159732 - DNA, 25 bp, Mus musculus
agatcccagcaaggttgcggaccct

SEQ ID NO: 159733 - DNA, 25 bp, Mus musculus
agatcccagctaagatgtagccagg

SEQ ID NO: 159734 - DNA, 25 bp, Mus musculus
agatcccagctatgatgtagccagg

SEQ ID NO: 159735 - DNA, 25 bp, Mus musculus
agatcccaggaacccatgacattca

SEQ ID NO: 159736 - DNA, 25 bp, Mus musculus
agatcccaggaagccatgacattca

SEQ ID NO: 159737 - DNA, 25 bp, Mus musculus
agatcccaggctctgtccttttggg

SEQ ID NO: 159738 - DNA, 25 bp, Mus musculus
agatcccaggctgtgtccttttggg

SEQ ID NO: 159739 - DNA, 25 bp, Mus musculus
agatcccagtagcaccgtccacaga

SEQ ID NO: 159740 - DNA, 25 bp, Mus musculus
agatcccagtaggaccgtccacaga

SEQ ID NO: 159741 - DNA, 25 bp, Mus musculus
agatcccagtttcctcaggcataac

SEQ ID NO: 159742 - DNA, 25 bp, Mus musculus
agatcccagtttgctcaggcataac

SEQ ID NO: 159743 - DNA, 25 bp, Mus musculus
agatcccatatcaagcagttgccca

SEQ ID NO: 159744 - DNA, 25 bp, Mus musculus
agatcccatatctagcagttgccca

SEQ ID NO: 159745 - DNA, 25 bp, Mus musculus
agatcccatgaaacatttgccaaat

SEQ ID NO: 159746 - DNA, 25 bp, Mus musculus
agatcccatgaatcatttgccaaat

SEQ ID NO: 159747 - DNA, 25 bp, Mus musculus
agatcccatgtcattccaagagcag

SEQ ID NO: 159748 - DNA, 25 bp, Mus musculus
agatcccatgtctttccaagagcag

SEQ ID NO: 159749 - DNA, 25 bp, Mus musculus
agatccccaatcaggtctgttttct

SEQ ID NO: 159750 - DNA, 25 bp, Mus musculus
agatccccaatctggtctgttttct

SEQ ID NO: 159751 - DNA, 25 bp, Mus musculus
agatccccagggaaagacatcagaa

SEQ ID NO: 159752 - DNA, 25 bp, Mus musculus
agatccccagggtaagacatcagaa

SEQ ID NO: 159753 - DNA, 25 bp, Mus musculus
agatccccatctcactcagtacatg

SEQ ID NO: 159754 - DNA, 25 bp, Mus musculus
agatccccatctgactcagtacatg

SEQ ID NO: 159755 - DNA, 25 bp, Mus musculus
agatccccattacctgtggccagaa

SEQ ID NO: 159756 - DNA, 25 bp, Mus musculus
agatccccattagctgtggccagaa

SEQ ID NO: 159757 - DNA, 25 bp, Mus musculus
agatccccattcatcttgacacagt

SEQ ID NO: 159758 - DNA, 25 bp, Mus musculus
agatccccattcttcttgacacagt

SEQ ID NO: 159759 - DNA, 25 bp, Mus musculus
agatcccccagaacaggatgtctct

SEQ ID NO: 159760 - DNA, 25 bp, Mus musculus
agatcccccagatcaggatgtctct

SEQ ID NO: 159761 - DNA, 25 bp, Mus musculus
agatccccgaggctgtacgaagcct

SEQ ID NO: 159762 - DNA, 25 bp, Mus musculus
agatccccgagggtgtacgaagcct

SEQ ID NO: 159763 - DNA, 25 bp, Mus musculus
agatcccctataacgagaattacag

SEQ ID NO: 159764 - DNA, 25 bp, Mus musculus
agatcccctatatcgagaattacag

SEQ ID NO: 159765 - DNA, 25 bp, Mus musculus
agatcccctgaactagagtcacaga

SEQ ID NO: 159766 - DNA, 25 bp, Mus musculus
agatcccctgaagtagagtcacaga

SEQ ID NO: 159767 - DNA, 25 bp, Mus musculus
agatcccctgatcctgttagcctta

SEQ ID NO: 159768 - DNA, 25 bp, Mus musculus
agatcccctgatgctgttagcctta

SEQ ID NO: 159769 - DNA, 25 bp, Mus musculus
agatcccctgggaatgtgacctact

SEQ ID NO: 159770 - DNA, 25 bp, Mus musculus
agatcccctgggtatgtgacctact

SEQ ID NO: 159771 - DNA, 25 bp, Mus musculus
agatcccctgtgatctggacaggag

SEQ ID NO: 159772 - DNA, 25 bp, Mus musculus
agatcccctgtgttctggacaggag

SEQ ID NO: 159773 - DNA, 25 bp, Mus musculus
agatcccgaggacaatcaagcccta

SEQ ID NO: 159774 - DNA, 25 bp, Mus musculus
agatcccgaggagaatcaagcccta

SEQ ID NO: 159775 - DNA, 25 bp, Mus musculus
agatcccgctccagctaaaaatgaa

SEQ ID NO: 159776 - DNA, 25 bp, Mus musculus
agatcccgctcctgctaaaaatgaa

SEQ ID NO: 159777 - DNA, 25 bp, Mus musculus
agatcccgctttactggacaaacac

SEQ ID NO: 159778 - DNA, 25 bp, Mus musculus
agatcccgcttttctggacaaacac

SEQ ID NO: 159779 - DNA, 25 bp, Mus musculus
agatcccggaggactctggaggact

SEQ ID NO: 159780 - DNA, 25 bp, Mus musculus
agatcccggaggtctctggaggact

SEQ ID NO: 159781 - DNA, 25 bp, Mus musculus
agatcccgtttgatagccttcgtga

SEQ ID NO: 159782 - DNA, 25 bp, Mus musculus
agatcccgtttgttagccttcgtga

SEQ ID NO: 159783 - DNA, 25 bp, Mus musculus
agatccctaaacctgacaatattca

SEQ ID NO: 159784 - DNA, 25 bp, Mus musculus
agatccctaaacgtgacaatattca

SEQ ID NO: 159785 - DNA, 25 bp, Mus musculus
agatccctcatcctttactttgagg

SEQ ID NO: 159786 - DNA, 25 bp, Mus musculus
agatccctcatcgtttactttgagg

SEQ ID NO: 159787 - DNA, 25 bp, Mus musculus
agatccctcatgagtgctctttctg

SEQ ID NO: 159788 - DNA, 25 bp, Mus musculus
agatccctcatgtgtgctctttctg

SEQ ID NO: 159789 - DNA, 25 bp, Mus musculus
agatccctccaactcaaagtgagag

SEQ ID NO: 159790 - DNA, 25 bp, Mus musculus
agatccctccaagtcaaagtgagag

SEQ ID NO: 159791 - DNA, 25 bp, Mus musculus
agatccctccggcacagatggagca

SEQ ID NO: 159792 - DNA, 25 bp, Mus musculus
agatccctccgggacagatggagca

SEQ ID NO: 159793 - DNA, 25 bp, Mus musculus
agatccctcggtatttctatgtcag

SEQ ID NO: 159794 - DNA, 25 bp, Mus musculus
agatccctcggtttttctatgtcag

SEQ ID NO: 159795 - DNA, 25 bp, Mus musculus
agatccctgaacctgcgagttcaag

SEQ ID NO: 159796 - DNA, 25 bp, Mus musculus
agatccctgaacgtgcgagttcaag

SEQ ID NO: 159797 - DNA, 25 bp, Mus musculus
agatccctgactacattggcctcta

SEQ ID NO: 159798 - DNA, 25 bp, Mus musculus
agatccctgacttcattggcctcta

SEQ ID NO: 159799 - DNA, 25 bp, Mus musculus
agatccctgatgactgtcactatag

SEQ ID NO: 159800 - DNA, 25 bp, Mus musculus
agatccctgatgtctgtcactatag

SEQ ID NO: 159801 - DNA, 25 bp, Mus musculus
agatccctgattcctattccctaaa

SEQ ID NO: 159802 - DNA, 25 bp, Mus musculus
agatccctgattgctattccctaaa

SEQ ID NO: 159803 - DNA, 25 bp, Mus musculus
agatccctgggaaagctggctggtc

SEQ ID NO: 159804 - DNA, 25 bp, Mus musculus
agatccctgggatagctggctggtc

SEQ ID NO: 159805 - DNA, 25 bp, Mus musculus
agatccctgggtctatattctgcta

SEQ ID NO: 159806 - DNA, 25 bp, Mus musculus
agatccctgggtgtatattctgcta

SEQ ID NO: 159807 - DNA, 25 bp, Mus musculus
agatcccttctgattctttcaattc

SEQ ID NO: 159808 - DNA, 25 bp, Mus musculus
agatcccttctgtttctttcaattc

SEQ ID NO: 159809 - DNA, 25 bp, Mus musculus
agatcccttcttaggttgtacatga

SEQ ID NO: 159810 - DNA, 25 bp, Mus musculus
agatcccttctttggttgtacatga

SEQ ID NO: 159811 - DNA, 25 bp, Mus musculus
agatcccttgatcgtaagcctctgg

SEQ ID NO: 159812 - DNA, 25 bp, Mus musculus
agatcccttgatggtaagcctctgg

SEQ ID NO: 159813 - DNA, 25 bp, Mus musculus
agatcccttgtacccagagttcagg

SEQ ID NO: 159814 - DNA, 25 bp, Mus musculus
agatcccttgtagccagagttcagg

SEQ ID NO: 159815 - DNA, 25 bp, Mus musculus
agatcccttttaaactgccacttgc

SEQ ID NO: 159816 - DNA, 25 bp, Mus musculus
agatcccttttaattgctggcaaac

SEQ ID NO: 159817 - DNA, 25 bp, Mus musculus
agatcccttttatactgccacttgc

SEQ ID NO: 159818 - DNA, 25 bp, Mus musculus
agatcccttttatttgctggcaaac

SEQ ID NO: 159819 - DNA, 25 bp, Mus musculus
agatcccttttcaccacttggagcg

SEQ ID NO: 159820 - DNA, 25 bp, Mus musculus
agatcccttttccacggtgtagata

SEQ ID NO: 159821 - DNA, 25 bp, Mus musculus
agatcccttttcgacggtgtagata

SEQ ID NO: 159822 - DNA, 25 bp, Mus musculus
agatcccttttctccacttggagcg

SEQ ID NO: 159823 - DNA, 25 bp, Mus musculus
agatccgaacacagcggtcgacatt

SEQ ID NO: 159824 - DNA, 25 bp, Mus musculus
agatccgaacactgcggtcgacatt

SEQ ID NO: 159825 - DNA, 25 bp, Mus musculus
agatccgacaaaactagagctgctg

SEQ ID NO: 159826 - DNA, 25 bp, Mus musculus
agatccgacaaatctagagctgctg

SEQ ID NO: 159827 - DNA, 25 bp, Mus musculus
agatccgagactacgcttttgtgca

SEQ ID NO: 159828 - DNA, 25 bp, Mus musculus
agatccgagacttcgcttttgtgca

SEQ ID NO: 159829 - DNA, 25 bp, Mus musculus
agatccgagagaccagccagacgaa

SEQ ID NO: 159830 - DNA, 25 bp, Mus musculus
agatccgagagagcagccagacgaa

SEQ ID NO: 159831 - DNA, 25 bp, Mus musculus
agatccgaggcactggtgagctacc

SEQ ID NO: 159832 - DNA, 25 bp, Mus musculus
agatccgaggcagtggtgagctacc

SEQ ID NO: 159833 - DNA, 25 bp, Mus musculus
agatccgagggacccacaaccaaag

SEQ ID NO: 159834 - DNA, 25 bp, Mus musculus
agatccgagggagccacaaccaaag

SEQ ID NO: 159835 - DNA, 25 bp, Mus musculus
agatccgcaagcctagtccttatga

SEQ ID NO: 159836 - DNA, 25 bp, Mus musculus
agatccgcaagcgtagtccttatga

SEQ ID NO: 159837 - DNA, 25 bp, Mus musculus
agatccgcacagagagccagcatga

SEQ ID NO: 159838 - DNA, 25 bp, Mus musculus
agatccgcacagtgagccagcatga

SEQ ID NO: 159839 - DNA, 25 bp, Mus musculus
agatccgcgggcctaaacgcttcga

SEQ ID NO: 159840 - DNA, 25 bp, Mus musculus
agatccgcgggcgtaaacgcttcga

SEQ ID NO: 159841 - DNA, 25 bp, Mus musculus
agatccgctcgcaaggtcgttcttg

SEQ ID NO: 159842 - DNA, 25 bp, Mus musculus
agatccgctcgctaggtcgttcttg

SEQ ID NO: 159843 - DNA, 25 bp, Mus musculus
agatccgctctcacatcagttttgg

SEQ ID NO: 159844 - DNA, 25 bp, Mus musculus
agatccgctctctcatcagttttgg

SEQ ID NO: 159845 - DNA, 25 bp, Mus musculus
agatccggaacacatgctctatggg

SEQ ID NO: 159846 - DNA, 25 bp, Mus musculus
agatccggaacagatgctctatggg

SEQ ID NO: 159847 - DNA, 25 bp, Mus musculus
agatccggattcagactgatgccag

SEQ ID NO: 159848 - DNA, 25 bp, Mus musculus
agatccggattctgactgatgccag

SEQ ID NO: 159849 - DNA, 25 bp, Mus musculus
agatccggcaggctcggttacctcg

SEQ ID NO: 159850 - DNA, 25 bp, Mus musculus
agatccggcagggtcggttacctcg

SEQ ID NO: 159851 - DNA, 25 bp, Mus musculus
agatccggcgctaccagaagtcgac

SEQ ID NO: 159852 - DNA, 25 bp, Mus musculus
agatccggcgcttccagaagtcgac

SEQ ID NO: 159853 - DNA, 25 bp, Mus musculus
agatccggcgtgcacactttttgga

SEQ ID NO: 159854 - DNA, 25 bp, Mus musculus
agatccggcgtggacactttttgga

SEQ ID NO: 159855 - DNA, 25 bp, Mus musculus
agatccgggagtcctggacttcctg

SEQ ID NO: 159856 - DNA, 25 bp, Mus musculus
agatccgggagtgctggacttcctg

SEQ ID NO: 159857 - DNA, 25 bp, Mus musculus
agatccgggctcaagacagcgacat

SEQ ID NO: 159858 - DNA, 25 bp, Mus musculus
agatccgggctctagacagcgacat

SEQ ID NO: 159859 - DNA, 25 bp, Mus musculus
agatccggtctcagggtataaaggt

SEQ ID NO: 159860 - DNA, 25 bp, Mus musculus
agatccggtctctgggtataaaggt

SEQ ID NO: 159861 - DNA, 25 bp, Mus musculus
agatccggtggacggttcctagaat

SEQ ID NO: 159862 - DNA, 25 bp, Mus musculus
agatccggtggagggttcctagaat

SEQ ID NO: 159863 - DNA, 25 bp, Mus musculus
agatccgtatggaggtgggccccac

SEQ ID NO: 159864 - DNA, 25 bp, Mus musculus
agatccgtatggtggtgggccccac

SEQ ID NO: 159865 - DNA, 25 bp, Mus musculus
agatccgtatgtctctgtctaccaa

SEQ ID NO: 159866 - DNA, 25 bp, Mus musculus
agatccgtatgtgtctgtctaccaa

SEQ ID NO: 159867 - DNA, 25 bp, Mus musculus
agatccgtcgagagatttcactgaa

SEQ ID NO: 159868 - DNA, 25 bp, Mus musculus
agatccgtcgagtgatttcactgaa

SEQ ID NO: 159869 - DNA, 25 bp, Mus musculus
agatccgtcttaatgagactggcat

SEQ ID NO: 159870 - DNA, 25 bp, Mus musculus
agatccgtcttattgagactggcat

SEQ ID NO: 159871 - DNA, 25 bp, Mus musculus
agatccgtgcgaactgtcctgccgg

SEQ ID NO: 159872 - DNA, 25 bp, Mus musculus
agatccgtgcgatctgtcctgccgg

SEQ ID NO: 159873 - DNA, 25 bp, Mus musculus
agatccgtgctacagaattcgcctg

SEQ ID NO: 159874 - DNA, 25 bp, Mus musculus
agatccgtgctagagaattcgcctg

SEQ ID NO: 159875 - DNA, 25 bp, Mus musculus
agatccgttctgaccgtgtgggcac

SEQ ID NO: 159876 - DNA, 25 bp, Mus musculus
agatccgttctgtccgtgtgggcac

SEQ ID NO: 159877 - DNA, 25 bp, Mus musculus
agatccgtttgaagaacatggcagt

SEQ ID NO: 159878 - DNA, 25 bp, Mus musculus
agatccgtttgatgaacatggcagt

SEQ ID NO: 159879 - DNA, 25 bp, Mus musculus
agatcctaaattagacccaggccct

SEQ ID NO: 159880 - DNA, 25 bp, Mus musculus
agatcctaaatttgacccaggccct

SEQ ID NO: 159881 - DNA, 25 bp, Mus musculus
agatcctaagctagactctcttgtg

SEQ ID NO: 159882 - DNA, 25 bp, Mus musculus
agatcctaagcttgactctcttgtg

SEQ ID NO: 159883 - DNA, 25 bp, Mus musculus
agatcctacactagagtaccccaaa

SEQ ID NO: 159884 - DNA, 25 bp, Mus musculus
agatcctacacttgagtaccccaaa

SEQ ID NO: 159885 - DNA, 25 bp, Mus musculus
agatcctacctgatggctcttcaga

SEQ ID NO: 159886 - DNA, 25 bp, Mus musculus
agatcctacctgttggctcttcaga

SEQ ID NO: 159887 - DNA, 25 bp, Mus musculus
agatcctaccttaactgtgaaattc

SEQ ID NO: 159888 - DNA, 25 bp, Mus musculus
agatcctacctttactgtgaaattc

SEQ ID NO: 159889 - DNA, 25 bp, Mus musculus
agatcctactgaagaagtgcccacc

SEQ ID NO: 159890 - DNA, 25 bp, Mus musculus
agatcctactgatgaagtgcccacc

SEQ ID NO: 159891 - DNA, 25 bp, Mus musculus
agatcctagaaactagccctgctca

SEQ ID NO: 159892 - DNA, 25 bp, Mus musculus
agatcctagaaagtagccctgctca

SEQ ID NO: 159893 - DNA, 25 bp, Mus musculus
agatcctaggaaacagttcctgaaa

SEQ ID NO: 159894 - DNA, 25 bp, Mus musculus
agatcctaggaatcagttcctgaaa

SEQ ID NO: 159895 - DNA, 25 bp, Mus musculus
agatcctaggagacagccactgggc

SEQ ID NO: 159896 - DNA, 25 bp, Mus musculus
agatcctaggagtcagccactgggc

SEQ ID NO: 159897 - DNA, 25 bp, Mus musculus
agatcctaggcccttaagctatagg

SEQ ID NO: 159898 - DNA, 25 bp, Mus musculus
agatcctaggccgttaagctatagg

SEQ ID NO: 159899 - DNA, 25 bp, Mus musculus
agatcctaggtgcaagtctccatgc

SEQ ID NO: 159900 - DNA, 25 bp, Mus musculus
agatcctaggtggaagtctccatgc

SEQ ID NO: 159901 - DNA, 25 bp, Mus musculus
agatcctatctgctcggaagcatgt

SEQ ID NO: 159902 - DNA, 25 bp, Mus musculus
agatcctatctggtcggaagcatgt

SEQ ID NO: 159903 - DNA, 25 bp, Mus musculus
agatcctatggtcgtccccttattt

SEQ ID NO: 159904 - DNA, 25 bp, Mus musculus
agatcctatggtggtccccttattt

SEQ ID NO: 159905 - DNA, 25 bp, Mus musculus
agatcctcaaggagccagtcacaga

SEQ ID NO: 159906 - DNA, 25 bp, Mus musculus
agatcctcaaggtgccagtcacaga

SEQ ID NO: 159907 - DNA, 25 bp, Mus musculus
agatcctcaataacctaagcaagag

SEQ ID NO: 159908 - DNA, 25 bp, Mus musculus
agatcctcaatatcctaagcaagag

SEQ ID NO: 159909 - DNA, 25 bp, Mus musculus
agatcctcaggacaacttctgcacg

SEQ ID NO: 159910 - DNA, 25 bp, Mus musculus
agatcctcaggagaacttctgcacg

SEQ ID NO: 159911 - DNA, 25 bp, Mus musculus
agatcctcagtaccagcagcatttg

SEQ ID NO: 159912 - DNA, 25 bp, Mus musculus
agatcctcagtagcagcagcatttg

SEQ ID NO: 159913 - DNA, 25 bp, Mus musculus
agatcctcagtcatgatataacgaa

SEQ ID NO: 159914 - DNA, 25 bp, Mus musculus
agatcctcagtcttgatataacgaa

SEQ ID NO: 159915 - DNA, 25 bp, Mus musculus
agatcctcagtgcttcttttgacca

SEQ ID NO: 159916 - DNA, 25 bp, Mus musculus
agatcctcagtggttcttttgacca

SEQ ID NO: 159917 - DNA, 25 bp, Mus musculus
agatcctcatcgcatatctcgagta

SEQ ID NO: 159918 - DNA, 25 bp, Mus musculus
agatcctcatcggatatctcgagta

SEQ ID NO: 159919 - DNA, 25 bp, Mus musculus
agatcctcatttcgaataccattgt

SEQ ID NO: 159920 - DNA, 25 bp, Mus musculus
agatcctcatttggaataccattgt

SEQ ID NO: 159921 - DNA, 25 bp, Mus musculus
agatcctccaatatgtgcctcagaa

SEQ ID NO: 159922 - DNA, 25 bp, Mus musculus
agatcctccaatttgtgcctcagaa

SEQ ID NO: 159923 - DNA, 25 bp, Mus musculus
agatcctccattaactgttgttcag

SEQ ID NO: 159924 - DNA, 25 bp, Mus musculus
agatcctccatttactgttgttcag

SEQ ID NO: 159925 - DNA, 25 bp, Mus musculus
agatcctcccagctagaggcgttga

SEQ ID NO: 159926 - DNA, 25 bp, Mus musculus
agatcctcccaggtagaggcgttga

SEQ ID NO: 159927 - DNA, 25 bp, Mus musculus
agatcctccgtgagtatgcctacca

SEQ ID NO: 159928 - DNA, 25 bp, Mus musculus
agatcctccgtgtgtatgcctacca

SEQ ID NO: 159929 - DNA, 25 bp, Mus musculus
agatcctcctcaagctggacaggct

SEQ ID NO: 159930 - DNA, 25 bp, Mus musculus
agatcctcctcatgctggacaggct

SEQ ID NO: 159931 - DNA, 25 bp, Mus musculus
agatcctcggtgcattaagttctcc

SEQ ID NO: 159932 - DNA, 25 bp, Mus musculus
agatcctcggtggattaagttctcc

SEQ ID NO: 159933 - DNA, 25 bp, Mus musculus
agatcctcgtgtcgaagtacccgtc

SEQ ID NO: 159934 - DNA, 25 bp, Mus musculus
agatcctcgtgtggaagtacccgtc

SEQ ID NO: 159935 - DNA, 25 bp, Mus musculus
agatcctctaagaggcctactactg

SEQ ID NO: 159936 - DNA, 25 bp, Mus musculus
agatcctctaagtggcctactactg

SEQ ID NO: 159937 - DNA, 25 bp, Mus musculus
agatcctctattctgcgccgcgatc

SEQ ID NO: 159938 - DNA, 25 bp, Mus musculus
agatcctctattgtgcgccgcgatc

SEQ ID NO: 159939 - DNA, 25 bp, Mus musculus
agatcctctctcagctggtggaaat

SEQ ID NO: 159940 - DNA, 25 bp, Mus musculus
agatcctctctctgctggtggaaat

SEQ ID NO: 159941 - DNA, 25 bp, Mus musculus
agatcctctgataccaggtaccata

SEQ ID NO: 159942 - DNA, 25 bp, Mus musculus
agatcctctgattccaggtaccata

SEQ ID NO: 159943 - DNA, 25 bp, Mus musculus
agatcctctggacgcctgagagttg

SEQ ID NO: 159944 - DNA, 25 bp, Mus musculus
agatcctctggaggcctgagagttg

SEQ ID NO: 159945 - DNA, 25 bp, Mus musculus
agatcctctggcatttctaatcagg

SEQ ID NO: 159946 - DNA, 25 bp, Mus musculus
agatcctctggcttttctaatcagg

SEQ ID NO: 159947 - DNA, 25 bp, Mus musculus
agatcctgaacaagcgtggcagctc

SEQ ID NO: 159948 - DNA, 25 bp, Mus musculus
agatcctgaacatgcgtggcagctc

SEQ ID NO: 159949 - DNA, 25 bp, Mus musculus
agatcctgaaccataattgaaccag

SEQ ID NO: 159950 - DNA, 25 bp, Mus musculus
agatcctgaaccttaattgaaccag

SEQ ID NO: 159951 - DNA, 25 bp, Mus musculus
agatcctgacagagcacctaagaaa

SEQ ID NO: 159952 - DNA, 25 bp, Mus musculus
agatcctgacagtgcacctaagaaa

SEQ ID NO: 159953 - DNA, 25 bp, Mus musculus
agatcctgagacaggttcatattcc

SEQ ID NO: 159954 - DNA, 25 bp, Mus musculus
agatcctgagactggttcatattcc

SEQ ID NO: 159955 - DNA, 25 bp, Mus musculus
agatcctgcaaacttccctgggtga

SEQ ID NO: 159956 - DNA, 25 bp, Mus musculus
agatcctgcaaagttccctgggtga

SEQ ID NO: 159957 - DNA, 25 bp, Mus musculus
agatcctgcactcagctctgctgaa

SEQ ID NO: 159958 - DNA, 25 bp, Mus musculus
agatcctgcactgagctctgctgaa

SEQ ID NO: 159959 - DNA, 25 bp, Mus musculus
agatcctgcccgaagttagctaaga

SEQ ID NO: 159960 - DNA, 25 bp, Mus musculus
agatcctgcccgtagttagctaaga

SEQ ID NO: 159961 - DNA, 25 bp, Mus musculus
agatcctgcctgcatcaccctgaag

SEQ ID NO: 159962 - DNA, 25 bp, Mus musculus
agatcctgcctggatcaccctgaag

SEQ ID NO: 159963 - DNA, 25 bp, Mus musculus
agatcctgctcaactctgactactt

SEQ ID NO: 159964 - DNA, 25 bp, Mus musculus
agatcctgctcatctctgactactt

SEQ ID NO: 159965 - DNA, 25 bp, Mus musculus
agatcctgctcgaggagaccctgct

SEQ ID NO: 159966 - DNA, 25 bp, Mus musculus
agatcctgctcgtggagaccctgct

SEQ ID NO: 159967 - DNA, 25 bp, Mus musculus
agatcctggagcacctgaaaaccct

SEQ ID NO: 159968 - DNA, 25 bp, Mus musculus
agatcctggagctcctgaaaaccct

SEQ ID NO: 159969 - DNA, 25 bp, Mus musculus
agatcctggatcatcggaggccctg

SEQ ID NO: 159970 - DNA, 25 bp, Mus musculus
agatcctggatcttcggaggccctg

SEQ ID NO: 159971 - DNA, 25 bp, Mus musculus
agatcctggcagctcagctggcaga

SEQ ID NO: 159972 - DNA, 25 bp, Mus musculus
agatcctggcaggtcagctggcaga

SEQ ID NO: 159973 - DNA, 25 bp, Mus musculus
agatcctggccaaggtcagtcaaga

SEQ ID NO: 159974 - DNA, 25 bp, Mus musculus
agatcctggccatggtcagtcaaga

SEQ ID NO: 159975 - DNA, 25 bp, Mus musculus
agatcctgggaacactgctatgtgg

SEQ ID NO: 159976 - DNA, 25 bp, Mus musculus
agatcctgggaacttaactgatgcc

SEQ ID NO: 159977 - DNA, 25 bp, Mus musculus
agatcctgggaagactgctatgtgg

SEQ ID NO: 159978 - DNA, 25 bp, Mus musculus
agatcctgggaagttaactgatgcc

SEQ ID NO: 159979 - DNA, 25 bp, Mus musculus
agatcctgggatcacactaataatg

SEQ ID NO: 159980 - DNA, 25 bp, Mus musculus
agatcctgggatgacactaataatg

SEQ ID NO: 159981 - DNA, 25 bp, Mus musculus
agatcctgggctacttgctaggcaa

SEQ ID NO: 159982 - DNA, 25 bp, Mus musculus
agatcctgggctctcaacaaacgtc

SEQ ID NO: 159983 - DNA, 25 bp, Mus musculus
agatcctgggctgtcaacaaacgtc

SEQ ID NO: 159984 - DNA, 25 bp, Mus musculus
agatcctgggcttcttgctaggcaa

SEQ ID NO: 159985 - DNA, 25 bp, Mus musculus
agatcctgggtccaatagtcagcac

SEQ ID NO: 159986 - DNA, 25 bp, Mus musculus
agatcctgggtcgaatagtcagcac

SEQ ID NO: 159987 - DNA, 25 bp, Mus musculus
agatcctgggtgattggctgaccta

SEQ ID NO: 159988 - DNA, 25 bp, Mus musculus
agatcctgggtgtttggctgaccta

SEQ ID NO: 159989 - DNA, 25 bp, Mus musculus
agatcctgggttaaggcggctcatc

SEQ ID NO: 159990 - DNA, 25 bp, Mus musculus
agatcctgggtttaggcggctcatc

SEQ ID NO: 159991 - DNA, 25 bp, Mus musculus
agatcctggtctctgtagtgctcac

SEQ ID NO: 159992 - DNA, 25 bp, Mus musculus
agatcctggtctgtgtagtgctcac

SEQ ID NO: 159993 - DNA, 25 bp, Mus musculus
agatcctggtggagaggcccatgct

SEQ ID NO: 159994 - DNA, 25 bp, Mus musculus
agatcctggtggtgaggcccatgct

SEQ ID NO: 159995 - DNA, 25 bp, Mus musculus
agatcctggttgcatctgcccttgg

SEQ ID NO: 159996 - DNA, 25 bp, Mus musculus
agatcctggttggatctgcccttgg

SEQ ID NO: 159997 - DNA, 25 bp, Mus musculus
agatcctgtcagagttggccaaggg

SEQ ID NO: 159998 - DNA, 25 bp, Mus musculus
agatcctgtcagtgttggccaaggg

SEQ ID NO: 159999 - DNA, 25 bp, Mus musculus
agatcctgtcatattcatgtgaccc

SEQ ID NO: 160000 - DNA, 25 bp, Mus musculus
agatcctgtcattttcatgtgaccc

SEQ ID NO: 160001 - DNA, 25 bp, Mus musculus
agatcctgtctcatagtactacctg

SEQ ID NO: 160002 - DNA, 25 bp, Mus musculus
agatcctgtctcttagtactacctg

SEQ ID NO: 160003 - DNA, 25 bp, Mus musculus
agatcctgtggtataggaaggaatc

SEQ ID NO: 160004 - DNA, 25 bp, Mus musculus
agatcctgtggtattcagccttcgt

SEQ ID NO: 160005 - DNA, 25 bp, Mus musculus
agatcctgtggtttaggaaggaatc

SEQ ID NO: 160006 - DNA, 25 bp, Mus musculus
agatcctgtggttttcagccttcgt

SEQ ID NO: 160007 - DNA, 25 bp, Mus musculus
agatcctgttgcagaatgaactaat

SEQ ID NO: 160008 - DNA, 25 bp, Mus musculus
agatcctgttgctgaatgaactaat

SEQ ID NO: 160009 - DNA, 25 bp, Mus musculus
agatccttagctcccttaaagttaa

SEQ ID NO: 160010 - DNA, 25 bp, Mus musculus
agatccttagctgccttaaagttaa

SEQ ID NO: 160011 - DNA, 25 bp, Mus musculus
agatccttaggtcttctggagaagc

SEQ ID NO: 160012 - DNA, 25 bp, Mus musculus
agatccttaggtgttctggagaagc

SEQ ID NO: 160013 - DNA, 25 bp, Mus musculus
agatccttatcaaaggtccgccttt

SEQ ID NO: 160014 - DNA, 25 bp, Mus musculus
agatccttatcataggtccgccttt

SEQ ID NO: 160015 - DNA, 25 bp, Mus musculus
agatccttccagatcgccaaaggac

SEQ ID NO: 160016 - DNA, 25 bp, Mus musculus
agatccttccagctccatattcaag

SEQ ID NO: 160017 - DNA, 25 bp, Mus musculus
agatccttccaggtccatattcaag

SEQ ID NO: 160018 - DNA, 25 bp, Mus musculus
agatccttccagttcgccaaaggac

SEQ ID NO: 160019 - DNA, 25 bp, Mus musculus
agatccttctacctccagattggag

SEQ ID NO: 160020 - DNA, 25 bp, Mus musculus
agatccttctacgtccagattggag

SEQ ID NO: 160021 - DNA, 25 bp, Mus musculus
agatccttctccatatatgcggaca

SEQ ID NO: 160022 - DNA, 25 bp, Mus musculus
agatccttctccttatatgcggaca

SEQ ID NO: 160023 - DNA, 25 bp, Mus musculus
agatccttctctcctgaattggctt

SEQ ID NO: 160024 - DNA, 25 bp, Mus musculus
agatccttctctgctgaattggctt

SEQ ID NO: 160025 - DNA, 25 bp, Mus musculus
agatccttctggatggcactttctg

SEQ ID NO: 160026 - DNA, 25 bp, Mus musculus
agatccttctggttggcactttctg

SEQ ID NO: 160027 - DNA, 25 bp, Mus musculus
agatccttgaagactatgagccgat

SEQ ID NO: 160028 - DNA, 25 bp, Mus musculus
agatccttgaagtctatgagccgat

SEQ ID NO: 160029 - DNA, 25 bp, Mus musculus
agatccttggcccttcccattagct

SEQ ID NO: 160030 - DNA, 25 bp, Mus musculus
agatccttggccgttcccattagct

SEQ ID NO: 160031 - DNA, 25 bp, Mus musculus
agatccttgggaacctgtctgagat

SEQ ID NO: 160032 - DNA, 25 bp, Mus musculus
agatccttgggatcctgtctgagat

SEQ ID NO: 160033 - DNA, 25 bp, Mus musculus
agatccttgtctctctggtcctggg

SEQ ID NO: 160034 - DNA, 25 bp, Mus musculus
agatccttgtctgtctggtcctggg

SEQ ID NO: 160035 - DNA, 25 bp, Mus musculus
agatcctttaggagtcccagaagcc

SEQ ID NO: 160036 - DNA, 25 bp, Mus musculus
agatcctttaggtgtcccagaagcc

SEQ ID NO: 160037 - DNA, 25 bp, Mus musculus
agatcctttcctatccttccaaatt

SEQ ID NO: 160038 - DNA, 25 bp, Mus musculus
agatcctttcctttccttccaaatt

SEQ ID NO: 160039 - DNA, 25 bp, Mus musculus
agatcctttcggagcaatttcagag

SEQ ID NO: 160040 - DNA, 25 bp, Mus musculus
agatcctttcggtgcaatttcagag

SEQ ID NO: 160041 - DNA, 25 bp, Mus musculus
agatcctttctcaggttcttttcac

SEQ ID NO: 160042 - DNA, 25 bp, Mus musculus
agatcctttctctggttcttttcac

SEQ ID NO: 160043 - DNA, 25 bp, Mus musculus
agatcctttgagaccaggagacctt

SEQ ID NO: 160044 - DNA, 25 bp, Mus musculus
agatcctttgagtccaggagacctt

SEQ ID NO: 160045 - DNA, 25 bp, Mus musculus
agatcctttgcacacagtggccata

SEQ ID NO: 160046 - DNA, 25 bp, Mus musculus
agatcctttgcagacagtggccata

SEQ ID NO: 160047 - DNA, 25 bp, Mus musculus
agatcctttgcccggccaggaatac

SEQ ID NO: 160048 - DNA, 25 bp, Mus musculus
agatcctttgccgggccaggaatac

SEQ ID NO: 160049 - DNA, 25 bp, Mus musculus
agatcctttgtaccaatctggtcta

SEQ ID NO: 160050 - DNA, 25 bp, Mus musculus
agatcctttgtagcaatctggtcta

SEQ ID NO: 160051 - DNA, 25 bp, Mus musculus
agatcctttgtgaggctttgatggt

SEQ ID NO: 160052 - DNA, 25 bp, Mus musculus
agatcctttgtgtggctttgatggt

SEQ ID NO: 160053 - DNA, 25 bp, Mus musculus
agatccttttgtcttgttgggtcaa

SEQ ID NO: 160054 - DNA, 25 bp, Mus musculus
agatccttttgtgttgttgggtcaa

SEQ ID NO: 160055 - DNA, 25 bp, Mus musculus
agatcgaaggtccgaactccagtgc

SEQ ID NO: 160056 - DNA, 25 bp, Mus musculus
agatcgaaggtcggaactccagtgc

SEQ ID NO: 160057 - DNA, 25 bp, Mus musculus
agatcgacaatcattttaaactttt

SEQ ID NO: 160058 - DNA, 25 bp, Mus musculus
agatcgacaatctttttaaactttt

SEQ ID NO: 160059 - DNA, 25 bp, Mus musculus
agatcgacagcaatctgggcaataa

SEQ ID NO: 160060 - DNA, 25 bp, Mus musculus
agatcgacagcattctgggcaataa

SEQ ID NO: 160061 - DNA, 25 bp, Mus musculus
agatcgacatctacgtgcaggtgct

SEQ ID NO: 160062 - DNA, 25 bp, Mus musculus
agatcgacatcttcgtgcaggtgct

SEQ ID NO: 160063 - DNA, 25 bp, Mus musculus
agatcgaccagaagttcgcagcctt

SEQ ID NO: 160064 - DNA, 25 bp, Mus musculus
agatcgaccagatgttcgcagcctt

SEQ ID NO: 160065 - DNA, 25 bp, Mus musculus
agatcgacgccacatacgtcaggtt

SEQ ID NO: 160066 - DNA, 25 bp, Mus musculus
agatcgacgccagatacgtcaggtt

SEQ ID NO: 160067 - DNA, 25 bp, Mus musculus
agatcgactcgacgccttctggaag

SEQ ID NO: 160068 - DNA, 25 bp, Mus musculus
agatcgactcgaggccttctggaag

SEQ ID NO: 160069 - DNA, 25 bp, Mus musculus
agatcgagccgtcatccagatgcat

SEQ ID NO: 160070 - DNA, 25 bp, Mus musculus
agatcgagccgtgatccagatgcat

SEQ ID NO: 160071 - DNA, 25 bp, Mus musculus
agatcgagtacactggcaccgcctt

SEQ ID NO: 160072 - DNA, 25 bp, Mus musculus
agatcgagtacagtggcaccgcctt

SEQ ID NO: 160073 - DNA, 25 bp, Mus musculus
agatcgatatctaccaatttcagtg

SEQ ID NO: 160074 - DNA, 25 bp, Mus musculus
agatcgatatcttccaatttcagtg

SEQ ID NO: 160075 - DNA, 25 bp, Mus musculus
agatcgatcaggagtacagcaggta

SEQ ID NO: 160076 - DNA, 25 bp, Mus musculus
agatcgatcaggtgtacagcaggta

SEQ ID NO: 160077 - DNA, 25 bp, Mus musculus
agatcgatcctgcacactgactgca

SEQ ID NO: 160078 - DNA, 25 bp, Mus musculus
agatcgatcctggacactgactgca

SEQ ID NO: 160079 - DNA, 25 bp, Mus musculus
agatcgatcgtccttctggtaagaa

SEQ ID NO: 160080 - DNA, 25 bp, Mus musculus
agatcgatcgtcgttctggtaagaa

SEQ ID NO: 160081 - DNA, 25 bp, Mus musculus
agatcgcacattatctacttgagga

SEQ ID NO: 160082 - DNA, 25 bp, Mus musculus
agatcgcacattttctacttgagga

SEQ ID NO: 160083 - DNA, 25 bp, Mus musculus
agatcgcactacagttgggccgcat

SEQ ID NO: 160084 - DNA, 25 bp, Mus musculus
agatcgcactactgttgggccgcat

SEQ ID NO: 160085 - DNA, 25 bp, Mus musculus
agatcgcaggccctatggacattgg

SEQ ID NO: 160086 - DNA, 25 bp, Mus musculus
agatcgcaggccgtatggacattgg

SEQ ID NO: 160087 - DNA, 25 bp, Mus musculus
agatcgcagtgcctctgactcagac

SEQ ID NO: 160088 - DNA, 25 bp, Mus musculus
agatcgcagtgcgtctgactcagac

SEQ ID NO: 160089 - DNA, 25 bp, Mus musculus
agatcgccaagccatccaagatcaa

SEQ ID NO: 160090 - DNA, 25 bp, Mus musculus
agatcgccaagcgatccaagatcaa

SEQ ID NO: 160091 - DNA, 25 bp, Mus musculus
agatcgccctcaagggcggcaagaa

SEQ ID NO: 160092 - DNA, 25 bp, Mus musculus
agatcgccctcatgggcggcaagaa

SEQ ID NO: 160093 - DNA, 25 bp, Mus musculus
agatcgcctctgatgagcggcttcg

SEQ ID NO: 160094 - DNA, 25 bp, Mus musculus
agatcgcctctgttgagcggcttcg

SEQ ID NO: 160095 - DNA, 25 bp, Mus musculus
agatcgccttcacgttgcaggaacc

SEQ ID NO: 160096 - DNA, 25 bp, Mus musculus
agatcgccttcaggttgcaggaacc

SEQ ID NO: 160097 - DNA, 25 bp, Mus musculus
agatcgcgccggattattgctgcaa

SEQ ID NO: 160098 - DNA, 25 bp, Mus musculus
agatcgcgccggtttattgctgcaa

SEQ ID NO: 160099 - DNA, 25 bp, Mus musculus
agatcgcgcttcaaatgtggctctc

SEQ ID NO: 160100 - DNA, 25 bp, Mus musculus
agatcgcgcttctaatgtggctctc

SEQ ID NO: 160101 - DNA, 25 bp, Mus musculus
agatcgcgtgaaaggcgccatcgca

SEQ ID NO: 160102 - DNA, 25 bp, Mus musculus
agatcgcgtgaatggcgccatcgca

SEQ ID NO: 160103 - DNA, 25 bp, Mus musculus
agatcgctggtcatgaacgtggtcc

SEQ ID NO: 160104 - DNA, 25 bp, Mus musculus
agatcgctggtcttgaacgtggtcc

SEQ ID NO: 160105 - DNA, 25 bp, Mus musculus
agatcggaactgaatgtgggcaaag

SEQ ID NO: 160106 - DNA, 25 bp, Mus musculus
agatcggaactgtatgtgggcaaag

SEQ ID NO: 160107 - DNA, 25 bp, Mus musculus
agatcggaggtgagctgcccaccct

SEQ ID NO: 160108 - DNA, 25 bp, Mus musculus
agatcggaggtgtgctgcccaccct

SEQ ID NO: 160109 - DNA, 25 bp, Mus musculus
agatcggattggcatgtctccacgc

SEQ ID NO: 160110 - DNA, 25 bp, Mus musculus
agatcggattgggatgtctccacgc

SEQ ID NO: 160111 - DNA, 25 bp, Mus musculus
agatcggcatgtactgtttcaccgg

SEQ ID NO: 160112 - DNA, 25 bp, Mus musculus
agatcggcatgttctgtttcaccgg

SEQ ID NO: 160113 - DNA, 25 bp, Mus musculus
agatcggccatccttggactatgaa

SEQ ID NO: 160114 - DNA, 25 bp, Mus musculus
agatcggccatcgttggactatgaa

SEQ ID NO: 160115 - DNA, 25 bp, Mus musculus
agatcggccctccagttgattggat

SEQ ID NO: 160116 - DNA, 25 bp, Mus musculus
agatcggccctcctttgaagaaatc

SEQ ID NO: 160117 - DNA, 25 bp, Mus musculus
agatcggccctcgagttgattggat

SEQ ID NO: 160118 - DNA, 25 bp, Mus musculus
agatcggccctcgtttgaagaaatc

SEQ ID NO: 160119 - DNA, 25 bp, Mus musculus
agatcgggcatcatccacattaatg

SEQ ID NO: 160120 - DNA, 25 bp, Mus musculus
agatcgggcatcttccacattaatg

SEQ ID NO: 160121 - DNA, 25 bp, Mus musculus
agatcgggctgcacagcttcttctt

SEQ ID NO: 160122 - DNA, 25 bp, Mus musculus
agatcgggctgctcagcttcttctt

SEQ ID NO: 160123 - DNA, 25 bp, Mus musculus
agatcgggtatgagtctgagtacaa

SEQ ID NO: 160124 - DNA, 25 bp, Mus musculus
agatcgggtatgtgtctgagtacaa

SEQ ID NO: 160125 - DNA, 25 bp, Mus musculus
agatcggtcggcaggtgcagcaaat

SEQ ID NO: 160126 - DNA, 25 bp, Mus musculus
agatcggtcggctggtgcagcaaat

SEQ ID NO: 160127 - DNA, 25 bp, Mus musculus
agatcggtctcacacattgatggtc

SEQ ID NO: 160128 - DNA, 25 bp, Mus musculus
agatcggtctcagacattgatggtc

SEQ ID NO: 160129 - DNA, 25 bp, Mus musculus
agatcggtttatccctgagcgcttc

SEQ ID NO: 160130 - DNA, 25 bp, Mus musculus
agatcggtttatgcctgagcgcttc

SEQ ID NO: 160131 - DNA, 25 bp, Mus musculus
agatcgtacccaaattgatttccat

SEQ ID NO: 160132 - DNA, 25 bp, Mus musculus
agatcgtacccatattgatttccat

SEQ ID NO: 160133 - DNA, 25 bp, Mus musculus
agatcgtaccgtcgttcctggatca

SEQ ID NO: 160134 - DNA, 25 bp, Mus musculus
agatcgtaccgtggttcctggatca

SEQ ID NO: 160135 - DNA, 25 bp, Mus musculus
agatcgtagtcaatctcgagggcat

SEQ ID NO: 160136 - DNA, 25 bp, Mus musculus
agatcgtagtcattctcgagggcat

SEQ ID NO: 160137 - DNA, 25 bp, Mus musculus
agatcgtcacctacagagtttggtg

SEQ ID NO: 160138 - DNA, 25 bp, Mus musculus
agatcgtcaccttcagagtttggtg

SEQ ID NO: 160139 - DNA, 25 bp, Mus musculus
agatcgtcaggcaacatgatgaacc

SEQ ID NO: 160140 - DNA, 25 bp, Mus musculus
agatcgtcaggctacatgatgaacc

SEQ ID NO: 160141 - DNA, 25 bp, Mus musculus
agatcgtccgtaacatcctgattga

SEQ ID NO: 160142 - DNA, 25 bp, Mus musculus
agatcgtccgtatcatcctgattga

SEQ ID NO: 160143 - DNA, 25 bp, Mus musculus
agatcgtcgctgaataaatgaactc

SEQ ID NO: 160144 - DNA, 25 bp, Mus musculus
agatcgtcgctgtataaatgaactc

SEQ ID NO: 160145 - DNA, 25 bp, Mus musculus
agatcgtctctgctcaacttacagg

SEQ ID NO: 160146 - DNA, 25 bp, Mus musculus
agatcgtctctggtcaacttacagg

SEQ ID NO: 160147 - DNA, 25 bp, Mus musculus
agatcgtcttcaatggccagcagtt

SEQ ID NO: 160148 - DNA, 25 bp, Mus musculus
agatcgtcttcattggccagcagtt

SEQ ID NO: 160149 - DNA, 25 bp, Mus musculus
agatcgtgaccccaaggactgcttt

SEQ ID NO: 160150 - DNA, 25 bp, Mus musculus
agatcgtgacccgaaggactgcttt

SEQ ID NO: 160151 - DNA, 25 bp, Mus musculus
agatcgtgccaactatgagcgcttc

SEQ ID NO: 160152 - DNA, 25 bp, Mus musculus
agatcgtgccaagtatgagcgcttc

SEQ ID NO: 160153 - DNA, 25 bp, Mus musculus
agatcgtgcctcattgtcaagctat

SEQ ID NO: 160154 - DNA, 25 bp, Mus musculus
agatcgtgcctctttgtcaagctat

SEQ ID NO: 160155 - DNA, 25 bp, Mus musculus
agatcgtgctgcatttcccgctgga

SEQ ID NO: 160156 - DNA, 25 bp, Mus musculus
agatcgtgctgcttttcccgctgga

SEQ ID NO: 160157 - DNA, 25 bp, Mus musculus
agatcgtggcttctctcaatggttt

SEQ ID NO: 160158 - DNA, 25 bp, Mus musculus
agatcgtggcttgtctcaatggttt

SEQ ID NO: 160159 - DNA, 25 bp, Mus musculus
agatcgtggtagatctggtactcct

SEQ ID NO: 160160 - DNA, 25 bp, Mus musculus
agatcgtggtagttctggtactcct

SEQ ID NO: 160161 - DNA, 25 bp, Mus musculus
agatcgtggtggacatcttccgcaa

SEQ ID NO: 160162 - DNA, 25 bp, Mus musculus
agatcgtggtggtcatcttccgcaa

SEQ ID NO: 160163 - DNA, 25 bp, Mus musculus
agatcgtgtgtaacagtcctgagtc

SEQ ID NO: 160164 - DNA, 25 bp, Mus musculus
agatcgtgtgtatcagtcctgagtc

SEQ ID NO: 160165 - DNA, 25 bp, Mus musculus
agatcgttataacgctattgtgtat

SEQ ID NO: 160166 - DNA, 25 bp, Mus musculus
agatcgttataaggctattgtgtat

SEQ ID NO: 160167 - DNA, 25 bp, Mus musculus
agatcgttcgcaccaagaactaagg

SEQ ID NO: 160168 - DNA, 25 bp, Mus musculus
agatcgttcgcagcaagaactaagg

SEQ ID NO: 160169 - DNA, 25 bp, Mus musculus
agatctaacactagcacttgggaga

SEQ ID NO: 160170 - DNA, 25 bp, Mus musculus
agatctaacacttgcacttgggaga

SEQ ID NO: 160171 - DNA, 25 bp, Mus musculus
agatctaactctacatagtgtgtaa

SEQ ID NO: 160172 - DNA, 25 bp, Mus musculus
agatctaactcttcatagtgtgtaa

SEQ ID NO: 160173 - DNA, 25 bp, Mus musculus
agatctaactgtcgatgcttactga

SEQ ID NO: 160174 - DNA, 25 bp, Mus musculus
agatctaactgtggatgcttactga

SEQ ID NO: 160175 - DNA, 25 bp, Mus musculus
agatctaagactcccaaggtgcctg

SEQ ID NO: 160176 - DNA, 25 bp, Mus musculus
agatctaagactgccaaggtgcctg

SEQ ID NO: 160177 - DNA, 25 bp, Mus musculus
agatctaagtacatgctccacaacc

SEQ ID NO: 160178 - DNA, 25 bp, Mus musculus
agatctaagtacttgctccacaacc

SEQ ID NO: 160179 - DNA, 25 bp, Mus musculus
agatctaagtttctgcaggattgca

SEQ ID NO: 160180 - DNA, 25 bp, Mus musculus
agatctaagtttgtgcaggattgca

SEQ ID NO: 160181 - DNA, 25 bp, Mus musculus
agatctaatgccctgccacactgtt

SEQ ID NO: 160182 - DNA, 25 bp, Mus musculus
agatctaatgccgtgccacactgtt

SEQ ID NO: 160183 - DNA, 25 bp, Mus musculus
agatctacaaccagattcacctgga

SEQ ID NO: 160184 - DNA, 25 bp, Mus musculus
agatctacaacctgattcacctgga

SEQ ID NO: 160185 - DNA, 25 bp, Mus musculus
agatctacaatcatgcttgaccttt

SEQ ID NO: 160186 - DNA, 25 bp, Mus musculus
agatctacaatcttgcttgaccttt

SEQ ID NO: 160187 - DNA, 25 bp, Mus musculus
agatctacagggacctatgtcctct

SEQ ID NO: 160188 - DNA, 25 bp, Mus musculus
agatctacagggtcctatgtcctct

SEQ ID NO: 160189 - DNA, 25 bp, Mus musculus
agatctaccactcacgtcaggaagg

SEQ ID NO: 160190 - DNA, 25 bp, Mus musculus
agatctaccactgacgtcaggaagg

SEQ ID NO: 160191 - DNA, 25 bp, Mus musculus
agatctaccctactcagtctttttt

SEQ ID NO: 160192 - DNA, 25 bp, Mus musculus
agatctaccctagtcagtctttttt

SEQ ID NO: 160193 - DNA, 25 bp, Mus musculus
agatctaccgatacacatcctttgt

SEQ ID NO: 160194 - DNA, 25 bp, Mus musculus
agatctaccgattcacatcctttgt

SEQ ID NO: 160195 - DNA, 25 bp, Mus musculus
agatctaccgctctacgaggcatct

SEQ ID NO: 160196 - DNA, 25 bp, Mus musculus
agatctaccgctgtacgaggcatct

SEQ ID NO: 160197 - DNA, 25 bp, Mus musculus
agatctaccgtgagcttctgtgaag

SEQ ID NO: 160198 - DNA, 25 bp, Mus musculus
agatctaccgtgtgcttctgtgaag

SEQ ID NO: 160199 - DNA, 25 bp, Mus musculus
agatctacctcaacactagctagct

SEQ ID NO: 160200 - DNA, 25 bp, Mus musculus
agatctacctcatcactagctagct

SEQ ID NO: 160201 - DNA, 25 bp, Mus musculus
agatctacctgtccctttaatgctg

SEQ ID NO: 160202 - DNA, 25 bp, Mus musculus
agatctacctgtgcctttaatgctg

SEQ ID NO: 160203 - DNA, 25 bp, Mus musculus
agatctactcagacaagggctgcaa

SEQ ID NO: 160204 - DNA, 25 bp, Mus musculus
agatctactcagtcaagggctgcaa

SEQ ID NO: 160205 - DNA, 25 bp, Mus musculus
agatctacttctaagcccgctaatt

SEQ ID NO: 160206 - DNA, 25 bp, Mus musculus
agatctacttcttagcccgctaatt

SEQ ID NO: 160207 - DNA, 25 bp, Mus musculus
agatctacttgtctctgccttccat

SEQ ID NO: 160208 - DNA, 25 bp, Mus musculus
agatctacttgtgtctgccttccat

SEQ ID NO: 160209 - DNA, 25 bp, Mus musculus
agatctagattaccctaagaatgtt

SEQ ID NO: 160210 - DNA, 25 bp, Mus musculus
agatctagattagcctaagaatgtt

SEQ ID NO: 160211 - DNA, 25 bp, Mus musculus
agatctagccgcactgcgcgcaggc

SEQ ID NO: 160212 - DNA, 25 bp, Mus musculus
agatctagccgctctgcgcgcaggc

SEQ ID NO: 160213 - DNA, 25 bp, Mus musculus
agatctaggagtccatcccaacagc

SEQ ID NO: 160214 - DNA, 25 bp, Mus musculus
agatctaggagtgcatcccaacagc

SEQ ID NO: 160215 - DNA, 25 bp, Mus musculus
agatctataccaagttctttggtta

SEQ ID NO: 160216 - DNA, 25 bp, Mus musculus
agatctataccatgttctttggtta

SEQ ID NO: 160217 - DNA, 25 bp, Mus musculus
agatctatagtgaccctgacccttc

SEQ ID NO: 160218 - DNA, 25 bp, Mus musculus
agatctatagtgtccctgacccttc

SEQ ID NO: 160219 - DNA, 25 bp, Mus musculus
agatctatcacaccctgttccagtg

SEQ ID NO: 160220 - DNA, 25 bp, Mus musculus
agatctatcacagcctgttccagtg

SEQ ID NO: 160221 - DNA, 25 bp, Mus musculus
agatctatgaggaccatgacagcct

SEQ ID NO: 160222 - DNA, 25 bp, Mus musculus
agatctatgaggtccatgacagcct

SEQ ID NO: 160223 - DNA, 25 bp, Mus musculus
agatctatggatattctgtagcaag

SEQ ID NO: 160224 - DNA, 25 bp, Mus musculus
agatctatggattttctgtagcaag

SEQ ID NO: 160225 - DNA, 25 bp, Mus musculus
agatctatggcaccgcaggcccctg

SEQ ID NO: 160226 - DNA, 25 bp, Mus musculus
agatctatggcagcgcaggcccctg

SEQ ID NO: 160227 - DNA, 25 bp, Mus musculus
agatctattctgacactaagcctca

SEQ ID NO: 160228 - DNA, 25 bp, Mus musculus
agatctattctgtcactaagcctca

SEQ ID NO: 160229 - DNA, 25 bp, Mus musculus
agatctatttccaggtttcccagac

SEQ ID NO: 160230 - DNA, 25 bp, Mus musculus
agatctatttcctggtttcccagac

SEQ ID NO: 160231 - DNA, 25 bp, Mus musculus
agatctcaaaggctattcttacagt

SEQ ID NO: 160232 - DNA, 25 bp, Mus musculus
agatctcaaagggtattcttacagt

SEQ ID NO: 160233 - DNA, 25 bp, Mus musculus
agatctcaaattccctctgacattt

SEQ ID NO: 160234 - DNA, 25 bp, Mus musculus
agatctcaaattgcctctgacattt

SEQ ID NO: 160235 - DNA, 25 bp, Mus musculus
agatctcaagttcatgtcaccctga

SEQ ID NO: 160236 - DNA, 25 bp, Mus musculus
agatctcaagttgatgtcaccctga

SEQ ID NO: 160237 - DNA, 25 bp, Mus musculus
agatctcaatttcccgtggcataat

SEQ ID NO: 160238 - DNA, 25 bp, Mus musculus
agatctcaatttgccgtggcataat

SEQ ID NO: 160239 - DNA, 25 bp, Mus musculus
agatctcacatccatcctggaacgc

SEQ ID NO: 160240 - DNA, 25 bp, Mus musculus
agatctcacatcgatcctggaacgc

SEQ ID NO: 160241 - DNA, 25 bp, Mus musculus
agatctcactaacaacttattccat

SEQ ID NO: 160242 - DNA, 25 bp, Mus musculus
agatctcactaagaacttattccat

SEQ ID NO: 160243 - DNA, 25 bp, Mus musculus
agatctcactagcagacttcttttt

SEQ ID NO: 160244 - DNA, 25 bp, Mus musculus
agatctcactaggagacttcttttt

SEQ ID NO: 160245 - DNA, 25 bp, Mus musculus
agatctcactcaaacctctgcatag

SEQ ID NO: 160246 - DNA, 25 bp, Mus musculus
agatctcactcaccaacaagtacat

SEQ ID NO: 160247 - DNA, 25 bp, Mus musculus
agatctcactcagcaacaagtacat

SEQ ID NO: 160248 - DNA, 25 bp, Mus musculus
agatctcactcatacctctgcatag

SEQ ID NO: 160249 - DNA, 25 bp, Mus musculus
agatctcacttcatcctgtaaagcc

SEQ ID NO: 160250 - DNA, 25 bp, Mus musculus
agatctcacttcttcctgtaaagcc

SEQ ID NO: 160251 - DNA, 25 bp, Mus musculus
agatctcagaatcatgttttccata

SEQ ID NO: 160252 - DNA, 25 bp, Mus musculus
agatctcagaatgatgttttccata

SEQ ID NO: 160253 - DNA, 25 bp, Mus musculus
agatctcagcagatacccatcagtt

SEQ ID NO: 160254 - DNA, 25 bp, Mus musculus
agatctcagcagttacccatcagtt

SEQ ID NO: 160255 - DNA, 25 bp, Mus musculus
agatctcagcatcttctagatgggt

SEQ ID NO: 160256 - DNA, 25 bp, Mus musculus
agatctcagcatgttctagatgggt

SEQ ID NO: 160257 - DNA, 25 bp, Mus musculus
agatctcagctcagatattcgctcg

SEQ ID NO: 160258 - DNA, 25 bp, Mus musculus
agatctcagctctgatattcgctcg

SEQ ID NO: 160259 - DNA, 25 bp, Mus musculus
agatctcaggtgattttgtcgccag

SEQ ID NO: 160260 - DNA, 25 bp, Mus musculus
agatctcaggtgtttttgtcgccag

SEQ ID NO: 160261 - DNA, 25 bp, Mus musculus
agatctcagtcactagtggacccta

SEQ ID NO: 160262 - DNA, 25 bp, Mus musculus
agatctcagtcagtagtggacccta

SEQ ID NO: 160263 - DNA, 25 bp, Mus musculus
agatctcagtgaaggcagcctataa

SEQ ID NO: 160264 - DNA, 25 bp, Mus musculus
agatctcagtgatggcagcctataa

SEQ ID NO: 160265 - DNA, 25 bp, Mus musculus
agatctcatgcaaaacaacatcccc

SEQ ID NO: 160266 - DNA, 25 bp, Mus musculus
agatctcatgcataacaacatcccc

SEQ ID NO: 160267 - DNA, 25 bp, Mus musculus
agatctcattccctcctgaagttga

SEQ ID NO: 160268 - DNA, 25 bp, Mus musculus
agatctcattccgtcctgaagttga

SEQ ID NO: 160269 - DNA, 25 bp, Mus musculus
agatctccaagtacttctccgagag

SEQ ID NO: 160270 - DNA, 25 bp, Mus musculus
agatctccaagttcttctccgagag

SEQ ID NO: 160271 - DNA, 25 bp, Mus musculus
agatctccacctccttgtagatgga

SEQ ID NO: 160272 - DNA, 25 bp, Mus musculus
agatctccacctgcttgtagatgga

SEQ ID NO: 160273 - DNA, 25 bp, Mus musculus
agatctccacgaacagttccaacat

SEQ ID NO: 160274 - DNA, 25 bp, Mus musculus
agatctccacgatcagttccaacat

SEQ ID NO: 160275 - DNA, 25 bp, Mus musculus
agatctccacgcctgaccatgtggt

SEQ ID NO: 160276 - DNA, 25 bp, Mus musculus
agatctccacgcgtgaccatgtggt

SEQ ID NO: 160277 - DNA, 25 bp, Mus musculus
agatctccagtaacctcataaaaag

SEQ ID NO: 160278 - DNA, 25 bp, Mus musculus
agatctccagtatcctcataaaaag

SEQ ID NO: 160279 - DNA, 25 bp, Mus musculus
agatctcccagcctgtttaatcatt

SEQ ID NO: 160280 - DNA, 25 bp, Mus musculus
agatctcccagcgtgtttaatcatt

SEQ ID NO: 160281 - DNA, 25 bp, Mus musculus
agatctcccaggatcccagagtttg

SEQ ID NO: 160282 - DNA, 25 bp, Mus musculus
agatctcccaggttcccagagtttg

SEQ ID NO: 160283 - DNA, 25 bp, Mus musculus
agatctcccggacatgtgactgtat

SEQ ID NO: 160284 - DNA, 25 bp, Mus musculus
agatctcccggagatgtgactgtat

SEQ ID NO: 160285 - DNA, 25 bp, Mus musculus
agatctcccgtgatgagctgttaca

SEQ ID NO: 160286 - DNA, 25 bp, Mus musculus
agatctcccgtgttgagctgttaca

SEQ ID NO: 160287 - DNA, 25 bp, Mus musculus
agatctccctagaccacaagtacta

SEQ ID NO: 160288 - DNA, 25 bp, Mus musculus
agatctccctagtccacaagtacta

SEQ ID NO: 160289 - DNA, 25 bp, Mus musculus
agatctccctatacctgccttagga

SEQ ID NO: 160290 - DNA, 25 bp, Mus musculus
agatctccctattcctgccttagga

SEQ ID NO: 160291 - DNA, 25 bp, Mus musculus
agatctccctggataaagctccatt

SEQ ID NO: 160292 - DNA, 25 bp, Mus musculus
agatctccctggttaaagctccatt

SEQ ID NO: 160293 - DNA, 25 bp, Mus musculus
agatctccgaggactcatccaagtg

SEQ ID NO: 160294 - DNA, 25 bp, Mus musculus
agatctccgaggtctcatccaagtg

SEQ ID NO: 160295 - DNA, 25 bp, Mus musculus
agatctccgttacagtccgaggtcc

SEQ ID NO: 160296 - DNA, 25 bp, Mus musculus
agatctccgttagagtccgaggtcc

SEQ ID NO: 160297 - DNA, 25 bp, Mus musculus
agatctcctcatagctctttgcaag

SEQ ID NO: 160298 - DNA, 25 bp, Mus musculus
agatctcctcattgctctttgcaag

SEQ ID NO: 160299 - DNA, 25 bp, Mus musculus
agatctcctccactgagatgggagg

SEQ ID NO: 160300 - DNA, 25 bp, Mus musculus
agatctcctccagtgagatgggagg

SEQ ID NO: 160301 - DNA, 25 bp, Mus musculus
agatctccttcaatccccaaggaaa

SEQ ID NO: 160302 - DNA, 25 bp, Mus musculus
agatctccttcattccccaaggaaa

SEQ ID NO: 160303 - DNA, 25 bp, Mus musculus
agatctccttgcatatgtctcccaa

SEQ ID NO: 160304 - DNA, 25 bp, Mus musculus
agatctccttgcttatgtctcccaa

SEQ ID NO: 160305 - DNA, 25 bp, Mus musculus
agatctcggaatcgaccccaactgc

SEQ ID NO: 160306 - DNA, 25 bp, Mus musculus
agatctcggaatggaccccaactgc

SEQ ID NO: 160307 - DNA, 25 bp, Mus musculus
agatctcggtgtcatcagaggctcc

SEQ ID NO: 160308 - DNA, 25 bp, Mus musculus
agatctcggtgtgatcagaggctcc

SEQ ID NO: 160309 - DNA, 25 bp, Mus musculus
agatctcgtcttagtctcttagtcc

SEQ ID NO: 160310 - DNA, 25 bp, Mus musculus
agatctcgtctttgtctcttagtcc

SEQ ID NO: 160311 - DNA, 25 bp, Mus musculus
agatctcgtgtcactgtaactgttg

SEQ ID NO: 160312 - DNA, 25 bp, Mus musculus
agatctcgtgtctctgtaactgttg

SEQ ID NO: 160313 - DNA, 25 bp, Mus musculus
agatctctaagcacttgcaggctga

SEQ ID NO: 160314 - DNA, 25 bp, Mus musculus
agatctctaagctcttgcaggctga

SEQ ID NO: 160315 - DNA, 25 bp, Mus musculus
agatctctacaaagccttctgtaca

SEQ ID NO: 160316 - DNA, 25 bp, Mus musculus
agatctctacaatgccttctgtaca

SEQ ID NO: 160317 - DNA, 25 bp, Mus musculus
agatctctaccaaggaggtgcccgt

SEQ ID NO: 160318 - DNA, 25 bp, Mus musculus
agatctctaccatggaggtgcccgt

SEQ ID NO: 160319 - DNA, 25 bp, Mus musculus
agatctctagacatgcaagcacctg

SEQ ID NO: 160320 - DNA, 25 bp, Mus musculus
agatctctagacttgcaagcacctg

SEQ ID NO: 160321 - DNA, 25 bp, Mus musculus
agatctctcaccataatgtgctaat

SEQ ID NO: 160322 - DNA, 25 bp, Mus musculus
agatctctcaccttaatgtgctaat

SEQ ID NO: 160323 - DNA, 25 bp, Mus musculus
agatctctccctcatataactgatg

SEQ ID NO: 160324 - DNA, 25 bp, Mus musculus
agatctctccctgatataactgatg

SEQ ID NO: 160325 - DNA, 25 bp, Mus musculus
agatctctcctgcactgccaatagc

SEQ ID NO: 160326 - DNA, 25 bp, Mus musculus
agatctctcctggactgccaatagc

SEQ ID NO: 160327 - DNA, 25 bp, Mus musculus
agatctctctgcacttcacggtgtg

SEQ ID NO: 160328 - DNA, 25 bp, Mus musculus
agatctctctgctcttcacggtgtg

SEQ ID NO: 160329 - DNA, 25 bp, Mus musculus
agatctctgaataagctgagcctag

SEQ ID NO: 160330 - DNA, 25 bp, Mus musculus
agatctctgaattagctgagcctag

SEQ ID NO: 160331 - DNA, 25 bp, Mus musculus
agatctctgagtccagcctcatcta

SEQ ID NO: 160332 - DNA, 25 bp, Mus musculus
agatctctgagtgcagcctcatcta

SEQ ID NO: 160333 - DNA, 25 bp, Mus musculus
agatctctgatgcttctctctcctg

SEQ ID NO: 160334 - DNA, 25 bp, Mus musculus
agatctctgatggttctctctcctg

SEQ ID NO: 160335 - DNA, 25 bp, Mus musculus
agatctctgcctatatgaagaccag

SEQ ID NO: 160336 - DNA, 25 bp, Mus musculus
agatctctgcctttatgaagaccag

SEQ ID NO: 160337 - DNA, 25 bp, Mus musculus
agatctctgctcctgtggcattcat

SEQ ID NO: 160338 - DNA, 25 bp, Mus musculus
agatctctgctcgtgtggcattcat

SEQ ID NO: 160339 - DNA, 25 bp, Mus musculus
agatctctggcaaacgttgggaaga

SEQ ID NO: 160340 - DNA, 25 bp, Mus musculus
agatctctggcatacgttgggaaga

SEQ ID NO: 160341 - DNA, 25 bp, Mus musculus
agatctctgtaaaactgctaattca

SEQ ID NO: 160342 - DNA, 25 bp, Mus musculus
agatctctgtaatactgctaattca

SEQ ID NO: 160343 - DNA, 25 bp, Mus musculus
agatctctgtggaaagagcccaaca

SEQ ID NO: 160344 - DNA, 25 bp, Mus musculus
agatctctgtggtaagagcccaaca

SEQ ID NO: 160345 - DNA, 25 bp, Mus musculus
agatctctgtgtacgaagccaacct

SEQ ID NO: 160346 - DNA, 25 bp, Mus musculus
agatctctgtgttcgaagccaacct

SEQ ID NO: 160347 - DNA, 25 bp, Mus musculus
agatctctgtttccctggcaagcaa

SEQ ID NO: 160348 - DNA, 25 bp, Mus musculus
agatctctgtttgcctggcaagcaa

SEQ ID NO: 160349 - DNA, 25 bp, Mus musculus
agatctcttcagagctcacgagctc

SEQ ID NO: 160350 - DNA, 25 bp, Mus musculus
agatctcttcagtgctcacgagctc

SEQ ID NO: 160351 - DNA, 25 bp, Mus musculus
agatctcttctaaataacttgtaca

SEQ ID NO: 160352 - DNA, 25 bp, Mus musculus
agatctcttctatataacttgtaca

SEQ ID NO: 160353 - DNA, 25 bp, Mus musculus
agatctcttcttatttactgccata

SEQ ID NO: 160354 - DNA, 25 bp, Mus musculus
agatctcttcttttttactgccata

SEQ ID NO: 160355 - DNA, 25 bp, Mus musculus
agatctcttgagacgctgtgcttca

SEQ ID NO: 160356 - DNA, 25 bp, Mus musculus
agatctcttgagactcacttgcagc

SEQ ID NO: 160357 - DNA, 25 bp, Mus musculus
agatctcttgagtcgctgtgcttca

SEQ ID NO: 160358 - DNA, 25 bp, Mus musculus
agatctcttgagtctcacttgcagc

SEQ ID NO: 160359 - DNA, 25 bp, Mus musculus
agatctctttatagattccctccca

SEQ ID NO: 160360 - DNA, 25 bp, Mus musculus
agatctctttattgattccctccca

SEQ ID NO: 160361 - DNA, 25 bp, Mus musculus
agatctgaacaaagcccacatcaag

SEQ ID NO: 160362 - DNA, 25 bp, Mus musculus
agatctgaacaatgcccacatcaag

SEQ ID NO: 160363 - DNA, 25 bp, Mus musculus
agatctgaagaacctgctgcaccaa

SEQ ID NO: 160364 - DNA, 25 bp, Mus musculus
agatctgaagaagctgctgcaccaa

SEQ ID NO: 160365 - DNA, 25 bp, Mus musculus
agatctgaagcccatgcttgctttg

SEQ ID NO: 160366 - DNA, 25 bp, Mus musculus
agatctgaagccgatgcttgctttg

SEQ ID NO: 160367 - DNA, 25 bp, Mus musculus
agatctgacaagactgcagccctgg

SEQ ID NO: 160368 - DNA, 25 bp, Mus musculus
agatctgacaagtctgcagccctgg

SEQ ID NO: 160369 - DNA, 25 bp, Mus musculus
agatctgacaccactttatcattag

SEQ ID NO: 160370 - DNA, 25 bp, Mus musculus
agatctgacacctctttatcattag

SEQ ID NO: 160371 - DNA, 25 bp, Mus musculus
agatctgacactacagggctttcta

SEQ ID NO: 160372 - DNA, 25 bp, Mus musculus
agatctgacactactttgttttgct

SEQ ID NO: 160373 - DNA, 25 bp, Mus musculus
agatctgacactctccggagacacc

SEQ ID NO: 160374 - DNA, 25 bp, Mus musculus
agatctgacactgtccggagacacc

SEQ ID NO: 160375 - DNA, 25 bp, Mus musculus
agatctgacacttcagggctttcta

SEQ ID NO: 160376 - DNA, 25 bp, Mus musculus
agatctgacacttctttgttttgct

SEQ ID NO: 160377 - DNA, 25 bp, Mus musculus
agatctgaccaaatgttcccggact

SEQ ID NO: 160378 - DNA, 25 bp, Mus musculus
agatctgaccaattgttcccggact

SEQ ID NO: 160379 - DNA, 25 bp, Mus musculus
agatctgacgttagctgtgcccatc

SEQ ID NO: 160380 - DNA, 25 bp, Mus musculus
agatctgacgtttgctgtgcccatc

SEQ ID NO: 160381 - DNA, 25 bp, Mus musculus
agatctgactcactgtgtgccttac

SEQ ID NO: 160382 - DNA, 25 bp, Mus musculus
agatctgactcagtgtgtgccttac

SEQ ID NO: 160383 - DNA, 25 bp, Mus musculus
agatctgactgcatgtgcagtgccc

SEQ ID NO: 160384 - DNA, 25 bp, Mus musculus
agatctgactgcctgcacagggcaa

SEQ ID NO: 160385 - DNA, 25 bp, Mus musculus
agatctgactgcgtgcacagggcaa

SEQ ID NO: 160386 - DNA, 25 bp, Mus musculus
agatctgactgcttgtgcagtgccc

SEQ ID NO: 160387 - DNA, 25 bp, Mus musculus
agatctgactggctgtttgctgaag

SEQ ID NO: 160388 - DNA, 25 bp, Mus musculus
agatctgactgggtgtttgctgaag

SEQ ID NO: 160389 - DNA, 25 bp, Mus musculus
agatctgaggagctgtgatatctca

SEQ ID NO: 160390 - DNA, 25 bp, Mus musculus
agatctgaggaggtgtgatatctca

SEQ ID NO: 160391 - DNA, 25 bp, Mus musculus
agatctgagtctctcgtgtcgagtc

SEQ ID NO: 160392 - DNA, 25 bp, Mus musculus
agatctgagtctgtcgtgtcgagtc

SEQ ID NO: 160393 - DNA, 25 bp, Mus musculus
agatctgagtttcagctattctgat

SEQ ID NO: 160394 - DNA, 25 bp, Mus musculus
agatctgagtttgagctattctgat

SEQ ID NO: 160395 - DNA, 25 bp, Mus musculus
agatctgatcccagtgacaccagca

SEQ ID NO: 160396 - DNA, 25 bp, Mus musculus
agatctgatccctgtgacaccagca

SEQ ID NO: 160397 - DNA, 25 bp, Mus musculus
agatctgatgataccgtttgaatag

SEQ ID NO: 160398 - DNA, 25 bp, Mus musculus
agatctgatgattccgtttgaatag

SEQ ID NO: 160399 - DNA, 25 bp, Mus musculus
agatctgattttaccttggacccct

SEQ ID NO: 160400 - DNA, 25 bp, Mus musculus
agatctgatttttccttggacccct

SEQ ID NO: 160401 - DNA, 25 bp, Mus musculus
agatctgcaaacagatccgtccact

SEQ ID NO: 160402 - DNA, 25 bp, Mus musculus
agatctgcaaactgatccgtccact

SEQ ID NO: 160403 - DNA, 25 bp, Mus musculus
agatctgcaacccacaattccttgg

SEQ ID NO: 160404 - DNA, 25 bp, Mus musculus
agatctgcaaccctcttgctgacta

SEQ ID NO: 160405 - DNA, 25 bp, Mus musculus
agatctgcaaccgacaattccttgg

SEQ ID NO: 160406 - DNA, 25 bp, Mus musculus
agatctgcaaccgtcttgctgacta

SEQ ID NO: 160407 - DNA, 25 bp, Mus musculus
agatctgcactcatgggtcttgtca

SEQ ID NO: 160408 - DNA, 25 bp, Mus musculus
agatctgcactcttgggtcttgtca

SEQ ID NO: 160409 - DNA, 25 bp, Mus musculus
agatctgcactgcaagaaacaccca

SEQ ID NO: 160410 - DNA, 25 bp, Mus musculus
agatctgcactggaagaaacaccca

SEQ ID NO: 160411 - DNA, 25 bp, Mus musculus
agatctgcagcaccatacggacggg

SEQ ID NO: 160412 - DNA, 25 bp, Mus musculus
agatctgcagcagcatacggacggg

SEQ ID NO: 160413 - DNA, 25 bp, Mus musculus
agatctgcaggtcatacgcccacat

SEQ ID NO: 160414 - DNA, 25 bp, Mus musculus
agatctgcaggtgatacgcccacat

SEQ ID NO: 160415 - DNA, 25 bp, Mus musculus
agatctgcattcagatgacaacgag

SEQ ID NO: 160416 - DNA, 25 bp, Mus musculus
agatctgcattctgatgacaacgag

SEQ ID NO: 160417 - DNA, 25 bp, Mus musculus
agatctgccactctgcaggtggcaa

SEQ ID NO: 160418 - DNA, 25 bp, Mus musculus
agatctgccactgtgcaggtggcaa

SEQ ID NO: 160419 - DNA, 25 bp, Mus musculus
agatctgcccaaagaaaccctgcat

SEQ ID NO: 160420 - DNA, 25 bp, Mus musculus
agatctgcccaatgaaaccctgcat

SEQ ID NO: 160421 - DNA, 25 bp, Mus musculus
agatctgcccatacaggtgtcacct

SEQ ID NO: 160422 - DNA, 25 bp, Mus musculus
agatctgcccattcaggtgtcacct

SEQ ID NO: 160423 - DNA, 25 bp, Mus musculus
agatctgccctcatgaaaagcaaac

SEQ ID NO: 160424 - DNA, 25 bp, Mus musculus
agatctgccctcttgaaaagcaaac

SEQ ID NO: 160425 - DNA, 25 bp, Mus musculus
agatctgccgggattgcttcaagca

SEQ ID NO: 160426 - DNA, 25 bp, Mus musculus
agatctgccgggtttgcttcaagca

SEQ ID NO: 160427 - DNA, 25 bp, Mus musculus
agatctgccgtgcaattggtatcgt

SEQ ID NO: 160428 - DNA, 25 bp, Mus musculus
agatctgccgtggaattggtatcgt

SEQ ID NO: 160429 - DNA, 25 bp, Mus musculus
agatctgcctcaatcaagattttta

SEQ ID NO: 160430 - DNA, 25 bp, Mus musculus
agatctgcctcattcaagattttta

SEQ ID NO: 160431 - DNA, 25 bp, Mus musculus
agatctgcctctcggctgggcagat

SEQ ID NO: 160432 - DNA, 25 bp, Mus musculus
agatctgcctctgggctgggcagat

SEQ ID NO: 160433 - DNA, 25 bp, Mus musculus
agatctgcctgcacttaaaggtgta

SEQ ID NO: 160434 - DNA, 25 bp, Mus musculus
agatctgcctgctcttaaaggtgta

SEQ ID NO: 160435 - DNA, 25 bp, Mus musculus
agatctgccttaagcttgccttcct

SEQ ID NO: 160436 - DNA, 25 bp, Mus musculus
agatctgccttatgcttgccttcct

SEQ ID NO: 160437 - DNA, 25 bp, Mus musculus
agatctgccttgagacattccttct

SEQ ID NO: 160438 - DNA, 25 bp, Mus musculus
agatctgccttgtgacattccttct

SEQ ID NO: 160439 - DNA, 25 bp, Mus musculus
agatctgcgatgaactgggagtgaa

SEQ ID NO: 160440 - DNA, 25 bp, Mus musculus
agatctgcgatgtactgggagtgaa

SEQ ID NO: 160441 - DNA, 25 bp, Mus musculus
agatctgcgctgactccaaagagac

SEQ ID NO: 160442 - DNA, 25 bp, Mus musculus
agatctgcgctgtctccaaagagac

SEQ ID NO: 160443 - DNA, 25 bp, Mus musculus
agatctgcgttgagagcttcctaaa

SEQ ID NO: 160444 - DNA, 25 bp, Mus musculus
agatctgcgttgtgagcttcctaaa

SEQ ID NO: 160445 - DNA, 25 bp, Mus musculus
agatctgctcctcattgcacatgtg

SEQ ID NO: 160446 - DNA, 25 bp, Mus musculus
agatctgctcctgattgcacatgtg

SEQ ID NO: 160447 - DNA, 25 bp, Mus musculus
agatctgctctaccctttaaccaca

SEQ ID NO: 160448 - DNA, 25 bp, Mus musculus
agatctgctctagcctttaaccaca

SEQ ID NO: 160449 - DNA, 25 bp, Mus musculus
agatctgctctgaaggtttacctgt

SEQ ID NO: 160450 - DNA, 25 bp, Mus musculus
agatctgctctgtaggtttacctgt

SEQ ID NO: 160451 - DNA, 25 bp, Mus musculus
agatctgctgagatcagggcaagct

SEQ ID NO: 160452 - DNA, 25 bp, Mus musculus
agatctgctgagttcagggcaagct

SEQ ID NO: 160453 - DNA, 25 bp, Mus musculus
agatctgctgatattggcctctggg

SEQ ID NO: 160454 - DNA, 25 bp, Mus musculus
agatctgctgattttggcctctggg

SEQ ID NO: 160455 - DNA, 25 bp, Mus musculus
agatctgctgctcctgcagtcttta

SEQ ID NO: 160456 - DNA, 25 bp, Mus musculus
agatctgctgctgctgcagtcttta

SEQ ID NO: 160457 - DNA, 25 bp, Mus musculus
agatctgcttctattagtcaccttc

SEQ ID NO: 160458 - DNA, 25 bp, Mus musculus
agatctgcttcttttagtcaccttc

SEQ ID NO: 160459 - DNA, 25 bp, Mus musculus
agatctggaagaccattccccttgt

SEQ ID NO: 160460 - DNA, 25 bp, Mus musculus
agatctggaagagcattccccttgt

SEQ ID NO: 160461 - DNA, 25 bp, Mus musculus
agatctggaattcggtgctcaaaga

SEQ ID NO: 160462 - DNA, 25 bp, Mus musculus
agatctggaattgggtgctcaaaga

SEQ ID NO: 160463 - DNA, 25 bp, Mus musculus
agatctggatcccttctagcttgga

SEQ ID NO: 160464 - DNA, 25 bp, Mus musculus
agatctggatccgttctagcttgga

SEQ ID NO: 160465 - DNA, 25 bp, Mus musculus
agatctggatggctgcctctgctag

SEQ ID NO: 160466 - DNA, 25 bp, Mus musculus
agatctggatgggtgcctctgctag

SEQ ID NO: 160467 - DNA, 25 bp, Mus musculus
agatctggattaaggttgccctcct

SEQ ID NO: 160468 - DNA, 25 bp, Mus musculus
agatctggattatggttgccctcct

SEQ ID NO: 160469 - DNA, 25 bp, Mus musculus
agatctggcaggagtacctcgacta

SEQ ID NO: 160470 - DNA, 25 bp, Mus musculus
agatctggcaggcagaagtcccctc

SEQ ID NO: 160471 - DNA, 25 bp, Mus musculus
agatctggcagggagaagtcccctc

SEQ ID NO: 160472 - DNA, 25 bp, Mus musculus
agatctggcaggtgtacctcgacta

SEQ ID NO: 160473 - DNA, 25 bp, Mus musculus
agatctggcatcaaatctggccttt

SEQ ID NO: 160474 - DNA, 25 bp, Mus musculus
agatctggcatcacaagtacctgga

SEQ ID NO: 160475 - DNA, 25 bp, Mus musculus
agatctggcatctaatctggccttt

SEQ ID NO: 160476 - DNA, 25 bp, Mus musculus
agatctggcatctcaagtacctgga

SEQ ID NO: 160477 - DNA, 25 bp, Mus musculus
agatctggcatgagaaccccatggt

SEQ ID NO: 160478 - DNA, 25 bp, Mus musculus
agatctggcatgtgaaccccatggt

SEQ ID NO: 160479 - DNA, 25 bp, Mus musculus
agatctggctcgatgtcttttcata

SEQ ID NO: 160480 - DNA, 25 bp, Mus musculus
agatctggctcgttgtcttttcata

SEQ ID NO: 160481 - DNA, 25 bp, Mus musculus
agatctggctgcagtggctacggac

SEQ ID NO: 160482 - DNA, 25 bp, Mus musculus
agatctggctgctgtggctacggac

SEQ ID NO: 160483 - DNA, 25 bp, Mus musculus
agatctggctggcactacatagagt

SEQ ID NO: 160484 - DNA, 25 bp, Mus musculus
agatctggctgggactacatagagt

SEQ ID NO: 160485 - DNA, 25 bp, Mus musculus
agatctgggcaactgtccctttcct

SEQ ID NO: 160486 - DNA, 25 bp, Mus musculus
agatctgggcaagtgtccctttcct

SEQ ID NO: 160487 - DNA, 25 bp, Mus musculus
agatctgggccaagcatgcacagtc

SEQ ID NO: 160488 - DNA, 25 bp, Mus musculus
agatctgggccatgcatgcacagtc

SEQ ID NO: 160489 - DNA, 25 bp, Mus musculus
agatctgggctcactgcatgtccta

SEQ ID NO: 160490 - DNA, 25 bp, Mus musculus
agatctgggctcagggtccatcagg

SEQ ID NO: 160491 - DNA, 25 bp, Mus musculus
agatctgggctctctgcatgtccta

SEQ ID NO: 160492 - DNA, 25 bp, Mus musculus
agatctgggctctgggtccatcagg

SEQ ID NO: 160493 - DNA, 25 bp, Mus musculus
agatctgggtctatgttggaacttc

SEQ ID NO: 160494 - DNA, 25 bp, Mus musculus
agatctgggtctttgttggaacttc

SEQ ID NO: 160495 - DNA, 25 bp, Mus musculus
agatctggtacgatgctcttctgta

SEQ ID NO: 160496 - DNA, 25 bp, Mus musculus
agatctggtacgttgctcttctgta

SEQ ID NO: 160497 - DNA, 25 bp, Mus musculus
agatctggtcatcccagtaccttga

SEQ ID NO: 160498 - DNA, 25 bp, Mus musculus
agatctggtcatgccagtaccttga

SEQ ID NO: 160499 - DNA, 25 bp, Mus musculus
agatctggtggtactgttttgggtt

SEQ ID NO: 160500 - DNA, 25 bp, Mus musculus
agatctggtggtcttcattgtagca

SEQ ID NO: 160501 - DNA, 25 bp, Mus musculus
agatctggtggtgttcattgtagca

SEQ ID NO: 160502 - DNA, 25 bp, Mus musculus
agatctggtggttctgttttgggtt

SEQ ID NO: 160503 - DNA, 25 bp, Mus musculus
agatctggttttctgaggcttggcc

SEQ ID NO: 160504 - DNA, 25 bp, Mus musculus
agatctggttttgtgaggcttggcc

SEQ ID NO: 160505 - DNA, 25 bp, Mus musculus
agatctgtacagagctgtccgttcc

SEQ ID NO: 160506 - DNA, 25 bp, Mus musculus
agatctgtacagtgctgtccgttcc

SEQ ID NO: 160507 - DNA, 25 bp, Mus musculus
agatctgtacggagtacctcaccaa

SEQ ID NO: 160508 - DNA, 25 bp, Mus musculus
agatctgtacggtgtacctcaccaa

SEQ ID NO: 160509 - DNA, 25 bp, Mus musculus
agatctgtagagcattagacctttc

SEQ ID NO: 160510 - DNA, 25 bp, Mus musculus
agatctgtagaggattagacctttc

SEQ ID NO: 160511 - DNA, 25 bp, Mus musculus
agatctgtaggcactttgacacttt

SEQ ID NO: 160512 - DNA, 25 bp, Mus musculus
agatctgtaggctctttgacacttt

SEQ ID NO: 160513 - DNA, 25 bp, Mus musculus
agatctgtataacgcctaaggatga

SEQ ID NO: 160514 - DNA, 25 bp, Mus musculus
agatctgtataaggcctaaggatga

SEQ ID NO: 160515 - DNA, 25 bp, Mus musculus
agatctgtcagcaagccaggactta

SEQ ID NO: 160516 - DNA, 25 bp, Mus musculus
agatctgtcagctagccaggactta

SEQ ID NO: 160517 - DNA, 25 bp, Mus musculus
agatctgtcatcagtggaacccgtt

SEQ ID NO: 160518 - DNA, 25 bp, Mus musculus
agatctgtcatctgtggaacccgtt

SEQ ID NO: 160519 - DNA, 25 bp, Mus musculus
agatctgtccagaagattttagaga

SEQ ID NO: 160520 - DNA, 25 bp, Mus musculus
agatctgtccagtagattttagaga

SEQ ID NO: 160521 - DNA, 25 bp, Mus musculus
agatctgtccatattcaggaatctg

SEQ ID NO: 160522 - DNA, 25 bp, Mus musculus
agatctgtccattttcaggaatctg

SEQ ID NO: 160523 - DNA, 25 bp, Mus musculus
agatctgtcgtcaggttgtgtgtca

SEQ ID NO: 160524 - DNA, 25 bp, Mus musculus
agatctgtcgtctggttgtgtgtca

SEQ ID NO: 160525 - DNA, 25 bp, Mus musculus
agatctgtctaaagatatccttgag

SEQ ID NO: 160526 - DNA, 25 bp, Mus musculus
agatctgtctaatgatatccttgag

SEQ ID NO: 160527 - DNA, 25 bp, Mus musculus
agatctgtctatcagccatgctttt

SEQ ID NO: 160528 - DNA, 25 bp, Mus musculus
agatctgtctatgagccatgctttt

SEQ ID NO: 160529 - DNA, 25 bp, Mus musculus
agatctgtctcaacagagcatggaa

SEQ ID NO: 160530 - DNA, 25 bp, Mus musculus
agatctgtctcatcagagcatggaa

SEQ ID NO: 160531 - DNA, 25 bp, Mus musculus
agatctgtctcgattttctaataca

SEQ ID NO: 160532 - DNA, 25 bp, Mus musculus
agatctgtctcgtttttctaataca

SEQ ID NO: 160533 - DNA, 25 bp, Mus musculus
agatctgtctggctttgtgtgttta

SEQ ID NO: 160534 - DNA, 25 bp, Mus musculus
agatctgtctgggtttgtgtgttta

SEQ ID NO: 160535 - DNA, 25 bp, Mus musculus
agatctgtcttgcaggcagcaggct

SEQ ID NO: 160536 - DNA, 25 bp, Mus musculus
agatctgtcttggaggcagcaggct

SEQ ID NO: 160537 - DNA, 25 bp, Mus musculus
agatctgtgaaaaagtaatggcctc

SEQ ID NO: 160538 - DNA, 25 bp, Mus musculus
agatctgtgaaatagtaatggcctc

SEQ ID NO: 160539 - DNA, 25 bp, Mus musculus
agatctgtgaacatgttgctcatga

SEQ ID NO: 160540 - DNA, 25 bp, Mus musculus
agatctgtgaacttgttgctcatga

SEQ ID NO: 160541 - DNA, 25 bp, Mus musculus
agatctgtgacgcagcctgtcattc

SEQ ID NO: 160542 - DNA, 25 bp, Mus musculus
agatctgtgacggagcctgtcattc

SEQ ID NO: 160543 - DNA, 25 bp, Mus musculus
agatctgtgagcctactaaccgccc

SEQ ID NO: 160544 - DNA, 25 bp, Mus musculus
agatctgtgagcgtactaaccgccc

SEQ ID NO: 160545 - DNA, 25 bp, Mus musculus
agatctgtgataatcaaaagggtac

SEQ ID NO: 160546 - DNA, 25 bp, Mus musculus
agatctgtgatattcaaaagggtac

SEQ ID NO: 160547 - DNA, 25 bp, Mus musculus
agatctgtgatcatctgctctccaa

SEQ ID NO: 160548 - DNA, 25 bp, Mus musculus
agatctgtgatcttctgctctccaa

SEQ ID NO: 160549 - DNA, 25 bp, Mus musculus
agatctgtgcaacagcgccgtggca

SEQ ID NO: 160550 - DNA, 25 bp, Mus musculus
agatctgtgcaagagcgccgtggca

SEQ ID NO: 160551 - DNA, 25 bp, Mus musculus
agatctgtgcgacatcccggctttg

SEQ ID NO: 160552 - DNA, 25 bp, Mus musculus
agatctgtgcgagatcccggctttg

SEQ ID NO: 160553 - DNA, 25 bp, Mus musculus
agatctgtggaacgctttgagctac

SEQ ID NO: 160554 - DNA, 25 bp, Mus musculus
agatctgtggaaggctttgagctac

SEQ ID NO: 160555 - DNA, 25 bp, Mus musculus
agatctgtggttaaggttttattca

SEQ ID NO: 160556 - DNA, 25 bp, Mus musculus
agatctgtggtttaggttttattca

SEQ ID NO: 160557 - DNA, 25 bp, Mus musculus
agatctgtgtagctgttaactggaa

SEQ ID NO: 160558 - DNA, 25 bp, Mus musculus
agatctgtgtaggtgttaactggaa

SEQ ID NO: 160559 - DNA, 25 bp, Mus musculus
agatctgtgtcaccatttgctccaa

SEQ ID NO: 160560 - DNA, 25 bp, Mus musculus
agatctgtgtcagcatttgctccaa

SEQ ID NO: 160561 - DNA, 25 bp, Mus musculus
agatctgtgtgaccgattccagctg

SEQ ID NO: 160562 - DNA, 25 bp, Mus musculus
agatctgtgtgagcgattccagctg

SEQ ID NO: 160563 - DNA, 25 bp, Mus musculus
agatctgttaatcctaatacctgaa

SEQ ID NO: 160564 - DNA, 25 bp, Mus musculus
agatctgttaatgctaatacctgaa

SEQ ID NO: 160565 - DNA, 25 bp, Mus musculus
agatctgttagtctgtcaggagcaa

SEQ ID NO: 160566 - DNA, 25 bp, Mus musculus
agatctgttagtgtgtcaggagcaa

SEQ ID NO: 160567 - DNA, 25 bp, Mus musculus
agatctgttgtcagtactccacttt

SEQ ID NO: 160568 - DNA, 25 bp, Mus musculus
agatctgttgtctgtactccacttt

SEQ ID NO: 160569 - DNA, 25 bp, Mus musculus
agatctgttttaacatatgagcgta

SEQ ID NO: 160570 - DNA, 25 bp, Mus musculus
agatctgttttatcatatgagcgta

SEQ ID NO: 160571 - DNA, 25 bp, Mus musculus
agatctgttttccatgcctgacaag

SEQ ID NO: 160572 - DNA, 25 bp, Mus musculus
agatctgttttcgatgcctgacaag

SEQ ID NO: 160573 - DNA, 25 bp, Mus musculus
agatcttaacacagatagcgccctc

SEQ ID NO: 160574 - DNA, 25 bp, Mus musculus
agatcttaacactgatagcgccctc

SEQ ID NO: 160575 - DNA, 25 bp, Mus musculus
agatcttaccctcaaaatggccttt

SEQ ID NO: 160576 - DNA, 25 bp, Mus musculus
agatcttaccctgaaaatggccttt

SEQ ID NO: 160577 - DNA, 25 bp, Mus musculus
agatcttacctcatcatgttatagg

SEQ ID NO: 160578 - DNA, 25 bp, Mus musculus
agatcttacctcttcatgttatagg

SEQ ID NO: 160579 - DNA, 25 bp, Mus musculus
agatcttaccttccctgagccgtgg

SEQ ID NO: 160580 - DNA, 25 bp, Mus musculus
agatcttaccttgcctgagccgtgg

SEQ ID NO: 160581 - DNA, 25 bp, Mus musculus
agatcttagggcaaatgctaatgag

SEQ ID NO: 160582 - DNA, 25 bp, Mus musculus
agatcttagggctaatgctaatgag

SEQ ID NO: 160583 - DNA, 25 bp, Mus musculus
agatcttatgtactggtgcatgtga

SEQ ID NO: 160584 - DNA, 25 bp, Mus musculus
agatcttatgtagtggtgcatgtga

SEQ ID NO: 160585 - DNA, 25 bp, Mus musculus
agatcttattgaatcctatccagga

SEQ ID NO: 160586 - DNA, 25 bp, Mus musculus
agatcttattgattcctatccagga

SEQ ID NO: 160587 - DNA, 25 bp, Mus musculus
agatcttatttcagttcttcaaaaa

SEQ ID NO: 160588 - DNA, 25 bp, Mus musculus
agatcttatttctgttcttcaaaaa

SEQ ID NO: 160589 - DNA, 25 bp, Mus musculus
agatcttattttcataccaccctgg

SEQ ID NO: 160590 - DNA, 25 bp, Mus musculus
agatcttattttctatgtatgagtg

SEQ ID NO: 160591 - DNA, 25 bp, Mus musculus
agatcttattttgataccaccctgg

SEQ ID NO: 160592 - DNA, 25 bp, Mus musculus
agatcttattttgtatgtatgagtg

SEQ ID NO: 160593 - DNA, 25 bp, Mus musculus
agatcttcacatattgctcatctct

SEQ ID NO: 160594 - DNA, 25 bp, Mus musculus
agatcttcacattttgctcatctct

SEQ ID NO: 160595 - DNA, 25 bp, Mus musculus
agatcttcaggtactggctgtcatt

SEQ ID NO: 160596 - DNA, 25 bp, Mus musculus
agatcttcaggttctggctgtcatt

SEQ ID NO: 160597 - DNA, 25 bp, Mus musculus
agatcttcagtcatcagcacaggga

SEQ ID NO: 160598 - DNA, 25 bp, Mus musculus
agatcttcagtcttcagcacaggga

SEQ ID NO: 160599 - DNA, 25 bp, Mus musculus
agatcttcatagacagcctgtgtgg

SEQ ID NO: 160600 - DNA, 25 bp, Mus musculus
agatcttcatagtcagcctgtgtgg

SEQ ID NO: 160601 - DNA, 25 bp, Mus musculus
agatcttcatatcagccataccttc

SEQ ID NO: 160602 - DNA, 25 bp, Mus musculus
agatcttcatatctgttgcatggaa

SEQ ID NO: 160603 - DNA, 25 bp, Mus musculus
agatcttcatatgagccataccttc

SEQ ID NO: 160604 - DNA, 25 bp, Mus musculus
agatcttcatatgtgttgcatggaa

SEQ ID NO: 160605 - DNA, 25 bp, Mus musculus
agatcttcatgcaaagttcctcttt

SEQ ID NO: 160606 - DNA, 25 bp, Mus musculus
agatcttcatgcaccaagcaatcca

SEQ ID NO: 160607 - DNA, 25 bp, Mus musculus
agatcttcatgctaagttcctcttt

SEQ ID NO: 160608 - DNA, 25 bp, Mus musculus
agatcttcatgctccaagcaatcca

SEQ ID NO: 160609 - DNA, 25 bp, Mus musculus
agatcttcatttcccgtgcctatga

SEQ ID NO: 160610 - DNA, 25 bp, Mus musculus
agatcttcatttgccgtgcctatga

SEQ ID NO: 160611 - DNA, 25 bp, Mus musculus
agatcttccctcatgggacgcttct

SEQ ID NO: 160612 - DNA, 25 bp, Mus musculus
agatcttccctcttgggacgcttct

SEQ ID NO: 160613 - DNA, 25 bp, Mus musculus
agatcttcctctagtgtccaattca

SEQ ID NO: 160614 - DNA, 25 bp, Mus musculus
agatcttcctcttgtgtccaattca

SEQ ID NO: 160615 - DNA, 25 bp, Mus musculus
agatcttcctgcctacgagaggctc

SEQ ID NO: 160616 - DNA, 25 bp, Mus musculus
agatcttcctgcgtacgagaggctc

SEQ ID NO: 160617 - DNA, 25 bp, Mus musculus
agatcttcgattaatctctttaaag

SEQ ID NO: 160618 - DNA, 25 bp, Mus musculus
agatcttcgatttatctctttaaag

SEQ ID NO: 160619 - DNA, 25 bp, Mus musculus
agatcttctaaaccccaaggtcctg

SEQ ID NO: 160620 - DNA, 25 bp, Mus musculus
agatcttctaaagcccaaggtcctg

SEQ ID NO: 160621 - DNA, 25 bp, Mus musculus
agatcttctagactgctcaaacctg

SEQ ID NO: 160622 - DNA, 25 bp, Mus musculus
agatcttctagagtgctcaaacctg

SEQ ID NO: 160623 - DNA, 25 bp, Mus musculus
agatcttctctgagcggcgcagtag

SEQ ID NO: 160624 - DNA, 25 bp, Mus musculus
agatcttctctgataccccaaagct

SEQ ID NO: 160625 - DNA, 25 bp, Mus musculus
agatcttctctgtgcggcgcagtag

SEQ ID NO: 160626 - DNA, 25 bp, Mus musculus
agatcttctctgttaccccaaagct

SEQ ID NO: 160627 - DNA, 25 bp, Mus musculus
agatcttctcttagggatattgccc

SEQ ID NO: 160628 - DNA, 25 bp, Mus musculus
agatcttctctttgggatattgccc

SEQ ID NO: 160629 - DNA, 25 bp, Mus musculus
agatcttcttgacgtttccatgaca

SEQ ID NO: 160630 - DNA, 25 bp, Mus musculus
agatcttcttgaggtttccatgaca

SEQ ID NO: 160631 - DNA, 25 bp, Mus musculus
agatcttgacctccgtgggcgtcag

SEQ ID NO: 160632 - DNA, 25 bp, Mus musculus
agatcttgacctgcgtgggcgtcag

SEQ ID NO: 160633 - DNA, 25 bp, Mus musculus
agatcttgagaactgttctgcccag

SEQ ID NO: 160634 - DNA, 25 bp, Mus musculus
agatcttgagaagtgttctgcccag

SEQ ID NO: 160635 - DNA, 25 bp, Mus musculus
agatcttgagggaaactgacaggca

SEQ ID NO: 160636 - DNA, 25 bp, Mus musculus
agatcttgagggtaactgacaggca

SEQ ID NO: 160637 - DNA, 25 bp, Mus musculus
agatcttgagtgcatctttgacgtt

SEQ ID NO: 160638 - DNA, 25 bp, Mus musculus
agatcttgagtggatctttgacgtt

SEQ ID NO: 160639 - DNA, 25 bp, Mus musculus
agatcttgcagcacgctggcactgc

SEQ ID NO: 160640 - DNA, 25 bp, Mus musculus
agatcttgcagctcgctggcactgc

SEQ ID NO: 160641 - DNA, 25 bp, Mus musculus
agatcttgcagtagttttcttcccc

SEQ ID NO: 160642 - DNA, 25 bp, Mus musculus
agatcttgcagttgttttcttcccc

SEQ ID NO: 160643 - DNA, 25 bp, Mus musculus
agatcttgcccgaggtgctggagaa

SEQ ID NO: 160644 - DNA, 25 bp, Mus musculus
agatcttgcccgtggtgctggagaa

SEQ ID NO: 160645 - DNA, 25 bp, Mus musculus
agatcttgcctcaaagggataggtg

SEQ ID NO: 160646 - DNA, 25 bp, Mus musculus
agatcttgcctctaagggataggtg

SEQ ID NO: 160647 - DNA, 25 bp, Mus musculus
agatcttgcgttccggcagtgagct

SEQ ID NO: 160648 - DNA, 25 bp, Mus musculus
agatcttgcgttgcggcagtgagct

SEQ ID NO: 160649 - DNA, 25 bp, Mus musculus
agatcttgcttgctaatgccttaga

SEQ ID NO: 160650 - DNA, 25 bp, Mus musculus
agatcttgcttggtaatgccttaga

SEQ ID NO: 160651 - DNA, 25 bp, Mus musculus
agatcttggtaacagatttgcttaa

SEQ ID NO: 160652 - DNA, 25 bp, Mus musculus
agatcttggtaagagatttgcttaa

SEQ ID NO: 160653 - DNA, 25 bp, Mus musculus
agatcttggtcgaagcctttagtcc

SEQ ID NO: 160654 - DNA, 25 bp, Mus musculus
agatcttggtcgtagcctttagtcc

SEQ ID NO: 160655 - DNA, 25 bp, Mus musculus
agatcttgtacgcttgtggctgtcc

SEQ ID NO: 160656 - DNA, 25 bp, Mus musculus
agatcttgtacggttgtggctgtcc

SEQ ID NO: 160657 - DNA, 25 bp, Mus musculus
agatcttgtccaacagctggtacta

SEQ ID NO: 160658 - DNA, 25 bp, Mus musculus
agatcttgtccatcagctggtacta

SEQ ID NO: 160659 - DNA, 25 bp, Mus musculus
agatcttgtcccattgcatttagtg

SEQ ID NO: 160660 - DNA, 25 bp, Mus musculus
agatcttgtccctttgcatttagtg

SEQ ID NO: 160661 - DNA, 25 bp, Mus musculus
agatctttactgcaagggcctgcca

SEQ ID NO: 160662 - DNA, 25 bp, Mus musculus
agatctttactggaagggcctgcca

SEQ ID NO: 160663 - DNA, 25 bp, Mus musculus
agatctttatgcctgcagtcaccac

SEQ ID NO: 160664 - DNA, 25 bp, Mus musculus
agatctttatgcgtgcagtcaccac

SEQ ID NO: 160665 - DNA, 25 bp, Mus musculus
agatctttcaaaccattttccccac

SEQ ID NO: 160666 - DNA, 25 bp, Mus musculus
agatctttcaaagcattttccccac

SEQ ID NO: 160667 - DNA, 25 bp, Mus musculus
agatctttcacacacactctatggg

SEQ ID NO: 160668 - DNA, 25 bp, Mus musculus
agatctttcacagacactctatggg

SEQ ID NO: 160669 - DNA, 25 bp, Mus musculus
agatctttccacctagaggtccatt

SEQ ID NO: 160670 - DNA, 25 bp, Mus musculus
agatctttccacgtagaggtccatt

SEQ ID NO: 160671 - DNA, 25 bp, Mus musculus
agatctttccttcactgttcttggc

SEQ ID NO: 160672 - DNA, 25 bp, Mus musculus
agatctttccttgactgttcttggc

SEQ ID NO: 160673 - DNA, 25 bp, Mus musculus
agatctttgacacttttgcagcttc

SEQ ID NO: 160674 - DNA, 25 bp, Mus musculus
agatctttgacagttttgcagcttc

SEQ ID NO: 160675 - DNA, 25 bp, Mus musculus
agatctttgcatcctcaaagcccag

SEQ ID NO: 160676 - DNA, 25 bp, Mus musculus
agatctttgcatgctcaaagcccag

SEQ ID NO: 160677 - DNA, 25 bp, Mus musculus
agatctttgccacaggtcctgaggc

SEQ ID NO: 160678 - DNA, 25 bp, Mus musculus
agatctttgccagaggtcctgaggc

SEQ ID NO: 160679 - DNA, 25 bp, Mus musculus
agatctttgcgacttcgaggccagt

SEQ ID NO: 160680 - DNA, 25 bp, Mus musculus
agatctttgcgagttcgaggccagt

SEQ ID NO: 160681 - DNA, 25 bp, Mus musculus
agatctttggacaggcacccgtgag

SEQ ID NO: 160682 - DNA, 25 bp, Mus musculus
agatctttggactggcacccgtgag

SEQ ID NO: 160683 - DNA, 25 bp, Mus musculus
agatctttggcacatttctctctac

SEQ ID NO: 160684 - DNA, 25 bp, Mus musculus
agatctttggcagatttctctctac

SEQ ID NO: 160685 - DNA, 25 bp, Mus musculus
agatctttggctctctatcacacca

SEQ ID NO: 160686 - DNA, 25 bp, Mus musculus
agatctttggctgtctatcacacca

SEQ ID NO: 160687 - DNA, 25 bp, Mus musculus
agatctttgggacgcctggacccct

SEQ ID NO: 160688 - DNA, 25 bp, Mus musculus
agatctttgggaggcctggacccct

SEQ ID NO: 160689 - DNA, 25 bp, Mus musculus
agatctttggtccagtgacgtgtgt

SEQ ID NO: 160690 - DNA, 25 bp, Mus musculus
agatctttggtccatcctttgagac

SEQ ID NO: 160691 - DNA, 25 bp, Mus musculus
agatctttggtcgagtgacgtgtgt

SEQ ID NO: 160692 - DNA, 25 bp, Mus musculus
agatctttggtcgatcctttgagac

SEQ ID NO: 160693 - DNA, 25 bp, Mus musculus
agatctttgtatacagaagcccaag

SEQ ID NO: 160694 - DNA, 25 bp, Mus musculus
agatctttgtattcagaagcccaag

SEQ ID NO: 160695 - DNA, 25 bp, Mus musculus
agatctttgtccagttctgcactgc

SEQ ID NO: 160696 - DNA, 25 bp, Mus musculus
agatctttgtcctgttctgcactgc

SEQ ID NO: 160697 - DNA, 25 bp, Mus musculus
agatctttgtgaaggccactcacgg

SEQ ID NO: 160698 - DNA, 25 bp, Mus musculus
agatctttgtgatggccactcacgg

SEQ ID NO: 160699 - DNA, 25 bp, Mus musculus
agatctttgtgtaaccctatgctgc

SEQ ID NO: 160700 - DNA, 25 bp, Mus musculus
agatctttgtgttaccctatgctgc

SEQ ID NO: 160701 - DNA, 25 bp, Mus musculus
agatcttttaaacctgggcgcagga

SEQ ID NO: 160702 - DNA, 25 bp, Mus musculus
agatcttttaaagctgggcgcagga

SEQ ID NO: 160703 - DNA, 25 bp, Mus musculus
agatcttttatcacttccgactaga

SEQ ID NO: 160704 - DNA, 25 bp, Mus musculus
agatcttttatctcttccgactaga

SEQ ID NO: 160705 - DNA, 25 bp, Mus musculus
agatcttttcatagggctattgccc

SEQ ID NO: 160706 - DNA, 25 bp, Mus musculus
agatcttttcatctcttgcatgacc

SEQ ID NO: 160707 - DNA, 25 bp, Mus musculus
agatcttttcatgtcttgcatgacc

SEQ ID NO: 160708 - DNA, 25 bp, Mus musculus
agatcttttcattgggctattgccc

SEQ ID NO: 160709 - DNA, 25 bp, Mus musculus
agatcttttcctattcatgcttgtc

SEQ ID NO: 160710 - DNA, 25 bp, Mus musculus
agatcttttccttttcatgcttgtc

SEQ ID NO: 160711 - DNA, 25 bp, Mus musculus
agatcttttgagcatgacccttaga

SEQ ID NO: 160712 - DNA, 25 bp, Mus musculus
agatcttttgaggatgacccttaga

SEQ ID NO: 160713 - DNA, 25 bp, Mus musculus
agatcttttgttaatctctctcatt

SEQ ID NO: 160714 - DNA, 25 bp, Mus musculus
agatcttttgtttatctctctcatt

SEQ ID NO: 160715 - DNA, 25 bp, Mus musculus
agatctttttccaatccccacagga

SEQ ID NO: 160716 - DNA, 25 bp, Mus musculus
agatctttttcctatccccacagga

SEQ ID NO: 160717 - DNA, 25 bp, Mus musculus
agatctttttctaagctgttacaca

SEQ ID NO: 160718 - DNA, 25 bp, Mus musculus
agatctttttcttagctgttacaca

SEQ ID NO: 160719 - DNA, 25 bp, Mus musculus
agatctttttgaatagctgctcccc

SEQ ID NO: 160720 - DNA, 25 bp, Mus musculus
agatctttttgattagctgctcccc

SEQ ID NO: 160721 - DNA, 25 bp, Mus musculus
agatgaaacaatatatagcctaaat

SEQ ID NO: 160722 - DNA, 25 bp, Mus musculus
agatgaaacaatttatagcctaaat

SEQ ID NO: 160723 - DNA, 25 bp, Mus musculus
agatgaaaccatcgcaaccgcatag

SEQ ID NO: 160724 - DNA, 25 bp, Mus musculus
agatgaaaccatggcaaccgcatag

SEQ ID NO: 160725 - DNA, 25 bp, Mus musculus
agatgaaacctacgctctctttaag

SEQ ID NO: 160726 - DNA, 25 bp, Mus musculus
agatgaaacctaggctctctttaag

SEQ ID NO: 160727 - DNA, 25 bp, Mus musculus
agatgaaacggccagactcacattt

SEQ ID NO: 160728 - DNA, 25 bp, Mus musculus
agatgaaacggcgagactcacattt

SEQ ID NO: 160729 - DNA, 25 bp, Mus musculus
agatgaaactttagactgcccaaat

SEQ ID NO: 160730 - DNA, 25 bp, Mus musculus
agatgaaacttttgactgcccaaat

SEQ ID NO: 160731 - DNA, 25 bp, Mus musculus
agatgaaagaccaacggccaaccca

SEQ ID NO: 160732 - DNA, 25 bp, Mus musculus
agatgaaagacctacggccaaccca

SEQ ID NO: 160733 - DNA, 25 bp, Mus musculus
agatgaaagagtctgcccttgcccc

SEQ ID NO: 160734 - DNA, 25 bp, Mus musculus
agatgaaagagtgtgcccttgcccc

SEQ ID NO: 160735 - DNA, 25 bp, Mus musculus
agatgaaagcaaactccctaccact

SEQ ID NO: 160736 - DNA, 25 bp, Mus musculus
agatgaaagcaatctccctaccact

SEQ ID NO: 160737 - DNA, 25 bp, Mus musculus
agatgaaagcttccggctccagtgg

SEQ ID NO: 160738 - DNA, 25 bp, Mus musculus
agatgaaagcttctaacctctcacc

SEQ ID NO: 160739 - DNA, 25 bp, Mus musculus
agatgaaagcttgcggctccagtgg

SEQ ID NO: 160740 - DNA, 25 bp, Mus musculus
agatgaaagcttgtaacctctcacc

SEQ ID NO: 160741 - DNA, 25 bp, Mus musculus
agatgaaagtcactaaatactgttc

SEQ ID NO: 160742 - DNA, 25 bp, Mus musculus
agatgaaagtcagtaaatactgttc

SEQ ID NO: 160743 - DNA, 25 bp, Mus musculus
agatgaaataataagccccgcccct

SEQ ID NO: 160744 - DNA, 25 bp, Mus musculus
agatgaaataattagccccgcccct

SEQ ID NO: 160745 - DNA, 25 bp, Mus musculus
agatgaaatcagactgtctcctggg

SEQ ID NO: 160746 - DNA, 25 bp, Mus musculus
agatgaaatcagtctgtctcctggg

SEQ ID NO: 160747 - DNA, 25 bp, Mus musculus
agatgaaatcttcctcctgacggca

SEQ ID NO: 160748 - DNA, 25 bp, Mus musculus
agatgaaatcttgctcctgacggca

SEQ ID NO: 160749 - DNA, 25 bp, Mus musculus
agatgaaattgcctctcggtgacag

SEQ ID NO: 160750 - DNA, 25 bp, Mus musculus
agatgaaattgcgtctcggtgacag

SEQ ID NO: 160751 - DNA, 25 bp, Mus musculus
agatgaaattgtacagccgataaga

SEQ ID NO: 160752 - DNA, 25 bp, Mus musculus
agatgaaattgttcagccgataaga

SEQ ID NO: 160753 - DNA, 25 bp, Mus musculus
agatgaaatttgacctaccttcctc

SEQ ID NO: 160754 - DNA, 25 bp, Mus musculus
agatgaaatttgtcctaccttcctc

SEQ ID NO: 160755 - DNA, 25 bp, Mus musculus
agatgaacaaacctctcttttctcc

SEQ ID NO: 160756 - DNA, 25 bp, Mus musculus
agatgaacaaacgtctcttttctcc

SEQ ID NO: 160757 - DNA, 25 bp, Mus musculus
agatgaacacatagctgtgctttag

SEQ ID NO: 160758 - DNA, 25 bp, Mus musculus
agatgaacacattgctgtgctttag

SEQ ID NO: 160759 - DNA, 25 bp, Mus musculus
agatgaacacctagcctgtcatgac

SEQ ID NO: 160760 - DNA, 25 bp, Mus musculus
agatgaacaccttgcctgtcatgac

SEQ ID NO: 160761 - DNA, 25 bp, Mus musculus
agatgaacagctctgagggaaaccc

SEQ ID NO: 160762 - DNA, 25 bp, Mus musculus
agatgaacagctgtgagggaaaccc

SEQ ID NO: 160763 - DNA, 25 bp, Mus musculus
agatgaacaggcctctagaccactc

SEQ ID NO: 160764 - DNA, 25 bp, Mus musculus
agatgaacaggcgtctagaccactc

SEQ ID NO: 160765 - DNA, 25 bp, Mus musculus
agatgaaccggcacgtggcactggc

SEQ ID NO: 160766 - DNA, 25 bp, Mus musculus
agatgaaccggcatgacctgtgtga

SEQ ID NO: 160767 - DNA, 25 bp, Mus musculus
agatgaaccggctcgtggcactggc

SEQ ID NO: 160768 - DNA, 25 bp, Mus musculus
agatgaaccggcttgacctgtgtga

SEQ ID NO: 160769 - DNA, 25 bp, Mus musculus
agatgaacctccaggccagggtgtg

SEQ ID NO: 160770 - DNA, 25 bp, Mus musculus
agatgaacctccagtgacttctgtc

SEQ ID NO: 160771 - DNA, 25 bp, Mus musculus
agatgaacctcctggccagggtgtg

SEQ ID NO: 160772 - DNA, 25 bp, Mus musculus
agatgaacctcctgtgacttctgtc

SEQ ID NO: 160773 - DNA, 25 bp, Mus musculus
agatgaacgacccaagccagcccaa

SEQ ID NO: 160774 - DNA, 25 bp, Mus musculus
agatgaacgaccgaagccagcccaa

SEQ ID NO: 160775 - DNA, 25 bp, Mus musculus
agatgaacggcgagccagaccgcaa

SEQ ID NO: 160776 - DNA, 25 bp, Mus musculus
agatgaacggcgtgccagaccgcaa

SEQ ID NO: 160777 - DNA, 25 bp, Mus musculus
agatgaacgtgaatgccgcagacat

SEQ ID NO: 160778 - DNA, 25 bp, Mus musculus
agatgaacgtgattgccgcagacat

SEQ ID NO: 160779 - DNA, 25 bp, Mus musculus
agatgaactagtatctgtaccactg

SEQ ID NO: 160780 - DNA, 25 bp, Mus musculus
agatgaactagtttctgtaccactg

SEQ ID NO: 160781 - DNA, 25 bp, Mus musculus
agatgaactatcattacttggtaga

SEQ ID NO: 160782 - DNA, 25 bp, Mus musculus
agatgaactatctttacttggtaga

SEQ ID NO: 160783 - DNA, 25 bp, Mus musculus
agatgaactccacgccatggcaggt

SEQ ID NO: 160784 - DNA, 25 bp, Mus musculus
agatgaactccaggccatggcaggt

SEQ ID NO: 160785 - DNA, 25 bp, Mus musculus
agatgaactcttaagctgatgctta

SEQ ID NO: 160786 - DNA, 25 bp, Mus musculus
agatgaactctttagctgatgctta

SEQ ID NO: 160787 - DNA, 25 bp, Mus musculus
agatgaactgagactgttctggaga

SEQ ID NO: 160788 - DNA, 25 bp, Mus musculus
agatgaactgagatgtcccgaggct

SEQ ID NO: 160789 - DNA, 25 bp, Mus musculus
agatgaactgagtctgttctggaga

SEQ ID NO: 160790 - DNA, 25 bp, Mus musculus
agatgaactgagttgtcccgaggct

SEQ ID NO: 160791 - DNA, 25 bp, Mus musculus
agatgaactgcccagcaccgtgcag

SEQ ID NO: 160792 - DNA, 25 bp, Mus musculus
agatgaactgccgagcaccgtgcag

SEQ ID NO: 160793 - DNA, 25 bp, Mus musculus
agatgaactgttcgctggtctcaca

SEQ ID NO: 160794 - DNA, 25 bp, Mus musculus
agatgaactgttggctggtctcaca

SEQ ID NO: 160795 - DNA, 25 bp, Mus musculus
agatgaacttcaagaggcaggcaga

SEQ ID NO: 160796 - DNA, 25 bp, Mus musculus
agatgaacttcatgaggcaggcaga

SEQ ID NO: 160797 - DNA, 25 bp, Mus musculus
agatgaacttctccatctgcatcac

SEQ ID NO: 160798 - DNA, 25 bp, Mus musculus
agatgaacttctgcatctgcatcac

SEQ ID NO: 160799 - DNA, 25 bp, Mus musculus
agatgaagaactccgccaagctctg

SEQ ID NO: 160800 - DNA, 25 bp, Mus musculus
agatgaagaactgcgccaagctctg

SEQ ID NO: 160801 - DNA, 25 bp, Mus musculus
agatgaagacagagcccgcagggta

SEQ ID NO: 160802 - DNA, 25 bp, Mus musculus
agatgaagacagtgcccgcagggta

SEQ ID NO: 160803 - DNA, 25 bp, Mus musculus
agatgaagacatcctacagctccac

SEQ ID NO: 160804 - DNA, 25 bp, Mus musculus
agatgaagacatgctacagctccac

SEQ ID NO: 160805 - DNA, 25 bp, Mus musculus
agatgaagagacacgctctggagcc

SEQ ID NO: 160806 - DNA, 25 bp, Mus musculus
agatgaagagactcgctctggagcc

SEQ ID NO: 160807 - DNA, 25 bp, Mus musculus
agatgaagatctcctctctgccagg

SEQ ID NO: 160808 - DNA, 25 bp, Mus musculus
agatgaagatctgctctctgccagg

SEQ ID NO: 160809 - DNA, 25 bp, Mus musculus
agatgaagatgcatggcccgttcac

SEQ ID NO: 160810 - DNA, 25 bp, Mus musculus
agatgaagatgcttggcccgttcac

SEQ ID NO: 160811 - DNA, 25 bp, Mus musculus
agatgaagcagacctctacgtggac

SEQ ID NO: 160812 - DNA, 25 bp, Mus musculus
agatgaagcagagctctacgtggac

SEQ ID NO: 160813 - DNA, 25 bp, Mus musculus
agatgaagccctcaacccagtgcag

SEQ ID NO: 160814 - DNA, 25 bp, Mus musculus
agatgaagccctgaacccagtgcag

SEQ ID NO: 160815 - DNA, 25 bp, Mus musculus
agatgaagccttatcatactgccct

SEQ ID NO: 160816 - DNA, 25 bp, Mus musculus
agatgaagccttttcatactgccct

SEQ ID NO: 160817 - DNA, 25 bp, Mus musculus
agatgaagcgtcacacgggcccagg

SEQ ID NO: 160818 - DNA, 25 bp, Mus musculus
agatgaagcgtctcacgggcccagg

SEQ ID NO: 160819 - DNA, 25 bp, Mus musculus
agatgaagctgacccagtgcctcgt

SEQ ID NO: 160820 - DNA, 25 bp, Mus musculus
agatgaagctgagccagtgcctcgt

SEQ ID NO: 160821 - DNA, 25 bp, Mus musculus
agatgaagctgtaagggttaccctg

SEQ ID NO: 160822 - DNA, 25 bp, Mus musculus
agatgaagctgtactacccagccct

SEQ ID NO: 160823 - DNA, 25 bp, Mus musculus
agatgaagctgttagggttaccctg

SEQ ID NO: 160824 - DNA, 25 bp, Mus musculus
agatgaagctgttctacccagccct

SEQ ID NO: 160825 - DNA, 25 bp, Mus musculus
agatgaagcttcctggccgcgagaa

SEQ ID NO: 160826 - DNA, 25 bp, Mus musculus
agatgaagcttcgtggccgcgagaa

SEQ ID NO: 160827 - DNA, 25 bp, Mus musculus
agatgaagctttcgcgccagggctc

SEQ ID NO: 160828 - DNA, 25 bp, Mus musculus
agatgaagctttggcgccagggctc

SEQ ID NO: 160829 - DNA, 25 bp, Mus musculus
agatgaaggacaaccgctccgaggc

SEQ ID NO: 160830 - DNA, 25 bp, Mus musculus
agatgaaggacatccgctccgaggc

SEQ ID NO: 160831 - DNA, 25 bp, Mus musculus
agatgaaggcctcccatggcatgag

SEQ ID NO: 160832 - DNA, 25 bp, Mus musculus
agatgaaggcctgccatggcatgag

SEQ ID NO: 160833 - DNA, 25 bp, Mus musculus
agatgaaggtggacacagccctctg

SEQ ID NO: 160834 - DNA, 25 bp, Mus musculus
agatgaaggtggtcacagccctctg

SEQ ID NO: 160835 - DNA, 25 bp, Mus musculus
agatgaagtctaaggctgccatgga

SEQ ID NO: 160836 - DNA, 25 bp, Mus musculus
agatgaagtctatggctgccatgga

SEQ ID NO: 160837 - DNA, 25 bp, Mus musculus
agatgaagtctgacagtgataacag

SEQ ID NO: 160838 - DNA, 25 bp, Mus musculus
agatgaagtctgtcagtgataacag

SEQ ID NO: 160839 - DNA, 25 bp, Mus musculus
agatgaagtgtcatctcagctcttc

SEQ ID NO: 160840 - DNA, 25 bp, Mus musculus
agatgaagtgtcattgcctttgcct

SEQ ID NO: 160841 - DNA, 25 bp, Mus musculus
agatgaagtgtcttctcagctcttc

SEQ ID NO: 160842 - DNA, 25 bp, Mus musculus
agatgaagtgtctttgcctttgcct

SEQ ID NO: 160843 - DNA, 25 bp, Mus musculus
agatgaagttccactggcagtggca

SEQ ID NO: 160844 - DNA, 25 bp, Mus musculus
agatgaagttcctctggcagtggca

SEQ ID NO: 160845 - DNA, 25 bp, Mus musculus
agatgaagtttcctgacgcggcgct

SEQ ID NO: 160846 - DNA, 25 bp, Mus musculus
agatgaagtttcgtgacgcggcgct

SEQ ID NO: 160847 - DNA, 25 bp, Mus musculus
agatgaatacagacggagtcattct

SEQ ID NO: 160848 - DNA, 25 bp, Mus musculus
agatgaatacagtcggagtcattct

SEQ ID NO: 160849 - DNA, 25 bp, Mus musculus
agatgaatactgactctcggagtta

SEQ ID NO: 160850 - DNA, 25 bp, Mus musculus
agatgaatactgtctctcggagtta

SEQ ID NO: 160851 - DNA, 25 bp, Mus musculus
agatgaatcacacactcccgaggga

SEQ ID NO: 160852 - DNA, 25 bp, Mus musculus
agatgaatcacagactcccgaggga

SEQ ID NO: 160853 - DNA, 25 bp, Mus musculus
agatgaatcactcacctaaatgtaa

SEQ ID NO: 160854 - DNA, 25 bp, Mus musculus
agatgaatcactgacctaaatgtaa

SEQ ID NO: 160855 - DNA, 25 bp, Mus musculus
agatgaatcataatgcctataggca

SEQ ID NO: 160856 - DNA, 25 bp, Mus musculus
agatgaatcatattgcctataggca

SEQ ID NO: 160857 - DNA, 25 bp, Mus musculus
agatgaatccgaagatgatcctgct

SEQ ID NO: 160858 - DNA, 25 bp, Mus musculus
agatgaatccgatgatgatcctgct

SEQ ID NO: 160859 - DNA, 25 bp, Mus musculus
agatgaatcctgatcctgtgatgac

SEQ ID NO: 160860 - DNA, 25 bp, Mus musculus
agatgaatcctgttcctgtgatgac

SEQ ID NO: 160861 - DNA, 25 bp, Mus musculus
agatgaatgactcgcctctgtctgt

SEQ ID NO: 160862 - DNA, 25 bp, Mus musculus
agatgaatgactggcctctgtctgt

SEQ ID NO: 160863 - DNA, 25 bp, Mus musculus
agatgaatgagcctgttcacctaac

SEQ ID NO: 160864 - DNA, 25 bp, Mus musculus
agatgaatgagcgtgttcacctaac

SEQ ID NO: 160865 - DNA, 25 bp, Mus musculus
agatgaatgcaaaagtccctacccc

SEQ ID NO: 160866 - DNA, 25 bp, Mus musculus
agatgaatgcaatagtccctacccc

SEQ ID NO: 160867 - DNA, 25 bp, Mus musculus
agatgaatgctcaacattctgccta

SEQ ID NO: 160868 - DNA, 25 bp, Mus musculus
agatgaatgctctacattctgccta

SEQ ID NO: 160869 - DNA, 25 bp, Mus musculus
agatgaatgctgagcaccaccacgc

SEQ ID NO: 160870 - DNA, 25 bp, Mus musculus
agatgaatgctgtgcaccaccacgc

SEQ ID NO: 160871 - DNA, 25 bp, Mus musculus
agatgaatggcaagcctccccttgt

SEQ ID NO: 160872 - DNA, 25 bp, Mus musculus
agatgaatggcatgcctccccttgt

SEQ ID NO: 160873 - DNA, 25 bp, Mus musculus
agatgaatgttcacccttccaagat

SEQ ID NO: 160874 - DNA, 25 bp, Mus musculus
agatgaatgttctcccttccaagat

SEQ ID NO: 160875 - DNA, 25 bp, Mus musculus
agatgaatttctaccagctgccttc

SEQ ID NO: 160876 - DNA, 25 bp, Mus musculus
agatgaatttcttccagctgccttc

SEQ ID NO: 160877 - DNA, 25 bp, Mus musculus
agatgacaaaggcagcacaggcagt

SEQ ID NO: 160878 - DNA, 25 bp, Mus musculus
agatgacaaagggagcacaggcagt

SEQ ID NO: 160879 - DNA, 25 bp, Mus musculus
agatgacaacataccaaagctgcag

SEQ ID NO: 160880 - DNA, 25 bp, Mus musculus
agatgacaacattccaaagctgcag

SEQ ID NO: 160881 - DNA, 25 bp, Mus musculus
agatgacaaccaagtccacgcacag

SEQ ID NO: 160882 - DNA, 25 bp, Mus musculus
agatgacaaccatgtccacgcacag

SEQ ID NO: 160883 - DNA, 25 bp, Mus musculus
agatgacaacggctgtttccctctg

SEQ ID NO: 160884 - DNA, 25 bp, Mus musculus
agatgacaacgggtgtttccctctg

SEQ ID NO: 160885 - DNA, 25 bp, Mus musculus
agatgacaagcacccctatgagaag

SEQ ID NO: 160886 - DNA, 25 bp, Mus musculus
agatgacaagcagccctatgagaag

SEQ ID NO: 160887 - DNA, 25 bp, Mus musculus
agatgacacagccactgctctccgt

SEQ ID NO: 160888 - DNA, 25 bp, Mus musculus
agatgacacagcgactgctctccgt

SEQ ID NO: 160889 - DNA, 25 bp, Mus musculus
agatgacacctacaggctgtcgcga

SEQ ID NO: 160890 - DNA, 25 bp, Mus musculus
agatgacacctagaggctgtcgcga

SEQ ID NO: 160891 - DNA, 25 bp, Mus musculus
agatgacacctcagtgctctctaag

SEQ ID NO: 160892 - DNA, 25 bp, Mus musculus
agatgacacctctgtgctctctaag

SEQ ID NO: 160893 - DNA, 25 bp, Mus musculus
agatgacacgacactaatgacttgc

SEQ ID NO: 160894 - DNA, 25 bp, Mus musculus
agatgacacgactctaatgacttgc

SEQ ID NO: 160895 - DNA, 25 bp, Mus musculus
agatgacactgaacaccttccactt

SEQ ID NO: 160896 - DNA, 25 bp, Mus musculus
agatgacactgatcaccttccactt

SEQ ID NO: 160897 - DNA, 25 bp, Mus musculus
agatgacactttcccgataattgat

SEQ ID NO: 160898 - DNA, 25 bp, Mus musculus
agatgacactttgccgataattgat

SEQ ID NO: 160899 - DNA, 25 bp, Mus musculus
agatgacagactaggccagcacgta

SEQ ID NO: 160900 - DNA, 25 bp, Mus musculus
agatgacagacttggccagcacgta

SEQ ID NO: 160901 - DNA, 25 bp, Mus musculus
agatgacagcatactcaagtgaggc

SEQ ID NO: 160902 - DNA, 25 bp, Mus musculus
agatgacagcattctcaagtgaggc

SEQ ID NO: 160903 - DNA, 25 bp, Mus musculus
agatgacagcttagatctgcttcat

SEQ ID NO: 160904 - DNA, 25 bp, Mus musculus
agatgacagctttgatctgcttcat

SEQ ID NO: 160905 - DNA, 25 bp, Mus musculus
agatgacaggcactaagtctcaggg

SEQ ID NO: 160906 - DNA, 25 bp, Mus musculus
agatgacaggcagtaagtctcaggg

SEQ ID NO: 160907 - DNA, 25 bp, Mus musculus
agatgacaggccactttcctgctgc

SEQ ID NO: 160908 - DNA, 25 bp, Mus musculus
agatgacaggcctctttcctgctgc

SEQ ID NO: 160909 - DNA, 25 bp, Mus musculus
agatgacaggtcaatgctccgagtg

SEQ ID NO: 160910 - DNA, 25 bp, Mus musculus
agatgacaggtctatgctccgagtg

SEQ ID NO: 160911 - DNA, 25 bp, Mus musculus
agatgacaggtgcaggccagcacac

SEQ ID NO: 160912 - DNA, 25 bp, Mus musculus
agatgacaggtggaggccagcacac

SEQ ID NO: 160913 - DNA, 25 bp, Mus musculus
agatgacaggttccagctggcttgc

SEQ ID NO: 160914 - DNA, 25 bp, Mus musculus
agatgacaggttgcagctggcttgc

SEQ ID NO: 160915 - DNA, 25 bp, Mus musculus
agatgacatcctagtggcctcggca

SEQ ID NO: 160916 - DNA, 25 bp, Mus musculus
agatgacatccttgtggcctcggca

SEQ ID NO: 160917 - DNA, 25 bp, Mus musculus
agatgacatgctactctctgataag

SEQ ID NO: 160918 - DNA, 25 bp, Mus musculus
agatgacatgcttctctctgataag

SEQ ID NO: 160919 - DNA, 25 bp, Mus musculus
agatgacattaaccctacagtacta

SEQ ID NO: 160920 - DNA, 25 bp, Mus musculus
agatgacattaagcctacagtacta

SEQ ID NO: 160921 - DNA, 25 bp, Mus musculus
agatgacattgaagccttggccttt

SEQ ID NO: 160922 - DNA, 25 bp, Mus musculus
agatgacattgatgccttggccttt

SEQ ID NO: 160923 - DNA, 25 bp, Mus musculus
agatgacatttaatcccactgagga

SEQ ID NO: 160924 - DNA, 25 bp, Mus musculus
agatgacatttattcccactgagga

SEQ ID NO: 160925 - DNA, 25 bp, Mus musculus
agatgacattttaagccagctgtag

SEQ ID NO: 160926 - DNA, 25 bp, Mus musculus
agatgacattttcgcagctacccca

SEQ ID NO: 160927 - DNA, 25 bp, Mus musculus
agatgacattttggcagctacccca

SEQ ID NO: 160928 - DNA, 25 bp, Mus musculus
agatgacatttttagccagctgtag

SEQ ID NO: 160929 - DNA, 25 bp, Mus musculus
agatgaccaagcaccaggcctggct

SEQ ID NO: 160930 - DNA, 25 bp, Mus musculus
agatgaccaagctccaggcctggct

SEQ ID NO: 160931 - DNA, 25 bp, Mus musculus
agatgaccaaggaaggccagtcaat

SEQ ID NO: 160932 - DNA, 25 bp, Mus musculus
agatgaccaaggtaggccagtcaat

SEQ ID NO: 160933 - DNA, 25 bp, Mus musculus
agatgaccaagtaggccggacccca

SEQ ID NO: 160934 - DNA, 25 bp, Mus musculus
agatgaccaagttggccggacccca

SEQ ID NO: 160935 - DNA, 25 bp, Mus musculus
agatgaccacctaaccttaggacag

SEQ ID NO: 160936 - DNA, 25 bp, Mus musculus
agatgaccaccttaccttaggacag

SEQ ID NO: 160937 - DNA, 25 bp, Mus musculus
agatgaccagctactgtggcctgct

SEQ ID NO: 160938 - DNA, 25 bp, Mus musculus
agatgaccagcttctgtggcctgct

SEQ ID NO: 160939 - DNA, 25 bp, Mus musculus
agatgaccagggaagctcacagcca

SEQ ID NO: 160940 - DNA, 25 bp, Mus musculus
agatgaccagggtagctcacagcca

SEQ ID NO: 160941 - DNA, 25 bp, Mus musculus
agatgaccataactttgagcttgat

SEQ ID NO: 160942 - DNA, 25 bp, Mus musculus
agatgaccataagtttgagcttgat

SEQ ID NO: 160943 - DNA, 25 bp, Mus musculus
agatgaccatacaggtacacctctc

SEQ ID NO: 160944 - DNA, 25 bp, Mus musculus
agatgaccatactggtacacctctc

SEQ ID NO: 160945 - DNA, 25 bp, Mus musculus
agatgacccagaaccagacagcctg

SEQ ID NO: 160946 - DNA, 25 bp, Mus musculus
agatgacccagatccagacagcctg

SEQ ID NO: 160947 - DNA, 25 bp, Mus musculus
agatgacccagtatgtcccaaggtc

SEQ ID NO: 160948 - DNA, 25 bp, Mus musculus
agatgacccagtttgtcccaaggtc

SEQ ID NO: 160949 - DNA, 25 bp, Mus musculus
agatgaccccagaaatcagatcaag

SEQ ID NO: 160950 - DNA, 25 bp, Mus musculus
agatgaccccagtaatcagatcaag

SEQ ID NO: 160951 - DNA, 25 bp, Mus musculus
agatgaccccttacatggaaacggt

SEQ ID NO: 160952 - DNA, 25 bp, Mus musculus
agatgacccctttcatggaaacggt

SEQ ID NO: 160953 - DNA, 25 bp, Mus musculus
agatgaccctcacagcatcacggct

SEQ ID NO: 160954 - DNA, 25 bp, Mus musculus
agatgaccctcagagcatcacggct

SEQ ID NO: 160955 - DNA, 25 bp, Mus musculus
agatgaccctctaactaacacagtc

SEQ ID NO: 160956 - DNA, 25 bp, Mus musculus
agatgaccctcttactaacacagtc

SEQ ID NO: 160957 - DNA, 25 bp, Mus musculus
agatgaccgaggagagctcttacat

SEQ ID NO: 160958 - DNA, 25 bp, Mus musculus
agatgaccgaggtgagctcttacat

SEQ ID NO: 160959 - DNA, 25 bp, Mus musculus
agatgaccgcgcagatgcactgcag

SEQ ID NO: 160960 - DNA, 25 bp, Mus musculus
agatgaccgcgctgatgcactgcag

SEQ ID NO: 160961 - DNA, 25 bp, Mus musculus
agatgaccgggcatggcagggcacg

SEQ ID NO: 160962 - DNA, 25 bp, Mus musculus
agatgaccgggcttggcagggcacg

SEQ ID NO: 160963 - DNA, 25 bp, Mus musculus
agatgaccgtgaatcccggcagaga

SEQ ID NO: 160964 - DNA, 25 bp, Mus musculus
agatgaccgtgattcccggcagaga

SEQ ID NO: 160965 - DNA, 25 bp, Mus musculus
agatgacctcatcagggcagccagc

SEQ ID NO: 160966 - DNA, 25 bp, Mus musculus
agatgacctcatccgctgtgtggac

SEQ ID NO: 160967 - DNA, 25 bp, Mus musculus
agatgacctcatgagggcagccagc

SEQ ID NO: 160968 - DNA, 25 bp, Mus musculus
agatgacctcatgcgctgtgtggac

SEQ ID NO: 160969 - DNA, 25 bp, Mus musculus
agatgacctcgtacaaagggctcag

SEQ ID NO: 160970 - DNA, 25 bp, Mus musculus
agatgacctcgttcaaagggctcag

SEQ ID NO: 160971 - DNA, 25 bp, Mus musculus
agatgacctgaccaaaaactttaca

SEQ ID NO: 160972 - DNA, 25 bp, Mus musculus
agatgacctgacgaaaaactttaca

SEQ ID NO: 160973 - DNA, 25 bp, Mus musculus
agatgacctggaaggactcctgagt

SEQ ID NO: 160974 - DNA, 25 bp, Mus musculus
agatgacctggacttcctgattcag

SEQ ID NO: 160975 - DNA, 25 bp, Mus musculus
agatgacctggagttcctgattcag

SEQ ID NO: 160976 - DNA, 25 bp, Mus musculus
agatgacctggatggactcctgagt

SEQ ID NO: 160977 - DNA, 25 bp, Mus musculus
agatgacctggcacgtccattgctt

SEQ ID NO: 160978 - DNA, 25 bp, Mus musculus
agatgacctggccacaatggcgaga

SEQ ID NO: 160979 - DNA, 25 bp, Mus musculus
agatgacctggcgacaatggcgaga

SEQ ID NO: 160980 - DNA, 25 bp, Mus musculus
agatgacctggctcgtccattgctt

SEQ ID NO: 160981 - DNA, 25 bp, Mus musculus
agatgacctgtgacacctgtctgta

SEQ ID NO: 160982 - DNA, 25 bp, Mus musculus
agatgacctgtgtcacctgtctgta

SEQ ID NO: 160983 - DNA, 25 bp, Mus musculus
agatgaccttctcattatttccatt

SEQ ID NO: 160984 - DNA, 25 bp, Mus musculus
agatgaccttctgattatttccatt

SEQ ID NO: 160985 - DNA, 25 bp, Mus musculus
agatgaccttgcactgtccatcata

SEQ ID NO: 160986 - DNA, 25 bp, Mus musculus
agatgaccttgcatgcattcctgac

SEQ ID NO: 160987 - DNA, 25 bp, Mus musculus
agatgaccttgctctgtccatcata

SEQ ID NO: 160988 - DNA, 25 bp, Mus musculus
agatgaccttgcttgcattcctgac

SEQ ID NO: 160989 - DNA, 25 bp, Mus musculus
agatgacgacagaccacccagacgg

SEQ ID NO: 160990 - DNA, 25 bp, Mus musculus
agatgacgacagtccacccagacgg

SEQ ID NO: 160991 - DNA, 25 bp, Mus musculus
agatgacgaccaccaagagtcctgt

SEQ ID NO: 160992 - DNA, 25 bp, Mus musculus
agatgacgaccagcaagagtcctgt

SEQ ID NO: 160993 - DNA, 25 bp, Mus musculus
agatgacgatgccttacccttgtat

SEQ ID NO: 160994 - DNA, 25 bp, Mus musculus
agatgacgatgcgttacccttgtat

SEQ ID NO: 160995 - DNA, 25 bp, Mus musculus
agatgacggagtaccttaaagagga

SEQ ID NO: 160996 - DNA, 25 bp, Mus musculus
agatgacggagttccttaaagagga

SEQ ID NO: 160997 - DNA, 25 bp, Mus musculus
agatgacggcatctgtgacctcgcc

SEQ ID NO: 160998 - DNA, 25 bp, Mus musculus
agatgacggcatgtgtgacctcgcc

SEQ ID NO: 160999 - DNA, 25 bp, Mus musculus
agatgacgggctactgagcacagaa

SEQ ID NO: 161000 - DNA, 25 bp, Mus musculus
agatgacgggcttctgagcacagaa

SEQ ID NO: 161001 - DNA, 25 bp, Mus musculus
agatgacgtcatcactcggctggcc

SEQ ID NO: 161002 - DNA, 25 bp, Mus musculus
agatgacgtcatgactcggctggcc

SEQ ID NO: 161003 - DNA, 25 bp, Mus musculus
agatgacgtcccagctctggcagac

SEQ ID NO: 161004 - DNA, 25 bp, Mus musculus
agatgacgtccctgctctggcagac

SEQ ID NO: 161005 - DNA, 25 bp, Mus musculus
agatgacgtcttagcctatctacag

SEQ ID NO: 161006 - DNA, 25 bp, Mus musculus
agatgacgtctttgcctatctacag

SEQ ID NO: 161007 - DNA, 25 bp, Mus musculus
agatgacgtgccagacatcacctca

SEQ ID NO: 161008 - DNA, 25 bp, Mus musculus
agatgacgtgcctgacatcacctca

SEQ ID NO: 161009 - DNA, 25 bp, Mus musculus
agatgactaaataatgcctccaaat

SEQ ID NO: 161010 - DNA, 25 bp, Mus musculus
agatgactaaatagctgttccttct

SEQ ID NO: 161011 - DNA, 25 bp, Mus musculus
agatgactaaattatgcctccaaat

SEQ ID NO: 161012 - DNA, 25 bp, Mus musculus
agatgactaaattgctgttccttct

SEQ ID NO: 161013 - DNA, 25 bp, Mus musculus
agatgactacagacctatttttaga

SEQ ID NO: 161014 - DNA, 25 bp, Mus musculus
agatgactacagtcctatttttaga

SEQ ID NO: 161015 - DNA, 25 bp, Mus musculus
agatgactagctagtatcactctgc

SEQ ID NO: 161016 - DNA, 25 bp, Mus musculus
agatgactagcttgtatcactctgc

SEQ ID NO: 161017 - DNA, 25 bp, Mus musculus
agatgactcagacctgttgccagtc

SEQ ID NO: 161018 - DNA, 25 bp, Mus musculus
agatgactcagagctgttgccagtc

SEQ ID NO: 161019 - DNA, 25 bp, Mus musculus
agatgactccaaaattttcctaccc

SEQ ID NO: 161020 - DNA, 25 bp, Mus musculus
agatgactccaatattttcctaccc

SEQ ID NO: 161021 - DNA, 25 bp, Mus musculus
agatgactccacagcttattgaccc

SEQ ID NO: 161022 - DNA, 25 bp, Mus musculus
agatgactccactgcttattgaccc

SEQ ID NO: 161023 - DNA, 25 bp, Mus musculus
agatgactcccaagtgcctgaaact

SEQ ID NO: 161024 - DNA, 25 bp, Mus musculus
agatgactcccactggacttaagga

SEQ ID NO: 161025 - DNA, 25 bp, Mus musculus
agatgactcccagtggacttaagga

SEQ ID NO: 161026 - DNA, 25 bp, Mus musculus
agatgactcccatgtgcctgaaact

SEQ ID NO: 161027 - DNA, 25 bp, Mus musculus
agatgactcggaatctccaggactc

SEQ ID NO: 161028 - DNA, 25 bp, Mus musculus
agatgactcggattctccaggactc
